United States Patent 7,374,927 (METHODS OF ANALYSIS OF DEGRADED NUCLEIC ACID SAMPLES) - sequence listing, part 13

SEQ ID NO: 481197 - DNA, 25 bp, Homo sapien
gactattttggaagactttcacctc

SEQ ID NO: 481198 - DNA, 25 bp, Homo sapien
ttggaagactttcacctctgtttct

SEQ ID NO: 481199 - DNA, 25 bp, Homo sapien
tttcacctctgtttcttgtctttga

SEQ ID NO: 481200 - DNA, 25 bp, Homo sapien
ctgtttcttgtctttgaggctgatg

SEQ ID NO: 481201 - DNA, 25 bp, Homo sapien
gaggctgatgaatgtgtttctaagt

SEQ ID NO: 481202 - DNA, 25 bp, Homo sapien
tcatgtattattgttattggatcca

SEQ ID NO: 481203 - DNA, 25 bp, Homo sapien
attggatccaaacaatgtgttaagt

SEQ ID NO: 481204 - DNA, 25 bp, Homo sapien
gtgttaagtaatatttagggccaga

SEQ ID NO: 481205 - DNA, 25 bp, Homo sapien
cttgtacagaataatgatttctcct

SEQ ID NO: 481206 - DNA, 25 bp, Homo sapien
tggaaagggttttgttcaacttgag

SEQ ID NO: 481207 - DNA, 25 bp, Homo sapien
gggcaccgtcatgtatgtaggtctc

SEQ ID NO: 481208 - DNA, 25 bp, Homo sapien
accgtcatgtatgtaggtctcacag

SEQ ID NO: 481209 - DNA, 25 bp, Homo sapien
ggtctcacagatttcaagcctggct

SEQ ID NO: 481210 - DNA, 25 bp, Homo sapien
aagcctggctactggattggtgtcc

SEQ ID NO: 481211 - DNA, 25 bp, Homo sapien
gctactggattggtgtccgctatga

SEQ ID NO: 481212 - DNA, 25 bp, Homo sapien
gattggtgtccgctatgatgagcca

SEQ ID NO: 481213 - DNA, 25 bp, Homo sapien
gtgtccgctatgatgagccactggg

SEQ ID NO: 481214 - DNA, 25 bp, Homo sapien
tggcagtgtgaatgggaaacgctac

SEQ ID NO: 481215 - DNA, 25 bp, Homo sapien
ggaaacgctacttcgaatgccaggc

SEQ ID NO: 481216 - DNA, 25 bp, Homo sapien
aatgccaggccaagtatggcgcctt

SEQ ID NO: 481217 - DNA, 25 bp, Homo sapien
tatggcgcctttgtcaagccagcag

SEQ ID NO: 481218 - DNA, 25 bp, Homo sapien
gtgctgtggacagtgcttgggccct

SEQ ID NO: 481219 - DNA, 25 bp, Homo sapien
ccagcggacacaagagcgtgctcag

SEQ ID NO: 481220 - DNA, 25 bp, Homo sapien
tgtgtgtacatacggggtctctctc

SEQ ID NO: 481221 - DNA, 25 bp, Homo sapien
atctccaccccatcatgtttacagg

SEQ ID NO: 481222 - DNA, 25 bp, Homo sapien
ccccatcatgtttacagggttcggc

SEQ ID NO: 481223 - DNA, 25 bp, Homo sapien
ttcggcggcagcgtttgttccagaa

SEQ ID NO: 481224 - DNA, 25 bp, Homo sapien
ggcggcagcgtttgttccagaacgc

SEQ ID NO: 481225 - DNA, 25 bp, Homo sapien
agcgtttgttccagaacgccgcctc

SEQ ID NO: 481226 - DNA, 25 bp, Homo sapien
tcccacccagatcgcggtatataga

SEQ ID NO: 481227 - DNA, 25 bp, Homo sapien
acccagatcgcggtatatagagata

SEQ ID NO: 481228 - DNA, 25 bp, Homo sapien
cgcggtatatagagatatgcatttt

SEQ ID NO: 481229 - DNA, 25 bp, Homo sapien
gggtaacttatgcatgacttattaa

SEQ ID NO: 481230 - DNA, 25 bp, Homo sapien
taaacctttctgtctttaaacatgt

SEQ ID NO: 481231 - DNA, 25 bp, Homo sapien
catgtttgccatgcagtgttattag

SEQ ID NO: 481232 - DNA, 25 bp, Homo sapien
gcagtgttattaggcattttactta

SEQ ID NO: 481233 - DNA, 25 bp, Homo sapien
acttacattgccattaacatcttca

SEQ ID NO: 481234 - DNA, 25 bp, Homo sapien
aacatcttcacaatagcctacacaa

SEQ ID NO: 481235 - DNA, 25 bp, Homo sapien
cacaatagcctacacaaacacaggg

SEQ ID NO: 481236 - DNA, 25 bp, Homo sapien
gaaacaaggttacagttcttaagtg

SEQ ID NO: 481237 - DNA, 25 bp, Homo sapien
ttgtgatataaactgcctgtttttc

SEQ ID NO: 481238 - DNA, 25 bp, Homo sapien
aaaagtgatgctatttgggctaaat

SEQ ID NO: 481239 - DNA, 25 bp, Homo sapien
gctatttgggctaaatgttttgttt

SEQ ID NO: 481240 - DNA, 25 bp, Homo sapien
tttaaatgagcctgacacctgtgtt

SEQ ID NO: 481241 - DNA, 25 bp, Homo sapien
gacacctgtgtttcagcatttggag

SEQ ID NO: 481242 - DNA, 25 bp, Homo sapien
tttcagcatttggagacatccccat

SEQ ID NO: 481243 - DNA, 25 bp, Homo sapien
ggagacatccccatgttattctttt

SEQ ID NO: 481244 - DNA, 25 bp, Homo sapien
atccccatgttattcttttaagtgt

SEQ ID NO: 481245 - DNA, 25 bp, Homo sapien
atgtgcagtctttataatgtatgta

SEQ ID NO: 481246 - DNA, 25 bp, Homo sapien
cagtttcaactatcatattttcttt

SEQ ID NO: 481247 - DNA, 25 bp, Homo sapien
gctctgattataatgccagtgaatg

SEQ ID NO: 481248 - DNA, 25 bp, Homo sapien
gtgaatgttgctgaactctttgtat

SEQ ID NO: 481249 - DNA, 25 bp, Homo sapien
gttgctgaactctttgtatatgcaa

SEQ ID NO: 481250 - DNA, 25 bp, Homo sapien
aagatttaaaccattctgatgcaag

SEQ ID NO: 481251 - DNA, 25 bp, Homo sapien
gatgggccggtatacagagattttc

SEQ ID NO: 481252 - DNA, 25 bp, Homo sapien
tacagttcaatggacgctgtggctc

SEQ ID NO: 481253 - DNA, 25 bp, Homo sapien
caggtgaccttggaggatttgagac

SEQ ID NO: 481254 - DNA, 25 bp, Homo sapien
tttgagacggcttggagtgactctt

SEQ ID NO: 481255 - DNA, 25 bp, Homo sapien
gagtgactcttgtcggtcaccagaa

SEQ ID NO: 481256 - DNA, 25 bp, Homo sapien
ttgtcggtcaccagaagaagatcat

SEQ ID NO: 481257 - DNA, 25 bp, Homo sapien
gaagatcatgaacagccttcaagaa

SEQ ID NO: 481258 - DNA, 25 bp, Homo sapien
tgaaggtgcagctggtaaacggaat

SEQ ID NO: 481259 - DNA, 25 bp, Homo sapien
gaatggtgccattgtaacttcatgt

SEQ ID NO: 481260 - DNA, 25 bp, Homo sapien
aacttcatgtaaatgtcgcttcttc

SEQ ID NO: 481261 - DNA, 25 bp, Homo sapien
aaatgtcgcttcttcaagtgaatga

SEQ ID NO: 481262 - DNA, 25 bp, Homo sapien
ggcaaaatctggtcctgtggtaggc

SEQ ID NO: 481263 - DNA, 25 bp, Homo sapien
aaatctggtcctgtggtaggctaaa

SEQ ID NO: 481264 - DNA, 25 bp, Homo sapien
tctggtcctgtggtaggctaaataa

SEQ ID NO: 481265 - DNA, 25 bp, Homo sapien
cctgtgaaaggaatgtttgtggctc

SEQ ID NO: 481266 - DNA, 25 bp, Homo sapien
gtttgtggctcatgtcagtgtgtga

SEQ ID NO: 481267 - DNA, 25 bp, Homo sapien
ggctcatgtcagtgtgtgaatgcat

SEQ ID NO: 481268 - DNA, 25 bp, Homo sapien
gatatttatcttgagcactgcaatc

SEQ ID NO: 481269 - DNA, 25 bp, Homo sapien
tatcttgagcactgcaatctcaccc

SEQ ID NO: 481270 - DNA, 25 bp, Homo sapien
ccaccaagggaattcaatgggaatg

SEQ ID NO: 481271 - DNA, 25 bp, Homo sapien
gaatgtttattgtgactttgtcctc

SEQ ID NO: 481272 - DNA, 25 bp, Homo sapien
tattgtgactttgtcctctgttgca

SEQ ID NO: 481273 - DNA, 25 bp, Homo sapien
tcatataaaggcacctccagcttcg

SEQ ID NO: 481274 - DNA, 25 bp, Homo sapien
tccagcttcgagttgccaacacagg

SEQ ID NO: 481275 - DNA, 25 bp, Homo sapien
aggaagaatgctccctgctgttcag

SEQ ID NO: 481276 - DNA, 25 bp, Homo sapien
gctccctgctgttcagatgctgata

SEQ ID NO: 481277 - DNA, 25 bp, Homo sapien
gatgctgatatgtgtcctgtgcttc

SEQ ID NO: 481278 - DNA, 25 bp, Homo sapien
ggtagaagcaagaccttcatccact

SEQ ID NO: 481279 - DNA, 25 bp, Homo sapien
accttcatccactgacttcatattt

SEQ ID NO: 481280 - DNA, 25 bp, Homo sapien
atatttcttccacatcctgaactgt

SEQ ID NO: 481281 - DNA, 25 bp, Homo sapien
agattttggcaaaaacccacatgac

SEQ ID NO: 481282 - DNA, 25 bp, Homo sapien
cccacatgacatttgcgtctgcaga

SEQ ID NO: 481283 - DNA, 25 bp, Homo sapien
gagtagacttggaaggcatgcacct

SEQ ID NO: 481284 - DNA, 25 bp, Homo sapien
gtaactatataaaaacaggctgctt

SEQ ID NO: 481285 - DNA, 25 bp, Homo sapien
gctgctttaaaaggactagcctgca

SEQ ID NO: 481286 - DNA, 25 bp, Homo sapien
ggactagcctgcagaaagtttccaa

SEQ ID NO: 481287 - DNA, 25 bp, Homo sapien
gaaagtttccaaatacaagtacatt

SEQ ID NO: 481288 - DNA, 25 bp, Homo sapien
tgaatctactgtccaatttggcttg

SEQ ID NO: 481289 - DNA, 25 bp, Homo sapien
actgtccaatttggcttgttttcaa

SEQ ID NO: 481290 - DNA, 25 bp, Homo sapien
gatcatatcatttgttaattgcctg

SEQ ID NO: 481291 - DNA, 25 bp, Homo sapien
taattgcctggagtagaggattaca

SEQ ID NO: 481292 - DNA, 25 bp, Homo sapien
agaggattacagcatattgagtggt

SEQ ID NO: 481293 - DNA, 25 bp, Homo sapien
ttgagtggtagctaacgtatgtttt

SEQ ID NO: 481294 - DNA, 25 bp, Homo sapien
acaacagttcttcattaaatgtacc

SEQ ID NO: 481295 - DNA, 25 bp, Homo sapien
gaacaaattctatgtcaagcaaatt

SEQ ID NO: 481296 - DNA, 25 bp, Homo sapien
attctatgtcaagcaaattaagtaa

SEQ ID NO: 481297 - DNA, 25 bp, Homo sapien
gtaaacatctatgaagagactgaaa

SEQ ID NO: 481298 - DNA, 25 bp, Homo sapien
gtaaatagaaattgctaagcaccta

SEQ ID NO: 481299 - DNA, 25 bp, Homo sapien
gaaattgctaagcacctagcaataa

SEQ ID NO: 481300 - DNA, 25 bp, Homo sapien
taagcacctagcaataaagaattac

SEQ ID NO: 481301 - DNA, 25 bp, Homo sapien
taaagaattacaacaactcaaggaa

SEQ ID NO: 481302 - DNA, 25 bp, Homo sapien
gaattacaacaactcaaggaaatat

SEQ ID NO: 481303 - DNA, 25 bp, Homo sapien
ttattagcaggatcatgaattaatt

SEQ ID NO: 481304 - DNA, 25 bp, Homo sapien
cgcttctagctgagtttgttgtaca

SEQ ID NO: 481305 - DNA, 25 bp, Homo sapien
cttctagctgagtttgttgtacata

SEQ ID NO: 481306 - DNA, 25 bp, Homo sapien
gggcaactaaacaaacacaaagtat

SEQ ID NO: 481307 - DNA, 25 bp, Homo sapien
ggcaactaaacaaacacaaagtatt

SEQ ID NO: 481308 - DNA, 25 bp, Homo sapien
gcaactaaacaaacacaaagtattc

SEQ ID NO: 481309 - DNA, 25 bp, Homo sapien
caactaaacaaacacaaagtattct

SEQ ID NO: 481310 - DNA, 25 bp, Homo sapien
aactaaacaaacacaaagtattctg

SEQ ID NO: 481311 - DNA, 25 bp, Homo sapien
actaaacaaacacaaagtattctgt

SEQ ID NO: 481312 - DNA, 25 bp, Homo sapien
ctaaacaaacacaaagtattctgtg

SEQ ID NO: 481313 - DNA, 25 bp, Homo sapien
taaacaaacacaaagtattctgtgt

SEQ ID NO: 481314 - DNA, 25 bp, Homo sapien
aaacaaacacaaagtattctgtgtc

SEQ ID NO: 481315 - DNA, 25 bp, Homo sapien
gctggacagggcagttgtgtgttgg

SEQ ID NO: 481316 - DNA, 25 bp, Homo sapien
cgggtgctcccgctctgccatagca

SEQ ID NO: 481317 - DNA, 25 bp, Homo sapien
gagcaatgcaagcaccaacatcttg

SEQ ID NO: 481318 - DNA, 25 bp, Homo sapien
tccctttttgcttagaggtcctaca

SEQ ID NO: 481319 - DNA, 25 bp, Homo sapien
tgcttagaggtcctacatctctgac

SEQ ID NO: 481320 - DNA, 25 bp, Homo sapien
acatctctgacctctgtattcagtt

SEQ ID NO: 481321 - DNA, 25 bp, Homo sapien
cagtttcataacacggtcaccaaga

SEQ ID NO: 481322 - DNA, 25 bp, Homo sapien
aagttctgtaaagctttcatcggca

SEQ ID NO: 481323 - DNA, 25 bp, Homo sapien
ttcatcggcagcaatggtatcaatt

SEQ ID NO: 481324 - DNA, 25 bp, Homo sapien
ttggttttccttgatgtttctccca

SEQ ID NO: 481325 - DNA, 25 bp, Homo sapien
tgtttctcccattctgatcatctga

SEQ ID NO: 481326 - DNA, 25 bp, Homo sapien
caggaaggctgttgcagtcccgcag

SEQ ID NO: 481327 - DNA, 25 bp, Homo sapien
gttgcagtcccgcagggtaaatttg

SEQ ID NO: 481328 - DNA, 25 bp, Homo sapien
tcaatttacagaccttggcttttct

SEQ ID NO: 481329 - DNA, 25 bp, Homo sapien
cacttcttcagtcaaccaaaccaat

SEQ ID NO: 481330 - DNA, 25 bp, Homo sapien
cttcttcagtcaaccaaaccaatta

SEQ ID NO: 481331 - DNA, 25 bp, Homo sapien
tcttcagtcaaccaaaccaattaca

SEQ ID NO: 481332 - DNA, 25 bp, Homo sapien
tcagtcaaccaaaccaattacaaaa

SEQ ID NO: 481333 - DNA, 25 bp, Homo sapien
ttacaaaattgtgttccaatgtcac

SEQ ID NO: 481334 - DNA, 25 bp, Homo sapien
aattgtgttccaatgtcacatgttc

SEQ ID NO: 481335 - DNA, 25 bp, Homo sapien
ttgtgttccaatgtcacatgttcaa

SEQ ID NO: 481336 - DNA, 25 bp, Homo sapien
gtgttccaatgtcacatgttcaaaa

SEQ ID NO: 481337 - DNA, 25 bp, Homo sapien
gttccaatgtcacatgttcaaaaat

SEQ ID NO: 481338 - DNA, 25 bp, Homo sapien
ccaatgtcacatgttcaaaaataaa

SEQ ID NO: 481339 - DNA, 25 bp, Homo sapien
gaaggagagggctagttgtctgaga

SEQ ID NO: 481340 - DNA, 25 bp, Homo sapien
ggctgcagactaggaaatgggattc

SEQ ID NO: 481341 - DNA, 25 bp, Homo sapien
tgggattccaggtttaagatagctc

SEQ ID NO: 481342 - DNA, 25 bp, Homo sapien
gattccaggtttaagatagctcctt

SEQ ID NO: 481343 - DNA, 25 bp, Homo sapien
ggtttaagatagctcctttctggac

SEQ ID NO: 481344 - DNA, 25 bp, Homo sapien
tttaagatagctcctttctggacct

SEQ ID NO: 481345 - DNA, 25 bp, Homo sapien
tcagtccttcacctagtcacctagt

SEQ ID NO: 481346 - DNA, 25 bp, Homo sapien
ttcacctagtcacctagtcacaggg

SEQ ID NO: 481347 - DNA, 25 bp, Homo sapien
tagtcacctagtcacagggtggatt

SEQ ID NO: 481348 - DNA, 25 bp, Homo sapien
ggaaagcaacaaccatccctgtaag

SEQ ID NO: 481349 - DNA, 25 bp, Homo sapien
agcaacaaccatccctgtaagccat

SEQ ID NO: 481350 - DNA, 25 bp, Homo sapien
ggcccaggctctccatgagagtttg

SEQ ID NO: 481351 - DNA, 25 bp, Homo sapien
gtttggcttgaacattcattgtctg

SEQ ID NO: 481352 - DNA, 25 bp, Homo sapien
ccaatgtgtgaagaaatgaccagct

SEQ ID NO: 481353 - DNA, 25 bp, Homo sapien
aaggcccagggtgcacaggtcttcg

SEQ ID NO: 481354 - DNA, 25 bp, Homo sapien
acaggtcttcgttgggagaggcatc

SEQ ID NO: 481355 - DNA, 25 bp, Homo sapien
ggagaggcatctgcaggcctttcct

SEQ ID NO: 481356 - DNA, 25 bp, Homo sapien
actgggatccttgcctagcatagtg

SEQ ID NO: 481357 - DNA, 25 bp, Homo sapien
gatccttgcctagcatagtgacgat

SEQ ID NO: 481358 - DNA, 25 bp, Homo sapien
gtggctcgctttcaggtttatctcc

SEQ ID NO: 481359 - DNA, 25 bp, Homo sapien
gtttatctccatccctggaagcaga

SEQ ID NO: 481360 - DNA, 25 bp, Homo sapien
tggaagcagagttgctctggcccag

SEQ ID NO: 481361 - DNA, 25 bp, Homo sapien
gtataatctttgtaagtctcaggtt

SEQ ID NO: 481362 - DNA, 25 bp, Homo sapien
aatctttgtaagtctcaggttgtta

SEQ ID NO: 481363 - DNA, 25 bp, Homo sapien
tgtaagtctcaggttgttattagct

SEQ ID NO: 481364 - DNA, 25 bp, Homo sapien
agtctcaggttgttattagcttttt

SEQ ID NO: 481365 - DNA, 25 bp, Homo sapien
ataagtactatttctaactaaagat

SEQ ID NO: 481366 - DNA, 25 bp, Homo sapien
tttcccctaatagaaatgaggctgg

SEQ ID NO: 481367 - DNA, 25 bp, Homo sapien
tcccctaatagaaatgaggctgggt

SEQ ID NO: 481368 - DNA, 25 bp, Homo sapien
aactgaagtgagagagtgactggtt

SEQ ID NO: 481369 - DNA, 25 bp, Homo sapien
agagtgactggttgaattggttgca

SEQ ID NO: 481370 - DNA, 25 bp, Homo sapien
ggttgaattggttgcacagtggttt

SEQ ID NO: 481371 - DNA, 25 bp, Homo sapien
ttgaattggttgcacagtggttttc

SEQ ID NO: 481372 - DNA, 25 bp, Homo sapien
gaaaagttcaacaacagtgttatga

SEQ ID NO: 481373 - DNA, 25 bp, Homo sapien
gaatacactcattcatcactagtac

SEQ ID NO: 481374 - DNA, 25 bp, Homo sapien
catcactagtactgttctcctgaac

SEQ ID NO: 481375 - DNA, 25 bp, Homo sapien
actgttctcctgaacatgatatgtg

SEQ ID NO: 481376 - DNA, 25 bp, Homo sapien
gggatctatgtatcatgacctctcc

SEQ ID NO: 481377 - DNA, 25 bp, Homo sapien
tctatgtatcatgacctctccacat

SEQ ID NO: 481378 - DNA, 25 bp, Homo sapien
ttttccgtaccctcagtgcttggca

SEQ ID NO: 481379 - DNA, 25 bp, Homo sapien
accctcagtgcttggcagtgcctag

SEQ ID NO: 481380 - DNA, 25 bp, Homo sapien
gatacacacacctcaacaataacgt

SEQ ID NO: 481381 - DNA, 25 bp, Homo sapien
acacacctcaacaataacgttatga

SEQ ID NO: 481382 - DNA, 25 bp, Homo sapien
aacatcaacaacaacgttatgaaaa

SEQ ID NO: 481383 - DNA, 25 bp, Homo sapien
gcttcctttggccaagaaagatgaa

SEQ ID NO: 481384 - DNA, 25 bp, Homo sapien
agcagccgccgtcctgagatgttct

SEQ ID NO: 481385 - DNA, 25 bp, Homo sapien
gagatgttctctgcagggctgtttg

SEQ ID NO: 481386 - DNA, 25 bp, Homo sapien
gcagggctgtttgtggctgtaattt

SEQ ID NO: 481387 - DNA, 25 bp, Homo sapien
gtaattttatgcttggccggacttc

SEQ ID NO: 481388 - DNA, 25 bp, Homo sapien
gacttctgggttacctgttacctag

SEQ ID NO: 481389 - DNA, 25 bp, Homo sapien
ggttacctgttacctagcttcaagg

SEQ ID NO: 481390 - DNA, 25 bp, Homo sapien
gaagaatggcagtatcaccccaggt

SEQ ID NO: 481391 - DNA, 25 bp, Homo sapien
ttgcagcatggctaaaacactatgg

SEQ ID NO: 481392 - DNA, 25 bp, Homo sapien
tatcaccccaggtgacagagctctg

SEQ ID NO: 481393 - DNA, 25 bp, Homo sapien
tgtggttgagctctcttaacacctg

SEQ ID NO: 481394 - DNA, 25 bp, Homo sapien
cccaaacagggttgaagtgcttttg

SEQ ID NO: 481395 - DNA, 25 bp, Homo sapien
aacagggttgaagtgcttttgacac

SEQ ID NO: 481396 - DNA, 25 bp, Homo sapien
cagggttgaagtgcttttgacacat

SEQ ID NO: 481397 - DNA, 25 bp, Homo sapien
gggttgaagtgcttttgacacattt

SEQ ID NO: 481398 - DNA, 25 bp, Homo sapien
gaagtgcttttgacacatttgtgat

SEQ ID NO: 481399 - DNA, 25 bp, Homo sapien
agtgcttttgacacatttgtgataa

SEQ ID NO: 481400 - DNA, 25 bp, Homo sapien
gacacatttgtgataaaagttctga

SEQ ID NO: 481401 - DNA, 25 bp, Homo sapien
aacttaaatgacttcttctcctgct

SEQ ID NO: 481402 - DNA, 25 bp, Homo sapien
acttaaatgacttcttctcctgctc

SEQ ID NO: 481403 - DNA, 25 bp, Homo sapien
ttaaatgacttcttctcctgctcct

SEQ ID NO: 481404 - DNA, 25 bp, Homo sapien
aaatgacttcttctcctgctcctgg

SEQ ID NO: 481405 - DNA, 25 bp, Homo sapien
tggatttaagtcctacccatcgaga

SEQ ID NO: 481406 - DNA, 25 bp, Homo sapien
aagtcctacccatcgagactactgt

SEQ ID NO: 481407 - DNA, 25 bp, Homo sapien
tcgagactactgtcttcagagggca

SEQ ID NO: 481408 - DNA, 25 bp, Homo sapien
gctgcggctggaaccacagtggaca

SEQ ID NO: 481409 - DNA, 25 bp, Homo sapien
gctccaaggacaatcctctgcagaa

SEQ ID NO: 481410 - DNA, 25 bp, Homo sapien
ggacaatcctctgcagaaaccagca

SEQ ID NO: 481411 - DNA, 25 bp, Homo sapien
gaaacaattcttaatgctgcaggaa

SEQ ID NO: 481412 - DNA, 25 bp, Homo sapien
aatgctgcaggaagtagttaggaga

SEQ ID NO: 481413 - DNA, 25 bp, Homo sapien
aaacgactgtgtaagtcagagctaa

SEQ ID NO: 481414 - DNA, 25 bp, Homo sapien
gaaaatatttccaaggctgtctgtg

SEQ ID NO: 481415 - DNA, 25 bp, Homo sapien
tttccaaggctgtctgtgaagtggg

SEQ ID NO: 481416 - DNA, 25 bp, Homo sapien
aaaagaactttacggtgctgtgact

SEQ ID NO: 481417 - DNA, 25 bp, Homo sapien
gaactttacggtgctgtgactccga

SEQ ID NO: 481418 - DNA, 25 bp, Homo sapien
actttacggtgctgtgactccgata

SEQ ID NO: 481419 - DNA, 25 bp, Homo sapien
tacggtgctgtgactccgataggat

SEQ ID NO: 481420 - DNA, 25 bp, Homo sapien
tgctgtgactccgataggatcagat

SEQ ID NO: 481421 - DNA, 25 bp, Homo sapien
gtgactccgataggatcagattcat

SEQ ID NO: 481422 - DNA, 25 bp, Homo sapien
tcagattcatcattggacccccaga

SEQ ID NO: 481423 - DNA, 25 bp, Homo sapien
ggaccccaagtgtgcacctttgaag

SEQ ID NO: 481424 - DNA, 25 bp, Homo sapien
aagccattgtcttcactcctgactg

SEQ ID NO: 481425 - DNA, 25 bp, Homo sapien
tgtcttcactcctgactgatagatc

SEQ ID NO: 481426 - DNA, 25 bp, Homo sapien
cttcactcctgactgatagatcggg

SEQ ID NO: 481427 - DNA, 25 bp, Homo sapien
tgagtgcccagacagcgcaggacca

SEQ ID NO: 481428 - DNA, 25 bp, Homo sapien
agacagcgcaggaccacgcagtcca

SEQ ID NO: 481429 - DNA, 25 bp, Homo sapien
gacctgtgccacattcttgtgtcag

SEQ ID NO: 481430 - DNA, 25 bp, Homo sapien
ctgcgttttcttcaacatatgagag

SEQ ID NO: 481431 - DNA, 25 bp, Homo sapien
agcatttagaggagctgccctattc

SEQ ID NO: 481432 - DNA, 25 bp, Homo sapien
gagctgccctattctggtgtcctgg

SEQ ID NO: 481433 - DNA, 25 bp, Homo sapien
agagagacgtgcttgtgaccccggc

SEQ ID NO: 481434 - DNA, 25 bp, Homo sapien
gcaggagccctgaacctttctggga

SEQ ID NO: 481435 - DNA, 25 bp, Homo sapien
ctgaacctttctgggagcaccagct

SEQ ID NO: 481436 - DNA, 25 bp, Homo sapien
agctcacttgggtgattggctcatt

SEQ ID NO: 481437 - DNA, 25 bp, Homo sapien
acttgggtgattggctcattcaggt

SEQ ID NO: 481438 - DNA, 25 bp, Homo sapien
agaggcagcgcctttgtctgtctat

SEQ ID NO: 481439 - DNA, 25 bp, Homo sapien
agcgcctttgtctgtctatctggtg

SEQ ID NO: 481440 - DNA, 25 bp, Homo sapien
gcctttgtctgtctatctggtgaca

SEQ ID NO: 481441 - DNA, 25 bp, Homo sapien
gtctgtctatctggtgacaagagag

SEQ ID NO: 481442 - DNA, 25 bp, Homo sapien
gctcagcgggcagtgcttagagcac

SEQ ID NO: 481443 - DNA, 25 bp, Homo sapien
agtgcttagagcacaggcccctctg

SEQ ID NO: 481444 - DNA, 25 bp, Homo sapien
gcttagagcacaggcccctctgttg

SEQ ID NO: 481445 - DNA, 25 bp, Homo sapien
cagtctgcccttgggagcgtaggcc

SEQ ID NO: 481446 - DNA, 25 bp, Homo sapien
agcgtaggccccagggagacttcta

SEQ ID NO: 481447 - DNA, 25 bp, Homo sapien
taggccccagggagacttctaaagc

SEQ ID NO: 481448 - DNA, 25 bp, Homo sapien
aagcatctcactcggcccacggagg

SEQ ID NO: 481449 - DNA, 25 bp, Homo sapien
ttgtcgtcctccaccacacactgaa

SEQ ID NO: 481450 - DNA, 25 bp, Homo sapien
agcttggaggccccctagaccagct

SEQ ID NO: 481451 - DNA, 25 bp, Homo sapien
ttccagctggatggagcacacacag

SEQ ID NO: 481452 - DNA, 25 bp, Homo sapien
ctgggccatgtcagtctcatcgtcc

SEQ ID NO: 481453 - DNA, 25 bp, Homo sapien
gggccatgtcagtctcatcgtccca

SEQ ID NO: 481454 - DNA, 25 bp, Homo sapien
ggccatgtcagtctcatcgtcccaa

SEQ ID NO: 481455 - DNA, 25 bp, Homo sapien
ttcttctcccgcgtactgctgcagc

SEQ ID NO: 481456 - DNA, 25 bp, Homo sapien
tctcccgcgtactgctgcagccgct

SEQ ID NO: 481457 - DNA, 25 bp, Homo sapien
tgagctgtgccgcttcttgtcctcc

SEQ ID NO: 481458 - DNA, 25 bp, Homo sapien
gagctgtgccgcttcttgtcctcct

SEQ ID NO: 481459 - DNA, 25 bp, Homo sapien
aagtctgtccccaccttgtcgtcct

SEQ ID NO: 481460 - DNA, 25 bp, Homo sapien
gtattctgtgtcaggtattgggctg

SEQ ID NO: 481461 - DNA, 25 bp, Homo sapien
taatgtttacaatctgcctcaatca

SEQ ID NO: 481462 - DNA, 25 bp, Homo sapien
gcctcaatcactctgtcttttataa

SEQ ID NO: 481463 - DNA, 25 bp, Homo sapien
gctctgccatagcactgatcagtga

SEQ ID NO: 481464 - DNA, 25 bp, Homo sapien
atcagtgacaatttacaggaatgta

SEQ ID NO: 481465 - DNA, 25 bp, Homo sapien
acaggaatgtagcagcgatggaatt

SEQ ID NO: 481466 - DNA, 25 bp, Homo sapien
gaatgtagcagcgatggaattacct

SEQ ID NO: 481467 - DNA, 25 bp, Homo sapien
gtagcagcgatggaattacctggaa

SEQ ID NO: 481468 - DNA, 25 bp, Homo sapien
agcagcgatggaattacctggaaca

SEQ ID NO: 481469 - DNA, 25 bp, Homo sapien
cagcgatggaattacctggaacagt

SEQ ID NO: 481470 - DNA, 25 bp, Homo sapien
gcgatggaattacctggaacagttt

SEQ ID NO: 481471 - DNA, 25 bp, Homo sapien
gtatttagactatattcaagcctcg

SEQ ID NO: 481472 - DNA, 25 bp, Homo sapien
tagactatattcaagcctcgctctg

SEQ ID NO: 481473 - DNA, 25 bp, Homo sapien
gactatattcaagcctcgctctgtc

SEQ ID NO: 481474 - DNA, 25 bp, Homo sapien
cacccatgcttgagtgcaacctctg

SEQ ID NO: 481475 - DNA, 25 bp, Homo sapien
catgcttgagtgcaacctctgccca

SEQ ID NO: 481476 - DNA, 25 bp, Homo sapien
ttgagtgcaacctctgcccactgtg

SEQ ID NO: 481477 - DNA, 25 bp, Homo sapien
gagtgcaacctctgcccactgtgtt

SEQ ID NO: 481478 - DNA, 25 bp, Homo sapien
acctctgcccactgtgttcaggcga

SEQ ID NO: 481479 - DNA, 25 bp, Homo sapien
tgcccactgtgttcaggcgattctc

SEQ ID NO: 481480 - DNA, 25 bp, Homo sapien
cgcccggccagttacataagatttt

SEQ ID NO: 481481 - DNA, 25 bp, Homo sapien
gcccggccagttacataagatttta

SEQ ID NO: 481482 - DNA, 25 bp, Homo sapien
aaatctcattggctcattcctgttt

SEQ ID NO: 481483 - DNA, 25 bp, Homo sapien
tcattggctcattcctgtttttagg

SEQ ID NO: 481484 - DNA, 25 bp, Homo sapien
ggcactaacgctgcttgtttggcaa

SEQ ID NO: 481485 - DNA, 25 bp, Homo sapien
gtttggcaaatcatcatcactgagg

SEQ ID NO: 481486 - DNA, 25 bp, Homo sapien
atcactgaggtattccacccagaga

SEQ ID NO: 481487 - DNA, 25 bp, Homo sapien
gaggagagccattatacccgttgtc

SEQ ID NO: 481488 - DNA, 25 bp, Homo sapien
attatacccgttgtctttctgggct

SEQ ID NO: 481489 - DNA, 25 bp, Homo sapien
tttctgggctccttgagtttatctg

SEQ ID NO: 481490 - DNA, 25 bp, Homo sapien
ccttgagtttatctggattccaaca

SEQ ID NO: 481491 - DNA, 25 bp, Homo sapien
aacagcacttggaaagtaccgccct

SEQ ID NO: 481492 - DNA, 25 bp, Homo sapien
acctcaaatgcaaacacaatctctg

SEQ ID NO: 481493 - DNA, 25 bp, Homo sapien
taaccaggtttaccagccgctttct

SEQ ID NO: 481494 - DNA, 25 bp, Homo sapien
gctttctgcctctttgtgcttttga

SEQ ID NO: 481495 - DNA, 25 bp, Homo sapien
aaagatgattatttggcccaggctg

SEQ ID NO: 481496 - DNA, 25 bp, Homo sapien
ggctgagggtgcaaacagaactctt

SEQ ID NO: 481497 - DNA, 25 bp, Homo sapien
aacagaactcttcacgtgtccacga

SEQ ID NO: 481498 - DNA, 25 bp, Homo sapien
gtgtccacgacaagaaaaatagttt

SEQ ID NO: 481499 - DNA, 25 bp, Homo sapien
aaaagtgtgagtttttgcacctgca

SEQ ID NO: 481500 - DNA, 25 bp, Homo sapien
tttgcacctgcaaaattgtaatgca

SEQ ID NO: 481501 - DNA, 25 bp, Homo sapien
taatgcaagccctgactgggtggaa

SEQ ID NO: 481502 - DNA, 25 bp, Homo sapien
ccctgactgggtggaagctgaagtc

SEQ ID NO: 481503 - DNA, 25 bp, Homo sapien
gaagctgaagtcttgctgttttaaa

SEQ ID NO: 481504 - DNA, 25 bp, Homo sapien
agcagggctgtcaaactctgggaga

SEQ ID NO: 481505 - DNA, 25 bp, Homo sapien
aactctgggagaaaccgactcggct

SEQ ID NO: 481506 - DNA, 25 bp, Homo sapien
aaccgactcggctctgacagggaga

SEQ ID NO: 481507 - DNA, 25 bp, Homo sapien
agccgagcgttcagggctgcgctcc

SEQ ID NO: 481508 - DNA, 25 bp, Homo sapien
tgagagggcacgtgccccgtcacag

SEQ ID NO: 481509 - DNA, 25 bp, Homo sapien
cctggattgatgtgtctcacagact

SEQ ID NO: 481510 - DNA, 25 bp, Homo sapien
tgtctcacagactcggaagggttct

SEQ ID NO: 481511 - DNA, 25 bp, Homo sapien
acagactcggaagggttctgctcct

SEQ ID NO: 481512 - DNA, 25 bp, Homo sapien
cccctgaacaatgctggcagttgct

SEQ ID NO: 481513 - DNA, 25 bp, Homo sapien
gctggcagttgctacaaatagattt

SEQ ID NO: 481514 - DNA, 25 bp, Homo sapien
tattggaggcttatggctccggttc

SEQ ID NO: 481515 - DNA, 25 bp, Homo sapien
gtactgtaaatctactgtaatcctg

SEQ ID NO: 481516 - DNA, 25 bp, Homo sapien
aaatctactgtaatcctgttttgca

SEQ ID NO: 481517 - DNA, 25 bp, Homo sapien
gtaatcctgttttgcagaatactgc

SEQ ID NO: 481518 - DNA, 25 bp, Homo sapien
gaatactgcacgacggagattgaga

SEQ ID NO: 481519 - DNA, 25 bp, Homo sapien
agtgagagctcttatgacatagatt

SEQ ID NO: 481520 - DNA, 25 bp, Homo sapien
gattacattgtgattcccatgtcat

SEQ ID NO: 481521 - DNA, 25 bp, Homo sapien
ccatgtcattagtagccccagctaa

SEQ ID NO: 481522 - DNA, 25 bp, Homo sapien
aatacttactccaaggtatgtatac

SEQ ID NO: 481523 - DNA, 25 bp, Homo sapien
gtatacttacatcttcatatttttc

SEQ ID NO: 481524 - DNA, 25 bp, Homo sapien
atgaaaggagcatccttctcccagt

SEQ ID NO: 481525 - DNA, 25 bp, Homo sapien
tcccagttccttcatagccatggag

SEQ ID NO: 481526 - DNA, 25 bp, Homo sapien
aagtggctgatgtccataacttctg

SEQ ID NO: 481527 - DNA, 25 bp, Homo sapien
gatgtccataacttctgagtctgtt

SEQ ID NO: 481528 - DNA, 25 bp, Homo sapien
gactcttgttaatgctgttaccaga

SEQ ID NO: 481529 - DNA, 25 bp, Homo sapien
gagtagagatttgaccagcctctcc

SEQ ID NO: 481530 - DNA, 25 bp, Homo sapien
gcctctccctaaaatgtaagcttct

SEQ ID NO: 481531 - DNA, 25 bp, Homo sapien
taagcttctcaacaacagtacagga

SEQ ID NO: 481532 - DNA, 25 bp, Homo sapien
gtgcaagagtagactagaaccttta

SEQ ID NO: 481533 - DNA, 25 bp, Homo sapien
ggaacggagctatgttgcatctgtt

SEQ ID NO: 481534 - DNA, 25 bp, Homo sapien
tataagttctacatgcaccagccaa

SEQ ID NO: 481535 - DNA, 25 bp, Homo sapien
atgcaccagccaaaacttaggacag

SEQ ID NO: 481536 - DNA, 25 bp, Homo sapien
ggatgtccccaaattaagatactac

SEQ ID NO: 481537 - DNA, 25 bp, Homo sapien
ctcacctattcttgccgggagcagg

SEQ ID NO: 481538 - DNA, 25 bp, Homo sapien
ttcttgccgggagcaggtactctaa

SEQ ID NO: 481539 - DNA, 25 bp, Homo sapien
gagcaggtactctaagggtccattc

SEQ ID NO: 481540 - DNA, 25 bp, Homo sapien
tactctaagggtccattcgggcctg

SEQ ID NO: 481541 - DNA, 25 bp, Homo sapien
attcgggcctgtgccacgctaagct

SEQ ID NO: 481542 - DNA, 25 bp, Homo sapien
gtgccacgctaagctttacaaacag

SEQ ID NO: 481543 - DNA, 25 bp, Homo sapien
tcacactggtgagggcatgcttgtc

SEQ ID NO: 481544 - DNA, 25 bp, Homo sapien
tgcccgccgacggatggcgaacttg

SEQ ID NO: 481545 - DNA, 25 bp, Homo sapien
gatggcgaacttggccactatggaa

SEQ ID NO: 481546 - DNA, 25 bp, Homo sapien
catcctggcaggagttggactttta

SEQ ID NO: 481547 - DNA, 25 bp, Homo sapien
gcaggagttggacttttactcgttt

SEQ ID NO: 481548 - DNA, 25 bp, Homo sapien
accccagtgtagattctgatccaag

SEQ ID NO: 481549 - DNA, 25 bp, Homo sapien
aagtccttagagtcacacaggcagg

SEQ ID NO: 481550 - DNA, 25 bp, Homo sapien
acaggcaggagatggtggcttttca

SEQ ID NO: 481551 - DNA, 25 bp, Homo sapien
ggcttttcaggttttcagagtctca

SEQ ID NO: 481552 - DNA, 25 bp, Homo sapien
tttcagagtctcacttgatccctat

SEQ ID NO: 481553 - DNA, 25 bp, Homo sapien
acttgatccctattttgctggtctt

SEQ ID NO: 481554 - DNA, 25 bp, Homo sapien
taggaatctctgtaaacctgctgat

SEQ ID NO: 481555 - DNA, 25 bp, Homo sapien
gattgttaatttagccgtatgttca

SEQ ID NO: 481556 - DNA, 25 bp, Homo sapien
taaggagtcagctctgttcagattc

SEQ ID NO: 481557 - DNA, 25 bp, Homo sapien
agctctgttcagattctcagttgaa

SEQ ID NO: 481558 - DNA, 25 bp, Homo sapien
ctcagttgaatcgtttttatctata

SEQ ID NO: 481559 - DNA, 25 bp, Homo sapien
agcttactgaaacgtctgcgtctca

SEQ ID NO: 481560 - DNA, 25 bp, Homo sapien
aaacgtctgcgtctcaggttcaagc

SEQ ID NO: 481561 - DNA, 25 bp, Homo sapien
gctggaattacagtgttagcagtca

SEQ ID NO: 481562 - DNA, 25 bp, Homo sapien
gtgttagcagtcactgatgctcaaa

SEQ ID NO: 481563 - DNA, 25 bp, Homo sapien
gcagtcactgatgctcaaacatgag

SEQ ID NO: 481564 - DNA, 25 bp, Homo sapien
aacatgagaagactgggacatccat

SEQ ID NO: 481565 - DNA, 25 bp, Homo sapien
tgggacatccatcagataagaaacg

SEQ ID NO: 481566 - DNA, 25 bp, Homo sapien
gataagaaacgctgcccaaagtgtt

SEQ ID NO: 481567 - DNA, 25 bp, Homo sapien
acgctgcccaaagtgttagactaat

SEQ ID NO: 481568 - DNA, 25 bp, Homo sapien
gactaataagtgacagggttggaca

SEQ ID NO: 481569 - DNA, 25 bp, Homo sapien
tgacagggttggacaatgaacccaa

SEQ ID NO: 481570 - DNA, 25 bp, Homo sapien
tgagaccctgactcagaaagaacca

SEQ ID NO: 481571 - DNA, 25 bp, Homo sapien
tcagaaagaaccacttgcccacagt

SEQ ID NO: 481572 - DNA, 25 bp, Homo sapien
acttgcccacagtccagacagatgg

SEQ ID NO: 481573 - DNA, 25 bp, Homo sapien
ttgcccacagtccagacagatggat

SEQ ID NO: 481574 - DNA, 25 bp, Homo sapien
acagatggattgtaggtgggttttc

SEQ ID NO: 481575 - DNA, 25 bp, Homo sapien
gggttttctggagattagtagatac

SEQ ID NO: 481576 - DNA, 25 bp, Homo sapien
attgtgtcagtagtacaaagtgtat

SEQ ID NO: 481577 - DNA, 25 bp, Homo sapien
agtgtatataggctgtttactctta

SEQ ID NO: 481578 - DNA, 25 bp, Homo sapien
gatacagatttatggtactgatacc

SEQ ID NO: 481579 - DNA, 25 bp, Homo sapien
atggtactgatacctttaaattata

SEQ ID NO: 481580 - DNA, 25 bp, Homo sapien
tgcactactgcagtgcaacctgggt

SEQ ID NO: 481581 - DNA, 25 bp, Homo sapien
ggcctctggaatgctctagcgtgtg

SEQ ID NO: 481582 - DNA, 25 bp, Homo sapien
cctctggaatgctctagcgtgtgac

SEQ ID NO: 481583 - DNA, 25 bp, Homo sapien
tctggaatgctctagcgtgtgacgt

SEQ ID NO: 481584 - DNA, 25 bp, Homo sapien
tggaatgctctagcgtgtgacgtgt

SEQ ID NO: 481585 - DNA, 25 bp, Homo sapien
aatgctctagcgtgtgacgtgttct

SEQ ID NO: 481586 - DNA, 25 bp, Homo sapien
tgctctagcgtgtgacgtgttctca

SEQ ID NO: 481587 - DNA, 25 bp, Homo sapien
tctagcgtgtgacgtgttctcagga

SEQ ID NO: 481588 - DNA, 25 bp, Homo sapien
tagcgtgtgacgtgttctcaggaaa

SEQ ID NO: 481589 - DNA, 25 bp, Homo sapien
gcgtgtgacgtgttctcaggaaaac

SEQ ID NO: 481590 - DNA, 25 bp, Homo sapien
gacgtgttctcaggaaaacgttctg

SEQ ID NO: 481591 - DNA, 25 bp, Homo sapien
tgtccggcatgggactgcgctggag

SEQ ID NO: 481592 - DNA, 25 bp, Homo sapien
atgggggtctccacagcatgacttt

SEQ ID NO: 481593 - DNA, 25 bp, Homo sapien
tgggggtctccacagcatgactttg

SEQ ID NO: 481594 - DNA, 25 bp, Homo sapien
gggggtctccacagcatgactttgg

SEQ ID NO: 481595 - DNA, 25 bp, Homo sapien
ggggtctccacagcatgactttggg

SEQ ID NO: 481596 - DNA, 25 bp, Homo sapien
aagtgaacatcagcttgcctggacc

SEQ ID NO: 481597 - DNA, 25 bp, Homo sapien
gtcaacagtgggcaggacggcagag

SEQ ID NO: 481598 - DNA, 25 bp, Homo sapien
gacggcagaggtggaatcagggatg

SEQ ID NO: 481599 - DNA, 25 bp, Homo sapien
cggcagaggtggaatcagggatggt

SEQ ID NO: 481600 - DNA, 25 bp, Homo sapien
cagaggtggaatcagggatggtgaa

SEQ ID NO: 481601 - DNA, 25 bp, Homo sapien
gtgaagagggaggtgatactcccct

SEQ ID NO: 481602 - DNA, 25 bp, Homo sapien
tgaagagggaggtgatactcccctt

SEQ ID NO: 481603 - DNA, 25 bp, Homo sapien
aaagaatcactatcacagccttact

SEQ ID NO: 481604 - DNA, 25 bp, Homo sapien
agaatcactatcacagccttactgc

SEQ ID NO: 481605 - DNA, 25 bp, Homo sapien
gaatcactatcacagccttactgca

SEQ ID NO: 481606 - DNA, 25 bp, Homo sapien
aatcactatcacagccttactgcaa

SEQ ID NO: 481607 - DNA, 25 bp, Homo sapien
actatcacagccttactgcaacact

SEQ ID NO: 481608 - DNA, 25 bp, Homo sapien
ctatcacagccttactgcaacactg

SEQ ID NO: 481609 - DNA, 25 bp, Homo sapien
tcacagccttactgcaacactgtgt

SEQ ID NO: 481610 - DNA, 25 bp, Homo sapien
gtggcatgcactgctgatagccaac

SEQ ID NO: 481611 - DNA, 25 bp, Homo sapien
atttgaatactttacatgccaagaa

SEQ ID NO: 481612 - DNA, 25 bp, Homo sapien
gaaatgatcagaatactctaatgac

SEQ ID NO: 481613 - DNA, 25 bp, Homo sapien
tcctcctttacaatgcaaacctgta

SEQ ID NO: 481614 - DNA, 25 bp, Homo sapien
gtactgtaaatctactgtaatcctg

SEQ ID NO: 481615 - DNA, 25 bp, Homo sapien
aaatctactgtaatcctgttttgca

SEQ ID NO: 481616 - DNA, 25 bp, Homo sapien
tctactgtaatcctgttttgcagaa

SEQ ID NO: 481617 - DNA, 25 bp, Homo sapien
gtaatcctgttttgcagaatactgc

SEQ ID NO: 481618 - DNA, 25 bp, Homo sapien
tgttttgcagaatactgcacgacgg

SEQ ID NO: 481619 - DNA, 25 bp, Homo sapien
aatacttactccaaggtatgtatac

SEQ ID NO: 481620 - DNA, 25 bp, Homo sapien
gtatacttacatcttcatatttttc

SEQ ID NO: 481621 - DNA, 25 bp, Homo sapien
aatgaaaggagcatccttctcccag

SEQ ID NO: 481622 - DNA, 25 bp, Homo sapien
gaaaggagcatccttctcccagttc

SEQ ID NO: 481623 - DNA, 25 bp, Homo sapien
tcccagttccttcatagccatggag

SEQ ID NO: 481624 - DNA, 25 bp, Homo sapien
ccagttccttcatagccatggaggg

SEQ ID NO: 481625 - DNA, 25 bp, Homo sapien
cctgcaaaatagctccctttgtctg

SEQ ID NO: 481626 - DNA, 25 bp, Homo sapien
ctgcaaaatagctccctttgtctgt

SEQ ID NO: 481627 - DNA, 25 bp, Homo sapien
tgcaaaatagctccctttgtctgtt

SEQ ID NO: 481628 - DNA, 25 bp, Homo sapien
caaaatagctccctttgtctgttct

SEQ ID NO: 481629 - DNA, 25 bp, Homo sapien
aaaatagctccctttgtctgttctt

SEQ ID NO: 481630 - DNA, 25 bp, Homo sapien
aaatagctccctttgtctgttctta

SEQ ID NO: 481631 - DNA, 25 bp, Homo sapien
agctccctttgtctgttcttatcag

SEQ ID NO: 481632 - DNA, 25 bp, Homo sapien
ccagctacttaggtcgtaagtgaaa

SEQ ID NO: 481633 - DNA, 25 bp, Homo sapien
cttaggtcgtaagtgaaatacttga

SEQ ID NO: 481634 - DNA, 25 bp, Homo sapien
taaagcccctgcctaacaatcaata

SEQ ID NO: 481635 - DNA, 25 bp, Homo sapien
gaaagcttactactagcctgcaaaa

SEQ ID NO: 481636 - DNA, 25 bp, Homo sapien
cctggtcggtaattttccagaagca

SEQ ID NO: 481637 - DNA, 25 bp, Homo sapien
caatttcttgtttcctccaaatggc

SEQ ID NO: 481638 - DNA, 25 bp, Homo sapien
tgtttcctccaaatggcctgtagag

SEQ ID NO: 481639 - DNA, 25 bp, Homo sapien
ttgttttccaatcaccgactgtcct

SEQ ID NO: 481640 - DNA, 25 bp, Homo sapien
gactgtcctgtctacattagcattc

SEQ ID NO: 481641 - DNA, 25 bp, Homo sapien
tgtctacattagcattcaccccggg

SEQ ID NO: 481642 - DNA, 25 bp, Homo sapien
tcaccccgggtgtctataattaagc

SEQ ID NO: 481643 - DNA, 25 bp, Homo sapien
taagcaagcctaagctgggcacata

SEQ ID NO: 481644 - DNA, 25 bp, Homo sapien
ctcagtaacctcttacgcatggaga

SEQ ID NO: 481645 - DNA, 25 bp, Homo sapien
aggacacacgtgagtccagccaact

SEQ ID NO: 481646 - DNA, 25 bp, Homo sapien
ccagccaactcagagcttcaaggag

SEQ ID NO: 481647 - DNA, 25 bp, Homo sapien
gttttctctctctaaagctttgttc

SEQ ID NO: 481648 - DNA, 25 bp, Homo sapien
agctttgttcattgtatctggtgga

SEQ ID NO: 481649 - DNA, 25 bp, Homo sapien
agggagtagacacctagccatgctt

SEQ ID NO: 481650 - DNA, 25 bp, Homo sapien
gacacctagccatgcttctaatgtg

SEQ ID NO: 481651 - DNA, 25 bp, Homo sapien
aatgtgaagtgtctactagcccagt

SEQ ID NO: 481652 - DNA, 25 bp, Homo sapien
ctactagcccagtggtctctatttt

SEQ ID NO: 481653 - DNA, 25 bp, Homo sapien
gtctctattttggatttgaacttac

SEQ ID NO: 481654 - DNA, 25 bp, Homo sapien
acctggtgccttaccttttaatcat

SEQ ID NO: 481655 - DNA, 25 bp, Homo sapien
ggtgccttaccttttaatcatatta

SEQ ID NO: 481656 - DNA, 25 bp, Homo sapien
gttattattccttagttcctatctg

SEQ ID NO: 481657 - DNA, 25 bp, Homo sapien
ttccttagttcctatctgtaagatc

SEQ ID NO: 481658 - DNA, 25 bp, Homo sapien
gggatgtcagagactcctccttggc

SEQ ID NO: 481659 - DNA, 25 bp, Homo sapien
tcagagactcctccttggcgacgca

SEQ ID NO: 481660 - DNA, 25 bp, Homo sapien
cgccttttccgatgcttggagacag

SEQ ID NO: 481661 - DNA, 25 bp, Homo sapien
tgcttggagacaggtcggtgctcct

SEQ ID NO: 481662 - DNA, 25 bp, Homo sapien
ttggagacaggtcggtgctcctccc

SEQ ID NO: 481663 - DNA, 25 bp, Homo sapien
acgctggcgggctggacagtgtcaa

SEQ ID NO: 481664 - DNA, 25 bp, Homo sapien
gtgtcaagccaagagctacttgccc

SEQ ID NO: 481665 - DNA, 25 bp, Homo sapien
caagagctacttgcccgaaggtacg

SEQ ID NO: 481666 - DNA, 25 bp, Homo sapien
acagggagagcctgagacgcccttc

SEQ ID NO: 481667 - DNA, 25 bp, Homo sapien
gagagcctgagacgcccttctcttg

SEQ ID NO: 481668 - DNA, 25 bp, Homo sapien
ctgagaacatacccacttctggctc

SEQ ID NO: 481669 - DNA, 25 bp, Homo sapien
aaaagtcactgctctaatacaagaa

SEQ ID NO: 481670 - DNA, 25 bp, Homo sapien
gctctaatacaagaaaagtcccggt

SEQ ID NO: 481671 - DNA, 25 bp, Homo sapien
ggtgaatggttccataaactgtgtt

SEQ ID NO: 481672 - DNA, 25 bp, Homo sapien
aactgtgttaaccaggcttcttaca

SEQ ID NO: 481673 - DNA, 25 bp, Homo sapien
taaccaggcttcttacaggctagtc

SEQ ID NO: 481674 - DNA, 25 bp, Homo sapien
gcttcttacaggctagtcccagaat

SEQ ID NO: 481675 - DNA, 25 bp, Homo sapien
gaatctgaccaccatgtgcaatact

SEQ ID NO: 481676 - DNA, 25 bp, Homo sapien
tgtttctaagaaaagtgtgctccaa

SEQ ID NO: 481677 - DNA, 25 bp, Homo sapien
gaatataacctcttcacggttcagt

SEQ ID NO: 481678 - DNA, 25 bp, Homo sapien
acctcttcacggttcagtgttttca

SEQ ID NO: 481679 - DNA, 25 bp, Homo sapien
cacggttcagtgttttcataagcaa

SEQ ID NO: 481680 - DNA, 25 bp, Homo sapien
cttttccatatccaattgttttctg

SEQ ID NO: 481681 - DNA, 25 bp, Homo sapien
tccaattgttttctgtagtgaatac

SEQ ID NO: 481682 - DNA, 25 bp, Homo sapien
gaaatacgggcactattttgtaact

SEQ ID NO: 481683 - DNA, 25 bp, Homo sapien
gacatcatctcaagtctacaagaat

SEQ ID NO: 481684 - DNA, 25 bp, Homo sapien
aggtcttcagacactattaatgcag

SEQ ID NO: 481685 - DNA, 25 bp, Homo sapien
atgcagattgtagcctctaggtcct

SEQ ID NO: 481686 - DNA, 25 bp, Homo sapien
gtagcctctaggtcctgaagatttt

SEQ ID NO: 481687 - DNA, 25 bp, Homo sapien
gaagattttactagatactggttac

SEQ ID NO: 481688 - DNA, 25 bp, Homo sapien
gatactggttactgaaactgagctt

SEQ ID NO: 481689 - DNA, 25 bp, Homo sapien
aaactgagctttcttgaattctttt

SEQ ID NO: 481690 - DNA, 25 bp, Homo sapien
ttgtggcatagcatgttagtttctt

SEQ ID NO: 481691 - DNA, 25 bp, Homo sapien
cccgatccatggctgtggtttttta

SEQ ID NO: 481692 - DNA, 25 bp, Homo sapien
atctgagcatatgtatttggctgac

SEQ ID NO: 481693 - DNA, 25 bp, Homo sapien
ggctgacatgtcattgtgaaacctc

SEQ ID NO: 481694 - DNA, 25 bp, Homo sapien
ttgtgaaacctcacagcttcagtca

SEQ ID NO: 481695 - DNA, 25 bp, Homo sapien
gcttcagtcagtgtctctccaagga

SEQ ID NO: 481696 - DNA, 25 bp, Homo sapien
gtgtctctccaaggactaaacaatg

SEQ ID NO: 481697 - DNA, 25 bp, Homo sapien
gactgtagaagatgctattcattaa

SEQ ID NO: 481698 - DNA, 25 bp, Homo sapien
gactattattcgcttctcatgggac

SEQ ID NO: 481699 - DNA, 25 bp, Homo sapien
attcgcttctcatgggacaggactt

SEQ ID NO: 481700 - DNA, 25 bp, Homo sapien
gacaggacttttcagggcacctgaa

SEQ ID NO: 481701 - DNA, 25 bp, Homo sapien
ggcacctgaaaaaactcccatgaaa

SEQ ID NO: 481702 - DNA, 25 bp, Homo sapien
taatattattaattccctgctgagg

SEQ ID NO: 481703 - DNA, 25 bp, Homo sapien
ccctgctgaggacattaactggttt

SEQ ID NO: 481704 - DNA, 25 bp, Homo sapien
gacattaactggtttccaaggctgc

SEQ ID NO: 481705 - DNA, 25 bp, Homo sapien
ataaatacttttacatacatggttg

SEQ ID NO: 481706 - DNA, 25 bp, Homo sapien
catggttgtatgtttatctgaacta

SEQ ID NO: 481707 - DNA, 25 bp, Homo sapien
gaactattttcaccaatatattcac

SEQ ID NO: 481708 - DNA, 25 bp, Homo sapien
ttgtcttcccccattttctaggcaa

SEQ ID NO: 481709 - DNA, 25 bp, Homo sapien
gtactttgtcctcttgaaaaacaat

SEQ ID NO: 481710 - DNA, 25 bp, Homo sapien
cctatgttacatagaggcctgtgta

SEQ ID NO: 481711 - DNA, 25 bp, Homo sapien
gaggcctgtgtaatgcatttgtgtg

SEQ ID NO: 481712 - DNA, 25 bp, Homo sapien
atggtgtcaatttcatgaatataca

SEQ ID NO: 481713 - DNA, 25 bp, Homo sapien
aggctggtctcttcgaaatcttaaa

SEQ ID NO: 481714 - DNA, 25 bp, Homo sapien
gctggtctcttcgaaatcttaaatc

SEQ ID NO: 481715 - DNA, 25 bp, Homo sapien
ggtctcttcgaaatcttaaatccaa

SEQ ID NO: 481716 - DNA, 25 bp, Homo sapien
tcttcgaaatcttaaatccaaacat

SEQ ID NO: 481717 - DNA, 25 bp, Homo sapien
tattcttctagatcccttgctcagg

SEQ ID NO: 481718 - DNA, 25 bp, Homo sapien
ttctagatcccttgctcaggcgaat

SEQ ID NO: 481719 - DNA, 25 bp, Homo sapien
agatcccttgctcaggcgaatcctt

SEQ ID NO: 481720 - DNA, 25 bp, Homo sapien
ttgctcaggcgaatcctttcatctt

SEQ ID NO: 481721 - DNA, 25 bp, Homo sapien
gctcaggcgaatcctttcatctttc

SEQ ID NO: 481722 - DNA, 25 bp, Homo sapien
tctttcccttatagctcatcagcat

SEQ ID NO: 481723 - DNA, 25 bp, Homo sapien
ctttcccttatagctcatcagcatg

SEQ ID NO: 481724 - DNA, 25 bp, Homo sapien
atgtatttggctgacatgtcattgt

SEQ ID NO: 481725 - DNA, 25 bp, Homo sapien
gtatttggctgacatgtcattgtga

SEQ ID NO: 481726 - DNA, 25 bp, Homo sapien
ggctgacatgtcattgtgaaacctc

SEQ ID NO: 481727 - DNA, 25 bp, Homo sapien
ctgacatgtcattgtgaaacctcac

SEQ ID NO: 481728 - DNA, 25 bp, Homo sapien
catgtcattgtgaaacctcacagct

SEQ ID NO: 481729 - DNA, 25 bp, Homo sapien
agtgtctctccaaggactaaacaat

SEQ ID NO: 481730 - DNA, 25 bp, Homo sapien
gtctctccaaggactaaacaatgga

SEQ ID NO: 481731 - DNA, 25 bp, Homo sapien
caaggactaaacaatggaagactgt

SEQ ID NO: 481732 - DNA, 25 bp, Homo sapien
ggaagactgtagaagatgctattca

SEQ ID NO: 481733 - DNA, 25 bp, Homo sapien
gactgtagaagatgctattcattaa

SEQ ID NO: 481734 - DNA, 25 bp, Homo sapien
agaagatgctattcattaagatatc

SEQ ID NO: 481735 - DNA, 25 bp, Homo sapien
atttaagtgcaccttcccattactt

SEQ ID NO: 481736 - DNA, 25 bp, Homo sapien
tttaagtgcaccttcccattacttt

SEQ ID NO: 481737 - DNA, 25 bp, Homo sapien
ttaagtgcaccttcccattactttc

SEQ ID NO: 481738 - DNA, 25 bp, Homo sapien
taagtgcaccttcccattactttcc

SEQ ID NO: 481739 - DNA, 25 bp, Homo sapien
tgcaccttcccattactttccttaa

SEQ ID NO: 481740 - DNA, 25 bp, Homo sapien
tcccattactttccttaaatcacct

SEQ ID NO: 481741 - DNA, 25 bp, Homo sapien
ccattactttccttaaatcacctca

SEQ ID NO: 481742 - DNA, 25 bp, Homo sapien
ttactttccttaaatcacctcatag

SEQ ID NO: 481743 - DNA, 25 bp, Homo sapien
actttccttaaatcacctcatagtt

SEQ ID NO: 481744 - DNA, 25 bp, Homo sapien
tttccttaaatcacctcatagttag

SEQ ID NO: 481745 - DNA, 25 bp, Homo sapien
taaatcacctcatagttaggctggg

SEQ ID NO: 481746 - DNA, 25 bp, Homo sapien
tgctcctggcccaaaacatctcttt

SEQ ID NO: 481747 - DNA, 25 bp, Homo sapien
tggcccaaaacatctctttctacat

SEQ ID NO: 481748 - DNA, 25 bp, Homo sapien
ccaaaacatctctttctacatacac

SEQ ID NO: 481749 - DNA, 25 bp, Homo sapien
aaacatctctttctacatacacttg

SEQ ID NO: 481750 - DNA, 25 bp, Homo sapien
atctctttctacatacacttgagta

SEQ ID NO: 481751 - DNA, 25 bp, Homo sapien
taggtggcataaaatgcactgtcaa

SEQ ID NO: 481752 - DNA, 25 bp, Homo sapien
ggcataaaatgcactgtcaatatat

SEQ ID NO: 481753 - DNA, 25 bp, Homo sapien
aatgcactgtcaatatatagaaaac

SEQ ID NO: 481754 - DNA, 25 bp, Homo sapien
tccgatcagagaatcacaagagcag

SEQ ID NO: 481755 - DNA, 25 bp, Homo sapien
tcagagaatcacaagagcagcaaat

SEQ ID NO: 481756 - DNA, 25 bp, Homo sapien
gaatcacaagagcagcaaatgtggt

SEQ ID NO: 481757 - DNA, 25 bp, Homo sapien
agcatccgcaagctgcagtgctagt

SEQ ID NO: 481758 - DNA, 25 bp, Homo sapien
tgcagtgctagtcccggcatcctga

SEQ ID NO: 481759 - DNA, 25 bp, Homo sapien
agtcccggcatcctgatggctccga

SEQ ID NO: 481760 - DNA, 25 bp, Homo sapien
tgatggctccgacaggcctgctcca

SEQ ID NO: 481761 - DNA, 25 bp, Homo sapien
tgctccagagcacggctgaccattt

SEQ ID NO: 481762 - DNA, 25 bp, Homo sapien
tgaccatttctgctccgggatctca

SEQ ID NO: 481763 - DNA, 25 bp, Homo sapien
agctgctccagtctcagcctgggca

SEQ ID NO: 481764 - DNA, 25 bp, Homo sapien
ttttgcacgtttgcatccccagcat

SEQ ID NO: 481765 - DNA, 25 bp, Homo sapien
atttcctgagttataaggccacagg

SEQ ID NO: 481766 - DNA, 25 bp, Homo sapien
gccacaggagtggatagctgttttc

SEQ ID NO: 481767 - DNA, 25 bp, Homo sapien
aagcccacccgaatcttgtagaaat

SEQ ID NO: 481768 - DNA, 25 bp, Homo sapien
gtatgccagtcaacaattattcctt

SEQ ID NO: 481769 - DNA, 25 bp, Homo sapien
gtcaacaattattccttctgaaagt

SEQ ID NO: 481770 - DNA, 25 bp, Homo sapien
tttccgagcagccttatcatcacaa

SEQ ID NO: 481771 - DNA, 25 bp, Homo sapien
agccttatcatcacaatccatcatt

SEQ ID NO: 481772 - DNA, 25 bp, Homo sapien
aatccatcattctggcagatacatt

SEQ ID NO: 481773 - DNA, 25 bp, Homo sapien
gagtcacagttgaaaccacattgaa

SEQ ID NO: 481774 - DNA, 25 bp, Homo sapien
gatatgttcccagttccaacaagcc

SEQ ID NO: 481775 - DNA, 25 bp, Homo sapien
ccagttccaacaagccaaataccag

SEQ ID NO: 481776 - DNA, 25 bp, Homo sapien
aaataccagatgtgcatttctttta

SEQ ID NO: 481777 - DNA, 25 bp, Homo sapien
gatggctctctgtaccaacaatata

SEQ ID NO: 481778 - DNA, 25 bp, Homo sapien
tggcagggtcagatgattacacaaa

SEQ ID NO: 481779 - DNA, 25 bp, Homo sapien
agaatgagttaaatgctaaggaagc

SEQ ID NO: 481780 - DNA, 25 bp, Homo sapien
tcaggaatccgaaccctgaacagct

SEQ ID NO: 481781 - DNA, 25 bp, Homo sapien
ggaatccgaaccctgaacagctgga

SEQ ID NO: 481782 - DNA, 25 bp, Homo sapien
gaatccgaaccctgaacagctggaa

SEQ ID NO: 481783 - DNA, 25 bp, Homo sapien
aatccgaaccctgaacagctggaaa

SEQ ID NO: 481784 - DNA, 25 bp, Homo sapien
atccgaaccctgaacagctggaaat

SEQ ID NO: 481785 - DNA, 25 bp, Homo sapien
ccgaaccctgaacagctggaaatga

SEQ ID NO: 481786 - DNA, 25 bp, Homo sapien
aaccctgaacagctggaaatgagcc

SEQ ID NO: 481787 - DNA, 25 bp, Homo sapien
ccctgaacagctggaaatgagccca

SEQ ID NO: 481788 - DNA, 25 bp, Homo sapien
gaacagctggaaatgagcccagata

SEQ ID NO: 481789 - DNA, 25 bp, Homo sapien
tgctgttctgtaggcgtgttgtgga

SEQ ID NO: 481790 - DNA, 25 bp, Homo sapien
ctaagtgtatgtgtcattgttttgt

SEQ ID NO: 481791 - DNA, 25 bp, Homo sapien
attgttttgttactgatcccatgaa

SEQ ID NO: 481792 - DNA, 25 bp, Homo sapien
ttgttttgttactgatcccatgaag

SEQ ID NO: 481793 - DNA, 25 bp, Homo sapien
gttttgttactgatcccatgaagaa

SEQ ID NO: 481794 - DNA, 25 bp, Homo sapien
tttgttactgatcccatgaagaatt

SEQ ID NO: 481795 - DNA, 25 bp, Homo sapien
gttactgatcccatgaagaattaga

SEQ ID NO: 481796 - DNA, 25 bp, Homo sapien
tactgatcccatgaagaattagaaa

SEQ ID NO: 481797 - DNA, 25 bp, Homo sapien
aggtgagtgtaagcctgaggatctt

SEQ ID NO: 481798 - DNA, 25 bp, Homo sapien
gagtgtaagcctgaggatcttactt

SEQ ID NO: 481799 - DNA, 25 bp, Homo sapien
ataccatttattacaacagatttct

SEQ ID NO: 481800 - DNA, 25 bp, Homo sapien
caacagatttctaaaactcctatta

SEQ ID NO: 481801 - DNA, 25 bp, Homo sapien
cagttgacaaagtagattcctgtaa

SEQ ID NO: 481802 - DNA, 25 bp, Homo sapien
gattcctgtaatacccagattgttt

SEQ ID NO: 481803 - DNA, 25 bp, Homo sapien
gattgtttcaaacacacctagggac

SEQ ID NO: 481804 - DNA, 25 bp, Homo sapien
tcaaacacacctagggactttccag

SEQ ID NO: 481805 - DNA, 25 bp, Homo sapien
ctagggactttccagtaactgcatt

SEQ ID NO: 481806 - DNA, 25 bp, Homo sapien
gtaactgcattgagtatctgggctt

SEQ ID NO: 481807 - DNA, 25 bp, Homo sapien
gtatctgggctttgcaattaacttt

SEQ ID NO: 481808 - DNA, 25 bp, Homo sapien
aatttggattcatgttctcagtcac

SEQ ID NO: 481809 - DNA, 25 bp, Homo sapien
ggattcatgttctcagtcacactgg

SEQ ID NO: 481810 - DNA, 25 bp, Homo sapien
atgttctcagtcacactggccataa

SEQ ID NO: 481811 - DNA, 25 bp, Homo sapien
ctcagtcacactggccataattcag

SEQ ID NO: 481812 - DNA, 25 bp, Homo sapien
ttcctgacgggaatgttgtgctata

SEQ ID NO: 481813 - DNA, 25 bp, Homo sapien
aatgaatctgcataacgcttgggat

SEQ ID NO: 481814 - DNA, 25 bp, Homo sapien
ataacgcttgggattctaggaggaa

SEQ ID NO: 481815 - DNA, 25 bp, Homo sapien
gaaggaaggttccatggacatgtaa

SEQ ID NO: 481816 - DNA, 25 bp, Homo sapien
tgtaagtacagcatattcccctcag

SEQ ID NO: 481817 - DNA, 25 bp, Homo sapien
atattcccctcagtcttctaggagg

SEQ ID NO: 481818 - DNA, 25 bp, Homo sapien
gggcagagtgaatcccagaactggt

SEQ ID NO: 481819 - DNA, 25 bp, Homo sapien
agattgggaatctgagcattgccac

SEQ ID NO: 481820 - DNA, 25 bp, Homo sapien
cattttgacacatcctgttttttag

SEQ ID NO: 481821 - DNA, 25 bp, Homo sapien
aagcataccttgttaggaacgtgtt

SEQ ID NO: 481822 - DNA, 25 bp, Homo sapien
taagacacatttgggttgtcattct

SEQ ID NO: 481823 - DNA, 25 bp, Homo sapien
aaaaaatccaggtgtaagtggctct

SEQ ID NO: 481824 - DNA, 25 bp, Homo sapien
tgtaagtggctctgcgcagtccaaa

SEQ ID NO: 481825 - DNA, 25 bp, Homo sapien
gtggctctgcgcagtccaaacctgt

SEQ ID NO: 481826 - DNA, 25 bp, Homo sapien
gggtcaactgtgtatgaatccaagc

SEQ ID NO: 481827 - DNA, 25 bp, Homo sapien
gaatccaagcgaaagcttttcttaa

SEQ ID NO: 481828 - DNA, 25 bp, Homo sapien
aagcttttcttaacacctcataaga

SEQ ID NO: 481829 - DNA, 25 bp, Homo sapien
ggaactagcatagagtaaccatcac

SEQ ID NO: 481830 - DNA, 25 bp, Homo sapien
accatcacaggtaaagtgtaatttg

SEQ ID NO: 481831 - DNA, 25 bp, Homo sapien
gtgtaatttgttatcagccatcttt

SEQ ID NO: 481832 - DNA, 25 bp, Homo sapien
tcttttgcccatttcagtactggta

SEQ ID NO: 481833 - DNA, 25 bp, Homo sapien
cagtactggtagaaggctcaatggt

SEQ ID NO: 481834 - DNA, 25 bp, Homo sapien
gttggttgaggctatcattccatga

SEQ ID NO: 481835 - DNA, 25 bp, Homo sapien
gcacttgtggcaattggactgcaat

SEQ ID NO: 481836 - DNA, 25 bp, Homo sapien
ggactgcaatttggccttaaaatga

SEQ ID NO: 481837 - DNA, 25 bp, Homo sapien
aaatgacacaattcctcgttctcag

SEQ ID NO: 481838 - DNA, 25 bp, Homo sapien
aattgccttgaaatttgcatgtacc

SEQ ID NO: 481839 - DNA, 25 bp, Homo sapien
gcatgtaccagactaagtgccagta

SEQ ID NO: 481840 - DNA, 25 bp, Homo sapien
gactgatattttcgtgactcataga

SEQ ID NO: 481841 - DNA, 25 bp, Homo sapien
gactcatagaaggtgtccatggtat

SEQ ID NO: 481842 - DNA, 25 bp, Homo sapien
tggtatagagtttatgcctacatct

SEQ ID NO: 481843 - DNA, 25 bp, Homo sapien
gcctacatctctatctttattttgg

SEQ ID NO: 481844 - DNA, 25 bp, Homo sapien
ttttgggcacacatgagcttttgtt

SEQ ID NO: 481845 - DNA, 25 bp, Homo sapien
ctttgtgtttgttgattttggtgtc

SEQ ID NO: 481846 - DNA, 25 bp, Homo sapien
gtcaattttgtggacatttggcagg

SEQ ID NO: 481847 - DNA, 25 bp, Homo sapien
tggacatttggcaggagttttgact

SEQ ID NO: 481848 - DNA, 25 bp, Homo sapien
gtaggagaaacccatgacattagaa

SEQ ID NO: 481849 - DNA, 25 bp, Homo sapien
aacctagaagttggatattggcata

SEQ ID NO: 481850 - DNA, 25 bp, Homo sapien
tatgcagcatcatcttttgcagcat

SEQ ID NO: 481851 - DNA, 25 bp, Homo sapien
atcatcttttgcagcattcctctgc

SEQ ID NO: 481852 - DNA, 25 bp, Homo sapien
actgaactccagttcttctggtcat

SEQ ID NO: 481853 - DNA, 25 bp, Homo sapien
cagttcttctggtcattttgcatgg

SEQ ID NO: 481854 - DNA, 25 bp, Homo sapien
attttgcatggtagctcttgtcacg

SEQ ID NO: 481855 - DNA, 25 bp, Homo sapien
atggtagctcttgtcacgttccttc

SEQ ID NO: 481856 - DNA, 25 bp, Homo sapien
gaaaacgttctgtgccaagtgccgc

SEQ ID NO: 481857 - DNA, 25 bp, Homo sapien
ggcgtggaaggcagacctcctgtac

SEQ ID NO: 481858 - DNA, 25 bp, Homo sapien
tgtacctctatcgttcccatttgtg

SEQ ID NO: 481859 - DNA, 25 bp, Homo sapien
tatcgttcccatttgtggcatccaa

SEQ ID NO: 481860 - DNA, 25 bp, Homo sapien
tccaaaggcggaaggctcatggctt

SEQ ID NO: 481861 - DNA, 25 bp, Homo sapien
actagaggcggcgtcttgggctttc

SEQ ID NO: 481862 - DNA, 25 bp, Homo sapien
ttgggctttcccattggattgtgaa

SEQ ID NO: 481863 - DNA, 25 bp, Homo sapien
gactgtttggagatgttggctgtat

SEQ ID NO: 481864 - DNA, 25 bp, Homo sapien
gagatgttggctgtatttcctgtca

SEQ ID NO: 481865 - DNA, 25 bp, Homo sapien
gtatttcctgtcacatcaggttgta

SEQ ID NO: 481866 - DNA, 25 bp, Homo sapien
gacgaataaaaggtgctgtgacccg

SEQ ID NO: 481867 - DNA, 25 bp, Homo sapien
gagccacgtatgtttttgtgtattt

SEQ ID NO: 481868 - DNA, 25 bp, Homo sapien
aacactatatggcagtgtctttcca

SEQ ID NO: 481869 - DNA, 25 bp, Homo sapien
gttttgtggaggagctcaggacact

SEQ ID NO: 481870 - DNA, 25 bp, Homo sapien
gctcaggacactaatacaccaggta

SEQ ID NO: 481871 - DNA, 25 bp, Homo sapien
acacaaggtcatttgctaactagct

SEQ ID NO: 481872 - DNA, 25 bp, Homo sapien
agcttggaaactggatgaggtcata

SEQ ID NO: 481873 - DNA, 25 bp, Homo sapien
aggtcatagcagtgcttgattgcgt

SEQ ID NO: 481874 - DNA, 25 bp, Homo sapien
gcttgattgcgtggaattgtgctga

SEQ ID NO: 481875 - DNA, 25 bp, Homo sapien
ctgagttggtgttgacatgtgcttt

SEQ ID NO: 481876 - DNA, 25 bp, Homo sapien
ggcttttacaccagttcctttcaat

SEQ ID NO: 481877 - DNA, 25 bp, Homo sapien
ccagttcctttcaatggtttgcaag

SEQ ID NO: 481878 - DNA, 25 bp, Homo sapien
cttttgaaagagagctcagcggaag

SEQ ID NO: 481879 - DNA, 25 bp, Homo sapien
gagctcagcggaagttttactccag

SEQ ID NO: 481880 - DNA, 25 bp, Homo sapien
tttactccagagatagtgccctgct

SEQ ID NO: 481881 - DNA, 25 bp, Homo sapien
actccagagatagtgccctgcttct

SEQ ID NO: 481882 - DNA, 25 bp, Homo sapien
tgcttctactggaagaactacacac

SEQ ID NO: 481883 - DNA, 25 bp, Homo sapien
gaactacacactttttctccaaggg

SEQ ID NO: 481884 - DNA, 25 bp, Homo sapien
tacacactttttctccaagggtctt

SEQ ID NO: 481885 - DNA, 25 bp, Homo sapien
taataaaccttcatagtcatgtgta

SEQ ID NO: 481886 - DNA, 25 bp, Homo sapien
gcctttgtggcattgaagagttaaa

SEQ ID NO: 481887 - DNA, 25 bp, Homo sapien
aatagtggatattgactcagaggtc

SEQ ID NO: 481888 - DNA, 25 bp, Homo sapien
attgactcagaggtcagcaaagaat

SEQ ID NO: 481889 - DNA, 25 bp, Homo sapien
ggcttggtggcgcgctccagtggcc

SEQ ID NO: 481890 - DNA, 25 bp, Homo sapien
cttggtggcgcgctccagtggcccc

SEQ ID NO: 481891 - DNA, 25 bp, Homo sapien
ttggtggcgcgctccagtggcccca

SEQ ID NO: 481892 - DNA, 25 bp, Homo sapien
cctgggctatagagcgatacctcca

SEQ ID NO: 481893 - DNA, 25 bp, Homo sapien
ctgggctatagagcgatacctccat

SEQ ID NO: 481894 - DNA, 25 bp, Homo sapien
tgggctatagagcgatacctccatc

SEQ ID NO: 481895 - DNA, 25 bp, Homo sapien
gggctatagagcgatacctccatct

SEQ ID NO: 481896 - DNA, 25 bp, Homo sapien
ggctatagagcgatacctccatctc

SEQ ID NO: 481897 - DNA, 25 bp, Homo sapien
aatcaaaccacaatggatttttgtt

SEQ ID NO: 481898 - DNA, 25 bp, Homo sapien
gatttttgtttcctagttgggagtg

SEQ ID NO: 481899 - DNA, 25 bp, Homo sapien
gtctttgtgagggtgcctctgtaca

SEQ ID NO: 481900 - DNA, 25 bp, Homo sapien
tgtgagggtgcctctgtacagctgc

SEQ ID NO: 481901 - DNA, 25 bp, Homo sapien
gacacccacgtcaaagcacagcatc

SEQ ID NO: 481902 - DNA, 25 bp, Homo sapien
gcacagcatcaagttcgtttggaca

SEQ ID NO: 481903 - DNA, 25 bp, Homo sapien
gcaaggcctcttaccaaatgaggcg

SEQ ID NO: 481904 - DNA, 25 bp, Homo sapien
tcttaccaaatgaggcgccagataa

SEQ ID NO: 481905 - DNA, 25 bp, Homo sapien
gaggcgccagataacttaataagct

SEQ ID NO: 481906 - DNA, 25 bp, Homo sapien
taccaaaatgtgttgactgacccgg

SEQ ID NO: 481907 - DNA, 25 bp, Homo sapien
caaaatgtgttgactgacccggagg

SEQ ID NO: 481908 - DNA, 25 bp, Homo sapien
acactttaaggttatttagatcaga

SEQ ID NO: 481909 - DNA, 25 bp, Homo sapien
cactttaaggttatttagatcagaa

SEQ ID NO: 481910 - DNA, 25 bp, Homo sapien
aaggttatttagatcagaagaaatc

SEQ ID NO: 481911 - DNA, 25 bp, Homo sapien
gaagaaatctggatgtctcaggcca

SEQ ID NO: 481912 - DNA, 25 bp, Homo sapien
aagaaatctggatgtctcaggccag

SEQ ID NO: 481913 - DNA, 25 bp, Homo sapien
agaaatctggatgtctcaggccagg

SEQ ID NO: 481914 - DNA, 25 bp, Homo sapien
gaaatctggatgtctcaggccaggt

SEQ ID NO: 481915 - DNA, 25 bp, Homo sapien
aaatctggatgtctcaggccaggtg

SEQ ID NO: 481916 - DNA, 25 bp, Homo sapien
aatctggatgtctcaggccaggtgc

SEQ ID NO: 481917 - DNA, 25 bp, Homo sapien
atctggatgtctcaggccaggtgca

SEQ ID NO: 481918 - DNA, 25 bp, Homo sapien
ttgcaggttgccaagccaagataat

SEQ ID NO: 481919 - DNA, 25 bp, Homo sapien
aagcacctcttcaagtgagatggca

SEQ ID NO: 481920 - DNA, 25 bp, Homo sapien
acctcttcaagtgagatggcagacc

SEQ ID NO: 481921 - DNA, 25 bp, Homo sapien
gtgagatggcagaccacctcaggat

SEQ ID NO: 481922 - DNA, 25 bp, Homo sapien
atggcagaccacctcaggatggaaa

SEQ ID NO: 481923 - DNA, 25 bp, Homo sapien
cctcaggatggaaatgtatttcttc

SEQ ID NO: 481924 - DNA, 25 bp, Homo sapien
gtgacctcctgcaaataagggagag

SEQ ID NO: 481925 - DNA, 25 bp, Homo sapien
cagtcaaagaaacaatgtcaacacc

SEQ ID NO: 481926 - DNA, 25 bp, Homo sapien
gaaggagtgactgaacattgacaag

SEQ ID NO: 481927 - DNA, 25 bp, Homo sapien
gaacattgacaagactttggttggg

SEQ ID NO: 481928 - DNA, 25 bp, Homo sapien
atggtcagagaggagattagctgct

SEQ ID NO: 481929 - DNA, 25 bp, Homo sapien
tgctcatagagatggaattcctaac

SEQ ID NO: 481930 - DNA, 25 bp, Homo sapien
gactgtagttctggacaaggtggaa

SEQ ID NO: 481931 - DNA, 25 bp, Homo sapien
gttctggacaaggtggaaaactctt

SEQ ID NO: 481932 - DNA, 25 bp, Homo sapien
tctggacaaggtggaaaactcttaa

SEQ ID NO: 481933 - DNA, 25 bp, Homo sapien
gacaaggtggaaaactcttaaagtg

SEQ ID NO: 481934 - DNA, 25 bp, Homo sapien
tggaaaactcttaaagtggaagtat

SEQ ID NO: 481935 - DNA, 25 bp, Homo sapien
attggggcaagtgctctgacaggct

SEQ ID NO: 481936 - DNA, 25 bp, Homo sapien
gtagaatgttaacagttcagactca

SEQ ID NO: 481937 - DNA, 25 bp, Homo sapien
gaatgttaacagttcagactcaaac

SEQ ID NO: 481938 - DNA, 25 bp, Homo sapien
gttaacagttcagactcaaaccttg

SEQ ID NO: 481939 - DNA, 25 bp, Homo sapien
ttttgcagaataaatggagttacct

SEQ ID NO: 481940 - DNA, 25 bp, Homo sapien
gcagaataaatggagttacctgctt

SEQ ID NO: 481941 - DNA, 25 bp, Homo sapien
gacaaggctaactgggaagcttccc

SEQ ID NO: 481942 - DNA, 25 bp, Homo sapien
taactgggaagcttcccgttggcac

SEQ ID NO: 481943 - DNA, 25 bp, Homo sapien
gttggcaccctgacataagagcaag

SEQ ID NO: 481944 - DNA, 25 bp, Homo sapien
gaaccaggagttgagcactttcttg

SEQ ID NO: 481945 - DNA, 25 bp, Homo sapien
cactttcttggcagtgtccctccag

SEQ ID NO: 481946 - DNA, 25 bp, Homo sapien
tccagcaccacctactgatgtggat

SEQ ID NO: 481947 - DNA, 25 bp, Homo sapien
tggataactttgtgcctgctggcaa

SEQ ID NO: 481948 - DNA, 25 bp, Homo sapien
attttgaaggtccaggtccaatatt

SEQ ID NO: 481949 - DNA, 25 bp, Homo sapien
ggtccaggtccaatattacaaagca

SEQ ID NO: 481950 - DNA, 25 bp, Homo sapien
ggaagctgcccactaggatgtcatt

SEQ ID NO: 481951 - DNA, 25 bp, Homo sapien
ggatgtcattgagacttgctggaaa

SEQ ID NO: 481952 - DNA, 25 bp, Homo sapien
gagaatggcttttggccactgtgct

SEQ ID NO: 481953 - DNA, 25 bp, Homo sapien
tcccttgaggcggaaagtcttctcg

SEQ ID NO: 481954 - DNA, 25 bp, Homo sapien
ggaaagtcttctcgcattcaggaca

SEQ ID NO: 481955 - DNA, 25 bp, Homo sapien
cgcattcaggacactggtagggctt

SEQ ID NO: 481956 - DNA, 25 bp, Homo sapien
gactgatgcgtgtaggtcttgtcac

SEQ ID NO: 481957 - DNA, 25 bp, Homo sapien
tgtaggtcttgtcacactcaccgca

SEQ ID NO: 481958 - DNA, 25 bp, Homo sapien
tgtgcatccgctggtggaacttcat

SEQ ID NO: 481959 - DNA, 25 bp, Homo sapien
gctggtggaacttcatggaggcctt

SEQ ID NO: 481960 - DNA, 25 bp, Homo sapien
tggaggccttccaggagaagctctt

SEQ ID NO: 481961 - DNA, 25 bp, Homo sapien
agaagctcttgtcgcactcgggaca

SEQ ID NO: 481962 - DNA, 25 bp, Homo sapien
ctcgccactgtgaagcctcgtgtgc

SEQ ID NO: 481963 - DNA, 25 bp, Homo sapien
gatgaaatgcttcttggcttcctca

SEQ ID NO: 481964 - DNA, 25 bp, Homo sapien
agcacttggcaaggtagacctcata

SEQ ID NO: 481965 - DNA, 25 bp, Homo sapien
gcaaccttgaatatgactttcttta

SEQ ID NO: 481966 - DNA, 25 bp, Homo sapien
actttctttagtctctagctatgca

SEQ ID NO: 481967 - DNA, 25 bp, Homo sapien
gtctctagctatgcactattaagtg

SEQ ID NO: 481968 - DNA, 25 bp, Homo sapien
atgcactattaagtgcctcttgggt

SEQ ID NO: 481969 - DNA, 25 bp, Homo sapien
gtattgagtgccagtcttgacgtcc

SEQ ID NO: 481970 - DNA, 25 bp, Homo sapien
ttgacgtccgtatgcctcagttttt

SEQ ID NO: 481971 - DNA, 25 bp, Homo sapien
tacctcatcatttgttgtagggatt

SEQ ID NO: 481972 - DNA, 25 bp, Homo sapien
atccgggagagcaattctgaagcct

SEQ ID NO: 481973 - DNA, 25 bp, Homo sapien
aattctgaagcctataaatttcctt

SEQ ID NO: 481974 - DNA, 25 bp, Homo sapien
gcctggagaaggacaatatatgaag

SEQ ID NO: 481975 - DNA, 25 bp, Homo sapien
aggacaatatatgaagagcttagtg

SEQ ID NO: 481976 - DNA, 25 bp, Homo sapien
gagcttagtgaagtttgattggaac

SEQ ID NO: 481977 - DNA, 25 bp, Homo sapien
gtttgattggaactgaaaaacatca

SEQ ID NO: 481978 - DNA, 25 bp, Homo sapien
gaaagcatcaagtggataaatctca

SEQ ID NO: 481979 - DNA, 25 bp, Homo sapien
gcatcaagtggataaatctcagaaa

SEQ ID NO: 481980 - DNA, 25 bp, Homo sapien
atctcagaaacataatctctagagg

SEQ ID NO: 481981 - DNA, 25 bp, Homo sapien
aatcacagagaaatacctacagtgt

SEQ ID NO: 481982 - DNA, 25 bp, Homo sapien
cagagaaatacctacagtgtgattc

SEQ ID NO: 481983 - DNA, 25 bp, Homo sapien
gaaatacctacagtgtgattccatt

SEQ ID NO: 481984 - DNA, 25 bp, Homo sapien
agtcaaaggcagggaaaaccaacag

SEQ ID NO: 481985 - DNA, 25 bp, Homo sapien
agatctaattccaagttgcatatgt

SEQ ID NO: 481986 - DNA, 25 bp, Homo sapien
gatctaattccaagttgcatatgtg

SEQ ID NO: 481987 - DNA, 25 bp, Homo sapien
atctaattccaagttgcatatgtgt

SEQ ID NO: 481988 - DNA, 25 bp, Homo sapien
tccaagttgcatatgtgtagaaaaa

SEQ ID NO: 481989 - DNA, 25 bp, Homo sapien
aagaagtatagcaagctggccaggc

SEQ ID NO: 481990 - DNA, 25 bp, Homo sapien
agaagtatagcaagctggccaggca

SEQ ID NO: 481991 - DNA, 25 bp, Homo sapien
gaagtatagcaagctggccaggcat

SEQ ID NO: 481992 - DNA, 25 bp, Homo sapien
aagtatagcaagctggccaggcatg

SEQ ID NO: 481993 - DNA, 25 bp, Homo sapien
aattagctgggcatactctggggct

SEQ ID NO: 481994 - DNA, 25 bp, Homo sapien
ggaagagctatggaggcagaagttg

SEQ ID NO: 481995 - DNA, 25 bp, Homo sapien
attgtgccactgtgcacctgcggtc

SEQ ID NO: 481996 - DNA, 25 bp, Homo sapien
acccagctggctatgaagtgaataa

SEQ ID NO: 481997 - DNA, 25 bp, Homo sapien
attgtgaagcacgaggaaccccatg

SEQ ID NO: 481998 - DNA, 25 bp, Homo sapien
aagcacgaggaaccccatgtgtgtg

SEQ ID NO: 481999 - DNA, 25 bp, Homo sapien
gtgagagcacacaattattagcatc

SEQ ID NO: 482000 - DNA, 25 bp, Homo sapien
attagcatcatttctgagtgatctc

SEQ ID NO: 482001 - DNA, 25 bp, Homo sapien
tttgctttttgacaactgcttctcc

SEQ ID NO: 482002 - DNA, 25 bp, Homo sapien
gttccttgcaattctattctctcac

SEQ ID NO: 482003 - DNA, 25 bp, Homo sapien
ttctctcaccttcactttactattt

SEQ ID NO: 482004 - DNA, 25 bp, Homo sapien
actatttgtattcgatggaccagga

SEQ ID NO: 482005 - DNA, 25 bp, Homo sapien
cgatggaccaggataattcaggcaa

SEQ ID NO: 482006 - DNA, 25 bp, Homo sapien
aattggccacacaccatgttgtcac

SEQ ID NO: 482007 - DNA, 25 bp, Homo sapien
tgataacaactactgctgcctggga

SEQ ID NO: 482008 - DNA, 25 bp, Homo sapien
ctgcctgggatcatgagagacctga

SEQ ID NO: 482009 - DNA, 25 bp, Homo sapien
tgagagacctgaactgaactgatag

SEQ ID NO: 482010 - DNA, 25 bp, Homo sapien
gggtcactcatctccagtagaatta

SEQ ID NO: 482011 - DNA, 25 bp, Homo sapien
gaatagacccatctgcagaggatca

SEQ ID NO: 482012 - DNA, 25 bp, Homo sapien
gcagaggatcataaaaccagcaaag

SEQ ID NO: 482013 - DNA, 25 bp, Homo sapien
gtctaagatgccttcacaaactttg

SEQ ID NO: 482014 - DNA, 25 bp, Homo sapien
cacaaactttgtccatgagaactct

SEQ ID NO: 482015 - DNA, 25 bp, Homo sapien
actctaaggacttctccagacctgt

SEQ ID NO: 482016 - DNA, 25 bp, Homo sapien
gttggctgctgctgtgatctctgcc

SEQ ID NO: 482017 - DNA, 25 bp, Homo sapien
ttaagtccacagtgaagttgtcccc

SEQ ID NO: 482018 - DNA, 25 bp, Homo sapien
agatctaattccaagttgcatatgt

SEQ ID NO: 482019 - DNA, 25 bp, Homo sapien
gatctaattccaagttgcatatgtg

SEQ ID NO: 482020 - DNA, 25 bp, Homo sapien
atctaattccaagttgcatatgtgt

SEQ ID NO: 482021 - DNA, 25 bp, Homo sapien
aaagaagtatagcaagctggccagg

SEQ ID NO: 482022 - DNA, 25 bp, Homo sapien
aagaagtatagcaagctggccaggc

SEQ ID NO: 482023 - DNA, 25 bp, Homo sapien
agaagtatagcaagctggccaggca

SEQ ID NO: 482024 - DNA, 25 bp, Homo sapien
gaagtatagcaagctggccaggcat

SEQ ID NO: 482025 - DNA, 25 bp, Homo sapien
aagtatagcaagctggccaggcatg

SEQ ID NO: 482026 - DNA, 25 bp, Homo sapien
aattagctgggcatactctggggct

SEQ ID NO: 482027 - DNA, 25 bp, Homo sapien
tgaggtggaagagctatggaggcag

SEQ ID NO: 482028 - DNA, 25 bp, Homo sapien
ggaagagctatggaggcagaagttg

SEQ ID NO: 482029 - DNA, 25 bp, Homo sapien
aaatatgaagaggttatggctgtcc

SEQ ID NO: 482030 - DNA, 25 bp, Homo sapien
atgaagaggttatggctgtccttgg

SEQ ID NO: 482031 - DNA, 25 bp, Homo sapien
ccatatgtgaccatggatataaaat

SEQ ID NO: 482032 - DNA, 25 bp, Homo sapien
gatgaagatagcaacaacatcacag

SEQ ID NO: 482033 - DNA, 25 bp, Homo sapien
tgttggttaagttgacaaggcaaac

SEQ ID NO: 482034 - DNA, 25 bp, Homo sapien
caaggcaaacaatggctgaagtatt

SEQ ID NO: 482035 - DNA, 25 bp, Homo sapien
aaaggagcagtccatctgtgctgca

SEQ ID NO: 482036 - DNA, 25 bp, Homo sapien
agcagtccatctgtgctgcagagga

SEQ ID NO: 482037 - DNA, 25 bp, Homo sapien
tgcagaggaacagccagcagaagat

SEQ ID NO: 482038 - DNA, 25 bp, Homo sapien
aagatgggcagggtgaaactaacaa

SEQ ID NO: 482039 - DNA, 25 bp, Homo sapien
gggtgaaactaacaagaacaggaca

SEQ ID NO: 482040 - DNA, 25 bp, Homo sapien
tagctctactagttgatctttttgt

SEQ ID NO: 482041 - DNA, 25 bp, Homo sapien
atcatgatacttaacctctaccttg

SEQ ID NO: 482042 - DNA, 25 bp, Homo sapien
tgatacttaacctctaccttggttt

SEQ ID NO: 482043 - DNA, 25 bp, Homo sapien
gatagacctaagtatattaccttta

SEQ ID NO: 482044 - DNA, 25 bp, Homo sapien
tacctttattgtaagattcttggaa

SEQ ID NO: 482045 - DNA, 25 bp, Homo sapien
ctcttagaatggtgccttgaacgta

SEQ ID NO: 482046 - DNA, 25 bp, Homo sapien
gtgccttgaacgtagcataccacaa

SEQ ID NO: 482047 - DNA, 25 bp, Homo sapien
gcataccacaaatattagctaccat

SEQ ID NO: 482048 - DNA, 25 bp, Homo sapien
tagctaccattttcactagtgttat

SEQ ID NO: 482049 - DNA, 25 bp, Homo sapien
aggaagccctttagccatattgaaa

SEQ ID NO: 482050 - DNA, 25 bp, Homo sapien
agccctttagccatattgaaaacaa

SEQ ID NO: 482051 - DNA, 25 bp, Homo sapien
agggatttcccctcatagtacaact

SEQ ID NO: 482052 - DNA, 25 bp, Homo sapien
gatttcccctcatagtacaactgga

SEQ ID NO: 482053 - DNA, 25 bp, Homo sapien
tcccctcatagtacaactggaagga

SEQ ID NO: 482054 - DNA, 25 bp, Homo sapien
caactggaaggatagtgcttgtaaa

SEQ ID NO: 482055 - DNA, 25 bp, Homo sapien
aatcattgagggagggtggatattt

SEQ ID NO: 482056 - DNA, 25 bp, Homo sapien
gggtggatatttttattcctagata

SEQ ID NO: 482057 - DNA, 25 bp, Homo sapien
ggaggaaacataagtctgtagtatt

SEQ ID NO: 482058 - DNA, 25 bp, Homo sapien
gattgtaataattctttcctatcaa

SEQ ID NO: 482059 - DNA, 25 bp, Homo sapien
aaaggttgccactttcagtgcagaa

SEQ ID NO: 482060 - DNA, 25 bp, Homo sapien
gtgcagaatactaccggcatcttgt

SEQ ID NO: 482061 - DNA, 25 bp, Homo sapien
ggcatcttgttactgcaatagttgg

SEQ ID NO: 482062 - DNA, 25 bp, Homo sapien
gaaatattagcaccccagtttttag

SEQ ID NO: 482063 - DNA, 25 bp, Homo sapien
cccagtttttagtgatatttaccat

SEQ ID NO: 482064 - DNA, 25 bp, Homo sapien
attactagagttctggattcactga

SEQ ID NO: 482065 - DNA, 25 bp, Homo sapien
ggtctatatgcaacatattccttaa

SEQ ID NO: 482066 - DNA, 25 bp, Homo sapien
aactataatgtttcactatttccta

SEQ ID NO: 482067 - DNA, 25 bp, Homo sapien
atgacatcatctctactacctttaa

SEQ ID NO: 482068 - DNA, 25 bp, Homo sapien
tacctttaaattgtcctttggacat

SEQ ID NO: 482069 - DNA, 25 bp, Homo sapien
aagaactatggacccacagtacctc

SEQ ID NO: 482070 - DNA, 25 bp, Homo sapien
agtacctcattagatgcccttggga

SEQ ID NO: 482071 - DNA, 25 bp, Homo sapien
atgcccttgggaaccaggatggtgc

SEQ ID NO: 482072 - DNA, 25 bp, Homo sapien
ggtgcattggacattcagacaactt

SEQ ID NO: 482073 - DNA, 25 bp, Homo sapien
gatcatgagagacctgaactgaact

SEQ ID NO: 482074 - DNA, 25 bp, Homo sapien
catgagagacctgaactgaactgat

SEQ ID NO: 482075 - DNA, 25 bp, Homo sapien
tgagagacctgaactgaactgatag

SEQ ID NO: 482076 - DNA, 25 bp, Homo sapien
agagacctgaactgaactgatagga

SEQ ID NO: 482077 - DNA, 25 bp, Homo sapien
taatgagaatagacccatctgcaga

SEQ ID NO: 482078 - DNA, 25 bp, Homo sapien
aatgagaatagacccatctgcagag

SEQ ID NO: 482079 - DNA, 25 bp, Homo sapien
tgagaatagacccatctgcagagga

SEQ ID NO: 482080 - DNA, 25 bp, Homo sapien
gagaatagacccatctgcagaggat

SEQ ID NO: 482081 - DNA, 25 bp, Homo sapien
gaatagacccatctgcagaggatca

SEQ ID NO: 482082 - DNA, 25 bp, Homo sapien
agtagaattaagtccacagtgaagt

SEQ ID NO: 482083 - DNA, 25 bp, Homo sapien
gtagaattaagtccacagtgaagtt

SEQ ID NO: 482084 - DNA, 25 bp, Homo sapien
cctgcaaaatagctccctttgtctg

SEQ ID NO: 482085 - DNA, 25 bp, Homo sapien
ctgcaaaatagctccctttgtctgt

SEQ ID NO: 482086 - DNA, 25 bp, Homo sapien
tgcaaaatagctccctttgtctgtt

SEQ ID NO: 482087 - DNA, 25 bp, Homo sapien
caaaatagctccctttgtctgttct

SEQ ID NO: 482088 - DNA, 25 bp, Homo sapien
aaaatagctccctttgtctgttctt

SEQ ID NO: 482089 - DNA, 25 bp, Homo sapien
aaatagctccctttgtctgttctta

SEQ ID NO: 482090 - DNA, 25 bp, Homo sapien
ccagctacttaggtcgtaagtgaaa

SEQ ID NO: 482091 - DNA, 25 bp, Homo sapien
cagctacttaggtcgtaagtgaaat

SEQ ID NO: 482092 - DNA, 25 bp, Homo sapien
gctacttaggtcgtaagtgaaatac

SEQ ID NO: 482093 - DNA, 25 bp, Homo sapien
cttaggtcgtaagtgaaatacttga

SEQ ID NO: 482094 - DNA, 25 bp, Homo sapien
taaagcccctgcctaacaatcaata

SEQ ID NO: 482095 - DNA, 25 bp, Homo sapien
gtcataataaaaattctggcatgta

SEQ ID NO: 482096 - DNA, 25 bp, Homo sapien
gatattttgcacttgtggtagttaa

SEQ ID NO: 482097 - DNA, 25 bp, Homo sapien
aagatgtcacatagctattttacag

SEQ ID NO: 482098 - DNA, 25 bp, Homo sapien
acagctatagatgtgatctggtttg

SEQ ID NO: 482099 - DNA, 25 bp, Homo sapien
attattttctttccactctattgcc

SEQ ID NO: 482100 - DNA, 25 bp, Homo sapien
tttctttccactctattgccataac

SEQ ID NO: 482101 - DNA, 25 bp, Homo sapien
ctttccactctattgccataactaa

SEQ ID NO: 482102 - DNA, 25 bp, Homo sapien
cactctattgccataactaaggaca

SEQ ID NO: 482103 - DNA, 25 bp, Homo sapien
gttgtcacatagaacttggagagat

SEQ ID NO: 482104 - DNA, 25 bp, Homo sapien
aagcaagatgtttattcactcacac

SEQ ID NO: 482105 - DNA, 25 bp, Homo sapien
cactcacacatagcttttcagaaat

SEQ ID NO: 482106 - DNA, 25 bp, Homo sapien
gagaattctaagtatccatcactgt

SEQ ID NO: 482107 - DNA, 25 bp, Homo sapien
ttctaagtatccatcactgttcttt

SEQ ID NO: 482108 - DNA, 25 bp, Homo sapien
tgcatttgatgagatgggccctcca

SEQ ID NO: 482109 - DNA, 25 bp, Homo sapien
agatgggccctccaggagccacaga

SEQ ID NO: 482110 - DNA, 25 bp, Homo sapien
ggagccacagaattcatcctcctct

SEQ ID NO: 482111 - DNA, 25 bp, Homo sapien
tctctctagggctatgcctgttgct

SEQ ID NO: 482112 - DNA, 25 bp, Homo sapien
agggctatgcctgttgctttcatta

SEQ ID NO: 482113 - DNA, 25 bp, Homo sapien
tgttgctttcattacccttttataa

SEQ ID NO: 482114 - DNA, 25 bp, Homo sapien
aatttgtggctgcagggagaggctc

SEQ ID NO: 482115 - DNA, 25 bp, Homo sapien
ggagaggctctgttaagatatttca

SEQ ID NO: 482116 - DNA, 25 bp, Homo sapien
tcttgcctttccaagtgtgcacagg

SEQ ID NO: 482117 - DNA, 25 bp, Homo sapien
ctactcaggagtctgaggaggagaa

SEQ ID NO: 482118 - DNA, 25 bp, Homo sapien
tactcaggagtctgaggaggagaat

SEQ ID NO: 482119 - DNA, 25 bp, Homo sapien
cagtgagtcgaggttgcgctactgc

SEQ ID NO: 482120 - DNA, 25 bp, Homo sapien
agtgagtcgaggttgcgctactgca

SEQ ID NO: 482121 - DNA, 25 bp, Homo sapien
gtgagtcgaggttgcgctactgcac

SEQ ID NO: 482122 - DNA, 25 bp, Homo sapien
tgagtcgaggttgcgctactgcact

SEQ ID NO: 482123 - DNA, 25 bp, Homo sapien
gagtcgaggttgcgctactgcactc

SEQ ID NO: 482124 - DNA, 25 bp, Homo sapien
agtcgaggttgcgctactgcactcc

SEQ ID NO: 482125 - DNA, 25 bp, Homo sapien
gtcgaggttgcgctactgcactcca

SEQ ID NO: 482126 - DNA, 25 bp, Homo sapien
tcgaggttgcgctactgcactccag

SEQ ID NO: 482127 - DNA, 25 bp, Homo sapien
tagagtaataccctaattattagtt

SEQ ID NO: 482128 - DNA, 25 bp, Homo sapien
tggtatatgcaagaataaatgtgtg

SEQ ID NO: 482129 - DNA, 25 bp, Homo sapien
gcaagaataaatgtgtgcgtgaatc

SEQ ID NO: 482130 - DNA, 25 bp, Homo sapien
aacctgactaatccagccagcaacc

SEQ ID NO: 482131 - DNA, 25 bp, Homo sapien
acctgactaatccagccagcaacct

SEQ ID NO: 482132 - DNA, 25 bp, Homo sapien
gactaatccagccagcaaccttaca

SEQ ID NO: 482133 - DNA, 25 bp, Homo sapien
actaatccagccagcaaccttacaa

SEQ ID NO: 482134 - DNA, 25 bp, Homo sapien
tgttgaattgaagagatatggtgac

SEQ ID NO: 482135 - DNA, 25 bp, Homo sapien
gttgaattgaagagatatggtgaca

SEQ ID NO: 482136 - DNA, 25 bp, Homo sapien
ttgaattgaagagatatggtgacaa

SEQ ID NO: 482137 - DNA, 25 bp, Homo sapien
tgaattgaagagatatggtgacaat

SEQ ID NO: 482138 - DNA, 25 bp, Homo sapien
gaattgaagagatatggtgacaata

SEQ ID NO: 482139 - DNA, 25 bp, Homo sapien
acagcactggtgctcacctctacct

SEQ ID NO: 482140 - DNA, 25 bp, Homo sapien
gtcctcaggccgtgcggcacgacat

SEQ ID NO: 482141 - DNA, 25 bp, Homo sapien
gcacgacatggccagcacgcagaag

SEQ ID NO: 482142 - DNA, 25 bp, Homo sapien
gacatggccagcacgcagaaggagc

SEQ ID NO: 482143 - DNA, 25 bp, Homo sapien
atggccagcacgcagaaggagccct

SEQ ID NO: 482144 - DNA, 25 bp, Homo sapien
gcacgcagaaggagccctcccggga

SEQ ID NO: 482145 - DNA, 25 bp, Homo sapien
cccgtggtggactccgcggcacatg

SEQ ID NO: 482146 - DNA, 25 bp, Homo sapien
gcggcacatgcttcccaaggtggtc

SEQ ID NO: 482147 - DNA, 25 bp, Homo sapien
gtggtcccacggagggtgttactgg

SEQ ID NO: 482148 - DNA, 25 bp, Homo sapien
ggcaccagtggactcgccccatggc

SEQ ID NO: 482149 - DNA, 25 bp, Homo sapien
cccatggcccgttcctgggagatga

SEQ ID NO: 482150 - DNA, 25 bp, Homo sapien
aagtgtagttcgactcttcttggtc

SEQ ID NO: 482151 - DNA, 25 bp, Homo sapien
cttcttggtcttggagtttgagagt

SEQ ID NO: 482152 - DNA, 25 bp, Homo sapien
ttaataacttgacttacccctccat

SEQ ID NO: 482153 - DNA, 25 bp, Homo sapien
ttacccctccataagttactgctaa

SEQ ID NO: 482154 - DNA, 25 bp, Homo sapien
actgctaactggagatacccttgta

SEQ ID NO: 482155 - DNA, 25 bp, Homo sapien
tggagatacccttgtatgcccaacc

SEQ ID NO: 482156 - DNA, 25 bp, Homo sapien
cttgtatgcccaacctgtaaaggaa

SEQ ID NO: 482157 - DNA, 25 bp, Homo sapien
tatatttataggacattcttctcag

SEQ ID NO: 482158 - DNA, 25 bp, Homo sapien
gacattcttctcagtcaaggaacag

SEQ ID NO: 482159 - DNA, 25 bp, Homo sapien
gtaggtttcaatcagttgctctcaa

SEQ ID NO: 482160 - DNA, 25 bp, Homo sapien
ttcaatcagttgctctcaaccctga

SEQ ID NO: 482161 - DNA, 25 bp, Homo sapien
cttcaaggtcatttacttgtacgag

SEQ ID NO: 482162 - DNA, 25 bp, Homo sapien
ggtcatttacttgtacgagacagaa

SEQ ID NO: 482163 - DNA, 25 bp, Homo sapien
gtacgagacagaaaaagatagcatt

SEQ ID NO: 482164 - DNA, 25 bp, Homo sapien
gtagggatattttttagtttgtgat

SEQ ID NO: 482165 - DNA, 25 bp, Homo sapien
tacatttatctgtacatactttttc

SEQ ID NO: 482166 - DNA, 25 bp, Homo sapien
gtacatactttttcaagattgatca

SEQ ID NO: 482167 - DNA, 25 bp, Homo sapien
tttataaccatggttttcctgaaat

SEQ ID NO: 482168 - DNA, 25 bp, Homo sapien
ggttttcctgaaatcctcaattcat

SEQ ID NO: 482169 - DNA, 25 bp, Homo sapien
gaaggaaatgaaccacatagacttt

SEQ ID NO: 482170 - DNA, 25 bp, Homo sapien
gaaccacatagactttatgcaataa

SEQ ID NO: 482171 - DNA, 25 bp, Homo sapien
taacagtgcaagtgagtataactct

SEQ ID NO: 482172 - DNA, 25 bp, Homo sapien
ggtaggcctgtaattatggtacttt

SEQ ID NO: 482173 - DNA, 25 bp, Homo sapien
aatagaattatccacttgttttcct

SEQ ID NO: 482174 - DNA, 25 bp, Homo sapien
ccacttgttttccttcatcttcatt

SEQ ID NO: 482175 - DNA, 25 bp, Homo sapien
tatgttctagaagtaggatcagcct

SEQ ID NO: 482176 - DNA, 25 bp, Homo sapien
ggatcagcctgttccaatttgccaa

SEQ ID NO: 482177 - DNA, 25 bp, Homo sapien
gcctgttccaatttgccaagcatta

SEQ ID NO: 482178 - DNA, 25 bp, Homo sapien
gaggaataattccataccatgtaaa

SEQ ID NO: 482179 - DNA, 25 bp, Homo sapien
accatgatatgctgattatactaca

SEQ ID NO: 482180 - DNA, 25 bp, Homo sapien
gttgcgttcactaaattctgtcctg

SEQ ID NO: 482181 - DNA, 25 bp, Homo sapien
ctaaattctgtcctgtttcttcaaa

SEQ ID NO: 482182 - DNA, 25 bp, Homo sapien
gcatgttaattgtatatcttaccta

SEQ ID NO: 482183 - DNA, 25 bp, Homo sapien
catgcctggataaattacacacagt

SEQ ID NO: 482184 - DNA, 25 bp, Homo sapien
tatttttgctaacaggttgggcctt

SEQ ID NO: 482185 - DNA, 25 bp, Homo sapien
caggttgggccttatttataatgta

SEQ ID NO: 482186 - DNA, 25 bp, Homo sapien
aaggaaactcctagcgtcgcaacat

SEQ ID NO: 482187 - DNA, 25 bp, Homo sapien
gcgtcgcaacattgggcagggtaat

SEQ ID NO: 482188 - DNA, 25 bp, Homo sapien
ggtaatgacaaaacatcccagcaga

SEQ ID NO: 482189 - DNA, 25 bp, Homo sapien
catcccagcagacatatctactatc

SEQ ID NO: 482190 - DNA, 25 bp, Homo sapien
gacatatctactatcttgaaaccct

SEQ ID NO: 482191 - DNA, 25 bp, Homo sapien
gaaacccttctagatgtcgagttat

SEQ ID NO: 482192 - DNA, 25 bp, Homo sapien
aagaccttggagacatttccttcat

SEQ ID NO: 482193 - DNA, 25 bp, Homo sapien
catttccttcattaggtggcaagaa

SEQ ID NO: 482194 - DNA, 25 bp, Homo sapien
tctagatatagaaggctgagagtga

SEQ ID NO: 482195 - DNA, 25 bp, Homo sapien
gtgagcactggatataattcatttt

SEQ ID NO: 482196 - DNA, 25 bp, Homo sapien
attgatatggtgttattgttcttcc

SEQ ID NO: 482197 - DNA, 25 bp, Homo sapien
gatatggtgttattgttcttccagt

SEQ ID NO: 482198 - DNA, 25 bp, Homo sapien
atggtgttattgttcttccagttgt

SEQ ID NO: 482199 - DNA, 25 bp, Homo sapien
gtcctttgtgtatgttcttatttat

SEQ ID NO: 482200 - DNA, 25 bp, Homo sapien
gttcttatttatatgttgatacact

SEQ ID NO: 482201 - DNA, 25 bp, Homo sapien
tatttatatgttgatacactgtaac

SEQ ID NO: 482202 - DNA, 25 bp, Homo sapien
tgtagataaacaagatattggcatc

SEQ ID NO: 482203 - DNA, 25 bp, Homo sapien
gacattttaatatatgtgataccta

SEQ ID NO: 482204 - DNA, 25 bp, Homo sapien
tatgtgatacctatatctagatata

SEQ ID NO: 482205 - DNA, 25 bp, Homo sapien
gaaatttccaatcagacaatgtagt

SEQ ID NO: 482206 - DNA, 25 bp, Homo sapien
ttgttttaaatatgcggtaccatgt

SEQ ID NO: 482207 - DNA, 25 bp, Homo sapien
gtaccatgtaaaattactcgtgtta

SEQ ID NO: 482208 - DNA, 25 bp, Homo sapien
actcgtgttaggaataaagtccact

SEQ ID NO: 482209 - DNA, 25 bp, Homo sapien
agtccactgttgaagttgaatgtca

SEQ ID NO: 482210 - DNA, 25 bp, Homo sapien
gaatgtcactaagcttattatgtta

SEQ ID NO: 482211 - DNA, 25 bp, Homo sapien
ggaaccagtgtgattaggaaaacct

SEQ ID NO: 482212 - DNA, 25 bp, Homo sapien
aaacctaccagaagccagatacagt

SEQ ID NO: 482213 - DNA, 25 bp, Homo sapien
gatacagtgtggtacgtgcaacatt

SEQ ID NO: 482214 - DNA, 25 bp, Homo sapien
gcaacatttcatgcacattttgatt

SEQ ID NO: 482215 - DNA, 25 bp, Homo sapien
tctgagttttataatttctaggtac

SEQ ID NO: 482216 - DNA, 25 bp, Homo sapien
gggtcttatggcctggtggaggtgc

SEQ ID NO: 482217 - DNA, 25 bp, Homo sapien
ggctacgtgggctccctgtaatatc

SEQ ID NO: 482218 - DNA, 25 bp, Homo sapien
acgtgggctccctgtaatatcaatg

SEQ ID NO: 482219 - DNA, 25 bp, Homo sapien
gtgggctccctgtaatatcaatgcc

SEQ ID NO: 482220 - DNA, 25 bp, Homo sapien
gctccctgtaatatcaatgccattc

SEQ ID NO: 482221 - DNA, 25 bp, Homo sapien
tccctgtaatatcaatgccattctt

SEQ ID NO: 482222 - DNA, 25 bp, Homo sapien
taatatcaatgccattcttcgcaga

SEQ ID NO: 482223 - DNA, 25 bp, Homo sapien
atatcaatgccattcttcgcagaaa

SEQ ID NO: 482224 - DNA, 25 bp, Homo sapien
tcaatgccattcttcgcagaaatag

SEQ ID NO: 482225 - DNA, 25 bp, Homo sapien
agccaaaccaccctgagcaaaaatt

SEQ ID NO: 482226 - DNA, 25 bp, Homo sapien
gccaaaccaccctgagcaaaaatta

SEQ ID NO: 482227 - DNA, 25 bp, Homo sapien
tttctgtatgatgagccccagggcc

SEQ ID NO: 482228 - DNA, 25 bp, Homo sapien
agggcccatcctgaggtctgctagc

SEQ ID NO: 482229 - DNA, 25 bp, Homo sapien
aggtctgctagccatgtgcttagtc

SEQ ID NO: 482230 - DNA, 25 bp, Homo sapien
gctagccatgtgcttagtctcacct

SEQ ID NO: 482231 - DNA, 25 bp, Homo sapien
cccacgtctgtgttcttatttgcag

SEQ ID NO: 482232 - DNA, 25 bp, Homo sapien
atttgcagctcagggtttgcattcc

SEQ ID NO: 482233 - DNA, 25 bp, Homo sapien
cagggtttgcattcccaggtagaac

SEQ ID NO: 482234 - DNA, 25 bp, Homo sapien
tcccaggtagaacaggtgtcgtaca

SEQ ID NO: 482235 - DNA, 25 bp, Homo sapien
gtgtcgtacactgtgaaatgttcca

SEQ ID NO: 482236 - DNA, 25 bp, Homo sapien
gaaatgttccaggttatttgtttat

SEQ ID NO: 482237 - DNA, 25 bp, Homo sapien
acttcatcatcttgtcatatttctg

SEQ ID NO: 482238 - DNA, 25 bp, Homo sapien
tagagctgagtctgggctgggtgtg

SEQ ID NO: 482239 - DNA, 25 bp, Homo sapien
agagctgagtctgggctgggtgtgg

SEQ ID NO: 482240 - DNA, 25 bp, Homo sapien
catggctgtaatccctgagcttcgg

SEQ ID NO: 482241 - DNA, 25 bp, Homo sapien
atggctgtaatccctgagcttcggg

SEQ ID NO: 482242 - DNA, 25 bp, Homo sapien
tggctgtaatccctgagcttcggga

SEQ ID NO: 482243 - DNA, 25 bp, Homo sapien
ggctgtaatccctgagcttcgggag

SEQ ID NO: 482244 - DNA, 25 bp, Homo sapien
gctgtaatccctgagcttcgggagg

SEQ ID NO: 482245 - DNA, 25 bp, Homo sapien
gccaggtgttcaaaacctgcctgga

SEQ ID NO: 482246 - DNA, 25 bp, Homo sapien
ccaggtgttcaaaacctgcctggac

SEQ ID NO: 482247 - DNA, 25 bp, Homo sapien
ttcaaaacctgcctggacaacagag

SEQ ID NO: 482248 - DNA, 25 bp, Homo sapien
aaaatagtcaagcatggtggtgtgt

SEQ ID NO: 482249 - DNA, 25 bp, Homo sapien
gaaattttctttgtggcagtcattt

SEQ ID NO: 482250 - DNA, 25 bp, Homo sapien
ggcagtcatttattaaggattcaac

SEQ ID NO: 482251 - DNA, 25 bp, Homo sapien
aaggattcaactcgtgatacaccaa

SEQ ID NO: 482252 - DNA, 25 bp, Homo sapien
gagttgacttcagagatgtgttcca

SEQ ID NO: 482253 - DNA, 25 bp, Homo sapien
gagatgtgttccatgctctctagca

SEQ ID NO: 482254 - DNA, 25 bp, Homo sapien
gttccatgctctctagcacaggaat

SEQ ID NO: 482255 - DNA, 25 bp, Homo sapien
tgctctctagcacaggaatgaataa

SEQ ID NO: 482256 - DNA, 25 bp, Homo sapien
atttataacacctgctttagccttt

SEQ ID NO: 482257 - DNA, 25 bp, Homo sapien
acacctgctttagcctttgttttca

SEQ ID NO: 482258 - DNA, 25 bp, Homo sapien
taaggaatcaggttttttctacctg

SEQ ID NO: 482259 - DNA, 25 bp, Homo sapien
tttctacctggtaaacattctctat

SEQ ID NO: 482260 - DNA, 25 bp, Homo sapien
gaggaactcttctgggcaatatctt

SEQ ID NO: 482261 - DNA, 25 bp, Homo sapien
aatatctttcccaatctcatctaaa

SEQ ID NO: 482262 - DNA, 25 bp, Homo sapien
caatctcatctaaattctgggaaat

SEQ ID NO: 482263 - DNA, 25 bp, Homo sapien
aacccagctctgaaactaagcacct

SEQ ID NO: 482264 - DNA, 25 bp, Homo sapien
agcacctggtgatctttagtttgag

SEQ ID NO: 482265 - DNA, 25 bp, Homo sapien
gagatgtctatatggtacttttgag

SEQ ID NO: 482266 - DNA, 25 bp, Homo sapien
gaaatcaagatatagctcagtggga

SEQ ID NO: 482267 - DNA, 25 bp, Homo sapien
gtacaaggccttagggcagtatcta

SEQ ID NO: 482268 - DNA, 25 bp, Homo sapien
agtatctagcccagtattattccag

SEQ ID NO: 482269 - DNA, 25 bp, Homo sapien
attccagattctcctgagctctata

SEQ ID NO: 482270 - DNA, 25 bp, Homo sapien
ataaagggcattttggaggaactct

SEQ ID NO: 482271 - DNA, 25 bp, Homo sapien
gggagttagtagctgatacagatca

SEQ ID NO: 482272 - DNA, 25 bp, Homo sapien
tctgagtcactggtgcctgctgtgg

SEQ ID NO: 482273 - DNA, 25 bp, Homo sapien
ctgagtcactggtgcctgctgtggt

SEQ ID NO: 482274 - DNA, 25 bp, Homo sapien
tgcctgctgtggtggcattgttcat

SEQ ID NO: 482275 - DNA, 25 bp, Homo sapien
ctgctgtggtggcattgttcatgaa

SEQ ID NO: 482276 - DNA, 25 bp, Homo sapien
gctgtggtggcattgttcatgaaca

SEQ ID NO: 482277 - DNA, 25 bp, Homo sapien
gtggtggcattgttcatgaacatgt

SEQ ID NO: 482278 - DNA, 25 bp, Homo sapien
tgtacagttattgggaagtgatctt

SEQ ID NO: 482279 - DNA, 25 bp, Homo sapien
gacggcgggatgtaaaagaatcata

SEQ ID NO: 482280 - DNA, 25 bp, Homo sapien
cggaattgatgttccggccgcatgg

SEQ ID NO: 482281 - DNA, 25 bp, Homo sapien
attgatgttccggccgcatggcggc

SEQ ID NO: 482282 - DNA, 25 bp, Homo sapien
tagcttgccacagcgcaacctcttc

SEQ ID NO: 482283 - DNA, 25 bp, Homo sapien
tttcagtcatttgctgtacttccct

SEQ ID NO: 482284 - DNA, 25 bp, Homo sapien
gcatcaggctcacgggtgttcatgt

SEQ ID NO: 482285 - DNA, 25 bp, Homo sapien
tgttcatgtgtgttcgtgcgtgtgt

SEQ ID NO: 482286 - DNA, 25 bp, Homo sapien
tgtgtgcgtacgtgtatataactga

SEQ ID NO: 482287 - DNA, 25 bp, Homo sapien
gtacgtgtatataactgaagtgtct

SEQ ID NO: 482288 - DNA, 25 bp, Homo sapien
ataactgaagtgtctgtacggaatg

SEQ ID NO: 482289 - DNA, 25 bp, Homo sapien
ctagccatgggctggtcaccagatt

SEQ ID NO: 482290 - DNA, 25 bp, Homo sapien
ggtcaccagattgttttgtaatgcc

SEQ ID NO: 482291 - DNA, 25 bp, Homo sapien
accagattgttttgtaatgcccgcc

SEQ ID NO: 482292 - DNA, 25 bp, Homo sapien
ttgcctcgatattgccagtttcttg

SEQ ID NO: 482293 - DNA, 25 bp, Homo sapien
agagaggttggcacggcttggcccc

SEQ ID NO: 482294 - DNA, 25 bp, Homo sapien
cgtctactcggccagcacaagatgg

SEQ ID NO: 482295 - DNA, 25 bp, Homo sapien
actcggccagcacaagatggcagcc

SEQ ID NO: 482296 - DNA, 25 bp, Homo sapien
gggccgctcgtccaatttgtgcaac

SEQ ID NO: 482297 - DNA, 25 bp, Homo sapien
gctcgtccaatttgtgcaactgtcc

SEQ ID NO: 482298 - DNA, 25 bp, Homo sapien
tcgtccaatttgtgcaactgtcccc

SEQ ID NO: 482299 - DNA, 25 bp, Homo sapien
atttgtgcaactgtcccccaaagca

SEQ ID NO: 482300 - DNA, 25 bp, Homo sapien
agcctcagtgacaggagctgctcac

SEQ ID NO: 482301 - DNA, 25 bp, Homo sapien
tcagtgacaggagctgctcacaaca

SEQ ID NO: 482302 - DNA, 25 bp, Homo sapien
agggtgtcccccaaaatggcagcag

SEQ ID NO: 482303 - DNA, 25 bp, Homo sapien
gtgtcccccaaaatggcagcagtgg

SEQ ID NO: 482304 - DNA, 25 bp, Homo sapien
agcaccccaggatcgaagagggcgc

SEQ ID NO: 482305 - DNA, 25 bp, Homo sapien
accccaggatcgaagagggcgcacg

SEQ ID NO: 482306 - DNA, 25 bp, Homo sapien
ccccaggatcgaagagggcgcacgg

SEQ ID NO: 482307 - DNA, 25 bp, Homo sapien
ggttacctgcgcagagccagctgtg

SEQ ID NO: 482308 - DNA, 25 bp, Homo sapien
gttacctgcgcagagccagctgtga

SEQ ID NO: 482309 - DNA, 25 bp, Homo sapien
ccaggatcgaagagggcgcacgggc

SEQ ID NO: 482310 - DNA, 25 bp, Homo sapien
ttacctgcgcagagccagctgtgat

SEQ ID NO: 482311 - DNA, 25 bp, Homo sapien
tacctgcgcagagccagctgtgatg

SEQ ID NO: 482312 - DNA, 25 bp, Homo sapien
acctgcgcagagccagctgtgatgt

SEQ ID NO: 482313 - DNA, 25 bp, Homo sapien
caggatcgaagagggcgcacgggcc

SEQ ID NO: 482314 - DNA, 25 bp, Homo sapien
atcgaagagggcgcacgggcccggc

SEQ ID NO: 482315 - DNA, 25 bp, Homo sapien
tgtggcccgtccctgaagttacatg

SEQ ID NO: 482316 - DNA, 25 bp, Homo sapien
gcccgtccctgaagttacatgttca

SEQ ID NO: 482317 - DNA, 25 bp, Homo sapien
gtgctcctggagctccaaagacaca

SEQ ID NO: 482318 - DNA, 25 bp, Homo sapien
gggtccaagagccaccacggataag

SEQ ID NO: 482319 - DNA, 25 bp, Homo sapien
agagccaccacggataagttatcaa

SEQ ID NO: 482320 - DNA, 25 bp, Homo sapien
ataagttatcaagtcacacaatcaa

SEQ ID NO: 482321 - DNA, 25 bp, Homo sapien
agtcacacaatcaacattatagctg

SEQ ID NO: 482322 - DNA, 25 bp, Homo sapien
cattatagctgaggaaaggacttta

SEQ ID NO: 482323 - DNA, 25 bp, Homo sapien
ggactttagttaatcacacttctgg

SEQ ID NO: 482324 - DNA, 25 bp, Homo sapien
acacttctggattacatgtggcaat

SEQ ID NO: 482325 - DNA, 25 bp, Homo sapien
ctggattacatgtggcaattttaaa

SEQ ID NO: 482326 - DNA, 25 bp, Homo sapien
ctctgctgggaggtcgtgcatcttc

SEQ ID NO: 482327 - DNA, 25 bp, Homo sapien
ggtcgtgcatcttcgtgtgtgttta

SEQ ID NO: 482328 - DNA, 25 bp, Homo sapien
catcttcgtgtgtgtttaggagcca

SEQ ID NO: 482329 - DNA, 25 bp, Homo sapien
gtgtgtttaggagccacttcctttc

SEQ ID NO: 482330 - DNA, 25 bp, Homo sapien
tgttcttcagttacctgcccatttg

SEQ ID NO: 482331 - DNA, 25 bp, Homo sapien
gttacctgcccatttgtgtattaga

SEQ ID NO: 482332 - DNA, 25 bp, Homo sapien
gattgtggtctttcttattgatttg

SEQ ID NO: 482333 - DNA, 25 bp, Homo sapien
gtagcagctcattatatgtgataga

SEQ ID NO: 482334 - DNA, 25 bp, Homo sapien
tagaaattaggccttttcggtgaca

SEQ ID NO: 482335 - DNA, 25 bp, Homo sapien
taggccttttcggtgacaacaattt

SEQ ID NO: 482336 - DNA, 25 bp, Homo sapien
tgttttctcccagttcttcatgttt

SEQ ID NO: 482337 - DNA, 25 bp, Homo sapien
gtcctattagagaacttaccaaaca

SEQ ID NO: 482338 - DNA, 25 bp, Homo sapien
caagaacattctaacggcggaggct

SEQ ID NO: 482339 - DNA, 25 bp, Homo sapien
ttctaacggcggaggctgtcaacta

SEQ ID NO: 482340 - DNA, 25 bp, Homo sapien
ggcggaggctgtcaactagcatatt

SEQ ID NO: 482341 - DNA, 25 bp, Homo sapien
ctagcatattgaggctatggtcctt

SEQ ID NO: 482342 - DNA, 25 bp, Homo sapien
ggctatggtccttgttgaacaggtt

SEQ ID NO: 482343 - DNA, 25 bp, Homo sapien
gaacaggttttgtcatctgatactg

SEQ ID NO: 482344 - DNA, 25 bp, Homo sapien
gaaatctaagatgcctttggagtat

SEQ ID NO: 482345 - DNA, 25 bp, Homo sapien
acttgcctcaagtcaggatcatggg

SEQ ID NO: 482346 - DNA, 25 bp, Homo sapien
gcagatgtctgctgagactgatgtg

SEQ ID NO: 482347 - DNA, 25 bp, Homo sapien
gagactgatgtgaggtcttttacct

SEQ ID NO: 482348 - DNA, 25 bp, Homo sapien
aatgtggccatgcctccagtgcctc

SEQ ID NO: 482349 - DNA, 25 bp, Homo sapien
agtgcctccattcaaccccctctaa

SEQ ID NO: 482350 - DNA, 25 bp, Homo sapien
ccattcaaccccctctaactgattc

SEQ ID NO: 482351 - DNA, 25 bp, Homo sapien
attcaaccccctctaactgattcct

SEQ ID NO: 482352 - DNA, 25 bp, Homo sapien
ttcaaccccctctaactgattcctt

SEQ ID NO: 482353 - DNA, 25 bp, Homo sapien
tcaaccccctctaactgattccttc

SEQ ID NO: 482354 - DNA, 25 bp, Homo sapien
catgtattagcttccatggccccca

SEQ ID NO: 482355 - DNA, 25 bp, Homo sapien
atgtattagcttccatggcccccac

SEQ ID NO: 482356 - DNA, 25 bp, Homo sapien
tgtattagcttccatggcccccacc

SEQ ID NO: 482357 - DNA, 25 bp, Homo sapien
gtattagcttccatggcccccaccc

SEQ ID NO: 482358 - DNA, 25 bp, Homo sapien
tattagcttccatggcccccacccc

SEQ ID NO: 482359 - DNA, 25 bp, Homo sapien
ggaatgctcctagtggatagaagtc

SEQ ID NO: 482360 - DNA, 25 bp, Homo sapien
gttaaacccattccacaatgcacag

SEQ ID NO: 482361 - DNA, 25 bp, Homo sapien
atgatctctcactcagaatgtcagt

SEQ ID NO: 482362 - DNA, 25 bp, Homo sapien
ctcagaatgtcagtgttgccaaggt

SEQ ID NO: 482363 - DNA, 25 bp, Homo sapien
gttgccaaggtggagacatcctgca

SEQ ID NO: 482364 - DNA, 25 bp, Homo sapien
gagggtactggttgtcccccagtat

SEQ ID NO: 482365 - DNA, 25 bp, Homo sapien
attcacctgtgttaatacatgctcc

SEQ ID NO: 482366 - DNA, 25 bp, Homo sapien
gtgttaatacatgctccagttttgt

SEQ ID NO: 482367 - DNA, 25 bp, Homo sapien
ttttataaacagctgtcaagcataa

SEQ ID NO: 482368 - DNA, 25 bp, Homo sapien
gataacattttccatctccttgtat

SEQ ID NO: 482369 - DNA, 25 bp, Homo sapien
catctccttgtatgtaagtggaaat

SEQ ID NO: 482370 - DNA, 25 bp, Homo sapien
gtatggagaagggaccagcacccat

SEQ ID NO: 482371 - DNA, 25 bp, Homo sapien
ggaccagcacccatgccacagttta

SEQ ID NO: 482372 - DNA, 25 bp, Homo sapien
acccatgccacagtttacagctaag

SEQ ID NO: 482373 - DNA, 25 bp, Homo sapien
ccatgccacagtttacagctaagta

SEQ ID NO: 482374 - DNA, 25 bp, Homo sapien
cagctaagtaattgttactcctttt

SEQ ID NO: 482375 - DNA, 25 bp, Homo sapien
tcctttttacctgacgtaggcctgt

SEQ ID NO: 482376 - DNA, 25 bp, Homo sapien
ttacctgacgtaggcctgtaaaaga

SEQ ID NO: 482377 - DNA, 25 bp, Homo sapien
ggaaattcagacatcgtacgactcg

SEQ ID NO: 482378 - DNA, 25 bp, Homo sapien
gtggagctgactgcaatattttgtc

SEQ ID NO: 482379 - DNA, 25 bp, Homo sapien
gaatagtgccctgcactttgcgaag

SEQ ID NO: 482380 - DNA, 25 bp, Homo sapien
aatgtgcttgtgtacgacttgctga

SEQ ID NO: 482381 - DNA, 25 bp, Homo sapien
cattccttaaagacatcagtctcgg

SEQ ID NO: 482382 - DNA, 25 bp, Homo sapien
attccttaaagacatcagtctcggc

SEQ ID NO: 482383 - DNA, 25 bp, Homo sapien
ttccttaaagacatcagtctcggcc

SEQ ID NO: 482384 - DNA, 25 bp, Homo sapien
tccttaaagacatcagtctcggccg

SEQ ID NO: 482385 - DNA, 25 bp, Homo sapien
ccttaaagacatcagtctcggccgg

SEQ ID NO: 482386 - DNA, 25 bp, Homo sapien
cttaaagacatcagtctcggccggg

SEQ ID NO: 482387 - DNA, 25 bp, Homo sapien
ttaaagacatcagtctcggccgggc

SEQ ID NO: 482388 - DNA, 25 bp, Homo sapien
taaagacatcagtctcggccgggcg

SEQ ID NO: 482389 - DNA, 25 bp, Homo sapien
aaagacatcagtctcggccgggcgc

SEQ ID NO: 482390 - DNA, 25 bp, Homo sapien
ttgaagccaatcattttattttccc

SEQ ID NO: 482391 - DNA, 25 bp, Homo sapien
tttattttcccttgtatcagaaaga

SEQ ID NO: 482392 - DNA, 25 bp, Homo sapien
gaaaagagttccttgtatcaaaaga

SEQ ID NO: 482393 - DNA, 25 bp, Homo sapien
acacaattataatagctaggtgatt

SEQ ID NO: 482394 - DNA, 25 bp, Homo sapien
atttcattagtgttcatacattaga

SEQ ID NO: 482395 - DNA, 25 bp, Homo sapien
aatggtttattgcatatttgagaac

SEQ ID NO: 482396 - DNA, 25 bp, Homo sapien
gagaacaagactgtgttttatcaat

SEQ ID NO: 482397 - DNA, 25 bp, Homo sapien
agactgtgttttatcaatatatatc

SEQ ID NO: 482398 - DNA, 25 bp, Homo sapien
atatatatcatctttaataggtcaa

SEQ ID NO: 482399 - DNA, 25 bp, Homo sapien
tactattttttctacccagaggaag

SEQ ID NO: 482400 - DNA, 25 bp, Homo sapien
tctacccagaggaaggttattcttt

SEQ ID NO: 482401 - DNA, 25 bp, Homo sapien
ttgggatgctctttctgcctatcaa

SEQ ID NO: 482402 - DNA, 25 bp, Homo sapien
tgcctatcaaggctaatttttagtc

SEQ ID NO: 482403 - DNA, 25 bp, Homo sapien
aatttttagtccttctagactcaga

SEQ ID NO: 482404 - DNA, 25 bp, Homo sapien
gtccttctagactcagaaaaaccac

SEQ ID NO: 482405 - DNA, 25 bp, Homo sapien
tacattcgcctgtctgttttgttta

SEQ ID NO: 482406 - DNA, 25 bp, Homo sapien
gtttatctagagtgtagtctcctta

SEQ ID NO: 482407 - DNA, 25 bp, Homo sapien
aggccaaagaagtcttgtgtctgct

SEQ ID NO: 482408 - DNA, 25 bp, Homo sapien
gtgtctgctgatgagagcaccactc

SEQ ID NO: 482409 - DNA, 25 bp, Homo sapien
atgagagcaccactcatctgcgaaa

SEQ ID NO: 482410 - DNA, 25 bp, Homo sapien
cactcatctgcgaaacgcacgtaaa

SEQ ID NO: 482411 - DNA, 25 bp, Homo sapien
ctagggatgggaaattctgcatctt

SEQ ID NO: 482412 - DNA, 25 bp, Homo sapien
aattggaagtttacagctattacca

SEQ ID NO: 482413 - DNA, 25 bp, Homo sapien
tcgcagtagcttctggcacccgtgg

SEQ ID NO: 482414 - DNA, 25 bp, Homo sapien
cccgtggcttcatgtctttagcaaa

SEQ ID NO: 482415 - DNA, 25 bp, Homo sapien
gtctttagcaaagtcttgatgtcat

SEQ ID NO: 482416 - DNA, 25 bp, Homo sapien
gtatgcagttagttacctgattttg

SEQ ID NO: 482417 - DNA, 25 bp, Homo sapien
taaacaaacagtggctgacctgggc

SEQ ID NO: 482418 - DNA, 25 bp, Homo sapien
tgacctgggcccttaaatcaccttc

SEQ ID NO: 482419 - DNA, 25 bp, Homo sapien
taaatcaccttcacaccttttagaa

SEQ ID NO: 482420 - DNA, 25 bp, Homo sapien
ttcatcttttatgcttagaaacctg

SEQ ID NO: 482421 - DNA, 25 bp, Homo sapien
atgcttagaaacctgttctctccag

SEQ ID NO: 482422 - DNA, 25 bp, Homo sapien
cacttctgaggcatggatgagctga

SEQ ID NO: 482423 - DNA, 25 bp, Homo sapien
ttgttttcttattaggcctatcctg

SEQ ID NO: 482424 - DNA, 25 bp, Homo sapien
gttttcttattaggcctatcctgaa

SEQ ID NO: 482425 - DNA, 25 bp, Homo sapien
ttcttattaggcctatcctgaagcc

SEQ ID NO: 482426 - DNA, 25 bp, Homo sapien
tcttattaggcctatcctgaagcca

SEQ ID NO: 482427 - DNA, 25 bp, Homo sapien
ttattaggcctatcctgaagccaaa

SEQ ID NO: 482428 - DNA, 25 bp, Homo sapien
attaggcctatcctgaagccaaagg

SEQ ID NO: 482429 - DNA, 25 bp, Homo sapien
gaagccaaaggaaatgagatcggaa

SEQ ID NO: 482430 - DNA, 25 bp, Homo sapien
aggaaatgagatcggaattcctcgg

SEQ ID NO: 482431 - DNA, 25 bp, Homo sapien
atgagatcggaattcctcggggaat

SEQ ID NO: 482432 - DNA, 25 bp, Homo sapien
gggaattccaattccacattttcaa

SEQ ID NO: 482433 - DNA, 25 bp, Homo sapien
ggaattccaattccacattttcaag

SEQ ID NO: 482434 - DNA, 25 bp, Homo sapien
ggctgactgtcgctctgcctttgac

SEQ ID NO: 482435 - DNA, 25 bp, Homo sapien
tgtcgctctgcctttgacaggagag

SEQ ID NO: 482436 - DNA, 25 bp, Homo sapien
tttgacaggagaggctgcttcttgt

SEQ ID NO: 482437 - DNA, 25 bp, Homo sapien
gttaattgttaaatccagtatggcc

SEQ ID NO: 482438 - DNA, 25 bp, Homo sapien
aattgttaaatccagtatggccaca

SEQ ID NO: 482439 - DNA, 25 bp, Homo sapien
gatggcatgaatgatcaggatttac

SEQ ID NO: 482440 - DNA, 25 bp, Homo sapien
gaatgatcaggatttaccaaactgg

SEQ ID NO: 482441 - DNA, 25 bp, Homo sapien
tcaggatttaccaaactggagtaat

SEQ ID NO: 482442 - DNA, 25 bp, Homo sapien
gtaatgagaatgttgatgacaggct

SEQ ID NO: 482443 - DNA, 25 bp, Homo sapien
gatgacaggctcaacaatatggatt

SEQ ID NO: 482444 - DNA, 25 bp, Homo sapien
gacaggctcaacaatatggattggg

SEQ ID NO: 482445 - DNA, 25 bp, Homo sapien
gaaggaacgtttaggtagcacctat

SEQ ID NO: 482446 - DNA, 25 bp, Homo sapien
ggtagcacctattttgtactgattc

SEQ ID NO: 482447 - DNA, 25 bp, Homo sapien
agcacctattttgtactgattctac

SEQ ID NO: 482448 - DNA, 25 bp, Homo sapien
tactgattctacaagtagggcccga

SEQ ID NO: 482449 - DNA, 25 bp, Homo sapien
attctacaagtagggcccgaggtgc

SEQ ID NO: 482450 - DNA, 25 bp, Homo sapien
cctgtctacctacctaaggagaaag

SEQ ID NO: 482451 - DNA, 25 bp, Homo sapien
tgtgggcccgtcagggtctcctgct

SEQ ID NO: 482452 - DNA, 25 bp, Homo sapien
gcccccataactaagcagcacaata

SEQ ID NO: 482453 - DNA, 25 bp, Homo sapien
agcagcacaataaccgacttagcga

SEQ ID NO: 482454 - DNA, 25 bp, Homo sapien
aaccgacttagcgaattcaggtaga

SEQ ID NO: 482455 - DNA, 25 bp, Homo sapien
gcgaattcaggtagaaggaacgttt

SEQ ID NO: 482456 - DNA, 25 bp, Homo sapien
atgacttctcttcctcaaaagacat

SEQ ID NO: 482457 - DNA, 25 bp, Homo sapien
caaaagacatcaaatgggacaaggt

SEQ ID NO: 482458 - DNA, 25 bp, Homo sapien
aaagacatcaaatgggacaaggtat

SEQ ID NO: 482459 - DNA, 25 bp, Homo sapien
aagacatcaaatgggacaaggtatt

SEQ ID NO: 482460 - DNA, 25 bp, Homo sapien
aatgggacaaggtatttgtaacaca

SEQ ID NO: 482461 - DNA, 25 bp, Homo sapien
atgggacaaggtatttgtaacacat

SEQ ID NO: 482462 - DNA, 25 bp, Homo sapien
tgggacaaggtatttgtaacacata

SEQ ID NO: 482463 - DNA, 25 bp, Homo sapien
gggacaaggtatttgtaacacatat

SEQ ID NO: 482464 - DNA, 25 bp, Homo sapien
ggacaaggtatttgtaacacatata

SEQ ID NO: 482465 - DNA, 25 bp, Homo sapien
gacaaggtatttgtaacacatataa

SEQ ID NO: 482466 - DNA, 25 bp, Homo sapien
ggtatttgtaacacatataaacaag

SEQ ID NO: 482467 - DNA, 25 bp, Homo sapien
aaagaacttcagtaagtacagataa

SEQ ID NO: 482468 - DNA, 25 bp, Homo sapien
agataaaatggagtgtattctaggc

SEQ ID NO: 482469 - DNA, 25 bp, Homo sapien
aacatggacatataatgaacttgac

SEQ ID NO: 482470 - DNA, 25 bp, Homo sapien
gaacttgacatactcataaattggt

SEQ ID NO: 482471 - DNA, 25 bp, Homo sapien
ctacattttgaggaatgctgagtat

SEQ ID NO: 482472 - DNA, 25 bp, Homo sapien
tatgaggcagggagctttgagtttc

SEQ ID NO: 482473 - DNA, 25 bp, Homo sapien
ggagctttgagtttcatgtaagaga

SEQ ID NO: 482474 - DNA, 25 bp, Homo sapien
gataaattgggctgaaatgtagatt

SEQ ID NO: 482475 - DNA, 25 bp, Homo sapien
aatgtagatttcctgactcccaatt

SEQ ID NO: 482476 - DNA, 25 bp, Homo sapien
gtagatttcctgactcccaattctt

SEQ ID NO: 482477 - DNA, 25 bp, Homo sapien
cccaattcttctccttagtgtagac

SEQ ID NO: 482478 - DNA, 25 bp, Homo sapien
tggagtgcagtaacaccactgaagc

SEQ ID NO: 482479 - DNA, 25 bp, Homo sapien
gtaacaccactgaagctcactgtaa

SEQ ID NO: 482480 - DNA, 25 bp, Homo sapien
ctgtaactttgaactgctggacttg

SEQ ID NO: 482481 - DNA, 25 bp, Homo sapien
aactttgaactgctggacttggaat

SEQ ID NO: 482482 - DNA, 25 bp, Homo sapien
tgaactgctggacttggaatcctcc

SEQ ID NO: 482483 - DNA, 25 bp, Homo sapien
tcctgctgtggccttcaaagggctg

SEQ ID NO: 482484 - DNA, 25 bp, Homo sapien
tgctgtggccttcaaagggctgcaa

SEQ ID NO: 482485 - DNA, 25 bp, Homo sapien
gtggccttcaaagggctgcaattac

SEQ ID NO: 482486 - DNA, 25 bp, Homo sapien
ttcaaagggctgcaattacaagtgt

SEQ ID NO: 482487 - DNA, 25 bp, Homo sapien
actgcatcccacctcacattttatt

SEQ ID NO: 482488 - DNA, 25 bp, Homo sapien
gcatcccacctcacattttattctt

SEQ ID NO: 482489 - DNA, 25 bp, Homo sapien
taagtaatattgtttagaccttggg

SEQ ID NO: 482490 - DNA, 25 bp, Homo sapien
cctggagtttcttatagagagaaat

SEQ ID NO: 482491 - DNA, 25 bp, Homo sapien
gagatttattttcataagctggtaa

SEQ ID NO: 482492 - DNA, 25 bp, Homo sapien
ataaagcattatgttaacatttctt

SEQ ID NO: 482493 - DNA, 25 bp, Homo sapien
ccccggatacgtccatgtacatggc

SEQ ID NO: 482494 - DNA, 25 bp, Homo sapien
cccggatacgtccatgtacatggca

SEQ ID NO: 482495 - DNA, 25 bp, Homo sapien
ggatacgtccatgtacatggcaaat

SEQ ID NO: 482496 - DNA, 25 bp, Homo sapien
gtccatgtacatggcaaatattccc

SEQ ID NO: 482497 - DNA, 25 bp, Homo sapien
catgtacatggcaaatattcccaaa

SEQ ID NO: 482498 - DNA, 25 bp, Homo sapien
gtacatggcaaatattcccaaaatc

SEQ ID NO: 482499 - DNA, 25 bp, Homo sapien
atggcaaatattcccaaaatcccaa

SEQ ID NO: 482500 - DNA, 25 bp, Homo sapien
gaccaagtacatgctaggaattcca

SEQ ID NO: 482501 - DNA, 25 bp, Homo sapien
ggaattccagtcaattaatggttat

SEQ ID NO: 482502 - DNA, 25 bp, Homo sapien
catgcaactaggaggttcttagctt

SEQ ID NO: 482503 - DNA, 25 bp, Homo sapien
aggttcttagcttggtctcagttat

SEQ ID NO: 482504 - DNA, 25 bp, Homo sapien
gcttggtctcagttataactctaag

SEQ ID NO: 482505 - DNA, 25 bp, Homo sapien
cttattttgtaatcctgctccaggt

SEQ ID NO: 482506 - DNA, 25 bp, Homo sapien
caaggaatagaaactcagagcccat

SEQ ID NO: 482507 - DNA, 25 bp, Homo sapien
aactcagagcccatgtatttaagaa

SEQ ID NO: 482508 - DNA, 25 bp, Homo sapien
gtaagtttgctccaagtagggatac

SEQ ID NO: 482509 - DNA, 25 bp, Homo sapien
gacaatcaagtgacattgccatcta

SEQ ID NO: 482510 - DNA, 25 bp, Homo sapien
tgacattgccatctattcagttgct

SEQ ID NO: 482511 - DNA, 25 bp, Homo sapien
ttgtgtaatgattgccatggtcaat

SEQ ID NO: 482512 - DNA, 25 bp, Homo sapien
tgtgtaatgattgccatggtcaatt

SEQ ID NO: 482513 - DNA, 25 bp, Homo sapien
tgccatggtcaattaacacatcacc

SEQ ID NO: 482514 - DNA, 25 bp, Homo sapien
gccatggtcaattaacacatcacca

SEQ ID NO: 482515 - DNA, 25 bp, Homo sapien
ggtcaattaacacatcaccattttt

SEQ ID NO: 482516 - DNA, 25 bp, Homo sapien
gtcaattaacacatcaccatttttg

SEQ ID NO: 482517 - DNA, 25 bp, Homo sapien
tcaattaacacatcaccatttttgt

SEQ ID NO: 482518 - DNA, 25 bp, Homo sapien
caattaacacatcaccatttttgtg

SEQ ID NO: 482519 - DNA, 25 bp, Homo sapien
attaacacatcaccatttttgtgtg

SEQ ID NO: 482520 - DNA, 25 bp, Homo sapien
ttaacacatcaccatttttgtgtgt

SEQ ID NO: 482521 - DNA, 25 bp, Homo sapien
taacacatcaccatttttgtgtgtg

SEQ ID NO: 482522 - DNA, 25 bp, Homo sapien
agcctcgacccagggacatgcaggg

SEQ ID NO: 482523 - DNA, 25 bp, Homo sapien
acccagggacatgcagggctcacag

SEQ ID NO: 482524 - DNA, 25 bp, Homo sapien
gacatgcagggctcacaggagacag

SEQ ID NO: 482525 - DNA, 25 bp, Homo sapien
cagggctcacaggagacagggctca

SEQ ID NO: 482526 - DNA, 25 bp, Homo sapien
tatctgtaaagcaaagcgacaccag

SEQ ID NO: 482527 - DNA, 25 bp, Homo sapien
aagcaaagcgacaccagcaagcctg

SEQ ID NO: 482528 - DNA, 25 bp, Homo sapien
accagcaagcctgtgagcattgtgt

SEQ ID NO: 482529 - DNA, 25 bp, Homo sapien
gcaagcctgtgagcattgtgtatat

SEQ ID NO: 482530 - DNA, 25 bp, Homo sapien
aataaacacaaagcgactgaaggat

SEQ ID NO: 482531 - DNA, 25 bp, Homo sapien
acaaagcgactgaaggatgggacca

SEQ ID NO: 482532 - DNA, 25 bp, Homo sapien
gcgactgaaggatgggaccagcaaa

SEQ ID NO: 482533 - DNA, 25 bp, Homo sapien
gtggttccaggcacgtccctaagaa

SEQ ID NO: 482534 - DNA, 25 bp, Homo sapien
ggcacgtccctaagaaggtcaggat

SEQ ID NO: 482535 - DNA, 25 bp, Homo sapien
caggatggttctgatgccgtgcaac

SEQ ID NO: 482536 - DNA, 25 bp, Homo sapien
tgatgccgtgcaacctcacaggaga

SEQ ID NO: 482537 - DNA, 25 bp, Homo sapien
ggccagcgacagaagctgccgagaa

SEQ ID NO: 482538 - DNA, 25 bp, Homo sapien
tgccgagaacaggaggctgcacgca

SEQ ID NO: 482539 - DNA, 25 bp, Homo sapien
tgcccatcaagtattcctaagtcta

SEQ ID NO: 482540 - DNA, 25 bp, Homo sapien
gtattcctaagtctacagatagctc

SEQ ID NO: 482541 - DNA, 25 bp, Homo sapien
agtctacagatagctctgcactctc

SEQ ID NO: 482542 - DNA, 25 bp, Homo sapien
agatagctctgcactctccagggtg

SEQ ID NO: 482543 - DNA, 25 bp, Homo sapien
agctctgcactctccagggtgggcg

SEQ ID NO: 482544 - DNA, 25 bp, Homo sapien
agatgtctgcatcccctcaagtcag

SEQ ID NO: 482545 - DNA, 25 bp, Homo sapien
gggtgggatactttaaagtgctcct

SEQ ID NO: 482546 - DNA, 25 bp, Homo sapien
gatactttaaagtgctcctgcttaa

SEQ ID NO: 482547 - DNA, 25 bp, Homo sapien
taaagtgctcctgcttaaataaatt

SEQ ID NO: 482548 - DNA, 25 bp, Homo sapien
aataaattagaccagaccagtgtat

SEQ ID NO: 482549 - DNA, 25 bp, Homo sapien
aaattagaccagaccagtgtatttc

SEQ ID NO: 482550 - DNA, 25 bp, Homo sapien
gaccagtgtatttctaaagaaaatc

SEQ ID NO: 482551 - DNA, 25 bp, Homo sapien
aagaaaatcctgacatgcacaccca

SEQ ID NO: 482552 - DNA, 25 bp, Homo sapien
aaaatcctgacatgcacacccatta

SEQ ID NO: 482553 - DNA, 25 bp, Homo sapien
atcctgacatgcacacccattaaaa

SEQ ID NO: 482554 - DNA, 25 bp, Homo sapien
ctgacatgcacacccattaaaaata

SEQ ID NO: 482555 - DNA, 25 bp, Homo sapien
aaagaacttcagtaagtacagataa

SEQ ID NO: 482556 - DNA, 25 bp, Homo sapien
acagataaaatggagtgtattctag

SEQ ID NO: 482557 - DNA, 25 bp, Homo sapien
aacatggacatataatgaacttgac

SEQ ID NO: 482558 - DNA, 25 bp, Homo sapien
ggacatataatgaacttgacatact

SEQ ID NO: 482559 - DNA, 25 bp, Homo sapien
gaacttgacatactcataaattggt

SEQ ID NO: 482560 - DNA, 25 bp, Homo sapien
gacatactcataaattggtgaagaa

SEQ ID NO: 482561 - DNA, 25 bp, Homo sapien
ctacattttgaggaatgctgagtat

SEQ ID NO: 482562 - DNA, 25 bp, Homo sapien
tatgaggcagggagctttgagtttc

SEQ ID NO: 482563 - DNA, 25 bp, Homo sapien
ggagctttgagtttcatgtaagaga

SEQ ID NO: 482564 - DNA, 25 bp, Homo sapien
gataaattgggctgaaatgtagatt

SEQ ID NO: 482565 - DNA, 25 bp, Homo sapien
cccaattcttctccttagtgtagac

SEQ ID NO: 482566 - DNA, 25 bp, Homo sapien
tggaatgtggccatgcctccagtgc

SEQ ID NO: 482567 - DNA, 25 bp, Homo sapien
ggaatgtggccatgcctccagtgcc

SEQ ID NO: 482568 - DNA, 25 bp, Homo sapien
gaatgtggccatgcctccagtgcct

SEQ ID NO: 482569 - DNA, 25 bp, Homo sapien
aatgtggccatgcctccagtgcctc

SEQ ID NO: 482570 - DNA, 25 bp, Homo sapien
agtgcctccattcaaccccctctaa

SEQ ID NO: 482571 - DNA, 25 bp, Homo sapien
attcaaccccctctaactgattcct

SEQ ID NO: 482572 - DNA, 25 bp, Homo sapien
aactgattccttccatcctctgcga

SEQ ID NO: 482573 - DNA, 25 bp, Homo sapien
accacctccagaagctcctggctgg

SEQ ID NO: 482574 - DNA, 25 bp, Homo sapien
acctccagaagctcctggctggggt

SEQ ID NO: 482575 - DNA, 25 bp, Homo sapien
catgtattagcttccatggccccca

SEQ ID NO: 482576 - DNA, 25 bp, Homo sapien
atgtattagcttccatggcccccac

SEQ ID NO: 482577 - DNA, 25 bp, Homo sapien
tgaccttgaaataaacgcattaaag

SEQ ID NO: 482578 - DNA, 25 bp, Homo sapien
aacgcattaaagatttgctttcaga

SEQ ID NO: 482579 - DNA, 25 bp, Homo sapien
tgctttcagatacagccaaccaagt

SEQ ID NO: 482580 - DNA, 25 bp, Homo sapien
agctaggtatgacttgatttgcaat

SEQ ID NO: 482581 - DNA, 25 bp, Homo sapien
agaaatttcatttacagttggaggt

SEQ ID NO: 482582 - DNA, 25 bp, Homo sapien
tacagttggaggtagactgccaaat

SEQ ID NO: 482583 - DNA, 25 bp, Homo sapien
gtagactgccaaatgtagtagtttt

SEQ ID NO: 482584 - DNA, 25 bp, Homo sapien
tttttccagttaacacttcattata

SEQ ID NO: 482585 - DNA, 25 bp, Homo sapien
ttcattataacatgtgcccaacact

SEQ ID NO: 482586 - DNA, 25 bp, Homo sapien
atgtgcccaacactttgtactcttg

SEQ ID NO: 482587 - DNA, 25 bp, Homo sapien
tgcccaacactttgtactcttggaa

SEQ ID NO: 482588 - DNA, 25 bp, Homo sapien
ctggctccagtattttctcacaaga

SEQ ID NO: 482589 - DNA, 25 bp, Homo sapien
aattgtggcatacctataccttctg

SEQ ID NO: 482590 - DNA, 25 bp, Homo sapien
taccttctggttggttagtgctgaa

SEQ ID NO: 482591 - DNA, 25 bp, Homo sapien
agtacaggactacttttgagaagtt

SEQ ID NO: 482592 - DNA, 25 bp, Homo sapien
gaagttgacgatgtggttatcattc

SEQ ID NO: 482593 - DNA, 25 bp, Homo sapien
gtggttatcattcaaagtttgccta

SEQ ID NO: 482594 - DNA, 25 bp, Homo sapien
gtttgcctataattgtaacttgggt

SEQ ID NO: 482595 - DNA, 25 bp, Homo sapien
agtgtagtactgattgttctgaaga

SEQ ID NO: 482596 - DNA, 25 bp, Homo sapien
agccagcatctgtacctagacccaa

SEQ ID NO: 482597 - DNA, 25 bp, Homo sapien
tgtacctagacccaacttgaattcc

SEQ ID NO: 482598 - DNA, 25 bp, Homo sapien
tgaattccccaaagaagttaaactg

SEQ ID NO: 482599 - DNA, 25 bp, Homo sapien
tcttagttctgggatgttggccact

SEQ ID NO: 482600 - DNA, 25 bp, Homo sapien
ttctgggatgttggccactgtggta

SEQ ID NO: 482601 - DNA, 25 bp, Homo sapien
tgcgtctttcaactgcggttgatgg

SEQ ID NO: 482602 - DNA, 25 bp, Homo sapien
agtaagaaatctggcctttttctgc

SEQ ID NO: 482603 - DNA, 25 bp, Homo sapien
ttctctttgtttctaaggtcagttt

SEQ ID NO: 482604 - DNA, 25 bp, Homo sapien
ttgtttgaattctgccagtttagga

SEQ ID NO: 482605 - DNA, 25 bp, Homo sapien
actgcggttgatggaaatgctgtgt

SEQ ID NO: 482606 - DNA, 25 bp, Homo sapien
caagctttatgctgtagtcactaat

SEQ ID NO: 482607 - DNA, 25 bp, Homo sapien
aatgctgtgtgcactgggcttagct

SEQ ID NO: 482608 - DNA, 25 bp, Homo sapien
gcttagctgtttttggaaagtcctt

SEQ ID NO: 482609 - DNA, 25 bp, Homo sapien
ttttctcttccacttggcagctttt

SEQ ID NO: 482610 - DNA, 25 bp, Homo sapien
gatggattttgagctaggagagcca

SEQ ID NO: 482611 - DNA, 25 bp, Homo sapien
acgggagaggcatattgtaaagaac

SEQ ID NO: 482612 - DNA, 25 bp, Homo sapien
atgctgaagagttaggccattgtag

SEQ ID NO: 482613 - DNA, 25 bp, Homo sapien
ggccattgtagtattctgagcagga

SEQ ID NO: 482614 - DNA, 25 bp, Homo sapien
tgaaggcctggatcagtagagtgat

SEQ ID NO: 482615 - DNA, 25 bp, Homo sapien
tttggattccatgcctaggaatttg

SEQ ID NO: 482616 - DNA, 25 bp, Homo sapien
atgcctaggaatttggactcttctc

SEQ ID NO: 482617 - DNA, 25 bp, Homo sapien
gaatttggactcttctctgagtgaa

SEQ ID NO: 482618 - DNA, 25 bp, Homo sapien
ctcttctctgagtgaaaaggatgtt

SEQ ID NO: 482619 - DNA, 25 bp, Homo sapien
ggatgttaaatcagtccccacttct

SEQ ID NO: 482620 - DNA, 25 bp, Homo sapien
agtccccacttcttcagggaagtga

SEQ ID NO: 482621 - DNA, 25 bp, Homo sapien
catgctgccagtgccttcagtagag

SEQ ID NO: 482622 - DNA, 25 bp, Homo sapien
gccagtgccttcagtagagttacgt

SEQ ID NO: 482623 - DNA, 25 bp, Homo sapien
agagttacgtggctcacactgagtg

SEQ ID NO: 482624 - DNA, 25 bp, Homo sapien
ggctcacactgagtgtctgcccagg

SEQ ID NO: 482625 - DNA, 25 bp, Homo sapien
aggtccttcaccttcttactcgtag

SEQ ID NO: 482626 - DNA, 25 bp, Homo sapien
cttcttactcgtagtcgacggtagt

SEQ ID NO: 482627 - DNA, 25 bp, Homo sapien
tcgacggtagtggtttggaaacctg

SEQ ID NO: 482628 - DNA, 25 bp, Homo sapien
aaacctgccgtcgtgtgtgggcaga

SEQ ID NO: 482629 - DNA, 25 bp, Homo sapien
gatcaaggatgttttcatatgctgt

SEQ ID NO: 482630 - DNA, 25 bp, Homo sapien
ttcatatgctgttgttcacgccttc

SEQ ID NO: 482631 - DNA, 25 bp, Homo sapien
tcacgccttccctggatttctaaca

SEQ ID NO: 482632 - DNA, 25 bp, Homo sapien
agccgggcatgctgtcatgtgcctt

SEQ ID NO: 482633 - DNA, 25 bp, Homo sapien
gccgggcatgctgtcatgtgccttc

SEQ ID NO: 482634 - DNA, 25 bp, Homo sapien
ccgggcatgctgtcatgtgccttca

SEQ ID NO: 482635 - DNA, 25 bp, Homo sapien
cgggcatgctgtcatgtgccttcag

SEQ ID NO: 482636 - DNA, 25 bp, Homo sapien
gggcatgctgtcatgtgccttcagt

SEQ ID NO: 482637 - DNA, 25 bp, Homo sapien
ggcatgctgtcatgtgccttcagtc

SEQ ID NO: 482638 - DNA, 25 bp, Homo sapien
gcatgctgtcatgtgccttcagtct

SEQ ID NO: 482639 - DNA, 25 bp, Homo sapien
catgctgtcatgtgccttcagtctc

SEQ ID NO: 482640 - DNA, 25 bp, Homo sapien
atgctgtcatgtgccttcagtctca

SEQ ID NO: 482641 - DNA, 25 bp, Homo sapien
tgctgtcatgtgccttcagtctcag

SEQ ID NO: 482642 - DNA, 25 bp, Homo sapien
gctgtcatgtgccttcagtctcagc

SEQ ID NO: 482643 - DNA, 25 bp, Homo sapien
gggcaagtcagagcattagcagcta

SEQ ID NO: 482644 - DNA, 25 bp, Homo sapien
ggcaagtcagagcattagcagctat

SEQ ID NO: 482645 - DNA, 25 bp, Homo sapien
gcaagtcagagcattagcagctatt

SEQ ID NO: 482646 - DNA, 25 bp, Homo sapien
caagtcagagcattagcagctattt

SEQ ID NO: 482647 - DNA, 25 bp, Homo sapien
aagtcagagcattagcagctattta

SEQ ID NO: 482648 - DNA, 25 bp, Homo sapien
caacttactactgtcaacagagtta

SEQ ID NO: 482649 - DNA, 25 bp, Homo sapien
aacttactactgtcaacagagttac

SEQ ID NO: 482650 - DNA, 25 bp, Homo sapien
acttactactgtcaacagagttaca

SEQ ID NO: 482651 - DNA, 25 bp, Homo sapien
cttactactgtcaacagagttacag

SEQ ID NO: 482652 - DNA, 25 bp, Homo sapien
ttactactgtcaacagagttacagt

SEQ ID NO: 482653 - DNA, 25 bp, Homo sapien
gtcaacagagttacagtacccctca

SEQ ID NO: 482654 - DNA, 25 bp, Homo sapien
aggtggcccgctgactgcactgcat

SEQ ID NO: 482655 - DNA, 25 bp, Homo sapien
ggcccgctgactgcactgcattggg

SEQ ID NO: 482656 - DNA, 25 bp, Homo sapien
gttgtcagaggctagggcagtgact

SEQ ID NO: 482657 - DNA, 25 bp, Homo sapien
gcagtgactgaggacctgggcaaaa

SEQ ID NO: 482658 - DNA, 25 bp, Homo sapien
gactgaggacctgggcaaaacctgc

SEQ ID NO: 482659 - DNA, 25 bp, Homo sapien
gaggacctgggcaaaacctgccaca

SEQ ID NO: 482660 - DNA, 25 bp, Homo sapien
gacctgggcaaaacctgccacaggg

SEQ ID NO: 482661 - DNA, 25 bp, Homo sapien
ctgggcaaaacctgccacagggtgt

SEQ ID NO: 482662 - DNA, 25 bp, Homo sapien
gcaaaacctgccacagggtgtggga

SEQ ID NO: 482663 - DNA, 25 bp, Homo sapien
aaacctgccacagggtgtgggaacg

SEQ ID NO: 482664 - DNA, 25 bp, Homo sapien
cacagggtgtgggaacgaggaggct

SEQ ID NO: 482665 - DNA, 25 bp, Homo sapien
agaaaggttgtgctcgctacactgc

SEQ ID NO: 482666 - DNA, 25 bp, Homo sapien
tgtgctcgctacactgctggtgtgt

SEQ ID NO: 482667 - DNA, 25 bp, Homo sapien
gagacctcttgtattcaatctgtga

SEQ ID NO: 482668 - DNA, 25 bp, Homo sapien
gtattaatccgtacacccgtatagc

SEQ ID NO: 482669 - DNA, 25 bp, Homo sapien
gtacacccgtatagcctcaatattt

SEQ ID NO: 482670 - DNA, 25 bp, Homo sapien
agcctcaatatttgtctgaagacac

SEQ ID NO: 482671 - DNA, 25 bp, Homo sapien
gaagacacttaaattctgacccata

SEQ ID NO: 482672 - DNA, 25 bp, Homo sapien
ttctgacccataaaggaaagttcta

SEQ ID NO: 482673 - DNA, 25 bp, Homo sapien
acattctccaaacaacatcaagcat

SEQ ID NO: 482674 - DNA, 25 bp, Homo sapien
catcaagcattgatacacactgaag

SEQ ID NO: 482675 - DNA, 25 bp, Homo sapien
tgtatcactctaagtatgttggaat

SEQ ID NO: 482676 - DNA, 25 bp, Homo sapien
ttccaatttctagccatacgctcag

SEQ ID NO: 482677 - DNA, 25 bp, Homo sapien
tcagctcatccatgcctcagaagtg

SEQ ID NO: 482678 - DNA, 25 bp, Homo sapien
catgcctcagaagtgcatctggaga

SEQ ID NO: 482679 - DNA, 25 bp, Homo sapien
aaattcagcaaagtggttccctctc

SEQ ID NO: 482680 - DNA, 25 bp, Homo sapien
ggttccctctcttagggacagtcaa

SEQ ID NO: 482681 - DNA, 25 bp, Homo sapien
gggacagtcaaaaccaagtcactta

SEQ ID NO: 482682 - DNA, 25 bp, Homo sapien
agcttagctttagaaacagtgcaac

SEQ ID NO: 482683 - DNA, 25 bp, Homo sapien
agtgcaacactggtctgctgttcca

SEQ ID NO: 482684 - DNA, 25 bp, Homo sapien
gttccagtggtaagctatgtcccag

SEQ ID NO: 482685 - DNA, 25 bp, Homo sapien
ggaatcagtttaaaagcacgacagt

SEQ ID NO: 482686 - DNA, 25 bp, Homo sapien
gcacgacagtggatgctgggtccat

SEQ ID NO: 482687 - DNA, 25 bp, Homo sapien
ggagagtgtggtcaggcggctcgga

SEQ ID NO: 482688 - DNA, 25 bp, Homo sapien
gtggtcaggcggctcggactgagca

SEQ ID NO: 482689 - DNA, 25 bp, Homo sapien
ggactgagcaggacccatcccaatc

SEQ ID NO: 482690 - DNA, 25 bp, Homo sapien
gactgagcaggacccatcccaatct

SEQ ID NO: 482691 - DNA, 25 bp, Homo sapien
ctgagcaggacccatcccaatctta

SEQ ID NO: 482692 - DNA, 25 bp, Homo sapien
tgagcaggacccatcccaatcttac

SEQ ID NO: 482693 - DNA, 25 bp, Homo sapien
gagcaggacccatcccaatcttacc

SEQ ID NO: 482694 - DNA, 25 bp, Homo sapien
agcaggacccatcccaatcttacca

SEQ ID NO: 482695 - DNA, 25 bp, Homo sapien
aggacccatcccaatcttaccagat

SEQ ID NO: 482696 - DNA, 25 bp, Homo sapien
ggacccatcccaatcttaccagatg

SEQ ID NO: 482697 - DNA, 25 bp, Homo sapien
atcccaatcttaccagatgctactg

SEQ ID NO: 482698 - DNA, 25 bp, Homo sapien
aagatgaaaggattcgcctgagcaa

SEQ ID NO: 482699 - DNA, 25 bp, Homo sapien
aaggattcgcctgagcaagggatct

SEQ ID NO: 482700 - DNA, 25 bp, Homo sapien
gattcgcctgagcaagggatctaga

SEQ ID NO: 482701 - DNA, 25 bp, Homo sapien
ttcgcctgagcaagggatctagaag

SEQ ID NO: 482702 - DNA, 25 bp, Homo sapien
tttaagatttcgaagagaccagcct

SEQ ID NO: 482703 - DNA, 25 bp, Homo sapien
ggagaagagagatgtcaagacactt

SEQ ID NO: 482704 - DNA, 25 bp, Homo sapien
gatgtcaagacacttacatgctgat

SEQ ID NO: 482705 - DNA, 25 bp, Homo sapien
gtcaagacacttacatgctgatgag

SEQ ID NO: 482706 - DNA, 25 bp, Homo sapien
aagacacttacatgctgatgagcta

SEQ ID NO: 482707 - DNA, 25 bp, Homo sapien
gacacttacatgctgatgagctata

SEQ ID NO: 482708 - DNA, 25 bp, Homo sapien
atgctgatgagctataagggaaaga

SEQ ID NO: 482709 - DNA, 25 bp, Homo sapien
ttggcgacgcagggggcctagagag

SEQ ID NO: 482710 - DNA, 25 bp, Homo sapien
gcagggggcctagagagccccgtga

SEQ ID NO: 482711 - DNA, 25 bp, Homo sapien
cagggggcctagagagccccgtgat

SEQ ID NO: 482712 - DNA, 25 bp, Homo sapien
agggggcctagagagccccgtgatg

SEQ ID NO: 482713 - DNA, 25 bp, Homo sapien
gggggcctagagagccccgtgatgg

SEQ ID NO: 482714 - DNA, 25 bp, Homo sapien
ggggcctagagagccccgtgatgga

SEQ ID NO: 482715 - DNA, 25 bp, Homo sapien
gggcctagagagccccgtgatggac

SEQ ID NO: 482716 - DNA, 25 bp, Homo sapien
ggcctagagagccccgtgatggacg

SEQ ID NO: 482717 - DNA, 25 bp, Homo sapien
gcctagagagccccgtgatggacgg

SEQ ID NO: 482718 - DNA, 25 bp, Homo sapien
aagtgaagctgtgctcactgttatc

SEQ ID NO: 482719 - DNA, 25 bp, Homo sapien
gaagctgtgctcactgttatccttt

SEQ ID NO: 482720 - DNA, 25 bp, Homo sapien
tcactgttatcctttccttaggagg

SEQ ID NO: 482721 - DNA, 25 bp, Homo sapien
actgttatcctttccttaggaggag

SEQ ID NO: 482722 - DNA, 25 bp, Homo sapien
atcctttccttaggaggagattcac

SEQ ID NO: 482723 - DNA, 25 bp, Homo sapien
ccttaggaggagattcacaagttgc

SEQ ID NO: 482724 - DNA, 25 bp, Homo sapien
ttaggaggagattcaacagttgcaa

SEQ ID NO: 482725 - DNA, 25 bp, Homo sapien
gattcaacagttgcaattggtataa

SEQ ID NO: 482726 - DNA, 25 bp, Homo sapien
aacagttgcaattggtataaatcag

SEQ ID NO: 482727 - DNA, 25 bp, Homo sapien
tcatcaactagaattggggccttca

SEQ ID NO: 482728 - DNA, 25 bp, Homo sapien
tcatatttaaaacttaccttctcag

SEQ ID NO: 482729 - DNA, 25 bp, Homo sapien
atgctctatgtggacctgagacgca

SEQ ID NO: 482730 - DNA, 25 bp, Homo sapien
gtggacctgagacgcagctgacaaa

SEQ ID NO: 482731 - DNA, 25 bp, Homo sapien
agctgacaaagcaaaccgtgtttat

SEQ ID NO: 482732 - DNA, 25 bp, Homo sapien
tgtttatctgagatgctgggacctc

SEQ ID NO: 482733 - DNA, 25 bp, Homo sapien
acagaatgtcagacacctgccaggg

SEQ ID NO: 482734 - DNA, 25 bp, Homo sapien
gccctacttacggtgcctacaaagg

SEQ ID NO: 482735 - DNA, 25 bp, Homo sapien
acaaaggctcgcaggcatgatctcg

SEQ ID NO: 482736 - DNA, 25 bp, Homo sapien
aaaacgcagtgttctttacagtagc

SEQ ID NO: 482737 - DNA, 25 bp, Homo sapien
gttctttacagtagctgtgcctcac

SEQ ID NO: 482738 - DNA, 25 bp, Homo sapien
gtgcctcacagccagagtcaagtct

SEQ ID NO: 482739 - DNA, 25 bp, Homo sapien
agtcaagtcttgtccatctacacca

SEQ ID NO: 482740 - DNA, 25 bp, Homo sapien
tgggcactcctgatttttcctttaa

SEQ ID NO: 482741 - DNA, 25 bp, Homo sapien
ggcactcctgatttttcctttaagg

SEQ ID NO: 482742 - DNA, 25 bp, Homo sapien
gcactcctgatttttcctttaagga

SEQ ID NO: 482743 - DNA, 25 bp, Homo sapien
tattttaagagtaaggcccaagaat

SEQ ID NO: 482744 - DNA, 25 bp, Homo sapien
aaggcccaagaatatgattgcagcc

SEQ ID NO: 482745 - DNA, 25 bp, Homo sapien
caagaatatgattgcagcctggtat

SEQ ID NO: 482746 - DNA, 25 bp, Homo sapien
gaatatgattgcagcctggtatatt

SEQ ID NO: 482747 - DNA, 25 bp, Homo sapien
gattgcagcctggtatattggagtg

SEQ ID NO: 482748 - DNA, 25 bp, Homo sapien
gcagcctggtatattggagtgagca

SEQ ID NO: 482749 - DNA, 25 bp, Homo sapien
tggagtgagcagacaagtaagaaat

SEQ ID NO: 482750 - DNA, 25 bp, Homo sapien
atgaggttttctaggtttagttgag

SEQ ID NO: 482751 - DNA, 25 bp, Homo sapien
agatttttgctgacagtgaaaaaaa

SEQ ID NO: 482752 - DNA, 25 bp, Homo sapien
gacagaagggcgaggctacaaaaac

SEQ ID NO: 482753 - DNA, 25 bp, Homo sapien
ggcgaggctacaaaaactaaccctg

SEQ ID NO: 482754 - DNA, 25 bp, Homo sapien
gcgaggctacaaaaactaaccctgg

SEQ ID NO: 482755 - DNA, 25 bp, Homo sapien
aactaaccctggatcctactctctt

SEQ ID NO: 482756 - DNA, 25 bp, Homo sapien
actaaccctggatcctactctctta

SEQ ID NO: 482757 - DNA, 25 bp, Homo sapien
taaccctggatcctactctcttatt

SEQ ID NO: 482758 - DNA, 25 bp, Homo sapien
aaccctggatcctactctcttatta

SEQ ID NO: 482759 - DNA, 25 bp, Homo sapien
accctggatcctactctcttattaa

SEQ ID NO: 482760 - DNA, 25 bp, Homo sapien
ccctggatcctactctcttattaaa

SEQ ID NO: 482761 - DNA, 25 bp, Homo sapien
tggatcctactctcttattaaaaag

SEQ ID NO: 482762 - DNA, 25 bp, Homo sapien
aaggctgagagtgagcactggatat

SEQ ID NO: 482763 - DNA, 25 bp, Homo sapien
gtgagcactggatataattcatttt

SEQ ID NO: 482764 - DNA, 25 bp, Homo sapien
attgatatggtgttattgttcttcc

SEQ ID NO: 482765 - DNA, 25 bp, Homo sapien
gatatggtgttattgttcttccagt

SEQ ID NO: 482766 - DNA, 25 bp, Homo sapien
atggtgttattgttcttccagttgt

SEQ ID NO: 482767 - DNA, 25 bp, Homo sapien
ttccagttgtctgtcctttgtgtat

SEQ ID NO: 482768 - DNA, 25 bp, Homo sapien
gtcctttgtgtatgttcttatttat

SEQ ID NO: 482769 - DNA, 25 bp, Homo sapien
gttcttatttatatgttgatacact

SEQ ID NO: 482770 - DNA, 25 bp, Homo sapien
tgtagataaacaagatattggcatc

SEQ ID NO: 482771 - DNA, 25 bp, Homo sapien
gacattttaatatatgtgataccta

SEQ ID NO: 482772 - DNA, 25 bp, Homo sapien
tatgtgatacctatatctagatata

SEQ ID NO: 482773 - DNA, 25 bp, Homo sapien
ggtgggtcacagaacgtatttgatc

SEQ ID NO: 482774 - DNA, 25 bp, Homo sapien
atttgatcaggcaaagaggactctt

SEQ ID NO: 482775 - DNA, 25 bp, Homo sapien
aagaggactcttgccatccaagcct

SEQ ID NO: 482776 - DNA, 25 bp, Homo sapien
caagcctgttccctcagataaatgg

SEQ ID NO: 482777 - DNA, 25 bp, Homo sapien
ggataattcatatgtcataagccaa

SEQ ID NO: 482778 - DNA, 25 bp, Homo sapien
atctggttccagagcctgctctcaa

SEQ ID NO: 482779 - DNA, 25 bp, Homo sapien
agagcctgctctcaatcccaatgat

SEQ ID NO: 482780 - DNA, 25 bp, Homo sapien
caatcccaatgatgtgctaccttca

SEQ ID NO: 482781 - DNA, 25 bp, Homo sapien
gtgctaccttcacatcctagttacg

SEQ ID NO: 482782 - DNA, 25 bp, Homo sapien
gttacgccactgactagctttgtga

SEQ ID NO: 482783 - DNA, 25 bp, Homo sapien
agttatttaacatcccaggatctgt

SEQ ID NO: 482784 - DNA, 25 bp, Homo sapien
atgacatccgaacagccaacgatgg

SEQ ID NO: 482785 - DNA, 25 bp, Homo sapien
gattactggcgcctcctgaaccctg

SEQ ID NO: 482786 - DNA, 25 bp, Homo sapien
gcctcctgaaccctggagagtatgt

SEQ ID NO: 482787 - DNA, 25 bp, Homo sapien
gtatgtggtcacagcaaaggccgaa

SEQ ID NO: 482788 - DNA, 25 bp, Homo sapien
catccaccaagaactgtatggttgg

SEQ ID NO: 482789 - DNA, 25 bp, Homo sapien
gaactgtatggttggctatgacatg

SEQ ID NO: 482790 - DNA, 25 bp, Homo sapien
gggccacaaggtgtgacttcacact

SEQ ID NO: 482791 - DNA, 25 bp, Homo sapien
gtgtgacttcacacttagcaaaacc

SEQ ID NO: 482792 - DNA, 25 bp, Homo sapien
gcaaaaccaacatggccaggatccg

SEQ ID NO: 482793 - DNA, 25 bp, Homo sapien
ccaggatccgagagatcatggagaa

SEQ ID NO: 482794 - DNA, 25 bp, Homo sapien
agtttgggaagcagcccgtcagcct

SEQ ID NO: 482795 - DNA, 25 bp, Homo sapien
ttagagatttcttcttaaaagctaa

SEQ ID NO: 482796 - DNA, 25 bp, Homo sapien
agccgggcatgctgtcatgtgcctt

SEQ ID NO: 482797 - DNA, 25 bp, Homo sapien
ccgggcatgctgtcatgtgccttca

SEQ ID NO: 482798 - DNA, 25 bp, Homo sapien
cgggcatgctgtcatgtgccttcag

SEQ ID NO: 482799 - DNA, 25 bp, Homo sapien
gggcatgctgtcatgtgccttcagt

SEQ ID NO: 482800 - DNA, 25 bp, Homo sapien
ggcatgctgtcatgtgccttcagtc

SEQ ID NO: 482801 - DNA, 25 bp, Homo sapien
gcatgctgtcatgtgccttcagtct

SEQ ID NO: 482802 - DNA, 25 bp, Homo sapien
catgctgtcatgtgccttcagtctc

SEQ ID NO: 482803 - DNA, 25 bp, Homo sapien
atgctgtcatgtgccttcagtctca

SEQ ID NO: 482804 - DNA, 25 bp, Homo sapien
gctgtcatgtgccttcagtctcagc

SEQ ID NO: 482805 - DNA, 25 bp, Homo sapien
tgtcatgtgccttcagtctcagcta

SEQ ID NO: 482806 - DNA, 25 bp, Homo sapien
cccagggcaactgcctataatgtat

SEQ ID NO: 482807 - DNA, 25 bp, Homo sapien
ggcaactgcctataatgtatgttca

SEQ ID NO: 482808 - DNA, 25 bp, Homo sapien
ataatgtatgttcacatgtgctatc

SEQ ID NO: 482809 - DNA, 25 bp, Homo sapien
gctatctcctttggtcaataccaca

SEQ ID NO: 482810 - DNA, 25 bp, Homo sapien
tggtcaataccacacactacaggtg

SEQ ID NO: 482811 - DNA, 25 bp, Homo sapien
ataccacacactacaggtgaggaaa

SEQ ID NO: 482812 - DNA, 25 bp, Homo sapien
aggaaactgagtctctgctgggaca

SEQ ID NO: 482813 - DNA, 25 bp, Homo sapien
aactgagtctctgctgggacactgg

SEQ ID NO: 482814 - DNA, 25 bp, Homo sapien
acactgggtcaggaagcaggcagtt

SEQ ID NO: 482815 - DNA, 25 bp, Homo sapien
gcaggcagttaaggtcacctgtgca

SEQ ID NO: 482816 - DNA, 25 bp, Homo sapien
gtcacctgtgcacagtggcagcaca

SEQ ID NO: 482817 - DNA, 25 bp, Homo sapien
aaatgtggaattggaattccccgag

SEQ ID NO: 482818 - DNA, 25 bp, Homo sapien
attccccgaggaattccgatctcat

SEQ ID NO: 482819 - DNA, 25 bp, Homo sapien
gaggaattccgatctcatttccttt

SEQ ID NO: 482820 - DNA, 25 bp, Homo sapien
gaattccgatctcatttcctttggc

SEQ ID NO: 482821 - DNA, 25 bp, Homo sapien
attccgatctcatttcctttggctt

SEQ ID NO: 482822 - DNA, 25 bp, Homo sapien
cctttggcttcaggataggcctaat

SEQ ID NO: 482823 - DNA, 25 bp, Homo sapien
ggcttcaggataggcctaataagaa

SEQ ID NO: 482824 - DNA, 25 bp, Homo sapien
tatatgaacatttttgcctccttat

SEQ ID NO: 482825 - DNA, 25 bp, Homo sapien
tatgaacatttttgcctccttattt

SEQ ID NO: 482826 - DNA, 25 bp, Homo sapien
ttttgcctccttatttcttgaaaat

SEQ ID NO: 482827 - DNA, 25 bp, Homo sapien
gcctccttatttcttgaaaatgtgg

SEQ ID NO: 482828 - DNA, 25 bp, Homo sapien
tttattgtatgttggctagcagttc

SEQ ID NO: 482829 - DNA, 25 bp, Homo sapien
gtatgttggctagcagttcatcctt

SEQ ID NO: 482830 - DNA, 25 bp, Homo sapien
atgttggctagcagttcatccttct

SEQ ID NO: 482831 - DNA, 25 bp, Homo sapien
tggctagcagttcatccttctgcaa

SEQ ID NO: 482832 - DNA, 25 bp, Homo sapien
agacttaaaccatttgtgtcatttg

SEQ ID NO: 482833 - DNA, 25 bp, Homo sapien
gaacctatatttttcatcattaact

SEQ ID NO: 482834 - DNA, 25 bp, Homo sapien
atcattaacttcctaatataccaga

SEQ ID NO: 482835 - DNA, 25 bp, Homo sapien
tataccagaacatatacctttttca

SEQ ID NO: 482836 - DNA, 25 bp, Homo sapien
tacctttttcatgtaaagttggcaa

SEQ ID NO: 482837 - DNA, 25 bp, Homo sapien
agttggcaatgggatatggcagttt

SEQ ID NO: 482838 - DNA, 25 bp, Homo sapien
ggcaatgggatatggcagttttatt

SEQ ID NO: 482839 - DNA, 25 bp, Homo sapien
aaagaatcactatcacagccttact

SEQ ID NO: 482840 - DNA, 25 bp, Homo sapien
agaatcactatcacagccttactgc

SEQ ID NO: 482841 - DNA, 25 bp, Homo sapien
gaatcactatcacagccttactgca

SEQ ID NO: 482842 - DNA, 25 bp, Homo sapien
aatcactatcacagccttactgcaa

SEQ ID NO: 482843 - DNA, 25 bp, Homo sapien
actatcacagccttactgcaacact

SEQ ID NO: 482844 - DNA, 25 bp, Homo sapien
ctatcacagccttactgcaacactg

SEQ ID NO: 482845 - DNA, 25 bp, Homo sapien
tcacagccttactgcaacactgtgt

SEQ ID NO: 482846 - DNA, 25 bp, Homo sapien
atttgaatactttacatgccaagaa

SEQ ID NO: 482847 - DNA, 25 bp, Homo sapien
tttgaatactttacatgccaagaaa

SEQ ID NO: 482848 - DNA, 25 bp, Homo sapien
gaaatgatcagaatactctaatgac

SEQ ID NO: 482849 - DNA, 25 bp, Homo sapien
ctttacaatgcaaacctgtaaaata

SEQ ID NO: 482850 - DNA, 25 bp, Homo sapien
gcgcacatgtcctgatgcctggaga

SEQ ID NO: 482851 - DNA, 25 bp, Homo sapien
tgtcctgatgcctggagaaatctca

SEQ ID NO: 482852 - DNA, 25 bp, Homo sapien
agggacccactcatagttagcaatg

SEQ ID NO: 482853 - DNA, 25 bp, Homo sapien
aaatctcagaattgtaagccacggc

SEQ ID NO: 482854 - DNA, 25 bp, Homo sapien
gtaagccacggcattaggaaactgt

SEQ ID NO: 482855 - DNA, 25 bp, Homo sapien
aggaaactgtcctgatttccaccca

SEQ ID NO: 482856 - DNA, 25 bp, Homo sapien
tgatttccacccacattaatacctc

SEQ ID NO: 482857 - DNA, 25 bp, Homo sapien
aaagtgctccttagtaacctggctg

SEQ ID NO: 482858 - DNA, 25 bp, Homo sapien
aatgcttaaagagcaccctccacag

SEQ ID NO: 482859 - DNA, 25 bp, Homo sapien
agccacatctgatacaaactgaagt

SEQ ID NO: 482860 - DNA, 25 bp, Homo sapien
gaagtatctcctaagagagccagag

SEQ ID NO: 482861 - DNA, 25 bp, Homo sapien
accatgcccagccacatatactata

SEQ ID NO: 482862 - DNA, 25 bp, Homo sapien
ccatgcccagccacatatactatat

SEQ ID NO: 482863 - DNA, 25 bp, Homo sapien
catgcccagccacatatactatatt

SEQ ID NO: 482864 - DNA, 25 bp, Homo sapien
atgcccagccacatatactatattt

SEQ ID NO: 482865 - DNA, 25 bp, Homo sapien
agccacatatactatatttcagcaa

SEQ ID NO: 482866 - DNA, 25 bp, Homo sapien
gccacatatactatatttcagcaaa

SEQ ID NO: 482867 - DNA, 25 bp, Homo sapien
cacatatactatatttcagcaaaat

SEQ ID NO: 482868 - DNA, 25 bp, Homo sapien
atttcagcaaaatattctatacaat

SEQ ID NO: 482869 - DNA, 25 bp, Homo sapien
ttcagcaaaatattctatacaatag

SEQ ID NO: 482870 - DNA, 25 bp, Homo sapien
atagagtttaatacaactttttgca

SEQ ID NO: 482871 - DNA, 25 bp, Homo sapien
agagtttaatacaactttttgcaat

SEQ ID NO: 482872 - DNA, 25 bp, Homo sapien
ctgagcagccaggtcccactaggtg

SEQ ID NO: 482873 - DNA, 25 bp, Homo sapien
gagcagccaggtcccactaggtgct

SEQ ID NO: 482874 - DNA, 25 bp, Homo sapien
agccaggtcccactaggtgctctac

SEQ ID NO: 482875 - DNA, 25 bp, Homo sapien
cactaggtgctctaccctgagggag

SEQ ID NO: 482876 - DNA, 25 bp, Homo sapien
aggtgctctaccctgagggagccta

SEQ ID NO: 482877 - DNA, 25 bp, Homo sapien
tgctctaccctgagggagcctaggg

SEQ ID NO: 482878 - DNA, 25 bp, Homo sapien
gctgctgagacccttagatctttgg

SEQ ID NO: 482879 - DNA, 25 bp, Homo sapien
gctgagacccttagatctttgggcc

SEQ ID NO: 482880 - DNA, 25 bp, Homo sapien
gagacccttagatctttgggcctag

SEQ ID NO: 482881 - DNA, 25 bp, Homo sapien
gacccttagatctttgggcctagga

SEQ ID NO: 482882 - DNA, 25 bp, Homo sapien
ccttagatctttgggcctaggaggg

SEQ ID NO: 482883 - DNA, 25 bp, Homo sapien
ttctttttcaccctgtattctcaat

SEQ ID NO: 482884 - DNA, 25 bp, Homo sapien
ctgtattctcaatgatcccttcctc

SEQ ID NO: 482885 - DNA, 25 bp, Homo sapien
tatgaaactggcacttgactgaaca

SEQ ID NO: 482886 - DNA, 25 bp, Homo sapien
ggaaacagctgtacctctaagctcc

SEQ ID NO: 482887 - DNA, 25 bp, Homo sapien
acctctaagctcctttcacagaaat

SEQ ID NO: 482888 - DNA, 25 bp, Homo sapien
cacagaaatcgtcatctgccttgga

SEQ ID NO: 482889 - DNA, 25 bp, Homo sapien
aaagaacagtgaattgggcccaaag

SEQ ID NO: 482890 - DNA, 25 bp, Homo sapien
gggcccaaagatcaaacacagcatt

SEQ ID NO: 482891 - DNA, 25 bp, Homo sapien
gaattctaaacgcacaactcgggag

SEQ ID NO: 482892 - DNA, 25 bp, Homo sapien
acaactcgggagctgtgcacggctt

SEQ ID NO: 482893 - DNA, 25 bp, Homo sapien
gtgcacggcttctcaagtgattcag

SEQ ID NO: 482894 - DNA, 25 bp, Homo sapien
cattccttaaagacatcagtctcgg

SEQ ID NO: 482895 - DNA, 25 bp, Homo sapien
attccttaaagacatcagtctcggc

SEQ ID NO: 482896 - DNA, 25 bp, Homo sapien
ttccttaaagacatcagtctcggcc

SEQ ID NO: 482897 - DNA, 25 bp, Homo sapien
tccttaaagacatcagtctcggccg

SEQ ID NO: 482898 - DNA, 25 bp, Homo sapien
ccttaaagacatcagtctcggccgg

SEQ ID NO: 482899 - DNA, 25 bp, Homo sapien
cttaaagacatcagtctcggccggg

SEQ ID NO: 482900 - DNA, 25 bp, Homo sapien
ttaaagacatcagtctcggccgggc

SEQ ID NO: 482901 - DNA, 25 bp, Homo sapien
taaagacatcagtctcggccgggcg

SEQ ID NO: 482902 - DNA, 25 bp, Homo sapien
aaagacatcagtctcggccgggcgc

SEQ ID NO: 482903 - DNA, 25 bp, Homo sapien
aagacatcagtctcggccgggcgcg

SEQ ID NO: 482904 - DNA, 25 bp, Homo sapien
agacatcagtctcggccgggcgcgg

SEQ ID NO: 482905 - DNA, 25 bp, Homo sapien
gggtcacggagggcttggctctcac

SEQ ID NO: 482906 - DNA, 25 bp, Homo sapien
gtcacggagggcttggctctcacct

SEQ ID NO: 482907 - DNA, 25 bp, Homo sapien
tcacggagggcttggctctcacctc

SEQ ID NO: 482908 - DNA, 25 bp, Homo sapien
cacggagggcttggctctcacctca

SEQ ID NO: 482909 - DNA, 25 bp, Homo sapien
acggagggcttggctctcacctcag

SEQ ID NO: 482910 - DNA, 25 bp, Homo sapien
cggagggcttggctctcacctcaga

SEQ ID NO: 482911 - DNA, 25 bp, Homo sapien
ggagggcttggctctcacctcagag

SEQ ID NO: 482912 - DNA, 25 bp, Homo sapien
gagggcttggctctcacctcagagc

SEQ ID NO: 482913 - DNA, 25 bp, Homo sapien
agggcttggctctcacctcagagct

SEQ ID NO: 482914 - DNA, 25 bp, Homo sapien
gggcttggctctcacctcagagctg

SEQ ID NO: 482915 - DNA, 25 bp, Homo sapien
ggcttggctctcacctcagagctgc

SEQ ID NO: 482916 - DNA, 25 bp, Homo sapien
gtgtcagggcagtatatttttataa

SEQ ID NO: 482917 - DNA, 25 bp, Homo sapien
caaattaatcaatgacttctcttcc

SEQ ID NO: 482918 - DNA, 25 bp, Homo sapien
atgacttctcttcctcaaaagacat

SEQ ID NO: 482919 - DNA, 25 bp, Homo sapien
caaaagacatcaaatgggacaaggt

SEQ ID NO: 482920 - DNA, 25 bp, Homo sapien
aagacatcaaatgggacaaggtatt

SEQ ID NO: 482921 - DNA, 25 bp, Homo sapien
aatgggacaaggtatttgtaacaca

SEQ ID NO: 482922 - DNA, 25 bp, Homo sapien
atgggacaaggtatttgtaacacat

SEQ ID NO: 482923 - DNA, 25 bp, Homo sapien
gggacaaggtatttgtaacacatat

SEQ ID NO: 482924 - DNA, 25 bp, Homo sapien
gacaaggtatttgtaacacatataa

SEQ ID NO: 482925 - DNA, 25 bp, Homo sapien
ggtatttgtaacacatataaacaag

SEQ ID NO: 482926 - DNA, 25 bp, Homo sapien
aaacaaggatttatatttagcatat

SEQ ID NO: 482927 - DNA, 25 bp, Homo sapien
ggtggtgggcgcctaattgcagcta

SEQ ID NO: 482928 - DNA, 25 bp, Homo sapien
aggagaaccattgaaccaggagcgg

SEQ ID NO: 482929 - DNA, 25 bp, Homo sapien
gagaaccattgaaccaggagcggag

SEQ ID NO: 482930 - DNA, 25 bp, Homo sapien
aataattaacgatgactgtccaagg

SEQ ID NO: 482931 - DNA, 25 bp, Homo sapien
taacgatgactgtccaaggagaaaa

SEQ ID NO: 482932 - DNA, 25 bp, Homo sapien
tgactgtccaaggagaaaactggaa

SEQ ID NO: 482933 - DNA, 25 bp, Homo sapien
actcaccaccaccagtttttgtgtt

SEQ ID NO: 482934 - DNA, 25 bp, Homo sapien
accaccaccagtttttgtgtttctg

SEQ ID NO: 482935 - DNA, 25 bp, Homo sapien
accaccagtttttgtgtttctggct

SEQ ID NO: 482936 - DNA, 25 bp, Homo sapien
accagtttttgtgtttctggctgac

SEQ ID NO: 482937 - DNA, 25 bp, Homo sapien
ttcatctcccttccacagagcatct

SEQ ID NO: 482938 - DNA, 25 bp, Homo sapien
gaggaatgcggccatccgtgacatt

SEQ ID NO: 482939 - DNA, 25 bp, Homo sapien
cggccatccgtgacatttttgggac

SEQ ID NO: 482940 - DNA, 25 bp, Homo sapien
ccccactgcaccctagagagtattg

SEQ ID NO: 482941 - DNA, 25 bp, Homo sapien
caccctagagagtattgcaagcaga

SEQ ID NO: 482942 - DNA, 25 bp, Homo sapien
agagatggcaagtccaagcgtgcac

SEQ ID NO: 482943 - DNA, 25 bp, Homo sapien
aagtccaagcgtgcacaggcagagg

SEQ ID NO: 482944 - DNA, 25 bp, Homo sapien
tgcaggaaactgacccctggccgct

SEQ ID NO: 482945 - DNA, 25 bp, Homo sapien
gacccctggccgcttatctggtgtt

SEQ ID NO: 482946 - DNA, 25 bp, Homo sapien
gcttatctggtgttccggctctcaa

SEQ ID NO: 482947 - DNA, 25 bp, Homo sapien
ggatgatgtctcagtttacccagag

SEQ ID NO: 482948 - DNA, 25 bp, Homo sapien
tgtctcagtttacccagagttccag

SEQ ID NO: 482949 - DNA, 25 bp, Homo sapien
ccagtgccttcagtcaacaaagaat

SEQ ID NO: 482950 - DNA, 25 bp, Homo sapien
gtgccttcagtcaacaaagaatgag

SEQ ID NO: 482951 - DNA, 25 bp, Homo sapien
agaatgagttaaatgctaaggaagc

SEQ ID NO: 482952 - DNA, 25 bp, Homo sapien
ggaatccgaaccctgaacagctgga

SEQ ID NO: 482953 - DNA, 25 bp, Homo sapien
aatccgaaccctgaacagctggaaa

SEQ ID NO: 482954 - DNA, 25 bp, Homo sapien
tccgaaccctgaacagctggaaatg

SEQ ID NO: 482955 - DNA, 25 bp, Homo sapien
aaccctgaacagctggaaatgagcc

SEQ ID NO: 482956 - DNA, 25 bp, Homo sapien
gaacagctggaaatgagcccagata

SEQ ID NO: 482957 - DNA, 25 bp, Homo sapien
tgctgttctgtaggcgtgttgtgga

SEQ ID NO: 482958 - DNA, 25 bp, Homo sapien
atgacgtatctggagtttgtgctta

SEQ ID NO: 482959 - DNA, 25 bp, Homo sapien
gaagcattcttaattatccatctaa

SEQ ID NO: 482960 - DNA, 25 bp, Homo sapien
tatgctccagagaattacaattccc

SEQ ID NO: 482961 - DNA, 25 bp, Homo sapien
agaattacaattcccctgcttctct

SEQ ID NO: 482962 - DNA, 25 bp, Homo sapien
agaagaccattcctaccaacacttg

SEQ ID NO: 482963 - DNA, 25 bp, Homo sapien
ccatctgctactgcgcatcgtgtga

SEQ ID NO: 482964 - DNA, 25 bp, Homo sapien
tgctactgcgcatcgtgtgaggcag

SEQ ID NO: 482965 - DNA, 25 bp, Homo sapien
cagaggacttggatgctctccaggc

SEQ ID NO: 482966 - DNA, 25 bp, Homo sapien
gcagagtacttctacccgagcacag

SEQ ID NO: 482967 - DNA, 25 bp, Homo sapien
ttctacccgagcacagactgtgtgg

SEQ ID NO: 482968 - DNA, 25 bp, Homo sapien
acagactgtgtggactttgccccct

SEQ ID NO: 482969 - DNA, 25 bp, Homo sapien
agccgccaccagtgatttctataag

SEQ ID NO: 482970 - DNA, 25 bp, Homo sapien
acaaactgtgacatctgctatagtt

SEQ ID NO: 482971 - DNA, 25 bp, Homo sapien
acatagtaatctctaaggtgcaaaa

SEQ ID NO: 482972 - DNA, 25 bp, Homo sapien
agtaatctctaaggtgcaaaacaca

SEQ ID NO: 482973 - DNA, 25 bp, Homo sapien
atctctaaggtgcaaaacacacgtg

SEQ ID NO: 482974 - DNA, 25 bp, Homo sapien
tctaaggtgcaaaacacacgtggaa

SEQ ID NO: 482975 - DNA, 25 bp, Homo sapien
taaggtgcaaaacacacgtggaaaa

SEQ ID NO: 482976 - DNA, 25 bp, Homo sapien
atgctgaaacgttgccaggagtttt

SEQ ID NO: 482977 - DNA, 25 bp, Homo sapien
tgctgaaacgttgccaggagttttc

SEQ ID NO: 482978 - DNA, 25 bp, Homo sapien
ctgaaacgttgccaggagttttctc

SEQ ID NO: 482979 - DNA, 25 bp, Homo sapien
tgaaacgttgccaggagttttctct

SEQ ID NO: 482980 - DNA, 25 bp, Homo sapien
gaaacgttgccaggagttttctctg

SEQ ID NO: 482981 - DNA, 25 bp, Homo sapien
aaacgttgccaggagttttctctga

SEQ ID NO: 482982 - DNA, 25 bp, Homo sapien
tattttagggtctgtcctcatacct

SEQ ID NO: 482983 - DNA, 25 bp, Homo sapien
gtcctcatacctgtcacattggtga

SEQ ID NO: 482984 - DNA, 25 bp, Homo sapien
aaacctcaagatccccaaatatatg

SEQ ID NO: 482985 - DNA, 25 bp, Homo sapien
cagaggagggccatgccgctgaaaa

SEQ ID NO: 482986 - DNA, 25 bp, Homo sapien
atttgattgccttatcacatggtca

SEQ ID NO: 482987 - DNA, 25 bp, Homo sapien
cacatggtcaagtaccttgccaaat

SEQ ID NO: 482988 - DNA, 25 bp, Homo sapien
agcaaatgatttgggtctcaactga

SEQ ID NO: 482989 - DNA, 25 bp, Homo sapien
gggtctcaactgaagatgaagctca

SEQ ID NO: 482990 - DNA, 25 bp, Homo sapien
gacagtgctgtagccttgagactaa

SEQ ID NO: 482991 - DNA, 25 bp, Homo sapien
atgaacaaagaaacctgctctagtt

SEQ ID NO: 482992 - DNA, 25 bp, Homo sapien
tgctctagttttacaggaccatatt

SEQ ID NO: 482993 - DNA, 25 bp, Homo sapien
agaaaggcgtcttgtttcctggact

SEQ ID NO: 482994 - DNA, 25 bp, Homo sapien
aggcgtcttgtttcctggactttgg

SEQ ID NO: 482995 - DNA, 25 bp, Homo sapien
aaggccttggagtccggagattcct

SEQ ID NO: 482996 - DNA, 25 bp, Homo sapien
gagtccggagattcctgtcacgagt

SEQ ID NO: 482997 - DNA, 25 bp, Homo sapien
gattcctgtcacgagttgcagattt

SEQ ID NO: 482998 - DNA, 25 bp, Homo sapien
gtgttttcacactctggatactttc

SEQ ID NO: 482999 - DNA, 25 bp, Homo sapien
ggatactttcaaccacctgtgcgtg

SEQ ID NO: 483000 - DNA, 25 bp, Homo sapien
tggccacagccacaaatacaagaat

SEQ ID NO: 483001 - DNA, 25 bp, Homo sapien
gaggactgggtttgaaggcacacat

SEQ ID NO: 483002 - DNA, 25 bp, Homo sapien
gaaggcacacatcggttttcaattt

SEQ ID NO: 483003 - DNA, 25 bp, Homo sapien
gcactcactgagaaaggcgtcttgt

SEQ ID NO: 483004 - DNA, 25 bp, Homo sapien
tcagatggtgcactggccccgggag

SEQ ID NO: 483005 - DNA, 25 bp, Homo sapien
tggccccgggaggagtctgaccaaa

SEQ ID NO: 483006 - DNA, 25 bp, Homo sapien
tgaccaaaaatggagcccgctctgt

SEQ ID NO: 483007 - DNA, 25 bp, Homo sapien
cacgagaaacggtcccacggtgcgg

SEQ ID NO: 483008 - DNA, 25 bp, Homo sapien
gaaacggtcccacggtgcggatctc

SEQ ID NO: 483009 - DNA, 25 bp, Homo sapien
tgggcctccaatcctgcggagcttt

SEQ ID NO: 483010 - DNA, 25 bp, Homo sapien
aatcctgcggagctttcctgggtgt

SEQ ID NO: 483011 - DNA, 25 bp, Homo sapien
tcctgggtgtggctttgacctcaga

SEQ ID NO: 483012 - DNA, 25 bp, Homo sapien
gacctcagaagtggctctggtttgg

SEQ ID NO: 483013 - DNA, 25 bp, Homo sapien
aagtggctctggtttggcctcagga

SEQ ID NO: 483014 - DNA, 25 bp, Homo sapien
tggggggcccttgatgccactaatc

SEQ ID NO: 483015 - DNA, 25 bp, Homo sapien
taaatggtagaaacactctgggtga

SEQ ID NO: 483016 - DNA, 25 bp, Homo sapien
atgctgacactggtacatatcctat

SEQ ID NO: 483017 - DNA, 25 bp, Homo sapien
acaagcctactgaagtgacacacag

SEQ ID NO: 483018 - DNA, 25 bp, Homo sapien
acacacagacctacctgcaatggaa

SEQ ID NO: 483019 - DNA, 25 bp, Homo sapien
tacctgcaatggaagatgacgacac

SEQ ID NO: 483020 - DNA, 25 bp, Homo sapien
gagatctaaaggacctacttgacca

SEQ ID NO: 483021 - DNA, 25 bp, Homo sapien
aaggacctacttgaccatggcccat

SEQ ID NO: 483022 - DNA, 25 bp, Homo sapien
gaccatggcccatgggcctgacaga

SEQ ID NO: 483023 - DNA, 25 bp, Homo sapien
aagaattgaacagtacccagtgtcc

SEQ ID NO: 483024 - DNA, 25 bp, Homo sapien
gtacccagtgtccaaaaggtcctga

SEQ ID NO: 483025 - DNA, 25 bp, Homo sapien
gggagaagaggctctagtctaagca

SEQ ID NO: 483026 - DNA, 25 bp, Homo sapien
aagaatttatacttgtgagaaactc

SEQ ID NO: 483027 - DNA, 25 bp, Homo sapien
agaatttatacttgtgagaaactct

SEQ ID NO: 483028 - DNA, 25 bp, Homo sapien
gaatttatacttgtgagaaactcta

SEQ ID NO: 483029 - DNA, 25 bp, Homo sapien
aatgtgacagaacttttaaccaatt

SEQ ID NO: 483030 - DNA, 25 bp, Homo sapien
tgtgacagaacttttaaccaattct

SEQ ID NO: 483031 - DNA, 25 bp, Homo sapien
aaaaaagattatgctcgagagaaac

SEQ ID NO: 483032 - DNA, 25 bp, Homo sapien
aaaagattatgctcgagagaaacca

SEQ ID NO: 483033 - DNA, 25 bp, Homo sapien
aaagattatgctcgagagaaaccat

SEQ ID NO: 483034 - DNA, 25 bp, Homo sapien
aagattatgctcgagagaaaccata

SEQ ID NO: 483035 - DNA, 25 bp, Homo sapien
agattatgctcgagagaaaccatac

SEQ ID NO: 483036 - DNA, 25 bp, Homo sapien
gattatgctcgagagaaaccataca

SEQ ID NO: 483037 - DNA, 25 bp, Homo sapien
gaacctaactgtatcttgaggtggt

SEQ ID NO: 483038 - DNA, 25 bp, Homo sapien
ggtagtaaaacacagagggccagta

SEQ ID NO: 483039 - DNA, 25 bp, Homo sapien
cagagggccagtaacgggtcgtaat

SEQ ID NO: 483040 - DNA, 25 bp, Homo sapien
gccagtaacgggtcgtaatgactta

SEQ ID NO: 483041 - DNA, 25 bp, Homo sapien
gggtcgtaatgacttattgtggata

SEQ ID NO: 483042 - DNA, 25 bp, Homo sapien
atgatagatttgacctcctccctgt

SEQ ID NO: 483043 - DNA, 25 bp, Homo sapien
gatttgacctcctccctgttatttt

SEQ ID NO: 483044 - DNA, 25 bp, Homo sapien
tgacctcattaaccgatgctttacc

SEQ ID NO: 483045 - DNA, 25 bp, Homo sapien
taaccgatgctttaccaaacagcaa

SEQ ID NO: 483046 - DNA, 25 bp, Homo sapien
accaagagattgctaattgctgttg

SEQ ID NO: 483047 - DNA, 25 bp, Homo sapien
agagattgctaattgctgttgaaag

SEQ ID NO: 483048 - DNA, 25 bp, Homo sapien
gaatagacccatctgcagaggatca

SEQ ID NO: 483049 - DNA, 25 bp, Homo sapien
gtctaagatgccttcacaaactttg

SEQ ID NO: 483050 - DNA, 25 bp, Homo sapien
cacaaactttgtccatgagaactct

SEQ ID NO: 483051 - DNA, 25 bp, Homo sapien
gagaactcttaaggatttcaccaga

SEQ ID NO: 483052 - DNA, 25 bp, Homo sapien
atttcaccagacctgttggctgctg

SEQ ID NO: 483053 - DNA, 25 bp, Homo sapien
tgctgtgatctctgcccaagaggag

SEQ ID NO: 483054 - DNA, 25 bp, Homo sapien
aagaggagcctctgaccaacatcca

SEQ ID NO: 483055 - DNA, 25 bp, Homo sapien
aaagggcttctggacccactggact

SEQ ID NO: 483056 - DNA, 25 bp, Homo sapien
cactggactcctctggaggtacctt

SEQ ID NO: 483057 - DNA, 25 bp, Homo sapien
tagtctcccgatccatggctgtgtt

SEQ ID NO: 483058 - DNA, 25 bp, Homo sapien
ctttatcgctgcctgtgtgtagaat

SEQ ID NO: 483059 - DNA, 25 bp, Homo sapien
ctggtgctggtcattgtcggcctct

SEQ ID NO: 483060 - DNA, 25 bp, Homo sapien
tgctggtcattgtcggcctctgtct

SEQ ID NO: 483061 - DNA, 25 bp, Homo sapien
tcattgtcggcctctgtctctggct

SEQ ID NO: 483062 - DNA, 25 bp, Homo sapien
gcctccaaggaacctgacaaccatg

SEQ ID NO: 483063 - DNA, 25 bp, Homo sapien
tccaaggaacctgacaaccatgtgt

SEQ ID NO: 483064 - DNA, 25 bp, Homo sapien
aaggaacctgacaaccatgtgtaca

SEQ ID NO: 483065 - DNA, 25 bp, Homo sapien
ggaacctgacaaccatgtgtacacc

SEQ ID NO: 483066 - DNA, 25 bp, Homo sapien
aacctgacaaccatgtgtacaccag

SEQ ID NO: 483067 - DNA, 25 bp, Homo sapien
gtggccgcggatgccaagcagtgct

SEQ ID NO: 483068 - DNA, 25 bp, Homo sapien
caccaaatcctcctgtctttcgtgg

SEQ ID NO: 483069 - DNA, 25 bp, Homo sapien
aaatcctcctgtctttcgtggccaa

SEQ ID NO: 483070 - DNA, 25 bp, Homo sapien
ggaagctcagaaaagcataaagaca

SEQ ID NO: 483071 - DNA, 25 bp, Homo sapien
aagaggaaaaggttcgagcctctgg

SEQ ID NO: 483072 - DNA, 25 bp, Homo sapien
aaggttcgagcctctggggatgcaa

SEQ ID NO: 483073 - DNA, 25 bp, Homo sapien
aaggaaaatggcttctctagtccac

SEQ ID NO: 483074 - DNA, 25 bp, Homo sapien
ggaaaatggcttctctagtccacca

SEQ ID NO: 483075 - DNA, 25 bp, Homo sapien
aaatggcttctctagtccaccacaa

SEQ ID NO: 483076 - DNA, 25 bp, Homo sapien
gcttctctagtccaccacaaattaa

SEQ ID NO: 483077 - DNA, 25 bp, Homo sapien
ctagtccaccacaaattaaagatga

SEQ ID NO: 483078 - DNA, 25 bp, Homo sapien
attttgttcctcctaaagaggatat

SEQ ID NO: 483079 - DNA, 25 bp, Homo sapien
taaagccattaaagagacctcgaga

SEQ ID NO: 483080 - DNA, 25 bp, Homo sapien
aaagagacctcgagatgaggatgat

SEQ ID NO: 483081 - DNA, 25 bp, Homo sapien
tcacgcactagaaattaactgcaag

SEQ ID NO: 483082 - DNA, 25 bp, Homo sapien
aattaactgcaagattggctgaagt

SEQ ID NO: 483083 - DNA, 25 bp, Homo sapien
aagttcatttgtaacctggtcaggc

SEQ ID NO: 483084 - DNA, 25 bp, Homo sapien
tcatttgtaacctggtcaggcccag

SEQ ID NO: 483085 - DNA, 25 bp, Homo sapien
gcactggccccttcaccaaagggaa

SEQ ID NO: 483086 - DNA, 25 bp, Homo sapien
taagctgttggagtggattgcacca

SEQ ID NO: 483087 - DNA, 25 bp, Homo sapien
gggctggatcttgacatggaccgta

SEQ ID NO: 483088 - DNA, 25 bp, Homo sapien
gatcttgacatggaccgtatgcctc

SEQ ID NO: 483089 - DNA, 25 bp, Homo sapien
ggaccgtatgcctccagaattctct

SEQ ID NO: 483090 - DNA, 25 bp, Homo sapien
tctccccggtcaaggctgaaattta

SEQ ID NO: 483091 - DNA, 25 bp, Homo sapien
ggtcaaggctgaaatttactcctgg

SEQ ID NO: 483092 - DNA, 25 bp, Homo sapien
agccacatatactatatttcagcaa

SEQ ID NO: 483093 - DNA, 25 bp, Homo sapien
gccacatatactatatttcagcaaa

SEQ ID NO: 483094 - DNA, 25 bp, Homo sapien
ccacatatactatatttcagcaaaa

SEQ ID NO: 483095 - DNA, 25 bp, Homo sapien
cacatatactatatttcagcaaaat

SEQ ID NO: 483096 - DNA, 25 bp, Homo sapien
atttcagcaaaatattctatacaat

SEQ ID NO: 483097 - DNA, 25 bp, Homo sapien
tttcagcaaaatattctatacaata

SEQ ID NO: 483098 - DNA, 25 bp, Homo sapien
ttcagcaaaatattctatacaatag

SEQ ID NO: 483099 - DNA, 25 bp, Homo sapien
tcagcaaaatattctatacaataga

SEQ ID NO: 483100 - DNA, 25 bp, Homo sapien
cagcaaaatattctatacaatagag

SEQ ID NO: 483101 - DNA, 25 bp, Homo sapien
tctatacaatagagtttaatacaac

SEQ ID NO: 483102 - DNA, 25 bp, Homo sapien
atagagtttaatacaactttttgca

SEQ ID NO: 483103 - DNA, 25 bp, Homo sapien
accacctggagccaaaagcctcttt

SEQ ID NO: 483104 - DNA, 25 bp, Homo sapien
cacctggagccaaaagcctcttttc

SEQ ID NO: 483105 - DNA, 25 bp, Homo sapien
tccctctggccagagcctcagagtg

SEQ ID NO: 483106 - DNA, 25 bp, Homo sapien
cctcagagtgggaaagggaatccct

SEQ ID NO: 483107 - DNA, 25 bp, Homo sapien
caaggaggttttctctcagccgccc

SEQ ID NO: 483108 - DNA, 25 bp, Homo sapien
tccttcagaactgacatggctcctg

SEQ ID NO: 483109 - DNA, 25 bp, Homo sapien
ttcagaactgacatggctcctgcct

SEQ ID NO: 483110 - DNA, 25 bp, Homo sapien
tcagaactgacatggctcctgcctc

SEQ ID NO: 483111 - DNA, 25 bp, Homo sapien
ttgtctttattcatctttccggatc

SEQ ID NO: 483112 - DNA, 25 bp, Homo sapien
gtctttattcatctttccggatctt

SEQ ID NO: 483113 - DNA, 25 bp, Homo sapien
tctttattcatctttccggatcttg

SEQ ID NO: 483114 - DNA, 25 bp, Homo sapien
gctcctgtcagcagatgccgacggg

SEQ ID NO: 483115 - DNA, 25 bp, Homo sapien
atgccgacgggcagatcaagtgctg

SEQ ID NO: 483116 - DNA, 25 bp, Homo sapien
aagtgctggagcatggcggaccacc

SEQ ID NO: 483117 - DNA, 25 bp, Homo sapien
ggagcatggcggaccacctggctaa

SEQ ID NO: 483118 - DNA, 25 bp, Homo sapien
gaccacctggctaatagctgggaga

SEQ ID NO: 483119 - DNA, 25 bp, Homo sapien
gggaccccattgtggccctgtcctg

SEQ ID NO: 483120 - DNA, 25 bp, Homo sapien
ctgtcctggctgcacaatggtgtga

SEQ ID NO: 483121 - DNA, 25 bp, Homo sapien
cacgtggagaagtcgggcgcctcca

SEQ ID NO: 483122 - DNA, 25 bp, Homo sapien
agaagttctcccgagtcaagttctc

SEQ ID NO: 483123 - DNA, 25 bp, Homo sapien
gagtcaagttctcaccgtcgctcac

SEQ ID NO: 483124 - DNA, 25 bp, Homo sapien
gtcgctcacgctgttcggcggcaag

SEQ ID NO: 483125 - DNA, 25 bp, Homo sapien
catagtgttaggtggcagataggct

SEQ ID NO: 483126 - DNA, 25 bp, Homo sapien
gctagtattgtaaaggaacactgat

SEQ ID NO: 483127 - DNA, 25 bp, Homo sapien
aacactgatgtgtactggagcctac

SEQ ID NO: 483128 - DNA, 25 bp, Homo sapien
tgatgtgtactggagcctactagct

SEQ ID NO: 483129 - DNA, 25 bp, Homo sapien
gtactggagcctactagctctcaat

SEQ ID NO: 483130 - DNA, 25 bp, Homo sapien
agcctactagctctcaatccattgc

SEQ ID NO: 483131 - DNA, 25 bp, Homo sapien
gagagagcacattctctatccagag

SEQ ID NO: 483132 - DNA, 25 bp, Homo sapien
gagcacattctctatccagagaaat

SEQ ID NO: 483133 - DNA, 25 bp, Homo sapien
agaatatgcagtttatggttgtcct

SEQ ID NO: 483134 - DNA, 25 bp, Homo sapien
tgcagtttatggttgtcctgtggac

SEQ ID NO: 483135 - DNA, 25 bp, Homo sapien
gatgatcatatttacttccctcctc

SEQ ID NO: 483136 - DNA, 25 bp, Homo sapien
gaagtcacttagtgttgtgaaggtg

SEQ ID NO: 483137 - DNA, 25 bp, Homo sapien
tgggaagactcaccacatactcatc

SEQ ID NO: 483138 - DNA, 25 bp, Homo sapien
atcctcatctggaactccagtgtta

SEQ ID NO: 483139 - DNA, 25 bp, Homo sapien
agtgttagggtcacagtcccggact

SEQ ID NO: 483140 - DNA, 25 bp, Homo sapien
gcagctaaaggagcctgcaactgga

SEQ ID NO: 483141 - DNA, 25 bp, Homo sapien
gaagggaggcaaacctgcatcagtg

SEQ ID NO: 483142 - DNA, 25 bp, Homo sapien
gagtgcaagggagacgtttccatca

SEQ ID NO: 483143 - DNA, 25 bp, Homo sapien
aagggagacgtttccatcatttctt

SEQ ID NO: 483144 - DNA, 25 bp, Homo sapien
tttcttaggaagtgccatctgtact

SEQ ID NO: 483145 - DNA, 25 bp, Homo sapien
taggaagtgccatctgtactcagca

SEQ ID NO: 483146 - DNA, 25 bp, Homo sapien
tgccatctgtactcagcactgtgtt

SEQ ID NO: 483147 - DNA, 25 bp, Homo sapien
tctctctgtcagtgtgttatcggtg

SEQ ID NO: 483148 - DNA, 25 bp, Homo sapien
tctgtcagtgtgttatcggtgtgga

SEQ ID NO: 483149 - DNA, 25 bp, Homo sapien
ttatcggtgtggagcggaggccgcg

SEQ ID NO: 483150 - DNA, 25 bp, Homo sapien
cggaggccgcggaggctcctcggtc

SEQ ID NO: 483151 - DNA, 25 bp, Homo sapien
gtatgttgggacaaacacgctgttg

SEQ ID NO: 483152 - DNA, 25 bp, Homo sapien
gttgggacaaacacgctgttgctaa

SEQ ID NO: 483153 - DNA, 25 bp, Homo sapien
gggacaaacacgctgttgctaaatg

SEQ ID NO: 483154 - DNA, 25 bp, Homo sapien
aaacacgctgttgctaaatggaaac

SEQ ID NO: 483155 - DNA, 25 bp, Homo sapien
cacgctgttgctaaatggaaacact

SEQ ID NO: 483156 - DNA, 25 bp, Homo sapien
tggaaacactgacctcacagtgcat

SEQ ID NO: 483157 - DNA, 25 bp, Homo sapien
aaacactgacctcacagtgcatcct

SEQ ID NO: 483158 - DNA, 25 bp, Homo sapien
agtaccttgatcttatgctttctga

SEQ ID NO: 483159 - DNA, 25 bp, Homo sapien
atgctttctgagtgtcctgccttgt

SEQ ID NO: 483160 - DNA, 25 bp, Homo sapien
gttgccatctgcatggatgagtgaa

SEQ ID NO: 483161 - DNA, 25 bp, Homo sapien
aatgcttctatgcacgaggagactc

SEQ ID NO: 483162 - DNA, 25 bp, Homo sapien
actcaagccaactcagagtctgctt

SEQ ID NO: 483163 - DNA, 25 bp, Homo sapien
tcccaggtttcttttgcaaagcttg

SEQ ID NO: 483164 - DNA, 25 bp, Homo sapien
aaagcttggtcatttggcccaggtc

SEQ ID NO: 483165 - DNA, 25 bp, Homo sapien
gtcttcctggaaagtggagtacatg

SEQ ID NO: 483166 - DNA, 25 bp, Homo sapien
tacatgtcactgactagggtggcgt

SEQ ID NO: 483167 - DNA, 25 bp, Homo sapien
aagtcttgttacctcagtgatgtga

SEQ ID NO: 483168 - DNA, 25 bp, Homo sapien
taaaaagcatccttgctggttcttc

SEQ ID NO: 483169 - DNA, 25 bp, Homo sapien
tgcccagaatgtgaccgtggacgag

SEQ ID NO: 483170 - DNA, 25 bp, Homo sapien
tggacgaggtcatcggcgcctacaa

SEQ ID NO: 483171 - DNA, 25 bp, Homo sapien
tgaactgcaggcagatccccaagct

SEQ ID NO: 483172 - DNA, 25 bp, Homo sapien
tcaggcagctgcaggaattcacaga

SEQ ID NO: 483173 - DNA, 25 bp, Homo sapien
gcctcgactgtctggacctgaaagg

SEQ ID NO: 483174 - DNA, 25 bp, Homo sapien
ctacaagacctgtgaggccctggaa

SEQ ID NO: 483175 - DNA, 25 bp, Homo sapien
aggctgcagttcaaggtcgtggacc

SEQ ID NO: 483176 - DNA, 25 bp, Homo sapien
gacctggagcagacaaacctggatg

SEQ ID NO: 483177 - DNA, 25 bp, Homo sapien
tggatgaagatggtgcctcggccct

SEQ ID NO: 483178 - DNA, 25 bp, Homo sapien
ggccctcttcgacatgatcgagtac

SEQ ID NO: 483179 - DNA, 25 bp, Homo sapien
atgatcgagtactacgagtcggcca

SEQ ID NO: 483180 - DNA, 25 bp, Homo sapien
ttcctgttactaatgattgggccat

SEQ ID NO: 483181 - DNA, 25 bp, Homo sapien
attgggccatgcatatttaaccttg

SEQ ID NO: 483182 - DNA, 25 bp, Homo sapien
atatttaaccttgtatcccgcttca

SEQ ID NO: 483183 - DNA, 25 bp, Homo sapien
ttgtatcccgcttcatttcccaaag

SEQ ID NO: 483184 - DNA, 25 bp, Homo sapien
tttcccaaaggctgaattgttttat

SEQ ID NO: 483185 - DNA, 25 bp, Homo sapien
attgttttatccaggcaagcatgca

SEQ ID NO: 483186 - DNA, 25 bp, Homo sapien
ggcaagcatgcaaaaacacattgat

SEQ ID NO: 483187 - DNA, 25 bp, Homo sapien
gaggaaaccattcggaagctccaga

SEQ ID NO: 483188 - DNA, 25 bp, Homo sapien
gaagctccagaacccaggccctaat

SEQ ID NO: 483189 - DNA, 25 bp, Homo sapien
agccagatgatcaacgacgcccttt

SEQ ID NO: 483190 - DNA, 25 bp, Homo sapien
ataagaatgttagcccaaactgcac

SEQ ID NO: 483191 - DNA, 25 bp, Homo sapien
aagacgtccgactgtacccagaggt

SEQ ID NO: 483192 - DNA, 25 bp, Homo sapien
acccagaggtgcctgaggtcctaaa

SEQ ID NO: 483193 - DNA, 25 bp, Homo sapien
ggtcctaaaacgattgcagagcctt

SEQ ID NO: 483194 - DNA, 25 bp, Homo sapien
tactggagctctttgacctcttcag

SEQ ID NO: 483195 - DNA, 25 bp, Homo sapien
gttcatcgggaaatctatccaggca

SEQ ID NO: 483196 - DNA, 25 bp, Homo sapien
gggaaatctatccaggcagcaagat

SEQ ID NO: 483197 - DNA, 25 bp, Homo sapien
ggcagcaagatcacacactttgaga

SEQ ID NO: 483198 - DNA, 25 bp, Homo sapien
ccatcactgctcttatggaacggag

SEQ ID NO: 483199 - DNA, 25 bp, Homo sapien
cttatggaacggagggtctacgtgc

SEQ ID NO: 483200 - DNA, 25 bp, Homo sapien
gtctacgtgcgtgtcgacccagaaa

SEQ ID NO: 483201 - DNA, 25 bp, Homo sapien
gtgtcgacccagaaaggccagagag

SEQ ID NO: 483202 - DNA, 25 bp, Homo sapien
taaaacatgacatcaggctcgtctg

SEQ ID NO: 483203 - DNA, 25 bp, Homo sapien
tgacatcaggctcgtctgaagttct

SEQ ID NO: 483204 - DNA, 25 bp, Homo sapien
gaagttcttgtgtgaaattcctagt

SEQ ID NO: 483205 - DNA, 25 bp, Homo sapien
tcagcttaaagccatctgcagagtg

SEQ ID NO: 483206 - DNA, 25 bp, Homo sapien
agagtggcccctcattgtggtcttt

SEQ ID NO: 483207 - DNA, 25 bp, Homo sapien
cattgtggtcttttgctgggaccaa

SEQ ID NO: 483208 - DNA, 25 bp, Homo sapien
gctgggaccaatgcaagagactagg

SEQ ID NO: 483209 - DNA, 25 bp, Homo sapien
gtttgcttatggctagagactatat

SEQ ID NO: 483210 - DNA, 25 bp, Homo sapien
gagactatatccagccctaatgatg

SEQ ID NO: 483211 - DNA, 25 bp, Homo sapien
atgaattttcacctgatgaccgtta

SEQ ID NO: 483212 - DNA, 25 bp, Homo sapien
cctgatgaccgttatattggtttgt

SEQ ID NO: 483213 - DNA, 25 bp, Homo sapien
gagctgttttgtgatttaaaggttt

SEQ ID NO: 483214 - DNA, 25 bp, Homo sapien
tttctctaaccaaactgcttgatcc

SEQ ID NO: 483215 - DNA, 25 bp, Homo sapien
aaccaaactgcttgatccagatgca

SEQ ID NO: 483216 - DNA, 25 bp, Homo sapien
aaactgcttgatccagatgcaggac

SEQ ID NO: 483217 - DNA, 25 bp, Homo sapien
gcttgatccagatgcaggactgcaa

SEQ ID NO: 483218 - DNA, 25 bp, Homo sapien
atccagatgcaggactgcaaatgtt

SEQ ID NO: 483219 - DNA, 25 bp, Homo sapien
aaaggaatggccacaatccacctga

SEQ ID NO: 483220 - DNA, 25 bp, Homo sapien
aggaatggccacaatccacctgaaa

SEQ ID NO: 483221 - DNA, 25 bp, Homo sapien
gtgtgcagcctactaaatcagaatg

SEQ ID NO: 483222 - DNA, 25 bp, Homo sapien
gcagcctactaaatcagaatgaaaa

SEQ ID NO: 483223 - DNA, 25 bp, Homo sapien
tcagtgtcagctatgacaattgaaa

SEQ ID NO: 483224 - DNA, 25 bp, Homo sapien
actctattaaactgggcctctgctt

SEQ ID NO: 483225 - DNA, 25 bp, Homo sapien
tctgcttttggaactcaggaaatgg

SEQ ID NO: 483226 - DNA, 25 bp, Homo sapien
gaggtcaaaggtcatcatcattaca

SEQ ID NO: 483227 - DNA, 25 bp, Homo sapien
atgctgcatgttttggaagacctca

SEQ ID NO: 483228 - DNA, 25 bp, Homo sapien
agacctcaagtagcaaagactctgt

SEQ ID NO: 483229 - DNA, 25 bp, Homo sapien
aagactctgttacggcatggtgcaa

SEQ ID NO: 483230 - DNA, 25 bp, Homo sapien
gcatggtgcaaatccagatctgaga

SEQ ID NO: 483231 - DNA, 25 bp, Homo sapien
ggaaaactccattagataaagctcg

SEQ ID NO: 483232 - DNA, 25 bp, Homo sapien
aagtggtagctattcttcagtctcc

SEQ ID NO: 483233 - DNA, 25 bp, Homo sapien
tattcttcagtctccaggtgattgg

SEQ ID NO: 483234 - DNA, 25 bp, Homo sapien
ccaggtgattggatgtgtccagtta

SEQ ID NO: 483235 - DNA, 25 bp, Homo sapien
tgaagcccgagttcgccctggcact

SEQ ID NO: 483236 - DNA, 25 bp, Homo sapien
aactgagctgctccaagaacgagaa

SEQ ID NO: 483237 - DNA, 25 bp, Homo sapien
ctgagctgctccaagaacgagaagg

SEQ ID NO: 483238 - DNA, 25 bp, Homo sapien
tggaagccagtcaggaatccgggca

SEQ ID NO: 483239 - DNA, 25 bp, Homo sapien
gacactgtgacactttagttccctt

SEQ ID NO: 483240 - DNA, 25 bp, Homo sapien
actgtgacactttagttcccttttg

SEQ ID NO: 483241 - DNA, 25 bp, Homo sapien
tgacactttagttcccttttgccgg

SEQ ID NO: 483242 - DNA, 25 bp, Homo sapien
ttttgccggtcggtttgcgatgagt

SEQ ID NO: 483243 - DNA, 25 bp, Homo sapien
cggtttgcgatgagtgaggcccaga

SEQ ID NO: 483244 - DNA, 25 bp, Homo sapien
gaggcccagagccatgagaatctgc

SEQ ID NO: 483245 - DNA, 25 bp, Homo sapien
agccatgagaatctgctcaccttgc

SEQ ID NO: 483246 - DNA, 25 bp, Homo sapien
aatttaccatctaattggcatccgt

SEQ ID NO: 483247 - DNA, 25 bp, Homo sapien
attggcatccgtactgtgcattgat

SEQ ID NO: 483248 - DNA, 25 bp, Homo sapien
tccaaatcatcttattcttccatag

SEQ ID NO: 483249 - DNA, 25 bp, Homo sapien
gaggaagcgctcatataaatcacat

SEQ ID NO: 483250 - DNA, 25 bp, Homo sapien
taaatcacattgctgagaactatat

SEQ ID NO: 483251 - DNA, 25 bp, Homo sapien
ctacatagaggtaaatggtgcttat

SEQ ID NO: 483252 - DNA, 25 bp, Homo sapien
gagtatagtttgttacttgctggaa

SEQ ID NO: 483253 - DNA, 25 bp, Homo sapien
acttgctggaagtcttctagttcat

SEQ ID NO: 483254 - DNA, 25 bp, Homo sapien
catttggaccattttcttaccctga

SEQ ID NO: 483255 - DNA, 25 bp, Homo sapien
ttaccctgaggtgaactcaatatct

SEQ ID NO: 483256 - DNA, 25 bp, Homo sapien
ggtgaactcaatatctgttggcaat

SEQ ID NO: 483257 - DNA, 25 bp, Homo sapien
aagacgtccgactgtacccagaggt

SEQ ID NO: 483258 - DNA, 25 bp, Homo sapien
gactgtacccagaggtgcctgaggt

SEQ ID NO: 483259 - DNA, 25 bp, Homo sapien
gtacccagaggtgcctgaggtccta

SEQ ID NO: 483260 - DNA, 25 bp, Homo sapien
cccagaggtgcctgaggtcctaaaa

SEQ ID NO: 483261 - DNA, 25 bp, Homo sapien
aggtgcctgaggtcctaaaacgatt

SEQ ID NO: 483262 - DNA, 25 bp, Homo sapien
ggtcctaaaacgattgcagagcctt

SEQ ID NO: 483263 - DNA, 25 bp, Homo sapien
cctaaaacgattgcagagccttggg

SEQ ID NO: 483264 - DNA, 25 bp, Homo sapien
tgcttcaaggacaagtgagatagaa

SEQ ID NO: 483265 - DNA, 25 bp, Homo sapien
gggccaaccagctactggagctctt

SEQ ID NO: 483266 - DNA, 25 bp, Homo sapien
agctactggagctctttgacctctt

SEQ ID NO: 483267 - DNA, 25 bp, Homo sapien
tactggagctctttgacctcttcag

SEQ ID NO: 483268 - DNA, 25 bp, Homo sapien
aaaatgggtcagatagctttggcca

SEQ ID NO: 483269 - DNA, 25 bp, Homo sapien
ggcctatgacacttagtgcccttag

SEQ ID NO: 483270 - DNA, 25 bp, Homo sapien
cacttagtgcccttagatgggatac

SEQ ID NO: 483271 - DNA, 25 bp, Homo sapien
agatgggatacatcttgcctcggcc

SEQ ID NO: 483272 - DNA, 25 bp, Homo sapien
gatacatcttgcctcggccccaaga

SEQ ID NO: 483273 - DNA, 25 bp, Homo sapien
cctgcacagcttagagaggctcaca

SEQ ID NO: 483274 - DNA, 25 bp, Homo sapien
gaggctcacagcttggcaaatgcta

SEQ ID NO: 483275 - DNA, 25 bp, Homo sapien
aaagctccatggaaacaggcacctg

SEQ ID NO: 483276 - DNA, 25 bp, Homo sapien
caggcacctggtagctgcggaacac

SEQ ID NO: 483277 - DNA, 25 bp, Homo sapien
tgcggaacacccgtggacttgtgta

SEQ ID NO: 483278 - DNA, 25 bp, Homo sapien
cacccgtggacttgtgtatatggtc

SEQ ID NO: 483279 - DNA, 25 bp, Homo sapien
tgtggcctgacgggcccccaaaagt

SEQ ID NO: 483280 - DNA, 25 bp, Homo sapien
tgtatggagaagggaccagcaccca

SEQ ID NO: 483281 - DNA, 25 bp, Homo sapien
ggaccagcacccatgccacagttta

SEQ ID NO: 483282 - DNA, 25 bp, Homo sapien
agcacccatgccacagtttacagct

SEQ ID NO: 483283 - DNA, 25 bp, Homo sapien
acccatgccacagtttacagctaag

SEQ ID NO: 483284 - DNA, 25 bp, Homo sapien
ccatgccacagtttacagctaagta

SEQ ID NO: 483285 - DNA, 25 bp, Homo sapien
tgccacagtttacagctaagtaatt

SEQ ID NO: 483286 - DNA, 25 bp, Homo sapien
cagctaagtaattgttactcctttt

SEQ ID NO: 483287 - DNA, 25 bp, Homo sapien
ctcctttttacctgacgtaggcctg

SEQ ID NO: 483288 - DNA, 25 bp, Homo sapien
tcctttttacctgacgtaggcctgt

SEQ ID NO: 483289 - DNA, 25 bp, Homo sapien
ttacctgacgtaggcctgtaaaaga

SEQ ID NO: 483290 - DNA, 25 bp, Homo sapien
tgtgctcgggcgctagcggtcggcg

SEQ ID NO: 483291 - DNA, 25 bp, Homo sapien
cgggcgctagcggtcggcgggcagg

SEQ ID NO: 483292 - DNA, 25 bp, Homo sapien
aggcggacgacgagcgtagcgagct

SEQ ID NO: 483293 - DNA, 25 bp, Homo sapien
acgtggagacggacactgagggcgc

SEQ ID NO: 483294 - DNA, 25 bp, Homo sapien
tggagacggacactgagggcgcggc

SEQ ID NO: 483295 - DNA, 25 bp, Homo sapien
agacggacactgagggcgcggcggg

SEQ ID NO: 483296 - DNA, 25 bp, Homo sapien
tccttcagctcgcaccacctcatgc

SEQ ID NO: 483297 - DNA, 25 bp, Homo sapien
tcatgccctgcgacactctggcgcg

SEQ ID NO: 483298 - DNA, 25 bp, Homo sapien
tcggcgtcgtccagcagccaggagt

SEQ ID NO: 483299 - DNA, 25 bp, Homo sapien
gcgtcgtccagcagccaggagtcgc

SEQ ID NO: 483300 - DNA, 25 bp, Homo sapien
tcgtccagcagccaggagtcgctgc

SEQ ID NO: 483301 - DNA, 25 bp, Homo sapien
aagaatttatacttgtgagaaactc

SEQ ID NO: 483302 - DNA, 25 bp, Homo sapien
agaatttatacttgtgagaaactct

SEQ ID NO: 483303 - DNA, 25 bp, Homo sapien
gaatttatacttgtgagaaactcta

SEQ ID NO: 483304 - DNA, 25 bp, Homo sapien
taaaaaagattatgctcgagagaaa

SEQ ID NO: 483305 - DNA, 25 bp, Homo sapien
aaaaaagattatgctcgagagaaac

SEQ ID NO: 483306 - DNA, 25 bp, Homo sapien
aaaaagattatgctcgagagaaacc

SEQ ID NO: 483307 - DNA, 25 bp, Homo sapien
aaaagattatgctcgagagaaacca

SEQ ID NO: 483308 - DNA, 25 bp, Homo sapien
aaagattatgctcgagagaaaccat

SEQ ID NO: 483309 - DNA, 25 bp, Homo sapien
aagattatgctcgagagaaaccata

SEQ ID NO: 483310 - DNA, 25 bp, Homo sapien
agattatgctcgagagaaaccatac

SEQ ID NO: 483311 - DNA, 25 bp, Homo sapien
gattatgctcgagagaaaccataca

SEQ ID NO: 483312 - DNA, 25 bp, Homo sapien
agccgggtgcgaggaggagcatgca

SEQ ID NO: 483313 - DNA, 25 bp, Homo sapien
gagcatgcacggaccaagcgcggca

SEQ ID NO: 483314 - DNA, 25 bp, Homo sapien
catgcacggaccaagcgcggcaggc

SEQ ID NO: 483315 - DNA, 25 bp, Homo sapien
agcctggttggcctttcttatttat

SEQ ID NO: 483316 - DNA, 25 bp, Homo sapien
ctggttggcctttcttatttatata

SEQ ID NO: 483317 - DNA, 25 bp, Homo sapien
gttggcctttcttatttatatagag

SEQ ID NO: 483318 - DNA, 25 bp, Homo sapien
gagaacacttcacttttttgtacat

SEQ ID NO: 483319 - DNA, 25 bp, Homo sapien
aagcctgggtgtggcccggtggtgg

SEQ ID NO: 483320 - DNA, 25 bp, Homo sapien
gtggtgcactggtgacttcatggcc

SEQ ID NO: 483321 - DNA, 25 bp, Homo sapien
tgcactggtgacttcatggccacgc

SEQ ID NO: 483322 - DNA, 25 bp, Homo sapien
ggacgcacttgggactcctcgagag

SEQ ID NO: 483323 - DNA, 25 bp, Homo sapien
gactgtagttctggacaaggtggaa

SEQ ID NO: 483324 - DNA, 25 bp, Homo sapien
gttctggacaaggtggaaaactctt

SEQ ID NO: 483325 - DNA, 25 bp, Homo sapien
ggcaagtgctctgacaggctaggat

SEQ ID NO: 483326 - DNA, 25 bp, Homo sapien
gtagaatgttaacagttcagactca

SEQ ID NO: 483327 - DNA, 25 bp, Homo sapien
gttaacagttcagactcaaaccttg

SEQ ID NO: 483328 - DNA, 25 bp, Homo sapien
aaggaaatccctcacagcaactggc

SEQ ID NO: 483329 - DNA, 25 bp, Homo sapien
gcaactggcaccataatcaagacag

SEQ ID NO: 483330 - DNA, 25 bp, Homo sapien
ttttgcagaataaatggagttacct

SEQ ID NO: 483331 - DNA, 25 bp, Homo sapien
aaatggagttacctgctttcagccc

SEQ ID NO: 483332 - DNA, 25 bp, Homo sapien
tgctttcagccccaggtcgtagcta

SEQ ID NO: 483333 - DNA, 25 bp, Homo sapien
caggtcgtagctattgtctgccctg

SEQ ID NO: 483334 - DNA, 25 bp, Homo sapien
ggcaaagtgatcgtccaaactcaaa

SEQ ID NO: 483335 - DNA, 25 bp, Homo sapien
acaaagcctatatgacaagtctcta

SEQ ID NO: 483336 - DNA, 25 bp, Homo sapien
gatttcatttgatcaggaagttaat

SEQ ID NO: 483337 - DNA, 25 bp, Homo sapien
tgaaatctactttatactctccttt

SEQ ID NO: 483338 - DNA, 25 bp, Homo sapien
atctccgtttatatgagttgcataa

SEQ ID NO: 483339 - DNA, 25 bp, Homo sapien
gttgcataagttaaggcactttcaa

SEQ ID NO: 483340 - DNA, 25 bp, Homo sapien
gtgtcaaggaatattcacggaaata

SEQ ID NO: 483341 - DNA, 25 bp, Homo sapien
ggaaatatttccagctatgtgtcgc

SEQ ID NO: 483342 - DNA, 25 bp, Homo sapien
gctatgtgtcgctaaaactgcattt

SEQ ID NO: 483343 - DNA, 25 bp, Homo sapien
tattttctgttctaagatcccttca

SEQ ID NO: 483344 - DNA, 25 bp, Homo sapien
tctgttctaagatcccttcattaac

SEQ ID NO: 483345 - DNA, 25 bp, Homo sapien
cacagcgtcctagggctgggtgtca

SEQ ID NO: 483346 - DNA, 25 bp, Homo sapien
gggtgtcaggctgttcaacagattt

SEQ ID NO: 483347 - DNA, 25 bp, Homo sapien
gtcaggctgttcaacagatttctga

SEQ ID NO: 483348 - DNA, 25 bp, Homo sapien
aggcgtgtgaccagcccttgtgaaa

SEQ ID NO: 483349 - DNA, 25 bp, Homo sapien
gtgtgaccagcccttgtgaaagagc

SEQ ID NO: 483350 - DNA, 25 bp, Homo sapien
gaccagcccttgtgaaagagccagt

SEQ ID NO: 483351 - DNA, 25 bp, Homo sapien
ccagtgtgtgatggctgagataatt

SEQ ID NO: 483352 - DNA, 25 bp, Homo sapien
gagataattacatagggccacaagc

SEQ ID NO: 483353 - DNA, 25 bp, Homo sapien
agggccacaagccagtgactgccaa

SEQ ID NO: 483354 - DNA, 25 bp, Homo sapien
gtgactgccaactgactcataggaa

SEQ ID NO: 483355 - DNA, 25 bp, Homo sapien
atgtggtcacagaggcagtagagtc

SEQ ID NO: 483356 - DNA, 25 bp, Homo sapien
tgctttcagccccaggtcgtagcta

SEQ ID NO: 483357 - DNA, 25 bp, Homo sapien
gctttcagccccaggtcgtagctat

SEQ ID NO: 483358 - DNA, 25 bp, Homo sapien
ctttcagccccaggtcgtagctatt

SEQ ID NO: 483359 - DNA, 25 bp, Homo sapien
tcagccccaggtcgtagctattgtc

SEQ ID NO: 483360 - DNA, 25 bp, Homo sapien
cagccccaggtcgtagctattgtct

SEQ ID NO: 483361 - DNA, 25 bp, Homo sapien
agccccaggtcgtagctattgtctg

SEQ ID NO: 483362 - DNA, 25 bp, Homo sapien
gccccaggtcgtagctattgtctgc

SEQ ID NO: 483363 - DNA, 25 bp, Homo sapien
ccccaggtcgtagctattgtctgcc

SEQ ID NO: 483364 - DNA, 25 bp, Homo sapien
cccaggtcgtagctattgtctgccc

SEQ ID NO: 483365 - DNA, 25 bp, Homo sapien
ccaggtcgtagctattgtctgccct

SEQ ID NO: 483366 - DNA, 25 bp, Homo sapien
caggtcgtagctattgtctgccctg

SEQ ID NO: 483367 - DNA, 25 bp, Homo sapien
tagcttgccacagcgcaacctcttc

SEQ ID NO: 483368 - DNA, 25 bp, Homo sapien
cgcaacctcttctgtccctttcagt

SEQ ID NO: 483369 - DNA, 25 bp, Homo sapien
gcatcaggctcacgggtgttcatgt

SEQ ID NO: 483370 - DNA, 25 bp, Homo sapien
tgtgtgcgtacgtgtatataactga

SEQ ID NO: 483371 - DNA, 25 bp, Homo sapien
gtgcgtacgtgtatataactgaagt

SEQ ID NO: 483372 - DNA, 25 bp, Homo sapien
gtacgtgtatataactgaagtgtct

SEQ ID NO: 483373 - DNA, 25 bp, Homo sapien
ataactgaagtgtctgtacggaatg

SEQ ID NO: 483374 - DNA, 25 bp, Homo sapien
ctagccatgggctggtcaccagatt

SEQ ID NO: 483375 - DNA, 25 bp, Homo sapien
tggtcaccagattgttttgtaatgc

SEQ ID NO: 483376 - DNA, 25 bp, Homo sapien
gtcaccagattgttttgtaatgccc

SEQ ID NO: 483377 - DNA, 25 bp, Homo sapien
accagattgttttgtaatgcccgcc

SEQ ID NO: 483378 - DNA, 25 bp, Homo sapien
cgattccggtcatcacccaaccatc

SEQ ID NO: 483379 - DNA, 25 bp, Homo sapien
ggcttgtaaagtgggcggcggccgg

SEQ ID NO: 483380 - DNA, 25 bp, Homo sapien
cggcggccggtgttcccacagctga

SEQ ID NO: 483381 - DNA, 25 bp, Homo sapien
ggccggtgttcccacagctgagtca

SEQ ID NO: 483382 - DNA, 25 bp, Homo sapien
cggtgttcccacagctgagtcacag

SEQ ID NO: 483383 - DNA, 25 bp, Homo sapien
aagtcccgggcctaagcgtgcagcg

SEQ ID NO: 483384 - DNA, 25 bp, Homo sapien
gggcctaagcgtgcagcggtcacaa

SEQ ID NO: 483385 - DNA, 25 bp, Homo sapien
gcctaagcgtgcagcggtcacaaga

SEQ ID NO: 483386 - DNA, 25 bp, Homo sapien
cagcggtcacaagagcggcagtgct

SEQ ID NO: 483387 - DNA, 25 bp, Homo sapien
tcacaagagcggcagtgctgtcccc

SEQ ID NO: 483388 - DNA, 25 bp, Homo sapien
agagcggcagtgctgtcccccgatt

SEQ ID NO: 483389 - DNA, 25 bp, Homo sapien
gcaatggataatgacggcctctagt

SEQ ID NO: 483390 - DNA, 25 bp, Homo sapien
gacggcctctagtggtagtttagct

SEQ ID NO: 483391 - DNA, 25 bp, Homo sapien
tagtggtagtttagctgcctccagc

SEQ ID NO: 483392 - DNA, 25 bp, Homo sapien
tgcctccagcggcttgtgtatgagt

SEQ ID NO: 483393 - DNA, 25 bp, Homo sapien
tttgccatttattatggcggttctt

SEQ ID NO: 483394 - DNA, 25 bp, Homo sapien
tatggcggttctttttgtagttaga

SEQ ID NO: 483395 - DNA, 25 bp, Homo sapien
cctgccagattacagtgtgagactg

SEQ ID NO: 483396 - DNA, 25 bp, Homo sapien
tgtgagactgtaggacatggtatgc

SEQ ID NO: 483397 - DNA, 25 bp, Homo sapien
tttccctttgctagagtgagggtct

SEQ ID NO: 483398 - DNA, 25 bp, Homo sapien
gttagggcaaatagttccgcttgtt

SEQ ID NO: 483399 - DNA, 25 bp, Homo sapien
ttccgcttgttgtgaggtgatatgt

SEQ ID NO: 483400 - DNA, 25 bp, Homo sapien
attatttatcacttttatgacccaa

SEQ ID NO: 483401 - DNA, 25 bp, Homo sapien
atcacttttatgacccaaatcacaa

SEQ ID NO: 483402 - DNA, 25 bp, Homo sapien
acttttatgacccaaatcacaataa

SEQ ID NO: 483403 - DNA, 25 bp, Homo sapien
ggagaatagactgaacatatggtta

SEQ ID NO: 483404 - DNA, 25 bp, Homo sapien
catatggttatattcacagttattt

SEQ ID NO: 483405 - DNA, 25 bp, Homo sapien
tgttattccaacattagagctaatg

SEQ ID NO: 483406 - DNA, 25 bp, Homo sapien
gatttaaactgtaacgtctaatatt

SEQ ID NO: 483407 - DNA, 25 bp, Homo sapien
attaaagtattagcactgtggttga

SEQ ID NO: 483408 - DNA, 25 bp, Homo sapien
tcttgaattatgttgcatcttgtac

SEQ ID NO: 483409 - DNA, 25 bp, Homo sapien
gaattatgttgcatcttgtactact

SEQ ID NO: 483410 - DNA, 25 bp, Homo sapien
atgttgcatcttgtactactaagct

SEQ ID NO: 483411 - DNA, 25 bp, Homo sapien
tccaggactacatcagcacgcagag

SEQ ID NO: 483412 - DNA, 25 bp, Homo sapien
acatcagcacgcagagtgctaagga

SEQ ID NO: 483413 - DNA, 25 bp, Homo sapien
agtgagggcttagggcactcacctc

SEQ ID NO: 483414 - DNA, 25 bp, Homo sapien
actcacctcctgtttccacaggaat

SEQ ID NO: 483415 - DNA, 25 bp, Homo sapien
gtttccacaggaatcttttggtcaa

SEQ ID NO: 483416 - DNA, 25 bp, Homo sapien
aggagaccctcctgttcttaactgt

SEQ ID NO: 483417 - DNA, 25 bp, Homo sapien
gttcttaactgtgggcgatgagaaa

SEQ ID NO: 483418 - DNA, 25 bp, Homo sapien
gtggtggactcttcttactggcagg

SEQ ID NO: 483419 - DNA, 25 bp, Homo sapien
ggactcttcttactggcagggccac

SEQ ID NO: 483420 - DNA, 25 bp, Homo sapien
ggtggctgaggtcctggaaggcaaa

SEQ ID NO: 483421 - DNA, 25 bp, Homo sapien
aggcgcaggcgcttctccaggacta

SEQ ID NO: 483422 - DNA, 25 bp, Homo sapien
taaagcgtccttccctcatgtataa

SEQ ID NO: 483423 - DNA, 25 bp, Homo sapien
tcatgtataactaccttctgggagg

SEQ ID NO: 483424 - DNA, 25 bp, Homo sapien
tgggagggagcctcgctaccctgaa

SEQ ID NO: 483425 - DNA, 25 bp, Homo sapien
tcgctaccctgaagcacaggacatt

SEQ ID NO: 483426 - DNA, 25 bp, Homo sapien
acaggacatttggtgatcagggaca

SEQ ID NO: 483427 - DNA, 25 bp, Homo sapien
gatcagggacacttaagcctcgcag

SEQ ID NO: 483428 - DNA, 25 bp, Homo sapien
aagcctcgcagctcagcaggtctgg

SEQ ID NO: 483429 - DNA, 25 bp, Homo sapien
gcaggtctgggctatgacactaagg

SEQ ID NO: 483430 - DNA, 25 bp, Homo sapien
aaggaattcttaccgctctttggag

SEQ ID NO: 483431 - DNA, 25 bp, Homo sapien
gggtctggcataagggtctagacaa

SEQ ID NO: 483432 - DNA, 25 bp, Homo sapien
ggacccagggttatttctcagaaat

SEQ ID NO: 483433 - DNA, 25 bp, Homo sapien
ttctctcttataatcaagtaactag

SEQ ID NO: 483434 - DNA, 25 bp, Homo sapien
tgaaatccaacataggcgctatatt

SEQ ID NO: 483435 - DNA, 25 bp, Homo sapien
ataggcgctatattacaaactgtgc

SEQ ID NO: 483436 - DNA, 25 bp, Homo sapien
gcgctatattacaaactgtgccgga

SEQ ID NO: 483437 - DNA, 25 bp, Homo sapien
tattacaaactgtgccggattatgc

SEQ ID NO: 483438 - DNA, 25 bp, Homo sapien
aactgtgccggattatgcaaattgt

SEQ ID NO: 483439 - DNA, 25 bp, Homo sapien
gtgccggattatgcaaattgtagtt

SEQ ID NO: 483440 - DNA, 25 bp, Homo sapien
gtagttgttactgatcaaagtttaa

SEQ ID NO: 483441 - DNA, 25 bp, Homo sapien
gttactgatcaaagtttaattgctt

SEQ ID NO: 483442 - DNA, 25 bp, Homo sapien
gtttaaaaagggatactgatgtcag

SEQ ID NO: 483443 - DNA, 25 bp, Homo sapien
gggatactgatgtcagaaaatctgt

SEQ ID NO: 483444 - DNA, 25 bp, Homo sapien
agcctttgtaggcaccgtaagtagg

SEQ ID NO: 483445 - DNA, 25 bp, Homo sapien
gtaagtagggctgcaggcatccctg

SEQ ID NO: 483446 - DNA, 25 bp, Homo sapien
gtgtctgacattctgtttcccaaga

SEQ ID NO: 483447 - DNA, 25 bp, Homo sapien
gtttcccaagagttcctgcggccgg

SEQ ID NO: 483448 - DNA, 25 bp, Homo sapien
gaggtcccagcatctcagataaaca

SEQ ID NO: 483449 - DNA, 25 bp, Homo sapien
gataaacacggtttgctttgtcagc

SEQ ID NO: 483450 - DNA, 25 bp, Homo sapien
tttgctttgtcagctgcgtctcagg

SEQ ID NO: 483451 - DNA, 25 bp, Homo sapien
gcgtctcaggtccacatagagcatg

SEQ ID NO: 483452 - DNA, 25 bp, Homo sapien
atagagcatggtgtctgggccttcc

SEQ ID NO: 483453 - DNA, 25 bp, Homo sapien
gccttgcctgtgcattttcagtgat

SEQ ID NO: 483454 - DNA, 25 bp, Homo sapien
aacatgctcgagttaggccagtgac

SEQ ID NO: 483455 - DNA, 25 bp, Homo sapien
gcaacatcaggcctgatttctccaa

SEQ ID NO: 483456 - DNA, 25 bp, Homo sapien
ctcccctggcctacgtgaagcggtg

SEQ ID NO: 483457 - DNA, 25 bp, Homo sapien
ctacgtgaagcggtggctttggacc

SEQ ID NO: 483458 - DNA, 25 bp, Homo sapien
agcctggtgaccgtgaaaatcgccc

SEQ ID NO: 483459 - DNA, 25 bp, Homo sapien
aaatcgccccgccagagagcagagg

SEQ ID NO: 483460 - DNA, 25 bp, Homo sapien
agagcagaggaagcccgacgcccag

SEQ ID NO: 483461 - DNA, 25 bp, Homo sapien
tgatgagaaacggagtggcctgttc

SEQ ID NO: 483462 - DNA, 25 bp, Homo sapien
ggagtggcctgttccgttgtgccca

SEQ ID NO: 483463 - DNA, 25 bp, Homo sapien
gttgtgcccaggtctaggccgctga

SEQ ID NO: 483464 - DNA, 25 bp, Homo sapien
tcactcccaggcagagttgtctgaa

SEQ ID NO: 483465 - DNA, 25 bp, Homo sapien
ggcagagttgtctgaatccttcctg

SEQ ID NO: 483466 - DNA, 25 bp, Homo sapien
acagcctcccgcaacaaagaattgc

SEQ ID NO: 483467 - DNA, 25 bp, Homo sapien
aagaattgcctggtccaaaatgggt

SEQ ID NO: 483468 - DNA, 25 bp, Homo sapien
ctgacttagaggcttagggagtttt

SEQ ID NO: 483469 - DNA, 25 bp, Homo sapien
aaatgacttgaagcgattgccacat

SEQ ID NO: 483470 - DNA, 25 bp, Homo sapien
gcgattgccacatgggttacacata

SEQ ID NO: 483471 - DNA, 25 bp, Homo sapien
atgtgtccatggcatacagttctga

SEQ ID NO: 483472 - DNA, 25 bp, Homo sapien
aatgagcgtcactcaatggtgacag

SEQ ID NO: 483473 - DNA, 25 bp, Homo sapien
caggaaactggaagcactgttaaaa

SEQ ID NO: 483474 - DNA, 25 bp, Homo sapien
gagggaagtggtgctcctacatcta

SEQ ID NO: 483475 - DNA, 25 bp, Homo sapien
gtggtgctcctacatctaatgcgag

SEQ ID NO: 483476 - DNA, 25 bp, Homo sapien
tgctaaacatcattcccacacagga

SEQ ID NO: 483477 - DNA, 25 bp, Homo sapien
cagctactgctgcatcagaagaaat

SEQ ID NO: 483478 - DNA, 25 bp, Homo sapien
gccaagagttgtaacctctgcacaa

SEQ ID NO: 483479 - DNA, 25 bp, Homo sapien
gaagaactattacagcccggatcac

SEQ ID NO: 483480 - DNA, 25 bp, Homo sapien
aatgggagtttctcctcccatgagc

SEQ ID NO: 483481 - DNA, 25 bp, Homo sapien
atgagctcagttgttgtggaaaaac

SEQ ID NO: 483482 - DNA, 25 bp, Homo sapien
gaaaaacatcatccagtcacagtgc

SEQ ID NO: 483483 - DNA, 25 bp, Homo sapien
gtcacagtgcaaaccattcctcaag

SEQ ID NO: 483484 - DNA, 25 bp, Homo sapien
aaaccattcctcaagcaactgcagc

SEQ ID NO: 483485 - DNA, 25 bp, Homo sapien
gcaactgcagcaaaatatccccgga

SEQ ID NO: 483486 - DNA, 25 bp, Homo sapien
tatccccggaccattcatcctgaaa

SEQ ID NO: 483487 - DNA, 25 bp, Homo sapien
tgaaagtagtacctcagcttccaga

SEQ ID NO: 483488 - DNA, 25 bp, Homo sapien
attgttgcaaaagtaatccatgtga

SEQ ID NO: 483489 - DNA, 25 bp, Homo sapien
catgtatctgactttctataacccc

SEQ ID NO: 483490 - DNA, 25 bp, Homo sapien
atccatgtgattgatgtttattatg

SEQ ID NO: 483491 - DNA, 25 bp, Homo sapien
tttaatacagatgaaccaggagaag

SEQ ID NO: 483492 - DNA, 25 bp, Homo sapien
gaatgtgtcctgtcaggcattcgtt

SEQ ID NO: 483493 - DNA, 25 bp, Homo sapien
tgtcctgtcaggcattcgtttatac

SEQ ID NO: 483494 - DNA, 25 bp, Homo sapien
gtcaggcattcgtttatacacacat

SEQ ID NO: 483495 - DNA, 25 bp, Homo sapien
caggcattcgtttatacacacatat

SEQ ID NO: 483496 - DNA, 25 bp, Homo sapien
gggcctccactcatgaggcatggga

SEQ ID NO: 483497 - DNA, 25 bp, Homo sapien
ctcatgaggcatgggaaggtgtttt

SEQ ID NO: 483498 - DNA, 25 bp, Homo sapien
ttgtttgaatgcagttgactttttt

SEQ ID NO: 483499 - DNA, 25 bp, Homo sapien
ccaggagctgggaaactctgggctc

SEQ ID NO: 483500 - DNA, 25 bp, Homo sapien
ggagataatgcaccaccagcctcaa

SEQ ID NO: 483501 - DNA, 25 bp, Homo sapien
gcaccaccagcctcaaaaaggagct

SEQ ID NO: 483502 - DNA, 25 bp, Homo sapien
aggagctgcccaagttgaatatgta

SEQ ID NO: 483503 - DNA, 25 bp, Homo sapien
gaatatgtagcaaagaccatgggat

SEQ ID NO: 483504 - DNA, 25 bp, Homo sapien
aagttgaatagtggccagacgaatc

SEQ ID NO: 483505 - DNA, 25 bp, Homo sapien
ggccagacgaatcactaataactca

SEQ ID NO: 483506 - DNA, 25 bp, Homo sapien
agcagatgccagcaacctactcatt

SEQ ID NO: 483507 - DNA, 25 bp, Homo sapien
ctactcattagtaccacccagtgat

SEQ ID NO: 483508 - DNA, 25 bp, Homo sapien
tagtaccacccagtgataaggcatc

SEQ ID NO: 483509 - DNA, 25 bp, Homo sapien
gtgataaggcatcccctgggctaga

SEQ ID NO: 483510 - DNA, 25 bp, Homo sapien
gaagttacacacattgctcccaaat

SEQ ID NO: 483511 - DNA, 25 bp, Homo sapien
ggaaatagaccacagtaccttacct

SEQ ID NO: 483512 - DNA, 25 bp, Homo sapien
agaccacagtaccttacctttcatt

SEQ ID NO: 483513 - DNA, 25 bp, Homo sapien
cttctttgcttcagtggttgaaaac

SEQ ID NO: 483514 - DNA, 25 bp, Homo sapien
gaaaacagttgccatattcaaagta

SEQ ID NO: 483515 - DNA, 25 bp, Homo sapien
gacaagtcccattttacaatcctag

SEQ ID NO: 483516 - DNA, 25 bp, Homo sapien
accaatttcatttcacgcgccaggg

SEQ ID NO: 483517 - DNA, 25 bp, Homo sapien
atttcacgcgccagggcggctgcag

SEQ ID NO: 483518 - DNA, 25 bp, Homo sapien
agccctctgctcactgaatgtcttg

SEQ ID NO: 483519 - DNA, 25 bp, Homo sapien
gaatgtcttgcatgtgctgactgct

SEQ ID NO: 483520 - DNA, 25 bp, Homo sapien
gactgctgcccgcagtgctgaacat

SEQ ID NO: 483521 - DNA, 25 bp, Homo sapien
ctcactgcaatcatcttcaattgct

SEQ ID NO: 483522 - DNA, 25 bp, Homo sapien
actgcaatcatcttcaattgctctg

SEQ ID NO: 483523 - DNA, 25 bp, Homo sapien
gggcctggatgcccaatgctccatc

SEQ ID NO: 483524 - DNA, 25 bp, Homo sapien
gcaatcatcttcaattgctctgccc

SEQ ID NO: 483525 - DNA, 25 bp, Homo sapien
aatcatcttcaattgctctgcccag

SEQ ID NO: 483526 - DNA, 25 bp, Homo sapien
atcatcttcaattgctctgcccagc

SEQ ID NO: 483527 - DNA, 25 bp, Homo sapien
accaccctgaagacttacctagaca

SEQ ID NO: 483528 - DNA, 25 bp, Homo sapien
tgaagacttacctagacaccctccc

SEQ ID NO: 483529 - DNA, 25 bp, Homo sapien
atcttcaattgctctgcccagcacg

SEQ ID NO: 483530 - DNA, 25 bp, Homo sapien
agcttgcctggacccctaacggctg

SEQ ID NO: 483531 - DNA, 25 bp, Homo sapien
ctggacccctaacggctgttctcag

SEQ ID NO: 483532 - DNA, 25 bp, Homo sapien
ctgaagagttcctcacggctgtgaa

SEQ ID NO: 483533 - DNA, 25 bp, Homo sapien
acggctgtgaaggagtcggcactct

SEQ ID NO: 483534 - DNA, 25 bp, Homo sapien
gacacaacgctttggacagatctga

SEQ ID NO: 483535 - DNA, 25 bp, Homo sapien
gaaagcatctccaaagctgatttca

SEQ ID NO: 483536 - DNA, 25 bp, Homo sapien
gctgatttcagaggacggtgtcaaa

SEQ ID NO: 483537 - DNA, 25 bp, Homo sapien
aaaagatgggtgctcggctgctaca

SEQ ID NO: 483538 - DNA, 25 bp, Homo sapien
ctacatatcttctcaacacctggat

SEQ ID NO: 483539 - DNA, 25 bp, Homo sapien
ggacagatctgagctttcactgcta

SEQ ID NO: 483540 - DNA, 25 bp, Homo sapien
ggattctggtgcctctaagggaaaa

SEQ ID NO: 483541 - DNA, 25 bp, Homo sapien
ctgagctttcactgctatgccaatg

SEQ ID NO: 483542 - DNA, 25 bp, Homo sapien
ggtttaagagcttctggagcctgaa

SEQ ID NO: 483543 - DNA, 25 bp, Homo sapien
ggcagtgcccaacattgagtacctc

SEQ ID NO: 483544 - DNA, 25 bp, Homo sapien
caagaaggagccgtacgcccgggag

SEQ ID NO: 483545 - DNA, 25 bp, Homo sapien
acgcccgggagatgctggcgatctc

SEQ ID NO: 483546 - DNA, 25 bp, Homo sapien
ggagatgctggcgatctccttcatc

SEQ ID NO: 483547 - DNA, 25 bp, Homo sapien
gagatgctggcgatctccttcatct

SEQ ID NO: 483548 - DNA, 25 bp, Homo sapien
agatgctggcgatctccttcatctc

SEQ ID NO: 483549 - DNA, 25 bp, Homo sapien
atgctggcgatctccttcatctcgg

SEQ ID NO: 483550 - DNA, 25 bp, Homo sapien
tggcgatctccttcatctcggccgt

SEQ ID NO: 483551 - DNA, 25 bp, Homo sapien
tcggccgtcaaccgcaagcgcaaga

SEQ ID NO: 483552 - DNA, 25 bp, Homo sapien
agcaccgacgacgactcggagcagg

SEQ ID NO: 483553 - DNA, 25 bp, Homo sapien
gcaccgacgacgactcggagcagga

SEQ ID NO: 483554 - DNA, 25 bp, Homo sapien
ttataaaaatatactgccctgacac

SEQ ID NO: 483555 - DNA, 25 bp, Homo sapien
ccccatgtccacatcaatattcagt

SEQ ID NO: 483556 - DNA, 25 bp, Homo sapien
ccatgtccacatcaatattcagttt

SEQ ID NO: 483557 - DNA, 25 bp, Homo sapien
atgtccacatcaatattcagtttag

SEQ ID NO: 483558 - DNA, 25 bp, Homo sapien
tgtccacatcaatattcagtttaga

SEQ ID NO: 483559 - DNA, 25 bp, Homo sapien
gtccacatcaatattcagtttagat

SEQ ID NO: 483560 - DNA, 25 bp, Homo sapien
atattcagtttagattggtttaatc

SEQ ID NO: 483561 - DNA, 25 bp, Homo sapien
ggtttaatcttgaagtgtaatccag

SEQ ID NO: 483562 - DNA, 25 bp, Homo sapien
ttaatcttgaagtgtaatccagtaa

SEQ ID NO: 483563 - DNA, 25 bp, Homo sapien
cttgaagtgtaatccagtaagactg

SEQ ID NO: 483564 - DNA, 25 bp, Homo sapien
gaagtgtaatccagtaagactgaag

SEQ ID NO: 483565 - DNA, 25 bp, Homo sapien
ggaagcgtctgctgtggaacccacc

SEQ ID NO: 483566 - DNA, 25 bp, Homo sapien
gcaacgcaggcagagttcagcctga

SEQ ID NO: 483567 - DNA, 25 bp, Homo sapien
aacaacagcgagaaggagccaaagc

SEQ ID NO: 483568 - DNA, 25 bp, Homo sapien
tgtcttccgagcaccgcttctcagg

SEQ ID NO: 483569 - DNA, 25 bp, Homo sapien
ctcaggtcgcttcccaatctgagga

SEQ ID NO: 483570 - DNA, 25 bp, Homo sapien
aatctgaggaggctgtcgtgtccac

SEQ ID NO: 483571 - DNA, 25 bp, Homo sapien
tgtcgtgtccacaaccagtccaggg

SEQ ID NO: 483572 - DNA, 25 bp, Homo sapien
gatgtgcgccactagctgaggacgc

SEQ ID NO: 483573 - DNA, 25 bp, Homo sapien
cactagctgaggacgccaggcccgg

SEQ ID NO: 483574 - DNA, 25 bp, Homo sapien
tgacagttagcaccttcctttcaca

SEQ ID NO: 483575 - DNA, 25 bp, Homo sapien
ttagcaccttcctttcacaacatct

SEQ ID NO: 483576 - DNA, 25 bp, Homo sapien
tcgggccggagtggcctttttccat

SEQ ID NO: 483577 - DNA, 25 bp, Homo sapien
gagtggcctttttccatctgcagga

SEQ ID NO: 483578 - DNA, 25 bp, Homo sapien
ggcctttttccatctgcaggactat

SEQ ID NO: 483579 - DNA, 25 bp, Homo sapien
ttttccatctgcaggactatgacca

SEQ ID NO: 483580 - DNA, 25 bp, Homo sapien
atctgcaggactatgaccaggcccg

SEQ ID NO: 483581 - DNA, 25 bp, Homo sapien
actacctcctggctgccgtgaatag

SEQ ID NO: 483582 - DNA, 25 bp, Homo sapien
tacctcctggctgccgtgaataggc

SEQ ID NO: 483583 - DNA, 25 bp, Homo sapien
ctgccgtgaataggcagcctaaaga

SEQ ID NO: 483584 - DNA, 25 bp, Homo sapien
aacgtccggcggtacctccagctga

SEQ ID NO: 483585 - DNA, 25 bp, Homo sapien
cggtacctccagctgacacagtcag

SEQ ID NO: 483586 - DNA, 25 bp, Homo sapien
acagtcagaactcagcagctaccat

SEQ ID NO: 483587 - DNA, 25 bp, Homo sapien
gcctggagaaggacaatatatgaag

SEQ ID NO: 483588 - DNA, 25 bp, Homo sapien
aggacaatatatgaagagcttagtg

SEQ ID NO: 483589 - DNA, 25 bp, Homo sapien
gagcttagtgaagtttgattggaac

SEQ ID NO: 483590 - DNA, 25 bp, Homo sapien
gtttgattggaactgaaaaacatca

SEQ ID NO: 483591 - DNA, 25 bp, Homo sapien
gaaagcatcaagtggataaatctca

SEQ ID NO: 483592 - DNA, 25 bp, Homo sapien
gcatcaagtggataaatctcagaaa

SEQ ID NO: 483593 - DNA, 25 bp, Homo sapien
atctcagaaacataatctctagagg

SEQ ID NO: 483594 - DNA, 25 bp, Homo sapien
aatcacagagaaatacctacagtgt

SEQ ID NO: 483595 - DNA, 25 bp, Homo sapien
gaaatacctacagtgtgattccatt

SEQ ID NO: 483596 - DNA, 25 bp, Homo sapien
gggccttcacgaaaagcgcctacgt

SEQ ID NO: 483597 - DNA, 25 bp, Homo sapien
aagcgcctacgtttagcgagagagg

SEQ ID NO: 483598 - DNA, 25 bp, Homo sapien
gctgtgccgggaactcacactgaaa

SEQ ID NO: 483599 - DNA, 25 bp, Homo sapien
aataactcaataaccccaactgcca

SEQ ID NO: 483600 - DNA, 25 bp, Homo sapien
ggagccccagtaccagaactcacat

SEQ ID NO: 483601 - DNA, 25 bp, Homo sapien
ggaactggtgatacttccaccgaaa

SEQ ID NO: 483602 - DNA, 25 bp, Homo sapien
aaaactgcggtcataagcaccaggg

SEQ ID NO: 483603 - DNA, 25 bp, Homo sapien
tgaaaactcgcttcctagagacagc

SEQ ID NO: 483604 - DNA, 25 bp, Homo sapien
ggaaccttgcttcgtcctaggaaga

SEQ ID NO: 483605 - DNA, 25 bp, Homo sapien
agccagctccgggttagacaagtgt

SEQ ID NO: 483606 - DNA, 25 bp, Homo sapien
tagacaagtgtcttgcgcccgccta

SEQ ID NO: 483607 - DNA, 25 bp, Homo sapien
ccgcctaagacacaaacattccgat

SEQ ID NO: 483608 - DNA, 25 bp, Homo sapien
aaacattccgatacctgctgctgtg

SEQ ID NO: 483609 - DNA, 25 bp, Homo sapien
aggaaactcctcaccaggagagcca

SEQ ID NO: 483610 - DNA, 25 bp, Homo sapien
ggaaactcctcaccaggagagccaa

SEQ ID NO: 483611 - DNA, 25 bp, Homo sapien
gaaactcctcaccaggagagccaaa

SEQ ID NO: 483612 - DNA, 25 bp, Homo sapien
aactcctcaccaggagagccaaaga

SEQ ID NO: 483613 - DNA, 25 bp, Homo sapien
tcctcaccaggagagccaaagacag

SEQ ID NO: 483614 - DNA, 25 bp, Homo sapien
caccaggagagccaaagacagggtt

SEQ ID NO: 483615 - DNA, 25 bp, Homo sapien
ccaggagagccaaagacagggttgt

SEQ ID NO: 483616 - DNA, 25 bp, Homo sapien
agagccaaagacagggttgtgcctt

SEQ ID NO: 483617 - DNA, 25 bp, Homo sapien
gagccaaagacagggttgtgcctta

SEQ ID NO: 483618 - DNA, 25 bp, Homo sapien
gccaaagacagggttgtgccttacc

SEQ ID NO: 483619 - DNA, 25 bp, Homo sapien
aagacagggttgtgccttaccccag

SEQ ID NO: 483620 - DNA, 25 bp, Homo sapien
aattccccagagaagattgtgtgtg

SEQ ID NO: 483621 - DNA, 25 bp, Homo sapien
gagcaataacaaaagtaagcgagtg

SEQ ID NO: 483622 - DNA, 25 bp, Homo sapien
aggcaaaaagggtatgagcagaatt

SEQ ID NO: 483623 - DNA, 25 bp, Homo sapien
gagcagaattctgtggctctccaga

SEQ ID NO: 483624 - DNA, 25 bp, Homo sapien
gaattctgtggctctccagaaataa

SEQ ID NO: 483625 - DNA, 25 bp, Homo sapien
tctgtggctctccagaaataagaga

SEQ ID NO: 483626 - DNA, 25 bp, Homo sapien
agagaggaacatagcatgtattctg

SEQ ID NO: 483627 - DNA, 25 bp, Homo sapien
ttctgtgccactgatgggacaggaa

SEQ ID NO: 483628 - DNA, 25 bp, Homo sapien
cactgatgggacaggaagtttgaca

SEQ ID NO: 483629 - DNA, 25 bp, Homo sapien
ccaaattaccccaagtactcattag

SEQ ID NO: 483630 - DNA, 25 bp, Homo sapien
ttaccccaagtactcattagaaata

SEQ ID NO: 483631 - DNA, 25 bp, Homo sapien
tcagatggtgcactggccccgggag

SEQ ID NO: 483632 - DNA, 25 bp, Homo sapien
tggccccgggaggagtctgaccaaa

SEQ ID NO: 483633 - DNA, 25 bp, Homo sapien
tgaccaaaaatggagcccgctctgt

SEQ ID NO: 483634 - DNA, 25 bp, Homo sapien
cacgagaaacggtcccacggtgcgg

SEQ ID NO: 483635 - DNA, 25 bp, Homo sapien
gaaacggtcccacggtgcggatctc

SEQ ID NO: 483636 - DNA, 25 bp, Homo sapien
tgggcctccaatcctgcggagcttt

SEQ ID NO: 483637 - DNA, 25 bp, Homo sapien
gcggagctttcctgggtgtggcttt

SEQ ID NO: 483638 - DNA, 25 bp, Homo sapien
gacctcagaagtggctctggtttgg

SEQ ID NO: 483639 - DNA, 25 bp, Homo sapien
cagaagtggctctggtttggcctca

SEQ ID NO: 483640 - DNA, 25 bp, Homo sapien
aagtggctctggtttggcctcagga

SEQ ID NO: 483641 - DNA, 25 bp, Homo sapien
tggggggcccttgatgccactaatc

SEQ ID NO: 483642 - DNA, 25 bp, Homo sapien
gagaccaaggcgggcggaccactta

SEQ ID NO: 483643 - DNA, 25 bp, Homo sapien
agcctgagaaacatggcgaaccctg

SEQ ID NO: 483644 - DNA, 25 bp, Homo sapien
cctgagaaacatggcgaaccctgtc

SEQ ID NO: 483645 - DNA, 25 bp, Homo sapien
ttggtggcgcgctccagtggcccca

SEQ ID NO: 483646 - DNA, 25 bp, Homo sapien
tggcgcgctccagtggccccagcta

SEQ ID NO: 483647 - DNA, 25 bp, Homo sapien
cgcttgagcccggagattgaagctg

SEQ ID NO: 483648 - DNA, 25 bp, Homo sapien
gcttgagcccggagattgaagctgc

SEQ ID NO: 483649 - DNA, 25 bp, Homo sapien
cctgggctatagagcgatacctcca

SEQ ID NO: 483650 - DNA, 25 bp, Homo sapien
ctgggctatagagcgatacctccat

SEQ ID NO: 483651 - DNA, 25 bp, Homo sapien
gggctatagagcgatacctccatct

SEQ ID NO: 483652 - DNA, 25 bp, Homo sapien
ggctatagagcgatacctccatctc

SEQ ID NO: 483653 - DNA, 25 bp, Homo sapien
aagaagctgcatacctgtgtgaggc

SEQ ID NO: 483654 - DNA, 25 bp, Homo sapien
ctgcatacctgtgtgaggccattgc

SEQ ID NO: 483655 - DNA, 25 bp, Homo sapien
gggatttgagaggactgcctcttag

SEQ ID NO: 483656 - DNA, 25 bp, Homo sapien
gaggactgcctcttagaaaggttta

SEQ ID NO: 483657 - DNA, 25 bp, Homo sapien
agagttctcttttatatctgtccag

SEQ ID NO: 483658 - DNA, 25 bp, Homo sapien
ttatatctgtccagatgtcctcatt

SEQ ID NO: 483659 - DNA, 25 bp, Homo sapien
catgtctggagccaacttgacttta

SEQ ID NO: 483660 - DNA, 25 bp, Homo sapien
ggagccaacttgactttataacctt

SEQ ID NO: 483661 - DNA, 25 bp, Homo sapien
tagataacacatttccgtactgttt

SEQ ID NO: 483662 - DNA, 25 bp, Homo sapien
tccgtactgtttaaggccttttgag

SEQ ID NO: 483663 - DNA, 25 bp, Homo sapien
gtttaaggccttttgaggcaagata

SEQ ID NO: 483664 - DNA, 25 bp, Homo sapien
accatgcctaactatcgttgctact

SEQ ID NO: 483665 - DNA, 25 bp, Homo sapien
ctatcgttgctactttctattggaa

SEQ ID NO: 483666 - DNA, 25 bp, Homo sapien
gagaaggcagccctgatttagtctg

SEQ ID NO: 483667 - DNA, 25 bp, Homo sapien
ggcagccctgatttagtctgtttac

SEQ ID NO: 483668 - DNA, 25 bp, Homo sapien
gtctgtttacagtctgcattatgtg

SEQ ID NO: 483669 - DNA, 25 bp, Homo sapien
tacagtctgcattatgtggagaata

SEQ ID NO: 483670 - DNA, 25 bp, Homo sapien
gaatagagagccatcatagtcccta

SEQ ID NO: 483671 - DNA, 25 bp, Homo sapien
agagccatcatagtccctaaaactt

SEQ ID NO: 483672 - DNA, 25 bp, Homo sapien
actttccttgccagttaacccagca

SEQ ID NO: 483673 - DNA, 25 bp, Homo sapien
cagttaacccagcaggacaacctgt

SEQ ID NO: 483674 - DNA, 25 bp, Homo sapien
gacaacctgtctttgtctcttgaca

SEQ ID NO: 483675 - DNA, 25 bp, Homo sapien
ctcttctctttctgatcctttatca

SEQ ID NO: 483676 - DNA, 25 bp, Homo sapien
aattccccagagaagattgtgtgtg

SEQ ID NO: 483677 - DNA, 25 bp, Homo sapien
aggcaaaaagggtatgagcagaatt

SEQ ID NO: 483678 - DNA, 25 bp, Homo sapien
gagcagaattctgtggctctccaga

SEQ ID NO: 483679 - DNA, 25 bp, Homo sapien
tctgtggctctccagaaataagaga

SEQ ID NO: 483680 - DNA, 25 bp, Homo sapien
gaacatagcatgtattctgtgccac

SEQ ID NO: 483681 - DNA, 25 bp, Homo sapien
ttctgtgccactgatgggacaggaa

SEQ ID NO: 483682 - DNA, 25 bp, Homo sapien
cactgatgggacaggaagtttgaca

SEQ ID NO: 483683 - DNA, 25 bp, Homo sapien
tgacagtttataaaactcggtccaa

SEQ ID NO: 483684 - DNA, 25 bp, Homo sapien
ccaaattaccccaagtactcattag

SEQ ID NO: 483685 - DNA, 25 bp, Homo sapien
ttaccccaagtactcattagaaata

SEQ ID NO: 483686 - DNA, 25 bp, Homo sapien
atgggggtctccacagcatgacttt

SEQ ID NO: 483687 - DNA, 25 bp, Homo sapien
ggggtctccacagcatgactttggg

SEQ ID NO: 483688 - DNA, 25 bp, Homo sapien
gcctggatgcccaatgctccatcat

SEQ ID NO: 483689 - DNA, 25 bp, Homo sapien
aatcatcttcaattgctctgcccag

SEQ ID NO: 483690 - DNA, 25 bp, Homo sapien
accaccctgaagacttacctagaca

SEQ ID NO: 483691 - DNA, 25 bp, Homo sapien
tagacaccctccctgaagtgaacat

SEQ ID NO: 483692 - DNA, 25 bp, Homo sapien
aagtgaacatcagcttgcctggacc

SEQ ID NO: 483693 - DNA, 25 bp, Homo sapien
acgctgctgtcaacagtgggcagga

SEQ ID NO: 483694 - DNA, 25 bp, Homo sapien
gtcaacagtgggcaggacggcagag

SEQ ID NO: 483695 - DNA, 25 bp, Homo sapien
gacggcagaggtggaatcagggatg

SEQ ID NO: 483696 - DNA, 25 bp, Homo sapien
tgaagagggaggtgatactcccctt

SEQ ID NO: 483697 - DNA, 25 bp, Homo sapien
agggatttcccctcatagtacaact

SEQ ID NO: 483698 - DNA, 25 bp, Homo sapien
gatttcccctcatagtacaactgga

SEQ ID NO: 483699 - DNA, 25 bp, Homo sapien
tcccctcatagtacaactggaagga

SEQ ID NO: 483700 - DNA, 25 bp, Homo sapien
caactggaaggatagtgcttgtaaa

SEQ ID NO: 483701 - DNA, 25 bp, Homo sapien
gatgtgtacatgatgaatcattgag

SEQ ID NO: 483702 - DNA, 25 bp, Homo sapien
atcattgagggagggtggatatttt

SEQ ID NO: 483703 - DNA, 25 bp, Homo sapien
ggaggaaacataagtctgtagtatt

SEQ ID NO: 483704 - DNA, 25 bp, Homo sapien
aactgattgtaataattctttccta

SEQ ID NO: 483705 - DNA, 25 bp, Homo sapien
gattgtaataattctttcctatcaa

SEQ ID NO: 483706 - DNA, 25 bp, Homo sapien
ggcatcttgttactgcaatagttgg

SEQ ID NO: 483707 - DNA, 25 bp, Homo sapien
tcttgttactgcaatagttggaaat

SEQ ID NO: 483708 - DNA, 25 bp, Homo sapien
aattaagttgttccagcactggcca

SEQ ID NO: 483709 - DNA, 25 bp, Homo sapien
ctggccatcctgacgctaaaatttt

SEQ ID NO: 483710 - DNA, 25 bp, Homo sapien
tttccccaagtcttaccaacaattg

SEQ ID NO: 483711 - DNA, 25 bp, Homo sapien
ccaacaattgcctacagttccagta

SEQ ID NO: 483712 - DNA, 25 bp, Homo sapien
gaatctgtgagcctaatagcccagt

SEQ ID NO: 483713 - DNA, 25 bp, Homo sapien
agcattcactgctagaacgcacgtc

SEQ ID NO: 483714 - DNA, 25 bp, Homo sapien
gagtgttgacctgactattttgccc

SEQ ID NO: 483715 - DNA, 25 bp, Homo sapien
acctgactattttgccctctggata

SEQ ID NO: 483716 - DNA, 25 bp, Homo sapien
gccctctggatagtgcaaatctgtt

SEQ ID NO: 483717 - DNA, 25 bp, Homo sapien
gtgcaaatctgttgggaatctcctg

SEQ ID NO: 483718 - DNA, 25 bp, Homo sapien
gggaatctcctgacttctgattaaa

SEQ ID NO: 483719 - DNA, 25 bp, Homo sapien
ggcaaatacaccaaagaaaccagct

SEQ ID NO: 483720 - DNA, 25 bp, Homo sapien
gaaaccagcttacaaaagattatga

SEQ ID NO: 483721 - DNA, 25 bp, Homo sapien
gaactgcaaacctcatctttcgaaa

SEQ ID NO: 483722 - DNA, 25 bp, Homo sapien
ctcatctttcgaaaacaaggttttg

SEQ ID NO: 483723 - DNA, 25 bp, Homo sapien
tgtacagcagagtaagagtgttttt

SEQ ID NO: 483724 - DNA, 25 bp, Homo sapien
gattatttaattcccatatttctaa

SEQ ID NO: 483725 - DNA, 25 bp, Homo sapien
tactacacagtaatccatgcctgtt

SEQ ID NO: 483726 - DNA, 25 bp, Homo sapien
ccatgcctgttagtttggaggactt

SEQ ID NO: 483727 - DNA, 25 bp, Homo sapien
ggaggacttgactgtctcatttttt

SEQ ID NO: 483728 - DNA, 25 bp, Homo sapien
attcattgtcagtcatgcttggaac

SEQ ID NO: 483729 - DNA, 25 bp, Homo sapien
atgcttggaacagcatttccactag

SEQ ID NO: 483730 - DNA, 25 bp, Homo sapien
caagaaagaggtggccaatcccaga

SEQ ID NO: 483731 - DNA, 25 bp, Homo sapien
caatcccagaaagtacaggagcaag

SEQ ID NO: 483732 - DNA, 25 bp, Homo sapien
ggagcaaggactacacagaccgacc

SEQ ID NO: 483733 - DNA, 25 bp, Homo sapien
ggactacacagaccgaccacagcag

SEQ ID NO: 483734 - DNA, 25 bp, Homo sapien
aaaggcctctccagctgtggagttc

SEQ ID NO: 483735 - DNA, 25 bp, Homo sapien
agaaagctactctgacccacaactg

SEQ ID NO: 483736 - DNA, 25 bp, Homo sapien
aactgcccgtacgtagaacatcctg

SEQ ID NO: 483737 - DNA, 25 bp, Homo sapien
ccgtacgtagaacatcctgctgaaa

SEQ ID NO: 483738 - DNA, 25 bp, Homo sapien
gaaagacaagagctcaccccaagaa

SEQ ID NO: 483739 - DNA, 25 bp, Homo sapien
gaaaagatgctgatcacaccctgta

SEQ ID NO: 483740 - DNA, 25 bp, Homo sapien
gatcacaccctgtacaaagatattg

SEQ ID NO: 483741 - DNA, 25 bp, Homo sapien
cacctcaagggctgctcagaagaga

SEQ ID NO: 483742 - DNA, 25 bp, Homo sapien
gagcaccttcagcatgagttgttgc

SEQ ID NO: 483743 - DNA, 25 bp, Homo sapien
catgagttgttgctggaagatctaa

SEQ ID NO: 483744 - DNA, 25 bp, Homo sapien
gatctaataagctgtgtttcctggg

SEQ ID NO: 483745 - DNA, 25 bp, Homo sapien
gtttcctgggaagtggtgctttact

SEQ ID NO: 483746 - DNA, 25 bp, Homo sapien
gtgctttacttagccctgtggacaa

SEQ ID NO: 483747 - DNA, 25 bp, Homo sapien
tgtggacaacttctctatgcatctg

SEQ ID NO: 483748 - DNA, 25 bp, Homo sapien
aacttctctatgcatctgtgtgagc

SEQ ID NO: 483749 - DNA, 25 bp, Homo sapien
gagcagatgatcattgtattacctt

SEQ ID NO: 483750 - DNA, 25 bp, Homo sapien
taccttttatcggtagtaagcttgg

SEQ ID NO: 483751 - DNA, 25 bp, Homo sapien
aatggtccatttatatgttctttta

SEQ ID NO: 483752 - DNA, 25 bp, Homo sapien
ttctcggagaagttcttagcctgat

SEQ ID NO: 483753 - DNA, 25 bp, Homo sapien
tcttagcctgatgaaataacttggg

SEQ ID NO: 483754 - DNA, 25 bp, Homo sapien
gcagattgtcaaattaagggtgtca

SEQ ID NO: 483755 - DNA, 25 bp, Homo sapien
gggtgtcattgtgttgtgctaaacg

SEQ ID NO: 483756 - DNA, 25 bp, Homo sapien
cattgtgttgtgctaaacgctggga

SEQ ID NO: 483757 - DNA, 25 bp, Homo sapien
gctaaacgctgggagggtacaagtt

SEQ ID NO: 483758 - DNA, 25 bp, Homo sapien
gggtacaagttggtcattcctaaat

SEQ ID NO: 483759 - DNA, 25 bp, Homo sapien
caagttggtcattcctaaatctgtg

SEQ ID NO: 483760 - DNA, 25 bp, Homo sapien
agaaatggcaggtctagtttgggca

SEQ ID NO: 483761 - DNA, 25 bp, Homo sapien
gcaggtctagtttgggcattgtgat

SEQ ID NO: 483762 - DNA, 25 bp, Homo sapien
gtttgggcattgtgattgcattgca

SEQ ID NO: 483763 - DNA, 25 bp, Homo sapien
tacacaagtaccactgtgttacagt

SEQ ID NO: 483764 - DNA, 25 bp, Homo sapien
acaagtaccactgtgttacagttgc

SEQ ID NO: 483765 - DNA, 25 bp, Homo sapien
caagtaccactgtgttacagttgcc

SEQ ID NO: 483766 - DNA, 25 bp, Homo sapien
tacagtaacacactttacaagctta

SEQ ID NO: 483767 - DNA, 25 bp, Homo sapien
agtaacacactttacaagcttatag

SEQ ID NO: 483768 - DNA, 25 bp, Homo sapien
aacacactttacaagcttatagcct

SEQ ID NO: 483769 - DNA, 25 bp, Homo sapien
acacactttacaagcttatagccta

SEQ ID NO: 483770 - DNA, 25 bp, Homo sapien
acactttacaagcttatagcctagg

SEQ ID NO: 483771 - DNA, 25 bp, Homo sapien
actttacaagcttatagcctaggaa

SEQ ID NO: 483772 - DNA, 25 bp, Homo sapien
tttttaatccattataccatatttt

SEQ ID NO: 483773 - DNA, 25 bp, Homo sapien
tagatacacaagtaccactgtgtta

SEQ ID NO: 483774 - DNA, 25 bp, Homo sapien
acacccacggccaccatgtccacag

SEQ ID NO: 483775 - DNA, 25 bp, Homo sapien
tcctccactccagagactgtccaca

SEQ ID NO: 483776 - DNA, 25 bp, Homo sapien
agagactgtccacacctccacagtg

SEQ ID NO: 483777 - DNA, 25 bp, Homo sapien
actgtccacacctccacagtgctta

SEQ ID NO: 483778 - DNA, 25 bp, Homo sapien
ccaggaacagctcacactaccaaag

SEQ ID NO: 483779 - DNA, 25 bp, Homo sapien
caggaacagctcacactaccaaagt

SEQ ID NO: 483780 - DNA, 25 bp, Homo sapien
aggaacagctcacactaccaaagtg

SEQ ID NO: 483781 - DNA, 25 bp, Homo sapien
ggaacagctcacactaccaaagtgc

SEQ ID NO: 483782 - DNA, 25 bp, Homo sapien
gactaccacaaccacgggcttcaca

SEQ ID NO: 483783 - DNA, 25 bp, Homo sapien
actaccacaaccacgggcttcacag

SEQ ID NO: 483784 - DNA, 25 bp, Homo sapien
acaaccacgggcttcacagccaccc

SEQ ID NO: 483785 - DNA, 25 bp, Homo sapien
ataaatactgtggtatattccaaca

SEQ ID NO: 483786 - DNA, 25 bp, Homo sapien
atactgtggtatattccaacagtgg

SEQ ID NO: 483787 - DNA, 25 bp, Homo sapien
atgtatgtgaacatggacaaaactc

SEQ ID NO: 483788 - DNA, 25 bp, Homo sapien
ggatggatttaagcatttgtgtgta

SEQ ID NO: 483789 - DNA, 25 bp, Homo sapien
tcacagaagaatacatcactatggt

SEQ ID NO: 483790 - DNA, 25 bp, Homo sapien
gaagaatacatcactatggttccat

SEQ ID NO: 483791 - DNA, 25 bp, Homo sapien
gaatacatcactatggttccatttc

SEQ ID NO: 483792 - DNA, 25 bp, Homo sapien
acatcactatggttccatttcaatg

SEQ ID NO: 483793 - DNA, 25 bp, Homo sapien
ctatggttccatttcaatgaaagtc

SEQ ID NO: 483794 - DNA, 25 bp, Homo sapien
aagcatttgtgtgtaataggaagaa

SEQ ID NO: 483795 - DNA, 25 bp, Homo sapien
cgggaagatcccaagtgtccaccaa

SEQ ID NO: 483796 - DNA, 25 bp, Homo sapien
aggattgggacctgctctgacagct

SEQ ID NO: 483797 - DNA, 25 bp, Homo sapien
tgacagctggacacatgagccctgg

SEQ ID NO: 483798 - DNA, 25 bp, Homo sapien
ctggacacatgagccctggatgagt

SEQ ID NO: 483799 - DNA, 25 bp, Homo sapien
acatgagccctggatgagtatggta

SEQ ID NO: 483800 - DNA, 25 bp, Homo sapien
ggtttgaagaatcccctgtccacct

SEQ ID NO: 483801 - DNA, 25 bp, Homo sapien
tagaactgccattcccaagacctct

SEQ ID NO: 483802 - DNA, 25 bp, Homo sapien
aaccacccttggaacttgcctcttg

SEQ ID NO: 483803 - DNA, 25 bp, Homo sapien
ttggaacttgcctcttgtcctgctg

SEQ ID NO: 483804 - DNA, 25 bp, Homo sapien
gctggaaagatagcagtgttctcct

SEQ ID NO: 483805 - DNA, 25 bp, Homo sapien
agatagcagtgttctcctgacttcg

SEQ ID NO: 483806 - DNA, 25 bp, Homo sapien
agtgttctcctgacttcgccctact

SEQ ID NO: 483807 - DNA, 25 bp, Homo sapien
cttgctggccctgcgaacgaacgag

SEQ ID NO: 483808 - DNA, 25 bp, Homo sapien
tgctggccctgcgaacgaacgagca

SEQ ID NO: 483809 - DNA, 25 bp, Homo sapien
tggccctgcgaacgaacgagcactg

SEQ ID NO: 483810 - DNA, 25 bp, Homo sapien
gccctgcgaacgaacgagcactgtt

SEQ ID NO: 483811 - DNA, 25 bp, Homo sapien
gaacgaacgagcactgttcgtggtt

SEQ ID NO: 483812 - DNA, 25 bp, Homo sapien
gaacgagcactgttcgtggttagaa

SEQ ID NO: 483813 - DNA, 25 bp, Homo sapien
cgagcactgttcgtggttagaaaag

SEQ ID NO: 483814 - DNA, 25 bp, Homo sapien
gcactgttcgtggttagaaaagcga

SEQ ID NO: 483815 - DNA, 25 bp, Homo sapien
gtggttagaaaagcgaagtgctgta

SEQ ID NO: 483816 - DNA, 25 bp, Homo sapien
gccgggcggagtccgcgggatccaa

SEQ ID NO: 483817 - DNA, 25 bp, Homo sapien
agtccgcgggatccaaaggcggcgg

SEQ ID NO: 483818 - DNA, 25 bp, Homo sapien
ggtccgcggtttattcttgaggtca

SEQ ID NO: 483819 - DNA, 25 bp, Homo sapien
cgcggtttattcttgaggtcagtga

SEQ ID NO: 483820 - DNA, 25 bp, Homo sapien
ggtttattcttgaggtcagtgagac

SEQ ID NO: 483821 - DNA, 25 bp, Homo sapien
cttgcccttctacttttcacaggta

SEQ ID NO: 483822 - DNA, 25 bp, Homo sapien
ttttcacaggtactaaggtctcaaa

SEQ ID NO: 483823 - DNA, 25 bp, Homo sapien
ggtactaaggtctcaaactcataag

SEQ ID NO: 483824 - DNA, 25 bp, Homo sapien
ccagggttttctgcattgaacaact

SEQ ID NO: 483825 - DNA, 25 bp, Homo sapien
gggttttctgcattgaacaactttt

SEQ ID NO: 483826 - DNA, 25 bp, Homo sapien
ctgcattgaacaactttttgtttgt

SEQ ID NO: 483827 - DNA, 25 bp, Homo sapien
tggtagtgaggaatagaccttcccc

SEQ ID NO: 483828 - DNA, 25 bp, Homo sapien
tgaggaatagaccttccccctttga

SEQ ID NO: 483829 - DNA, 25 bp, Homo sapien
aatacatgtgtatctgttcattttt

SEQ ID NO: 483830 - DNA, 25 bp, Homo sapien
atacatgtgtatctgttcatttttg

SEQ ID NO: 483831 - DNA, 25 bp, Homo sapien
tacatgtgtatctgttcatttttgc

SEQ ID NO: 483832 - DNA, 25 bp, Homo sapien
acatgtgtatctgttcatttttgca

SEQ ID NO: 483833 - DNA, 25 bp, Homo sapien
catgtgtatctgttcatttttgcaa

SEQ ID NO: 483834 - DNA, 25 bp, Homo sapien
atgtgtatctgttcatttttgcaaa

SEQ ID NO: 483835 - DNA, 25 bp, Homo sapien
gtgtatctgttcatttttgcaaaag

SEQ ID NO: 483836 - DNA, 25 bp, Homo sapien
gtatctgttcatttttgcaaaagaa

SEQ ID NO: 483837 - DNA, 25 bp, Homo sapien
agaaatataggaagtggccaggtgc

SEQ ID NO: 483838 - DNA, 25 bp, Homo sapien
gaaatataggaagtggccaggtgcg

SEQ ID NO: 483839 - DNA, 25 bp, Homo sapien
agccgggcatggtgatgtatgccta

SEQ ID NO: 483840 - DNA, 25 bp, Homo sapien
aaagcagaagtcgacgttgactgaa

SEQ ID NO: 483841 - DNA, 25 bp, Homo sapien
gaagccatttgcaaagctaatggtg

SEQ ID NO: 483842 - DNA, 25 bp, Homo sapien
gctaatggtgttgagaggcatgtct

SEQ ID NO: 483843 - DNA, 25 bp, Homo sapien
agaggcatgtctctgctattccgta

SEQ ID NO: 483844 - DNA, 25 bp, Homo sapien
gctattccgtatcagctaggtttca

SEQ ID NO: 483845 - DNA, 25 bp, Homo sapien
gctaggtttcaggaaggtggttcaa

SEQ ID NO: 483846 - DNA, 25 bp, Homo sapien
aggtggttcaatagctgcagcatta

SEQ ID NO: 483847 - DNA, 25 bp, Homo sapien
cagcattaaaatgagggacagcctc

SEQ ID NO: 483848 - DNA, 25 bp, Homo sapien
tcataattgaacacacccaggtcct

SEQ ID NO: 483849 - DNA, 25 bp, Homo sapien
caggtcctcaatgtcagcagttggg

SEQ ID NO: 483850 - DNA, 25 bp, Homo sapien
tcagcagttgggtttcctgatgcaa

SEQ ID NO: 483851 - DNA, 25 bp, Homo sapien
tcagcctctttctaagggacttcct

SEQ ID NO: 483852 - DNA, 25 bp, Homo sapien
gcctctttctaagggacttcctcag

SEQ ID NO: 483853 - DNA, 25 bp, Homo sapien
ctcttctgcgcctggcagataggat

SEQ ID NO: 483854 - DNA, 25 bp, Homo sapien
ccacgggaagtttggctgcgtactt

SEQ ID NO: 483855 - DNA, 25 bp, Homo sapien
gctgggatgagacaagcccccgaca

SEQ ID NO: 483856 - DNA, 25 bp, Homo sapien
ggaagtttggctgcgtacttgcatg

SEQ ID NO: 483857 - DNA, 25 bp, Homo sapien
tttggctgcgtacttgcatgagctt

SEQ ID NO: 483858 - DNA, 25 bp, Homo sapien
gctgcgtacttgcatgagctttcca

SEQ ID NO: 483859 - DNA, 25 bp, Homo sapien
tgcgtacttgcatgagctttccacc

SEQ ID NO: 483860 - DNA, 25 bp, Homo sapien
tgcatgagctttccacccacttgag

SEQ ID NO: 483861 - DNA, 25 bp, Homo sapien
ttgagcccagtcctccgggccgttt

SEQ ID NO: 483862 - DNA, 25 bp, Homo sapien
tcttaagaaatatttgtttgggccg

SEQ ID NO: 483863 - DNA, 25 bp, Homo sapien
agaaatatttgtttgggccgggcat

SEQ ID NO: 483864 - DNA, 25 bp, Homo sapien
gaaatatttgtttgggccgggcatg

SEQ ID NO: 483865 - DNA, 25 bp, Homo sapien
aatatttgtttgggccgggcatggt

SEQ ID NO: 483866 - DNA, 25 bp, Homo sapien
cactttgagagaccagaacaggcag

SEQ ID NO: 483867 - DNA, 25 bp, Homo sapien
ctttgagagaccagaacaggcagat

SEQ ID NO: 483868 - DNA, 25 bp, Homo sapien
tttgagagaccagaacaggcagatc

SEQ ID NO: 483869 - DNA, 25 bp, Homo sapien
ttgagagaccagaacaggcagatca

SEQ ID NO: 483870 - DNA, 25 bp, Homo sapien
gagagaccagaacaggcagatcacc

SEQ ID NO: 483871 - DNA, 25 bp, Homo sapien
agagaccagaacaggcagatcacct

SEQ ID NO: 483872 - DNA, 25 bp, Homo sapien
gagaccagaacaggcagatcacctg

SEQ ID NO: 483873 - DNA, 25 bp, Homo sapien
taagcatgtgcactactgaccacga

SEQ ID NO: 483874 - DNA, 25 bp, Homo sapien
tgtgcactactgaccacgactctgg

SEQ ID NO: 483875 - DNA, 25 bp, Homo sapien
acgactctggtctttcctgttgttg

SEQ ID NO: 483876 - DNA, 25 bp, Homo sapien
tacagaaacaggctgggttccagga

SEQ ID NO: 483877 - DNA, 25 bp, Homo sapien
ctgccccgagtctggaagagggcaa

SEQ ID NO: 483878 - DNA, 25 bp, Homo sapien
aagagggcaaggacacttccattcc

SEQ ID NO: 483879 - DNA, 25 bp, Homo sapien
cttccattcctctgtaccatggagt

SEQ ID NO: 483880 - DNA, 25 bp, Homo sapien
tcctctgtaccatggagtcctgcag

SEQ ID NO: 483881 - DNA, 25 bp, Homo sapien
gtggcaactgtgtacagcttacccc

SEQ ID NO: 483882 - DNA, 25 bp, Homo sapien
tccagttgcaccacttctagatgtg

SEQ ID NO: 483883 - DNA, 25 bp, Homo sapien
gtgcctttaaaagatctaactatgg

SEQ ID NO: 483884 - DNA, 25 bp, Homo sapien
agggcattgtggcacatgccaaggt

SEQ ID NO: 483885 - DNA, 25 bp, Homo sapien
gggcattgtggcacatgccaaggtg

SEQ ID NO: 483886 - DNA, 25 bp, Homo sapien
ggcattgtggcacatgccaaggtgg

SEQ ID NO: 483887 - DNA, 25 bp, Homo sapien
gcattgtggcacatgccaaggtggg

SEQ ID NO: 483888 - DNA, 25 bp, Homo sapien
cattgtggcacatgccaaggtgggc

SEQ ID NO: 483889 - DNA, 25 bp, Homo sapien
attgtggcacatgccaaggtgggca

SEQ ID NO: 483890 - DNA, 25 bp, Homo sapien
ttgtggcacatgccaaggtgggcag

SEQ ID NO: 483891 - DNA, 25 bp, Homo sapien
tgtggcacatgccaaggtgggcaga

SEQ ID NO: 483892 - DNA, 25 bp, Homo sapien
gacacacccttgttctggaggctgg

SEQ ID NO: 483893 - DNA, 25 bp, Homo sapien
agagcatggagccagcatctggtga

SEQ ID NO: 483894 - DNA, 25 bp, Homo sapien
catgctgcatcatcctgtgacagaa

SEQ ID NO: 483895 - DNA, 25 bp, Homo sapien
gctgcatcatcctgtgacagaagtt

SEQ ID NO: 483896 - DNA, 25 bp, Homo sapien
acagaagttgaagggcaaaatgcta

SEQ ID NO: 483897 - DNA, 25 bp, Homo sapien
atgctatagttatccatgaagtcta

SEQ ID NO: 483898 - DNA, 25 bp, Homo sapien
tagttatccatgaagtctatgaaga

SEQ ID NO: 483899 - DNA, 25 bp, Homo sapien
gcagcagccagagatggaagacttt

SEQ ID NO: 483900 - DNA, 25 bp, Homo sapien
ggctggtgaccagatattagaggtt

SEQ ID NO: 483901 - DNA, 25 bp, Homo sapien
gggttgacctgaggaactccagcca

SEQ ID NO: 483902 - DNA, 25 bp, Homo sapien
acctgaggaactccagccacgaaga

SEQ ID NO: 483903 - DNA, 25 bp, Homo sapien
attaggcagaaaacaccaggattcc

SEQ ID NO: 483904 - DNA, 25 bp, Homo sapien
gattccttaagtgatccttgaaatg

SEQ ID NO: 483905 - DNA, 25 bp, Homo sapien
tggttattgttttctgccttgtcac

SEQ ID NO: 483906 - DNA, 25 bp, Homo sapien
acatttgccactgtgccctttaaaa

SEQ ID NO: 483907 - DNA, 25 bp, Homo sapien
ctgtgccctttaaaacgatgtggaa

SEQ ID NO: 483908 - DNA, 25 bp, Homo sapien
aaacctcaggtttgtggacagcaca

SEQ ID NO: 483909 - DNA, 25 bp, Homo sapien
aatgacatcttgtgcttcctgaggc

SEQ ID NO: 483910 - DNA, 25 bp, Homo sapien
cctctaccaggcacattagcttagt

SEQ ID NO: 483911 - DNA, 25 bp, Homo sapien
ggcacattagcttagtgcttcagat

SEQ ID NO: 483912 - DNA, 25 bp, Homo sapien
ctttatgttctccaatataagggaa

SEQ ID NO: 483913 - DNA, 25 bp, Homo sapien
ggttggtactacttctgattaggca

SEQ ID NO: 483914 - DNA, 25 bp, Homo sapien
atgctatagttatccatgaagtcta

SEQ ID NO: 483915 - DNA, 25 bp, Homo sapien
tgctatagttatccatgaagtctat

SEQ ID NO: 483916 - DNA, 25 bp, Homo sapien
gctatagttatccatgaagtctatg

SEQ ID NO: 483917 - DNA, 25 bp, Homo sapien
atagttatccatgaagtctatgaag

SEQ ID NO: 483918 - DNA, 25 bp, Homo sapien
ctttgggctggtgaccagatattag

SEQ ID NO: 483919 - DNA, 25 bp, Homo sapien
tttgggctggtgaccagatattaga

SEQ ID NO: 483920 - DNA, 25 bp, Homo sapien
ggctggtgaccagatattagaggtt

SEQ ID NO: 483921 - DNA, 25 bp, Homo sapien
gctggtgaccagatattagaggtta

SEQ ID NO: 483922 - DNA, 25 bp, Homo sapien
ctggtgaccagatattagaggttaa

SEQ ID NO: 483923 - DNA, 25 bp, Homo sapien
ggtgaccagatattagaggttaatg

SEQ ID NO: 483924 - DNA, 25 bp, Homo sapien
gtgaccagatattagaggttaatgg

SEQ ID NO: 483925 - DNA, 25 bp, Homo sapien
gatggcagagtatttaacacttcaa

SEQ ID NO: 483926 - DNA, 25 bp, Homo sapien
ttaacacttcaaatcatgaccctta

SEQ ID NO: 483927 - DNA, 25 bp, Homo sapien
aaatcatgacccttactgtccaggt

SEQ ID NO: 483928 - DNA, 25 bp, Homo sapien
ttactgtccaggtcacatgcccaca

SEQ ID NO: 483929 - DNA, 25 bp, Homo sapien
aaagtcagccctgtcgtcaggcctt

SEQ ID NO: 483930 - DNA, 25 bp, Homo sapien
gtcaggccttggtttccttgtctgt

SEQ ID NO: 483931 - DNA, 25 bp, Homo sapien
gtttccttgtctgtcaagtgggaga

SEQ ID NO: 483932 - DNA, 25 bp, Homo sapien
taagaggtccagtgaacagcatgag

SEQ ID NO: 483933 - DNA, 25 bp, Homo sapien
tttgttatctgggtctcagcaccgg

SEQ ID NO: 483934 - DNA, 25 bp, Homo sapien
tcagcaccgggtggcaggccaaact

SEQ ID NO: 483935 - DNA, 25 bp, Homo sapien
gcaggccaaactccttgccaggagt

SEQ ID NO: 483936 - DNA, 25 bp, Homo sapien
gctgggacaggtgccggtactacca

SEQ ID NO: 483937 - DNA, 25 bp, Homo sapien
gacaggtgccggtactaccatgaca

SEQ ID NO: 483938 - DNA, 25 bp, Homo sapien
ggtgccggtactaccatgacaggta

SEQ ID NO: 483939 - DNA, 25 bp, Homo sapien
gtactaccatgacaggtacgccctg

SEQ ID NO: 483940 - DNA, 25 bp, Homo sapien
taccatgacaggtacgccctgtacg

SEQ ID NO: 483941 - DNA, 25 bp, Homo sapien
tgtacgctgcccgggactggaagcc

SEQ ID NO: 483942 - DNA, 25 bp, Homo sapien
ggaagcccttccacggcggccgcga

SEQ ID NO: 483943 - DNA, 25 bp, Homo sapien
ttctcccacgacagaactgcacttg

SEQ ID NO: 483944 - DNA, 25 bp, Homo sapien
gacagaactgcacttgtagccggag

SEQ ID NO: 483945 - DNA, 25 bp, Homo sapien
gaactgcacttgtagccggagacaa

SEQ ID NO: 483946 - DNA, 25 bp, Homo sapien
acttgtagccggagacaactgtaac

SEQ ID NO: 483947 - DNA, 25 bp, Homo sapien
aattgatttctatttgccattctcc

SEQ ID NO: 483948 - DNA, 25 bp, Homo sapien
attgatttctatttgccattctcca

SEQ ID NO: 483949 - DNA, 25 bp, Homo sapien
tgatttctatttgccattctccaaa

SEQ ID NO: 483950 - DNA, 25 bp, Homo sapien
tttctatttgccattctccaaaaga

SEQ ID NO: 483951 - DNA, 25 bp, Homo sapien
gcttttcacagctgcagttatagcc

SEQ ID NO: 483952 - DNA, 25 bp, Homo sapien
ttttcacagctgcagttatagccta

SEQ ID NO: 483953 - DNA, 25 bp, Homo sapien
ttcacagctgcagttatagcctact

SEQ ID NO: 483954 - DNA, 25 bp, Homo sapien
tcacagctgcagttatagcctactg

SEQ ID NO: 483955 - DNA, 25 bp, Homo sapien
agttatagcctactgcagcctcgaa

SEQ ID NO: 483956 - DNA, 25 bp, Homo sapien
cccaggtatctaggacaacaggcat

SEQ ID NO: 483957 - DNA, 25 bp, Homo sapien
ggtatctaggacaacaggcatgcaa

SEQ ID NO: 483958 - DNA, 25 bp, Homo sapien
ttaagacgtgttgagattggcctgg

SEQ ID NO: 483959 - DNA, 25 bp, Homo sapien
acgtgttgagattggcctgggaata

SEQ ID NO: 483960 - DNA, 25 bp, Homo sapien
attggcctgggaatatcatcatttt

SEQ ID NO: 483961 - DNA, 25 bp, Homo sapien
gaatatcatcattttctagttgaca

SEQ ID NO: 483962 - DNA, 25 bp, Homo sapien
agttgacatttgaatcctgtgtgca

SEQ ID NO: 483963 - DNA, 25 bp, Homo sapien
acatttgaatcctgtgtgcagatgc

SEQ ID NO: 483964 - DNA, 25 bp, Homo sapien
caagctgcattcaaaagacaaacaa

SEQ ID NO: 483965 - DNA, 25 bp, Homo sapien
atgtctatcatttacagtttcaata

SEQ ID NO: 483966 - DNA, 25 bp, Homo sapien
acagtttcaatagcacataatttat

SEQ ID NO: 483967 - DNA, 25 bp, Homo sapien
ttctatgcattataaatggccttgc

SEQ ID NO: 483968 - DNA, 25 bp, Homo sapien
taaatggccttgcagttggctcagt

SEQ ID NO: 483969 - DNA, 25 bp, Homo sapien
tacacagcgcgcacggaaggcgagc

SEQ ID NO: 483970 - DNA, 25 bp, Homo sapien
tcggtgctgctctacggacagccag

SEQ ID NO: 483971 - DNA, 25 bp, Homo sapien
accttccccggacgatgtgaagcgc

SEQ ID NO: 483972 - DNA, 25 bp, Homo sapien
atgtgaagcgccgtgtcaagtcccc

SEQ ID NO: 483973 - DNA, 25 bp, Homo sapien
cggcagccatgtgcgccagaaggca

SEQ ID NO: 483974 - DNA, 25 bp, Homo sapien
agaaggcagtgcgtaggcccagctc

SEQ ID NO: 483975 - DNA, 25 bp, Homo sapien
gctccatgtacagcacaggcggcaa

SEQ ID NO: 483976 - DNA, 25 bp, Homo sapien
gcggcaaacgaaaggacaacccaat

SEQ ID NO: 483977 - DNA, 25 bp, Homo sapien
aacccaattgaggatgagctcgtct

SEQ ID NO: 483978 - DNA, 25 bp, Homo sapien
atgagctcgtcttccgtgttggcag

SEQ ID NO: 483979 - DNA, 25 bp, Homo sapien
gtcttccgtgttggcagtcgtggaa

SEQ ID NO: 483980 - DNA, 25 bp, Homo sapien
aaattaggttttacaaagatcacat

SEQ ID NO: 483981 - DNA, 25 bp, Homo sapien
ggttttacaaagatcacattttggt

SEQ ID NO: 483982 - DNA, 25 bp, Homo sapien
cacattttggtgaatagactaagat

SEQ ID NO: 483983 - DNA, 25 bp, Homo sapien
gtcacagatggaagtcaagggaagt

SEQ ID NO: 483984 - DNA, 25 bp, Homo sapien
caagagcacatggaagaggatgcaa

SEQ ID NO: 483985 - DNA, 25 bp, Homo sapien
tggaagaggatgcaagaagaatcat

SEQ ID NO: 483986 - DNA, 25 bp, Homo sapien
gggtaaccatcttgaccttctgttt

SEQ ID NO: 483987 - DNA, 25 bp, Homo sapien
gtaaccatcttgaccttctgttttt

SEQ ID NO: 483988 - DNA, 25 bp, Homo sapien
taaccatcttgaccttctgtttttt

SEQ ID NO: 483989 - DNA, 25 bp, Homo sapien
accatcttgaccttctgttttttct

SEQ ID NO: 483990 - DNA, 25 bp, Homo sapien
ctgttttttctctcccctgcaggaa

SEQ ID NO: 483991 - DNA, 25 bp, Homo sapien
gcacaaggaccacaaccggggccgt

SEQ ID NO: 483992 - DNA, 25 bp, Homo sapien
agagggagcggcaccgccccagcag

SEQ ID NO: 483993 - DNA, 25 bp, Homo sapien
ttctcccacgacagaactgcacttg

SEQ ID NO: 483994 - DNA, 25 bp, Homo sapien
tcccacgacagaactgcacttgtag

SEQ ID NO: 483995 - DNA, 25 bp, Homo sapien
acgacagaactgcacttgtagccgg

SEQ ID NO: 483996 - DNA, 25 bp, Homo sapien
gacagaactgcacttgtagccggag

SEQ ID NO: 483997 - DNA, 25 bp, Homo sapien
acagaactgcacttgtagccggaga

SEQ ID NO: 483998 - DNA, 25 bp, Homo sapien
agaactgcacttgtagccggagaca

SEQ ID NO: 483999 - DNA, 25 bp, Homo sapien
gaactgcacttgtagccggagacaa

SEQ ID NO: 484000 - DNA, 25 bp, Homo sapien
actgcacttgtagccggagacaact

SEQ ID NO: 484001 - DNA, 25 bp, Homo sapien
acttgtagccggagacaactgtaac

SEQ ID NO: 484002 - DNA, 25 bp, Homo sapien
aaaagacagcagaaggcccggcgca

SEQ ID NO: 484003 - DNA, 25 bp, Homo sapien
aagacagcagaaggcccggcgcagt

SEQ ID NO: 484004 - DNA, 25 bp, Homo sapien
aggccgaggaggacggatcagatca

SEQ ID NO: 484005 - DNA, 25 bp, Homo sapien
gaggacggatcagatcacctgagat

SEQ ID NO: 484006 - DNA, 25 bp, Homo sapien
tcaggagttgaagacgagcccgatc

SEQ ID NO: 484007 - DNA, 25 bp, Homo sapien
caggagttgaagacgagcccgatca

SEQ ID NO: 484008 - DNA, 25 bp, Homo sapien
aggagttgaagacgagcccgatcaa

SEQ ID NO: 484009 - DNA, 25 bp, Homo sapien
ggagttgaagacgagcccgatcaac

SEQ ID NO: 484010 - DNA, 25 bp, Homo sapien
gagttgaagacgagcccgatcaaca

SEQ ID NO: 484011 - DNA, 25 bp, Homo sapien
agttgaagacgagcccgatcaacat

SEQ ID NO: 484012 - DNA, 25 bp, Homo sapien
gaagacgagcccgatcaacatggag

SEQ ID NO: 484013 - DNA, 25 bp, Homo sapien
aatacaaattccctctggcacagtg

SEQ ID NO: 484014 - DNA, 25 bp, Homo sapien
gtcaaagacctcctgcgtcgtctaa

SEQ ID NO: 484015 - DNA, 25 bp, Homo sapien
gcgtcgtctaactggtcaggctgaa

SEQ ID NO: 484016 - DNA, 25 bp, Homo sapien
ggtcaggctgaaggcaagctaatct

SEQ ID NO: 484017 - DNA, 25 bp, Homo sapien
gaaggcaagctaatctctgtagaat

SEQ ID NO: 484018 - DNA, 25 bp, Homo sapien
gtttattcaggtccactcagaagtg

SEQ ID NO: 484019 - DNA, 25 bp, Homo sapien
aaagagtgtctttctacctaggatt

SEQ ID NO: 484020 - DNA, 25 bp, Homo sapien
tacctaggattttccattgaaggcc

SEQ ID NO: 484021 - DNA, 25 bp, Homo sapien
attgaaggccctctggcatatgata

SEQ ID NO: 484022 - DNA, 25 bp, Homo sapien
aggccctctggcatatgatatagaa

SEQ ID NO: 484023 - DNA, 25 bp, Homo sapien
tacatcacctgtagttcaaatacgt

SEQ ID NO: 484024 - DNA, 25 bp, Homo sapien
gagccagaggcttgacagagctgtt

SEQ ID NO: 484025 - DNA, 25 bp, Homo sapien
gacagagctgttacttatgtgtgag

SEQ ID NO: 484026 - DNA, 25 bp, Homo sapien
gttacttatgtgtgagggctttatt

SEQ ID NO: 484027 - DNA, 25 bp, Homo sapien
agggctttattctcaggcagtagtt

SEQ ID NO: 484028 - DNA, 25 bp, Homo sapien
ttctcaggcagtagtttattcatca

SEQ ID NO: 484029 - DNA, 25 bp, Homo sapien
tttattcatcatttggtaagcccct

SEQ ID NO: 484030 - DNA, 25 bp, Homo sapien
gtttgtgatgactctcagaagcctt

SEQ ID NO: 484031 - DNA, 25 bp, Homo sapien
gatgactctcagaagccttttggct

SEQ ID NO: 484032 - DNA, 25 bp, Homo sapien
gagtttctaagttcctagagagcca

SEQ ID NO: 484033 - DNA, 25 bp, Homo sapien
aagttcctagagagccatttaataa

SEQ ID NO: 484034 - DNA, 25 bp, Homo sapien
taattagttggtgagccagaggctt

SEQ ID NO: 484035 - DNA, 25 bp, Homo sapien
gatctatggatagtgaacctctttg

SEQ ID NO: 484036 - DNA, 25 bp, Homo sapien
tgaacctctttgaagctggaaccat

SEQ ID NO: 484037 - DNA, 25 bp, Homo sapien
acacttgctgcacttgtacgagttt

SEQ ID NO: 484038 - DNA, 25 bp, Homo sapien
gtacgagttttctccatcaagctgt

SEQ ID NO: 484039 - DNA, 25 bp, Homo sapien
gttccggcttcacaaactgctccaa

SEQ ID NO: 484040 - DNA, 25 bp, Homo sapien
aaactgctccaatgccttgttgaca

SEQ ID NO: 484041 - DNA, 25 bp, Homo sapien
ttgttgacactctgagcagccttta

SEQ ID NO: 484042 - DNA, 25 bp, Homo sapien
agcagcctttatctccaatgttata

SEQ ID NO: 484043 - DNA, 25 bp, Homo sapien
aaagtatctgaaacgcccttgcaat

SEQ ID NO: 484044 - DNA, 25 bp, Homo sapien
gaaacgcccttgcaatttaaacatt

SEQ ID NO: 484045 - DNA, 25 bp, Homo sapien
aacatttggctctagatcttaggta

SEQ ID NO: 484046 - DNA, 25 bp, Homo sapien
agtttacttgtagcaaatatgttta

SEQ ID NO: 484047 - DNA, 25 bp, Homo sapien
gtttacattgataaagccagatatg

SEQ ID NO: 484048 - DNA, 25 bp, Homo sapien
aagccagatatgttttgacaatgaa

SEQ ID NO: 484049 - DNA, 25 bp, Homo sapien
tttacatatcaagtactgcaaataa

SEQ ID NO: 484050 - DNA, 25 bp, Homo sapien
aaggtggtgctatgatatatgctta

SEQ ID NO: 484051 - DNA, 25 bp, Homo sapien
atatgcttaggaggacagttttaat

SEQ ID NO: 484052 - DNA, 25 bp, Homo sapien
taatgattgtacttgcatgaacaca

SEQ ID NO: 484053 - DNA, 25 bp, Homo sapien
gcatgaacacaatcatatgatggta

SEQ ID NO: 484054 - DNA, 25 bp, Homo sapien
tcatatgatggtaaagcagaaactt

SEQ ID NO: 484055 - DNA, 25 bp, Homo sapien
tttgaattgaactacgctaggccta

SEQ ID NO: 484056 - DNA, 25 bp, Homo sapien
ttgaactacgctaggcctaaatgcc

SEQ ID NO: 484057 - DNA, 25 bp, Homo sapien
ccaaattactgtgggttgcaaagaa

SEQ ID NO: 484058 - DNA, 25 bp, Homo sapien
gaattagcaggtcatttacaaagca

SEQ ID NO: 484059 - DNA, 25 bp, Homo sapien
tttacaaagcagacatcccttcacc

SEQ ID NO: 484060 - DNA, 25 bp, Homo sapien
gtggttttgcatgctcaggttctca

SEQ ID NO: 484061 - DNA, 25 bp, Homo sapien
gcatgctcaggttctcagtctatga

SEQ ID NO: 484062 - DNA, 25 bp, Homo sapien
cagtctatgagctttggtgcaggat

SEQ ID NO: 484063 - DNA, 25 bp, Homo sapien
ttggtgcaggatcattttggctact

SEQ ID NO: 484064 - DNA, 25 bp, Homo sapien
gatcattttggctactggaaaaacc

SEQ ID NO: 484065 - DNA, 25 bp, Homo sapien
aaatttctggttgccaaagccacca

SEQ ID NO: 484066 - DNA, 25 bp, Homo sapien
aaagccaccacacgtgtggtctgtg

SEQ ID NO: 484067 - DNA, 25 bp, Homo sapien
gtctgtggatgaccattgtctgcag

SEQ ID NO: 484068 - DNA, 25 bp, Homo sapien
gagacagggcattcctccccactct

SEQ ID NO: 484069 - DNA, 25 bp, Homo sapien
tctccaggctgcctctgggtagcct

SEQ ID NO: 484070 - DNA, 25 bp, Homo sapien
ccaggctgcctctgggtagcctcta

SEQ ID NO: 484071 - DNA, 25 bp, Homo sapien
ctgcctctgggtagcctctagtctg

SEQ ID NO: 484072 - DNA, 25 bp, Homo sapien
tgcctctgggtagcctctagtctgc

SEQ ID NO: 484073 - DNA, 25 bp, Homo sapien
cctctgggtagcctctagtctgctg

SEQ ID NO: 484074 - DNA, 25 bp, Homo sapien
ctctgggtagcctctagtctgctgt

SEQ ID NO: 484075 - DNA, 25 bp, Homo sapien
tctgggtagcctctagtctgctgtt

SEQ ID NO: 484076 - DNA, 25 bp, Homo sapien
ctgggtagcctctagtctgctgttc

SEQ ID NO: 484077 - DNA, 25 bp, Homo sapien
tgggtagcctctagtctgctgttct

SEQ ID NO: 484078 - DNA, 25 bp, Homo sapien
gggtagcctctagtctgctgttctt

SEQ ID NO: 484079 - DNA, 25 bp, Homo sapien
tatagtggttctttatttaaggaat

SEQ ID NO: 484080 - DNA, 25 bp, Homo sapien
tatttaaggaataactcagctgggt

SEQ ID NO: 484081 - DNA, 25 bp, Homo sapien
atttaaggaataactcagctgggtg

SEQ ID NO: 484082 - DNA, 25 bp, Homo sapien
tttaaggaataactcagctgggtgc

SEQ ID NO: 484083 - DNA, 25 bp, Homo sapien
ttaaggaataactcagctgggtgca

SEQ ID NO: 484084 - DNA, 25 bp, Homo sapien
taaggaataactcagctgggtgcag

SEQ ID NO: 484085 - DNA, 25 bp, Homo sapien
aaggaataactcagctgggtgcagt

SEQ ID NO: 484086 - DNA, 25 bp, Homo sapien
aggaataactcagctgggtgcagtg

SEQ ID NO: 484087 - DNA, 25 bp, Homo sapien
ggaataactcagctgggtgcagtgg

SEQ ID NO: 484088 - DNA, 25 bp, Homo sapien
cgtgcacctatggtcccagctattt

SEQ ID NO: 484089 - DNA, 25 bp, Homo sapien
tgcacctatggtcccagctatttgg

SEQ ID NO: 484090 - DNA, 25 bp, Homo sapien
ggcctctagcttttcaatacctgat

SEQ ID NO: 484091 - DNA, 25 bp, Homo sapien
atacctgataagtgttcttggttat

SEQ ID NO: 484092 - DNA, 25 bp, Homo sapien
ttcttggttatgttttgaacactta

SEQ ID NO: 484093 - DNA, 25 bp, Homo sapien
tctatatttatgtaggggccaccct

SEQ ID NO: 484094 - DNA, 25 bp, Homo sapien
ttgccctacttgcatgccactttga

SEQ ID NO: 484095 - DNA, 25 bp, Homo sapien
tggtttgggagaatacactgatact

SEQ ID NO: 484096 - DNA, 25 bp, Homo sapien
atcagtgtgaattctgtatgcataa

SEQ ID NO: 484097 - DNA, 25 bp, Homo sapien
gaatacactgatacttcctcatttg

SEQ ID NO: 484098 - DNA, 25 bp, Homo sapien
acactgatacttcctcatttgaaaa

SEQ ID NO: 484099 - DNA, 25 bp, Homo sapien
aagaaccagaagtggctggcctcta

SEQ ID NO: 484100 - DNA, 25 bp, Homo sapien
aagtggctggcctctagcttttcaa

SEQ ID NO: 484101 - DNA, 25 bp, Homo sapien
gggcactcaccctaagtatctagaa

SEQ ID NO: 484102 - DNA, 25 bp, Homo sapien
gatataggagatgccacccaagttt

SEQ ID NO: 484103 - DNA, 25 bp, Homo sapien
atgccacccaagtttatgtagcgtt

SEQ ID NO: 484104 - DNA, 25 bp, Homo sapien
atgtagcgttcttggtttacctgga

SEQ ID NO: 484105 - DNA, 25 bp, Homo sapien
tagcgttcttggtttacctggacct

SEQ ID NO: 484106 - DNA, 25 bp, Homo sapien
caaaagctggcatgaagtaaactgt

SEQ ID NO: 484107 - DNA, 25 bp, Homo sapien
gtgtaggattaccagaactccagct

SEQ ID NO: 484108 - DNA, 25 bp, Homo sapien
agctcatctgccttgttggtactga

SEQ ID NO: 484109 - DNA, 25 bp, Homo sapien
ctgccttgttggtactgagatagaa

SEQ ID NO: 484110 - DNA, 25 bp, Homo sapien
gagctccttcgtgggcccctgagga

SEQ ID NO: 484111 - DNA, 25 bp, Homo sapien
tgaggacgcctggatgggcactcac

SEQ ID NO: 484112 - DNA, 25 bp, Homo sapien
gctttggcttacttgaaatgtactt

SEQ ID NO: 484113 - DNA, 25 bp, Homo sapien
tggcttacttgaaatgtacttttta

SEQ ID NO: 484114 - DNA, 25 bp, Homo sapien
actacaggttcaacttaaaagtgct

SEQ ID NO: 484115 - DNA, 25 bp, Homo sapien
ggtaaaaacagcaagactcagaaca

SEQ ID NO: 484116 - DNA, 25 bp, Homo sapien
agcaagactcagaacatacgggtat

SEQ ID NO: 484117 - DNA, 25 bp, Homo sapien
gactcagaacatacgggtataccgt

SEQ ID NO: 484118 - DNA, 25 bp, Homo sapien
acgggtataccgtcatatattttga

SEQ ID NO: 484119 - DNA, 25 bp, Homo sapien
ggtataccgtcatatattttgaaag

SEQ ID NO: 484120 - DNA, 25 bp, Homo sapien
atagatcagctacaaaactcttgaa

SEQ ID NO: 484121 - DNA, 25 bp, Homo sapien
atatgtttatatttcctcccacctc

SEQ ID NO: 484122 - DNA, 25 bp, Homo sapien
atgaaaaatacatttacttctctgc

SEQ ID NO: 484123 - DNA, 25 bp, Homo sapien
ttttttgaacctcagcaactttgaa

SEQ ID NO: 484124 - DNA, 25 bp, Homo sapien
ttgaacctcagcaactttgaatgat

SEQ ID NO: 484125 - DNA, 25 bp, Homo sapien
acctcagcaactttgaatgatttta

SEQ ID NO: 484126 - DNA, 25 bp, Homo sapien
gaactttagaatgattttctccaca

SEQ ID NO: 484127 - DNA, 25 bp, Homo sapien
ctttagaatgattttctccacattt

SEQ ID NO: 484128 - DNA, 25 bp, Homo sapien
aaaacctgcttatatttatacagtg

SEQ ID NO: 484129 - DNA, 25 bp, Homo sapien
ttatacagtgagtctgaagcgaaga

SEQ ID NO: 484130 - DNA, 25 bp, Homo sapien
ctgaagcgaagaaatttgaaccata

SEQ ID NO: 484131 - DNA, 25 bp, Homo sapien
gaaccatacaatgtttaattcctat

SEQ ID NO: 484132 - DNA, 25 bp, Homo sapien
gtttaattcctatggtgcttttcat

SEQ ID NO: 484133 - DNA, 25 bp, Homo sapien
gcttttcatgtacttcatttatcgt

SEQ ID NO: 484134 - DNA, 25 bp, Homo sapien
aaattaggttttacaaagatcacat

SEQ ID NO: 484135 - DNA, 25 bp, Homo sapien
ggttttacaaagatcacattttggt

SEQ ID NO: 484136 - DNA, 25 bp, Homo sapien
cacattttggtgaatagactaagat

SEQ ID NO: 484137 - DNA, 25 bp, Homo sapien
gtcacagatggaagtcaagggaagt

SEQ ID NO: 484138 - DNA, 25 bp, Homo sapien
caagagcacatggaagaggatgcaa

SEQ ID NO: 484139 - DNA, 25 bp, Homo sapien
gggtaaccatcttgaccttctgttt

SEQ ID NO: 484140 - DNA, 25 bp, Homo sapien
gtaaccatcttgaccttctgttttt

SEQ ID NO: 484141 - DNA, 25 bp, Homo sapien
accatcttgaccttctgttttttct

SEQ ID NO: 484142 - DNA, 25 bp, Homo sapien
ctgttttttctctcccctgcaggaa

SEQ ID NO: 484143 - DNA, 25 bp, Homo sapien
ggagcaccttcattagtacagcttg

SEQ ID NO: 484144 - DNA, 25 bp, Homo sapien
gtacagcttgcatatttaacatttt

SEQ ID NO: 484145 - DNA, 25 bp, Homo sapien
gcgcgtccaggtgccctgtgtccct

SEQ ID NO: 484146 - DNA, 25 bp, Homo sapien
gggcggatcagacctggaggtctga

SEQ ID NO: 484147 - DNA, 25 bp, Homo sapien
tgcctgcgggactggccacccaagg

SEQ ID NO: 484148 - DNA, 25 bp, Homo sapien
tgcgggactggccacccaagggccg

SEQ ID NO: 484149 - DNA, 25 bp, Homo sapien
tggacgcctccctctgtgaggtcag

SEQ ID NO: 484150 - DNA, 25 bp, Homo sapien
gacgcctccctctgtgaggtcaggt

SEQ ID NO: 484151 - DNA, 25 bp, Homo sapien
gggtcaaggctgtgcgcagggtcgt

SEQ ID NO: 484152 - DNA, 25 bp, Homo sapien
aaggctgtgcgcagggtcgtgttga

SEQ ID NO: 484153 - DNA, 25 bp, Homo sapien
tgcaacagggttcagaatgacacca

SEQ ID NO: 484154 - DNA, 25 bp, Homo sapien
aacagggttcagaatgacaccacca

SEQ ID NO: 484155 - DNA, 25 bp, Homo sapien
agggttcagaatgacaccaccaggt

SEQ ID NO: 484156 - DNA, 25 bp, Homo sapien
caggtggcggcgttgccatgtcgca

SEQ ID NO: 484157 - DNA, 25 bp, Homo sapien
ttgccatgtcgcacggtcacagcca

SEQ ID NO: 484158 - DNA, 25 bp, Homo sapien
atgtcgcacggtcacagccacggcg

SEQ ID NO: 484159 - DNA, 25 bp, Homo sapien
gctgcgccgccgaacgggaggagcc

SEQ ID NO: 484160 - DNA, 25 bp, Homo sapien
tggcctacggcctgtacctgcgcat

SEQ ID NO: 484161 - DNA, 25 bp, Homo sapien
tggagcggctgcaatgccttaacga

SEQ ID NO: 484162 - DNA, 25 bp, Homo sapien
agcggctgcaatgccttaacgagag

SEQ ID NO: 484163 - DNA, 25 bp, Homo sapien
gcgcgcttagttgccggagctgaac

SEQ ID NO: 484164 - DNA, 25 bp, Homo sapien
cttagttgccggagctgaacggcgc

SEQ ID NO: 484165 - DNA, 25 bp, Homo sapien
acggcgcggagctggtctgaggcga

SEQ ID NO: 484166 - DNA, 25 bp, Homo sapien
ggagctggtctgaggcgagccgagc

SEQ ID NO: 484167 - DNA, 25 bp, Homo sapien
gatggcacaatctggtttagaaaac

SEQ ID NO: 484168 - DNA, 25 bp, Homo sapien
gatcaatgacataaccctgctgcct

SEQ ID NO: 484169 - DNA, 25 bp, Homo sapien
ctggtgtctgtactttgatgaaggt

SEQ ID NO: 484170 - DNA, 25 bp, Homo sapien
gtgagctataatattggtggttaac

SEQ ID NO: 484171 - DNA, 25 bp, Homo sapien
ggtggttaacataatccagaaggct

SEQ ID NO: 484172 - DNA, 25 bp, Homo sapien
agaaggcttagttctgtgtgtgttc

SEQ ID NO: 484173 - DNA, 25 bp, Homo sapien
tgtgttctgtccctatataaactgg

SEQ ID NO: 484174 - DNA, 25 bp, Homo sapien
ataattatgggctcacttcctactg

SEQ ID NO: 484175 - DNA, 25 bp, Homo sapien
ggctcacttcctactggagatgttg

SEQ ID NO: 484176 - DNA, 25 bp, Homo sapien
tcctactggagatgttgaaagtcta

SEQ ID NO: 484177 - DNA, 25 bp, Homo sapien
gtctaaatcggtttgaccattttga

SEQ ID NO: 484178 - DNA, 25 bp, Homo sapien
ccctagggatgaggccacagatcag

SEQ ID NO: 484179 - DNA, 25 bp, Homo sapien
acagatcaggcttgccctacagctt

SEQ ID NO: 484180 - DNA, 25 bp, Homo sapien
gggccagtgccctgctcataggcag

SEQ ID NO: 484181 - DNA, 25 bp, Homo sapien
tgctcataggcagtgggccctgctc

SEQ ID NO: 484182 - DNA, 25 bp, Homo sapien
ggcaggctggctactcactgcgctg

SEQ ID NO: 484183 - DNA, 25 bp, Homo sapien
tactcactgcgctgctcagggagtc

SEQ ID NO: 484184 - DNA, 25 bp, Homo sapien
ttcattttcttcttgctctaccgtc

SEQ ID NO: 484185 - DNA, 25 bp, Homo sapien
taccgtcctgttctttcagagcagg

SEQ ID NO: 484186 - DNA, 25 bp, Homo sapien
gggcatggtttccttccaaatattt

SEQ ID NO: 484187 - DNA, 25 bp, Homo sapien
tccttccaaatatttctgctgcttt

SEQ ID NO: 484188 - DNA, 25 bp, Homo sapien
gctgcttttataagtgtacaccctt

SEQ ID NO: 484189 - DNA, 25 bp, Homo sapien
gcccagctactattcttattattcc

SEQ ID NO: 484190 - DNA, 25 bp, Homo sapien
aaatgccaccccaccatatttctaa

SEQ ID NO: 484191 - DNA, 25 bp, Homo sapien
aagattctactttgcccagtttgtc

SEQ ID NO: 484192 - DNA, 25 bp, Homo sapien
tttgcccagtttgtcctcaattgag

SEQ ID NO: 484193 - DNA, 25 bp, Homo sapien
gtcctcaattgagcagttttgtcta

SEQ ID NO: 484194 - DNA, 25 bp, Homo sapien
ttgagcagttttgtctaagcccaga

SEQ ID NO: 484195 - DNA, 25 bp, Homo sapien
agttttgtctaagcccagagtttct

SEQ ID NO: 484196 - DNA, 25 bp, Homo sapien
agagtttctgctgggccagagtatg

SEQ ID NO: 484197 - DNA, 25 bp, Homo sapien
gagtatggatgagctgtctctccct

SEQ ID NO: 484198 - DNA, 25 bp, Homo sapien
atggatgagctgtctctccctggct

SEQ ID NO: 484199 - DNA, 25 bp, Homo sapien
tggctggtgcccatgcctgcctgta

SEQ ID NO: 484200 - DNA, 25 bp, Homo sapien
tgcgtgtttgggtcagtctgtgccc

SEQ ID NO: 484201 - DNA, 25 bp, Homo sapien
tgggtcagtctgtgccctctcagta

SEQ ID NO: 484202 - DNA, 25 bp, Homo sapien
ccctctcagtagacactggagctgc

SEQ ID NO: 484203 - DNA, 25 bp, Homo sapien
gagctgctctgtccctgaagaggcc

SEQ ID NO: 484204 - DNA, 25 bp, Homo sapien
acccgatgcaggactcacctctgtg

SEQ ID NO: 484205 - DNA, 25 bp, Homo sapien
ttgctgctcctgaggcccaagggca

SEQ ID NO: 484206 - DNA, 25 bp, Homo sapien
ggcccaagggcagccatggtgctct

SEQ ID NO: 484207 - DNA, 25 bp, Homo sapien
atggtgctctgtactgctcgggccg

SEQ ID NO: 484208 - DNA, 25 bp, Homo sapien
gggccgcccaggtcacagagcctga

SEQ ID NO: 484209 - DNA, 25 bp, Homo sapien
gtagccaaagcagcctgatgaccca

SEQ ID NO: 484210 - DNA, 25 bp, Homo sapien
tgatgacccacccaccaaggaagaa

SEQ ID NO: 484211 - DNA, 25 bp, Homo sapien
tgcgtgtttgggtcagtctgtgccc

SEQ ID NO: 484212 - DNA, 25 bp, Homo sapien
gtttgggtcagtctgtgccctctca

SEQ ID NO: 484213 - DNA, 25 bp, Homo sapien
gggtcagtctgtgccctctcagtag

SEQ ID NO: 484214 - DNA, 25 bp, Homo sapien
ccctctcagtagacactggagctgc

SEQ ID NO: 484215 - DNA, 25 bp, Homo sapien
acccgatgcaggactcacctctgtg

SEQ ID NO: 484216 - DNA, 25 bp, Homo sapien
cgatgcaggactcacctctgtgcct

SEQ ID NO: 484217 - DNA, 25 bp, Homo sapien
tctgtgccttgctgctcctgaggcc

SEQ ID NO: 484218 - DNA, 25 bp, Homo sapien
ttgctgctcctgaggcccaagggca

SEQ ID NO: 484219 - DNA, 25 bp, Homo sapien
ggcccaagggcagccatggtgctct

SEQ ID NO: 484220 - DNA, 25 bp, Homo sapien
atggtgctctgtactgctcgggccg

SEQ ID NO: 484221 - DNA, 25 bp, Homo sapien
gtagccaaagcagcctgatgaccca

SEQ ID NO: 484222 - DNA, 25 bp, Homo sapien
tgggtgtgccataacctctctcgta

SEQ ID NO: 484223 - DNA, 25 bp, Homo sapien
ataacctctctcgtagccattcatt

SEQ ID NO: 484224 - DNA, 25 bp, Homo sapien
gtagccattcattcccggatacata

SEQ ID NO: 484225 - DNA, 25 bp, Homo sapien
tcattcccggatacataccctagag

SEQ ID NO: 484226 - DNA, 25 bp, Homo sapien
tcccggatacataccctagagaaac

SEQ ID NO: 484227 - DNA, 25 bp, Homo sapien
cggatacataccctagagaaactct

SEQ ID NO: 484228 - DNA, 25 bp, Homo sapien
gaaactcttacacatgcgtaccagg

SEQ ID NO: 484229 - DNA, 25 bp, Homo sapien
gatggatttaagcatttgtgtgtaa

SEQ ID NO: 484230 - DNA, 25 bp, Homo sapien
cgggaagatcccaagtgtccaccaa

SEQ ID NO: 484231 - DNA, 25 bp, Homo sapien
atactgtggtatattccaacagtgg

SEQ ID NO: 484232 - DNA, 25 bp, Homo sapien
tgaactgcagctatgtatgtgaaca

SEQ ID NO: 484233 - DNA, 25 bp, Homo sapien
ggacaaggaccacgcgaaagagtac

SEQ ID NO: 484234 - DNA, 25 bp, Homo sapien
gaaagagtacaaacgagcccggcat

SEQ ID NO: 484235 - DNA, 25 bp, Homo sapien
agagtacaaacgagcccggcatgag

SEQ ID NO: 484236 - DNA, 25 bp, Homo sapien
aacgagcccggcatgagatcaaaaa

SEQ ID NO: 484237 - DNA, 25 bp, Homo sapien
agaagtcgtcggacacgctgaagct

SEQ ID NO: 484238 - DNA, 25 bp, Homo sapien
ccctgcaggacgtcaacgacatgta

SEQ ID NO: 484239 - DNA, 25 bp, Homo sapien
aggacgtcaacgacatgtacctgct

SEQ ID NO: 484240 - DNA, 25 bp, Homo sapien
agaagcaggccgtgcgccgggcgct

SEQ ID NO: 484241 - DNA, 25 bp, Homo sapien
cctgtggtgaatggagagctgacca

SEQ ID NO: 484242 - DNA, 25 bp, Homo sapien
agagctgaccatgctgggagagatc

SEQ ID NO: 484243 - DNA, 25 bp, Homo sapien
gaccatgctgggagagatcacccac

SEQ ID NO: 484244 - DNA, 25 bp, Homo sapien
gggatggatttaagcatttgtgtgt

SEQ ID NO: 484245 - DNA, 25 bp, Homo sapien
gatggatttaagcatttgtgtgtaa

SEQ ID NO: 484246 - DNA, 25 bp, Homo sapien
aagcatttgtgtgtaataggaagaa

SEQ ID NO: 484247 - DNA, 25 bp, Homo sapien
ccgggaagatcccaagtgtccacca

SEQ ID NO: 484248 - DNA, 25 bp, Homo sapien
cgggaagatcccaagtgtccaccaa

SEQ ID NO: 484249 - DNA, 25 bp, Homo sapien
ataaatactgtggtatattccaaca

SEQ ID NO: 484250 - DNA, 25 bp, Homo sapien
taaatactgtggtatattccaacag

SEQ ID NO: 484251 - DNA, 25 bp, Homo sapien
aaatactgtggtatattccaacagt

SEQ ID NO: 484252 - DNA, 25 bp, Homo sapien
aatactgtggtatattccaacagtg

SEQ ID NO: 484253 - DNA, 25 bp, Homo sapien
atactgtggtatattccaacagtgg

SEQ ID NO: 484254 - DNA, 25 bp, Homo sapien
atgtatgtgaacatggacaaaactc

SEQ ID NO: 484255 - DNA, 25 bp, Homo sapien
tcacacagatgtgggattgttgaga

SEQ ID NO: 484256 - DNA, 25 bp, Homo sapien
gattgttgagagctgagtgtcctat

SEQ ID NO: 484257 - DNA, 25 bp, Homo sapien
gagagctgagtgtcctatgacctct

SEQ ID NO: 484258 - DNA, 25 bp, Homo sapien
tatgacctcttctgctgcccaagaa

SEQ ID NO: 484259 - DNA, 25 bp, Homo sapien
tctccacggaggtcttaaggcagag

SEQ ID NO: 484260 - DNA, 25 bp, Homo sapien
ctgtgagcagccaaaagggtttaga

SEQ ID NO: 484261 - DNA, 25 bp, Homo sapien
tttagagtcaggcagcctcaggtta

SEQ ID NO: 484262 - DNA, 25 bp, Homo sapien
agtcaggcagcctcaggttacaaat

SEQ ID NO: 484263 - DNA, 25 bp, Homo sapien
ggcagcctcaggttacaaatccagt

SEQ ID NO: 484264 - DNA, 25 bp, Homo sapien
ctcaggttacaaatccagtcctgca

SEQ ID NO: 484265 - DNA, 25 bp, Homo sapien
gtaagcttaaaaaagtgactgcact

SEQ ID NO: 484266 - DNA, 25 bp, Homo sapien
gtccatatccgggtggaccgggtgg

SEQ ID NO: 484267 - DNA, 25 bp, Homo sapien
cctccaggtcccgaggtggataagg

SEQ ID NO: 484268 - DNA, 25 bp, Homo sapien
gagtgacgtgcagagattccctttc

SEQ ID NO: 484269 - DNA, 25 bp, Homo sapien
tgacgtgcagagattccctttcgcc

SEQ ID NO: 484270 - DNA, 25 bp, Homo sapien
ttcgccccttcggatccaagagagg

SEQ ID NO: 484271 - DNA, 25 bp, Homo sapien
ccttcggatccaagagagggtggca

SEQ ID NO: 484272 - DNA, 25 bp, Homo sapien
aatgcgtgggtgacttggcgtggat

SEQ ID NO: 484273 - DNA, 25 bp, Homo sapien
ggatttagggcgtgcccaccctgca

SEQ ID NO: 484274 - DNA, 25 bp, Homo sapien
ggcctcctagagtgtcccgagggcc

SEQ ID NO: 484275 - DNA, 25 bp, Homo sapien
tgagaggccgcagggacacgaagga

SEQ ID NO: 484276 - DNA, 25 bp, Homo sapien
gaggaacccgaagagggctcgccta

SEQ ID NO: 484277 - DNA, 25 bp, Homo sapien
cggatcgcccggaggctggacaaga

SEQ ID NO: 484278 - DNA, 25 bp, Homo sapien
ggatcgcccggaggctggacaagat

SEQ ID NO: 484279 - DNA, 25 bp, Homo sapien
cgctgctcctgaggcgatgatgggc

SEQ ID NO: 484280 - DNA, 25 bp, Homo sapien
tgctcctgaggcgatgatgggcaag

SEQ ID NO: 484281 - DNA, 25 bp, Homo sapien
gctcctgaggcgatgatgggcaagg

SEQ ID NO: 484282 - DNA, 25 bp, Homo sapien
ctgaggcgatgatgggcaaggaaga

SEQ ID NO: 484283 - DNA, 25 bp, Homo sapien
ggaagaggagattgcgcggatcgcc

SEQ ID NO: 484284 - DNA, 25 bp, Homo sapien
gaagaggagattgcgcggatcgccc

SEQ ID NO: 484285 - DNA, 25 bp, Homo sapien
ggagattgcgcggatcgcccggagg

SEQ ID NO: 484286 - DNA, 25 bp, Homo sapien
agattgcgcggatcgcccggaggct

SEQ ID NO: 484287 - DNA, 25 bp, Homo sapien
gattgcgcggatcgcccggaggctg

SEQ ID NO: 484288 - DNA, 25 bp, Homo sapien
accttctaggcgaatagtccccaga

SEQ ID NO: 484289 - DNA, 25 bp, Homo sapien
taggcgaatagtccccagagctgtg

SEQ ID NO: 484290 - DNA, 25 bp, Homo sapien
agctgtgttcctccaaggggtccga

SEQ ID NO: 484291 - DNA, 25 bp, Homo sapien
gggtccgaggaatcactcactcctg

SEQ ID NO: 484292 - DNA, 25 bp, Homo sapien
ctggaggctggcaaggagacagtct

SEQ ID NO: 484293 - DNA, 25 bp, Homo sapien
gggacacatgaagggatgtccccac

SEQ ID NO: 484294 - DNA, 25 bp, Homo sapien
ccccaggcttccagagttgaaagcc

SEQ ID NO: 484295 - DNA, 25 bp, Homo sapien
cttccagagttgaaagccaggagaa

SEQ ID NO: 484296 - DNA, 25 bp, Homo sapien
gagaaaatcggcaaagaccaccctt

SEQ ID NO: 484297 - DNA, 25 bp, Homo sapien
taaacccaagcacccaatgatgcaa

SEQ ID NO: 484298 - DNA, 25 bp, Homo sapien
acccaagcacccaatgatgcaaaaa

SEQ ID NO: 484299 - DNA, 25 bp, Homo sapien
tgctcctcctggttggagcgcagtg

SEQ ID NO: 484300 - DNA, 25 bp, Homo sapien
ctcctcctggttggagcgcagtgtc

SEQ ID NO: 484301 - DNA, 25 bp, Homo sapien
tcctcctggttggagcgcagtgtcc

SEQ ID NO: 484302 - DNA, 25 bp, Homo sapien
cctcctggttggagcgcagtgtccg

SEQ ID NO: 484303 - DNA, 25 bp, Homo sapien
ctggttggagcgcagtgtccggagc

SEQ ID NO: 484304 - DNA, 25 bp, Homo sapien
tggttggagcgcagtgtccggagcg

SEQ ID NO: 484305 - DNA, 25 bp, Homo sapien
cgagagcagggttcggtgccttttc

SEQ ID NO: 484306 - DNA, 25 bp, Homo sapien
gagcagggttcggtgccttttcctc

SEQ ID NO: 484307 - DNA, 25 bp, Homo sapien
agcagggttcggtgccttttcctct

SEQ ID NO: 484308 - DNA, 25 bp, Homo sapien
gcagggttcggtgccttttcctctg

SEQ ID NO: 484309 - DNA, 25 bp, Homo sapien
cagggttcggtgccttttcctctgt

SEQ ID NO: 484310 - DNA, 25 bp, Homo sapien
tcatacctgctgatgggttttcttt

SEQ ID NO: 484311 - DNA, 25 bp, Homo sapien
ttctaaaaggaatgctcgccccagc

SEQ ID NO: 484312 - DNA, 25 bp, Homo sapien
tggtgagaccatgcacttctctgtt

SEQ ID NO: 484313 - DNA, 25 bp, Homo sapien
tgcccagtgagttagcacagcagta

SEQ ID NO: 484314 - DNA, 25 bp, Homo sapien
agtagcactgcccttgagcacagtt

SEQ ID NO: 484315 - DNA, 25 bp, Homo sapien
tcccctacaagtctcacgtgtgaaa

SEQ ID NO: 484316 - DNA, 25 bp, Homo sapien
gtctcacgtgtgaaagggctcagct

SEQ ID NO: 484317 - DNA, 25 bp, Homo sapien
agggctcagctcagagtggagactc

SEQ ID NO: 484318 - DNA, 25 bp, Homo sapien
gtggagactcgctgtcaagtcttaa

SEQ ID NO: 484319 - DNA, 25 bp, Homo sapien
gctgtcaagtcttaagcaatccttt

SEQ ID NO: 484320 - DNA, 25 bp, Homo sapien
ttttctgttgtgtgaaggtttcact

SEQ ID NO: 484321 - DNA, 25 bp, Homo sapien
tgccagggctcccttttgacttatt

SEQ ID NO: 484322 - DNA, 25 bp, Homo sapien
agggctcccttttgacttattgtcg

SEQ ID NO: 484323 - DNA, 25 bp, Homo sapien
gctcccttttgacttattgtcgcca

SEQ ID NO: 484324 - DNA, 25 bp, Homo sapien
ttttgacttattgtcgccactgccc

SEQ ID NO: 484325 - DNA, 25 bp, Homo sapien
ttattgtcgccactgccccttggtg

SEQ ID NO: 484326 - DNA, 25 bp, Homo sapien
tggcggttgaggaacgcttcagcct

SEQ ID NO: 484327 - DNA, 25 bp, Homo sapien
gttgaggaacgcttcagccttagct

SEQ ID NO: 484328 - DNA, 25 bp, Homo sapien
aggaacgcttcagccttagctgcta

SEQ ID NO: 484329 - DNA, 25 bp, Homo sapien
ttcagccttagctgctacctttcgg

SEQ ID NO: 484330 - DNA, 25 bp, Homo sapien
ttagctgctacctttcggcagcagt

SEQ ID NO: 484331 - DNA, 25 bp, Homo sapien
gctacctttcggcagcagtgaaata

SEQ ID NO: 484332 - DNA, 25 bp, Homo sapien
gacagcagaaggcccggcgcagtgg

SEQ ID NO: 484333 - DNA, 25 bp, Homo sapien
aggccgaggaggacggatcagatca

SEQ ID NO: 484334 - DNA, 25 bp, Homo sapien
gccgaggaggacggatcagatcacc

SEQ ID NO: 484335 - DNA, 25 bp, Homo sapien
atcaggagttgaagacgagcccgat

SEQ ID NO: 484336 - DNA, 25 bp, Homo sapien
tcaggagttgaagacgagcccgatc

SEQ ID NO: 484337 - DNA, 25 bp, Homo sapien
caggagttgaagacgagcccgatca

SEQ ID NO: 484338 - DNA, 25 bp, Homo sapien
aggagttgaagacgagcccgatcaa

SEQ ID NO: 484339 - DNA, 25 bp, Homo sapien
ggagttgaagacgagcccgatcaac

SEQ ID NO: 484340 - DNA, 25 bp, Homo sapien
gagttgaagacgagcccgatcaaca

SEQ ID NO: 484341 - DNA, 25 bp, Homo sapien
agttgaagacgagcccgatcaacat

SEQ ID NO: 484342 - DNA, 25 bp, Homo sapien
gaagacgagcccgatcaacatggag

SEQ ID NO: 484343 - DNA, 25 bp, Homo sapien
aaccagggaccagaatatcaaatgt

SEQ ID NO: 484344 - DNA, 25 bp, Homo sapien
aatgtctacacatgtcagccaaaga

SEQ ID NO: 484345 - DNA, 25 bp, Homo sapien
cttgagtaatcacctgcttttttcc

SEQ ID NO: 484346 - DNA, 25 bp, Homo sapien
accctgtgtggaatgcagccagcta

SEQ ID NO: 484347 - DNA, 25 bp, Homo sapien
agccagctagctggtttaaaccagt

SEQ ID NO: 484348 - DNA, 25 bp, Homo sapien
ttaaaccagttcatgacagacctca

SEQ ID NO: 484349 - DNA, 25 bp, Homo sapien
gacagacctcagcaatttacagatg

SEQ ID NO: 484350 - DNA, 25 bp, Homo sapien
agatggatcccagtgtactttcctc

SEQ ID NO: 484351 - DNA, 25 bp, Homo sapien
tttcctcattaccatgctagtatct

SEQ ID NO: 484352 - DNA, 25 bp, Homo sapien
atgctagtatcttcaccctgggaga

SEQ ID NO: 484353 - DNA, 25 bp, Homo sapien
tcaccctgggagatgctatagcttc

SEQ ID NO: 484354 - DNA, 25 bp, Homo sapien
ttgctttcttaaagactttggtcgg

SEQ ID NO: 484355 - DNA, 25 bp, Homo sapien
tgctttcttaaagactttggtcggg

SEQ ID NO: 484356 - DNA, 25 bp, Homo sapien
taaagactttggtcgggtatttgtg

SEQ ID NO: 484357 - DNA, 25 bp, Homo sapien
gactttggtcgggtatttgtgttgt

SEQ ID NO: 484358 - DNA, 25 bp, Homo sapien
ctttggtcgggtatttgtgttgttg

SEQ ID NO: 484359 - DNA, 25 bp, Homo sapien
tttggtcgggtatttgtgttgttga

SEQ ID NO: 484360 - DNA, 25 bp, Homo sapien
gtcgggtatttgtgttgttgagtat

SEQ ID NO: 484361 - DNA, 25 bp, Homo sapien
cgggtatttgtgttgttgagtattg

SEQ ID NO: 484362 - DNA, 25 bp, Homo sapien
atttgtgttgttgagtattgtgtct

SEQ ID NO: 484363 - DNA, 25 bp, Homo sapien
ttgtgttgttgagtattgtgtctgg

SEQ ID NO: 484364 - DNA, 25 bp, Homo sapien
ttgagtattgtgtctgggtgtgggt

SEQ ID NO: 484365 - DNA, 25 bp, Homo sapien
atgagagcatactcatacatgttcc

SEQ ID NO: 484366 - DNA, 25 bp, Homo sapien
aaatctgcgaggtagtttctttggt

SEQ ID NO: 484367 - DNA, 25 bp, Homo sapien
ttctttggtattcttgcccaggaaa

SEQ ID NO: 484368 - DNA, 25 bp, Homo sapien
ccaggaaatgggttgattcatcaca

SEQ ID NO: 484369 - DNA, 25 bp, Homo sapien
atcttattgtttttgtaacttgcat

SEQ ID NO: 484370 - DNA, 25 bp, Homo sapien
aagagttctgaccagcaccagataa

SEQ ID NO: 484371 - DNA, 25 bp, Homo sapien
cagataagcttcagtgctctccttt

SEQ ID NO: 484372 - DNA, 25 bp, Homo sapien
gctctcctttctttggccttaatat

SEQ ID NO: 484373 - DNA, 25 bp, Homo sapien
taaagaattactgcctctcactagg

SEQ ID NO: 484374 - DNA, 25 bp, Homo sapien
tactgcctctcactaggagcatcat

SEQ ID NO: 484375 - DNA, 25 bp, Homo sapien
aggagcatcatttatttaccattat

SEQ ID NO: 484376 - DNA, 25 bp, Homo sapien
tcagtcctagtctcagaatctacct

SEQ ID NO: 484377 - DNA, 25 bp, Homo sapien
agtctcagaatctaccttctacttc

SEQ ID NO: 484378 - DNA, 25 bp, Homo sapien
aatctaccttctacttcacacttaa

SEQ ID NO: 484379 - DNA, 25 bp, Homo sapien
cacttaaaattctgagagcagttgg

SEQ ID NO: 484380 - DNA, 25 bp, Homo sapien
gcagttggcaaagctttgccttctc

SEQ ID NO: 484381 - DNA, 25 bp, Homo sapien
gggcaccaataacagtcatgtttga

SEQ ID NO: 484382 - DNA, 25 bp, Homo sapien
gatagaaagattgggcgtcagctaa

SEQ ID NO: 484383 - DNA, 25 bp, Homo sapien
gattgggcgtcagctaaagccaaat

SEQ ID NO: 484384 - DNA, 25 bp, Homo sapien
taaaacattatagcagtatctgtgg

SEQ ID NO: 484385 - DNA, 25 bp, Homo sapien
tagcagtatctgtggttattagaat

SEQ ID NO: 484386 - DNA, 25 bp, Homo sapien
ttcacaaatcccacacatggcctag

SEQ ID NO: 484387 - DNA, 25 bp, Homo sapien
ccagggattgcccagctatagtgtg

SEQ ID NO: 484388 - DNA, 25 bp, Homo sapien
ccagctatagtgtgggtgccctact

SEQ ID NO: 484389 - DNA, 25 bp, Homo sapien
tgggtgccctactgaactctgatta

SEQ ID NO: 484390 - DNA, 25 bp, Homo sapien
ctgaactctgattagggaacctgta

SEQ ID NO: 484391 - DNA, 25 bp, Homo sapien
acctgtataagggtattgagtgtga

SEQ ID NO: 484392 - DNA, 25 bp, Homo sapien
gaaccgatgtgaatggcaggcagat

SEQ ID NO: 484393 - DNA, 25 bp, Homo sapien
tggcaggcagataacatgcacacat

SEQ ID NO: 484394 - DNA, 25 bp, Homo sapien
catgcacacatgaagctggctgggt

SEQ ID NO: 484395 - DNA, 25 bp, Homo sapien
gggagcagcatgctgtctaacagct

SEQ ID NO: 484396 - DNA, 25 bp, Homo sapien
gctgtctaacagctgttagctccag

SEQ ID NO: 484397 - DNA, 25 bp, Homo sapien
tgttagctccagctggttgttgcca

SEQ ID NO: 484398 - DNA, 25 bp, Homo sapien
gactgtccaccgatgaacactcaga

SEQ ID NO: 484399 - DNA, 25 bp, Homo sapien
gaacactcagagtggacaccatctt

SEQ ID NO: 484400 - DNA, 25 bp, Homo sapien
agagtggacaccatcttccgtccac

SEQ ID NO: 484401 - DNA, 25 bp, Homo sapien
tgaacacagggtaaacatctgccgg

SEQ ID NO: 484402 - DNA, 25 bp, Homo sapien
ctccctgggccatgggacagcggca

SEQ ID NO: 484403 - DNA, 25 bp, Homo sapien
cagcggcagggctcaccacggacag

SEQ ID NO: 484404 - DNA, 25 bp, Homo sapien
gcagggctcaccacggacagcacgt

SEQ ID NO: 484405 - DNA, 25 bp, Homo sapien
ttgtcacctccacggagctgcctgt

SEQ ID NO: 484406 - DNA, 25 bp, Homo sapien
cacggagctgcctgtctgggataat

SEQ ID NO: 484407 - DNA, 25 bp, Homo sapien
gagctgcctgtctgggataatttgg

SEQ ID NO: 484408 - DNA, 25 bp, Homo sapien
gggggataattcttttgcatgaccc

SEQ ID NO: 484409 - DNA, 25 bp, Homo sapien
aagatggctgctgagttcgacacct

SEQ ID NO: 484410 - DNA, 25 bp, Homo sapien
ttcgacaccttcttggccagtgggc

SEQ ID NO: 484411 - DNA, 25 bp, Homo sapien
cagtgggcttaggtggttctgccat

SEQ ID NO: 484412 - DNA, 25 bp, Homo sapien
ggacgatgacaactatgtgaaccca

SEQ ID NO: 484413 - DNA, 25 bp, Homo sapien
atgtgaacccaagggcgctgctgca

SEQ ID NO: 484414 - DNA, 25 bp, Homo sapien
cgcgacgtctatgtgggaaggccca

SEQ ID NO: 484415 - DNA, 25 bp, Homo sapien
acaaccgcacgaggctggtacagtt

SEQ ID NO: 484416 - DNA, 25 bp, Homo sapien
ggtacagttctggtttgccactggg

SEQ ID NO: 484417 - DNA, 25 bp, Homo sapien
ctggcttctgcatcaatcgcaaact

SEQ ID NO: 484418 - DNA, 25 bp, Homo sapien
gcatcaatcgcaaactggctttgaa

SEQ ID NO: 484419 - DNA, 25 bp, Homo sapien
tttgaagatggctccgtgggccagt

SEQ ID NO: 484420 - DNA, 25 bp, Homo sapien
tatagtggttctttatttaaggaat

SEQ ID NO: 484421 - DNA, 25 bp, Homo sapien
ttatttaaggaataactcagctggg

SEQ ID NO: 484422 - DNA, 25 bp, Homo sapien
tatttaaggaataactcagctgggt

SEQ ID NO: 484423 - DNA, 25 bp, Homo sapien
atttaaggaataactcagctgggtg

SEQ ID NO: 484424 - DNA, 25 bp, Homo sapien
tttaaggaataactcagctgggtgc

SEQ ID NO: 484425 - DNA, 25 bp, Homo sapien
ttaaggaataactcagctgggtgca

SEQ ID NO: 484426 - DNA, 25 bp, Homo sapien
taaggaataactcagctgggtgcag

SEQ ID NO: 484427 - DNA, 25 bp, Homo sapien
aaggaataactcagctgggtgcagt

SEQ ID NO: 484428 - DNA, 25 bp, Homo sapien
gaaggcaccagaaagctaccaaggc

SEQ ID NO: 484429 - DNA, 25 bp, Homo sapien
ctaccaaggcagagatggcttaatg

SEQ ID NO: 484430 - DNA, 25 bp, Homo sapien
tggcttaatgggacaagcttccaaa

SEQ ID NO: 484431 - DNA, 25 bp, Homo sapien
gaggtgagtccagtgctttgcacaa

SEQ ID NO: 484432 - DNA, 25 bp, Homo sapien
tgctttgcacaactgttcaccttga

SEQ ID NO: 484433 - DNA, 25 bp, Homo sapien
aactgttcaccttgaggcgtttcct

SEQ ID NO: 484434 - DNA, 25 bp, Homo sapien
ggcgtttcctgtttccaaagtaatg

SEQ ID NO: 484435 - DNA, 25 bp, Homo sapien
gagagactgaccagctgcacagagc

SEQ ID NO: 484436 - DNA, 25 bp, Homo sapien
gcacagagcttccatcaatctcaaa

SEQ ID NO: 484437 - DNA, 25 bp, Homo sapien
gaacttcagggccagccaaggaaaa

SEQ ID NO: 484438 - DNA, 25 bp, Homo sapien
tcttccacccatgaataatagccag

SEQ ID NO: 484439 - DNA, 25 bp, Homo sapien
gggcacggaattcgaagacccagca

SEQ ID NO: 484440 - DNA, 25 bp, Homo sapien
cgaagacccagcagcgaacacaagt

SEQ ID NO: 484441 - DNA, 25 bp, Homo sapien
agcgaacacaagtcccggaggcaca

SEQ ID NO: 484442 - DNA, 25 bp, Homo sapien
ggaggcacagaaagggcaaccattc

SEQ ID NO: 484443 - DNA, 25 bp, Homo sapien
aaatccttggtaagggctccgtgca

SEQ ID NO: 484444 - DNA, 25 bp, Homo sapien
taagggctccgtgcagtagttaacc

SEQ ID NO: 484445 - DNA, 25 bp, Homo sapien
aaatccgactaaggagagcaggacg

SEQ ID NO: 484446 - DNA, 25 bp, Homo sapien
acccgggtgccctaatcaaatatgg

SEQ ID NO: 484447 - DNA, 25 bp, Homo sapien
tatgggcaccaaggtaagccggcgc

SEQ ID NO: 484448 - DNA, 25 bp, Homo sapien
taagccggcgcgatcacgtgacatg

SEQ ID NO: 484449 - DNA, 25 bp, Homo sapien
gcgatcacgtgacatgcaccgcgcg

SEQ ID NO: 484450 - DNA, 25 bp, Homo sapien
tgaacttcaggataagcctagagta

SEQ ID NO: 484451 - DNA, 25 bp, Homo sapien
tcaggataagcctagagtaacggtt

SEQ ID NO: 484452 - DNA, 25 bp, Homo sapien
ataagcctagagtaacggttgggag

SEQ ID NO: 484453 - DNA, 25 bp, Homo sapien
aaccttaggagagagagacctacat

SEQ ID NO: 484454 - DNA, 25 bp, Homo sapien
agagagacctacataatggggccca

SEQ ID NO: 484455 - DNA, 25 bp, Homo sapien
tttctccctgaggtctttataaaga

SEQ ID NO: 484456 - DNA, 25 bp, Homo sapien
tctccctgaggtctttataaagaag

SEQ ID NO: 484457 - DNA, 25 bp, Homo sapien
ccctgaggtctttataaagaaggca

SEQ ID NO: 484458 - DNA, 25 bp, Homo sapien
aaagaaggcattgcagaatacagag

SEQ ID NO: 484459 - DNA, 25 bp, Homo sapien
tatcctcaacaatatttcagtaatc

SEQ ID NO: 484460 - DNA, 25 bp, Homo sapien
caacaatatttcagtaatcacaatg

SEQ ID NO: 484461 - DNA, 25 bp, Homo sapien
gatacaataatctacctgtgcatca

SEQ ID NO: 484462 - DNA, 25 bp, Homo sapien
ctgtgcatcagttagtaggtgctgc

SEQ ID NO: 484463 - DNA, 25 bp, Homo sapien
gtaggtgctgcagggtttcttacta

SEQ ID NO: 484464 - DNA, 25 bp, Homo sapien
gtgctgcagggtttcttactattta

SEQ ID NO: 484465 - DNA, 25 bp, Homo sapien
gcagggtttcttactatttacagaa

SEQ ID NO: 484466 - DNA, 25 bp, Homo sapien
gaaacattttgtgcagtctttgtta

SEQ ID NO: 484467 - DNA, 25 bp, Homo sapien
aattatacctcatttagctaactag

SEQ ID NO: 484468 - DNA, 25 bp, Homo sapien
aactagtattctaatacctggtaga

SEQ ID NO: 484469 - DNA, 25 bp, Homo sapien
cagtgagccagcctttaagcatcta

SEQ ID NO: 484470 - DNA, 25 bp, Homo sapien
ccagcctttaagcatctaacaaaat

SEQ ID NO: 484471 - DNA, 25 bp, Homo sapien
ttttgaactgaagacatcattggga

SEQ ID NO: 484472 - DNA, 25 bp, Homo sapien
ggattcatgaacttgaataattcta

SEQ ID NO: 484473 - DNA, 25 bp, Homo sapien
gaataattctacagtttgaaactct

SEQ ID NO: 484474 - DNA, 25 bp, Homo sapien
ttctacagtttgaaactctgatgct

SEQ ID NO: 484475 - DNA, 25 bp, Homo sapien
tacagtttgaaactctgatgctata

SEQ ID NO: 484476 - DNA, 25 bp, Homo sapien
acagtttgaaactctgatgctatat

SEQ ID NO: 484477 - DNA, 25 bp, Homo sapien
agtttgaaactctgatgctatatat

SEQ ID NO: 484478 - DNA, 25 bp, Homo sapien
tttgaaactctgatgctatatatac

SEQ ID NO: 484479 - DNA, 25 bp, Homo sapien
gaaactctgatgctatatatacatg

SEQ ID NO: 484480 - DNA, 25 bp, Homo sapien
aactctgatgctatatatacatggt

SEQ ID NO: 484481 - DNA, 25 bp, Homo sapien
atggtataatgtattcagactttga

SEQ ID NO: 484482 - DNA, 25 bp, Homo sapien
cagactttgattactacttatttaa

SEQ ID NO: 484483 - DNA, 25 bp, Homo sapien
ggatcgcccggaggctggacaagat

SEQ ID NO: 484484 - DNA, 25 bp, Homo sapien
agaagagcgcgcatttgtcgccggc

SEQ ID NO: 484485 - DNA, 25 bp, Homo sapien
atttgtcgccggcaacagtttggag

SEQ ID NO: 484486 - DNA, 25 bp, Homo sapien
tgtcgccggcaacagtttggagtct

SEQ ID NO: 484487 - DNA, 25 bp, Homo sapien
tcgccggcaacagtttggagtctga

SEQ ID NO: 484488 - DNA, 25 bp, Homo sapien
cggcaacagtttggagtctgaggtt

SEQ ID NO: 484489 - DNA, 25 bp, Homo sapien
ggtcctgcccggctgcggaggcggg

SEQ ID NO: 484490 - DNA, 25 bp, Homo sapien
gagtctgaggttggatccccttttc

SEQ ID NO: 484491 - DNA, 25 bp, Homo sapien
agccagatacctgtcttgcctgtgg

SEQ ID NO: 484492 - DNA, 25 bp, Homo sapien
tgctcctgaggcgatgatgggcaag

SEQ ID NO: 484493 - DNA, 25 bp, Homo sapien
gaagaggagattgcgcggatcgccc

SEQ ID NO: 484494 - DNA, 25 bp, Homo sapien
aatacatgtgtatctgttcattttt

SEQ ID NO: 484495 - DNA, 25 bp, Homo sapien
atacatgtgtatctgttcatttttg

SEQ ID NO: 484496 - DNA, 25 bp, Homo sapien
tacatgtgtatctgttcatttttgc

SEQ ID NO: 484497 - DNA, 25 bp, Homo sapien
acatgtgtatctgttcatttttgca

SEQ ID NO: 484498 - DNA, 25 bp, Homo sapien
aaagaaatataggaagtggccaggt

SEQ ID NO: 484499 - DNA, 25 bp, Homo sapien
aagaaatataggaagtggccaggtg

SEQ ID NO: 484500 - DNA, 25 bp, Homo sapien
agaaatataggaagtggccaggtgc

SEQ ID NO: 484501 - DNA, 25 bp, Homo sapien
gaaatataggaagtggccaggtgcg

SEQ ID NO: 484502 - DNA, 25 bp, Homo sapien
gctagaagacaacttatgtatattc

SEQ ID NO: 484503 - DNA, 25 bp, Homo sapien
gtatagcagcacatttcatttatgg

SEQ ID NO: 484504 - DNA, 25 bp, Homo sapien
tcatttatggaaatatgttctcaga

SEQ ID NO: 484505 - DNA, 25 bp, Homo sapien
atatatttatcttaagccatgtctt

SEQ ID NO: 484506 - DNA, 25 bp, Homo sapien
aagccatgtcttatgttgagagtgt

SEQ ID NO: 484507 - DNA, 25 bp, Homo sapien
gagtgtgacattgttggaataatca

SEQ ID NO: 484508 - DNA, 25 bp, Homo sapien
gaaaatgactaacacaagaccctgt

SEQ ID NO: 484509 - DNA, 25 bp, Homo sapien
gactaacacaagaccctgtaaatac

SEQ ID NO: 484510 - DNA, 25 bp, Homo sapien
gtaaatacatgataattgcacacag

SEQ ID NO: 484511 - DNA, 25 bp, Homo sapien
attgcacacagattttacatatttg

SEQ ID NO: 484512 - DNA, 25 bp, Homo sapien
caagttgtagtcttctatggttttg

SEQ ID NO: 484513 - DNA, 25 bp, Homo sapien
ggttctaagcagtgaccagcagtcc

SEQ ID NO: 484514 - DNA, 25 bp, Homo sapien
ccagcagtcccggtggaggagagag

SEQ ID NO: 484515 - DNA, 25 bp, Homo sapien
agatctgcagggaaggtatggccca

SEQ ID NO: 484516 - DNA, 25 bp, Homo sapien
gatctgcagggaaggtatggcccaa

SEQ ID NO: 484517 - DNA, 25 bp, Homo sapien
atctgcagggaaggtatggcccaag

SEQ ID NO: 484518 - DNA, 25 bp, Homo sapien
tatggcccaaggaaagtgggcaaca

SEQ ID NO: 484519 - DNA, 25 bp, Homo sapien
aggaaagtgggcaacagagctaaga

SEQ ID NO: 484520 - DNA, 25 bp, Homo sapien
aaagtgggcaacagagctaagagag

SEQ ID NO: 484521 - DNA, 25 bp, Homo sapien
gtgggcaacagagctaagagaggaa

SEQ ID NO: 484522 - DNA, 25 bp, Homo sapien
agagaggaaagagagcaattctggg

SEQ ID NO: 484523 - DNA, 25 bp, Homo sapien
caagaacaggtggaatgagaatgag

SEQ ID NO: 484524 - DNA, 25 bp, Homo sapien
atttgtcgccggcaacagtttggag

SEQ ID NO: 484525 - DNA, 25 bp, Homo sapien
tttgtcgccggcaacagtttggagt

SEQ ID NO: 484526 - DNA, 25 bp, Homo sapien
ttgtcgccggcaacagtttggagtc

SEQ ID NO: 484527 - DNA, 25 bp, Homo sapien
tgtcgccggcaacagtttggagtct

SEQ ID NO: 484528 - DNA, 25 bp, Homo sapien
gtcgccggcaacagtttggagtctg

SEQ ID NO: 484529 - DNA, 25 bp, Homo sapien
tcgccggcaacagtttggagtctga

SEQ ID NO: 484530 - DNA, 25 bp, Homo sapien
cgccggcaacagtttggagtctgag

SEQ ID NO: 484531 - DNA, 25 bp, Homo sapien
gccggcaacagtttggagtctgagg

SEQ ID NO: 484532 - DNA, 25 bp, Homo sapien
ccggcaacagtttggagtctgaggt

SEQ ID NO: 484533 - DNA, 25 bp, Homo sapien
cggcaacagtttggagtctgaggtt

SEQ ID NO: 484534 - DNA, 25 bp, Homo sapien
ctgcggaggcgggcgcgacgggcgc

SEQ ID NO: 484535 - DNA, 25 bp, Homo sapien
catcaaaatcttggtatagtatata

SEQ ID NO: 484536 - DNA, 25 bp, Homo sapien
ttttttgaacctcagcaactttgaa

SEQ ID NO: 484537 - DNA, 25 bp, Homo sapien
tttgaacctcagcaactttgaatga

SEQ ID NO: 484538 - DNA, 25 bp, Homo sapien
gaacctcagcaactttgaatgattt

SEQ ID NO: 484539 - DNA, 25 bp, Homo sapien
cctcagcaactttgaatgattttag

SEQ ID NO: 484540 - DNA, 25 bp, Homo sapien
gaactttagaatgattttctccaca

SEQ ID NO: 484541 - DNA, 25 bp, Homo sapien
ctttagaatgattttctccacattt

SEQ ID NO: 484542 - DNA, 25 bp, Homo sapien
aaaacctgcttatatttatacagtg

SEQ ID NO: 484543 - DNA, 25 bp, Homo sapien
ttatacagtgagtctgaagcgaaga

SEQ ID NO: 484544 - DNA, 25 bp, Homo sapien
ctgaagcgaagaaatttgaaccata

SEQ ID NO: 484545 - DNA, 25 bp, Homo sapien
gaaccatacaatgtttaattcctat

SEQ ID NO: 484546 - DNA, 25 bp, Homo sapien
aagtcatgtgcgaacagccctccaa

SEQ ID NO: 484547 - DNA, 25 bp, Homo sapien
tgcgaacagccctccaaagcctatg

SEQ ID NO: 484548 - DNA, 25 bp, Homo sapien
caaagcctatgccacagacagctct

SEQ ID NO: 484549 - DNA, 25 bp, Homo sapien
agacagctcttgccccagccagaat

SEQ ID NO: 484550 - DNA, 25 bp, Homo sapien
atctgtccgtccgttccctggagaa

SEQ ID NO: 484551 - DNA, 25 bp, Homo sapien
gtccgttccctggagaagacacaag

SEQ ID NO: 484552 - DNA, 25 bp, Homo sapien
gaagacacaagggtatccatgctct

SEQ ID NO: 484553 - DNA, 25 bp, Homo sapien
accctctggaactcacaaaagctgg

SEQ ID NO: 484554 - DNA, 25 bp, Homo sapien
ctggaactcacaaaagctggctttt

SEQ ID NO: 484555 - DNA, 25 bp, Homo sapien
aggtgctgggcagtcactctgctaa

SEQ ID NO: 484556 - DNA, 25 bp, Homo sapien
ctgggcagtcactctgctaagagtc

SEQ ID NO: 484557 - DNA, 25 bp, Homo sapien
ccttgtagatggagcttgcagatgg

SEQ ID NO: 484558 - DNA, 25 bp, Homo sapien
cttgtagatggagcttgcagatgga

SEQ ID NO: 484559 - DNA, 25 bp, Homo sapien
ttgtagatggagcttgcagatggag

SEQ ID NO: 484560 - DNA, 25 bp, Homo sapien
tgtagatggagcttgcagatggagc

SEQ ID NO: 484561 - DNA, 25 bp, Homo sapien
gtagatggagcttgcagatggagcc

SEQ ID NO: 484562 - DNA, 25 bp, Homo sapien
tagatggagcttgcagatggagccc

SEQ ID NO: 484563 - DNA, 25 bp, Homo sapien
atggagcttgcagatggagccccgt

SEQ ID NO: 484564 - DNA, 25 bp, Homo sapien
tggagcttgcagatggagccccgtg

SEQ ID NO: 484565 - DNA, 25 bp, Homo sapien
ggagcttgcagatggagccccgtga

SEQ ID NO: 484566 - DNA, 25 bp, Homo sapien
gccccgtgacctctcacctacccac

SEQ ID NO: 484567 - DNA, 25 bp, Homo sapien
ttataacgtggaaaacctgagcata

SEQ ID NO: 484568 - DNA, 25 bp, Homo sapien
aaacctgagcatatgattaacatct

SEQ ID NO: 484569 - DNA, 25 bp, Homo sapien
attaacatctcccagctctttaata

SEQ ID NO: 484570 - DNA, 25 bp, Homo sapien
atctcccagctctttaatacagaat

SEQ ID NO: 484571 - DNA, 25 bp, Homo sapien
tgtttttagtactggcggttaccag

SEQ ID NO: 484572 - DNA, 25 bp, Homo sapien
ggaatttcttgagtgaagcgatcat

SEQ ID NO: 484573 - DNA, 25 bp, Homo sapien
gagtgaagcgatcattttaccaaat

SEQ ID NO: 484574 - DNA, 25 bp, Homo sapien
gatttgaatcaagttctgatgttaa

SEQ ID NO: 484575 - DNA, 25 bp, Homo sapien
gattctgtttaaagcttgtattttc

SEQ ID NO: 484576 - DNA, 25 bp, Homo sapien
aaacatttttatcaggcatcttcct

SEQ ID NO: 484577 - DNA, 25 bp, Homo sapien
tatcaggcatcttcctgtttctctt

SEQ ID NO: 484578 - DNA, 25 bp, Homo sapien
gaccccaaatcctttgactactctt

SEQ ID NO: 484579 - DNA, 25 bp, Homo sapien
aatcctttgactactcttggtgttt

SEQ ID NO: 484580 - DNA, 25 bp, Homo sapien
agcagcactagaccccaacattgca

SEQ ID NO: 484581 - DNA, 25 bp, Homo sapien
ttggagagataccacagccaccact

SEQ ID NO: 484582 - DNA, 25 bp, Homo sapien
cacagccaccacttatgggaaacgt

SEQ ID NO: 484583 - DNA, 25 bp, Homo sapien
tgggaaacgtggatccttccaaaat

SEQ ID NO: 484584 - DNA, 25 bp, Homo sapien
tatgttggaaatctggaattcccag

SEQ ID NO: 484585 - DNA, 25 bp, Homo sapien
ggaattcccagacaacgacagctga

SEQ ID NO: 484586 - DNA, 25 bp, Homo sapien
agacaacgacagctgattcaactta

SEQ ID NO: 484587 - DNA, 25 bp, Homo sapien
gacagctgattcaacttacttggaa

SEQ ID NO: 484588 - DNA, 25 bp, Homo sapien
gctgattcaacttacttggaatttt

SEQ ID NO: 484589 - DNA, 25 bp, Homo sapien
cgtaatttctatgatcgatacaggg

SEQ ID NO: 484590 - DNA, 25 bp, Homo sapien
gagactatgatcgattttacgggcg

SEQ ID NO: 484591 - DNA, 25 bp, Homo sapien
tacgggcgagattatgagtacaaca

SEQ ID NO: 484592 - DNA, 25 bp, Homo sapien
gagtacaacagatacagagactatt

SEQ ID NO: 484593 - DNA, 25 bp, Homo sapien
tattacagacaatacaatcgggatt

SEQ ID NO: 484594 - DNA, 25 bp, Homo sapien
aatcgggattggcagagttactact

SEQ ID NO: 484595 - DNA, 25 bp, Homo sapien
tggcagagttactactaccaccacc

SEQ ID NO: 484596 - DNA, 25 bp, Homo sapien
gacagagaccgatactacaggaatt

SEQ ID NO: 484597 - DNA, 25 bp, Homo sapien
tacaggaattactacgggtaccaag

SEQ ID NO: 484598 - DNA, 25 bp, Homo sapien
aagggtatcggtgaagcccctgcca

SEQ ID NO: 484599 - DNA, 25 bp, Homo sapien
atggtcacctgtcagccatgaagct

SEQ ID NO: 484600 - DNA, 25 bp, Homo sapien
gagaggacacctatatgcgtatttc

SEQ ID NO: 484601 - DNA, 25 bp, Homo sapien
atatgcgtatttcctctacacacat

SEQ ID NO: 484602 - DNA, 25 bp, Homo sapien
ccccttctataatcttaagccatga

SEQ ID NO: 484603 - DNA, 25 bp, Homo sapien
atcttaagccatgactagcctggtg

SEQ ID NO: 484604 - DNA, 25 bp, Homo sapien
tagcctggtggcgtgttagtttctg

SEQ ID NO: 484605 - DNA, 25 bp, Homo sapien
gtgttagtttctgcccagttctacc

SEQ ID NO: 484606 - DNA, 25 bp, Homo sapien
tctgaatactgaatgtgactgtttg

SEQ ID NO: 484607 - DNA, 25 bp, Homo sapien
gtgactgtttgaaagctggtagaat

SEQ ID NO: 484608 - DNA, 25 bp, Homo sapien
agctggtagaattcatccctcttac

SEQ ID NO: 484609 - DNA, 25 bp, Homo sapien
atccctcttactgtagataacactg

SEQ ID NO: 484610 - DNA, 25 bp, Homo sapien
agataacactgcaaatcttggaatt

SEQ ID NO: 484611 - DNA, 25 bp, Homo sapien
atgtcccaaggacgtggtcatctcc

SEQ ID NO: 484612 - DNA, 25 bp, Homo sapien
aggacgtggtcatctccttgactat

SEQ ID NO: 484613 - DNA, 25 bp, Homo sapien
caatgtgagtgctgaggtttgttgt

SEQ ID NO: 484614 - DNA, 25 bp, Homo sapien
tgcctcagtaccatatagttcactt

SEQ ID NO: 484615 - DNA, 25 bp, Homo sapien
gtatataattcgatgccctttagca

SEQ ID NO: 484616 - DNA, 25 bp, Homo sapien
gatgccctttagcatgttcacagtc

SEQ ID NO: 484617 - DNA, 25 bp, Homo sapien
gcatgttcacagtcatgaaactatt

SEQ ID NO: 484618 - DNA, 25 bp, Homo sapien
gaaactattaccacaatcaacttta

SEQ ID NO: 484619 - DNA, 25 bp, Homo sapien
ttgttggtgcggttgctatgtcccc

SEQ ID NO: 484620 - DNA, 25 bp, Homo sapien
tgctatgtccccaatgaacatggtt

SEQ ID NO: 484621 - DNA, 25 bp, Homo sapien
tgaacatggttacagggctcattgt

SEQ ID NO: 484622 - DNA, 25 bp, Homo sapien
tttcagctctcctgagggtagggat

SEQ ID NO: 484623 - DNA, 25 bp, Homo sapien
agtctcacgccttctggtgtgtcca

SEQ ID NO: 484624 - DNA, 25 bp, Homo sapien
tggtgtgtccagatcacgaagcgac

SEQ ID NO: 484625 - DNA, 25 bp, Homo sapien
ggtaatgtggaaagcgcctcccagg

SEQ ID NO: 484626 - DNA, 25 bp, Homo sapien
acacccatgtgatgtggctcctgct

SEQ ID NO: 484627 - DNA, 25 bp, Homo sapien
tgctcgtttttctccatgggcctca

SEQ ID NO: 484628 - DNA, 25 bp, Homo sapien
tgggcctcactgactttaccctaca

SEQ ID NO: 484629 - DNA, 25 bp, Homo sapien
aagccacttgacatttccctagatg

SEQ ID NO: 484630 - DNA, 25 bp, Homo sapien
gaggcagaagcaacaaacactttta

SEQ ID NO: 484631 - DNA, 25 bp, Homo sapien
ttttacaccttttagactcagttca

SEQ ID NO: 484632 - DNA, 25 bp, Homo sapien
ttagactcagttcaagcatcaggtt

SEQ ID NO: 484633 - DNA, 25 bp, Homo sapien
acctgccagaaagtgtgaaagcctt

SEQ ID NO: 484634 - DNA, 25 bp, Homo sapien
aagccttgaatgtggaccccttttg

SEQ ID NO: 484635 - DNA, 25 bp, Homo sapien
ggaccccttttgatatgcctggcat

SEQ ID NO: 484636 - DNA, 25 bp, Homo sapien
tgcctggcattgttgcattgagttt

SEQ ID NO: 484637 - DNA, 25 bp, Homo sapien
gagttttgtcatccgtttctagaaa

SEQ ID NO: 484638 - DNA, 25 bp, Homo sapien
cttgtttttacttactatgtcttca

SEQ ID NO: 484639 - DNA, 25 bp, Homo sapien
taacgacaacaaccaagagtgccag

SEQ ID NO: 484640 - DNA, 25 bp, Homo sapien
agaattctcttgtagcactaacccc

SEQ ID NO: 484641 - DNA, 25 bp, Homo sapien
ttgtctccctccgtgaaaaggcaac

SEQ ID NO: 484642 - DNA, 25 bp, Homo sapien
ggcatctgtttctttaagggccaca

SEQ ID NO: 484643 - DNA, 25 bp, Homo sapien
ttaagggccacagatctccttactg

SEQ ID NO: 484644 - DNA, 25 bp, Homo sapien
agaaaaattctccaatcaacacaag

SEQ ID NO: 484645 - DNA, 25 bp, Homo sapien
aagatgcattatgcttggcagatgc

SEQ ID NO: 484646 - DNA, 25 bp, Homo sapien
cattatgcttggcagatgcaaatta

SEQ ID NO: 484647 - DNA, 25 bp, Homo sapien
aaaacacacagacagaaagaagcag

SEQ ID NO: 484648 - DNA, 25 bp, Homo sapien
gtcaaataaatcacacccactctaa

SEQ ID NO: 484649 - DNA, 25 bp, Homo sapien
aaatcacacccactctaagtatcaa

SEQ ID NO: 484650 - DNA, 25 bp, Homo sapien
acacccactctaagtatcaatgaat

SEQ ID NO: 484651 - DNA, 25 bp, Homo sapien
gaatagctgatatgcattgttggga

SEQ ID NO: 484652 - DNA, 25 bp, Homo sapien
aaacttttaacagattcctcacaat

SEQ ID NO: 484653 - DNA, 25 bp, Homo sapien
ttaaagttctactattagaccaact

SEQ ID NO: 484654 - DNA, 25 bp, Homo sapien
tagaccaacttttactatacagtat

SEQ ID NO: 484655 - DNA, 25 bp, Homo sapien
cctggattatgtgctgagtgttaag

SEQ ID NO: 484656 - DNA, 25 bp, Homo sapien
agagatacactctggtcatcctttg

SEQ ID NO: 484657 - DNA, 25 bp, Homo sapien
gatacactctggtcatcctttggtg

SEQ ID NO: 484658 - DNA, 25 bp, Homo sapien
actctggtcatcctttggtgtggtt

SEQ ID NO: 484659 - DNA, 25 bp, Homo sapien
gggatacttggttgattcttgtagt

SEQ ID NO: 484660 - DNA, 25 bp, Homo sapien
tacttggttgattcttgtagttaaa

SEQ ID NO: 484661 - DNA, 25 bp, Homo sapien
agttaaagtgaagttgcttttctga

SEQ ID NO: 484662 - DNA, 25 bp, Homo sapien
cagccctttccagggaaatacgatg

SEQ ID NO: 484663 - DNA, 25 bp, Homo sapien
ctttccagggaaatacgatgtttct

SEQ ID NO: 484664 - DNA, 25 bp, Homo sapien
gggaaatacgatgtttctgagtgag

SEQ ID NO: 484665 - DNA, 25 bp, Homo sapien
ttcagtgcagataggaagagctggt

SEQ ID NO: 484666 - DNA, 25 bp, Homo sapien
taaagtttctctggctgtgtgctat

SEQ ID NO: 484667 - DNA, 25 bp, Homo sapien
tctggctgtgtgctattcgctgcgt

SEQ ID NO: 484668 - DNA, 25 bp, Homo sapien
ttcgctgcgtccacagcagtgaaga

SEQ ID NO: 484669 - DNA, 25 bp, Homo sapien
agtgaagaagacagacgcagcccct

SEQ ID NO: 484670 - DNA, 25 bp, Homo sapien
gcgccgagccaggacgttgagccaa

SEQ ID NO: 484671 - DNA, 25 bp, Homo sapien
aggacgttgagccaagtccccatct

SEQ ID NO: 484672 - DNA, 25 bp, Homo sapien
catctcctaggactcgcagtgcgga

SEQ ID NO: 484673 - DNA, 25 bp, Homo sapien
gggcttagaacaacgccgggcacag

SEQ ID NO: 484674 - DNA, 25 bp, Homo sapien
caggctaagcgctcactaaacgtta

SEQ ID NO: 484675 - DNA, 25 bp, Homo sapien
actaaacgttagctctcgccaataa

SEQ ID NO: 484676 - DNA, 25 bp, Homo sapien
gctctcgccaataacatcactgatt

SEQ ID NO: 484677 - DNA, 25 bp, Homo sapien
gatcaagtcttacatgcccattcag

SEQ ID NO: 484678 - DNA, 25 bp, Homo sapien
ttacatgcccattcagcttctaggc

SEQ ID NO: 484679 - DNA, 25 bp, Homo sapien
agtggccctgagacacgtgaacacc

SEQ ID NO: 484680 - DNA, 25 bp, Homo sapien
aaaccttctccaccgagctttggtg

SEQ ID NO: 484681 - DNA, 25 bp, Homo sapien
ctggcacacctaactagcattggca

SEQ ID NO: 484682 - DNA, 25 bp, Homo sapien
gcattggcagaggagagtctacact

SEQ ID NO: 484683 - DNA, 25 bp, Homo sapien
gagagtctacactctcttcctcatt

SEQ ID NO: 484684 - DNA, 25 bp, Homo sapien
tcctcattcagggaagatgctttaa

SEQ ID NO: 484685 - DNA, 25 bp, Homo sapien
gatgctttaagaaatcctgcctctg

SEQ ID NO: 484686 - DNA, 25 bp, Homo sapien
agaaatcctgcctctgtgcagcaga

SEQ ID NO: 484687 - DNA, 25 bp, Homo sapien
catccctccccaaataaaggcttat

SEQ ID NO: 484688 - DNA, 25 bp, Homo sapien
attgcatggcatagattattagtaa

SEQ ID NO: 484689 - DNA, 25 bp, Homo sapien
gattattagtaatatcctgcattgt

SEQ ID NO: 484690 - DNA, 25 bp, Homo sapien
atcctgcattgtatacttttccaaa

SEQ ID NO: 484691 - DNA, 25 bp, Homo sapien
gggttggactcctaaggattagaat

SEQ ID NO: 484692 - DNA, 25 bp, Homo sapien
ggattagaatccttataagcttgag

SEQ ID NO: 484693 - DNA, 25 bp, Homo sapien
gggaaagctgaaactaatttgaaca

SEQ ID NO: 484694 - DNA, 25 bp, Homo sapien
tagttaacactttacaatggattag

SEQ ID NO: 484695 - DNA, 25 bp, Homo sapien
tattacctagtataatccgtagcag

SEQ ID NO: 484696 - DNA, 25 bp, Homo sapien
gaaataagccactgcagttgctaga

SEQ ID NO: 484697 - DNA, 25 bp, Homo sapien
agttgctagaactgacatgctttca

SEQ ID NO: 484698 - DNA, 25 bp, Homo sapien
tagaactgacatgctttcattttca

SEQ ID NO: 484699 - DNA, 25 bp, Homo sapien
tactgtactaagaacttgtcctttc

SEQ ID NO: 484700 - DNA, 25 bp, Homo sapien
acttgtcctttctccttgaatcaaa

SEQ ID NO: 484701 - DNA, 25 bp, Homo sapien
gaatcaaagtaggacatgcatcatc

SEQ ID NO: 484702 - DNA, 25 bp, Homo sapien
acatgcatcatcctcctaattttaa

SEQ ID NO: 484703 - DNA, 25 bp, Homo sapien
gttggctctgattttaaagtggtgc

SEQ ID NO: 484704 - DNA, 25 bp, Homo sapien
ggtgcatttgattccagccttggta

SEQ ID NO: 484705 - DNA, 25 bp, Homo sapien
cagccttggtaatggagagtttgca

SEQ ID NO: 484706 - DNA, 25 bp, Homo sapien
gagtttgcaaacacacagcggccca

SEQ ID NO: 484707 - DNA, 25 bp, Homo sapien
gcccacagcttcacgtggtggtgtg

SEQ ID NO: 484708 - DNA, 25 bp, Homo sapien
agtgtgaggcagctccttggctttc

SEQ ID NO: 484709 - DNA, 25 bp, Homo sapien
ggttttcacaacaagctagagattt

SEQ ID NO: 484710 - DNA, 25 bp, Homo sapien
ctgtccctcattttaatgctgcagc

SEQ ID NO: 484711 - DNA, 25 bp, Homo sapien
aatgctgcagctattgaaccacctt

SEQ ID NO: 484712 - DNA, 25 bp, Homo sapien
ctgcagctattgaaccaccttcctg

SEQ ID NO: 484713 - DNA, 25 bp, Homo sapien
cttcctgaaacctagctgatacgga

SEQ ID NO: 484714 - DNA, 25 bp, Homo sapien
gaaacctagctgatacggaatagca

SEQ ID NO: 484715 - DNA, 25 bp, Homo sapien
tacggaatagcagagacatgcctct

SEQ ID NO: 484716 - DNA, 25 bp, Homo sapien
tttcagtcaacgtcgacttctgctt

SEQ ID NO: 484717 - DNA, 25 bp, Homo sapien
aacgtcgacttctgctttggccaat

SEQ ID NO: 484718 - DNA, 25 bp, Homo sapien
cgtcgacttctgctttggccaattg

SEQ ID NO: 484719 - DNA, 25 bp, Homo sapien
aaaaacacagatgcacttaaaacat

SEQ ID NO: 484720 - DNA, 25 bp, Homo sapien
gctttctggagatgttactgttaaa

SEQ ID NO: 484721 - DNA, 25 bp, Homo sapien
gagtatgttaagctctttatgactg

SEQ ID NO: 484722 - DNA, 25 bp, Homo sapien
tagtggtatagagtactgcagaata

SEQ ID NO: 484723 - DNA, 25 bp, Homo sapien
gcagaatacagtaagctgctctatt

SEQ ID NO: 484724 - DNA, 25 bp, Homo sapien
acagtaagctgctctattgtagcat

SEQ ID NO: 484725 - DNA, 25 bp, Homo sapien
agctgctctattgtagcatttcttg

SEQ ID NO: 484726 - DNA, 25 bp, Homo sapien
gcatttcttgatgttgcttagtcac

SEQ ID NO: 484727 - DNA, 25 bp, Homo sapien
gatgttgcttagtcacttatttcat

SEQ ID NO: 484728 - DNA, 25 bp, Homo sapien
tgttgcttagtcacttatttcataa

SEQ ID NO: 484729 - DNA, 25 bp, Homo sapien
aatgttctgaataatttcttactaa

SEQ ID NO: 484730 - DNA, 25 bp, Homo sapien
acattttgttattgggcaagtgatt

SEQ ID NO: 484731 - DNA, 25 bp, Homo sapien
gaaaatagtaaatgctttgtgtgat

SEQ ID NO: 484732 - DNA, 25 bp, Homo sapien
gtaacaatattgtgagctctgaatt

SEQ ID NO: 484733 - DNA, 25 bp, Homo sapien
atattgtgagctctgaattactttg

SEQ ID NO: 484734 - DNA, 25 bp, Homo sapien
tactttggagtatatctattgtcaa

SEQ ID NO: 484735 - DNA, 25 bp, Homo sapien
atctattgtcaagttaattctctat

SEQ ID NO: 484736 - DNA, 25 bp, Homo sapien
aattctctatttaccattcactctc

SEQ ID NO: 484737 - DNA, 25 bp, Homo sapien
tctctatttaccattcactctcagc

SEQ ID NO: 484738 - DNA, 25 bp, Homo sapien
actctcagccacattccaggaaaat

SEQ ID NO: 484739 - DNA, 25 bp, Homo sapien
aactaagccagggagattggtctta

SEQ ID NO: 484740 - DNA, 25 bp, Homo sapien
agccagggagattggtcttaggaat

SEQ ID NO: 484741 - DNA, 25 bp, Homo sapien
gtactttgaacttagtagacattca

SEQ ID NO: 484742 - DNA, 25 bp, Homo sapien
ttctgaatgcttgtgtacatgtgca

SEQ ID NO: 484743 - DNA, 25 bp, Homo sapien
gggagaccaccacgatttcgagagt

SEQ ID NO: 484744 - DNA, 25 bp, Homo sapien
agaccaccacgatttcgagagtccg

SEQ ID NO: 484745 - DNA, 25 bp, Homo sapien
accacgatttcgagagtccgggcac

SEQ ID NO: 484746 - DNA, 25 bp, Homo sapien
cgatttcgagagtccgggcaccggt

SEQ ID NO: 484747 - DNA, 25 bp, Homo sapien
gggcaccggttaggattttcctgca

SEQ ID NO: 484748 - DNA, 25 bp, Homo sapien
caccggttaggattttcctgcagaa

SEQ ID NO: 484749 - DNA, 25 bp, Homo sapien
gattttcctgcagaacaggcaccgc

SEQ ID NO: 484750 - DNA, 25 bp, Homo sapien
tttcctgcagaacaggcaccgcgaa

SEQ ID NO: 484751 - DNA, 25 bp, Homo sapien
tgcagaacaggcaccgcgaagctgc

SEQ ID NO: 484752 - DNA, 25 bp, Homo sapien
cccggccattaactacggctctggg

SEQ ID NO: 484753 - DNA, 25 bp, Homo sapien
tcacacaatctaccccagacgggcg

SEQ ID NO: 484754 - DNA, 25 bp, Homo sapien
gtggagtctgattctacaatagtct

SEQ ID NO: 484755 - DNA, 25 bp, Homo sapien
gatggatttatgctgccagaccctc

SEQ ID NO: 484756 - DNA, 25 bp, Homo sapien
tgccagaccctcagaatatttctct

SEQ ID NO: 484757 - DNA, 25 bp, Homo sapien
gaagatgacatccatgtttcctgat

SEQ ID NO: 484758 - DNA, 25 bp, Homo sapien
tgacatccatgtttcctgatgcttg

SEQ ID NO: 484759 - DNA, 25 bp, Homo sapien
ggatttgagacccatcagactgctt

SEQ ID NO: 484760 - DNA, 25 bp, Homo sapien
agacccatcagactgcttcatcttt

SEQ ID NO: 484761 - DNA, 25 bp, Homo sapien
gaaatagggttgacgtacatagtga

SEQ ID NO: 484762 - DNA, 25 bp, Homo sapien
atagtgagggttgacttccccattc

SEQ ID NO: 484763 - DNA, 25 bp, Homo sapien
cttccccattccataaggttttcat

SEQ ID NO: 484764 - DNA, 25 bp, Homo sapien
tccccaggtagaagactttctcctt

SEQ ID NO: 484765 - DNA, 25 bp, Homo sapien
gtgacattacttttagtagcccaaa

SEQ ID NO: 484766 - DNA, 25 bp, Homo sapien
tagtagcccaaattataaaccactt

SEQ ID NO: 484767 - DNA, 25 bp, Homo sapien
ttttaaacctactgtctctgtcata

SEQ ID NO: 484768 - DNA, 25 bp, Homo sapien
acctactgtctctgtcataacttgt

SEQ ID NO: 484769 - DNA, 25 bp, Homo sapien
gtcataacttgtcaacactgctgta

SEQ ID NO: 484770 - DNA, 25 bp, Homo sapien
gtcaacactgctgtatgaagcacaa

SEQ ID NO: 484771 - DNA, 25 bp, Homo sapien
acaatacgggcgtggctttgttcca

SEQ ID NO: 484772 - DNA, 25 bp, Homo sapien
tacgggcgtggctttgttccagtaa

SEQ ID NO: 484773 - DNA, 25 bp, Homo sapien
atgtggtgccatagtttgtcatccc

SEQ ID NO: 484774 - DNA, 25 bp, Homo sapien
agtttgtcatccctgggtctaggaa

SEQ ID NO: 484775 - DNA, 25 bp, Homo sapien
gtcatccctgggtctaggaaatagt

SEQ ID NO: 484776 - DNA, 25 bp, Homo sapien
gtttgcttgaagttgaactgtcctt

SEQ ID NO: 484777 - DNA, 25 bp, Homo sapien
gtccttctctgagccattataaagt

SEQ ID NO: 484778 - DNA, 25 bp, Homo sapien
ttagattcagacttgctctttgaca

SEQ ID NO: 484779 - DNA, 25 bp, Homo sapien
aaaaccctggctatgaggacttgct

SEQ ID NO: 484780 - DNA, 25 bp, Homo sapien
gcaaatctttggttggcgttggata

SEQ ID NO: 484781 - DNA, 25 bp, Homo sapien
ggcgttggataagcttcttttcctt

SEQ ID NO: 484782 - DNA, 25 bp, Homo sapien
ttttccttggcgctgactcatcttt

SEQ ID NO: 484783 - DNA, 25 bp, Homo sapien
gactcatctttcctggtgtcagaag

SEQ ID NO: 484784 - DNA, 25 bp, Homo sapien
gtcagaagctgagattcgtcactgt

SEQ ID NO: 484785 - DNA, 25 bp, Homo sapien
gagattcgtcactgtttgctacaac

SEQ ID NO: 484786 - DNA, 25 bp, Homo sapien
gctacaacagttgatggcccaagga

SEQ ID NO: 484787 - DNA, 25 bp, Homo sapien
tactgtatttgtcagcttcttcctt

SEQ ID NO: 484788 - DNA, 25 bp, Homo sapien
gcatcccaacttcctcagactttgg

SEQ ID NO: 484789 - DNA, 25 bp, Homo sapien
gggtacttttgcacagacctagcca

SEQ ID NO: 484790 - DNA, 25 bp, Homo sapien
gatgcagcaatccactttcacaaaa

SEQ ID NO: 484791 - DNA, 25 bp, Homo sapien
ttcacaaaaccccatggacaatgca

SEQ ID NO: 484792 - DNA, 25 bp, Homo sapien
gaaagggacagaaatggcatcacta

SEQ ID NO: 484793 - DNA, 25 bp, Homo sapien
ggcatcactatccaagactgaaaaa

SEQ ID NO: 484794 - DNA, 25 bp, Homo sapien
gaatggattatcactctgacccaac

SEQ ID NO: 484795 - DNA, 25 bp, Homo sapien
actctgacccaactgcacatttcta

SEQ ID NO: 484796 - DNA, 25 bp, Homo sapien
gttcctgcactcaatggcttctgtt

SEQ ID NO: 484797 - DNA, 25 bp, Homo sapien
aatggcttctgttcgaagtccctat

SEQ ID NO: 484798 - DNA, 25 bp, Homo sapien
acaggtgaggcaactgagactcaaa

SEQ ID NO: 484799 - DNA, 25 bp, Homo sapien
caggtgaggcaactgagactcaaag

SEQ ID NO: 484800 - DNA, 25 bp, Homo sapien
aggtgaggcaactgagactcaaagg

SEQ ID NO: 484801 - DNA, 25 bp, Homo sapien
ggtgaggcaactgagactcaaaggt

SEQ ID NO: 484802 - DNA, 25 bp, Homo sapien
gtgaggcaactgagactcaaaggtg

SEQ ID NO: 484803 - DNA, 25 bp, Homo sapien
ggcaactgagactcaaaggtgatgt

SEQ ID NO: 484804 - DNA, 25 bp, Homo sapien
gcaactgagactcaaaggtgatgta

SEQ ID NO: 484805 - DNA, 25 bp, Homo sapien
caactgagactcaaaggtgatgtaa

SEQ ID NO: 484806 - DNA, 25 bp, Homo sapien
aactgagactcaaaggtgatgtaat

SEQ ID NO: 484807 - DNA, 25 bp, Homo sapien
agaggtctgagtcctgctgatgcct

SEQ ID NO: 484808 - DNA, 25 bp, Homo sapien
tgctgatgcctggagtcgcggtctc

SEQ ID NO: 484809 - DNA, 25 bp, Homo sapien
ggtctcggtgtttgtctttggattt

SEQ ID NO: 484810 - DNA, 25 bp, Homo sapien
ttctttgctttaggctcttctagag

SEQ ID NO: 484811 - DNA, 25 bp, Homo sapien
ttctagaggatccttctgttcgctc

SEQ ID NO: 484812 - DNA, 25 bp, Homo sapien
ctttcttttcaacatgactgtcact

SEQ ID NO: 484813 - DNA, 25 bp, Homo sapien
gtcactgttctccacactgtcgtgt

SEQ ID NO: 484814 - DNA, 25 bp, Homo sapien
tgtcgtgtctccgtttccgggactt

SEQ ID NO: 484815 - DNA, 25 bp, Homo sapien
tttgtgtctgtggaggtcagcgtca

SEQ ID NO: 484816 - DNA, 25 bp, Homo sapien
ggtcagcgtcagagcacgctgctga

SEQ ID NO: 484817 - DNA, 25 bp, Homo sapien
gcacgctgctgagaggtctgagtcc

SEQ ID NO: 484818 - DNA, 25 bp, Homo sapien
cttcttagagaaacccaactaaatg

SEQ ID NO: 484819 - DNA, 25 bp, Homo sapien
ttcttagagaaacccaactaaatga

SEQ ID NO: 484820 - DNA, 25 bp, Homo sapien
tcttagagaaacccaactaaatgag

SEQ ID NO: 484821 - DNA, 25 bp, Homo sapien
cttagagaaacccaactaaatgagt

SEQ ID NO: 484822 - DNA, 25 bp, Homo sapien
ttagagaaacccaactaaatgagtt

SEQ ID NO: 484823 - DNA, 25 bp, Homo sapien
tagagaaacccaactaaatgagttt

SEQ ID NO: 484824 - DNA, 25 bp, Homo sapien
aaaaatctgtgaaagggctgggcac

SEQ ID NO: 484825 - DNA, 25 bp, Homo sapien
aaaatctgtgaaagggctgggcaca

SEQ ID NO: 484826 - DNA, 25 bp, Homo sapien
aaatctgtgaaagggctgggcacag

SEQ ID NO: 484827 - DNA, 25 bp, Homo sapien
aatctgtgaaagggctgggcacagt

SEQ ID NO: 484828 - DNA, 25 bp, Homo sapien
tggtcgagcatggtagtgtgtgcct

SEQ ID NO: 484829 - DNA, 25 bp, Homo sapien
aattttaaaacacctcaagagtcag

SEQ ID NO: 484830 - DNA, 25 bp, Homo sapien
acacctcaagagtcagataattcag

SEQ ID NO: 484831 - DNA, 25 bp, Homo sapien
gataattcagggaaagaccatgcaa

SEQ ID NO: 484832 - DNA, 25 bp, Homo sapien
gaccatgcaaggctgttactgaaga

SEQ ID NO: 484833 - DNA, 25 bp, Homo sapien
actgaagaaagtgctacgagtctgt

SEQ ID NO: 484834 - DNA, 25 bp, Homo sapien
gagcatccttcctcacttctaagtg

SEQ ID NO: 484835 - DNA, 25 bp, Homo sapien
gaattttccagatctgtgcattggg

SEQ ID NO: 484836 - DNA, 25 bp, Homo sapien
gaggctcagtcctgatgtactgttt

SEQ ID NO: 484837 - DNA, 25 bp, Homo sapien
aaaccacatggttaatccagatcca

SEQ ID NO: 484838 - DNA, 25 bp, Homo sapien
atggttaatccagatccagcccctg

SEQ ID NO: 484839 - DNA, 25 bp, Homo sapien
gctttcttagttatgaggcttctca

SEQ ID NO: 484840 - DNA, 25 bp, Homo sapien
aaagggaggcaaatcatacaatggg

SEQ ID NO: 484841 - DNA, 25 bp, Homo sapien
gttttggaacaatgtaactcaatgt

SEQ ID NO: 484842 - DNA, 25 bp, Homo sapien
actcaatgttctcacaccctttaga

SEQ ID NO: 484843 - DNA, 25 bp, Homo sapien
tcacaccctttagagaggagctcag

SEQ ID NO: 484844 - DNA, 25 bp, Homo sapien
ggagctcagagacatgaagtaacct

SEQ ID NO: 484845 - DNA, 25 bp, Homo sapien
tgaagtaacctatcgtccggaacta

SEQ ID NO: 484846 - DNA, 25 bp, Homo sapien
ctatcgtccggaactacattttctt

SEQ ID NO: 484847 - DNA, 25 bp, Homo sapien
acattttctttgcatccagtgggct

SEQ ID NO: 484848 - DNA, 25 bp, Homo sapien
tgatgtttaatgagttccgagcttc

SEQ ID NO: 484849 - DNA, 25 bp, Homo sapien
atgagttccgagcttcagtttggga

SEQ ID NO: 484850 - DNA, 25 bp, Homo sapien
tagatattggtagtggttgcagaat

SEQ ID NO: 484851 - DNA, 25 bp, Homo sapien
gacagcgaggacctgacctcacaga

SEQ ID NO: 484852 - DNA, 25 bp, Homo sapien
tgacctcacagagggaggcgtccag

SEQ ID NO: 484853 - DNA, 25 bp, Homo sapien
agaagcttggtccacgccacctgct

SEQ ID NO: 484854 - DNA, 25 bp, Homo sapien
gggaggcgtccagggcggcccttgg

SEQ ID NO: 484855 - DNA, 25 bp, Homo sapien
ccttgggtggccagtcccgcaggca

SEQ ID NO: 484856 - DNA, 25 bp, Homo sapien
aagcttggtccacgccacctgctgt

SEQ ID NO: 484857 - DNA, 25 bp, Homo sapien
tctgatccgcccctcagtgggagcg

SEQ ID NO: 484858 - DNA, 25 bp, Homo sapien
tccgcccctcagtgggagcgggaca

SEQ ID NO: 484859 - DNA, 25 bp, Homo sapien
acagggcacctggacgcgcgggaga

SEQ ID NO: 484860 - DNA, 25 bp, Homo sapien
gagaccttgggtcaacacgaccctg

SEQ ID NO: 484861 - DNA, 25 bp, Homo sapien
tgggtcaacacgaccctgcgcacag

SEQ ID NO: 484862 - DNA, 25 bp, Homo sapien
cttgctggccctgcgaacgaacgag

SEQ ID NO: 484863 - DNA, 25 bp, Homo sapien
tgctggccctgcgaacgaacgagca

SEQ ID NO: 484864 - DNA, 25 bp, Homo sapien
tggccctgcgaacgaacgagcactg

SEQ ID NO: 484865 - DNA, 25 bp, Homo sapien
gccctgcgaacgaacgagcactgtt

SEQ ID NO: 484866 - DNA, 25 bp, Homo sapien
gaacgagcactgttcgtggttagaa

SEQ ID NO: 484867 - DNA, 25 bp, Homo sapien
cgagcactgttcgtggttagaaaag

SEQ ID NO: 484868 - DNA, 25 bp, Homo sapien
gcactgttcgtggttagaaaagcga

SEQ ID NO: 484869 - DNA, 25 bp, Homo sapien
gtggttagaaaagcgaagtgctgta

SEQ ID NO: 484870 - DNA, 25 bp, Homo sapien
gccttcacgaaaagcgcctacggtt

SEQ ID NO: 484871 - DNA, 25 bp, Homo sapien
ctacggttagcgagagagggatcac

SEQ ID NO: 484872 - DNA, 25 bp, Homo sapien
gagtccgcgggatccaaaggcggcg

SEQ ID NO: 484873 - DNA, 25 bp, Homo sapien
ctcctcctctcactttagtagagta

SEQ ID NO: 484874 - DNA, 25 bp, Homo sapien
tagagtacgcggtggacagctgatc

SEQ ID NO: 484875 - DNA, 25 bp, Homo sapien
acagctgatctccttcagtcgtcta

SEQ ID NO: 484876 - DNA, 25 bp, Homo sapien
agtcgtctacccacttccgtcattg

SEQ ID NO: 484877 - DNA, 25 bp, Homo sapien
cgtcattgtcctccgctagaataac

SEQ ID NO: 484878 - DNA, 25 bp, Homo sapien
gagtagttggtagtcatggccagaa

SEQ ID NO: 484879 - DNA, 25 bp, Homo sapien
gggtttctgtgctgtgtgacacaag

SEQ ID NO: 484880 - DNA, 25 bp, Homo sapien
agtgacaatcttgaagtcctaactt

SEQ ID NO: 484881 - DNA, 25 bp, Homo sapien
aagtcctaacttccactattctaga

SEQ ID NO: 484882 - DNA, 25 bp, Homo sapien
agtatagtggtgatttgtgtgcaaa

SEQ ID NO: 484883 - DNA, 25 bp, Homo sapien
gtaccaagttcctgaaattcaataa

SEQ ID NO: 484884 - DNA, 25 bp, Homo sapien
gaaaaatccgtggaactgaagctga

SEQ ID NO: 484885 - DNA, 25 bp, Homo sapien
ctgaagctgagatctttagtacgtg

SEQ ID NO: 484886 - DNA, 25 bp, Homo sapien
agatctttagtacgtggagtcacct

SEQ ID NO: 484887 - DNA, 25 bp, Homo sapien
acgtggagtcaccttacagatacag

SEQ ID NO: 484888 - DNA, 25 bp, Homo sapien
gagtcaccttacagatacagagcat

SEQ ID NO: 484889 - DNA, 25 bp, Homo sapien
ttacagatacagagcatttatgcgg

SEQ ID NO: 484890 - DNA, 25 bp, Homo sapien
atttatgcggtattcattggtgcct

SEQ ID NO: 484891 - DNA, 25 bp, Homo sapien
gtattcattggtgcctaaagaactt

SEQ ID NO: 484892 - DNA, 25 bp, Homo sapien
aagaactttaggcatcctctggaaa

SEQ ID NO: 484893 - DNA, 25 bp, Homo sapien
ttaggcatcctctggaaaaccggcc

SEQ ID NO: 484894 - DNA, 25 bp, Homo sapien
gaaaaccggcccagcacgtttcttg

SEQ ID NO: 484895 - DNA, 25 bp, Homo sapien
tatggagtgagtcttgaccgctttc

SEQ ID NO: 484896 - DNA, 25 bp, Homo sapien
agtcttgaccgctttccaagttcaa

SEQ ID NO: 484897 - DNA, 25 bp, Homo sapien
gaccgctttccaagttcaatagaag

SEQ ID NO: 484898 - DNA, 25 bp, Homo sapien
gaagttcaagattgcctctcagtga

SEQ ID NO: 484899 - DNA, 25 bp, Homo sapien
aagattgcctctcagtgattaggga

SEQ ID NO: 484900 - DNA, 25 bp, Homo sapien
gcctctcagtgattagggaaattga

SEQ ID NO: 484901 - DNA, 25 bp, Homo sapien
gcttttaaagctcctggtctcagta

SEQ ID NO: 484902 - DNA, 25 bp, Homo sapien
tcctggtctcagtaattcctcagaa

SEQ ID NO: 484903 - DNA, 25 bp, Homo sapien
ggtctcagtaattcctcagaataaa

SEQ ID NO: 484904 - DNA, 25 bp, Homo sapien
ttaccagtaattgaggttttatctg

SEQ ID NO: 484905 - DNA, 25 bp, Homo sapien
gatgatgaaatggttccttcttgga

SEQ ID NO: 484906 - DNA, 25 bp, Homo sapien
ttttataacaaagtcacgggtatct

SEQ ID NO: 484907 - DNA, 25 bp, Homo sapien
aagtcacgggtatctttaggttcag

SEQ ID NO: 484908 - DNA, 25 bp, Homo sapien
tcacgggtatctttaggttcaggga

SEQ ID NO: 484909 - DNA, 25 bp, Homo sapien
aggttcagggaactagactaggtca

SEQ ID NO: 484910 - DNA, 25 bp, Homo sapien
gaactagactaggtcattcgtgtaa

SEQ ID NO: 484911 - DNA, 25 bp, Homo sapien
attcgtgtaaatggactggtagtta

SEQ ID NO: 484912 - DNA, 25 bp, Homo sapien
tggtagttacagtcttaggttaaag

SEQ ID NO: 484913 - DNA, 25 bp, Homo sapien
tacagtcttaggttaaagtattcta

SEQ ID NO: 484914 - DNA, 25 bp, Homo sapien
ggaactaaattgctggttttctaag

SEQ ID NO: 484915 - DNA, 25 bp, Homo sapien
aaattgctggttttctaagataaga

SEQ ID NO: 484916 - DNA, 25 bp, Homo sapien
atgggatatgggtcatataactttt

SEQ ID NO: 484917 - DNA, 25 bp, Homo sapien
agggactgttggcaagtgaaatata

SEQ ID NO: 484918 - DNA, 25 bp, Homo sapien
attaacaccattagtcaaccagtct

SEQ ID NO: 484919 - DNA, 25 bp, Homo sapien
acaccattagtcaaccagtcttaga

SEQ ID NO: 484920 - DNA, 25 bp, Homo sapien
cattagtcaaccagtcttagattct

SEQ ID NO: 484921 - DNA, 25 bp, Homo sapien
cttagattctgagggctgggacaga

SEQ ID NO: 484922 - DNA, 25 bp, Homo sapien
gagggagttctggtcagttctctaa

SEQ ID NO: 484923 - DNA, 25 bp, Homo sapien
agttctggtcagttctctaaaagga

SEQ ID NO: 484924 - DNA, 25 bp, Homo sapien
ctggtcagttctctaaaaggacaac

SEQ ID NO: 484925 - DNA, 25 bp, Homo sapien
aactactataaagggattgtcccag

SEQ ID NO: 484926 - DNA, 25 bp, Homo sapien
ttgtcccagggcaaagataacaggc

SEQ ID NO: 484927 - DNA, 25 bp, Homo sapien
cagggcaaagataacaggccaggca

SEQ ID NO: 484928 - DNA, 25 bp, Homo sapien
aacccttgctgtgctcaagttcttg

SEQ ID NO: 484929 - DNA, 25 bp, Homo sapien
gattcagagctaagttcaaaattta

SEQ ID NO: 484930 - DNA, 25 bp, Homo sapien
gaaacagtgccttaaagacgggcaa

SEQ ID NO: 484931 - DNA, 25 bp, Homo sapien
aaaacccggtgtgggagtctgctca

SEQ ID NO: 484932 - DNA, 25 bp, Homo sapien
gagtctgctcatctatggtttgtta

SEQ ID NO: 484933 - DNA, 25 bp, Homo sapien
atctatggtttgttactgctctcgc

SEQ ID NO: 484934 - DNA, 25 bp, Homo sapien
gatattcttaaattcctaggtacca

SEQ ID NO: 484935 - DNA, 25 bp, Homo sapien
agacaggagcgtgtgcaccttccat

SEQ ID NO: 484936 - DNA, 25 bp, Homo sapien
gtgcaccttccatctgtgagaggca

SEQ ID NO: 484937 - DNA, 25 bp, Homo sapien
tgtgagaggcacacttcagtctggg

SEQ ID NO: 484938 - DNA, 25 bp, Homo sapien
acttcagtctgggttcaagatgcag

SEQ ID NO: 484939 - DNA, 25 bp, Homo sapien
acgcactgtattccagctggtgatc

SEQ ID NO: 484940 - DNA, 25 bp, Homo sapien
gtgatcaagtctgggaacagccgta

SEQ ID NO: 484941 - DNA, 25 bp, Homo sapien
ggaacagccgtaacaggtcaacctt

SEQ ID NO: 484942 - DNA, 25 bp, Homo sapien
aggtcaaccttgtggagccatcgcg

SEQ ID NO: 484943 - DNA, 25 bp, Homo sapien
agccatcgcgagttagagggtgaaa

SEQ ID NO: 484944 - DNA, 25 bp, Homo sapien
gagtgtgttttttgagtttgcatca

SEQ ID NO: 484945 - DNA, 25 bp, Homo sapien
gcatcaatcttaatgtctcttcata

SEQ ID NO: 484946 - DNA, 25 bp, Homo sapien
aatacattaagcctcttgtctacat

SEQ ID NO: 484947 - DNA, 25 bp, Homo sapien
agcctcttgtctacatatttggaga

SEQ ID NO: 484948 - DNA, 25 bp, Homo sapien
gagaatatgactttactagcagaga

SEQ ID NO: 484949 - DNA, 25 bp, Homo sapien
atatatcttgtctactggactgtaa

SEQ ID NO: 484950 - DNA, 25 bp, Homo sapien
gatcagtgacggtgagagccatctc

SEQ ID NO: 484951 - DNA, 25 bp, Homo sapien
gtgacggtgagagccatctccacag

SEQ ID NO: 484952 - DNA, 25 bp, Homo sapien
ggctcatcttttacactcctttaaa

SEQ ID NO: 484953 - DNA, 25 bp, Homo sapien
gataagtgtgggtcaatttttgctt

SEQ ID NO: 484954 - DNA, 25 bp, Homo sapien
atttttgcttgacttttggtatgcg

SEQ ID NO: 484955 - DNA, 25 bp, Homo sapien
tgcttgacttttggtatgcgtacac

SEQ ID NO: 484956 - DNA, 25 bp, Homo sapien
gacttttggtatgcgtacaccaggc

SEQ ID NO: 484957 - DNA, 25 bp, Homo sapien
ggaagaacatcctgcatacaataac

SEQ ID NO: 484958 - DNA, 25 bp, Homo sapien
catcctgcatacaataaccgttttg

SEQ ID NO: 484959 - DNA, 25 bp, Homo sapien
tgttttcccaatttctatagggttg

SEQ ID NO: 484960 - DNA, 25 bp, Homo sapien
tcccaatttctatagggttgaagct

SEQ ID NO: 484961 - DNA, 25 bp, Homo sapien
tgctattgcacttcaccagaggttg

SEQ ID NO: 484962 - DNA, 25 bp, Homo sapien
ttgcacttcaccagaggttggctct

SEQ ID NO: 484963 - DNA, 25 bp, Homo sapien
gttggctctggcctcagtaccctca

SEQ ID NO: 484964 - DNA, 25 bp, Homo sapien
ctctccccacattgtgtcctgtggg

SEQ ID NO: 484965 - DNA, 25 bp, Homo sapien
gccgctgctctgtacagaaccacag

SEQ ID NO: 484966 - DNA, 25 bp, Homo sapien
tgtacagaaccacaggaactgatgt

SEQ ID NO: 484967 - DNA, 25 bp, Homo sapien
atgtgggatatgttcccctattcct

SEQ ID NO: 484968 - DNA, 25 bp, Homo sapien
atatgttcccctattcctgtatttc

SEQ ID NO: 484969 - DNA, 25 bp, Homo sapien
tgggtagggttgctcagtctttggg

SEQ ID NO: 484970 - DNA, 25 bp, Homo sapien
gaggttagggacttatcctgtgctt

SEQ ID NO: 484971 - DNA, 25 bp, Homo sapien
gggacttatcctgtgcttgtaaata

SEQ ID NO: 484972 - DNA, 25 bp, Homo sapien
ggccaaactagctcttggaggaacg

SEQ ID NO: 484973 - DNA, 25 bp, Homo sapien
aaacagaagcggtgcatacctcaga

SEQ ID NO: 484974 - DNA, 25 bp, Homo sapien
ggtgcatacctcagagcctggataa

SEQ ID NO: 484975 - DNA, 25 bp, Homo sapien
attgaacctggaactggctttgacc

SEQ ID NO: 484976 - DNA, 25 bp, Homo sapien
tggctttgaccatgaaactgtgaat

SEQ ID NO: 484977 - DNA, 25 bp, Homo sapien
gaaactgtgaatggccctaacttca

SEQ ID NO: 484978 - DNA, 25 bp, Homo sapien
gagaaatcgaaggaattggcccaat

SEQ ID NO: 484979 - DNA, 25 bp, Homo sapien
gaaaagtctgcgttagtctggagaa

SEQ ID NO: 484980 - DNA, 25 bp, Homo sapien
ggatgtcatcaatctcaggaatgct

SEQ ID NO: 484981 - DNA, 25 bp, Homo sapien
aggaatgctattacccagagcctct

SEQ ID NO: 484982 - DNA, 25 bp, Homo sapien
agagcctctgagctactactttgca

SEQ ID NO: 484983 - DNA, 25 bp, Homo sapien
gtgctggagctcttctgatattatc

SEQ ID NO: 484984 - DNA, 25 bp, Homo sapien
gatattatcaattctccttcataga

SEQ ID NO: 484985 - DNA, 25 bp, Homo sapien
aaagctcttttatgtgaactcttgc

SEQ ID NO: 484986 - DNA, 25 bp, Homo sapien
gtgaactcttgcttcatccaggcaa

SEQ ID NO: 484987 - DNA, 25 bp, Homo sapien
ttcatccaggcaagaacggtgtttt

SEQ ID NO: 484988 - DNA, 25 bp, Homo sapien
cggtgttttgtttgcgaccatctca

SEQ ID NO: 484989 - DNA, 25 bp, Homo sapien
gtttgcgaccatctcagtgtcaaga

SEQ ID NO: 484990 - DNA, 25 bp, Homo sapien
gaaacgtgtcagtgagtacctggac

SEQ ID NO: 484991 - DNA, 25 bp, Homo sapien
gtacctggaccatcacttaactgat

SEQ ID NO: 484992 - DNA, 25 bp, Homo sapien
ggtaggactgcaggtttcacatgaa

SEQ ID NO: 484993 - DNA, 25 bp, Homo sapien
tggagaggttctgcaattttttaaa

SEQ ID NO: 484994 - DNA, 25 bp, Homo sapien
agattattcttctcaaatttagttg

SEQ ID NO: 484995 - DNA, 25 bp, Homo sapien
aaatttagttgagctttctaagaga

SEQ ID NO: 484996 - DNA, 25 bp, Homo sapien
agaagcaattggctttttcccactt

SEQ ID NO: 484997 - DNA, 25 bp, Homo sapien
aatcattttcagtttgactcataca

SEQ ID NO: 484998 - DNA, 25 bp, Homo sapien
gactcatacagttaacacaatgtga

SEQ ID NO: 484999 - DNA, 25 bp, Homo sapien
gaatttcttcctcagcataacagag

SEQ ID NO: 485000 - DNA, 25 bp, Homo sapien
tcttcctcagcataacagagttata

SEQ ID NO: 485001 - DNA, 25 bp, Homo sapien
aacagagttatagaatgacagggct

SEQ ID NO: 485002 - DNA, 25 bp, Homo sapien
aatgacagggctggaagtgacctta

SEQ ID NO: 485003 - DNA, 25 bp, Homo sapien
agtgaccttagagagtatccagttc

SEQ ID NO: 485004 - DNA, 25 bp, Homo sapien
ttagagagtatccagttctttcatt

SEQ ID NO: 485005 - DNA, 25 bp, Homo sapien
ttggcaactgactcgtgacaaaggg

SEQ ID NO: 485006 - DNA, 25 bp, Homo sapien
tggcaactgactcgtgacaaagggt

SEQ ID NO: 485007 - DNA, 25 bp, Homo sapien
ggcaactgactcgtgacaaagggtt

SEQ ID NO: 485008 - DNA, 25 bp, Homo sapien
gcaactgactcgtgacaaagggttc

SEQ ID NO: 485009 - DNA, 25 bp, Homo sapien
caactgactcgtgacaaagggttca

SEQ ID NO: 485010 - DNA, 25 bp, Homo sapien
aactgactcgtgacaaagggttcaa

SEQ ID NO: 485011 - DNA, 25 bp, Homo sapien
actgactcgtgacaaagggttcaag

SEQ ID NO: 485012 - DNA, 25 bp, Homo sapien
ctgactcgtgacaaagggttcaaga

SEQ ID NO: 485013 - DNA, 25 bp, Homo sapien
tgactcgtgacaaagggttcaagat

SEQ ID NO: 485014 - DNA, 25 bp, Homo sapien
agtgatgtgtatggccaggcatggt

SEQ ID NO: 485015 - DNA, 25 bp, Homo sapien
gtgatgtgtatggccaggcatggtg

SEQ ID NO: 485016 - DNA, 25 bp, Homo sapien
tgatgtgtatggccaggcatggtgg

SEQ ID NO: 485017 - DNA, 25 bp, Homo sapien
tgtagtgagctgagactgcgcctct

SEQ ID NO: 485018 - DNA, 25 bp, Homo sapien
gtagtgagctgagactgcgcctctg

SEQ ID NO: 485019 - DNA, 25 bp, Homo sapien
tagtgagctgagactgcgcctctgc

SEQ ID NO: 485020 - DNA, 25 bp, Homo sapien
agtgagctgagactgcgcctctgca

SEQ ID NO: 485021 - DNA, 25 bp, Homo sapien
gtgagctgagactgcgcctctgcac

SEQ ID NO: 485022 - DNA, 25 bp, Homo sapien
tgagctgagactgcgcctctgcact

SEQ ID NO: 485023 - DNA, 25 bp, Homo sapien
gctgagactgcgcctctgcactcca

SEQ ID NO: 485024 - DNA, 25 bp, Homo sapien
tcccgaagccgaagtctcactttgc

SEQ ID NO: 485025 - DNA, 25 bp, Homo sapien
acatggaacacccaattctgcgtct

SEQ ID NO: 485026 - DNA, 25 bp, Homo sapien
aattctgcgtctccctgtagccaga

SEQ ID NO: 485027 - DNA, 25 bp, Homo sapien
tgcgtctccctgtagccagagacac

SEQ ID NO: 485028 - DNA, 25 bp, Homo sapien
ggtgttgtcacaatcacgcatcaca

SEQ ID NO: 485029 - DNA, 25 bp, Homo sapien
atcacgcatcacaagtcgcctgcag

SEQ ID NO: 485030 - DNA, 25 bp, Homo sapien
tgcagccgcccgaagagccaagagt

SEQ ID NO: 485031 - DNA, 25 bp, Homo sapien
gccgcccgaagagccaagagtcagt

SEQ ID NO: 485032 - DNA, 25 bp, Homo sapien
gagccaagagtcagtattccggcca

SEQ ID NO: 485033 - DNA, 25 bp, Homo sapien
agtattccggccagcttcacgaagt

SEQ ID NO: 485034 - DNA, 25 bp, Homo sapien
ccggccagcttcacgaagtcagaga

SEQ ID NO: 485035 - DNA, 25 bp, Homo sapien
ctcccagagtgctatgcgagtggct

SEQ ID NO: 485036 - DNA, 25 bp, Homo sapien
ccagagtgctatgcgagtggctgcc

SEQ ID NO: 485037 - DNA, 25 bp, Homo sapien
ctatgcgagtggctgccgtgcagtt

SEQ ID NO: 485038 - DNA, 25 bp, Homo sapien
gtttagacacagataggagtccagg

SEQ ID NO: 485039 - DNA, 25 bp, Homo sapien
cacagataggagtccagggtatgac

SEQ ID NO: 485040 - DNA, 25 bp, Homo sapien
gataggagtccagggtatgactgat

SEQ ID NO: 485041 - DNA, 25 bp, Homo sapien
gtatgactgatggaggccccggccc

SEQ ID NO: 485042 - DNA, 25 bp, Homo sapien
tatgactgatggaggccccggccca

SEQ ID NO: 485043 - DNA, 25 bp, Homo sapien
ggcccacgtgaccagcaaggtcaga

SEQ ID NO: 485044 - DNA, 25 bp, Homo sapien
accagcaaggtcagaggcccagcca

SEQ ID NO: 485045 - DNA, 25 bp, Homo sapien
ggaagcaaatgaattctcagaggaa

SEQ ID NO: 485046 - DNA, 25 bp, Homo sapien
gtgggccttcagagttggacccgac

SEQ ID NO: 485047 - DNA, 25 bp, Homo sapien
gaccccaatggatgaagacccactt

SEQ ID NO: 485048 - DNA, 25 bp, Homo sapien
agacccacttcaaagagaccagcct

SEQ ID NO: 485049 - DNA, 25 bp, Homo sapien
ctgtgccagacctcttggctagaag

SEQ ID NO: 485050 - DNA, 25 bp, Homo sapien
agacctcttggctagaaggactcac

SEQ ID NO: 485051 - DNA, 25 bp, Homo sapien
aggactcactggactcaggaaagct

SEQ ID NO: 485052 - DNA, 25 bp, Homo sapien
ggaaagctgctaggctcacagttac

SEQ ID NO: 485053 - DNA, 25 bp, Homo sapien
gattattacagtacatggacagaga

SEQ ID NO: 485054 - DNA, 25 bp, Homo sapien
atcagcatagggaggaggtgcacta

SEQ ID NO: 485055 - DNA, 25 bp, Homo sapien
aggaggtgcactagacacgttccac

SEQ ID NO: 485056 - DNA, 25 bp, Homo sapien
ggtgcactagacacgttccactaca

SEQ ID NO: 485057 - DNA, 25 bp, Homo sapien
gtaacaatattgtgagctctgaatt

SEQ ID NO: 485058 - DNA, 25 bp, Homo sapien
atattgtgagctctgaattactttg

SEQ ID NO: 485059 - DNA, 25 bp, Homo sapien
tactttggagtatatctattgtcaa

SEQ ID NO: 485060 - DNA, 25 bp, Homo sapien
atctattgtcaagttaattctctat

SEQ ID NO: 485061 - DNA, 25 bp, Homo sapien
aattctctatttaccattcactctc

SEQ ID NO: 485062 - DNA, 25 bp, Homo sapien
ttctctatttaccattcactctcag

SEQ ID NO: 485063 - DNA, 25 bp, Homo sapien
attcactctcagccacattccagga

SEQ ID NO: 485064 - DNA, 25 bp, Homo sapien
aactaagccagggagattggtctta

SEQ ID NO: 485065 - DNA, 25 bp, Homo sapien
agccagggagattggtcttaggaat

SEQ ID NO: 485066 - DNA, 25 bp, Homo sapien
agtactttgaacttagtagacattc

SEQ ID NO: 485067 - DNA, 25 bp, Homo sapien
tgaacttagtagacattcattgagt

SEQ ID NO: 485068 - DNA, 25 bp, Homo sapien
accagcctccacaatatatttctag

SEQ ID NO: 485069 - DNA, 25 bp, Homo sapien
gggatgttatcctgctttatatatg

SEQ ID NO: 485070 - DNA, 25 bp, Homo sapien
ttatacccaggtttccctgtatgta

SEQ ID NO: 485071 - DNA, 25 bp, Homo sapien
atacccaggtttccctgtatgtact

SEQ ID NO: 485072 - DNA, 25 bp, Homo sapien
tcttgttcctattgttaggtgagag

SEQ ID NO: 485073 - DNA, 25 bp, Homo sapien
aaattcagtttgatgtacctgcgtg

SEQ ID NO: 485074 - DNA, 25 bp, Homo sapien
tcagtttgatgtacctgcgtgacac

SEQ ID NO: 485075 - DNA, 25 bp, Homo sapien
taaaaatccaaagtgtttcctcaga

SEQ ID NO: 485076 - DNA, 25 bp, Homo sapien
aatccaaagtgtttcctcagacatg

SEQ ID NO: 485077 - DNA, 25 bp, Homo sapien
aagtgtttcctcagacatgatcaca

SEQ ID NO: 485078 - DNA, 25 bp, Homo sapien
gtgtttcctcagacatgatcacacc

SEQ ID NO: 485079 - DNA, 25 bp, Homo sapien
ggttttcttggataaaagttggcag

SEQ ID NO: 485080 - DNA, 25 bp, Homo sapien
ttggcagtgaagtggcagtttgcaa

SEQ ID NO: 485081 - DNA, 25 bp, Homo sapien
tgaagtggcagtttgcaagtggcca

SEQ ID NO: 485082 - DNA, 25 bp, Homo sapien
aagtggccagtgattcccccaactc

SEQ ID NO: 485083 - DNA, 25 bp, Homo sapien
caaagacagatttttacctttctgg

SEQ ID NO: 485084 - DNA, 25 bp, Homo sapien
tttgggcagggcaaaggttacctga

SEQ ID NO: 485085 - DNA, 25 bp, Homo sapien
ggttacctgagacacaattactttg

SEQ ID NO: 485086 - DNA, 25 bp, Homo sapien
gatacgttacatggaaacttgcaac

SEQ ID NO: 485087 - DNA, 25 bp, Homo sapien
ggaaacttgcaactggcatccgaaa

SEQ ID NO: 485088 - DNA, 25 bp, Homo sapien
actggcatccgaaagaaaaactgtt

SEQ ID NO: 485089 - DNA, 25 bp, Homo sapien
gtttttatcctgttgtacaaataca

SEQ ID NO: 485090 - DNA, 25 bp, Homo sapien
gtggaataaaataagatgcatcgac

SEQ ID NO: 485091 - DNA, 25 bp, Homo sapien
gaataaaataagatgcatcgacgta

SEQ ID NO: 485092 - DNA, 25 bp, Homo sapien
ttttgtcagggactgcaatcctgcc

SEQ ID NO: 485093 - DNA, 25 bp, Homo sapien
tttgtcagggactgcaatcctgccc

SEQ ID NO: 485094 - DNA, 25 bp, Homo sapien
tgtcagggactgcaatcctgcccct

SEQ ID NO: 485095 - DNA, 25 bp, Homo sapien
gctggctctcagagacaccgtgaca

SEQ ID NO: 485096 - DNA, 25 bp, Homo sapien
tggctctcagagacaccgtgacatc

SEQ ID NO: 485097 - DNA, 25 bp, Homo sapien
gacaccgtgacatcacgggtgatga

SEQ ID NO: 485098 - DNA, 25 bp, Homo sapien
cacgggtgatgatgagaggagttca

SEQ ID NO: 485099 - DNA, 25 bp, Homo sapien
agagagaattatatgctggcgcggt

SEQ ID NO: 485100 - DNA, 25 bp, Homo sapien
gagaattatatgctggcgcggtggc

SEQ ID NO: 485101 - DNA, 25 bp, Homo sapien
tacacaagtaccactgtgttacagt

SEQ ID NO: 485102 - DNA, 25 bp, Homo sapien
caagtaccactgtgttacagttgcc

SEQ ID NO: 485103 - DNA, 25 bp, Homo sapien
ttacagttgcctatagtactcagta

SEQ ID NO: 485104 - DNA, 25 bp, Homo sapien
tacagtaacacactttacaagctta

SEQ ID NO: 485105 - DNA, 25 bp, Homo sapien
aacacactttacaagcttatagcct

SEQ ID NO: 485106 - DNA, 25 bp, Homo sapien
acactttacaagcttatagcctagg

SEQ ID NO: 485107 - DNA, 25 bp, Homo sapien
actttacaagcttatagcctaggaa

SEQ ID NO: 485108 - DNA, 25 bp, Homo sapien
tacaagcttatagcctaggaacaat

SEQ ID NO: 485109 - DNA, 25 bp, Homo sapien
gcatgactgtataatggttttatgg

SEQ ID NO: 485110 - DNA, 25 bp, Homo sapien
tttttaatccattataccatatttt

SEQ ID NO: 485111 - DNA, 25 bp, Homo sapien
tagatacacaagtaccactgtgtta

SEQ ID NO: 485112 - DNA, 25 bp, Homo sapien
tacacaagggtatacatttcattaa

SEQ ID NO: 485113 - DNA, 25 bp, Homo sapien
actgtgttttatttgcaagagcgac

SEQ ID NO: 485114 - DNA, 25 bp, Homo sapien
caagagcgacaattgttggtgacaa

SEQ ID NO: 485115 - DNA, 25 bp, Homo sapien
aattgttggtgacaagtttgcttgt

SEQ ID NO: 485116 - DNA, 25 bp, Homo sapien
gtttgcttgtttggaagaaaagtct

SEQ ID NO: 485117 - DNA, 25 bp, Homo sapien
gaaaagtctgatacactaattaaga

SEQ ID NO: 485118 - DNA, 25 bp, Homo sapien
tgggagaagggaatagcctatttta

SEQ ID NO: 485119 - DNA, 25 bp, Homo sapien
attgttttcaaagccaaagcaccat

SEQ ID NO: 485120 - DNA, 25 bp, Homo sapien
agccaaagcaccatggaaacttctt

SEQ ID NO: 485121 - DNA, 25 bp, Homo sapien
aagcaccatggaaacttcttcactg

SEQ ID NO: 485122 - DNA, 25 bp, Homo sapien
caccatggaaacttcttcactgatt

SEQ ID NO: 485123 - DNA, 25 bp, Homo sapien
gctttggcttacttgaaatgtactt

SEQ ID NO: 485124 - DNA, 25 bp, Homo sapien
actacaggttcaacttaaaagtgct

SEQ ID NO: 485125 - DNA, 25 bp, Homo sapien
acttaaaagtgctctcctttatctc

SEQ ID NO: 485126 - DNA, 25 bp, Homo sapien
ttaccaggtaaaaacagcaagactc

SEQ ID NO: 485127 - DNA, 25 bp, Homo sapien
agcaagactcagaacatacgggtat

SEQ ID NO: 485128 - DNA, 25 bp, Homo sapien
gactcagaacatacgggtataccgt

SEQ ID NO: 485129 - DNA, 25 bp, Homo sapien
acgggtataccgtcatatattttga

SEQ ID NO: 485130 - DNA, 25 bp, Homo sapien
atagatcagctacaaaactcttgaa

SEQ ID NO: 485131 - DNA, 25 bp, Homo sapien
atatgtttatatttcctcccacctc

SEQ ID NO: 485132 - DNA, 25 bp, Homo sapien
atgaaaaatacatttacttctctgc

SEQ ID NO: 485133 - DNA, 25 bp, Homo sapien
atacatttacttctctgctttggct

SEQ ID NO: 485134 - DNA, 25 bp, Homo sapien
gaccccaaatcctttgactactctt

SEQ ID NO: 485135 - DNA, 25 bp, Homo sapien
caaatcctttgactactcttggtgt

SEQ ID NO: 485136 - DNA, 25 bp, Homo sapien
aatcctttgactactcttggtgttt

SEQ ID NO: 485137 - DNA, 25 bp, Homo sapien
tatgttggaaatctggaattcccag

SEQ ID NO: 485138 - DNA, 25 bp, Homo sapien
tggaattcccagacaacgacagctg

SEQ ID NO: 485139 - DNA, 25 bp, Homo sapien
gaattcccagacaacgacagctgat

SEQ ID NO: 485140 - DNA, 25 bp, Homo sapien
ttcccagacaacgacagctgattca

SEQ ID NO: 485141 - DNA, 25 bp, Homo sapien
agacaacgacagctgattcaactta

SEQ ID NO: 485142 - DNA, 25 bp, Homo sapien
acgacagctgattcaacttacttgg

SEQ ID NO: 485143 - DNA, 25 bp, Homo sapien
gacagctgattcaacttacttggaa

SEQ ID NO: 485144 - DNA, 25 bp, Homo sapien
gctgattcaacttacttggaatttt

SEQ ID NO: 485145 - DNA, 25 bp, Homo sapien
ttggaacaccctcatggaacactgg

SEQ ID NO: 485146 - DNA, 25 bp, Homo sapien
ggaacactggcaacatggaatgtag

SEQ ID NO: 485147 - DNA, 25 bp, Homo sapien
aatgtagagagctgatgtcttcccc

SEQ ID NO: 485148 - DNA, 25 bp, Homo sapien
ctcatagaggccattggcttccttt

SEQ ID NO: 485149 - DNA, 25 bp, Homo sapien
aggccattggcttcctttgtataag

SEQ ID NO: 485150 - DNA, 25 bp, Homo sapien
gagaagttggtatgtctagcttcat

SEQ ID NO: 485151 - DNA, 25 bp, Homo sapien
tcgggctacccagcaagaggattct

SEQ ID NO: 485152 - DNA, 25 bp, Homo sapien
gaggattctgcatcaaggaactgga

SEQ ID NO: 485153 - DNA, 25 bp, Homo sapien
atcaaggaactggacgagccgctac

SEQ ID NO: 485154 - DNA, 25 bp, Homo sapien
ggaactggacgagccgctacccaaa

SEQ ID NO: 485155 - DNA, 25 bp, Homo sapien
gaaattgagcggttggaacaccctc

SEQ ID NO: 485156 - DNA, 25 bp, Homo sapien
gttttgcctaataattttagctcca

SEQ ID NO: 485157 - DNA, 25 bp, Homo sapien
tttagctccaatccatctttctctt

SEQ ID NO: 485158 - DNA, 25 bp, Homo sapien
ccaccccttaagtacttagtcatgc

SEQ ID NO: 485159 - DNA, 25 bp, Homo sapien
gattatacatttcttgggtcccata

SEQ ID NO: 485160 - DNA, 25 bp, Homo sapien
tcttgggtcccatactttgcattta

SEQ ID NO: 485161 - DNA, 25 bp, Homo sapien
gtcccatactttgcatttaccatag

SEQ ID NO: 485162 - DNA, 25 bp, Homo sapien
ccatactttgcatttaccatagcag

SEQ ID NO: 485163 - DNA, 25 bp, Homo sapien
tttcatagcccatacaaacattagg

SEQ ID NO: 485164 - DNA, 25 bp, Homo sapien
aaacattaggccttcaaaatatttg

SEQ ID NO: 485165 - DNA, 25 bp, Homo sapien
aaatatttgtcaagtatttcttcaa

SEQ ID NO: 485166 - DNA, 25 bp, Homo sapien
atgaaaacatcccaaatcttgatcc

SEQ ID NO: 485167 - DNA, 25 bp, Homo sapien
ggaaccctgacttagagtgccctgt

SEQ ID NO: 485168 - DNA, 25 bp, Homo sapien
aaccctgacttagagtgccctgtga

SEQ ID NO: 485169 - DNA, 25 bp, Homo sapien
ctatagattatagccatctgttttt

SEQ ID NO: 485170 - DNA, 25 bp, Homo sapien
tttgttcgttttgcttagtatttga

SEQ ID NO: 485171 - DNA, 25 bp, Homo sapien
tagactgacaggactataaatacat

SEQ ID NO: 485172 - DNA, 25 bp, Homo sapien
gttcgttttgcttagtatttgaaat

SEQ ID NO: 485173 - DNA, 25 bp, Homo sapien
catttttctttctgttgtattgctt

SEQ ID NO: 485174 - DNA, 25 bp, Homo sapien
tttctttctgttgtattgcttgtct

SEQ ID NO: 485175 - DNA, 25 bp, Homo sapien
ctttctgttgtattgcttgtcttaa

SEQ ID NO: 485176 - DNA, 25 bp, Homo sapien
tttctggccataacctgtacaagta

SEQ ID NO: 485177 - DNA, 25 bp, Homo sapien
ggccataacctgtacaagtatttgt

SEQ ID NO: 485178 - DNA, 25 bp, Homo sapien
gaggtttctaattaatggtatgcta

SEQ ID NO: 485179 - DNA, 25 bp, Homo sapien
ggtatgctagtttctactgttttat

SEQ ID NO: 485180 - DNA, 25 bp, Homo sapien
ttatctagtgttgtataaggacttt

SEQ ID NO: 485181 - DNA, 25 bp, Homo sapien
aaggactttagtattgtggatgatg

SEQ ID NO: 485182 - DNA, 25 bp, Homo sapien
atgggagtggctttttgtggcatat

SEQ ID NO: 485183 - DNA, 25 bp, Homo sapien
aaatgtgtgggtagttaattacaat

SEQ ID NO: 485184 - DNA, 25 bp, Homo sapien
acaaccaggatgtatggattcttga

SEQ ID NO: 485185 - DNA, 25 bp, Homo sapien
atgtatggattcttgaggttttggc

SEQ ID NO: 485186 - DNA, 25 bp, Homo sapien
cttgagctttctcttgagtacttga

SEQ ID NO: 485187 - DNA, 25 bp, Homo sapien
gagctttctcttgagtacttgatac

SEQ ID NO: 485188 - DNA, 25 bp, Homo sapien
gagtacttgatactgttttctgaat

SEQ ID NO: 485189 - DNA, 25 bp, Homo sapien
atactgaggaagtgtcggtgaccgg

SEQ ID NO: 485190 - DNA, 25 bp, Homo sapien
tactgaggaagtgtcggtgaccgga

SEQ ID NO: 485191 - DNA, 25 bp, Homo sapien
actgaggaagtgtcggtgaccggaa

SEQ ID NO: 485192 - DNA, 25 bp, Homo sapien
ctgaggaagtgtcggtgaccggaag

SEQ ID NO: 485193 - DNA, 25 bp, Homo sapien
gaggaagtgtcggtgaccggaagag

SEQ ID NO: 485194 - DNA, 25 bp, Homo sapien
aggaagtgtcggtgaccggaagagg

SEQ ID NO: 485195 - DNA, 25 bp, Homo sapien
ggaagtgtcggtgaccggaagaggg

SEQ ID NO: 485196 - DNA, 25 bp, Homo sapien
gggtggtgtgacctgaggatgctga

SEQ ID NO: 485197 - DNA, 25 bp, Homo sapien
tggtgtgacctgaggatgctgagga

SEQ ID NO: 485198 - DNA, 25 bp, Homo sapien
gtgtgacctgaggatgctgaggaag

SEQ ID NO: 485199 - DNA, 25 bp, Homo sapien
gtgacctgaggatgctgaggaaggg

SEQ ID NO: 485200 - DNA, 25 bp, Homo sapien
ttttcactgggatgagtagaactct

SEQ ID NO: 485201 - DNA, 25 bp, Homo sapien
ctgggatgagtagaactctgctttt

SEQ ID NO: 485202 - DNA, 25 bp, Homo sapien
gagtagaactctgcttttagtaaaa

SEQ ID NO: 485203 - DNA, 25 bp, Homo sapien
ggatgatttgggatcagagcttttc

SEQ ID NO: 485204 - DNA, 25 bp, Homo sapien
gatttgggatcagagcttttcatct

SEQ ID NO: 485205 - DNA, 25 bp, Homo sapien
ttttagcctgtaaaataaacagcta

SEQ ID NO: 485206 - DNA, 25 bp, Homo sapien
aacagctatattgttttgcccttta

SEQ ID NO: 485207 - DNA, 25 bp, Homo sapien
tctgtctttctttccctagttgtaa

SEQ ID NO: 485208 - DNA, 25 bp, Homo sapien
ttccctagttgtaaaagtaaagcat

SEQ ID NO: 485209 - DNA, 25 bp, Homo sapien
aaaatcacccttataactctataag

SEQ ID NO: 485210 - DNA, 25 bp, Homo sapien
acccttataactctataagccatag

SEQ ID NO: 485211 - DNA, 25 bp, Homo sapien
tttattaaccactcagcatccccag

SEQ ID NO: 485212 - DNA, 25 bp, Homo sapien
atccccagtgcctgacctatagtag

SEQ ID NO: 485213 - DNA, 25 bp, Homo sapien
cccagtgcctgacctatagtaggtg

SEQ ID NO: 485214 - DNA, 25 bp, Homo sapien
gcctgacctatagtaggtgctacgt

SEQ ID NO: 485215 - DNA, 25 bp, Homo sapien
tagtaggtgctacgtatctgctttt

SEQ ID NO: 485216 - DNA, 25 bp, Homo sapien
agtaggtgctacgtatctgcttttg

SEQ ID NO: 485217 - DNA, 25 bp, Homo sapien
aggtgctacgtatctgcttttggaa

SEQ ID NO: 485218 - DNA, 25 bp, Homo sapien
ggtgctacgtatctgcttttggaaa

SEQ ID NO: 485219 - DNA, 25 bp, Homo sapien
tgctacgtatctgcttttggaaaac

SEQ ID NO: 485220 - DNA, 25 bp, Homo sapien
ctacgtatctgcttttggaaaacat

SEQ ID NO: 485221 - DNA, 25 bp, Homo sapien
agaccaacaaggcttgggccaaggg

SEQ ID NO: 485222 - DNA, 25 bp, Homo sapien
atggacatacagctctaaatataga

SEQ ID NO: 485223 - DNA, 25 bp, Homo sapien
gagaggtctgccgtgacagttcagt

SEQ ID NO: 485224 - DNA, 25 bp, Homo sapien
aggtctgccgtgacagttcagtagg

SEQ ID NO: 485225 - DNA, 25 bp, Homo sapien
taggagactggaaatacttttgctt

SEQ ID NO: 485226 - DNA, 25 bp, Homo sapien
atacttttgctttctgtatcgatag

SEQ ID NO: 485227 - DNA, 25 bp, Homo sapien
aggtttcgttttgatcttgagaaat

SEQ ID NO: 485228 - DNA, 25 bp, Homo sapien
tctgataaaaccaccaactgaaaac

SEQ ID NO: 485229 - DNA, 25 bp, Homo sapien
ggagggatttcacaacgttcattcc

SEQ ID NO: 485230 - DNA, 25 bp, Homo sapien
cgttcattccaaaaaactgtggcta

SEQ ID NO: 485231 - DNA, 25 bp, Homo sapien
aactgtggctattcatttctggaag

SEQ ID NO: 485232 - DNA, 25 bp, Homo sapien
attcactgcagaagaatcgctgttt

SEQ ID NO: 485233 - DNA, 25 bp, Homo sapien
catacactatatcccctccttgtat

SEQ ID NO: 485234 - DNA, 25 bp, Homo sapien
gtatccagccattctgtactattcg

SEQ ID NO: 485235 - DNA, 25 bp, Homo sapien
agccattctgtactattcgatgaaa

SEQ ID NO: 485236 - DNA, 25 bp, Homo sapien
gtaatgtagtcttatgccacgttga

SEQ ID NO: 485237 - DNA, 25 bp, Homo sapien
gccacgttgagaaaaccctgctttt

SEQ ID NO: 485238 - DNA, 25 bp, Homo sapien
cttttcctgtgcacaagacctgaaa

SEQ ID NO: 485239 - DNA, 25 bp, Homo sapien
atagctcaaaaatcaatcttccaat

SEQ ID NO: 485240 - DNA, 25 bp, Homo sapien
acgaaatcatgcttggtgtctctta

SEQ ID NO: 485241 - DNA, 25 bp, Homo sapien
cttggtgtctcttaagaacttagcg

SEQ ID NO: 485242 - DNA, 25 bp, Homo sapien
gaacttagcggaaaaatcctcagtg

SEQ ID NO: 485243 - DNA, 25 bp, Homo sapien
atcctcagtgagtgcgtcataaagt

SEQ ID NO: 485244 - DNA, 25 bp, Homo sapien
aactatagaacaggccttcaggttt

SEQ ID NO: 485245 - DNA, 25 bp, Homo sapien
ttcaggtttgctgctgatagtggct

SEQ ID NO: 485246 - DNA, 25 bp, Homo sapien
gatagtggctggtccaccacaaaaa

SEQ ID NO: 485247 - DNA, 25 bp, Homo sapien
ggtccaccacaaaaaccaacaggag

SEQ ID NO: 485248 - DNA, 25 bp, Homo sapien
ggagggagaaccaacaccactctga

SEQ ID NO: 485249 - DNA, 25 bp, Homo sapien
actctgaacacacagctgcacatgg

SEQ ID NO: 485250 - DNA, 25 bp, Homo sapien
acacagctgcacatggaagcaacca

SEQ ID NO: 485251 - DNA, 25 bp, Homo sapien
gataagcagtcatcgaccgacacag

SEQ ID NO: 485252 - DNA, 25 bp, Homo sapien
tcttcccttgtgagccaaagctgct

SEQ ID NO: 485253 - DNA, 25 bp, Homo sapien
accacctcatctttctggatggaca

SEQ ID NO: 485254 - DNA, 25 bp, Homo sapien
tggatggacaaaggccttcaagaga

SEQ ID NO: 485255 - DNA, 25 bp, Homo sapien
cattggcgtagagcatgtgagtgac

SEQ ID NO: 485256 - DNA, 25 bp, Homo sapien
tgagtgactgtgagcgcctggccaa

SEQ ID NO: 485257 - DNA, 25 bp, Homo sapien
tgtgggacctgctcagcgacctgga

SEQ ID NO: 485258 - DNA, 25 bp, Homo sapien
ctgctcagcgacctggaggccaagt

SEQ ID NO: 485259 - DNA, 25 bp, Homo sapien
ccaagtgcgagaaggtgtctgagtt

SEQ ID NO: 485260 - DNA, 25 bp, Homo sapien
aaggtgtctgagtttgtggcgtcta

SEQ ID NO: 485261 - DNA, 25 bp, Homo sapien
gtgtctgagtttgtggcgtctaagc

SEQ ID NO: 485262 - DNA, 25 bp, Homo sapien
gagtttgtggcgtctaagccaggca

SEQ ID NO: 485263 - DNA, 25 bp, Homo sapien
tgtggcgtctaagccaggcacgtgt

SEQ ID NO: 485264 - DNA, 25 bp, Homo sapien
tgtgaaggtgctgaccatcgagccc

SEQ ID NO: 485265 - DNA, 25 bp, Homo sapien
ccgagctccgaggtgatctttggga

SEQ ID NO: 485266 - DNA, 25 bp, Homo sapien
gaagaatcttacatcttgggtaggt

SEQ ID NO: 485267 - DNA, 25 bp, Homo sapien
tcttgggtaggtaaactgctgataa

SEQ ID NO: 485268 - DNA, 25 bp, Homo sapien
gtatgtacttacctaatgcagttgc

SEQ ID NO: 485269 - DNA, 25 bp, Homo sapien
gttgcattattacgtactgaaagat

SEQ ID NO: 485270 - DNA, 25 bp, Homo sapien
ttatttccaggatgcatttgcttgt

SEQ ID NO: 485271 - DNA, 25 bp, Homo sapien
atttgcttgttttggtcatggcagc

SEQ ID NO: 485272 - DNA, 25 bp, Homo sapien
ggtaatcctaaaccatcacttccag

SEQ ID NO: 485273 - DNA, 25 bp, Homo sapien
atcacttccagcagtattcatggta

SEQ ID NO: 485274 - DNA, 25 bp, Homo sapien
gagctgatctgtgttcatatgttga

SEQ ID NO: 485275 - DNA, 25 bp, Homo sapien
tatatatcttattggctctctgctt

SEQ ID NO: 485276 - DNA, 25 bp, Homo sapien
cttattggctctctgctttgtattt

SEQ ID NO: 485277 - DNA, 25 bp, Homo sapien
ttccatctctttcacgaggatataa

SEQ ID NO: 485278 - DNA, 25 bp, Homo sapien
gaggatataaattccataaagtcag

SEQ ID NO: 485279 - DNA, 25 bp, Homo sapien
cagaaatctagtctgactggcttaa

SEQ ID NO: 485280 - DNA, 25 bp, Homo sapien
gactggcttaaaatagtattcctag

SEQ ID NO: 485281 - DNA, 25 bp, Homo sapien
gtattcctagcacttaacacagggc

SEQ ID NO: 485282 - DNA, 25 bp, Homo sapien
gcacttaacacagggctttgaatac

SEQ ID NO: 485283 - DNA, 25 bp, Homo sapien
tcattcatcatctattccttacttc

SEQ ID NO: 485284 - DNA, 25 bp, Homo sapien
atctattccttacttcagctgactg

SEQ ID NO: 485285 - DNA, 25 bp, Homo sapien
tcagctgactgtttgccttgcttta

SEQ ID NO: 485286 - DNA, 25 bp, Homo sapien
tgctttaaaatacttctcaaggaag

SEQ ID NO: 485287 - DNA, 25 bp, Homo sapien
aagggaattcagaagcccatccaca

SEQ ID NO: 485288 - DNA, 25 bp, Homo sapien
gatatcacctgttcttcgggcctta

SEQ ID NO: 485289 - DNA, 25 bp, Homo sapien
ttcttcgggccttagagcctggcag

SEQ ID NO: 485290 - DNA, 25 bp, Homo sapien
ggcccagcctcgtgcagaacaatag

SEQ ID NO: 485291 - DNA, 25 bp, Homo sapien
gaacaatagcaggtgggctcagcaa

SEQ ID NO: 485292 - DNA, 25 bp, Homo sapien
tagcaggtgggctcagcaagccact

SEQ ID NO: 485293 - DNA, 25 bp, Homo sapien
aggtgggctcagcaagccactgctc

SEQ ID NO: 485294 - DNA, 25 bp, Homo sapien
gggctgctctgagccctattgcaca

SEQ ID NO: 485295 - DNA, 25 bp, Homo sapien
tgagccctattgcacatcttctgtt

SEQ ID NO: 485296 - DNA, 25 bp, Homo sapien
cctattgcacatcttctgttctagt

SEQ ID NO: 485297 - DNA, 25 bp, Homo sapien
tgcacatcttctgttctagtttctc

SEQ ID NO: 485298 - DNA, 25 bp, Homo sapien
tcttctgttctagtttctctcccaa

SEQ ID NO: 485299 - DNA, 25 bp, Homo sapien
aaggtcacgctacccaactatgaca

SEQ ID NO: 485300 - DNA, 25 bp, Homo sapien
actatgacaacgtcccaggcaatct

SEQ ID NO: 485301 - DNA, 25 bp, Homo sapien
aacgtcccaggcaatctcatgctta

SEQ ID NO: 485302 - DNA, 25 bp, Homo sapien
aggcaatctcatgcttagcgcactg

SEQ ID NO: 485303 - DNA, 25 bp, Homo sapien
tggagctggacgaacctgagggcaa

SEQ ID NO: 485304 - DNA, 25 bp, Homo sapien
acctgagggcaagaacgatggcagc

SEQ ID NO: 485305 - DNA, 25 bp, Homo sapien
gggcgttcggtacttcatctgccct

SEQ ID NO: 485306 - DNA, 25 bp, Homo sapien
aagcagggtctctttgcctccgtgt

SEQ ID NO: 485307 - DNA, 25 bp, Homo sapien
ggtctctttgcctccgtgtccaaga

SEQ ID NO: 485308 - DNA, 25 bp, Homo sapien
gtccaagatcttccaaggcagtggg

SEQ ID NO: 485309 - DNA, 25 bp, Homo sapien
aagatcttccaaggcagtgggacgc

SEQ ID NO: 485310 - DNA, 25 bp, Homo sapien
taaaaaatagttggactttggcagc

SEQ ID NO: 485311 - DNA, 25 bp, Homo sapien
ggaggtgttttaggattgctatcaa

SEQ ID NO: 485312 - DNA, 25 bp, Homo sapien
gctatcaattttcagcattgtgcta

SEQ ID NO: 485313 - DNA, 25 bp, Homo sapien
gtgttttgcttttgtctgatggtct

SEQ ID NO: 485314 - DNA, 25 bp, Homo sapien
gcttttgtctgatggtctgggctca

SEQ ID NO: 485315 - DNA, 25 bp, Homo sapien
ggtctgggctcatttttatgtttat

SEQ ID NO: 485316 - DNA, 25 bp, Homo sapien
gaaaactgttgcatcaatatattat

SEQ ID NO: 485317 - DNA, 25 bp, Homo sapien
attatgtttcttggcattgttcagc

SEQ ID NO: 485318 - DNA, 25 bp, Homo sapien
ttcttggcattgttcagcataggta

SEQ ID NO: 485319 - DNA, 25 bp, Homo sapien
tcagcataggtaatgtgtgcacttt

SEQ ID NO: 485320 - DNA, 25 bp, Homo sapien
gtgtgcactttatgtgtacacataa

SEQ ID NO: 485321 - DNA, 25 bp, Homo sapien
gctctcaaggtctcttgatctagct

SEQ ID NO: 485322 - DNA, 25 bp, Homo sapien
tgatctagcttaattttgtccacat

SEQ ID NO: 485323 - DNA, 25 bp, Homo sapien
tgtccacatcgttttcttcattagg

SEQ ID NO: 485324 - DNA, 25 bp, Homo sapien
agaatcttctccactaggaaccggg

SEQ ID NO: 485325 - DNA, 25 bp, Homo sapien
ggcagcttcctctatgtttatgtta

SEQ ID NO: 485326 - DNA, 25 bp, Homo sapien
atgttatcctttgcagaggtttcaa

SEQ ID NO: 485327 - DNA, 25 bp, Homo sapien
gtttcaaaccatccggcaaagccat

SEQ ID NO: 485328 - DNA, 25 bp, Homo sapien
ctttgcagaattggtccacctggga

SEQ ID NO: 485329 - DNA, 25 bp, Homo sapien
aggactctggctactgtccttgttc

SEQ ID NO: 485330 - DNA, 25 bp, Homo sapien
gtccttgttctggtcacatttgtta

SEQ ID NO: 485331 - DNA, 25 bp, Homo sapien
ttactatccagatcacttttccatt

SEQ ID NO: 485332 - DNA, 25 bp, Homo sapien
gaactacaacacaaaagtgcagact

SEQ ID NO: 485333 - DNA, 25 bp, Homo sapien
aagtgcagacttatatttgagaatt

SEQ ID NO: 485334 - DNA, 25 bp, Homo sapien
ttaatgttaaccctttgtgtctagt

SEQ ID NO: 485335 - DNA, 25 bp, Homo sapien
aaccctttgtgtctagtttgaagct

SEQ ID NO: 485336 - DNA, 25 bp, Homo sapien
tagtttgaagcttcttgtatttgtc

SEQ ID NO: 485337 - DNA, 25 bp, Homo sapien
tgtctaaaacaacaagccagaattt

SEQ ID NO: 485338 - DNA, 25 bp, Homo sapien
gtagttttgcatattcttgtgctgc

SEQ ID NO: 485339 - DNA, 25 bp, Homo sapien
cttgtgctgcacatgggctgaattt

SEQ ID NO: 485340 - DNA, 25 bp, Homo sapien
ctgcacatgggctgaatttttaaat

SEQ ID NO: 485341 - DNA, 25 bp, Homo sapien
agcagaaccttgtaatttgtgtaaa

SEQ ID NO: 485342 - DNA, 25 bp, Homo sapien
gacaagtgtaaaatcctaccataaa

SEQ ID NO: 485343 - DNA, 25 bp, Homo sapien
ggattcatgaacttgaataattcta

SEQ ID NO: 485344 - DNA, 25 bp, Homo sapien
gaacttgaataattctacagtttga

SEQ ID NO: 485345 - DNA, 25 bp, Homo sapien
gaataattctacagtttgaaactct

SEQ ID NO: 485346 - DNA, 25 bp, Homo sapien
ttctacagtttgaaactctgatgct

SEQ ID NO: 485347 - DNA, 25 bp, Homo sapien
tacagtttgaaactctgatgctata

SEQ ID NO: 485348 - DNA, 25 bp, Homo sapien
acagtttgaaactctgatgctatat

SEQ ID NO: 485349 - DNA, 25 bp, Homo sapien
agtttgaaactctgatgctatatat

SEQ ID NO: 485350 - DNA, 25 bp, Homo sapien
gtttgaaactctgatgctatatata

SEQ ID NO: 485351 - DNA, 25 bp, Homo sapien
ttgaaactctgatgctatatataca

SEQ ID NO: 485352 - DNA, 25 bp, Homo sapien
gaaactctgatgctatatatacatg

SEQ ID NO: 485353 - DNA, 25 bp, Homo sapien
aactctgatgctatatatacatggt

SEQ ID NO: 485354 - DNA, 25 bp, Homo sapien
cagccacgcgctgaaaattcaaagc

SEQ ID NO: 485355 - DNA, 25 bp, Homo sapien
tagcccctctctcattctctaggtt

SEQ ID NO: 485356 - DNA, 25 bp, Homo sapien
tctctcattctctaggttcactttt

SEQ ID NO: 485357 - DNA, 25 bp, Homo sapien
ctcattctctaggttcacttttgaa

SEQ ID NO: 485358 - DNA, 25 bp, Homo sapien
ttgaagaaccaaatgacctcactgg

SEQ ID NO: 485359 - DNA, 25 bp, Homo sapien
atgacctcactggtaaggttccctt

SEQ ID NO: 485360 - DNA, 25 bp, Homo sapien
gacctcactggtaaggttccctttg

SEQ ID NO: 485361 - DNA, 25 bp, Homo sapien
tccctttggaaaagtgatagtttca

SEQ ID NO: 485362 - DNA, 25 bp, Homo sapien
gaaaagtgatagtttcatttttaca

SEQ ID NO: 485363 - DNA, 25 bp, Homo sapien
caaaccactgtttcctgaataaaca

SEQ ID NO: 485364 - DNA, 25 bp, Homo sapien
gtttcctgaataaacaatggattga

SEQ ID NO: 485365 - DNA, 25 bp, Homo sapien
gggccatgtggcaatacgtaagcaa

SEQ ID NO: 485366 - DNA, 25 bp, Homo sapien
gtggcaatacgtaagcaaataggct

SEQ ID NO: 485367 - DNA, 25 bp, Homo sapien
caaataggcttgctgtgtttcaata

SEQ ID NO: 485368 - DNA, 25 bp, Homo sapien
gtgggctgagctgctttgtataatc

SEQ ID NO: 485369 - DNA, 25 bp, Homo sapien
ggctgagctgctttgtataatctta

SEQ ID NO: 485370 - DNA, 25 bp, Homo sapien
gagctgctttgtataatcttaggta

SEQ ID NO: 485371 - DNA, 25 bp, Homo sapien
tcttaggtaccttgaatccatagtc

SEQ ID NO: 485372 - DNA, 25 bp, Homo sapien
taggtaccttgaatccatagtccaa

SEQ ID NO: 485373 - DNA, 25 bp, Homo sapien
gaatccatagtccaaggatggtaga

SEQ ID NO: 485374 - DNA, 25 bp, Homo sapien
gagccagataggaaatagtccaatc

SEQ ID NO: 485375 - DNA, 25 bp, Homo sapien
agtccaatcgtgaagtgggccatgt

SEQ ID NO: 485376 - DNA, 25 bp, Homo sapien
gcaaggtcgtagaacttccctagaa

SEQ ID NO: 485377 - DNA, 25 bp, Homo sapien
ttccctagaaaagttcactcgcagt

SEQ ID NO: 485378 - DNA, 25 bp, Homo sapien
taagaggccctgatcccaaaatgca

SEQ ID NO: 485379 - DNA, 25 bp, Homo sapien
aaaaaagagcaagcggctccctctg

SEQ ID NO: 485380 - DNA, 25 bp, Homo sapien
aagcggctccctctgcagaaggtgc

SEQ ID NO: 485381 - DNA, 25 bp, Homo sapien
agaaggtgcacccttgatcgcccag

SEQ ID NO: 485382 - DNA, 25 bp, Homo sapien
aggcctgggcatttgatcatctgtt

SEQ ID NO: 485383 - DNA, 25 bp, Homo sapien
gatcatctgttcagggctttgagga

SEQ ID NO: 485384 - DNA, 25 bp, Homo sapien
aagagtgacagctatgcccgcttcc

SEQ ID NO: 485385 - DNA, 25 bp, Homo sapien
ttcctccggtcaaatgcttaccagg

SEQ ID NO: 485386 - DNA, 25 bp, Homo sapien
aaatgcttaccaggatttgctgctg

SEQ ID NO: 485387 - DNA, 25 bp, Homo sapien
tgattattctcctagctcatatctc

SEQ ID NO: 485388 - DNA, 25 bp, Homo sapien
agctcatatctccttgatgtgcatg

SEQ ID NO: 485389 - DNA, 25 bp, Homo sapien
agggagcactgggtctaatttttgg

SEQ ID NO: 485390 - DNA, 25 bp, Homo sapien
gtgaggtcagtttttcccaggagtc

SEQ ID NO: 485391 - DNA, 25 bp, Homo sapien
aattctggtaccttacattgagggt

SEQ ID NO: 485392 - DNA, 25 bp, Homo sapien
gaaagggtgtcatagttctgaaaat

SEQ ID NO: 485393 - DNA, 25 bp, Homo sapien
gtagcatgaagcaccagacctgtct

SEQ ID NO: 485394 - DNA, 25 bp, Homo sapien
gtctcattccttattagatgtctat

SEQ ID NO: 485395 - DNA, 25 bp, Homo sapien
gatgtctatctcaaatgacagagtt

SEQ ID NO: 485396 - DNA, 25 bp, Homo sapien
atttgatatttccatgcctgactcg

SEQ ID NO: 485397 - DNA, 25 bp, Homo sapien
tccatgcctgactcgggaaaataac

SEQ ID NO: 485398 - DNA, 25 bp, Homo sapien
actttcttagtctttcctattagag

SEQ ID NO: 485399 - DNA, 25 bp, Homo sapien
gtctttcctattagagctgccagta

SEQ ID NO: 485400 - DNA, 25 bp, Homo sapien
ttagagctgccagtaagtccagata

SEQ ID NO: 485401 - DNA, 25 bp, Homo sapien
gccagtaagtccagataatatcaga

SEQ ID NO: 485402 - DNA, 25 bp, Homo sapien
gtttttggccaaagaacattgattc

SEQ ID NO: 485403 - DNA, 25 bp, Homo sapien
cattcctattggcaattgaccccat

SEQ ID NO: 485404 - DNA, 25 bp, Homo sapien
attggcaattgaccccatttttcag

SEQ ID NO: 485405 - DNA, 25 bp, Homo sapien
gcaattgaccccatttttcagtgat

SEQ ID NO: 485406 - DNA, 25 bp, Homo sapien
gaccccatttttcagtgatgatgtt

SEQ ID NO: 485407 - DNA, 25 bp, Homo sapien
cagtgatgatgttgtagaggttaat

SEQ ID NO: 485408 - DNA, 25 bp, Homo sapien
taatgttggtaaggagatgcgttga

SEQ ID NO: 485409 - DNA, 25 bp, Homo sapien
gttgtattccaacactccactcgct

SEQ ID NO: 485410 - DNA, 25 bp, Homo sapien
ttccaacactccactcgctaagagg

SEQ ID NO: 485411 - DNA, 25 bp, Homo sapien
actccactcgctaagaggccctgat

SEQ ID NO: 485412 - DNA, 25 bp, Homo sapien
atctacaagctgatgaagagtgaca

SEQ ID NO: 485413 - DNA, 25 bp, Homo sapien
aagagtgacagctatgcccgcttcc

SEQ ID NO: 485414 - DNA, 25 bp, Homo sapien
gagtgacagctatgcccgcttcctc

SEQ ID NO: 485415 - DNA, 25 bp, Homo sapien
tatgcccgcttcctccggtcaaatg

SEQ ID NO: 485416 - DNA, 25 bp, Homo sapien
ttcctccggtcaaatgcttaccagg

SEQ ID NO: 485417 - DNA, 25 bp, Homo sapien
tccggtcaaatgcttaccaggattt

SEQ ID NO: 485418 - DNA, 25 bp, Homo sapien
aaatgcttaccaggatttgctgctg

SEQ ID NO: 485419 - DNA, 25 bp, Homo sapien
tgcttaccaggatttgctgctggcc

SEQ ID NO: 485420 - DNA, 25 bp, Homo sapien
cttgccctaaccagcaatctgtaac

SEQ ID NO: 485421 - DNA, 25 bp, Homo sapien
aatctgtaacatcctgggcctcagg

SEQ ID NO: 485422 - DNA, 25 bp, Homo sapien
gagggtgactctgagctccagatag

SEQ ID NO: 485423 - DNA, 25 bp, Homo sapien
ccagatagtgtctaggaggctcaaa

SEQ ID NO: 485424 - DNA, 25 bp, Homo sapien
taggaggctcaaataagcctgcttt

SEQ ID NO: 485425 - DNA, 25 bp, Homo sapien
ttttggtcctcaccctagccgtggg

SEQ ID NO: 485426 - DNA, 25 bp, Homo sapien
ctccctaccaagcagctcagagaat

SEQ ID NO: 485427 - DNA, 25 bp, Homo sapien
ccaaaagtctccatagttcataggg

SEQ ID NO: 485428 - DNA, 25 bp, Homo sapien
tagttcatagggagccccaaacctc

SEQ ID NO: 485429 - DNA, 25 bp, Homo sapien
aagcctcaaaatttctcttaccctg

SEQ ID NO: 485430 - DNA, 25 bp, Homo sapien
caaaatttctcttaccctgacccag

SEQ ID NO: 485431 - DNA, 25 bp, Homo sapien
ttccgtaggccaggtttctgcagca

SEQ ID NO: 485432 - DNA, 25 bp, Homo sapien
gtaggccaggtttctgcagcaagcc

SEQ ID NO: 485433 - DNA, 25 bp, Homo sapien
ccaggtttctgcagcaagccccaaa

SEQ ID NO: 485434 - DNA, 25 bp, Homo sapien
gcagcaagccccaaagacaaagctt

SEQ ID NO: 485435 - DNA, 25 bp, Homo sapien
acaaagcttggcagaggctgtggca

SEQ ID NO: 485436 - DNA, 25 bp, Homo sapien
tctctctggagcctcatccctttgt

SEQ ID NO: 485437 - DNA, 25 bp, Homo sapien
tctggagcctcatccctttgtcctt

SEQ ID NO: 485438 - DNA, 25 bp, Homo sapien
ttgtccttcccaacaggtagtcgta

SEQ ID NO: 485439 - DNA, 25 bp, Homo sapien
cttcccaacaggtagtcgtacatct

SEQ ID NO: 485440 - DNA, 25 bp, Homo sapien
aacaggtagtcgtacatcttcactg

SEQ ID NO: 485441 - DNA, 25 bp, Homo sapien
caggtagtcgtacatcttcactgac

SEQ ID NO: 485442 - DNA, 25 bp, Homo sapien
aaagagaccagcctccctccctgtg

SEQ ID NO: 485443 - DNA, 25 bp, Homo sapien
ctgtgccagacctcaaaacgacggg

SEQ ID NO: 485444 - DNA, 25 bp, Homo sapien
gtgccagacctcaaaacgacggggg

SEQ ID NO: 485445 - DNA, 25 bp, Homo sapien
gggcaggtgcaagttcataggtctc

SEQ ID NO: 485446 - DNA, 25 bp, Homo sapien
ggcaggtgcaagttcataggtctcc

SEQ ID NO: 485447 - DNA, 25 bp, Homo sapien
gcaggtgcaagttcataggtctcca

SEQ ID NO: 485448 - DNA, 25 bp, Homo sapien
caggtgcaagttcataggtctccaa

SEQ ID NO: 485449 - DNA, 25 bp, Homo sapien
caccctcctttcatttgctagaagg

SEQ ID NO: 485450 - DNA, 25 bp, Homo sapien
accctcctttcatttgctagaagga

SEQ ID NO: 485451 - DNA, 25 bp, Homo sapien
cctcctttcatttgctagaaggact

SEQ ID NO: 485452 - DNA, 25 bp, Homo sapien
cctttcatttgctagaaggactcac

SEQ ID NO: 485453 - DNA, 25 bp, Homo sapien
gcatctacgatgtcagtttctagta

SEQ ID NO: 485454 - DNA, 25 bp, Homo sapien
cccagcccgtgatgaatggcaaatc

SEQ ID NO: 485455 - DNA, 25 bp, Homo sapien
atggcaaatccaagctgaactccag

SEQ ID NO: 485456 - DNA, 25 bp, Homo sapien
tgctggtgccctatggcgccgagtc

SEQ ID NO: 485457 - DNA, 25 bp, Homo sapien
tctgaggactctgacgaggagtcaa

SEQ ID NO: 485458 - DNA, 25 bp, Homo sapien
attggtacgattgtgagctcccact

SEQ ID NO: 485459 - DNA, 25 bp, Homo sapien
tctcccggccaagatgccgaagatg

SEQ ID NO: 485460 - DNA, 25 bp, Homo sapien
gaggccactccgcacgagcttcaag

SEQ ID NO: 485461 - DNA, 25 bp, Homo sapien
gagcttcaagaacccatgaccctaa

SEQ ID NO: 485462 - DNA, 25 bp, Homo sapien
acccatgaccctaaacggtgctaat

SEQ ID NO: 485463 - DNA, 25 bp, Homo sapien
ggtgctaatagtgcagacagcgaca

SEQ ID NO: 485464 - DNA, 25 bp, Homo sapien
gtacagttatcatgaaaagcttttt

SEQ ID NO: 485465 - DNA, 25 bp, Homo sapien
ttgccaatgtcaatcaatcacagta

SEQ ID NO: 485466 - DNA, 25 bp, Homo sapien
tcctgggttctgtgagtcctgagat

SEQ ID NO: 485467 - DNA, 25 bp, Homo sapien
gtgagtcctgagatggatttaattc

SEQ ID NO: 485468 - DNA, 25 bp, Homo sapien
gatttaattcttgatgctggtgcta

SEQ ID NO: 485469 - DNA, 25 bp, Homo sapien
tcttgatgctggtgctagaagtagg

SEQ ID NO: 485470 - DNA, 25 bp, Homo sapien
atgggattgttgtcccaaccctgta

SEQ ID NO: 485471 - DNA, 25 bp, Homo sapien
attgttgtcccaaccctgtactgta

SEQ ID NO: 485472 - DNA, 25 bp, Homo sapien
ctgtactgtactcccagtggccaaa

SEQ ID NO: 485473 - DNA, 25 bp, Homo sapien
tgtactcccagtggccaaacttatt

SEQ ID NO: 485474 - DNA, 25 bp, Homo sapien
cccagtggccaaacttatttatgct

SEQ ID NO: 485475 - DNA, 25 bp, Homo sapien
tggtacgcagcgacgctggccactg

SEQ ID NO: 485476 - DNA, 25 bp, Homo sapien
acgcagcgacgctggccactggaac

SEQ ID NO: 485477 - DNA, 25 bp, Homo sapien
gacgctggccactggaacgccccgt

SEQ ID NO: 485478 - DNA, 25 bp, Homo sapien
ggaacgccccgtgcctgggtggcaa

SEQ ID NO: 485479 - DNA, 25 bp, Homo sapien
gcggggtgccccagtactccagcag

SEQ ID NO: 485480 - DNA, 25 bp, Homo sapien
ccagcgccgacgacagcagggtgat

SEQ ID NO: 485481 - DNA, 25 bp, Homo sapien
agcagggtgataggcagccccacgc

SEQ ID NO: 485482 - DNA, 25 bp, Homo sapien
agggtgataggcagccccacgccgc

SEQ ID NO: 485483 - DNA, 25 bp, Homo sapien
gtgataggcagccccacgccgctaa

SEQ ID NO: 485484 - DNA, 25 bp, Homo sapien
tctgccatcatcagcaccaggagag

SEQ ID NO: 485485 - DNA, 25 bp, Homo sapien
acagacccgctggaacccagcagcg

SEQ ID NO: 485486 - DNA, 25 bp, Homo sapien
acacccacggccaccatgtccacag

SEQ ID NO: 485487 - DNA, 25 bp, Homo sapien
tcctccactccagagactgtccaca

SEQ ID NO: 485488 - DNA, 25 bp, Homo sapien
agagactgtccacacctccacagtg

SEQ ID NO: 485489 - DNA, 25 bp, Homo sapien
actgtccacacctccacagtgctta

SEQ ID NO: 485490 - DNA, 25 bp, Homo sapien
ccaggaacagctcacactaccaaag

SEQ ID NO: 485491 - DNA, 25 bp, Homo sapien
caggaacagctcacactaccaaagt

SEQ ID NO: 485492 - DNA, 25 bp, Homo sapien
aggaacagctcacactaccaaagtg

SEQ ID NO: 485493 - DNA, 25 bp, Homo sapien
ggaacagctcacactaccaaagtgc

SEQ ID NO: 485494 - DNA, 25 bp, Homo sapien
gactaccacaaccacgggcttcaca

SEQ ID NO: 485495 - DNA, 25 bp, Homo sapien
acaaccacgggcttcacagccaccc

SEQ ID NO: 485496 - DNA, 25 bp, Homo sapien
tccagtgtggatcagcacaaccacc

SEQ ID NO: 485497 - DNA, 25 bp, Homo sapien
aaaatccctgtgtggctcattagac

SEQ ID NO: 485498 - DNA, 25 bp, Homo sapien
ctgtgtggctcattagacgactata

SEQ ID NO: 485499 - DNA, 25 bp, Homo sapien
gacgactataagcacaacctgtatt

SEQ ID NO: 485500 - DNA, 25 bp, Homo sapien
acctgtatttgtaccttaatctctt

SEQ ID NO: 485501 - DNA, 25 bp, Homo sapien
ttaatctcttacatttccactgctg

SEQ ID NO: 485502 - DNA, 25 bp, Homo sapien
tccactgctgtgtatctgacatatc

SEQ ID NO: 485503 - DNA, 25 bp, Homo sapien
gacatatctactagtaagcactgtt

SEQ ID NO: 485504 - DNA, 25 bp, Homo sapien
agcactgttttgtcaaaccgtcttt

SEQ ID NO: 485505 - DNA, 25 bp, Homo sapien
tttctctccttcattttactggttc

SEQ ID NO: 485506 - DNA, 25 bp, Homo sapien
actggttcttagtctcctatcaata

SEQ ID NO: 485507 - DNA, 25 bp, Homo sapien
cagggagccgccattgtgtgttacg

SEQ ID NO: 485508 - DNA, 25 bp, Homo sapien
cctttttcaattcagcctcctgagg

SEQ ID NO: 485509 - DNA, 25 bp, Homo sapien
ctcctgagggagtctagcccctgga

SEQ ID NO: 485510 - DNA, 25 bp, Homo sapien
gagtctagcccctggagcctctctg

SEQ ID NO: 485511 - DNA, 25 bp, Homo sapien
gggtgccttcagtgccaattgccac

SEQ ID NO: 485512 - DNA, 25 bp, Homo sapien
ttcagtgccaattgccactcagatc

SEQ ID NO: 485513 - DNA, 25 bp, Homo sapien
aattgccactcagatcctgggcttg

SEQ ID NO: 485514 - DNA, 25 bp, Homo sapien
gccactcagatcctgggcttgccaa

SEQ ID NO: 485515 - DNA, 25 bp, Homo sapien
gaaggccctgccagggactgcctat

SEQ ID NO: 485516 - DNA, 25 bp, Homo sapien
gggactgcctatcacaagacacttg

SEQ ID NO: 485517 - DNA, 25 bp, Homo sapien
ctatcacaagacacttgccagggac

SEQ ID NO: 485518 - DNA, 25 bp, Homo sapien
ccatgtcactgcctaaagggttagg

SEQ ID NO: 485519 - DNA, 25 bp, Homo sapien
ccagcagtcccggtggaggagagag

SEQ ID NO: 485520 - DNA, 25 bp, Homo sapien
agatctgcagggaaggtatggccca

SEQ ID NO: 485521 - DNA, 25 bp, Homo sapien
gatctgcagggaaggtatggcccaa

SEQ ID NO: 485522 - DNA, 25 bp, Homo sapien
atctgcagggaaggtatggcccaag

SEQ ID NO: 485523 - DNA, 25 bp, Homo sapien
gcagggaaggtatggcccaaggaaa

SEQ ID NO: 485524 - DNA, 25 bp, Homo sapien
tatggcccaaggaaagtgggcaaca

SEQ ID NO: 485525 - DNA, 25 bp, Homo sapien
aggaaagtgggcaacagagctaaga

SEQ ID NO: 485526 - DNA, 25 bp, Homo sapien
aaagtgggcaacagagctaagagag

SEQ ID NO: 485527 - DNA, 25 bp, Homo sapien
gtgggcaacagagctaagagaggaa

SEQ ID NO: 485528 - DNA, 25 bp, Homo sapien
agagaggaaagagagcaattctggg

SEQ ID NO: 485529 - DNA, 25 bp, Homo sapien
caagaacaggtggaatgagaatgag

SEQ ID NO: 485530 - DNA, 25 bp, Homo sapien
tttactgcagctctgccggcctgga

SEQ ID NO: 485531 - DNA, 25 bp, Homo sapien
ggaggaagaagtatgcgctgcacat

SEQ ID NO: 485532 - DNA, 25 bp, Homo sapien
gcgctgcacatttctgaggctactg

SEQ ID NO: 485533 - DNA, 25 bp, Homo sapien
gaggctactgcatttgctttcaagg

SEQ ID NO: 485534 - DNA, 25 bp, Homo sapien
tcaaggcagaaatcttgctctgagc

SEQ ID NO: 485535 - DNA, 25 bp, Homo sapien
tctgagcagtcagcggctccagttt

SEQ ID NO: 485536 - DNA, 25 bp, Homo sapien
ttgggcccgataaggaagttctccg

SEQ ID NO: 485537 - DNA, 25 bp, Homo sapien
gataaggaagttctccgtggcctcc

SEQ ID NO: 485538 - DNA, 25 bp, Homo sapien
aggaggctgacattgccagtctctt

SEQ ID NO: 485539 - DNA, 25 bp, Homo sapien
gagatccaatcccatagacagctct

SEQ ID NO: 485540 - DNA, 25 bp, Homo sapien
gggcctcttgcatttgagtttttca

SEQ ID NO: 485541 - DNA, 25 bp, Homo sapien
gatcatgaacttttcttggtttagc

SEQ ID NO: 485542 - DNA, 25 bp, Homo sapien
acttttcttggtttagcactaggat

SEQ ID NO: 485543 - DNA, 25 bp, Homo sapien
agcactaggatttagctatgaagag

SEQ ID NO: 485544 - DNA, 25 bp, Homo sapien
agctcataggctttcaggtgctaat

SEQ ID NO: 485545 - DNA, 25 bp, Homo sapien
gtgctaattgagatctgccctgtta

SEQ ID NO: 485546 - DNA, 25 bp, Homo sapien
gagatctgccctgttagagtcttgg

SEQ ID NO: 485547 - DNA, 25 bp, Homo sapien
gggtgctagattggtcacattgaca

SEQ ID NO: 485548 - DNA, 25 bp, Homo sapien
ggtcacattgacaccagtggcaggg

SEQ ID NO: 485549 - DNA, 25 bp, Homo sapien
acaccagtggcagggaaggcatcta

SEQ ID NO: 485550 - DNA, 25 bp, Homo sapien
cagggaaggcatctatgagtttgat

SEQ ID NO: 485551 - DNA, 25 bp, Homo sapien
gagtttgatgctttttatcacacac

SEQ ID NO: 485552 - DNA, 25 bp, Homo sapien
ataacctctctcgtagccattcatt

SEQ ID NO: 485553 - DNA, 25 bp, Homo sapien
tctcgtagccattcattcccggata

SEQ ID NO: 485554 - DNA, 25 bp, Homo sapien
gtagccattcattcccggatacata

SEQ ID NO: 485555 - DNA, 25 bp, Homo sapien
tagccattcattcccggatacatac

SEQ ID NO: 485556 - DNA, 25 bp, Homo sapien
attcattcccggatacataccctag

SEQ ID NO: 485557 - DNA, 25 bp, Homo sapien
tcattcccggatacataccctagag

SEQ ID NO: 485558 - DNA, 25 bp, Homo sapien
attcccggatacataccctagagaa

SEQ ID NO: 485559 - DNA, 25 bp, Homo sapien
tcccggatacataccctagagaaac

SEQ ID NO: 485560 - DNA, 25 bp, Homo sapien
cggatacataccctagagaaactct

SEQ ID NO: 485561 - DNA, 25 bp, Homo sapien
gaaactcttacacatgcgtaccagg

SEQ ID NO: 485562 - DNA, 25 bp, Homo sapien
aaactcttacacatgcgtaccaggg

SEQ ID NO: 485563 - DNA, 25 bp, Homo sapien
gtgttgtctaagatgtcagttttat

SEQ ID NO: 485564 - DNA, 25 bp, Homo sapien
atattctatttacatgtatgtcaac

SEQ ID NO: 485565 - DNA, 25 bp, Homo sapien
ccttaagactgtgatgagagcattt

SEQ ID NO: 485566 - DNA, 25 bp, Homo sapien
taagactgtgatgagagcatttatc

SEQ ID NO: 485567 - DNA, 25 bp, Homo sapien
gactgtgatgagagcatttatcatt

SEQ ID NO: 485568 - DNA, 25 bp, Homo sapien
gcattgagaaagacatttattatgg

SEQ ID NO: 485569 - DNA, 25 bp, Homo sapien
gacatctgcatcttcagcttacaag

SEQ ID NO: 485570 - DNA, 25 bp, Homo sapien
atctgcatcttcagcttacaagatc

SEQ ID NO: 485571 - DNA, 25 bp, Homo sapien
tgcatcttcagcttacaagatctac

SEQ ID NO: 485572 - DNA, 25 bp, Homo sapien
tcagcttacaagatctacaatgcag

SEQ ID NO: 485573 - DNA, 25 bp, Homo sapien
tattttttgctgaaactagatgttt

SEQ ID NO: 485574 - DNA, 25 bp, Homo sapien
cacgcttactaccttcagtataaaa

SEQ ID NO: 485575 - DNA, 25 bp, Homo sapien
ccttcagtataaaaatgtcaggcct

SEQ ID NO: 485576 - DNA, 25 bp, Homo sapien
atgtcaggcctgattatctaaaagc

SEQ ID NO: 485577 - DNA, 25 bp, Homo sapien
ggcctgattatctaaaagctatttg

SEQ ID NO: 485578 - DNA, 25 bp, Homo sapien
agctatttggaatgtaatcaactgg

SEQ ID NO: 485579 - DNA, 25 bp, Homo sapien
tggaatgtaatcaactgggagaatg

SEQ ID NO: 485580 - DNA, 25 bp, Homo sapien
caactgggagaatgtaactgaaaga

SEQ ID NO: 485581 - DNA, 25 bp, Homo sapien
gtaactgaaagatacatggcttgca

SEQ ID NO: 485582 - DNA, 25 bp, Homo sapien
aagatacatggcttgcaaaaagtaa

SEQ ID NO: 485583 - DNA, 25 bp, Homo sapien
ttgcaaaaagtaaaccacgatcgtt

SEQ ID NO: 485584 - DNA, 25 bp, Homo sapien
aagtaaaccacgatcgttatgctga

SEQ ID NO: 485585 - DNA, 25 bp, Homo sapien
gctgaaaccttgtttccaggctggg

SEQ ID NO: 485586 - DNA, 25 bp, Homo sapien
ggactctgcagctcgggagacgact

SEQ ID NO: 485587 - DNA, 25 bp, Homo sapien
agacgactgagagcgggcaaacacc

SEQ ID NO: 485588 - DNA, 25 bp, Homo sapien
gtggcagatctcaatggccctgtgg

SEQ ID NO: 485589 - DNA, 25 bp, Homo sapien
gtgcctgtgtttggtctccttgcta

SEQ ID NO: 485590 - DNA, 25 bp, Homo sapien
tacgcccctcagagttcttttgtgg

SEQ ID NO: 485591 - DNA, 25 bp, Homo sapien
gatctgctccatgctgggaagcacc

SEQ ID NO: 485592 - DNA, 25 bp, Homo sapien
gggaagcaccacagagagcttgtaa

SEQ ID NO: 485593 - DNA, 25 bp, Homo sapien
gtaaagacgagtcgtgtcctcacct

SEQ ID NO: 485594 - DNA, 25 bp, Homo sapien
gtcctcacctgtttgttgtgttaga

SEQ ID NO: 485595 - DNA, 25 bp, Homo sapien
aaaaaggccaccaagtgcctgccag

SEQ ID NO: 485596 - DNA, 25 bp, Homo sapien
acatcgtcaagctctttgcggtgga

SEQ ID NO: 485597 - DNA, 25 bp, Homo sapien
ggtactggtgatggagtactgctcc

SEQ ID NO: 485598 - DNA, 25 bp, Homo sapien
gagtactgctccagtgggagcctgc

SEQ ID NO: 485599 - DNA, 25 bp, Homo sapien
tgctggagagccctgagaatgcctt

SEQ ID NO: 485600 - DNA, 25 bp, Homo sapien
tgagaatgcctttgggctgcctgag

SEQ ID NO: 485601 - DNA, 25 bp, Homo sapien
gcgctgtgtgggtgagcccctccct

SEQ ID NO: 485602 - DNA, 25 bp, Homo sapien
ggacagatgctgacaggactcaggt

SEQ ID NO: 485603 - DNA, 25 bp, Homo sapien
gatgctgacaggactcaggtgtctg

SEQ ID NO: 485604 - DNA, 25 bp, Homo sapien
ctgacaggactcaggtgtctgactc

SEQ ID NO: 485605 - DNA, 25 bp, Homo sapien
aggtgtctgactcctgctaatcatt

SEQ ID NO: 485606 - DNA, 25 bp, Homo sapien
gtctgactcctgctaatcattccat

SEQ ID NO: 485607 - DNA, 25 bp, Homo sapien
gtggagttcccactcgagaagacag

SEQ ID NO: 485608 - DNA, 25 bp, Homo sapien
gagttcccactcgagaagacagcac

SEQ ID NO: 485609 - DNA, 25 bp, Homo sapien
ttcccactcgagaagacagcacagt

SEQ ID NO: 485610 - DNA, 25 bp, Homo sapien
gacagcacagtagcaagtagaggct

SEQ ID NO: 485611 - DNA, 25 bp, Homo sapien
aagtagaggctggtcctgggacact

SEQ ID NO: 485612 - DNA, 25 bp, Homo sapien
atgtgtgtcaggaagcccctgcggt

SEQ ID NO: 485613 - DNA, 25 bp, Homo sapien
gtcaggaagcccctgcggtcacacg

SEQ ID NO: 485614 - DNA, 25 bp, Homo sapien
gtgggaggacacttcgccccccatt

SEQ ID NO: 485615 - DNA, 25 bp, Homo sapien
cctgcggtcacacggcccatgagga

SEQ ID NO: 485616 - DNA, 25 bp, Homo sapien
gtcacacggcccatgaggaagccag

SEQ ID NO: 485617 - DNA, 25 bp, Homo sapien
attgttaacgtccaccgcgcccaga

SEQ ID NO: 485618 - DNA, 25 bp, Homo sapien
aatccgtctctaaaaaagcaatcac

SEQ ID NO: 485619 - DNA, 25 bp, Homo sapien
ggaaaactgtcataaagtcacctac

SEQ ID NO: 485620 - DNA, 25 bp, Homo sapien
agtcacctactgtaccagagtttca

SEQ ID NO: 485621 - DNA, 25 bp, Homo sapien
cagagtttcagcttatttgcactaa

SEQ ID NO: 485622 - DNA, 25 bp, Homo sapien
gcactaatcttgatgaactcaggga

SEQ ID NO: 485623 - DNA, 25 bp, Homo sapien
gaactcagggaattaatcacaaaaa

SEQ ID NO: 485624 - DNA, 25 bp, Homo sapien
atggtatcatcggaggcagctgtaa

SEQ ID NO: 485625 - DNA, 25 bp, Homo sapien
catagttacattggatcacgtcttt

SEQ ID NO: 485626 - DNA, 25 bp, Homo sapien
ggatcacgtcttttaaatgaatggc

SEQ ID NO: 485627 - DNA, 25 bp, Homo sapien
gaatggctgccatgggaaccaaagt

SEQ ID NO: 485628 - DNA, 25 bp, Homo sapien
taatgaaggctttccaaagaaacag

SEQ ID NO: 485629 - DNA, 25 bp, Homo sapien
tgtttagtaacattcttcctcatat

SEQ ID NO: 485630 - DNA, 25 bp, Homo sapien
tagtaacattcttcctcatattcaa

SEQ ID NO: 485631 - DNA, 25 bp, Homo sapien
aacattcttcctcatattcaatgac

SEQ ID NO: 485632 - DNA, 25 bp, Homo sapien
gtatgtatcagtccttatttagaga

SEQ ID NO: 485633 - DNA, 25 bp, Homo sapien
gtccttatttagagactgcctgctt

SEQ ID NO: 485634 - DNA, 25 bp, Homo sapien
gcctgctttttaattcatatagctc

SEQ ID NO: 485635 - DNA, 25 bp, Homo sapien
ttaattcatatagctctttggttct

SEQ ID NO: 485636 - DNA, 25 bp, Homo sapien
gctctttggttctattctttgtttt

SEQ ID NO: 485637 - DNA, 25 bp, Homo sapien
gttgttttattgcttgttagacctt

SEQ ID NO: 485638 - DNA, 25 bp, Homo sapien
attgcttgttagacctttactaaag

SEQ ID NO: 485639 - DNA, 25 bp, Homo sapien
ggcatttacatttgaatctagacta

SEQ ID NO: 485640 - DNA, 25 bp, Homo sapien
aggagacgggcggaagccggcagaa

SEQ ID NO: 485641 - DNA, 25 bp, Homo sapien
gaagccggcagaaggtactggtgat

SEQ ID NO: 485642 - DNA, 25 bp, Homo sapien
cagaaggtactggtgatggagtact

SEQ ID NO: 485643 - DNA, 25 bp, Homo sapien
atggagtactgctccagtgggagcc

SEQ ID NO: 485644 - DNA, 25 bp, Homo sapien
gtactgctccagtgggagcctgctg

SEQ ID NO: 485645 - DNA, 25 bp, Homo sapien
ctgctccagtgggagcctgctgagt

SEQ ID NO: 485646 - DNA, 25 bp, Homo sapien
ctgagtgtgctggagagccctgaga

SEQ ID NO: 485647 - DNA, 25 bp, Homo sapien
ctggagagccctgagaatgcctttg

SEQ ID NO: 485648 - DNA, 25 bp, Homo sapien
tggagagccctgagaatgcctttgg

SEQ ID NO: 485649 - DNA, 25 bp, Homo sapien
gagagccctgagaatgcctttgggc

SEQ ID NO: 485650 - DNA, 25 bp, Homo sapien
agccctgagaatgcctttgggctgc

SEQ ID NO: 485651 - DNA, 25 bp, Homo sapien
agagcatggagccagcatctggtga

SEQ ID NO: 485652 - DNA, 25 bp, Homo sapien
ctgtgacagaagttgaagggcaaaa

SEQ ID NO: 485653 - DNA, 25 bp, Homo sapien
tgtgacagaagttgaagggcaaaat

SEQ ID NO: 485654 - DNA, 25 bp, Homo sapien
gtgacagaagttgaagggcaaaatg

SEQ ID NO: 485655 - DNA, 25 bp, Homo sapien
tgacagaagttgaagggcaaaatgc

SEQ ID NO: 485656 - DNA, 25 bp, Homo sapien
gacagaagttgaagggcaaaatgct

SEQ ID NO: 485657 - DNA, 25 bp, Homo sapien
acagaagttgaagggcaaaatgcta

SEQ ID NO: 485658 - DNA, 25 bp, Homo sapien
cagaagttgaagggcaaaatgctat

SEQ ID NO: 485659 - DNA, 25 bp, Homo sapien
agaagttgaagggcaaaatgctata

SEQ ID NO: 485660 - DNA, 25 bp, Homo sapien
gaagttgaagggcaaaatgctatag

SEQ ID NO: 485661 - DNA, 25 bp, Homo sapien
aagttgaagggcaaaatgctatagt

SEQ ID NO: 485662 - DNA, 25 bp, Homo sapien
gagctaaagttgaagccagctgtgt

SEQ ID NO: 485663 - DNA, 25 bp, Homo sapien
ctgtgtgtagcagctgttacctgaa

SEQ ID NO: 485664 - DNA, 25 bp, Homo sapien
gctgttacctgaagacgtgctacct

SEQ ID NO: 485665 - DNA, 25 bp, Homo sapien
acgtgctacctctctacaaagtgtt

SEQ ID NO: 485666 - DNA, 25 bp, Homo sapien
tctacaaagtgttgatccccttctt

SEQ ID NO: 485667 - DNA, 25 bp, Homo sapien
ttctttcccatgagagagagaactg

SEQ ID NO: 485668 - DNA, 25 bp, Homo sapien
gagagaactggtgatactccaacac

SEQ ID NO: 485669 - DNA, 25 bp, Homo sapien
aacaccgtccagttgtggcagctct

SEQ ID NO: 485670 - DNA, 25 bp, Homo sapien
gttgtggcagctctccagaagtaat

SEQ ID NO: 485671 - DNA, 25 bp, Homo sapien
tgacaactttctgtgccttttcctt

SEQ ID NO: 485672 - DNA, 25 bp, Homo sapien
catttttacccttttctatgccatt

SEQ ID NO: 485673 - DNA, 25 bp, Homo sapien
atttcataagagacatggcctgggc

SEQ ID NO: 485674 - DNA, 25 bp, Homo sapien
catggcctgggcacaatgttaacaa

SEQ ID NO: 485675 - DNA, 25 bp, Homo sapien
atagtagctctgcagtcacaatgtg

SEQ ID NO: 485676 - DNA, 25 bp, Homo sapien
aatgtgcacttacgttgggtgtccc

SEQ ID NO: 485677 - DNA, 25 bp, Homo sapien
tgggtgtccccagccaaagccagtg

SEQ ID NO: 485678 - DNA, 25 bp, Homo sapien
gggagctcagcaccgtcaatgtcac

SEQ ID NO: 485679 - DNA, 25 bp, Homo sapien
accgtcaatgtcactgtcagcgctg

SEQ ID NO: 485680 - DNA, 25 bp, Homo sapien
tgtcagcgctgccatacaggagcct

SEQ ID NO: 485681 - DNA, 25 bp, Homo sapien
agggagcttcagacacaccatgctg

SEQ ID NO: 485682 - DNA, 25 bp, Homo sapien
aggacaagtagccaagcgccttttg

SEQ ID NO: 485683 - DNA, 25 bp, Homo sapien
gccaagcgccttttgtggtggaaat

SEQ ID NO: 485684 - DNA, 25 bp, Homo sapien
aatgctgagactttcccaaagggtg

SEQ ID NO: 485685 - DNA, 25 bp, Homo sapien
tttcccaaagggtgtctgtaacaga

SEQ ID NO: 485686 - DNA, 25 bp, Homo sapien
agtggcaacaccatcctagccaagg

SEQ ID NO: 485687 - DNA, 25 bp, Homo sapien
accatcctagccaagggcgtggaga

SEQ ID NO: 485688 - DNA, 25 bp, Homo sapien
gtgatgataataatggctcccgctg

SEQ ID NO: 485689 - DNA, 25 bp, Homo sapien
taatggctcccgctgattgagtcct

SEQ ID NO: 485690 - DNA, 25 bp, Homo sapien
tgattgagtcctcgctctatgccag

SEQ ID NO: 485691 - DNA, 25 bp, Homo sapien
tctatgccagactcgggacccttac

SEQ ID NO: 485692 - DNA, 25 bp, Homo sapien
cttgggatccttactatttctgtga

SEQ ID NO: 485693 - DNA, 25 bp, Homo sapien
gaaacagagtggcttacagagcaca

SEQ ID NO: 485694 - DNA, 25 bp, Homo sapien
tacagagcacaggtgttggattcag

SEQ ID NO: 485695 - DNA, 25 bp, Homo sapien
tccaacgccaaccaaagatttgcat

SEQ ID NO: 485696 - DNA, 25 bp, Homo sapien
aacgccaaccaaagatttgcatcag

SEQ ID NO: 485697 - DNA, 25 bp, Homo sapien
aaccaaagatttgcatcagccatct

SEQ ID NO: 485698 - DNA, 25 bp, Homo sapien
agatttgcatcagccatctcttagt

SEQ ID NO: 485699 - DNA, 25 bp, Homo sapien
atttgcatcagccatctcttagtcc

SEQ ID NO: 485700 - DNA, 25 bp, Homo sapien
atcagccatctcttagtccagcaag

SEQ ID NO: 485701 - DNA, 25 bp, Homo sapien
cagccatctcttagtccagcaagtc

SEQ ID NO: 485702 - DNA, 25 bp, Homo sapien
atctcttagtccagcaagtcctcat

SEQ ID NO: 485703 - DNA, 25 bp, Homo sapien
tagtccagcaagtcctcatagccag

SEQ ID NO: 485704 - DNA, 25 bp, Homo sapien
tccagcaagtcctcatagccagggt

SEQ ID NO: 485705 - DNA, 25 bp, Homo sapien
agcaagtcctcatagccagggtttt

SEQ ID NO: 485706 - DNA, 25 bp, Homo sapien
gacaacttagattgggtttataact

SEQ ID NO: 485707 - DNA, 25 bp, Homo sapien
ataactattaggaatcactgcacag

SEQ ID NO: 485708 - DNA, 25 bp, Homo sapien
taggaatcactgcacagtttatttg

SEQ ID NO: 485709 - DNA, 25 bp, Homo sapien
agagcaatggaggaagtgacagcta

SEQ ID NO: 485710 - DNA, 25 bp, Homo sapien
gacagctaatgttgcagttcttatt

SEQ ID NO: 485711 - DNA, 25 bp, Homo sapien
gcagttcttattgtatggcatagga

SEQ ID NO: 485712 - DNA, 25 bp, Homo sapien
gtatggcataggactggcattatat

SEQ ID NO: 485713 - DNA, 25 bp, Homo sapien
actggcattatatagcagaaatcaa

SEQ ID NO: 485714 - DNA, 25 bp, Homo sapien
gaaatcaactactgtacaatttctt

SEQ ID NO: 485715 - DNA, 25 bp, Homo sapien
taaatgacgctttgctaattttaag

SEQ ID NO: 485716 - DNA, 25 bp, Homo sapien
taagtgttaagcattttgcattaaa

SEQ ID NO: 485717 - DNA, 25 bp, Homo sapien
tgtctccctcttgacttaagtcgtg

SEQ ID NO: 485718 - DNA, 25 bp, Homo sapien
gacttaagtcgtggttcagaagtta

SEQ ID NO: 485719 - DNA, 25 bp, Homo sapien
tcagaagttacagcaccggtagcct

SEQ ID NO: 485720 - DNA, 25 bp, Homo sapien
ttacagcaccggtagcctcagattc

SEQ ID NO: 485721 - DNA, 25 bp, Homo sapien
cctcagattcctcttaccgtaatga

SEQ ID NO: 485722 - DNA, 25 bp, Homo sapien
accgtaatgaatgtcccagggcaga

SEQ ID NO: 485723 - DNA, 25 bp, Homo sapien
gaggatacacagatgcttccaaatc

SEQ ID NO: 485724 - DNA, 25 bp, Homo sapien
atgcttccaaatccttcttccaaag

SEQ ID NO: 485725 - DNA, 25 bp, Homo sapien
aatccttcttccaaagcaatagctg

SEQ ID NO: 485726 - DNA, 25 bp, Homo sapien
aattggaagacaaaagctcaacagc

SEQ ID NO: 485727 - DNA, 25 bp, Homo sapien
agagagacaaagatcactacagacc

SEQ ID NO: 485728 - DNA, 25 bp, Homo sapien
aaggtgaattcctcctgtgcctggc

SEQ ID NO: 485729 - DNA, 25 bp, Homo sapien
agaaccagacacagacaatcacact

SEQ ID NO: 485730 - DNA, 25 bp, Homo sapien
gggaaacacgtgctccatcggaaaa

SEQ ID NO: 485731 - DNA, 25 bp, Homo sapien
cgtgctccatcggaaaagtccagag

SEQ ID NO: 485732 - DNA, 25 bp, Homo sapien
cagagaggcccagcgtgcaccagag

SEQ ID NO: 485733 - DNA, 25 bp, Homo sapien
gtgcaccagagcctcgctcaggtca

SEQ ID NO: 485734 - DNA, 25 bp, Homo sapien
agagcctcgctcaggtcagcgccag

SEQ ID NO: 485735 - DNA, 25 bp, Homo sapien
atgcacattttccaagactgcctgt

SEQ ID NO: 485736 - DNA, 25 bp, Homo sapien
attttccaagactgcctgtgacctg

SEQ ID NO: 485737 - DNA, 25 bp, Homo sapien
cctgtgccgggcagagctgaggatg

SEQ ID NO: 485738 - DNA, 25 bp, Homo sapien
ggatgccaaggtgaattcctcctgt

SEQ ID NO: 485739 - DNA, 25 bp, Homo sapien
ggacttcagggagaatctaccgcct

SEQ ID NO: 485740 - DNA, 25 bp, Homo sapien
acttcagggagaatctaccgccttc

SEQ ID NO: 485741 - DNA, 25 bp, Homo sapien
tagcaccgcaacagcccctgttgaa

SEQ ID NO: 485742 - DNA, 25 bp, Homo sapien
aacagcccctgttgaagaatctaca

SEQ ID NO: 485743 - DNA, 25 bp, Homo sapien
cagcccctgttgaagaatctacaac

SEQ ID NO: 485744 - DNA, 25 bp, Homo sapien
agcccaggctcgactccaacaacac

SEQ ID NO: 485745 - DNA, 25 bp, Homo sapien
tcaacaatattccacagcagcccag

SEQ ID NO: 485746 - DNA, 25 bp, Homo sapien
acaatattccacagcagcccagatg

SEQ ID NO: 485747 - DNA, 25 bp, Homo sapien
cagcccagatgcaagtggaacaaca

SEQ ID NO: 485748 - DNA, 25 bp, Homo sapien
gatgcaagtggaacaacaccctcat

SEQ ID NO: 485749 - DNA, 25 bp, Homo sapien
gcaagtggaacaacaccctcatctg

SEQ ID NO: 485750 - DNA, 25 bp, Homo sapien
ccaggtacttatgagcaaaattcta

SEQ ID NO: 485751 - DNA, 25 bp, Homo sapien
gagcaaaattctactcagtctgaca

SEQ ID NO: 485752 - DNA, 25 bp, Homo sapien
actcagtctgacaactctgcttaga

SEQ ID NO: 485753 - DNA, 25 bp, Homo sapien
aatgcagtggtcactctacctttct

SEQ ID NO: 485754 - DNA, 25 bp, Homo sapien
gtggtcactctacctttctaaggta

SEQ ID NO: 485755 - DNA, 25 bp, Homo sapien
acctttctaaggtagttcagctcaa

SEQ ID NO: 485756 - DNA, 25 bp, Homo sapien
gttcagctcaagttacagcgatcca

SEQ ID NO: 485757 - DNA, 25 bp, Homo sapien
aagttacagcgatccagtcctgata

SEQ ID NO: 485758 - DNA, 25 bp, Homo sapien
gatccagtcctgatagagctttgaa

SEQ ID NO: 485759 - DNA, 25 bp, Homo sapien
gtcctgatagagctttgaaacctca

SEQ ID NO: 485760 - DNA, 25 bp, Homo sapien
taatgaaaaattggcttggtgaggt

SEQ ID NO: 485761 - DNA, 25 bp, Homo sapien
gaccccaatggatgaagacccactt

SEQ ID NO: 485762 - DNA, 25 bp, Homo sapien
caatggatgaagacccacttcaaag

SEQ ID NO: 485763 - DNA, 25 bp, Homo sapien
tgtgcctgtgccagacctcttggct

SEQ ID NO: 485764 - DNA, 25 bp, Homo sapien
ctgtgccagacctcttggctagaag

SEQ ID NO: 485765 - DNA, 25 bp, Homo sapien
gtgccagacctcttggctagaagga

SEQ ID NO: 485766 - DNA, 25 bp, Homo sapien
agacctcttggctagaaggactcac

SEQ ID NO: 485767 - DNA, 25 bp, Homo sapien
gattattacagtacatggacagaga

SEQ ID NO: 485768 - DNA, 25 bp, Homo sapien
atcagcatagggaggaggtgcacta

SEQ ID NO: 485769 - DNA, 25 bp, Homo sapien
aggaggtgcactagacacgttccac

SEQ ID NO: 485770 - DNA, 25 bp, Homo sapien
gaggtgcactagacacgttccacta

SEQ ID NO: 485771 - DNA, 25 bp, Homo sapien
ggtgcactagacacgttccactaca

SEQ ID NO: 485772 - DNA, 25 bp, Homo sapien
aactggcctgagcaccttaccagag

SEQ ID NO: 485773 - DNA, 25 bp, Homo sapien
tggcctgagcaccttaccagagcgc

SEQ ID NO: 485774 - DNA, 25 bp, Homo sapien
ggcccaatcgagtgtggacagacgc

SEQ ID NO: 485775 - DNA, 25 bp, Homo sapien
atcgagtgtggacagacgcagtaca

SEQ ID NO: 485776 - DNA, 25 bp, Homo sapien
gacagacgcagtacacggagaggtt

SEQ ID NO: 485777 - DNA, 25 bp, Homo sapien
cagtacacggagaggttgcccaaaa

SEQ ID NO: 485778 - DNA, 25 bp, Homo sapien
gaagcagcttaaaacacagcccccg

SEQ ID NO: 485779 - DNA, 25 bp, Homo sapien
agctcaacacatcaaaagcctcgtt

SEQ ID NO: 485780 - DNA, 25 bp, Homo sapien
aaaagcctcgttactgacagacatt

SEQ ID NO: 485781 - DNA, 25 bp, Homo sapien
agcctcgttactgacagacattgca

SEQ ID NO: 485782 - DNA, 25 bp, Homo sapien
ctcgttactgacagacattgcaact

SEQ ID NO: 485783 - DNA, 25 bp, Homo sapien
agtactcttggaatgtctctttgct

SEQ ID NO: 485784 - DNA, 25 bp, Homo sapien
gtctctttgctgtttactgtggcct

SEQ ID NO: 485785 - DNA, 25 bp, Homo sapien
tactgtggcctctttacaatggtga

SEQ ID NO: 485786 - DNA, 25 bp, Homo sapien
tgagacttatttctaccctctactt

SEQ ID NO: 485787 - DNA, 25 bp, Homo sapien
ggataatactagtctgagcagccct

SEQ ID NO: 485788 - DNA, 25 bp, Homo sapien
gagcagccctaatactagatgtacc

SEQ ID NO: 485789 - DNA, 25 bp, Homo sapien
gccaagtcattgttcagtgtagtca

SEQ ID NO: 485790 - DNA, 25 bp, Homo sapien
gtgtagtcatttcttagtatctgtt

SEQ ID NO: 485791 - DNA, 25 bp, Homo sapien
gtatctgtttatattttgtcacaca

SEQ ID NO: 485792 - DNA, 25 bp, Homo sapien
atagagcatgtgtttgtctacttgt

SEQ ID NO: 485793 - DNA, 25 bp, Homo sapien
ttgtctacttgtttgtctactataa

SEQ ID NO: 485794 - DNA, 25 bp, Homo sapien
tgggcttggtaccttaagcaccctt

SEQ ID NO: 485795 - DNA, 25 bp, Homo sapien
ttcattctcagaattacacctgtct

SEQ ID NO: 485796 - DNA, 25 bp, Homo sapien
acctgtctgaagcaggcattttcca

SEQ ID NO: 485797 - DNA, 25 bp, Homo sapien
gcattttccaatgccctagatggga

SEQ ID NO: 485798 - DNA, 25 bp, Homo sapien
gaagcatttgcctgtgtgtcagaac

SEQ ID NO: 485799 - DNA, 25 bp, Homo sapien
gtcagaacattcactgaggatcctc

SEQ ID NO: 485800 - DNA, 25 bp, Homo sapien
gaggatcctcataggcacttctaga

SEQ ID NO: 485801 - DNA, 25 bp, Homo sapien
gcacttctagaaaccaaatccttga

SEQ ID NO: 485802 - DNA, 25 bp, Homo sapien
aagatgactaaccagaaatgcccgt

SEQ ID NO: 485803 - DNA, 25 bp, Homo sapien
gaaatgcccgtcatagcactgttta

SEQ ID NO: 485804 - DNA, 25 bp, Homo sapien
actgaagccaattgaaatgtccatc

SEQ ID NO: 485805 - DNA, 25 bp, Homo sapien
ttgctttcttaaagactttggtcgg

SEQ ID NO: 485806 - DNA, 25 bp, Homo sapien
tgctttcttaaagactttggtcggg

SEQ ID NO: 485807 - DNA, 25 bp, Homo sapien
gactttggtcgggtatttgtgttgt

SEQ ID NO: 485808 - DNA, 25 bp, Homo sapien
ctttggtcgggtatttgtgttgttg

SEQ ID NO: 485809 - DNA, 25 bp, Homo sapien
tttggtcgggtatttgtgttgttga

SEQ ID NO: 485810 - DNA, 25 bp, Homo sapien
gtcgggtatttgtgttgttgagtat

SEQ ID NO: 485811 - DNA, 25 bp, Homo sapien
cgggtatttgtgttgttgagtattg

SEQ ID NO: 485812 - DNA, 25 bp, Homo sapien
atttgtgttgttgagtattgtgtct

SEQ ID NO: 485813 - DNA, 25 bp, Homo sapien
ttgtgttgttgagtattgtgtctgg

SEQ ID NO: 485814 - DNA, 25 bp, Homo sapien
ttgagtattgtgtctgggtgtgggt

SEQ ID NO: 485815 - DNA, 25 bp, Homo sapien
ctgggtgtgggtatttgattctttt

SEQ ID NO: 485816 - DNA, 25 bp, Homo sapien
ctctgagctctggactctgtttgaa

SEQ ID NO: 485817 - DNA, 25 bp, Homo sapien
agctctggactctgtttgaatattc

SEQ ID NO: 485818 - DNA, 25 bp, Homo sapien
tatggacagtccagggcttatgccc

SEQ ID NO: 485819 - DNA, 25 bp, Homo sapien
agcagcccactggaggcattcttca

SEQ ID NO: 485820 - DNA, 25 bp, Homo sapien
gcattcttcaggctcctttaaggca

SEQ ID NO: 485821 - DNA, 25 bp, Homo sapien
ggcaggtgcattgatagttccatta

SEQ ID NO: 485822 - DNA, 25 bp, Homo sapien
agttccattagtgtgacccttgcat

SEQ ID NO: 485823 - DNA, 25 bp, Homo sapien
attagtgtgacccttgcattggcac

SEQ ID NO: 485824 - DNA, 25 bp, Homo sapien
gcaacttccttctgccctagagcaa

SEQ ID NO: 485825 - DNA, 25 bp, Homo sapien
tagagcaagccatgagccccagagc

SEQ ID NO: 485826 - DNA, 25 bp, Homo sapien
gccccagagcagtagcaggagactt

SEQ ID NO: 485827 - DNA, 25 bp, Homo sapien
gacttcagggagaatctaccgcctt

SEQ ID NO: 485828 - DNA, 25 bp, Homo sapien
agggagaatctaccgccttccagac

SEQ ID NO: 485829 - DNA, 25 bp, Homo sapien
tagcaccgcaacagcccctgttgaa

SEQ ID NO: 485830 - DNA, 25 bp, Homo sapien
acagcccctgttgaagaatctacaa

SEQ ID NO: 485831 - DNA, 25 bp, Homo sapien
acaacttcgggccacagtgagaaat

SEQ ID NO: 485832 - DNA, 25 bp, Homo sapien
ttcgggccacagtgagaaatcaaca

SEQ ID NO: 485833 - DNA, 25 bp, Homo sapien
tcaacaatattccacagcagcccag

SEQ ID NO: 485834 - DNA, 25 bp, Homo sapien
acaatattccacagcagcccagatg

SEQ ID NO: 485835 - DNA, 25 bp, Homo sapien
cagcccagatgcaagtggaacaaca

SEQ ID NO: 485836 - DNA, 25 bp, Homo sapien
gatgcaagtggaacaacaccctcat

SEQ ID NO: 485837 - DNA, 25 bp, Homo sapien
gcaagtggaacaacaccctcatctg

SEQ ID NO: 485838 - DNA, 25 bp, Homo sapien
tggagacctgtgagtatcccaccca

SEQ ID NO: 485839 - DNA, 25 bp, Homo sapien
gacctgtgagtatcccacccagaaa

SEQ ID NO: 485840 - DNA, 25 bp, Homo sapien
ccacccagaaaccttggatactgag

SEQ ID NO: 485841 - DNA, 25 bp, Homo sapien
gaaaccttggatactgagtctccta

SEQ ID NO: 485842 - DNA, 25 bp, Homo sapien
ggatactgagtctcctaatcttatc

SEQ ID NO: 485843 - DNA, 25 bp, Homo sapien
gagtctcctaatcttatcaattctg

SEQ ID NO: 485844 - DNA, 25 bp, Homo sapien
tatcaattctgatggtttctttttt

SEQ ID NO: 485845 - DNA, 25 bp, Homo sapien
ttttcccagcttttgagccaacaac

SEQ ID NO: 485846 - DNA, 25 bp, Homo sapien
gcttttgagccaacaactctgatta

SEQ ID NO: 485847 - DNA, 25 bp, Homo sapien
caactctgattaactattcctatag

SEQ ID NO: 485848 - DNA, 25 bp, Homo sapien
attcctatagcatttactatatttg

SEQ ID NO: 485849 - DNA, 25 bp, Homo sapien
aacaactagcaaggttctttcactt

SEQ ID NO: 485850 - DNA, 25 bp, Homo sapien
ggaattactaagatcggagttttgc

SEQ ID NO: 485851 - DNA, 25 bp, Homo sapien
tgattaaagcaaccatacccaagaa

SEQ ID NO: 485852 - DNA, 25 bp, Homo sapien
atacccaagaaatagctagcatcaa

SEQ ID NO: 485853 - DNA, 25 bp, Homo sapien
gagatttatccaatgttgggtcaag

SEQ ID NO: 485854 - DNA, 25 bp, Homo sapien
gggtcaagaacattgcttcgacatg

SEQ ID NO: 485855 - DNA, 25 bp, Homo sapien
gaacattgcttcgacatggaaatta

SEQ ID NO: 485856 - DNA, 25 bp, Homo sapien
ggaacattgcttttcgtgatactgt

SEQ ID NO: 485857 - DNA, 25 bp, Homo sapien
gtgatactgttaatttcatactatg

SEQ ID NO: 485858 - DNA, 25 bp, Homo sapien
gataaacataattcttcacgatagt

SEQ ID NO: 485859 - DNA, 25 bp, Homo sapien
aattcttcacgatagtagttttcta

SEQ ID NO: 485860 - DNA, 25 bp, Homo sapien
agcaccctatggagcacagctctct

SEQ ID NO: 485861 - DNA, 25 bp, Homo sapien
gccaattcacagcattaacaccttc

SEQ ID NO: 485862 - DNA, 25 bp, Homo sapien
ttccccttgggcaggttagctgggc

SEQ ID NO: 485863 - DNA, 25 bp, Homo sapien
gttagctgggctgcaaacgggccac

SEQ ID NO: 485864 - DNA, 25 bp, Homo sapien
acgggccacagaaagtcagtagttt

SEQ ID NO: 485865 - DNA, 25 bp, Homo sapien
agtttcaatcatacacagcaccctg

SEQ ID NO: 485866 - DNA, 25 bp, Homo sapien
acagcaccctgtgtgtataacaatc

SEQ ID NO: 485867 - DNA, 25 bp, Homo sapien
gattctacaaaatcctggccttttc

SEQ ID NO: 485868 - DNA, 25 bp, Homo sapien
aatcctggccttttccagagatata

SEQ ID NO: 485869 - DNA, 25 bp, Homo sapien
gacagaacagaaggctagggagcac

SEQ ID NO: 485870 - DNA, 25 bp, Homo sapien
tagggagcacagcaccggcagcacc

SEQ ID NO: 485871 - DNA, 25 bp, Homo sapien
tagtctgctgttcttcaggaggcct

SEQ ID NO: 485872 - DNA, 25 bp, Homo sapien
gtctgctgttcttcaggaggcctgc

SEQ ID NO: 485873 - DNA, 25 bp, Homo sapien
ctgctgttcttcaggaggcctgcca

SEQ ID NO: 485874 - DNA, 25 bp, Homo sapien
aggaggcctgccataaactcttcgg

SEQ ID NO: 485875 - DNA, 25 bp, Homo sapien
gtttacgtgttgcaccttttcacag

SEQ ID NO: 485876 - DNA, 25 bp, Homo sapien
ttacgtgttgcaccttttcacagac

SEQ ID NO: 485877 - DNA, 25 bp, Homo sapien
acgtgttgcaccttttcacagacgg

SEQ ID NO: 485878 - DNA, 25 bp, Homo sapien
gtgttgcaccttttcacagacggtt

SEQ ID NO: 485879 - DNA, 25 bp, Homo sapien
tgttgcaccttttcacagacggttc

SEQ ID NO: 485880 - DNA, 25 bp, Homo sapien
ttgcaccttttcacagacggttccc

SEQ ID NO: 485881 - DNA, 25 bp, Homo sapien
tttcacagacggttccccacagcat

SEQ ID NO: 485882 - DNA, 25 bp, Homo sapien
aactgtggtcttgaaccccaattct

SEQ ID NO: 485883 - DNA, 25 bp, Homo sapien
cttgaaccccaattctcagcttatt

SEQ ID NO: 485884 - DNA, 25 bp, Homo sapien
attgtattagggatatgtcatgtta

SEQ ID NO: 485885 - DNA, 25 bp, Homo sapien
gtcatgttatatttacttttggata

SEQ ID NO: 485886 - DNA, 25 bp, Homo sapien
tacttttggataaaacttgcattag

SEQ ID NO: 485887 - DNA, 25 bp, Homo sapien
gatgcataataactcagtaagtttt

SEQ ID NO: 485888 - DNA, 25 bp, Homo sapien
cttgtttagaagttaagcaccttat

SEQ ID NO: 485889 - DNA, 25 bp, Homo sapien
taagcaccttatcaagatattaagt

SEQ ID NO: 485890 - DNA, 25 bp, Homo sapien
gtaacttgagagtaatggatgctgt

SEQ ID NO: 485891 - DNA, 25 bp, Homo sapien
atggatgctgtagtgatgtctttca

SEQ ID NO: 485892 - DNA, 25 bp, Homo sapien
tagtgatgtctttcacatatgtgaa

SEQ ID NO: 485893 - DNA, 25 bp, Homo sapien
ttgctacgtgaaaagtgcgtatttg

SEQ ID NO: 485894 - DNA, 25 bp, Homo sapien
agtgcgtatttgtttggtcacctac

SEQ ID NO: 485895 - DNA, 25 bp, Homo sapien
gtatttgtttggtcacctacacttg

SEQ ID NO: 485896 - DNA, 25 bp, Homo sapien
tgtttggtcacctacacttgtatta

SEQ ID NO: 485897 - DNA, 25 bp, Homo sapien
ggtcacctacacttgtattagctgt

SEQ ID NO: 485898 - DNA, 25 bp, Homo sapien
cctacacttgtattagctgtttcaa

SEQ ID NO: 485899 - DNA, 25 bp, Homo sapien
gtattagctgtttcaatgtgatttt

SEQ ID NO: 485900 - DNA, 25 bp, Homo sapien
gtattgttataaaccatgcttcagt

SEQ ID NO: 485901 - DNA, 25 bp, Homo sapien
gttataaaccatgcttcagtttttt

SEQ ID NO: 485902 - DNA, 25 bp, Homo sapien
cacccaaaagtcattgtctattttt

SEQ ID NO: 485903 - DNA, 25 bp, Homo sapien
gttaagaagttttttccaatatatg

SEQ ID NO: 485904 - DNA, 25 bp, Homo sapien
agatgaaccacaggaagatgctaaa

SEQ ID NO: 485905 - DNA, 25 bp, Homo sapien
gctaaagaattgcaacaaggtaaac

SEQ ID NO: 485906 - DNA, 25 bp, Homo sapien
aggtaaaccatatcattggagagac

SEQ ID NO: 485907 - DNA, 25 bp, Homo sapien
cattggagagactggtcaatcatta

SEQ ID NO: 485908 - DNA, 25 bp, Homo sapien
gatgcagcagccttggaattatcta

SEQ ID NO: 485909 - DNA, 25 bp, Homo sapien
gccttggaattatctaatggcagta

SEQ ID NO: 485910 - DNA, 25 bp, Homo sapien
ggatggaaaacttgccaccatgtat

SEQ ID NO: 485911 - DNA, 25 bp, Homo sapien
catgtattcaagtggtagtccggaa

SEQ ID NO: 485912 - DNA, 25 bp, Homo sapien
gtccggaaggtggatctgacagttc

SEQ ID NO: 485913 - DNA, 25 bp, Homo sapien
gacagttcagaaagccgaagtgaat

SEQ ID NO: 485914 - DNA, 25 bp, Homo sapien
gaaagccgaagtgaattcttagaga

SEQ ID NO: 485915 - DNA, 25 bp, Homo sapien
ggatgtatctgcaccaggaaggtca

SEQ ID NO: 485916 - DNA, 25 bp, Homo sapien
aggtgtgaccatgccaagactgaga

SEQ ID NO: 485917 - DNA, 25 bp, Homo sapien
ggccatgatgtaatctgcaatctgc

SEQ ID NO: 485918 - DNA, 25 bp, Homo sapien
gtaatgctagtaatccagttgggtt

SEQ ID NO: 485919 - DNA, 25 bp, Homo sapien
taggtatttgccaggtgtgcccatc

SEQ ID NO: 485920 - DNA, 25 bp, Homo sapien
aataaggcattccaagtcttcccga

SEQ ID NO: 485921 - DNA, 25 bp, Homo sapien
gtcttcccgaaaggcaggactttgc

SEQ ID NO: 485922 - DNA, 25 bp, Homo sapien
gtgcccatccaaacaagtctacaag

SEQ ID NO: 485923 - DNA, 25 bp, Homo sapien
gtctacaagtctgtacaggctggca

SEQ ID NO: 485924 - DNA, 25 bp, Homo sapien
tacagcgagtaagtttttctccctt

SEQ ID NO: 485925 - DNA, 25 bp, Homo sapien
agtttttctcccttcacatatgagg

SEQ ID NO: 485926 - DNA, 25 bp, Homo sapien
ttattatttttgcttagtgcaaaga

SEQ ID NO: 485927 - DNA, 25 bp, Homo sapien
ataatgtgtgtttatgatgaaaacc

SEQ ID NO: 485928 - DNA, 25 bp, Homo sapien
aaaccctgaaaatgtagacaggtat

SEQ ID NO: 485929 - DNA, 25 bp, Homo sapien
gaaatagtccattaactaatcaccc

SEQ ID NO: 485930 - DNA, 25 bp, Homo sapien
atagtccattaactaatcacccaga

SEQ ID NO: 485931 - DNA, 25 bp, Homo sapien
gtccattaactaatcacccagaaat

SEQ ID NO: 485932 - DNA, 25 bp, Homo sapien
cattaactaatcacccagaaataac

SEQ ID NO: 485933 - DNA, 25 bp, Homo sapien
tacaaaataaatgggaggtcagtta

SEQ ID NO: 485934 - DNA, 25 bp, Homo sapien
atgggaggtcagttaaagtacgaga

SEQ ID NO: 485935 - DNA, 25 bp, Homo sapien
aggtcagttaaagtacgagataggt

SEQ ID NO: 485936 - DNA, 25 bp, Homo sapien
taaagtacgagataggtttggctgg

SEQ ID NO: 485937 - DNA, 25 bp, Homo sapien
aagattgcagagttcctcagagccc

SEQ ID NO: 485938 - DNA, 25 bp, Homo sapien
aggcacgaggtaatcatttaaccca

SEQ ID NO: 485939 - DNA, 25 bp, Homo sapien
gaggtaatcatttaacccatgctta

SEQ ID NO: 485940 - DNA, 25 bp, Homo sapien
atttaacccatgcttatagacttaa

SEQ ID NO: 485941 - DNA, 25 bp, Homo sapien
aggaaagtgttagacgcagaaggct

SEQ ID NO: 485942 - DNA, 25 bp, Homo sapien
gacgcagaaggctaagactgggcta

SEQ ID NO: 485943 - DNA, 25 bp, Homo sapien
agaaggctaagactgggctaaatct

SEQ ID NO: 485944 - DNA, 25 bp, Homo sapien
cgcaagcttataggtacaaaattaa

SEQ ID NO: 485945 - DNA, 25 bp, Homo sapien
aattaaggtgtgtgggtccttctct

SEQ ID NO: 485946 - DNA, 25 bp, Homo sapien
aggtgtgtgggtccttctcttttcg

SEQ ID NO: 485947 - DNA, 25 bp, Homo sapien
tgtgggtccttctcttttcgtcgtt

SEQ ID NO: 485948 - DNA, 25 bp, Homo sapien
ggagggggatccagcgaccaaacca

SEQ ID NO: 485949 - DNA, 25 bp, Homo sapien
ggggatccagcgaccaaaccagagg

SEQ ID NO: 485950 - DNA, 25 bp, Homo sapien
ttccgggcccgtgcgctccctggct

SEQ ID NO: 485951 - DNA, 25 bp, Homo sapien
cagcttgcgagggtcgttggcccct

SEQ ID NO: 485952 - DNA, 25 bp, Homo sapien
ttgcgagggtcgttggcccctggag

SEQ ID NO: 485953 - DNA, 25 bp, Homo sapien
gcgagggtcgttggcccctggaggc

SEQ ID NO: 485954 - DNA, 25 bp, Homo sapien
cgtcagcccgcctgccgggtggagg

SEQ ID NO: 485955 - DNA, 25 bp, Homo sapien
ccgggtggaggcgtctagtggcgtc

SEQ ID NO: 485956 - DNA, 25 bp, Homo sapien
gtggaggcgtctagtggcgtcctga

SEQ ID NO: 485957 - DNA, 25 bp, Homo sapien
ggaggcgtctagtggcgtcctgagc

SEQ ID NO: 485958 - DNA, 25 bp, Homo sapien
aggcgtctagtggcgtcctgagccc

SEQ ID NO: 485959 - DNA, 25 bp, Homo sapien
gataaatgaaactggccttgtcaca

SEQ ID NO: 485960 - DNA, 25 bp, Homo sapien
aatgaaactggccttgtcacaactt

SEQ ID NO: 485961 - DNA, 25 bp, Homo sapien
atgaaactggccttgtcacaacttg

SEQ ID NO: 485962 - DNA, 25 bp, Homo sapien
tgaaactggccttgtcacaacttga

SEQ ID NO: 485963 - DNA, 25 bp, Homo sapien
gaaactggccttgtcacaacttgac

SEQ ID NO: 485964 - DNA, 25 bp, Homo sapien
aaactggccttgtcacaacttgaca

SEQ ID NO: 485965 - DNA, 25 bp, Homo sapien
actggccttgtcacaacttgacaat

SEQ ID NO: 485966 - DNA, 25 bp, Homo sapien
ggccttgtcacaacttgacaatatt

SEQ ID NO: 485967 - DNA, 25 bp, Homo sapien
ttgaactgaaacaacgtaaaacatc

SEQ ID NO: 485968 - DNA, 25 bp, Homo sapien
tgaacagccaattagaacactagac

SEQ ID NO: 485969 - DNA, 25 bp, Homo sapien
cagccaattagaacactagacaaag

SEQ ID NO: 485970 - DNA, 25 bp, Homo sapien
agacctatttagatccgtcagccca

SEQ ID NO: 485971 - DNA, 25 bp, Homo sapien
tatttagatccgtcagcccacggac

SEQ ID NO: 485972 - DNA, 25 bp, Homo sapien
tttagatccgtcagcccacggacca

SEQ ID NO: 485973 - DNA, 25 bp, Homo sapien
caagcagtcattccctgttatacaa

SEQ ID NO: 485974 - DNA, 25 bp, Homo sapien
gcagtcattccctgttatacaagca

SEQ ID NO: 485975 - DNA, 25 bp, Homo sapien
gtcattccctgttatacaagcaaga

SEQ ID NO: 485976 - DNA, 25 bp, Homo sapien
ttccctgttatacaagcaagagtca

SEQ ID NO: 485977 - DNA, 25 bp, Homo sapien
ttatacaagcaagagtcaggaggag

SEQ ID NO: 485978 - DNA, 25 bp, Homo sapien
caggctgcggctggcatatggaggt

SEQ ID NO: 485979 - DNA, 25 bp, Homo sapien
ctgcggctggcatatggaggttgag

SEQ ID NO: 485980 - DNA, 25 bp, Homo sapien
gcatcagcttcacccggctggggat

SEQ ID NO: 485981 - DNA, 25 bp, Homo sapien
acttcgaaggctttactctgaaaca

SEQ ID NO: 485982 - DNA, 25 bp, Homo sapien
gaaggctttactctgaaacatcaca

SEQ ID NO: 485983 - DNA, 25 bp, Homo sapien
tttgccgacctaactcaggtggaaa

SEQ ID NO: 485984 - DNA, 25 bp, Homo sapien
tttctacctgccgtgtatcagcgaa

SEQ ID NO: 485985 - DNA, 25 bp, Homo sapien
ttctacctgccgtgtatcagcgaag

SEQ ID NO: 485986 - DNA, 25 bp, Homo sapien
tctacctgccgtgtatcagcgaagg

SEQ ID NO: 485987 - DNA, 25 bp, Homo sapien
ctacctgccgtgtatcagcgaaggt

SEQ ID NO: 485988 - DNA, 25 bp, Homo sapien
tacctgccgtgtatcagcgaaggtt

SEQ ID NO: 485989 - DNA, 25 bp, Homo sapien
acctgccgtgtatcagcgaaggttg

SEQ ID NO: 485990 - DNA, 25 bp, Homo sapien
cctgccgtgtatcagcgaaggttgg

SEQ ID NO: 485991 - DNA, 25 bp, Homo sapien
ccgtgtatcagcgaaggttgggact

SEQ ID NO: 485992 - DNA, 25 bp, Homo sapien
ttagttcatgccgagactagaaaac

SEQ ID NO: 485993 - DNA, 25 bp, Homo sapien
tagttcatgccgagactagaaaact

SEQ ID NO: 485994 - DNA, 25 bp, Homo sapien
agttcatgccgagactagaaaactg

SEQ ID NO: 485995 - DNA, 25 bp, Homo sapien
gttcatgccgagactagaaaactga

SEQ ID NO: 485996 - DNA, 25 bp, Homo sapien
ttcatgccgagactagaaaactgaa

SEQ ID NO: 485997 - DNA, 25 bp, Homo sapien
tcatgccgagactagaaaactgaac

SEQ ID NO: 485998 - DNA, 25 bp, Homo sapien
catgccgagactagaaaactgaacc

SEQ ID NO: 485999 - DNA, 25 bp, Homo sapien
atgccgagactagaaaactgaaccc

SEQ ID NO: 486000 - DNA, 25 bp, Homo sapien
tgccgagactagaaaactgaaccct

SEQ ID NO: 486001 - DNA, 25 bp, Homo sapien
ctagaaaactgaaccctagtactgt

SEQ ID NO: 486002 - DNA, 25 bp, Homo sapien
tagaaaactgaaccctagtactgtt

SEQ ID NO: 486003 - DNA, 25 bp, Homo sapien
ggaagagatgtgtctaaaacagcat

SEQ ID NO: 486004 - DNA, 25 bp, Homo sapien
tgtgtctaaaacagcatcttaaagc

SEQ ID NO: 486005 - DNA, 25 bp, Homo sapien
agcatcttaaagctgagtgtatttc

SEQ ID NO: 486006 - DNA, 25 bp, Homo sapien
aaagctgagtgtatttctttgcaca

SEQ ID NO: 486007 - DNA, 25 bp, Homo sapien
ctgagtgtatttctttgcacaaggg

SEQ ID NO: 486008 - DNA, 25 bp, Homo sapien
tgaattcttctttcattctgatctt

SEQ ID NO: 486009 - DNA, 25 bp, Homo sapien
gaaatatttgtagcttgctatctgt

SEQ ID NO: 486010 - DNA, 25 bp, Homo sapien
tgtagcttgctatctgtatttgaat

SEQ ID NO: 486011 - DNA, 25 bp, Homo sapien
gcttgctatctgtatttgaattttt

SEQ ID NO: 486012 - DNA, 25 bp, Homo sapien
gactaatttggtcattaaatcttgt

SEQ ID NO: 486013 - DNA, 25 bp, Homo sapien
aaatcttgtgacatattcgatatta

SEQ ID NO: 486014 - DNA, 25 bp, Homo sapien
tggtgaccctgattatatccagtaa

SEQ ID NO: 486015 - DNA, 25 bp, Homo sapien
gaccctgattatatccagtaacaca

SEQ ID NO: 486016 - DNA, 25 bp, Homo sapien
ccagtaacacatagactgtgcgcat

SEQ ID NO: 486017 - DNA, 25 bp, Homo sapien
atagactgtgcgcataggcctgctt

SEQ ID NO: 486018 - DNA, 25 bp, Homo sapien
actgtgcgcataggcctgctttgtc

SEQ ID NO: 486019 - DNA, 25 bp, Homo sapien
ataggcctgctttgtctcctctatc

SEQ ID NO: 486020 - DNA, 25 bp, Homo sapien
tttgtctcctctatcctgggctttt

SEQ ID NO: 486021 - DNA, 25 bp, Homo sapien
ctcctctatcctgggcttttgtttt

SEQ ID NO: 486022 - DNA, 25 bp, Homo sapien
aactcattttgcttgtggctccaca

SEQ ID NO: 486023 - DNA, 25 bp, Homo sapien
ttgcttgtggctccacacacacaaa

SEQ ID NO: 486024 - DNA, 25 bp, Homo sapien
tttctgataaccatagcataggaca

SEQ ID NO: 486025 - DNA, 25 bp, Homo sapien
aaataaccagcgaagcaggctacat

SEQ ID NO: 486026 - DNA, 25 bp, Homo sapien
accagcgaagcaggctacatggagt

SEQ ID NO: 486027 - DNA, 25 bp, Homo sapien
tggagtacttggctcctgcctacct

SEQ ID NO: 486028 - DNA, 25 bp, Homo sapien
ttggctcctgcctacctggagctcg

SEQ ID NO: 486029 - DNA, 25 bp, Homo sapien
tgggcctgaaaggtggcttgccttc

SEQ ID NO: 486030 - DNA, 25 bp, Homo sapien
gaaaggtggcttgccttcctgctaa

SEQ ID NO: 486031 - DNA, 25 bp, Homo sapien
aggtggcttgccttcctgctaaagg

SEQ ID NO: 486032 - DNA, 25 bp, Homo sapien
cgagggacttcgtgggctcattaga

SEQ ID NO: 486033 - DNA, 25 bp, Homo sapien
tccatttccaagacagactgatttg

SEQ ID NO: 486034 - DNA, 25 bp, Homo sapien
tgatttgctggaagccaccaagcca

SEQ ID NO: 486035 - DNA, 25 bp, Homo sapien
agtgccagcgttctctggccccgtg

SEQ ID NO: 486036 - DNA, 25 bp, Homo sapien
ttcccgagcgaaagcgtaagcgact

SEQ ID NO: 486037 - DNA, 25 bp, Homo sapien
tcccgagcgaaagcgtaagcgactg

SEQ ID NO: 486038 - DNA, 25 bp, Homo sapien
cgagcgaaagcgtaagcgactgcgt

SEQ ID NO: 486039 - DNA, 25 bp, Homo sapien
gagcgaaagcgtaagcgactgcgtc

SEQ ID NO: 486040 - DNA, 25 bp, Homo sapien
gcgaaagcgtaagcgactgcgtcga

SEQ ID NO: 486041 - DNA, 25 bp, Homo sapien
gaaagcgtaagcgactgcgtcgact

SEQ ID NO: 486042 - DNA, 25 bp, Homo sapien
aaagcgtaagcgactgcgtcgactc

SEQ ID NO: 486043 - DNA, 25 bp, Homo sapien
aagcgtaagcgactgcgtcgactcc

SEQ ID NO: 486044 - DNA, 25 bp, Homo sapien
agcgtaagcgactgcgtcgactccc

SEQ ID NO: 486045 - DNA, 25 bp, Homo sapien
gagcaagaccgtgaccgcggcgggc

SEQ ID NO: 486046 - DNA, 25 bp, Homo sapien
ggcgggccagtactcgccagggatg

SEQ ID NO: 486047 - DNA, 25 bp, Homo sapien
ccctttataaatccaagtagatagg

SEQ ID NO: 486048 - DNA, 25 bp, Homo sapien
aagacaaactttgcatctcagtatg

SEQ ID NO: 486049 - DNA, 25 bp, Homo sapien
tttttgttgacattagtctcagtga

SEQ ID NO: 486050 - DNA, 25 bp, Homo sapien
gacattagtctcagtgaagactatg

SEQ ID NO: 486051 - DNA, 25 bp, Homo sapien
ttatctaaatatggactgctcagga

SEQ ID NO: 486052 - DNA, 25 bp, Homo sapien
tggactgctcaggaaacgagacttt

SEQ ID NO: 486053 - DNA, 25 bp, Homo sapien
attaattgggccagcttttcaaaca

SEQ ID NO: 486054 - DNA, 25 bp, Homo sapien
aagatgccacattcaaaatagggta

SEQ ID NO: 486055 - DNA, 25 bp, Homo sapien
atgccacattcaaaatagggtatat

SEQ ID NO: 486056 - DNA, 25 bp, Homo sapien
tagggtatattttcctatattacgg

SEQ ID NO: 486057 - DNA, 25 bp, Homo sapien
tatattttcctatattacggtttgc

SEQ ID NO: 486058 - DNA, 25 bp, Homo sapien
gatcattgcaagtgaaattttgaga

SEQ ID NO: 486059 - DNA, 25 bp, Homo sapien
catttggtaatattgctttggttca

SEQ ID NO: 486060 - DNA, 25 bp, Homo sapien
aacatttaattacatcaggttctaa

SEQ ID NO: 486061 - DNA, 25 bp, Homo sapien
aacatgtattactcacttgaggcca

SEQ ID NO: 486062 - DNA, 25 bp, Homo sapien
gtattactcacttgaggccactttt

SEQ ID NO: 486063 - DNA, 25 bp, Homo sapien
ctcacttgaggccacttttaaatat

SEQ ID NO: 486064 - DNA, 25 bp, Homo sapien
gaggccacttttaaatattcatact

SEQ ID NO: 486065 - DNA, 25 bp, Homo sapien
ttcatactctttgacataagatgct

SEQ ID NO: 486066 - DNA, 25 bp, Homo sapien
aagatgctttgtatatttctcattt

SEQ ID NO: 486067 - DNA, 25 bp, Homo sapien
tctcatttcttttagttcttagtaa

SEQ ID NO: 486068 - DNA, 25 bp, Homo sapien
tagttcttagtaagtcagctttaaa

SEQ ID NO: 486069 - DNA, 25 bp, Homo sapien
aaagatactgttgtctgtgcatcag

SEQ ID NO: 486070 - DNA, 25 bp, Homo sapien
tgtctgtgcatcaggttagcttgag

SEQ ID NO: 486071 - DNA, 25 bp, Homo sapien
atcaggttagcttgaggtcaccaca

SEQ ID NO: 486072 - DNA, 25 bp, Homo sapien
gttagcttgaggtcaccacaggtcc

SEQ ID NO: 486073 - DNA, 25 bp, Homo sapien
cttgaggtcaccacaggtcctggga

SEQ ID NO: 486074 - DNA, 25 bp, Homo sapien
tttgcattagcctcagaaactcttg

SEQ ID NO: 486075 - DNA, 25 bp, Homo sapien
attagcctcagaaactcttgtcttt

SEQ ID NO: 486076 - DNA, 25 bp, Homo sapien
gaaactcttgtctttagctgataac

SEQ ID NO: 486077 - DNA, 25 bp, Homo sapien
ctttagctgataacctttgagggat

SEQ ID NO: 486078 - DNA, 25 bp, Homo sapien
gcctagttggagcatctgagaaaat

SEQ ID NO: 486079 - DNA, 25 bp, Homo sapien
tcaaatagtttgtccttctagtccc

SEQ ID NO: 486080 - DNA, 25 bp, Homo sapien
tctctcatttgttccttgtggaaca

SEQ ID NO: 486081 - DNA, 25 bp, Homo sapien
aatgtgggtgtttatgtctgtgtat

SEQ ID NO: 486082 - DNA, 25 bp, Homo sapien
tgtattttttacttcatgcatggct

SEQ ID NO: 486083 - DNA, 25 bp, Homo sapien
ttttacttcatgcatggcttctcct

SEQ ID NO: 486084 - DNA, 25 bp, Homo sapien
tccaacttcctcctgcacttaaaaa

SEQ ID NO: 486085 - DNA, 25 bp, Homo sapien
gggccaggttccaaattagacttgt

SEQ ID NO: 486086 - DNA, 25 bp, Homo sapien
tgacactactcctggatagttccaa

SEQ ID NO: 486087 - DNA, 25 bp, Homo sapien
tcttccttgtggcaggtttcctggc

SEQ ID NO: 486088 - DNA, 25 bp, Homo sapien
tggcaggtttcctggctgagcccga

SEQ ID NO: 486089 - DNA, 25 bp, Homo sapien
ctccctgtttattgtgttcatgatc

SEQ ID NO: 486090 - DNA, 25 bp, Homo sapien
gttcatgatcagtatgtgtttccat

SEQ ID NO: 486091 - DNA, 25 bp, Homo sapien
aaaattgatacagttagataccttc

SEQ ID NO: 486092 - DNA, 25 bp, Homo sapien
gttagataccttcagattacctaag

SEQ ID NO: 486093 - DNA, 25 bp, Homo sapien
gataccttcagattacctaagttaa

SEQ ID NO: 486094 - DNA, 25 bp, Homo sapien
agttaagtttttgccaaaatgctat

SEQ ID NO: 486095 - DNA, 25 bp, Homo sapien
tttatgccctttttgtaaagttatg

SEQ ID NO: 486096 - DNA, 25 bp, Homo sapien
tagttttctcttgagtgtttggaca

SEQ ID NO: 486097 - DNA, 25 bp, Homo sapien
ctcttgagtgtttggacatgagaat

SEQ ID NO: 486098 - DNA, 25 bp, Homo sapien
aattacaatttacaagatcacttca

SEQ ID NO: 486099 - DNA, 25 bp, Homo sapien
acaagatcacttcattaggcacagg

SEQ ID NO: 486100 - DNA, 25 bp, Homo sapien
gatcacttcattaggcacaggaaaa

SEQ ID NO: 486101 - DNA, 25 bp, Homo sapien
aaaataaatctatgaagaacccatg

SEQ ID NO: 486102 - DNA, 25 bp, Homo sapien
agctgggagcggctttgggtcctcc

SEQ ID NO: 486103 - DNA, 25 bp, Homo sapien
gctgggagcggctttgggtcctcca

SEQ ID NO: 486104 - DNA, 25 bp, Homo sapien
tgggagcggctttgggtcctccagc

SEQ ID NO: 486105 - DNA, 25 bp, Homo sapien
gggagcggctttgggtcctccagcc

SEQ ID NO: 486106 - DNA, 25 bp, Homo sapien
gagcggctttgggtcctccagccca

SEQ ID NO: 486107 - DNA, 25 bp, Homo sapien
gcggctttgggtcctccagcccacg

SEQ ID NO: 486108 - DNA, 25 bp, Homo sapien
accgcggcgagcagtccccggagga

SEQ ID NO: 486109 - DNA, 25 bp, Homo sapien
gcggcgagcagtccccggaggagaa

SEQ ID NO: 486110 - DNA, 25 bp, Homo sapien
gagcagtccccggaggagaagccgg

SEQ ID NO: 486111 - DNA, 25 bp, Homo sapien
gcagtccccggaggagaagccgggt

SEQ ID NO: 486112 - DNA, 25 bp, Homo sapien
tccccggaggagaagccgggtggct

SEQ ID NO: 486113 - DNA, 25 bp, Homo sapien
gatgtaggcatacagcgtcccattg

SEQ ID NO: 486114 - DNA, 25 bp, Homo sapien
atacagcgtcccattgtttctcgtt

SEQ ID NO: 486115 - DNA, 25 bp, Homo sapien
tgtttctcgttttctttggtacaga

SEQ ID NO: 486116 - DNA, 25 bp, Homo sapien
tggactccacatcaaagtcttccac

SEQ ID NO: 486117 - DNA, 25 bp, Homo sapien
tcttccacattcaagaccaggtcga

SEQ ID NO: 486118 - DNA, 25 bp, Homo sapien
tcgatctgctgtgtatcagactccc

SEQ ID NO: 486119 - DNA, 25 bp, Homo sapien
accaggtcgatgttgttctcagcac

SEQ ID NO: 486120 - DNA, 25 bp, Homo sapien
cacccaggtgggacctcgtcgtggt

SEQ ID NO: 486121 - DNA, 25 bp, Homo sapien
tcagactccccggtgagcaggttga

SEQ ID NO: 486122 - DNA, 25 bp, Homo sapien
gagcaggttgatttcttctggcttg

SEQ ID NO: 486123 - DNA, 25 bp, Homo sapien
tcagaggactgaccaggtgcacctg

SEQ ID NO: 486124 - DNA, 25 bp, Homo sapien
gggaaaaagtgcaaattgctccatg

SEQ ID NO: 486125 - DNA, 25 bp, Homo sapien
ttctctcccttatgtaacatctcct

SEQ ID NO: 486126 - DNA, 25 bp, Homo sapien
tctcccttatgtaacatctcctgag

SEQ ID NO: 486127 - DNA, 25 bp, Homo sapien
cttatgtaacatctcctgagggtgt

SEQ ID NO: 486128 - DNA, 25 bp, Homo sapien
atgtaacatctcctgagggtgttta

SEQ ID NO: 486129 - DNA, 25 bp, Homo sapien
gtaacatctcctgagggtgtttagt

SEQ ID NO: 486130 - DNA, 25 bp, Homo sapien
catctcctgagggtgtttagttgca

SEQ ID NO: 486131 - DNA, 25 bp, Homo sapien
tctcctgagggtgtttagttgcatg

SEQ ID NO: 486132 - DNA, 25 bp, Homo sapien
cctgagggtgtttagttgcatggct

SEQ ID NO: 486133 - DNA, 25 bp, Homo sapien
agttgcatggctgttcagaaaggta

SEQ ID NO: 486134 - DNA, 25 bp, Homo sapien
tgcatggctgttcagaaaggtatta

SEQ ID NO: 486135 - DNA, 25 bp, Homo sapien
ttcccgagcgaaagcgtaagcgact

SEQ ID NO: 486136 - DNA, 25 bp, Homo sapien
gagcgaaagcgtaagcgactgcgtc

SEQ ID NO: 486137 - DNA, 25 bp, Homo sapien
gcgaaagcgtaagcgactgcgtcga

SEQ ID NO: 486138 - DNA, 25 bp, Homo sapien
aaagcgtaagcgactgcgtcgactc

SEQ ID NO: 486139 - DNA, 25 bp, Homo sapien
agcgtaagcgactgcgtcgactccc

SEQ ID NO: 486140 - DNA, 25 bp, Homo sapien
gagcaagaccgtgaccgcggcgggc

SEQ ID NO: 486141 - DNA, 25 bp, Homo sapien
gcggcgggccagtactcgccaggga

SEQ ID NO: 486142 - DNA, 25 bp, Homo sapien
tactcgccagggatgaccatgagcg

SEQ ID NO: 486143 - DNA, 25 bp, Homo sapien
ccagggatgaccatgagcgtgtgat

SEQ ID NO: 486144 - DNA, 25 bp, Homo sapien
tctgcgggcctaggcttctgcccag

SEQ ID NO: 486145 - DNA, 25 bp, Homo sapien
ggctgaggtcacacctcgggcacct

SEQ ID NO: 486146 - DNA, 25 bp, Homo sapien
ataggaaaagctcctgatccagcag

SEQ ID NO: 486147 - DNA, 25 bp, Homo sapien
gatccagcaggttttattcttaaat

SEQ ID NO: 486148 - DNA, 25 bp, Homo sapien
ttcccaggtataggccggctttcag

SEQ ID NO: 486149 - DNA, 25 bp, Homo sapien
tataggccggctttcagaaaccctg

SEQ ID NO: 486150 - DNA, 25 bp, Homo sapien
tttcagaaaccctgcaccacataga

SEQ ID NO: 486151 - DNA, 25 bp, Homo sapien
agaccctgggcctgaattgctgtga

SEQ ID NO: 486152 - DNA, 25 bp, Homo sapien
gactctgctggtaatttgtgtcctt

SEQ ID NO: 486153 - DNA, 25 bp, Homo sapien
aatttgtgtccttctgcttggaact

SEQ ID NO: 486154 - DNA, 25 bp, Homo sapien
ggacttcttagcttgcactccaatt

SEQ ID NO: 486155 - DNA, 25 bp, Homo sapien
tgcactccaattcttttccaacatt

SEQ ID NO: 486156 - DNA, 25 bp, Homo sapien
tgttctcttgggatccaggtttatt

SEQ ID NO: 486157 - DNA, 25 bp, Homo sapien
atcaatcaatattcttcccttgcct

SEQ ID NO: 486158 - DNA, 25 bp, Homo sapien
ttcccttgcctgtgggcagtggaga

SEQ ID NO: 486159 - DNA, 25 bp, Homo sapien
agtgctgctgggtgtacgctgcacc

SEQ ID NO: 486160 - DNA, 25 bp, Homo sapien
ataatcagtgagcactgttctgctc

SEQ ID NO: 486161 - DNA, 25 bp, Homo sapien
tgttctgctcagagctcctgatcta

SEQ ID NO: 486162 - DNA, 25 bp, Homo sapien
ccaggactgggtcaaagctgcatga

SEQ ID NO: 486163 - DNA, 25 bp, Homo sapien
aaagctgcatgaaaccaggccctgg

SEQ ID NO: 486164 - DNA, 25 bp, Homo sapien
ccctggcagcaacctgggaatggct

SEQ ID NO: 486165 - DNA, 25 bp, Homo sapien
ctcctccaacattactggaactcta

SEQ ID NO: 486166 - DNA, 25 bp, Homo sapien
tactggaactctatcctgttaggat

SEQ ID NO: 486167 - DNA, 25 bp, Homo sapien
tgttaggatcttctgagcttgtttc

SEQ ID NO: 486168 - DNA, 25 bp, Homo sapien
gaaaatcagcagagtggaggctgag

SEQ ID NO: 486169 - DNA, 25 bp, Homo sapien
tgttggggtttattactgcatgcaa

SEQ ID NO: 486170 - DNA, 25 bp, Homo sapien
gttggggtttattactgcatgcaag

SEQ ID NO: 486171 - DNA, 25 bp, Homo sapien
ttggggtttattactgcatgcaagc

SEQ ID NO: 486172 - DNA, 25 bp, Homo sapien
tggggtttattactgcatgcaagct

SEQ ID NO: 486173 - DNA, 25 bp, Homo sapien
ggggtttattactgcatgcaagctc

SEQ ID NO: 486174 - DNA, 25 bp, Homo sapien
gggtttattactgcatgcaagctct

SEQ ID NO: 486175 - DNA, 25 bp, Homo sapien
ggtttattactgcatgcaagctcta

SEQ ID NO: 486176 - DNA, 25 bp, Homo sapien
gtttattactgcatgcaagctctac

SEQ ID NO: 486177 - DNA, 25 bp, Homo sapien
tttattactgcatgcaagctctaca

SEQ ID NO: 486178 - DNA, 25 bp, Homo sapien
tcctgcacccgttcccgagcgaaag

SEQ ID NO: 486179 - DNA, 25 bp, Homo sapien
tactcgccagggatgaccatgagcg

SEQ ID NO: 486180 - DNA, 25 bp, Homo sapien
actcgccagggatgaccatgagcgt

SEQ ID NO: 486181 - DNA, 25 bp, Homo sapien
ccagggatgaccatgagcgtgtgat

SEQ ID NO: 486182 - DNA, 25 bp, Homo sapien
cagggatgaccatgagcgtgtgatg

SEQ ID NO: 486183 - DNA, 25 bp, Homo sapien
atgagcgtgtgatggggcggcagcc

SEQ ID NO: 486184 - DNA, 25 bp, Homo sapien
ccgggcctctctgcgggcctaggct

SEQ ID NO: 486185 - DNA, 25 bp, Homo sapien
tctgcgggcctaggcttctgcccag

SEQ ID NO: 486186 - DNA, 25 bp, Homo sapien
tgcgggcctaggcttctgcccagcg

SEQ ID NO: 486187 - DNA, 25 bp, Homo sapien
ggctgaggtcacacctcgggcacct

SEQ ID NO: 486188 - DNA, 25 bp, Homo sapien
gctgaggtcacacctcgggcacctg

SEQ ID NO: 486189 - DNA, 25 bp, Homo sapien
tggcaccgccatggatgatgccgat

SEQ ID NO: 486190 - DNA, 25 bp, Homo sapien
atggatgatgccgatcctccaggcc

SEQ ID NO: 486191 - DNA, 25 bp, Homo sapien
ctgagaacctgtttgtgaactacct

SEQ ID NO: 486192 - DNA, 25 bp, Homo sapien
gaacctgtttgtgaactacctgtcc

SEQ ID NO: 486193 - DNA, 25 bp, Homo sapien
tgtcccgcatccatcgtgaggagga

SEQ ID NO: 486194 - DNA, 25 bp, Homo sapien
gcatccatcgtgaggaggacttcca

SEQ ID NO: 486195 - DNA, 25 bp, Homo sapien
gcctaactccaccaagaagatccag

SEQ ID NO: 486196 - DNA, 25 bp, Homo sapien
caggagctgctagttctcttctgga

SEQ ID NO: 486197 - DNA, 25 bp, Homo sapien
agctctgcgacttcgacaaggtggg

SEQ ID NO: 486198 - DNA, 25 bp, Homo sapien
gacttcgacaaggtgggccagcctc

SEQ ID NO: 486199 - DNA, 25 bp, Homo sapien
actgtggacggcaccaccactggca

SEQ ID NO: 486200 - DNA, 25 bp, Homo sapien
tgctatgcctcaactcatagaagat

SEQ ID NO: 486201 - DNA, 25 bp, Homo sapien
gatgaacccttcaagaaaacgtgaa

SEQ ID NO: 486202 - DNA, 25 bp, Homo sapien
caggcaagtaaagtatttcttcgga

SEQ ID NO: 486203 - DNA, 25 bp, Homo sapien
gtaaaactggattagagaagacttt

SEQ ID NO: 486204 - DNA, 25 bp, Homo sapien
tcagtgggttatctctaggatgatc

SEQ ID NO: 486205 - DNA, 25 bp, Homo sapien
gtgggttatctctaggatgatcagt

SEQ ID NO: 486206 - DNA, 25 bp, Homo sapien
ggatgatcagtagttcagcacttaa

SEQ ID NO: 486207 - DNA, 25 bp, Homo sapien
gtagttcagcacttaaaaactgcag

SEQ ID NO: 486208 - DNA, 25 bp, Homo sapien
ttatgttccagataactttccgttg

SEQ ID NO: 486209 - DNA, 25 bp, Homo sapien
tgttccagataactttccgttgttt

SEQ ID NO: 486210 - DNA, 25 bp, Homo sapien
ttttcttagatttggtcatcatcag

SEQ ID NO: 486211 - DNA, 25 bp, Homo sapien
gtttcaggtgcttgtgactaaattc

SEQ ID NO: 486212 - DNA, 25 bp, Homo sapien
taatttcactggctgtcaaggctgt

SEQ ID NO: 486213 - DNA, 25 bp, Homo sapien
tgctgtgggttttgagtactggact

SEQ ID NO: 486214 - DNA, 25 bp, Homo sapien
actggactggatgtcagaaaccttt

SEQ ID NO: 486215 - DNA, 25 bp, Homo sapien
agaaacctttgccatcacgggaaat

SEQ ID NO: 486216 - DNA, 25 bp, Homo sapien
cacgggaaattctgtcactctggat

SEQ ID NO: 486217 - DNA, 25 bp, Homo sapien
gtcactctggatttactgtctgttc

SEQ ID NO: 486218 - DNA, 25 bp, Homo sapien
agctaaattcctctgcagtgtgatt

SEQ ID NO: 486219 - DNA, 25 bp, Homo sapien
cagtgtgatttagcaccctggatcc

SEQ ID NO: 486220 - DNA, 25 bp, Homo sapien
tatttgaatgcattaccccactggt

SEQ ID NO: 486221 - DNA, 25 bp, Homo sapien
taccccactggtttccataaactat

SEQ ID NO: 486222 - DNA, 25 bp, Homo sapien
gggagcaccctgagatgcaccgcgc

SEQ ID NO: 486223 - DNA, 25 bp, Homo sapien
gagcaccctgagatgcaccgcgcag

SEQ ID NO: 486224 - DNA, 25 bp, Homo sapien
agcaccctgagatgcaccgcgcagg

SEQ ID NO: 486225 - DNA, 25 bp, Homo sapien
aagagcaggagagcacctgccccat

SEQ ID NO: 486226 - DNA, 25 bp, Homo sapien
agagcaggagagcacctgccccatc

SEQ ID NO: 486227 - DNA, 25 bp, Homo sapien
tccagaatgccaagacattggagaa

SEQ ID NO: 486228 - DNA, 25 bp, Homo sapien
caagacattggagaagtgccggcat

SEQ ID NO: 486229 - DNA, 25 bp, Homo sapien
aagacattggagaagtgccggcatt

SEQ ID NO: 486230 - DNA, 25 bp, Homo sapien
gacattggagaagtgccggcattca

SEQ ID NO: 486231 - DNA, 25 bp, Homo sapien
cattggagaagtgccggcattcatt

SEQ ID NO: 486232 - DNA, 25 bp, Homo sapien
gagaagtgccggcattcattctgcg

SEQ ID NO: 486233 - DNA, 25 bp, Homo sapien
ctcccaaaggaagcagttaaataag

SEQ ID NO: 486234 - DNA, 25 bp, Homo sapien
taaataagtctgtgggaggtcagtg

SEQ ID NO: 486235 - DNA, 25 bp, Homo sapien
aatgaagtgaacagagagtgcagct

SEQ ID NO: 486236 - DNA, 25 bp, Homo sapien
gagagtgcagctaggccttccccta

SEQ ID NO: 486237 - DNA, 25 bp, Homo sapien
taggccttcccctaggagatagcta

SEQ ID NO: 486238 - DNA, 25 bp, Homo sapien
ggagatagctactgagtgtctttta

SEQ ID NO: 486239 - DNA, 25 bp, Homo sapien
gagtgtcttttaagccagactctat

SEQ ID NO: 486240 - DNA, 25 bp, Homo sapien
aagccagactctattaacagggaag

SEQ ID NO: 486241 - DNA, 25 bp, Homo sapien
aagtgggaggtccattggcctttgt

SEQ ID NO: 486242 - DNA, 25 bp, Homo sapien
ggttcttcaataattctattccctt

SEQ ID NO: 486243 - DNA, 25 bp, Homo sapien
agacatgtgacccaattttaggcca

SEQ ID NO: 486244 - DNA, 25 bp, Homo sapien
ttaaaacactagtacttcagaatat

SEQ ID NO: 486245 - DNA, 25 bp, Homo sapien
ttcagaatatagatacaagtacacc

SEQ ID NO: 486246 - DNA, 25 bp, Homo sapien
agatacaagtacaccatcttgaaga

SEQ ID NO: 486247 - DNA, 25 bp, Homo sapien
gtttttcagggcaattcaaatgacc

SEQ ID NO: 486248 - DNA, 25 bp, Homo sapien
gtattccagacagtgtttctgtcat

SEQ ID NO: 486249 - DNA, 25 bp, Homo sapien
gtgtttctgtcattggatctctgat

SEQ ID NO: 486250 - DNA, 25 bp, Homo sapien
gtttctgtcattggatctctgattg

SEQ ID NO: 486251 - DNA, 25 bp, Homo sapien
tctgtcattggatctctgattggta

SEQ ID NO: 486252 - DNA, 25 bp, Homo sapien
gtcattggatctctgattggtagtg

SEQ ID NO: 486253 - DNA, 25 bp, Homo sapien
tggatctctgattggtagtgttaat

SEQ ID NO: 486254 - DNA, 25 bp, Homo sapien
gatctctgattggtagtgttaataa

SEQ ID NO: 486255 - DNA, 25 bp, Homo sapien
tgctggacggcaccttctgtcaggc

SEQ ID NO: 486256 - DNA, 25 bp, Homo sapien
gcaccttctgtcaggcggcgctgcg

SEQ ID NO: 486257 - DNA, 25 bp, Homo sapien
gggagacgcagctgtgcaccacaag

SEQ ID NO: 486258 - DNA, 25 bp, Homo sapien
gctgtgcaccacaagatgtgtgtta

SEQ ID NO: 486259 - DNA, 25 bp, Homo sapien
agctagaaacattgggaaaggactt

SEQ ID NO: 486260 - DNA, 25 bp, Homo sapien
aactgattgcacaaaaatgccaagt

SEQ ID NO: 486261 - DNA, 25 bp, Homo sapien
aatgccaagttcgaaattgtcctca

SEQ ID NO: 486262 - DNA, 25 bp, Homo sapien
aaattgtcctcatttcaagaatgca

SEQ ID NO: 486263 - DNA, 25 bp, Homo sapien
atgcagtgagtggatcagaatgtct

SEQ ID NO: 486264 - DNA, 25 bp, Homo sapien
agaatgtctgctttccatggttgaa

SEQ ID NO: 486265 - DNA, 25 bp, Homo sapien
tcatcattattttgtggcaacacag

SEQ ID NO: 486266 - DNA, 25 bp, Homo sapien
ggtgatgtgtgcctagagttccaac

SEQ ID NO: 486267 - DNA, 25 bp, Homo sapien
gtgatgtgtgcctagagttccaact

SEQ ID NO: 486268 - DNA, 25 bp, Homo sapien
tgatgtgtgcctagagttccaacta

SEQ ID NO: 486269 - DNA, 25 bp, Homo sapien
gatgtgtgcctagagttccaactac

SEQ ID NO: 486270 - DNA, 25 bp, Homo sapien
atgtgtgcctagagttccaactact

SEQ ID NO: 486271 - DNA, 25 bp, Homo sapien
tgtgtgcctagagttccaactactt

SEQ ID NO: 486272 - DNA, 25 bp, Homo sapien
gtgtgcctagagttccaactacttg

SEQ ID NO: 486273 - DNA, 25 bp, Homo sapien
gtgcctagagttccaactacttgga

SEQ ID NO: 486274 - DNA, 25 bp, Homo sapien
gcctagagttccaactacttggaaa

SEQ ID NO: 486275 - DNA, 25 bp, Homo sapien
ggttgcagtgatctataatcaccac

SEQ ID NO: 486276 - DNA, 25 bp, Homo sapien
gttgcagtgatctataatcaccact

SEQ ID NO: 486277 - DNA, 25 bp, Homo sapien
atgtgtatatagcatcctgagctgt

SEQ ID NO: 486278 - DNA, 25 bp, Homo sapien
gtttctacttattgaatctgcttta

SEQ ID NO: 486279 - DNA, 25 bp, Homo sapien
tttagcaattttcttccttgtgaac

SEQ ID NO: 486280 - DNA, 25 bp, Homo sapien
atgaaccatataaagtgtctgtgac

SEQ ID NO: 486281 - DNA, 25 bp, Homo sapien
gtgtctgtgacttaatgatttcatg

SEQ ID NO: 486282 - DNA, 25 bp, Homo sapien
gatttcatgtaagtctgtcgcatac

SEQ ID NO: 486283 - DNA, 25 bp, Homo sapien
taagtctgtcgcatacatccttctt

SEQ ID NO: 486284 - DNA, 25 bp, Homo sapien
catccttcttttgtagcttacacca

SEQ ID NO: 486285 - DNA, 25 bp, Homo sapien
gtagcttacaccatgtggatgctct

SEQ ID NO: 486286 - DNA, 25 bp, Homo sapien
accatgtggatgctctgtctgtaga

SEQ ID NO: 486287 - DNA, 25 bp, Homo sapien
ctgtctgtagacactgcttgataaa

SEQ ID NO: 486288 - DNA, 25 bp, Homo sapien
atggaatttgagatcctagggaaaa

SEQ ID NO: 486289 - DNA, 25 bp, Homo sapien
aagaacacaatcatagagacctata

SEQ ID NO: 486290 - DNA, 25 bp, Homo sapien
gagacctatatttagtggatggtag

SEQ ID NO: 486291 - DNA, 25 bp, Homo sapien
gttgataatttgatactggaggatg

SEQ ID NO: 486292 - DNA, 25 bp, Homo sapien
gagaagtgggagtacaagattacaa

SEQ ID NO: 486293 - DNA, 25 bp, Homo sapien
aagattacaaaagcactgtcacaga

SEQ ID NO: 486294 - DNA, 25 bp, Homo sapien
gcactgtcacagaaattaagagaaa

SEQ ID NO: 486295 - DNA, 25 bp, Homo sapien
tctttaaaagatgggacatttggcc

SEQ ID NO: 486296 - DNA, 25 bp, Homo sapien
agatgggacatttggccggtggcgg

SEQ ID NO: 486297 - DNA, 25 bp, Homo sapien
ggaatcattctctgagataacctta

SEQ ID NO: 486298 - DNA, 25 bp, Homo sapien
gagataaccttagaaatcatggaat

SEQ ID NO: 486299 - DNA, 25 bp, Homo sapien
acagcctgcaaaactccaagaagag

SEQ ID NO: 486300 - DNA, 25 bp, Homo sapien
ctgcaaaactccaagaagagcccaa

SEQ ID NO: 486301 - DNA, 25 bp, Homo sapien
gagcccaagaagacattactactaa

SEQ ID NO: 486302 - DNA, 25 bp, Homo sapien
acattactactaactgtcacatggt

SEQ ID NO: 486303 - DNA, 25 bp, Homo sapien
tactactaactgtcacatggtgtca

SEQ ID NO: 486304 - DNA, 25 bp, Homo sapien
ctaactgtcacatggtgtcacggat

SEQ ID NO: 486305 - DNA, 25 bp, Homo sapien
aactgtcacatggtgtcacggatgg

SEQ ID NO: 486306 - DNA, 25 bp, Homo sapien
tcacatggtgtcacggatgggatct

SEQ ID NO: 486307 - DNA, 25 bp, Homo sapien
catggtgtcacggatgggatcttcg

SEQ ID NO: 486308 - DNA, 25 bp, Homo sapien
tcacggatgggatcttcggacagaa

SEQ ID NO: 486309 - DNA, 25 bp, Homo sapien
acggatgggatcttcggacagaaaa

SEQ ID NO: 486310 - DNA, 25 bp, Homo sapien
caaaaatcttcaaagactggtttct

SEQ ID NO: 486311 - DNA, 25 bp, Homo sapien
tgaaagaacacttctaagcctaagt

SEQ ID NO: 486312 - DNA, 25 bp, Homo sapien
ttctaagcctaagtgtgtgatacag

SEQ ID NO: 486313 - DNA, 25 bp, Homo sapien
gtgtgatacagtttgttacttttaa

SEQ ID NO: 486314 - DNA, 25 bp, Homo sapien
acagttgactgtatctgacccatca

SEQ ID NO: 486315 - DNA, 25 bp, Homo sapien
gactgtatctgacccatcatactac

SEQ ID NO: 486316 - DNA, 25 bp, Homo sapien
tctgacccatcatactactatactt

SEQ ID NO: 486317 - DNA, 25 bp, Homo sapien
tactactatacttctgggttgaaca

SEQ ID NO: 486318 - DNA, 25 bp, Homo sapien
ggttgaacagaattatttatgcaga

SEQ ID NO: 486319 - DNA, 25 bp, Homo sapien
ttgaatatccatcacttaaatacag

SEQ ID NO: 486320 - DNA, 25 bp, Homo sapien
cttaaatacagtgacaggacagcaa

SEQ ID NO: 486321 - DNA, 25 bp, Homo sapien
gcaacctaagagctaaagatgtaat

SEQ ID NO: 486322 - DNA, 25 bp, Homo sapien
attgtaaatcttttgtgtctcctga

SEQ ID NO: 486323 - DNA, 25 bp, Homo sapien
gtgtctcctgaagacttcccttaaa

SEQ ID NO: 486324 - DNA, 25 bp, Homo sapien
ttcccttaaaattagctctgagtga

SEQ ID NO: 486325 - DNA, 25 bp, Homo sapien
aaaagacatcttcgaatccatattt

SEQ ID NO: 486326 - DNA, 25 bp, Homo sapien
gaatccatatttcaagcctggtaga

SEQ ID NO: 486327 - DNA, 25 bp, Homo sapien
gaattggcttttctagcagaacctt

SEQ ID NO: 486328 - DNA, 25 bp, Homo sapien
attgagattcataacaacaccaaga

SEQ ID NO: 486329 - DNA, 25 bp, Homo sapien
acaccaagaattgattttgtagcca

SEQ ID NO: 486330 - DNA, 25 bp, Homo sapien
gattttgtagccaacattcattcaa

SEQ ID NO: 486331 - DNA, 25 bp, Homo sapien
gaggaaacatttgacttatctggaa

SEQ ID NO: 486332 - DNA, 25 bp, Homo sapien
attgggatgcattcgagtctgtaac

SEQ ID NO: 486333 - DNA, 25 bp, Homo sapien
gagtctgtaacttctgaaacctgaa

SEQ ID NO: 486334 - DNA, 25 bp, Homo sapien
aacttctgaaacctgaacaacctca

SEQ ID NO: 486335 - DNA, 25 bp, Homo sapien
gaagggacagcagtgacatcggaca

SEQ ID NO: 486336 - DNA, 25 bp, Homo sapien
gacatcggacagaagacccgggctc

SEQ ID NO: 486337 - DNA, 25 bp, Homo sapien
gacggtccccacataggaagggcac

SEQ ID NO: 486338 - DNA, 25 bp, Homo sapien
ccagccctcttgctggtgacattgt

SEQ ID NO: 486339 - DNA, 25 bp, Homo sapien
gacattgtcatggtcatcttgtttc

SEQ ID NO: 486340 - DNA, 25 bp, Homo sapien
tggatttttcttctgggtcttatgt

SEQ ID NO: 486341 - DNA, 25 bp, Homo sapien
ttttcttctgggtcttatgtttggg

SEQ ID NO: 486342 - DNA, 25 bp, Homo sapien
gggaggtttattctttctgaaaatg

SEQ ID NO: 486343 - DNA, 25 bp, Homo sapien
ctttatactaatgacttaatagagc

SEQ ID NO: 486344 - DNA, 25 bp, Homo sapien
tttatactaatgacttaatagagct

SEQ ID NO: 486345 - DNA, 25 bp, Homo sapien
ttatactaatgacttaatagagctt

SEQ ID NO: 486346 - DNA, 25 bp, Homo sapien
tatactaatgacttaatagagcttt

SEQ ID NO: 486347 - DNA, 25 bp, Homo sapien
atactaatgacttaatagagcttta

SEQ ID NO: 486348 - DNA, 25 bp, Homo sapien
tactaatgacttaatagagctttaa

SEQ ID NO: 486349 - DNA, 25 bp, Homo sapien
actaatgacttaatagagctttaaa

SEQ ID NO: 486350 - DNA, 25 bp, Homo sapien
taatgacttaatagagctttaaaag

SEQ ID NO: 486351 - DNA, 25 bp, Homo sapien
aatgacttaatagagctttaaaaga

SEQ ID NO: 486352 - DNA, 25 bp, Homo sapien
atgacttaatagagctttaaaagaa

SEQ ID NO: 486353 - DNA, 25 bp, Homo sapien
gacttaatagagctttaaaagaaag

SEQ ID NO: 486354 - DNA, 25 bp, Homo sapien
tgatctcagtgcaaactacactagt

SEQ ID NO: 486355 - DNA, 25 bp, Homo sapien
tacactagtctgtttctttgccctg

SEQ ID NO: 486356 - DNA, 25 bp, Homo sapien
tttgccctggtctcaagtctctaag

SEQ ID NO: 486357 - DNA, 25 bp, Homo sapien
caagtctctaagacgctggtgtgta

SEQ ID NO: 486358 - DNA, 25 bp, Homo sapien
cgctggtgtgtattatgtgggctaa

SEQ ID NO: 486359 - DNA, 25 bp, Homo sapien
tatgtgggctaagttcatgtgttat

SEQ ID NO: 486360 - DNA, 25 bp, Homo sapien
gttatcctaaggcacaagagttgag

SEQ ID NO: 486361 - DNA, 25 bp, Homo sapien
atgaaattggccctcttttagcata

SEQ ID NO: 486362 - DNA, 25 bp, Homo sapien
ttggccctcttttagcataagttgg

SEQ ID NO: 486363 - DNA, 25 bp, Homo sapien
agtgtgcactggctggaggcttcca

SEQ ID NO: 486364 - DNA, 25 bp, Homo sapien
ccagaggcttccagccatgaggtgt

SEQ ID NO: 486365 - DNA, 25 bp, Homo sapien
aaatgactagctttgcacagacacc

SEQ ID NO: 486366 - DNA, 25 bp, Homo sapien
tttgcacagacacctctaccttcag

SEQ ID NO: 486367 - DNA, 25 bp, Homo sapien
tctaccttcagcactatgggattct

SEQ ID NO: 486368 - DNA, 25 bp, Homo sapien
cagcactatgggattctagattaat

SEQ ID NO: 486369 - DNA, 25 bp, Homo sapien
gtgacttgatctttttaatgtccaa

SEQ ID NO: 486370 - DNA, 25 bp, Homo sapien
gtgctaaatgacttttttggccaaa

SEQ ID NO: 486371 - DNA, 25 bp, Homo sapien
ggccaaaggcttagttgtgaaaaat

SEQ ID NO: 486372 - DNA, 25 bp, Homo sapien
tatacattcaaggtagtggccaaat

SEQ ID NO: 486373 - DNA, 25 bp, Homo sapien
gtagtggccaaatgtaacacatcaa

SEQ ID NO: 486374 - DNA, 25 bp, Homo sapien
atgatttctctgctaacagccgcct

SEQ ID NO: 486375 - DNA, 25 bp, Homo sapien
acagccgcctgtatgtttcaataaa

SEQ ID NO: 486376 - DNA, 25 bp, Homo sapien
atgggtaatggagggttcacctgca

SEQ ID NO: 486377 - DNA, 25 bp, Homo sapien
gtaatggagggttcacctgcaactt

SEQ ID NO: 486378 - DNA, 25 bp, Homo sapien
aatggagggttcacctgcaacttaa

SEQ ID NO: 486379 - DNA, 25 bp, Homo sapien
ttcaaacagtcagacaaagggtcca

SEQ ID NO: 486380 - DNA, 25 bp, Homo sapien
cagtcagacaaagggtccaagcggg

SEQ ID NO: 486381 - DNA, 25 bp, Homo sapien
aatagacaagtcaaaaggcaggttt

SEQ ID NO: 486382 - DNA, 25 bp, Homo sapien
aaggcaggtttttagaatctcctca

SEQ ID NO: 486383 - DNA, 25 bp, Homo sapien
ggcaggtttttagaatctcctcatg

SEQ ID NO: 486384 - DNA, 25 bp, Homo sapien
ggtttttagaatctcctcatggtga

SEQ ID NO: 486385 - DNA, 25 bp, Homo sapien
tttagaatctcctcatggtgaactt

SEQ ID NO: 486386 - DNA, 25 bp, Homo sapien
tagaatctcctcatggtgaactttt

SEQ ID NO: 486387 - DNA, 25 bp, Homo sapien
gatctgtttccatgaggtcctgtac

SEQ ID NO: 486388 - DNA, 25 bp, Homo sapien
gtcacggtgcagaacgttagctgaa

SEQ ID NO: 486389 - DNA, 25 bp, Homo sapien
ttcatttgctcgatggttggtgctc

SEQ ID NO: 486390 - DNA, 25 bp, Homo sapien
gttggtgctcgaataatgtcattga

SEQ ID NO: 486391 - DNA, 25 bp, Homo sapien
gatgttctcatgtctgaagcgcagt

SEQ ID NO: 486392 - DNA, 25 bp, Homo sapien
gtaagatttttatctccctcagggt

SEQ ID NO: 486393 - DNA, 25 bp, Homo sapien
ctctggcagtaggtctggtgctcaa

SEQ ID NO: 486394 - DNA, 25 bp, Homo sapien
gggctgattttcttgatagctactc

SEQ ID NO: 486395 - DNA, 25 bp, Homo sapien
atggatatattttaaccctctgagg

SEQ ID NO: 486396 - DNA, 25 bp, Homo sapien
taaccctctgaggatctggtagaga

SEQ ID NO: 486397 - DNA, 25 bp, Homo sapien
cattgctgaggtgttgtgtcttcaa

SEQ ID NO: 486398 - DNA, 25 bp, Homo sapien
acagcaaccaagtagcttttagcag

SEQ ID NO: 486399 - DNA, 25 bp, Homo sapien
agtagcttttagcagaggaaacaga

SEQ ID NO: 486400 - DNA, 25 bp, Homo sapien
acaatgatgactgggctttgtcagc

SEQ ID NO: 486401 - DNA, 25 bp, Homo sapien
agccactttacagactggtcttcct

SEQ ID NO: 486402 - DNA, 25 bp, Homo sapien
atctctggagataaggtcgatggca

SEQ ID NO: 486403 - DNA, 25 bp, Homo sapien
gtcgatggcaattgcactggactta

SEQ ID NO: 486404 - DNA, 25 bp, Homo sapien
actggacttagagtgaatgttggca

SEQ ID NO: 486405 - DNA, 25 bp, Homo sapien
gtgatggcaaagctcacttttccat

SEQ ID NO: 486406 - DNA, 25 bp, Homo sapien
tgctgaggacccatttattgcaatc

SEQ ID NO: 486407 - DNA, 25 bp, Homo sapien
ggacccatttattgcaatccatgct

SEQ ID NO: 486408 - DNA, 25 bp, Homo sapien
ttgcaatccatgctgactcaaaatt

SEQ ID NO: 486409 - DNA, 25 bp, Homo sapien
tctcaatgggggcagttccctccac

SEQ ID NO: 486410 - DNA, 25 bp, Homo sapien
tttggttgtcagaactgcgggaggg

SEQ ID NO: 486411 - DNA, 25 bp, Homo sapien
ggtgctagtgacatctatgggtaga

SEQ ID NO: 486412 - DNA, 25 bp, Homo sapien
gctagtgacatctatgggtagaggc

SEQ ID NO: 486413 - DNA, 25 bp, Homo sapien
ccagctcaaaatgttattagtgcca

SEQ ID NO: 486414 - DNA, 25 bp, Homo sapien
gctcaaaatgttattagtgccaggt

SEQ ID NO: 486415 - DNA, 25 bp, Homo sapien
aaatgttattagtgccaggttgaga

SEQ ID NO: 486416 - DNA, 25 bp, Homo sapien
ggttgagaaactctggattaagtaa

SEQ ID NO: 486417 - DNA, 25 bp, Homo sapien
ctctggattaagtaaatagggcata

SEQ ID NO: 486418 - DNA, 25 bp, Homo sapien
gtcttccaggaagggctaaaatggt

SEQ ID NO: 486419 - DNA, 25 bp, Homo sapien
tccaggaagggctaaaatggtggtt

SEQ ID NO: 486420 - DNA, 25 bp, Homo sapien
tgcctggcacgcagtgagcgctctg

SEQ ID NO: 486421 - DNA, 25 bp, Homo sapien
tgagcgctctgcacattgatgggtc

SEQ ID NO: 486422 - DNA, 25 bp, Homo sapien
agcgctctgcacattgatgggtcaa

SEQ ID NO: 486423 - DNA, 25 bp, Homo sapien
atgggtcaatggacgagctcgtgct

SEQ ID NO: 486424 - DNA, 25 bp, Homo sapien
tcaatggacgagctcgtgctgcagc

SEQ ID NO: 486425 - DNA, 25 bp, Homo sapien
accgggctgggcacatagcacataa

SEQ ID NO: 486426 - DNA, 25 bp, Homo sapien
atgggggcgctcacaatttagctgg

SEQ ID NO: 486427 - DNA, 25 bp, Homo sapien
acaagaccggcgctcatagaacgct

SEQ ID NO: 486428 - DNA, 25 bp, Homo sapien
gaccggcgctcatagaacgctggag

SEQ ID NO: 486429 - DNA, 25 bp, Homo sapien
aacgctggagctggaagcaacgaca

SEQ ID NO: 486430 - DNA, 25 bp, Homo sapien
agctggaagcaacgacaacagcgac

SEQ ID NO: 486431 - DNA, 25 bp, Homo sapien
gacatggtggcaaccctactggcgt

SEQ ID NO: 486432 - DNA, 25 bp, Homo sapien
acatggtggcaaccctactggcgtg

SEQ ID NO: 486433 - DNA, 25 bp, Homo sapien
ggccacagcgctgatgtgtgccagt

SEQ ID NO: 486434 - DNA, 25 bp, Homo sapien
gccacagcgctgatgtgtgccagtg

SEQ ID NO: 486435 - DNA, 25 bp, Homo sapien
ccacagcgctgatgtgtgccagtga

SEQ ID NO: 486436 - DNA, 25 bp, Homo sapien
acagcgctgatgtgtgccagtgagt

SEQ ID NO: 486437 - DNA, 25 bp, Homo sapien
cagcgctgatgtgtgccagtgagta

SEQ ID NO: 486438 - DNA, 25 bp, Homo sapien
agcgctgatgtgtgccagtgagtat

SEQ ID NO: 486439 - DNA, 25 bp, Homo sapien
ctgatgtgtgccagtgagtatgggc

SEQ ID NO: 486440 - DNA, 25 bp, Homo sapien
atgcccacctgagctcgggccagcc

SEQ ID NO: 486441 - DNA, 25 bp, Homo sapien
ggccagcccgacacccagagcgagt

SEQ ID NO: 486442 - DNA, 25 bp, Homo sapien
gagtgtggcggcttggccctttccc

SEQ ID NO: 486443 - DNA, 25 bp, Homo sapien
tcccctgctggaccaaaacttgggt

SEQ ID NO: 486444 - DNA, 25 bp, Homo sapien
ttatattcctacctcggccgaagag

SEQ ID NO: 486445 - DNA, 25 bp, Homo sapien
ggccgaagaggcgaaatgtgtttac

SEQ ID NO: 486446 - DNA, 25 bp, Homo sapien
ggaaagaaatgcctccttaacacac

SEQ ID NO: 486447 - DNA, 25 bp, Homo sapien
atgcctccttaacacacaggtgatg

SEQ ID NO: 486448 - DNA, 25 bp, Homo sapien
ttaggatgaaatgaggagccccacg

SEQ ID NO: 486449 - DNA, 25 bp, Homo sapien
cagctgagggcgacgggattcccat

SEQ ID NO: 486450 - DNA, 25 bp, Homo sapien
gagggcgacgggattcccatccttt

SEQ ID NO: 486451 - DNA, 25 bp, Homo sapien
cccatccttttaagagcacttttca

SEQ ID NO: 486452 - DNA, 25 bp, Homo sapien
ttaagagcacttttcagccacttca

SEQ ID NO: 486453 - DNA, 25 bp, Homo sapien
agatggccccccagcactggttggg

SEQ ID NO: 486454 - DNA, 25 bp, Homo sapien
acaagggccaaattggtgaccacca

SEQ ID NO: 486455 - DNA, 25 bp, Homo sapien
attggtgaccaccagtcatgcctag

SEQ ID NO: 486456 - DNA, 25 bp, Homo sapien
gaccaccagtcatgcctaggacctg

SEQ ID NO: 486457 - DNA, 25 bp, Homo sapien
aaaagccgggcaacctctggctaca

SEQ ID NO: 486458 - DNA, 25 bp, Homo sapien
agccgggcaacctctggctacaggg

SEQ ID NO: 486459 - DNA, 25 bp, Homo sapien
cattgggtgccctcccagttgagag

SEQ ID NO: 486460 - DNA, 25 bp, Homo sapien
tgtttcgccttgtccgtcagtgcca

SEQ ID NO: 486461 - DNA, 25 bp, Homo sapien
tggcgaggtgagtcctccagagctt

SEQ ID NO: 486462 - DNA, 25 bp, Homo sapien
cacgctagctgtcccttttctgatt

SEQ ID NO: 486463 - DNA, 25 bp, Homo sapien
cgctagctgtcccttttctgattct

SEQ ID NO: 486464 - DNA, 25 bp, Homo sapien
tgtctaggcaatgttggccctgttt

SEQ ID NO: 486465 - DNA, 25 bp, Homo sapien
acacttctaaggcatgcatcatggc

SEQ ID NO: 486466 - DNA, 25 bp, Homo sapien
gcatcatggcacttgcgaagacatt

SEQ ID NO: 486467 - DNA, 25 bp, Homo sapien
gaagacattggcatcctctttgctg

SEQ ID NO: 486468 - DNA, 25 bp, Homo sapien
gttgagaccatacacctgtctagca

SEQ ID NO: 486469 - DNA, 25 bp, Homo sapien
tagcatctcgccactggtggaaggt

SEQ ID NO: 486470 - DNA, 25 bp, Homo sapien
ggtctgtgtagcttgattgtacttc

SEQ ID NO: 486471 - DNA, 25 bp, Homo sapien
gattgtacttcaaccctttaggaat

SEQ ID NO: 486472 - DNA, 25 bp, Homo sapien
ggaatggcacagtttatcacgacct

SEQ ID NO: 486473 - DNA, 25 bp, Homo sapien
tgcccaccactctgaatgtgttgtt

SEQ ID NO: 486474 - DNA, 25 bp, Homo sapien
ctgaatgtgttgttgcctgtatggt

SEQ ID NO: 486475 - DNA, 25 bp, Homo sapien
tatctgacctgaagcctggacactg

SEQ ID NO: 486476 - DNA, 25 bp, Homo sapien
gaagcctggacactgggcccttcag

SEQ ID NO: 486477 - DNA, 25 bp, Homo sapien
tgggcccttcaggtcgcaagaaaaa

SEQ ID NO: 486478 - DNA, 25 bp, Homo sapien
gttccctcctaaattctattaggat

SEQ ID NO: 486479 - DNA, 25 bp, Homo sapien
acagtaagaagctctgggttgctcc

SEQ ID NO: 486480 - DNA, 25 bp, Homo sapien
gggttgctccttgggcttctcaaaa

SEQ ID NO: 486481 - DNA, 25 bp, Homo sapien
tacgaagtattccagccgtgttgct

SEQ ID NO: 486482 - DNA, 25 bp, Homo sapien
agccgtgttgctgatctagttggat

SEQ ID NO: 486483 - DNA, 25 bp, Homo sapien
ctagttggatagttgtacctcaaaa

SEQ ID NO: 486484 - DNA, 25 bp, Homo sapien
gtaggtgagaactggcttcctcatt

SEQ ID NO: 486485 - DNA, 25 bp, Homo sapien
taatgacataagagctcacttacgt

SEQ ID NO: 486486 - DNA, 25 bp, Homo sapien
accgtgtcacagctgtgtccccttg

SEQ ID NO: 486487 - DNA, 25 bp, Homo sapien
gtgtcacagctgtgtccccttgtca

SEQ ID NO: 486488 - DNA, 25 bp, Homo sapien
agctgtgtccccttgtcaggaagac

SEQ ID NO: 486489 - DNA, 25 bp, Homo sapien
gaggcgtggccaccaccagatgctc

SEQ ID NO: 486490 - DNA, 25 bp, Homo sapien
accagatgctccctgtctggggcag

SEQ ID NO: 486491 - DNA, 25 bp, Homo sapien
gcaggcagggccgtttactcaccag

SEQ ID NO: 486492 - DNA, 25 bp, Homo sapien
aggcagggccgtttactcaccaggc

SEQ ID NO: 486493 - DNA, 25 bp, Homo sapien
cgtcccggcgcctccgttagggctg

SEQ ID NO: 486494 - DNA, 25 bp, Homo sapien
attttcaattccacattcctgatta

SEQ ID NO: 486495 - DNA, 25 bp, Homo sapien
tcaattccacattcctgattaaaag

SEQ ID NO: 486496 - DNA, 25 bp, Homo sapien
ttccacattcctgattaaaaggtct

SEQ ID NO: 486497 - DNA, 25 bp, Homo sapien
tatttccctcacaatacttgccaca

SEQ ID NO: 486498 - DNA, 25 bp, Homo sapien
tacttgccacattacttggcatagg

SEQ ID NO: 486499 - DNA, 25 bp, Homo sapien
gcctttggatcagggcttgactcat

SEQ ID NO: 486500 - DNA, 25 bp, Homo sapien
tcagggcttgactcatgatagacaa

SEQ ID NO: 486501 - DNA, 25 bp, Homo sapien
tagacaaagtatatgcctgctggat

SEQ ID NO: 486502 - DNA, 25 bp, Homo sapien
tgcctgctggatggaagaatctctt

SEQ ID NO: 486503 - DNA, 25 bp, Homo sapien
aatctcttgggcgagcaccattttt

SEQ ID NO: 486504 - DNA, 25 bp, Homo sapien
atcttcagctttgggtaggaggaat

SEQ ID NO: 486505 - DNA, 25 bp, Homo sapien
tacttcatcttttctggagtttgaa

SEQ ID NO: 486506 - DNA, 25 bp, Homo sapien
ggagtttgaagttgtgactctcctg

SEQ ID NO: 486507 - DNA, 25 bp, Homo sapien
gtgactctcctgctaccaattaaat

SEQ ID NO: 486508 - DNA, 25 bp, Homo sapien
aaaccttgttatatctgagaggctt

SEQ ID NO: 486509 - DNA, 25 bp, Homo sapien
tttaaaagcctattaactgtttcag

SEQ ID NO: 486510 - DNA, 25 bp, Homo sapien
cgcggtacagacgtggtctctgtga

SEQ ID NO: 486511 - DNA, 25 bp, Homo sapien
ggtctctgtgagacttccacctgac

SEQ ID NO: 486512 - DNA, 25 bp, Homo sapien
tccacctgaccccagttttaagtgg

SEQ ID NO: 486513 - DNA, 25 bp, Homo sapien
ttaagtggtacgaatgttgtgcatt

SEQ ID NO: 486514 - DNA, 25 bp, Homo sapien
tttaatgttaaaggacagtctgcaa

SEQ ID NO: 486515 - DNA, 25 bp, Homo sapien
agacctggctgctctattgtaagct

SEQ ID NO: 486516 - DNA, 25 bp, Homo sapien
ctctattgtaagctttggaaacaca

SEQ ID NO: 486517 - DNA, 25 bp, Homo sapien
ggaaacacaatttatgcaacagatg

SEQ ID NO: 486518 - DNA, 25 bp, Homo sapien
gcaacagatgtccagatatgattct

SEQ ID NO: 486519 - DNA, 25 bp, Homo sapien
aacctttaagtcctacagcactttg

SEQ ID NO: 486520 - DNA, 25 bp, Homo sapien
tttaagtcctacagcactttgccct

SEQ ID NO: 486521 - DNA, 25 bp, Homo sapien
taagtcctacagcactttgccctgt

SEQ ID NO: 486522 - DNA, 25 bp, Homo sapien
agtcctacagcactttgccctgttt

SEQ ID NO: 486523 - DNA, 25 bp, Homo sapien
ctacagcactttgccctgttttcaa

SEQ ID NO: 486524 - DNA, 25 bp, Homo sapien
agcactttgccctgttttcaacatt

SEQ ID NO: 486525 - DNA, 25 bp, Homo sapien
cactttgccctgttttcaacattgg

SEQ ID NO: 486526 - DNA, 25 bp, Homo sapien
actttgccctgttttcaacattgga

SEQ ID NO: 486527 - DNA, 25 bp, Homo sapien
actgcatagcagataccattgaatt

SEQ ID NO: 486528 - DNA, 25 bp, Homo sapien
gcagataccattgaattgctgtaaa

SEQ ID NO: 486529 - DNA, 25 bp, Homo sapien
gataccattgaattgctgtaaaaat

SEQ ID NO: 486530 - DNA, 25 bp, Homo sapien
attactgctgagtcctgggtcacca

SEQ ID NO: 486531 - DNA, 25 bp, Homo sapien
aggcacacccaaaacacaagtctgt

SEQ ID NO: 486532 - DNA, 25 bp, Homo sapien
gtctgtggctagaacctgatgtggt

SEQ ID NO: 486533 - DNA, 25 bp, Homo sapien
gaaacactgaagatgtcctgaggag

SEQ ID NO: 486534 - DNA, 25 bp, Homo sapien
ctggacatatactgggcttcacact

SEQ ID NO: 486535 - DNA, 25 bp, Homo sapien
ggcttcacacttatcttatggcttg

SEQ ID NO: 486536 - DNA, 25 bp, Homo sapien
tatcttatggcttggcagaatcttt

SEQ ID NO: 486537 - DNA, 25 bp, Homo sapien
gtgtgggatctctgaaggccctatt

SEQ ID NO: 486538 - DNA, 25 bp, Homo sapien
tttcttcgttactttgctgcttcat

SEQ ID NO: 486539 - DNA, 25 bp, Homo sapien
ttgctgcttcatgtgtactttccta

SEQ ID NO: 486540 - DNA, 25 bp, Homo sapien
tgtactttcctaccccaagaggaag

SEQ ID NO: 486541 - DNA, 25 bp, Homo sapien
tcgaacgtaaacaacaaggcctaga

SEQ ID NO: 486542 - DNA, 25 bp, Homo sapien
gttttccaagagcttcatctccatg

SEQ ID NO: 486543 - DNA, 25 bp, Homo sapien
tcatctccatggaagtgcctgtcat

SEQ ID NO: 486544 - DNA, 25 bp, Homo sapien
ggaagtgcctgtcatggtagtaaat

SEQ ID NO: 486545 - DNA, 25 bp, Homo sapien
gcttgctaagcgagtgagtaggtta

SEQ ID NO: 486546 - DNA, 25 bp, Homo sapien
gttaagcacaagtacaaccatagaa

SEQ ID NO: 486547 - DNA, 25 bp, Homo sapien
gattactattaagtctccagagaaa

SEQ ID NO: 486548 - DNA, 25 bp, Homo sapien
aaatcgaagaagtcctgtcacctga

SEQ ID NO: 486549 - DNA, 25 bp, Homo sapien
agaagtcctgtcacctgaaggctcc

SEQ ID NO: 486550 - DNA, 25 bp, Homo sapien
gaaggctccccttcaaaatcgccat

SEQ ID NO: 486551 - DNA, 25 bp, Homo sapien
gaagaaattccgcactccttctttt

SEQ ID NO: 486552 - DNA, 25 bp, Homo sapien
tcccctccctcgcaggattgaggtt

SEQ ID NO: 486553 - DNA, 25 bp, Homo sapien
tcgcaggattgaggttaggactaaa

SEQ ID NO: 486554 - DNA, 25 bp, Homo sapien
tgggacgcggcttacctcccggctg

SEQ ID NO: 486555 - DNA, 25 bp, Homo sapien
tgtagcgcgcctgcatgccgaatac

SEQ ID NO: 486556 - DNA, 25 bp, Homo sapien
ctgcatgccgaataccgacagggtg

SEQ ID NO: 486557 - DNA, 25 bp, Homo sapien
tgccgaataccgacagggtgccggt

SEQ ID NO: 486558 - DNA, 25 bp, Homo sapien
cccggctgtcgctgctgtgtgtgtt

SEQ ID NO: 486559 - DNA, 25 bp, Homo sapien
gctgtgtgtgttgcccgcgccagtc

SEQ ID NO: 486560 - DNA, 25 bp, Homo sapien
gcgccagtcacgtccctaatgggac

SEQ ID NO: 486561 - DNA, 25 bp, Homo sapien
atgggaccctccgtttcggcgtctg

SEQ ID NO: 486562 - DNA, 25 bp, Homo sapien
tccgtttcggcgtctgtaaggcgag

SEQ ID NO: 486563 - DNA, 25 bp, Homo sapien
gcaagcaacccccagggcacgagaa

SEQ ID NO: 486564 - DNA, 25 bp, Homo sapien
ccccagggcacgagaagagctcttg

SEQ ID NO: 486565 - DNA, 25 bp, Homo sapien
ccagggcacgagaagagctcttgct

SEQ ID NO: 486566 - DNA, 25 bp, Homo sapien
agggcacgagaagagctcttgctgt

SEQ ID NO: 486567 - DNA, 25 bp, Homo sapien
ggcacgagaagagctcttgctgtct

SEQ ID NO: 486568 - DNA, 25 bp, Homo sapien
cccagctgcatcaagtggaggcgga

SEQ ID NO: 486569 - DNA, 25 bp, Homo sapien
ggaggagggtggcaccatgggcccg

SEQ ID NO: 486570 - DNA, 25 bp, Homo sapien
catgcccgggggatgaagacactgc

SEQ ID NO: 486571 - DNA, 25 bp, Homo sapien
ttcccaagcccttagggaccgcaga

SEQ ID NO: 486572 - DNA, 25 bp, Homo sapien
caagcccttagggaccgcagaggac

SEQ ID NO: 486573 - DNA, 25 bp, Homo sapien
agcccttagggaccgcagaggactt

SEQ ID NO: 486574 - DNA, 25 bp, Homo sapien
actctaatggttacttgctcgtgcg

SEQ ID NO: 486575 - DNA, 25 bp, Homo sapien
ataatttgcttcatttccttgctat

SEQ ID NO: 486576 - DNA, 25 bp, Homo sapien
ttcatttccttgctatttgatacat

SEQ ID NO: 486577 - DNA, 25 bp, Homo sapien
tgatacatagtgtgcatttctctgt

SEQ ID NO: 486578 - DNA, 25 bp, Homo sapien
tctctgtcactgtaactattgtaat

SEQ ID NO: 486579 - DNA, 25 bp, Homo sapien
aattttcatcttactgcacaatcaa

SEQ ID NO: 486580 - DNA, 25 bp, Homo sapien
ataggaatgaactccagaggctggg

SEQ ID NO: 486581 - DNA, 25 bp, Homo sapien
tcaggcctggtgctcagtcgtacga

SEQ ID NO: 486582 - DNA, 25 bp, Homo sapien
tggtgctcagtcgtacgacctgtac

SEQ ID NO: 486583 - DNA, 25 bp, Homo sapien
tacgacctgtacctctcaacttttg

SEQ ID NO: 486584 - DNA, 25 bp, Homo sapien
acctctcaacttttgccctatctgt

SEQ ID NO: 486585 - DNA, 25 bp, Homo sapien
gaaatccatctatctacagcctaag

SEQ ID NO: 486586 - DNA, 25 bp, Homo sapien
atctacagcctaagttacacataag

SEQ ID NO: 486587 - DNA, 25 bp, Homo sapien
gttacacataagtttcagaaagtct

SEQ ID NO: 486588 - DNA, 25 bp, Homo sapien
tctttttacaagttccttcctcagt

SEQ ID NO: 486589 - DNA, 25 bp, Homo sapien
tttacaagttccttcctcagtttca

SEQ ID NO: 486590 - DNA, 25 bp, Homo sapien
ttcctcagtttcagttctttccagt

SEQ ID NO: 486591 - DNA, 25 bp, Homo sapien
gttctttccagtgttttgtagctca

SEQ ID NO: 486592 - DNA, 25 bp, Homo sapien
tagctcactgtcactcactgaatag

SEQ ID NO: 486593 - DNA, 25 bp, Homo sapien
agagaaacgtgtgccctatacttcc

SEQ ID NO: 486594 - DNA, 25 bp, Homo sapien
gccctatacttcctgtgacaatcat

SEQ ID NO: 486595 - DNA, 25 bp, Homo sapien
gtgacaatcattttgctgacagaat

SEQ ID NO: 486596 - DNA, 25 bp, Homo sapien
gtgtgttgtcaatgcaagtcaatca

SEQ ID NO: 486597 - DNA, 25 bp, Homo sapien
gcaagtcaatcattaaccaacaata

SEQ ID NO: 486598 - DNA, 25 bp, Homo sapien
agaactttatatttgctgtaatcat

SEQ ID NO: 486599 - DNA, 25 bp, Homo sapien
tagtccttcctcctagtttgtagat

SEQ ID NO: 486600 - DNA, 25 bp, Homo sapien
ttcctcctagtttgtagatttgcaa

SEQ ID NO: 486601 - DNA, 25 bp, Homo sapien
ttatctgcagtaatctgggcttctt

SEQ ID NO: 486602 - DNA, 25 bp, Homo sapien
tctgggcttcttattaccggatata

SEQ ID NO: 486603 - DNA, 25 bp, Homo sapien
atatttgcattttacctccaggcca

SEQ ID NO: 486604 - DNA, 25 bp, Homo sapien
cctccaggccatgttagttcttaga

SEQ ID NO: 486605 - DNA, 25 bp, Homo sapien
gttcttagaagattattttcctcat

SEQ ID NO: 486606 - DNA, 25 bp, Homo sapien
attttcctcatgaaccctgttttgt

SEQ ID NO: 486607 - DNA, 25 bp, Homo sapien
tttgaagcaactgcactgacattca

SEQ ID NO: 486608 - DNA, 25 bp, Homo sapien
gcaactgcactgacattcatttgag

SEQ ID NO: 486609 - DNA, 25 bp, Homo sapien
gagttttctctcattatcagattct

SEQ ID NO: 486610 - DNA, 25 bp, Homo sapien
ttatcagattctgttccaaacaagt

SEQ ID NO: 486611 - DNA, 25 bp, Homo sapien
tctgttccaaacaagtattctgtag

SEQ ID NO: 486612 - DNA, 25 bp, Homo sapien
agtattctgtagatccaaatggatt

SEQ ID NO: 486613 - DNA, 25 bp, Homo sapien
agtgtgctacagacttcttattata

SEQ ID NO: 486614 - DNA, 25 bp, Homo sapien
gacttcttattatagaacagcattc

SEQ ID NO: 486615 - DNA, 25 bp, Homo sapien
aacagcattctattctacatcaaaa

SEQ ID NO: 486616 - DNA, 25 bp, Homo sapien
tgtaagttagttttggttaccatct

SEQ ID NO: 486617 - DNA, 25 bp, Homo sapien
ctaagtcagttaactgtacttctaa

SEQ ID NO: 486618 - DNA, 25 bp, Homo sapien
tttaacattcagagtatgacacagc

SEQ ID NO: 486619 - DNA, 25 bp, Homo sapien
atgacacagccgcatccttgccagg

SEQ ID NO: 486620 - DNA, 25 bp, Homo sapien
gcatccttgccagggccggagggag

SEQ ID NO: 486621 - DNA, 25 bp, Homo sapien
gtggatggacttataggtgttgctt

SEQ ID NO: 486622 - DNA, 25 bp, Homo sapien
ggatggacttataggtgttgcttgt

SEQ ID NO: 486623 - DNA, 25 bp, Homo sapien
gggtgacttgcttctgccaacaaga

SEQ ID NO: 486624 - DNA, 25 bp, Homo sapien
aagattttcacagacacggcacaag

SEQ ID NO: 486625 - DNA, 25 bp, Homo sapien
cttgattttccccacgagatatgcg

SEQ ID NO: 486626 - DNA, 25 bp, Homo sapien
gattttccccacgagatatgcgtgc

SEQ ID NO: 486627 - DNA, 25 bp, Homo sapien
acgagatatgcgtgccccagggaac

SEQ ID NO: 486628 - DNA, 25 bp, Homo sapien
ttcccaccctcagcctagagtcaag

SEQ ID NO: 486629 - DNA, 25 bp, Homo sapien
tgtacggggacatgagggcttccaa

SEQ ID NO: 486630 - DNA, 25 bp, Homo sapien
tacggggacatgagggcttccaatg

SEQ ID NO: 486631 - DNA, 25 bp, Homo sapien
acggggacatgagggcttccaatgt

SEQ ID NO: 486632 - DNA, 25 bp, Homo sapien
ggacatgagggcttccaatgtgctg

SEQ ID NO: 486633 - DNA, 25 bp, Homo sapien
gacatgagggcttccaatgtgctgc

SEQ ID NO: 486634 - DNA, 25 bp, Homo sapien
acatgagggcttccaatgtgctgcc

SEQ ID NO: 486635 - DNA, 25 bp, Homo sapien
catgagggcttccaatgtgctgccc

SEQ ID NO: 486636 - DNA, 25 bp, Homo sapien
atgagggcttccaatgtgctgcccc

SEQ ID NO: 486637 - DNA, 25 bp, Homo sapien
tgagggcttccaatgtgctgccccc

SEQ ID NO: 486638 - DNA, 25 bp, Homo sapien
gagggcttccaatgtgctgcccccc

SEQ ID NO: 486639 - DNA, 25 bp, Homo sapien
agggcttccaatgtgctgcccccct

SEQ ID NO: 486640 - DNA, 25 bp, Homo sapien
tagaaaccatttattggccggacgc

SEQ ID NO: 486641 - DNA, 25 bp, Homo sapien
agaaaccatttattggccggacgcg

SEQ ID NO: 486642 - DNA, 25 bp, Homo sapien
gaaaccatttattggccggacgcgg

SEQ ID NO: 486643 - DNA, 25 bp, Homo sapien
aaccatttattggccggacgcggtg

SEQ ID NO: 486644 - DNA, 25 bp, Homo sapien
accatttattggccggacgcggtgg

SEQ ID NO: 486645 - DNA, 25 bp, Homo sapien
ccatttattggccggacgcggtggc

SEQ ID NO: 486646 - DNA, 25 bp, Homo sapien
catttattggccggacgcggtggct

SEQ ID NO: 486647 - DNA, 25 bp, Homo sapien
atttattggccggacgcggtggctc

SEQ ID NO: 486648 - DNA, 25 bp, Homo sapien
cggctcacgacgtcaggagatccag

SEQ ID NO: 486649 - DNA, 25 bp, Homo sapien
ggctcacgacgtcaggagatccaga

SEQ ID NO: 486650 - DNA, 25 bp, Homo sapien
agattgcgccactgtactcctgggc

SEQ ID NO: 486651 - DNA, 25 bp, Homo sapien
tccttttgggtttatgggtgccctg

SEQ ID NO: 486652 - DNA, 25 bp, Homo sapien
gggtgccctgatactccagcagaga

SEQ ID NO: 486653 - DNA, 25 bp, Homo sapien
aaaaagtctgcagtaatgcacgtat

SEQ ID NO: 486654 - DNA, 25 bp, Homo sapien
gatactccagcagagatcagaaggc

SEQ ID NO: 486655 - DNA, 25 bp, Homo sapien
gaaggctacagatccattctatcca

SEQ ID NO: 486656 - DNA, 25 bp, Homo sapien
gatccattctatccatccgttatgt

SEQ ID NO: 486657 - DNA, 25 bp, Homo sapien
ttgccatcccagcttggagtgtctt

SEQ ID NO: 486658 - DNA, 25 bp, Homo sapien
tcccagcttggagtgtctttacaaa

SEQ ID NO: 486659 - DNA, 25 bp, Homo sapien
taacagttgtgttctttgctctcgt

SEQ ID NO: 486660 - DNA, 25 bp, Homo sapien
ttctttgctctcgttttggatgcat

SEQ ID NO: 486661 - DNA, 25 bp, Homo sapien
ctcgttttggatgcatagactgaaa

SEQ ID NO: 486662 - DNA, 25 bp, Homo sapien
tattctgtatttatgattctctgag

SEQ ID NO: 486663 - DNA, 25 bp, Homo sapien
tctgtatttatgattctctgagaaa

SEQ ID NO: 486664 - DNA, 25 bp, Homo sapien
tatgattctctgagaaatgcttttg

SEQ ID NO: 486665 - DNA, 25 bp, Homo sapien
aagtcttaggtttgacattgcagta

SEQ ID NO: 486666 - DNA, 25 bp, Homo sapien
ggtttgacattgcagtagttgacat

SEQ ID NO: 486667 - DNA, 25 bp, Homo sapien
attgcagtagttgacatacacggta

SEQ ID NO: 486668 - DNA, 25 bp, Homo sapien
gtagttgacatacacggtaaaggat

SEQ ID NO: 486669 - DNA, 25 bp, Homo sapien
gtaaaggataacctagtgacaaatc

SEQ ID NO: 486670 - DNA, 25 bp, Homo sapien
gtgacaaatcactgaagatgcttcc

SEQ ID NO: 486671 - DNA, 25 bp, Homo sapien
aatcactgaagatgcttcctttgtt

SEQ ID NO: 486672 - DNA, 25 bp, Homo sapien
acaggattggctgttttccaagaac

SEQ ID NO: 486673 - DNA, 25 bp, Homo sapien
aatagaaattatctcactacttaaa

SEQ ID NO: 486674 - DNA, 25 bp, Homo sapien
catttttttcacttcatatgaaaga

SEQ ID NO: 486675 - DNA, 25 bp, Homo sapien
tttattctgtagtatcagcgaaatc

SEQ ID NO: 486676 - DNA, 25 bp, Homo sapien
tgtagtatcagcgaaatcagtcatg

SEQ ID NO: 486677 - DNA, 25 bp, Homo sapien
tagtatcagcgaaatcagtcatgtt

SEQ ID NO: 486678 - DNA, 25 bp, Homo sapien
gtatcagcgaaatcagtcatgttta

SEQ ID NO: 486679 - DNA, 25 bp, Homo sapien
atcagcgaaatcagtcatgtttata

SEQ ID NO: 486680 - DNA, 25 bp, Homo sapien
cagcgaaatcagtcatgtttatacc

SEQ ID NO: 486681 - DNA, 25 bp, Homo sapien
gcgaaatcagtcatgtttatacctt

SEQ ID NO: 486682 - DNA, 25 bp, Homo sapien
gaaatcagtcatgtttataccttga

SEQ ID NO: 486683 - DNA, 25 bp, Homo sapien
atcagtcatgtttataccttgaata

SEQ ID NO: 486684 - DNA, 25 bp, Homo sapien
tggcgtctcacatctcacctgttga

SEQ ID NO: 486685 - DNA, 25 bp, Homo sapien
atctcacctgttgatcccttagctt

SEQ ID NO: 486686 - DNA, 25 bp, Homo sapien
gttgatcccttagctttcttgccaa

SEQ ID NO: 486687 - DNA, 25 bp, Homo sapien
tttcttgccaaggatctagtgcccc

SEQ ID NO: 486688 - DNA, 25 bp, Homo sapien
ggccactgtcagttaacacatatgc

SEQ ID NO: 486689 - DNA, 25 bp, Homo sapien
atttgtgatgtctaccttggtggct

SEQ ID NO: 486690 - DNA, 25 bp, Homo sapien
gtctaccttggtggctccactatga

SEQ ID NO: 486691 - DNA, 25 bp, Homo sapien
aacccatgagcccagagaaattcac

SEQ ID NO: 486692 - DNA, 25 bp, Homo sapien
gagcccagagaaattcaccgtgata

SEQ ID NO: 486693 - DNA, 25 bp, Homo sapien
tcaccgtgataatggaatcctggca

SEQ ID NO: 486694 - DNA, 25 bp, Homo sapien
ccttatctcatgaggcaggaggtgg

SEQ ID NO: 486695 - DNA, 25 bp, Homo sapien
gactgtcgggaagttgacccggatt

SEQ ID NO: 486696 - DNA, 25 bp, Homo sapien
agttgacccggattggcaagaaaca

SEQ ID NO: 486697 - DNA, 25 bp, Homo sapien
gtgtcttggaggtggtcccccagat

SEQ ID NO: 486698 - DNA, 25 bp, Homo sapien
aggacagggcctgatttgagcctcc

SEQ ID NO: 486699 - DNA, 25 bp, Homo sapien
ttgagcctcctctctgaagatgatt

SEQ ID NO: 486700 - DNA, 25 bp, Homo sapien
ctgaagatgatttggccgagcggaa

SEQ ID NO: 486701 - DNA, 25 bp, Homo sapien
aaagttgctggtgacatttcttgcc

SEQ ID NO: 486702 - DNA, 25 bp, Homo sapien
tcttgccaattctaacactgtctag

SEQ ID NO: 486703 - DNA, 25 bp, Homo sapien
taacactgtctagggaagagttcct

SEQ ID NO: 486704 - DNA, 25 bp, Homo sapien
aagagttcctagtctattgtgttca

SEQ ID NO: 486705 - DNA, 25 bp, Homo sapien
gtctattgtgttcaaacagagtcaa

SEQ ID NO: 486706 - DNA, 25 bp, Homo sapien
attagttcatgccgagactagaaaa

SEQ ID NO: 486707 - DNA, 25 bp, Homo sapien
ttagttcatgccgagactagaaaac

SEQ ID NO: 486708 - DNA, 25 bp, Homo sapien
tagttcatgccgagactagaaaact

SEQ ID NO: 486709 - DNA, 25 bp, Homo sapien
agttcatgccgagactagaaaactg

SEQ ID NO: 486710 - DNA, 25 bp, Homo sapien
gttcatgccgagactagaaaactga

SEQ ID NO: 486711 - DNA, 25 bp, Homo sapien
ttcatgccgagactagaaaactgaa

SEQ ID NO: 486712 - DNA, 25 bp, Homo sapien
tcatgccgagactagaaaactgaac

SEQ ID NO: 486713 - DNA, 25 bp, Homo sapien
ctagaaaactgaaccctagtactgt

SEQ ID NO: 486714 - DNA, 25 bp, Homo sapien
tagaaaactgaaccctagtactgtt

SEQ ID NO: 486715 - DNA, 25 bp, Homo sapien
cccttcccagtgctgttagggattt

SEQ ID NO: 486716 - DNA, 25 bp, Homo sapien
agtgctgttagggatttcttccctt

SEQ ID NO: 486717 - DNA, 25 bp, Homo sapien
cttccctttctgatacagatcttaa

SEQ ID NO: 486718 - DNA, 25 bp, Homo sapien
gatacagatcttaatctgctgtcaa

SEQ ID NO: 486719 - DNA, 25 bp, Homo sapien
gtttcttacacctaagcaaacatta

SEQ ID NO: 486720 - DNA, 25 bp, Homo sapien
gaagacaaaaccgtcactgctcctt

SEQ ID NO: 486721 - DNA, 25 bp, Homo sapien
actgctcctttcatcaactcttgta

SEQ ID NO: 486722 - DNA, 25 bp, Homo sapien
atcaactcttgtagcctccattata

SEQ ID NO: 486723 - DNA, 25 bp, Homo sapien
gtagcctccattatactttccacaa

SEQ ID NO: 486724 - DNA, 25 bp, Homo sapien
aagtctctgaccttgtatgtcatcc

SEQ ID NO: 486725 - DNA, 25 bp, Homo sapien
tatgtcatccttcaggcctcaacca

SEQ ID NO: 486726 - DNA, 25 bp, Homo sapien
aaagcattctctgggaggttcagcc

SEQ ID NO: 486727 - DNA, 25 bp, Homo sapien
aggttcagcctccttgtgtgtactg

SEQ ID NO: 486728 - DNA, 25 bp, Homo sapien
gtgtgtactgtactgtgcagacatg

SEQ ID NO: 486729 - DNA, 25 bp, Homo sapien
ataaacccgtttactgtgtgcgtgt

SEQ ID NO: 486730 - DNA, 25 bp, Homo sapien
gtgcgtgtaaatagcctggtcatca

SEQ ID NO: 486731 - DNA, 25 bp, Homo sapien
ggtcatcaggccattttcagccaat

SEQ ID NO: 486732 - DNA, 25 bp, Homo sapien
ttcagccaatagtcacatccagtgc

SEQ ID NO: 486733 - DNA, 25 bp, Homo sapien
tagtcacatccagtgcaattttgca

SEQ ID NO: 486734 - DNA, 25 bp, Homo sapien
tgcaattttgcaccgaacacttaag

SEQ ID NO: 486735 - DNA, 25 bp, Homo sapien
gtgtggtttgtaagtacgatctgta

SEQ ID NO: 486736 - DNA, 25 bp, Homo sapien
gatgaattcccatgtatacctgtgt

SEQ ID NO: 486737 - DNA, 25 bp, Homo sapien
catttcacatttaccagcaagtcag

SEQ ID NO: 486738 - DNA, 25 bp, Homo sapien
aatagtgcttatttacatagtcaat

SEQ ID NO: 486739 - DNA, 25 bp, Homo sapien
aataatatcttcgatctgcccaata

SEQ ID NO: 486740 - DNA, 25 bp, Homo sapien
ttaggataagtttttgtaggtcaga

SEQ ID NO: 486741 - DNA, 25 bp, Homo sapien
tcgatctgcccaatatttaatgtat

SEQ ID NO: 486742 - DNA, 25 bp, Homo sapien
ccgctccattatgtaaacattaaga

SEQ ID NO: 486743 - DNA, 25 bp, Homo sapien
agatatgcctatgtttctttaacta

SEQ ID NO: 486744 - DNA, 25 bp, Homo sapien
gtttctttaactatacagcctcttt

SEQ ID NO: 486745 - DNA, 25 bp, Homo sapien
taactatacagcctctttacaataa

SEQ ID NO: 486746 - DNA, 25 bp, Homo sapien
gacaaaacatatccatgagtgtgaa

SEQ ID NO: 486747 - DNA, 25 bp, Homo sapien
aaagctgtgttgacgaatagattac

SEQ ID NO: 486748 - DNA, 25 bp, Homo sapien
tccgtgcacatcttataggcttcag

SEQ ID NO: 486749 - DNA, 25 bp, Homo sapien
ataggcttcagactgctggtacgcc

SEQ ID NO: 486750 - DNA, 25 bp, Homo sapien
agctccttcatgtactgctgcttct

SEQ ID NO: 486751 - DNA, 25 bp, Homo sapien
atccaggtaccgctgcttttccgtt

SEQ ID NO: 486752 - DNA, 25 bp, Homo sapien
tgcttttccgttggctgcagcttgc

SEQ ID NO: 486753 - DNA, 25 bp, Homo sapien
actcggcgcccagcatcttggtgat

SEQ ID NO: 486754 - DNA, 25 bp, Homo sapien
cagcatcttggtgatctcgggaaag

SEQ ID NO: 486755 - DNA, 25 bp, Homo sapien
ggagagtgttcatgagcccagagct

SEQ ID NO: 486756 - DNA, 25 bp, Homo sapien
agagctcgagtcttctttcttgatc

SEQ ID NO: 486757 - DNA, 25 bp, Homo sapien
agtcttctttcttgatcttcttctc

SEQ ID NO: 486758 - DNA, 25 bp, Homo sapien
tggatcttctccgtgcacatcttat

SEQ ID NO: 486759 - DNA, 25 bp, Homo sapien
ttaaaacactagtacttcagaatat

SEQ ID NO: 486760 - DNA, 25 bp, Homo sapien
agatacaagtacaccatcttgaaga

SEQ ID NO: 486761 - DNA, 25 bp, Homo sapien
gtttttcagggcaattcaaatgacc

SEQ ID NO: 486762 - DNA, 25 bp, Homo sapien
tttgttctttttgtattccagacag

SEQ ID NO: 486763 - DNA, 25 bp, Homo sapien
gtattccagacagtgtttctgtcat

SEQ ID NO: 486764 - DNA, 25 bp, Homo sapien
gtgtttctgtcattggatctctgat

SEQ ID NO: 486765 - DNA, 25 bp, Homo sapien
ttctgtcattggatctctgattggt

SEQ ID NO: 486766 - DNA, 25 bp, Homo sapien
tgtcattggatctctgattggtagt

SEQ ID NO: 486767 - DNA, 25 bp, Homo sapien
ggatctctgattggtagtgttaata

SEQ ID NO: 486768 - DNA, 25 bp, Homo sapien
tattctttcagtgtgagccagattc

SEQ ID NO: 486769 - DNA, 25 bp, Homo sapien
tcagtgtgagccagattcataaaat

SEQ ID NO: 486770 - DNA, 25 bp, Homo sapien
tgaaagtctcataaaatatcataaa

SEQ ID NO: 486771 - DNA, 25 bp, Homo sapien
aagctgccctgttctctggttgacc

SEQ ID NO: 486772 - DNA, 25 bp, Homo sapien
agctgccctgttctctggttgacca

SEQ ID NO: 486773 - DNA, 25 bp, Homo sapien
gctgccctgttctctggttgaccat

SEQ ID NO: 486774 - DNA, 25 bp, Homo sapien
ctgccctgttctctggttgaccatt

SEQ ID NO: 486775 - DNA, 25 bp, Homo sapien
tgccctgttctctggttgaccattg

SEQ ID NO: 486776 - DNA, 25 bp, Homo sapien
tgttctctggttgaccattggataa

SEQ ID NO: 486777 - DNA, 25 bp, Homo sapien
gttctctggttgaccattggataat

SEQ ID NO: 486778 - DNA, 25 bp, Homo sapien
ttctctggttgaccattggataatt

SEQ ID NO: 486779 - DNA, 25 bp, Homo sapien
tctctggttgaccattggataattt

SEQ ID NO: 486780 - DNA, 25 bp, Homo sapien
ctctggttgaccattggataattta

SEQ ID NO: 486781 - DNA, 25 bp, Homo sapien
cagacacgggcaccggctcagacgt

SEQ ID NO: 486782 - DNA, 25 bp, Homo sapien
ccggctcagacgtgctggcgccatg

SEQ ID NO: 486783 - DNA, 25 bp, Homo sapien
aggggccaacgaccctcgcaagctg

SEQ ID NO: 486784 - DNA, 25 bp, Homo sapien
cgggactgaggccaggtggagggtt

SEQ ID NO: 486785 - DNA, 25 bp, Homo sapien
ggcggtcagtgcatcctctggtttg

SEQ ID NO: 486786 - DNA, 25 bp, Homo sapien
ggtcagtgcatcctctggtttggtc

SEQ ID NO: 486787 - DNA, 25 bp, Homo sapien
agtgcatcctctggtttggtcgctg

SEQ ID NO: 486788 - DNA, 25 bp, Homo sapien
tgcatcctctggtttggtcgctgga

SEQ ID NO: 486789 - DNA, 25 bp, Homo sapien
atcctctggtttggtcgctggatcc

SEQ ID NO: 486790 - DNA, 25 bp, Homo sapien
cctctggtttggtcgctggatcccc

SEQ ID NO: 486791 - DNA, 25 bp, Homo sapien
gggctcaggacgccactagacgcct

SEQ ID NO: 486792 - DNA, 25 bp, Homo sapien
acactcagcttgcaaagccttcttt

SEQ ID NO: 486793 - DNA, 25 bp, Homo sapien
tcagcttgcaaagccttctttagaa

SEQ ID NO: 486794 - DNA, 25 bp, Homo sapien
taaatgtacgtttgtagttattcaa

SEQ ID NO: 486795 - DNA, 25 bp, Homo sapien
atgaatttcaagatggccacctatt

SEQ ID NO: 486796 - DNA, 25 bp, Homo sapien
agatggccacctattttgaaacgca

SEQ ID NO: 486797 - DNA, 25 bp, Homo sapien
tggccacctattttgaaacgcacac

SEQ ID NO: 486798 - DNA, 25 bp, Homo sapien
cctattttgaaacgcacacctttgc

SEQ ID NO: 486799 - DNA, 25 bp, Homo sapien
gcacacctttgccatgaagtctgtt

SEQ ID NO: 486800 - DNA, 25 bp, Homo sapien
tctttagaaaataacccactctgag

SEQ ID NO: 486801 - DNA, 25 bp, Homo sapien
agaaaataacccactctgagtagaa

SEQ ID NO: 486802 - DNA, 25 bp, Homo sapien
acccactctgagtagaagtaatgag

SEQ ID NO: 486803 - DNA, 25 bp, Homo sapien
aattccatcaagaactcatcttcag

SEQ ID NO: 486804 - DNA, 25 bp, Homo sapien
agagcagtgttctcctttggatacc

SEQ ID NO: 486805 - DNA, 25 bp, Homo sapien
gttctcctttggataccaacagttg

SEQ ID NO: 486806 - DNA, 25 bp, Homo sapien
gaacttctgatagagatgtcactgt

SEQ ID NO: 486807 - DNA, 25 bp, Homo sapien
gtcactgttgttcaatttaagagcc

SEQ ID NO: 486808 - DNA, 25 bp, Homo sapien
aataatccaaagactcctccagatg

SEQ ID NO: 486809 - DNA, 25 bp, Homo sapien
actcctccagatgggaaaagtcatt

SEQ ID NO: 486810 - DNA, 25 bp, Homo sapien
ttcctgaactacaagacgacagtag

SEQ ID NO: 486811 - DNA, 25 bp, Homo sapien
acaagaattagttgctggtcagttt

SEQ ID NO: 486812 - DNA, 25 bp, Homo sapien
ctggtcagttttcatctaaatgtga

SEQ ID NO: 486813 - DNA, 25 bp, Homo sapien
aatgtgataaactaaatcccttgca

SEQ ID NO: 486814 - DNA, 25 bp, Homo sapien
gatgtgaatgaggaccctccttaaa

SEQ ID NO: 486815 - DNA, 25 bp, Homo sapien
gaggaccctccttaaacaggaatgg

SEQ ID NO: 486816 - DNA, 25 bp, Homo sapien
gagaggttgagctggtcatttccaa

SEQ ID NO: 486817 - DNA, 25 bp, Homo sapien
tggtcatttccaaccttagcttcaa

SEQ ID NO: 486818 - DNA, 25 bp, Homo sapien
tttccaaccttagcttcaaggcaga

SEQ ID NO: 486819 - DNA, 25 bp, Homo sapien
taaaccttgatcctaggcacttagt

SEQ ID NO: 486820 - DNA, 25 bp, Homo sapien
ggcacttagttctagaagatcctac

SEQ ID NO: 486821 - DNA, 25 bp, Homo sapien
aagatcctacaagcacgtctgctgt

SEQ ID NO: 486822 - DNA, 25 bp, Homo sapien
gcacgtctgctgtaactctatgtat

SEQ ID NO: 486823 - DNA, 25 bp, Homo sapien
gctgtaactctatgtatgttttctg

SEQ ID NO: 486824 - DNA, 25 bp, Homo sapien
gttttctgtaaaatcacatacctat

SEQ ID NO: 486825 - DNA, 25 bp, Homo sapien
gagatttgctttatgacctagatta

SEQ ID NO: 486826 - DNA, 25 bp, Homo sapien
ttatgacctagattataacctgttt

SEQ ID NO: 486827 - DNA, 25 bp, Homo sapien
gtaaatgtttcatgattgcttgaaa

SEQ ID NO: 486828 - DNA, 25 bp, Homo sapien
tatgcttgttttttagttgttggat

SEQ ID NO: 486829 - DNA, 25 bp, Homo sapien
gttttttagttgttggatgtccatt

SEQ ID NO: 486830 - DNA, 25 bp, Homo sapien
ggatgtccattagaccaaagttgtt

SEQ ID NO: 486831 - DNA, 25 bp, Homo sapien
tttccattttactattcttttgtct

SEQ ID NO: 486832 - DNA, 25 bp, Homo sapien
ttgtcttctacttgatctctcagac

SEQ ID NO: 486833 - DNA, 25 bp, Homo sapien
cttctacttgatctctcagactctg

SEQ ID NO: 486834 - DNA, 25 bp, Homo sapien
ctctgagatgtgttgaaattttcta

SEQ ID NO: 486835 - DNA, 25 bp, Homo sapien
cagaaaataggtacatgttaagact

SEQ ID NO: 486836 - DNA, 25 bp, Homo sapien
gggctgtccgcggtcgcgccgggct

SEQ ID NO: 486837 - DNA, 25 bp, Homo sapien
tcgcgccgggctccgcctgcagtgt

SEQ ID NO: 486838 - DNA, 25 bp, Homo sapien
agtgtggcccgtccggacagtccct

SEQ ID NO: 486839 - DNA, 25 bp, Homo sapien
gtggcccgtccggacagtccctcac

SEQ ID NO: 486840 - DNA, 25 bp, Homo sapien
tggcccgtccggacagtccctcacc

SEQ ID NO: 486841 - DNA, 25 bp, Homo sapien
ggacagtccctcaccccggcctgcg

SEQ ID NO: 486842 - DNA, 25 bp, Homo sapien
cccggcctgcgctgctgcgtggact

SEQ ID NO: 486843 - DNA, 25 bp, Homo sapien
ccggcctgcgctgctgcgtggactc

SEQ ID NO: 486844 - DNA, 25 bp, Homo sapien
cggcctgcgctgctgcgtggactcg

SEQ ID NO: 486845 - DNA, 25 bp, Homo sapien
ggcctgcgctgctgcgtggactcgg

SEQ ID NO: 486846 - DNA, 25 bp, Homo sapien
gcctgcgctgctgcgtggactcggg

SEQ ID NO: 486847 - DNA, 25 bp, Homo sapien
acttggaggacagggtgaagctgca

SEQ ID NO: 486848 - DNA, 25 bp, Homo sapien
agggtgaagctgcagaagacctggg

SEQ ID NO: 486849 - DNA, 25 bp, Homo sapien
ggaagttaggaataccttacatcca

SEQ ID NO: 486850 - DNA, 25 bp, Homo sapien
gaagttaggaataccttacatccaa

SEQ ID NO: 486851 - DNA, 25 bp, Homo sapien
aagttaggaataccttacatccaat

SEQ ID NO: 486852 - DNA, 25 bp, Homo sapien
gttaggaataccttacatccaatgc

SEQ ID NO: 486853 - DNA, 25 bp, Homo sapien
ttaggaataccttacatccaatgcc

SEQ ID NO: 486854 - DNA, 25 bp, Homo sapien
taggaataccttacatccaatgccc

SEQ ID NO: 486855 - DNA, 25 bp, Homo sapien
aggaataccttacatccaatgccca

SEQ ID NO: 486856 - DNA, 25 bp, Homo sapien
ggaataccttacatccaatgcccac

SEQ ID NO: 486857 - DNA, 25 bp, Homo sapien
atgcccacccgtgctccgcaggcaa

SEQ ID NO: 486858 - DNA, 25 bp, Homo sapien
gccagggctttcgacttggagacca

SEQ ID NO: 486859 - DNA, 25 bp, Homo sapien
ggctttcgacttggagaccagtgaa

SEQ ID NO: 486860 - DNA, 25 bp, Homo sapien
taacaactgcgttctggctaacact

SEQ ID NO: 486861 - DNA, 25 bp, Homo sapien
tggctaacactgttggacctgaccc

SEQ ID NO: 486862 - DNA, 25 bp, Homo sapien
ggacctgacccacactgaatgtagt

SEQ ID NO: 486863 - DNA, 25 bp, Homo sapien
tgacccacactgaatgtagtctttc

SEQ ID NO: 486864 - DNA, 25 bp, Homo sapien
gaatgtagtctttcagtacgagaca

SEQ ID NO: 486865 - DNA, 25 bp, Homo sapien
tcagtacgagacaaagtttcttaaa

SEQ ID NO: 486866 - DNA, 25 bp, Homo sapien
gttccacaagtttcacgattctcat

SEQ ID NO: 486867 - DNA, 25 bp, Homo sapien
acgattctcattcaagtccttactg

SEQ ID NO: 486868 - DNA, 25 bp, Homo sapien
aagtccttactgctgtgaagaacaa

SEQ ID NO: 486869 - DNA, 25 bp, Homo sapien
ttatttcagttacaacaccatgttg

SEQ ID NO: 486870 - DNA, 25 bp, Homo sapien
caacaccatgttgtaactttagtaa

SEQ ID NO: 486871 - DNA, 25 bp, Homo sapien
gtaaactaagtggtatacagatgcc

SEQ ID NO: 486872 - DNA, 25 bp, Homo sapien
tatacagatgcccaaggtttgttct

SEQ ID NO: 486873 - DNA, 25 bp, Homo sapien
gatgcccaaggtttgttctgtggtc

SEQ ID NO: 486874 - DNA, 25 bp, Homo sapien
gcccaaggtttgttctgtggtcatg

SEQ ID NO: 486875 - DNA, 25 bp, Homo sapien
gttctgtggtcatgtgaaaaaattg

SEQ ID NO: 486876 - DNA, 25 bp, Homo sapien
agtcatttttagcatagaaaacttg

SEQ ID NO: 486877 - DNA, 25 bp, Homo sapien
tattctttcaagccaaaaatgtttt

SEQ ID NO: 486878 - DNA, 25 bp, Homo sapien
gttttacagtagaacttggatcaag

SEQ ID NO: 486879 - DNA, 25 bp, Homo sapien
ggatcaagaaaagaggtactaggct

SEQ ID NO: 486880 - DNA, 25 bp, Homo sapien
tattattggcttacacaaactctag

SEQ ID NO: 486881 - DNA, 25 bp, Homo sapien
ggcttacacaaactctagcaaaaat

SEQ ID NO: 486882 - DNA, 25 bp, Homo sapien
tgacttgaatcccaagtatcttcat

SEQ ID NO: 486883 - DNA, 25 bp, Homo sapien
gaatcccaagtatcttcataccaaa

SEQ ID NO: 486884 - DNA, 25 bp, Homo sapien
ataccaaacatatcagggttccctg

SEQ ID NO: 486885 - DNA, 25 bp, Homo sapien
atcagggttccctgcatagtttgca

SEQ ID NO: 486886 - DNA, 25 bp, Homo sapien
gggttccctgcatagtttgcagttg

SEQ ID NO: 486887 - DNA, 25 bp, Homo sapien
gcatagtttgcagttgattgaggat

SEQ ID NO: 486888 - DNA, 25 bp, Homo sapien
gttgattgaggatttcacacgactt

SEQ ID NO: 486889 - DNA, 25 bp, Homo sapien
tttcacacgacttggcataaatttg

SEQ ID NO: 486890 - DNA, 25 bp, Homo sapien
cttggcataaatttgattacatctc

SEQ ID NO: 486891 - DNA, 25 bp, Homo sapien
tgtacttggagttgggacctcacct

SEQ ID NO: 486892 - DNA, 25 bp, Homo sapien
tggagttgggacctcacctggctct

SEQ ID NO: 486893 - DNA, 25 bp, Homo sapien
tggctctcccttatctttccggctg

SEQ ID NO: 486894 - DNA, 25 bp, Homo sapien
ttatctttccggctgccattttttc

SEQ ID NO: 486895 - DNA, 25 bp, Homo sapien
tttctaactttctttcccatacact

SEQ ID NO: 486896 - DNA, 25 bp, Homo sapien
actttctttcccatacacttatttg

SEQ ID NO: 486897 - DNA, 25 bp, Homo sapien
gaaatattatctcacggtaacgaaa

SEQ ID NO: 486898 - DNA, 25 bp, Homo sapien
aataaagtgtctgtcacctcctgct

SEQ ID NO: 486899 - DNA, 25 bp, Homo sapien
ctcctgctgtgttgtcatcttgcat

SEQ ID NO: 486900 - DNA, 25 bp, Homo sapien
gttgtcatcttgcatgagctatcta

SEQ ID NO: 486901 - DNA, 25 bp, Homo sapien
gcatgagctatctaagttctctgtt

SEQ ID NO: 486902 - DNA, 25 bp, Homo sapien
aaggcagctgccgatggttccagat

SEQ ID NO: 486903 - DNA, 25 bp, Homo sapien
agagttttgtagacgggctacgctc

SEQ ID NO: 486904 - DNA, 25 bp, Homo sapien
tgtagacgggctacgctcattgtgc

SEQ ID NO: 486905 - DNA, 25 bp, Homo sapien
tacgctcattgtgcctttgaaagag

SEQ ID NO: 486906 - DNA, 25 bp, Homo sapien
aagcttgatttagattgcatacagc

SEQ ID NO: 486907 - DNA, 25 bp, Homo sapien
tgaaagagcagagccggcagcctct

SEQ ID NO: 486908 - DNA, 25 bp, Homo sapien
cagcctctagtcatcatttggatat

SEQ ID NO: 486909 - DNA, 25 bp, Homo sapien
gagcatgaatctgatgtagagctac

SEQ ID NO: 486910 - DNA, 25 bp, Homo sapien
ttgcatacagcttttgctacccaag

SEQ ID NO: 486911 - DNA, 25 bp, Homo sapien
tttgctacccaagaccaagaggctc

SEQ ID NO: 486912 - DNA, 25 bp, Homo sapien
acccaagaccaagaggctctggcaa

SEQ ID NO: 486913 - DNA, 25 bp, Homo sapien
gtgtttttatcatctttgtaatctc

SEQ ID NO: 486914 - DNA, 25 bp, Homo sapien
atctttgtaatctcaacacctagaa

SEQ ID NO: 486915 - DNA, 25 bp, Homo sapien
acacctagaagagggctacagcaca

SEQ ID NO: 486916 - DNA, 25 bp, Homo sapien
gagggctacagcacaaagtagctat

SEQ ID NO: 486917 - DNA, 25 bp, Homo sapien
agtagctatttaatgccccactgtc

SEQ ID NO: 486918 - DNA, 25 bp, Homo sapien
acaactattgaattcctgctctgga

SEQ ID NO: 486919 - DNA, 25 bp, Homo sapien
attgaattcctgctctggaaggccc

SEQ ID NO: 486920 - DNA, 25 bp, Homo sapien
tggaaggccctgttctatgtgctgg

SEQ ID NO: 486921 - DNA, 25 bp, Homo sapien
accaagattcttgcattcatggaac

SEQ ID NO: 486922 - DNA, 25 bp, Homo sapien
gattcttgcattcatggaacttatt

SEQ ID NO: 486923 - DNA, 25 bp, Homo sapien
acttattagtgcaagggttgggagc

SEQ ID NO: 486924 - DNA, 25 bp, Homo sapien
taccttcctgaactagttcccaaag

SEQ ID NO: 486925 - DNA, 25 bp, Homo sapien
gaactagttcccaaagattcgtgtt

SEQ ID NO: 486926 - DNA, 25 bp, Homo sapien
aaagattcgtgttctcctccagaag

SEQ ID NO: 486927 - DNA, 25 bp, Homo sapien
tcgtgttctcctccagaagggtaaa

SEQ ID NO: 486928 - DNA, 25 bp, Homo sapien
ggacttcagccacttctatttatac

SEQ ID NO: 486929 - DNA, 25 bp, Homo sapien
actattcttaactcttgaattcctt

SEQ ID NO: 486930 - DNA, 25 bp, Homo sapien
cagagaatcattacaagggcctttt

SEQ ID NO: 486931 - DNA, 25 bp, Homo sapien
taatgtatcagctctcagggaatgt

SEQ ID NO: 486932 - DNA, 25 bp, Homo sapien
cagctctcagggaatgtatgatcct

SEQ ID NO: 486933 - DNA, 25 bp, Homo sapien
atgatcctgggtgggtctggatcct

SEQ ID NO: 486934 - DNA, 25 bp, Homo sapien
taacagctaaaaccattaccacaag

SEQ ID NO: 486935 - DNA, 25 bp, Homo sapien
tcgttaataaactttgctactttgc

SEQ ID NO: 486936 - DNA, 25 bp, Homo sapien
ctttgctttctaatttcggtgaaga

SEQ ID NO: 486937 - DNA, 25 bp, Homo sapien
gtaagactatgtgaaactgggttat

SEQ ID NO: 486938 - DNA, 25 bp, Homo sapien
ggctgttggctgttgtatcttgtaa

SEQ ID NO: 486939 - DNA, 25 bp, Homo sapien
gtaaacaattcaacgcaatgccaag

SEQ ID NO: 486940 - DNA, 25 bp, Homo sapien
gaagttgttagtccctctatctaga

SEQ ID NO: 486941 - DNA, 25 bp, Homo sapien
ccctctatctagaattctttcccaa

SEQ ID NO: 486942 - DNA, 25 bp, Homo sapien
gaattctttcccaaatagctgcata

SEQ ID NO: 486943 - DNA, 25 bp, Homo sapien
tcctctgcttcatttaagtctgtgc

SEQ ID NO: 486944 - DNA, 25 bp, Homo sapien
gtgctgaaatgttatctactcagag

SEQ ID NO: 486945 - DNA, 25 bp, Homo sapien
ctcagagaagacattctggatcatt

SEQ ID NO: 486946 - DNA, 25 bp, Homo sapien
atgaaggcagctgccgatggttcca

SEQ ID NO: 486947 - DNA, 25 bp, Homo sapien
gcagctgccgatggttccagatgta

SEQ ID NO: 486948 - DNA, 25 bp, Homo sapien
ccgatggttccagatgtagagagat

SEQ ID NO: 486949 - DNA, 25 bp, Homo sapien
ctcattgtgcctttgaaagagcaga

SEQ ID NO: 486950 - DNA, 25 bp, Homo sapien
tgaaagagcagagccggcagcctct

SEQ ID NO: 486951 - DNA, 25 bp, Homo sapien
cagcctctagtcatcatttggatat

SEQ ID NO: 486952 - DNA, 25 bp, Homo sapien
catttggatatacaggactagagca

SEQ ID NO: 486953 - DNA, 25 bp, Homo sapien
aggactagagcatgaatctgatgta

SEQ ID NO: 486954 - DNA, 25 bp, Homo sapien
agcatgaatctgatgtagagctaca

SEQ ID NO: 486955 - DNA, 25 bp, Homo sapien
gtagagctacagaatgaagagcaac

SEQ ID NO: 486956 - DNA, 25 bp, Homo sapien
ggctctggcaagacagggtggtttt

SEQ ID NO: 486957 - DNA, 25 bp, Homo sapien
tagtgttgtgatctcttaaggttta

SEQ ID NO: 486958 - DNA, 25 bp, Homo sapien
agtgttgtgatctcttaaggtttat

SEQ ID NO: 486959 - DNA, 25 bp, Homo sapien
gtgttgtgatctcttaaggtttatc

SEQ ID NO: 486960 - DNA, 25 bp, Homo sapien
gttgtgatctcttaaggtttatcct

SEQ ID NO: 486961 - DNA, 25 bp, Homo sapien
ttgtgatctcttaaggtttatcctt

SEQ ID NO: 486962 - DNA, 25 bp, Homo sapien
gtgatctcttaaggtttatccttcc

SEQ ID NO: 486963 - DNA, 25 bp, Homo sapien
gatctcttaaggtttatccttcctc

SEQ ID NO: 486964 - DNA, 25 bp, Homo sapien
atctcttaaggtttatccttcctct

SEQ ID NO: 486965 - DNA, 25 bp, Homo sapien
tctcttaaggtttatccttcctctt

SEQ ID NO: 486966 - DNA, 25 bp, Homo sapien
ttaaactataaagagctggctgggc

SEQ ID NO: 486967 - DNA, 25 bp, Homo sapien
aaactataaagagctggctgggcac

SEQ ID NO: 486968 - DNA, 25 bp, Homo sapien
aggctcctgggcaatatgatcgtga

SEQ ID NO: 486969 - DNA, 25 bp, Homo sapien
gctcctgggcaatatgatcgtgatt

SEQ ID NO: 486970 - DNA, 25 bp, Homo sapien
atatgatcgtgattgtgctgggcca

SEQ ID NO: 486971 - DNA, 25 bp, Homo sapien
tgatcgtgattgtgctgggccacca

SEQ ID NO: 486972 - DNA, 25 bp, Homo sapien
tgggccaccacctgggcaaggattt

SEQ ID NO: 486973 - DNA, 25 bp, Homo sapien
tcctgctcttgcctgtgaacaatgg

SEQ ID NO: 486974 - DNA, 25 bp, Homo sapien
gctcttgcctgtgaacaatggttaa

SEQ ID NO: 486975 - DNA, 25 bp, Homo sapien
aacaatggttaattgttcccaagag

SEQ ID NO: 486976 - DNA, 25 bp, Homo sapien
ttgttcccaagagagcatctgtcag

SEQ ID NO: 486977 - DNA, 25 bp, Homo sapien
cccaagagagcatctgtcagttgtt

SEQ ID NO: 486978 - DNA, 25 bp, Homo sapien
agcatctgtcagttgttggcaaaat

SEQ ID NO: 486979 - DNA, 25 bp, Homo sapien
acatactcgacctctccctaaaaag

SEQ ID NO: 486980 - DNA, 25 bp, Homo sapien
aagatgttgcaacccagtttctctg

SEQ ID NO: 486981 - DNA, 25 bp, Homo sapien
ccagtttctctgaattccaccacaa

SEQ ID NO: 486982 - DNA, 25 bp, Homo sapien
aaagagaccctgaataagaagagca

SEQ ID NO: 486983 - DNA, 25 bp, Homo sapien
aaacaaagttgcctgattccgcgca

SEQ ID NO: 486984 - DNA, 25 bp, Homo sapien
agttgcctgattccgcgcaggtgca

SEQ ID NO: 486985 - DNA, 25 bp, Homo sapien
cgcaggtgcacaggccccggatgta

SEQ ID NO: 486986 - DNA, 25 bp, Homo sapien
gtggctgtagaatcatccatccgtc

SEQ ID NO: 486987 - DNA, 25 bp, Homo sapien
atcatccatccgtctacagctaaaa

SEQ ID NO: 486988 - DNA, 25 bp, Homo sapien
atccgtctacagctaaaacaatttg

SEQ ID NO: 486989 - DNA, 25 bp, Homo sapien
taaagtacatgtttttcctaagcca

SEQ ID NO: 486990 - DNA, 25 bp, Homo sapien
gccagtcagaatgacctctcggact

SEQ ID NO: 486991 - DNA, 25 bp, Homo sapien
agaatgacctctcggacttccgcag

SEQ ID NO: 486992 - DNA, 25 bp, Homo sapien
agcgagccagccctgtatttctgag

SEQ ID NO: 486993 - DNA, 25 bp, Homo sapien
agccctgtatttctgagcccagcac

SEQ ID NO: 486994 - DNA, 25 bp, Homo sapien
actgccaggaccaaggctgagccca

SEQ ID NO: 486995 - DNA, 25 bp, Homo sapien
aggaccaaggctgagcccagctgtg

SEQ ID NO: 486996 - DNA, 25 bp, Homo sapien
gagcccagctgtgggagtcccggaa

SEQ ID NO: 486997 - DNA, 25 bp, Homo sapien
gggcagtagccagggactactgcac

SEQ ID NO: 486998 - DNA, 25 bp, Homo sapien
ttgtttggcctcactgtatcccacc

SEQ ID NO: 486999 - DNA, 25 bp, Homo sapien
ctggaagcagctagggtgcctcctg

SEQ ID NO: 487000 - DNA, 25 bp, Homo sapien
agctagggtgcctcctgccatcggg

SEQ ID NO: 487001 - DNA, 25 bp, Homo sapien
accgtgtcacagctgtgtccccttg

SEQ ID NO: 487002 - DNA, 25 bp, Homo sapien
gtgtcacagctgtgtccccttgtca

SEQ ID NO: 487003 - DNA, 25 bp, Homo sapien
caccaccagatgctccctgtctggg

SEQ ID NO: 487004 - DNA, 25 bp, Homo sapien
gcaggcagggccgtttactcaccag

SEQ ID NO: 487005 - DNA, 25 bp, Homo sapien
aggcagggccgtttactcaccaggc

SEQ ID NO: 487006 - DNA, 25 bp, Homo sapien
ggcagggccgtttactcaccaggcc

SEQ ID NO: 487007 - DNA, 25 bp, Homo sapien
cgtcccggcgcctccgttagggctg

SEQ ID NO: 487008 - DNA, 25 bp, Homo sapien
attttcaattccacattcctgatta

SEQ ID NO: 487009 - DNA, 25 bp, Homo sapien
tttcaattccacattcctgattaaa

SEQ ID NO: 487010 - DNA, 25 bp, Homo sapien
tcaattccacattcctgattaaaag

SEQ ID NO: 487011 - DNA, 25 bp, Homo sapien
ttccacattcctgattaaaaggtct

SEQ ID NO: 487012 - DNA, 25 bp, Homo sapien
ttgtgtccatcatttagcaccctcc

SEQ ID NO: 487013 - DNA, 25 bp, Homo sapien
atttagcaccctccccatggcttgg

SEQ ID NO: 487014 - DNA, 25 bp, Homo sapien
tctcctctgggcttagacttagcag

SEQ ID NO: 487015 - DNA, 25 bp, Homo sapien
gggcttagacttagcagttctggga

SEQ ID NO: 487016 - DNA, 25 bp, Homo sapien
ttagacttagcagttctgggagagg

SEQ ID NO: 487017 - DNA, 25 bp, Homo sapien
gaatgctgcctagggtatggccact

SEQ ID NO: 487018 - DNA, 25 bp, Homo sapien
atggccactgtggaggtacagctaa

SEQ ID NO: 487019 - DNA, 25 bp, Homo sapien
ggtacagctaaaggctttctcctca

SEQ ID NO: 487020 - DNA, 25 bp, Homo sapien
cagctaaaggctttctcctcattaa

SEQ ID NO: 487021 - DNA, 25 bp, Homo sapien
aaaggctttctcctcattaactcta

SEQ ID NO: 487022 - DNA, 25 bp, Homo sapien
gctttctcctcattaactctaagac

SEQ ID NO: 487023 - DNA, 25 bp, Homo sapien
gattctccccgaaggtgccctcgga

SEQ ID NO: 487024 - DNA, 25 bp, Homo sapien
aggtgccctcggaggcagcaggttt

SEQ ID NO: 487025 - DNA, 25 bp, Homo sapien
gtgctttcagatgcattgactcttc

SEQ ID NO: 487026 - DNA, 25 bp, Homo sapien
tttcagatgcattgactcttcccgc

SEQ ID NO: 487027 - DNA, 25 bp, Homo sapien
gcaatacactgttcctagtgagcag

SEQ ID NO: 487028 - DNA, 25 bp, Homo sapien
tggccctgaggagtctttgcaatgt

SEQ ID NO: 487029 - DNA, 25 bp, Homo sapien
tgaggagtctttgcaatgtattgaa

SEQ ID NO: 487030 - DNA, 25 bp, Homo sapien
gtattgaaggaattgctgccgtgtg

SEQ ID NO: 487031 - DNA, 25 bp, Homo sapien
aattgctgccgtgtgagttttgaat

SEQ ID NO: 487032 - DNA, 25 bp, Homo sapien
ttgaatgattttgcagtaaagacct

SEQ ID NO: 487033 - DNA, 25 bp, Homo sapien
tttgcagtaaagacctgatctttct

SEQ ID NO: 487034 - DNA, 25 bp, Homo sapien
gcagaataggcagaggcctctccgt

SEQ ID NO: 487035 - DNA, 25 bp, Homo sapien
tttttgacagatggcgggacggaaa

SEQ ID NO: 487036 - DNA, 25 bp, Homo sapien
ggcgggacggaaatgcaatagacca

SEQ ID NO: 487037 - DNA, 25 bp, Homo sapien
tgcaatagaccagcctgcaagaaag

SEQ ID NO: 487038 - DNA, 25 bp, Homo sapien
tgttttgatgacaggcagtgtggcc

SEQ ID NO: 487039 - DNA, 25 bp, Homo sapien
acaagcacaggccttggaatccaat

SEQ ID NO: 487040 - DNA, 25 bp, Homo sapien
gactgaatcagaaccctaggcctgc

SEQ ID NO: 487041 - DNA, 25 bp, Homo sapien
taggcctgccatctgtcagccgggt

SEQ ID NO: 487042 - DNA, 25 bp, Homo sapien
tgtcagccgggtgacctgggtcaat

SEQ ID NO: 487043 - DNA, 25 bp, Homo sapien
ggagatgctggctttacctaaggtc

SEQ ID NO: 487044 - DNA, 25 bp, Homo sapien
gctggctttacctaaggtctcgaaa

SEQ ID NO: 487045 - DNA, 25 bp, Homo sapien
gacaactgcaaatgtagactatact

SEQ ID NO: 487046 - DNA, 25 bp, Homo sapien
tctctctcggcattcttttttctca

SEQ ID NO: 487047 - DNA, 25 bp, Homo sapien
attcttttttctcatactcttcaaa

SEQ ID NO: 487048 - DNA, 25 bp, Homo sapien
tttctcatactcttcaaaaagcagt

SEQ ID NO: 487049 - DNA, 25 bp, Homo sapien
agttctgcagctggttaattcatgt

SEQ ID NO: 487050 - DNA, 25 bp, Homo sapien
gcagctggttaattcatgtaactgt

SEQ ID NO: 487051 - DNA, 25 bp, Homo sapien
aattcatgtaactgtgagagcaaat

SEQ ID NO: 487052 - DNA, 25 bp, Homo sapien
ttcctgctattctgaaattgcctac

SEQ ID NO: 487053 - DNA, 25 bp, Homo sapien
aattgcctacatgtttcaataccag

SEQ ID NO: 487054 - DNA, 25 bp, Homo sapien
gcctacatgtttcaataccagttat

SEQ ID NO: 487055 - DNA, 25 bp, Homo sapien
ataccagttatatggagtgcttgaa

SEQ ID NO: 487056 - DNA, 25 bp, Homo sapien
attactgtaccctcgcatgactgtt

SEQ ID NO: 487057 - DNA, 25 bp, Homo sapien
accctcgcatgactgttacagcttt

SEQ ID NO: 487058 - DNA, 25 bp, Homo sapien
ctttctgtgcagagatgactgtcca

SEQ ID NO: 487059 - DNA, 25 bp, Homo sapien
agtgccacatgcctacgattgaaat

SEQ ID NO: 487060 - DNA, 25 bp, Homo sapien
atgaaaactctattgttacctctga

SEQ ID NO: 487061 - DNA, 25 bp, Homo sapien
tattgttacctctgagttgtgttcc

SEQ ID NO: 487062 - DNA, 25 bp, Homo sapien
gtgttccacggaaaatgctatccag

SEQ ID NO: 487063 - DNA, 25 bp, Homo sapien
atgctatccagcagatcatttagga

SEQ ID NO: 487064 - DNA, 25 bp, Homo sapien
gacagcaatggagaatgggttatat

SEQ ID NO: 487065 - DNA, 25 bp, Homo sapien
gggttatataaagactgcctgctaa

SEQ ID NO: 487066 - DNA, 25 bp, Homo sapien
aagactgcctgctaatatgaacaga

SEQ ID NO: 487067 - DNA, 25 bp, Homo sapien
aagaatcaggctcttttgtactttg

SEQ ID NO: 487068 - DNA, 25 bp, Homo sapien
gtttttaaatctgtgatgcttttca

SEQ ID NO: 487069 - DNA, 25 bp, Homo sapien
aattgatgcaatttcatacttagga

SEQ ID NO: 487070 - DNA, 25 bp, Homo sapien
aatgtaaactctgccacttttttgt

SEQ ID NO: 487071 - DNA, 25 bp, Homo sapien
ctgccacttttttgtgttcaaaatt

SEQ ID NO: 487072 - DNA, 25 bp, Homo sapien
aattttggtttttatgaagccagat

SEQ ID NO: 487073 - DNA, 25 bp, Homo sapien
ggtttttatgaagccagatggattg

SEQ ID NO: 487074 - DNA, 25 bp, Homo sapien
gccagatggattgaagagttacata

SEQ ID NO: 487075 - DNA, 25 bp, Homo sapien
aagagttacataagcatttgaatgc

SEQ ID NO: 487076 - DNA, 25 bp, Homo sapien
aatataaggctaatgattttctgtt

SEQ ID NO: 487077 - DNA, 25 bp, Homo sapien
tctgttagtgtttgaatatcttcat

SEQ ID NO: 487078 - DNA, 25 bp, Homo sapien
ctcgggtgcgtcctctctcaggagt

SEQ ID NO: 487079 - DNA, 25 bp, Homo sapien
ctctctcaggagtgcacgaagttca

SEQ ID NO: 487080 - DNA, 25 bp, Homo sapien
ctctcaggagtgcacgaagttcaag

SEQ ID NO: 487081 - DNA, 25 bp, Homo sapien
ctcaggagtgcacgaagttcaaggt

SEQ ID NO: 487082 - DNA, 25 bp, Homo sapien
caggagtgcacgaagttcaaggtca

SEQ ID NO: 487083 - DNA, 25 bp, Homo sapien
gagtgcacgaagttcaaggtcagca

SEQ ID NO: 487084 - DNA, 25 bp, Homo sapien
gcacgaagttcaaggtcagcagctg

SEQ ID NO: 487085 - DNA, 25 bp, Homo sapien
cacgaagttcaaggtcagcagctgc

SEQ ID NO: 487086 - DNA, 25 bp, Homo sapien
agcagctgccgggaatgcatcgagt

SEQ ID NO: 487087 - DNA, 25 bp, Homo sapien
cagctgccgggaatgcatcgagtcg

SEQ ID NO: 487088 - DNA, 25 bp, Homo sapien
cggctgcacctggtgccagaagctg

SEQ ID NO: 487089 - DNA, 25 bp, Homo sapien
gttccagcagcaagatcatctctac

SEQ ID NO: 487090 - DNA, 25 bp, Homo sapien
accaccaccctgaacaagagacgat

SEQ ID NO: 487091 - DNA, 25 bp, Homo sapien
acgatagaggagacgaggtccctgc

SEQ ID NO: 487092 - DNA, 25 bp, Homo sapien
tggtgtctctgtgcttccttcactt

SEQ ID NO: 487093 - DNA, 25 bp, Homo sapien
gggctcatcttactagtatcccctc

SEQ ID NO: 487094 - DNA, 25 bp, Homo sapien
caggatgatcttctgtgctgggaca

SEQ ID NO: 487095 - DNA, 25 bp, Homo sapien
atcttctgtgctgggacagggactc

SEQ ID NO: 487096 - DNA, 25 bp, Homo sapien
gacagggactctgcctcttggagtt

SEQ ID NO: 487097 - DNA, 25 bp, Homo sapien
gcctcttggagtttggtagctactt

SEQ ID NO: 487098 - DNA, 25 bp, Homo sapien
agctacttcttgatttgggcctggt

SEQ ID NO: 487099 - DNA, 25 bp, Homo sapien
gcctggtgacccacctggaatggga

SEQ ID NO: 487100 - DNA, 25 bp, Homo sapien
tcctgtattccgatgatcatcctgt

SEQ ID NO: 487101 - DNA, 25 bp, Homo sapien
cctgtattccgatgatcatcctgta

SEQ ID NO: 487102 - DNA, 25 bp, Homo sapien
ctgtattccgatgatcatcctgtaa

SEQ ID NO: 487103 - DNA, 25 bp, Homo sapien
tgtattccgatgatcatcctgtaaa

SEQ ID NO: 487104 - DNA, 25 bp, Homo sapien
gtattccgatgatcatcctgtaaac

SEQ ID NO: 487105 - DNA, 25 bp, Homo sapien
attccgatgatcatcctgtaaacat

SEQ ID NO: 487106 - DNA, 25 bp, Homo sapien
tccgatgatcatcctgtaaacattt

SEQ ID NO: 487107 - DNA, 25 bp, Homo sapien
cgatgatcatcctgtaaacatttta

SEQ ID NO: 487108 - DNA, 25 bp, Homo sapien
atatctctacgctggaaactttctg

SEQ ID NO: 487109 - DNA, 25 bp, Homo sapien
gctggaaactttctgcctcaatgtt

SEQ ID NO: 487110 - DNA, 25 bp, Homo sapien
tctgcctcaatgtttactgtgcctt

SEQ ID NO: 487111 - DNA, 25 bp, Homo sapien
gggacagttgcagtctcacttggga

SEQ ID NO: 487112 - DNA, 25 bp, Homo sapien
acagttgcagtctcacttgggacag

SEQ ID NO: 487113 - DNA, 25 bp, Homo sapien
ttgcagtctcacttgggacaggcca

SEQ ID NO: 487114 - DNA, 25 bp, Homo sapien
agtctcacttgggacaggccacagc

SEQ ID NO: 487115 - DNA, 25 bp, Homo sapien
gcccgtgggataaaagccaaaagca

SEQ ID NO: 487116 - DNA, 25 bp, Homo sapien
taaaagccaaaagcatgcgtcagct

SEQ ID NO: 487117 - DNA, 25 bp, Homo sapien
gtagagcccctcgtgcaatgcaatg

SEQ ID NO: 487118 - DNA, 25 bp, Homo sapien
gagcccctcgtgcaatgcaatgaat

SEQ ID NO: 487119 - DNA, 25 bp, Homo sapien
gcaatgcaatgaatggaccctcctg

SEQ ID NO: 487120 - DNA, 25 bp, Homo sapien
aatgaatggaccctcctgtcactct

SEQ ID NO: 487121 - DNA, 25 bp, Homo sapien
ctgtcactctgctgaacagaattta

SEQ ID NO: 487122 - DNA, 25 bp, Homo sapien
ggaaaaccattacaagagttgagtg

SEQ ID NO: 487123 - DNA, 25 bp, Homo sapien
gaagtctggaatctgaatagttcaa

SEQ ID NO: 487124 - DNA, 25 bp, Homo sapien
caattatatttggttatcactggta

SEQ ID NO: 487125 - DNA, 25 bp, Homo sapien
ggttatcactggtattgtattgtta

SEQ ID NO: 487126 - DNA, 25 bp, Homo sapien
atatactgggaactatgttgggaaa

SEQ ID NO: 487127 - DNA, 25 bp, Homo sapien
ggaaaatgttgccatagtaacttta

SEQ ID NO: 487128 - DNA, 25 bp, Homo sapien
gaatagttcaaccacagttgcatgg

SEQ ID NO: 487129 - DNA, 25 bp, Homo sapien
cacagttgcatggaacactttgagt

SEQ ID NO: 487130 - DNA, 25 bp, Homo sapien
acactttgagtgttcaactgcatta

SEQ ID NO: 487131 - DNA, 25 bp, Homo sapien
gagtgttcaactgcattatgtggtc

SEQ ID NO: 487132 - DNA, 25 bp, Homo sapien
aactgcattatgtggtcttgataaa

SEQ ID NO: 487133 - DNA, 25 bp, Homo sapien
gagttgtaaatacacatgcttgcaa

SEQ ID NO: 487134 - DNA, 25 bp, Homo sapien
atgcttgcaaaaacattagtcgtga

SEQ ID NO: 487135 - DNA, 25 bp, Homo sapien
attagtcgtgaaatccctagcaaca

SEQ ID NO: 487136 - DNA, 25 bp, Homo sapien
gaaatccctagcaacaagtcactgg

SEQ ID NO: 487137 - DNA, 25 bp, Homo sapien
ggatttttctctgtcagcacgcgtg

SEQ ID NO: 487138 - DNA, 25 bp, Homo sapien
gtcagcacgcgtgtcagctgccaaa

SEQ ID NO: 487139 - DNA, 25 bp, Homo sapien
gtcagctgccaaagaatagacttaa

SEQ ID NO: 487140 - DNA, 25 bp, Homo sapien
gaagaagtgcccacatgctggcagg

SEQ ID NO: 487141 - DNA, 25 bp, Homo sapien
ctggccagccagatactgctagatt

SEQ ID NO: 487142 - DNA, 25 bp, Homo sapien
gacctgtggtacacagctgtgctgt

SEQ ID NO: 487143 - DNA, 25 bp, Homo sapien
tgtggctcagtcagcaacctcagaa

SEQ ID NO: 487144 - DNA, 25 bp, Homo sapien
tggtgtctctgtgcttccttcactt

SEQ ID NO: 487145 - DNA, 25 bp, Homo sapien
tgtctctgtgcttccttcacttcac

SEQ ID NO: 487146 - DNA, 25 bp, Homo sapien
gggctcatcttactagtatcccctc

SEQ ID NO: 487147 - DNA, 25 bp, Homo sapien
atcttactagtatcccctccactat

SEQ ID NO: 487148 - DNA, 25 bp, Homo sapien
ctccactatcccatgggctctctct

SEQ ID NO: 487149 - DNA, 25 bp, Homo sapien
tagctacttcttgatttgggcctgg

SEQ ID NO: 487150 - DNA, 25 bp, Homo sapien
agctacttcttgatttgggcctggt

SEQ ID NO: 487151 - DNA, 25 bp, Homo sapien
ctacttcttgatttgggcctggtga

SEQ ID NO: 487152 - DNA, 25 bp, Homo sapien
acttcttgatttgggcctggtgacc

SEQ ID NO: 487153 - DNA, 25 bp, Homo sapien
gcctggtgacccacctggaatggga

SEQ ID NO: 487154 - DNA, 25 bp, Homo sapien
cctggtgacccacctggaatgggaa

SEQ ID NO: 487155 - DNA, 25 bp, Homo sapien
aattaagtacttgagctataggaca

SEQ ID NO: 487156 - DNA, 25 bp, Homo sapien
gctataggacaaaccttgggcattt

SEQ ID NO: 487157 - DNA, 25 bp, Homo sapien
ttgggcatttaaccatttactgtct

SEQ ID NO: 487158 - DNA, 25 bp, Homo sapien
aatgtgattggcttaggtaatccca

SEQ ID NO: 487159 - DNA, 25 bp, Homo sapien
tgaggcaaagtagagcggcaacatt

SEQ ID NO: 487160 - DNA, 25 bp, Homo sapien
gtagagcggcaacattaagtgctat

SEQ ID NO: 487161 - DNA, 25 bp, Homo sapien
agtgctatgctagtcacttagctga

SEQ ID NO: 487162 - DNA, 25 bp, Homo sapien
gctagtcacttagctgacgtaacca

SEQ ID NO: 487163 - DNA, 25 bp, Homo sapien
ttagctgacgtaaccagcttggtta

SEQ ID NO: 487164 - DNA, 25 bp, Homo sapien
aaccagcttggttaagcagcttatg

SEQ ID NO: 487165 - DNA, 25 bp, Homo sapien
aagcagcttatgaaaccatataaag

SEQ ID NO: 487166 - DNA, 25 bp, Homo sapien
caaaatacaaatggcaggaagggtc

SEQ ID NO: 487167 - DNA, 25 bp, Homo sapien
gaagggtccatacagaaaagaacgt

SEQ ID NO: 487168 - DNA, 25 bp, Homo sapien
aaagaacgtctctgaggtccttgcg

SEQ ID NO: 487169 - DNA, 25 bp, Homo sapien
tctgaggtccttgcgtttttaataa

SEQ ID NO: 487170 - DNA, 25 bp, Homo sapien
aaatggtaagagtctttcgtgtggg

SEQ ID NO: 487171 - DNA, 25 bp, Homo sapien
cccagctgggcaagccttgattggc

SEQ ID NO: 487172 - DNA, 25 bp, Homo sapien
caagccttgattggccaggagtcca

SEQ ID NO: 487173 - DNA, 25 bp, Homo sapien
ccttgattggccaggagtccaggtg

SEQ ID NO: 487174 - DNA, 25 bp, Homo sapien
ggtgcccgaggtgtgacctcagccc

SEQ ID NO: 487175 - DNA, 25 bp, Homo sapien
ctgggcagaagcctaggcccgcaga

SEQ ID NO: 487176 - DNA, 25 bp, Homo sapien
gcctttctctctgggacaaaataca

SEQ ID NO: 487177 - DNA, 25 bp, Homo sapien
tgacttatttgcacaagaaattgaa

SEQ ID NO: 487178 - DNA, 25 bp, Homo sapien
gaaattgaatatagtccagttgaat

SEQ ID NO: 487179 - DNA, 25 bp, Homo sapien
ccagttgaattggagtcattgagca

SEQ ID NO: 487180 - DNA, 25 bp, Homo sapien
ttgaattggagtcattgagcaatga

SEQ ID NO: 487181 - DNA, 25 bp, Homo sapien
agagatggaatggaagaatacttca

SEQ ID NO: 487182 - DNA, 25 bp, Homo sapien
gaagaatacttcagatgttaaatcg

SEQ ID NO: 487183 - DNA, 25 bp, Homo sapien
gatgttaaatcgtttacgggtcgct

SEQ ID NO: 487184 - DNA, 25 bp, Homo sapien
tgttaaatcgtttacgggtcgctga

SEQ ID NO: 487185 - DNA, 25 bp, Homo sapien
gttaaatcgtttacgggtcgctgat

SEQ ID NO: 487186 - DNA, 25 bp, Homo sapien
aatcgtttacgggtcgctgatcagg

SEQ ID NO: 487187 - DNA, 25 bp, Homo sapien
atcgtttacgggtcgctgatcaggg

SEQ ID NO: 487188 - DNA, 25 bp, Homo sapien
atacttattatttttgcttagtgca

SEQ ID NO: 487189 - DNA, 25 bp, Homo sapien
gcttagtgcaaagataatgtgtgtt

SEQ ID NO: 487190 - DNA, 25 bp, Homo sapien
ataatgtgtgtttatgatgaaaacc

SEQ ID NO: 487191 - DNA, 25 bp, Homo sapien
aaaccctgaaaatgtagacaggtat

SEQ ID NO: 487192 - DNA, 25 bp, Homo sapien
aatagtccattaactaatcacccag

SEQ ID NO: 487193 - DNA, 25 bp, Homo sapien
gtccattaactaatcacccagaaat

SEQ ID NO: 487194 - DNA, 25 bp, Homo sapien
cattaactaatcacccagaaataac

SEQ ID NO: 487195 - DNA, 25 bp, Homo sapien
tacaaaataaatgggaggtcagtta

SEQ ID NO: 487196 - DNA, 25 bp, Homo sapien
atgggaggtcagttaaagtacgaga

SEQ ID NO: 487197 - DNA, 25 bp, Homo sapien
aggtcagttaaagtacgagataggt

SEQ ID NO: 487198 - DNA, 25 bp, Homo sapien
taaagtacgagataggtttggctgg

SEQ ID NO: 487199 - DNA, 25 bp, Homo sapien
atatccttgttatcctcgtagtgtg

SEQ ID NO: 487200 - DNA, 25 bp, Homo sapien
tgttatcctcgtagtgtgccaagtc

SEQ ID NO: 487201 - DNA, 25 bp, Homo sapien
tatcctcgtagtgtgccaagtcaga

SEQ ID NO: 487202 - DNA, 25 bp, Homo sapien
gtgtgccaagtcagaggctttctct

SEQ ID NO: 487203 - DNA, 25 bp, Homo sapien
tgccaagtcagaggctttctcttgc

SEQ ID NO: 487204 - DNA, 25 bp, Homo sapien
ggaaacagatttttgctgaatttct

SEQ ID NO: 487205 - DNA, 25 bp, Homo sapien
ttgctgaatttctggctcagatctt

SEQ ID NO: 487206 - DNA, 25 bp, Homo sapien
gaatttctggctcagatcttctagc

SEQ ID NO: 487207 - DNA, 25 bp, Homo sapien
gctcagatcttctagccaggaaagg

SEQ ID NO: 487208 - DNA, 25 bp, Homo sapien
gatcttctagccaggaaaggcaaga

SEQ ID NO: 487209 - DNA, 25 bp, Homo sapien
tgacatacactaatcattggccggg

SEQ ID NO: 487210 - DNA, 25 bp, Homo sapien
tttatactaaatgggctccttcatg

SEQ ID NO: 487211 - DNA, 25 bp, Homo sapien
aatcaagaactgaggcctgaggctg

SEQ ID NO: 487212 - DNA, 25 bp, Homo sapien
gaggctggttgtacaatgcccacgc

SEQ ID NO: 487213 - DNA, 25 bp, Homo sapien
ttcacctgggagtgctttcgatgtg

SEQ ID NO: 487214 - DNA, 25 bp, Homo sapien
tcgatgtgggcacctgggcttccta

SEQ ID NO: 487215 - DNA, 25 bp, Homo sapien
gcttcctagggctgcttctgagtgg

SEQ ID NO: 487216 - DNA, 25 bp, Homo sapien
tggttctttcacgtgttgtgtccat

SEQ ID NO: 487217 - DNA, 25 bp, Homo sapien
gtgtccatagctttagtcttcctaa

SEQ ID NO: 487218 - DNA, 25 bp, Homo sapien
taaataagatccacccacacctaag

SEQ ID NO: 487219 - DNA, 25 bp, Homo sapien
gtcacagaatttctaagttccccaa

SEQ ID NO: 487220 - DNA, 25 bp, Homo sapien
actactctcacacccttttaaagat

SEQ ID NO: 487221 - DNA, 25 bp, Homo sapien
actgttttccagtgtaaatctgaat

SEQ ID NO: 487222 - DNA, 25 bp, Homo sapien
aaatctgaatagcttggtctctgct

SEQ ID NO: 487223 - DNA, 25 bp, Homo sapien
ccatttctacatcccaattcagtga

SEQ ID NO: 487224 - DNA, 25 bp, Homo sapien
ccaattcagtgatactgggatctta

SEQ ID NO: 487225 - DNA, 25 bp, Homo sapien
gggatcttaataacctacctgtgag

SEQ ID NO: 487226 - DNA, 25 bp, Homo sapien
aacctacctgtgaggtgaagttgga

SEQ ID NO: 487227 - DNA, 25 bp, Homo sapien
gcataggcaaggatagttgtcctga

SEQ ID NO: 487228 - DNA, 25 bp, Homo sapien
gttgtcctgagagttttacacttgt

SEQ ID NO: 487229 - DNA, 25 bp, Homo sapien
aatactggcagctttgattttaaga

SEQ ID NO: 487230 - DNA, 25 bp, Homo sapien
gaatagatgatcgtggttcatgcct

SEQ ID NO: 487231 - DNA, 25 bp, Homo sapien
tggttcatgcctatactccctatac

SEQ ID NO: 487232 - DNA, 25 bp, Homo sapien
tatatgtatcttacccccaattctt

SEQ ID NO: 487233 - DNA, 25 bp, Homo sapien
agtttgccacatattacatgatttt

SEQ ID NO: 487234 - DNA, 25 bp, Homo sapien
ttaaataatcctcaaaatacccaag

SEQ ID NO: 487235 - DNA, 25 bp, Homo sapien
tttggtatgagtatactactttggt

SEQ ID NO: 487236 - DNA, 25 bp, Homo sapien
gtttaattttagcttcatggatgtt

SEQ ID NO: 487237 - DNA, 25 bp, Homo sapien
ttctgcatggaaggatttttgtttt

SEQ ID NO: 487238 - DNA, 25 bp, Homo sapien
ttttcccattgctagcagagtgaaa

SEQ ID NO: 487239 - DNA, 25 bp, Homo sapien
cattgctagcagagtgaaatccaag

SEQ ID NO: 487240 - DNA, 25 bp, Homo sapien
gaaatccaagagaccaaacatttgc

SEQ ID NO: 487241 - DNA, 25 bp, Homo sapien
gagaccaaacatttgcaagcattgt

SEQ ID NO: 487242 - DNA, 25 bp, Homo sapien
tgcaagcattgtatttgagcacttt

SEQ ID NO: 487243 - DNA, 25 bp, Homo sapien
ctgcatctgtaaaacgatgacaatg

SEQ ID NO: 487244 - DNA, 25 bp, Homo sapien
gatgacaatgacagagccaacctcg

SEQ ID NO: 487245 - DNA, 25 bp, Homo sapien
gacaatgacagagccaacctcgctt

SEQ ID NO: 487246 - DNA, 25 bp, Homo sapien
aatgacagagccaacctcgctttga

SEQ ID NO: 487247 - DNA, 25 bp, Homo sapien
tgacagagccaacctcgctttgagg

SEQ ID NO: 487248 - DNA, 25 bp, Homo sapien
acagagccaacctcgctttgaggat

SEQ ID NO: 487249 - DNA, 25 bp, Homo sapien
gagccaacctcgctttgaggatcac

SEQ ID NO: 487250 - DNA, 25 bp, Homo sapien
gccaacctcgctttgaggatcacat

SEQ ID NO: 487251 - DNA, 25 bp, Homo sapien
cctcgctttgaggatcacatgagtt

SEQ ID NO: 487252 - DNA, 25 bp, Homo sapien
cgctttgaggatcacatgagttaat

SEQ ID NO: 487253 - DNA, 25 bp, Homo sapien
gatcacatgagttaataaaggcctg

SEQ ID NO: 487254 - DNA, 25 bp, Homo sapien
ttcaagtttcatgtggagttgtatc

SEQ ID NO: 487255 - DNA, 25 bp, Homo sapien
gagttgtatctcactgtttggttac

SEQ ID NO: 487256 - DNA, 25 bp, Homo sapien
tatctcactgtttggttactttttc

SEQ ID NO: 487257 - DNA, 25 bp, Homo sapien
accaattggacttttctcccacctg

SEQ ID NO: 487258 - DNA, 25 bp, Homo sapien
gacagacttagtaatagcacccaac

SEQ ID NO: 487259 - DNA, 25 bp, Homo sapien
atagcacccaactgtttaactgagg

SEQ ID NO: 487260 - DNA, 25 bp, Homo sapien
aactgaggtagatccacattgtaaa

SEQ ID NO: 487261 - DNA, 25 bp, Homo sapien
tgtaaagaaagctgggtcccctcca

SEQ ID NO: 487262 - DNA, 25 bp, Homo sapien
tttctcccacctgtaatataaataa

SEQ ID NO: 487263 - DNA, 25 bp, Homo sapien
atatgtactgtttcatactgaattt

SEQ ID NO: 487264 - DNA, 25 bp, Homo sapien
tactgaattttttcaatgcattggg

SEQ ID NO: 487265 - DNA, 25 bp, Homo sapien
ggcccacccttaatggagacctgaa

SEQ ID NO: 487266 - DNA, 25 bp, Homo sapien
tattggttttcaccacagctgccaa

SEQ ID NO: 487267 - DNA, 25 bp, Homo sapien
taagaactacccattgctgggccac

SEQ ID NO: 487268 - DNA, 25 bp, Homo sapien
gggccacagatcaatcagagctcaa

SEQ ID NO: 487269 - DNA, 25 bp, Homo sapien
tcaacttatgtgcttcgggctgggc

SEQ ID NO: 487270 - DNA, 25 bp, Homo sapien
ggcactggtgtgtttctgaagctct

SEQ ID NO: 487271 - DNA, 25 bp, Homo sapien
aagctctgaagctcattcgaaggtg

SEQ ID NO: 487272 - DNA, 25 bp, Homo sapien
gagcctgggtcaaggaccactgaca

SEQ ID NO: 487273 - DNA, 25 bp, Homo sapien
acccactctgattttacctgcagtg

SEQ ID NO: 487274 - DNA, 25 bp, Homo sapien
cctgcagtgctctgggaactcatta

SEQ ID NO: 487275 - DNA, 25 bp, Homo sapien
ggaactcattactgggtcaagacaa

SEQ ID NO: 487276 - DNA, 25 bp, Homo sapien
tcctaagcttgcagggccaagtgct

SEQ ID NO: 487277 - DNA, 25 bp, Homo sapien
gaagtagtttggttctgatgtagat

SEQ ID NO: 487278 - DNA, 25 bp, Homo sapien
atctagtgggagatggcattggact

SEQ ID NO: 487279 - DNA, 25 bp, Homo sapien
cattggactgggaagggacatatgt

SEQ ID NO: 487280 - DNA, 25 bp, Homo sapien
gggacatatgtgaccccaataattc

SEQ ID NO: 487281 - DNA, 25 bp, Homo sapien
tatgtgaccccaataattctggaga

SEQ ID NO: 487282 - DNA, 25 bp, Homo sapien
gtgagaggtcagctgacatccttcc

SEQ ID NO: 487283 - DNA, 25 bp, Homo sapien
gcattttattgaagattcacctgca

SEQ ID NO: 487284 - DNA, 25 bp, Homo sapien
attcacctgcagatggataagaggg

SEQ ID NO: 487285 - DNA, 25 bp, Homo sapien
gggacactaagtggttctcatccta

SEQ ID NO: 487286 - DNA, 25 bp, Homo sapien
agtggttctcatcctaagcttgcag

SEQ ID NO: 487287 - DNA, 25 bp, Homo sapien
gatttcgttctctggtatgtttcat

SEQ ID NO: 487288 - DNA, 25 bp, Homo sapien
cagatgaacttattgctgttagtga

SEQ ID NO: 487289 - DNA, 25 bp, Homo sapien
aacttattgctgttagtgagatggt

SEQ ID NO: 487290 - DNA, 25 bp, Homo sapien
gtgagatggtgaagcactttaacct

SEQ ID NO: 487291 - DNA, 25 bp, Homo sapien
gcactttaaccttttgaatcaatag

SEQ ID NO: 487292 - DNA, 25 bp, Homo sapien
tttaacccaagaaaagagttgctct

SEQ ID NO: 487293 - DNA, 25 bp, Homo sapien
aagagttgctcttactatctactgc

SEQ ID NO: 487294 - DNA, 25 bp, Homo sapien
ttgctcttactatctactgctgact

SEQ ID NO: 487295 - DNA, 25 bp, Homo sapien
cttactatctactgctgactcttga

SEQ ID NO: 487296 - DNA, 25 bp, Homo sapien
actatctactgctgactcttgaact

SEQ ID NO: 487297 - DNA, 25 bp, Homo sapien
tctactgctgactcttgaacttttt

SEQ ID NO: 487298 - DNA, 25 bp, Homo sapien
tcctgtattccgatgatcatcctgt

SEQ ID NO: 487299 - DNA, 25 bp, Homo sapien
cctgtattccgatgatcatcctgta

SEQ ID NO: 487300 - DNA, 25 bp, Homo sapien
ctgtattccgatgatcatcctgtaa

SEQ ID NO: 487301 - DNA, 25 bp, Homo sapien
tgtattccgatgatcatcctgtaaa

SEQ ID NO: 487302 - DNA, 25 bp, Homo sapien
gtattccgatgatcatcctgtaaac

SEQ ID NO: 487303 - DNA, 25 bp, Homo sapien
tattccgatgatcatcctgtaaaca

SEQ ID NO: 487304 - DNA, 25 bp, Homo sapien
attccgatgatcatcctgtaaacat

SEQ ID NO: 487305 - DNA, 25 bp, Homo sapien
ttccgatgatcatcctgtaaacatt

SEQ ID NO: 487306 - DNA, 25 bp, Homo sapien
tccgatgatcatcctgtaaacattt

SEQ ID NO: 487307 - DNA, 25 bp, Homo sapien
ccgatgatcatcctgtaaacatttt

SEQ ID NO: 487308 - DNA, 25 bp, Homo sapien
cgatgatcatcctgtaaacatttta

SEQ ID NO: 487309 - DNA, 25 bp, Homo sapien
tgacttatttgcacaagaaattgaa

SEQ ID NO: 487310 - DNA, 25 bp, Homo sapien
gaaattgaatatagtccagttgaat

SEQ ID NO: 487311 - DNA, 25 bp, Homo sapien
ccagttgaattggagtcattgagca

SEQ ID NO: 487312 - DNA, 25 bp, Homo sapien
gaagaatacttcagatgttaaatcg

SEQ ID NO: 487313 - DNA, 25 bp, Homo sapien
gatgttaaatcgtttacgggtcgct

SEQ ID NO: 487314 - DNA, 25 bp, Homo sapien
tgttaaatcgtttacgggtcgctga

SEQ ID NO: 487315 - DNA, 25 bp, Homo sapien
aatcgtttacgggtcgctgatcagg

SEQ ID NO: 487316 - DNA, 25 bp, Homo sapien
atcgtttacgggtcgctgatcaggg

SEQ ID NO: 487317 - DNA, 25 bp, Homo sapien
tttacgggtcgctgatcagggccag

SEQ ID NO: 487318 - DNA, 25 bp, Homo sapien
tgatcagggccaggcggctgcagca

SEQ ID NO: 487319 - DNA, 25 bp, Homo sapien
agcgactgcagaggcgctgcgccaa

SEQ ID NO: 487320 - DNA, 25 bp, Homo sapien
acttcgaaggcttaactctgaaaca

SEQ ID NO: 487321 - DNA, 25 bp, Homo sapien
cttcgaaggcttaactctgaaacat

SEQ ID NO: 487322 - DNA, 25 bp, Homo sapien
ttcgaaggcttaactctgaaacatc

SEQ ID NO: 487323 - DNA, 25 bp, Homo sapien
tcgaaggcttaactctgaaacatca

SEQ ID NO: 487324 - DNA, 25 bp, Homo sapien
cgaaggcttaactctgaaacatcac

SEQ ID NO: 487325 - DNA, 25 bp, Homo sapien
gaaggcttaactctgaaacatcaca

SEQ ID NO: 487326 - DNA, 25 bp, Homo sapien
ctacctcaggttgaaacttttggct

SEQ ID NO: 487327 - DNA, 25 bp, Homo sapien
tacctcaggttgaaacttttggctt

SEQ ID NO: 487328 - DNA, 25 bp, Homo sapien
tcaggttgaaacttttggctttcgg

SEQ ID NO: 487329 - DNA, 25 bp, Homo sapien
ctttgtgcactgagtgatgtcacca

SEQ ID NO: 487330 - DNA, 25 bp, Homo sapien
ttgtgcactgagtgatgtcaccatt

SEQ ID NO: 487331 - DNA, 25 bp, Homo sapien
tcaagtccccgatgtgatggctcct

SEQ ID NO: 487332 - DNA, 25 bp, Homo sapien
tgatggctcctcagcatgatcagga

SEQ ID NO: 487333 - DNA, 25 bp, Homo sapien
agacctatttagatccgtcagccca

SEQ ID NO: 487334 - DNA, 25 bp, Homo sapien
tatttagatccgtcagcccacggac

SEQ ID NO: 487335 - DNA, 25 bp, Homo sapien
tttagatccgtcagcccacggacca

SEQ ID NO: 487336 - DNA, 25 bp, Homo sapien
caagcagtcattccctgttatacaa

SEQ ID NO: 487337 - DNA, 25 bp, Homo sapien
agtcattccctgttatacaagcaag

SEQ ID NO: 487338 - DNA, 25 bp, Homo sapien
attccctgttatacaagcaagagtc

SEQ ID NO: 487339 - DNA, 25 bp, Homo sapien
gttatacaagcaagagtcaggagga

SEQ ID NO: 487340 - DNA, 25 bp, Homo sapien
caggctgcggctggcatatggaggt

SEQ ID NO: 487341 - DNA, 25 bp, Homo sapien
gcatcagcttcacccggctggggat

SEQ ID NO: 487342 - DNA, 25 bp, Homo sapien
ggtcgctgatcagggccaggcggct

SEQ ID NO: 487343 - DNA, 25 bp, Homo sapien
gtcgctgatcagggccaggcggctg

SEQ ID NO: 487344 - DNA, 25 bp, Homo sapien
gctgatcagggccaggcggctgcag

SEQ ID NO: 487345 - DNA, 25 bp, Homo sapien
ctgatcagggccaggcggctgcagc

SEQ ID NO: 487346 - DNA, 25 bp, Homo sapien
tgatcagggccaggcggctgcagca

SEQ ID NO: 487347 - DNA, 25 bp, Homo sapien
tgcagaggcgctgcgccaagccggg

SEQ ID NO: 487348 - DNA, 25 bp, Homo sapien
gcagaggcgctgcgccaagccgggc

SEQ ID NO: 487349 - DNA, 25 bp, Homo sapien
gggccggagtggtgcgagccggcgg

SEQ ID NO: 487350 - DNA, 25 bp, Homo sapien
ctcagcccccgggataccgcccatc

SEQ ID NO: 487351 - DNA, 25 bp, Homo sapien
gataccgcccatcccaccccttact

SEQ ID NO: 487352 - DNA, 25 bp, Homo sapien
tcccaccccttactcggacccacag

SEQ ID NO: 487353 - DNA, 25 bp, Homo sapien
tctttctcaggaatggctgttaaaa

SEQ ID NO: 487354 - DNA, 25 bp, Homo sapien
aatatggtcttgtaactttcctgta

SEQ ID NO: 487355 - DNA, 25 bp, Homo sapien
tttcctgtacttagtgaacctcctt

SEQ ID NO: 487356 - DNA, 25 bp, Homo sapien
tgaacctccttatttacaccctgtt

SEQ ID NO: 487357 - DNA, 25 bp, Homo sapien
tgaagtggctgtgttcaccctgggt

SEQ ID NO: 487358 - DNA, 25 bp, Homo sapien
ttcaccctgggtggacacggaatgt

SEQ ID NO: 487359 - DNA, 25 bp, Homo sapien
acacggaatgtttttggcatgtaca

SEQ ID NO: 487360 - DNA, 25 bp, Homo sapien
caaagagaattttatgctgcctgtg

SEQ ID NO: 487361 - DNA, 25 bp, Homo sapien
atgctgcctgtgtacagttattaat

SEQ ID NO: 487362 - DNA, 25 bp, Homo sapien
gtacactcagctttttgtatctgta

SEQ ID NO: 487363 - DNA, 25 bp, Homo sapien
atatctgtgtatgtaagcaaacttg

SEQ ID NO: 487364 - DNA, 25 bp, Homo sapien
agccacctgtcctgggatggagtgt

SEQ ID NO: 487365 - DNA, 25 bp, Homo sapien
ggagtgtcagcatccaccccttggt

SEQ ID NO: 487366 - DNA, 25 bp, Homo sapien
atccaccccttggttgtcatcgagg

SEQ ID NO: 487367 - DNA, 25 bp, Homo sapien
tcctgggtgaagatatttgggccac

SEQ ID NO: 487368 - DNA, 25 bp, Homo sapien
cgtaggaaatagacacgtgcttttt

SEQ ID NO: 487369 - DNA, 25 bp, Homo sapien
acacgtgctttttaatgcaggacac

SEQ ID NO: 487370 - DNA, 25 bp, Homo sapien
gcaggacactttgagtgttacaaaa

SEQ ID NO: 487371 - DNA, 25 bp, Homo sapien
gttacaaaatctgtagacctggcag

SEQ ID NO: 487372 - DNA, 25 bp, Homo sapien
gacctggcagtagggtcatgatgtt

SEQ ID NO: 487373 - DNA, 25 bp, Homo sapien
tagtgccctaggttggtgacagaag

SEQ ID NO: 487374 - DNA, 25 bp, Homo sapien
acttgtgcacaggtgtctttggtga

SEQ ID NO: 487375 - DNA, 25 bp, Homo sapien
tcaggactcagttaggtgtgcccag

SEQ ID NO: 487376 - DNA, 25 bp, Homo sapien
actcagttaggtgtgcccagacgca

SEQ ID NO: 487377 - DNA, 25 bp, Homo sapien
tgcccagacgcactgacaaaatgac

SEQ ID NO: 487378 - DNA, 25 bp, Homo sapien
gcacctggaccagctatgggtagtt

SEQ ID NO: 487379 - DNA, 25 bp, Homo sapien
acacattctgtgtaagagccccact

SEQ ID NO: 487380 - DNA, 25 bp, Homo sapien
taagagccccactgagggctctgca

SEQ ID NO: 487381 - DNA, 25 bp, Homo sapien
ggctctgcagcggagtgacagcaac

SEQ ID NO: 487382 - DNA, 25 bp, Homo sapien
gatgaggcaccagagagtgccactg

SEQ ID NO: 487383 - DNA, 25 bp, Homo sapien
gtgccactgcatgagacacctgtga

SEQ ID NO: 487384 - DNA, 25 bp, Homo sapien
gacacctgtgaccattcgaagtctg

SEQ ID NO: 487385 - DNA, 25 bp, Homo sapien
gaccattcgaagtctgaaatgcggg

SEQ ID NO: 487386 - DNA, 25 bp, Homo sapien
ggctgtttgttcttcagcatattag

SEQ ID NO: 487387 - DNA, 25 bp, Homo sapien
gtaaagcgctcatttagagacatct

SEQ ID NO: 487388 - DNA, 25 bp, Homo sapien
gacatcttggtggtgctttttagca

SEQ ID NO: 487389 - DNA, 25 bp, Homo sapien
tgctttttagcacaactttcggcgc

SEQ ID NO: 487390 - DNA, 25 bp, Homo sapien
tagcacaactttcggcgctgactgt

SEQ ID NO: 487391 - DNA, 25 bp, Homo sapien
gctgactgtgcagccatcttcgaat

SEQ ID NO: 487392 - DNA, 25 bp, Homo sapien
gccatcttcgaatcccgagaatcga

SEQ ID NO: 487393 - DNA, 25 bp, Homo sapien
tggttagatgcgtaagcggtagtat

SEQ ID NO: 487394 - DNA, 25 bp, Homo sapien
gcggtagtatgcgagctcagttcgt

SEQ ID NO: 487395 - DNA, 25 bp, Homo sapien
atgcgagctcagttcgttgttgctg

SEQ ID NO: 487396 - DNA, 25 bp, Homo sapien
ttgttgctggttggctgtctagtcg

SEQ ID NO: 487397 - DNA, 25 bp, Homo sapien
tcagtctgaaaatccatttccttca

SEQ ID NO: 487398 - DNA, 25 bp, Homo sapien
agttctaggaaatttcatctgtatc

SEQ ID NO: 487399 - DNA, 25 bp, Homo sapien
gtatctttgaaaatgtccttcccta

SEQ ID NO: 487400 - DNA, 25 bp, Homo sapien
tgaaaatgtccttccctatatgttt

SEQ ID NO: 487401 - DNA, 25 bp, Homo sapien
atagtagttctattttggacctcct

SEQ ID NO: 487402 - DNA, 25 bp, Homo sapien
gtagttctattttggacctcctgga

SEQ ID NO: 487403 - DNA, 25 bp, Homo sapien
ttctattttggacctcctggatcaa

SEQ ID NO: 487404 - DNA, 25 bp, Homo sapien
ttttggacctcctggatcaattctc

SEQ ID NO: 487405 - DNA, 25 bp, Homo sapien
gacctcctggatcaattctctgtaa

SEQ ID NO: 487406 - DNA, 25 bp, Homo sapien
tcctggatcaattctctgtaattta

SEQ ID NO: 487407 - DNA, 25 bp, Homo sapien
aaatttacatggctaggtgcagtag

SEQ ID NO: 487408 - DNA, 25 bp, Homo sapien
ttttattaaccatgtctaactacgt

SEQ ID NO: 487409 - DNA, 25 bp, Homo sapien
aaccatgtctaactacgtatctgtg

SEQ ID NO: 487410 - DNA, 25 bp, Homo sapien
atgtctaactacgtatctgtgccac

SEQ ID NO: 487411 - DNA, 25 bp, Homo sapien
gtctaactacgtatctgtgccacag

SEQ ID NO: 487412 - DNA, 25 bp, Homo sapien
taactacgtatctgtgccacagctt

SEQ ID NO: 487413 - DNA, 25 bp, Homo sapien
gccacagcttgcagtgaggcaggcc

SEQ ID NO: 487414 - DNA, 25 bp, Homo sapien
gaggcaggccactcgtggcagatac

SEQ ID NO: 487415 - DNA, 25 bp, Homo sapien
gcaggccactcgtggcagatacaag

SEQ ID NO: 487416 - DNA, 25 bp, Homo sapien
gtgggtaggatggtcacactctgcc

SEQ ID NO: 487417 - DNA, 25 bp, Homo sapien
ggtaggatggtcacactctgcccat

SEQ ID NO: 487418 - DNA, 25 bp, Homo sapien
aggatggtcacactctgcccattgc

SEQ ID NO: 487419 - DNA, 25 bp, Homo sapien
gatctagactggaccctggtttgat

SEQ ID NO: 487420 - DNA, 25 bp, Homo sapien
agactggaccctggtttgatgaacc

SEQ ID NO: 487421 - DNA, 25 bp, Homo sapien
gaccctggtttgatgaaccagctgt

SEQ ID NO: 487422 - DNA, 25 bp, Homo sapien
gagaaaccggagtatgccctggact

SEQ ID NO: 487423 - DNA, 25 bp, Homo sapien
cggagtatgccctggactggatatt

SEQ ID NO: 487424 - DNA, 25 bp, Homo sapien
gtatgccctggactggatattaaat

SEQ ID NO: 487425 - DNA, 25 bp, Homo sapien
taaaacatttcatacaacacgattg

SEQ ID NO: 487426 - DNA, 25 bp, Homo sapien
aacacgattgtattttggcaagcaa

SEQ ID NO: 487427 - DNA, 25 bp, Homo sapien
gtattttggcaagcaaacacacaca

SEQ ID NO: 487428 - DNA, 25 bp, Homo sapien
tctcacacaggaaacgacctggaag

SEQ ID NO: 487429 - DNA, 25 bp, Homo sapien
gtgtttctgaaatttctacaattaa

SEQ ID NO: 487430 - DNA, 25 bp, Homo sapien
acatcatgtgtaactgtattaaaca

SEQ ID NO: 487431 - DNA, 25 bp, Homo sapien
catacacaagtgactgccaggcatg

SEQ ID NO: 487432 - DNA, 25 bp, Homo sapien
gactgccaggcatgggaatgtaact

SEQ ID NO: 487433 - DNA, 25 bp, Homo sapien
gtaacttccgagtaaatgctttggt

SEQ ID NO: 487434 - DNA, 25 bp, Homo sapien
gaatacactatgaacttctttccaa

SEQ ID NO: 487435 - DNA, 25 bp, Homo sapien
tgaacttctttccaaagacgggttg

SEQ ID NO: 487436 - DNA, 25 bp, Homo sapien
acgggttgtggtaaatagtggatat

SEQ ID NO: 487437 - DNA, 25 bp, Homo sapien
tccttgaagctttagctggagatac

SEQ ID NO: 487438 - DNA, 25 bp, Homo sapien
acagcaatagtgtggtgttcctaca

SEQ ID NO: 487439 - DNA, 25 bp, Homo sapien
ggtgttcctacaaatatcacagtgt

SEQ ID NO: 487440 - DNA, 25 bp, Homo sapien
agctgtgtgtttttatccaacttgt

SEQ ID NO: 487441 - DNA, 25 bp, Homo sapien
tataagtttctgtgcagcaaagtgg

SEQ ID NO: 487442 - DNA, 25 bp, Homo sapien
gtgcagcaaagtggctaattactca

SEQ ID NO: 487443 - DNA, 25 bp, Homo sapien
agcaaagtggctaattactcattaa

SEQ ID NO: 487444 - DNA, 25 bp, Homo sapien
aaagtggctaattactcattaaata

SEQ ID NO: 487445 - DNA, 25 bp, Homo sapien
gaatgtagtatctaaatccagcttt

SEQ ID NO: 487446 - DNA, 25 bp, Homo sapien
gtagtatctaaatccagctttttct

SEQ ID NO: 487447 - DNA, 25 bp, Homo sapien
cagctttttcttacctctggtacac

SEQ ID NO: 487448 - DNA, 25 bp, Homo sapien
tacctctggtacacttcagattact

SEQ ID NO: 487449 - DNA, 25 bp, Homo sapien
gtacacttcagattacttacctaat

SEQ ID NO: 487450 - DNA, 25 bp, Homo sapien
acttcagattacttacctaatacat

SEQ ID NO: 487451 - DNA, 25 bp, Homo sapien
gttccatagatggatttttgcccct

SEQ ID NO: 487452 - DNA, 25 bp, Homo sapien
caagaccaagcatcacatggagtgt

SEQ ID NO: 487453 - DNA, 25 bp, Homo sapien
agcatcacatggagtgtagggtcac

SEQ ID NO: 487454 - DNA, 25 bp, Homo sapien
gagcagaggtcacagcctctagaga

SEQ ID NO: 487455 - DNA, 25 bp, Homo sapien
gtgcatgggagtgtggctcatctcg

SEQ ID NO: 487456 - DNA, 25 bp, Homo sapien
tgaggtacacctttgcccctgtaag

SEQ ID NO: 487457 - DNA, 25 bp, Homo sapien
tttgcccctgtaagggcctctaggc

SEQ ID NO: 487458 - DNA, 25 bp, Homo sapien
ggctggagggcaaaggtcataacct

SEQ ID NO: 487459 - DNA, 25 bp, Homo sapien
agggcaaaggtcataacctcaccag

SEQ ID NO: 487460 - DNA, 25 bp, Homo sapien
gcaaaggtcataacctcaccagcca

SEQ ID NO: 487461 - DNA, 25 bp, Homo sapien
ctgaggtcatggaacctgggaacag

SEQ ID NO: 487462 - DNA, 25 bp, Homo sapien
gaacctgggaacagaagcctcaacc

SEQ ID NO: 487463 - DNA, 25 bp, Homo sapien
accaccaccctgaacaagagacgat

SEQ ID NO: 487464 - DNA, 25 bp, Homo sapien
accaccctgaacaagagacgataga

SEQ ID NO: 487465 - DNA, 25 bp, Homo sapien
acgatagaggagacgaggtccctgc

SEQ ID NO: 487466 - DNA, 25 bp, Homo sapien
caggatgatcttctgtgctgggaca

SEQ ID NO: 487467 - DNA, 25 bp, Homo sapien
gatcttctgtgctgggacagggact

SEQ ID NO: 487468 - DNA, 25 bp, Homo sapien
cttctgtgctgggacagggactctg

SEQ ID NO: 487469 - DNA, 25 bp, Homo sapien
ggacagggactctgcctcttggagt

SEQ ID NO: 487470 - DNA, 25 bp, Homo sapien
ggactctgcctcttggagtttggta

SEQ ID NO: 487471 - DNA, 25 bp, Homo sapien
ctctgcctcttggagtttggtagct

SEQ ID NO: 487472 - DNA, 25 bp, Homo sapien
gcctcttggagtttggtagctactt

SEQ ID NO: 487473 - DNA, 25 bp, Homo sapien
cttggagtttggtagctacttcttg

SEQ ID NO: 487474 - DNA, 25 bp, Homo sapien
gatcaaagggtgtgggagtatcacc

SEQ ID NO: 487475 - DNA, 25 bp, Homo sapien
tctcaggctgcagaaggtctcgagg

SEQ ID NO: 487476 - DNA, 25 bp, Homo sapien
aggtctcgagggtggcgtcacagca

SEQ ID NO: 487477 - DNA, 25 bp, Homo sapien
cacagcaggatttccgccttctgca

SEQ ID NO: 487478 - DNA, 25 bp, Homo sapien
gatttccgccttctgcattgcactg

SEQ ID NO: 487479 - DNA, 25 bp, Homo sapien
agagtaggtcactgccctctgggag

SEQ ID NO: 487480 - DNA, 25 bp, Homo sapien
tgccctctgggagtgttttgcagta

SEQ ID NO: 487481 - DNA, 25 bp, Homo sapien
gtgttgctacatagtcaagttcctt

SEQ ID NO: 487482 - DNA, 25 bp, Homo sapien
gagggctctctcactgctagatcta

SEQ ID NO: 487483 - DNA, 25 bp, Homo sapien
ctgctagatctaggctgagccatct

SEQ ID NO: 487484 - DNA, 25 bp, Homo sapien
gatctaggctgagccatctggaagg

SEQ ID NO: 487485 - DNA, 25 bp, Homo sapien
tttggttgtcagaactgcgggaggg

SEQ ID NO: 487486 - DNA, 25 bp, Homo sapien
ggtgctagtgacatctatgggtaga

SEQ ID NO: 487487 - DNA, 25 bp, Homo sapien
gctagtgacatctatgggtagaggc

SEQ ID NO: 487488 - DNA, 25 bp, Homo sapien
ccagctcaaaatgttattagtgcca

SEQ ID NO: 487489 - DNA, 25 bp, Homo sapien
gctcaaaatgttattagtgccaggt

SEQ ID NO: 487490 - DNA, 25 bp, Homo sapien
aaatgttattagtgccaggttgaga

SEQ ID NO: 487491 - DNA, 25 bp, Homo sapien
ggttgagaaactctggattaagtaa

SEQ ID NO: 487492 - DNA, 25 bp, Homo sapien
ctctggattaagtaaatagggcata

SEQ ID NO: 487493 - DNA, 25 bp, Homo sapien
gttagcacaaaagcctgtcttccag

SEQ ID NO: 487494 - DNA, 25 bp, Homo sapien
gtcttccaggaagggctaaaatggt

SEQ ID NO: 487495 - DNA, 25 bp, Homo sapien
aagggctaaaatggtggttctcaat

SEQ ID NO: 487496 - DNA, 25 bp, Homo sapien
accatggccttggtgcgcccgttga

SEQ ID NO: 487497 - DNA, 25 bp, Homo sapien
tggtgcgcccgttgatgacatagct

SEQ ID NO: 487498 - DNA, 25 bp, Homo sapien
gttgatgacatagctgcccagccgc

SEQ ID NO: 487499 - DNA, 25 bp, Homo sapien
cagtggcggatgacggcgtccacat

SEQ ID NO: 487500 - DNA, 25 bp, Homo sapien
atgacggcgtccacatgggccatga

SEQ ID NO: 487501 - DNA, 25 bp, Homo sapien
ccacatgggccatgagggcaccaat

SEQ ID NO: 487502 - DNA, 25 bp, Homo sapien
atgagggcaccaatgcttcgacagc

SEQ ID NO: 487503 - DNA, 25 bp, Homo sapien
aatgcttcgacagcctggttcatgg

SEQ ID NO: 487504 - DNA, 25 bp, Homo sapien
aggcaatctggtccccacggatgct

SEQ ID NO: 487505 - DNA, 25 bp, Homo sapien
gggatcgccctctggctcactagct

SEQ ID NO: 487506 - DNA, 25 bp, Homo sapien
ccaggaagctgtccttgacgcagat

SEQ ID NO: 487507 - DNA, 25 bp, Homo sapien
gaagactgttagaatgccctcggta

SEQ ID NO: 487508 - DNA, 25 bp, Homo sapien
gaatgccctcggtaacacagaggct

SEQ ID NO: 487509 - DNA, 25 bp, Homo sapien
acagaggctgagagatcctgacata

SEQ ID NO: 487510 - DNA, 25 bp, Homo sapien
ccttgtttgtcggaatctgatgctt

SEQ ID NO: 487511 - DNA, 25 bp, Homo sapien
gatgcttccaccagatgtctggatg

SEQ ID NO: 487512 - DNA, 25 bp, Homo sapien
gtgttccacttacttcttgaggtac

SEQ ID NO: 487513 - DNA, 25 bp, Homo sapien
cttgaggtacaaaaactgccggaga

SEQ ID NO: 487514 - DNA, 25 bp, Homo sapien
aaactgccggagattctggaattct

SEQ ID NO: 487515 - DNA, 25 bp, Homo sapien
gattctggaattctatcgtgatgca

SEQ ID NO: 487516 - DNA, 25 bp, Homo sapien
ggagtgaagccatttatgcctacgg

SEQ ID NO: 487517 - DNA, 25 bp, Homo sapien
aaatatgccctattgaatgtttgca

SEQ ID NO: 487518 - DNA, 25 bp, Homo sapien
cttggcaaaggcgatgtccttcagt

SEQ ID NO: 487519 - DNA, 25 bp, Homo sapien
aaaggcgatgtccttcagtcatctg

SEQ ID NO: 487520 - DNA, 25 bp, Homo sapien
tgtccttcagtcatctgtgataccc

SEQ ID NO: 487521 - DNA, 25 bp, Homo sapien
tctgtgatacccttcgctctcagct

SEQ ID NO: 487522 - DNA, 25 bp, Homo sapien
gctcctcttgcacccgggtcaggta

SEQ ID NO: 487523 - DNA, 25 bp, Homo sapien
gaactcccttcccagtcagacaggt

SEQ ID NO: 487524 - DNA, 25 bp, Homo sapien
ctggtcttgtggtggatgtcgttcc

SEQ ID NO: 487525 - DNA, 25 bp, Homo sapien
tcttgtggtggatgtcgttccaggt

SEQ ID NO: 487526 - DNA, 25 bp, Homo sapien
ttccaggtgatgacattcggtctcc

SEQ ID NO: 487527 - DNA, 25 bp, Homo sapien
gatgacattcggtctccctgtggtc

SEQ ID NO: 487528 - DNA, 25 bp, Homo sapien
tgctgggtcctagtagaggcagaca

SEQ ID NO: 487529 - DNA, 25 bp, Homo sapien
gggatccagcgaccaaaccagagga

SEQ ID NO: 487530 - DNA, 25 bp, Homo sapien
gatccagcgaccaaaccagaggatg

SEQ ID NO: 487531 - DNA, 25 bp, Homo sapien
cagcgaccaaaccagaggatgcact

SEQ ID NO: 487532 - DNA, 25 bp, Homo sapien
gcgaccaaaccagaggatgcactga

SEQ ID NO: 487533 - DNA, 25 bp, Homo sapien
caaaccagaggatgcactgaccgcc

SEQ ID NO: 487534 - DNA, 25 bp, Homo sapien
cagcttgcgagggtcgttggcccct

SEQ ID NO: 487535 - DNA, 25 bp, Homo sapien
gcgagggtcgttggcccctggaggc

SEQ ID NO: 487536 - DNA, 25 bp, Homo sapien
cgtcagcccgcctgccgggtggagg

SEQ ID NO: 487537 - DNA, 25 bp, Homo sapien
ccgggtggaggcgtctagtggcgtc

SEQ ID NO: 487538 - DNA, 25 bp, Homo sapien
ggaggcgtctagtggcgtcctgagc

SEQ ID NO: 487539 - DNA, 25 bp, Homo sapien
aggcgtctagtggcgtcctgagccc

SEQ ID NO: 487540 - DNA, 25 bp, Homo sapien
atctcctttgccatctttaattcac

SEQ ID NO: 487541 - DNA, 25 bp, Homo sapien
ctaggtgttctcttactgtctttaa

SEQ ID NO: 487542 - DNA, 25 bp, Homo sapien
ctgtctttaaaagcttcctgtattt

SEQ ID NO: 487543 - DNA, 25 bp, Homo sapien
tcctgtattttattagtggtccttg

SEQ ID NO: 487544 - DNA, 25 bp, Homo sapien
attagtggtccttgaaaaactgtga

SEQ ID NO: 487545 - DNA, 25 bp, Homo sapien
agtaggatattttgacctgactgga

SEQ ID NO: 487546 - DNA, 25 bp, Homo sapien
cctgactggaaagatggttgtgttt

SEQ ID NO: 487547 - DNA, 25 bp, Homo sapien
attgccaggtaataagtgtgatcat

SEQ ID NO: 487548 - DNA, 25 bp, Homo sapien
gatcattgttgaacttcagctccag

SEQ ID NO: 487549 - DNA, 25 bp, Homo sapien
gtctctccagaataagacattggca

SEQ ID NO: 487550 - DNA, 25 bp, Homo sapien
ggcattcaaatgtctatatcttgtt

SEQ ID NO: 487551 - DNA, 25 bp, Homo sapien
gggcctcaggaattccgctgcggcc

SEQ ID NO: 487552 - DNA, 25 bp, Homo sapien
tcaggaattccgctgcggcccaagg

SEQ ID NO: 487553 - DNA, 25 bp, Homo sapien
ggcccaaggcttgccgtttgacgag

SEQ ID NO: 487554 - DNA, 25 bp, Homo sapien
aaggcttgccgtttgacgaggagca

SEQ ID NO: 487555 - DNA, 25 bp, Homo sapien
gcttgccgtttgacgaggagcagtc

SEQ ID NO: 487556 - DNA, 25 bp, Homo sapien
ttgccgtttgacgaggagcagtcgc

SEQ ID NO: 487557 - DNA, 25 bp, Homo sapien
agcagtcgcggtaggcggtgggcaa

SEQ ID NO: 487558 - DNA, 25 bp, Homo sapien
cgcggctcggactccagcatggcga

SEQ ID NO: 487559 - DNA, 25 bp, Homo sapien
atggcgaccgcggtgcgcgctgtgg

SEQ ID NO: 487560 - DNA, 25 bp, Homo sapien
ctccccgtgctgtgtagcgggacgg

SEQ ID NO: 487561 - DNA, 25 bp, Homo sapien
tagcgggacggcaggtcatttattg

SEQ ID NO: 487562 - DNA, 25 bp, Homo sapien
gaagtcactgtgacagttctccagg

SEQ ID NO: 487563 - DNA, 25 bp, Homo sapien
gtcactgtgacagttctccaggaag

SEQ ID NO: 487564 - DNA, 25 bp, Homo sapien
cactgtgacagttctccaggaagga

SEQ ID NO: 487565 - DNA, 25 bp, Homo sapien
ctgtgacagttctccaggaaggagg

SEQ ID NO: 487566 - DNA, 25 bp, Homo sapien
cgaggccccgaaaagcactggtcgt

SEQ ID NO: 487567 - DNA, 25 bp, Homo sapien
aggccccgaaaagcactggtcgtca

SEQ ID NO: 487568 - DNA, 25 bp, Homo sapien
gccccgaaaagcactggtcgtcagg

SEQ ID NO: 487569 - DNA, 25 bp, Homo sapien
gaaaagcactggtcgtcagggagct

SEQ ID NO: 487570 - DNA, 25 bp, Homo sapien
aaagcactggtcgtcagggagctcc

SEQ ID NO: 487571 - DNA, 25 bp, Homo sapien
aagcactggtcgtcagggagctcct

SEQ ID NO: 487572 - DNA, 25 bp, Homo sapien
agcactggtcgtcagggagctcctc

SEQ ID NO: 487573 - DNA, 25 bp, Homo sapien
gaagtcactgtgacagttctccagg

SEQ ID NO: 487574 - DNA, 25 bp, Homo sapien
gtcactgtgacagttctccaggaag

SEQ ID NO: 487575 - DNA, 25 bp, Homo sapien
actgtgacagttctccaggaaggag

SEQ ID NO: 487576 - DNA, 25 bp, Homo sapien
cgaggccccgaaaagcactggtcgt

SEQ ID NO: 487577 - DNA, 25 bp, Homo sapien
aggccccgaaaagcactggtcgtca

SEQ ID NO: 487578 - DNA, 25 bp, Homo sapien
gccccgaaaagcactggtcgtcagg

SEQ ID NO: 487579 - DNA, 25 bp, Homo sapien
gaaaagcactggtcgtcagggagct

SEQ ID NO: 487580 - DNA, 25 bp, Homo sapien
aaagcactggtcgtcagggagctcc

SEQ ID NO: 487581 - DNA, 25 bp, Homo sapien
agcactggtcgtcagggagctcctc

SEQ ID NO: 487582 - DNA, 25 bp, Homo sapien
gtttcttcccactgcactgtggtgc

SEQ ID NO: 487583 - DNA, 25 bp, Homo sapien
gtcacatacaccagcatctttctgt

SEQ ID NO: 487584 - DNA, 25 bp, Homo sapien
acttttgggccctcagcttatctcg

SEQ ID NO: 487585 - DNA, 25 bp, Homo sapien
ggccctcagcttatctcgggcaggg

SEQ ID NO: 487586 - DNA, 25 bp, Homo sapien
gtgctgaggtataagccctgggccc

SEQ ID NO: 487587 - DNA, 25 bp, Homo sapien
ccttcctggagaagactctcaaaag

SEQ ID NO: 487588 - DNA, 25 bp, Homo sapien
ctgtatatttgagttcaccagcaat

SEQ ID NO: 487589 - DNA, 25 bp, Homo sapien
ataactccccacactcgaagcaggt

SEQ ID NO: 487590 - DNA, 25 bp, Homo sapien
cttgggctctgtggcactgtcttcc

SEQ ID NO: 487591 - DNA, 25 bp, Homo sapien
ctctgtggcactgtcttcccaagat

SEQ ID NO: 487592 - DNA, 25 bp, Homo sapien
tgtcttcccaagatccttcctgttg

SEQ ID NO: 487593 - DNA, 25 bp, Homo sapien
aagatccttcctgttgcacaatggg

SEQ ID NO: 487594 - DNA, 25 bp, Homo sapien
tcctgttgcacaatgggaaacctaa

SEQ ID NO: 487595 - DNA, 25 bp, Homo sapien
gaggacaacgtgatcactgtattca

SEQ ID NO: 487596 - DNA, 25 bp, Homo sapien
gaatggtccaggttcttctagatga

SEQ ID NO: 487597 - DNA, 25 bp, Homo sapien
ggttcttctagatgatctgcacaaa

SEQ ID NO: 487598 - DNA, 25 bp, Homo sapien
ttctagatgatctgcacaaatggct

SEQ ID NO: 487599 - DNA, 25 bp, Homo sapien
tagatgatctgcacaaatggctcct

SEQ ID NO: 487600 - DNA, 25 bp, Homo sapien
agatgatctgcacaaatggctcctc

SEQ ID NO: 487601 - DNA, 25 bp, Homo sapien
gatgatctgcacaaatggctcctct

SEQ ID NO: 487602 - DNA, 25 bp, Homo sapien
atgatctgcacaaatggctcctctc

SEQ ID NO: 487603 - DNA, 25 bp, Homo sapien
gatctgcacaaatggctcctctcct

SEQ ID NO: 487604 - DNA, 25 bp, Homo sapien
tcctccttcctgatgtctgccatta

SEQ ID NO: 487605 - DNA, 25 bp, Homo sapien
cctccttcctgatgtctgccattag

SEQ ID NO: 487606 - DNA, 25 bp, Homo sapien
cctgcaaaactgactgtaactggag

SEQ ID NO: 487607 - DNA, 25 bp, Homo sapien
gcaaaactgactgtaactggagagc

SEQ ID NO: 487608 - DNA, 25 bp, Homo sapien
aaaactgactgtaactggagagcta

SEQ ID NO: 487609 - DNA, 25 bp, Homo sapien
aactgactgtaactggagagctacg

SEQ ID NO: 487610 - DNA, 25 bp, Homo sapien
tgactgtaactggagagctacgggc

SEQ ID NO: 487611 - DNA, 25 bp, Homo sapien
actgtaactggagagctacgggcat

SEQ ID NO: 487612 - DNA, 25 bp, Homo sapien
tgtaactggagagctacgggcatgc

SEQ ID NO: 487613 - DNA, 25 bp, Homo sapien
taactggagagctacgggcatgcag

SEQ ID NO: 487614 - DNA, 25 bp, Homo sapien
aactggagagctacgggcatgcaga

SEQ ID NO: 487615 - DNA, 25 bp, Homo sapien
gggcatgcagaagttggaagacgag

SEQ ID NO: 487616 - DNA, 25 bp, Homo sapien
ttggaagacgagggaaggcatcaca

SEQ ID NO: 487617 - DNA, 25 bp, Homo sapien
gacacccagctgtgtggtgctcgat

SEQ ID NO: 487618 - DNA, 25 bp, Homo sapien
ggtgctcgattttgtgattcctcag

SEQ ID NO: 487619 - DNA, 25 bp, Homo sapien
ttgtgattcctcaggcaactccttt

SEQ ID NO: 487620 - DNA, 25 bp, Homo sapien
aactcctttgctgtgactggctatg

SEQ ID NO: 487621 - DNA, 25 bp, Homo sapien
ggctatgaccttgcggagatccgga

SEQ ID NO: 487622 - DNA, 25 bp, Homo sapien
agatccggagattcagcagtgtgtg

SEQ ID NO: 487623 - DNA, 25 bp, Homo sapien
ttcctttgtccctgtggtattcata

SEQ ID NO: 487624 - DNA, 25 bp, Homo sapien
ggtattcataaagtacccgctccac

SEQ ID NO: 487625 - DNA, 25 bp, Homo sapien
acctggcttctgaggtgggcaagct

SEQ ID NO: 487626 - DNA, 25 bp, Homo sapien
tgggcaagctactctctgcaggtga

SEQ ID NO: 487627 - DNA, 25 bp, Homo sapien
ggtgaggacacctttgtgcatatct

SEQ ID NO: 487628 - DNA, 25 bp, Homo sapien
aagctggatcctgcacaaagggatg

SEQ ID NO: 487629 - DNA, 25 bp, Homo sapien
gctggatcctgcacaaagggatgtg

SEQ ID NO: 487630 - DNA, 25 bp, Homo sapien
tggatcctgcacaaagggatgtgat

SEQ ID NO: 487631 - DNA, 25 bp, Homo sapien
atcctgcacaaagggatgtgatgct

SEQ ID NO: 487632 - DNA, 25 bp, Homo sapien
gaacctagtctcactttggcttcca

SEQ ID NO: 487633 - DNA, 25 bp, Homo sapien
aacctagtctcactttggcttccag

SEQ ID NO: 487634 - DNA, 25 bp, Homo sapien
acctagtctcactttggcttccagt

SEQ ID NO: 487635 - DNA, 25 bp, Homo sapien
ctagtctcactttggcttccagttt

SEQ ID NO: 487636 - DNA, 25 bp, Homo sapien
ggaaaagaaccattgaagcttgaga

SEQ ID NO: 487637 - DNA, 25 bp, Homo sapien
aagaaccattgaagcttgagagaaa

SEQ ID NO: 487638 - DNA, 25 bp, Homo sapien
gaaaagcccccaaaagcagctattc

SEQ ID NO: 487639 - DNA, 25 bp, Homo sapien
tgatcaagccttcatttattttagg

SEQ ID NO: 487640 - DNA, 25 bp, Homo sapien
ttgatccattttgttttccctgctg

SEQ ID NO: 487641 - DNA, 25 bp, Homo sapien
tattctgtatttatgattctctgag

SEQ ID NO: 487642 - DNA, 25 bp, Homo sapien
aagtcttaggtttgacattgcagta

SEQ ID NO: 487643 - DNA, 25 bp, Homo sapien
ggtttgacattgcagtagttgacat

SEQ ID NO: 487644 - DNA, 25 bp, Homo sapien
attgcagtagttgacatacacggta

SEQ ID NO: 487645 - DNA, 25 bp, Homo sapien
gtagttgacatacacggtaaaggat

SEQ ID NO: 487646 - DNA, 25 bp, Homo sapien
gtaaaggataacctagtgacaaatc

SEQ ID NO: 487647 - DNA, 25 bp, Homo sapien
tgacaaatcactgaagatgcttcct

SEQ ID NO: 487648 - DNA, 25 bp, Homo sapien
agatgcttcctttgttacctcaaaa

SEQ ID NO: 487649 - DNA, 25 bp, Homo sapien
acaggattggctgttttccaagaac

SEQ ID NO: 487650 - DNA, 25 bp, Homo sapien
agcaccttcaaagggacacctacgg

SEQ ID NO: 487651 - DNA, 25 bp, Homo sapien
gacacctacggcagagaacccagag

SEQ ID NO: 487652 - DNA, 25 bp, Homo sapien
agtacctgggtctggacgtgccagt

SEQ ID NO: 487653 - DNA, 25 bp, Homo sapien
tggacgtgccagtgtgaaccagaag

SEQ ID NO: 487654 - DNA, 25 bp, Homo sapien
agaaggccaagtccgcagaagccct

SEQ ID NO: 487655 - DNA, 25 bp, Homo sapien
gggaacctgccatgccaggaacctg

SEQ ID NO: 487656 - DNA, 25 bp, Homo sapien
gccaggaacctgtcctaaggaacct

SEQ ID NO: 487657 - DNA, 25 bp, Homo sapien
tgtcctaaggaaccttccttcctgc

SEQ ID NO: 487658 - DNA, 25 bp, Homo sapien
ttccttcctgcttgagttcccagat

SEQ ID NO: 487659 - DNA, 25 bp, Homo sapien
tgcttgagttcccagatggctggaa

SEQ ID NO: 487660 - DNA, 25 bp, Homo sapien
ggtccagcctcgttggaagaggaac

SEQ ID NO: 487661 - DNA, 25 bp, Homo sapien
caaatgtgtgagtctgctatggatt

SEQ ID NO: 487662 - DNA, 25 bp, Homo sapien
ccacagatagtttgagaagcccagc

SEQ ID NO: 487663 - DNA, 25 bp, Homo sapien
atagtttgagaagcccagcactgcc

SEQ ID NO: 487664 - DNA, 25 bp, Homo sapien
gtttgagaagcccagcactgccact

SEQ ID NO: 487665 - DNA, 25 bp, Homo sapien
gccactcaacaaatgctggtgcatt

SEQ ID NO: 487666 - DNA, 25 bp, Homo sapien
atattctgcagctattaaaggagtt

SEQ ID NO: 487667 - DNA, 25 bp, Homo sapien
agttaaaactgcctccacttacctg

SEQ ID NO: 487668 - DNA, 25 bp, Homo sapien
tggaggcccatctgtgacacctttt

SEQ ID NO: 487669 - DNA, 25 bp, Homo sapien
gaaaaacttgcttaggactgaatat

SEQ ID NO: 487670 - DNA, 25 bp, Homo sapien
aggactgaatatgagcggttgcaat

SEQ ID NO: 487671 - DNA, 25 bp, Homo sapien
gagcggttgcaatttgtaacaatga

SEQ ID NO: 487672 - DNA, 25 bp, Homo sapien
gcaaagctgtaaaaactaggtgcta

SEQ ID NO: 487673 - DNA, 25 bp, Homo sapien
gctagtgggcacctaatatcatcat

SEQ ID NO: 487674 - DNA, 25 bp, Homo sapien
tttcaagctaatatgcaaaatccca

SEQ ID NO: 487675 - DNA, 25 bp, Homo sapien
atcccatctctgtttttaaactaag

SEQ ID NO: 487676 - DNA, 25 bp, Homo sapien
aaacagtctactcagcttgacaagt

SEQ ID NO: 487677 - DNA, 25 bp, Homo sapien
cagtctactcagcttgacaagtgtt

SEQ ID NO: 487678 - DNA, 25 bp, Homo sapien
cagcttgacaagtgttttatgttaa

SEQ ID NO: 487679 - DNA, 25 bp, Homo sapien
atgttaaattggctggtggtttgaa

SEQ ID NO: 487680 - DNA, 25 bp, Homo sapien
gtggtttgaaatgaatcatcttcac

SEQ ID NO: 487681 - DNA, 25 bp, Homo sapien
tcatcttcacataatgttttcttta

SEQ ID NO: 487682 - DNA, 25 bp, Homo sapien
aactctaattcttgttattctgtgt

SEQ ID NO: 487683 - DNA, 25 bp, Homo sapien
gaaagcaatgccaaatggttgtgga

SEQ ID NO: 487684 - DNA, 25 bp, Homo sapien
agaaagtggccggagcctccctgga

SEQ ID NO: 487685 - DNA, 25 bp, Homo sapien
tccctggagtggagcagccctgaag

SEQ ID NO: 487686 - DNA, 25 bp, Homo sapien
tgcgggccgctgttttggtttgaca

SEQ ID NO: 487687 - DNA, 25 bp, Homo sapien
gccgctgttttggtttgacatgaca

SEQ ID NO: 487688 - DNA, 25 bp, Homo sapien
ttgacatgacaaggaaaggacttcc

SEQ ID NO: 487689 - DNA, 25 bp, Homo sapien
aaggacttcctgctgaccctgagag

SEQ ID NO: 487690 - DNA, 25 bp, Homo sapien
gcatgattgtgctagcgtttagtct

SEQ ID NO: 487691 - DNA, 25 bp, Homo sapien
gctagcgtttagtctgagttgatct

SEQ ID NO: 487692 - DNA, 25 bp, Homo sapien
gcgtttagtctgagttgatcttttt

SEQ ID NO: 487693 - DNA, 25 bp, Homo sapien
tctttttaaaactgcaagtgttgaa

SEQ ID NO: 487694 - DNA, 25 bp, Homo sapien
catatttattactgactttgagtca

SEQ ID NO: 487695 - DNA, 25 bp, Homo sapien
taaaatagcagtgccacagctcgtc

SEQ ID NO: 487696 - DNA, 25 bp, Homo sapien
ccacagctcgtctcttgccttagtg

SEQ ID NO: 487697 - DNA, 25 bp, Homo sapien
agaaccaaaatccagcacagcatcc

SEQ ID NO: 487698 - DNA, 25 bp, Homo sapien
agcatcctgtgaagccacgtgtaat

SEQ ID NO: 487699 - DNA, 25 bp, Homo sapien
gccacgtgtaatgatggtcccataa

SEQ ID NO: 487700 - DNA, 25 bp, Homo sapien
gtatgtgaatatggctcttgtaaag

SEQ ID NO: 487701 - DNA, 25 bp, Homo sapien
ctattgtaattttagcttatgctct

SEQ ID NO: 487702 - DNA, 25 bp, Homo sapien
gcttatgctctgtattctgttttct

SEQ ID NO: 487703 - DNA, 25 bp, Homo sapien
tctatggaattatttaagccctttt

SEQ ID NO: 487704 - DNA, 25 bp, Homo sapien
agcccttttagtgacctttgtcctg

SEQ ID NO: 487705 - DNA, 25 bp, Homo sapien
gaagccagactcaagggtatatact

SEQ ID NO: 487706 - DNA, 25 bp, Homo sapien
gggtatatactctgtgattctattc

SEQ ID NO: 487707 - DNA, 25 bp, Homo sapien
tattcataggacttaaacaggcaca

SEQ ID NO: 487708 - DNA, 25 bp, Homo sapien
aacaggcacaatcaaaaccatctca

SEQ ID NO: 487709 - DNA, 25 bp, Homo sapien
accatctcagtcagaagtcagagcg

SEQ ID NO: 487710 - DNA, 25 bp, Homo sapien
agtcagaagtcagagcgtggtacct

SEQ ID NO: 487711 - DNA, 25 bp, Homo sapien
gtggtacctgggagagaaccccgag

SEQ ID NO: 487712 - DNA, 25 bp, Homo sapien
catgttggtgatatggacgtacttc

SEQ ID NO: 487713 - DNA, 25 bp, Homo sapien
gatatggacgtacttcacttgtgaa

SEQ ID NO: 487714 - DNA, 25 bp, Homo sapien
ataaagctgggacaatggcataaat

SEQ ID NO: 487715 - DNA, 25 bp, Homo sapien
gggacaatggcataaatgaatctca

SEQ ID NO: 487716 - DNA, 25 bp, Homo sapien
ggaacactgttttcaagaagggtca

SEQ ID NO: 487717 - DNA, 25 bp, Homo sapien
aatggtcaggactttgtgggcaaat

SEQ ID NO: 487718 - DNA, 25 bp, Homo sapien
ctttgtgggcaaatatctagtctgg

SEQ ID NO: 487719 - DNA, 25 bp, Homo sapien
atatctagtctggaaatgcccttgg

SEQ ID NO: 487720 - DNA, 25 bp, Homo sapien
tggaaatgcccttggaattttgtaa

SEQ ID NO: 487721 - DNA, 25 bp, Homo sapien
atgagagctcttcctactaggctgc

SEQ ID NO: 487722 - DNA, 25 bp, Homo sapien
taggctgcgggttcttctgttctca

SEQ ID NO: 487723 - DNA, 25 bp, Homo sapien
cattcttttcactccgataaagaga

SEQ ID NO: 487724 - DNA, 25 bp, Homo sapien
gagaactgctctttttcctatttcc

SEQ ID NO: 487725 - DNA, 25 bp, Homo sapien
cattcattcttgctagtcacaggtt

SEQ ID NO: 487726 - DNA, 25 bp, Homo sapien
gctagtcacaggttgcatgaacaga

SEQ ID NO: 487727 - DNA, 25 bp, Homo sapien
gactgtaattgtccactacccaccc

SEQ ID NO: 487728 - DNA, 25 bp, Homo sapien
tgtaattgtccactacccacccaaa

SEQ ID NO: 487729 - DNA, 25 bp, Homo sapien
gtaattgtccactacccacccaaat

SEQ ID NO: 487730 - DNA, 25 bp, Homo sapien
tcccttcactgactcctttttcaga

SEQ ID NO: 487731 - DNA, 25 bp, Homo sapien
ccttcactgactcctttttcagact

SEQ ID NO: 487732 - DNA, 25 bp, Homo sapien
cttcactgactcctttttcagactc

SEQ ID NO: 487733 - DNA, 25 bp, Homo sapien
ttcactgactcctttttcagactca

SEQ ID NO: 487734 - DNA, 25 bp, Homo sapien
tcactgactcctttttcagactcag

SEQ ID NO: 487735 - DNA, 25 bp, Homo sapien
gactcctttttcagactcagcctgc

SEQ ID NO: 487736 - DNA, 25 bp, Homo sapien
actcctttttcagactcagcctgcc

SEQ ID NO: 487737 - DNA, 25 bp, Homo sapien
tcctttttcagactcagcctgcctg

SEQ ID NO: 487738 - DNA, 25 bp, Homo sapien
tctaaacagtctgctcagaaatgtt

SEQ ID NO: 487739 - DNA, 25 bp, Homo sapien
ttctgtttcctattcaaattgctgt

SEQ ID NO: 487740 - DNA, 25 bp, Homo sapien
caaattgctgttttgtctcctatgt

SEQ ID NO: 487741 - DNA, 25 bp, Homo sapien
ttgtctcctatgtttaatcatgtat

SEQ ID NO: 487742 - DNA, 25 bp, Homo sapien
tttctcatttggtggtaatttcaag

SEQ ID NO: 487743 - DNA, 25 bp, Homo sapien
atttcaagaagagcgtttatccact

SEQ ID NO: 487744 - DNA, 25 bp, Homo sapien
gaagagcgtttatccactattgatt

SEQ ID NO: 487745 - DNA, 25 bp, Homo sapien
gcgtttatccactattgattttcaa

SEQ ID NO: 487746 - DNA, 25 bp, Homo sapien
gaaaccaagcagcattgaaatcatg

SEQ ID NO: 487747 - DNA, 25 bp, Homo sapien
gtggaagtcatttgtgtctgcagct

SEQ ID NO: 487748 - DNA, 25 bp, Homo sapien
gtcatttgtgtctgcagctgttttt

SEQ ID NO: 487749 - DNA, 25 bp, Homo sapien
atgacacagccgcatccttgccagg

SEQ ID NO: 487750 - DNA, 25 bp, Homo sapien
tgacacagccgcatccttgccaggg

SEQ ID NO: 487751 - DNA, 25 bp, Homo sapien
gcatccttgccagggccggagggag

SEQ ID NO: 487752 - DNA, 25 bp, Homo sapien
gtggatggacttataggtgttgctt

SEQ ID NO: 487753 - DNA, 25 bp, Homo sapien
ggatggacttataggtgttgcttgt

SEQ ID NO: 487754 - DNA, 25 bp, Homo sapien
cttgattttccccacgagatatgcg

SEQ ID NO: 487755 - DNA, 25 bp, Homo sapien
ttgattttccccacgagatatgcgt

SEQ ID NO: 487756 - DNA, 25 bp, Homo sapien
gattttccccacgagatatgcgtgc

SEQ ID NO: 487757 - DNA, 25 bp, Homo sapien
attttccccacgagatatgcgtgcc

SEQ ID NO: 487758 - DNA, 25 bp, Homo sapien
acgagatatgcgtgccccagggaac

SEQ ID NO: 487759 - DNA, 25 bp, Homo sapien
ttcccaccctcagcctagagtcaag

SEQ ID NO: 487760 - DNA, 25 bp, Homo sapien
tatgatatgtcgcttctccagaatt

SEQ ID NO: 487761 - DNA, 25 bp, Homo sapien
gcttctccagaattttaacttcagg

SEQ ID NO: 487762 - DNA, 25 bp, Homo sapien
aacactaaagacatgactcacaaag

SEQ ID NO: 487763 - DNA, 25 bp, Homo sapien
gactcacaaaggtaactggtacaaa

SEQ ID NO: 487764 - DNA, 25 bp, Homo sapien
acattgtacacaacagcctggtggt

SEQ ID NO: 487765 - DNA, 25 bp, Homo sapien
cctggtggtctctaaagccaacagt

SEQ ID NO: 487766 - DNA, 25 bp, Homo sapien
gtctctaaagccaacagtgtcctgt

SEQ ID NO: 487767 - DNA, 25 bp, Homo sapien
aacagtgtcctgtaccctgaaatca

SEQ ID NO: 487768 - DNA, 25 bp, Homo sapien
gtgtcctgtaccctgaaatcagcac

SEQ ID NO: 487769 - DNA, 25 bp, Homo sapien
aaatcagcacagaaacaccggccct

SEQ ID NO: 487770 - DNA, 25 bp, Homo sapien
atactcactcgcatattctctggag

SEQ ID NO: 487771 - DNA, 25 bp, Homo sapien
tctggtcttccagcgaggtgggaga

SEQ ID NO: 487772 - DNA, 25 bp, Homo sapien
agcggtccctgcagaagccagaagg

SEQ ID NO: 487773 - DNA, 25 bp, Homo sapien
gtccctgcagaagccagaaggtgca

SEQ ID NO: 487774 - DNA, 25 bp, Homo sapien
agcatcggagggagtcccagagccc

SEQ ID NO: 487775 - DNA, 25 bp, Homo sapien
ggaccttgggcctagaccgcgtgat

SEQ ID NO: 487776 - DNA, 25 bp, Homo sapien
cttgggcctagaccgcgtgataaaa

SEQ ID NO: 487777 - DNA, 25 bp, Homo sapien
ggcctagaccgcgtgataaaactgg

SEQ ID NO: 487778 - DNA, 25 bp, Homo sapien
gaccgcgtgataaaactgggttgag

SEQ ID NO: 487779 - DNA, 25 bp, Homo sapien
gagggatgctggaaccagttacgac

SEQ ID NO: 487780 - DNA, 25 bp, Homo sapien
gaaccagttacgactgaagtcagtg

SEQ ID NO: 487781 - DNA, 25 bp, Homo sapien
aagtcagtgtagacctgagctggga

SEQ ID NO: 487782 - DNA, 25 bp, Homo sapien
gtgtctgtgcagaatacacagcttt

SEQ ID NO: 487783 - DNA, 25 bp, Homo sapien
gaatacacagcttttaacttggtca

SEQ ID NO: 487784 - DNA, 25 bp, Homo sapien
gcttttaacttggtcatacctctcc

SEQ ID NO: 487785 - DNA, 25 bp, Homo sapien
atacctctcccccaggatcataagg

SEQ ID NO: 487786 - DNA, 25 bp, Homo sapien
aggcagcaaatagtgttaggtagta

SEQ ID NO: 487787 - DNA, 25 bp, Homo sapien
gatgatgctacctgggttcagttcc

SEQ ID NO: 487788 - DNA, 25 bp, Homo sapien
atgctacctgggttcagttcccatt

SEQ ID NO: 487789 - DNA, 25 bp, Homo sapien
agttcccattgctttgaaccttgaa

SEQ ID NO: 487790 - DNA, 25 bp, Homo sapien
cccattgctttgaaccttgaatatt

SEQ ID NO: 487791 - DNA, 25 bp, Homo sapien
aagaaatccccataagggctggcca

SEQ ID NO: 487792 - DNA, 25 bp, Homo sapien
aaatccccataagggctggccacgg

SEQ ID NO: 487793 - DNA, 25 bp, Homo sapien
gaaggcagtgggaaagcaatgccaa

SEQ ID NO: 487794 - DNA, 25 bp, Homo sapien
aaagcaatgccaaatggttgtggag

SEQ ID NO: 487795 - DNA, 25 bp, Homo sapien
agaaagtggccggagcctccctgga

SEQ ID NO: 487796 - DNA, 25 bp, Homo sapien
tgcgggccgctgttttggtttgaca

SEQ ID NO: 487797 - DNA, 25 bp, Homo sapien
gccgctgttttggtttgacatgaca

SEQ ID NO: 487798 - DNA, 25 bp, Homo sapien
ttgacatgacaaggaaaggacttcc

SEQ ID NO: 487799 - DNA, 25 bp, Homo sapien
ggacttcctgctgaccctgagagcc

SEQ ID NO: 487800 - DNA, 25 bp, Homo sapien
gcatgattgtgctagcgtttagtct

SEQ ID NO: 487801 - DNA, 25 bp, Homo sapien
gctagcgtttagtctgagttgatct

SEQ ID NO: 487802 - DNA, 25 bp, Homo sapien
gcgtttagtctgagttgatcttttt

SEQ ID NO: 487803 - DNA, 25 bp, Homo sapien
tctttttaaaactgcaagtgttgaa

SEQ ID NO: 487804 - DNA, 25 bp, Homo sapien
cagtggtggcagcagatcctgtggc

SEQ ID NO: 487805 - DNA, 25 bp, Homo sapien
tggtggcagcagatcctgtggccgg

SEQ ID NO: 487806 - DNA, 25 bp, Homo sapien
cggacgggacccagtgatacttgta

SEQ ID NO: 487807 - DNA, 25 bp, Homo sapien
ggacgggacccagtgatacttgtat

SEQ ID NO: 487808 - DNA, 25 bp, Homo sapien
gacgggacccagtgatacttgtata

SEQ ID NO: 487809 - DNA, 25 bp, Homo sapien
cgggacccagtgatacttgtatatt

SEQ ID NO: 487810 - DNA, 25 bp, Homo sapien
gatacttgtatattacacagtcctg

SEQ ID NO: 487811 - DNA, 25 bp, Homo sapien
cttgtatattacacagtcctgattt

SEQ ID NO: 487812 - DNA, 25 bp, Homo sapien
gtatattacacagtcctgatttcag

SEQ ID NO: 487813 - DNA, 25 bp, Homo sapien
tattacacagtcctgatttcagaca

SEQ ID NO: 487814 - DNA, 25 bp, Homo sapien
gatttcagacaatttcaaccttaat

SEQ ID NO: 487815 - DNA, 25 bp, Homo sapien
tttctttgggctcttctaatttgag

SEQ ID NO: 487816 - DNA, 25 bp, Homo sapien
ttgggctcttctaatttgagtggag

SEQ ID NO: 487817 - DNA, 25 bp, Homo sapien
tgttgtgaaacagtccagtgaaact

SEQ ID NO: 487818 - DNA, 25 bp, Homo sapien
cagtccagtgaaactgtgcagggaa

SEQ ID NO: 487819 - DNA, 25 bp, Homo sapien
taattactgtccaacacagtggagc

SEQ ID NO: 487820 - DNA, 25 bp, Homo sapien
tgtccaacacagtggagcagcttgt

SEQ ID NO: 487821 - DNA, 25 bp, Homo sapien
acacagtggagcagcttgtccacaa

SEQ ID NO: 487822 - DNA, 25 bp, Homo sapien
ggagcagcttgtccacaaatatagt

SEQ ID NO: 487823 - DNA, 25 bp, Homo sapien
gcttgtccacaaatatagtaattac

SEQ ID NO: 487824 - DNA, 25 bp, Homo sapien
tagtaattactatttattgctctaa

SEQ ID NO: 487825 - DNA, 25 bp, Homo sapien
gaaacatctgttacattaatgtcta

SEQ ID NO: 487826 - DNA, 25 bp, Homo sapien
gtccttgattggcagcacaccaaat

SEQ ID NO: 487827 - DNA, 25 bp, Homo sapien
ttgattggcagcacaccaaatgctt

SEQ ID NO: 487828 - DNA, 25 bp, Homo sapien
gattggcagcacaccaaatgcttac

SEQ ID NO: 487829 - DNA, 25 bp, Homo sapien
tggcagcacaccaaatgcttacact

SEQ ID NO: 487830 - DNA, 25 bp, Homo sapien
gcagcacaccaaatgcttacactgg

SEQ ID NO: 487831 - DNA, 25 bp, Homo sapien
agcacaccaaatgcttacactggtc

SEQ ID NO: 487832 - DNA, 25 bp, Homo sapien
acaccaaatgcttacactggtccgg

SEQ ID NO: 487833 - DNA, 25 bp, Homo sapien
accaaatgcttacactggtccgggc

SEQ ID NO: 487834 - DNA, 25 bp, Homo sapien
aaatgcttacactggtccgggcgcg

SEQ ID NO: 487835 - DNA, 25 bp, Homo sapien
atgcttacactggtccgggcgcggt

SEQ ID NO: 487836 - DNA, 25 bp, Homo sapien
acactggtccgggcgcggtgattca

SEQ ID NO: 487837 - DNA, 25 bp, Homo sapien
ctgtctctttgttccaagtgtggtt

SEQ ID NO: 487838 - DNA, 25 bp, Homo sapien
ccaagtgtggttcctatttattgag

SEQ ID NO: 487839 - DNA, 25 bp, Homo sapien
gctgtctggccaaaggaaatctatt

SEQ ID NO: 487840 - DNA, 25 bp, Homo sapien
ttgtcagaaaggtgcaggtgctcca

SEQ ID NO: 487841 - DNA, 25 bp, Homo sapien
caggtgctccacaaacgggtggtaa

SEQ ID NO: 487842 - DNA, 25 bp, Homo sapien
aggcctcgagctcttggatgttgta

SEQ ID NO: 487843 - DNA, 25 bp, Homo sapien
caccggagttgaggctgtgcgcctt

SEQ ID NO: 487844 - DNA, 25 bp, Homo sapien
tgtgcgccttggtgggcttcacgtc

SEQ ID NO: 487845 - DNA, 25 bp, Homo sapien
tcccctggatttgcttagtactcag

SEQ ID NO: 487846 - DNA, 25 bp, Homo sapien
ttagtactcagccagtgccacagtt

SEQ ID NO: 487847 - DNA, 25 bp, Homo sapien
gtgccacagtttgaagattctcatt

SEQ ID NO: 487848 - DNA, 25 bp, Homo sapien
ttgcctccgccatgcagcagatgct

SEQ ID NO: 487849 - DNA, 25 bp, Homo sapien
agcagatgctgactgagagctgtaa

SEQ ID NO: 487850 - DNA, 25 bp, Homo sapien
agagctgtaagaaccggctcatcca

SEQ ID NO: 487851 - DNA, 25 bp, Homo sapien
atccagatggcctacgaatctcaga

SEQ ID NO: 487852 - DNA, 25 bp, Homo sapien
gaatctcagaggcagaacttggtcc

SEQ ID NO: 487853 - DNA, 25 bp, Homo sapien
agaacttggtccagcaggcctgttc

SEQ ID NO: 487854 - DNA, 25 bp, Homo sapien
gcctgttccagcatggccgaaatgg

SEQ ID NO: 487855 - DNA, 25 bp, Homo sapien
ggatgaacgattccagcagattctg

SEQ ID NO: 487856 - DNA, 25 bp, Homo sapien
cagattctgtcgtggcagcaaatgg

SEQ ID NO: 487857 - DNA, 25 bp, Homo sapien
tcagaacaaagccatcagccagatc

SEQ ID NO: 487858 - DNA, 25 bp, Homo sapien
agaaagacctgatgcatcggcagat

SEQ ID NO: 487859 - DNA, 25 bp, Homo sapien
cctctggagttcattcctatcaatg

SEQ ID NO: 487860 - DNA, 25 bp, Homo sapien
atgtcattttgattgtgcagtaaga

SEQ ID NO: 487861 - DNA, 25 bp, Homo sapien
atagttacagtgacagagaaatgca

SEQ ID NO: 487862 - DNA, 25 bp, Homo sapien
gagaaatgcacactatgtatcaaat

SEQ ID NO: 487863 - DNA, 25 bp, Homo sapien
ataacacagtgtggcaacgcacgag

SEQ ID NO: 487864 - DNA, 25 bp, Homo sapien
gcaacgcacgagcaagtaaccatta

SEQ ID NO: 487865 - DNA, 25 bp, Homo sapien
gagcaagtaaccattagagtaacat

SEQ ID NO: 487866 - DNA, 25 bp, Homo sapien
gcatatatttaacagatagggcaaa

SEQ ID NO: 487867 - DNA, 25 bp, Homo sapien
gcaaaagttgagaggtacaggtcgt

SEQ ID NO: 487868 - DNA, 25 bp, Homo sapien
gtacaggtcgtacgactgagcacca

SEQ ID NO: 487869 - DNA, 25 bp, Homo sapien
ggtcgtacgactgagcaccaggcct

SEQ ID NO: 487870 - DNA, 25 bp, Homo sapien
agcacttgaatgttggtactctatg

SEQ ID NO: 487871 - DNA, 25 bp, Homo sapien
atgttggtactctatgtttggtgaa

SEQ ID NO: 487872 - DNA, 25 bp, Homo sapien
tttggtgaagtttgcttttccccat

SEQ ID NO: 487873 - DNA, 25 bp, Homo sapien
tggtgaagtttgcttttccccataa

SEQ ID NO: 487874 - DNA, 25 bp, Homo sapien
ttgcttttccccataaaacactcca

SEQ ID NO: 487875 - DNA, 25 bp, Homo sapien
aacactccaggaacaactgacgtga

SEQ ID NO: 487876 - DNA, 25 bp, Homo sapien
ctgacgtgacagttgaagaccgttt

SEQ ID NO: 487877 - DNA, 25 bp, Homo sapien
gacagttgaagaccgttttgtacta

SEQ ID NO: 487878 - DNA, 25 bp, Homo sapien
gaccgttttgtactaagtctcattt

SEQ ID NO: 487879 - DNA, 25 bp, Homo sapien
aagtctcattttgtatactggtaaa

SEQ ID NO: 487880 - DNA, 25 bp, Homo sapien
actggtaaaaactacatgcttgatt

SEQ ID NO: 487881 - DNA, 25 bp, Homo sapien
tgagggtgttaatctaggaaacttc

SEQ ID NO: 487882 - DNA, 25 bp, Homo sapien
ccccgtgaaaagattggtctagtat

SEQ ID NO: 487883 - DNA, 25 bp, Homo sapien
aaagtggaggcacacctgggttcaa

SEQ ID NO: 487884 - DNA, 25 bp, Homo sapien
ttcaaattctagctccagcatataa

SEQ ID NO: 487885 - DNA, 25 bp, Homo sapien
gtggctgtgcagactttggtaagat

SEQ ID NO: 487886 - DNA, 25 bp, Homo sapien
gtttaatcttttgtgcctcgatttc

SEQ ID NO: 487887 - DNA, 25 bp, Homo sapien
ttgtgcctcgatttctccatttgta

SEQ ID NO: 487888 - DNA, 25 bp, Homo sapien
gtaaaagtatctagcacagttgcct

SEQ ID NO: 487889 - DNA, 25 bp, Homo sapien
acagttgcctagcacattgtgggta

SEQ ID NO: 487890 - DNA, 25 bp, Homo sapien
gcctagcacattgtgggtactcaat

SEQ ID NO: 487891 - DNA, 25 bp, Homo sapien
gtactcaataaaaggtaacagcagc

SEQ ID NO: 487892 - DNA, 25 bp, Homo sapien
ccccatcagggcaaatggtctaact

SEQ ID NO: 487893 - DNA, 25 bp, Homo sapien
tggtctaactggtgcaatcatgaag

SEQ ID NO: 487894 - DNA, 25 bp, Homo sapien
gttaatggttaacagacattggcca

SEQ ID NO: 487895 - DNA, 25 bp, Homo sapien
aacaccccatggactgtgactcgag

SEQ ID NO: 487896 - DNA, 25 bp, Homo sapien
gtgactcgagtatccaacaggcagt

SEQ ID NO: 487897 - DNA, 25 bp, Homo sapien
aacaggcagtcagagctctcccggt

SEQ ID NO: 487898 - DNA, 25 bp, Homo sapien
tctcccggtctgaaagttgcattgc

SEQ ID NO: 487899 - DNA, 25 bp, Homo sapien
gcattgccactgctaactttgggat

SEQ ID NO: 487900 - DNA, 25 bp, Homo sapien
tgggattgcatcagagaggccctga

SEQ ID NO: 487901 - DNA, 25 bp, Homo sapien
tggtttgatgttacacactcctcac

SEQ ID NO: 487902 - DNA, 25 bp, Homo sapien
ctttctgagtgtcctttctctgaaa

SEQ ID NO: 487903 - DNA, 25 bp, Homo sapien
ggcttctggtcatggcctcctaaaa

SEQ ID NO: 487904 - DNA, 25 bp, Homo sapien
tcatggcctcctaaaaccttaaact

SEQ ID NO: 487905 - DNA, 25 bp, Homo sapien
gtagaaatgtactcaagccctattt

SEQ ID NO: 487906 - DNA, 25 bp, Homo sapien
gtactcaagccctatttataaacaa

SEQ ID NO: 487907 - DNA, 25 bp, Homo sapien
aaacccctacagaacatcacctgga

SEQ ID NO: 487908 - DNA, 25 bp, Homo sapien
cagaacatcacctggaattgccact

SEQ ID NO: 487909 - DNA, 25 bp, Homo sapien
gaattgccactcacactgggttgga

SEQ ID NO: 487910 - DNA, 25 bp, Homo sapien
cacactgggttggagtcattgggca

SEQ ID NO: 487911 - DNA, 25 bp, Homo sapien
tcattgggcagctgtgcctgtgcga

SEQ ID NO: 487912 - DNA, 25 bp, Homo sapien
agagcagtttgggtttggagtatta

SEQ ID NO: 487913 - DNA, 25 bp, Homo sapien
ggagtattatatttggcttctattt

SEQ ID NO: 487914 - DNA, 25 bp, Homo sapien
gactagtatgtgagtttgtttaatt

SEQ ID NO: 487915 - DNA, 25 bp, Homo sapien
acctttatttgtgtactgttttgtg

SEQ ID NO: 487916 - DNA, 25 bp, Homo sapien
ttatttgtgtactgttttgtgtgtg

SEQ ID NO: 487917 - DNA, 25 bp, Homo sapien
aactgatgccttttaaacacttact

SEQ ID NO: 487918 - DNA, 25 bp, Homo sapien
tgccttttaaacacttactaatctg

SEQ ID NO: 487919 - DNA, 25 bp, Homo sapien
acttactaatctgataatctgccga

SEQ ID NO: 487920 - DNA, 25 bp, Homo sapien
tactaatctgataatctgccgaaaa

SEQ ID NO: 487921 - DNA, 25 bp, Homo sapien
atctgataatctgccgaaaaagaat

SEQ ID NO: 487922 - DNA, 25 bp, Homo sapien
atggaaaattacttactgaacaata

SEQ ID NO: 487923 - DNA, 25 bp, Homo sapien
attttatttctcaagaacgctgaag

SEQ ID NO: 487924 - DNA, 25 bp, Homo sapien
tctcaagaacgctgaagattttgtt

SEQ ID NO: 487925 - DNA, 25 bp, Homo sapien
ccccacctgattgttcttgtgtgga

SEQ ID NO: 487926 - DNA, 25 bp, Homo sapien
acctgattgttcttgtgtggattcc

SEQ ID NO: 487927 - DNA, 25 bp, Homo sapien
gattgttcttgtgtggattccagag

SEQ ID NO: 487928 - DNA, 25 bp, Homo sapien
ttgtgtggattccagagctgactgc

SEQ ID NO: 487929 - DNA, 25 bp, Homo sapien
cctagtgcatcgtaatttcttactt

SEQ ID NO: 487930 - DNA, 25 bp, Homo sapien
gtgcatcgtaatttcttacttgagg

SEQ ID NO: 487931 - DNA, 25 bp, Homo sapien
aaacgaactggaaagctgccttctt

SEQ ID NO: 487932 - DNA, 25 bp, Homo sapien
agtcaaatctgctaaatcataccta

SEQ ID NO: 487933 - DNA, 25 bp, Homo sapien
aatctgctaaatcatacctacaatg

SEQ ID NO: 487934 - DNA, 25 bp, Homo sapien
gaatgatattcaataacttctgtca

SEQ ID NO: 487935 - DNA, 25 bp, Homo sapien
ataacttctgtcatggcaaaattta

SEQ ID NO: 487936 - DNA, 25 bp, Homo sapien
accaagaggcaacaggtcccaggct

SEQ ID NO: 487937 - DNA, 25 bp, Homo sapien
caagaggcaacaggtcccaggctca

SEQ ID NO: 487938 - DNA, 25 bp, Homo sapien
aagaggcaacaggtcccaggctcag

SEQ ID NO: 487939 - DNA, 25 bp, Homo sapien
agaggcaacaggtcccaggctcagc

SEQ ID NO: 487940 - DNA, 25 bp, Homo sapien
gaggcaacaggtcccaggctcagca

SEQ ID NO: 487941 - DNA, 25 bp, Homo sapien
ggttatcttgaactgactgactcat

SEQ ID NO: 487942 - DNA, 25 bp, Homo sapien
gttatcttgaactgactgactcatg

SEQ ID NO: 487943 - DNA, 25 bp, Homo sapien
atcttgaactgactgactcatgcca

SEQ ID NO: 487944 - DNA, 25 bp, Homo sapien
tacatattggagcaacagcgtgttg

SEQ ID NO: 487945 - DNA, 25 bp, Homo sapien
agcgtgttggctgggctcttgacat

SEQ ID NO: 487946 - DNA, 25 bp, Homo sapien
ggctgggctcttgacatggatgaaa

SEQ ID NO: 487947 - DNA, 25 bp, Homo sapien
tcttcctctgctcgaacctatgagt

SEQ ID NO: 487948 - DNA, 25 bp, Homo sapien
tgctcgaacctatgagtcccagcct

SEQ ID NO: 487949 - DNA, 25 bp, Homo sapien
tggcggcctcagacatgctcaggag

SEQ ID NO: 487950 - DNA, 25 bp, Homo sapien
ggcctcagacatgctcaggagtgac

SEQ ID NO: 487951 - DNA, 25 bp, Homo sapien
gaggccgctgagttgcccgttagaa

SEQ ID NO: 487952 - DNA, 25 bp, Homo sapien
gagttgcccgttagaactcttactg

SEQ ID NO: 487953 - DNA, 25 bp, Homo sapien
gggaccctgaaccaaacagaacgtg

SEQ ID NO: 487954 - DNA, 25 bp, Homo sapien
acagaacgtgtgctaattttccgaa

SEQ ID NO: 487955 - DNA, 25 bp, Homo sapien
acgtgtgctaattttccgaactcca

SEQ ID NO: 487956 - DNA, 25 bp, Homo sapien
gtgtgctaattttccgaactccaaa

SEQ ID NO: 487957 - DNA, 25 bp, Homo sapien
gctaattttccgaactccaaactgt

SEQ ID NO: 487958 - DNA, 25 bp, Homo sapien
gtgggcattggatgtaaggtattcc

SEQ ID NO: 487959 - DNA, 25 bp, Homo sapien
gggcattggatgtaaggtattccta

SEQ ID NO: 487960 - DNA, 25 bp, Homo sapien
ggcattggatgtaaggtattcctaa

SEQ ID NO: 487961 - DNA, 25 bp, Homo sapien
gcattggatgtaaggtattcctaac

SEQ ID NO: 487962 - DNA, 25 bp, Homo sapien
ttggatgtaaggtattcctaacttc

SEQ ID NO: 487963 - DNA, 25 bp, Homo sapien
tggatgtaaggtattcctaacttcc

SEQ ID NO: 487964 - DNA, 25 bp, Homo sapien
tccccagtccttggcgtcctctcta

SEQ ID NO: 487965 - DNA, 25 bp, Homo sapien
caggtcttctgcagcttcaccctgt

SEQ ID NO: 487966 - DNA, 25 bp, Homo sapien
gtcttctgcagcttcaccctgtcct

SEQ ID NO: 487967 - DNA, 25 bp, Homo sapien
ttgcctgcggagcacgggtgggcat

SEQ ID NO: 487968 - DNA, 25 bp, Homo sapien
tgcggagcacgggtgggcattggat

SEQ ID NO: 487969 - DNA, 25 bp, Homo sapien
ttcaacattggagtaggcactgcat

SEQ ID NO: 487970 - DNA, 25 bp, Homo sapien
tgctgtaaaaataggatggcgagtt

SEQ ID NO: 487971 - DNA, 25 bp, Homo sapien
aggatggcgagtttgtgttttaatt

SEQ ID NO: 487972 - DNA, 25 bp, Homo sapien
gaacctgttggttgacaaaattggc

SEQ ID NO: 487973 - DNA, 25 bp, Homo sapien
tggttgacaaaattggctgttggca

SEQ ID NO: 487974 - DNA, 25 bp, Homo sapien
ggctgttggcatcagtatagaaacc

SEQ ID NO: 487975 - DNA, 25 bp, Homo sapien
atagaaaccaactggcagctttccc

SEQ ID NO: 487976 - DNA, 25 bp, Homo sapien
agctttccctgacaagctctttgac

SEQ ID NO: 487977 - DNA, 25 bp, Homo sapien
aagctctttgacacatggacaccat

SEQ ID NO: 487978 - DNA, 25 bp, Homo sapien
atggacaccatttcatgtctacagc

SEQ ID NO: 487979 - DNA, 25 bp, Homo sapien
agctgtttgtgggatgttggaaaaa

SEQ ID NO: 487980 - DNA, 25 bp, Homo sapien
aattttgtagctggtacactctggc

SEQ ID NO: 487981 - DNA, 25 bp, Homo sapien
tgggtctctgaattcagcctgtcac

SEQ ID NO: 487982 - DNA, 25 bp, Homo sapien
agcctgtcaccgatggctgactgat

SEQ ID NO: 487983 - DNA, 25 bp, Homo sapien
gatggctgactgatgaaatggacac

SEQ ID NO: 487984 - DNA, 25 bp, Homo sapien
aaatggacacgtctcatctgaccca

SEQ ID NO: 487985 - DNA, 25 bp, Homo sapien
ctccaggtggaccaaagggatgcac

SEQ ID NO: 487986 - DNA, 25 bp, Homo sapien
aaagggatgcacaggcggctcgcat

SEQ ID NO: 487987 - DNA, 25 bp, Homo sapien
cccagggccagctaagagttccaaa

SEQ ID NO: 487988 - DNA, 25 bp, Homo sapien
gggccagctaagagttccaaagatc

SEQ ID NO: 487989 - DNA, 25 bp, Homo sapien
cagatttggttttagtcatgaatac

SEQ ID NO: 487990 - DNA, 25 bp, Homo sapien
gtctcaaactcgcacaattttttcc

SEQ ID NO: 487991 - DNA, 25 bp, Homo sapien
cagtggatcaggcacagattttaca

SEQ ID NO: 487992 - DNA, 25 bp, Homo sapien
gtggatcaggcacagattttacact

SEQ ID NO: 487993 - DNA, 25 bp, Homo sapien
gatcaggcacagattttacactgaa

SEQ ID NO: 487994 - DNA, 25 bp, Homo sapien
tcaggcacagattttacactgaaaa

SEQ ID NO: 487995 - DNA, 25 bp, Homo sapien
gaaaatcagcagagtggaggctgag

SEQ ID NO: 487996 - DNA, 25 bp, Homo sapien
gggtttattactgcatgcaagctct

SEQ ID NO: 487997 - DNA, 25 bp, Homo sapien
ggtttattactgcatgcaagctcta

SEQ ID NO: 487998 - DNA, 25 bp, Homo sapien
gtttattactgcatgcaagctctac

SEQ ID NO: 487999 - DNA, 25 bp, Homo sapien
tttattactgcatgcaagctctaca

SEQ ID NO: 488000 - DNA, 25 bp, Homo sapien
ttactgcatgcaagctctacaaact

SEQ ID NO: 488001 - DNA, 25 bp, Homo sapien
tgcatgcaagctctacaaactcctc

SEQ ID NO: 488002 - DNA, 25 bp, Homo sapien
gatgaggacgtctgattctcgctga

SEQ ID NO: 488003 - DNA, 25 bp, Homo sapien
attctcgctgagacagggctcggca

SEQ ID NO: 488004 - DNA, 25 bp, Homo sapien
acagggctcggcacgcgttgaaagc

SEQ ID NO: 488005 - DNA, 25 bp, Homo sapien
tcggcacgcgttgaaagccccggtg

SEQ ID NO: 488006 - DNA, 25 bp, Homo sapien
ttgaaagccccggtgcccaggtctt

SEQ ID NO: 488007 - DNA, 25 bp, Homo sapien
aggtcttccctttcgcgggcttcag

SEQ ID NO: 488008 - DNA, 25 bp, Homo sapien
gggcttcagttcatccctcaaggga

SEQ ID NO: 488009 - DNA, 25 bp, Homo sapien
catccctcaagggattgggacccag

SEQ ID NO: 488010 - DNA, 25 bp, Homo sapien
caggcgtccacgtacagggactgga

SEQ ID NO: 488011 - DNA, 25 bp, Homo sapien
ttagggacgcgggattataacatgg

SEQ ID NO: 488012 - DNA, 25 bp, Homo sapien
tgactccccaccaagattttgcaga

SEQ ID NO: 488013 - DNA, 25 bp, Homo sapien
acaggcacccctcccagccgtggtc

SEQ ID NO: 488014 - DNA, 25 bp, Homo sapien
tcccagccgtggtcaacggagggag

SEQ ID NO: 488015 - DNA, 25 bp, Homo sapien
cccagccgtggtcaacggagggagt

SEQ ID NO: 488016 - DNA, 25 bp, Homo sapien
tcaacggagggagtggcacttctgc

SEQ ID NO: 488017 - DNA, 25 bp, Homo sapien
caacggagggagtggcacttctgcc

SEQ ID NO: 488018 - DNA, 25 bp, Homo sapien
aacggagggagtggcacttctgcct

SEQ ID NO: 488019 - DNA, 25 bp, Homo sapien
acggagggagtggcacttctgcctt

SEQ ID NO: 488020 - DNA, 25 bp, Homo sapien
cggagggagtggcacttctgccttg

SEQ ID NO: 488021 - DNA, 25 bp, Homo sapien
ggagggagtggcacttctgccttga

SEQ ID NO: 488022 - DNA, 25 bp, Homo sapien
gggagtggcacttctgccttgagtc

SEQ ID NO: 488023 - DNA, 25 bp, Homo sapien
ggagtggcacttctgccttgagtcc

SEQ ID NO: 488024 - DNA, 25 bp, Homo sapien
ggtgttctaacagtatcccctagaa

SEQ ID NO: 488025 - DNA, 25 bp, Homo sapien
gttctaacagtatcccctagaagtt

SEQ ID NO: 488026 - DNA, 25 bp, Homo sapien
taacagtatcccctagaagttggat

SEQ ID NO: 488027 - DNA, 25 bp, Homo sapien
cagtatcccctagaagttggatgtc

SEQ ID NO: 488028 - DNA, 25 bp, Homo sapien
gttggatgtctaaaactcaagtaaa

SEQ ID NO: 488029 - DNA, 25 bp, Homo sapien
ggatgtctaaaactcaagtaaatgg

SEQ ID NO: 488030 - DNA, 25 bp, Homo sapien
gaagtgggaggcaatttagataatt

SEQ ID NO: 488031 - DNA, 25 bp, Homo sapien
aattaagtgtaaagccttgtaactg

SEQ ID NO: 488032 - DNA, 25 bp, Homo sapien
gtgtaaagccttgtaactgaagatg

SEQ ID NO: 488033 - DNA, 25 bp, Homo sapien
tagaaactattttaatgccaagata

SEQ ID NO: 488034 - DNA, 25 bp, Homo sapien
tattttaatgccaagatagttacag

SEQ ID NO: 488035 - DNA, 25 bp, Homo sapien
acttatacagcaacatttcttcaat

SEQ ID NO: 488036 - DNA, 25 bp, Homo sapien
aacatttcttcaattagcagtctag

SEQ ID NO: 488037 - DNA, 25 bp, Homo sapien
agcagtctagacattttataaacag

SEQ ID NO: 488038 - DNA, 25 bp, Homo sapien
ggaccaattgataatatttctgact

SEQ ID NO: 488039 - DNA, 25 bp, Homo sapien
tactatgtgaatctcttaaaaatct

SEQ ID NO: 488040 - DNA, 25 bp, Homo sapien
aatctgacattttacagtctgtatt

SEQ ID NO: 488041 - DNA, 25 bp, Homo sapien
taatgttttacttctgccttaagat

SEQ ID NO: 488042 - DNA, 25 bp, Homo sapien
tacttctgccttaagatttaggttt

SEQ ID NO: 488043 - DNA, 25 bp, Homo sapien
aaatgtatttttgccctgaattaag

SEQ ID NO: 488044 - DNA, 25 bp, Homo sapien
tttttgccctgaattaagtgttaat

SEQ ID NO: 488045 - DNA, 25 bp, Homo sapien
tttaaaatcatcatttactgggttc

SEQ ID NO: 488046 - DNA, 25 bp, Homo sapien
tctatataccatatgattaacatgc

SEQ ID NO: 488047 - DNA, 25 bp, Homo sapien
catatgattaacatgcattttcaat

SEQ ID NO: 488048 - DNA, 25 bp, Homo sapien
gagtttggaggtggatatttagttt

SEQ ID NO: 488049 - DNA, 25 bp, Homo sapien
ggtggatatttagtttacagtgtat

SEQ ID NO: 488050 - DNA, 25 bp, Homo sapien
cctttaacaacgctttgtgttagca

SEQ ID NO: 488051 - DNA, 25 bp, Homo sapien
aacgctttgtgttagcatgctgcaa

SEQ ID NO: 488052 - DNA, 25 bp, Homo sapien
gctttgtgttagcatgctgcaaatc

SEQ ID NO: 488053 - DNA, 25 bp, Homo sapien
gtgttagcatgctgcaaatcaaaat

SEQ ID NO: 488054 - DNA, 25 bp, Homo sapien
aaaatggcacttaatattaaaagct

SEQ ID NO: 488055 - DNA, 25 bp, Homo sapien
aatcctgttcataaatgtaatgcat

SEQ ID NO: 488056 - DNA, 25 bp, Homo sapien
gcatatgatatgtacttttaagttt

SEQ ID NO: 488057 - DNA, 25 bp, Homo sapien
aaagcttgatgcagttttttgacat

SEQ ID NO: 488058 - DNA, 25 bp, Homo sapien
gcagttttttgacatagcagactaa

SEQ ID NO: 488059 - DNA, 25 bp, Homo sapien
gtgtatgatggaatctgaagccact

SEQ ID NO: 488060 - DNA, 25 bp, Homo sapien
gaatctgaagccactgaaaatccta

SEQ ID NO: 488061 - DNA, 25 bp, Homo sapien
gaagccactgaaaatcctacttgaa

SEQ ID NO: 488062 - DNA, 25 bp, Homo sapien
gccactgaaaatcctacttgaaaag

SEQ ID NO: 488063 - DNA, 25 bp, Homo sapien
gaaaagccatgtctaactcacctat

SEQ ID NO: 488064 - DNA, 25 bp, Homo sapien
agccatgtctaactcacctattgaa

SEQ ID NO: 488065 - DNA, 25 bp, Homo sapien
gtctaactcacctattgaattttta

SEQ ID NO: 488066 - DNA, 25 bp, Homo sapien
gttaacagcaactatttttcataca

SEQ ID NO: 488067 - DNA, 25 bp, Homo sapien
gacactgatgccgaaactgaacaaa

SEQ ID NO: 488068 - DNA, 25 bp, Homo sapien
tatatttcagattttcagtgctaac

SEQ ID NO: 488069 - DNA, 25 bp, Homo sapien
atttcagattttcagtgctaacaga

SEQ ID NO: 488070 - DNA, 25 bp, Homo sapien
gattttcagtgctaacagattgcat

SEQ ID NO: 488071 - DNA, 25 bp, Homo sapien
cagattgcatatatacagttcattt

SEQ ID NO: 488072 - DNA, 25 bp, Homo sapien
gcatatatacagttcatttactttt

SEQ ID NO: 488073 - DNA, 25 bp, Homo sapien
aaattggcaatcgatattttattga

SEQ ID NO: 488074 - DNA, 25 bp, Homo sapien
gagttatattttaggagatactttc

SEQ ID NO: 488075 - DNA, 25 bp, Homo sapien
taggagatactttctagacagtttg

SEQ ID NO: 488076 - DNA, 25 bp, Homo sapien
ttgaagtttgggtgctatatgaaga

SEQ ID NO: 488077 - DNA, 25 bp, Homo sapien
atactcagatataaacaccttgttt

SEQ ID NO: 488078 - DNA, 25 bp, Homo sapien
taaacaccttgttttcttgaatgta

SEQ ID NO: 488079 - DNA, 25 bp, Homo sapien
gatttccagtgagtgatctagttct

SEQ ID NO: 488080 - DNA, 25 bp, Homo sapien
ttccagtgagtgatctagttctacg

SEQ ID NO: 488081 - DNA, 25 bp, Homo sapien
ccagtgagtgatctagttctacgta

SEQ ID NO: 488082 - DNA, 25 bp, Homo sapien
gagtgatctagttctacgtattaca

SEQ ID NO: 488083 - DNA, 25 bp, Homo sapien
gatctagttctacgtattacacagg

SEQ ID NO: 488084 - DNA, 25 bp, Homo sapien
ctagttctacgtattacacaggtgt

SEQ ID NO: 488085 - DNA, 25 bp, Homo sapien
agttctacgtattacacaggtgtaa

SEQ ID NO: 488086 - DNA, 25 bp, Homo sapien
aggtgtaatatctgtgagtgtaaat

SEQ ID NO: 488087 - DNA, 25 bp, Homo sapien
gtgtaaataactggaactgtacact

SEQ ID NO: 488088 - DNA, 25 bp, Homo sapien
aactgtacactgattaacatgacag

SEQ ID NO: 488089 - DNA, 25 bp, Homo sapien
ctgattaacatgacagtttctcttt

SEQ ID NO: 488090 - DNA, 25 bp, Homo sapien
taaaaattgaccgtctccaacttgt

SEQ ID NO: 488091 - DNA, 25 bp, Homo sapien
tctccaacttgtcccctttactatt

SEQ ID NO: 488092 - DNA, 25 bp, Homo sapien
gtcccctttactattaacaatgtga

SEQ ID NO: 488093 - DNA, 25 bp, Homo sapien
gtgaccaacagatctgtggcacgga

SEQ ID NO: 488094 - DNA, 25 bp, Homo sapien
tggcacggacacagtacaaagagtt

SEQ ID NO: 488095 - DNA, 25 bp, Homo sapien
caaagagttgtcatggcaatgagtt

SEQ ID NO: 488096 - DNA, 25 bp, Homo sapien
gagtttggctgatgcaaaggtcatt

SEQ ID NO: 488097 - DNA, 25 bp, Homo sapien
gcaaaggtcattgtgcagggtcaaa

SEQ ID NO: 488098 - DNA, 25 bp, Homo sapien
aagggcaaaatcagtggtccatgtt

SEQ ID NO: 488099 - DNA, 25 bp, Homo sapien
caaaatcagtggtccatgttacccc

SEQ ID NO: 488100 - DNA, 25 bp, Homo sapien
tagagtattaactagtgaacccttt

SEQ ID NO: 488101 - DNA, 25 bp, Homo sapien
atagcttctatttctagcctaaaag

SEQ ID NO: 488102 - DNA, 25 bp, Homo sapien
aagctcagagattacagacagaatt

SEQ ID NO: 488103 - DNA, 25 bp, Homo sapien
aaagctttcacagacccttcaggtg

SEQ ID NO: 488104 - DNA, 25 bp, Homo sapien
ttcacagacccttcaggtgcagtta

SEQ ID NO: 488105 - DNA, 25 bp, Homo sapien
cttcaggtgcagttagagcggatcc

SEQ ID NO: 488106 - DNA, 25 bp, Homo sapien
gagcggatccggcaagctgactcct

SEQ ID NO: 488107 - DNA, 25 bp, Homo sapien
ccggcaagctgactccttggagaga

SEQ ID NO: 488108 - DNA, 25 bp, Homo sapien
ccttggagagaatccgggcaattct

SEQ ID NO: 488109 - DNA, 25 bp, Homo sapien
gaatccgggcaattctgaatgatac

SEQ ID NO: 488110 - DNA, 25 bp, Homo sapien
ggcaattctgaatgatactaaactg

SEQ ID NO: 488111 - DNA, 25 bp, Homo sapien
taaactgacagacattaaccagctt

SEQ ID NO: 488112 - DNA, 25 bp, Homo sapien
taagttccccgaaatgaaatgttag

SEQ ID NO: 488113 - DNA, 25 bp, Homo sapien
gaaatgttagtatactcctaagtga

SEQ ID NO: 488114 - DNA, 25 bp, Homo sapien
ttagtaattagatctcaggttgaat

SEQ ID NO: 488115 - DNA, 25 bp, Homo sapien
tactaaatccttaataactgcatgt

SEQ ID NO: 488116 - DNA, 25 bp, Homo sapien
aactgcatgtttacttttaagacct

SEQ ID NO: 488117 - DNA, 25 bp, Homo sapien
gagcatgtactaattgttcacactt

SEQ ID NO: 488118 - DNA, 25 bp, Homo sapien
tgttcacacttgtttataaaagcat

SEQ ID NO: 488119 - DNA, 25 bp, Homo sapien
tagtacgtttaatgttgacttcaac

SEQ ID NO: 488120 - DNA, 25 bp, Homo sapien
aaccacagatacatagggctaactt

SEQ ID NO: 488121 - DNA, 25 bp, Homo sapien
ggctaacttaagtaagtgccgacat

SEQ ID NO: 488122 - DNA, 25 bp, Homo sapien
gtgccgacataaatgcgttagtcat

SEQ ID NO: 488123 - DNA, 25 bp, Homo sapien
agctgggacttaaatgactcactta

SEQ ID NO: 488124 - DNA, 25 bp, Homo sapien
aagtacctggcattgaagcctccca

SEQ ID NO: 488125 - DNA, 25 bp, Homo sapien
cccttttcctccattgatgtgcggg

SEQ ID NO: 488126 - DNA, 25 bp, Homo sapien
cacgcgttaatttctgttggctgag

SEQ ID NO: 488127 - DNA, 25 bp, Homo sapien
tgcggcgtttccagaacccgagatt

SEQ ID NO: 488128 - DNA, 25 bp, Homo sapien
gaacccgagatttggagccctccct

SEQ ID NO: 488129 - DNA, 25 bp, Homo sapien
ctggctgcacttggctgggtttgca

SEQ ID NO: 488130 - DNA, 25 bp, Homo sapien
gggtttgcagtcagatacacagatt

SEQ ID NO: 488131 - DNA, 25 bp, Homo sapien
agatacacagatttcacctgggaga

SEQ ID NO: 488132 - DNA, 25 bp, Homo sapien
ttcacctgggagaacctctttttct

SEQ ID NO: 488133 - DNA, 25 bp, Homo sapien
cacccctgacttaccctggaggagg

SEQ ID NO: 488134 - DNA, 25 bp, Homo sapien
ttccaggcttgattgcaggctcagg

SEQ ID NO: 488135 - DNA, 25 bp, Homo sapien
tccaggcttgattgcaggctcagga

SEQ ID NO: 488136 - DNA, 25 bp, Homo sapien
ccaggcttgattgcaggctcaggaa

SEQ ID NO: 488137 - DNA, 25 bp, Homo sapien
caggcttgattgcaggctcaggaaa

SEQ ID NO: 488138 - DNA, 25 bp, Homo sapien
aggcttgattgcaggctcaggaaag

SEQ ID NO: 488139 - DNA, 25 bp, Homo sapien
ggcttgattgcaggctcaggaaagt

SEQ ID NO: 488140 - DNA, 25 bp, Homo sapien
cttgattgcaggctcaggaaagttt

SEQ ID NO: 488141 - DNA, 25 bp, Homo sapien
ttgattgcaggctcaggaaagtttg

SEQ ID NO: 488142 - DNA, 25 bp, Homo sapien
tgattgcaggctcaggaaagtttga

SEQ ID NO: 488143 - DNA, 25 bp, Homo sapien
tccaacttgacatcacagtttctgg

SEQ ID NO: 488144 - DNA, 25 bp, Homo sapien
gattgcaggctcaggaaagtttgag

SEQ ID NO: 488145 - DNA, 25 bp, Homo sapien
atagacacttcattgttccagcttc

SEQ ID NO: 488146 - DNA, 25 bp, Homo sapien
tcattgttccagcttctcgcttcaa

SEQ ID NO: 488147 - DNA, 25 bp, Homo sapien
ttctcgcttcaagctcctgaaggga

SEQ ID NO: 488148 - DNA, 25 bp, Homo sapien
gagcacataacgacttacacgttca

SEQ ID NO: 488149 - DNA, 25 bp, Homo sapien
gttcaatactcacaaagcccagcat

SEQ ID NO: 488150 - DNA, 25 bp, Homo sapien
aaagcccagcataccttctgtaaga

SEQ ID NO: 488151 - DNA, 25 bp, Homo sapien
gagatgtggcgttcagagcttctat

SEQ ID NO: 488152 - DNA, 25 bp, Homo sapien
gagcttctatactccacgatcaaac

SEQ ID NO: 488153 - DNA, 25 bp, Homo sapien
tcaaaccccggaggcttcggaattg

SEQ ID NO: 488154 - DNA, 25 bp, Homo sapien
gcactgtgcggagtatggtcactga

SEQ ID NO: 488155 - DNA, 25 bp, Homo sapien
actgaggaattcaatggcagcgatt

SEQ ID NO: 488156 - DNA, 25 bp, Homo sapien
gccaggcatttggccgggtgtggtg

SEQ ID NO: 488157 - DNA, 25 bp, Homo sapien
ggaggacaaggtgggcggaacacaa

SEQ ID NO: 488158 - DNA, 25 bp, Homo sapien
gaggacaaggtgggcggaacacaag

SEQ ID NO: 488159 - DNA, 25 bp, Homo sapien
aggacaaggtgggcggaacacaagg

SEQ ID NO: 488160 - DNA, 25 bp, Homo sapien
acaaggtgggcggaacacaaggtca

SEQ ID NO: 488161 - DNA, 25 bp, Homo sapien
gaatacaaaattagcaggacgtggt

SEQ ID NO: 488162 - DNA, 25 bp, Homo sapien
aattagcaggacgtggtggcacgcg

SEQ ID NO: 488163 - DNA, 25 bp, Homo sapien
attagcaggacgtggtggcacgcgc

SEQ ID NO: 488164 - DNA, 25 bp, Homo sapien
ttagcaggacgtggtggcacgcgcc

SEQ ID NO: 488165 - DNA, 25 bp, Homo sapien
tagcaggacgtggtggcacgcgcct

SEQ ID NO: 488166 - DNA, 25 bp, Homo sapien
gtcccagttactgggaggcggaggt

SEQ ID NO: 488167 - DNA, 25 bp, Homo sapien
gggtttccacactcaggaggtcaga

SEQ ID NO: 488168 - DNA, 25 bp, Homo sapien
gtttccacactcaggaggtcagagg

SEQ ID NO: 488169 - DNA, 25 bp, Homo sapien
ttccacactcaggaggtcagaggac

SEQ ID NO: 488170 - DNA, 25 bp, Homo sapien
ccacactcaggaggtcagaggactg

SEQ ID NO: 488171 - DNA, 25 bp, Homo sapien
tggctcctgtgaccagggcccctct

SEQ ID NO: 488172 - DNA, 25 bp, Homo sapien
ggcccctctcccctgaatgggaaag

SEQ ID NO: 488173 - DNA, 25 bp, Homo sapien
ctgggtgtggcccatcttctgtggg

SEQ ID NO: 488174 - DNA, 25 bp, Homo sapien
gtggcccatcttctgtgggcccctt

SEQ ID NO: 488175 - DNA, 25 bp, Homo sapien
cagacaccggatccatgggcactaa

SEQ ID NO: 488176 - DNA, 25 bp, Homo sapien
gacaccggatccatgggcactaacc

SEQ ID NO: 488177 - DNA, 25 bp, Homo sapien
agctgcagtagaggcggcacgggct

SEQ ID NO: 488178 - DNA, 25 bp, Homo sapien
atttttcacacagagatgatgctat

SEQ ID NO: 488179 - DNA, 25 bp, Homo sapien
atgatgctatattacaccttccctt

SEQ ID NO: 488180 - DNA, 25 bp, Homo sapien
gctatattacaccttcccttttttg

SEQ ID NO: 488181 - DNA, 25 bp, Homo sapien
ggtttcttaaactctaatctcatga

SEQ ID NO: 488182 - DNA, 25 bp, Homo sapien
tcatgacagattataccttccttat

SEQ ID NO: 488183 - DNA, 25 bp, Homo sapien
tccttattacttgttttatcttact

SEQ ID NO: 488184 - DNA, 25 bp, Homo sapien
gttttatcttactcagaatctttga

SEQ ID NO: 488185 - DNA, 25 bp, Homo sapien
tttctgcccagaattatctaaacaa

SEQ ID NO: 488186 - DNA, 25 bp, Homo sapien
aagaagtatgtctcacttgggaact

SEQ ID NO: 488187 - DNA, 25 bp, Homo sapien
tcacttgggaactgaatcaactcta

SEQ ID NO: 488188 - DNA, 25 bp, Homo sapien
tcaactctaaatcagttttgtcaca

SEQ ID NO: 488189 - DNA, 25 bp, Homo sapien
actgggtgtggtctttttactgtgt

SEQ ID NO: 488190 - DNA, 25 bp, Homo sapien
acgttgttttaagtgatagtgtcct

SEQ ID NO: 488191 - DNA, 25 bp, Homo sapien
gatagtgtccttaaattttagtgtc

SEQ ID NO: 488192 - DNA, 25 bp, Homo sapien
tagtgtcatttggtcaacttactgg

SEQ ID NO: 488193 - DNA, 25 bp, Homo sapien
catttggtcaacttactggtaacac

SEQ ID NO: 488194 - DNA, 25 bp, Homo sapien
ctggtaacaccagaacaagaaagca

SEQ ID NO: 488195 - DNA, 25 bp, Homo sapien
taataaattctgctggcacagaact

SEQ ID NO: 488196 - DNA, 25 bp, Homo sapien
tgctggcacagaactaacatatcat

SEQ ID NO: 488197 - DNA, 25 bp, Homo sapien
gaactaacatatcatttggtaactg

SEQ ID NO: 488198 - DNA, 25 bp, Homo sapien
ttggtaactgtaaaacctatttgca

SEQ ID NO: 488199 - DNA, 25 bp, Homo sapien
cctatttgcagttaaaggttgattt

SEQ ID NO: 488200 - DNA, 25 bp, Homo sapien
cttgtctggcactggagcatgcaga

SEQ ID NO: 488201 - DNA, 25 bp, Homo sapien
ttgtctggcactggagcatgcagag

SEQ ID NO: 488202 - DNA, 25 bp, Homo sapien
gtctggcactggagcatgcagagga

SEQ ID NO: 488203 - DNA, 25 bp, Homo sapien
gggagggaggtaacgggtgcctgct

SEQ ID NO: 488204 - DNA, 25 bp, Homo sapien
ggaggtaacgggtgcctgctgcggc

SEQ ID NO: 488205 - DNA, 25 bp, Homo sapien
gtaacgggtgcctgctgcggcagac

SEQ ID NO: 488206 - DNA, 25 bp, Homo sapien
tccccaccctgaacaaatcttgggt

SEQ ID NO: 488207 - DNA, 25 bp, Homo sapien
ccccaccctgaacaaatcttgggtg

SEQ ID NO: 488208 - DNA, 25 bp, Homo sapien
accctgaacaaatcttgggtgggtg

SEQ ID NO: 488209 - DNA, 25 bp, Homo sapien
ccctgaacaaatcttgggtgggtga

SEQ ID NO: 488210 - DNA, 25 bp, Homo sapien
cctggctggaagagggtgaaaggca

SEQ ID NO: 488211 - DNA, 25 bp, Homo sapien
ttttgacttttggtggcctctgcag

SEQ ID NO: 488212 - DNA, 25 bp, Homo sapien
gcctctgcaggcctcgacaaggccc

SEQ ID NO: 488213 - DNA, 25 bp, Homo sapien
cctctgcaggcctcgacaaggccca

SEQ ID NO: 488214 - DNA, 25 bp, Homo sapien
ctctgcaggcctcgacaaggcccag

SEQ ID NO: 488215 - DNA, 25 bp, Homo sapien
tctgcaggcctcgacaaggcccagc

SEQ ID NO: 488216 - DNA, 25 bp, Homo sapien
ctgcaggcctcgacaaggcccagcc

SEQ ID NO: 488217 - DNA, 25 bp, Homo sapien
tgcaggcctcgacaaggcccagcct

SEQ ID NO: 488218 - DNA, 25 bp, Homo sapien
gcaggcctcgacaaggcccagcctc

SEQ ID NO: 488219 - DNA, 25 bp, Homo sapien
caggcctcgacaaggcccagcctcc

SEQ ID NO: 488220 - DNA, 25 bp, Homo sapien
gggattcaaagccgccgttccccag

SEQ ID NO: 488221 - DNA, 25 bp, Homo sapien
catggtaaccaggaagcccgtttca

SEQ ID NO: 488222 - DNA, 25 bp, Homo sapien
ggtaaccaggaagcccgtttcatgt

SEQ ID NO: 488223 - DNA, 25 bp, Homo sapien
caggaagcccgtttcatgttcagtt

SEQ ID NO: 488224 - DNA, 25 bp, Homo sapien
gaagcccgtttcatgttcagttgct

SEQ ID NO: 488225 - DNA, 25 bp, Homo sapien
cccgtttcatgttcagttgcttttg

SEQ ID NO: 488226 - DNA, 25 bp, Homo sapien
acagctgtcaatcacaagcccttaa

SEQ ID NO: 488227 - DNA, 25 bp, Homo sapien
attgggggactgtttcctgacatcc

SEQ ID NO: 488228 - DNA, 25 bp, Homo sapien
caagggaagcccactagaggctgga

SEQ ID NO: 488229 - DNA, 25 bp, Homo sapien
ggaagcccactagaggctggaacag

SEQ ID NO: 488230 - DNA, 25 bp, Homo sapien
accgtgcccatctcaactggacttc

SEQ ID NO: 488231 - DNA, 25 bp, Homo sapien
gaagaacagctctctggctgaacat

SEQ ID NO: 488232 - DNA, 25 bp, Homo sapien
tctctggctgaacatatcccttgga

SEQ ID NO: 488233 - DNA, 25 bp, Homo sapien
tatcccttggatgttgttattacca

SEQ ID NO: 488234 - DNA, 25 bp, Homo sapien
tgttgttattaccagctgcctctag

SEQ ID NO: 488235 - DNA, 25 bp, Homo sapien
ttaccagctgcctctagatttgaga

SEQ ID NO: 488236 - DNA, 25 bp, Homo sapien
tgcctctagatttgagaacagtgct

SEQ ID NO: 488237 - DNA, 25 bp, Homo sapien
gaacagtgctgagcatgcttttaaa

SEQ ID NO: 488238 - DNA, 25 bp, Homo sapien
gatctttgaggtactttaagctagc

SEQ ID NO: 488239 - DNA, 25 bp, Homo sapien
ggtactttaagctagctacacctga

SEQ ID NO: 488240 - DNA, 25 bp, Homo sapien
tagctacacctgaaagcatacctag

SEQ ID NO: 488241 - DNA, 25 bp, Homo sapien
aaagcatacctagccctcatttctg

SEQ ID NO: 488242 - DNA, 25 bp, Homo sapien
aaaattggccgggcaaggcggtgca

SEQ ID NO: 488243 - DNA, 25 bp, Homo sapien
aaattggccgggcaaggcggtgcac

SEQ ID NO: 488244 - DNA, 25 bp, Homo sapien
attggccgggcaaggcggtgcacgc

SEQ ID NO: 488245 - DNA, 25 bp, Homo sapien
ttggccgggcaaggcggtgcacgcc

SEQ ID NO: 488246 - DNA, 25 bp, Homo sapien
tggccgggcaaggcggtgcacgcct

SEQ ID NO: 488247 - DNA, 25 bp, Homo sapien
ggcggtgcacgcctgaagtccgggc

SEQ ID NO: 488248 - DNA, 25 bp, Homo sapien
gcggtgcacgcctgaagtccgggct

SEQ ID NO: 488249 - DNA, 25 bp, Homo sapien
cggtgcacgcctgaagtccgggctg

SEQ ID NO: 488250 - DNA, 25 bp, Homo sapien
ggtgcacgcctgaagtccgggctgc

SEQ ID NO: 488251 - DNA, 25 bp, Homo sapien
gtgcacgcctgaagtccgggctgct

SEQ ID NO: 488252 - DNA, 25 bp, Homo sapien
ttcggagagatatctgccctcgacc

SEQ ID NO: 488253 - DNA, 25 bp, Homo sapien
ttaccagtcagaggcggaaggactc

SEQ ID NO: 488254 - DNA, 25 bp, Homo sapien
aggcggaaggactcctggaatgcca

SEQ ID NO: 488255 - DNA, 25 bp, Homo sapien
caaatacttgtgcactgggagaggt

SEQ ID NO: 488256 - DNA, 25 bp, Homo sapien
tgagccgttttgcaggctgtttgat

SEQ ID NO: 488257 - DNA, 25 bp, Homo sapien
gatcatttactgtcactggtggttc

SEQ ID NO: 488258 - DNA, 25 bp, Homo sapien
tactgtcactggtggttctggaagg

SEQ ID NO: 488259 - DNA, 25 bp, Homo sapien
gatggtctgagctggtgaagcaaaa

SEQ ID NO: 488260 - DNA, 25 bp, Homo sapien
taagcagattcccttgtgggttcct

SEQ ID NO: 488261 - DNA, 25 bp, Homo sapien
ttgtgggttcctagcattttcattt

SEQ ID NO: 488262 - DNA, 25 bp, Homo sapien
catttctgtacttgtgaggttcttg

SEQ ID NO: 488263 - DNA, 25 bp, Homo sapien
agcacccctgaacgctgagcaaagg

SEQ ID NO: 488264 - DNA, 25 bp, Homo sapien
cacccctgaacgctgagcaaaggca

SEQ ID NO: 488265 - DNA, 25 bp, Homo sapien
acccctgaacgctgagcaaaggcag

SEQ ID NO: 488266 - DNA, 25 bp, Homo sapien
cccctgaacgctgagcaaaggcaga

SEQ ID NO: 488267 - DNA, 25 bp, Homo sapien
ctgaacgctgagcaaaggcagactt

SEQ ID NO: 488268 - DNA, 25 bp, Homo sapien
gaacgctgagcaaaggcagacttac

SEQ ID NO: 488269 - DNA, 25 bp, Homo sapien
acgctgagcaaaggcagacttacga

SEQ ID NO: 488270 - DNA, 25 bp, Homo sapien
gctgagcaaaggcagacttacgaga

SEQ ID NO: 488271 - DNA, 25 bp, Homo sapien
gagcaaaggcagacttacgagaaac

SEQ ID NO: 488272 - DNA, 25 bp, Homo sapien
gcaaaggcagacttacgagaaacca

SEQ ID NO: 488273 - DNA, 25 bp, Homo sapien
caaaggcagacttacgagaaaccac

SEQ ID NO: 488274 - DNA, 25 bp, Homo sapien
aagtcgtcctcaagtcggcctggaa

SEQ ID NO: 488275 - DNA, 25 bp, Homo sapien
ctcaagtcggcctggaagtgggcct

SEQ ID NO: 488276 - DNA, 25 bp, Homo sapien
gtgcaaaacttcctcgagtcagcct

SEQ ID NO: 488277 - DNA, 25 bp, Homo sapien
cagttcatggctctcggcggccttc

SEQ ID NO: 488278 - DNA, 25 bp, Homo sapien
aggccccgcttttgacttttggcag

SEQ ID NO: 488279 - DNA, 25 bp, Homo sapien
gcttttgacttttggcagcctcttc

SEQ ID NO: 488280 - DNA, 25 bp, Homo sapien
tggcagcctcttcaggcgcagaact

SEQ ID NO: 488281 - DNA, 25 bp, Homo sapien
ttcaggcgcagaacttgatctccag

SEQ ID NO: 488282 - DNA, 25 bp, Homo sapien
aggcgcagaacttgatctccagtcg

SEQ ID NO: 488283 - DNA, 25 bp, Homo sapien
agaacttgatctccagtcggccttt

SEQ ID NO: 488284 - DNA, 25 bp, Homo sapien
acttgatctccagtcggcctttgca

SEQ ID NO: 488285 - DNA, 25 bp, Homo sapien
agctggtctctaaattgccggtgaa

SEQ ID NO: 488286 - DNA, 25 bp, Homo sapien
gctggtctctaaattgccggtgaaa

SEQ ID NO: 488287 - DNA, 25 bp, Homo sapien
ctggtctctaaattgccggtgaaaa

SEQ ID NO: 488288 - DNA, 25 bp, Homo sapien
tggtctctaaattgccggtgaaaat

SEQ ID NO: 488289 - DNA, 25 bp, Homo sapien
ggtctctaaattgccggtgaaaatc

SEQ ID NO: 488290 - DNA, 25 bp, Homo sapien
gtctctaaattgccggtgaaaatcc

SEQ ID NO: 488291 - DNA, 25 bp, Homo sapien
tctctaaattgccggtgaaaatcct

SEQ ID NO: 488292 - DNA, 25 bp, Homo sapien
ctctaaattgccggtgaaaatccta

SEQ ID NO: 488293 - DNA, 25 bp, Homo sapien
tctaaattgccggtgaaaatcctat

SEQ ID NO: 488294 - DNA, 25 bp, Homo sapien
ctaaattgccggtgaaaatcctatt

SEQ ID NO: 488295 - DNA, 25 bp, Homo sapien
tgacatttcatctgggtggtctgaa

SEQ ID NO: 488296 - DNA, 25 bp, Homo sapien
gacatttcatctgggtggtctgaat

SEQ ID NO: 488297 - DNA, 25 bp, Homo sapien
catttcatctgggtggtctgaatat

SEQ ID NO: 488298 - DNA, 25 bp, Homo sapien
tttcatctgggtggtctgaatatta

SEQ ID NO: 488299 - DNA, 25 bp, Homo sapien
tcatctgggtggtctgaatattaaa

SEQ ID NO: 488300 - DNA, 25 bp, Homo sapien
atctgggtggtctgaatattaaagc

SEQ ID NO: 488301 - DNA, 25 bp, Homo sapien
ctgggtggtctgaatattaaagctc

SEQ ID NO: 488302 - DNA, 25 bp, Homo sapien
gggtggtctgaatattaaagctctt

SEQ ID NO: 488303 - DNA, 25 bp, Homo sapien
ggtggtctgaatattaaagctcttc

SEQ ID NO: 488304 - DNA, 25 bp, Homo sapien
tggtctgaatattaaagctcttcat

SEQ ID NO: 488305 - DNA, 25 bp, Homo sapien
gtctgaatattaaagctcttcattt

SEQ ID NO: 488306 - DNA, 25 bp, Homo sapien
ataaacattcacagcttgcatgcgt

SEQ ID NO: 488307 - DNA, 25 bp, Homo sapien
taaacattcacagcttgcatgcgtg

SEQ ID NO: 488308 - DNA, 25 bp, Homo sapien
tgtgtgtatgtttgcttgcactgca

SEQ ID NO: 488309 - DNA, 25 bp, Homo sapien
gtgtgtatgtttgcttgcactgcat

SEQ ID NO: 488310 - DNA, 25 bp, Homo sapien
gtgtatgtttgcttgcactgcataa

SEQ ID NO: 488311 - DNA, 25 bp, Homo sapien
aaacaattgcaacatcaacagaaat

SEQ ID NO: 488312 - DNA, 25 bp, Homo sapien
taaaggaataattctcctccgactc

SEQ ID NO: 488313 - DNA, 25 bp, Homo sapien
aaggaataattctcctccgactctg

SEQ ID NO: 488314 - DNA, 25 bp, Homo sapien
aggaataattctcctccgactctgc

SEQ ID NO: 488315 - DNA, 25 bp, Homo sapien
aataattctcctccgactctgccgt

SEQ ID NO: 488316 - DNA, 25 bp, Homo sapien
gttgacataacggtctgttttcaag

SEQ ID NO: 488317 - DNA, 25 bp, Homo sapien
acttgtcccattaaccctcttctag

SEQ ID NO: 488318 - DNA, 25 bp, Homo sapien
ccattaaccctcttctagtctagat

SEQ ID NO: 488319 - DNA, 25 bp, Homo sapien
aaccctcttctagtctagatgagat

SEQ ID NO: 488320 - DNA, 25 bp, Homo sapien
gaaaacgtatgttcttctactcagc

SEQ ID NO: 488321 - DNA, 25 bp, Homo sapien
gtatgttcttctactcagcattgcc

SEQ ID NO: 488322 - DNA, 25 bp, Homo sapien
tgttcttctactcagcattgccctt

SEQ ID NO: 488323 - DNA, 25 bp, Homo sapien
acttcacctccgagtagcttgttta

SEQ ID NO: 488324 - DNA, 25 bp, Homo sapien
tcacctccgagtagcttgtttatca

SEQ ID NO: 488325 - DNA, 25 bp, Homo sapien
acctccgagtagcttgtttatcaag

SEQ ID NO: 488326 - DNA, 25 bp, Homo sapien
agaatgggagagaaatgactacctt

SEQ ID NO: 488327 - DNA, 25 bp, Homo sapien
gttcctactcttttatataattatc

SEQ ID NO: 488328 - DNA, 25 bp, Homo sapien
agatgccaaacagcttgtggcctca

SEQ ID NO: 488329 - DNA, 25 bp, Homo sapien
tagtccccgggagtaaaatgagtga

SEQ ID NO: 488330 - DNA, 25 bp, Homo sapien
tccccgggagtaaaatgagtgacct

SEQ ID NO: 488331 - DNA, 25 bp, Homo sapien
gagtgacctcagaaacaagaattcc

SEQ ID NO: 488332 - DNA, 25 bp, Homo sapien
gaattcctggaaaggcacatgccga

SEQ ID NO: 488333 - DNA, 25 bp, Homo sapien
gcacatgccgaagaggaatatggta

SEQ ID NO: 488334 - DNA, 25 bp, Homo sapien
atcatttgaactgataagcactttt

SEQ ID NO: 488335 - DNA, 25 bp, Homo sapien
gcactttttgtgtcaatataaaata

SEQ ID NO: 488336 - DNA, 25 bp, Homo sapien
aactgatgaaatgctaagacatgtc

SEQ ID NO: 488337 - DNA, 25 bp, Homo sapien
gaccacttttatttactcatgagaa

SEQ ID NO: 488338 - DNA, 25 bp, Homo sapien
tatttactcatgagaagtggaagct

SEQ ID NO: 488339 - DNA, 25 bp, Homo sapien
aaagcaaggcagtgacacaaagagg

SEQ ID NO: 488340 - DNA, 25 bp, Homo sapien
aggtcactgggattgcctgaagctt

SEQ ID NO: 488341 - DNA, 25 bp, Homo sapien
gggattgcctgaagcttgaccacag

SEQ ID NO: 488342 - DNA, 25 bp, Homo sapien
gaagcttgaccacaggcacgagtga

SEQ ID NO: 488343 - DNA, 25 bp, Homo sapien
acaggcacgagtgactttcctcttg

SEQ ID NO: 488344 - DNA, 25 bp, Homo sapien
tgactttcctcttggctggtaccat

SEQ ID NO: 488345 - DNA, 25 bp, Homo sapien
taacaaaggatatctcaatagagtc

SEQ ID NO: 488346 - DNA, 25 bp, Homo sapien
aatagagtcaattagcccagcatgc

SEQ ID NO: 488347 - DNA, 25 bp, Homo sapien
aattagcccagcatgcctcagagag

SEQ ID NO: 488348 - DNA, 25 bp, Homo sapien
agcatgcctcagagagttctgtgat

SEQ ID NO: 488349 - DNA, 25 bp, Homo sapien
tgtgagtggtcacttctttgaacta

SEQ ID NO: 488350 - DNA, 25 bp, Homo sapien
gcttttgacttttggcagcctcttc

SEQ ID NO: 488351 - DNA, 25 bp, Homo sapien
cttttgacttttggcagcctcttca

SEQ ID NO: 488352 - DNA, 25 bp, Homo sapien
tggcagcctcttcaggcgcagaact

SEQ ID NO: 488353 - DNA, 25 bp, Homo sapien
tcttcaggcgcagaacttgatctcc

SEQ ID NO: 488354 - DNA, 25 bp, Homo sapien
cttcaggcgcagaacttgatctcca

SEQ ID NO: 488355 - DNA, 25 bp, Homo sapien
ttcaggcgcagaacttgatctccag

SEQ ID NO: 488356 - DNA, 25 bp, Homo sapien
cggcctttgcaggcccggcctcctg

SEQ ID NO: 488357 - DNA, 25 bp, Homo sapien
ggcctttgcaggcccggcctcctgc

SEQ ID NO: 488358 - DNA, 25 bp, Homo sapien
caatgaagtgtctattctgcttctt

SEQ ID NO: 488359 - DNA, 25 bp, Homo sapien
atatgcaagtctgctgaggcccaaa

SEQ ID NO: 488360 - DNA, 25 bp, Homo sapien
gaggcccaaacttcaaaacgaactg

SEQ ID NO: 488361 - DNA, 25 bp, Homo sapien
atagaagctctgaacgccacatctc

SEQ ID NO: 488362 - DNA, 25 bp, Homo sapien
aaacgaactgctccacagtggcagc

SEQ ID NO: 488363 - DNA, 25 bp, Homo sapien
accaggccctggtattcaaaggtgt

SEQ ID NO: 488364 - DNA, 25 bp, Homo sapien
tgtctagcaggagcttggcggcacc

SEQ ID NO: 488365 - DNA, 25 bp, Homo sapien
gaacgccacatctcttacagaaggt

SEQ ID NO: 488366 - DNA, 25 bp, Homo sapien
tacagaaggtatgctgggctttgtg

SEQ ID NO: 488367 - DNA, 25 bp, Homo sapien
gggctttgtgagtattgaacgtgta

SEQ ID NO: 488368 - DNA, 25 bp, Homo sapien
gtaagtcgttatgtgctcacgtccc

SEQ ID NO: 488369 - DNA, 25 bp, Homo sapien
gatgatggacttgagcgccgtgttc

SEQ ID NO: 488370 - DNA, 25 bp, Homo sapien
acttgagcgccgtgttcttcagcct

SEQ ID NO: 488371 - DNA, 25 bp, Homo sapien
cgacttgactcaccgtcacctggaa

SEQ ID NO: 488372 - DNA, 25 bp, Homo sapien
gactcaccgtcacctggaagcaggg

SEQ ID NO: 488373 - DNA, 25 bp, Homo sapien
tgggtcttcagatcataaactacgt

SEQ ID NO: 488374 - DNA, 25 bp, Homo sapien
gatcataaactacgtattccctctt

SEQ ID NO: 488375 - DNA, 25 bp, Homo sapien
ataaactacgtattccctcttgaca

SEQ ID NO: 488376 - DNA, 25 bp, Homo sapien
aaactacgtattccctcttgacact

SEQ ID NO: 488377 - DNA, 25 bp, Homo sapien
tcttgacactcacaatctcgttcac

SEQ ID NO: 488378 - DNA, 25 bp, Homo sapien
tcacaatctcgttcaccacgtgggc

SEQ ID NO: 488379 - DNA, 25 bp, Homo sapien
aatctcgttcaccacgtgggcctgg

SEQ ID NO: 488380 - DNA, 25 bp, Homo sapien
atccatgagttcagccctccggcaa

SEQ ID NO: 488381 - DNA, 25 bp, Homo sapien
tgagttcagccctccggcaagcggg

SEQ ID NO: 488382 - DNA, 25 bp, Homo sapien
agccctccggcaagcgggagctgca

SEQ ID NO: 488383 - DNA, 25 bp, Homo sapien
ggcgcaccaaggaaagcctctgctt

SEQ ID NO: 488384 - DNA, 25 bp, Homo sapien
ggaaagcctctgcttcagacccagg

SEQ ID NO: 488385 - DNA, 25 bp, Homo sapien
ggagggagcttcaaaagcagtcagc

SEQ ID NO: 488386 - DNA, 25 bp, Homo sapien
caaaagcagtcagcatccagccaga

SEQ ID NO: 488387 - DNA, 25 bp, Homo sapien
agccagattctttcaataggacccc

SEQ ID NO: 488388 - DNA, 25 bp, Homo sapien
tgtcctggtcccacatgagcacagc

SEQ ID NO: 488389 - DNA, 25 bp, Homo sapien
tggtcccacatgagcacagcacctg

SEQ ID NO: 488390 - DNA, 25 bp, Homo sapien
ccagcaggcctaggagagagtccca

SEQ ID NO: 488391 - DNA, 25 bp, Homo sapien
ggaggttcagcgacaaggccaatgt

SEQ ID NO: 488392 - DNA, 25 bp, Homo sapien
aaggccaatgtctagttaagaagca

SEQ ID NO: 488393 - DNA, 25 bp, Homo sapien
agcaatttggcttacagagaggcaa

SEQ ID NO: 488394 - DNA, 25 bp, Homo sapien
caaattgtcaactgcagggtaatgt

SEQ ID NO: 488395 - DNA, 25 bp, Homo sapien
gtgattcattggtaaaggccaattc

SEQ ID NO: 488396 - DNA, 25 bp, Homo sapien
aggccaattcatcataaagcagcag

SEQ ID NO: 488397 - DNA, 25 bp, Homo sapien
atgagcccagcggatggtctaacaa

SEQ ID NO: 488398 - DNA, 25 bp, Homo sapien
gaaattactagggttagagtcttgg

SEQ ID NO: 488399 - DNA, 25 bp, Homo sapien
gagtcttggttacccaggtaactat

SEQ ID NO: 488400 - DNA, 25 bp, Homo sapien
gttacccaggtaactatacaaagat

SEQ ID NO: 488401 - DNA, 25 bp, Homo sapien
ctgaacattatagtagctgtgaaac

SEQ ID NO: 488402 - DNA, 25 bp, Homo sapien
aaatcagagaaaagcccacctttga

SEQ ID NO: 488403 - DNA, 25 bp, Homo sapien
cacctttgaatacgtggctgaagat

SEQ ID NO: 488404 - DNA, 25 bp, Homo sapien
cagccaagaattggtctttcctaaa

SEQ ID NO: 488405 - DNA, 25 bp, Homo sapien
gataatgctgctagattgttatttt

SEQ ID NO: 488406 - DNA, 25 bp, Homo sapien
aaatcggtatttaaactgaagacat

SEQ ID NO: 488407 - DNA, 25 bp, Homo sapien
aaagttgaaagtgactgctctgtac

SEQ ID NO: 488408 - DNA, 25 bp, Homo sapien
gactgctctgtacatcatgacctta

SEQ ID NO: 488409 - DNA, 25 bp, Homo sapien
gtacatcatgaccttaacaatgtta

SEQ ID NO: 488410 - DNA, 25 bp, Homo sapien
gttaatgctgtaagtgaaagttcac

SEQ ID NO: 488411 - DNA, 25 bp, Homo sapien
gaaagttcactgtcgtctgtatact

SEQ ID NO: 488412 - DNA, 25 bp, Homo sapien
cactgtcgtctgtatactaaattta

SEQ ID NO: 488413 - DNA, 25 bp, Homo sapien
cagccccagcagaccacaggaggtt

SEQ ID NO: 488414 - DNA, 25 bp, Homo sapien
agcagaccacaggaggttggcccca

SEQ ID NO: 488415 - DNA, 25 bp, Homo sapien
cagaccacaggaggttggccccaga

SEQ ID NO: 488416 - DNA, 25 bp, Homo sapien
gttggccccagactcactgagtgcc

SEQ ID NO: 488417 - DNA, 25 bp, Homo sapien
ctgcagcagccgtacagacacagca

SEQ ID NO: 488418 - DNA, 25 bp, Homo sapien
agccgtacagacacagcatccttgg

SEQ ID NO: 488419 - DNA, 25 bp, Homo sapien
atcccggccatctagggtcagcaca

SEQ ID NO: 488420 - DNA, 25 bp, Homo sapien
atctagggtcagcacaacccagatg

SEQ ID NO: 488421 - DNA, 25 bp, Homo sapien
agcacaacccagatgaggccgctga

SEQ ID NO: 488422 - DNA, 25 bp, Homo sapien
acaacccagatgaggccgctgaagg

SEQ ID NO: 488423 - DNA, 25 bp, Homo sapien
atgaggccgctgaagggcaccggat

SEQ ID NO: 488424 - DNA, 25 bp, Homo sapien
atgttctttaatgccatgctcgcgc

SEQ ID NO: 488425 - DNA, 25 bp, Homo sapien
gctcgcgcctcaactaaatacattt

SEQ ID NO: 488426 - DNA, 25 bp, Homo sapien
accctgccctcctttaaacatggag

SEQ ID NO: 488427 - DNA, 25 bp, Homo sapien
aacatggaggagttactgcggctac

SEQ ID NO: 488428 - DNA, 25 bp, Homo sapien
tactgcggctactcctatcagggtt

SEQ ID NO: 488429 - DNA, 25 bp, Homo sapien
actcctatcagggttctagattcta

SEQ ID NO: 488430 - DNA, 25 bp, Homo sapien
cagttccctcatttataaaacagat

SEQ ID NO: 488431 - DNA, 25 bp, Homo sapien
ataaaacagatcaccatttgacaga

SEQ ID NO: 488432 - DNA, 25 bp, Homo sapien
cagggattagcttctgactgtaaaa

SEQ ID NO: 488433 - DNA, 25 bp, Homo sapien
aaatgcttggcatggtctctggtac

SEQ ID NO: 488434 - DNA, 25 bp, Homo sapien
cttggcatggtctctggtacttgaa

SEQ ID NO: 488435 - DNA, 25 bp, Homo sapien
accagcatcgacaccaagatcaaag

SEQ ID NO: 488436 - DNA, 25 bp, Homo sapien
ccagcatcgacaccaagatcaaaga

SEQ ID NO: 488437 - DNA, 25 bp, Homo sapien
accaaaagaaccaagtgctgtagag

SEQ ID NO: 488438 - DNA, 25 bp, Homo sapien
aagaaccaagtgctgtagaggacat

SEQ ID NO: 488439 - DNA, 25 bp, Homo sapien
gaaccaagtgctgtagaggacatta

SEQ ID NO: 488440 - DNA, 25 bp, Homo sapien
aaccaagtgctgtagaggacattaa

SEQ ID NO: 488441 - DNA, 25 bp, Homo sapien
ccaagtgctgtagaggacattaaag

SEQ ID NO: 488442 - DNA, 25 bp, Homo sapien
aagtggaagccaagttcatgattta

SEQ ID NO: 488443 - DNA, 25 bp, Homo sapien
gtggaagccaagttcatgatttatg

SEQ ID NO: 488444 - DNA, 25 bp, Homo sapien
gaagccaagttcatgatttatgtga

SEQ ID NO: 488445 - DNA, 25 bp, Homo sapien
agccaagttcatgatttatgtgaag

SEQ ID NO: 488446 - DNA, 25 bp, Homo sapien
gagggagaacctaaatatacttctt

SEQ ID NO: 488447 - DNA, 25 bp, Homo sapien
tatacttctttgtagagaggatcgt

SEQ ID NO: 488448 - DNA, 25 bp, Homo sapien
agagaggatcgtgaactgctttaag

SEQ ID NO: 488449 - DNA, 25 bp, Homo sapien
aactgctttaagtctggtggcatca

SEQ ID NO: 488450 - DNA, 25 bp, Homo sapien
ttagacatcttcaggttgattccac

SEQ ID NO: 488451 - DNA, 25 bp, Homo sapien
ttcaggttgattccacagagcagtt

SEQ ID NO: 488452 - DNA, 25 bp, Homo sapien
gattccacagagcagttgtttcctt

SEQ ID NO: 488453 - DNA, 25 bp, Homo sapien
acagagcagttgtttcctttttcac

SEQ ID NO: 488454 - DNA, 25 bp, Homo sapien
cctttttcacttgacttacatagaa

SEQ ID NO: 488455 - DNA, 25 bp, Homo sapien
atcaagttggtttttccattgtaag

SEQ ID NO: 488456 - DNA, 25 bp, Homo sapien
aattacatacaaatggccgggtgcg

SEQ ID NO: 488457 - DNA, 25 bp, Homo sapien
tcttttatttttcaatatcccagta

SEQ ID NO: 488458 - DNA, 25 bp, Homo sapien
ttcaatatcccagtaaacccatgta

SEQ ID NO: 488459 - DNA, 25 bp, Homo sapien
gtaaacccatgtatattatcactat

SEQ ID NO: 488460 - DNA, 25 bp, Homo sapien
ttttctactgatcatcataactctg

SEQ ID NO: 488461 - DNA, 25 bp, Homo sapien
gatcatcataactctgtatctgagc

SEQ ID NO: 488462 - DNA, 25 bp, Homo sapien
cataactctgtatctgagcagtgat

SEQ ID NO: 488463 - DNA, 25 bp, Homo sapien
tgagcagtgataccaaccacatctg

SEQ ID NO: 488464 - DNA, 25 bp, Homo sapien
gtgataccaaccacatctgaagtca

SEQ ID NO: 488465 - DNA, 25 bp, Homo sapien
agtcaacagaagatccaagtttaaa

SEQ ID NO: 488466 - DNA, 25 bp, Homo sapien
gcggaatgtgtgcagtatctagaaa

SEQ ID NO: 488467 - DNA, 25 bp, Homo sapien
gcagtatctagaaaaatgaaccgta

SEQ ID NO: 488468 - DNA, 25 bp, Homo sapien
aggccctgttctgtagtgtttctta

SEQ ID NO: 488469 - DNA, 25 bp, Homo sapien
gtgtttcttatcctcacacagagta

SEQ ID NO: 488470 - DNA, 25 bp, Homo sapien
agcctgtttgctttatttaacttat

SEQ ID NO: 488471 - DNA, 25 bp, Homo sapien
ataataccagcttctgctctagaac

SEQ ID NO: 488472 - DNA, 25 bp, Homo sapien
gctctagaactactttgggtgaaat

SEQ ID NO: 488473 - DNA, 25 bp, Homo sapien
ggtaatagcaaatgacctcctttaa

SEQ ID NO: 488474 - DNA, 25 bp, Homo sapien
gacctcctttaacaagacactcatc

SEQ ID NO: 488475 - DNA, 25 bp, Homo sapien
gacactcatctcaaacaatgccatt

SEQ ID NO: 488476 - DNA, 25 bp, Homo sapien
atgccatttagttcaggagatctct

SEQ ID NO: 488477 - DNA, 25 bp, Homo sapien
ggagatctctaagtgtagctgtaaa

SEQ ID NO: 488478 - DNA, 25 bp, Homo sapien
taatttggcttatattggacctttt

SEQ ID NO: 488479 - DNA, 25 bp, Homo sapien
tggcggcggcccacaccttcaagag

SEQ ID NO: 488480 - DNA, 25 bp, Homo sapien
ttcaagagcccaagccagcgctgcc

SEQ ID NO: 488481 - DNA, 25 bp, Homo sapien
ctcccgggatcccatctagagaggg

SEQ ID NO: 488482 - DNA, 25 bp, Homo sapien
atcccatctagagagggagctgcgg

SEQ ID NO: 488483 - DNA, 25 bp, Homo sapien
gggcgcatcatagcacgcgtcctaa

SEQ ID NO: 488484 - DNA, 25 bp, Homo sapien
atcatagcacgcgtcctaagtgggc

SEQ ID NO: 488485 - DNA, 25 bp, Homo sapien
atagcacgcgtcctaagtgggccgc

SEQ ID NO: 488486 - DNA, 25 bp, Homo sapien
acgcgtcctaagtgggccgcctggc

SEQ ID NO: 488487 - DNA, 25 bp, Homo sapien
agaaccatggcaggagccggaagca

SEQ ID NO: 488488 - DNA, 25 bp, Homo sapien
ggaagcagctgtgcgcagccagcca

SEQ ID NO: 488489 - DNA, 25 bp, Homo sapien
gggtcccgagggaggaacgcgagcg

SEQ ID NO: 488490 - DNA, 25 bp, Homo sapien
ggcaccccagcccacgatcaccatc

SEQ ID NO: 488491 - DNA, 25 bp, Homo sapien
acgatcaccatccttgtctggcact

SEQ ID NO: 488492 - DNA, 25 bp, Homo sapien
cgatcaccatccttgtctggcactg

SEQ ID NO: 488493 - DNA, 25 bp, Homo sapien
gatcaccatccttgtctggcactgg

SEQ ID NO: 488494 - DNA, 25 bp, Homo sapien
gccccacccggaggctgcgaggctt

SEQ ID NO: 488495 - DNA, 25 bp, Homo sapien
cccacccggaggctgcgaggcttgg

SEQ ID NO: 488496 - DNA, 25 bp, Homo sapien
ccacccggaggctgcgaggcttggg

SEQ ID NO: 488497 - DNA, 25 bp, Homo sapien
ccggaggctgcgaggcttgggggtc

SEQ ID NO: 488498 - DNA, 25 bp, Homo sapien
ggaggctgcgaggcttgggggtcct

SEQ ID NO: 488499 - DNA, 25 bp, Homo sapien
gtggctgctggggtcagcccctcgg

SEQ ID NO: 488500 - DNA, 25 bp, Homo sapien
tggctgctggggtcagcccctcggg

SEQ ID NO: 488501 - DNA, 25 bp, Homo sapien
tccttgtccctttttgattgaaaca

SEQ ID NO: 488502 - DNA, 25 bp, Homo sapien
ttttgattgaaacatggctgtagct

SEQ ID NO: 488503 - DNA, 25 bp, Homo sapien
agtgccaggcccatcaataattcag

SEQ ID NO: 488504 - DNA, 25 bp, Homo sapien
caggcccatcaataattcagcaaga

SEQ ID NO: 488505 - DNA, 25 bp, Homo sapien
gggccaggctagtgttcgcaagcat

SEQ ID NO: 488506 - DNA, 25 bp, Homo sapien
tagtgttcgcaagcatgcctcagtc

SEQ ID NO: 488507 - DNA, 25 bp, Homo sapien
atgcctcagtctggcatgtgacttc

SEQ ID NO: 488508 - DNA, 25 bp, Homo sapien
catgtgacttctcgccctgcaggtg

SEQ ID NO: 488509 - DNA, 25 bp, Homo sapien
tcatgcttcctagggcagctgaacc

SEQ ID NO: 488510 - DNA, 25 bp, Homo sapien
agggcagctgaacccatccccagga

SEQ ID NO: 488511 - DNA, 25 bp, Homo sapien
gtagcctggtagcactctcctcctt

SEQ ID NO: 488512 - DNA, 25 bp, Homo sapien
tgcgggccatgctggccatcgaaga

SEQ ID NO: 488513 - DNA, 25 bp, Homo sapien
gccatgctggccatcgaagactggc

SEQ ID NO: 488514 - DNA, 25 bp, Homo sapien
catgctggccatcgaagactggcag

SEQ ID NO: 488515 - DNA, 25 bp, Homo sapien
gctggccatcgaagactggcagaaa

SEQ ID NO: 488516 - DNA, 25 bp, Homo sapien
gaagactggcagaaaacgtccgctc

SEQ ID NO: 488517 - DNA, 25 bp, Homo sapien
agactggcagaaaacgtccgctcag

SEQ ID NO: 488518 - DNA, 25 bp, Homo sapien
actggcagaaaacgtccgctcagca

SEQ ID NO: 488519 - DNA, 25 bp, Homo sapien
tggcagaaaacgtccgctcagcagc

SEQ ID NO: 488520 - DNA, 25 bp, Homo sapien
ggcagaaaacgtccgctcagcagca

SEQ ID NO: 488521 - DNA, 25 bp, Homo sapien
agaaaacgtccgctcagcagcaccg

SEQ ID NO: 488522 - DNA, 25 bp, Homo sapien
aaacgtccgctcagcagcaccgaga

SEQ ID NO: 488523 - DNA, 25 bp, Homo sapien
ggacatggaaataaagcacccagcg

SEQ ID NO: 488524 - DNA, 25 bp, Homo sapien
gacatggaaataaagcacccagcgc

SEQ ID NO: 488525 - DNA, 25 bp, Homo sapien
acatggaaataaagcacccagcgct

SEQ ID NO: 488526 - DNA, 25 bp, Homo sapien
catggaaataaagcacccagcgctg

SEQ ID NO: 488527 - DNA, 25 bp, Homo sapien
atggaaataaagcacccagcgctgc

SEQ ID NO: 488528 - DNA, 25 bp, Homo sapien
tggaaataaagcacccagcgctgcc

SEQ ID NO: 488529 - DNA, 25 bp, Homo sapien
ggaaataaagcacccagcgctgccc

SEQ ID NO: 488530 - DNA, 25 bp, Homo sapien
gaaataaagcacccagcgctgccct

SEQ ID NO: 488531 - DNA, 25 bp, Homo sapien
aaataaagcacccagcgctgccctg

SEQ ID NO: 488532 - DNA, 25 bp, Homo sapien
aataaagcacccagcgctgccctgg

SEQ ID NO: 488533 - DNA, 25 bp, Homo sapien
ataaagcacccagcgctgccctggg

SEQ ID NO: 488534 - DNA, 25 bp, Homo sapien
cctgccccaggttggcttgttgttg

SEQ ID NO: 488535 - DNA, 25 bp, Homo sapien
ctgccccaggttggcttgttgttgc

SEQ ID NO: 488536 - DNA, 25 bp, Homo sapien
ccccaggttggcttgttgttgcagc

SEQ ID NO: 488537 - DNA, 25 bp, Homo sapien
cccaggttggcttgttgttgcagca

SEQ ID NO: 488538 - DNA, 25 bp, Homo sapien
ccaggttggcttgttgttgcagcag

SEQ ID NO: 488539 - DNA, 25 bp, Homo sapien
caggttggcttgttgttgcagcagc

SEQ ID NO: 488540 - DNA, 25 bp, Homo sapien
aggttggcttgttgttgcagcagca

SEQ ID NO: 488541 - DNA, 25 bp, Homo sapien
gttggcttgttgttgcagcagcagc

SEQ ID NO: 488542 - DNA, 25 bp, Homo sapien
ctcacaggacaggtgttttatgacc

SEQ ID NO: 488543 - DNA, 25 bp, Homo sapien
cacaggacaggtgttttatgaccca

SEQ ID NO: 488544 - DNA, 25 bp, Homo sapien
acaggacaggtgttttatgacccag

SEQ ID NO: 488545 - DNA, 25 bp, Homo sapien
caaaaccgaaagtgagcctcaagca

SEQ ID NO: 488546 - DNA, 25 bp, Homo sapien
gagcttggctcacaaatcaactttt

SEQ ID NO: 488547 - DNA, 25 bp, Homo sapien
aatcaacttttctgctcgtgagacc

SEQ ID NO: 488548 - DNA, 25 bp, Homo sapien
aacttttctgctcgtgagacccagg

SEQ ID NO: 488549 - DNA, 25 bp, Homo sapien
ttttctgctcgtgagacccaggaag

SEQ ID NO: 488550 - DNA, 25 bp, Homo sapien
tctgctcgtgagacccaggaagtca

SEQ ID NO: 488551 - DNA, 25 bp, Homo sapien
gctcgtgagacccaggaagtcacag

SEQ ID NO: 488552 - DNA, 25 bp, Homo sapien
ggaagtcacagatacagggcatctt

SEQ ID NO: 488553 - DNA, 25 bp, Homo sapien
gtcacagatacagggcatctttagt

SEQ ID NO: 488554 - DNA, 25 bp, Homo sapien
agatacagggcatctttagtgaagg

SEQ ID NO: 488555 - DNA, 25 bp, Homo sapien
ccaaaatgagaggattgctgagacc

SEQ ID NO: 488556 - DNA, 25 bp, Homo sapien
acttccatgcattaacccaggacga

SEQ ID NO: 488557 - DNA, 25 bp, Homo sapien
cttccatgcattaacccaggacgaa

SEQ ID NO: 488558 - DNA, 25 bp, Homo sapien
aggaggaagcacgaggattcaagat

SEQ ID NO: 488559 - DNA, 25 bp, Homo sapien
gaggaagcacgaggattcaagattc

SEQ ID NO: 488560 - DNA, 25 bp, Homo sapien
aggaagcacgaggattcaagattct

SEQ ID NO: 488561 - DNA, 25 bp, Homo sapien
ggaagcacgaggattcaagattctc

SEQ ID NO: 488562 - DNA, 25 bp, Homo sapien
gaagcacgaggattcaagattctca

SEQ ID NO: 488563 - DNA, 25 bp, Homo sapien
aagcacgaggattcaagattctcat

SEQ ID NO: 488564 - DNA, 25 bp, Homo sapien
agcacgaggattcaagattctcatt

SEQ ID NO: 488565 - DNA, 25 bp, Homo sapien
gcacgaggattcaagattctcattt

SEQ ID NO: 488566 - DNA, 25 bp, Homo sapien
cacgaggattcaagattctcattta

SEQ ID NO: 488567 - DNA, 25 bp, Homo sapien
catgaactgggtcgtgggcagcgcg

SEQ ID NO: 488568 - DNA, 25 bp, Homo sapien
agacacgccctccatgtactgtgag

SEQ ID NO: 488569 - DNA, 25 bp, Homo sapien
ctccatgtactgtgaggccaagctg

SEQ ID NO: 488570 - DNA, 25 bp, Homo sapien
ggcgcacacctaccagtctgtgaaa

SEQ ID NO: 488571 - DNA, 25 bp, Homo sapien
aacagcagctgttcaaggcctttca

SEQ ID NO: 488572 - DNA, 25 bp, Homo sapien
gcagctgttcaaggcctttcagaag

SEQ ID NO: 488573 - DNA, 25 bp, Homo sapien
gcacctgggtgaggaaaccaccgga

SEQ ID NO: 488574 - DNA, 25 bp, Homo sapien
gcagcgcggacctggagattatcaa

SEQ ID NO: 488575 - DNA, 25 bp, Homo sapien
ggagattatcaacgccaccactggg

SEQ ID NO: 488576 - DNA, 25 bp, Homo sapien
atcaacgccaccactgggcggagga

SEQ ID NO: 488577 - DNA, 25 bp, Homo sapien
atcccggctctgcaagcacgtgctg

SEQ ID NO: 488578 - DNA, 25 bp, Homo sapien
ttctaaccacaaatctggcaggaaa

SEQ ID NO: 488579 - DNA, 25 bp, Homo sapien
ctcatgcatatttccatactaagac

SEQ ID NO: 488580 - DNA, 25 bp, Homo sapien
atttccatactaagacatttttgtc

SEQ ID NO: 488581 - DNA, 25 bp, Homo sapien
gacatttttgtctaaacaactgtat

SEQ ID NO: 488582 - DNA, 25 bp, Homo sapien
caactgtatttgaatctggcttttt

SEQ ID NO: 488583 - DNA, 25 bp, Homo sapien
tctggctttttataagaagtccaaa

SEQ ID NO: 488584 - DNA, 25 bp, Homo sapien
cttacaacggttggctcattacgaa

SEQ ID NO: 488585 - DNA, 25 bp, Homo sapien
acggttggctcattacgaacacttt

SEQ ID NO: 488586 - DNA, 25 bp, Homo sapien
ttggctcattacgaacactttaagt

SEQ ID NO: 488587 - DNA, 25 bp, Homo sapien
taagttcgtattaagaagggtacag

SEQ ID NO: 488588 - DNA, 25 bp, Homo sapien
aagggtacagggagccgggtgcagt

SEQ ID NO: 488589 - DNA, 25 bp, Homo sapien
agatggcatggttgctctattggac

SEQ ID NO: 488590 - DNA, 25 bp, Homo sapien
gatggcatggttgctctattggact

SEQ ID NO: 488591 - DNA, 25 bp, Homo sapien
atggcatggttgctctattggacta

SEQ ID NO: 488592 - DNA, 25 bp, Homo sapien
tggcatggttgctctattggactac

SEQ ID NO: 488593 - DNA, 25 bp, Homo sapien
ggcatggttgctctattggactacc

SEQ ID NO: 488594 - DNA, 25 bp, Homo sapien
gcatggttgctctattggactaccg

SEQ ID NO: 488595 - DNA, 25 bp, Homo sapien
atggttgctctattggactaccgtg

SEQ ID NO: 488596 - DNA, 25 bp, Homo sapien
tggttgctctattggactaccgtga

SEQ ID NO: 488597 - DNA, 25 bp, Homo sapien
ggttgctctattggactaccgtgag

SEQ ID NO: 488598 - DNA, 25 bp, Homo sapien
gttgctctattggactaccgtgagg

SEQ ID NO: 488599 - DNA, 25 bp, Homo sapien
gtggtattttggtacagcagcctta

SEQ ID NO: 488600 - DNA, 25 bp, Homo sapien
taaaacacctctgatacttacctgc

SEQ ID NO: 488601 - DNA, 25 bp, Homo sapien
tacttacctgcgcttgtggctgtgt

SEQ ID NO: 488602 - DNA, 25 bp, Homo sapien
gtggctgtgttttctgatactatga

SEQ ID NO: 488603 - DNA, 25 bp, Homo sapien
atgagagccgtagtatctggatacc

SEQ ID NO: 488604 - DNA, 25 bp, Homo sapien
gataccggagagtctgcgaacttga

SEQ ID NO: 488605 - DNA, 25 bp, Homo sapien
agagaagggccgtgtctgattttcc

SEQ ID NO: 488606 - DNA, 25 bp, Homo sapien
gattttccttcagtgtcccaaggaa

SEQ ID NO: 488607 - DNA, 25 bp, Homo sapien
ggaaggatcttgcacagtacccaga

SEQ ID NO: 488608 - DNA, 25 bp, Homo sapien
agtacccagatttggagaggtgcca

SEQ ID NO: 488609 - DNA, 25 bp, Homo sapien
tgccaagtgaatgcttcggtggact

SEQ ID NO: 488610 - DNA, 25 bp, Homo sapien
ggctaaacatttaatcagggattca

SEQ ID NO: 488611 - DNA, 25 bp, Homo sapien
cagggattcaagatgtatgcatgag

SEQ ID NO: 488612 - DNA, 25 bp, Homo sapien
attagcagtgtcagagggtggtcca

SEQ ID NO: 488613 - DNA, 25 bp, Homo sapien
cagtgtcagagggtggtccagccac

SEQ ID NO: 488614 - DNA, 25 bp, Homo sapien
ggtccagccactgtgtgctatagga

SEQ ID NO: 488615 - DNA, 25 bp, Homo sapien
agccactgtgtgctataggagttca

SEQ ID NO: 488616 - DNA, 25 bp, Homo sapien
cagaggaggaagcatttgtgataca

SEQ ID NO: 488617 - DNA, 25 bp, Homo sapien
cccatcctagaccacttcaaggagt

SEQ ID NO: 488618 - DNA, 25 bp, Homo sapien
gaccacttcaaggagtagctactaa

SEQ ID NO: 488619 - DNA, 25 bp, Homo sapien
agtagctactaaggcagggtttcta

SEQ ID NO: 488620 - DNA, 25 bp, Homo sapien
ggcagggtttctaaggatgaatatg

SEQ ID NO: 488621 - DNA, 25 bp, Homo sapien
ctgctgcttggtcgctgcatgagct

SEQ ID NO: 488622 - DNA, 25 bp, Homo sapien
gtcgctgcatgagcttctgctgtgc

SEQ ID NO: 488623 - DNA, 25 bp, Homo sapien
ttctgctgtgctgacctctctggtt

SEQ ID NO: 488624 - DNA, 25 bp, Homo sapien
ctctggtttgtctcgtcatgtgtaa

SEQ ID NO: 488625 - DNA, 25 bp, Homo sapien
gtaaggtgacaccagatacctacct

SEQ ID NO: 488626 - DNA, 25 bp, Homo sapien
gacaccagatacctacctcttaggg

SEQ ID NO: 488627 - DNA, 25 bp, Homo sapien
agggctgccccgagactaaaataag

SEQ ID NO: 488628 - DNA, 25 bp, Homo sapien
gactaaaataagaccatgtgcatga

SEQ ID NO: 488629 - DNA, 25 bp, Homo sapien
tgtgcatgaaccacttaccaaagtg

SEQ ID NO: 488630 - DNA, 25 bp, Homo sapien
ttaccaaagtgcctgttgctctcca

SEQ ID NO: 488631 - DNA, 25 bp, Homo sapien
tgttgctctccaggtgtgcctaccg

SEQ ID NO: 488632 - DNA, 25 bp, Homo sapien
ctaccgcatgttgccgctgctgttt

SEQ ID NO: 488633 - DNA, 25 bp, Homo sapien
gcatgttgccgctgctgtttctgct

SEQ ID NO: 488634 - DNA, 25 bp, Homo sapien
gctgtttctgctgggacgtctgact

SEQ ID NO: 488635 - DNA, 25 bp, Homo sapien
gtttctgctgggacgtctgactcca

SEQ ID NO: 488636 - DNA, 25 bp, Homo sapien
tctgctgggacgtctgactccagtt

SEQ ID NO: 488637 - DNA, 25 bp, Homo sapien
tgggacgtctgactccagttccttc

SEQ ID NO: 488638 - DNA, 25 bp, Homo sapien
ggacgtctgactccagttccttctc

SEQ ID NO: 488639 - DNA, 25 bp, Homo sapien
gtgacaaggtcatttacaacttaca

SEQ ID NO: 488640 - DNA, 25 bp, Homo sapien
tacaacttacatttacaatttatag

SEQ ID NO: 488641 - DNA, 25 bp, Homo sapien
ttaccagtattaaattctcagccac

SEQ ID NO: 488642 - DNA, 25 bp, Homo sapien
accagtattaaattctcagccactc

SEQ ID NO: 488643 - DNA, 25 bp, Homo sapien
cttcatccacagcatccattgttga

SEQ ID NO: 488644 - DNA, 25 bp, Homo sapien
attttcagttgtgatgccttaacta

SEQ ID NO: 488645 - DNA, 25 bp, Homo sapien
gtgatgccttaactaagaagccaat

SEQ ID NO: 488646 - DNA, 25 bp, Homo sapien
agaagccaattgttagcctgaaatg

SEQ ID NO: 488647 - DNA, 25 bp, Homo sapien
gcctgaaatgcaatcttggtagcca

SEQ ID NO: 488648 - DNA, 25 bp, Homo sapien
tcttggtagccagtttcaatgaagc

SEQ ID NO: 488649 - DNA, 25 bp, Homo sapien
aagttagctgttgggctttagaaag

SEQ ID NO: 488650 - DNA, 25 bp, Homo sapien
ggattttgagtcctgtcatttctac

SEQ ID NO: 488651 - DNA, 25 bp, Homo sapien
cctgtcatttctacttgggagcatt

SEQ ID NO: 488652 - DNA, 25 bp, Homo sapien
acttgggagcattttggagcagatt

SEQ ID NO: 488653 - DNA, 25 bp, Homo sapien
gtggctacctgatggaaacttttct

SEQ ID NO: 488654 - DNA, 25 bp, Homo sapien
tcgtcccgcacgtagccattgttga

SEQ ID NO: 488655 - DNA, 25 bp, Homo sapien
gtagccattgttgaccaggttctgc

SEQ ID NO: 488656 - DNA, 25 bp, Homo sapien
attgttgaccaggttctgcaccagt

SEQ ID NO: 488657 - DNA, 25 bp, Homo sapien
accaggttctgcaccagtgtgtgca

SEQ ID NO: 488658 - DNA, 25 bp, Homo sapien
tgtgtgcaggtaccctgccagcttg

SEQ ID NO: 488659 - DNA, 25 bp, Homo sapien
tgccagcttgctgctgtccaggtac

SEQ ID NO: 488660 - DNA, 25 bp, Homo sapien
tgctgtccaggtactccacagagta

SEQ ID NO: 488661 - DNA, 25 bp, Homo sapien
actccacagagtaggtcttgccaaa

SEQ ID NO: 488662 - DNA, 25 bp, Homo sapien
taggtcttgccaaagccagggacgc

SEQ ID NO: 488663 - DNA, 25 bp, Homo sapien
ttgccaaagccagggacgcggatct

SEQ ID NO: 488664 - DNA, 25 bp, Homo sapien
ccagggacgcggatctggacaccag

SEQ ID NO: 488665 - DNA, 25 bp, Homo sapien
aaaggcctgtgcattctagaccagc

SEQ ID NO: 488666 - DNA, 25 bp, Homo sapien
ccaattggtgggacagcgtgatgac

SEQ ID NO: 488667 - DNA, 25 bp, Homo sapien
atgaccggcagggttcaacagacca

SEQ ID NO: 488668 - DNA, 25 bp, Homo sapien
ttcaacagaccagggcatcttcttg

SEQ ID NO: 488669 - DNA, 25 bp, Homo sapien
catcttcttgtgtcttaaacaggca

SEQ ID NO: 488670 - DNA, 25 bp, Homo sapien
taaacaggcatctctccactgacag

SEQ ID NO: 488671 - DNA, 25 bp, Homo sapien
ctgacagccggtgtggtcacttgga

SEQ ID NO: 488672 - DNA, 25 bp, Homo sapien
tggtcacttggagcacggctttaat

SEQ ID NO: 488673 - DNA, 25 bp, Homo sapien
gaaggactcagtacaaactccgtta

SEQ ID NO: 488674 - DNA, 25 bp, Homo sapien
aactccgttatgatatatcctagcc

SEQ ID NO: 488675 - DNA, 25 bp, Homo sapien
tatcctagccacatgcagggtaaca

SEQ ID NO: 488676 - DNA, 25 bp, Homo sapien
atatctgatgagagactaataacca

SEQ ID NO: 488677 - DNA, 25 bp, Homo sapien
gatgagagactaataaccagaatat

SEQ ID NO: 488678 - DNA, 25 bp, Homo sapien
gagagactaataaccagaatatgta

SEQ ID NO: 488679 - DNA, 25 bp, Homo sapien
taaccagaatatgtaagaacctcaa

SEQ ID NO: 488680 - DNA, 25 bp, Homo sapien
accagaatatgtaagaacctcaaac

SEQ ID NO: 488681 - DNA, 25 bp, Homo sapien
atgtaagaacctcaaacaactctat

SEQ ID NO: 488682 - DNA, 25 bp, Homo sapien
ggactaaagattttaatagacattt

SEQ ID NO: 488683 - DNA, 25 bp, Homo sapien
gacatacaaatggaaaacagctata

SEQ ID NO: 488684 - DNA, 25 bp, Homo sapien
aaacagctatatgaaaagatactca

SEQ ID NO: 488685 - DNA, 25 bp, Homo sapien
gacagacgataacaaatgctggcaa

SEQ ID NO: 488686 - DNA, 25 bp, Homo sapien
agacgataacaaatgctggcaagga

SEQ ID NO: 488687 - DNA, 25 bp, Homo sapien
atcaccatccttgtctggcactgga

SEQ ID NO: 488688 - DNA, 25 bp, Homo sapien
cttgtctggcactggagcatgcaga

SEQ ID NO: 488689 - DNA, 25 bp, Homo sapien
ttgtctggcactggagcatgcagag

SEQ ID NO: 488690 - DNA, 25 bp, Homo sapien
gtctggcactggagcatgcagagga

SEQ ID NO: 488691 - DNA, 25 bp, Homo sapien
gggagggaggtaacgggtgcctgct

SEQ ID NO: 488692 - DNA, 25 bp, Homo sapien
ggaggtaacgggtgcctgctgcggc

SEQ ID NO: 488693 - DNA, 25 bp, Homo sapien
gtaacgggtgcctgctgcggcagac

SEQ ID NO: 488694 - DNA, 25 bp, Homo sapien
tccccaccctgaacaaatcttgggt

SEQ ID NO: 488695 - DNA, 25 bp, Homo sapien
ccctgaacaaatcttgggtgggtga

SEQ ID NO: 488696 - DNA, 25 bp, Homo sapien
atcttgggtgggtgaaggcctggct

SEQ ID NO: 488697 - DNA, 25 bp, Homo sapien
cctggctggaagagggtgaaaggca

SEQ ID NO: 488698 - DNA, 25 bp, Homo sapien
agggctccgcgcccaagtgaggggg

SEQ ID NO: 488699 - DNA, 25 bp, Homo sapien
gggcttagaggctgggatggctcct

SEQ ID NO: 488700 - DNA, 25 bp, Homo sapien
ggcttagaggctgggatggctcctg

SEQ ID NO: 488701 - DNA, 25 bp, Homo sapien
gcttagaggctgggatggctcctgg

SEQ ID NO: 488702 - DNA, 25 bp, Homo sapien
cttagaggctgggatggctcctggc

SEQ ID NO: 488703 - DNA, 25 bp, Homo sapien
gggctccgcgcccaagtgagggggc

SEQ ID NO: 488704 - DNA, 25 bp, Homo sapien
acatacctgtcccttggctatgagc

SEQ ID NO: 488705 - DNA, 25 bp, Homo sapien
catacctgtcccttggctatgagca

SEQ ID NO: 488706 - DNA, 25 bp, Homo sapien
tttcaagatgaaaatggaccagccg

SEQ ID NO: 488707 - DNA, 25 bp, Homo sapien
ttcaagatgaaaatggaccagccgc

SEQ ID NO: 488708 - DNA, 25 bp, Homo sapien
caagatgaaaatggaccagccgcag

SEQ ID NO: 488709 - DNA, 25 bp, Homo sapien
aagatgaaaatggaccagccgcagt

SEQ ID NO: 488710 - DNA, 25 bp, Homo sapien
agatgaaaatggaccagccgcagtg

SEQ ID NO: 488711 - DNA, 25 bp, Homo sapien
atgaaaatggaccagccgcagtggc

SEQ ID NO: 488712 - DNA, 25 bp, Homo sapien
tgaaaatggaccagccgcagtggct

SEQ ID NO: 488713 - DNA, 25 bp, Homo sapien
gaaaatggaccagccgcagtggctc

SEQ ID NO: 488714 - DNA, 25 bp, Homo sapien
gcagagtctgcggtgaccgagatca

SEQ ID NO: 488715 - DNA, 25 bp, Homo sapien
cagagtctgcggtgaccgagatcat

SEQ ID NO: 488716 - DNA, 25 bp, Homo sapien
agagtctgcggtgaccgagatcatg

SEQ ID NO: 488717 - DNA, 25 bp, Homo sapien
gactttgaaagactctggtgccttg

SEQ ID NO: 488718 - DNA, 25 bp, Homo sapien
cttgtggtgcccttctgaaattcaa

SEQ ID NO: 488719 - DNA, 25 bp, Homo sapien
gtctgcattagaatttacggtgtct

SEQ ID NO: 488720 - DNA, 25 bp, Homo sapien
aaagagcttgcctacagatggtttc

SEQ ID NO: 488721 - DNA, 25 bp, Homo sapien
acagatggtttccacacttgaaatt

SEQ ID NO: 488722 - DNA, 25 bp, Homo sapien
acttgaaattgtgccctgcgagttg

SEQ ID NO: 488723 - DNA, 25 bp, Homo sapien
ctgcgagttgcatagctggaagttc

SEQ ID NO: 488724 - DNA, 25 bp, Homo sapien
gaagttcaatgctcagtcctacctt

SEQ ID NO: 488725 - DNA, 25 bp, Homo sapien
ttggctcccattaaacatttggtgc

SEQ ID NO: 488726 - DNA, 25 bp, Homo sapien
aaacatttggtgctctgtggattga

SEQ ID NO: 488727 - DNA, 25 bp, Homo sapien
aacgtgttgaggctttgcaatttca

SEQ ID NO: 488728 - DNA, 25 bp, Homo sapien
taataaatctacgatggctggctgc

SEQ ID NO: 488729 - DNA, 25 bp, Homo sapien
ataaatctacgatggctggctgcaa

SEQ ID NO: 488730 - DNA, 25 bp, Homo sapien
taaatctacgatggctggctgcaat

SEQ ID NO: 488731 - DNA, 25 bp, Homo sapien
aatctacgatggctggctgcaatat

SEQ ID NO: 488732 - DNA, 25 bp, Homo sapien
atctacgatggctggctgcaatatg

SEQ ID NO: 488733 - DNA, 25 bp, Homo sapien
tctacgatggctggctgcaatatgc

SEQ ID NO: 488734 - DNA, 25 bp, Homo sapien
tacgatggctggctgcaatatgcct

SEQ ID NO: 488735 - DNA, 25 bp, Homo sapien
cgatggctggctgcaatatgcctca

SEQ ID NO: 488736 - DNA, 25 bp, Homo sapien
gatggctggctgcaatatgcctcac

SEQ ID NO: 488737 - DNA, 25 bp, Homo sapien
atggctggctgcaatatgcctcact

SEQ ID NO: 488738 - DNA, 25 bp, Homo sapien
ggctggctgcaatatgcctcactgt

SEQ ID NO: 488739 - DNA, 25 bp, Homo sapien
gccgggatgggctcctcaccatgct

SEQ ID NO: 488740 - DNA, 25 bp, Homo sapien
gcccaccacctgtgtatgcagctga

SEQ ID NO: 488741 - DNA, 25 bp, Homo sapien
accacctgtgtatgcagctgacagc

SEQ ID NO: 488742 - DNA, 25 bp, Homo sapien
gtatgcagctgacagcaacagcccc

SEQ ID NO: 488743 - DNA, 25 bp, Homo sapien
tgccgaaggccctgaggtgcatcca

SEQ ID NO: 488744 - DNA, 25 bp, Homo sapien
gaaggccctgaggtgcatccaaacc

SEQ ID NO: 488745 - DNA, 25 bp, Homo sapien
tgcatccaaaccctctgctgtggat

SEQ ID NO: 488746 - DNA, 25 bp, Homo sapien
atccaaaccctctgctgtggatgcc

SEQ ID NO: 488747 - DNA, 25 bp, Homo sapien
gtatcccctcggctggtgaacgcag

SEQ ID NO: 488748 - DNA, 25 bp, Homo sapien
ggtgaacgcagtggccacaagaacc

SEQ ID NO: 488749 - DNA, 25 bp, Homo sapien
gcagtggccacaagaacctggctct

SEQ ID NO: 488750 - DNA, 25 bp, Homo sapien
aaaaatatatgaaatgggccagccg

SEQ ID NO: 488751 - DNA, 25 bp, Homo sapien
aaaatatatgaaatgggccagccgc

SEQ ID NO: 488752 - DNA, 25 bp, Homo sapien
aaatatatgaaatgggccagccgcg

SEQ ID NO: 488753 - DNA, 25 bp, Homo sapien
aatatatgaaatgggccagccgcgg

SEQ ID NO: 488754 - DNA, 25 bp, Homo sapien
atatatgaaatgggccagccgcggt

SEQ ID NO: 488755 - DNA, 25 bp, Homo sapien
tatatgaaatgggccagccgcggtg

SEQ ID NO: 488756 - DNA, 25 bp, Homo sapien
tatgaaatgggccagccgcggtggc

SEQ ID NO: 488757 - DNA, 25 bp, Homo sapien
atgaaatgggccagccgcggtggct

SEQ ID NO: 488758 - DNA, 25 bp, Homo sapien
tgaaatgggccagccgcggtggctt

SEQ ID NO: 488759 - DNA, 25 bp, Homo sapien
aatgggccagccgcggtggcttaca

SEQ ID NO: 488760 - DNA, 25 bp, Homo sapien
gactaacatggtaataaaactccgt

SEQ ID NO: 488761 - DNA, 25 bp, Homo sapien
gcttttgacttttggcagcctcttc

SEQ ID NO: 488762 - DNA, 25 bp, Homo sapien
cttttgacttttggcagcctcttca

SEQ ID NO: 488763 - DNA, 25 bp, Homo sapien
tggcagcctcttcaggcgcagaact

SEQ ID NO: 488764 - DNA, 25 bp, Homo sapien
tcttcaggcgcagaacttgatctcc

SEQ ID NO: 488765 - DNA, 25 bp, Homo sapien
cttcaggcgcagaacttgatctcca

SEQ ID NO: 488766 - DNA, 25 bp, Homo sapien
ttcaggcgcagaacttgatctccag

SEQ ID NO: 488767 - DNA, 25 bp, Homo sapien
cggcctttgcaggcccggcctcctg

SEQ ID NO: 488768 - DNA, 25 bp, Homo sapien
ggcctttgcaggcccggcctcctgc

SEQ ID NO: 488769 - DNA, 25 bp, Homo sapien
ttgaaaagccttggagaactcggtt

SEQ ID NO: 488770 - DNA, 25 bp, Homo sapien
gaactcggtttggtagacttggaca

SEQ ID NO: 488771 - DNA, 25 bp, Homo sapien
tggtagacttggacatctctctggc

SEQ ID NO: 488772 - DNA, 25 bp, Homo sapien
cttggacatctctctggcttctgaa

SEQ ID NO: 488773 - DNA, 25 bp, Homo sapien
attcctgtccctttgttaccatact

SEQ ID NO: 488774 - DNA, 25 bp, Homo sapien
tgttaccatactgtctctggagtga

SEQ ID NO: 488775 - DNA, 25 bp, Homo sapien
tctggagtgatggtgtccttccctg

SEQ ID NO: 488776 - DNA, 25 bp, Homo sapien
acgcatgctcagtgccttttggttt

SEQ ID NO: 488777 - DNA, 25 bp, Homo sapien
ttggtttcaccttccctcgacttga

SEQ ID NO: 488778 - DNA, 25 bp, Homo sapien
cactccctcttggtttttatcaaat

SEQ ID NO: 488779 - DNA, 25 bp, Homo sapien
tttatcaaatttgccatgacatttc

SEQ ID NO: 488780 - DNA, 25 bp, Homo sapien
tgacgagttaattggtgcaacacaa

SEQ ID NO: 488781 - DNA, 25 bp, Homo sapien
gacgagttaattggtgcaacacaac

SEQ ID NO: 488782 - DNA, 25 bp, Homo sapien
acgagttaattggtgcaacacaaca

SEQ ID NO: 488783 - DNA, 25 bp, Homo sapien
cgagttaattggtgcaacacaacaa

SEQ ID NO: 488784 - DNA, 25 bp, Homo sapien
gagttaattggtgcaacacaacaac

SEQ ID NO: 488785 - DNA, 25 bp, Homo sapien
gttaattggtgcaacacaacaacat

SEQ ID NO: 488786 - DNA, 25 bp, Homo sapien
ttaattggtgcaacacaacaacatg

SEQ ID NO: 488787 - DNA, 25 bp, Homo sapien
taattggtgcaacacaacaacatgg

SEQ ID NO: 488788 - DNA, 25 bp, Homo sapien
aattggtgcaacacaacaacatggc

SEQ ID NO: 488789 - DNA, 25 bp, Homo sapien
attggtgcaacacaacaacatggca

SEQ ID NO: 488790 - DNA, 25 bp, Homo sapien
ttggtgcaacacaacaacatggcac

SEQ ID NO: 488791 - DNA, 25 bp, Homo sapien
attttcctctcgtttgctttcaggg

SEQ ID NO: 488792 - DNA, 25 bp, Homo sapien
agggcctcccttgacttcagcaaaa

SEQ ID NO: 488793 - DNA, 25 bp, Homo sapien
tgcagtatactgtgggcgtgttttt

SEQ ID NO: 488794 - DNA, 25 bp, Homo sapien
tttgtttttctcttcgtactgccgc

SEQ ID NO: 488795 - DNA, 25 bp, Homo sapien
gattcagccagctgttcttcaagct

SEQ ID NO: 488796 - DNA, 25 bp, Homo sapien
aagctccagcaacatatcttttagg

SEQ ID NO: 488797 - DNA, 25 bp, Homo sapien
caacctggtacatgaagtttgtctt

SEQ ID NO: 488798 - DNA, 25 bp, Homo sapien
gtcttttcattgtctagctgagcat

SEQ ID NO: 488799 - DNA, 25 bp, Homo sapien
gctgagcattggaaaccatagcctt

SEQ ID NO: 488800 - DNA, 25 bp, Homo sapien
ccatagccttcttatatttctcttc

SEQ ID NO: 488801 - DNA, 25 bp, Homo sapien
gattattccatggtttcctcgagca

SEQ ID NO: 488802 - DNA, 25 bp, Homo sapien
tgtttgctaggcactcttgctgagg

SEQ ID NO: 488803 - DNA, 25 bp, Homo sapien
ctaggcactcttgctgaggttggga

SEQ ID NO: 488804 - DNA, 25 bp, Homo sapien
cgcccagacagacaccgaactggaa

SEQ ID NO: 488805 - DNA, 25 bp, Homo sapien
gacaccgaactggaaatacacccct

SEQ ID NO: 488806 - DNA, 25 bp, Homo sapien
taacctctaccccagatacacctga

SEQ ID NO: 488807 - DNA, 25 bp, Homo sapien
atacacctgacaagctgatcccctg

SEQ ID NO: 488808 - DNA, 25 bp, Homo sapien
gcaggtggctccaaggtcagagcct

SEQ ID NO: 488809 - DNA, 25 bp, Homo sapien
gctccaaggtcagagcctgcagaac

SEQ ID NO: 488810 - DNA, 25 bp, Homo sapien
ctgcagaacacagacgcaatagaga

SEQ ID NO: 488811 - DNA, 25 bp, Homo sapien
gcaatagagaaagactcagcgctgt

SEQ ID NO: 488812 - DNA, 25 bp, Homo sapien
gactcagcgctgtggaaagacaccc

SEQ ID NO: 488813 - DNA, 25 bp, Homo sapien
aaaagggcatgtatctcattcagat

SEQ ID NO: 488814 - DNA, 25 bp, Homo sapien
ctcattcagatgtgccttttgtttt

SEQ ID NO: 488815 - DNA, 25 bp, Homo sapien
ttttgtttttgcagactatgacgtc

SEQ ID NO: 488816 - DNA, 25 bp, Homo sapien
ctatgacgtctttagctaatgaatt

SEQ ID NO: 488817 - DNA, 25 bp, Homo sapien
tgaattgcctattgttatggaaaac

SEQ ID NO: 488818 - DNA, 25 bp, Homo sapien
gttaatatgccatgtatgtacagtt

SEQ ID NO: 488819 - DNA, 25 bp, Homo sapien
gaggcctataatacaatctgctact

SEQ ID NO: 488820 - DNA, 25 bp, Homo sapien
caatctgctactttactaattcata

SEQ ID NO: 488821 - DNA, 25 bp, Homo sapien
gcataggaaccaactgccttgcctt

SEQ ID NO: 488822 - DNA, 25 bp, Homo sapien
tgccttgccttcaagacctagtaac

SEQ ID NO: 488823 - DNA, 25 bp, Homo sapien
gacctagtaactttctctataaatc

SEQ ID NO: 488824 - DNA, 25 bp, Homo sapien
tctgtttcaataagacactgtgtcc

SEQ ID NO: 488825 - DNA, 25 bp, Homo sapien
gttggttctgattaagactcactga

SEQ ID NO: 488826 - DNA, 25 bp, Homo sapien
actgagatccagtgctcttgagctg

SEQ ID NO: 488827 - DNA, 25 bp, Homo sapien
tcttgagctgggtctcagtcccctc

SEQ ID NO: 488828 - DNA, 25 bp, Homo sapien
tgccgccactgttttcattgttgtg

SEQ ID NO: 488829 - DNA, 25 bp, Homo sapien
cattgttgtgttctcgttgtgattg

SEQ ID NO: 488830 - DNA, 25 bp, Homo sapien
gattgttaagactcacactcctggc

SEQ ID NO: 488831 - DNA, 25 bp, Homo sapien
ctggctcagcagtggttttccagaa

SEQ ID NO: 488832 - DNA, 25 bp, Homo sapien
ggttttccagaaggcccaaagagcg

SEQ ID NO: 488833 - DNA, 25 bp, Homo sapien
acgtcgcagtgtccgttccgggctt

SEQ ID NO: 488834 - DNA, 25 bp, Homo sapien
ggtgggcagacctggtcgcatctca

SEQ ID NO: 488835 - DNA, 25 bp, Homo sapien
tgtctgctctgagcgacctgcatgc

SEQ ID NO: 488836 - DNA, 25 bp, Homo sapien
gcatgcccacaagctgcgtgtggat

SEQ ID NO: 488837 - DNA, 25 bp, Homo sapien
acaagctgcgtgtggatcccgtcaa

SEQ ID NO: 488838 - DNA, 25 bp, Homo sapien
agctgcgtgtggatcccgtcaactt

SEQ ID NO: 488839 - DNA, 25 bp, Homo sapien
gtgtggatcccgtcaacttcaagct

SEQ ID NO: 488840 - DNA, 25 bp, Homo sapien
tgctggtgaccttggctagccacca

SEQ ID NO: 488841 - DNA, 25 bp, Homo sapien
aaattccttgcctctgtgagcaccg

SEQ ID NO: 488842 - DNA, 25 bp, Homo sapien
attccttgcctctgtgagcaccgtg

SEQ ID NO: 488843 - DNA, 25 bp, Homo sapien
tccaagtaccgttaagctgccttct

SEQ ID NO: 488844 - DNA, 25 bp, Homo sapien
gtaccgttaagctgccttctgcggg

SEQ ID NO: 488845 - DNA, 25 bp, Homo sapien
tgcacctgtacctcttggtctttga

SEQ ID NO: 488846 - DNA, 25 bp, Homo sapien
gaagcaaaaagtgaaagtccccatt

SEQ ID NO: 488847 - DNA, 25 bp, Homo sapien
aggtgatttttgtggccaatctggt

SEQ ID NO: 488848 - DNA, 25 bp, Homo sapien
ttgtggccaatctggtttcattccc

SEQ ID NO: 488849 - DNA, 25 bp, Homo sapien
atctggtttcattccctcccagaca

SEQ ID NO: 488850 - DNA, 25 bp, Homo sapien
tcccagacacttttctaggcatcta

SEQ ID NO: 488851 - DNA, 25 bp, Homo sapien
gacacttttctaggcatctatgcgc

SEQ ID NO: 488852 - DNA, 25 bp, Homo sapien
atctatgcgcctctattcacatata

SEQ ID NO: 488853 - DNA, 25 bp, Homo sapien
gcgcctctattcacatataaacaaa

SEQ ID NO: 488854 - DNA, 25 bp, Homo sapien
tttcctgtgcttcccttaaatggca

SEQ ID NO: 488855 - DNA, 25 bp, Homo sapien
gtgcttcccttaaatggcatatgta

SEQ ID NO: 488856 - DNA, 25 bp, Homo sapien
ggcatatgtatctttcactcttttt

SEQ ID NO: 488857 - DNA, 25 bp, Homo sapien
aacttaattaagctctaggtcagat

SEQ ID NO: 488858 - DNA, 25 bp, Homo sapien
taagctctaggtcagataacaatgg

SEQ ID NO: 488859 - DNA, 25 bp, Homo sapien
tctaggtcagataacaatggagtaa

SEQ ID NO: 488860 - DNA, 25 bp, Homo sapien
tggagtaaagtgatacctgcatttt

SEQ ID NO: 488861 - DNA, 25 bp, Homo sapien
gagtaaagtgatacctgcatttttt

SEQ ID NO: 488862 - DNA, 25 bp, Homo sapien
gtgtaatcttaatttactattgtat

SEQ ID NO: 488863 - DNA, 25 bp, Homo sapien
gggaacactaagattaaattgacta

SEQ ID NO: 488864 - DNA, 25 bp, Homo sapien
gactaggttcaaatatgcttcctta

SEQ ID NO: 488865 - DNA, 25 bp, Homo sapien
ggttcaaatatgcttccttatgaga

SEQ ID NO: 488866 - DNA, 25 bp, Homo sapien
aatatgcttccttatgagattcaaa

SEQ ID NO: 488867 - DNA, 25 bp, Homo sapien
tgcttccttatgagattcaaaattt

SEQ ID NO: 488868 - DNA, 25 bp, Homo sapien
gagccctacctacccagtggttgta

SEQ ID NO: 488869 - DNA, 25 bp, Homo sapien
ggttgtatttttgtagccagtgtgg

SEQ ID NO: 488870 - DNA, 25 bp, Homo sapien
tattcattcttcagctaactccagc

SEQ ID NO: 488871 - DNA, 25 bp, Homo sapien
ggacacaggagattggcagaccaac

SEQ ID NO: 488872 - DNA, 25 bp, Homo sapien
ccatgtttgttcagtttgttgacat

SEQ ID NO: 488873 - DNA, 25 bp, Homo sapien
atgtggcatgttcatttgttcacaa

SEQ ID NO: 488874 - DNA, 25 bp, Homo sapien
catttgttcacaacttaatcacggg

SEQ ID NO: 488875 - DNA, 25 bp, Homo sapien
actccagcaatgagctgaaactcat

SEQ ID NO: 488876 - DNA, 25 bp, Homo sapien
tgaaactcattcatcacccttgctg

SEQ ID NO: 488877 - DNA, 25 bp, Homo sapien
attcatcacccttgctgagttttct

SEQ ID NO: 488878 - DNA, 25 bp, Homo sapien
agttttcttctcaatccttattcct

SEQ ID NO: 488879 - DNA, 25 bp, Homo sapien
gaaaatgcctatgatctggaagcca

SEQ ID NO: 488880 - DNA, 25 bp, Homo sapien
aatgcctatgatctggaagccaacc

SEQ ID NO: 488881 - DNA, 25 bp, Homo sapien
tggaagccaacctggctgtcctgaa

SEQ ID NO: 488882 - DNA, 25 bp, Homo sapien
aagccaacctggctgtcctgaagct

SEQ ID NO: 488883 - DNA, 25 bp, Homo sapien
gctgtcctgaagctgtaccagttca

SEQ ID NO: 488884 - DNA, 25 bp, Homo sapien
tgtcctgaagctgtaccagttcaac

SEQ ID NO: 488885 - DNA, 25 bp, Homo sapien
gtaccagttcaacccagccttcttt

SEQ ID NO: 488886 - DNA, 25 bp, Homo sapien
accaacttgccgcacacagacttca

SEQ ID NO: 488887 - DNA, 25 bp, Homo sapien
gaagaacggccaatccgacagattt

SEQ ID NO: 488888 - DNA, 25 bp, Homo sapien
aacggccaatccgacagattttgta

SEQ ID NO: 488889 - DNA, 25 bp, Homo sapien
aatccgacagattttgtacctcggg

SEQ ID NO: 488890 - DNA, 25 bp, Homo sapien
gcagtgacccaaggttgcaaaaatg

SEQ ID NO: 488891 - DNA, 25 bp, Homo sapien
ccaaggttgcaaaaatgcactccag

SEQ ID NO: 488892 - DNA, 25 bp, Homo sapien
aaacctactctataggcagagcagc

SEQ ID NO: 488893 - DNA, 25 bp, Homo sapien
cagagcagcggcatgggctgctcaa

SEQ ID NO: 488894 - DNA, 25 bp, Homo sapien
gggctgctcaactgaatatacttat

SEQ ID NO: 488895 - DNA, 25 bp, Homo sapien
gaatatacttatagttatttcctga

SEQ ID NO: 488896 - DNA, 25 bp, Homo sapien
attattcatgagtttccgggtaagg

SEQ ID NO: 488897 - DNA, 25 bp, Homo sapien
gcagttcccggaaccgagaattcct

SEQ ID NO: 488898 - DNA, 25 bp, Homo sapien
gagaattcctcctccttttagacaa

SEQ ID NO: 488899 - DNA, 25 bp, Homo sapien
aattcctcctccttttagacaatat

SEQ ID NO: 488900 - DNA, 25 bp, Homo sapien
tcctccttttagacaatatagggca

SEQ ID NO: 488901 - DNA, 25 bp, Homo sapien
taggtcctacctaaatgtccagcag

SEQ ID NO: 488902 - DNA, 25 bp, Homo sapien
gtccagcaggacattagacagtcgt

SEQ ID NO: 488903 - DNA, 25 bp, Homo sapien
ataattcttcgttgtgtggcactaa

SEQ ID NO: 488904 - DNA, 25 bp, Homo sapien
tggcactaacccacacactgcagga

SEQ ID NO: 488905 - DNA, 25 bp, Homo sapien
gctgggagtagtccccagttattat

SEQ ID NO: 488906 - DNA, 25 bp, Homo sapien
ttatgaaaccaccaataacccactg

SEQ ID NO: 488907 - DNA, 25 bp, Homo sapien
gaaccactgattttttccactgacc

SEQ ID NO: 488908 - DNA, 25 bp, Homo sapien
gacctactgaatatctagcatcctt

SEQ ID NO: 488909 - DNA, 25 bp, Homo sapien
gcatccttagattggctcaactgtt

SEQ ID NO: 488910 - DNA, 25 bp, Homo sapien
ggctcaactgttactttcctaagga

SEQ ID NO: 488911 - DNA, 25 bp, Homo sapien
ggagtccttctacagaataggtcag

SEQ ID NO: 488912 - DNA, 25 bp, Homo sapien
gtgaaaatgcccaaattcagcatgc

SEQ ID NO: 488913 - DNA, 25 bp, Homo sapien
tgaaaatgcccaaattcagcatgcc

SEQ ID NO: 488914 - DNA, 25 bp, Homo sapien
gaaaatgcccaaattcagcatgcca

SEQ ID NO: 488915 - DNA, 25 bp, Homo sapien
aaaatgcccaaattcagcatgccag

SEQ ID NO: 488916 - DNA, 25 bp, Homo sapien
aaatgcccaaattcagcatgccagg

SEQ ID NO: 488917 - DNA, 25 bp, Homo sapien
aatgcccaaattcagcatgccagga

SEQ ID NO: 488918 - DNA, 25 bp, Homo sapien
atgcccaaattcagcatgccaggat

SEQ ID NO: 488919 - DNA, 25 bp, Homo sapien
tgcccaaattcagcatgccaggatt

SEQ ID NO: 488920 - DNA, 25 bp, Homo sapien
tggtctatttggaggctgctctcca

SEQ ID NO: 488921 - DNA, 25 bp, Homo sapien
acgttctcacttttccctgcaggaa

SEQ ID NO: 488922 - DNA, 25 bp, Homo sapien
aaagtgttagatcagttatctccac

SEQ ID NO: 488923 - DNA, 25 bp, Homo sapien
actccaacagggttcaaggtctggt

SEQ ID NO: 488924 - DNA, 25 bp, Homo sapien
aaggtctggttgcaaacatcttctc

SEQ ID NO: 488925 - DNA, 25 bp, Homo sapien
tggttgcaaacatcttctctctagc

SEQ ID NO: 488926 - DNA, 25 bp, Homo sapien
agcccaggctatagctaagacttaa

SEQ ID NO: 488927 - DNA, 25 bp, Homo sapien
agacttaagggcaaggtggccatat

SEQ ID NO: 488928 - DNA, 25 bp, Homo sapien
ggtggccatattctagttgctacaa

SEQ ID NO: 488929 - DNA, 25 bp, Homo sapien
gcaagagaatctatttgtgcagaac

SEQ ID NO: 488930 - DNA, 25 bp, Homo sapien
acagaacatactcataaggcacaaa

SEQ ID NO: 488931 - DNA, 25 bp, Homo sapien
tgagctcccagattcgtcagaatta

SEQ ID NO: 488932 - DNA, 25 bp, Homo sapien
gagctcccagattcgtcagaattat

SEQ ID NO: 488933 - DNA, 25 bp, Homo sapien
gctcccagattcgtcagaattattc

SEQ ID NO: 488934 - DNA, 25 bp, Homo sapien
cccagattcgtcagaattattccac

SEQ ID NO: 488935 - DNA, 25 bp, Homo sapien
tcgtcagaattattccaccgacgtg

SEQ ID NO: 488936 - DNA, 25 bp, Homo sapien
gtcagaattattccaccgacgtgga

SEQ ID NO: 488937 - DNA, 25 bp, Homo sapien
agaattattccaccgacgtggaggc

SEQ ID NO: 488938 - DNA, 25 bp, Homo sapien
attattccaccgacgtggaggcagc

SEQ ID NO: 488939 - DNA, 25 bp, Homo sapien
tattccaccgacgtggaggcagccg

SEQ ID NO: 488940 - DNA, 25 bp, Homo sapien
cgacgtggaggcagccgtcaacagc

SEQ ID NO: 488941 - DNA, 25 bp, Homo sapien
gacgtggaggcagccgtcaacagcc

SEQ ID NO: 488942 - DNA, 25 bp, Homo sapien
taaagttatgtaaatatgtagctat

SEQ ID NO: 488943 - DNA, 25 bp, Homo sapien
gttgtgaacataactattgtgaata

SEQ ID NO: 488944 - DNA, 25 bp, Homo sapien
tgtgaacataactattgtgaatact

SEQ ID NO: 488945 - DNA, 25 bp, Homo sapien
gtgaacataactattgtgaatacta

SEQ ID NO: 488946 - DNA, 25 bp, Homo sapien
gaacataactattgtgaatactatg

SEQ ID NO: 488947 - DNA, 25 bp, Homo sapien
actattgtgaatactatgttatatg

SEQ ID NO: 488948 - DNA, 25 bp, Homo sapien
ttgtgaatactatgttatatgttat

SEQ ID NO: 488949 - DNA, 25 bp, Homo sapien
gttatatgttatagttgtgaatgta

SEQ ID NO: 488950 - DNA, 25 bp, Homo sapien
atgtaaatagtattcacaattgtga

SEQ ID NO: 488951 - DNA, 25 bp, Homo sapien
aatgtaaatagctttcacaattgtg

SEQ ID NO: 488952 - DNA, 25 bp, Homo sapien
atgtaaatagctttcacaattgtga

SEQ ID NO: 488953 - DNA, 25 bp, Homo sapien
aagatatgtttaagaccaagactat

SEQ ID NO: 488954 - DNA, 25 bp, Homo sapien
aaagttgttggagacgccaatagca

SEQ ID NO: 488955 - DNA, 25 bp, Homo sapien
gagacgccaatagcaatatctagga

SEQ ID NO: 488956 - DNA, 25 bp, Homo sapien
ggaaatttgcattgagaccattgta

SEQ ID NO: 488957 - DNA, 25 bp, Homo sapien
gaccattgtattttccactagcagt

SEQ ID NO: 488958 - DNA, 25 bp, Homo sapien
ccattgtattttccactagcagtga

SEQ ID NO: 488959 - DNA, 25 bp, Homo sapien
tccactagcagtgaaaatgattttt

SEQ ID NO: 488960 - DNA, 25 bp, Homo sapien
atgatttttcacaactaacttgtaa

SEQ ID NO: 488961 - DNA, 25 bp, Homo sapien
atttttatttggacatcaaccacag

SEQ ID NO: 488962 - DNA, 25 bp, Homo sapien
ggacatcaaccacagacaatttaaa

SEQ ID NO: 488963 - DNA, 25 bp, Homo sapien
ctgcagcagcaggttacatagcaaa

SEQ ID NO: 488964 - DNA, 25 bp, Homo sapien
tcgatggcaaccagctcgtccagcg

SEQ ID NO: 488965 - DNA, 25 bp, Homo sapien
tgctcaaggagcagactgcgtaccc

SEQ ID NO: 488966 - DNA, 25 bp, Homo sapien
cccgacacactacatccggagggtg

SEQ ID NO: 488967 - DNA, 25 bp, Homo sapien
acatccggagggtgccccagaggaa

SEQ ID NO: 488968 - DNA, 25 bp, Homo sapien
gggtgccccagaggaagatccacta

SEQ ID NO: 488969 - DNA, 25 bp, Homo sapien
gaagatccactacttcacgggcctg

SEQ ID NO: 488970 - DNA, 25 bp, Homo sapien
tgctgtgtgccttcggcatgagctc

SEQ ID NO: 488971 - DNA, 25 bp, Homo sapien
atgaagatgatctttcccctcatca

SEQ ID NO: 488972 - DNA, 25 bp, Homo sapien
tttcccctcatcatgatcgccatga

SEQ ID NO: 488973 - DNA, 25 bp, Homo sapien
gctatatcctgctgccccgaatcat

SEQ ID NO: 488974 - DNA, 25 bp, Homo sapien
tgccccgaatcattgaagccaagta

SEQ ID NO: 488975 - DNA, 25 bp, Homo sapien
gaagaaattccagcagtcctgtagc

SEQ ID NO: 488976 - DNA, 25 bp, Homo sapien
gaaattccagcagtcctgtagcttc

SEQ ID NO: 488977 - DNA, 25 bp, Homo sapien
aattccagcagtcctgtagcttcca

SEQ ID NO: 488978 - DNA, 25 bp, Homo sapien
cagcagtcctgtagcttccacagga

SEQ ID NO: 488979 - DNA, 25 bp, Homo sapien
tgtagcttccacaggactagaaata

SEQ ID NO: 488980 - DNA, 25 bp, Homo sapien
gcttccacaggactagaaatatttc

SEQ ID NO: 488981 - DNA, 25 bp, Homo sapien
gtgatgggtgtatggatgttattta

SEQ ID NO: 488982 - DNA, 25 bp, Homo sapien
cataacttagattcacatcccactt

SEQ ID NO: 488983 - DNA, 25 bp, Homo sapien
tttgagaatatctcctatagaaaca

SEQ ID NO: 488984 - DNA, 25 bp, Homo sapien
atgccaactagcctaccgcgtggat

SEQ ID NO: 488985 - DNA, 25 bp, Homo sapien
ctagcctaccgcgtggatcacggag

SEQ ID NO: 488986 - DNA, 25 bp, Homo sapien
gaaggcatctgccatcaccaccatt

SEQ ID NO: 488987 - DNA, 25 bp, Homo sapien
gaagtggaccttcattccattgctg

SEQ ID NO: 488988 - DNA, 25 bp, Homo sapien
tccacgacaaagcacttctcaacat

SEQ ID NO: 488989 - DNA, 25 bp, Homo sapien
aaagggagcacacacacccatccat

SEQ ID NO: 488990 - DNA, 25 bp, Homo sapien
ccatgcacagagatggaccaccact

SEQ ID NO: 488991 - DNA, 25 bp, Homo sapien
gaccaccactgttggagaatgccca

SEQ ID NO: 488992 - DNA, 25 bp, Homo sapien
atgcccattcttcctgagttcctct

SEQ ID NO: 488993 - DNA, 25 bp, Homo sapien
gagttcctctgtactgggatgtata

SEQ ID NO: 488994 - DNA, 25 bp, Homo sapien
gatgtatattttcctagccccaaat

SEQ ID NO: 488995 - DNA, 25 bp, Homo sapien
ctagccccaaatccattgctggcaa

SEQ ID NO: 488996 - DNA, 25 bp, Homo sapien
tgctggcaatggatgcactgaatgt

SEQ ID NO: 488997 - DNA, 25 bp, Homo sapien
aaagaatcacttccacttctatttg

SEQ ID NO: 488998 - DNA, 25 bp, Homo sapien
aagaatcacttccacttctatttga

SEQ ID NO: 488999 - DNA, 25 bp, Homo sapien
gaatcacttccacttctatttgaat

SEQ ID NO: 489000 - DNA, 25 bp, Homo sapien
atcacttccacttctatttgaatca

SEQ ID NO: 489001 - DNA, 25 bp, Homo sapien
ctttgaactgaaactctaaactata

SEQ ID NO: 489002 - DNA, 25 bp, Homo sapien
gaactgaaactctaaactatatgaa

SEQ ID NO: 489003 - DNA, 25 bp, Homo sapien
cagaaacaactgctgaatgtgataa

SEQ ID NO: 489004 - DNA, 25 bp, Homo sapien
tcccattttctctatctcattgtgt

SEQ ID NO: 489005 - DNA, 25 bp, Homo sapien
cccattttctctatctcattgtgtg

SEQ ID NO: 489006 - DNA, 25 bp, Homo sapien
ccattttctctatctcattgtgtgt

SEQ ID NO: 489007 - DNA, 25 bp, Homo sapien
ctcattgtgtgtgaaatcattctta

SEQ ID NO: 489008 - DNA, 25 bp, Homo sapien
aacagtatgcacgtacaaatttctt

SEQ ID NO: 489009 - DNA, 25 bp, Homo sapien
gtatgcacgtacaaatttcttaacc

SEQ ID NO: 489010 - DNA, 25 bp, Homo sapien
gcacgtacaaatttcttaacctgtt

SEQ ID NO: 489011 - DNA, 25 bp, Homo sapien
tcttaacctgttatcaatgtctgag

SEQ ID NO: 489012 - DNA, 25 bp, Homo sapien
acctgttatcaatgtctgagctaca

SEQ ID NO: 489013 - DNA, 25 bp, Homo sapien
gtctgagctacataattatctttct

SEQ ID NO: 489014 - DNA, 25 bp, Homo sapien
cataattatctttctagttggagtt

SEQ ID NO: 489015 - DNA, 25 bp, Homo sapien
tatctttctagttggagtttgtttt

SEQ ID NO: 489016 - DNA, 25 bp, Homo sapien
ttgttttaggtgtgtaccaactgac

SEQ ID NO: 489017 - DNA, 25 bp, Homo sapien
aggtgtgtaccaactgacatttcag

SEQ ID NO: 489018 - DNA, 25 bp, Homo sapien
gtgtgtaccaactgacatttcagtt

SEQ ID NO: 489019 - DNA, 25 bp, Homo sapien
atgagctcctatcatctctgcagga

SEQ ID NO: 489020 - DNA, 25 bp, Homo sapien
cctatcatctctgcaggaatgtgct

SEQ ID NO: 489021 - DNA, 25 bp, Homo sapien
gctcatgaacagaattcattcattc

SEQ ID NO: 489022 - DNA, 25 bp, Homo sapien
aacagtttgtgagtctctcctttgt

SEQ ID NO: 489023 - DNA, 25 bp, Homo sapien
ttgtgagtctctcctttgttccaca

SEQ ID NO: 489024 - DNA, 25 bp, Homo sapien
ctttgttccacagccgtgctagata

SEQ ID NO: 489025 - DNA, 25 bp, Homo sapien
acagccgtgctagatactcttttac

SEQ ID NO: 489026 - DNA, 25 bp, Homo sapien
gatactcttttacttagagtcgatt

SEQ ID NO: 489027 - DNA, 25 bp, Homo sapien
gagtcgattaactcctccaaagttt

SEQ ID NO: 489028 - DNA, 25 bp, Homo sapien
tgttatactctgtaaactgcttttt

SEQ ID NO: 489029 - DNA, 25 bp, Homo sapien
ctgctttttctagttttccaatcca

SEQ ID NO: 489030 - DNA, 25 bp, Homo sapien
gagttttttgattcaaatccattag

SEQ ID NO: 489031 - DNA, 25 bp, Homo sapien
aatccattagtttgaacttttcgag

SEQ ID NO: 489032 - DNA, 25 bp, Homo sapien
gaacttttcgagcttattatccatt

SEQ ID NO: 489033 - DNA, 25 bp, Homo sapien
cgagcttattatccatttccttaaa

SEQ ID NO: 489034 - DNA, 25 bp, Homo sapien
catttccttaaatcccatagcttat

SEQ ID NO: 489035 - DNA, 25 bp, Homo sapien
ttaaatcccatagcttatcagagtt

SEQ ID NO: 489036 - DNA, 25 bp, Homo sapien
tcagagttaacatcagagggaggta

SEQ ID NO: 489037 - DNA, 25 bp, Homo sapien
tatttctgtgatattctttgtataa

SEQ ID NO: 489038 - DNA, 25 bp, Homo sapien
gaaatggattagtaacctgtgaaca

SEQ ID NO: 489039 - DNA, 25 bp, Homo sapien
gtaacctgtgaacaatacatatttt

SEQ ID NO: 489040 - DNA, 25 bp, Homo sapien
gtgagcaaagtggttttcagtgttt

SEQ ID NO: 489041 - DNA, 25 bp, Homo sapien
gcaagggccactgtttgtggaagat

SEQ ID NO: 489042 - DNA, 25 bp, Homo sapien
tggtgctgtgtaaacccaaactttt

SEQ ID NO: 489043 - DNA, 25 bp, Homo sapien
ccttaaaatctctgactctggaaaa

SEQ ID NO: 489044 - DNA, 25 bp, Homo sapien
gaaaatgcatcaagcagcacagaat

SEQ ID NO: 489045 - DNA, 25 bp, Homo sapien
gcagcacagaatacaattcgccaac

SEQ ID NO: 489046 - DNA, 25 bp, Homo sapien
ggatcaacggcaaataacccactga

SEQ ID NO: 489047 - DNA, 25 bp, Homo sapien
aacccactgaatgataactgagcac

SEQ ID NO: 489048 - DNA, 25 bp, Homo sapien
aactgagcactttagggaacaacct

SEQ ID NO: 489049 - DNA, 25 bp, Homo sapien
gcactttagggaacaacctgcctta

SEQ ID NO: 489050 - DNA, 25 bp, Homo sapien
acaacctgccttatctactatttaa

SEQ ID NO: 489051 - DNA, 25 bp, Homo sapien
aatatgcttctgtgtgctgaaagta

SEQ ID NO: 489052 - DNA, 25 bp, Homo sapien
tccaaggtgtacgaggacccagctc

SEQ ID NO: 489053 - DNA, 25 bp, Homo sapien
catcttcctgcacaacaactacaat

SEQ ID NO: 489054 - DNA, 25 bp, Homo sapien
tacaattacatcctcaagtccctgg

SEQ ID NO: 489055 - DNA, 25 bp, Homo sapien
agaagtctgaactgatccagctggt

SEQ ID NO: 489056 - DNA, 25 bp, Homo sapien
acagaagactgctgagcgctcctac

SEQ ID NO: 489057 - DNA, 25 bp, Homo sapien
tcctaccgggagcacattgagcagc

SEQ ID NO: 489058 - DNA, 25 bp, Homo sapien
ccagcgcagctggttaaaggtgact

SEQ ID NO: 489059 - DNA, 25 bp, Homo sapien
aaggtgactgattacatcgcagaga

SEQ ID NO: 489060 - DNA, 25 bp, Homo sapien
cagagaagaatctacctgtgttcca

SEQ ID NO: 489061 - DNA, 25 bp, Homo sapien
acctgtgttccagccgggagtcaag

SEQ ID NO: 489062 - DNA, 25 bp, Homo sapien
caaggagcgttttaagggcttcaat

SEQ ID NO: 489063 - DNA, 25 bp, Homo sapien
ctacaggcctgtttacagattatta

SEQ ID NO: 489064 - DNA, 25 bp, Homo sapien
gcctgtttacagattattacggtga

SEQ ID NO: 489065 - DNA, 25 bp, Homo sapien
tacagattattacggtgaactgaat

SEQ ID NO: 489066 - DNA, 25 bp, Homo sapien
tgtaccaattttaagagcattcccc

SEQ ID NO: 489067 - DNA, 25 bp, Homo sapien
tccccacacacccaaacaaaatgtg

SEQ ID NO: 489068 - DNA, 25 bp, Homo sapien
tgtggtggtgttgccttcaaaaaag

SEQ ID NO: 489069 - DNA, 25 bp, Homo sapien
gtggtgttgccttcaaaaaagagaa

SEQ ID NO: 489070 - DNA, 25 bp, Homo sapien
aataactgtcaactattctatttgc

SEQ ID NO: 489071 - DNA, 25 bp, Homo sapien
atttgcatttaggagactgttcatc

SEQ ID NO: 489072 - DNA, 25 bp, Homo sapien
aggagactgttcatctatgctagat

SEQ ID NO: 489073 - DNA, 25 bp, Homo sapien
atctatgctagattgtcattttccc

SEQ ID NO: 489074 - DNA, 25 bp, Homo sapien
atttgcatgataagcctagaaggat

SEQ ID NO: 489075 - DNA, 25 bp, Homo sapien
tgagcaaatgctggacaattagagt

SEQ ID NO: 489076 - DNA, 25 bp, Homo sapien
ggacaattagagtctgagatttcag

SEQ ID NO: 489077 - DNA, 25 bp, Homo sapien
gatttcagagttttagcagttcaca

SEQ ID NO: 489078 - DNA, 25 bp, Homo sapien
gcagttcacagtaatgttagttcaa

SEQ ID NO: 489079 - DNA, 25 bp, Homo sapien
gttttttgaaatgcatcacgggtaa

SEQ ID NO: 489080 - DNA, 25 bp, Homo sapien
gaattggaatactccagctcctttt

SEQ ID NO: 489081 - DNA, 25 bp, Homo sapien
agctccttttttggaacatagattg

SEQ ID NO: 489082 - DNA, 25 bp, Homo sapien
taccttagatggttttatttctgtg

SEQ ID NO: 489083 - DNA, 25 bp, Homo sapien
ggctatgactacagcaattttagtg

SEQ ID NO: 489084 - DNA, 25 bp, Homo sapien
gtgagagccttgaaatgtcatttta

SEQ ID NO: 489085 - DNA, 25 bp, Homo sapien
gtagagacaggttcacatatgcagc

SEQ ID NO: 489086 - DNA, 25 bp, Homo sapien
aggttcacatatgcagctgtctgac

SEQ ID NO: 489087 - DNA, 25 bp, Homo sapien
atatgcagctgtctgactcgactct

SEQ ID NO: 489088 - DNA, 25 bp, Homo sapien
agctgtctgactcgactctagtgat

SEQ ID NO: 489089 - DNA, 25 bp, Homo sapien
tgtctgactcgactctagtgatcac

SEQ ID NO: 489090 - DNA, 25 bp, Homo sapien
tgactcgactctagtgatcaccact

SEQ ID NO: 489091 - DNA, 25 bp, Homo sapien
actctagtgatcaccactgctcaaa

SEQ ID NO: 489092 - DNA, 25 bp, Homo sapien
gattacagctagagcaccacgcgat

SEQ ID NO: 489093 - DNA, 25 bp, Homo sapien
gctagagcaccacgcgatctttttt

SEQ ID NO: 489094 - DNA, 25 bp, Homo sapien
cagagtctgctctgttgtcgaggtc

SEQ ID NO: 489095 - DNA, 25 bp, Homo sapien
tctgctctgttgtcgaggtcggagt

SEQ ID NO: 489096 - DNA, 25 bp, Homo sapien
gggtttccacactcaggaggtcaga

SEQ ID NO: 489097 - DNA, 25 bp, Homo sapien
tccacactcaggaggtcagaggact

SEQ ID NO: 489098 - DNA, 25 bp, Homo sapien
aggactggctcctgtgaccagggcc

SEQ ID NO: 489099 - DNA, 25 bp, Homo sapien
ggcccctctcccctgaatgggaaag

SEQ ID NO: 489100 - DNA, 25 bp, Homo sapien
agatgatgctgggtgtggcccatct

SEQ ID NO: 489101 - DNA, 25 bp, Homo sapien
gtggcccatcttctgtgggcccctt

SEQ ID NO: 489102 - DNA, 25 bp, Homo sapien
cagacaccggatccatgggcactaa

SEQ ID NO: 489103 - DNA, 25 bp, Homo sapien
gacaccggatccatgggcactaacc

SEQ ID NO: 489104 - DNA, 25 bp, Homo sapien
ggctgatgcccggaggcagcttcct

SEQ ID NO: 489105 - DNA, 25 bp, Homo sapien
agctgcagtagaggcggcacgggct

SEQ ID NO: 489106 - DNA, 25 bp, Homo sapien
ggtggcagagagaaggctcctcctc

SEQ ID NO: 489107 - DNA, 25 bp, Homo sapien
gaatggtggactcatctttggttaa

SEQ ID NO: 489108 - DNA, 25 bp, Homo sapien
aatggtggactcatctttggttaaa

SEQ ID NO: 489109 - DNA, 25 bp, Homo sapien
ggttttgcatcctggattgaatatc

SEQ ID NO: 489110 - DNA, 25 bp, Homo sapien
gtgtagaccactgcttcccagagta

SEQ ID NO: 489111 - DNA, 25 bp, Homo sapien
agaccactgcttcccagagtatgat

SEQ ID NO: 489112 - DNA, 25 bp, Homo sapien
accactgcttcccagagtatgatat

SEQ ID NO: 489113 - DNA, 25 bp, Homo sapien
ttgtttctgctgattacacccgtgc

SEQ ID NO: 489114 - DNA, 25 bp, Homo sapien
ctgctgattacacccgtgcccagga

SEQ ID NO: 489115 - DNA, 25 bp, Homo sapien
ggagcttgacgccttagataacagc

SEQ ID NO: 489116 - DNA, 25 bp, Homo sapien
agcttgacgccttagataacagcca

SEQ ID NO: 489117 - DNA, 25 bp, Homo sapien
gataacagccatcctattgaagtca

SEQ ID NO: 489118 - DNA, 25 bp, Homo sapien
gtcaaagactaatatgtctcaggta

SEQ ID NO: 489119 - DNA, 25 bp, Homo sapien
gtctcaggtacatttagctacagta

SEQ ID NO: 489120 - DNA, 25 bp, Homo sapien
gagaatctcaactgctttacctttt

SEQ ID NO: 489121 - DNA, 25 bp, Homo sapien
accaatagtcttcaaggttgcagag

SEQ ID NO: 489122 - DNA, 25 bp, Homo sapien
tttgtattttctctccacttctcta

SEQ ID NO: 489123 - DNA, 25 bp, Homo sapien
aagaagacagagtgctcccattccc

SEQ ID NO: 489124 - DNA, 25 bp, Homo sapien
acttcttcagcctattgggtcacaa

SEQ ID NO: 489125 - DNA, 25 bp, Homo sapien
ttctgtctgccactttcctgatgta

SEQ ID NO: 489126 - DNA, 25 bp, Homo sapien
ctgccactttcctgatgtactgaat

SEQ ID NO: 489127 - DNA, 25 bp, Homo sapien
cctgatgtactgaatggcccttggt

SEQ ID NO: 489128 - DNA, 25 bp, Homo sapien
aatggcccttggtatatctttataa

SEQ ID NO: 489129 - DNA, 25 bp, Homo sapien
aatctatttttcttggtctcatact

SEQ ID NO: 489130 - DNA, 25 bp, Homo sapien
tatttttcttggtctcatactcagt

SEQ ID NO: 489131 - DNA, 25 bp, Homo sapien
ttcttggtctcatactcagtttttt

SEQ ID NO: 489132 - DNA, 25 bp, Homo sapien
tttgcttgttttctccacactaatt

SEQ ID NO: 489133 - DNA, 25 bp, Homo sapien
tgttttctccacactaattttaggg

SEQ ID NO: 489134 - DNA, 25 bp, Homo sapien
ttctccacactaattttagggtgaa

SEQ ID NO: 489135 - DNA, 25 bp, Homo sapien
ttagggtgaattcctcatttcgctt

SEQ ID NO: 489136 - DNA, 25 bp, Homo sapien
ggtgaattcctcatttcgcttttca

SEQ ID NO: 489137 - DNA, 25 bp, Homo sapien
gaattcctcatttcgcttttcagat

SEQ ID NO: 489138 - DNA, 25 bp, Homo sapien
ttcctcatttcgcttttcagatcat

SEQ ID NO: 489139 - DNA, 25 bp, Homo sapien
ctcatttcgcttttcagatcatggg

SEQ ID NO: 489140 - DNA, 25 bp, Homo sapien
cagagtagtctagataagttttcaa

SEQ ID NO: 489141 - DNA, 25 bp, Homo sapien
ggaatgttcattagtaactcatctt

SEQ ID NO: 489142 - DNA, 25 bp, Homo sapien
aaacgaggcttattgctattgcaga

SEQ ID NO: 489143 - DNA, 25 bp, Homo sapien
agaaatcccaaactggcaaaggcca

SEQ ID NO: 489144 - DNA, 25 bp, Homo sapien
caaaggccagtatatatggtattcc

SEQ ID NO: 489145 - DNA, 25 bp, Homo sapien
ggtattccataatataaccagcttt

SEQ ID NO: 489146 - DNA, 25 bp, Homo sapien
tatgtgtttggattagtgccttctg

SEQ ID NO: 489147 - DNA, 25 bp, Homo sapien
gattagtgccttctggttaccagta

SEQ ID NO: 489148 - DNA, 25 bp, Homo sapien
ggttaccagtattgactctgctagt

SEQ ID NO: 489149 - DNA, 25 bp, Homo sapien
attgactctgctagtttgcaccttt

SEQ ID NO: 489150 - DNA, 25 bp, Homo sapien
ttgcacctttccgttcttaacagaa

SEQ ID NO: 489151 - DNA, 25 bp, Homo sapien
aagggcaactcccaagagccactgc

SEQ ID NO: 489152 - DNA, 25 bp, Homo sapien
tttgagtgtcttcccttctagactt

SEQ ID NO: 489153 - DNA, 25 bp, Homo sapien
tgagtgtcttcccttctagactttc

SEQ ID NO: 489154 - DNA, 25 bp, Homo sapien
tgtcttcccttctagactttcccat

SEQ ID NO: 489155 - DNA, 25 bp, Homo sapien
tagactttcccatctcctggtgaga

SEQ ID NO: 489156 - DNA, 25 bp, Homo sapien
gactttcccatctcctggtgagatg

SEQ ID NO: 489157 - DNA, 25 bp, Homo sapien
tttcccatctcctggtgagatgttt

SEQ ID NO: 489158 - DNA, 25 bp, Homo sapien
ggtgagatgtttcccacttatgccg

SEQ ID NO: 489159 - DNA, 25 bp, Homo sapien
tgagatgtttcccacttatgccgtg

SEQ ID NO: 489160 - DNA, 25 bp, Homo sapien
gatgtttcccacttatgccgtggtc

SEQ ID NO: 489161 - DNA, 25 bp, Homo sapien
gtttcccacttatgccgtggtcctg

SEQ ID NO: 489162 - DNA, 25 bp, Homo sapien
atatctgatgagagactaataacca

SEQ ID NO: 489163 - DNA, 25 bp, Homo sapien
gatgagagactaataaccagaatat

SEQ ID NO: 489164 - DNA, 25 bp, Homo sapien
gagagactaataaccagaatatgta

SEQ ID NO: 489165 - DNA, 25 bp, Homo sapien
taaccagaatatgtaagaacctcaa

SEQ ID NO: 489166 - DNA, 25 bp, Homo sapien
atgtaagaacctcaaacaactctat

SEQ ID NO: 489167 - DNA, 25 bp, Homo sapien
ggactaaagattttaatagacattt

SEQ ID NO: 489168 - DNA, 25 bp, Homo sapien
gacatacaaatggaaaacagctata

SEQ ID NO: 489169 - DNA, 25 bp, Homo sapien
aaacagctatatgaaaagatactca

SEQ ID NO: 489170 - DNA, 25 bp, Homo sapien
atggcttgtatccaaaagacagacg

SEQ ID NO: 489171 - DNA, 25 bp, Homo sapien
gacagacgataacaaatgctggcaa

SEQ ID NO: 489172 - DNA, 25 bp, Homo sapien
agacgataacaaatgctggcaagga

SEQ ID NO: 489173 - DNA, 25 bp, Homo sapien
gtctcggctccctttcatggacaga

SEQ ID NO: 489174 - DNA, 25 bp, Homo sapien
agactggccttcttagctgtactat

SEQ ID NO: 489175 - DNA, 25 bp, Homo sapien
agctgtactataaatttgtgagtga

SEQ ID NO: 489176 - DNA, 25 bp, Homo sapien
ttgtgagtgaagttagagcccagct

SEQ ID NO: 489177 - DNA, 25 bp, Homo sapien
agctcacttagccagctcactttga

SEQ ID NO: 489178 - DNA, 25 bp, Homo sapien
acacccaactgttcttttatcgtct

SEQ ID NO: 489179 - DNA, 25 bp, Homo sapien
caactgttcttttatcgtctcggtt

SEQ ID NO: 489180 - DNA, 25 bp, Homo sapien
ttatcgtctcggttttagccaaaag

SEQ ID NO: 489181 - DNA, 25 bp, Homo sapien
tcgtctcggttttagccaaaagtga

SEQ ID NO: 489182 - DNA, 25 bp, Homo sapien
tagggccccgtttccatccagaaat

SEQ ID NO: 489183 - DNA, 25 bp, Homo sapien
gccccgtttccatccagaaataaag

SEQ ID NO: 489184 - DNA, 25 bp, Homo sapien
gctgcttgaggctgttggcgaccat

SEQ ID NO: 489185 - DNA, 25 bp, Homo sapien
ctctcgtctggagaatccacgtgga

SEQ ID NO: 489186 - DNA, 25 bp, Homo sapien
gaaggtcctctcgatgactgtggtc

SEQ ID NO: 489187 - DNA, 25 bp, Homo sapien
gtggtccactgcaggcagcgtatga

SEQ ID NO: 489188 - DNA, 25 bp, Homo sapien
caaaggtgttgggtcgcggcctctc

SEQ ID NO: 489189 - DNA, 25 bp, Homo sapien
ctctcggtcttcatcagctggcatt

SEQ ID NO: 489190 - DNA, 25 bp, Homo sapien
tcagctggcattctgctacggagaa

SEQ ID NO: 489191 - DNA, 25 bp, Homo sapien
tgtacccaatgaaggagccgtcgct

SEQ ID NO: 489192 - DNA, 25 bp, Homo sapien
agccgtcgctcttcagcaggaagta

SEQ ID NO: 489193 - DNA, 25 bp, Homo sapien
gcaggaagtaccgtggcctccaggt

SEQ ID NO: 489194 - DNA, 25 bp, Homo sapien
gtcttgatgtattcaccacgcttgt

SEQ ID NO: 489195 - DNA, 25 bp, Homo sapien
agcagtctcctttgccgtcgacgcg

SEQ ID NO: 489196 - DNA, 25 bp, Homo sapien
ggcttttaggggtaggcagttatat

SEQ ID NO: 489197 - DNA, 25 bp, Homo sapien
gcttttaggggtaggcagttatatc

SEQ ID NO: 489198 - DNA, 25 bp, Homo sapien
cttttaggggtaggcagttatatca

SEQ ID NO: 489199 - DNA, 25 bp, Homo sapien
tttaggggtaggcagttatatcaag

SEQ ID NO: 489200 - DNA, 25 bp, Homo sapien
ttaggggtaggcagttatatcaagt

SEQ ID NO: 489201 - DNA, 25 bp, Homo sapien
taggggtaggcagttatatcaagtg

SEQ ID NO: 489202 - DNA, 25 bp, Homo sapien
caagtgcaacagcagacacagcaac

SEQ ID NO: 489203 - DNA, 25 bp, Homo sapien
agcaacagcctcagcagtctccttt

SEQ ID NO: 489204 - DNA, 25 bp, Homo sapien
gcaacagcctcagcagtctcctttg

SEQ ID NO: 489205 - DNA, 25 bp, Homo sapien
caacagcctcagcagtctcctttgc

SEQ ID NO: 489206 - DNA, 25 bp, Homo sapien
gcttctttaggccaagctcatgctt

SEQ ID NO: 489207 - DNA, 25 bp, Homo sapien
aagctcatgcttcacaagggccttt

SEQ ID NO: 489208 - DNA, 25 bp, Homo sapien
catgcttcacaagggcctttccagg

SEQ ID NO: 489209 - DNA, 25 bp, Homo sapien
ctttccaggcccaacttttgtctca

SEQ ID NO: 489210 - DNA, 25 bp, Homo sapien
aacttttgtctcatggcaaccttcc

SEQ ID NO: 489211 - DNA, 25 bp, Homo sapien
ctagacaggcccaggtcttgcctca

SEQ ID NO: 489212 - DNA, 25 bp, Homo sapien
actggcctctctacatccagcttat

SEQ ID NO: 489213 - DNA, 25 bp, Homo sapien
ctacatccagcttatgcctcacggt

SEQ ID NO: 489214 - DNA, 25 bp, Homo sapien
caggacgtcatctccgggcccaaaa

SEQ ID NO: 489215 - DNA, 25 bp, Homo sapien
cgggcccaaaacttactcaagtcag

SEQ ID NO: 489216 - DNA, 25 bp, Homo sapien
aagtcagactctctagtcccaactg

SEQ ID NO: 489217 - DNA, 25 bp, Homo sapien
cgcgtcgacggcaaaggagactgct

SEQ ID NO: 489218 - DNA, 25 bp, Homo sapien
cgtcgacggcaaaggagactgctga

SEQ ID NO: 489219 - DNA, 25 bp, Homo sapien
aaaggagactgctgaggctgttgct

SEQ ID NO: 489220 - DNA, 25 bp, Homo sapien
agactgctgaggctgttgctgatga

SEQ ID NO: 489221 - DNA, 25 bp, Homo sapien
aggctgggccacttgttgctgtgtc

SEQ ID NO: 489222 - DNA, 25 bp, Homo sapien
gctgggccacttgttgctgtgtctg

SEQ ID NO: 489223 - DNA, 25 bp, Homo sapien
tgggccacttgttgctgtgtctgct

SEQ ID NO: 489224 - DNA, 25 bp, Homo sapien
gggccacttgttgctgtgtctgctg

SEQ ID NO: 489225 - DNA, 25 bp, Homo sapien
ggccacttgttgctgtgtctgctgt

SEQ ID NO: 489226 - DNA, 25 bp, Homo sapien
gccacttgttgctgtgtctgctgtt

SEQ ID NO: 489227 - DNA, 25 bp, Homo sapien
ttgttgctgtgtctgctgttgcact

SEQ ID NO: 489228 - DNA, 25 bp, Homo sapien
atcttccgcagataaatgtagaaat

SEQ ID NO: 489229 - DNA, 25 bp, Homo sapien
ttgtagcttctgaaggtgcagaaaa

SEQ ID NO: 489230 - DNA, 25 bp, Homo sapien
aaaatgcttttattcctgggctaat

SEQ ID NO: 489231 - DNA, 25 bp, Homo sapien
atgcttttattcctgggctaatcct

SEQ ID NO: 489232 - DNA, 25 bp, Homo sapien
ttattcctgggctaatcctgtccct

SEQ ID NO: 489233 - DNA, 25 bp, Homo sapien
gggctaatcctgtccctccctaagt

SEQ ID NO: 489234 - DNA, 25 bp, Homo sapien
cagcgaggtgtctgtcccagggctg

SEQ ID NO: 489235 - DNA, 25 bp, Homo sapien
gagatgcttcccaaggaggagtctg

SEQ ID NO: 489236 - DNA, 25 bp, Homo sapien
cccaaggaggagtctgttttgttga

SEQ ID NO: 489237 - DNA, 25 bp, Homo sapien
tttgttgagagtgggcgtgggcttc

SEQ ID NO: 489238 - DNA, 25 bp, Homo sapien
aaacggctttcattaccaaataatg

SEQ ID NO: 489239 - DNA, 25 bp, Homo sapien
tagcatgatcattgtgattaatata

SEQ ID NO: 489240 - DNA, 25 bp, Homo sapien
tgggaatatgaattagtacagctat

SEQ ID NO: 489241 - DNA, 25 bp, Homo sapien
agtacagctattatggaagttcctc

SEQ ID NO: 489242 - DNA, 25 bp, Homo sapien
cagctattatggaagttcctcaaaa

SEQ ID NO: 489243 - DNA, 25 bp, Homo sapien
gtcaaagagatacctgtactccagt

SEQ ID NO: 489244 - DNA, 25 bp, Homo sapien
ctccagtgtttattgctgcactatt

SEQ ID NO: 489245 - DNA, 25 bp, Homo sapien
gtgtttattgctgcactattcataa

SEQ ID NO: 489246 - DNA, 25 bp, Homo sapien
gccagaatatggaatcaccctaagt

SEQ ID NO: 489247 - DNA, 25 bp, Homo sapien
ggaatcaccctaagtgtccactaat

SEQ ID NO: 489248 - DNA, 25 bp, Homo sapien
atcaccctaagtgtccactaataga

SEQ ID NO: 489249 - DNA, 25 bp, Homo sapien
ctaagtgtccactaatagatgaatg

SEQ ID NO: 489250 - DNA, 25 bp, Homo sapien
ctggttgcgcgtagttgctaacagc

SEQ ID NO: 489251 - DNA, 25 bp, Homo sapien
tggttgcgcgtagttgctaacagca

SEQ ID NO: 489252 - DNA, 25 bp, Homo sapien
ggttgcgcgtagttgctaacagcaa

SEQ ID NO: 489253 - DNA, 25 bp, Homo sapien
gttgcgcgtagttgctaacagcaaa

SEQ ID NO: 489254 - DNA, 25 bp, Homo sapien
ttgcgcgtagttgctaacagcaaag

SEQ ID NO: 489255 - DNA, 25 bp, Homo sapien
tgcgcgtagttgctaacagcaaaga

SEQ ID NO: 489256 - DNA, 25 bp, Homo sapien
gcgcgtagttgctaacagcaaagag

SEQ ID NO: 489257 - DNA, 25 bp, Homo sapien
acagcaaagagagttacgaattacg

SEQ ID NO: 489258 - DNA, 25 bp, Homo sapien
cagcaaagagagttacgaattacgt

SEQ ID NO: 489259 - DNA, 25 bp, Homo sapien
agcaaagagagttacgaattacgtt

SEQ ID NO: 489260 - DNA, 25 bp, Homo sapien
gcaaagagagttacgaattacgtta

SEQ ID NO: 489261 - DNA, 25 bp, Homo sapien
gaaaacacagtacaggttgagtcaa

SEQ ID NO: 489262 - DNA, 25 bp, Homo sapien
tgacaggaccagaactccccttgag

SEQ ID NO: 489263 - DNA, 25 bp, Homo sapien
cccttgagccatccaactgttggag

SEQ ID NO: 489264 - DNA, 25 bp, Homo sapien
tccaactgttggagtgacttagatg

SEQ ID NO: 489265 - DNA, 25 bp, Homo sapien
gtgacttagatggtgggaaccacac

SEQ ID NO: 489266 - DNA, 25 bp, Homo sapien
agtggcctcgtgtcctttagggcat

SEQ ID NO: 489267 - DNA, 25 bp, Homo sapien
tcctttagggcatagtgatgacaca

SEQ ID NO: 489268 - DNA, 25 bp, Homo sapien
tgacaaatgtatggtagaggtcccc

SEQ ID NO: 489269 - DNA, 25 bp, Homo sapien
gtagaggtcccccaagagttagaga

SEQ ID NO: 489270 - DNA, 25 bp, Homo sapien
agagttagagacaagcacagggcat

SEQ ID NO: 489271 - DNA, 25 bp, Homo sapien
caagcacagggcatagtttagagaa

SEQ ID NO: 489272 - DNA, 25 bp, Homo sapien
agctacgctctgctgcgccattcta

SEQ ID NO: 489273 - DNA, 25 bp, Homo sapien
cttctactgataaccctcctaaaag

SEQ ID NO: 489274 - DNA, 25 bp, Homo sapien
tgataaccctcctaaaagccaactg

SEQ ID NO: 489275 - DNA, 25 bp, Homo sapien
cctcctaaaagccaactgggattga

SEQ ID NO: 489276 - DNA, 25 bp, Homo sapien
tgggattgaattactcctctgccaa

SEQ ID NO: 489277 - DNA, 25 bp, Homo sapien
ttgaattactcctctgccaagaacc

SEQ ID NO: 489278 - DNA, 25 bp, Homo sapien
ttatccaaggcccaccataaaatga

SEQ ID NO: 489279 - DNA, 25 bp, Homo sapien
ataaaatgatgccagcccacctcac

SEQ ID NO: 489280 - DNA, 25 bp, Homo sapien
tcacccaaaacctcttccagaaagt

SEQ ID NO: 489281 - DNA, 25 bp, Homo sapien
caaaacctcttccagaaagtcccag

SEQ ID NO: 489282 - DNA, 25 bp, Homo sapien
acctgtatgtggtctgatggctctc

SEQ ID NO: 489283 - DNA, 25 bp, Homo sapien
cgtgtcttcacagaggagcgggccc

SEQ ID NO: 489284 - DNA, 25 bp, Homo sapien
cttcacagaggagcgggcccggttt

SEQ ID NO: 489285 - DNA, 25 bp, Homo sapien
ggcccggttttatggtgcagagatt

SEQ ID NO: 489286 - DNA, 25 bp, Homo sapien
atggtgcagagattgtctcggctct

SEQ ID NO: 489287 - DNA, 25 bp, Homo sapien
agattgtctcggctcttgagtactt

SEQ ID NO: 489288 - DNA, 25 bp, Homo sapien
tcttgagtacttgcactcgcgggac

SEQ ID NO: 489289 - DNA, 25 bp, Homo sapien
ttgcactcgcgggacgtggtatacc

SEQ ID NO: 489290 - DNA, 25 bp, Homo sapien
gggacgtggtataccgcgacatcaa

SEQ ID NO: 489291 - DNA, 25 bp, Homo sapien
ataccgcgacatcaagctggaaaac

SEQ ID NO: 489292 - DNA, 25 bp, Homo sapien
caccatgaaaaccttctgtgggacc

SEQ ID NO: 489293 - DNA, 25 bp, Homo sapien
aggacaatgactatggccgggccgt

SEQ ID NO: 489294 - DNA, 25 bp, Homo sapien
gatagtgtccttaaattttagtgtc

SEQ ID NO: 489295 - DNA, 25 bp, Homo sapien
ttttagtgtcatttggtcaacttac

SEQ ID NO: 489296 - DNA, 25 bp, Homo sapien
gtgtcatttggtcaacttactggta

SEQ ID NO: 489297 - DNA, 25 bp, Homo sapien
catttggtcaacttactggtaacac

SEQ ID NO: 489298 - DNA, 25 bp, Homo sapien
ttggtcaacttactggtaacaccag

SEQ ID NO: 489299 - DNA, 25 bp, Homo sapien
ctggtaacaccagaacaagaaagca

SEQ ID NO: 489300 - DNA, 25 bp, Homo sapien
taataaattctgctggcacagaact

SEQ ID NO: 489301 - DNA, 25 bp, Homo sapien
tgctggcacagaactaacatatcat

SEQ ID NO: 489302 - DNA, 25 bp, Homo sapien
gaactaacatatcatttggtaactg

SEQ ID NO: 489303 - DNA, 25 bp, Homo sapien
ttggtaactgtaaaacctatttgca

SEQ ID NO: 489304 - DNA, 25 bp, Homo sapien
cctatttgcagttaaaggttgattt

SEQ ID NO: 489305 - DNA, 25 bp, Homo sapien
ctgggacttgctttgaaaagtaaca

SEQ ID NO: 489306 - DNA, 25 bp, Homo sapien
tgaaaagtaacaaagcccattcctt

SEQ ID NO: 489307 - DNA, 25 bp, Homo sapien
gcccattcctttgatagctgttagt

SEQ ID NO: 489308 - DNA, 25 bp, Homo sapien
agctgttagtgacatagttgtagaa

SEQ ID NO: 489309 - DNA, 25 bp, Homo sapien
gcagttttcctttatccatgcagat

SEQ ID NO: 489310 - DNA, 25 bp, Homo sapien
atccatgcagatctctgactttctc

SEQ ID NO: 489311 - DNA, 25 bp, Homo sapien
tctccttcaaaaagactggtcctca

SEQ ID NO: 489312 - DNA, 25 bp, Homo sapien
gactggtcctcatttgaagtttttc

SEQ ID NO: 489313 - DNA, 25 bp, Homo sapien
ccaaggctgagatgtagtcgtctca

SEQ ID NO: 489314 - DNA, 25 bp, Homo sapien
agatgtagtcgtctcatgatttgag

SEQ ID NO: 489315 - DNA, 25 bp, Homo sapien
taaacagactaaactatgcagattt

SEQ ID NO: 489316 - DNA, 25 bp, Homo sapien
gattatgacatatcactttgcccag

SEQ ID NO: 489317 - DNA, 25 bp, Homo sapien
tatcactttgcccagcatctatgtg

SEQ ID NO: 489318 - DNA, 25 bp, Homo sapien
gcatctatgtgctttgacagccttc

SEQ ID NO: 489319 - DNA, 25 bp, Homo sapien
gacagccttctctttaatggacctg

SEQ ID NO: 489320 - DNA, 25 bp, Homo sapien
tctttaatggacctgcccactaggg

SEQ ID NO: 489321 - DNA, 25 bp, Homo sapien
tgcccactagggtgatttgtgtcat

SEQ ID NO: 489322 - DNA, 25 bp, Homo sapien
tcatggagcagagcccaccttctag

SEQ ID NO: 489323 - DNA, 25 bp, Homo sapien
caccttctaggttatgggactttat

SEQ ID NO: 489324 - DNA, 25 bp, Homo sapien
atatctctgacattctcaccaaggt

SEQ ID NO: 489325 - DNA, 25 bp, Homo sapien
gacatattgctatacccagaaccta

SEQ ID NO: 489326 - DNA, 25 bp, Homo sapien
gactcttttttactgcttgggcttt

SEQ ID NO: 489327 - DNA, 25 bp, Homo sapien
gggattcaaagccgccgttccccag

SEQ ID NO: 489328 - DNA, 25 bp, Homo sapien
catggtaaccaggaagcccgtttca

SEQ ID NO: 489329 - DNA, 25 bp, Homo sapien
ggtaaccaggaagcccgtttcatgt

SEQ ID NO: 489330 - DNA, 25 bp, Homo sapien
caggaagcccgtttcatgttcagtt

SEQ ID NO: 489331 - DNA, 25 bp, Homo sapien
gaagcccgtttcatgttcagttgct

SEQ ID NO: 489332 - DNA, 25 bp, Homo sapien
cccgtttcatgttcagttgcttttg

SEQ ID NO: 489333 - DNA, 25 bp, Homo sapien
acagctgtcaatcacaagcccttaa

SEQ ID NO: 489334 - DNA, 25 bp, Homo sapien
gggactgtttcctgacatcctggac

SEQ ID NO: 489335 - DNA, 25 bp, Homo sapien
tcctggacaagggaagcccactaga

SEQ ID NO: 489336 - DNA, 25 bp, Homo sapien
ggaagcccactagaggctggaacag

SEQ ID NO: 489337 - DNA, 25 bp, Homo sapien
accgtgcccatctcaactggacttc

SEQ ID NO: 489338 - DNA, 25 bp, Homo sapien
gtacccagatagtccttgttttaat

SEQ ID NO: 489339 - DNA, 25 bp, Homo sapien
tgttttaatgatgggttctctcacc

SEQ ID NO: 489340 - DNA, 25 bp, Homo sapien
taatgatgggttctctcaccactgt

SEQ ID NO: 489341 - DNA, 25 bp, Homo sapien
tcaccactgtcttgatgctctgagc

SEQ ID NO: 489342 - DNA, 25 bp, Homo sapien
gatgctctgagcaagttacctcttc

SEQ ID NO: 489343 - DNA, 25 bp, Homo sapien
tgagcaagttacctcttccctctga

SEQ ID NO: 489344 - DNA, 25 bp, Homo sapien
atgggtacagagtgactagaatgat

SEQ ID NO: 489345 - DNA, 25 bp, Homo sapien
gtataactattctgatcactgacat

SEQ ID NO: 489346 - DNA, 25 bp, Homo sapien
tgatcactgacattaatattcctat

SEQ ID NO: 489347 - DNA, 25 bp, Homo sapien
ttcctattgttattattctttactc

SEQ ID NO: 489348 - DNA, 25 bp, Homo sapien
tattctttactcacgagggtataca

SEQ ID NO: 489349 - DNA, 25 bp, Homo sapien
gaaagacgagagccctgaaggcagc

SEQ ID NO: 489350 - DNA, 25 bp, Homo sapien
cgtccccagctggttcgggctgtga

SEQ ID NO: 489351 - DNA, 25 bp, Homo sapien
tccccagctggttcgggctgtgacg

SEQ ID NO: 489352 - DNA, 25 bp, Homo sapien
gcggcatccccagctggttcgggcc

SEQ ID NO: 489353 - DNA, 25 bp, Homo sapien
agctgtggcagagcagtcccgacac

SEQ ID NO: 489354 - DNA, 25 bp, Homo sapien
tgtggcagagcagtcccgacaccta

SEQ ID NO: 489355 - DNA, 25 bp, Homo sapien
tggcagagcagtcccgacacctaaa

SEQ ID NO: 489356 - DNA, 25 bp, Homo sapien
agagcagtcccgacacctaaataaa

SEQ ID NO: 489357 - DNA, 25 bp, Homo sapien
gcagtcccgacacctaaataaaagt

SEQ ID NO: 489358 - DNA, 25 bp, Homo sapien
cacctaaataaaagtcttgctgcag

SEQ ID NO: 489359 - DNA, 25 bp, Homo sapien
cctaaataaaagtcttgctgcagga

SEQ ID NO: 489360 - DNA, 25 bp, Homo sapien
ccgagccaggccaacttgtggataa

SEQ ID NO: 489361 - DNA, 25 bp, Homo sapien
gccaacttgtggataagcccagcca

SEQ ID NO: 489362 - DNA, 25 bp, Homo sapien
tggataagcccagccagagcacaga

SEQ ID NO: 489363 - DNA, 25 bp, Homo sapien
gccagagcacagaatcgagtttaaa

SEQ ID NO: 489364 - DNA, 25 bp, Homo sapien
atcgagtttaaatccagccttccac

SEQ ID NO: 489365 - DNA, 25 bp, Homo sapien
agcaccaacatacttcccagtagca

SEQ ID NO: 489366 - DNA, 25 bp, Homo sapien
gtagcaccaacatgaaaatcaggca

SEQ ID NO: 489367 - DNA, 25 bp, Homo sapien
ggcaaactgttgttgtttagtccca

SEQ ID NO: 489368 - DNA, 25 bp, Homo sapien
ttgttgtttagtcccagacacacct

SEQ ID NO: 489369 - DNA, 25 bp, Homo sapien
gacacacctggtagtgtttctcttc

SEQ ID NO: 489370 - DNA, 25 bp, Homo sapien
gtttctcttctctgtggatctcctt

SEQ ID NO: 489371 - DNA, 25 bp, Homo sapien
aaagcaccgagcagggtaaccacga

SEQ ID NO: 489372 - DNA, 25 bp, Homo sapien
gtaaccacgaccagcttaaagaact

SEQ ID NO: 489373 - DNA, 25 bp, Homo sapien
aactgtattcggctgggaacttgac

SEQ ID NO: 489374 - DNA, 25 bp, Homo sapien
gaacttgacggtgctggctactgac

SEQ ID NO: 489375 - DNA, 25 bp, Homo sapien
gtacagttagactttcacttccgcc

SEQ ID NO: 489376 - DNA, 25 bp, Homo sapien
attggcacggccttctctgtgaccg

SEQ ID NO: 489377 - DNA, 25 bp, Homo sapien
gtgaccgtcgactcttcctggatat

SEQ ID NO: 489378 - DNA, 25 bp, Homo sapien
ggatatcccatatcaggccttggat

SEQ ID NO: 489379 - DNA, 25 bp, Homo sapien
ggcaaccgggaaagtttgactgcaa

SEQ ID NO: 489380 - DNA, 25 bp, Homo sapien
gactgcaaccctggagtacgtggaa

SEQ ID NO: 489381 - DNA, 25 bp, Homo sapien
tccctagtaggcctccaggagggca

SEQ ID NO: 489382 - DNA, 25 bp, Homo sapien
tggaacgtgacaccaattcttggac

SEQ ID NO: 489383 - DNA, 25 bp, Homo sapien
acgtgacaccaattcttggactcag

SEQ ID NO: 489384 - DNA, 25 bp, Homo sapien
ggactcagcgagttgattctggaga

SEQ ID NO: 489385 - DNA, 25 bp, Homo sapien
ttctcttcaatgcagtgaacagaga

SEQ ID NO: 489386 - DNA, 25 bp, Homo sapien
tcttgatcttggtatctttggagcc

SEQ ID NO: 489387 - DNA, 25 bp, Homo sapien
gaaaggcaggataaaccttgctcaa

SEQ ID NO: 489388 - DNA, 25 bp, Homo sapien
accttgctcaattaagctatctttg

SEQ ID NO: 489389 - DNA, 25 bp, Homo sapien
taagctatctttgaggaaccagaaa

SEQ ID NO: 489390 - DNA, 25 bp, Homo sapien
aataaaccctaagcaggaaggatga

SEQ ID NO: 489391 - DNA, 25 bp, Homo sapien
aggatgaggatgtctattacttagt

SEQ ID NO: 489392 - DNA, 25 bp, Homo sapien
aattgagcagattggaacgtgacac

SEQ ID NO: 489393 - DNA, 25 bp, Homo sapien
tttatttcgaccttccaaacattct

SEQ ID NO: 489394 - DNA, 25 bp, Homo sapien
ttatttcgaccttccaaacattctg

SEQ ID NO: 489395 - DNA, 25 bp, Homo sapien
atttcgaccttccaaacattctggg

SEQ ID NO: 489396 - DNA, 25 bp, Homo sapien
tttcgaccttccaaacattctggga

SEQ ID NO: 489397 - DNA, 25 bp, Homo sapien
ttcgaccttccaaacattctgggag

SEQ ID NO: 489398 - DNA, 25 bp, Homo sapien
tcgaccttccaaacattctgggagt

SEQ ID NO: 489399 - DNA, 25 bp, Homo sapien
gaccttccaaacattctgggagttt

SEQ ID NO: 489400 - DNA, 25 bp, Homo sapien
ttccaaacattctgggagttttcct

SEQ ID NO: 489401 - DNA, 25 bp, Homo sapien
tccaaacattctgggagttttcctc

SEQ ID NO: 489402 - DNA, 25 bp, Homo sapien
caaacattctgggagttttcctcct

SEQ ID NO: 489403 - DNA, 25 bp, Homo sapien
ttgacgggcaactcggcgctggtgc

SEQ ID NO: 489404 - DNA, 25 bp, Homo sapien
attacgttacttccatgcattaacc

SEQ ID NO: 489405 - DNA, 25 bp, Homo sapien
acgttacttccatgcattaacccag

SEQ ID NO: 489406 - DNA, 25 bp, Homo sapien
gttacttccatgcattaacccagga

SEQ ID NO: 489407 - DNA, 25 bp, Homo sapien
acttccatgcattaacccaggacga

SEQ ID NO: 489408 - DNA, 25 bp, Homo sapien
cttccatgcattaacccaggacgaa

SEQ ID NO: 489409 - DNA, 25 bp, Homo sapien
catgcattaacccaggacgaagaag

SEQ ID NO: 489410 - DNA, 25 bp, Homo sapien
aggaggaagcacgaggattcaagat

SEQ ID NO: 489411 - DNA, 25 bp, Homo sapien
aggaagcacgaggattcaagattct

SEQ ID NO: 489412 - DNA, 25 bp, Homo sapien
gaagcacgaggattcaagattctca

SEQ ID NO: 489413 - DNA, 25 bp, Homo sapien
gcacgaggattcaagattctcattt

SEQ ID NO: 489414 - DNA, 25 bp, Homo sapien
cacgaggattcaagattctcattta

SEQ ID NO: 489415 - DNA, 25 bp, Homo sapien
cgccgacatggcgaaggcaaggtct

SEQ ID NO: 489416 - DNA, 25 bp, Homo sapien
acatggcgaaggcaaggtcttcccc

SEQ ID NO: 489417 - DNA, 25 bp, Homo sapien
gcgaaggcaaggtcttcccccagag

SEQ ID NO: 489418 - DNA, 25 bp, Homo sapien
acacctggaccaggcttgcaggctg

SEQ ID NO: 489419 - DNA, 25 bp, Homo sapien
tggaccaggcttgcaggctgccaga

SEQ ID NO: 489420 - DNA, 25 bp, Homo sapien
ggcttgcaggctgccagacgtcact

SEQ ID NO: 489421 - DNA, 25 bp, Homo sapien
tgctggtggcagctgactccatcac

SEQ ID NO: 489422 - DNA, 25 bp, Homo sapien
gtggcagctgactccatcaccaaca

SEQ ID NO: 489423 - DNA, 25 bp, Homo sapien
accaacaccatgtcatccctggtga

SEQ ID NO: 489424 - DNA, 25 bp, Homo sapien
aacaccatgtcatccctggtgaagg

SEQ ID NO: 489425 - DNA, 25 bp, Homo sapien
ggttagcagaggagccggacacaga

SEQ ID NO: 489426 - DNA, 25 bp, Homo sapien
ggttcaggaacccatggcagaaaca

SEQ ID NO: 489427 - DNA, 25 bp, Homo sapien
gaacccatggcagaaacactaaact

SEQ ID NO: 489428 - DNA, 25 bp, Homo sapien
ggcaaataatcacttcacctctggt

SEQ ID NO: 489429 - DNA, 25 bp, Homo sapien
caaataatcacttcacctctggtgc

SEQ ID NO: 489430 - DNA, 25 bp, Homo sapien
tggtgccttccatgcgtcgcataag

SEQ ID NO: 489431 - DNA, 25 bp, Homo sapien
atgcgtcgcataagcactcttgtca

SEQ ID NO: 489432 - DNA, 25 bp, Homo sapien
gcataagcactcttgtcaatcatgg

SEQ ID NO: 489433 - DNA, 25 bp, Homo sapien
gcactcttgtcaatcatggaattgg

SEQ ID NO: 489434 - DNA, 25 bp, Homo sapien
ttagattgtgtccttttaatattgt

SEQ ID NO: 489435 - DNA, 25 bp, Homo sapien
ttttgaggttttggccattttctct

SEQ ID NO: 489436 - DNA, 25 bp, Homo sapien
cattttctctttacacttcgtatgt

SEQ ID NO: 489437 - DNA, 25 bp, Homo sapien
atccatgagttcagccctccggcaa

SEQ ID NO: 489438 - DNA, 25 bp, Homo sapien
tgagttcagccctccggcaagcggg

SEQ ID NO: 489439 - DNA, 25 bp, Homo sapien
agccctccggcaagcgggagctgca

SEQ ID NO: 489440 - DNA, 25 bp, Homo sapien
ggcgcaccaaggaaagcctctgctt

SEQ ID NO: 489441 - DNA, 25 bp, Homo sapien
aaggaaagcctctgcttcagaccca

SEQ ID NO: 489442 - DNA, 25 bp, Homo sapien
gaaagcctctgcttcagacccaggc

SEQ ID NO: 489443 - DNA, 25 bp, Homo sapien
ggagggagcttcaaaagcagtcagc

SEQ ID NO: 489444 - DNA, 25 bp, Homo sapien
atccagccagattctttcaatagga

SEQ ID NO: 489445 - DNA, 25 bp, Homo sapien
agccagattctttcaataggacccc

SEQ ID NO: 489446 - DNA, 25 bp, Homo sapien
tgtcctggtcccacatgagcacagc

SEQ ID NO: 489447 - DNA, 25 bp, Homo sapien
tggtcccacatgagcacagcacctg

SEQ ID NO: 489448 - DNA, 25 bp, Homo sapien
ttcactttggtataagaattgctca

SEQ ID NO: 489449 - DNA, 25 bp, Homo sapien
gaattgctcattcaaaataccttag

SEQ ID NO: 489450 - DNA, 25 bp, Homo sapien
attgataattcagcacatggactta

SEQ ID NO: 489451 - DNA, 25 bp, Homo sapien
ggacttaattcacatcaaaactcaa

SEQ ID NO: 489452 - DNA, 25 bp, Homo sapien
actcaatttgtctttgttatggaac

SEQ ID NO: 489453 - DNA, 25 bp, Homo sapien
gaactttgagagattcctgcttaat

SEQ ID NO: 489454 - DNA, 25 bp, Homo sapien
ttcattaaagaagcccacacagtta

SEQ ID NO: 489455 - DNA, 25 bp, Homo sapien
cacacagttataccccacaaaaagc

SEQ ID NO: 489456 - DNA, 25 bp, Homo sapien
ataccccacaaaaagctaatgctat

SEQ ID NO: 489457 - DNA, 25 bp, Homo sapien
tactgtgaggtctataacttgtaag

SEQ ID NO: 489458 - DNA, 25 bp, Homo sapien
gtagtttaattcatccatatgttca

SEQ ID NO: 489459 - DNA, 25 bp, Homo sapien
gtttttcagctgacgtggaagccct

SEQ ID NO: 489460 - DNA, 25 bp, Homo sapien
ttgggttcaagtctgtatgtatgga

SEQ ID NO: 489461 - DNA, 25 bp, Homo sapien
agctttgctgctattgatttgtccc

SEQ ID NO: 489462 - DNA, 25 bp, Homo sapien
tgctgctattgatttgtccccgaca

SEQ ID NO: 489463 - DNA, 25 bp, Homo sapien
gatttgtccccgacagcaggcaaag

SEQ ID NO: 489464 - DNA, 25 bp, Homo sapien
gacagcaggcaaagcctcacattgc

SEQ ID NO: 489465 - DNA, 25 bp, Homo sapien
aaagcctcacattgccctcaatttt

SEQ ID NO: 489466 - DNA, 25 bp, Homo sapien
gaaggaccagtttttcatggtactt

SEQ ID NO: 489467 - DNA, 25 bp, Homo sapien
ttcatggtacttgtcttgatctttt

SEQ ID NO: 489468 - DNA, 25 bp, Homo sapien
tctttttcatagtgttcaaatctgt

SEQ ID NO: 489469 - DNA, 25 bp, Homo sapien
aaataattttctcaacactaatcgt

SEQ ID NO: 489470 - DNA, 25 bp, Homo sapien
ttgtcatccacacaacaccaggact

SEQ ID NO: 489471 - DNA, 25 bp, Homo sapien
tgtcatccacacaacaccaggactt

SEQ ID NO: 489472 - DNA, 25 bp, Homo sapien
gtcatccacacaacaccaggactta

SEQ ID NO: 489473 - DNA, 25 bp, Homo sapien
tcatccacacaacaccaggacttaa

SEQ ID NO: 489474 - DNA, 25 bp, Homo sapien
catccacacaacaccaggacttaag

SEQ ID NO: 489475 - DNA, 25 bp, Homo sapien
atccacacaacaccaggacttaaga

SEQ ID NO: 489476 - DNA, 25 bp, Homo sapien
tccacacaacaccaggacttaagac

SEQ ID NO: 489477 - DNA, 25 bp, Homo sapien
ccacacaacaccaggacttaagaca

SEQ ID NO: 489478 - DNA, 25 bp, Homo sapien
cacacaacaccaggacttaagacaa

SEQ ID NO: 489479 - DNA, 25 bp, Homo sapien
acacaacaccaggacttaagacaaa

SEQ ID NO: 489480 - DNA, 25 bp, Homo sapien
tttttctttctgtgtactgaagtta

SEQ ID NO: 489481 - DNA, 25 bp, Homo sapien
gtactgaagttagttcttatacatg

SEQ ID NO: 489482 - DNA, 25 bp, Homo sapien
acatggtcttatattttggctgtct

SEQ ID NO: 489483 - DNA, 25 bp, Homo sapien
attttggctgtctgtttttccctag

SEQ ID NO: 489484 - DNA, 25 bp, Homo sapien
ttggctgtctgtttttccctaggaa

SEQ ID NO: 489485 - DNA, 25 bp, Homo sapien
gctgtctgtttttccctaggaacat

SEQ ID NO: 489486 - DNA, 25 bp, Homo sapien
ttccctaggaacattcatacaggtt

SEQ ID NO: 489487 - DNA, 25 bp, Homo sapien
ttcatacaggttgaatattccttat

SEQ ID NO: 489488 - DNA, 25 bp, Homo sapien
cttgggactggaagtgttttcgatt

SEQ ID NO: 489489 - DNA, 25 bp, Homo sapien
gaagtgttttcgattttggattttg

SEQ ID NO: 489490 - DNA, 25 bp, Homo sapien
ggagatagtgtttttactcttgttg

SEQ ID NO: 489491 - DNA, 25 bp, Homo sapien
gattctgcctgccaacaaagtctga

SEQ ID NO: 489492 - DNA, 25 bp, Homo sapien
aacagcacagttagaacatgatgac

SEQ ID NO: 489493 - DNA, 25 bp, Homo sapien
aaatgcctgtatcccaagcaactag

SEQ ID NO: 489494 - DNA, 25 bp, Homo sapien
gaacacatagttggctatacttaat

SEQ ID NO: 489495 - DNA, 25 bp, Homo sapien
aggagtcaagacaaaccattcaatt

SEQ ID NO: 489496 - DNA, 25 bp, Homo sapien
gacaaaccattcaattcttctaaaa

SEQ ID NO: 489497 - DNA, 25 bp, Homo sapien
gtattcaaagcaccagagtcacaat

SEQ ID NO: 489498 - DNA, 25 bp, Homo sapien
gagtcacaatgttgagctcaggtgc

SEQ ID NO: 489499 - DNA, 25 bp, Homo sapien
gagctcaggtgcaattttctattca

SEQ ID NO: 489500 - DNA, 25 bp, Homo sapien
tctattcactttacttccagcatgg

SEQ ID NO: 489501 - DNA, 25 bp, Homo sapien
cttccagcatggtcgggttaagagt

SEQ ID NO: 489502 - DNA, 25 bp, Homo sapien
aatagtgcatagctcctttcagcct

SEQ ID NO: 489503 - DNA, 25 bp, Homo sapien
gggctccaaaagctatcccagttgc

SEQ ID NO: 489504 - DNA, 25 bp, Homo sapien
gctatcccagttgcctgtttttcaa

SEQ ID NO: 489505 - DNA, 25 bp, Homo sapien
aatgaggttcaaggtgctgctttgc

SEQ ID NO: 489506 - DNA, 25 bp, Homo sapien
aggtgctgctttgcatgcctgccaa

SEQ ID NO: 489507 - DNA, 25 bp, Homo sapien
gcctgccaacccatggaagttgttt

SEQ ID NO: 489508 - DNA, 25 bp, Homo sapien
tgtttcttacttcttttctctctta

SEQ ID NO: 489509 - DNA, 25 bp, Homo sapien
catggtctgagagttgtttttgttc

SEQ ID NO: 489510 - DNA, 25 bp, Homo sapien
gttctatgtaacagtattgccacaa

SEQ ID NO: 489511 - DNA, 25 bp, Homo sapien
aatcgtgtttgcagggagatttctg

SEQ ID NO: 489512 - DNA, 25 bp, Homo sapien
ctgatgcctctgtgggtgtgtgtaa

SEQ ID NO: 489513 - DNA, 25 bp, Homo sapien
acacaaagcacaatgattactcgaa

SEQ ID NO: 489514 - DNA, 25 bp, Homo sapien
gcacaatgattactcgaaattcagt

SEQ ID NO: 489515 - DNA, 25 bp, Homo sapien
acttccctgtcaaaattactggctg

SEQ ID NO: 489516 - DNA, 25 bp, Homo sapien
ctgtcaaaattactggctgccaaat

SEQ ID NO: 489517 - DNA, 25 bp, Homo sapien
ggctgccaaatttatacctgtttct

SEQ ID NO: 489518 - DNA, 25 bp, Homo sapien
tatacctgtttcttcagctgtacct

SEQ ID NO: 489519 - DNA, 25 bp, Homo sapien
ctgtttcttcagctgtaccttttga

SEQ ID NO: 489520 - DNA, 25 bp, Homo sapien
gtagaatgtaatgtgttcactgcct

SEQ ID NO: 489521 - DNA, 25 bp, Homo sapien
ctttgtgaagcggtatataattgta

SEQ ID NO: 489522 - DNA, 25 bp, Homo sapien
gtgtgtaaactgaatgcttgggctt

SEQ ID NO: 489523 - DNA, 25 bp, Homo sapien
taaactgaatgcttgggctttcaat

SEQ ID NO: 489524 - DNA, 25 bp, Homo sapien
ttttgcaaaatactgtaggtgtttt

SEQ ID NO: 489525 - DNA, 25 bp, Homo sapien
ctttgtattcccaatctcaaaagga

SEQ ID NO: 489526 - DNA, 25 bp, Homo sapien
ttcccaatctcaaaaggatcgcagg

SEQ ID NO: 489527 - DNA, 25 bp, Homo sapien
aaggatcgcaggcaagacttccaca

SEQ ID NO: 489528 - DNA, 25 bp, Homo sapien
gatcgcaggcaagacttccacagta

SEQ ID NO: 489529 - DNA, 25 bp, Homo sapien
gcaggcaagacttccacagtatttt

SEQ ID NO: 489530 - DNA, 25 bp, Homo sapien
attttcttctaagctatcataagca

SEQ ID NO: 489531 - DNA, 25 bp, Homo sapien
agcattctcctagaaacgatcctaa

SEQ ID NO: 489532 - DNA, 25 bp, Homo sapien
tagaaacgatcctaacacatcttct

SEQ ID NO: 489533 - DNA, 25 bp, Homo sapien
cacatcttcttggattcagcttacc

SEQ ID NO: 489534 - DNA, 25 bp, Homo sapien
ggattcagcttaccaaataaacact

SEQ ID NO: 489535 - DNA, 25 bp, Homo sapien
tccacagggctttcggacatgacag

SEQ ID NO: 489536 - DNA, 25 bp, Homo sapien
ctttcggacatgacagcaacctttt

SEQ ID NO: 489537 - DNA, 25 bp, Homo sapien
gcaaccttttctcccaggacaattg

SEQ ID NO: 489538 - DNA, 25 bp, Homo sapien
ttctcccaggacaattgaaatttgc

SEQ ID NO: 489539 - DNA, 25 bp, Homo sapien
gaggagggttcctcttaggtcagat

SEQ ID NO: 489540 - DNA, 25 bp, Homo sapien
cttaggtcagatggaggttctcaga

SEQ ID NO: 489541 - DNA, 25 bp, Homo sapien
gtcctccctctctactggagtggaa

SEQ ID NO: 489542 - DNA, 25 bp, Homo sapien
tggagtggaaggtctattggccaac

SEQ ID NO: 489543 - DNA, 25 bp, Homo sapien
gtctattggccaacaatcctttctg

SEQ ID NO: 489544 - DNA, 25 bp, Homo sapien
aattactattccctttgacttcagc

SEQ ID NO: 489545 - DNA, 25 bp, Homo sapien
gacttcagctgcctgaaacagccat

SEQ ID NO: 489546 - DNA, 25 bp, Homo sapien
ataagcattgttttcagtctccaga

SEQ ID NO: 489547 - DNA, 25 bp, Homo sapien
gcattgttttcagtctccagagttc

SEQ ID NO: 489548 - DNA, 25 bp, Homo sapien
gtctccagagttctactgtgtcata

SEQ ID NO: 489549 - DNA, 25 bp, Homo sapien
agttctactgtgtcatatactctac

SEQ ID NO: 489550 - DNA, 25 bp, Homo sapien
gtgtcatatactctacatgttccat

SEQ ID NO: 489551 - DNA, 25 bp, Homo sapien
tacatgttccatactattcactgaa

SEQ ID NO: 489552 - DNA, 25 bp, Homo sapien
actattcactgaaatcacctggatt

SEQ ID NO: 489553 - DNA, 25 bp, Homo sapien
gaaatcacctggattttcccctagt

SEQ ID NO: 489554 - DNA, 25 bp, Homo sapien
gattttcccctagttagtaagtatg

SEQ ID NO: 489555 - DNA, 25 bp, Homo sapien
agtaagtatgtagatcacttttttc

SEQ ID NO: 489556 - DNA, 25 bp, Homo sapien
tttccatccatatcagcatgtcatg

SEQ ID NO: 489557 - DNA, 25 bp, Homo sapien
gaaatcgtatttagaatttgcttta

SEQ ID NO: 489558 - DNA, 25 bp, Homo sapien
gcagtgagttatagagaacaggatt

SEQ ID NO: 489559 - DNA, 25 bp, Homo sapien
acaggattatgtagttagaaaagct

SEQ ID NO: 489560 - DNA, 25 bp, Homo sapien
aaggttggacttaatggacatatgg

SEQ ID NO: 489561 - DNA, 25 bp, Homo sapien
atggacatatggtatgggcatatat

SEQ ID NO: 489562 - DNA, 25 bp, Homo sapien
aaatagtattgctgctgttttaact

SEQ ID NO: 489563 - DNA, 25 bp, Homo sapien
agtattgctgctgttttaactattt

SEQ ID NO: 489564 - DNA, 25 bp, Homo sapien
aaatctttagaattattacctgcga

SEQ ID NO: 489565 - DNA, 25 bp, Homo sapien
gaattattacctgcgaatatctctt

SEQ ID NO: 489566 - DNA, 25 bp, Homo sapien
tacctgcgaatatctcttaatgaat

SEQ ID NO: 489567 - DNA, 25 bp, Homo sapien
ctcttaatgaatttcgttagcttct

SEQ ID NO: 489568 - DNA, 25 bp, Homo sapien
ctgccgcaggtaatctttaatagct

SEQ ID NO: 489569 - DNA, 25 bp, Homo sapien
gagaaagtattgtcactctatccag

SEQ ID NO: 489570 - DNA, 25 bp, Homo sapien
aagtattgtcactctatccaggctg

SEQ ID NO: 489571 - DNA, 25 bp, Homo sapien
tattgtcactctatccaggctggga

SEQ ID NO: 489572 - DNA, 25 bp, Homo sapien
ttgtcactctatccaggctgggaca

SEQ ID NO: 489573 - DNA, 25 bp, Homo sapien
tcactctatccaggctgggacattt

SEQ ID NO: 489574 - DNA, 25 bp, Homo sapien
tctatccaggctgggacattttatt

SEQ ID NO: 489575 - DNA, 25 bp, Homo sapien
tttgttctgaatacttaactcaagg

SEQ ID NO: 489576 - DNA, 25 bp, Homo sapien
tacttaactcaaggtcaggatccat

SEQ ID NO: 489577 - DNA, 25 bp, Homo sapien
aactcaaggtcaggatccatgtaat

SEQ ID NO: 489578 - DNA, 25 bp, Homo sapien
ggtcaggatccatgtaataaataaa

SEQ ID NO: 489579 - DNA, 25 bp, Homo sapien
tcggcctctacaatcccaacatctg

SEQ ID NO: 489580 - DNA, 25 bp, Homo sapien
aacatctgcctcacagcagattctt

SEQ ID NO: 489581 - DNA, 25 bp, Homo sapien
tctgcctcacagcagattcttcacg

SEQ ID NO: 489582 - DNA, 25 bp, Homo sapien
acagcagattcttcacgcccagcct

SEQ ID NO: 489583 - DNA, 25 bp, Homo sapien
cagtggaccctccagacccagatgg

SEQ ID NO: 489584 - DNA, 25 bp, Homo sapien
ggaccctccagacccagatggtgtc

SEQ ID NO: 489585 - DNA, 25 bp, Homo sapien
tggtgtctcactgtggcatcctcag

SEQ ID NO: 489586 - DNA, 25 bp, Homo sapien
ctcactgtggcatcctcaggcgaag

SEQ ID NO: 489587 - DNA, 25 bp, Homo sapien
caagccccgcttttgacttttggtg

SEQ ID NO: 489588 - DNA, 25 bp, Homo sapien
ttttgacttttggtggcctctgcag

SEQ ID NO: 489589 - DNA, 25 bp, Homo sapien
tgcaggcctcgacaaggcccagcct

SEQ ID NO: 489590 - DNA, 25 bp, Homo sapien
aactacggacgtaaagctggtctct

SEQ ID NO: 489591 - DNA, 25 bp, Homo sapien
agctggtctctaaattgccggtgaa

SEQ ID NO: 489592 - DNA, 25 bp, Homo sapien
gctggtctctaaattgccggtgaaa

SEQ ID NO: 489593 - DNA, 25 bp, Homo sapien
ctggtctctaaattgccggtgaaaa

SEQ ID NO: 489594 - DNA, 25 bp, Homo sapien
tggtctctaaattgccggtgaaaat

SEQ ID NO: 489595 - DNA, 25 bp, Homo sapien
ggtctctaaattgccggtgaaaatc

SEQ ID NO: 489596 - DNA, 25 bp, Homo sapien
gtctctaaattgccggtgaaaatcc

SEQ ID NO: 489597 - DNA, 25 bp, Homo sapien
tctctaaattgccggtgaaaatcct

SEQ ID NO: 489598 - DNA, 25 bp, Homo sapien
ctctaaattgccggtgaaaatccta

SEQ ID NO: 489599 - DNA, 25 bp, Homo sapien
tctaaattgccggtgaaaatcctat

SEQ ID NO: 489600 - DNA, 25 bp, Homo sapien
ctaaattgccggtgaaaatcctatt

SEQ ID NO: 489601 - DNA, 25 bp, Homo sapien
aataattgctaggtttggtggcaca

SEQ ID NO: 489602 - DNA, 25 bp, Homo sapien
ttggtggcacatgcgtacagcccca

SEQ ID NO: 489603 - DNA, 25 bp, Homo sapien
tgcgtacagccccagctacttagga

SEQ ID NO: 489604 - DNA, 25 bp, Homo sapien
tgggctgtggtacactatgccagtt

SEQ ID NO: 489605 - DNA, 25 bp, Homo sapien
cactatgccagttgggtgtaagttt

SEQ ID NO: 489606 - DNA, 25 bp, Homo sapien
tatggtgatgtccctgaagcaggaa

SEQ ID NO: 489607 - DNA, 25 bp, Homo sapien
aggaaaccacaaacttgcatcagga

SEQ ID NO: 489608 - DNA, 25 bp, Homo sapien
acccagcccaggttggaaatggagc

SEQ ID NO: 489609 - DNA, 25 bp, Homo sapien
atcagtaatgggatcttgcctatga

SEQ ID NO: 489610 - DNA, 25 bp, Homo sapien
ggatcttgcctatgaatagccagtg

SEQ ID NO: 489611 - DNA, 25 bp, Homo sapien
atagccagtgcactgcagccaggac

SEQ ID NO: 489612 - DNA, 25 bp, Homo sapien
tgtctgctctgagcgacctgcatgc

SEQ ID NO: 489613 - DNA, 25 bp, Homo sapien
gcatgcccacaagctgcgtgtggat

SEQ ID NO: 489614 - DNA, 25 bp, Homo sapien
acaagctgcgtgtggatcccgtcaa

SEQ ID NO: 489615 - DNA, 25 bp, Homo sapien
agctgcgtgtggatcccgtcaactt

SEQ ID NO: 489616 - DNA, 25 bp, Homo sapien
gtgtggatcccgtcaacttcaagct

SEQ ID NO: 489617 - DNA, 25 bp, Homo sapien
tggtgaccttggctagccaccaccc

SEQ ID NO: 489618 - DNA, 25 bp, Homo sapien
aaattccttgcctctgtgagcaccg

SEQ ID NO: 489619 - DNA, 25 bp, Homo sapien
attccttgcctctgtgagcaccgtg

SEQ ID NO: 489620 - DNA, 25 bp, Homo sapien
tccaagtaccgttaagctgccttct

SEQ ID NO: 489621 - DNA, 25 bp, Homo sapien
aagtaccgttaagctgccttctgcg

SEQ ID NO: 489622 - DNA, 25 bp, Homo sapien
gtaccgttaagctgccttctgcggg

SEQ ID NO: 489623 - DNA, 25 bp, Homo sapien
ataaataggattttcaccggcaatt

SEQ ID NO: 489624 - DNA, 25 bp, Homo sapien
ataggattttcaccggcaatttaga

SEQ ID NO: 489625 - DNA, 25 bp, Homo sapien
gattttcaccggcaatttagagacc

SEQ ID NO: 489626 - DNA, 25 bp, Homo sapien
ttcaccggcaatttagagaccagct

SEQ ID NO: 489627 - DNA, 25 bp, Homo sapien
ggaaattgcctacttgcaatcagtg

SEQ ID NO: 489628 - DNA, 25 bp, Homo sapien
gcctacttgcaatcagtgtgtggat

SEQ ID NO: 489629 - DNA, 25 bp, Homo sapien
aatcagtgtgtggatttgcacggca

SEQ ID NO: 489630 - DNA, 25 bp, Homo sapien
cagtgtgtggatttgcacggcagta

SEQ ID NO: 489631 - DNA, 25 bp, Homo sapien
gtgtgtggatttgcacggcagtatc

SEQ ID NO: 489632 - DNA, 25 bp, Homo sapien
gttacggcactcttataaataggat

SEQ ID NO: 489633 - DNA, 25 bp, Homo sapien
acggcactcttataaataggatttt

SEQ ID NO: 489634 - DNA, 25 bp, Homo sapien
gacagcgtgctgagggtgccggccc

SEQ ID NO: 489635 - DNA, 25 bp, Homo sapien
ggtgccggcccctccgtaggcgatg

SEQ ID NO: 489636 - DNA, 25 bp, Homo sapien
gggacgacagggtcacggtgtgcca

SEQ ID NO: 489637 - DNA, 25 bp, Homo sapien
ggctcctgggactccaactgggcgc

SEQ ID NO: 489638 - DNA, 25 bp, Homo sapien
gcctaaggggctgcgctctcggact

SEQ ID NO: 489639 - DNA, 25 bp, Homo sapien
gctctcggactgagcggtgcgcgct

SEQ ID NO: 489640 - DNA, 25 bp, Homo sapien
agcggtgcgcgctccgatgctttcg

SEQ ID NO: 489641 - DNA, 25 bp, Homo sapien
gtcacggtgtgccagagcgcgggtt

SEQ ID NO: 489642 - DNA, 25 bp, Homo sapien
gctcggaccacgtctggcccaagcc

SEQ ID NO: 489643 - DNA, 25 bp, Homo sapien
aagcggcctcctgccagcggcggca

SEQ ID NO: 489644 - DNA, 25 bp, Homo sapien
gcacacgcgcgcagccctgggagga

SEQ ID NO: 489645 - DNA, 25 bp, Homo sapien
ccaggagaaggaagttcacaggtta

SEQ ID NO: 489646 - DNA, 25 bp, Homo sapien
aaggaagttcacaggttaatcgctc

SEQ ID NO: 489647 - DNA, 25 bp, Homo sapien
ggaagttcacaggttaatcgctcag

SEQ ID NO: 489648 - DNA, 25 bp, Homo sapien
tcagaggtctgacacacatcactaa

SEQ ID NO: 489649 - DNA, 25 bp, Homo sapien
agaggtctgacacacatcactaagc

SEQ ID NO: 489650 - DNA, 25 bp, Homo sapien
gaggtctgacacacatcactaagct

SEQ ID NO: 489651 - DNA, 25 bp, Homo sapien
ggtctgacacacatcactaagctta

SEQ ID NO: 489652 - DNA, 25 bp, Homo sapien
ctgacacacatcactaagcttactc

SEQ ID NO: 489653 - DNA, 25 bp, Homo sapien
gacacacatcactaagcttactcta

SEQ ID NO: 489654 - DNA, 25 bp, Homo sapien
acacatcactaagcttactctatgg

SEQ ID NO: 489655 - DNA, 25 bp, Homo sapien
cacatcactaagcttactctatgga

SEQ ID NO: 489656 - DNA, 25 bp, Homo sapien
gtgtgtgtgcccttatgcatagtca

SEQ ID NO: 489657 - DNA, 25 bp, Homo sapien
gtgcccttatgcatagtcaactagt

SEQ ID NO: 489658 - DNA, 25 bp, Homo sapien
tagtcaactagtaagctgtacattg

SEQ ID NO: 489659 - DNA, 25 bp, Homo sapien
gctgtacattgattatattctcttt

SEQ ID NO: 489660 - DNA, 25 bp, Homo sapien
tattctcttttgatgtatgtgtttg

SEQ ID NO: 489661 - DNA, 25 bp, Homo sapien
tattaaaaccctttatattcatctt

SEQ ID NO: 489662 - DNA, 25 bp, Homo sapien
atgtggacttttgtgacaggtatgt

SEQ ID NO: 489663 - DNA, 25 bp, Homo sapien
gacaggtatgttgaatcttatatta

SEQ ID NO: 489664 - DNA, 25 bp, Homo sapien
ttttcttctgttttgatactagttt

SEQ ID NO: 489665 - DNA, 25 bp, Homo sapien
cttctgttttgatactagttttcac

SEQ ID NO: 489666 - DNA, 25 bp, Homo sapien
ttaaagctgtgttattagaggaata

SEQ ID NO: 489667 - DNA, 25 bp, Homo sapien
tcgctttggtgttctccactgggat

SEQ ID NO: 489668 - DNA, 25 bp, Homo sapien
gttctccactgggatctaggacaga

SEQ ID NO: 489669 - DNA, 25 bp, Homo sapien
taggacagaatcgtcggtcaccacc

SEQ ID NO: 489670 - DNA, 25 bp, Homo sapien
agtcacttcccagcgtgaaacgcag

SEQ ID NO: 489671 - DNA, 25 bp, Homo sapien
gcagttaatccagaatccacccatt

SEQ ID NO: 489672 - DNA, 25 bp, Homo sapien
gcatcgcagccgtcgcagagcaaaa

SEQ ID NO: 489673 - DNA, 25 bp, Homo sapien
tccacccattgccttagattcatat

SEQ ID NO: 489674 - DNA, 25 bp, Homo sapien
ttagattcatatttgggctccacag

SEQ ID NO: 489675 - DNA, 25 bp, Homo sapien
atatttgggctccacaggcccagag

SEQ ID NO: 489676 - DNA, 25 bp, Homo sapien
cctccacgtgtacacagggattttt

SEQ ID NO: 489677 - DNA, 25 bp, Homo sapien
acacctcacagaaggtcgggtcctc

SEQ ID NO: 489678 - DNA, 25 bp, Homo sapien
atgtctctgctcatttagtcccgtc

SEQ ID NO: 489679 - DNA, 25 bp, Homo sapien
gaaatgctgcctcttcagtgaagtc

SEQ ID NO: 489680 - DNA, 25 bp, Homo sapien
agtgaagtcatcctctttcagctct

SEQ ID NO: 489681 - DNA, 25 bp, Homo sapien
agctctggccgcattctgcagactt

SEQ ID NO: 489682 - DNA, 25 bp, Homo sapien
attctgcagacttcctatcttcgtg

SEQ ID NO: 489683 - DNA, 25 bp, Homo sapien
tcctatcttcgtgctgtatgttttt

SEQ ID NO: 489684 - DNA, 25 bp, Homo sapien
cccttcactctaatggactgttcca

SEQ ID NO: 489685 - DNA, 25 bp, Homo sapien
cagctgcttcggatccacactgtat

SEQ ID NO: 489686 - DNA, 25 bp, Homo sapien
ggatccacactgtatctgtgtcatc

SEQ ID NO: 489687 - DNA, 25 bp, Homo sapien
gtatctgtgtcatccccacatgggt

SEQ ID NO: 489688 - DNA, 25 bp, Homo sapien
cccacatgggtcctcataaaggatt

SEQ ID NO: 489689 - DNA, 25 bp, Homo sapien
ttccaggcttgattgcaggctcagg

SEQ ID NO: 489690 - DNA, 25 bp, Homo sapien
tccaggcttgattgcaggctcagga

SEQ ID NO: 489691 - DNA, 25 bp, Homo sapien
ccaggcttgattgcaggctcaggaa

SEQ ID NO: 489692 - DNA, 25 bp, Homo sapien
caggcttgattgcaggctcaggaaa

SEQ ID NO: 489693 - DNA, 25 bp, Homo sapien
aggcttgattgcaggctcaggaaag

SEQ ID NO: 489694 - DNA, 25 bp, Homo sapien
ggcttgattgcaggctcaggaaagt

SEQ ID NO: 489695 - DNA, 25 bp, Homo sapien
cttgattgcaggctcaggaaagttt

SEQ ID NO: 489696 - DNA, 25 bp, Homo sapien
tgattgcaggctcaggaaagtttga

SEQ ID NO: 489697 - DNA, 25 bp, Homo sapien
tccaacttgacatcacagtttctgg

SEQ ID NO: 489698 - DNA, 25 bp, Homo sapien
aggaaagtttgagaaaagcatctgc

SEQ ID NO: 489699 - DNA, 25 bp, Homo sapien
agagcagagcttacctcattgcctg

SEQ ID NO: 489700 - DNA, 25 bp, Homo sapien
aagggaaatcccaggatgatggcaa

SEQ ID NO: 489701 - DNA, 25 bp, Homo sapien
agctgtgcaacaagaataaagaaca

SEQ ID NO: 489702 - DNA, 25 bp, Homo sapien
taaagaacaatcagaggacctcttg

SEQ ID NO: 489703 - DNA, 25 bp, Homo sapien
gaacaatcagaggacctcttgagcc

SEQ ID NO: 489704 - DNA, 25 bp, Homo sapien
caaggtcgtgccactacactgaagc

SEQ ID NO: 489705 - DNA, 25 bp, Homo sapien
aggtcgtgccactacactgaagcct

SEQ ID NO: 489706 - DNA, 25 bp, Homo sapien
agaaaaggacctatcagccccaagt

SEQ ID NO: 489707 - DNA, 25 bp, Homo sapien
aaaggacctatcagccccaagtgga

SEQ ID NO: 489708 - DNA, 25 bp, Homo sapien
acctatcagccccaagtggagcaga

SEQ ID NO: 489709 - DNA, 25 bp, Homo sapien
tatcagccccaagtggagcagaaca

SEQ ID NO: 489710 - DNA, 25 bp, Homo sapien
gatttgggaggaatgtcctcagaaa

SEQ ID NO: 489711 - DNA, 25 bp, Homo sapien
caagcagctcatctgagcactttgg

SEQ ID NO: 489712 - DNA, 25 bp, Homo sapien
gatgtattcagcctacgttgccctg

SEQ ID NO: 489713 - DNA, 25 bp, Homo sapien
tcagcctacgttgccctggaaaagg

SEQ ID NO: 489714 - DNA, 25 bp, Homo sapien
gcaggagatgtctccctgtgggaaa

SEQ ID NO: 489715 - DNA, 25 bp, Homo sapien
gagaagttgtctctgagtcccctgt

SEQ ID NO: 489716 - DNA, 25 bp, Homo sapien
agtcccctgtcaccagttggattca

SEQ ID NO: 489717 - DNA, 25 bp, Homo sapien
aatgagccactttgaccaccctcgg

SEQ ID NO: 489718 - DNA, 25 bp, Homo sapien
cctcgggtgctatgggtgacacaag

SEQ ID NO: 489719 - DNA, 25 bp, Homo sapien
gtgacacaagagctgtccactgggt

SEQ ID NO: 489720 - DNA, 25 bp, Homo sapien
gctgtccactgggtgtttgcagaat

SEQ ID NO: 489721 - DNA, 25 bp, Homo sapien
tatgtctggatcctgatgatttcac

SEQ ID NO: 489722 - DNA, 25 bp, Homo sapien
agcagtctcctttgccgtcgacgcg

SEQ ID NO: 489723 - DNA, 25 bp, Homo sapien
cttttaggggtaggcagttatatca

SEQ ID NO: 489724 - DNA, 25 bp, Homo sapien
gggtaggcagttatatcaagtgcaa

SEQ ID NO: 489725 - DNA, 25 bp, Homo sapien
taggcagttatatcaagtgcaacag

SEQ ID NO: 489726 - DNA, 25 bp, Homo sapien
ggcagttatatcaagtgcaacagca

SEQ ID NO: 489727 - DNA, 25 bp, Homo sapien
caagtgcaacagcagacacagcaac

SEQ ID NO: 489728 - DNA, 25 bp, Homo sapien
gtgcaacagcagacacagcaacaag

SEQ ID NO: 489729 - DNA, 25 bp, Homo sapien
gcaacagcagacacagcaacaagtg

SEQ ID NO: 489730 - DNA, 25 bp, Homo sapien
acagcagacacagcaacaagtggcc

SEQ ID NO: 489731 - DNA, 25 bp, Homo sapien
gacacagcaacaagtggcccagcct

SEQ ID NO: 489732 - DNA, 25 bp, Homo sapien
agcaacagcctcagcagtctccttt

SEQ ID NO: 489733 - DNA, 25 bp, Homo sapien
agggccaggcagtcgtggttgcaga

SEQ ID NO: 489734 - DNA, 25 bp, Homo sapien
gaaggagcaattaggctgcctgcct

SEQ ID NO: 489735 - DNA, 25 bp, Homo sapien
tagggccccacctatttaggacgag

SEQ ID NO: 489736 - DNA, 25 bp, Homo sapien
ggccccacctatttaggacgagatt

SEQ ID NO: 489737 - DNA, 25 bp, Homo sapien
gacgagattgaagactgacccttga

SEQ ID NO: 489738 - DNA, 25 bp, Homo sapien
tgaagactgacccttgaggcacact

SEQ ID NO: 489739 - DNA, 25 bp, Homo sapien
cttgaggcacacttgcactggagat

SEQ ID NO: 489740 - DNA, 25 bp, Homo sapien
gcacacttgcactggagatgggttt

SEQ ID NO: 489741 - DNA, 25 bp, Homo sapien
gagatgggtttatttcacgctctgt

SEQ ID NO: 489742 - DNA, 25 bp, Homo sapien
atgggtttatttcacgctctgtgct

SEQ ID NO: 489743 - DNA, 25 bp, Homo sapien
cgctctgtgcttgtgtgctagcgga

SEQ ID NO: 489744 - DNA, 25 bp, Homo sapien
acactgaggttgcatatttaaagac

SEQ ID NO: 489745 - DNA, 25 bp, Homo sapien
tggcagtagatgctccaaggagaca

SEQ ID NO: 489746 - DNA, 25 bp, Homo sapien
ataaggtatccgtccatgttcttgc

SEQ ID NO: 489747 - DNA, 25 bp, Homo sapien
cgtccatgttcttgccagggaaatg

SEQ ID NO: 489748 - DNA, 25 bp, Homo sapien
gggaaatggattcttgtcctgttgt

SEQ ID NO: 489749 - DNA, 25 bp, Homo sapien
gtcctgttgttggagagttcccatg

SEQ ID NO: 489750 - DNA, 25 bp, Homo sapien
ttcaggcattagcaattcgtcgact

SEQ ID NO: 489751 - DNA, 25 bp, Homo sapien
gcaattcgtcgactagacaaaccaa

SEQ ID NO: 489752 - DNA, 25 bp, Homo sapien
gacaaaccaaagaagctatctgctg

SEQ ID NO: 489753 - DNA, 25 bp, Homo sapien
agctatctgctgagtgtgctaaata

SEQ ID NO: 489754 - DNA, 25 bp, Homo sapien
ggagaaatcatctcccagcaatata

SEQ ID NO: 489755 - DNA, 25 bp, Homo sapien
gacaaaccaagttctgggtcccaag

SEQ ID NO: 489756 - DNA, 25 bp, Homo sapien
ggtcccaagccccagggtcttatgc

SEQ ID NO: 489757 - DNA, 25 bp, Homo sapien
cctgccccaggttggcttgttgttg

SEQ ID NO: 489758 - DNA, 25 bp, Homo sapien
cccaggttggcttgttgttgcagca

SEQ ID NO: 489759 - DNA, 25 bp, Homo sapien
ccaggttggcttgttgttgcagcag

SEQ ID NO: 489760 - DNA, 25 bp, Homo sapien
caggttggcttgttgttgcagcagc

SEQ ID NO: 489761 - DNA, 25 bp, Homo sapien
aggttggcttgttgttgcagcagca

SEQ ID NO: 489762 - DNA, 25 bp, Homo sapien
gttggcttgttgttgcagcagcagc

SEQ ID NO: 489763 - DNA, 25 bp, Homo sapien
ctcacaggacaggtgttttatgacc

SEQ ID NO: 489764 - DNA, 25 bp, Homo sapien
acaggacaggtgttttatgacccag

SEQ ID NO: 489765 - DNA, 25 bp, Homo sapien
ttatgacccagtcccgggtggtcaa

SEQ ID NO: 489766 - DNA, 25 bp, Homo sapien
gaaaaatagatgttccagccacctt

SEQ ID NO: 489767 - DNA, 25 bp, Homo sapien
ttacttaactgtctagtcttttaag

SEQ ID NO: 489768 - DNA, 25 bp, Homo sapien
gtcttttaagaccaatcagtatgtt

SEQ ID NO: 489769 - DNA, 25 bp, Homo sapien
agaccaatcagtatgttccctggaa

SEQ ID NO: 489770 - DNA, 25 bp, Homo sapien
ttttactcccaaagcacagtatctc

SEQ ID NO: 489771 - DNA, 25 bp, Homo sapien
ctcccaaagcacagtatctcaacag

SEQ ID NO: 489772 - DNA, 25 bp, Homo sapien
aagcacagtatctcaacagcagcag

SEQ ID NO: 489773 - DNA, 25 bp, Homo sapien
cacagtatctcaacagcagcagcca

SEQ ID NO: 489774 - DNA, 25 bp, Homo sapien
agcagcagccaacatggggttttag

SEQ ID NO: 489775 - DNA, 25 bp, Homo sapien
ttattttggtgtacattcttctaga

SEQ ID NO: 489776 - DNA, 25 bp, Homo sapien
tagaaccaggttcatttttccagtt

SEQ ID NO: 489777 - DNA, 25 bp, Homo sapien
aatatgtttgcttgctcttaagtta

SEQ ID NO: 489778 - DNA, 25 bp, Homo sapien
tatgtttgcttgctcttaagttaga

SEQ ID NO: 489779 - DNA, 25 bp, Homo sapien
gtttgcttgctcttaagttagaagt

SEQ ID NO: 489780 - DNA, 25 bp, Homo sapien
gcttgctcttaagttagaagtattg

SEQ ID NO: 489781 - DNA, 25 bp, Homo sapien
acctctgtttcacaatactttgtgt

SEQ ID NO: 489782 - DNA, 25 bp, Homo sapien
caatactttgtgtagtgaaacctga

SEQ ID NO: 489783 - DNA, 25 bp, Homo sapien
actttgtgtagtgaaacctgatgga

SEQ ID NO: 489784 - DNA, 25 bp, Homo sapien
gaaacctgatggagtgatagtgtgt

SEQ ID NO: 489785 - DNA, 25 bp, Homo sapien
ggagtgatagtgtgttagttattat

SEQ ID NO: 489786 - DNA, 25 bp, Homo sapien
gtggacaattcacaagcagagtgtt

SEQ ID NO: 489787 - DNA, 25 bp, Homo sapien
attcacaagcagagtgtttgttcca

SEQ ID NO: 489788 - DNA, 25 bp, Homo sapien
agatagcgtgatatggcacaaacat

SEQ ID NO: 489789 - DNA, 25 bp, Homo sapien
acaaacattactatggccaccttct

SEQ ID NO: 489790 - DNA, 25 bp, Homo sapien
gccaccttctcagggttattcattc

SEQ ID NO: 489791 - DNA, 25 bp, Homo sapien
tattcattcttatgtccccagagcc

SEQ ID NO: 489792 - DNA, 25 bp, Homo sapien
aaatgcctgttgagctggactacat

SEQ ID NO: 489793 - DNA, 25 bp, Homo sapien
cttatgtccccagagcctaaaacaa

SEQ ID NO: 489794 - DNA, 25 bp, Homo sapien
gagcctaaaacaatagttggcacat

SEQ ID NO: 489795 - DNA, 25 bp, Homo sapien
gtgctcaataatgtttgcagatcat

SEQ ID NO: 489796 - DNA, 25 bp, Homo sapien
gatcatttgtatgccttgctgtctt

SEQ ID NO: 489797 - DNA, 25 bp, Homo sapien
ggactacatactgcagataccaaga

SEQ ID NO: 489798 - DNA, 25 bp, Homo sapien
ccctccctatctagcatagcagaaa

SEQ ID NO: 489799 - DNA, 25 bp, Homo sapien
tgctgcaacaacaagccaacctggg

SEQ ID NO: 489800 - DNA, 25 bp, Homo sapien
ctggaccaggagaccttggtggctg

SEQ ID NO: 489801 - DNA, 25 bp, Homo sapien
tggctgctgggaggcataagaccct

SEQ ID NO: 489802 - DNA, 25 bp, Homo sapien
ggcttgggacccagaacttggtttg

SEQ ID NO: 489803 - DNA, 25 bp, Homo sapien
ttgggacccagaacttggtttgtct

SEQ ID NO: 489804 - DNA, 25 bp, Homo sapien
ggacccagaacttggtttgtctgta

SEQ ID NO: 489805 - DNA, 25 bp, Homo sapien
agaacttggtttgtctgtactccag

SEQ ID NO: 489806 - DNA, 25 bp, Homo sapien
acttggtttgtctgtactccaggac

SEQ ID NO: 489807 - DNA, 25 bp, Homo sapien
tggtttgtctgtactccaggaccct

SEQ ID NO: 489808 - DNA, 25 bp, Homo sapien
tgaccacccgggactgggtcataaa

SEQ ID NO: 489809 - DNA, 25 bp, Homo sapien
gactgggtcataaaacacctgtcct

SEQ ID NO: 489810 - DNA, 25 bp, Homo sapien
ccaccacaaacactcaagtggaagg

SEQ ID NO: 489811 - DNA, 25 bp, Homo sapien
tgatgaggccgcattcctggagcgc

SEQ ID NO: 489812 - DNA, 25 bp, Homo sapien
gctcggcgtgaggaaagacgccaaa

SEQ ID NO: 489813 - DNA, 25 bp, Homo sapien
aaaaacgccttcaggaggctctgga

SEQ ID NO: 489814 - DNA, 25 bp, Homo sapien
gcggcagaaggagttcgacccaaca

SEQ ID NO: 489815 - DNA, 25 bp, Homo sapien
gaaggagttcgacccaacaataaca

SEQ ID NO: 489816 - DNA, 25 bp, Homo sapien
gttcgacccaacaataacagatgca

SEQ ID NO: 489817 - DNA, 25 bp, Homo sapien
aacagatgcaagtctgtcgctccca

SEQ ID NO: 489818 - DNA, 25 bp, Homo sapien
aagtctgtcgctcccaagcagaaga

SEQ ID NO: 489819 - DNA, 25 bp, Homo sapien
gtcgctcccaagcagaagaatgcaa

SEQ ID NO: 489820 - DNA, 25 bp, Homo sapien
gaaagtcgccaagaaagatacgaga

SEQ ID NO: 489821 - DNA, 25 bp, Homo sapien
agcgcatgcatctccgccaatacga

SEQ ID NO: 489822 - DNA, 25 bp, Homo sapien
atgcatctccgccaatacgagctgc

SEQ ID NO: 489823 - DNA, 25 bp, Homo sapien
tctccgccaatacgagctgctctaa

SEQ ID NO: 489824 - DNA, 25 bp, Homo sapien
ggaacacccaaatttaattcagcct

SEQ ID NO: 489825 - DNA, 25 bp, Homo sapien
gaacacccaaatttaattcagcctt

SEQ ID NO: 489826 - DNA, 25 bp, Homo sapien
accatagggcatgatcaacaccgca

SEQ ID NO: 489827 - DNA, 25 bp, Homo sapien
atagggcatgatcaacaccgcaacc

SEQ ID NO: 489828 - DNA, 25 bp, Homo sapien
tagggcatgatcaacaccgcaacct

SEQ ID NO: 489829 - DNA, 25 bp, Homo sapien
gggcatgatcaacaccgcaaccttt

SEQ ID NO: 489830 - DNA, 25 bp, Homo sapien
ggcatgatcaacaccgcaacctttc

SEQ ID NO: 489831 - DNA, 25 bp, Homo sapien
gatcaacaccgcaacctttcctttt

SEQ ID NO: 489832 - DNA, 25 bp, Homo sapien
aaagggtctgtggatcctggcttcc

SEQ ID NO: 489833 - DNA, 25 bp, Homo sapien
gaggctggagtcttcaggagatcac

SEQ ID NO: 489834 - DNA, 25 bp, Homo sapien
ggagatcaccaagcattttaagttg

SEQ ID NO: 489835 - DNA, 25 bp, Homo sapien
ctccttcagtcttcatggtcatgtg

SEQ ID NO: 489836 - DNA, 25 bp, Homo sapien
ttcatggtcatgtgacctgccctat

SEQ ID NO: 489837 - DNA, 25 bp, Homo sapien
tatctccaaaccacaaccttgggag

SEQ ID NO: 489838 - DNA, 25 bp, Homo sapien
caaccttgggagctaaaggcgttca

SEQ ID NO: 489839 - DNA, 25 bp, Homo sapien
aggcgttcaaatcaaggacttcacc

SEQ ID NO: 489840 - DNA, 25 bp, Homo sapien
aggacttcaccagagcctgtgaggt

SEQ ID NO: 489841 - DNA, 25 bp, Homo sapien
gacagggtacgaatagcgccccttg

SEQ ID NO: 489842 - DNA, 25 bp, Homo sapien
gccccttgccttagcaggagtgaag

SEQ ID NO: 489843 - DNA, 25 bp, Homo sapien
cggagatcacacaggaaggaggtaa

SEQ ID NO: 489844 - DNA, 25 bp, Homo sapien
aagggaaatcccaggatgatggcaa

SEQ ID NO: 489845 - DNA, 25 bp, Homo sapien
agtccccaaacaacagctgtgcaac

SEQ ID NO: 489846 - DNA, 25 bp, Homo sapien
taaagaacaatcagaggacctcttg

SEQ ID NO: 489847 - DNA, 25 bp, Homo sapien
gaacaatcagaggacctcttgagcc

SEQ ID NO: 489848 - DNA, 25 bp, Homo sapien
caaggtcgtgccactacactgaagc

SEQ ID NO: 489849 - DNA, 25 bp, Homo sapien
aggtcgtgccactacactgaagcct

SEQ ID NO: 489850 - DNA, 25 bp, Homo sapien
agaaaaggacctatcagccccaagt

SEQ ID NO: 489851 - DNA, 25 bp, Homo sapien
aaaggacctatcagccccaagtgga

SEQ ID NO: 489852 - DNA, 25 bp, Homo sapien
tatcagccccaagtggagcagaaca

SEQ ID NO: 489853 - DNA, 25 bp, Homo sapien
gatttgggaggaatgtcctcagaaa

SEQ ID NO: 489854 - DNA, 25 bp, Homo sapien
ttatttttctttcaccgttgtatca

SEQ ID NO: 489855 - DNA, 25 bp, Homo sapien
gtatcaaactacacagcggccttgg

SEQ ID NO: 489856 - DNA, 25 bp, Homo sapien
tcaaactacacagcggccttggaaa

SEQ ID NO: 489857 - DNA, 25 bp, Homo sapien
tacacagcggccttggaaaccatca

SEQ ID NO: 489858 - DNA, 25 bp, Homo sapien
gcggccttggaaaccatcacagttg

SEQ ID NO: 489859 - DNA, 25 bp, Homo sapien
ggaaaccatcacagttgagagtagg

SEQ ID NO: 489860 - DNA, 25 bp, Homo sapien
acagttgagagtaggtaacacccat

SEQ ID NO: 489861 - DNA, 25 bp, Homo sapien
gagtaggtaacacccatttgttgca

SEQ ID NO: 489862 - DNA, 25 bp, Homo sapien
ggtaacacccatttgttgcatagtt

SEQ ID NO: 489863 - DNA, 25 bp, Homo sapien
gttgcatagttttgtgctccacact

SEQ ID NO: 489864 - DNA, 25 bp, Homo sapien
atagttttgtgctccacactcttat

SEQ ID NO: 489865 - DNA, 25 bp, Homo sapien
gtcaaaccaaattctctcggtttgg

SEQ ID NO: 489866 - DNA, 25 bp, Homo sapien
tgtgaggaaagagtccgctctcaag

SEQ ID NO: 489867 - DNA, 25 bp, Homo sapien
gaaagagtccgctctcaaggcgcgt

SEQ ID NO: 489868 - DNA, 25 bp, Homo sapien
gagtccgctctcaaggcgcgttgtg

SEQ ID NO: 489869 - DNA, 25 bp, Homo sapien
tcaaggcgcgttgtggtctatccga

SEQ ID NO: 489870 - DNA, 25 bp, Homo sapien
aaggcgcgttgtggtctatccgagc

SEQ ID NO: 489871 - DNA, 25 bp, Homo sapien
gcgttgtggtctatccgagccccgt

SEQ ID NO: 489872 - DNA, 25 bp, Homo sapien
acgcgtggggtaggaccatcttacg

SEQ ID NO: 489873 - DNA, 25 bp, Homo sapien
ttggctcctgcccagtgtttagggt

SEQ ID NO: 489874 - DNA, 25 bp, Homo sapien
cctgcccagtgtttagggtgttggc

SEQ ID NO: 489875 - DNA, 25 bp, Homo sapien
aaaggggaagagtcatcgcctgtcg

SEQ ID NO: 489876 - DNA, 25 bp, Homo sapien
tacttatgtgatgcagacagacttc

SEQ ID NO: 489877 - DNA, 25 bp, Homo sapien
gcagacagacttcaagagagagagt

SEQ ID NO: 489878 - DNA, 25 bp, Homo sapien
gagagagttatagctttcaattcat

SEQ ID NO: 489879 - DNA, 25 bp, Homo sapien
tattaggttactatgggtttgccat

SEQ ID NO: 489880 - DNA, 25 bp, Homo sapien
tgccgccatcatcaatctgctgaga

SEQ ID NO: 489881 - DNA, 25 bp, Homo sapien
tgggtttgccattaatttctgagtg

SEQ ID NO: 489882 - DNA, 25 bp, Homo sapien
atctgctgagatttgtgaagaccac

SEQ ID NO: 489883 - DNA, 25 bp, Homo sapien
gtgaagaccactcaacgaagacagt

SEQ ID NO: 489884 - DNA, 25 bp, Homo sapien
gaagacagtcggctatgaatgaatc

SEQ ID NO: 489885 - DNA, 25 bp, Homo sapien
gaatgaatcatccaagactgatcaa

SEQ ID NO: 489886 - DNA, 25 bp, Homo sapien
tccaagactgatcaatacttatgtg

SEQ ID NO: 489887 - DNA, 25 bp, Homo sapien
ttcatccatttactaatactgtatt

SEQ ID NO: 489888 - DNA, 25 bp, Homo sapien
atactgtatttttggtggactaggc

SEQ ID NO: 489889 - DNA, 25 bp, Homo sapien
tttttggtggactaggcttgcctat

SEQ ID NO: 489890 - DNA, 25 bp, Homo sapien
ccttaatattctgtgtcttttgcaa

SEQ ID NO: 489891 - DNA, 25 bp, Homo sapien
aggcttgcctatgtgcttatgtgta

SEQ ID NO: 489892 - DNA, 25 bp, Homo sapien
gcctatgtgcttatgtgtagctttt

SEQ ID NO: 489893 - DNA, 25 bp, Homo sapien
attctgtgtcttttgcaattaaatt

SEQ ID NO: 489894 - DNA, 25 bp, Homo sapien
tttaaaacactatctgcaaactcag

SEQ ID NO: 489895 - DNA, 25 bp, Homo sapien
gcaaactcaggacactttaacaggg

SEQ ID NO: 489896 - DNA, 25 bp, Homo sapien
ggacactttaacagggcagaatact

SEQ ID NO: 489897 - DNA, 25 bp, Homo sapien
tcaaaaccttacagtccttcctaag

SEQ ID NO: 489898 - DNA, 25 bp, Homo sapien
tcttgacactcacaatctcgttcac

SEQ ID NO: 489899 - DNA, 25 bp, Homo sapien
aatctcgttcaccacgtgggcctgg

SEQ ID NO: 489900 - DNA, 25 bp, Homo sapien
accacgtgggcctggaactctaact

SEQ ID NO: 489901 - DNA, 25 bp, Homo sapien
ggaactctaactccatcgctgaggg

SEQ ID NO: 489902 - DNA, 25 bp, Homo sapien
ggtgatggagacttttgatggcttt

SEQ ID NO: 489903 - DNA, 25 bp, Homo sapien
ggagacttttgatggcttttggcag

SEQ ID NO: 489904 - DNA, 25 bp, Homo sapien
aaccgatccatagaagggcttccca

SEQ ID NO: 489905 - DNA, 25 bp, Homo sapien
ccaaaccttgttttgcaacatccca

SEQ ID NO: 489906 - DNA, 25 bp, Homo sapien
accttgttttgcaacatcccaaatt

SEQ ID NO: 489907 - DNA, 25 bp, Homo sapien
gaaggcctttatcagattcatagat

SEQ ID NO: 489908 - DNA, 25 bp, Homo sapien
gattcatagatgagctttcattgta

SEQ ID NO: 489909 - DNA, 25 bp, Homo sapien
cataggctggaaggtcacatgacaa

SEQ ID NO: 489910 - DNA, 25 bp, Homo sapien
ggcagtctggcttcatacttgataa

SEQ ID NO: 489911 - DNA, 25 bp, Homo sapien
gtctggcttcatacttgataagctt

SEQ ID NO: 489912 - DNA, 25 bp, Homo sapien
cttaatcacaatgccaaactggtaa

SEQ ID NO: 489913 - DNA, 25 bp, Homo sapien
atgccaaactggtaaatagctgtgt

SEQ ID NO: 489914 - DNA, 25 bp, Homo sapien
aaatagctgtgtggcataatttcag

SEQ ID NO: 489915 - DNA, 25 bp, Homo sapien
gtgtggcataatttcaggtagtgat

SEQ ID NO: 489916 - DNA, 25 bp, Homo sapien
ggatggctctttggagagactactt

SEQ ID NO: 489917 - DNA, 25 bp, Homo sapien
agagactacttagggatggctttca

SEQ ID NO: 489918 - DNA, 25 bp, Homo sapien
actacttagggatggctttcaggaa

SEQ ID NO: 489919 - DNA, 25 bp, Homo sapien
gagggattgatgtgacttgtgataa

SEQ ID NO: 489920 - DNA, 25 bp, Homo sapien
attggccgggcaaggcggtgcacgc

SEQ ID NO: 489921 - DNA, 25 bp, Homo sapien
ttggccgggcaaggcggtgcacgcc

SEQ ID NO: 489922 - DNA, 25 bp, Homo sapien
gcaaggcggtgcacgcctgaagtcc

SEQ ID NO: 489923 - DNA, 25 bp, Homo sapien
ggcggtgcacgcctgaagtccgggc

SEQ ID NO: 489924 - DNA, 25 bp, Homo sapien
gcggtgcacgcctgaagtccgggct

SEQ ID NO: 489925 - DNA, 25 bp, Homo sapien
cggtgcacgcctgaagtccgggctg

SEQ ID NO: 489926 - DNA, 25 bp, Homo sapien
ggtgcacgcctgaagtccgggctgc

SEQ ID NO: 489927 - DNA, 25 bp, Homo sapien
gtgcacgcctgaagtccgggctgct

SEQ ID NO: 489928 - DNA, 25 bp, Homo sapien
gcacgcctgaagtccgggctgctct

SEQ ID NO: 489929 - DNA, 25 bp, Homo sapien
cacgcctgaagtccgggctgctctg

SEQ ID NO: 489930 - DNA, 25 bp, Homo sapien
cgcctgaagtccgggctgctctgga

SEQ ID NO: 489931 - DNA, 25 bp, Homo sapien
accatggcctgttcgatctagttgt

SEQ ID NO: 489932 - DNA, 25 bp, Homo sapien
gatctagttgtctatggccaccacg

SEQ ID NO: 489933 - DNA, 25 bp, Homo sapien
gctccggaagcactgccaagacaaa

SEQ ID NO: 489934 - DNA, 25 bp, Homo sapien
attacccactcggttctactcttga

SEQ ID NO: 489935 - DNA, 25 bp, Homo sapien
ccactcggttctactcttgagtaca

SEQ ID NO: 489936 - DNA, 25 bp, Homo sapien
ctcttgagtacatggcagttgtggc

SEQ ID NO: 489937 - DNA, 25 bp, Homo sapien
tggcccagagttccggacagtttgt

SEQ ID NO: 489938 - DNA, 25 bp, Homo sapien
agttccggacagtttgtccccagat

SEQ ID NO: 489939 - DNA, 25 bp, Homo sapien
agtttgtccccagatccttccttgg

SEQ ID NO: 489940 - DNA, 25 bp, Homo sapien
ttggcccctgcaggaagctgcatct

SEQ ID NO: 489941 - DNA, 25 bp, Homo sapien
aggaagctgcatctcctcatccagg

SEQ ID NO: 489942 - DNA, 25 bp, Homo sapien
ttgaacaatgatttacagttttcag

SEQ ID NO: 489943 - DNA, 25 bp, Homo sapien
acagttttcagtgtagaagtcttac

SEQ ID NO: 489944 - DNA, 25 bp, Homo sapien
gtagaagtcttacactttccttgtt

SEQ ID NO: 489945 - DNA, 25 bp, Homo sapien
tagaagtcttacactttccttgtta

SEQ ID NO: 489946 - DNA, 25 bp, Homo sapien
taaatttattcctaactattgtagt

SEQ ID NO: 489947 - DNA, 25 bp, Homo sapien
taactattgtagtttgggatgcaat

SEQ ID NO: 489948 - DNA, 25 bp, Homo sapien
gtagtttgggatgcaattttaaata

SEQ ID NO: 489949 - DNA, 25 bp, Homo sapien
tatcctgcaaacttgctaaacttgt

SEQ ID NO: 489950 - DNA, 25 bp, Homo sapien
gctaaacttgtttattagttccaat

SEQ ID NO: 489951 - DNA, 25 bp, Homo sapien
tattcaaaagtcatgtaatctgcaa

SEQ ID NO: 489952 - DNA, 25 bp, Homo sapien
gtcatgtaatctgcaataaagtttt

SEQ ID NO: 489953 - DNA, 25 bp, Homo sapien
gaagaaattccagcagtcctgtagc

SEQ ID NO: 489954 - DNA, 25 bp, Homo sapien
gaaattccagcagtcctgtagcttc

SEQ ID NO: 489955 - DNA, 25 bp, Homo sapien
cagcagtcctgtagcttccacagga

SEQ ID NO: 489956 - DNA, 25 bp, Homo sapien
gtagcttccacaggactagaaatat

SEQ ID NO: 489957 - DNA, 25 bp, Homo sapien
tcattctgcatgaagtgatgggtgt

SEQ ID NO: 489958 - DNA, 25 bp, Homo sapien
gatgggtgtatggatgttatttaat

SEQ ID NO: 489959 - DNA, 25 bp, Homo sapien
cataacttagattcacatcccactt

SEQ ID NO: 489960 - DNA, 25 bp, Homo sapien
cacatcccactttgagaatatctcc

SEQ ID NO: 489961 - DNA, 25 bp, Homo sapien
atgccaactagcctaccgcgtggat

SEQ ID NO: 489962 - DNA, 25 bp, Homo sapien
ctagcctaccgcgtggatcacggag

SEQ ID NO: 489963 - DNA, 25 bp, Homo sapien
gtggatcacggagctcactgacgag

SEQ ID NO: 489964 - DNA, 25 bp, Homo sapien
cgcgtcgacggcaaaggagactgct

SEQ ID NO: 489965 - DNA, 25 bp, Homo sapien
cgtcgacggcaaaggagactgctga

SEQ ID NO: 489966 - DNA, 25 bp, Homo sapien
gagactgctgaggctgttgctgatg

SEQ ID NO: 489967 - DNA, 25 bp, Homo sapien
aggctgggccacttgttgctgtgtc

SEQ ID NO: 489968 - DNA, 25 bp, Homo sapien
ggctgggccacttgttgctgtgtct

SEQ ID NO: 489969 - DNA, 25 bp, Homo sapien
gctgggccacttgttgctgtgtctg

SEQ ID NO: 489970 - DNA, 25 bp, Homo sapien
ctgggccacttgttgctgtgtctgc

SEQ ID NO: 489971 - DNA, 25 bp, Homo sapien
tgggccacttgttgctgtgtctgct

SEQ ID NO: 489972 - DNA, 25 bp, Homo sapien
gggccacttgttgctgtgtctgctg

SEQ ID NO: 489973 - DNA, 25 bp, Homo sapien
ggccacttgttgctgtgtctgctgt

SEQ ID NO: 489974 - DNA, 25 bp, Homo sapien
gccacttgttgctgtgtctgctgtt

SEQ ID NO: 489975 - DNA, 25 bp, Homo sapien
ttgaacaatgatttacagttttcag

SEQ ID NO: 489976 - DNA, 25 bp, Homo sapien
acagttttcagtgtagaagtcttac

SEQ ID NO: 489977 - DNA, 25 bp, Homo sapien
gtagaagtcttacactttccttgtt

SEQ ID NO: 489978 - DNA, 25 bp, Homo sapien
taaatttattcctaactattgtagt

SEQ ID NO: 489979 - DNA, 25 bp, Homo sapien
taactattgtagtttgggatgcaat

SEQ ID NO: 489980 - DNA, 25 bp, Homo sapien
cagattttcattgctagtgtacagc

SEQ ID NO: 489981 - DNA, 25 bp, Homo sapien
tatattgatcttatatcctgcaaac

SEQ ID NO: 489982 - DNA, 25 bp, Homo sapien
tatcctgcaaacttgctaaacttgt

SEQ ID NO: 489983 - DNA, 25 bp, Homo sapien
gctaaacttgtttattagttccaat

SEQ ID NO: 489984 - DNA, 25 bp, Homo sapien
tattcaaaagtcatgtaatctgcaa

SEQ ID NO: 489985 - DNA, 25 bp, Homo sapien
gtcatgtaatctgcaataaagtttt

SEQ ID NO: 489986 - DNA, 25 bp, Homo sapien
actgtgaggccctgatacctgagct

SEQ ID NO: 489987 - DNA, 25 bp, Homo sapien
gaggccctgatacctgagctaactt

SEQ ID NO: 489988 - DNA, 25 bp, Homo sapien
gagctaacttcatattattacctct

SEQ ID NO: 489989 - DNA, 25 bp, Homo sapien
acttcatattattacctctacagca

SEQ ID NO: 489990 - DNA, 25 bp, Homo sapien
ttacctctacagcaagtgtccgtga

SEQ ID NO: 489991 - DNA, 25 bp, Homo sapien
ctacagcaagtgtccgtgagaacat

SEQ ID NO: 489992 - DNA, 25 bp, Homo sapien
gcaagtgtccgtgagaacatagata

SEQ ID NO: 489993 - DNA, 25 bp, Homo sapien
atgtgagtacacaatttacagaaga

SEQ ID NO: 489994 - DNA, 25 bp, Homo sapien
tacagaagaggaactacccttccaa

SEQ ID NO: 489995 - DNA, 25 bp, Homo sapien
aggatcgattaagcccaggaacttg

SEQ ID NO: 489996 - DNA, 25 bp, Homo sapien
taagcccaggaacttgaggttgaag

SEQ ID NO: 489997 - DNA, 25 bp, Homo sapien
aagctaccttttgtaagtgccatgt

SEQ ID NO: 489998 - DNA, 25 bp, Homo sapien
agctaccttttgtaagtgccatgtt

SEQ ID NO: 489999 - DNA, 25 bp, Homo sapien
gctaccttttgtaagtgccatgttt

SEQ ID NO: 490000 - DNA, 25 bp, Homo sapien
ctaccttttgtaagtgccatgttta

SEQ ID NO: 490001 - DNA, 25 bp, Homo sapien
taccttttgtaagtgccatgtttat

SEQ ID NO: 490002 - DNA, 25 bp, Homo sapien
accttttgtaagtgccatgtttatt

SEQ ID NO: 490003 - DNA, 25 bp, Homo sapien
ccttttgtaagtgccatgtttatta

SEQ ID NO: 490004 - DNA, 25 bp, Homo sapien
cttttgtaagtgccatgtttattat

SEQ ID NO: 490005 - DNA, 25 bp, Homo sapien
ttttgtaagtgccatgtttattatc

SEQ ID NO: 490006 - DNA, 25 bp, Homo sapien
tcctttctttcaaggacagtgtttt

SEQ ID NO: 490007 - DNA, 25 bp, Homo sapien
tgttttttgtagtaaaatcactggt

SEQ ID NO: 490008 - DNA, 25 bp, Homo sapien
cttcctcctgagtatgcataaacat

SEQ ID NO: 490009 - DNA, 25 bp, Homo sapien
ataaacattcacagcttgcatgcgt

SEQ ID NO: 490010 - DNA, 25 bp, Homo sapien
taaacattcacagcttgcatgcgtg

SEQ ID NO: 490011 - DNA, 25 bp, Homo sapien
tgtgtgtatgtttgcttgcactgca

SEQ ID NO: 490012 - DNA, 25 bp, Homo sapien
gtgtatgtttgcttgcactgcataa

SEQ ID NO: 490013 - DNA, 25 bp, Homo sapien
aaacaattgcaacatcaacagaaat

SEQ ID NO: 490014 - DNA, 25 bp, Homo sapien
aaggaataattctcctccgactctg

SEQ ID NO: 490015 - DNA, 25 bp, Homo sapien
aggaataattctcctccgactctgc

SEQ ID NO: 490016 - DNA, 25 bp, Homo sapien
aataattctcctccgactctgccgt

SEQ ID NO: 490017 - DNA, 25 bp, Homo sapien
gttgacataacggtctgttttcaag

SEQ ID NO: 490018 - DNA, 25 bp, Homo sapien
gtctgttttcaaggcagtttccgga

SEQ ID NO: 490019 - DNA, 25 bp, Homo sapien
gcgtgctgagaccaggcctgagtga

SEQ ID NO: 490020 - DNA, 25 bp, Homo sapien
gatgccctgccgtttcccatagctg

SEQ ID NO: 490021 - DNA, 25 bp, Homo sapien
cgtttcccatagctggccagcagtg

SEQ ID NO: 490022 - DNA, 25 bp, Homo sapien
agcagtggtgtcctctcagagacca

SEQ ID NO: 490023 - DNA, 25 bp, Homo sapien
agtggtgtcctctcagagaccagca

SEQ ID NO: 490024 - DNA, 25 bp, Homo sapien
ccatcagccgccgtgtgcctgcagg

SEQ ID NO: 490025 - DNA, 25 bp, Homo sapien
gttgcggcttcgtctcctgcggccg

SEQ ID NO: 490026 - DNA, 25 bp, Homo sapien
ctatgacaggccttctcttgggttt

SEQ ID NO: 490027 - DNA, 25 bp, Homo sapien
gtttctcagccattgtatgagtctt

SEQ ID NO: 490028 - DNA, 25 bp, Homo sapien
tcagccattgtatgagtctttgtat

SEQ ID NO: 490029 - DNA, 25 bp, Homo sapien
gccattgtatgagtctttgtatatt

SEQ ID NO: 490030 - DNA, 25 bp, Homo sapien
ggcaggcaaagcaccgcaagcacaa

SEQ ID NO: 490031 - DNA, 25 bp, Homo sapien
gcaccgcaagcacaaagtttggcca

SEQ ID NO: 490032 - DNA, 25 bp, Homo sapien
caatgtttaaagtgttccatgtaac

SEQ ID NO: 490033 - DNA, 25 bp, Homo sapien
ggacaaagctggtttttactctcca

SEQ ID NO: 490034 - DNA, 25 bp, Homo sapien
tttactctccagagtgttgcacgga

SEQ ID NO: 490035 - DNA, 25 bp, Homo sapien
ttaagcgcatgcgagagctctgtgc

SEQ ID NO: 490036 - DNA, 25 bp, Homo sapien
gagctctgtgcgctttacaggacct

SEQ ID NO: 490037 - DNA, 25 bp, Homo sapien
gacctctggaagcaactactcctga

SEQ ID NO: 490038 - DNA, 25 bp, Homo sapien
gaagcaactactcctgattaacctc

SEQ ID NO: 490039 - DNA, 25 bp, Homo sapien
ctactcctgattaacctcggtgaag

SEQ ID NO: 490040 - DNA, 25 bp, Homo sapien
aggaaaacttcgtggctgaagatgt

SEQ ID NO: 490041 - DNA, 25 bp, Homo sapien
acttggatgataaatgcagtcattt

SEQ ID NO: 490042 - DNA, 25 bp, Homo sapien
ataaatgcagtcattttattctcaa

SEQ ID NO: 490043 - DNA, 25 bp, Homo sapien
cattttattctcaagtgcttaaaat

SEQ ID NO: 490044 - DNA, 25 bp, Homo sapien
attctcaagtgcttaaaattaatgt

SEQ ID NO: 490045 - DNA, 25 bp, Homo sapien
aattaaaagcttagctgactacaga

SEQ ID NO: 490046 - DNA, 25 bp, Homo sapien
aaagcttagctgactacagaatagg

SEQ ID NO: 490047 - DNA, 25 bp, Homo sapien
gcttagctgactacagaataggtga

SEQ ID NO: 490048 - DNA, 25 bp, Homo sapien
ctgactacagaataggtgagggttt

SEQ ID NO: 490049 - DNA, 25 bp, Homo sapien
gactacagaataggtgagggtttct

SEQ ID NO: 490050 - DNA, 25 bp, Homo sapien
ggtgagggtttcttaaaaatgagat

SEQ ID NO: 490051 - DNA, 25 bp, Homo sapien
taaaaatgagatttaagggctgggc

SEQ ID NO: 490052 - DNA, 25 bp, Homo sapien
acgcagcctgtgcagtaaagaattt

SEQ ID NO: 490053 - DNA, 25 bp, Homo sapien
tcttgcccaaaaagatgtctagtct

SEQ ID NO: 490054 - DNA, 25 bp, Homo sapien
agtctttgccctaagcttcttggaa

SEQ ID NO: 490055 - DNA, 25 bp, Homo sapien
gccctaagcttcttggaatatcatg

SEQ ID NO: 490056 - DNA, 25 bp, Homo sapien
aatatcatgccaaagaggagtgtct

SEQ ID NO: 490057 - DNA, 25 bp, Homo sapien
caaagaggagtgtctttgtttgcct

SEQ ID NO: 490058 - DNA, 25 bp, Homo sapien
gggaccttgggttacattagatagt

SEQ ID NO: 490059 - DNA, 25 bp, Homo sapien
gggctggctacaccagaaagaccaa

SEQ ID NO: 490060 - DNA, 25 bp, Homo sapien
caccagaaagaccaacagggtggtt

SEQ ID NO: 490061 - DNA, 25 bp, Homo sapien
ccatgtgggcaatcagtgaagttta

SEQ ID NO: 490062 - DNA, 25 bp, Homo sapien
agtttatgtaatgaagccctaataa

SEQ ID NO: 490063 - DNA, 25 bp, Homo sapien
gtaaaatgcccactgagaactctct

SEQ ID NO: 490064 - DNA, 25 bp, Homo sapien
aatgcccactgagaactctcttaag

SEQ ID NO: 490065 - DNA, 25 bp, Homo sapien
gaactctcttaagactacctttctc

SEQ ID NO: 490066 - DNA, 25 bp, Homo sapien
tctcttaagactacctttctccaaa

SEQ ID NO: 490067 - DNA, 25 bp, Homo sapien
aagactacctttctccaaatggtgc

SEQ ID NO: 490068 - DNA, 25 bp, Homo sapien
aaatggtgcccttcactcaagcctg

SEQ ID NO: 490069 - DNA, 25 bp, Homo sapien
actcaagcctgtggttttggtctta

SEQ ID NO: 490070 - DNA, 25 bp, Homo sapien
gcctgtggttttggtcttaggaact

SEQ ID NO: 490071 - DNA, 25 bp, Homo sapien
ttttggtcttaggaactttgctgcc

SEQ ID NO: 490072 - DNA, 25 bp, Homo sapien
gtaatttacaccttacgaggccact

SEQ ID NO: 490073 - DNA, 25 bp, Homo sapien
cttacgaggccactcggtttctcag

SEQ ID NO: 490074 - DNA, 25 bp, Homo sapien
cagcggactctccacgcccagctag

SEQ ID NO: 490075 - DNA, 25 bp, Homo sapien
agcggactctccacgcccagctagc

SEQ ID NO: 490076 - DNA, 25 bp, Homo sapien
gcggactctccacgcccagctagct

SEQ ID NO: 490077 - DNA, 25 bp, Homo sapien
actctccacgcccagctagctctcg

SEQ ID NO: 490078 - DNA, 25 bp, Homo sapien
ctccacgcccagctagctctcgcct

SEQ ID NO: 490079 - DNA, 25 bp, Homo sapien
tttaggcccagctcattcctcacaa

SEQ ID NO: 490080 - DNA, 25 bp, Homo sapien
ttatcttttgtgtataaatcccaaa

SEQ ID NO: 490081 - DNA, 25 bp, Homo sapien
tatcttttgtgtataaatcccaaaa

SEQ ID NO: 490082 - DNA, 25 bp, Homo sapien
atcttttgtgtataaatcccaaaat

SEQ ID NO: 490083 - DNA, 25 bp, Homo sapien
ttgtgtataaatcccaaaatatgga

SEQ ID NO: 490084 - DNA, 25 bp, Homo sapien
gtataaatcccaaaatatggaattt

SEQ ID NO: 490085 - DNA, 25 bp, Homo sapien
tcagcctccctgctgggacagggac

SEQ ID NO: 490086 - DNA, 25 bp, Homo sapien
tgctgggacagggacctatggcacc

SEQ ID NO: 490087 - DNA, 25 bp, Homo sapien
gctgggacagggacctatggcacct

SEQ ID NO: 490088 - DNA, 25 bp, Homo sapien
ctgggacagggacctatggcacctg

SEQ ID NO: 490089 - DNA, 25 bp, Homo sapien
tgggacagggacctatggcacctgg

SEQ ID NO: 490090 - DNA, 25 bp, Homo sapien
gggacagggacctatggcacctggg

SEQ ID NO: 490091 - DNA, 25 bp, Homo sapien
tcccagcccagggtccaacctgacc

SEQ ID NO: 490092 - DNA, 25 bp, Homo sapien
ccagcccagggtccaacctgaccca

SEQ ID NO: 490093 - DNA, 25 bp, Homo sapien
agcaggcctgggtggccacttttct

SEQ ID NO: 490094 - DNA, 25 bp, Homo sapien
gcaggcctgggtggccacttttctg

SEQ ID NO: 490095 - DNA, 25 bp, Homo sapien
atcagcctccctgctgggacaggga

SEQ ID NO: 490096 - DNA, 25 bp, Homo sapien
gcccttgcccatgcgttgcaagaaa

SEQ ID NO: 490097 - DNA, 25 bp, Homo sapien
atgccacccagaaagaacagttgct

SEQ ID NO: 490098 - DNA, 25 bp, Homo sapien
ttgctcagggttcaacttgctacaa

SEQ ID NO: 490099 - DNA, 25 bp, Homo sapien
acaagtattggcaaccctccagttt

SEQ ID NO: 490100 - DNA, 25 bp, Homo sapien
gtttctttacttcaacagtgcacca

SEQ ID NO: 490101 - DNA, 25 bp, Homo sapien
accaatattctttcacagggaagca

SEQ ID NO: 490102 - DNA, 25 bp, Homo sapien
gtacctggctaagcaattgtcccat

SEQ ID NO: 490103 - DNA, 25 bp, Homo sapien
aattgtcccattgcagtaacgcatt

SEQ ID NO: 490104 - DNA, 25 bp, Homo sapien
gcagtaacgcattttcttcacaatt

SEQ ID NO: 490105 - DNA, 25 bp, Homo sapien
cttcacaattcagccaatgttccat

SEQ ID NO: 490106 - DNA, 25 bp, Homo sapien
gaagagcagttggtccaaggcttat

SEQ ID NO: 490107 - DNA, 25 bp, Homo sapien
tatgtgatgctctagaaaatagtca

SEQ ID NO: 490108 - DNA, 25 bp, Homo sapien
ttaataatgccttagatgatagtct

SEQ ID NO: 490109 - DNA, 25 bp, Homo sapien
ggttgaggtctacctaacctaagct

SEQ ID NO: 490110 - DNA, 25 bp, Homo sapien
tacctaacctaagctgcttcctgga

SEQ ID NO: 490111 - DNA, 25 bp, Homo sapien
gctgcttcctggaaagcttcatgtt

SEQ ID NO: 490112 - DNA, 25 bp, Homo sapien
tgaaagaacctatgggtggcaccat

SEQ ID NO: 490113 - DNA, 25 bp, Homo sapien
tatgggtggcaccatgtggactttt

SEQ ID NO: 490114 - DNA, 25 bp, Homo sapien
acttttctgtccctactgtgatgaa

SEQ ID NO: 490115 - DNA, 25 bp, Homo sapien
tactgtgatgaatagccccaccctt

SEQ ID NO: 490116 - DNA, 25 bp, Homo sapien
atgtcagtactgaattcctgcttgt

SEQ ID NO: 490117 - DNA, 25 bp, Homo sapien
agtactgaattcctgcttgttaatt

SEQ ID NO: 490118 - DNA, 25 bp, Homo sapien
gaagctggattctgaccccaccact

SEQ ID NO: 490119 - DNA, 25 bp, Homo sapien
ctcagacggcgggattaaaccaggc

SEQ ID NO: 490120 - DNA, 25 bp, Homo sapien
cggcgggattaaaccaggcagtaca

SEQ ID NO: 490121 - DNA, 25 bp, Homo sapien
accaggcagtacagggttactcggg

SEQ ID NO: 490122 - DNA, 25 bp, Homo sapien
tgctgggatttcctgtcgctttagc

SEQ ID NO: 490123 - DNA, 25 bp, Homo sapien
gatttcctgtcgctttagccagaat

SEQ ID NO: 490124 - DNA, 25 bp, Homo sapien
tagccagaataatccaggtatatgg

SEQ ID NO: 490125 - DNA, 25 bp, Homo sapien
gataatctgaaagagtttctcattt

SEQ ID NO: 490126 - DNA, 25 bp, Homo sapien
tatatttgtggaacatcgtgtaaga

SEQ ID NO: 490127 - DNA, 25 bp, Homo sapien
aactgaagagcaagtgcctgaaata

SEQ ID NO: 490128 - DNA, 25 bp, Homo sapien
agagcaagtgcctgaaataaaatcc

SEQ ID NO: 490129 - DNA, 25 bp, Homo sapien
gcattgattaatttaactggctttt

SEQ ID NO: 490130 - DNA, 25 bp, Homo sapien
tggcttttaaatatccccttccgct

SEQ ID NO: 490131 - DNA, 25 bp, Homo sapien
atccccttccgctgatatttgttgt

SEQ ID NO: 490132 - DNA, 25 bp, Homo sapien
cttccgctgatatttgttgtcagct

SEQ ID NO: 490133 - DNA, 25 bp, Homo sapien
gttgtcagctgcctacagtttaata

SEQ ID NO: 490134 - DNA, 25 bp, Homo sapien
cagtttaatatgcagcgttcacaaa

SEQ ID NO: 490135 - DNA, 25 bp, Homo sapien
aatatgcagcgttcacaaaacagct

SEQ ID NO: 490136 - DNA, 25 bp, Homo sapien
gccagtgctacaattaatgaagcaa

SEQ ID NO: 490137 - DNA, 25 bp, Homo sapien
attagcatcaatactttgacattca

SEQ ID NO: 490138 - DNA, 25 bp, Homo sapien
ttgacattcattacattggtttggg

SEQ ID NO: 490139 - DNA, 25 bp, Homo sapien
tgttccttgtgggagactttggcga

SEQ ID NO: 490140 - DNA, 25 bp, Homo sapien
gtaagtttgcaggtaaaaacattgt

SEQ ID NO: 490141 - DNA, 25 bp, Homo sapien
taagtttgcaggtaaaaacattgtc

SEQ ID NO: 490142 - DNA, 25 bp, Homo sapien
aagtttgcaggtaaaaacattgtca

SEQ ID NO: 490143 - DNA, 25 bp, Homo sapien
agtttgcaggtaaaaacattgtcaa

SEQ ID NO: 490144 - DNA, 25 bp, Homo sapien
gtttgcaggtaaaaacattgtcaac

SEQ ID NO: 490145 - DNA, 25 bp, Homo sapien
tttgcaggtaaaaacattgtcaact

SEQ ID NO: 490146 - DNA, 25 bp, Homo sapien
ttgcaggtaaaaacattgtcaacta

SEQ ID NO: 490147 - DNA, 25 bp, Homo sapien
tgcaggtaaaaacattgtcaactaa

SEQ ID NO: 490148 - DNA, 25 bp, Homo sapien
gcaggtaaaaacattgtcaactaaa

SEQ ID NO: 490149 - DNA, 25 bp, Homo sapien
aacattgtcaactaaacaaacaagc

SEQ ID NO: 490150 - DNA, 25 bp, Homo sapien
cattgtcaactaaacaaacaagcaa

SEQ ID NO: 490151 - DNA, 25 bp, Homo sapien
aactcattgccatgacaactctttg

SEQ ID NO: 490152 - DNA, 25 bp, Homo sapien
aactctttgtactgtgtccgtgcca

SEQ ID NO: 490153 - DNA, 25 bp, Homo sapien
gtgtccgtgccacagatctgttggt

SEQ ID NO: 490154 - DNA, 25 bp, Homo sapien
gccacagatctgttggtcacattgt

SEQ ID NO: 490155 - DNA, 25 bp, Homo sapien
cagatctgttggtcacattgttaat

SEQ ID NO: 490156 - DNA, 25 bp, Homo sapien
tggagacggtcaatttttacatttt

SEQ ID NO: 490157 - DNA, 25 bp, Homo sapien
gaaatatctgtgtgttgcaattcaa

SEQ ID NO: 490158 - DNA, 25 bp, Homo sapien
ttgtgaaaagcgcttcagtgccact

SEQ ID NO: 490159 - DNA, 25 bp, Homo sapien
aaagcgcttcagtgccactagctta

SEQ ID NO: 490160 - DNA, 25 bp, Homo sapien
gtgccactagcttaccggtacacta

SEQ ID NO: 490161 - DNA, 25 bp, Homo sapien
ccggtacactagactaagcccttga

SEQ ID NO: 490162 - DNA, 25 bp, Homo sapien
ttggctcagcgcctggtaccagctt

SEQ ID NO: 490163 - DNA, 25 bp, Homo sapien
cctggtaccagcttccttgggtcag

SEQ ID NO: 490164 - DNA, 25 bp, Homo sapien
tcctcatccatggagaagtggtaca

SEQ ID NO: 490165 - DNA, 25 bp, Homo sapien
gaagtggtacacaagagcaagcaga

SEQ ID NO: 490166 - DNA, 25 bp, Homo sapien
agagcaagcagaacctctctgaccg

SEQ ID NO: 490167 - DNA, 25 bp, Homo sapien
aggcctacactttccacctcatgga

SEQ ID NO: 490168 - DNA, 25 bp, Homo sapien
tacactttccacctcatggaggcct

SEQ ID NO: 490169 - DNA, 25 bp, Homo sapien
ttccccaactgtacacctaaaggct

SEQ ID NO: 490170 - DNA, 25 bp, Homo sapien
tgtacacctaaaggctctcgcaggg

SEQ ID NO: 490171 - DNA, 25 bp, Homo sapien
acctaaaggctctcgcagggcagga

SEQ ID NO: 490172 - DNA, 25 bp, Homo sapien
aaaggctctcgcagggcaggagccc

SEQ ID NO: 490173 - DNA, 25 bp, Homo sapien
tgggccattctctgatgcagggcac

SEQ ID NO: 490174 - DNA, 25 bp, Homo sapien
tgatgcagggcacttgctccacact

SEQ ID NO: 490175 - DNA, 25 bp, Homo sapien
agtctgccctgtcacgtagttgaag

SEQ ID NO: 490176 - DNA, 25 bp, Homo sapien
tgcatttatctttctggctcctaat

SEQ ID NO: 490177 - DNA, 25 bp, Homo sapien
tctttctggctcctaattcctttaa

SEQ ID NO: 490178 - DNA, 25 bp, Homo sapien
tttgttgcagaacctccacaaggct

SEQ ID NO: 490179 - DNA, 25 bp, Homo sapien
ataaaccattaactggccatcctgg

SEQ ID NO: 490180 - DNA, 25 bp, Homo sapien
ggccatcctggttttgcagagatca

SEQ ID NO: 490181 - DNA, 25 bp, Homo sapien
cagagatcaggttgttgacagttcc

SEQ ID NO: 490182 - DNA, 25 bp, Homo sapien
acagttcctggttgacccacagcta

SEQ ID NO: 490183 - DNA, 25 bp, Homo sapien
cacagctacccatgtcagttatctc

SEQ ID NO: 490184 - DNA, 25 bp, Homo sapien
agaacttttagcatcctgggaagag

SEQ ID NO: 490185 - DNA, 25 bp, Homo sapien
gaacaacttttgtaggactgtgtgt

SEQ ID NO: 490186 - DNA, 25 bp, Homo sapien
ggactgtgtgtttctttagatacat

SEQ ID NO: 490187 - DNA, 25 bp, Homo sapien
gtacaactgtaggtgacgagtagtc

SEQ ID NO: 490188 - DNA, 25 bp, Homo sapien
gtagtcagttattgcttgctagcta

SEQ ID NO: 490189 - DNA, 25 bp, Homo sapien
ttgctagctacacaccagggttgat

SEQ ID NO: 490190 - DNA, 25 bp, Homo sapien
cacaccagggttgatccattttaaa

SEQ ID NO: 490191 - DNA, 25 bp, Homo sapien
cttttggcattttgtcctcatgggc

SEQ ID NO: 490192 - DNA, 25 bp, Homo sapien
gcattttgtcctcatgggccataaa

SEQ ID NO: 490193 - DNA, 25 bp, Homo sapien
ggaggcacatgcacaatctccatgt

SEQ ID NO: 490194 - DNA, 25 bp, Homo sapien
ccatgtaacaaacctttagcagtag

SEQ ID NO: 490195 - DNA, 25 bp, Homo sapien
gtaactacaacattccaactcctga

SEQ ID NO: 490196 - DNA, 25 bp, Homo sapien
gacttttgagagttcagattttgtt

SEQ ID NO: 490197 - DNA, 25 bp, Homo sapien
gttttcttacattctggagaaccga

SEQ ID NO: 490198 - DNA, 25 bp, Homo sapien
tggagaaccgaagctcagctcagcc

SEQ ID NO: 490199 - DNA, 25 bp, Homo sapien
taaggctagaggtgagcatgtccct

SEQ ID NO: 490200 - DNA, 25 bp, Homo sapien
gaggtgagcatgtccctcacaattg

SEQ ID NO: 490201 - DNA, 25 bp, Homo sapien
gtccctcacaattgcacatgtcaag

SEQ ID NO: 490202 - DNA, 25 bp, Homo sapien
caattgcacatgtcaagccatcagc

SEQ ID NO: 490203 - DNA, 25 bp, Homo sapien
gtcaagccatcagcaaggcgcatca

SEQ ID NO: 490204 - DNA, 25 bp, Homo sapien
aggcgcatcacacaaaaggcaccaa

SEQ ID NO: 490205 - DNA, 25 bp, Homo sapien
caaaaggcaccaagacgtgaaactt

SEQ ID NO: 490206 - DNA, 25 bp, Homo sapien
gacggcgcgggacgactgggacaga

SEQ ID NO: 490207 - DNA, 25 bp, Homo sapien
cagccccaggcgaccacgtggtggt

SEQ ID NO: 490208 - DNA, 25 bp, Homo sapien
acgtggtggtaccttctcatggatc

SEQ ID NO: 490209 - DNA, 25 bp, Homo sapien
ttctcatggatctcctgcgtggact

SEQ ID NO: 490210 - DNA, 25 bp, Homo sapien
tcatggatctcctgcgtggactgcg

SEQ ID NO: 490211 - DNA, 25 bp, Homo sapien
gatctcctgcgtggactgcgcgtcg

SEQ ID NO: 490212 - DNA, 25 bp, Homo sapien
ctgcgcgtcgcagaaggccacagtg

SEQ ID NO: 490213 - DNA, 25 bp, Homo sapien
acagtggccacgtccttcaggatgg

SEQ ID NO: 490214 - DNA, 25 bp, Homo sapien
acgtccttcaggatgggcatctcca

SEQ ID NO: 490215 - DNA, 25 bp, Homo sapien
gatgggcatctccactgtgcagtcc

SEQ ID NO: 490216 - DNA, 25 bp, Homo sapien
gtgcagtcccggccatccagcaatg

SEQ ID NO: 490217 - DNA, 25 bp, Homo sapien
taaagttatgtaaatatgtagctat

SEQ ID NO: 490218 - DNA, 25 bp, Homo sapien
gttgtgaacataactattgtgaata

SEQ ID NO: 490219 - DNA, 25 bp, Homo sapien
ttgtgaacataactattgtgaatac

SEQ ID NO: 490220 - DNA, 25 bp, Homo sapien
tgtgaacataactattgtgaatact

SEQ ID NO: 490221 - DNA, 25 bp, Homo sapien
gtgaacataactattgtgaatacta

SEQ ID NO: 490222 - DNA, 25 bp, Homo sapien
tgaacataactattgtgaatactat

SEQ ID NO: 490223 - DNA, 25 bp, Homo sapien
gaacataactattgtgaatactatg

SEQ ID NO: 490224 - DNA, 25 bp, Homo sapien
actattgtgaatactatgttatatg

SEQ ID NO: 490225 - DNA, 25 bp, Homo sapien
ctattgtgaatactatgttatatgt

SEQ ID NO: 490226 - DNA, 25 bp, Homo sapien
ttgtgaatactatgttatatgttat

SEQ ID NO: 490227 - DNA, 25 bp, Homo sapien
gttatatgttatagttgtgaatgta

SEQ ID NO: 490228 - DNA, 25 bp, Homo sapien
tagggacttcctgatgcacaggaag

SEQ ID NO: 490229 - DNA, 25 bp, Homo sapien
ttagctcaacccaaagccatagcca

SEQ ID NO: 490230 - DNA, 25 bp, Homo sapien
tccctggcatctgagaagagtcatt

SEQ ID NO: 490231 - DNA, 25 bp, Homo sapien
tggaaggtgatatcaagaagcctct

SEQ ID NO: 490232 - DNA, 25 bp, Homo sapien
aagaagcctctgttagcctggtctg

SEQ ID NO: 490233 - DNA, 25 bp, Homo sapien
ctctgttagcctggtctggttcctg

SEQ ID NO: 490234 - DNA, 25 bp, Homo sapien
tgctctcccttcaggaaggcggctg

SEQ ID NO: 490235 - DNA, 25 bp, Homo sapien
aaggcggctgtctactcaccactgt

SEQ ID NO: 490236 - DNA, 25 bp, Homo sapien
actgtgcctttctggaaagcaggag

SEQ ID NO: 490237 - DNA, 25 bp, Homo sapien
ttctggaaagcaggagtcaagcctt

SEQ ID NO: 490238 - DNA, 25 bp, Homo sapien
ggagtcaagccttagaaagccagag

SEQ ID NO: 490239 - DNA, 25 bp, Homo sapien
ataaataggattttcaccggcaatt

SEQ ID NO: 490240 - DNA, 25 bp, Homo sapien
ataggattttcaccggcaatttaga

SEQ ID NO: 490241 - DNA, 25 bp, Homo sapien
gattttcaccggcaatttagagacc

SEQ ID NO: 490242 - DNA, 25 bp, Homo sapien
ttcaccggcaatttagagaccagct

SEQ ID NO: 490243 - DNA, 25 bp, Homo sapien
ggcaatttagagaccagctttacgt

SEQ ID NO: 490244 - DNA, 25 bp, Homo sapien
ggaaattgcctacttgcaatcagtg

SEQ ID NO: 490245 - DNA, 25 bp, Homo sapien
gcgtgtcccatttggcattcatttt

SEQ ID NO: 490246 - DNA, 25 bp, Homo sapien
gcctacttgcaatcagtgtgtggat

SEQ ID NO: 490247 - DNA, 25 bp, Homo sapien
aatcagtgtgtggatttgcacggca

SEQ ID NO: 490248 - DNA, 25 bp, Homo sapien
gtgtgtggatttgcacggcagtatc

SEQ ID NO: 490249 - DNA, 25 bp, Homo sapien
gttacggcactcttataaataggat

SEQ ID NO: 490250 - DNA, 25 bp, Homo sapien
ataagcctgattagcattttgtaag

SEQ ID NO: 490251 - DNA, 25 bp, Homo sapien
aatagccaagacttatcatctgcaa

SEQ ID NO: 490252 - DNA, 25 bp, Homo sapien
aagacttatcatctgcaattgaacc

SEQ ID NO: 490253 - DNA, 25 bp, Homo sapien
gaagtgcttatattttcagaacaca

SEQ ID NO: 490254 - DNA, 25 bp, Homo sapien
agaacacatagtccctaattagagt

SEQ ID NO: 490255 - DNA, 25 bp, Homo sapien
actcctgatggaataagcattctgc

SEQ ID NO: 490256 - DNA, 25 bp, Homo sapien
ttaatttcccagtgccatagggagg

SEQ ID NO: 490257 - DNA, 25 bp, Homo sapien
cagtgccatagggaggtcttgacta

SEQ ID NO: 490258 - DNA, 25 bp, Homo sapien
ggtcttgactattcaaaaactgtct

SEQ ID NO: 490259 - DNA, 25 bp, Homo sapien
aactgtctctaaatcttaggaacta

SEQ ID NO: 490260 - DNA, 25 bp, Homo sapien
ggaactatgctttcaagggctaaac

SEQ ID NO: 490261 - DNA, 25 bp, Homo sapien
tttcttattcctgagggtgtagatg

SEQ ID NO: 490262 - DNA, 25 bp, Homo sapien
ttcttattcctgagggtgtagatga

SEQ ID NO: 490263 - DNA, 25 bp, Homo sapien
tcttattcctgagggtgtagatgag

SEQ ID NO: 490264 - DNA, 25 bp, Homo sapien
ttattcctgagggtgtagatgagcg

SEQ ID NO: 490265 - DNA, 25 bp, Homo sapien
tattcctgagggtgtagatgagcgg

SEQ ID NO: 490266 - DNA, 25 bp, Homo sapien
attcctgagggtgtagatgagcggg

SEQ ID NO: 490267 - DNA, 25 bp, Homo sapien
ttcctgagggtgtagatgagcgggt

SEQ ID NO: 490268 - DNA, 25 bp, Homo sapien
tcctgagggtgtagatgagcgggtt

SEQ ID NO: 490269 - DNA, 25 bp, Homo sapien
gtgtgtatctatttacatgccttag

SEQ ID NO: 490270 - DNA, 25 bp, Homo sapien
tatttacatgccttagcacacgccc

SEQ ID NO: 490271 - DNA, 25 bp, Homo sapien
tgtcgccggaacaaccagaatgctg

SEQ ID NO: 490272 - DNA, 25 bp, Homo sapien
ccagaatgctggtgcgctgccggca

SEQ ID NO: 490273 - DNA, 25 bp, Homo sapien
tgcgctgccggcacagtacaagttg

SEQ ID NO: 490274 - DNA, 25 bp, Homo sapien
tgccggcacagtacaagttgatgaa

SEQ ID NO: 490275 - DNA, 25 bp, Homo sapien
aaaccctaatcagttatcttgtgtg

SEQ ID NO: 490276 - DNA, 25 bp, Homo sapien
gaaactccatagtattccttgtaga

SEQ ID NO: 490277 - DNA, 25 bp, Homo sapien
gaatatacatacctgtaggatgctg

SEQ ID NO: 490278 - DNA, 25 bp, Homo sapien
taggatgctgtgtaatgggaaacca

SEQ ID NO: 490279 - DNA, 25 bp, Homo sapien
atagaattgggcttttgtcatttca

SEQ ID NO: 490280 - DNA, 25 bp, Homo sapien
atatccttcttacacgactaagttg

SEQ ID NO: 490281 - DNA, 25 bp, Homo sapien
taaatctcactctaggagttcagtg

SEQ ID NO: 490282 - DNA, 25 bp, Homo sapien
ggagaggttagagccagccacactt

SEQ ID NO: 490283 - DNA, 25 bp, Homo sapien
aggttagagccagccacacttgaac

SEQ ID NO: 490284 - DNA, 25 bp, Homo sapien
gagccagccacacttgaacctaata

SEQ ID NO: 490285 - DNA, 25 bp, Homo sapien
ttgaacctaataccctgcccttgac

SEQ ID NO: 490286 - DNA, 25 bp, Homo sapien
tgcccttgacatctggaaacctcta

SEQ ID NO: 490287 - DNA, 25 bp, Homo sapien
ggaaacctctacatatttatataac

SEQ ID NO: 490288 - DNA, 25 bp, Homo sapien
aacgtgatacatttggataaacaac

SEQ ID NO: 490289 - DNA, 25 bp, Homo sapien
gaaaacctacatattccatgtttgg

SEQ ID NO: 490290 - DNA, 25 bp, Homo sapien
ccatgtttggaagacccttggaaga

SEQ ID NO: 490291 - DNA, 25 bp, Homo sapien
aaccactaaaagcaatatgaccgag

SEQ ID NO: 490292 - DNA, 25 bp, Homo sapien
gaccgagttgagatgtggtttccaa

SEQ ID NO: 490293 - DNA, 25 bp, Homo sapien
gtgaatttaagcaacctggatgtgc

SEQ ID NO: 490294 - DNA, 25 bp, Homo sapien
agcaacctggatgtgcatatgtgga

SEQ ID NO: 490295 - DNA, 25 bp, Homo sapien
atatgtggaggctcccgtctcactg

SEQ ID NO: 490296 - DNA, 25 bp, Homo sapien
tcccgtctcactgtttgatcaaact

SEQ ID NO: 490297 - DNA, 25 bp, Homo sapien
atgtagtcacgtagacttgattttt

SEQ ID NO: 490298 - DNA, 25 bp, Homo sapien
aaataggatttcctctaggctcctc

SEQ ID NO: 490299 - DNA, 25 bp, Homo sapien
tctaggctcctcgaagagatttttt

SEQ ID NO: 490300 - DNA, 25 bp, Homo sapien
atgatgcttgtcttactttcttaga

SEQ ID NO: 490301 - DNA, 25 bp, Homo sapien
ttcttagacacgttacatttcccct

SEQ ID NO: 490302 - DNA, 25 bp, Homo sapien
gaccggctggccctcaggagactcc

SEQ ID NO: 490303 - DNA, 25 bp, Homo sapien
gtcaaagggaatgtgcacgccctcc

SEQ ID NO: 490304 - DNA, 25 bp, Homo sapien
gatgagtcagagctgccagccacca

SEQ ID NO: 490305 - DNA, 25 bp, Homo sapien
aaagggaatgtgcacgccctcctga

SEQ ID NO: 490306 - DNA, 25 bp, Homo sapien
cagcccattgcccactttgtcactg

SEQ ID NO: 490307 - DNA, 25 bp, Homo sapien
actgtcagggtctgagtcgctgagg

SEQ ID NO: 490308 - DNA, 25 bp, Homo sapien
atgtgcacgccctcctgagtgatga

SEQ ID NO: 490309 - DNA, 25 bp, Homo sapien
caggtcctggaagtagcggtggcca

SEQ ID NO: 490310 - DNA, 25 bp, Homo sapien
tgcacgccctcctgagtgatgagcc

SEQ ID NO: 490311 - DNA, 25 bp, Homo sapien
cacacggccgtggtgtacaggccaa

SEQ ID NO: 490312 - DNA, 25 bp, Homo sapien
cggccgtggtgtacaggccaaaagt

SEQ ID NO: 490313 - DNA, 25 bp, Homo sapien
aagatagagaaatcagattgttgct

SEQ ID NO: 490314 - DNA, 25 bp, Homo sapien
agatagagaaatcagattgttgctg

SEQ ID NO: 490315 - DNA, 25 bp, Homo sapien
gatagagaaatcagattgttgctgt

SEQ ID NO: 490316 - DNA, 25 bp, Homo sapien
atagagaaatcagattgttgctgtg

SEQ ID NO: 490317 - DNA, 25 bp, Homo sapien
tagagaaatcagattgttgctgtgt

SEQ ID NO: 490318 - DNA, 25 bp, Homo sapien
agagaaatcagattgttgctgtgtc

SEQ ID NO: 490319 - DNA, 25 bp, Homo sapien
gagaaatcagattgttgctgtgtct

SEQ ID NO: 490320 - DNA, 25 bp, Homo sapien
aaatcagattgttgctgtgtctgtg

SEQ ID NO: 490321 - DNA, 25 bp, Homo sapien
aatcagattgttgctgtgtctgtgt

SEQ ID NO: 490322 - DNA, 25 bp, Homo sapien
atcagattgttgctgtgtctgtgta

SEQ ID NO: 490323 - DNA, 25 bp, Homo sapien
cactgagaacgggtcatgatgacga

SEQ ID NO: 490324 - DNA, 25 bp, Homo sapien
aagtatttccctacagaactcctca

SEQ ID NO: 490325 - DNA, 25 bp, Homo sapien
atttccctacagaactcctcaagaa

SEQ ID NO: 490326 - DNA, 25 bp, Homo sapien
gaaaacagagatcatttggctagag

SEQ ID NO: 490327 - DNA, 25 bp, Homo sapien
gctagagattgtctgagtgactcca

SEQ ID NO: 490328 - DNA, 25 bp, Homo sapien
gagtgactccaagctactcactgta

SEQ ID NO: 490329 - DNA, 25 bp, Homo sapien
aagctactcactgtattggacggga

SEQ ID NO: 490330 - DNA, 25 bp, Homo sapien
gtggatattccatttgtaggaccaa

SEQ ID NO: 490331 - DNA, 25 bp, Homo sapien
tgtaggaccaagtcgacatgcccat

SEQ ID NO: 490332 - DNA, 25 bp, Homo sapien
gacatgcccatcctgacattgtatg

SEQ ID NO: 490333 - DNA, 25 bp, Homo sapien
cattgtatgctacgagaactcttct

SEQ ID NO: 490334 - DNA, 25 bp, Homo sapien
aactcttctgatgatggaatttcga

SEQ ID NO: 490335 - DNA, 25 bp, Homo sapien
agccggcttgttcccaatcttgatg

SEQ ID NO: 490336 - DNA, 25 bp, Homo sapien
tttgagcgggcctttttagcaatgg

SEQ ID NO: 490337 - DNA, 25 bp, Homo sapien
tcctgggtctctgctttgggaggct

SEQ ID NO: 490338 - DNA, 25 bp, Homo sapien
tttattctcttcaagcgtcttccca

SEQ ID NO: 490339 - DNA, 25 bp, Homo sapien
ttcaagcgtcttcccagaaaacttc

SEQ ID NO: 490340 - DNA, 25 bp, Homo sapien
tcaaccagtcatcatctgaccaaac

SEQ ID NO: 490341 - DNA, 25 bp, Homo sapien
tggaagagccttccttaattctcat

SEQ ID NO: 490342 - DNA, 25 bp, Homo sapien
ccttaattctcattggtttggccaa

SEQ ID NO: 490343 - DNA, 25 bp, Homo sapien
aattgacacgaattgtacgtccaaa

SEQ ID NO: 490344 - DNA, 25 bp, Homo sapien
gtacgtccaaaaagctcagattcat

SEQ ID NO: 490345 - DNA, 25 bp, Homo sapien
tcatgttgtcgatagctgctgcagc

SEQ ID NO: 490346 - DNA, 25 bp, Homo sapien
atcttggccctctctgggcagacaa

SEQ ID NO: 490347 - DNA, 25 bp, Homo sapien
ctctctgggcagacaatgtgtgcac

SEQ ID NO: 490348 - DNA, 25 bp, Homo sapien
gggcagacaatgtgtgcacctatgt

SEQ ID NO: 490349 - DNA, 25 bp, Homo sapien
aatgtgtgcacctatgtggaaggcc

SEQ ID NO: 490350 - DNA, 25 bp, Homo sapien
gtgtgcacctatgtggaaggccaag

SEQ ID NO: 490351 - DNA, 25 bp, Homo sapien
tggacccaggccatctctggttgtg

SEQ ID NO: 490352 - DNA, 25 bp, Homo sapien
tctctggttgtgtctgtgccgactc

SEQ ID NO: 490353 - DNA, 25 bp, Homo sapien
gtgccgactcggtgttgaatcaaat

SEQ ID NO: 490354 - DNA, 25 bp, Homo sapien
tgaatcaaatcaggtgtgcgtcagg

SEQ ID NO: 490355 - DNA, 25 bp, Homo sapien
gtcaggagccggctgtgtccttcct

SEQ ID NO: 490356 - DNA, 25 bp, Homo sapien
acactcggggattcattccttagaa

SEQ ID NO: 490357 - DNA, 25 bp, Homo sapien
aggcaagcagctcctctcttctgta

SEQ ID NO: 490358 - DNA, 25 bp, Homo sapien
ctcctctcttctgtaggagctttgg

SEQ ID NO: 490359 - DNA, 25 bp, Homo sapien
tgtaggagctttgggttttcagagg

SEQ ID NO: 490360 - DNA, 25 bp, Homo sapien
agtgttccttatgatgcctccccat

SEQ ID NO: 490361 - DNA, 25 bp, Homo sapien
tgttccttatgatgcctccccattt

SEQ ID NO: 490362 - DNA, 25 bp, Homo sapien
tgtaatgtggggttctgttcagagc

SEQ ID NO: 490363 - DNA, 25 bp, Homo sapien
agagcttcctacagagcaccagttg

SEQ ID NO: 490364 - DNA, 25 bp, Homo sapien
gagcttcctacagagcaccagttgc

SEQ ID NO: 490365 - DNA, 25 bp, Homo sapien
tattggtattaattaccagttttgg

SEQ ID NO: 490366 - DNA, 25 bp, Homo sapien
ttggtcccctaccaacaattggtat

SEQ ID NO: 490367 - DNA, 25 bp, Homo sapien
tggtcccctaccaacaattggtatt

SEQ ID NO: 490368 - DNA, 25 bp, Homo sapien
agacatatcactgcttgatgtatag

SEQ ID NO: 490369 - DNA, 25 bp, Homo sapien
tgtatagttaaaaagagatgccatc

SEQ ID NO: 490370 - DNA, 25 bp, Homo sapien
gatgccatcatcacaattattcaaa

SEQ ID NO: 490371 - DNA, 25 bp, Homo sapien
ttacagtgtatgtttaaccaagtat

SEQ ID NO: 490372 - DNA, 25 bp, Homo sapien
gattatttctacctagtattttcag

SEQ ID NO: 490373 - DNA, 25 bp, Homo sapien
gaatgatttacttgggatgtgcggc

SEQ ID NO: 490374 - DNA, 25 bp, Homo sapien
tttacttgggatgtgcggcgattct

SEQ ID NO: 490375 - DNA, 25 bp, Homo sapien
gatgtgcggcgattcttttttagat

SEQ ID NO: 490376 - DNA, 25 bp, Homo sapien
gcggcgattcttttttagataagtg

SEQ ID NO: 490377 - DNA, 25 bp, Homo sapien
aatacattgaaccacatgctggaat

SEQ ID NO: 490378 - DNA, 25 bp, Homo sapien
gaaccacatgctggaatgttttaag

SEQ ID NO: 490379 - DNA, 25 bp, Homo sapien
gatgaaaagatctctaaggcataat

SEQ ID NO: 490380 - DNA, 25 bp, Homo sapien
aagcatggtgtcaaactgtatggca

SEQ ID NO: 490381 - DNA, 25 bp, Homo sapien
actgtatggcatgctacaattgatg

SEQ ID NO: 490382 - DNA, 25 bp, Homo sapien
gtttgtatatggtagactgtctctg

SEQ ID NO: 490383 - DNA, 25 bp, Homo sapien
ggtagactgtctctgaagacatata

SEQ ID NO: 490384 - DNA, 25 bp, Homo sapien
gacatatatggaagaacctgatcac

SEQ ID NO: 490385 - DNA, 25 bp, Homo sapien
gaacctgatcacattggtagtctcc

SEQ ID NO: 490386 - DNA, 25 bp, Homo sapien
cacattggtagtctccaaggagcag

SEQ ID NO: 490387 - DNA, 25 bp, Homo sapien
caaggagcagaactagatacctggg

SEQ ID NO: 490388 - DNA, 25 bp, Homo sapien
aggatcccaggagtgagccttttca

SEQ ID NO: 490389 - DNA, 25 bp, Homo sapien
aggagtgagccttttcattgtaaac

SEQ ID NO: 490390 - DNA, 25 bp, Homo sapien
agggcggtctttttcgcccgatctg

SEQ ID NO: 490391 - DNA, 25 bp, Homo sapien
aaagatttggattccttggtctcca

SEQ ID NO: 490392 - DNA, 25 bp, Homo sapien
ttcaaattccaccaccttggagggt

SEQ ID NO: 490393 - DNA, 25 bp, Homo sapien
gagggtggtaccaagctcactgaaa

SEQ ID NO: 490394 - DNA, 25 bp, Homo sapien
tgaaacattgcccaggcctgttgaa

SEQ ID NO: 490395 - DNA, 25 bp, Homo sapien
ccaggcctgttgaattatgtcggaa

SEQ ID NO: 490396 - DNA, 25 bp, Homo sapien
tacacactgaaggttccatttccat

SEQ ID NO: 490397 - DNA, 25 bp, Homo sapien
gaaggttccatttccatggtcaaca

SEQ ID NO: 490398 - DNA, 25 bp, Homo sapien
ggtcaacaattttccctgtgatgag

SEQ ID NO: 490399 - DNA, 25 bp, Homo sapien
aatgttggaatgaaagtcaccccat

SEQ ID NO: 490400 - DNA, 25 bp, Homo sapien
tcaccccatccaaacattttcttaa

SEQ ID NO: 490401 - DNA, 25 bp, Homo sapien
gcatttctccttgcattggtttgct

SEQ ID NO: 490402 - DNA, 25 bp, Homo sapien
ttctccttgcattggtttgctggta

SEQ ID NO: 490403 - DNA, 25 bp, Homo sapien
ccttgcattggtttgctggtatgga

SEQ ID NO: 490404 - DNA, 25 bp, Homo sapien
tggtttgctggtatggatggccctt

SEQ ID NO: 490405 - DNA, 25 bp, Homo sapien
gctggtatggatggcccttagattt

SEQ ID NO: 490406 - DNA, 25 bp, Homo sapien
atggatggcccttagattttggcat

SEQ ID NO: 490407 - DNA, 25 bp, Homo sapien
atggcccttagattttggcatgagt

SEQ ID NO: 490408 - DNA, 25 bp, Homo sapien
ggcatgagtgattatgcagcctatt

SEQ ID NO: 490409 - DNA, 25 bp, Homo sapien
gagtgattatgcagcctatttgaag

SEQ ID NO: 490410 - DNA, 25 bp, Homo sapien
gcagcctatttgaagaaaacctgtt

SEQ ID NO: 490411 - DNA, 25 bp, Homo sapien
ctgttacatgagttaaaggcaatca

SEQ ID NO: 490412 - DNA, 25 bp, Homo sapien
cgtcatcttattttagtggaatcca

SEQ ID NO: 490413 - DNA, 25 bp, Homo sapien
aagatgtcaagttcctcatttccca

SEQ ID NO: 490414 - DNA, 25 bp, Homo sapien
aagttcctcatttcccatacaaaga

SEQ ID NO: 490415 - DNA, 25 bp, Homo sapien
gaatgtgagattcatctttcttgaa

SEQ ID NO: 490416 - DNA, 25 bp, Homo sapien
ggcatcttttcaggaggactataat

SEQ ID NO: 490417 - DNA, 25 bp, Homo sapien
aggactataattgggccctctaact

SEQ ID NO: 490418 - DNA, 25 bp, Homo sapien
taactaaaaagtctcctatgcccct

SEQ ID NO: 490419 - DNA, 25 bp, Homo sapien
tatgccccttagatagatgagattt

SEQ ID NO: 490420 - DNA, 25 bp, Homo sapien
tttttgaccttgtacccaccaacat

SEQ ID NO: 490421 - DNA, 25 bp, Homo sapien
accaacattggtgggaggctcagaa

SEQ ID NO: 490422 - DNA, 25 bp, Homo sapien
tgtaactttgtagcactttctaaac

SEQ ID NO: 490423 - DNA, 25 bp, Homo sapien
ctgcctgctcctatgacactgagca

SEQ ID NO: 490424 - DNA, 25 bp, Homo sapien
gacactgagcatcattacatacgca

SEQ ID NO: 490425 - DNA, 25 bp, Homo sapien
cactgagcatcattacatacgcaag

SEQ ID NO: 490426 - DNA, 25 bp, Homo sapien
ctgagcatcattacatacgcaagtg

SEQ ID NO: 490427 - DNA, 25 bp, Homo sapien
gcatcattacatacgcaagtgcttt

SEQ ID NO: 490428 - DNA, 25 bp, Homo sapien
cattacatacgcaagtgctttgcag

SEQ ID NO: 490429 - DNA, 25 bp, Homo sapien
ttacatacgcaagtgctttgcagac

SEQ ID NO: 490430 - DNA, 25 bp, Homo sapien
agtgctttgcagacattagagttga

SEQ ID NO: 490431 - DNA, 25 bp, Homo sapien
gctttgcagacattagagttgaaca

SEQ ID NO: 490432 - DNA, 25 bp, Homo sapien
gaggaagataatattctgttctcat

SEQ ID NO: 490433 - DNA, 25 bp, Homo sapien
gataatattctgttctcatctccag

SEQ ID NO: 490434 - DNA, 25 bp, Homo sapien
gaacatttttactcctaatcaatat

SEQ ID NO: 490435 - DNA, 25 bp, Homo sapien
atcaatatacaaacatcatgctcag

SEQ ID NO: 490436 - DNA, 25 bp, Homo sapien
gtatgaaacttctgaacttcacaca

SEQ ID NO: 490437 - DNA, 25 bp, Homo sapien
tgaacttcacacattttcaagtcat

SEQ ID NO: 490438 - DNA, 25 bp, Homo sapien
gattggctcccatggaaatgcaact

SEQ ID NO: 490439 - DNA, 25 bp, Homo sapien
aaatgcaactgggactgcacatggg

SEQ ID NO: 490440 - DNA, 25 bp, Homo sapien
ggaatttggttcacacaaacctgtt

SEQ ID NO: 490441 - DNA, 25 bp, Homo sapien
aaacctgtttgggagattgcatttc

SEQ ID NO: 490442 - DNA, 25 bp, Homo sapien
tgggccaaattgagtttgtttcctt

SEQ ID NO: 490443 - DNA, 25 bp, Homo sapien
acaacattgttgtgccttgctgact

SEQ ID NO: 490444 - DNA, 25 bp, Homo sapien
cattgttgtgccttgctgactggaa

SEQ ID NO: 490445 - DNA, 25 bp, Homo sapien
atcctcatcctggtcctcattgtag

SEQ ID NO: 490446 - DNA, 25 bp, Homo sapien
tcattgtagccacagccattcttgt

SEQ ID NO: 490447 - DNA, 25 bp, Homo sapien
acagccattcttgtgacagtctata

SEQ ID NO: 490448 - DNA, 25 bp, Homo sapien
acagtctatatgtatcaccacccaa

SEQ ID NO: 490449 - DNA, 25 bp, Homo sapien
gcatcttctttattgagagacgccc

SEQ ID NO: 490450 - DNA, 25 bp, Homo sapien
gagagacgcccaagcagatggcctg

SEQ ID NO: 490451 - DNA, 25 bp, Homo sapien
agatggcctgcgatgaagtttagaa

SEQ ID NO: 490452 - DNA, 25 bp, Homo sapien
gacatcctgcctatgctgaagttga

SEQ ID NO: 490453 - DNA, 25 bp, Homo sapien
ggctttattgtatcagagcagtgct

SEQ ID NO: 490454 - DNA, 25 bp, Homo sapien
gagcagtgctaaaatttctaggaca

SEQ ID NO: 490455 - DNA, 25 bp, Homo sapien
tctaggacagaacaacaccagtact

SEQ ID NO: 490456 - DNA, 25 bp, Homo sapien
ttttaagccataatacagacagcct

SEQ ID NO: 490457 - DNA, 25 bp, Homo sapien
aagccataatacagacagccttata

SEQ ID NO: 490458 - DNA, 25 bp, Homo sapien
ataatacagacagccttatactcta

SEQ ID NO: 490459 - DNA, 25 bp, Homo sapien
ttgtccgatggtgctactctgtata

SEQ ID NO: 490460 - DNA, 25 bp, Homo sapien
gtccgatggtgctactctgtataaa

SEQ ID NO: 490461 - DNA, 25 bp, Homo sapien
gatggtgctactctgtataaacatt

SEQ ID NO: 490462 - DNA, 25 bp, Homo sapien
taaacattactgatgctatctatag

SEQ ID NO: 490463 - DNA, 25 bp, Homo sapien
actgatgctatctatagtagggcaa

SEQ ID NO: 490464 - DNA, 25 bp, Homo sapien
atgctatctatagtagggcaagaaa

SEQ ID NO: 490465 - DNA, 25 bp, Homo sapien
gattattcaggcagcatttttaaaa

SEQ ID NO: 490466 - DNA, 25 bp, Homo sapien
aaacatatgcacaagttatggtttt

SEQ ID NO: 490467 - DNA, 25 bp, Homo sapien
agtgaatagtcaaaaatcctgttag

SEQ ID NO: 490468 - DNA, 25 bp, Homo sapien
aatcctgttagcaaactgttatata

SEQ ID NO: 490469 - DNA, 25 bp, Homo sapien
gctaagtttgttcttttaacagctg

SEQ ID NO: 490470 - DNA, 25 bp, Homo sapien
aacagctggaatttattaagatgca

SEQ ID NO: 490471 - DNA, 25 bp, Homo sapien
gattttattcactgcctaaaacact

SEQ ID NO: 490472 - DNA, 25 bp, Homo sapien
tgcctaaaacactttgggtggtatt

SEQ ID NO: 490473 - DNA, 25 bp, Homo sapien
atggagttggtggattttcctccaa

SEQ ID NO: 490474 - DNA, 25 bp, Homo sapien
gattttcctccaagtgattaaatga

SEQ ID NO: 490475 - DNA, 25 bp, Homo sapien
aaatttgacgtatcttttcatccaa

SEQ ID NO: 490476 - DNA, 25 bp, Homo sapien
atccaaagttttgtacatcatgttt

SEQ ID NO: 490477 - DNA, 25 bp, Homo sapien
tgtacatcatgttttctaacggaaa

SEQ ID NO: 490478 - DNA, 25 bp, Homo sapien
agagactgatcctagccaggcacct

SEQ ID NO: 490479 - DNA, 25 bp, Homo sapien
atcctagccaggcaccttaggagta

SEQ ID NO: 490480 - DNA, 25 bp, Homo sapien
ccttaggagtatagggaggccccat

SEQ ID NO: 490481 - DNA, 25 bp, Homo sapien
tagggaggccccatataggtccatc

SEQ ID NO: 490482 - DNA, 25 bp, Homo sapien
ataggtccatcctcctaggatgaag

SEQ ID NO: 490483 - DNA, 25 bp, Homo sapien
gatgaagccttctgagagcttggtg

SEQ ID NO: 490484 - DNA, 25 bp, Homo sapien
gagcttggtgaaggtgtctccatca

SEQ ID NO: 490485 - DNA, 25 bp, Homo sapien
ggtgaaggtgtctccatcaccacca

SEQ ID NO: 490486 - DNA, 25 bp, Homo sapien
agccctggccagttcaaaggttcag

SEQ ID NO: 490487 - DNA, 25 bp, Homo sapien
agttcaaaggttcagccatccctgc

SEQ ID NO: 490488 - DNA, 25 bp, Homo sapien
ctgggctccagctgaggacaacgga

SEQ ID NO: 490489 - DNA, 25 bp, Homo sapien
ttgcacctgatacagagaacttggg

SEQ ID NO: 490490 - DNA, 25 bp, Homo sapien
gggactttcatcttgggcacattca

SEQ ID NO: 490491 - DNA, 25 bp, Homo sapien
catcttgggcacattcagtttgctc

SEQ ID NO: 490492 - DNA, 25 bp, Homo sapien
ttgggcacattcagtttgctcccag

SEQ ID NO: 490493 - DNA, 25 bp, Homo sapien
gccagtgatgctacccccaatttgg

SEQ ID NO: 490494 - DNA, 25 bp, Homo sapien
ggagcagaggcatccaccccaatgt

SEQ ID NO: 490495 - DNA, 25 bp, Homo sapien
taggtcaccctcaagtgatggccca

SEQ ID NO: 490496 - DNA, 25 bp, Homo sapien
accctcaagtgatggcccagtgatt

SEQ ID NO: 490497 - DNA, 25 bp, Homo sapien
ccctcaaggccctcaatattggcag

SEQ ID NO: 490498 - DNA, 25 bp, Homo sapien
ttggcagagggcacactgacttcca

SEQ ID NO: 490499 - DNA, 25 bp, Homo sapien
gggcacactgacttccagctgaggg

SEQ ID NO: 490500 - DNA, 25 bp, Homo sapien
taaagaattatagctcagtcctatg

SEQ ID NO: 490501 - DNA, 25 bp, Homo sapien
ttatagctcagtcctatgattaggc

SEQ ID NO: 490502 - DNA, 25 bp, Homo sapien
gctcagtcctatgattaggcaagtt

SEQ ID NO: 490503 - DNA, 25 bp, Homo sapien
gggtcgcttctgatctaggcggttc

SEQ ID NO: 490504 - DNA, 25 bp, Homo sapien
tgatctaggcggttcttgcctctgg

SEQ ID NO: 490505 - DNA, 25 bp, Homo sapien
gcggttcttgcctctggtgactggt

SEQ ID NO: 490506 - DNA, 25 bp, Homo sapien
tggctgagctgttctgtctcgaaaa

SEQ ID NO: 490507 - DNA, 25 bp, Homo sapien
gagctgttctgtctcgaaaagttcc

SEQ ID NO: 490508 - DNA, 25 bp, Homo sapien
tgttctgtctcgaaaagttcctaaa

SEQ ID NO: 490509 - DNA, 25 bp, Homo sapien
agttcctaaaactgtgctgctttaa

SEQ ID NO: 490510 - DNA, 25 bp, Homo sapien
tcctaaaactgtgctgctttaaaaa

SEQ ID NO: 490511 - DNA, 25 bp, Homo sapien
ggcttctggacaagacacccagctc

SEQ ID NO: 490512 - DNA, 25 bp, Homo sapien
ctggacaagacacccagctccgagg

SEQ ID NO: 490513 - DNA, 25 bp, Homo sapien
tctctggttgtgtctgtgccgactc

SEQ ID NO: 490514 - DNA, 25 bp, Homo sapien
gtgtctgtgccgactcggtgttgaa

SEQ ID NO: 490515 - DNA, 25 bp, Homo sapien
gtgccgactcggtgttgaatcaaat

SEQ ID NO: 490516 - DNA, 25 bp, Homo sapien
gccgactcggtgttgaatcaaatca

SEQ ID NO: 490517 - DNA, 25 bp, Homo sapien
gttgaatcaaatcaggtgtgcgtca

SEQ ID NO: 490518 - DNA, 25 bp, Homo sapien
tgaatcaaatcaggtgtgcgtcagg

SEQ ID NO: 490519 - DNA, 25 bp, Homo sapien
gtcaggagccggctgtgtccttcct

SEQ ID NO: 490520 - DNA, 25 bp, Homo sapien
aggagccggctgtgtccttcctgcc

SEQ ID NO: 490521 - DNA, 25 bp, Homo sapien
ttcctgccacactcggggattcatt

SEQ ID NO: 490522 - DNA, 25 bp, Homo sapien
ctctccccagaacggctctttttgt

SEQ ID NO: 490523 - DNA, 25 bp, Homo sapien
cagaacggctctttttgtcacacag

SEQ ID NO: 490524 - DNA, 25 bp, Homo sapien
gaacggctctttttgtcacacagga

SEQ ID NO: 490525 - DNA, 25 bp, Homo sapien
acggctctttttgtcacacaggatg

SEQ ID NO: 490526 - DNA, 25 bp, Homo sapien
ctttttgtcacacaggatggcatgt

SEQ ID NO: 490527 - DNA, 25 bp, Homo sapien
gtcacacaggatggcatgtgatcct

SEQ ID NO: 490528 - DNA, 25 bp, Homo sapien
gcatgtgatcctcaagacgacgaac

SEQ ID NO: 490529 - DNA, 25 bp, Homo sapien
tgtgatcctcaagacgacgaacaat

SEQ ID NO: 490530 - DNA, 25 bp, Homo sapien
gatcctcaagacgacgaacaatgaa

SEQ ID NO: 490531 - DNA, 25 bp, Homo sapien
aaccgacggacgacccctgtgtgag

SEQ ID NO: 490532 - DNA, 25 bp, Homo sapien
ggacgacccctgtgtgagccgcctg

SEQ ID NO: 490533 - DNA, 25 bp, Homo sapien
aaaacttcttctatcttatgtcatt

SEQ ID NO: 490534 - DNA, 25 bp, Homo sapien
ctgcctgccaccaggtgcaatatgt

SEQ ID NO: 490535 - DNA, 25 bp, Homo sapien
gccaccaggtgcaatatgtcatttg

SEQ ID NO: 490536 - DNA, 25 bp, Homo sapien
gtgcaatatgtcatttgcatcagcc

SEQ ID NO: 490537 - DNA, 25 bp, Homo sapien
ggaaattaaaacttggcatgcatta

SEQ ID NO: 490538 - DNA, 25 bp, Homo sapien
catgcattagttcatatgtatgagg

SEQ ID NO: 490539 - DNA, 25 bp, Homo sapien
atatgtatgaggttggctgtgtccc

SEQ ID NO: 490540 - DNA, 25 bp, Homo sapien
tccccaaacagcaattgcttgtaca

SEQ ID NO: 490541 - DNA, 25 bp, Homo sapien
gcttgtacaagatagaagtttgctt

SEQ ID NO: 490542 - DNA, 25 bp, Homo sapien
tttgaaaccatcctgagcaatagag

SEQ ID NO: 490543 - DNA, 25 bp, Homo sapien
aaccatcctgagcaatagagagacc

SEQ ID NO: 490544 - DNA, 25 bp, Homo sapien
aaaggcctagtcaaatcctcaggtg

SEQ ID NO: 490545 - DNA, 25 bp, Homo sapien
gaacaagccggctggtgcatccaaa

SEQ ID NO: 490546 - DNA, 25 bp, Homo sapien
agaattttctctacatgtgcaccca

SEQ ID NO: 490547 - DNA, 25 bp, Homo sapien
tttctctacatgtgcacccatttaa

SEQ ID NO: 490548 - DNA, 25 bp, Homo sapien
tgcacccatttaaaggactcggctt

SEQ ID NO: 490549 - DNA, 25 bp, Homo sapien
gactcggcttcaagggaagcagctt

SEQ ID NO: 490550 - DNA, 25 bp, Homo sapien
gatttcacaaaccacggtggcacca

SEQ ID NO: 490551 - DNA, 25 bp, Homo sapien
gtctgcgcaggcatggcactaagtg

SEQ ID NO: 490552 - DNA, 25 bp, Homo sapien
tggcactaagtgtcccatggcacat

SEQ ID NO: 490553 - DNA, 25 bp, Homo sapien
gagtaagggagagcccactgctaaa

SEQ ID NO: 490554 - DNA, 25 bp, Homo sapien
gagagcccactgctaaaaaaggcct

SEQ ID NO: 490555 - DNA, 25 bp, Homo sapien
tccagcctgtgaggagaaacggcct

SEQ ID NO: 490556 - DNA, 25 bp, Homo sapien
ggagaaacggcctccgctgcgagct

SEQ ID NO: 490557 - DNA, 25 bp, Homo sapien
tccgctgcgagctggctggtgcact

SEQ ID NO: 490558 - DNA, 25 bp, Homo sapien
tggctggtgcactcccaggctcagg

SEQ ID NO: 490559 - DNA, 25 bp, Homo sapien
agctgctgcgtctgtggtcaggcct

SEQ ID NO: 490560 - DNA, 25 bp, Homo sapien
tcctgccagggagcacgcgtggtct

SEQ ID NO: 490561 - DNA, 25 bp, Homo sapien
cacgcgtggtcttcgggttgagctc

SEQ ID NO: 490562 - DNA, 25 bp, Homo sapien
tgcgcatggctgctcatggtcccaa

SEQ ID NO: 490563 - DNA, 25 bp, Homo sapien
atggtcccaacacaggctactgtga

SEQ ID NO: 490564 - DNA, 25 bp, Homo sapien
gctactgtgagagccagcatccaac

SEQ ID NO: 490565 - DNA, 25 bp, Homo sapien
ttatcgatgcttcccacagtgtggt

SEQ ID NO: 490566 - DNA, 25 bp, Homo sapien
caagatgatatacaagacggccaca

SEQ ID NO: 490567 - DNA, 25 bp, Homo sapien
gacggccacatctatcatatatgag

SEQ ID NO: 490568 - DNA, 25 bp, Homo sapien
atatatgaggaagtcatctttgctt

SEQ ID NO: 490569 - DNA, 25 bp, Homo sapien
tgcttccatttaaaagagtccagac

SEQ ID NO: 490570 - DNA, 25 bp, Homo sapien
taaaagagtccagacatctgtttgg

SEQ ID NO: 490571 - DNA, 25 bp, Homo sapien
acaggaatatgctctgaaaccttat

SEQ ID NO: 490572 - DNA, 25 bp, Homo sapien
gctctgaaaccttattcttaagatg

SEQ ID NO: 490573 - DNA, 25 bp, Homo sapien
gagaagagattccttgatgattaac

SEQ ID NO: 490574 - DNA, 25 bp, Homo sapien
atttcttttcacagtaagcaatctt

SEQ ID NO: 490575 - DNA, 25 bp, Homo sapien
agcaatcttaatggcttcttctaca

SEQ ID NO: 490576 - DNA, 25 bp, Homo sapien
aatggcttcttctacatatgggaaa

SEQ ID NO: 490577 - DNA, 25 bp, Homo sapien
ttacattcgccggtgcgcttgcgcg

SEQ ID NO: 490578 - DNA, 25 bp, Homo sapien
cagcgacgagagtcccgggagcaaa

SEQ ID NO: 490579 - DNA, 25 bp, Homo sapien
aatgcagccctgaggatttggctac

SEQ ID NO: 490580 - DNA, 25 bp, Homo sapien
ggatttggctactgcatataacaac

SEQ ID NO: 490581 - DNA, 25 bp, Homo sapien
gaagccatggatgactacacatctg

SEQ ID NO: 490582 - DNA, 25 bp, Homo sapien
atctgccatagaagtccaacccaat

SEQ ID NO: 490583 - DNA, 25 bp, Homo sapien
gtccaacccaattttgaagttccat

SEQ ID NO: 490584 - DNA, 25 bp, Homo sapien
gaagttccatattacaacagagggt

SEQ ID NO: 490585 - DNA, 25 bp, Homo sapien
gttgatactgtataggctgggatat

SEQ ID NO: 490586 - DNA, 25 bp, Homo sapien
gaaggtcttagacttaaatcctgga

SEQ ID NO: 490587 - DNA, 25 bp, Homo sapien
taaatcctggatttcaagatgctac

SEQ ID NO: 490588 - DNA, 25 bp, Homo sapien
ggttagaagacatcattcagaattt

SEQ ID NO: 490589 - DNA, 25 bp, Homo sapien
aatccttggagtgtttaaatgaatg

SEQ ID NO: 490590 - DNA, 25 bp, Homo sapien
agtcctattgtgtaacctctattag

SEQ ID NO: 490591 - DNA, 25 bp, Homo sapien
acctctattagtagcacatgcgcaa

SEQ ID NO: 490592 - DNA, 25 bp, Homo sapien
gttgttgtgacagctttagttgaaa

SEQ ID NO: 490593 - DNA, 25 bp, Homo sapien
tgaaagattgcatcgggctctgacc

SEQ ID NO: 490594 - DNA, 25 bp, Homo sapien
ccttccttgcacatgtttacaagca

SEQ ID NO: 490595 - DNA, 25 bp, Homo sapien
tggatcaaagtgtccgtgtcccata

SEQ ID NO: 490596 - DNA, 25 bp, Homo sapien
gtgtcccatagctttgtactttccc

SEQ ID NO: 490597 - DNA, 25 bp, Homo sapien
atagctttgtactttccctttgctg

SEQ ID NO: 490598 - DNA, 25 bp, Homo sapien
tgctgccagttctcacattaggtta

SEQ ID NO: 490599 - DNA, 25 bp, Homo sapien
gggcagtgccaaagacgcagcactg

SEQ ID NO: 490600 - DNA, 25 bp, Homo sapien
aggagcaaagcgtgtgctgccagcc

SEQ ID NO: 490601 - DNA, 25 bp, Homo sapien
cagtggcctcatcccagaaaaagcc

SEQ ID NO: 490602 - DNA, 25 bp, Homo sapien
gaagctgcagcaactttatggaagg

SEQ ID NO: 490603 - DNA, 25 bp, Homo sapien
agctgcagcaactttatggaaggag

SEQ ID NO: 490604 - DNA, 25 bp, Homo sapien
gaaactagagcttcagttcatccac

SEQ ID NO: 490605 - DNA, 25 bp, Homo sapien
ctagagcttcagttcatccacctct

SEQ ID NO: 490606 - DNA, 25 bp, Homo sapien
agcttcagttcatccacctctcagg

SEQ ID NO: 490607 - DNA, 25 bp, Homo sapien
tcatccacctctcaggacagacaga

SEQ ID NO: 490608 - DNA, 25 bp, Homo sapien
acagacagacaccatgagaaagtac

SEQ ID NO: 490609 - DNA, 25 bp, Homo sapien
agacagacaccatgagaaagtacat

SEQ ID NO: 490610 - DNA, 25 bp, Homo sapien
agcacgatttcatgggtgaggccca

SEQ ID NO: 490611 - DNA, 25 bp, Homo sapien
gtgaggcccatcctgtggttttcag

SEQ ID NO: 490612 - DNA, 25 bp, Homo sapien
aagagtcggccaaactgcaggagga

SEQ ID NO: 490613 - DNA, 25 bp, Homo sapien
tggcccttggcggattcgatccgtt

SEQ ID NO: 490614 - DNA, 25 bp, Homo sapien
agggaccatccacggatggcttctt

SEQ ID NO: 490615 - DNA, 25 bp, Homo sapien
atggcttcttccttcatgtaggcag

SEQ ID NO: 490616 - DNA, 25 bp, Homo sapien
taggcagggccgatgaagacaccga

SEQ ID NO: 490617 - DNA, 25 bp, Homo sapien
aactcccacgattcagagccgtgga

SEQ ID NO: 490618 - DNA, 25 bp, Homo sapien
gtggactctcctcaggcaggattct

SEQ ID NO: 490619 - DNA, 25 bp, Homo sapien
caggcaggattctgactcggatgtg

SEQ ID NO: 490620 - DNA, 25 bp, Homo sapien
tagaggaagccgagcacgatttcat

SEQ ID NO: 490621 - DNA, 25 bp, Homo sapien
gtagtaacattcatgtcacttgttg

SEQ ID NO: 490622 - DNA, 25 bp, Homo sapien
gtcacttgttgaatttggttctcat

SEQ ID NO: 490623 - DNA, 25 bp, Homo sapien
aatttggttctcatatgtatattgc

SEQ ID NO: 490624 - DNA, 25 bp, Homo sapien
ctataagtcgtcatttttgagccat

SEQ ID NO: 490625 - DNA, 25 bp, Homo sapien
tgagccatcatcttacattcatgta

SEQ ID NO: 490626 - DNA, 25 bp, Homo sapien
gagtaaaaactagctcttaacttag

SEQ ID NO: 490627 - DNA, 25 bp, Homo sapien
aatcaggtcactacagtaaggttct

SEQ ID NO: 490628 - DNA, 25 bp, Homo sapien
gtaaggttctaagtattgccaattg

SEQ ID NO: 490629 - DNA, 25 bp, Homo sapien
tggtattactgttgcaaagtgttgt

SEQ ID NO: 490630 - DNA, 25 bp, Homo sapien
gtcaataattgactccaatagcatt

SEQ ID NO: 490631 - DNA, 25 bp, Homo sapien
tgtaaatacttgtatcccacaacta

SEQ ID NO: 490632 - DNA, 25 bp, Homo sapien
gattgcacaggccatttgcaggctg

SEQ ID NO: 490633 - DNA, 25 bp, Homo sapien
cacaggccatttgcaggctggattc

SEQ ID NO: 490634 - DNA, 25 bp, Homo sapien
gccatttgcaggctggattcgttct

SEQ ID NO: 490635 - DNA, 25 bp, Homo sapien
tggtgacccacctgtctgactcgag

SEQ ID NO: 490636 - DNA, 25 bp, Homo sapien
cacctgtctgactcgagttattttt

SEQ ID NO: 490637 - DNA, 25 bp, Homo sapien
ctgactcgagttatttttttcccat

SEQ ID NO: 490638 - DNA, 25 bp, Homo sapien
gacaaataacgatttgacctgtgat

SEQ ID NO: 490639 - DNA, 25 bp, Homo sapien
gcctggatttagtccaagggccctc

SEQ ID NO: 490640 - DNA, 25 bp, Homo sapien
gatttagtccaagggccctcagtgg

SEQ ID NO: 490641 - DNA, 25 bp, Homo sapien
gtccaagggccctcagtggcttttt

SEQ ID NO: 490642 - DNA, 25 bp, Homo sapien
ttcatcacctttaaaggcatcccca

SEQ ID NO: 490643 - DNA, 25 bp, Homo sapien
ggaagatgctcttgggacactgcaa

SEQ ID NO: 490644 - DNA, 25 bp, Homo sapien
tgctcttgggacactgcaagggaca

SEQ ID NO: 490645 - DNA, 25 bp, Homo sapien
gcaagggacaggattcttcaggcgt

SEQ ID NO: 490646 - DNA, 25 bp, Homo sapien
acaggattcttcaggcgtcgcttgg

SEQ ID NO: 490647 - DNA, 25 bp, Homo sapien
attcttcaggcgtcgcttggaactg

SEQ ID NO: 490648 - DNA, 25 bp, Homo sapien
gcgtcgcttggaactgtggtgcctc

SEQ ID NO: 490649 - DNA, 25 bp, Homo sapien
gcttggaactgtggtgcctctgtga

SEQ ID NO: 490650 - DNA, 25 bp, Homo sapien
gctgaccctgccacagattggctgt

SEQ ID NO: 490651 - DNA, 25 bp, Homo sapien
ctgccacagattggctgtgtgtctc

SEQ ID NO: 490652 - DNA, 25 bp, Homo sapien
gtggcttggccactctggacctcta

SEQ ID NO: 490653 - DNA, 25 bp, Homo sapien
gccactctggacctctaccaaataa

SEQ ID NO: 490654 - DNA, 25 bp, Homo sapien
tatgaaacatagaaggaggccaggc

SEQ ID NO: 490655 - DNA, 25 bp, Homo sapien
tgaaacatagaaggaggccaggcat

SEQ ID NO: 490656 - DNA, 25 bp, Homo sapien
aacatagaaggaggccaggcatgat

SEQ ID NO: 490657 - DNA, 25 bp, Homo sapien
agatcgtttgagtcctggagaccat

SEQ ID NO: 490658 - DNA, 25 bp, Homo sapien
gatcgtttgagtcctggagaccatc

SEQ ID NO: 490659 - DNA, 25 bp, Homo sapien
atcgtttgagtcctggagaccatcc

SEQ ID NO: 490660 - DNA, 25 bp, Homo sapien
tcgtttgagtcctggagaccatcct

SEQ ID NO: 490661 - DNA, 25 bp, Homo sapien
gtttgagtcctggagaccatcctgg

SEQ ID NO: 490662 - DNA, 25 bp, Homo sapien
atagcaaaaccttgtgtttacataa

SEQ ID NO: 490663 - DNA, 25 bp, Homo sapien
tagcaaaaccttgtgtttacataaa

SEQ ID NO: 490664 - DNA, 25 bp, Homo sapien
gcaaaaccttgtgtttacataaaat

SEQ ID NO: 490665 - DNA, 25 bp, Homo sapien
tcacccgggtgatgcgtgagcagca

SEQ ID NO: 490666 - DNA, 25 bp, Homo sapien
agcagcaggcggaactcgccccagg

SEQ ID NO: 490667 - DNA, 25 bp, Homo sapien
gggacccagtgctgtgcagaccagc

SEQ ID NO: 490668 - DNA, 25 bp, Homo sapien
ctgtgcagaccagcgaagtcgggat

SEQ ID NO: 490669 - DNA, 25 bp, Homo sapien
agcgaagtcgggatacctggatata

SEQ ID NO: 490670 - DNA, 25 bp, Homo sapien
acctggatatagtaagctggagatg

SEQ ID NO: 490671 - DNA, 25 bp, Homo sapien
acttgagaactgtcactgcgtggat

SEQ ID NO: 490672 - DNA, 25 bp, Homo sapien
actgcgtggatatttcaaaccctga

SEQ ID NO: 490673 - DNA, 25 bp, Homo sapien
ggatatttcaaaccctgagaatctt

SEQ ID NO: 490674 - DNA, 25 bp, Homo sapien
gaatctttgtaagaccctatacggg

SEQ ID NO: 490675 - DNA, 25 bp, Homo sapien
caccccagtatctgagcagtgctaa

SEQ ID NO: 490676 - DNA, 25 bp, Homo sapien
taacaaattaactctcccaaatatt

SEQ ID NO: 490677 - DNA, 25 bp, Homo sapien
tattttactgcccattattaactaa

SEQ ID NO: 490678 - DNA, 25 bp, Homo sapien
atatttttgtttgactttgagcacc

SEQ ID NO: 490679 - DNA, 25 bp, Homo sapien
gtttgactttgagcaccaactggta

SEQ ID NO: 490680 - DNA, 25 bp, Homo sapien
tactaataaatacccatgtcatgca

SEQ ID NO: 490681 - DNA, 25 bp, Homo sapien
atgtcatgcagatggctgggcgaat

SEQ ID NO: 490682 - DNA, 25 bp, Homo sapien
ggctgggcgaataagagatgtctaa

SEQ ID NO: 490683 - DNA, 25 bp, Homo sapien
aaatatgcactggtcttggaaaaca

SEQ ID NO: 490684 - DNA, 25 bp, Homo sapien
gcactggtcttggaaaacatggcac

SEQ ID NO: 490685 - DNA, 25 bp, Homo sapien
aaacatggcacaagtaaggatatca

SEQ ID NO: 490686 - DNA, 25 bp, Homo sapien
gggactccatttctaaggagactag

SEQ ID NO: 490687 - DNA, 25 bp, Homo sapien
tgaatggcccttcgtgataagtcag

SEQ ID NO: 490688 - DNA, 25 bp, Homo sapien
atggcccttcgtgataagtcagctg

SEQ ID NO: 490689 - DNA, 25 bp, Homo sapien
taagtcagctgtgactgtcagggct

SEQ ID NO: 490690 - DNA, 25 bp, Homo sapien
cagggctatgctatgggccttctag

SEQ ID NO: 490691 - DNA, 25 bp, Homo sapien
gggctatgctatgggccttctagac

SEQ ID NO: 490692 - DNA, 25 bp, Homo sapien
tatgctatgggccttctagactgtc

SEQ ID NO: 490693 - DNA, 25 bp, Homo sapien
tatgggccttctagactgtcttcta

SEQ ID NO: 490694 - DNA, 25 bp, Homo sapien
ggccttctagactgtcttctatgat

SEQ ID NO: 490695 - DNA, 25 bp, Homo sapien
tagactgtcttctatgatcctgccc

SEQ ID NO: 490696 - DNA, 25 bp, Homo sapien
ttctatgatcctgcccttcagagat

SEQ ID NO: 490697 - DNA, 25 bp, Homo sapien
tatgatcctgcccttcagagatgaa

SEQ ID NO: 490698 - DNA, 25 bp, Homo sapien
tgatcatcggcaagggaggcgccac

SEQ ID NO: 490699 - DNA, 25 bp, Homo sapien
cggtgaaagccgtgatggaacagtc

SEQ ID NO: 490700 - DNA, 25 bp, Homo sapien
aagccgtgatggaacagtcaggagc

SEQ ID NO: 490701 - DNA, 25 bp, Homo sapien
aacagtcaggagcatgggtgcagct

SEQ ID NO: 490702 - DNA, 25 bp, Homo sapien
agctgtcccagaagccggagggcat

SEQ ID NO: 490703 - DNA, 25 bp, Homo sapien
aagccggagggcatcaacctgcagg

SEQ ID NO: 490704 - DNA, 25 bp, Homo sapien
atcaacctgcaggagcgcgtggtga

SEQ ID NO: 490705 - DNA, 25 bp, Homo sapien
tgcacaaggccgtgagcgccatcgt

SEQ ID NO: 490706 - DNA, 25 bp, Homo sapien
gaaggtacaagaagacccccagagc

SEQ ID NO: 490707 - DNA, 25 bp, Homo sapien
agcagctgcctcaacatcagctacg

SEQ ID NO: 490708 - DNA, 25 bp, Homo sapien
atcagctacgccaacgtggcaggcc

SEQ ID NO: 490709 - DNA, 25 bp, Homo sapien
tcttccagtcccactgttcatctca

SEQ ID NO: 490710 - DNA, 25 bp, Homo sapien
ctcagggtagtagatgtttggtgga

SEQ ID NO: 490711 - DNA, 25 bp, Homo sapien
agatgtttggtggactagaaatgca

SEQ ID NO: 490712 - DNA, 25 bp, Homo sapien
tttggtggactagaaatgcagggag

SEQ ID NO: 490713 - DNA, 25 bp, Homo sapien
gaaaaggaaggcttggtgatgtcaa

SEQ ID NO: 490714 - DNA, 25 bp, Homo sapien
gaaggcttggtgatgtcaaggattt

SEQ ID NO: 490715 - DNA, 25 bp, Homo sapien
ggcttggtgatgtcaaggattttta

SEQ ID NO: 490716 - DNA, 25 bp, Homo sapien
ttggtgatgtcaaggatttttaaaa

SEQ ID NO: 490717 - DNA, 25 bp, Homo sapien
ttaaaagcaaactatctcactgtgt

SEQ ID NO: 490718 - DNA, 25 bp, Homo sapien
aaaagcaaactatctcactgtgttc

SEQ ID NO: 490719 - DNA, 25 bp, Homo sapien
tgagccccaacaagataggtttcat

SEQ ID NO: 490720 - DNA, 25 bp, Homo sapien
acagcccgccgaagtagaaggacca

SEQ ID NO: 490721 - DNA, 25 bp, Homo sapien
gtagaaggaccagccgtacgagtag

SEQ ID NO: 490722 - DNA, 25 bp, Homo sapien
tacgagtagtggtttttcttctcct

SEQ ID NO: 490723 - DNA, 25 bp, Homo sapien
ccgcgttggcggagatgtacacgat

SEQ ID NO: 490724 - DNA, 25 bp, Homo sapien
gagatgtacacgatcacgccgatga

SEQ ID NO: 490725 - DNA, 25 bp, Homo sapien
gatcacgccgatgatgttgctcagg

SEQ ID NO: 490726 - DNA, 25 bp, Homo sapien
atgatgttgctcaggcctgctgcca

SEQ ID NO: 490727 - DNA, 25 bp, Homo sapien
tgctgccacgaacaggatccctgcg

SEQ ID NO: 490728 - DNA, 25 bp, Homo sapien
tgcgcccagaatgatgttcctcttg

SEQ ID NO: 490729 - DNA, 25 bp, Homo sapien
gttcctcttggacttgtagacgcgg

SEQ ID NO: 490730 - DNA, 25 bp, Homo sapien
gaggcccggacaactcggagtagat

SEQ ID NO: 490731 - DNA, 25 bp, Homo sapien
aatactggcttgaatagaaaacatt

SEQ ID NO: 490732 - DNA, 25 bp, Homo sapien
gaaaacattctcagatgattcaaga

SEQ ID NO: 490733 - DNA, 25 bp, Homo sapien
gccctattcccaattgttagcatct

SEQ ID NO: 490734 - DNA, 25 bp, Homo sapien
tcccaattgttagcatctggctgat

SEQ ID NO: 490735 - DNA, 25 bp, Homo sapien
tctggctgatattaaggtctttgat

SEQ ID NO: 490736 - DNA, 25 bp, Homo sapien
atgtgtattccctctaatacagctg

SEQ ID NO: 490737 - DNA, 25 bp, Homo sapien
gtattccctctaatacagctgatag

SEQ ID NO: 490738 - DNA, 25 bp, Homo sapien
atacagctgatagaactgttgtgtt

SEQ ID NO: 490739 - DNA, 25 bp, Homo sapien
actgttgtgttaaagcaagttggaa

SEQ ID NO: 490740 - DNA, 25 bp, Homo sapien
aatttgcatgatagtgtggaaacca

SEQ ID NO: 490741 - DNA, 25 bp, Homo sapien
gtggaaaccaatggaggtccaaaat

SEQ ID NO: 490742 - DNA, 25 bp, Homo sapien
cctgagggcctagtctttccataga

SEQ ID NO: 490743 - DNA, 25 bp, Homo sapien
ctgagggcctagtctttccatagat

SEQ ID NO: 490744 - DNA, 25 bp, Homo sapien
tgagggcctagtctttccatagatg

SEQ ID NO: 490745 - DNA, 25 bp, Homo sapien
gagggcctagtctttccatagatga

SEQ ID NO: 490746 - DNA, 25 bp, Homo sapien
gggcctagtctttccatagatgaca

SEQ ID NO: 490747 - DNA, 25 bp, Homo sapien
gcctagtctttccatagatgacaag

SEQ ID NO: 490748 - DNA, 25 bp, Homo sapien
agtctttccatagatgacaagaaca

SEQ ID NO: 490749 - DNA, 25 bp, Homo sapien
ggtaccagcttgcataataacttct

SEQ ID NO: 490750 - DNA, 25 bp, Homo sapien
ataacttctgagactgtctccttgg

SEQ ID NO: 490751 - DNA, 25 bp, Homo sapien
atgtgatcctgactgtctgtcccaa

SEQ ID NO: 490752 - DNA, 25 bp, Homo sapien
taccactactgtcccgggagtaaca

SEQ ID NO: 490753 - DNA, 25 bp, Homo sapien
ttgcttggcccatccagtccaggcg

SEQ ID NO: 490754 - DNA, 25 bp, Homo sapien
tccaggcgcctggagcaagtgctca

SEQ ID NO: 490755 - DNA, 25 bp, Homo sapien
gagcaagtgctcagctacttctcct

SEQ ID NO: 490756 - DNA, 25 bp, Homo sapien
actcctggcctcacatttctctgtg

SEQ ID NO: 490757 - DNA, 25 bp, Homo sapien
tttctctgtgtgatcccccacttct

SEQ ID NO: 490758 - DNA, 25 bp, Homo sapien
tctgccaccccacagtgggaaaggc

SEQ ID NO: 490759 - DNA, 25 bp, Homo sapien
cacagtgggaaaggccaccctagaa

SEQ ID NO: 490760 - DNA, 25 bp, Homo sapien
ggccaccctagaaagaagtccgctg

SEQ ID NO: 490761 - DNA, 25 bp, Homo sapien
accctagaaagaagtccgctggcac

SEQ ID NO: 490762 - DNA, 25 bp, Homo sapien
gcaggaagggccaggaccagaacct

SEQ ID NO: 490763 - DNA, 25 bp, Homo sapien
ggaagggccaggaccagaaccttgc

SEQ ID NO: 490764 - DNA, 25 bp, Homo sapien
ttgagccaggaggcagaggctgcgg

SEQ ID NO: 490765 - DNA, 25 bp, Homo sapien
tgagccaggaggcagaggctgcggt

SEQ ID NO: 490766 - DNA, 25 bp, Homo sapien
agagagagataaggtgagactgaaa

SEQ ID NO: 490767 - DNA, 25 bp, Homo sapien
gagagagataaggtgagactgaaaa

SEQ ID NO: 490768 - DNA, 25 bp, Homo sapien
agagagataaggtgagactgaaaag

SEQ ID NO: 490769 - DNA, 25 bp, Homo sapien
gagagataaggtgagactgaaaaga

SEQ ID NO: 490770 - DNA, 25 bp, Homo sapien
agagataaggtgagactgaaaagaa

SEQ ID NO: 490771 - DNA, 25 bp, Homo sapien
gagataaggtgagactgaaaagaag

SEQ ID NO: 490772 - DNA, 25 bp, Homo sapien
gaagagcaccaactaaagtcattta

SEQ ID NO: 490773 - DNA, 25 bp, Homo sapien
aagagcaccaactaaagtcatttaa

SEQ ID NO: 490774 - DNA, 25 bp, Homo sapien
tggcgcacacctgtaacgcccagct

SEQ ID NO: 490775 - DNA, 25 bp, Homo sapien
tgtttttaccatagatgacaagtag

SEQ ID NO: 490776 - DNA, 25 bp, Homo sapien
gtttttaccatagatgacaagtaga

SEQ ID NO: 490777 - DNA, 25 bp, Homo sapien
tttttaccatagatgacaagtagag

SEQ ID NO: 490778 - DNA, 25 bp, Homo sapien
ttttaccatagatgacaagtagagg

SEQ ID NO: 490779 - DNA, 25 bp, Homo sapien
tttaccatagatgacaagtagaggg

SEQ ID NO: 490780 - DNA, 25 bp, Homo sapien
accatagatgacaagtagaggggcc

SEQ ID NO: 490781 - DNA, 25 bp, Homo sapien
ggtcccaactccgaagacatacttc

SEQ ID NO: 490782 - DNA, 25 bp, Homo sapien
gtcccaactccgaagacatacttcc

SEQ ID NO: 490783 - DNA, 25 bp, Homo sapien
tcccaactccgaagacatacttccc

SEQ ID NO: 490784 - DNA, 25 bp, Homo sapien
tccggcttcctcacgctgcacaacg

SEQ ID NO: 490785 - DNA, 25 bp, Homo sapien
tgcacaacgccttccccaaggaggc

SEQ ID NO: 490786 - DNA, 25 bp, Homo sapien
ggcggcggcgtcacggtcacggtca

SEQ ID NO: 490787 - DNA, 25 bp, Homo sapien
ggcgtcacggtcacggtcaccgggc

SEQ ID NO: 490788 - DNA, 25 bp, Homo sapien
gggaccctggccaaggaggccgccg

SEQ ID NO: 490789 - DNA, 25 bp, Homo sapien
aacaccaacacgctcaacaggaaaa

SEQ ID NO: 490790 - DNA, 25 bp, Homo sapien
accaacacgctcaacaggaaaacca

SEQ ID NO: 490791 - DNA, 25 bp, Homo sapien
aacacgctcaacaggaaaaccacgc

SEQ ID NO: 490792 - DNA, 25 bp, Homo sapien
gctcaacaggaaaaccacgcctgtg

SEQ ID NO: 490793 - DNA, 25 bp, Homo sapien
tcaacaggaaaaccacgcctgtgta

SEQ ID NO: 490794 - DNA, 25 bp, Homo sapien
acaggaaaaccacgcctgtgtaggg

SEQ ID NO: 490795 - DNA, 25 bp, Homo sapien
gaaaaagttactcaagacagctttc

SEQ ID NO: 490796 - DNA, 25 bp, Homo sapien
tggacgccgccctggtcttatcggc

SEQ ID NO: 490797 - DNA, 25 bp, Homo sapien
tggtcttatcggctctctcctcatc

SEQ ID NO: 490798 - DNA, 25 bp, Homo sapien
aaaaaatcgctctgtatagttacaa

SEQ ID NO: 490799 - DNA, 25 bp, Homo sapien
aatcgctctgtatagttacaacttg

SEQ ID NO: 490800 - DNA, 25 bp, Homo sapien
ttacaacttgtaagcatgtccgtgt

SEQ ID NO: 490801 - DNA, 25 bp, Homo sapien
atcttcccgcagctgatcgctgtag

SEQ ID NO: 490802 - DNA, 25 bp, Homo sapien
agctgatcgctgtagtgccttggaa

SEQ ID NO: 490803 - DNA, 25 bp, Homo sapien
tgatcgctgtagtgccttggaagtg

SEQ ID NO: 490804 - DNA, 25 bp, Homo sapien
ctgtagtgccttggaagtggagaaa

SEQ ID NO: 490805 - DNA, 25 bp, Homo sapien
gtgccttggaagtggagaaaaagtt

SEQ ID NO: 490806 - DNA, 25 bp, Homo sapien
acatggtaattcattaaaattgcct

SEQ ID NO: 490807 - DNA, 25 bp, Homo sapien
aaaattgccttagtaatatattaga

SEQ ID NO: 490808 - DNA, 25 bp, Homo sapien
tggcaatgacccactccccttggaa

SEQ ID NO: 490809 - DNA, 25 bp, Homo sapien
ccactccccttggaaatgcatgtat

SEQ ID NO: 490810 - DNA, 25 bp, Homo sapien
ggaaatgcatgtatgaactacccta

SEQ ID NO: 490811 - DNA, 25 bp, Homo sapien
aatgcatgtatgaactaccctatga

SEQ ID NO: 490812 - DNA, 25 bp, Homo sapien
gcatgtatgaactaccctatgaaat

SEQ ID NO: 490813 - DNA, 25 bp, Homo sapien
gaactaccctatgaaatgtaagctg

SEQ ID NO: 490814 - DNA, 25 bp, Homo sapien
ccctatgaaatgtaagctgcagaat

SEQ ID NO: 490815 - DNA, 25 bp, Homo sapien
gataaaacacaggtttccactaata

SEQ ID NO: 490816 - DNA, 25 bp, Homo sapien
ataaaagacatctgaacgtcctgaa

SEQ ID NO: 490817 - DNA, 25 bp, Homo sapien
tgaagcctcccagcacccattcagt

SEQ ID NO: 490818 - DNA, 25 bp, Homo sapien
tcgctaggttctccctggtgggtta

SEQ ID NO: 490819 - DNA, 25 bp, Homo sapien
taggttctccctggtgggttagtgc

SEQ ID NO: 490820 - DNA, 25 bp, Homo sapien
tccctggtgggttagtgctttgtat

SEQ ID NO: 490821 - DNA, 25 bp, Homo sapien
cctggtgggttagtgctttgtatct

SEQ ID NO: 490822 - DNA, 25 bp, Homo sapien
gtgggttagtgctttgtatctgtct

SEQ ID NO: 490823 - DNA, 25 bp, Homo sapien
gggttagtgctttgtatctgtctct

SEQ ID NO: 490824 - DNA, 25 bp, Homo sapien
ttagtgctttgtatctgtctctctg

SEQ ID NO: 490825 - DNA, 25 bp, Homo sapien
cctcactaattctacacccatgaga

SEQ ID NO: 490826 - DNA, 25 bp, Homo sapien
ctacacccatgagaattagacatta

SEQ ID NO: 490827 - DNA, 25 bp, Homo sapien
gagaattagacattattctccttaa

SEQ ID NO: 490828 - DNA, 25 bp, Homo sapien
ccatcccctgaactacttgggaggt

SEQ ID NO: 490829 - DNA, 25 bp, Homo sapien
ttggtagagatgagaggccgcattt

SEQ ID NO: 490830 - DNA, 25 bp, Homo sapien
tgagaggccgcattttgctgctaaa

SEQ ID NO: 490831 - DNA, 25 bp, Homo sapien
gaaacttggagctgaagcacacacc

SEQ ID NO: 490832 - DNA, 25 bp, Homo sapien
acacacctggtctgcccctagattt

SEQ ID NO: 490833 - DNA, 25 bp, Homo sapien
tagatttctcctcaaggcctctgga

SEQ ID NO: 490834 - DNA, 25 bp, Homo sapien
tcctcaaggcctctggagcaaccag

SEQ ID NO: 490835 - DNA, 25 bp, Homo sapien
tgcccccttggaatgcagagcctgg

SEQ ID NO: 490836 - DNA, 25 bp, Homo sapien
ggcctgccaaactacaatgtggtag

SEQ ID NO: 490837 - DNA, 25 bp, Homo sapien
tggtaggctgaaacgatggtgttaa

SEQ ID NO: 490838 - DNA, 25 bp, Homo sapien
gatggtgttaattcttaggactact

SEQ ID NO: 490839 - DNA, 25 bp, Homo sapien
ttctcggccgactgctgcgtactgg

SEQ ID NO: 490840 - DNA, 25 bp, Homo sapien
cgctccggccggcactactgggagg

SEQ ID NO: 490841 - DNA, 25 bp, Homo sapien
ggagcctaaagaaccctcctggcct

SEQ ID NO: 490842 - DNA, 25 bp, Homo sapien
gaccggccagaatttagcttcactt

SEQ ID NO: 490843 - DNA, 25 bp, Homo sapien
ggccagaatttagcttcacttgaga

SEQ ID NO: 490844 - DNA, 25 bp, Homo sapien
ttagcttcacttgagagagatctgg

SEQ ID NO: 490845 - DNA, 25 bp, Homo sapien
gagagatctggaatggtcgccatga

SEQ ID NO: 490846 - DNA, 25 bp, Homo sapien
ggtcgccatgattgaaaccacgcac

SEQ ID NO: 490847 - DNA, 25 bp, Homo sapien
tgattgaaaccacgcaccattacat

SEQ ID NO: 490848 - DNA, 25 bp, Homo sapien
ttgaaaccacgcaccattacatcat

SEQ ID NO: 490849 - DNA, 25 bp, Homo sapien
cacgcaccattacatcatcattaca

SEQ ID NO: 490850 - DNA, 25 bp, Homo sapien
gtggtctgacagaattggcttcaaa

SEQ ID NO: 490851 - DNA, 25 bp, Homo sapien
gaagaaactaaaagccacctcttgc

SEQ ID NO: 490852 - DNA, 25 bp, Homo sapien
aagccacctcttgcaggaaactgca

SEQ ID NO: 490853 - DNA, 25 bp, Homo sapien
aggaaactgcactgccctcaacatc

SEQ ID NO: 490854 - DNA, 25 bp, Homo sapien
ggaggaagaccagactgagcgattt

SEQ ID NO: 490855 - DNA, 25 bp, Homo sapien
gactgagcgatttggaatccacatc

SEQ ID NO: 490856 - DNA, 25 bp, Homo sapien
tggaatccacatcctaatgctgcca

SEQ ID NO: 490857 - DNA, 25 bp, Homo sapien
gctgccacaagctgcatgcacaaag

SEQ ID NO: 490858 - DNA, 25 bp, Homo sapien
aagaccttaggcacatctcttcatt

SEQ ID NO: 490859 - DNA, 25 bp, Homo sapien
atctcttcatttctctgtacactgg

SEQ ID NO: 490860 - DNA, 25 bp, Homo sapien
tctgtacactggtttctctactatg

SEQ ID NO: 490861 - DNA, 25 bp, Homo sapien
gaacctcattcaaggattaggagtg

SEQ ID NO: 490862 - DNA, 25 bp, Homo sapien
ccagtgctgcaggaacggcctccac

SEQ ID NO: 490863 - DNA, 25 bp, Homo sapien
agagcctgggtcatgcacctggagt

SEQ ID NO: 490864 - DNA, 25 bp, Homo sapien
agcctgggtcatgcacctggagttg

SEQ ID NO: 490865 - DNA, 25 bp, Homo sapien
agtgaggtggccatatccaccacat

SEQ ID NO: 490866 - DNA, 25 bp, Homo sapien
tatccaccacatcgcatttcgtggg

SEQ ID NO: 490867 - DNA, 25 bp, Homo sapien
aaacttaaggtgtctgcttatccag

SEQ ID NO: 490868 - DNA, 25 bp, Homo sapien
ttaaggtgtctgcttatccagccag

SEQ ID NO: 490869 - DNA, 25 bp, Homo sapien
aaggtgtctgcttatccagccagaa

SEQ ID NO: 490870 - DNA, 25 bp, Homo sapien
tctgcttatccagccagaaataaaa

SEQ ID NO: 490871 - DNA, 25 bp, Homo sapien
aaaaatctgccagtggtgttcccaa

SEQ ID NO: 490872 - DNA, 25 bp, Homo sapien
aacaagcaatccctaaattctcgcc

SEQ ID NO: 490873 - DNA, 25 bp, Homo sapien
aattctcgcccaggaaagtatcttg

SEQ ID NO: 490874 - DNA, 25 bp, Homo sapien
gtttttgagaaccttgagagtgtat

SEQ ID NO: 490875 - DNA, 25 bp, Homo sapien
gaaccttgagagtgtatattctatg

SEQ ID NO: 490876 - DNA, 25 bp, Homo sapien
tgaagtaacccctaaactcagccag

SEQ ID NO: 490877 - DNA, 25 bp, Homo sapien
tctaattccatttacactgcattct

SEQ ID NO: 490878 - DNA, 25 bp, Homo sapien
tacactgcattcttcaaatgtaatt

SEQ ID NO: 490879 - DNA, 25 bp, Homo sapien
aaagatgccttttgcctcatccctt

SEQ ID NO: 490880 - DNA, 25 bp, Homo sapien
cttttgcctcatcccttgcttttaa

SEQ ID NO: 490881 - DNA, 25 bp, Homo sapien
attatagacttttggagactcacga

SEQ ID NO: 490882 - DNA, 25 bp, Homo sapien
gagactcacgaaacaagcaatccct

SEQ ID NO: 490883 - DNA, 25 bp, Homo sapien
aatcttttgtctacagctcctcgtc

SEQ ID NO: 490884 - DNA, 25 bp, Homo sapien
tcctcgtcaccttacgtcaatacta

SEQ ID NO: 490885 - DNA, 25 bp, Homo sapien
ttacgtcaatactaacctaagggtg

SEQ ID NO: 490886 - DNA, 25 bp, Homo sapien
taagggtgaatcttaccactcgacc

SEQ ID NO: 490887 - DNA, 25 bp, Homo sapien
tccaccaccatatctcaggttctaa

SEQ ID NO: 490888 - DNA, 25 bp, Homo sapien
gtacagtagaggctgtgtcttcccc

SEQ ID NO: 490889 - DNA, 25 bp, Homo sapien
gtcttccccagactgcaaatctgaa

SEQ ID NO: 490890 - DNA, 25 bp, Homo sapien
aagagatccctcttgtcttcagcag

SEQ ID NO: 490891 - DNA, 25 bp, Homo sapien
cttgtcttcagcaggtaatttcttg

SEQ ID NO: 490892 - DNA, 25 bp, Homo sapien
ttcttgaaattcagactggccgatg

SEQ ID NO: 490893 - DNA, 25 bp, Homo sapien
gactggccgatgtcaatttcagtga

SEQ ID NO: 490894 - DNA, 25 bp, Homo sapien
gacactgtgcactggcgtgatgcgt

SEQ ID NO: 490895 - DNA, 25 bp, Homo sapien
tgcactggcgtgatgcgtctgccgc

SEQ ID NO: 490896 - DNA, 25 bp, Homo sapien
gggcatccacggctgaatcctctgc

SEQ ID NO: 490897 - DNA, 25 bp, Homo sapien
cttccaggaaagacttatgcttctc

SEQ ID NO: 490898 - DNA, 25 bp, Homo sapien
agacttatgcttctcatggtcctag

SEQ ID NO: 490899 - DNA, 25 bp, Homo sapien
atggtcctagttctcatgctgatct

SEQ ID NO: 490900 - DNA, 25 bp, Homo sapien
catgctgatctttctacttggcaaa

SEQ ID NO: 490901 - DNA, 25 bp, Homo sapien
ggcaactctgggaacatttggcttg

SEQ ID NO: 490902 - DNA, 25 bp, Homo sapien
aatgagtaagattccctaggcctaa

SEQ ID NO: 490903 - DNA, 25 bp, Homo sapien
gattccctaggcctaaatgcagagg

SEQ ID NO: 490904 - DNA, 25 bp, Homo sapien
tgcagaggcctccaaatgaatttct

SEQ ID NO: 490905 - DNA, 25 bp, Homo sapien
taattcccagagtcttccataaata

SEQ ID NO: 490906 - DNA, 25 bp, Homo sapien
cagagtcttccataaataaccaaat

SEQ ID NO: 490907 - DNA, 25 bp, Homo sapien
aaccaaatggtctcatacacgtaca

SEQ ID NO: 490908 - DNA, 25 bp, Homo sapien
atggtctcatacacgtacaatagga

SEQ ID NO: 490909 - DNA, 25 bp, Homo sapien
taggatcttgttataacgctatcat

SEQ ID NO: 490910 - DNA, 25 bp, Homo sapien
aacgctatcatttgacatgtgactg

SEQ ID NO: 490911 - DNA, 25 bp, Homo sapien
gaaatattttatggtctccacccct

SEQ ID NO: 490912 - DNA, 25 bp, Homo sapien
catctttgaataactgccacttcta

SEQ ID NO: 490913 - DNA, 25 bp, Homo sapien
aactgccacttctaaggacgccatt

SEQ ID NO: 490914 - DNA, 25 bp, Homo sapien
ggacgccattcagagcagagcatta

SEQ ID NO: 490915 - DNA, 25 bp, Homo sapien
agagcattagcagaatttcaccatg

SEQ ID NO: 490916 - DNA, 25 bp, Homo sapien
ttgcttggcccatccagtccaggcg

SEQ ID NO: 490917 - DNA, 25 bp, Homo sapien
cagtccaggcgcctggagcaagtgc

SEQ ID NO: 490918 - DNA, 25 bp, Homo sapien
tttctctgtgtgatcccccacttct

SEQ ID NO: 490919 - DNA, 25 bp, Homo sapien
tgtgatcccccacttctgggctctg

SEQ ID NO: 490920 - DNA, 25 bp, Homo sapien
tctgccaccccacagtgggaaaggc

SEQ ID NO: 490921 - DNA, 25 bp, Homo sapien
cacagtgggaaaggccaccctagaa

SEQ ID NO: 490922 - DNA, 25 bp, Homo sapien
aggccaccctagaaagaagtccgct

SEQ ID NO: 490923 - DNA, 25 bp, Homo sapien
ggccaccctagaaagaagtccgctg

SEQ ID NO: 490924 - DNA, 25 bp, Homo sapien
accctagaaagaagtccgctggcac

SEQ ID NO: 490925 - DNA, 25 bp, Homo sapien
gcaggaagggccaggaccagaacct

SEQ ID NO: 490926 - DNA, 25 bp, Homo sapien
ggaagggccaggaccagaaccttgc

SEQ ID NO: 490927 - DNA, 25 bp, Homo sapien
tatagtttcctgtacgcatggcaat

SEQ ID NO: 490928 - DNA, 25 bp, Homo sapien
atatgcatttctatttcttcccgtg

SEQ ID NO: 490929 - DNA, 25 bp, Homo sapien
tcggtcaacattttcaggcatccct

SEQ ID NO: 490930 - DNA, 25 bp, Homo sapien
aggcatccctgtcacttcaaagaca

SEQ ID NO: 490931 - DNA, 25 bp, Homo sapien
aaagacaggttccttatctctgctc

SEQ ID NO: 490932 - DNA, 25 bp, Homo sapien
atctctgctcggagttactatgtag

SEQ ID NO: 490933 - DNA, 25 bp, Homo sapien
actatgtaggtgtgggtctgctgct

SEQ ID NO: 490934 - DNA, 25 bp, Homo sapien
gggtctgctgctgaattcttttaat

SEQ ID NO: 490935 - DNA, 25 bp, Homo sapien
ttaatagttgctcctttgggtccaa

SEQ ID NO: 490936 - DNA, 25 bp, Homo sapien
ataagggaccctgacttggacggtg

SEQ ID NO: 490937 - DNA, 25 bp, Homo sapien
ttgaccgggcagattaggactacat

SEQ ID NO: 490938 - DNA, 25 bp, Homo sapien
accagggctcccaggagacccttat

SEQ ID NO: 490939 - DNA, 25 bp, Homo sapien
aggagacccttattcctccaaggct

SEQ ID NO: 490940 - DNA, 25 bp, Homo sapien
ttattcctccaaggctgtgatgccc

SEQ ID NO: 490941 - DNA, 25 bp, Homo sapien
tgtgatgcccacacagcatcagcat

SEQ ID NO: 490942 - DNA, 25 bp, Homo sapien
acagcatcagcatgggcttagagct

SEQ ID NO: 490943 - DNA, 25 bp, Homo sapien
tgggcttagagctggcatgaccaat

SEQ ID NO: 490944 - DNA, 25 bp, Homo sapien
ggagaagggctagcccaccgcagca

SEQ ID NO: 490945 - DNA, 25 bp, Homo sapien
ggtcaggaaccacctcaaaaagtgc

SEQ ID NO: 490946 - DNA, 25 bp, Homo sapien
agctccctgggatgcctgaacctcg

SEQ ID NO: 490947 - DNA, 25 bp, Homo sapien
tgggatgcctgaacctcgggtcctc

SEQ ID NO: 490948 - DNA, 25 bp, Homo sapien
tgggcagcctcgaccaacaccaggg

SEQ ID NO: 490949 - DNA, 25 bp, Homo sapien
tggccctcaggagactcctcagagt

SEQ ID NO: 490950 - DNA, 25 bp, Homo sapien
gtcaaagggaatgtgcacgccctcc

SEQ ID NO: 490951 - DNA, 25 bp, Homo sapien
gatgagtcagagctgccagccacca

SEQ ID NO: 490952 - DNA, 25 bp, Homo sapien
aaagggaatgtgcacgccctcctga

SEQ ID NO: 490953 - DNA, 25 bp, Homo sapien
agcccattgcccactttgtcactgt

SEQ ID NO: 490954 - DNA, 25 bp, Homo sapien
tcactgtcagggtctgagtcgctga

SEQ ID NO: 490955 - DNA, 25 bp, Homo sapien
atgtgcacgccctcctgagtgatga

SEQ ID NO: 490956 - DNA, 25 bp, Homo sapien
caggtcctggaagtagcggtggcca

SEQ ID NO: 490957 - DNA, 25 bp, Homo sapien
tgcacgccctcctgagtgatgagcc

SEQ ID NO: 490958 - DNA, 25 bp, Homo sapien
cacacggccgtggtgtacaggccaa

SEQ ID NO: 490959 - DNA, 25 bp, Homo sapien
cggccgtggtgtacaggccaaaagt

SEQ ID NO: 490960 - DNA, 25 bp, Homo sapien
gaaggacaatctccaaaacttgctg

SEQ ID NO: 490961 - DNA, 25 bp, Homo sapien
aaaacttgctgaggccttctcaggg

SEQ ID NO: 490962 - DNA, 25 bp, Homo sapien
ggcgcacgctcccaaatgcctgaag

SEQ ID NO: 490963 - DNA, 25 bp, Homo sapien
atgcctgaagcattttcccttggtg

SEQ ID NO: 490964 - DNA, 25 bp, Homo sapien
aagcattttcccttggtgaagaggc

SEQ ID NO: 490965 - DNA, 25 bp, Homo sapien
gaagaggccgtcaggtagagcacct

SEQ ID NO: 490966 - DNA, 25 bp, Homo sapien
ggtagagcacctcagttcacagaga

SEQ ID NO: 490967 - DNA, 25 bp, Homo sapien
gggccatgtatatagctgagctacc

SEQ ID NO: 490968 - DNA, 25 bp, Homo sapien
tgagctaccacagctttggtcagcc

SEQ ID NO: 490969 - DNA, 25 bp, Homo sapien
gtcagcccaacttcctgcttctgag

SEQ ID NO: 490970 - DNA, 25 bp, Homo sapien
agccagaaggcctgtgctcaagtcc

SEQ ID NO: 490971 - DNA, 25 bp, Homo sapien
tgacatcaacaaatcccctcagtta

SEQ ID NO: 490972 - DNA, 25 bp, Homo sapien
aaatcccctcagttacaacgtatag

SEQ ID NO: 490973 - DNA, 25 bp, Homo sapien
aaaagctcatgtggtatgacctcaa

SEQ ID NO: 490974 - DNA, 25 bp, Homo sapien
gtatgacctcaaggttgctaacctg

SEQ ID NO: 490975 - DNA, 25 bp, Homo sapien
ttgctaacctggtcactcatggtaa

SEQ ID NO: 490976 - DNA, 25 bp, Homo sapien
gaaactctgattggcagctttgtat

SEQ ID NO: 490977 - DNA, 25 bp, Homo sapien
tgattaggttttaggcgttctttca

SEQ ID NO: 490978 - DNA, 25 bp, Homo sapien
gagaactatcctatttggtgcttag

SEQ ID NO: 490979 - DNA, 25 bp, Homo sapien
agattttgaattactgtacgtacca

SEQ ID NO: 490980 - DNA, 25 bp, Homo sapien
tgtacgtaccagttgttgccatttc

SEQ ID NO: 490981 - DNA, 25 bp, Homo sapien
ccagttgttgccatttctttattaa

SEQ ID NO: 490982 - DNA, 25 bp, Homo sapien
gcaggaccctcaaggtagaacatca

SEQ ID NO: 490983 - DNA, 25 bp, Homo sapien
aaggtagaacatcagctcttccccg

SEQ ID NO: 490984 - DNA, 25 bp, Homo sapien
ggtagaacatcagctcttccccgag

SEQ ID NO: 490985 - DNA, 25 bp, Homo sapien
gagctaaaacacctctcccacctgg

SEQ ID NO: 490986 - DNA, 25 bp, Homo sapien
cagctccacgagtctcacagaacag

SEQ ID NO: 490987 - DNA, 25 bp, Homo sapien
agctccacgagtctcacagaacagc

SEQ ID NO: 490988 - DNA, 25 bp, Homo sapien
tccacgagtctcacagaacagccac

SEQ ID NO: 490989 - DNA, 25 bp, Homo sapien
agccacactggctccttcgttgtct

SEQ ID NO: 490990 - DNA, 25 bp, Homo sapien
acactggctccttcgttgtcttcag

SEQ ID NO: 490991 - DNA, 25 bp, Homo sapien
actggctccttcgttgtcttcagct

SEQ ID NO: 490992 - DNA, 25 bp, Homo sapien
gttgtcttcagctccacaacctaag

SEQ ID NO: 490993 - DNA, 25 bp, Homo sapien
tcaccctgaactcctatgttaccaa

SEQ ID NO: 490994 - DNA, 25 bp, Homo sapien
accctgaactcctatgttaccaatg

SEQ ID NO: 490995 - DNA, 25 bp, Homo sapien
cctgaactcctatgttaccaatgtg

SEQ ID NO: 490996 - DNA, 25 bp, Homo sapien
actcctatgttaccaatgtgtatcg

SEQ ID NO: 490997 - DNA, 25 bp, Homo sapien
tgttaccaatgtgtatcgtctccct

SEQ ID NO: 490998 - DNA, 25 bp, Homo sapien
ttaccaatgtgtatcgtctccctct

SEQ ID NO: 490999 - DNA, 25 bp, Homo sapien
gtatcgtctccctctccctaaagtg

SEQ ID NO: 491000 - DNA, 25 bp, Homo sapien
aatctttgctttcttttgcacaatg

SEQ ID NO: 491001 - DNA, 25 bp, Homo sapien
aaaattccagtaatttcgaagaatg

SEQ ID NO: 491002 - DNA, 25 bp, Homo sapien
atttcgaagaatgtggtgttggtgc

SEQ ID NO: 491003 - DNA, 25 bp, Homo sapien
gaatgtggtgttggtgctttcctaa

SEQ ID NO: 491004 - DNA, 25 bp, Homo sapien
agaagctgcagcaactttatggaag

SEQ ID NO: 491005 - DNA, 25 bp, Homo sapien
gaagctgcagcaactttatggaagg

SEQ ID NO: 491006 - DNA, 25 bp, Homo sapien
aagctgcagcaactttatggaagga

SEQ ID NO: 491007 - DNA, 25 bp, Homo sapien
agctgcagcaactttatggaaggag

SEQ ID NO: 491008 - DNA, 25 bp, Homo sapien
gaaactagagcttcagttcatccac

SEQ ID NO: 491009 - DNA, 25 bp, Homo sapien
ctagagcttcagttcatccacctct

SEQ ID NO: 491010 - DNA, 25 bp, Homo sapien
gagcttcagttcatccacctctcag

SEQ ID NO: 491011 - DNA, 25 bp, Homo sapien
agcttcagttcatccacctctcagg

SEQ ID NO: 491012 - DNA, 25 bp, Homo sapien
acagacagacaccatgagaaagtac

SEQ ID NO: 491013 - DNA, 25 bp, Homo sapien
cagacagacaccatgagaaagtaca

SEQ ID NO: 491014 - DNA, 25 bp, Homo sapien
agacagacaccatgagaaagtacat

SEQ ID NO: 491015 - DNA, 25 bp, Homo sapien
gaagacccaaatagagcctttttat

SEQ ID NO: 491016 - DNA, 25 bp, Homo sapien
tatttatcattcacttcatttcctg

SEQ ID NO: 491017 - DNA, 25 bp, Homo sapien
acttcatttcctgtctgttggtcct

SEQ ID NO: 491018 - DNA, 25 bp, Homo sapien
ttggtcctccagcaattctcagtga

SEQ ID NO: 491019 - DNA, 25 bp, Homo sapien
gtaagctgaaccttacatctggttc

SEQ ID NO: 491020 - DNA, 25 bp, Homo sapien
atctggttcacatcaagcatgcttc

SEQ ID NO: 491021 - DNA, 25 bp, Homo sapien
tttttctcagaagcacttttagtgt

SEQ ID NO: 491022 - DNA, 25 bp, Homo sapien
agcacttttagtgtttctgcaagat

SEQ ID NO: 491023 - DNA, 25 bp, Homo sapien
tagtgtttctgcaagatctcacagt

SEQ ID NO: 491024 - DNA, 25 bp, Homo sapien
gatctcacagtgtacacaggattcg

SEQ ID NO: 491025 - DNA, 25 bp, Homo sapien
gtgtacacaggattcgttgccaaat

SEQ ID NO: 491026 - DNA, 25 bp, Homo sapien
gcatcagagggagactagggaaagg

SEQ ID NO: 491027 - DNA, 25 bp, Homo sapien
caaaaatcatcatatagtacgtggt

SEQ ID NO: 491028 - DNA, 25 bp, Homo sapien
aaatcatcatatagtacgtggttac

SEQ ID NO: 491029 - DNA, 25 bp, Homo sapien
atcatcatatagtacgtggttacac

SEQ ID NO: 491030 - DNA, 25 bp, Homo sapien
tcatcatatagtacgtggttacaca

SEQ ID NO: 491031 - DNA, 25 bp, Homo sapien
atcatatagtacgtggttacacaac

SEQ ID NO: 491032 - DNA, 25 bp, Homo sapien
catatagtacgtggttacacaactc

SEQ ID NO: 491033 - DNA, 25 bp, Homo sapien
atatagtacgtggttacacaactct

SEQ ID NO: 491034 - DNA, 25 bp, Homo sapien
aaaggagtgaactatatctcaatat

SEQ ID NO: 491035 - DNA, 25 bp, Homo sapien
ggagtgaactatatctcaatatata

SEQ ID NO: 491036 - DNA, 25 bp, Homo sapien
gtgaactatatctcaatatataagg

SEQ ID NO: 491037 - DNA, 25 bp, Homo sapien
tgctgaaatggcacttctcccaatg

SEQ ID NO: 491038 - DNA, 25 bp, Homo sapien
aaatggcacttctcccaatgaggtg

SEQ ID NO: 491039 - DNA, 25 bp, Homo sapien
acttctcccaatgaggtggagccca

SEQ ID NO: 491040 - DNA, 25 bp, Homo sapien
gtggagcccacttctctgaattaac

SEQ ID NO: 491041 - DNA, 25 bp, Homo sapien
ttctctgaattaacagcgggttgac

SEQ ID NO: 491042 - DNA, 25 bp, Homo sapien
agcgggttgacatgccaatggccac

SEQ ID NO: 491043 - DNA, 25 bp, Homo sapien
atgccaatggccaccctgtggtgac

SEQ ID NO: 491044 - DNA, 25 bp, Homo sapien
atggccaccctgtggtgacctctga

SEQ ID NO: 491045 - DNA, 25 bp, Homo sapien
aggcagaggcctcgaggacacccat

SEQ ID NO: 491046 - DNA, 25 bp, Homo sapien
ggcctcgaggacacccatttatggg

SEQ ID NO: 491047 - DNA, 25 bp, Homo sapien
gtacatgagcaagatggctgtcaca

SEQ ID NO: 491048 - DNA, 25 bp, Homo sapien
gtcctaaagttcaaagagcattgag

SEQ ID NO: 491049 - DNA, 25 bp, Homo sapien
aagagcattgaggtgtgttttggca

SEQ ID NO: 491050 - DNA, 25 bp, Homo sapien
gttttggcaggcagttgagttacta

SEQ ID NO: 491051 - DNA, 25 bp, Homo sapien
gcagttgagttactattgggtcgac

SEQ ID NO: 491052 - DNA, 25 bp, Homo sapien
tattgggtcgacttgatcctttgga

SEQ ID NO: 491053 - DNA, 25 bp, Homo sapien
gatcctttggaatcttgtttgtttt

SEQ ID NO: 491054 - DNA, 25 bp, Homo sapien
tcatgaccccctgaaactctaaaaa

SEQ ID NO: 491055 - DNA, 25 bp, Homo sapien
tctaaaaacttattgaggactccga

SEQ ID NO: 491056 - DNA, 25 bp, Homo sapien
gaggactccgaagaattcttgctta

SEQ ID NO: 491057 - DNA, 25 bp, Homo sapien
gaattcttgcttatgtggattgtat

SEQ ID NO: 491058 - DNA, 25 bp, Homo sapien
ggattgtattaatgcttaccatatc

SEQ ID NO: 491059 - DNA, 25 bp, Homo sapien
agccctgcagtcacgtgaggcccct

SEQ ID NO: 491060 - DNA, 25 bp, Homo sapien
aggcccctgtgcagtagagagcctt

SEQ ID NO: 491061 - DNA, 25 bp, Homo sapien
gggctgggaaagaacttggacttct

SEQ ID NO: 491062 - DNA, 25 bp, Homo sapien
gctgggaaagaacttggacttctaa

SEQ ID NO: 491063 - DNA, 25 bp, Homo sapien
gaaagaacttggacttctaaaggcg

SEQ ID NO: 491064 - DNA, 25 bp, Homo sapien
agaacttggacttctaaaggcggag

SEQ ID NO: 491065 - DNA, 25 bp, Homo sapien
tggacttctaaaggcggagggtctc

SEQ ID NO: 491066 - DNA, 25 bp, Homo sapien
cttctaaaggcggagggtctccctg

SEQ ID NO: 491067 - DNA, 25 bp, Homo sapien
ttctaaaggcggagggtctccctgg

SEQ ID NO: 491068 - DNA, 25 bp, Homo sapien
taaaggcggagggtctccctgggca

SEQ ID NO: 491069 - DNA, 25 bp, Homo sapien
gggcaccctgcaggcaggcagacca

SEQ ID NO: 491070 - DNA, 25 bp, Homo sapien
gaccttttttagtgcccagccatgc

SEQ ID NO: 491071 - DNA, 25 bp, Homo sapien
cccagccatgcctaagagtgtgtca

SEQ ID NO: 491072 - DNA, 25 bp, Homo sapien
catgcctaagagtgtgtcatctgaa

SEQ ID NO: 491073 - DNA, 25 bp, Homo sapien
gaagagggaagcatctgcatactgc

SEQ ID NO: 491074 - DNA, 25 bp, Homo sapien
ctgattgctcagtcctcactaccta

SEQ ID NO: 491075 - DNA, 25 bp, Homo sapien
tcactacctaccagacccgttggta

SEQ ID NO: 491076 - DNA, 25 bp, Homo sapien
aaaagcagtctgcaccaccagtgat

SEQ ID NO: 491077 - DNA, 25 bp, Homo sapien
gcaccaccagtgataagctgtgaca

SEQ ID NO: 491078 - DNA, 25 bp, Homo sapien
gagtggaacagcctcaatgaaatga

SEQ ID NO: 491079 - DNA, 25 bp, Homo sapien
acagtggcattaaggatggtctctt

SEQ ID NO: 491080 - DNA, 25 bp, Homo sapien
cttaatcctgtgttaaccactagat

SEQ ID NO: 491081 - DNA, 25 bp, Homo sapien
atgtgaacaggttttatagtggaaa

SEQ ID NO: 491082 - DNA, 25 bp, Homo sapien
atagtggaaaaggtcccaggccaga

SEQ ID NO: 491083 - DNA, 25 bp, Homo sapien
tagtggaaaaggtcccaggccagaa

SEQ ID NO: 491084 - DNA, 25 bp, Homo sapien
tggaaaaggtcccaggccagaactg

SEQ ID NO: 491085 - DNA, 25 bp, Homo sapien
ggaaaaggtcccaggccagaactga

SEQ ID NO: 491086 - DNA, 25 bp, Homo sapien
gaaaaggtcccaggccagaactgag

SEQ ID NO: 491087 - DNA, 25 bp, Homo sapien
aaggtcccaggccagaactgaggct

SEQ ID NO: 491088 - DNA, 25 bp, Homo sapien
ggtcccaggccagaactgaggctgt

SEQ ID NO: 491089 - DNA, 25 bp, Homo sapien
aaatgaacagtttgctaggctgggc

SEQ ID NO: 491090 - DNA, 25 bp, Homo sapien
atgaacagtttgctaggctgggcac

SEQ ID NO: 491091 - DNA, 25 bp, Homo sapien
tgaacagtttgctaggctgggcaca

SEQ ID NO: 491092 - DNA, 25 bp, Homo sapien
ggcataggtgcaccctctgcagaga

SEQ ID NO: 491093 - DNA, 25 bp, Homo sapien
aagctctcagcttcaatcctcttat

SEQ ID NO: 491094 - DNA, 25 bp, Homo sapien
ttcaatcctcttatcctcaatgtag

SEQ ID NO: 491095 - DNA, 25 bp, Homo sapien
tcttatcctcaatgtagccacggcc

SEQ ID NO: 491096 - DNA, 25 bp, Homo sapien
tcagaagcccatgggaatccctgca

SEQ ID NO: 491097 - DNA, 25 bp, Homo sapien
atgggaatccctgcaaggtggcttt

SEQ ID NO: 491098 - DNA, 25 bp, Homo sapien
aaggtggctttgtctcatctgcgga

SEQ ID NO: 491099 - DNA, 25 bp, Homo sapien
atctgcggagttggctgatgcgatc

SEQ ID NO: 491100 - DNA, 25 bp, Homo sapien
tggctgatgcgatcggctcatgctg

SEQ ID NO: 491101 - DNA, 25 bp, Homo sapien
atggcaagaaacgtcccactgtcaa

SEQ ID NO: 491102 - DNA, 25 bp, Homo sapien
agtgaggcaggcataggtgcaccct

SEQ ID NO: 491103 - DNA, 25 bp, Homo sapien
tgtgattccacacatcttcttggtc

SEQ ID NO: 491104 - DNA, 25 bp, Homo sapien
cacacatcttcttggtcttgcataa

SEQ ID NO: 491105 - DNA, 25 bp, Homo sapien
ggtcttgcataaggcagttcctgga

SEQ ID NO: 491106 - DNA, 25 bp, Homo sapien
ctggagacccagcactctggttctc

SEQ ID NO: 491107 - DNA, 25 bp, Homo sapien
ctctctgcctgtgagaagcggaatg

SEQ ID NO: 491108 - DNA, 25 bp, Homo sapien
tgagaagcggaatgggtactgtcta

SEQ ID NO: 491109 - DNA, 25 bp, Homo sapien
agggcctgggcttgaatgtgactct

SEQ ID NO: 491110 - DNA, 25 bp, Homo sapien
gactctgttgagacatggccagcaa

SEQ ID NO: 491111 - DNA, 25 bp, Homo sapien
agcaattctggcacttggctgtcat

SEQ ID NO: 491112 - DNA, 25 bp, Homo sapien
tggcacttggctgtcattcggctgg

SEQ ID NO: 491113 - DNA, 25 bp, Homo sapien
attcggctggcctgcgcagagattg

SEQ ID NO: 491114 - DNA, 25 bp, Homo sapien
gtattctttaccactactctaagaa

SEQ ID NO: 491115 - DNA, 25 bp, Homo sapien
tattctttaccactactctaagaag

SEQ ID NO: 491116 - DNA, 25 bp, Homo sapien
attctttaccactactctaagaagt

SEQ ID NO: 491117 - DNA, 25 bp, Homo sapien
ttctttaccactactctaagaagta

SEQ ID NO: 491118 - DNA, 25 bp, Homo sapien
ctttaccactactctaagaagtagg

SEQ ID NO: 491119 - DNA, 25 bp, Homo sapien
tactctaagaagtaggtactgggcc

SEQ ID NO: 491120 - DNA, 25 bp, Homo sapien
actctaagaagtaggtactgggcca

SEQ ID NO: 491121 - DNA, 25 bp, Homo sapien
ctctaagaagtaggtactgggccag

SEQ ID NO: 491122 - DNA, 25 bp, Homo sapien
ctaagaagtaggtactgggccaggc

SEQ ID NO: 491123 - DNA, 25 bp, Homo sapien
aagaagtaggtactgggccaggcgc

SEQ ID NO: 491124 - DNA, 25 bp, Homo sapien
gaagtaggtactgggccaggcgcag

SEQ ID NO: 491125 - DNA, 25 bp, Homo sapien
ctgtcggtcctgactgtaccattta

SEQ ID NO: 491126 - DNA, 25 bp, Homo sapien
gtaccatttataaacagcttcactt

SEQ ID NO: 491127 - DNA, 25 bp, Homo sapien
agcttcactttcagcagttctcagc

SEQ ID NO: 491128 - DNA, 25 bp, Homo sapien
agttctcagccctcttaagctaggg

SEQ ID NO: 491129 - DNA, 25 bp, Homo sapien
tagggtcattgtcagtagggatact

SEQ ID NO: 491130 - DNA, 25 bp, Homo sapien
gcttcataagcaccagcagaacacc

SEQ ID NO: 491131 - DNA, 25 bp, Homo sapien
gggtgaaagcaaccagcactgccct

SEQ ID NO: 491132 - DNA, 25 bp, Homo sapien
ctggcgcttcataggttcttagagt

SEQ ID NO: 491133 - DNA, 25 bp, Homo sapien
tttcagtctaacacagcactgcctg

SEQ ID NO: 491134 - DNA, 25 bp, Homo sapien
taccgtgttcaccaaacttgtgtcc

SEQ ID NO: 491135 - DNA, 25 bp, Homo sapien
aacttgtgtccaaatagctttgggc

SEQ ID NO: 491136 - DNA, 25 bp, Homo sapien
acattttctgctgtactaggtcaaa

SEQ ID NO: 491137 - DNA, 25 bp, Homo sapien
tattgtaagacttcaaattgagcga

SEQ ID NO: 491138 - DNA, 25 bp, Homo sapien
aattgagcgaagtctgtttctataa

SEQ ID NO: 491139 - DNA, 25 bp, Homo sapien
aatgcttttctgtctatatttctaa

SEQ ID NO: 491140 - DNA, 25 bp, Homo sapien
ttctaaattttctctcttcttatgg

SEQ ID NO: 491141 - DNA, 25 bp, Homo sapien
tcttcttatggccttggttacttcc

SEQ ID NO: 491142 - DNA, 25 bp, Homo sapien
ttggttacttcctttgtgccagatt

SEQ ID NO: 491143 - DNA, 25 bp, Homo sapien
gtgccagattcccatagacacagtt

SEQ ID NO: 491144 - DNA, 25 bp, Homo sapien
gattcccatagacacagttattcaa

SEQ ID NO: 491145 - DNA, 25 bp, Homo sapien
agttattcaacaagacctgtggtct

SEQ ID NO: 491146 - DNA, 25 bp, Homo sapien
caggctgattcttccgttcttcttg

SEQ ID NO: 491147 - DNA, 25 bp, Homo sapien
gcaattatttatgaatttgtgcaat

SEQ ID NO: 491148 - DNA, 25 bp, Homo sapien
gattttcttatcaatcaagttcttg

SEQ ID NO: 491149 - DNA, 25 bp, Homo sapien
caagttcttgaatttgattctaagt

SEQ ID NO: 491150 - DNA, 25 bp, Homo sapien
agttgcatattataacagtctcgaa

SEQ ID NO: 491151 - DNA, 25 bp, Homo sapien
taacagtctcgaaaattattttact

SEQ ID NO: 491152 - DNA, 25 bp, Homo sapien
attattttacttgcccaacaaatat

SEQ ID NO: 491153 - DNA, 25 bp, Homo sapien
tacttgcccaacaaatattactttt

SEQ ID NO: 491154 - DNA, 25 bp, Homo sapien
tcatttgacctacctaattgctaaa

SEQ ID NO: 491155 - DNA, 25 bp, Homo sapien
tgacctacctaattgctaaatgaat

SEQ ID NO: 491156 - DNA, 25 bp, Homo sapien
acatatggtggactgttattaagag

SEQ ID NO: 491157 - DNA, 25 bp, Homo sapien
tatttactttaaggtagcttgaaat

SEQ ID NO: 491158 - DNA, 25 bp, Homo sapien
ctaaccttaggtcctactgtactct

SEQ ID NO: 491159 - DNA, 25 bp, Homo sapien
ctaaaggcactcctctgactaaaga

SEQ ID NO: 491160 - DNA, 25 bp, Homo sapien
ggcactcctctgactaaagagaagt

SEQ ID NO: 491161 - DNA, 25 bp, Homo sapien
ccttaggtcctactgtactcttggt

SEQ ID NO: 491162 - DNA, 25 bp, Homo sapien
actaaagagaagtggcagctgagca

SEQ ID NO: 491163 - DNA, 25 bp, Homo sapien
gcctgcccagggattttcttctgct

SEQ ID NO: 491164 - DNA, 25 bp, Homo sapien
aaaggacattattaagacaactggt

SEQ ID NO: 491165 - DNA, 25 bp, Homo sapien
gacaactggtctgtactgtattgcc

SEQ ID NO: 491166 - DNA, 25 bp, Homo sapien
aactggtctgtactgtattgcctga

SEQ ID NO: 491167 - DNA, 25 bp, Homo sapien
ggtctgtactgtattgcctgatagt

SEQ ID NO: 491168 - DNA, 25 bp, Homo sapien
ctgtactgtattgcctgatagtatc

SEQ ID NO: 491169 - DNA, 25 bp, Homo sapien
ttgcctaactggtccatgttaagaa

SEQ ID NO: 491170 - DNA, 25 bp, Homo sapien
gcctaactggtccatgttaagaaat

SEQ ID NO: 491171 - DNA, 25 bp, Homo sapien
aactggtccatgttaagaaatgtgt

SEQ ID NO: 491172 - DNA, 25 bp, Homo sapien
catgttaagaaatgtgtgtgggccg

SEQ ID NO: 491173 - DNA, 25 bp, Homo sapien
aagaaatgtgtgtgggccgggtgca

SEQ ID NO: 491174 - DNA, 25 bp, Homo sapien
agaatttacagttagctgggcgcca

SEQ ID NO: 491175 - DNA, 25 bp, Homo sapien
gaatttacagttagctgggcgccat

SEQ ID NO: 491176 - DNA, 25 bp, Homo sapien
aatttacagttagctgggcgccatt

SEQ ID NO: 491177 - DNA, 25 bp, Homo sapien
atttacagttagctgggcgccattg

SEQ ID NO: 491178 - DNA, 25 bp, Homo sapien
tttacagttagctgggcgccattgt

SEQ ID NO: 491179 - DNA, 25 bp, Homo sapien
ttacagttagctgggcgccattgta

SEQ ID NO: 491180 - DNA, 25 bp, Homo sapien
atgttacaaattttttccagctgag

SEQ ID NO: 491181 - DNA, 25 bp, Homo sapien
aagtgaatatgtatctagttgtaag

SEQ ID NO: 491182 - DNA, 25 bp, Homo sapien
actctatgtcctgtaacttttctca

SEQ ID NO: 491183 - DNA, 25 bp, Homo sapien
tatgtcctgtaacttttctcacttg

SEQ ID NO: 491184 - DNA, 25 bp, Homo sapien
ttgtaataatacagcattctcaccc

SEQ ID NO: 491185 - DNA, 25 bp, Homo sapien
agcattctcaccctgttaaatggaa

SEQ ID NO: 491186 - DNA, 25 bp, Homo sapien
taaatggaaatttagagcaccctta

SEQ ID NO: 491187 - DNA, 25 bp, Homo sapien
ttagagcacccttaaattccggaat

SEQ ID NO: 491188 - DNA, 25 bp, Homo sapien
taaattccggaataaaattgctatt

SEQ ID NO: 491189 - DNA, 25 bp, Homo sapien
gaaataacttttatgggattagaat

SEQ ID NO: 491190 - DNA, 25 bp, Homo sapien
ttatgggattagaatccatttttta

SEQ ID NO: 491191 - DNA, 25 bp, Homo sapien
taaagatgtgtgtacctcccaggcc

SEQ ID NO: 491192 - DNA, 25 bp, Homo sapien
ccaggccactctgatgcaagggcag

SEQ ID NO: 491193 - DNA, 25 bp, Homo sapien
gttgggaatggctctgtgactccag

SEQ ID NO: 491194 - DNA, 25 bp, Homo sapien
tgtgactccagaagctccgtctaaa

SEQ ID NO: 491195 - DNA, 25 bp, Homo sapien
gaagctccgtctaaaactccaaaga

SEQ ID NO: 491196 - DNA, 25 bp, Homo sapien
atttgtgagcacgatgcggcttctt

SEQ ID NO: 491197 - DNA, 25 bp, Homo sapien
ttttgcagagcaacctaagcgggca

SEQ ID NO: 491198 - DNA, 25 bp, Homo sapien
gggcagatgtacaaaccgtgtgttc

SEQ ID NO: 491199 - DNA, 25 bp, Homo sapien
gtgtgttcgaaacccctgagtccat

SEQ ID NO: 491200 - DNA, 25 bp, Homo sapien
aaacccctgagtccatgtgtgtgaa

SEQ ID NO: 491201 - DNA, 25 bp, Homo sapien
gtgaaaatgcaggttttctcttaga

SEQ ID NO: 491202 - DNA, 25 bp, Homo sapien
ccctgttcttgtcatctatggaaag

SEQ ID NO: 491203 - DNA, 25 bp, Homo sapien
cctgttcttgtcatctatggaaaga

SEQ ID NO: 491204 - DNA, 25 bp, Homo sapien
gttcttgtcatctatggaaagacta

SEQ ID NO: 491205 - DNA, 25 bp, Homo sapien
gtcatctatggaaagactaggccct

SEQ ID NO: 491206 - DNA, 25 bp, Homo sapien
tcatctatggaaagactaggccctc

SEQ ID NO: 491207 - DNA, 25 bp, Homo sapien
catctatggaaagactaggccctca

SEQ ID NO: 491208 - DNA, 25 bp, Homo sapien
atctatggaaagactaggccctcag

SEQ ID NO: 491209 - DNA, 25 bp, Homo sapien
tctatggaaagactaggccctcagg

SEQ ID NO: 491210 - DNA, 25 bp, Homo sapien
ctatggaaagactaggccctcaggg

SEQ ID NO: 491211 - DNA, 25 bp, Homo sapien
ggacagtagtggtaaccacccccat

SEQ ID NO: 491212 - DNA, 25 bp, Homo sapien
tagtggtaaccacccccattgggtg

SEQ ID NO: 491213 - DNA, 25 bp, Homo sapien
tacgcatcttgtgtcccggtttcag

SEQ ID NO: 491214 - DNA, 25 bp, Homo sapien
ggtttcagcgtcctaatgacggtaa

SEQ ID NO: 491215 - DNA, 25 bp, Homo sapien
gaggtgtcattaggccagctcaaca

SEQ ID NO: 491216 - DNA, 25 bp, Homo sapien
acacttgctttccttatgaggctca

SEQ ID NO: 491217 - DNA, 25 bp, Homo sapien
ttatgaggctcatttcctgcccggg

SEQ ID NO: 491218 - DNA, 25 bp, Homo sapien
gaacaccctgagactttcggaggtt

SEQ ID NO: 491219 - DNA, 25 bp, Homo sapien
tccttaccatttattgtttcgtgaa

SEQ ID NO: 491220 - DNA, 25 bp, Homo sapien
ttttcctagagacacatagctggca

SEQ ID NO: 491221 - DNA, 25 bp, Homo sapien
atagctggcaagagggagcctcact

SEQ ID NO: 491222 - DNA, 25 bp, Homo sapien
gagcctcactgggttcggcactaga

SEQ ID NO: 491223 - DNA, 25 bp, Homo sapien
cactgggttcggcactagatcctgt

SEQ ID NO: 491224 - DNA, 25 bp, Homo sapien
tggttcccacagtgttagcgtccct

SEQ ID NO: 491225 - DNA, 25 bp, Homo sapien
tcccacagtgttagcgtccctgaaa

SEQ ID NO: 491226 - DNA, 25 bp, Homo sapien
acagtgttagcgtccctgaaaagac

SEQ ID NO: 491227 - DNA, 25 bp, Homo sapien
gttagcgtccctgaaaagacaatat

SEQ ID NO: 491228 - DNA, 25 bp, Homo sapien
aagacaatattctctctaaagcaat

SEQ ID NO: 491229 - DNA, 25 bp, Homo sapien
aatattctctctaaagcaataaggg

SEQ ID NO: 491230 - DNA, 25 bp, Homo sapien
gggagactcctgttgtgactgaatg

SEQ ID NO: 491231 - DNA, 25 bp, Homo sapien
tcctgttgtgactgaatgtaacccc

SEQ ID NO: 491232 - DNA, 25 bp, Homo sapien
gaagggggacactcttcctgtctct

SEQ ID NO: 491233 - DNA, 25 bp, Homo sapien
ttctccccagctaaagagactttgg

SEQ ID NO: 491234 - DNA, 25 bp, Homo sapien
cccagctaaagagactttggactta

SEQ ID NO: 491235 - DNA, 25 bp, Homo sapien
tgctgatgctttctgacaccattcc

SEQ ID NO: 491236 - DNA, 25 bp, Homo sapien
gatgctttctgacaccattcctctg

SEQ ID NO: 491237 - DNA, 25 bp, Homo sapien
acaccattcctctggagttgagagg

SEQ ID NO: 491238 - DNA, 25 bp, Homo sapien
ggaggtagcagtccctccgcctcta

SEQ ID NO: 491239 - DNA, 25 bp, Homo sapien
ggcaaggccagaatcctgacatcct

SEQ ID NO: 491240 - DNA, 25 bp, Homo sapien
aatcctgacatcctctttttctttc

SEQ ID NO: 491241 - DNA, 25 bp, Homo sapien
tgacatcctctttttctttcagcta

SEQ ID NO: 491242 - DNA, 25 bp, Homo sapien
gcctctaccattagctcctggaagg

SEQ ID NO: 491243 - DNA, 25 bp, Homo sapien
tcctggaagggcgtcagaccatagg

SEQ ID NO: 491244 - DNA, 25 bp, Homo sapien
cgtcagaccataggcccgcaaaagt

SEQ ID NO: 491245 - DNA, 25 bp, Homo sapien
ccataggcccgcaaaagtctgagaa

SEQ ID NO: 491246 - DNA, 25 bp, Homo sapien
tggaaataggtgatgctgctacctc

SEQ ID NO: 491247 - DNA, 25 bp, Homo sapien
gccacacttgatacacgatgacacc

SEQ ID NO: 491248 - DNA, 25 bp, Homo sapien
gatacacgatgacaccttgcttgtt

SEQ ID NO: 491249 - DNA, 25 bp, Homo sapien
tgacaccttgcttgtttggaaacat

SEQ ID NO: 491250 - DNA, 25 bp, Homo sapien
catctagtagatgacttgcaggctg

SEQ ID NO: 491251 - DNA, 25 bp, Homo sapien
atgacttgcaggctgttggctacca

SEQ ID NO: 491252 - DNA, 25 bp, Homo sapien
gttggctaccagtttcctgtctgag

SEQ ID NO: 491253 - DNA, 25 bp, Homo sapien
accagtttcctgtctgaggtgtata

SEQ ID NO: 491254 - DNA, 25 bp, Homo sapien
aggtgtatatgttaacttcgtgatc

SEQ ID NO: 491255 - DNA, 25 bp, Homo sapien
gtcagattctgttttgtctacatgc

SEQ ID NO: 491256 - DNA, 25 bp, Homo sapien
ttttgtctacatgcctctgccgggt

SEQ ID NO: 491257 - DNA, 25 bp, Homo sapien
tgcatataccataatcaaaagtttg

SEQ ID NO: 491258 - DNA, 25 bp, Homo sapien
aatatcctgtttcttaaataatgag

SEQ ID NO: 491259 - DNA, 25 bp, Homo sapien
gaacattaatcacatttagcaagca

SEQ ID NO: 491260 - DNA, 25 bp, Homo sapien
gcatttgtacattcaaacctggata

SEQ ID NO: 491261 - DNA, 25 bp, Homo sapien
gtacattcaaacctggatattaaag

SEQ ID NO: 491262 - DNA, 25 bp, Homo sapien
tcatcattcaactactgaatttgaa

SEQ ID NO: 491263 - DNA, 25 bp, Homo sapien
gaatttgaaagcctcagcagtttca

SEQ ID NO: 491264 - DNA, 25 bp, Homo sapien
ttttaaaattaatcccaatggcatg

SEQ ID NO: 491265 - DNA, 25 bp, Homo sapien
atcccaatggcatgataaattttca

SEQ ID NO: 491266 - DNA, 25 bp, Homo sapien
taatggtttaatgccttttttgaat

SEQ ID NO: 491267 - DNA, 25 bp, Homo sapien
taatgccttttttgaataactggtt

SEQ ID NO: 491268 - DNA, 25 bp, Homo sapien
atgagaacagaatattatcttcctc

SEQ ID NO: 491269 - DNA, 25 bp, Homo sapien
tttgtgtttttgttcaactctaatg

SEQ ID NO: 491270 - DNA, 25 bp, Homo sapien
gtgtttttgttcaactctaatgtct

SEQ ID NO: 491271 - DNA, 25 bp, Homo sapien
gtttttgttcaactctaatgtctgc

SEQ ID NO: 491272 - DNA, 25 bp, Homo sapien
tgttcaactctaatgtctgcaaagc

SEQ ID NO: 491273 - DNA, 25 bp, Homo sapien
gttcaactctaatgtctgcaaagca

SEQ ID NO: 491274 - DNA, 25 bp, Homo sapien
tcaactctaatgtctgcaaagcact

SEQ ID NO: 491275 - DNA, 25 bp, Homo sapien
aactctaatgtctgcaaagcacttg

SEQ ID NO: 491276 - DNA, 25 bp, Homo sapien
tctaatgtctgcaaagcacttgcgt

SEQ ID NO: 491277 - DNA, 25 bp, Homo sapien
taatgtctgcaaagcacttgcgtat

SEQ ID NO: 491278 - DNA, 25 bp, Homo sapien
atgtctgcaaagcacttgcgtatgt

SEQ ID NO: 491279 - DNA, 25 bp, Homo sapien
ccatttccttttagtagtgctactg

SEQ ID NO: 491280 - DNA, 25 bp, Homo sapien
tatcgctgtgtgaatgttgcctctg

SEQ ID NO: 491281 - DNA, 25 bp, Homo sapien
gattatgtgacccagtggttctgta

SEQ ID NO: 491282 - DNA, 25 bp, Homo sapien
cagtggttctgtatacctgccaggt

SEQ ID NO: 491283 - DNA, 25 bp, Homo sapien
ggtgccaaccacttgtaaaggtctt

SEQ ID NO: 491284 - DNA, 25 bp, Homo sapien
gatattttcaattcttagactacct

SEQ ID NO: 491285 - DNA, 25 bp, Homo sapien
tagactacctatactttggcagaag

SEQ ID NO: 491286 - DNA, 25 bp, Homo sapien
agttgtctaaatataagccagtttg

SEQ ID NO: 491287 - DNA, 25 bp, Homo sapien
agccagtttgtgtttctgtccattt

SEQ ID NO: 491288 - DNA, 25 bp, Homo sapien
agcaccaaattgatggtcacaccat

SEQ ID NO: 491289 - DNA, 25 bp, Homo sapien
ttgatggtcacaccatttcctttta

SEQ ID NO: 491290 - DNA, 25 bp, Homo sapien
aactgaataggttccagagactttt

SEQ ID NO: 491291 - DNA, 25 bp, Homo sapien
gaatatttacttttagctctggaca

SEQ ID NO: 491292 - DNA, 25 bp, Homo sapien
atttacttttagctctggacatcat

SEQ ID NO: 491293 - DNA, 25 bp, Homo sapien
aggaatatttcccaaacctcttcag

SEQ ID NO: 491294 - DNA, 25 bp, Homo sapien
aaacctcttcagaccgagaatgcat

SEQ ID NO: 491295 - DNA, 25 bp, Homo sapien
tctctgttggctccctggacgatga

SEQ ID NO: 491296 - DNA, 25 bp, Homo sapien
agagactaagatgctgtcccagccg

SEQ ID NO: 491297 - DNA, 25 bp, Homo sapien
gatgctgtcccagccgtatttgctg

SEQ ID NO: 491298 - DNA, 25 bp, Homo sapien
gtatttgctggatccctccattacc

SEQ ID NO: 491299 - DNA, 25 bp, Homo sapien
tgtcggtagtagactttgtgcggtt

SEQ ID NO: 491300 - DNA, 25 bp, Homo sapien
agactttgtgcggtttgaatgtgga

SEQ ID NO: 491301 - DNA, 25 bp, Homo sapien
agaagcttggctttgctctaggttt

SEQ ID NO: 491302 - DNA, 25 bp, Homo sapien
ttggctttgctctaggtttcatgtt

SEQ ID NO: 491303 - DNA, 25 bp, Homo sapien
tgctctaggtttcatgttcccaaat

SEQ ID NO: 491304 - DNA, 25 bp, Homo sapien
tgttcccaaatgagccatctgtcag

SEQ ID NO: 491305 - DNA, 25 bp, Homo sapien
gagccatctgtcagtatattcactt

SEQ ID NO: 491306 - DNA, 25 bp, Homo sapien
cttacatattgatgcttaaatccag

SEQ ID NO: 491307 - DNA, 25 bp, Homo sapien
gatgcttaaatccagaaagtgtaaa

SEQ ID NO: 491308 - DNA, 25 bp, Homo sapien
ggatgtaagttactcagctttctgc

SEQ ID NO: 491309 - DNA, 25 bp, Homo sapien
gttactcagctttctgctccctaag

SEQ ID NO: 491310 - DNA, 25 bp, Homo sapien
caaacagtgtttgtcttcagtgtga

SEQ ID NO: 491311 - DNA, 25 bp, Homo sapien
acagtgtttgtcttcagtgtgaaat

SEQ ID NO: 491312 - DNA, 25 bp, Homo sapien
aagactggcctgaacccgccggtgt

SEQ ID NO: 491313 - DNA, 25 bp, Homo sapien
tgaacccgccggtgtgggccacagt

SEQ ID NO: 491314 - DNA, 25 bp, Homo sapien
tggctgcgggatggaggctctcctt

SEQ ID NO: 491315 - DNA, 25 bp, Homo sapien
tgctggctctgaccgtttcctctca

SEQ ID NO: 491316 - DNA, 25 bp, Homo sapien
tgaccgtttcctctcatgggtttgc

SEQ ID NO: 491317 - DNA, 25 bp, Homo sapien
tcatgggtttgctttacctgtggca

SEQ ID NO: 491318 - DNA, 25 bp, Homo sapien
gtttgctttacctgtggcagcaggt

SEQ ID NO: 491319 - DNA, 25 bp, Homo sapien
tgtggcagcaggttgctgctttcca

SEQ ID NO: 491320 - DNA, 25 bp, Homo sapien
tgctgctttccagggatgtgtccag

SEQ ID NO: 491321 - DNA, 25 bp, Homo sapien
gctttccagggatgtgtccagtgcc

SEQ ID NO: 491322 - DNA, 25 bp, Homo sapien
gatgtgtccagtgccctgggttctt

SEQ ID NO: 491323 - DNA, 25 bp, Homo sapien
ccagaaacggaaagcactttttgat

SEQ ID NO: 491324 - DNA, 25 bp, Homo sapien
gcactttttgatgagcacatgctat

SEQ ID NO: 491325 - DNA, 25 bp, Homo sapien
tgagcacatgctatgaatggaagaa

SEQ ID NO: 491326 - DNA, 25 bp, Homo sapien
cagtgtttaatttggaaagctttca

SEQ ID NO: 491327 - DNA, 25 bp, Homo sapien
aagctttcattagaactagctaaag

SEQ ID NO: 491328 - DNA, 25 bp, Homo sapien
agtggtttatttcctaatcatagcc

SEQ ID NO: 491329 - DNA, 25 bp, Homo sapien
atttcctaatcatagccttgcttaa

SEQ ID NO: 491330 - DNA, 25 bp, Homo sapien
tagccttgcttaataatccaatcat

SEQ ID NO: 491331 - DNA, 25 bp, Homo sapien
cagatatttatgctacaatttgggt

SEQ ID NO: 491332 - DNA, 25 bp, Homo sapien
caagtgatacatctagtctataaac

SEQ ID NO: 491333 - DNA, 25 bp, Homo sapien
gatggtgttggtggtcacttttaag

SEQ ID NO: 491334 - DNA, 25 bp, Homo sapien
gtaagccattatactgctgtaacta

SEQ ID NO: 491335 - DNA, 25 bp, Homo sapien
acaattcttctctttacatttatag

SEQ ID NO: 491336 - DNA, 25 bp, Homo sapien
gagagattccagcatagctttgtca

SEQ ID NO: 491337 - DNA, 25 bp, Homo sapien
agctttgtcaattccgactgagcca

SEQ ID NO: 491338 - DNA, 25 bp, Homo sapien
aattccgactgagccatactgtttt

SEQ ID NO: 491339 - DNA, 25 bp, Homo sapien
atactgttttccacaagggctcaac

SEQ ID NO: 491340 - DNA, 25 bp, Homo sapien
cacaagggctcaacacatagtcagt

SEQ ID NO: 491341 - DNA, 25 bp, Homo sapien
catagtcagtattccgtgctttcag

SEQ ID NO: 491342 - DNA, 25 bp, Homo sapien
gtattccgtgctttcagtgtgtgtt

SEQ ID NO: 491343 - DNA, 25 bp, Homo sapien
attctcctcttactggttttcttag

SEQ ID NO: 491344 - DNA, 25 bp, Homo sapien
gcaaatgcccatgtgtgatttttaa

SEQ ID NO: 491345 - DNA, 25 bp, Homo sapien
gtggtagtgttggaaatggacataa

SEQ ID NO: 491346 - DNA, 25 bp, Homo sapien
ggacataaatagacatattcaggaa

SEQ ID NO: 491347 - DNA, 25 bp, Homo sapien
cagaatggagtgtatgtggtcaaga

SEQ ID NO: 491348 - DNA, 25 bp, Homo sapien
ttaaggatgacttctcactggcttg

SEQ ID NO: 491349 - DNA, 25 bp, Homo sapien
cactggcttgaaatgctaaatggat

SEQ ID NO: 491350 - DNA, 25 bp, Homo sapien
atgctaaatggatgacggtgctgtt

SEQ ID NO: 491351 - DNA, 25 bp, Homo sapien
aatggatgacggtgctgtttagtga

SEQ ID NO: 491352 - DNA, 25 bp, Homo sapien
tcaagagtggaagctgtgaggctat

SEQ ID NO: 491353 - DNA, 25 bp, Homo sapien
aaaggtgacaatggcttagacttca

SEQ ID NO: 491354 - DNA, 25 bp, Homo sapien
gacaatggcttagacttcagtggta

SEQ ID NO: 491355 - DNA, 25 bp, Homo sapien
tggcttagacttcagtggtagtgtt

SEQ ID NO: 491356 - DNA, 25 bp, Homo sapien
aacgcatgaatacgaggaccctaat

SEQ ID NO: 491357 - DNA, 25 bp, Homo sapien
aggaccctaattattgctttcaacg

SEQ ID NO: 491358 - DNA, 25 bp, Homo sapien
tgctttcaacggacaaagtatggtg

SEQ ID NO: 491359 - DNA, 25 bp, Homo sapien
gaacgttgctgtacaacactggctg

SEQ ID NO: 491360 - DNA, 25 bp, Homo sapien
gtacaacactggctgtgtctcaaag

SEQ ID NO: 491361 - DNA, 25 bp, Homo sapien
gctgtgtctcaaagcggctttagaa

SEQ ID NO: 491362 - DNA, 25 bp, Homo sapien
aattctttggtacatggtattgcat

SEQ ID NO: 491363 - DNA, 25 bp, Homo sapien
gttaagaccttgttaagtggagctg

SEQ ID NO: 491364 - DNA, 25 bp, Homo sapien
gtttttgttgttccctggtagagct

SEQ ID NO: 491365 - DNA, 25 bp, Homo sapien
gttccctggtagagctcaacaaact

SEQ ID NO: 491366 - DNA, 25 bp, Homo sapien
gagctcaacaaactacagaccatgg

SEQ ID NO: 491367 - DNA, 25 bp, Homo sapien
tactccctggactagtgcagtcctt

SEQ ID NO: 491368 - DNA, 25 bp, Homo sapien
ctcagccccagaccagagatgggtg

SEQ ID NO: 491369 - DNA, 25 bp, Homo sapien
accagagatgggtggtatatgccat

SEQ ID NO: 491370 - DNA, 25 bp, Homo sapien
gggtgatgccagtagataaaagtgt

SEQ ID NO: 491371 - DNA, 25 bp, Homo sapien
ggtctccagggaagagtcacaggct

SEQ ID NO: 491372 - DNA, 25 bp, Homo sapien
ctccagggaagagtcacaggctgtt

SEQ ID NO: 491373 - DNA, 25 bp, Homo sapien
agtcacaggctgttggacgcagcct

SEQ ID NO: 491374 - DNA, 25 bp, Homo sapien
gggtcatcaccctctagcatcagtg

SEQ ID NO: 491375 - DNA, 25 bp, Homo sapien
tccacccaggacctaatgtacgtgt

SEQ ID NO: 491376 - DNA, 25 bp, Homo sapien
cccaggacctaatgtacgtgtgttt

SEQ ID NO: 491377 - DNA, 25 bp, Homo sapien
gacctaatgtacgtgtgttttgttt

SEQ ID NO: 491378 - DNA, 25 bp, Homo sapien
accgacccactttcttggcatatag

SEQ ID NO: 491379 - DNA, 25 bp, Homo sapien
gacccactttcttggcatatagccc

SEQ ID NO: 491380 - DNA, 25 bp, Homo sapien
actttcttggcatatagccccactt

SEQ ID NO: 491381 - DNA, 25 bp, Homo sapien
ttcttggcatatagccccacttaag

SEQ ID NO: 491382 - DNA, 25 bp, Homo sapien
tacttccttctgagtcctctacaaa

SEQ ID NO: 491383 - DNA, 25 bp, Homo sapien
ttccttctgagtcctctacaaagac

SEQ ID NO: 491384 - DNA, 25 bp, Homo sapien
agtcctctacaaagacatccgggta

SEQ ID NO: 491385 - DNA, 25 bp, Homo sapien
agacatccgggtactacatttccat

SEQ ID NO: 491386 - DNA, 25 bp, Homo sapien
tccgggtactacatttccatccctt

SEQ ID NO: 491387 - DNA, 25 bp, Homo sapien
tcccttccctattttgacaccaaat

SEQ ID NO: 491388 - DNA, 25 bp, Homo sapien
ccctattttgacaccaaattatggt

SEQ ID NO: 491389 - DNA, 25 bp, Homo sapien
tatttctgtgtatttacgaacagag

SEQ ID NO: 491390 - DNA, 25 bp, Homo sapien
ttacgaacagagaaataacccaaat

SEQ ID NO: 491391 - DNA, 25 bp, Homo sapien
ccaaatattatttctgcttagtgtc

SEQ ID NO: 491392 - DNA, 25 bp, Homo sapien
aaatattatttctgcttagtgtctt

SEQ ID NO: 491393 - DNA, 25 bp, Homo sapien
atattatttctgcttagtgtcttta

SEQ ID NO: 491394 - DNA, 25 bp, Homo sapien
attatttctgcttagtgtctttatt

SEQ ID NO: 491395 - DNA, 25 bp, Homo sapien
tttatttataaagcccatgagtagt

SEQ ID NO: 491396 - DNA, 25 bp, Homo sapien
gtatgcatctttcctacttgtaaag

SEQ ID NO: 491397 - DNA, 25 bp, Homo sapien
atgcatctttcctacttgtaaagat

SEQ ID NO: 491398 - DNA, 25 bp, Homo sapien
ctttcctacttgtaaagatgagtaa

SEQ ID NO: 491399 - DNA, 25 bp, Homo sapien
aaagatgagtaaaagtatgcagttt

SEQ ID NO: 491400 - DNA, 25 bp, Homo sapien
acagtgattaataatgttgctgtcc

SEQ ID NO: 491401 - DNA, 25 bp, Homo sapien
taacctgatgttatgaactgagatt

SEQ ID NO: 491402 - DNA, 25 bp, Homo sapien
gaatttgagtgcttacattattttg

SEQ ID NO: 491403 - DNA, 25 bp, Homo sapien
gtaaaggtggttgtatattcacata

SEQ ID NO: 491404 - DNA, 25 bp, Homo sapien
gtatattcacatatccacagttttt

SEQ ID NO: 491405 - DNA, 25 bp, Homo sapien
taaataacgtgaaaccgtgcttggt

SEQ ID NO: 491406 - DNA, 25 bp, Homo sapien
gtgcttggtttctcttttccaaagt

SEQ ID NO: 491407 - DNA, 25 bp, Homo sapien
gccttttccattacatgggcaagtc

SEQ ID NO: 491408 - DNA, 25 bp, Homo sapien
tttccattacatgggcaagtcctga

SEQ ID NO: 491409 - DNA, 25 bp, Homo sapien
aagtcctgaacctaagccgagacac

SEQ ID NO: 491410 - DNA, 25 bp, Homo sapien
aagccgagacactagtccatcatct

SEQ ID NO: 491411 - DNA, 25 bp, Homo sapien
tttaagaaatagtctctgtttccca

SEQ ID NO: 491412 - DNA, 25 bp, Homo sapien
ttaagaaatagtctctgtttcccag

SEQ ID NO: 491413 - DNA, 25 bp, Homo sapien
taagaaatagtctctgtttcccagg

SEQ ID NO: 491414 - DNA, 25 bp, Homo sapien
aagaaatagtctctgtttcccaggc

SEQ ID NO: 491415 - DNA, 25 bp, Homo sapien
ccactcccgactaatatatctgcta

SEQ ID NO: 491416 - DNA, 25 bp, Homo sapien
cactcccgactaatatatctgctat

SEQ ID NO: 491417 - DNA, 25 bp, Homo sapien
aatatatctgctatcaataacataa

SEQ ID NO: 491418 - DNA, 25 bp, Homo sapien
atatatctgctatcaataacataat

SEQ ID NO: 491419 - DNA, 25 bp, Homo sapien
tatatctgctatcaataacataatt

SEQ ID NO: 491420 - DNA, 25 bp, Homo sapien
tatctgctatcaataacataattgt

SEQ ID NO: 491421 - DNA, 25 bp, Homo sapien
tctgctatcaataacataattgttt

SEQ ID NO: 491422 - DNA, 25 bp, Homo sapien
gagtcgccacatcatttgagcttat

SEQ ID NO: 491423 - DNA, 25 bp, Homo sapien
cattatttccagacttttggtggga

SEQ ID NO: 491424 - DNA, 25 bp, Homo sapien
aatatgtgcaggtgtatcttccaac

SEQ ID NO: 491425 - DNA, 25 bp, Homo sapien
tgcaggtgtatcttccaacgtggtc

SEQ ID NO: 491426 - DNA, 25 bp, Homo sapien
caacgtggtccccatgtacttaggg

SEQ ID NO: 491427 - DNA, 25 bp, Homo sapien
ggagctggcccctaaaaacctgcgg

SEQ ID NO: 491428 - DNA, 25 bp, Homo sapien
ttcatcactgttggcatccttgtgg

SEQ ID NO: 491429 - DNA, 25 bp, Homo sapien
atctttggtcttcggaatctccttg

SEQ ID NO: 491430 - DNA, 25 bp, Homo sapien
ttcggaatctccttgcaaacgtaga

SEQ ID NO: 491431 - DNA, 25 bp, Homo sapien
tccttgcaaacgtagatggctggcc

SEQ ID NO: 491432 - DNA, 25 bp, Homo sapien
aaacgtagatggctggccgatcctg

SEQ ID NO: 491433 - DNA, 25 bp, Homo sapien
gaggcttcgaaaacggtgatccctt

SEQ ID NO: 491434 - DNA, 25 bp, Homo sapien
gcttcgaaaacggtgatcccttact

SEQ ID NO: 491435 - DNA, 25 bp, Homo sapien
gtgatcccttactccccaggtcttg

SEQ ID NO: 491436 - DNA, 25 bp, Homo sapien
aggtcttgcaggtgtcgactgtctt

SEQ ID NO: 491437 - DNA, 25 bp, Homo sapien
aggtgtcgactgtcttccggcccag

SEQ ID NO: 491438 - DNA, 25 bp, Homo sapien
atttatttgacctcccactacccag

SEQ ID NO: 491439 - DNA, 25 bp, Homo sapien
tacccagaatgggagacgtgcctcc

SEQ ID NO: 491440 - DNA, 25 bp, Homo sapien
agaatgggagacgtgcctccccttc

SEQ ID NO: 491441 - DNA, 25 bp, Homo sapien
ttcttgatctcttagggatcctata

SEQ ID NO: 491442 - DNA, 25 bp, Homo sapien
ggatcctatagggaggccatttcct

SEQ ID NO: 491443 - DNA, 25 bp, Homo sapien
tatagggaggccatttcctgtcctg

SEQ ID NO: 491444 - DNA, 25 bp, Homo sapien
agagcccacccgtgcagagggcaga

SEQ ID NO: 491445 - DNA, 25 bp, Homo sapien
agaagaggacgaaatgcctttgggt

SEQ ID NO: 491446 - DNA, 25 bp, Homo sapien
ctttgggtgggcagggcattaaact

SEQ ID NO: 491447 - DNA, 25 bp, Homo sapien
ctgagagctgaagagcaccaggttt

SEQ ID NO: 491448 - DNA, 25 bp, Homo sapien
accaggtttggtggacaaagctact

SEQ ID NO: 491449 - DNA, 25 bp, Homo sapien
ggacaaagctactgagatgcctgtt

SEQ ID NO: 491450 - DNA, 25 bp, Homo sapien
atgcctgttcatctgctgacttctg

SEQ ID NO: 491451 - DNA, 25 bp, Homo sapien
ctgacttctgtctaggctcatggat

SEQ ID NO: 491452 - DNA, 25 bp, Homo sapien
ttctgtctaggctcatggatgccac

SEQ ID NO: 491453 - DNA, 25 bp, Homo sapien
tttcatttcggcctaggcttcccct

SEQ ID NO: 491454 - DNA, 25 bp, Homo sapien
tgctcaccactgaggcctaatacaa

SEQ ID NO: 491455 - DNA, 25 bp, Homo sapien
gcaccttctacttgcagctgcgggc

SEQ ID NO: 491456 - DNA, 25 bp, Homo sapien
cactcaagacccgagaccgagagtt

SEQ ID NO: 491457 - DNA, 25 bp, Homo sapien
acccgagaccgagagttcggccagt

SEQ ID NO: 491458 - DNA, 25 bp, Homo sapien
tgctgtgcccttcacgcaggagtaa

SEQ ID NO: 491459 - DNA, 25 bp, Homo sapien
ttcacgcaggagtaagagccccaag

SEQ ID NO: 491460 - DNA, 25 bp, Homo sapien
gaccccaagacctctgaactctggg

SEQ ID NO: 491461 - DNA, 25 bp, Homo sapien
ggactctgagtcttccagcatcctt

SEQ ID NO: 491462 - DNA, 25 bp, Homo sapien
cagcatccttcaaggtcaccgaatg

SEQ ID NO: 491463 - DNA, 25 bp, Homo sapien
gtcaccgaatgaccagagatcaaag

SEQ ID NO: 491464 - DNA, 25 bp, Homo sapien
agatcaaagtaccttgcctcagggc

SEQ ID NO: 491465 - DNA, 25 bp, Homo sapien
tcagggccgggcagatgagatatta

SEQ ID NO: 491466 - DNA, 25 bp, Homo sapien
aataaatcctgcgagttcacgcccg

SEQ ID NO: 491467 - DNA, 25 bp, Homo sapien
actcctttcgcatgggatctacaaa

SEQ ID NO: 491468 - DNA, 25 bp, Homo sapien
gggatctacaaaaccgaactgcctt

SEQ ID NO: 491469 - DNA, 25 bp, Homo sapien
cgaactgccttaaagacctctttca

SEQ ID NO: 491470 - DNA, 25 bp, Homo sapien
gacctctttcacacggacgtgaagt

SEQ ID NO: 491471 - DNA, 25 bp, Homo sapien
aaaatcccatcctgtcaaagtgcac

SEQ ID NO: 491472 - DNA, 25 bp, Homo sapien
agtgcacgggtctttgaaatctaac

SEQ ID NO: 491473 - DNA, 25 bp, Homo sapien
gaaagattctctaaacaccctgtac

SEQ ID NO: 491474 - DNA, 25 bp, Homo sapien
ggacagggcactgcgttctgaagta

SEQ ID NO: 491475 - DNA, 25 bp, Homo sapien
ttctgaagtagaggccagggcactg

SEQ ID NO: 491476 - DNA, 25 bp, Homo sapien
agggcactggcccttagacacgtct

SEQ ID NO: 491477 - DNA, 25 bp, Homo sapien
gatgcaacattgcaactttatgaaa

SEQ ID NO: 491478 - DNA, 25 bp, Homo sapien
gaaaccattcattgcatgtttatta

SEQ ID NO: 491479 - DNA, 25 bp, Homo sapien
gcatgtttattatgcaagtttaaat

SEQ ID NO: 491480 - DNA, 25 bp, Homo sapien
gttgatcaacgtgagagaaatttca

SEQ ID NO: 491481 - DNA, 25 bp, Homo sapien
tcatagtaataaagtgtcgtgggct

SEQ ID NO: 491482 - DNA, 25 bp, Homo sapien
gtgtcgtgggcttaattgtatatct

SEQ ID NO: 491483 - DNA, 25 bp, Homo sapien
cttaattgtatatctggagccagtg

SEQ ID NO: 491484 - DNA, 25 bp, Homo sapien
atatctggagccagtgtcatccacc

SEQ ID NO: 491485 - DNA, 25 bp, Homo sapien
agtgtcatccaccaacaatgtgata

SEQ ID NO: 491486 - DNA, 25 bp, Homo sapien
gtgatacaatatgaacttgacagta

SEQ ID NO: 491487 - DNA, 25 bp, Homo sapien
tgaacttgacagtagttttgggttt

SEQ ID NO: 491488 - DNA, 25 bp, Homo sapien
catgttttaatataagtgttgtggt

SEQ ID NO: 491489 - DNA, 25 bp, Homo sapien
tttaatataagtgttgtggtaatac

SEQ ID NO: 491490 - DNA, 25 bp, Homo sapien
aatataagtgttgtggtaatacaat

SEQ ID NO: 491491 - DNA, 25 bp, Homo sapien
taagtgttgtggtaatacaataacc

SEQ ID NO: 491492 - DNA, 25 bp, Homo sapien
aattgaacacacagttttaaagctt

SEQ ID NO: 491493 - DNA, 25 bp, Homo sapien
tgaacacacagttttaaagcttttt

SEQ ID NO: 491494 - DNA, 25 bp, Homo sapien
atatggcatgttttacatagattaa

SEQ ID NO: 491495 - DNA, 25 bp, Homo sapien
gaaccaaattgaaagccgacagata

SEQ ID NO: 491496 - DNA, 25 bp, Homo sapien
aaattgaaagccgacagatactgca

SEQ ID NO: 491497 - DNA, 25 bp, Homo sapien
gcccttaggcaacatttattgaata

SEQ ID NO: 491498 - DNA, 25 bp, Homo sapien
taacttttataagattagaatccat

SEQ ID NO: 491499 - DNA, 25 bp, Homo sapien
ggcccctctacttgtcatctatggt

SEQ ID NO: 491500 - DNA, 25 bp, Homo sapien
gcccctctacttgtcatctatggta

SEQ ID NO: 491501 - DNA, 25 bp, Homo sapien
cccctctacttgtcatctatggtaa

SEQ ID NO: 491502 - DNA, 25 bp, Homo sapien
ccctctacttgtcatctatggtaaa

SEQ ID NO: 491503 - DNA, 25 bp, Homo sapien
cctctacttgtcatctatggtaaaa

SEQ ID NO: 491504 - DNA, 25 bp, Homo sapien
ctacttgtcatctatggtaaaaaca

SEQ ID NO: 491505 - DNA, 25 bp, Homo sapien
tgactattactgtcactcccgggac

SEQ ID NO: 491506 - DNA, 25 bp, Homo sapien
aggaccctgctgtgtctgtggcctt

SEQ ID NO: 491507 - DNA, 25 bp, Homo sapien
ccgggacagcagtgggaagtatgtc

SEQ ID NO: 491508 - DNA, 25 bp, Homo sapien
cgggacagcagtgggaagtatgtct

SEQ ID NO: 491509 - DNA, 25 bp, Homo sapien
gacagcctcagaagctattatgcaa

SEQ ID NO: 491510 - DNA, 25 bp, Homo sapien
tgctgatgctttctgacaccattcc

SEQ ID NO: 491511 - DNA, 25 bp, Homo sapien
gatgctttctgacaccattcctctg

SEQ ID NO: 491512 - DNA, 25 bp, Homo sapien
acaccattcctctggagttgagagg

SEQ ID NO: 491513 - DNA, 25 bp, Homo sapien
attcctctggagttgagaggtcagg

SEQ ID NO: 491514 - DNA, 25 bp, Homo sapien
ggaggtagcagtccctccgcctcta

SEQ ID NO: 491515 - DNA, 25 bp, Homo sapien
ggcaaggccagaatcctgacatcct

SEQ ID NO: 491516 - DNA, 25 bp, Homo sapien
aatcctgacatcctctttttctttc

SEQ ID NO: 491517 - DNA, 25 bp, Homo sapien
cctgacatcctctttttctttcagc

SEQ ID NO: 491518 - DNA, 25 bp, Homo sapien
tcctggaagggcgtcagaccatagg

SEQ ID NO: 491519 - DNA, 25 bp, Homo sapien
cgtcagaccataggcccgcaaaagt

SEQ ID NO: 491520 - DNA, 25 bp, Homo sapien
ccataggcccgcaaaagtctgagaa

SEQ ID NO: 491521 - DNA, 25 bp, Homo sapien
aactaccatcaccagaaaattccac

SEQ ID NO: 491522 - DNA, 25 bp, Homo sapien
ttctctttgtgtgatgtgtatgtac

SEQ ID NO: 491523 - DNA, 25 bp, Homo sapien
gtgtatgtacttcccaactaagtaa

SEQ ID NO: 491524 - DNA, 25 bp, Homo sapien
tttcctctagtgagtgctttaggta

SEQ ID NO: 491525 - DNA, 25 bp, Homo sapien
gagtgctttaggtaacctctttcca

SEQ ID NO: 491526 - DNA, 25 bp, Homo sapien
aggtaacctctttccatatggcagt

SEQ ID NO: 491527 - DNA, 25 bp, Homo sapien
agtagtgaaagaactgagccttcag

SEQ ID NO: 491528 - DNA, 25 bp, Homo sapien
ttcagttgatagttcttctctctcc

SEQ ID NO: 491529 - DNA, 25 bp, Homo sapien
tccagcaagtcgctaaactccacat

SEQ ID NO: 491530 - DNA, 25 bp, Homo sapien
gctaaactccacatcccttcgtttt

SEQ ID NO: 491531 - DNA, 25 bp, Homo sapien
aaactatcctagtttgcatttaatc

SEQ ID NO: 491532 - DNA, 25 bp, Homo sapien
agctggagggaagctgccacatctc

SEQ ID NO: 491533 - DNA, 25 bp, Homo sapien
tgccacatctcctagctaagcagtc

SEQ ID NO: 491534 - DNA, 25 bp, Homo sapien
agcagtctgacttacctgttgggaa

SEQ ID NO: 491535 - DNA, 25 bp, Homo sapien
gggatattgctctaagattgattag

SEQ ID NO: 491536 - DNA, 25 bp, Homo sapien
ggatgattgtagctagagtcttgaa

SEQ ID NO: 491537 - DNA, 25 bp, Homo sapien
gctagagtcttgaattctatctgta

SEQ ID NO: 491538 - DNA, 25 bp, Homo sapien
aattctatctgtatacggcagagaa

SEQ ID NO: 491539 - DNA, 25 bp, Homo sapien
gcaaaagcactttgagggctttata

SEQ ID NO: 491540 - DNA, 25 bp, Homo sapien
gtagttgatactcagtgcatctcca

SEQ ID NO: 491541 - DNA, 25 bp, Homo sapien
atactcagtgcatctccagacatag

SEQ ID NO: 491542 - DNA, 25 bp, Homo sapien
agtgcatctccagacatagtaaggg

SEQ ID NO: 491543 - DNA, 25 bp, Homo sapien
tccggcttcctcacgctgcacaacg

SEQ ID NO: 491544 - DNA, 25 bp, Homo sapien
tgcacaacgccttccccaaggaggc

SEQ ID NO: 491545 - DNA, 25 bp, Homo sapien
ggcggcggcgtcacggtcacggtca

SEQ ID NO: 491546 - DNA, 25 bp, Homo sapien
ggcgtcacggtcacggtcaccgggc

SEQ ID NO: 491547 - DNA, 25 bp, Homo sapien
aacaccaacacgctcaacaggaaaa

SEQ ID NO: 491548 - DNA, 25 bp, Homo sapien
accaacacgctcaacaggaaaacca

SEQ ID NO: 491549 - DNA, 25 bp, Homo sapien
aacacgctcaacaggaaaaccacgc

SEQ ID NO: 491550 - DNA, 25 bp, Homo sapien
acgctcaacaggaaaaccacgcctg

SEQ ID NO: 491551 - DNA, 25 bp, Homo sapien
gctcaacaggaaaaccacgcctgtg

SEQ ID NO: 491552 - DNA, 25 bp, Homo sapien
tcaacaggaaaaccacgcctgtgta

SEQ ID NO: 491553 - DNA, 25 bp, Homo sapien
acaggaaaaccacgcctgtgtaggg

SEQ ID NO: 491554 - DNA, 25 bp, Homo sapien
ttagagtgaatagggcggacactcc

SEQ ID NO: 491555 - DNA, 25 bp, Homo sapien
cctctcttttcctgtagcgtgtgga

SEQ ID NO: 491556 - DNA, 25 bp, Homo sapien
ttcctgtagcgtgtggaccggtcca

SEQ ID NO: 491557 - DNA, 25 bp, Homo sapien
tggaccggtccacgcaattctttat

SEQ ID NO: 491558 - DNA, 25 bp, Homo sapien
gtccacgcaattctttatcctgtga

SEQ ID NO: 491559 - DNA, 25 bp, Homo sapien
gcaattctttatcctgtgaactcat

SEQ ID NO: 491560 - DNA, 25 bp, Homo sapien
tttatcctgtgaactcatctgagtg

SEQ ID NO: 491561 - DNA, 25 bp, Homo sapien
tctctccgtagcatccgttggtctt

SEQ ID NO: 491562 - DNA, 25 bp, Homo sapien
agcatccgttggtctttctctccat

SEQ ID NO: 491563 - DNA, 25 bp, Homo sapien
tctctccatctctgttggtttgtct

SEQ ID NO: 491564 - DNA, 25 bp, Homo sapien
ggtgcccctgtgagcctcgaccttg

SEQ ID NO: 491565 - DNA, 25 bp, Homo sapien
ttcttctaggggagccattccagtt

SEQ ID NO: 491566 - DNA, 25 bp, Homo sapien
tcttctaggggagccattccagtta

SEQ ID NO: 491567 - DNA, 25 bp, Homo sapien
ttctaggggagccattccagttaaa

SEQ ID NO: 491568 - DNA, 25 bp, Homo sapien
tctaggggagccattccagttaaaa

SEQ ID NO: 491569 - DNA, 25 bp, Homo sapien
ctaggggagccattccagttaaaag

SEQ ID NO: 491570 - DNA, 25 bp, Homo sapien
gggagccattccagttaaaagaggt

SEQ ID NO: 491571 - DNA, 25 bp, Homo sapien
ggagccattccagttaaaagaggtc

SEQ ID NO: 491572 - DNA, 25 bp, Homo sapien
gagccattccagttaaaagaggtcc

SEQ ID NO: 491573 - DNA, 25 bp, Homo sapien
gccattccagttaaaagaggtccct

SEQ ID NO: 491574 - DNA, 25 bp, Homo sapien
cattccagttaaaagaggtccctct

SEQ ID NO: 491575 - DNA, 25 bp, Homo sapien
gaggtccctcttcaagaagtcgagt

SEQ ID NO: 491576 - DNA, 25 bp, Homo sapien
gggtgcgtcgctgctgatccctgct

SEQ ID NO: 491577 - DNA, 25 bp, Homo sapien
gtcgctgctgatccctgctgcaggt

SEQ ID NO: 491578 - DNA, 25 bp, Homo sapien
gctgcaggtgtttcccgagtgtcca

SEQ ID NO: 491579 - DNA, 25 bp, Homo sapien
ctgcaggtgtttcccgagtgtccac

SEQ ID NO: 491580 - DNA, 25 bp, Homo sapien
gtccaccgtcgggagttgctgttct

SEQ ID NO: 491581 - DNA, 25 bp, Homo sapien
ccaccgtcgggagttgctgttctta

SEQ ID NO: 491582 - DNA, 25 bp, Homo sapien
caccgtcgggagttgctgttcttag

SEQ ID NO: 491583 - DNA, 25 bp, Homo sapien
accgtcgggagttgctgttcttagg

SEQ ID NO: 491584 - DNA, 25 bp, Homo sapien
agttgctgttcttagggctgggaaa

SEQ ID NO: 491585 - DNA, 25 bp, Homo sapien
ttgctgttcttagggctgggaaagc

SEQ ID NO: 491586 - DNA, 25 bp, Homo sapien
gttcttagggctgggaaagctgtgc

SEQ ID NO: 491587 - DNA, 25 bp, Homo sapien
gctggaggggttcctaatacacatt

SEQ ID NO: 491588 - DNA, 25 bp, Homo sapien
acacatttaattcagtttctcttcc

SEQ ID NO: 491589 - DNA, 25 bp, Homo sapien
attcagtttctcttccctaagaggc

SEQ ID NO: 491590 - DNA, 25 bp, Homo sapien
tcttccctaagaggctgccggagtt

SEQ ID NO: 491591 - DNA, 25 bp, Homo sapien
gtgaacagggcttcagtcagcgcaa

SEQ ID NO: 491592 - DNA, 25 bp, Homo sapien
acagggcttcagtcagcgcaagtat

SEQ ID NO: 491593 - DNA, 25 bp, Homo sapien
ttcagtcagcgcaagtattccattt

SEQ ID NO: 491594 - DNA, 25 bp, Homo sapien
agcgcaagtattccatttgcatttg

SEQ ID NO: 491595 - DNA, 25 bp, Homo sapien
tttttcatgccacctatttatgaat

SEQ ID NO: 491596 - DNA, 25 bp, Homo sapien
agagtgtacacattcctaaaccatt

SEQ ID NO: 491597 - DNA, 25 bp, Homo sapien
gtgtacacattcctaaaccattaaa

SEQ ID NO: 491598 - DNA, 25 bp, Homo sapien
cgcggtctgagtggtttttccttct

SEQ ID NO: 491599 - DNA, 25 bp, Homo sapien
gcggtctgagtggtttttccttctt

SEQ ID NO: 491600 - DNA, 25 bp, Homo sapien
ccttcttgatggctcaatgacagag

SEQ ID NO: 491601 - DNA, 25 bp, Homo sapien
tcttgatggctcaatgacagagact

SEQ ID NO: 491602 - DNA, 25 bp, Homo sapien
ttgatggctcaatgacagagactag

SEQ ID NO: 491603 - DNA, 25 bp, Homo sapien
tcaatgacagagactagctcgtaaa

SEQ ID NO: 491604 - DNA, 25 bp, Homo sapien
aatgacagagactagctcgtaaact

SEQ ID NO: 491605 - DNA, 25 bp, Homo sapien
gacagagactagctcgtaaactccg

SEQ ID NO: 491606 - DNA, 25 bp, Homo sapien
acagagactagctcgtaaactccgg

SEQ ID NO: 491607 - DNA, 25 bp, Homo sapien
cagagactagctcgtaaactccggg

SEQ ID NO: 491608 - DNA, 25 bp, Homo sapien
gactagctcgtaaactccggggcgt

SEQ ID NO: 491609 - DNA, 25 bp, Homo sapien
gatcacagatgtcttcacatgccta

SEQ ID NO: 491610 - DNA, 25 bp, Homo sapien
catgcctatgactaatttgtacaca

SEQ ID NO: 491611 - DNA, 25 bp, Homo sapien
aaactaatgctcgtgtttcccaagc

SEQ ID NO: 491612 - DNA, 25 bp, Homo sapien
aagcacctggaagacatgccagatc

SEQ ID NO: 491613 - DNA, 25 bp, Homo sapien
gccagatccatgtgcagtaatgcct

SEQ ID NO: 491614 - DNA, 25 bp, Homo sapien
agtaatgcctggtggctccaggtct

SEQ ID NO: 491615 - DNA, 25 bp, Homo sapien
tcctgcccgtgtttgtgaatatcat

SEQ ID NO: 491616 - DNA, 25 bp, Homo sapien
tgaatatcattctgtcctcagctgc

SEQ ID NO: 491617 - DNA, 25 bp, Homo sapien
ttggcgctgcccaggaatggtatca

SEQ ID NO: 491618 - DNA, 25 bp, Homo sapien
aatggtatcaattcccctgtttctc

SEQ ID NO: 491619 - DNA, 25 bp, Homo sapien
gtttctcttgtagccagttactaga

SEQ ID NO: 491620 - DNA, 25 bp, Homo sapien
ctgggctccccacagtggtccatag

SEQ ID NO: 491621 - DNA, 25 bp, Homo sapien
actggcctccagctggcagtagtag

SEQ ID NO: 491622 - DNA, 25 bp, Homo sapien
gggtccacagctaacgatgggactc

SEQ ID NO: 491623 - DNA, 25 bp, Homo sapien
taacgatgggactcagcagggtctg

SEQ ID NO: 491624 - DNA, 25 bp, Homo sapien
cagcagggtctgacagccagctagg

SEQ ID NO: 491625 - DNA, 25 bp, Homo sapien
acgtcttccggcttgtgcagcgtga

SEQ ID NO: 491626 - DNA, 25 bp, Homo sapien
gcttgtgcagcgtgaggtagatctc

SEQ ID NO: 491627 - DNA, 25 bp, Homo sapien
tagatctcatagatcttccctcggg

SEQ ID NO: 491628 - DNA, 25 bp, Homo sapien
tgccctcgcacgactgctttttgag

SEQ ID NO: 491629 - DNA, 25 bp, Homo sapien
tcgcacgactgctttttgaggcgca

SEQ ID NO: 491630 - DNA, 25 bp, Homo sapien
actgctttttgaggcgcaggctcca

SEQ ID NO: 491631 - DNA, 25 bp, Homo sapien
agcgttgttttggtagttgaaactg

SEQ ID NO: 491632 - DNA, 25 bp, Homo sapien
gaaactgagacgtaacattttgcct

SEQ ID NO: 491633 - DNA, 25 bp, Homo sapien
gacgtaacattttgccttgtaggta

SEQ ID NO: 491634 - DNA, 25 bp, Homo sapien
ttgccttgtaggtatattcacgata

SEQ ID NO: 491635 - DNA, 25 bp, Homo sapien
ccttgtaggtatattcacgatagaa

SEQ ID NO: 491636 - DNA, 25 bp, Homo sapien
tgctggaatttcacaatgctgctaa

SEQ ID NO: 491637 - DNA, 25 bp, Homo sapien
ggaatttcacaatgctgctaagtat

SEQ ID NO: 491638 - DNA, 25 bp, Homo sapien
gctaagtatagcatcttgaacaacc

SEQ ID NO: 491639 - DNA, 25 bp, Homo sapien
gcatcttgaacaaccttcagtggag

SEQ ID NO: 491640 - DNA, 25 bp, Homo sapien
gaacaaccttcagtggagaaaatgt

SEQ ID NO: 491641 - DNA, 25 bp, Homo sapien
gagaaaatgtagatgctcttgtata

SEQ ID NO: 491642 - DNA, 25 bp, Homo sapien
caatcatcaccacgatcacagcagg

SEQ ID NO: 491643 - DNA, 25 bp, Homo sapien
atcaccacgatcacagcaggcgaat

SEQ ID NO: 491644 - DNA, 25 bp, Homo sapien
accacgatcacagcaggcgaataat

SEQ ID NO: 491645 - DNA, 25 bp, Homo sapien
acgatcacagcaggcgaataatatc

SEQ ID NO: 491646 - DNA, 25 bp, Homo sapien
tcacagcaggcgaataatatcaata

SEQ ID NO: 491647 - DNA, 25 bp, Homo sapien
gcaggcgaataatatcaatatgcat

SEQ ID NO: 491648 - DNA, 25 bp, Homo sapien
tatgcatagattagtatctcctggc

SEQ ID NO: 491649 - DNA, 25 bp, Homo sapien
gcatagattagtatctcctggcttg

SEQ ID NO: 491650 - DNA, 25 bp, Homo sapien
tagattagtatctcctggcttggga

SEQ ID NO: 491651 - DNA, 25 bp, Homo sapien
gattagtatctcctggcttgggaaa

SEQ ID NO: 491652 - DNA, 25 bp, Homo sapien
ttagtatctcctggcttgggaaaaa

SEQ ID NO: 491653 - DNA, 25 bp, Homo sapien
tttgcaaaaggtttccgggacactg

SEQ ID NO: 491654 - DNA, 25 bp, Homo sapien
ttccgggacactggaaatggccgaa

SEQ ID NO: 491655 - DNA, 25 bp, Homo sapien
cctgcagtccatgagggtgtttgat

SEQ ID NO: 491656 - DNA, 25 bp, Homo sapien
aatgggacctctgatgagtcctcca

SEQ ID NO: 491657 - DNA, 25 bp, Homo sapien
tctgatgagtcctccagtgaacaag

SEQ ID NO: 491658 - DNA, 25 bp, Homo sapien
gaacaagcagctttcaactgcttcg

SEQ ID NO: 491659 - DNA, 25 bp, Homo sapien
tttcaactgcttcgcccaggcttct

SEQ ID NO: 491660 - DNA, 25 bp, Homo sapien
cactgtagggacatcgaacctcaaa

SEQ ID NO: 491661 - DNA, 25 bp, Homo sapien
gaacctcaaagatttatgtcccagc

SEQ ID NO: 491662 - DNA, 25 bp, Homo sapien
gatttatgtcccagcgagggtgaga

SEQ ID NO: 491663 - DNA, 25 bp, Homo sapien
gagagcgacgccgaggccgagagca

SEQ ID NO: 491664 - DNA, 25 bp, Homo sapien
ctgtaactactactatgagtgctta

SEQ ID NO: 491665 - DNA, 25 bp, Homo sapien
gtaactactactatgagtgcttatg

SEQ ID NO: 491666 - DNA, 25 bp, Homo sapien
aactactactatgagtgcttatgct

SEQ ID NO: 491667 - DNA, 25 bp, Homo sapien
ctactactatgagtgcttatgctgt

SEQ ID NO: 491668 - DNA, 25 bp, Homo sapien
actactatgagtgcttatgctgtat

SEQ ID NO: 491669 - DNA, 25 bp, Homo sapien
tactatgagtgcttatgctgtattg

SEQ ID NO: 491670 - DNA, 25 bp, Homo sapien
tatgagtgcttatgctgtattgttt

SEQ ID NO: 491671 - DNA, 25 bp, Homo sapien
cacaggagcagaaaggtgcagttgt

SEQ ID NO: 491672 - DNA, 25 bp, Homo sapien
agcagaaaggtgcagttgtttattc

SEQ ID NO: 491673 - DNA, 25 bp, Homo sapien
gaaaggtgcagttgtttattctctt

SEQ ID NO: 491674 - DNA, 25 bp, Homo sapien
ttcccacaaatctagaaataattat

SEQ ID NO: 491675 - DNA, 25 bp, Homo sapien
tttaagaaatagtctctgtttccca

SEQ ID NO: 491676 - DNA, 25 bp, Homo sapien
ttaagaaatagtctctgtttcccag

SEQ ID NO: 491677 - DNA, 25 bp, Homo sapien
aatatatctgctatcaataacataa

SEQ ID NO: 491678 - DNA, 25 bp, Homo sapien
atatatctgctatcaataacataat

SEQ ID NO: 491679 - DNA, 25 bp, Homo sapien
tatatctgctatcaataacataatt

SEQ ID NO: 491680 - DNA, 25 bp, Homo sapien
atatctgctatcaataacataattg

SEQ ID NO: 491681 - DNA, 25 bp, Homo sapien
tatctgctatcaataacataattgt

SEQ ID NO: 491682 - DNA, 25 bp, Homo sapien
atctgctatcaataacataattgtt

SEQ ID NO: 491683 - DNA, 25 bp, Homo sapien
tctgctatcaataacataattgttt

SEQ ID NO: 491684 - DNA, 25 bp, Homo sapien
aatatgaaacatagaaggaggccag

SEQ ID NO: 491685 - DNA, 25 bp, Homo sapien
atatgaaacatagaaggaggccagg

SEQ ID NO: 491686 - DNA, 25 bp, Homo sapien
tatgaaacatagaaggaggccaggc

SEQ ID NO: 491687 - DNA, 25 bp, Homo sapien
agatcgtttgagtcctggagaccat

SEQ ID NO: 491688 - DNA, 25 bp, Homo sapien
gatcgtttgagtcctggagaccatc

SEQ ID NO: 491689 - DNA, 25 bp, Homo sapien
atcgtttgagtcctggagaccatcc

SEQ ID NO: 491690 - DNA, 25 bp, Homo sapien
atagcaaaaccttgtgtttacataa

SEQ ID NO: 491691 - DNA, 25 bp, Homo sapien
tagcaaaaccttgtgtttacataaa

SEQ ID NO: 491692 - DNA, 25 bp, Homo sapien
gggagctacttatcagccaaaagca

SEQ ID NO: 491693 - DNA, 25 bp, Homo sapien
tcagccaaaagcatataaagtgttc

SEQ ID NO: 491694 - DNA, 25 bp, Homo sapien
aaacagtgttatggcaatgggtgcc

SEQ ID NO: 491695 - DNA, 25 bp, Homo sapien
gcaatgggtgcctggttgatgttct

SEQ ID NO: 491696 - DNA, 25 bp, Homo sapien
gggtgcctggttgatgttcttaaag

SEQ ID NO: 491697 - DNA, 25 bp, Homo sapien
aaacactatgacatcctccagaggg

SEQ ID NO: 491698 - DNA, 25 bp, Homo sapien
tatgacatcctccagagggaagaaa

SEQ ID NO: 491699 - DNA, 25 bp, Homo sapien
gaataaatttctcccaattgccgcc

SEQ ID NO: 491700 - DNA, 25 bp, Homo sapien
ccaattgccgcctcagatttcaaaa

SEQ ID NO: 491701 - DNA, 25 bp, Homo sapien
attgccgcctcagatttcaaaatcc

SEQ ID NO: 491702 - DNA, 25 bp, Homo sapien
gccgcctcagatttcaaaatccaga

SEQ ID NO: 491703 - DNA, 25 bp, Homo sapien
tagcgtttgattcccttcacctttt

SEQ ID NO: 491704 - DNA, 25 bp, Homo sapien
ttacaattagatttacttactgctg

SEQ ID NO: 491705 - DNA, 25 bp, Homo sapien
cttactgctgtaaatctggtctatt

SEQ ID NO: 491706 - DNA, 25 bp, Homo sapien
atctggtctattttagtttcctctg

SEQ ID NO: 491707 - DNA, 25 bp, Homo sapien
gtttcctctgggtagttagtgttgc

SEQ ID NO: 491708 - DNA, 25 bp, Homo sapien
tcctctgggtagttagtgttgctaa

SEQ ID NO: 491709 - DNA, 25 bp, Homo sapien
tagtgttgctaataagatggacgta

SEQ ID NO: 491710 - DNA, 25 bp, Homo sapien
catcttttatgtaagtgtaattctc

SEQ ID NO: 491711 - DNA, 25 bp, Homo sapien
gcttaaagtttgcaaggctgcccag

SEQ ID NO: 491712 - DNA, 25 bp, Homo sapien
cagcctaacccacaacagtttgatg

SEQ ID NO: 491713 - DNA, 25 bp, Homo sapien
aacagtttgatgctgccccctagcg

SEQ ID NO: 491714 - DNA, 25 bp, Homo sapien
agggcggccggagccaggctatgag

SEQ ID NO: 491715 - DNA, 25 bp, Homo sapien
ggctatgagagcatggagcaattca

SEQ ID NO: 491716 - DNA, 25 bp, Homo sapien
gagagcatggagcaattcaccgtaa

SEQ ID NO: 491717 - DNA, 25 bp, Homo sapien
gagcatggagcaattcaccgtaagg

SEQ ID NO: 491718 - DNA, 25 bp, Homo sapien
gcatggagcaattcaccgtaagggt

SEQ ID NO: 491719 - DNA, 25 bp, Homo sapien
gcaattcaccgtaagggtggagcac

SEQ ID NO: 491720 - DNA, 25 bp, Homo sapien
tggccgaaatgctgcggaccatcga

SEQ ID NO: 491721 - DNA, 25 bp, Homo sapien
cgaaatgctgcggaccatcgacttc

SEQ ID NO: 491722 - DNA, 25 bp, Homo sapien
aatgctgcggaccatcgacttccag

SEQ ID NO: 491723 - DNA, 25 bp, Homo sapien
tgcggaccatcgacttccagccagg

SEQ ID NO: 491724 - DNA, 25 bp, Homo sapien
cgacttccagccaggcgcttccggg

SEQ ID NO: 491725 - DNA, 25 bp, Homo sapien
gcaggaccctcaaggtagaacatca

SEQ ID NO: 491726 - DNA, 25 bp, Homo sapien
aaggtagaacatcagctcttccccg

SEQ ID NO: 491727 - DNA, 25 bp, Homo sapien
ggtagaacatcagctcttccccgag

SEQ ID NO: 491728 - DNA, 25 bp, Homo sapien
acatcagctcttccccgagctaaaa

SEQ ID NO: 491729 - DNA, 25 bp, Homo sapien
gagctaaaacacctctcccacctgg

SEQ ID NO: 491730 - DNA, 25 bp, Homo sapien
agctccacgagtctcacagaacagc

SEQ ID NO: 491731 - DNA, 25 bp, Homo sapien
gagtctcacagaacagccacactgg

SEQ ID NO: 491732 - DNA, 25 bp, Homo sapien
agccacactggctccttcgttgtct

SEQ ID NO: 491733 - DNA, 25 bp, Homo sapien
actggctccttcgttgtcttcagct

SEQ ID NO: 491734 - DNA, 25 bp, Homo sapien
gttgtcttcagctccacaacctaag

SEQ ID NO: 491735 - DNA, 25 bp, Homo sapien
cagctcaacgactctcatagactta

SEQ ID NO: 491736 - DNA, 25 bp, Homo sapien
atgtgatcctgactgtctgtcccaa

SEQ ID NO: 491737 - DNA, 25 bp, Homo sapien
tgtgatcctgactgtctgtcccaag

SEQ ID NO: 491738 - DNA, 25 bp, Homo sapien
gtgatcctgactgtctgtcccaagg

SEQ ID NO: 491739 - DNA, 25 bp, Homo sapien
tgatcctgactgtctgtcccaaggc

SEQ ID NO: 491740 - DNA, 25 bp, Homo sapien
gatcctgactgtctgtcccaaggcc

SEQ ID NO: 491741 - DNA, 25 bp, Homo sapien
atcctgactgtctgtcccaaggcca

SEQ ID NO: 491742 - DNA, 25 bp, Homo sapien
tcctgactgtctgtcccaaggccac

SEQ ID NO: 491743 - DNA, 25 bp, Homo sapien
ctgactgtctgtcccaaggccacag

SEQ ID NO: 491744 - DNA, 25 bp, Homo sapien
ggagggactaccactcggtccgccg

SEQ ID NO: 491745 - DNA, 25 bp, Homo sapien
cggacgtgctgctgcattcggcgca

SEQ ID NO: 491746 - DNA, 25 bp, Homo sapien
tgcattcggcgcaccacggcctgga

SEQ ID NO: 491747 - DNA, 25 bp, Homo sapien
acgcgggcatgggtgacagcctctc

SEQ ID NO: 491748 - DNA, 25 bp, Homo sapien
gcatgggtgacagcctctcgctgca

SEQ ID NO: 491749 - DNA, 25 bp, Homo sapien
acggcctcggccatcccggaatgga

SEQ ID NO: 491750 - DNA, 25 bp, Homo sapien
tcggccatcccggaatggaagacgt

SEQ ID NO: 491751 - DNA, 25 bp, Homo sapien
atcccggaatggaagacgtccagtc

SEQ ID NO: 491752 - DNA, 25 bp, Homo sapien
ggaagacgtccagtcagttgaagat

SEQ ID NO: 491753 - DNA, 25 bp, Homo sapien
acgtccagtcagttgaagatgccaa

SEQ ID NO: 491754 - DNA, 25 bp, Homo sapien
cagtcagttgaagatgccaataaca

SEQ ID NO: 491755 - DNA, 25 bp, Homo sapien
ggtagaatacacatacaatcaaaat

SEQ ID NO: 491756 - DNA, 25 bp, Homo sapien
aactgaggcgtataacggagcaaca

SEQ ID NO: 491757 - DNA, 25 bp, Homo sapien
cggagcaacaatatcggttctcagt

SEQ ID NO: 491758 - DNA, 25 bp, Homo sapien
aacaatatcggttctcagtgtctat

SEQ ID NO: 491759 - DNA, 25 bp, Homo sapien
tatcggttctcagtgtctatttcaa

SEQ ID NO: 491760 - DNA, 25 bp, Homo sapien
tgtctatttcaagatacatttggag

SEQ ID NO: 491761 - DNA, 25 bp, Homo sapien
tacatttggagacaaccgtccggat

SEQ ID NO: 491762 - DNA, 25 bp, Homo sapien
tggagacaaccgtccggattttcca

SEQ ID NO: 491763 - DNA, 25 bp, Homo sapien
tccacttcggttctttcgagtttag

SEQ ID NO: 491764 - DNA, 25 bp, Homo sapien
ggttctttcgagtttagtaatactg

SEQ ID NO: 491765 - DNA, 25 bp, Homo sapien
atgagaaaaacgctaacttattgga

SEQ ID NO: 491766 - DNA, 25 bp, Homo sapien
gagggccgccagaggctgggctgac

SEQ ID NO: 491767 - DNA, 25 bp, Homo sapien
gacccgaagaggagacggtgcacca

SEQ ID NO: 491768 - DNA, 25 bp, Homo sapien
agaggagacggtgcaccaggcgccc

SEQ ID NO: 491769 - DNA, 25 bp, Homo sapien
ccaggcgccccgaggctaagagacg

SEQ ID NO: 491770 - DNA, 25 bp, Homo sapien
cgaggctaagagacggtggcagcaa

SEQ ID NO: 491771 - DNA, 25 bp, Homo sapien
gagaggcacagcgaccctgccccag

SEQ ID NO: 491772 - DNA, 25 bp, Homo sapien
gccttgctgacatcagacgggatat

SEQ ID NO: 491773 - DNA, 25 bp, Homo sapien
tgctgacatcagacgggatatccga

SEQ ID NO: 491774 - DNA, 25 bp, Homo sapien
acatcagacgggatatccgaatatc

SEQ ID NO: 491775 - DNA, 25 bp, Homo sapien
gggatatccgaatatctgatagcaa

SEQ ID NO: 491776 - DNA, 25 bp, Homo sapien
gatagcaattaaaaggcagccttgt

SEQ ID NO: 491777 - DNA, 25 bp, Homo sapien
aagagtcgagaaggctgagtgttaa

SEQ ID NO: 491778 - DNA, 25 bp, Homo sapien
ctgagtgttaagaggccaagtgcga

SEQ ID NO: 491779 - DNA, 25 bp, Homo sapien
taagaggccaagtgcgacgcgcgta

SEQ ID NO: 491780 - DNA, 25 bp, Homo sapien
aggccaagtgcgacgcgcgtatccg

SEQ ID NO: 491781 - DNA, 25 bp, Homo sapien
gtatccgggcagacggactgacgga

SEQ ID NO: 491782 - DNA, 25 bp, Homo sapien
gactgacggacgggcccgtgcttct

SEQ ID NO: 491783 - DNA, 25 bp, Homo sapien
gcgagtcgcgtctaagcggcggcgg

SEQ ID NO: 491784 - DNA, 25 bp, Homo sapien
agccatggcggctgacagtcgggag

SEQ ID NO: 491785 - DNA, 25 bp, Homo sapien
gaacttaatgttctggatgatattt

SEQ ID NO: 491786 - DNA, 25 bp, Homo sapien
gatgatattttaactgaagtaccag

SEQ ID NO: 491787 - DNA, 25 bp, Homo sapien
gatgatgaactgtataatccagaga

SEQ ID NO: 491788 - DNA, 25 bp, Homo sapien
tatatcggagttttatactgtcttc

SEQ ID NO: 491789 - DNA, 25 bp, Homo sapien
tatcggagttttatactgtcttcag

SEQ ID NO: 491790 - DNA, 25 bp, Homo sapien
atcggagttttatactgtcttcaga

SEQ ID NO: 491791 - DNA, 25 bp, Homo sapien
tcggagttttatactgtcttcagag

SEQ ID NO: 491792 - DNA, 25 bp, Homo sapien
ggtagcaataattttaacagtgacg

SEQ ID NO: 491793 - DNA, 25 bp, Homo sapien
gagttctgaagaattgcagtaaact

SEQ ID NO: 491794 - DNA, 25 bp, Homo sapien
gcagtaaactgaagagtacttactg

SEQ ID NO: 491795 - DNA, 25 bp, Homo sapien
tactgatctttgtagttggaacaga

SEQ ID NO: 491796 - DNA, 25 bp, Homo sapien
ctgatctttgtagttggaacagaat

SEQ ID NO: 491797 - DNA, 25 bp, Homo sapien
tctttgtagttggaacagaatggta

SEQ ID NO: 491798 - DNA, 25 bp, Homo sapien
gaatggtagtgaattaggtaccctt

SEQ ID NO: 491799 - DNA, 25 bp, Homo sapien
tttgtccctgtttctatcaactgta

SEQ ID NO: 491800 - DNA, 25 bp, Homo sapien
ttgtccctgtttctatcaactgtaa

SEQ ID NO: 491801 - DNA, 25 bp, Homo sapien
tgtccctgtttctatcaactgtaaa

SEQ ID NO: 491802 - DNA, 25 bp, Homo sapien
gtccctgtttctatcaactgtaaaa

SEQ ID NO: 491803 - DNA, 25 bp, Homo sapien
tccctgtttctatcaactgtaaaat

SEQ ID NO: 491804 - DNA, 25 bp, Homo sapien
ccctgtttctatcaactgtaaaatg

SEQ ID NO: 491805 - DNA, 25 bp, Homo sapien
cctgtttctatcaactgtaaaatgg

SEQ ID NO: 491806 - DNA, 25 bp, Homo sapien
tgtaaaatgggggttctagagttgt

SEQ ID NO: 491807 - DNA, 25 bp, Homo sapien
aaatgggggttctagagttgttgtg

SEQ ID NO: 491808 - DNA, 25 bp, Homo sapien
aatgggggttctagagttgttgtga

SEQ ID NO: 491809 - DNA, 25 bp, Homo sapien
gatgtttactttgctactaaactta

SEQ ID NO: 491810 - DNA, 25 bp, Homo sapien
tcactgtcacctgtgggcagtagtt

SEQ ID NO: 491811 - DNA, 25 bp, Homo sapien
gtgggcagtagttcagctaaattcc

SEQ ID NO: 491812 - DNA, 25 bp, Homo sapien
aaagtggactgtagcttttcctgcc

SEQ ID NO: 491813 - DNA, 25 bp, Homo sapien
agcttttcctgcctaactggcaaaa

SEQ ID NO: 491814 - DNA, 25 bp, Homo sapien
agaatacatcttaactaggcaccag

SEQ ID NO: 491815 - DNA, 25 bp, Homo sapien
taggcaccagaatagctcatttcca

SEQ ID NO: 491816 - DNA, 25 bp, Homo sapien
gaatagctcatttccaagtggttta

SEQ ID NO: 491817 - DNA, 25 bp, Homo sapien
atttccaagtggtttatacagcaat

SEQ ID NO: 491818 - DNA, 25 bp, Homo sapien
agtgttaacttctccaacagagacg

SEQ ID NO: 491819 - DNA, 25 bp, Homo sapien
ctccaacagagacgaaatcatttat

SEQ ID NO: 491820 - DNA, 25 bp, Homo sapien
ggcttcacgggcgagtgtacaatca

SEQ ID NO: 491821 - DNA, 25 bp, Homo sapien
ggtcttgagagtctgcttctgtaca

SEQ ID NO: 491822 - DNA, 25 bp, Homo sapien
gtgtggatcagcatgtgccgcttca

SEQ ID NO: 491823 - DNA, 25 bp, Homo sapien
tgccgcttcatgttcgcctgtaggg

SEQ ID NO: 491824 - DNA, 25 bp, Homo sapien
tgtagggtgaactcccggccacaca

SEQ ID NO: 491825 - DNA, 25 bp, Homo sapien
tgaactccttcacgcccttgtgggt

SEQ ID NO: 491826 - DNA, 25 bp, Homo sapien
tggtgaatctggctgaactccatgc

SEQ ID NO: 491827 - DNA, 25 bp, Homo sapien
atgccgcattcagtgcacacgaagg

SEQ ID NO: 491828 - DNA, 25 bp, Homo sapien
cacacgaagggtcgcacgttctggt

SEQ ID NO: 491829 - DNA, 25 bp, Homo sapien
acgttctggtgcttgagcatgtggt

SEQ ID NO: 491830 - DNA, 25 bp, Homo sapien
agcatgtggttctgcaactggctgc

SEQ ID NO: 491831 - DNA, 25 bp, Homo sapien
tgctgggctacagcctgtactggat

SEQ ID NO: 491832 - DNA, 25 bp, Homo sapien
ggctacagcctgtactggatgggcc

SEQ ID NO: 491833 - DNA, 25 bp, Homo sapien
tacagcctgtactggatgggccgcc

SEQ ID NO: 491834 - DNA, 25 bp, Homo sapien
agcctgtactggatgggccgccgca

SEQ ID NO: 491835 - DNA, 25 bp, Homo sapien
gcctgtactggatgggccgccgcac

SEQ ID NO: 491836 - DNA, 25 bp, Homo sapien
gcaccgcgagcctggtcctgtcgct

SEQ ID NO: 491837 - DNA, 25 bp, Homo sapien
ccgaggcccggcacaagtaggagac

SEQ ID NO: 491838 - DNA, 25 bp, Homo sapien
aagtaggagactgctccccgcccgc

SEQ ID NO: 491839 - DNA, 25 bp, Homo sapien
gcacttctgggtgccaggtgcatcc

SEQ ID NO: 491840 - DNA, 25 bp, Homo sapien
acttctgggtgccaggtgcatccta

SEQ ID NO: 491841 - DNA, 25 bp, Homo sapien
cttctgggtgccaggtgcatcctag

SEQ ID NO: 491842 - DNA, 25 bp, Homo sapien
gacagaagggcaacatttgagctga

SEQ ID NO: 491843 - DNA, 25 bp, Homo sapien
gaagggcaacatttgagctgattct

SEQ ID NO: 491844 - DNA, 25 bp, Homo sapien
aagggcaacatttgagctgattctt

SEQ ID NO: 491845 - DNA, 25 bp, Homo sapien
gggcaacatttgagctgattcttaa

SEQ ID NO: 491846 - DNA, 25 bp, Homo sapien
ggcaacatttgagctgattcttaaa

SEQ ID NO: 491847 - DNA, 25 bp, Homo sapien
gcaacatttgagctgattcttaaaa

SEQ ID NO: 491848 - DNA, 25 bp, Homo sapien
caacatttgagctgattcttaaaaa

SEQ ID NO: 491849 - DNA, 25 bp, Homo sapien
tagagatacacgagaaatccaaatt

SEQ ID NO: 491850 - DNA, 25 bp, Homo sapien
gatacacgagaaatccaaattagga

SEQ ID NO: 491851 - DNA, 25 bp, Homo sapien
aattaggatagaattccagaagaag

SEQ ID NO: 491852 - DNA, 25 bp, Homo sapien
gaagaagggagtagcatgtgcaaaa

SEQ ID NO: 491853 - DNA, 25 bp, Homo sapien
ggaatgtaatgtggggttctgttca

SEQ ID NO: 491854 - DNA, 25 bp, Homo sapien
aatgtaatgtggggttctgttcaga

SEQ ID NO: 491855 - DNA, 25 bp, Homo sapien
atgtaatgtggggttctgttcagag

SEQ ID NO: 491856 - DNA, 25 bp, Homo sapien
tgtaatgtggggttctgttcagagc

SEQ ID NO: 491857 - DNA, 25 bp, Homo sapien
gtaatgtggggttctgttcagagct

SEQ ID NO: 491858 - DNA, 25 bp, Homo sapien
taatgtggggttctgttcagagctt

SEQ ID NO: 491859 - DNA, 25 bp, Homo sapien
agagcttcctacagagcaccagttg

SEQ ID NO: 491860 - DNA, 25 bp, Homo sapien
gagcttcctacagagcaccagttgc

SEQ ID NO: 491861 - DNA, 25 bp, Homo sapien
tattggtattaattaccagttttgg

SEQ ID NO: 491862 - DNA, 25 bp, Homo sapien
ttggtcccctaccaacaattggtat

SEQ ID NO: 491863 - DNA, 25 bp, Homo sapien
tggtcccctaccaacaattggtatt

SEQ ID NO: 491864 - DNA, 25 bp, Homo sapien
actgcaggcgtttataacagaagca

SEQ ID NO: 491865 - DNA, 25 bp, Homo sapien
caggcgtttataacagaagcaaagc

SEQ ID NO: 491866 - DNA, 25 bp, Homo sapien
gaagcaaagctaaatctaccgacaa

SEQ ID NO: 491867 - DNA, 25 bp, Homo sapien
gcaaagctaaatctaccgacaagga

SEQ ID NO: 491868 - DNA, 25 bp, Homo sapien
atctaccgacaaggacaatgaccag

SEQ ID NO: 491869 - DNA, 25 bp, Homo sapien
acaaggacaatgaccagacaagatg

SEQ ID NO: 491870 - DNA, 25 bp, Homo sapien
gaaactggagatggagccaaagaaa

SEQ ID NO: 491871 - DNA, 25 bp, Homo sapien
attgtttacctctaattgtgttgtc

SEQ ID NO: 491872 - DNA, 25 bp, Homo sapien
aactttttgtctccattccttatgt

SEQ ID NO: 491873 - DNA, 25 bp, Homo sapien
ttttgtctccattccttatgtatgt

SEQ ID NO: 491874 - DNA, 25 bp, Homo sapien
gtctccattccttatgtatgtgtga

SEQ ID NO: 491875 - DNA, 25 bp, Homo sapien
agttgcagatagaatgcccctttac

SEQ ID NO: 491876 - DNA, 25 bp, Homo sapien
ttgcagatagaatgcccctttacca

SEQ ID NO: 491877 - DNA, 25 bp, Homo sapien
gatagaatgcccctttaccactata

SEQ ID NO: 491878 - DNA, 25 bp, Homo sapien
atagaatgcccctttaccactatat

SEQ ID NO: 491879 - DNA, 25 bp, Homo sapien
tagaatgcccctttaccactatata

SEQ ID NO: 491880 - DNA, 25 bp, Homo sapien
agaatgcccctttaccactatatac

SEQ ID NO: 491881 - DNA, 25 bp, Homo sapien
aatgcccctttaccactatatacct

SEQ ID NO: 491882 - DNA, 25 bp, Homo sapien
tgcccctttaccactatatacctga

SEQ ID NO: 491883 - DNA, 25 bp, Homo sapien
cccctttaccactatatacctgaat

SEQ ID NO: 491884 - DNA, 25 bp, Homo sapien
ctttaccactatatacctgaatgtg

SEQ ID NO: 491885 - DNA, 25 bp, Homo sapien
tataaattaagagaaatgggccaaa

SEQ ID NO: 491886 - DNA, 25 bp, Homo sapien
agaaaacttctgtctgtctctggca

SEQ ID NO: 491887 - DNA, 25 bp, Homo sapien
tctgtctgtctctggcaagaattgg

SEQ ID NO: 491888 - DNA, 25 bp, Homo sapien
tgtgggctgggcttggcttctaact

SEQ ID NO: 491889 - DNA, 25 bp, Homo sapien
gcttggcttctaactgctgtgtgac

SEQ ID NO: 491890 - DNA, 25 bp, Homo sapien
ttctaactgctgtgtgacccaagac

SEQ ID NO: 491891 - DNA, 25 bp, Homo sapien
ttctcctccctaaccttggttatgt

SEQ ID NO: 491892 - DNA, 25 bp, Homo sapien
aaccttggttatgtcttggcagcac

SEQ ID NO: 491893 - DNA, 25 bp, Homo sapien
ttatgtcttggcagcacagtgagca

SEQ ID NO: 491894 - DNA, 25 bp, Homo sapien
gcaggtcggactaggcgaacagttt

SEQ ID NO: 491895 - DNA, 25 bp, Homo sapien
ataaactcttatgtgtaaccccaat

SEQ ID NO: 491896 - DNA, 25 bp, Homo sapien
actagattaaaagggagtctctctg

SEQ ID NO: 491897 - DNA, 25 bp, Homo sapien
tgagggccggttgtttttaccatag

SEQ ID NO: 491898 - DNA, 25 bp, Homo sapien
tgtttttaccatagatgacaagtag

SEQ ID NO: 491899 - DNA, 25 bp, Homo sapien
gtttttaccatagatgacaagtaga

SEQ ID NO: 491900 - DNA, 25 bp, Homo sapien
tttaccatagatgacaagtagaggg

SEQ ID NO: 491901 - DNA, 25 bp, Homo sapien
tggtaccagcttgcataatagcttc

SEQ ID NO: 491902 - DNA, 25 bp, Homo sapien
taatagcttctgaggctgtctcctt

SEQ ID NO: 491903 - DNA, 25 bp, Homo sapien
atgtgatcctgactgtctgtcccaa

SEQ ID NO: 491904 - DNA, 25 bp, Homo sapien
ggtcccaactccgaagacatacttc

SEQ ID NO: 491905 - DNA, 25 bp, Homo sapien
aactccgaagacatacttcccactg

SEQ ID NO: 491906 - DNA, 25 bp, Homo sapien
cgaagacatacttcccactgctgtc

SEQ ID NO: 491907 - DNA, 25 bp, Homo sapien
gtcccgggagtgacagtaatagtca

SEQ ID NO: 491908 - DNA, 25 bp, Homo sapien
gggtttattacctgatcattttctt

SEQ ID NO: 491909 - DNA, 25 bp, Homo sapien
ggtttattacctgatcattttcttt

SEQ ID NO: 491910 - DNA, 25 bp, Homo sapien
gatcattttctttaggaagaggttt

SEQ ID NO: 491911 - DNA, 25 bp, Homo sapien
gagtcagtttcagacagttctctat

SEQ ID NO: 491912 - DNA, 25 bp, Homo sapien
gtcagtttcagacagttctctatgc

SEQ ID NO: 491913 - DNA, 25 bp, Homo sapien
cagtttcagacagttctctatgctt

SEQ ID NO: 491914 - DNA, 25 bp, Homo sapien
gtttcagacagttctctatgcttaa

SEQ ID NO: 491915 - DNA, 25 bp, Homo sapien
ttcagacagttctctatgcttaact

SEQ ID NO: 491916 - DNA, 25 bp, Homo sapien
cagacagttctctatgcttaactta

SEQ ID NO: 491917 - DNA, 25 bp, Homo sapien
gacagttctctatgcttaacttatt

SEQ ID NO: 491918 - DNA, 25 bp, Homo sapien
acagttctctatgcttaacttattt

SEQ ID NO: 491919 - DNA, 25 bp, Homo sapien
ggtcaagtagtaagagaagcggtaa

SEQ ID NO: 491920 - DNA, 25 bp, Homo sapien
caggagtcattgacctcttgggaga

SEQ ID NO: 491921 - DNA, 25 bp, Homo sapien
tcattgacctcttgggagaggagac

SEQ ID NO: 491922 - DNA, 25 bp, Homo sapien
gatgatttgctgaagcagccacaca

SEQ ID NO: 491923 - DNA, 25 bp, Homo sapien
atttgctgaagcagccacacacgtt

SEQ ID NO: 491924 - DNA, 25 bp, Homo sapien
gaagcagccacacacgttcagcttg

SEQ ID NO: 491925 - DNA, 25 bp, Homo sapien
agccacacacgttcagcttgtgagg

SEQ ID NO: 491926 - DNA, 25 bp, Homo sapien
acacgttcagcttgtgaggacagca

SEQ ID NO: 491927 - DNA, 25 bp, Homo sapien
cgttcagcttgtgaggacagcagtt

SEQ ID NO: 491928 - DNA, 25 bp, Homo sapien
cttgtgaggacagcagttgttaggc

SEQ ID NO: 491929 - DNA, 25 bp, Homo sapien
gaagctggcagatctgtgcaggtga

SEQ ID NO: 491930 - DNA, 25 bp, Homo sapien
tttcttattttgaggcaccaggact

SEQ ID NO: 491931 - DNA, 25 bp, Homo sapien
gaggcaccaggactatgctatattt

SEQ ID NO: 491932 - DNA, 25 bp, Homo sapien
ttagctactttaactcttgcagagg

SEQ ID NO: 491933 - DNA, 25 bp, Homo sapien
actcttgcagaggtacaatatctag

SEQ ID NO: 491934 - DNA, 25 bp, Homo sapien
caatatctaggttggcaggtaacta

SEQ ID NO: 491935 - DNA, 25 bp, Homo sapien
attttaagagtctcaggaggtcctc

SEQ ID NO: 491936 - DNA, 25 bp, Homo sapien
caggaggtcctctatatctggaagt

SEQ ID NO: 491937 - DNA, 25 bp, Homo sapien
gtgggaaaatgacacttcttgctaa

SEQ ID NO: 491938 - DNA, 25 bp, Homo sapien
atgacacttcttgctaaactctaag

SEQ ID NO: 491939 - DNA, 25 bp, Homo sapien
gaatctaacagtaacaacaaccatt

SEQ ID NO: 491940 - DNA, 25 bp, Homo sapien
gaatctactactaacaaccactgaa

SEQ ID NO: 491941 - DNA, 25 bp, Homo sapien
ctacagcagtagtttttcatatata

SEQ ID NO: 491942 - DNA, 25 bp, Homo sapien
gaggtcactttaatgtttcacagcg

SEQ ID NO: 491943 - DNA, 25 bp, Homo sapien
taatgtttcacagcgatctcagatc

SEQ ID NO: 491944 - DNA, 25 bp, Homo sapien
gatctcagatctaggcctcaggtag

SEQ ID NO: 491945 - DNA, 25 bp, Homo sapien
ctaggcctcaggtagaatggaagct

SEQ ID NO: 491946 - DNA, 25 bp, Homo sapien
gaagctgttctgcattcactgatta

SEQ ID NO: 491947 - DNA, 25 bp, Homo sapien
gattaacgttgctaaactcttggtg

SEQ ID NO: 491948 - DNA, 25 bp, Homo sapien
aactcttggtgaggcacgagctacc

SEQ ID NO: 491949 - DNA, 25 bp, Homo sapien
gagctaccagccaattgctcttcat

SEQ ID NO: 491950 - DNA, 25 bp, Homo sapien
ctcttcatcacagctatctgtcttt

SEQ ID NO: 491951 - DNA, 25 bp, Homo sapien
agctatctgtcttttagtgccacaa

SEQ ID NO: 491952 - DNA, 25 bp, Homo sapien
ttcctgcatgcggacttactttggt

SEQ ID NO: 491953 - DNA, 25 bp, Homo sapien
tcctgcatgcggacttactttggtc

SEQ ID NO: 491954 - DNA, 25 bp, Homo sapien
cctgcatgcggacttactttggtcc

SEQ ID NO: 491955 - DNA, 25 bp, Homo sapien
acattcctaacatcagaatttgcgc

SEQ ID NO: 491956 - DNA, 25 bp, Homo sapien
tcctaacatcagaatttgcgcctgt

SEQ ID NO: 491957 - DNA, 25 bp, Homo sapien
taacatcagaatttgcgcctgtgtt

SEQ ID NO: 491958 - DNA, 25 bp, Homo sapien
acatcagaatttgcgcctgtgtttt

SEQ ID NO: 491959 - DNA, 25 bp, Homo sapien
cagaatttgcgcctgtgttttcttc

SEQ ID NO: 491960 - DNA, 25 bp, Homo sapien
agaatttgcgcctgtgttttcttcc

SEQ ID NO: 491961 - DNA, 25 bp, Homo sapien
gaatttgcgcctgtgttttcttccc

SEQ ID NO: 491962 - DNA, 25 bp, Homo sapien
taaacacaatttgtaaaatcccgtg

SEQ ID NO: 491963 - DNA, 25 bp, Homo sapien
gctggtggctcacagcaaactgcac

SEQ ID NO: 491964 - DNA, 25 bp, Homo sapien
tacaaacccaatcgctacttcaagt

SEQ ID NO: 491965 - DNA, 25 bp, Homo sapien
aaacccaatcgctacttcaagtgtg

SEQ ID NO: 491966 - DNA, 25 bp, Homo sapien
aagcacctgcatgtttgcgcggagc

SEQ ID NO: 491967 - DNA, 25 bp, Homo sapien
catgtttgcgcggagcatgcgcaga

SEQ ID NO: 491968 - DNA, 25 bp, Homo sapien
ttgcgcggagcatgcgcagagccca

SEQ ID NO: 491969 - DNA, 25 bp, Homo sapien
gaactggctcagcatttgcgaaccc

SEQ ID NO: 491970 - DNA, 25 bp, Homo sapien
tggctcagcatttgcgaacccaatg

SEQ ID NO: 491971 - DNA, 25 bp, Homo sapien
tcagcatttgcgaacccaatgcccg

SEQ ID NO: 491972 - DNA, 25 bp, Homo sapien
actcagtccctgaaagccaagttct

SEQ ID NO: 491973 - DNA, 25 bp, Homo sapien
aaagccaagttcttccgctgctcag

SEQ ID NO: 491974 - DNA, 25 bp, Homo sapien
gcatcaacaattttgcctaactggt

SEQ ID NO: 491975 - DNA, 25 bp, Homo sapien
ttgcctaactggtccatgttaagaa

SEQ ID NO: 491976 - DNA, 25 bp, Homo sapien
gcctaactggtccatgttaagaaat

SEQ ID NO: 491977 - DNA, 25 bp, Homo sapien
aactggtccatgttaagaaatgtgt

SEQ ID NO: 491978 - DNA, 25 bp, Homo sapien
catgttaagaaatgtgtgtgggccg

SEQ ID NO: 491979 - DNA, 25 bp, Homo sapien
aagaaatgtgtgtgggccgggtgca

SEQ ID NO: 491980 - DNA, 25 bp, Homo sapien
aatccgggaggcagaatttacagtt

SEQ ID NO: 491981 - DNA, 25 bp, Homo sapien
agaatttacagttagctgggcgcca

SEQ ID NO: 491982 - DNA, 25 bp, Homo sapien
gaatttacagttagctgggcgccat

SEQ ID NO: 491983 - DNA, 25 bp, Homo sapien
atttacagttagctgggcgccattg

SEQ ID NO: 491984 - DNA, 25 bp, Homo sapien
ttacagttagctgggcgccattgta

SEQ ID NO: 491985 - DNA, 25 bp, Homo sapien
tgaagggagcatggtttttatctat

SEQ ID NO: 491986 - DNA, 25 bp, Homo sapien
gagcatggtttttatctatgatact

SEQ ID NO: 491987 - DNA, 25 bp, Homo sapien
tttatagctatgtagtagttcccct

SEQ ID NO: 491988 - DNA, 25 bp, Homo sapien
tagctatgtagtagttcccctaaat

SEQ ID NO: 491989 - DNA, 25 bp, Homo sapien
tatgtagtagttcccctaaattctt

SEQ ID NO: 491990 - DNA, 25 bp, Homo sapien
gtaattttttaccttgatttggcat

SEQ ID NO: 491991 - DNA, 25 bp, Homo sapien
gatttggcatgtttgtatgttactt

SEQ ID NO: 491992 - DNA, 25 bp, Homo sapien
gttactttaaagaggatgtgtgttc

SEQ ID NO: 491993 - DNA, 25 bp, Homo sapien
taaaggaggacatgagctgtgtgtt

SEQ ID NO: 491994 - DNA, 25 bp, Homo sapien
gctgtgtgttttcaagagaacaata

SEQ ID NO: 491995 - DNA, 25 bp, Homo sapien
agaacaatagagtgtgtctcttggg

SEQ ID NO: 491996 - DNA, 25 bp, Homo sapien
gttggtctcttaagtaagtcttatt

SEQ ID NO: 491997 - DNA, 25 bp, Homo sapien
gaatatcttaaaatggtaacctggg

SEQ ID NO: 491998 - DNA, 25 bp, Homo sapien
tgtgtgcacggcagcctagccagtg

SEQ ID NO: 491999 - DNA, 25 bp, Homo sapien
tataagtagttcacagactctgatg

SEQ ID NO: 492000 - DNA, 25 bp, Homo sapien
acagactctgatggcattttggtaa

SEQ ID NO: 492001 - DNA, 25 bp, Homo sapien
ggcattttggtaagctttccatctt

SEQ ID NO: 492002 - DNA, 25 bp, Homo sapien
tttggtaagctttccatctttaaga

SEQ ID NO: 492003 - DNA, 25 bp, Homo sapien
gaaattgaaccagcattctcttatt

SEQ ID NO: 492004 - DNA, 25 bp, Homo sapien
ggaagtaatttccagttcttacact

SEQ ID NO: 492005 - DNA, 25 bp, Homo sapien
agttcttacactctgatacgcatcc

SEQ ID NO: 492006 - DNA, 25 bp, Homo sapien
actctgatacgcatcccttttattt

SEQ ID NO: 492007 - DNA, 25 bp, Homo sapien
ttctttctgattcactcttgttttg

SEQ ID NO: 492008 - DNA, 25 bp, Homo sapien
gattcactcttgttttgtagttgtg

SEQ ID NO: 492009 - DNA, 25 bp, Homo sapien
cactcttgttttgtagttgtggaca

SEQ ID NO: 492010 - DNA, 25 bp, Homo sapien
tcttgttttgtagttgtggacattt

SEQ ID NO: 492011 - DNA, 25 bp, Homo sapien
gtggacatttaagaagactttttat

SEQ ID NO: 492012 - DNA, 25 bp, Homo sapien
tttttattcaaagggcttgtgctca

SEQ ID NO: 492013 - DNA, 25 bp, Homo sapien
tattcaaagggcttgtgctcaaata

SEQ ID NO: 492014 - DNA, 25 bp, Homo sapien
ttcaaagggcttgtgctcaaataaa

SEQ ID NO: 492015 - DNA, 25 bp, Homo sapien
caaagggcttgtgctcaaataaagt

SEQ ID NO: 492016 - DNA, 25 bp, Homo sapien
aagggcttgtgctcaaataaagtga

SEQ ID NO: 492017 - DNA, 25 bp, Homo sapien
gggcttgtgctcaaataaagtgaga

SEQ ID NO: 492018 - DNA, 25 bp, Homo sapien
gcaacaatgcttgaagttgtataca

SEQ ID NO: 492019 - DNA, 25 bp, Homo sapien
caatgcttgaagttgtatacagtct

SEQ ID NO: 492020 - DNA, 25 bp, Homo sapien
atgcttgaagttgtatacagtctgc

SEQ ID NO: 492021 - DNA, 25 bp, Homo sapien
gcttgaagttgtatacagtctgctc

SEQ ID NO: 492022 - DNA, 25 bp, Homo sapien
cttgaagttgtatacagtctgctct

SEQ ID NO: 492023 - DNA, 25 bp, Homo sapien
ttgaagttgtatacagtctgctctt

SEQ ID NO: 492024 - DNA, 25 bp, Homo sapien
tgaagttgtatacagtctgctcttt

SEQ ID NO: 492025 - DNA, 25 bp, Homo sapien
gaagttgtatacagtctgctctttc

SEQ ID NO: 492026 - DNA, 25 bp, Homo sapien
gtatacagtctgctctttcctggtt

SEQ ID NO: 492027 - DNA, 25 bp, Homo sapien
gaaagaaatgcaacaatgcttgaag

SEQ ID NO: 492028 - DNA, 25 bp, Homo sapien
gaaatgcaacaatgcttgaagttgt

SEQ ID NO: 492029 - DNA, 25 bp, Homo sapien
aaacatatcccccattggactcctt

SEQ ID NO: 492030 - DNA, 25 bp, Homo sapien
ccccattggactccttaggacaaat

SEQ ID NO: 492031 - DNA, 25 bp, Homo sapien
gactccttaggacaaatcttgcaga

SEQ ID NO: 492032 - DNA, 25 bp, Homo sapien
ggacaaatcttgcagattatcatac

SEQ ID NO: 492033 - DNA, 25 bp, Homo sapien
aacagcctgaagtctaaactgactc

SEQ ID NO: 492034 - DNA, 25 bp, Homo sapien
gaagtctaaactgactcactaaggg

SEQ ID NO: 492035 - DNA, 25 bp, Homo sapien
gggtatttccatccttgggttctgg

SEQ ID NO: 492036 - DNA, 25 bp, Homo sapien
atttccatccttgggttctggctta

SEQ ID NO: 492037 - DNA, 25 bp, Homo sapien
tccatccttgggttctggcttaata

SEQ ID NO: 492038 - DNA, 25 bp, Homo sapien
catccttgggttctggcttaatact

SEQ ID NO: 492039 - DNA, 25 bp, Homo sapien
tccttgggttctggcttaatacttt

SEQ ID NO: 492040 - DNA, 25 bp, Homo sapien
aaatttaaaaccagtggcgtgcagt

SEQ ID NO: 492041 - DNA, 25 bp, Homo sapien
aaaaccagtggcgtgcagtagctca

SEQ ID NO: 492042 - DNA, 25 bp, Homo sapien
aaccagtggcgtgcagtagctcaaa

SEQ ID NO: 492043 - DNA, 25 bp, Homo sapien
accagtggcgtgcagtagctcaaac

SEQ ID NO: 492044 - DNA, 25 bp, Homo sapien
cagtggcgtgcagtagctcaaacct

SEQ ID NO: 492045 - DNA, 25 bp, Homo sapien
aacacaaacagtcctgcatctaggc

SEQ ID NO: 492046 - DNA, 25 bp, Homo sapien
acaaacagtcctgcatctaggcggc

SEQ ID NO: 492047 - DNA, 25 bp, Homo sapien
aaacagtcctgcatctaggcggctc

SEQ ID NO: 492048 - DNA, 25 bp, Homo sapien
aacagtcctgcatctaggcggctct

SEQ ID NO: 492049 - DNA, 25 bp, Homo sapien
agtcctgcatctaggcggctctgaa

SEQ ID NO: 492050 - DNA, 25 bp, Homo sapien
gtcctgcatctaggcggctctgaaa

SEQ ID NO: 492051 - DNA, 25 bp, Homo sapien
agttgtatcctgagtccttgaaaag

SEQ ID NO: 492052 - DNA, 25 bp, Homo sapien
aagttctgggtgaatggctgcctta

SEQ ID NO: 492053 - DNA, 25 bp, Homo sapien
aatggctgccttatatccagtggcc

SEQ ID NO: 492054 - DNA, 25 bp, Homo sapien
cggagcctccacttgatagatgaca

SEQ ID NO: 492055 - DNA, 25 bp, Homo sapien
gacacacattgatagggcagagcag

SEQ ID NO: 492056 - DNA, 25 bp, Homo sapien
gagcagggagtgtgcacagtctcct

SEQ ID NO: 492057 - DNA, 25 bp, Homo sapien
tgcagggtgagctgcttctgtgaca

SEQ ID NO: 492058 - DNA, 25 bp, Homo sapien
gtggagacctgtgtcaagacagcta

SEQ ID NO: 492059 - DNA, 25 bp, Homo sapien
aagacagctaggtctctgtcctaac

SEQ ID NO: 492060 - DNA, 25 bp, Homo sapien
ggtctctgtcctaacctccaagttt

SEQ ID NO: 492061 - DNA, 25 bp, Homo sapien
aaaactacagtcaggcatgaattgt

SEQ ID NO: 492062 - DNA, 25 bp, Homo sapien
cgtttgtgaagagctgagggtatca

SEQ ID NO: 492063 - DNA, 25 bp, Homo sapien
agggtatcaggagggccgacgctgt

SEQ ID NO: 492064 - DNA, 25 bp, Homo sapien
cgacgctgtgttggcatgcgcagta

SEQ ID NO: 492065 - DNA, 25 bp, Homo sapien
agggttagccatagtattctttgca

SEQ ID NO: 492066 - DNA, 25 bp, Homo sapien
gtgaaagcgagacattatatcttct

SEQ ID NO: 492067 - DNA, 25 bp, Homo sapien
gacattatatcttctcttgcttggt

SEQ ID NO: 492068 - DNA, 25 bp, Homo sapien
atcttctcttgcttggtgtaactaa

SEQ ID NO: 492069 - DNA, 25 bp, Homo sapien
gcttggtgtaactaatcactgttaa

SEQ ID NO: 492070 - DNA, 25 bp, Homo sapien
aactccttagcaaaccaggtctaca

SEQ ID NO: 492071 - DNA, 25 bp, Homo sapien
aaccaggtctacatcctgttttgtt

SEQ ID NO: 492072 - DNA, 25 bp, Homo sapien
ggtcaaattggtactcttggaggaa

SEQ ID NO: 492073 - DNA, 25 bp, Homo sapien
ataggagtcgattacaatcacctgc

SEQ ID NO: 492074 - DNA, 25 bp, Homo sapien
ggagtcgattacaatcacctgccgt

SEQ ID NO: 492075 - DNA, 25 bp, Homo sapien
agtcgattacaatcacctgccgtcg

SEQ ID NO: 492076 - DNA, 25 bp, Homo sapien
tcgattacaatcacctgccgtcgtt

SEQ ID NO: 492077 - DNA, 25 bp, Homo sapien
gattacaatcacctgccgtcgttac

SEQ ID NO: 492078 - DNA, 25 bp, Homo sapien
attacaatcacctgccgtcgttaca

SEQ ID NO: 492079 - DNA, 25 bp, Homo sapien
aatcacctgccgtcgttacacgtct

SEQ ID NO: 492080 - DNA, 25 bp, Homo sapien
acctgccgtcgttacacgtctgact

SEQ ID NO: 492081 - DNA, 25 bp, Homo sapien
cgtcgttacacgtctgactggaaaa

SEQ ID NO: 492082 - DNA, 25 bp, Homo sapien
gtcgttacacgtctgactggaaaac

SEQ ID NO: 492083 - DNA, 25 bp, Homo sapien
tgactggaaaacctgcgtacccact

SEQ ID NO: 492084 - DNA, 25 bp, Homo sapien
tcagcagatttacatggccatattt

SEQ ID NO: 492085 - DNA, 25 bp, Homo sapien
gtagtaattctctatatgacacact

SEQ ID NO: 492086 - DNA, 25 bp, Homo sapien
gtagggaaaaacagatcacattatt

SEQ ID NO: 492087 - DNA, 25 bp, Homo sapien
gcatcaaatggatccttgttcagat

SEQ ID NO: 492088 - DNA, 25 bp, Homo sapien
ttgttcagattgaaactgctcccgt

SEQ ID NO: 492089 - DNA, 25 bp, Homo sapien
actgctcccgtagcataaatgggtt

SEQ ID NO: 492090 - DNA, 25 bp, Homo sapien
gttatctaatcatttctgtctacag

SEQ ID NO: 492091 - DNA, 25 bp, Homo sapien
tctgtctacagagccttcttttcca

SEQ ID NO: 492092 - DNA, 25 bp, Homo sapien
tcttttccaaaagcgaacctgtatc

SEQ ID NO: 492093 - DNA, 25 bp, Homo sapien
cgaacctgtatccaaacttccataa

SEQ ID NO: 492094 - DNA, 25 bp, Homo sapien
ttccataatgtcctcagcagattta

SEQ ID NO: 492095 - DNA, 25 bp, Homo sapien
ctgtaactactactatgagtgctta

SEQ ID NO: 492096 - DNA, 25 bp, Homo sapien
actactactatgagtgcttatgctg

SEQ ID NO: 492097 - DNA, 25 bp, Homo sapien
actactatgagtgcttatgctgtat

SEQ ID NO: 492098 - DNA, 25 bp, Homo sapien
tactatgagtgcttatgctgtattg

SEQ ID NO: 492099 - DNA, 25 bp, Homo sapien
tatgagtgcttatgctgtattgttt

SEQ ID NO: 492100 - DNA, 25 bp, Homo sapien
gtcttttctcattcacaggagcaga

SEQ ID NO: 492101 - DNA, 25 bp, Homo sapien
agcagaaaggtgcagttgtttattc

SEQ ID NO: 492102 - DNA, 25 bp, Homo sapien
gaaaggtgcagttgtttattctctt

SEQ ID NO: 492103 - DNA, 25 bp, Homo sapien
gcagttgtttattctcttagccttt

SEQ ID NO: 492104 - DNA, 25 bp, Homo sapien
tttttcctgtatttcccacaaatct

SEQ ID NO: 492105 - DNA, 25 bp, Homo sapien
tcctgtatttcccacaaatctagaa

SEQ ID NO: 492106 - DNA, 25 bp, Homo sapien
agctgcaaacaaccactgaattcgt

SEQ ID NO: 492107 - DNA, 25 bp, Homo sapien
cactgaattcgttctgtaaacctgt

SEQ ID NO: 492108 - DNA, 25 bp, Homo sapien
gtcatttgacgtttccaggcaggca

SEQ ID NO: 492109 - DNA, 25 bp, Homo sapien
tccaggcaggcatcaacatttacat

SEQ ID NO: 492110 - DNA, 25 bp, Homo sapien
gtaattcaatagacgctactactac

SEQ ID NO: 492111 - DNA, 25 bp, Homo sapien
gacgctactactacaaaggagcttt

SEQ ID NO: 492112 - DNA, 25 bp, Homo sapien
aaggagctttattcttccagcttaa

SEQ ID NO: 492113 - DNA, 25 bp, Homo sapien
tattcttccagcttaatatggttgc

SEQ ID NO: 492114 - DNA, 25 bp, Homo sapien
aatatggttgctgcgggaacactgc

SEQ ID NO: 492115 - DNA, 25 bp, Homo sapien
gggaacactgcaggatgaaactgac

SEQ ID NO: 492116 - DNA, 25 bp, Homo sapien
ttgtggtaatgtttctcctggttgg

SEQ ID NO: 492117 - DNA, 25 bp, Homo sapien
ctgagcaagctgtatgaacgccacg

SEQ ID NO: 492118 - DNA, 25 bp, Homo sapien
tgagcaagctgtatgaacgccacgt

SEQ ID NO: 492119 - DNA, 25 bp, Homo sapien
gagcaagctgtatgaacgccacgtt

SEQ ID NO: 492120 - DNA, 25 bp, Homo sapien
agcaagctgtatgaacgccacgttt

SEQ ID NO: 492121 - DNA, 25 bp, Homo sapien
gcaagctgtatgaacgccacgtttg

SEQ ID NO: 492122 - DNA, 25 bp, Homo sapien
caagctgtatgaacgccacgtttgt

SEQ ID NO: 492123 - DNA, 25 bp, Homo sapien
aagctgtatgaacgccacgtttgtg

SEQ ID NO: 492124 - DNA, 25 bp, Homo sapien
ctgtatgaacgccacgtttgtgaag

SEQ ID NO: 492125 - DNA, 25 bp, Homo sapien
tgtatgaacgccacgtttgtgaaga

SEQ ID NO: 492126 - DNA, 25 bp, Homo sapien
tatgaacgccacgtttgtgaagagc

SEQ ID NO: 492127 - DNA, 25 bp, Homo sapien
atgaacgccacgtttgtgaagagct

SEQ ID NO: 492128 - DNA, 25 bp, Homo sapien
gacaatttaagccatctatcttttt

SEQ ID NO: 492129 - DNA, 25 bp, Homo sapien
aatatgatcatgtcagtttggtcta

SEQ ID NO: 492130 - DNA, 25 bp, Homo sapien
gatcatgtcagtttggtctattttt

SEQ ID NO: 492131 - DNA, 25 bp, Homo sapien
cagtttggtctatttttatacgtgt

SEQ ID NO: 492132 - DNA, 25 bp, Homo sapien
tatacgtgttaaggagagcactaac

SEQ ID NO: 492133 - DNA, 25 bp, Homo sapien
ggagagcactaacagacaaaagaat

SEQ ID NO: 492134 - DNA, 25 bp, Homo sapien
ttgatttcattttgtggccattcct

SEQ ID NO: 492135 - DNA, 25 bp, Homo sapien
atttcattttgtggccattcctttt

SEQ ID NO: 492136 - DNA, 25 bp, Homo sapien
tttttggcagccacgaagactggga

SEQ ID NO: 492137 - DNA, 25 bp, Homo sapien
gcagccacgaagactgggatttcta

SEQ ID NO: 492138 - DNA, 25 bp, Homo sapien
gactgggatttctaattctatgtta

SEQ ID NO: 492139 - DNA, 25 bp, Homo sapien
gcatcagagggagactagggaaagg

SEQ ID NO: 492140 - DNA, 25 bp, Homo sapien
gagaggttagtattttcaaaaatca

SEQ ID NO: 492141 - DNA, 25 bp, Homo sapien
caaaaatcatcatatagtacgtggt

SEQ ID NO: 492142 - DNA, 25 bp, Homo sapien
aaatcatcatatagtacgtggttac

SEQ ID NO: 492143 - DNA, 25 bp, Homo sapien
atcatcatatagtacgtggttacac

SEQ ID NO: 492144 - DNA, 25 bp, Homo sapien
tcatcatatagtacgtggttacaca

SEQ ID NO: 492145 - DNA, 25 bp, Homo sapien
atcatatagtacgtggttacacaac

SEQ ID NO: 492146 - DNA, 25 bp, Homo sapien
atatagtacgtggttacacaactct

SEQ ID NO: 492147 - DNA, 25 bp, Homo sapien
aaaggagtgaactatatctcaatat

SEQ ID NO: 492148 - DNA, 25 bp, Homo sapien
ggagtgaactatatctcaatatata

SEQ ID NO: 492149 - DNA, 25 bp, Homo sapien
gtgaactatatctcaatatataagg

SEQ ID NO: 492150 - DNA, 25 bp, Homo sapien
tctgctgctgtctttactgctctca

SEQ ID NO: 492151 - DNA, 25 bp, Homo sapien
tcacttctcaacttcctgcttttta

SEQ ID NO: 492152 - DNA, 25 bp, Homo sapien
gttcctccaacaactacaacagatt

SEQ ID NO: 492153 - DNA, 25 bp, Homo sapien
acaactacaacagattgtctcattt

SEQ ID NO: 492154 - DNA, 25 bp, Homo sapien
tgggtcatgggctctaagctgctct

SEQ ID NO: 492155 - DNA, 25 bp, Homo sapien
atgggctctaagctgctcttctgtc

SEQ ID NO: 492156 - DNA, 25 bp, Homo sapien
ctcttctgtctgtctgagcttatga

SEQ ID NO: 492157 - DNA, 25 bp, Homo sapien
gtctgtctgagcttatgaacacccc

SEQ ID NO: 492158 - DNA, 25 bp, Homo sapien
atgaacacccccacaggtagaagtg

SEQ ID NO: 492159 - DNA, 25 bp, Homo sapien
ggagaaaccctaaatcactcctctc

SEQ ID NO: 492160 - DNA, 25 bp, Homo sapien
tcctctctccacttgacatatcaaa

SEQ ID NO: 492161 - DNA, 25 bp, Homo sapien
tcctcgtcagcaatggaacaacgct

SEQ ID NO: 492162 - DNA, 25 bp, Homo sapien
agcaatggaacaacgctggatggag

SEQ ID NO: 492163 - DNA, 25 bp, Homo sapien
aaaggaggaagcttgaacgcatcac

SEQ ID NO: 492164 - DNA, 25 bp, Homo sapien
ggaggaagcttgaacgcatcacaaa

SEQ ID NO: 492165 - DNA, 25 bp, Homo sapien
gaagcttgaacgcatcacaaagaag

SEQ ID NO: 492166 - DNA, 25 bp, Homo sapien
cttgaacgcatcacaaagaagctaa

SEQ ID NO: 492167 - DNA, 25 bp, Homo sapien
acaagcttcagtagccgactcgatc

SEQ ID NO: 492168 - DNA, 25 bp, Homo sapien
gcttcagtagccgactcgatcaagt

SEQ ID NO: 492169 - DNA, 25 bp, Homo sapien
ttcagtagccgactcgatcaagtgg

SEQ ID NO: 492170 - DNA, 25 bp, Homo sapien
cagtagccgactcgatcaagtggaa

SEQ ID NO: 492171 - DNA, 25 bp, Homo sapien
tagccgactcgatcaagtggaagaa

SEQ ID NO: 492172 - DNA, 25 bp, Homo sapien
gtctaaatgcttttcaaaaattatt

SEQ ID NO: 492173 - DNA, 25 bp, Homo sapien
ctgcgttggcctcccctgtagtccc

SEQ ID NO: 492174 - DNA, 25 bp, Homo sapien
tgcgttggcctcccctgtagtccca

SEQ ID NO: 492175 - DNA, 25 bp, Homo sapien
aggcggagcttgcacatcacgccac

SEQ ID NO: 492176 - DNA, 25 bp, Homo sapien
ggcggagcttgcacatcacgccacc

SEQ ID NO: 492177 - DNA, 25 bp, Homo sapien
gcggagcttgcacatcacgccaccg

SEQ ID NO: 492178 - DNA, 25 bp, Homo sapien
cggagcttgcacatcacgccaccgc

SEQ ID NO: 492179 - DNA, 25 bp, Homo sapien
ggagcttgcacatcacgccaccgca

SEQ ID NO: 492180 - DNA, 25 bp, Homo sapien
gagcttgcacatcacgccaccgcac

SEQ ID NO: 492181 - DNA, 25 bp, Homo sapien
agcttgcacatcacgccaccgcact

SEQ ID NO: 492182 - DNA, 25 bp, Homo sapien
gcttgcacatcacgccaccgcactc

SEQ ID NO: 492183 - DNA, 25 bp, Homo sapien
gcaacaatgcttgaagttgtataca

SEQ ID NO: 492184 - DNA, 25 bp, Homo sapien
caatgcttgaagttgtatacagtct

SEQ ID NO: 492185 - DNA, 25 bp, Homo sapien
atgcttgaagttgtatacagtctgc

SEQ ID NO: 492186 - DNA, 25 bp, Homo sapien
tgcttgaagttgtatacagtctgct

SEQ ID NO: 492187 - DNA, 25 bp, Homo sapien
gcttgaagttgtatacagtctgctc

SEQ ID NO: 492188 - DNA, 25 bp, Homo sapien
cttgaagttgtatacagtctgctct

SEQ ID NO: 492189 - DNA, 25 bp, Homo sapien
ttgaagttgtatacagtctgctctt

SEQ ID NO: 492190 - DNA, 25 bp, Homo sapien
tgaagttgtatacagtctgctcttt

SEQ ID NO: 492191 - DNA, 25 bp, Homo sapien
gaagttgtatacagtctgctctttc

SEQ ID NO: 492192 - DNA, 25 bp, Homo sapien
gaaagaaatgcaacaatgcttgaag

SEQ ID NO: 492193 - DNA, 25 bp, Homo sapien
gaaatgcaacaatgcttgaagttgt

SEQ ID NO: 492194 - DNA, 25 bp, Homo sapien
gtggtagtgttggaaatggacataa

SEQ ID NO: 492195 - DNA, 25 bp, Homo sapien
ggacataaatagacatattcaggaa

SEQ ID NO: 492196 - DNA, 25 bp, Homo sapien
ttagatctaataagacacgtaatag

SEQ ID NO: 492197 - DNA, 25 bp, Homo sapien
cactggcttgaaatgctaaatggat

SEQ ID NO: 492198 - DNA, 25 bp, Homo sapien
atgctaaatggatgacggtgctgtt

SEQ ID NO: 492199 - DNA, 25 bp, Homo sapien
aatggatgacggtgctgtttagtga

SEQ ID NO: 492200 - DNA, 25 bp, Homo sapien
gaaaggtgacaatggcttagacttc

SEQ ID NO: 492201 - DNA, 25 bp, Homo sapien
aggtgacaatggcttagacttcagt

SEQ ID NO: 492202 - DNA, 25 bp, Homo sapien
gacaatggcttagacttcagtggta

SEQ ID NO: 492203 - DNA, 25 bp, Homo sapien
caatggcttagacttcagtggtagt

SEQ ID NO: 492204 - DNA, 25 bp, Homo sapien
tggcttagacttcagtggtagtgtt

SEQ ID NO: 492205 - DNA, 25 bp, Homo sapien
gggagcattgggttgacctttgcaa

SEQ ID NO: 492206 - DNA, 25 bp, Homo sapien
gggttgacctttgcaaattatctag

SEQ ID NO: 492207 - DNA, 25 bp, Homo sapien
gacctttgcaaattatctagtttta

SEQ ID NO: 492208 - DNA, 25 bp, Homo sapien
ttatttacctattttacacaggaga

SEQ ID NO: 492209 - DNA, 25 bp, Homo sapien
ggagtagcttgctgtagttcagaca

SEQ ID NO: 492210 - DNA, 25 bp, Homo sapien
ttcagacagcaacttatttcaaagc

SEQ ID NO: 492211 - DNA, 25 bp, Homo sapien
caacttatttcaaagctggtgctaa

SEQ ID NO: 492212 - DNA, 25 bp, Homo sapien
aagctggtgctaaaacctagagtga

SEQ ID NO: 492213 - DNA, 25 bp, Homo sapien
acctagagtgaactggtacttctcc

SEQ ID NO: 492214 - DNA, 25 bp, Homo sapien
agtgaactggtacttctccatttct

SEQ ID NO: 492215 - DNA, 25 bp, Homo sapien
acttctccatttctgaaggaaatgc

SEQ ID NO: 492216 - DNA, 25 bp, Homo sapien
tcgtgatttgtctcaccttgagtag

SEQ ID NO: 492217 - DNA, 25 bp, Homo sapien
agtaggagacatgcttctcccctaa

SEQ ID NO: 492218 - DNA, 25 bp, Homo sapien
tgtccttttcagtaagtccatgcct

SEQ ID NO: 492219 - DNA, 25 bp, Homo sapien
gtaattagctaccatctttgcagca

SEQ ID NO: 492220 - DNA, 25 bp, Homo sapien
tttgcagcagccctggtaacttgaa

SEQ ID NO: 492221 - DNA, 25 bp, Homo sapien
aaatttgggtctggtgctgttcatt

SEQ ID NO: 492222 - DNA, 25 bp, Homo sapien
gctgttcattgagtctttgtgtaac

SEQ ID NO: 492223 - DNA, 25 bp, Homo sapien
ggaagtcaagactcctgttgcctcg

SEQ ID NO: 492224 - DNA, 25 bp, Homo sapien
ctgttgcctcgtgcttagcaaagca

SEQ ID NO: 492225 - DNA, 25 bp, Homo sapien
gcttagcaaagcagtccttatcctt

SEQ ID NO: 492226 - DNA, 25 bp, Homo sapien
gtccttatcctttatactctgttct

SEQ ID NO: 492227 - DNA, 25 bp, Homo sapien
gtcaccacagggtggccattggcat

SEQ ID NO: 492228 - DNA, 25 bp, Homo sapien
attggcatgtcaacccgctgttaat

SEQ ID NO: 492229 - DNA, 25 bp, Homo sapien
gtcaacccgctgttaattcagagaa

SEQ ID NO: 492230 - DNA, 25 bp, Homo sapien
taattcagagaagtgggctccacct

SEQ ID NO: 492231 - DNA, 25 bp, Homo sapien
tgggctccacctcattgggagaagt

SEQ ID NO: 492232 - DNA, 25 bp, Homo sapien
cacgttagacgtgtgttgctgttaa

SEQ ID NO: 492233 - DNA, 25 bp, Homo sapien
agaggactagcctcagagctctggc

SEQ ID NO: 492234 - DNA, 25 bp, Homo sapien
tggaaatgacctcctaagacttttt

SEQ ID NO: 492235 - DNA, 25 bp, Homo sapien
atgacctcctaagactttttcgtgg

SEQ ID NO: 492236 - DNA, 25 bp, Homo sapien
ttccaggtggcatctgagtacatca

SEQ ID NO: 492237 - DNA, 25 bp, Homo sapien
agtacatcagatggttttgcaaaat

SEQ ID NO: 492238 - DNA, 25 bp, Homo sapien
ctggaattctatcctaatttggatt

SEQ ID NO: 492239 - DNA, 25 bp, Homo sapien
tcctaatttggatttctcgtgtatc

SEQ ID NO: 492240 - DNA, 25 bp, Homo sapien
aatttggatttctcgtgtatctcta

SEQ ID NO: 492241 - DNA, 25 bp, Homo sapien
gaatcagctcaaatgttgcccttct

SEQ ID NO: 492242 - DNA, 25 bp, Homo sapien
atcagctcaaatgttgcccttctgt

SEQ ID NO: 492243 - DNA, 25 bp, Homo sapien
tcagctcaaatgttgcccttctgtc

SEQ ID NO: 492244 - DNA, 25 bp, Homo sapien
ttttttgcacatgctactcccttct

SEQ ID NO: 492245 - DNA, 25 bp, Homo sapien
tactcccttcttctggaattctatc

SEQ ID NO: 492246 - DNA, 25 bp, Homo sapien
tcccttcttctggaattctatccta

SEQ ID NO: 492247 - DNA, 25 bp, Homo sapien
cttcttctggaattctatcctaatt

SEQ ID NO: 492248 - DNA, 25 bp, Homo sapien
ttctggaattctatcctaatttgga

SEQ ID NO: 492249 - DNA, 25 bp, Homo sapien
ttgaaaattgctcttccagtcccac

SEQ ID NO: 492250 - DNA, 25 bp, Homo sapien
tcttccagtcccactgttcatctca

SEQ ID NO: 492251 - DNA, 25 bp, Homo sapien
atatgccagagaagtatattttggg

SEQ ID NO: 492252 - DNA, 25 bp, Homo sapien
agatgtttggtggactagaaatgca

SEQ ID NO: 492253 - DNA, 25 bp, Homo sapien
gaaaaggaaggcttggtgatgtcaa

SEQ ID NO: 492254 - DNA, 25 bp, Homo sapien
gaaggcttggtgatgtcaaggattt

SEQ ID NO: 492255 - DNA, 25 bp, Homo sapien
ggcttggtgatgtcaaggattttta

SEQ ID NO: 492256 - DNA, 25 bp, Homo sapien
ttaaaagcaaactatctcactgtgt

SEQ ID NO: 492257 - DNA, 25 bp, Homo sapien
aaaagcaaactatctcactgtgttc

SEQ ID NO: 492258 - DNA, 25 bp, Homo sapien
caaactatctcactgtgttctctca

SEQ ID NO: 492259 - DNA, 25 bp, Homo sapien
tgagccccaacaagataggtttcat

SEQ ID NO: 492260 - DNA, 25 bp, Homo sapien
aagggcaccgcctggtcccaagtgt

SEQ ID NO: 492261 - DNA, 25 bp, Homo sapien
cccactcacttgtaagctccttgat

SEQ ID NO: 492262 - DNA, 25 bp, Homo sapien
ttgatgagcaaacccctaaggcccc

SEQ ID NO: 492263 - DNA, 25 bp, Homo sapien
gactcagcaggcattcaggtcaact

SEQ ID NO: 492264 - DNA, 25 bp, Homo sapien
gcaggcattcaggtcaactcaggca

SEQ ID NO: 492265 - DNA, 25 bp, Homo sapien
ggtcaactcaggcagactggctaag

SEQ ID NO: 492266 - DNA, 25 bp, Homo sapien
tggctaaggaccagcccagggcaat

SEQ ID NO: 492267 - DNA, 25 bp, Homo sapien
atgatcatttgcacagaatgggttt

SEQ ID NO: 492268 - DNA, 25 bp, Homo sapien
tcacagggagaaacttgcctctgaa

SEQ ID NO: 492269 - DNA, 25 bp, Homo sapien
acttgcctctgaaagctattttctg

SEQ ID NO: 492270 - DNA, 25 bp, Homo sapien
tgatcaagaaaaggcccacttttta

SEQ ID NO: 492271 - DNA, 25 bp, Homo sapien
gtggacatatagtcattctgttttt

SEQ ID NO: 492272 - DNA, 25 bp, Homo sapien
tcaagattggcatttcctcggaaac

SEQ ID NO: 492273 - DNA, 25 bp, Homo sapien
atttcctcggaaacatgaacgaagg

SEQ ID NO: 492274 - DNA, 25 bp, Homo sapien
aacgaaggacacatggcaggtagac

SEQ ID NO: 492275 - DNA, 25 bp, Homo sapien
acatggcaggtagacgacggcgcaa

SEQ ID NO: 492276 - DNA, 25 bp, Homo sapien
agacgacggcgcaagccaatcgatt

SEQ ID NO: 492277 - DNA, 25 bp, Homo sapien
caagccaatcgattcctaccgctag

SEQ ID NO: 492278 - DNA, 25 bp, Homo sapien
atgaaaggagcagcagccgcattaa

SEQ ID NO: 492279 - DNA, 25 bp, Homo sapien
agcagccgcattaatatcccagaga

SEQ ID NO: 492280 - DNA, 25 bp, Homo sapien
cagattgttactgaacccgatgcaa

SEQ ID NO: 492281 - DNA, 25 bp, Homo sapien
gaacccgatgcaaactttccccagt

SEQ ID NO: 492282 - DNA, 25 bp, Homo sapien
tcccacccaaagagtctgactgaat

SEQ ID NO: 492283 - DNA, 25 bp, Homo sapien
aagtgtttgttgaaggatgacatat

SEQ ID NO: 492284 - DNA, 25 bp, Homo sapien
cacaaaccataagtgtaaagctcag

SEQ ID NO: 492285 - DNA, 25 bp, Homo sapien
ttcacaaaatgaatttaccccgagt

SEQ ID NO: 492286 - DNA, 25 bp, Homo sapien
gaatttaccccgagtaaccagcatc

SEQ ID NO: 492287 - DNA, 25 bp, Homo sapien
cgagtaaccagcatccaaatcatga

SEQ ID NO: 492288 - DNA, 25 bp, Homo sapien
tgaaacagaacatcaccagcaaccc

SEQ ID NO: 492289 - DNA, 25 bp, Homo sapien
ttccacttactacctggctccaaag

SEQ ID NO: 492290 - DNA, 25 bp, Homo sapien
ttactacctggctccaaaggctaat

SEQ ID NO: 492291 - DNA, 25 bp, Homo sapien
ggctccaaaggctaatgtccattct

SEQ ID NO: 492292 - DNA, 25 bp, Homo sapien
ccaaaggctaatgtccattctggct

SEQ ID NO: 492293 - DNA, 25 bp, Homo sapien
tgccgcctaatgagctcaggtctag

SEQ ID NO: 492294 - DNA, 25 bp, Homo sapien
ctaatgagctcaggtctaggccgag

SEQ ID NO: 492295 - DNA, 25 bp, Homo sapien
aatgagctcaggtctaggccgagca

SEQ ID NO: 492296 - DNA, 25 bp, Homo sapien
tgagctcaggtctaggccgagcaga

SEQ ID NO: 492297 - DNA, 25 bp, Homo sapien
acctggtcggactcggttgggctcg

SEQ ID NO: 492298 - DNA, 25 bp, Homo sapien
aggcgggcccttctcgacggcgcgg

SEQ ID NO: 492299 - DNA, 25 bp, Homo sapien
gaccgagatgcagctctatcctgtg

SEQ ID NO: 492300 - DNA, 25 bp, Homo sapien
cgagatgcagctctatcctgtgccc

SEQ ID NO: 492301 - DNA, 25 bp, Homo sapien
atgcagctctatcctgtgcccctgg

SEQ ID NO: 492302 - DNA, 25 bp, Homo sapien
tatcctgtgcccctggtcgcagcag

SEQ ID NO: 492303 - DNA, 25 bp, Homo sapien
ctgtgcccctggtcgcagcaggcag

SEQ ID NO: 492304 - DNA, 25 bp, Homo sapien
ttgcttttactcctatgctacacta

SEQ ID NO: 492305 - DNA, 25 bp, Homo sapien
cctatgctacactagtttgccatgt

SEQ ID NO: 492306 - DNA, 25 bp, Homo sapien
gccatgtagcaattgcactgtgcaa

SEQ ID NO: 492307 - DNA, 25 bp, Homo sapien
gtaatgtctattacggtttgcgata

SEQ ID NO: 492308 - DNA, 25 bp, Homo sapien
acggtttgcgatagtatttctctct

SEQ ID NO: 492309 - DNA, 25 bp, Homo sapien
agtatttctctctagttctcagtga

SEQ ID NO: 492310 - DNA, 25 bp, Homo sapien
taaatgtgaccaagccttctgtact

SEQ ID NO: 492311 - DNA, 25 bp, Homo sapien
ttgtcacaaaaagcgggttttccag

SEQ ID NO: 492312 - DNA, 25 bp, Homo sapien
ccaggtgactattttggtgagtgtc

SEQ ID NO: 492313 - DNA, 25 bp, Homo sapien
gaatttatggtgtattactgtcgat

SEQ ID NO: 492314 - DNA, 25 bp, Homo sapien
gtattactgtcgattcactttgaat

SEQ ID NO: 492315 - DNA, 25 bp, Homo sapien
aagccatgctctttggtaggaaccc

SEQ ID NO: 492316 - DNA, 25 bp, Homo sapien
tgctctttggtaggaacccacgcta

SEQ ID NO: 492317 - DNA, 25 bp, Homo sapien
aggaacccacgctacgagaacgtgc

SEQ ID NO: 492318 - DNA, 25 bp, Homo sapien
tacgtactctcccagcatgagagcc

SEQ ID NO: 492319 - DNA, 25 bp, Homo sapien
tgtctgtggcggatgagcacctgag

SEQ ID NO: 492320 - DNA, 25 bp, Homo sapien
agcacctgaggcactacgggaatca

SEQ ID NO: 492321 - DNA, 25 bp, Homo sapien
acgggaatcagtttccagcctaaca

SEQ ID NO: 492322 - DNA, 25 bp, Homo sapien
gtttccagcctaacagactttcggg

SEQ ID NO: 492323 - DNA, 25 bp, Homo sapien
tcctgcctcctttttccgttctggt

SEQ ID NO: 492324 - DNA, 25 bp, Homo sapien
tccgttctggtttttaattagtgca

SEQ ID NO: 492325 - DNA, 25 bp, Homo sapien
tagtgcaaatacaagctgcgtttct

SEQ ID NO: 492326 - DNA, 25 bp, Homo sapien
aataatagtacttacctggtaggat

SEQ ID NO: 492327 - DNA, 25 bp, Homo sapien
gaatagtgcctgacatatattatgt

SEQ ID NO: 492328 - DNA, 25 bp, Homo sapien
catatattatgttctctgtagttac

SEQ ID NO: 492329 - DNA, 25 bp, Homo sapien
ctctgtagttactggctgtgattat

SEQ ID NO: 492330 - DNA, 25 bp, Homo sapien
attaataatattgccgcaccctaat

SEQ ID NO: 492331 - DNA, 25 bp, Homo sapien
tgccgcaccctaatatctgttattt

SEQ ID NO: 492332 - DNA, 25 bp, Homo sapien
gaaatctgcttgtgtgcttataaga

SEQ ID NO: 492333 - DNA, 25 bp, Homo sapien
gaatttactgagttctcacttccct

SEQ ID NO: 492334 - DNA, 25 bp, Homo sapien
tcacttcccttacagtcatacatgg

SEQ ID NO: 492335 - DNA, 25 bp, Homo sapien
tacagtcatacatggtttttccctt

SEQ ID NO: 492336 - DNA, 25 bp, Homo sapien
tcccttttgcctaaatcagaactca

SEQ ID NO: 492337 - DNA, 25 bp, Homo sapien
ataatgaaaggagcagcagccgcat

SEQ ID NO: 492338 - DNA, 25 bp, Homo sapien
gaaaggagcagcagccgcattaata

SEQ ID NO: 492339 - DNA, 25 bp, Homo sapien
agcagccgcattaatatcccagaga

SEQ ID NO: 492340 - DNA, 25 bp, Homo sapien
agccgcattaatatcccagagagag

SEQ ID NO: 492341 - DNA, 25 bp, Homo sapien
cattaatatcccagagagagcaagt

SEQ ID NO: 492342 - DNA, 25 bp, Homo sapien
aggcaacttaaaccagattgttact

SEQ ID NO: 492343 - DNA, 25 bp, Homo sapien
aaccagattgttactgaacccgatg

SEQ ID NO: 492344 - DNA, 25 bp, Homo sapien
gattgttactgaacccgatgcaaac

SEQ ID NO: 492345 - DNA, 25 bp, Homo sapien
gttactgaacccgatgcaaactttc

SEQ ID NO: 492346 - DNA, 25 bp, Homo sapien
tgaacccgatgcaaactttccccag

SEQ ID NO: 492347 - DNA, 25 bp, Homo sapien
ccgatgcaaactttccccagttctt

SEQ ID NO: 492348 - DNA, 25 bp, Homo sapien
aaccagtgcccgtaggcaggactat

SEQ ID NO: 492349 - DNA, 25 bp, Homo sapien
gcaggactatgttccatctgagcca

SEQ ID NO: 492350 - DNA, 25 bp, Homo sapien
tgagccatggctgtcatctccctag

SEQ ID NO: 492351 - DNA, 25 bp, Homo sapien
tagtcactcatccactaggttccct

SEQ ID NO: 492352 - DNA, 25 bp, Homo sapien
ggttccctagaagtgcaggctgcaa

SEQ ID NO: 492353 - DNA, 25 bp, Homo sapien
aaatcctccctaccatagcaaagta

SEQ ID NO: 492354 - DNA, 25 bp, Homo sapien
agcaaagtaggatctccccttggtg

SEQ ID NO: 492355 - DNA, 25 bp, Homo sapien
tccccttggtgaacgtcagctagag

SEQ ID NO: 492356 - DNA, 25 bp, Homo sapien
ggaccatgccacactggctgtaaag

SEQ ID NO: 492357 - DNA, 25 bp, Homo sapien
taaagggctttttcctggtctggat

SEQ ID NO: 492358 - DNA, 25 bp, Homo sapien
gaccaggaaaaagctactgcactct

SEQ ID NO: 492359 - DNA, 25 bp, Homo sapien
acccctgagggcctagtctttccat

SEQ ID NO: 492360 - DNA, 25 bp, Homo sapien
cctgagggcctagtctttccataga

SEQ ID NO: 492361 - DNA, 25 bp, Homo sapien
ctgagggcctagtctttccatagat

SEQ ID NO: 492362 - DNA, 25 bp, Homo sapien
tgagggcctagtctttccatagatg

SEQ ID NO: 492363 - DNA, 25 bp, Homo sapien
gagggcctagtctttccatagatga

SEQ ID NO: 492364 - DNA, 25 bp, Homo sapien
agggcctagtctttccatagatgac

SEQ ID NO: 492365 - DNA, 25 bp, Homo sapien
gggcctagtctttccatagatgaca

SEQ ID NO: 492366 - DNA, 25 bp, Homo sapien
ggcctagtctttccatagatgacaa

SEQ ID NO: 492367 - DNA, 25 bp, Homo sapien
gcctagtctttccatagatgacaag

SEQ ID NO: 492368 - DNA, 25 bp, Homo sapien
agtctttccatagatgacaagaaca

SEQ ID NO: 492369 - DNA, 25 bp, Homo sapien
taccactactgtcccgggagtaaca

SEQ ID NO: 492370 - DNA, 25 bp, Homo sapien
gagatctatggaaaactgggaatgt

SEQ ID NO: 492371 - DNA, 25 bp, Homo sapien
atgtggattctgtcagagctcctac

SEQ ID NO: 492372 - DNA, 25 bp, Homo sapien
cagagctcctacagagcacagttgc

SEQ ID NO: 492373 - DNA, 25 bp, Homo sapien
attgtataatacagttttgtcccta

SEQ ID NO: 492374 - DNA, 25 bp, Homo sapien
gttttgtccctacacaattgtattt

SEQ ID NO: 492375 - DNA, 25 bp, Homo sapien
aattgtatttgccaagcttagtgca

SEQ ID NO: 492376 - DNA, 25 bp, Homo sapien
gcttagtgcattatgatacctttat

SEQ ID NO: 492377 - DNA, 25 bp, Homo sapien
tattcttaggtcattcaaagccatg

SEQ ID NO: 492378 - DNA, 25 bp, Homo sapien
gtcattcaaagccatgtatgctgta

SEQ ID NO: 492379 - DNA, 25 bp, Homo sapien
gtatgctgtaaatgtgctagtcttt

SEQ ID NO: 492380 - DNA, 25 bp, Homo sapien
gtgctagtctttagaatgacacata

SEQ ID NO: 492381 - DNA, 25 bp, Homo sapien
gtctttgccacggaacagggcagta

SEQ ID NO: 492382 - DNA, 25 bp, Homo sapien
tgccacggaacagggcagtatgcca

SEQ ID NO: 492383 - DNA, 25 bp, Homo sapien
tatgccagggtgttgccacggcaat

SEQ ID NO: 492384 - DNA, 25 bp, Homo sapien
ccctgttttagctcatcttcaagtt

SEQ ID NO: 492385 - DNA, 25 bp, Homo sapien
catcttcaagttagtctggtgtcca

SEQ ID NO: 492386 - DNA, 25 bp, Homo sapien
tcaagttagtctggtgtccaagctc

SEQ ID NO: 492387 - DNA, 25 bp, Homo sapien
gcctcagtctggtgacctccttctg

SEQ ID NO: 492388 - DNA, 25 bp, Homo sapien
ctgtgtctgatgagcatggcagcgt

SEQ ID NO: 492389 - DNA, 25 bp, Homo sapien
atgagcatggcagcgttgggacctt

SEQ ID NO: 492390 - DNA, 25 bp, Homo sapien
agcatggcagcgttgggaccttccc

SEQ ID NO: 492391 - DNA, 25 bp, Homo sapien
ggaggggctatcacgccagcgacat

SEQ ID NO: 492392 - DNA, 25 bp, Homo sapien
acctcaaccgagtcctacaaggaga

SEQ ID NO: 492393 - DNA, 25 bp, Homo sapien
tcctacaaggagacactgcacaaga

SEQ ID NO: 492394 - DNA, 25 bp, Homo sapien
tgcacaagacaatggtgacccgctt

SEQ ID NO: 492395 - DNA, 25 bp, Homo sapien
aatggtgacccgcttcaacgaggcc

SEQ ID NO: 492396 - DNA, 25 bp, Homo sapien
aacgaggcccagtgagcagcttcaa

SEQ ID NO: 492397 - DNA, 25 bp, Homo sapien
agcttcaagagcaacttctccacat

SEQ ID NO: 492398 - DNA, 25 bp, Homo sapien
aacttctccacatgttgggtgtcca

SEQ ID NO: 492399 - DNA, 25 bp, Homo sapien
ccacatgttgggtgtccatcctggg

SEQ ID NO: 492400 - DNA, 25 bp, Homo sapien
attgaggtggtgacttttgttggaa

SEQ ID NO: 492401 - DNA, 25 bp, Homo sapien
gaaaattgggctgggatcacgtcct

SEQ ID NO: 492402 - DNA, 25 bp, Homo sapien
gctgggatcacgtcctgttttgtaa

SEQ ID NO: 492403 - DNA, 25 bp, Homo sapien
agcccttccttaactcgatgtctga

SEQ ID NO: 492404 - DNA, 25 bp, Homo sapien
tgtcctgctacaatgttagctgtga

SEQ ID NO: 492405 - DNA, 25 bp, Homo sapien
gtgagtttgtagtatatggccttta

SEQ ID NO: 492406 - DNA, 25 bp, Homo sapien
tgaggcatgttccttctgtgcttag

SEQ ID NO: 492407 - DNA, 25 bp, Homo sapien
ctgtgcttagttctttgagagtttt

SEQ ID NO: 492408 - DNA, 25 bp, Homo sapien
tttctgggtctattgagatcgtcat

SEQ ID NO: 492409 - DNA, 25 bp, Homo sapien
agatcgtcatgtgggttttgttctt

SEQ ID NO: 492410 - DNA, 25 bp, Homo sapien
gattctcttaatgcaaagtatcgta

SEQ ID NO: 492411 - DNA, 25 bp, Homo sapien
gtatcgtatttgttgatttgcatat

SEQ ID NO: 492412 - DNA, 25 bp, Homo sapien
gcatatgttgagttgtccttgcatc

SEQ ID NO: 492413 - DNA, 25 bp, Homo sapien
gttgtccttgcatctctggtataaa

SEQ ID NO: 492414 - DNA, 25 bp, Homo sapien
gaagacaactgtctgaagtatttgt

SEQ ID NO: 492415 - DNA, 25 bp, Homo sapien
tgaagtatttgtgagggacagcgat

SEQ ID NO: 492416 - DNA, 25 bp, Homo sapien
ggacagcgatgtggccctctgtgtt

SEQ ID NO: 492417 - DNA, 25 bp, Homo sapien
ggccctctgtgttaagaataacgtg

SEQ ID NO: 492418 - DNA, 25 bp, Homo sapien
gaataacgtgtcctgctttggcaga

SEQ ID NO: 492419 - DNA, 25 bp, Homo sapien
acgtgtcctgctttggcagagagaa

SEQ ID NO: 492420 - DNA, 25 bp, Homo sapien
actgcccgctttcaaggcaagatcg

SEQ ID NO: 492421 - DNA, 25 bp, Homo sapien
ggcaagatcgaccttttctgttttg

SEQ ID NO: 492422 - DNA, 25 bp, Homo sapien
ggacaaaaattactgagtggccctt

SEQ ID NO: 492423 - DNA, 25 bp, Homo sapien
aaattactgagtggcccttaaagag

SEQ ID NO: 492424 - DNA, 25 bp, Homo sapien
agctgttctcttttgcccgtaggtg

SEQ ID NO: 492425 - DNA, 25 bp, Homo sapien
ttccctctgacacatgcggctttac

SEQ ID NO: 492426 - DNA, 25 bp, Homo sapien
tgcggctttacccacctttgtctgt

SEQ ID NO: 492427 - DNA, 25 bp, Homo sapien
ttgtctgtccctgatgtctactgca

SEQ ID NO: 492428 - DNA, 25 bp, Homo sapien
tgcactccacacagagccatatagg

SEQ ID NO: 492429 - DNA, 25 bp, Homo sapien
tatagggtcagctgccattgccgga

SEQ ID NO: 492430 - DNA, 25 bp, Homo sapien
attgccggaggatgccgacctggaa

SEQ ID NO: 492431 - DNA, 25 bp, Homo sapien
aggatgccgacctggaatgactcat

SEQ ID NO: 492432 - DNA, 25 bp, Homo sapien
gggaagccccacagcaaaaaggaga

SEQ ID NO: 492433 - DNA, 25 bp, Homo sapien
ccagactgtgagttcccagcccggg

SEQ ID NO: 492434 - DNA, 25 bp, Homo sapien
atctaccggcttgacgctggaactg

SEQ ID NO: 492435 - DNA, 25 bp, Homo sapien
cttgacgctggaactgggaagcaca

SEQ ID NO: 492436 - DNA, 25 bp, Homo sapien
caggtgcctccacgcatctcagtgg

SEQ ID NO: 492437 - DNA, 25 bp, Homo sapien
acgcatctcagtggccggtctgtgc

SEQ ID NO: 492438 - DNA, 25 bp, Homo sapien
ctcagtggccggtctgtgctgcctg

SEQ ID NO: 492439 - DNA, 25 bp, Homo sapien
gtgctgcctgcccagtcaggaagtt

SEQ ID NO: 492440 - DNA, 25 bp, Homo sapien
gcccagtcaggaagttttggtctgt

SEQ ID NO: 492441 - DNA, 25 bp, Homo sapien
gtcacagtccgagacttgtgggagt

SEQ ID NO: 492442 - DNA, 25 bp, Homo sapien
gggagtgtgggtctccatggcagga

SEQ ID NO: 492443 - DNA, 25 bp, Homo sapien
caatgctgggcacggttgggtgtta

SEQ ID NO: 492444 - DNA, 25 bp, Homo sapien
cacggttgggtgttagctaggcctg

SEQ ID NO: 492445 - DNA, 25 bp, Homo sapien
gggtgaacagtgaacttttgtccta

SEQ ID NO: 492446 - DNA, 25 bp, Homo sapien
gaacttttgtcctacacaaaggaga

SEQ ID NO: 492447 - DNA, 25 bp, Homo sapien
aggtcagtttgtggattgtaatccc

SEQ ID NO: 492448 - DNA, 25 bp, Homo sapien
gtggattgtaatcccatttacagat

SEQ ID NO: 492449 - DNA, 25 bp, Homo sapien
taagagcaacactccaagcttggcc

SEQ ID NO: 492450 - DNA, 25 bp, Homo sapien
atgatcacctccgttgtttcaggta

SEQ ID NO: 492451 - DNA, 25 bp, Homo sapien
gtttcaggtactctgtgtttattta

SEQ ID NO: 492452 - DNA, 25 bp, Homo sapien
gacgaggccagaagaatccttgagc

SEQ ID NO: 492453 - DNA, 25 bp, Homo sapien
gaatccttgagcagacagagccagt

SEQ ID NO: 492454 - DNA, 25 bp, Homo sapien
agacagagccagttgggcctcctaa

SEQ ID NO: 492455 - DNA, 25 bp, Homo sapien
cagttgggcctcctaagtgacctta

SEQ ID NO: 492456 - DNA, 25 bp, Homo sapien
taagtgaccttaaccttgcttgatt

SEQ ID NO: 492457 - DNA, 25 bp, Homo sapien
ttgcaagcatgtctgaaactttatt

SEQ ID NO: 492458 - DNA, 25 bp, Homo sapien
tcataccctcccagcatatacaaaa

SEQ ID NO: 492459 - DNA, 25 bp, Homo sapien
ataccctcccagcatatacaaaagg

SEQ ID NO: 492460 - DNA, 25 bp, Homo sapien
ggaggttttagacaggctccctgaa

SEQ ID NO: 492461 - DNA, 25 bp, Homo sapien
ggctccctgaatgttaaccacagag

SEQ ID NO: 492462 - DNA, 25 bp, Homo sapien
ccctgaatgttaaccacagaggagt

SEQ ID NO: 492463 - DNA, 25 bp, Homo sapien
acagaggagtcactccttcattcct

SEQ ID NO: 492464 - DNA, 25 bp, Homo sapien
acagcctgagtgacgaatttcctac

SEQ ID NO: 492465 - DNA, 25 bp, Homo sapien
gcctgagtgacgaatttcctactga

SEQ ID NO: 492466 - DNA, 25 bp, Homo sapien
ctgagtgacgaatttcctactgaat

SEQ ID NO: 492467 - DNA, 25 bp, Homo sapien
atttcctactgaatgtaccaagttc

SEQ ID NO: 492468 - DNA, 25 bp, Homo sapien
tcctactgaatgtaccaagttccaa

SEQ ID NO: 492469 - DNA, 25 bp, Homo sapien
caatcttcagtgagcggatacggat

SEQ ID NO: 492470 - DNA, 25 bp, Homo sapien
ggatacggatgtgacgccggcctcc

SEQ ID NO: 492471 - DNA, 25 bp, Homo sapien
ggttttagtcgcaagatctgcaggt

SEQ ID NO: 492472 - DNA, 25 bp, Homo sapien
aagatctgcaggtagactgtggctg

SEQ ID NO: 492473 - DNA, 25 bp, Homo sapien
gtacaggccgtaggtacacccacag

SEQ ID NO: 492474 - DNA, 25 bp, Homo sapien
gtacctttgtgaacatcaccttggg

SEQ ID NO: 492475 - DNA, 25 bp, Homo sapien
agagagggctgccatctgtctgtac

SEQ ID NO: 492476 - DNA, 25 bp, Homo sapien
atctgtctgtactgctgggtccgtc

SEQ ID NO: 492477 - DNA, 25 bp, Homo sapien
tgggtccgtctcctgggccatgcta

SEQ ID NO: 492478 - DNA, 25 bp, Homo sapien
gggccatgctaatgacggtctcggt

SEQ ID NO: 492479 - DNA, 25 bp, Homo sapien
gtggtggcgtggtactcgtcctcct

SEQ ID NO: 492480 - DNA, 25 bp, Homo sapien
gccatcgggcctctttttaagagtc

SEQ ID NO: 492481 - DNA, 25 bp, Homo sapien
gggcctctttttaagagtctaatga

SEQ ID NO: 492482 - DNA, 25 bp, Homo sapien
aatgatgtgtatatctaatgcccat

SEQ ID NO: 492483 - DNA, 25 bp, Homo sapien
tgtatatctaatgcccattccagct

SEQ ID NO: 492484 - DNA, 25 bp, Homo sapien
cattccagctggattgtaacactgc

SEQ ID NO: 492485 - DNA, 25 bp, Homo sapien
cagctggattgtaacactgcttggg

SEQ ID NO: 492486 - DNA, 25 bp, Homo sapien
agtagtaccgagattacagcagcta

SEQ ID NO: 492487 - DNA, 25 bp, Homo sapien
gtaccgagattacagcagctagtgt

SEQ ID NO: 492488 - DNA, 25 bp, Homo sapien
gagattacagcagctagtgtcctaa

SEQ ID NO: 492489 - DNA, 25 bp, Homo sapien
acagcagctagtgtcctaaatggaa

SEQ ID NO: 492490 - DNA, 25 bp, Homo sapien
gaagtgaaactaaatgtcataggag

SEQ ID NO: 492491 - DNA, 25 bp, Homo sapien
atcttggcttattgcagtctcgacc

SEQ ID NO: 492492 - DNA, 25 bp, Homo sapien
gaggtcttttaagctgtccttatcc

SEQ ID NO: 492493 - DNA, 25 bp, Homo sapien
ggtcttttaagctgtccttatccca

SEQ ID NO: 492494 - DNA, 25 bp, Homo sapien
gtcttttaagctgtccttatcccag

SEQ ID NO: 492495 - DNA, 25 bp, Homo sapien
ttccgcctcggccacctgtagtccc

SEQ ID NO: 492496 - DNA, 25 bp, Homo sapien
tccgcctcggccacctgtagtccca

SEQ ID NO: 492497 - DNA, 25 bp, Homo sapien
tcttttaagctgtccttatcccagc

SEQ ID NO: 492498 - DNA, 25 bp, Homo sapien
cttttaagctgtccttatcccagcc

SEQ ID NO: 492499 - DNA, 25 bp, Homo sapien
ttttaagctgtccttatcccagcct

SEQ ID NO: 492500 - DNA, 25 bp, Homo sapien
ttatcccagcctatttcttgttttt

SEQ ID NO: 492501 - DNA, 25 bp, Homo sapien
atcccagcctatttcttgttttttg

SEQ ID NO: 492502 - DNA, 25 bp, Homo sapien
gcaaattttacgcagaaaaatgctg

SEQ ID NO: 492503 - DNA, 25 bp, Homo sapien
aaatgctgtaatttcttgggaagat

SEQ ID NO: 492504 - DNA, 25 bp, Homo sapien
gggaagattttaatgtacacctatt

SEQ ID NO: 492505 - DNA, 25 bp, Homo sapien
gtacacctatttgtaaagtcatcag

SEQ ID NO: 492506 - DNA, 25 bp, Homo sapien
aagtcatcagaatagtgtggattat

SEQ ID NO: 492507 - DNA, 25 bp, Homo sapien
acagaaggtcttcaataagtaaagt

SEQ ID NO: 492508 - DNA, 25 bp, Homo sapien
caataagtaaagtaactccatatgg

SEQ ID NO: 492509 - DNA, 25 bp, Homo sapien
ctccatatggagtgattgtttcagt

SEQ ID NO: 492510 - DNA, 25 bp, Homo sapien
ggagtgattgtttcagtccaggcaa

SEQ ID NO: 492511 - DNA, 25 bp, Homo sapien
gattgtttcagtccaggcaattttt

SEQ ID NO: 492512 - DNA, 25 bp, Homo sapien
cagtccaggcaatttttctatttta

SEQ ID NO: 492513 - DNA, 25 bp, Homo sapien
atactctagtacagccacaatatat

SEQ ID NO: 492514 - DNA, 25 bp, Homo sapien
tacagccacaatatatagggataca

SEQ ID NO: 492515 - DNA, 25 bp, Homo sapien
gatacatggtagtccactttgtacc

SEQ ID NO: 492516 - DNA, 25 bp, Homo sapien
gtagtccactttgtaccctaatact

SEQ ID NO: 492517 - DNA, 25 bp, Homo sapien
tgtaccctaatacttccttcaacga

SEQ ID NO: 492518 - DNA, 25 bp, Homo sapien
aatacttccttcaacgaaggatgga

SEQ ID NO: 492519 - DNA, 25 bp, Homo sapien
cttcgttttcgtttttctatagcag

SEQ ID NO: 492520 - DNA, 25 bp, Homo sapien
agattgtgcatcagcaatggcccat

SEQ ID NO: 492521 - DNA, 25 bp, Homo sapien
tgtgcatcagcaatggcccatttat

SEQ ID NO: 492522 - DNA, 25 bp, Homo sapien
gcaatggcccatttatcaattgggt

SEQ ID NO: 492523 - DNA, 25 bp, Homo sapien
ggcccatttatcaattgggtgagga

SEQ ID NO: 492524 - DNA, 25 bp, Homo sapien
tgcggacaacttttcatcccctgtt

SEQ ID NO: 492525 - DNA, 25 bp, Homo sapien
ccctttgaagggtgggctaggccat

SEQ ID NO: 492526 - DNA, 25 bp, Homo sapien
aagggtgggctaggccattttgcca

SEQ ID NO: 492527 - DNA, 25 bp, Homo sapien
ggctaggccattttgccaagttcta

SEQ ID NO: 492528 - DNA, 25 bp, Homo sapien
ggccattttgccaagttctagctct

SEQ ID NO: 492529 - DNA, 25 bp, Homo sapien
ttttgccaagttctagctctcacaa

SEQ ID NO: 492530 - DNA, 25 bp, Homo sapien
aagttctagctctcacaagtccctc

SEQ ID NO: 492531 - DNA, 25 bp, Homo sapien
tccctccccagcctatgggaaggtg

SEQ ID NO: 492532 - DNA, 25 bp, Homo sapien
atgggaaggtggaaatttcaggcaa

SEQ ID NO: 492533 - DNA, 25 bp, Homo sapien
gacattcagttgagggcattcagtt

SEQ ID NO: 492534 - DNA, 25 bp, Homo sapien
gagggcattcagttgtctttttcca

SEQ ID NO: 492535 - DNA, 25 bp, Homo sapien
ataagcacccctaagtatgacgact

SEQ ID NO: 492536 - DNA, 25 bp, Homo sapien
aagtatgacgactatacacacacac

SEQ ID NO: 492537 - DNA, 25 bp, Homo sapien
gcccttgtgtttgcagtatagattt

SEQ ID NO: 492538 - DNA, 25 bp, Homo sapien
tgaatgaactgttaactgttagatt

SEQ ID NO: 492539 - DNA, 25 bp, Homo sapien
ctgttagattaagaattggtaccat

SEQ ID NO: 492540 - DNA, 25 bp, Homo sapien
ttacaaataatgcaacccctctttc

SEQ ID NO: 492541 - DNA, 25 bp, Homo sapien
ataatgcaacccctctttcaaataa

SEQ ID NO: 492542 - DNA, 25 bp, Homo sapien
gcaacccctctttcaaataataata

SEQ ID NO: 492543 - DNA, 25 bp, Homo sapien
aataataatatactgcttcttgggc

SEQ ID NO: 492544 - DNA, 25 bp, Homo sapien
gcttcttgggcagtgtaccttatag

SEQ ID NO: 492545 - DNA, 25 bp, Homo sapien
gggcagtgtaccttatagtaacaaa

SEQ ID NO: 492546 - DNA, 25 bp, Homo sapien
agtctacacaggctctggccttttc

SEQ ID NO: 492547 - DNA, 25 bp, Homo sapien
actctatccttctccgtttctgttc

SEQ ID NO: 492548 - DNA, 25 bp, Homo sapien
tggtcagttaaatcacagtctctgg

SEQ ID NO: 492549 - DNA, 25 bp, Homo sapien
tttccttactcttccttaaacatgg

SEQ ID NO: 492550 - DNA, 25 bp, Homo sapien
taaacatggcaagcatccacataag

SEQ ID NO: 492551 - DNA, 25 bp, Homo sapien
gatgattcttgccatcatactgatg

SEQ ID NO: 492552 - DNA, 25 bp, Homo sapien
gaaaatggagtccaagcttcaggtt

SEQ ID NO: 492553 - DNA, 25 bp, Homo sapien
ccaagcttcaggttgtttgattttg

SEQ ID NO: 492554 - DNA, 25 bp, Homo sapien
attttgaaaaggctcccctggtgat

SEQ ID NO: 492555 - DNA, 25 bp, Homo sapien
aaaaggctcccctggtgattctgat

SEQ ID NO: 492556 - DNA, 25 bp, Homo sapien
tgatgcgaagtctacacaggctctg

SEQ ID NO: 492557 - DNA, 25 bp, Homo sapien
tgtacttatttgcatttgctggcag

SEQ ID NO: 492558 - DNA, 25 bp, Homo sapien
ttgctggcagttcaggcatagttaa

SEQ ID NO: 492559 - DNA, 25 bp, Homo sapien
gcatagttaaagtgagagttctcct

SEQ ID NO: 492560 - DNA, 25 bp, Homo sapien
gagagttctcctatatttcataata

SEQ ID NO: 492561 - DNA, 25 bp, Homo sapien
cataataagtgggtctgccaaaacc

SEQ ID NO: 492562 - DNA, 25 bp, Homo sapien
ggtctgccaaaacccatgtattaaa

SEQ ID NO: 492563 - DNA, 25 bp, Homo sapien
aaattgtccaagtgaaactcgacta

SEQ ID NO: 492564 - DNA, 25 bp, Homo sapien
aactcgactaactttggcctttgtg

SEQ ID NO: 492565 - DNA, 25 bp, Homo sapien
ggcctttgtgtatttcctgaaggta

SEQ ID NO: 492566 - DNA, 25 bp, Homo sapien
atacttctgacactacatttaaatg

SEQ ID NO: 492567 - DNA, 25 bp, Homo sapien
ggtatcaagctgtaactaagacaat

SEQ ID NO: 492568 - DNA, 25 bp, Homo sapien
aggtgagttctgtatgtgccttgca

SEQ ID NO: 492569 - DNA, 25 bp, Homo sapien
gagttctgtatgtgccttgcagtac

SEQ ID NO: 492570 - DNA, 25 bp, Homo sapien
gtatgtgccttgcagtactgtaatt

SEQ ID NO: 492571 - DNA, 25 bp, Homo sapien
aaaataggaatctttggctgcaaaa

SEQ ID NO: 492572 - DNA, 25 bp, Homo sapien
ggaatctttggctgcaaaattttaa

SEQ ID NO: 492573 - DNA, 25 bp, Homo sapien
ggaagtaattttcgtgctaacatta

SEQ ID NO: 492574 - DNA, 25 bp, Homo sapien
aaatctgatggttctaaatcaatca

SEQ ID NO: 492575 - DNA, 25 bp, Homo sapien
gaattcagaggaaattaacccagct

SEQ ID NO: 492576 - DNA, 25 bp, Homo sapien
cagctaagtaaaaaatctgtcttga

SEQ ID NO: 492577 - DNA, 25 bp, Homo sapien
gtcttgattttgttacttattcctc

SEQ ID NO: 492578 - DNA, 25 bp, Homo sapien
gattttgttacttattcctcagaat

SEQ ID NO: 492579 - DNA, 25 bp, Homo sapien
tgtcagccttacacatcccgggact

SEQ ID NO: 492580 - DNA, 25 bp, Homo sapien
gggactcacacggtgctttggagaa

SEQ ID NO: 492581 - DNA, 25 bp, Homo sapien
ggttgttcacaacaggtatccagca

SEQ ID NO: 492582 - DNA, 25 bp, Homo sapien
gtatccagcaatgaggacctgccca

SEQ ID NO: 492583 - DNA, 25 bp, Homo sapien
tgaggacctgcccatttcaatggaa

SEQ ID NO: 492584 - DNA, 25 bp, Homo sapien
aagaatgtacagcttttgtcccagt

SEQ ID NO: 492585 - DNA, 25 bp, Homo sapien
ttgtcccagtttgtttctccattta

SEQ ID NO: 492586 - DNA, 25 bp, Homo sapien
tgtttctccatttactggatgcatt

SEQ ID NO: 492587 - DNA, 25 bp, Homo sapien
ctagggaggaagaagttgacacact

SEQ ID NO: 492588 - DNA, 25 bp, Homo sapien
ttgacacacttggtaacggctgctg

SEQ ID NO: 492589 - DNA, 25 bp, Homo sapien
ttggtaacggctgctgtcagcctta

SEQ ID NO: 492590 - DNA, 25 bp, Homo sapien
ttgtctcttccccaattcttagagt

SEQ ID NO: 492591 - DNA, 25 bp, Homo sapien
tgcattcatctcctcagtcataagt

SEQ ID NO: 492592 - DNA, 25 bp, Homo sapien
agtcataagtgtctgtcaacctccg

SEQ ID NO: 492593 - DNA, 25 bp, Homo sapien
tccgttgtgaagtcatgagtctctt

SEQ ID NO: 492594 - DNA, 25 bp, Homo sapien
aactccaagaatgtattgtgctcac

SEQ ID NO: 492595 - DNA, 25 bp, Homo sapien
tgtgctcacagtggcgatggtgttc

SEQ ID NO: 492596 - DNA, 25 bp, Homo sapien
atggtgttcctgtgctggatggtca

SEQ ID NO: 492597 - DNA, 25 bp, Homo sapien
gatctggttctaaattgtcttttgg

SEQ ID NO: 492598 - DNA, 25 bp, Homo sapien
ggtgaagtgccatagaccatttcgg

SEQ ID NO: 492599 - DNA, 25 bp, Homo sapien
agaccatttcggaccatttctatga

SEQ ID NO: 492600 - DNA, 25 bp, Homo sapien
atttctatgatgtaccagcagcccc

SEQ ID NO: 492601 - DNA, 25 bp, Homo sapien
atcaatcaagactgctcgtgctttt

SEQ ID NO: 492602 - DNA, 25 bp, Homo sapien
caatcaagactgctcgtgcttttaa

SEQ ID NO: 492603 - DNA, 25 bp, Homo sapien
aatcaagactgctcgtgcttttaaa

SEQ ID NO: 492604 - DNA, 25 bp, Homo sapien
tcaagactgctcgtgcttttaaaga

SEQ ID NO: 492605 - DNA, 25 bp, Homo sapien
aagactgctcgtgcttttaaagaac

SEQ ID NO: 492606 - DNA, 25 bp, Homo sapien
agactgctcgtgcttttaaagaaca

SEQ ID NO: 492607 - DNA, 25 bp, Homo sapien
tttcccttggaaatacttccaccat

SEQ ID NO: 492608 - DNA, 25 bp, Homo sapien
tcccttggaaatacttccaccatca

SEQ ID NO: 492609 - DNA, 25 bp, Homo sapien
cttggaaatacttccaccatcacca

SEQ ID NO: 492610 - DNA, 25 bp, Homo sapien
tggaaatacttccaccatcaccaac

SEQ ID NO: 492611 - DNA, 25 bp, Homo sapien
accaaccactctggtgtccacattt

SEQ ID NO: 492612 - DNA, 25 bp, Homo sapien
ccaacctgggcaagaagagcaaaac

SEQ ID NO: 492613 - DNA, 25 bp, Homo sapien
gaaaaaagaaataacaggccaggtg

SEQ ID NO: 492614 - DNA, 25 bp, Homo sapien
aaaaagaaataacaggccaggtgtg

SEQ ID NO: 492615 - DNA, 25 bp, Homo sapien
aaaagaaataacaggccaggtgtgg

SEQ ID NO: 492616 - DNA, 25 bp, Homo sapien
aaagaaataacaggccaggtgtggt

SEQ ID NO: 492617 - DNA, 25 bp, Homo sapien
aagaaataacaggccaggtgtggtg

SEQ ID NO: 492618 - DNA, 25 bp, Homo sapien
aaggcaagcagatcatttatggtca

SEQ ID NO: 492619 - DNA, 25 bp, Homo sapien
aggcaagcagatcatttatggtcag

SEQ ID NO: 492620 - DNA, 25 bp, Homo sapien
ggcaagcagatcatttatggtcagg

SEQ ID NO: 492621 - DNA, 25 bp, Homo sapien
aagcagatcatttatggtcaggagt

SEQ ID NO: 492622 - DNA, 25 bp, Homo sapien
agcagatcatttatggtcaggagtt

SEQ ID NO: 492623 - DNA, 25 bp, Homo sapien
gtatctctgctgacatagccagagg

SEQ ID NO: 492624 - DNA, 25 bp, Homo sapien
attcagtatacaaacatctccatga

SEQ ID NO: 492625 - DNA, 25 bp, Homo sapien
catctccatgacaatgtttttgcag

SEQ ID NO: 492626 - DNA, 25 bp, Homo sapien
gaatgcagtcagatctgtgttcagc

SEQ ID NO: 492627 - DNA, 25 bp, Homo sapien
agatctgtgttcagctgagtctgct

SEQ ID NO: 492628 - DNA, 25 bp, Homo sapien
gtctgctgggatctactcaataata

SEQ ID NO: 492629 - DNA, 25 bp, Homo sapien
atttcaggcagaactgccgggtatt

SEQ ID NO: 492630 - DNA, 25 bp, Homo sapien
aggccagagaaaacatcgccatttt

SEQ ID NO: 492631 - DNA, 25 bp, Homo sapien
aacatcgccattttttcgtcagata

SEQ ID NO: 492632 - DNA, 25 bp, Homo sapien
cgtcagatacatccaggttcatatt

SEQ ID NO: 492633 - DNA, 25 bp, Homo sapien
agacttttgaagatcgcccctccat

SEQ ID NO: 492634 - DNA, 25 bp, Homo sapien
taaattgatggatggctgcagtggc

SEQ ID NO: 492635 - DNA, 25 bp, Homo sapien
gtggccttgtggaaaagacgctgtc

SEQ ID NO: 492636 - DNA, 25 bp, Homo sapien
aagacgctgtcttgtggatccggag

SEQ ID NO: 492637 - DNA, 25 bp, Homo sapien
cttgtggatccggagacctggattt

SEQ ID NO: 492638 - DNA, 25 bp, Homo sapien
tggatttgaatcctaattcccgccc

SEQ ID NO: 492639 - DNA, 25 bp, Homo sapien
gtttgagctcgtggctttctttcta

SEQ ID NO: 492640 - DNA, 25 bp, Homo sapien
ctttctttctatggccttgttcttc

SEQ ID NO: 492641 - DNA, 25 bp, Homo sapien
aggcaagattcttttcacttctggg

SEQ ID NO: 492642 - DNA, 25 bp, Homo sapien
gaggaacaaagtgctacttggctaa

SEQ ID NO: 492643 - DNA, 25 bp, Homo sapien
gtatatggcatgattgtgaccacat

SEQ ID NO: 492644 - DNA, 25 bp, Homo sapien
tgaccacataggtaacaggttcatg

SEQ ID NO: 492645 - DNA, 25 bp, Homo sapien
atcccagatctggttgagtataaac

SEQ ID NO: 492646 - DNA, 25 bp, Homo sapien
ggctggcctgagctgtttatttcaa

SEQ ID NO: 492647 - DNA, 25 bp, Homo sapien
ggcctgagctgtttatttcaaaaga

SEQ ID NO: 492648 - DNA, 25 bp, Homo sapien
aagctatttttcctcagagtttttg

SEQ ID NO: 492649 - DNA, 25 bp, Homo sapien
ttcctcagagtttttgttttctata

SEQ ID NO: 492650 - DNA, 25 bp, Homo sapien
tactcattaagactaacatctcccc

SEQ ID NO: 492651 - DNA, 25 bp, Homo sapien
cactccatccccactgaaatttgtg

SEQ ID NO: 492652 - DNA, 25 bp, Homo sapien
gaaaatttagtacttggctctgagg

SEQ ID NO: 492653 - DNA, 25 bp, Homo sapien
gtacttggctctgaggttgccagtt

SEQ ID NO: 492654 - DNA, 25 bp, Homo sapien
ggctctgaggttgccagttatacaa

SEQ ID NO: 492655 - DNA, 25 bp, Homo sapien
ggttgccagttatacaataatctat

SEQ ID NO: 492656 - DNA, 25 bp, Homo sapien
atgtctggtcagagggttgcacttt

SEQ ID NO: 492657 - DNA, 25 bp, Homo sapien
ttgcactttgccactgctacatgtt

SEQ ID NO: 492658 - DNA, 25 bp, Homo sapien
gctacatgttcccagaggttggcac

SEQ ID NO: 492659 - DNA, 25 bp, Homo sapien
ggttggcacagcatgacctggacct

SEQ ID NO: 492660 - DNA, 25 bp, Homo sapien
caggcaaactctgctcatcttcgag

SEQ ID NO: 492661 - DNA, 25 bp, Homo sapien
atcttcgagctctctggaacccatt

SEQ ID NO: 492662 - DNA, 25 bp, Homo sapien
ctctctggaacccatttctcaaggg

SEQ ID NO: 492663 - DNA, 25 bp, Homo sapien
aagcagcctggctaaagcaatgact

SEQ ID NO: 492664 - DNA, 25 bp, Homo sapien
tgcagtctgagcttccactcaagtc

SEQ ID NO: 492665 - DNA, 25 bp, Homo sapien
gggcctgcctcacatatatatacaa

SEQ ID NO: 492666 - DNA, 25 bp, Homo sapien
agacccaatgtcagagtctgcctct

SEQ ID NO: 492667 - DNA, 25 bp, Homo sapien
gttttctggaccctcttacccagct

SEQ ID NO: 492668 - DNA, 25 bp, Homo sapien
ctcccagatggccatgcatttgaaa

SEQ ID NO: 492669 - DNA, 25 bp, Homo sapien
gcatttgaaaatcgccaattaggca

SEQ ID NO: 492670 - DNA, 25 bp, Homo sapien
aatcgccaattaggcactttgcagt

SEQ ID NO: 492671 - DNA, 25 bp, Homo sapien
aattaggcactttgcagtcacctgg

SEQ ID NO: 492672 - DNA, 25 bp, Homo sapien
agtcacctggagtttttctattgag

SEQ ID NO: 492673 - DNA, 25 bp, Homo sapien
ttgagacatgtttcaatctcattaa

SEQ ID NO: 492674 - DNA, 25 bp, Homo sapien
cttcctccactctcatcagaaaaga

SEQ ID NO: 492675 - DNA, 25 bp, Homo sapien
aaaaaactcatccagaagctttctt

SEQ ID NO: 492676 - DNA, 25 bp, Homo sapien
actcatccagaagctttctttctga

SEQ ID NO: 492677 - DNA, 25 bp, Homo sapien
tttgcaagcaggtgggttttcggtt

SEQ ID NO: 492678 - DNA, 25 bp, Homo sapien
gaacatctggtagattgatctgcca

SEQ ID NO: 492679 - DNA, 25 bp, Homo sapien
tgccaggctgggtggttctactgct

SEQ ID NO: 492680 - DNA, 25 bp, Homo sapien
gtggttctactgctttctcaatttc

SEQ ID NO: 492681 - DNA, 25 bp, Homo sapien
gagttctgctgaattatttgacaat

SEQ ID NO: 492682 - DNA, 25 bp, Homo sapien
tttgtaagtaccatgtttccttgtg

SEQ ID NO: 492683 - DNA, 25 bp, Homo sapien
tttccttgtggtgtatgctctgttc

SEQ ID NO: 492684 - DNA, 25 bp, Homo sapien
ctctgttctggtttctgttttcaaa

SEQ ID NO: 492685 - DNA, 25 bp, Homo sapien
ttcaaatcaaatgcctgtttgggag

SEQ ID NO: 492686 - DNA, 25 bp, Homo sapien
gtctattagatttgcactgctggat

SEQ ID NO: 492687 - DNA, 25 bp, Homo sapien
agtgtaaccttgaatagctgtctta

SEQ ID NO: 492688 - DNA, 25 bp, Homo sapien
aatagctgtcttattgtttatcctg

SEQ ID NO: 492689 - DNA, 25 bp, Homo sapien
gagaagcccttctcgtgccgggagt

SEQ ID NO: 492690 - DNA, 25 bp, Homo sapien
gtgcagcaaggccttttccgacccg

SEQ ID NO: 492691 - DNA, 25 bp, Homo sapien
cggccgcgtgcaaggcccatgagaa

SEQ ID NO: 492692 - DNA, 25 bp, Homo sapien
cgtgcaaggcccatgagaagacgca

SEQ ID NO: 492693 - DNA, 25 bp, Homo sapien
tgagaagacgcacagccctctgaag

SEQ ID NO: 492694 - DNA, 25 bp, Homo sapien
agtgcgggaagagctaccgcctcat

SEQ ID NO: 492695 - DNA, 25 bp, Homo sapien
cctgctgaacctgcacaagaagcgg

SEQ ID NO: 492696 - DNA, 25 bp, Homo sapien
aacctgcacaagaagcggcactcgg

SEQ ID NO: 492697 - DNA, 25 bp, Homo sapien
aagaagcggcactcgggcgaggcgc

SEQ ID NO: 492698 - DNA, 25 bp, Homo sapien
gcgaggcgcgctaccgctgcgagga

SEQ ID NO: 492699 - DNA, 25 bp, Homo sapien
cgctgcgaggactgcggcaagctct

SEQ ID NO: 492700 - DNA, 25 bp, Homo sapien
gagagtatgtaagcttttggcattt

SEQ ID NO: 492701 - DNA, 25 bp, Homo sapien
cactcagcaaattactcctaaggtt

SEQ ID NO: 492702 - DNA, 25 bp, Homo sapien
aaattactcctaaggtttatatgag

SEQ ID NO: 492703 - DNA, 25 bp, Homo sapien
accaccatgtatctaaccagatgaa

SEQ ID NO: 492704 - DNA, 25 bp, Homo sapien
gtatctaaccagatgaaagttgttt

SEQ ID NO: 492705 - DNA, 25 bp, Homo sapien
tttgatgtagtagtttatccattca

SEQ ID NO: 492706 - DNA, 25 bp, Homo sapien
atccattcacctatgagatatattt

SEQ ID NO: 492707 - DNA, 25 bp, Homo sapien
gagatatatttgcactgttttcctg

SEQ ID NO: 492708 - DNA, 25 bp, Homo sapien
gatatatttgcactgttttcctggt

SEQ ID NO: 492709 - DNA, 25 bp, Homo sapien
tatatttgcactgttttcctggttt

SEQ ID NO: 492710 - DNA, 25 bp, Homo sapien
ttcctggttttaagtgctataaata

SEQ ID NO: 492711 - DNA, 25 bp, Homo sapien
caagtgattctggtgtctcagccac

SEQ ID NO: 492712 - DNA, 25 bp, Homo sapien
cctggcctggtgtttctttaggtat

SEQ ID NO: 492713 - DNA, 25 bp, Homo sapien
ggcctggtgtttctttaggtataat

SEQ ID NO: 492714 - DNA, 25 bp, Homo sapien
ggtgtttctttaggtataatgtctt

SEQ ID NO: 492715 - DNA, 25 bp, Homo sapien
gtataatgtctttaccagagagcta

SEQ ID NO: 492716 - DNA, 25 bp, Homo sapien
atgtctttaccagagagctaatgca

SEQ ID NO: 492717 - DNA, 25 bp, Homo sapien
ctttaccagagagctaatgcagact

SEQ ID NO: 492718 - DNA, 25 bp, Homo sapien
gactgtcatgggtgagattgttctc

SEQ ID NO: 492719 - DNA, 25 bp, Homo sapien
gtcatgggtgagattgttctctgat

SEQ ID NO: 492720 - DNA, 25 bp, Homo sapien
gtgagattgttctctgatgttcaat

SEQ ID NO: 492721 - DNA, 25 bp, Homo sapien
ttgttctctgatgttcaattcccct

SEQ ID NO: 492722 - DNA, 25 bp, Homo sapien
tggaggtcctcaaagcattattgga

SEQ ID NO: 492723 - DNA, 25 bp, Homo sapien
ggtcctcaaagcattattggagttc

SEQ ID NO: 492724 - DNA, 25 bp, Homo sapien
attggagttcataatactgaagcta

SEQ ID NO: 492725 - DNA, 25 bp, Homo sapien
atactgaagctagaaccaagcagaa

SEQ ID NO: 492726 - DNA, 25 bp, Homo sapien
ttttttctgaggagtatcggtagca

SEQ ID NO: 492727 - DNA, 25 bp, Homo sapien
ttctgaggagtatcggtagcataaa

SEQ ID NO: 492728 - DNA, 25 bp, Homo sapien
gtatcggtagcataaatgtgattat

SEQ ID NO: 492729 - DNA, 25 bp, Homo sapien
tagtacacttgatatatggaggcag

SEQ ID NO: 492730 - DNA, 25 bp, Homo sapien
atctgcaaatggattcaacatgttt

SEQ ID NO: 492731 - DNA, 25 bp, Homo sapien
ggattcaacatgtttatgggttatt

SEQ ID NO: 492732 - DNA, 25 bp, Homo sapien
aggttctttatagtacacgtgttga

SEQ ID NO: 492733 - DNA, 25 bp, Homo sapien
gactagtagatttcatatgaccatt

SEQ ID NO: 492734 - DNA, 25 bp, Homo sapien
ttcatatgaccattgttatttccac

SEQ ID NO: 492735 - DNA, 25 bp, Homo sapien
tacttgtattttatgctacatgtaa

SEQ ID NO: 492736 - DNA, 25 bp, Homo sapien
gctacatgtaatgaagttggacctt

SEQ ID NO: 492737 - DNA, 25 bp, Homo sapien
tagtaattcctatatgttcctatac

SEQ ID NO: 492738 - DNA, 25 bp, Homo sapien
ctatatgttcctatacttttcattt

SEQ ID NO: 492739 - DNA, 25 bp, Homo sapien
tctagcaatatatctccatgagata

SEQ ID NO: 492740 - DNA, 25 bp, Homo sapien
atttatctttcaattcctgtgtgtg

SEQ ID NO: 492741 - DNA, 25 bp, Homo sapien
cctgtgtgtgtatcctatggttatc

SEQ ID NO: 492742 - DNA, 25 bp, Homo sapien
gtatcctatggttatctgtatgtat

SEQ ID NO: 492743 - DNA, 25 bp, Homo sapien
tggttatctgtatgtattattttct

SEQ ID NO: 492744 - DNA, 25 bp, Homo sapien
tgactttgacacacatggccacctt

SEQ ID NO: 492745 - DNA, 25 bp, Homo sapien
gactttgacacacatggccaccttg

SEQ ID NO: 492746 - DNA, 25 bp, Homo sapien
tggccaccttggcacaaaagccttg

SEQ ID NO: 492747 - DNA, 25 bp, Homo sapien
caccttggcacaaaagccttgtggt

SEQ ID NO: 492748 - DNA, 25 bp, Homo sapien
ctttccatctttcagcatagactta

SEQ ID NO: 492749 - DNA, 25 bp, Homo sapien
gatgccactgagatggcacctgtca

SEQ ID NO: 492750 - DNA, 25 bp, Homo sapien
tgccactgagatggcacctgtcaaa

SEQ ID NO: 492751 - DNA, 25 bp, Homo sapien
tgagatggcacctgtcaaaagagca

SEQ ID NO: 492752 - DNA, 25 bp, Homo sapien
ggcacctgtcaaaagagcagtggtt

SEQ ID NO: 492753 - DNA, 25 bp, Homo sapien
gtcaaaagagcagtggttccatttc

SEQ ID NO: 492754 - DNA, 25 bp, Homo sapien
aagagcagtggttccatttctagat

SEQ ID NO: 492755 - DNA, 25 bp, Homo sapien
gaacatggacgaaggaattcctcat

SEQ ID NO: 492756 - DNA, 25 bp, Homo sapien
ggaattcctcatttgcaagagagac

SEQ ID NO: 492757 - DNA, 25 bp, Homo sapien
ataggactggactattcctctttgt

SEQ ID NO: 492758 - DNA, 25 bp, Homo sapien
ggactattcctctttgtatatgtgt

SEQ ID NO: 492759 - DNA, 25 bp, Homo sapien
tatgtgtaaacccaaaaggagcatg

SEQ ID NO: 492760 - DNA, 25 bp, Homo sapien
ggagcatgaaacgagacgacaccaa

SEQ ID NO: 492761 - DNA, 25 bp, Homo sapien
gagacgacaccaaggatacctacaa

SEQ ID NO: 492762 - DNA, 25 bp, Homo sapien
attaatgaatgcattgctcagctga

SEQ ID NO: 492763 - DNA, 25 bp, Homo sapien
ctgaaagatttactgcctgaacatc

SEQ ID NO: 492764 - DNA, 25 bp, Homo sapien
tactgcctgaacatctgaaattgac

SEQ ID NO: 492765 - DNA, 25 bp, Homo sapien
aattgacaactctgggacatctgga

SEQ ID NO: 492766 - DNA, 25 bp, Homo sapien
tcctccttatttgtgttctaattga

SEQ ID NO: 492767 - DNA, 25 bp, Homo sapien
ttatttgtgttctaattgacccagg

SEQ ID NO: 492768 - DNA, 25 bp, Homo sapien
atttgtgttctaattgacccaggaa

SEQ ID NO: 492769 - DNA, 25 bp, Homo sapien
tgtgttctaattgacccaggaattt

SEQ ID NO: 492770 - DNA, 25 bp, Homo sapien
tatttcctatggaaaatcactaggg

SEQ ID NO: 492771 - DNA, 25 bp, Homo sapien
actagggggagtgctccctcaggca

SEQ ID NO: 492772 - DNA, 25 bp, Homo sapien
gaagaatacagtcttatatttaaag

SEQ ID NO: 492773 - DNA, 25 bp, Homo sapien
ctttttgaagtttatctctctttct

SEQ ID NO: 492774 - DNA, 25 bp, Homo sapien
gaagtttatctctctttctagtaaa

SEQ ID NO: 492775 - DNA, 25 bp, Homo sapien
ctctttctagtaaaatggtgcttac

SEQ ID NO: 492776 - DNA, 25 bp, Homo sapien
aatggtgcttactgtgaatggataa

SEQ ID NO: 492777 - DNA, 25 bp, Homo sapien
gacagagccacggtaggaacagcca

SEQ ID NO: 492778 - DNA, 25 bp, Homo sapien
agccacggtaggaacagccaggcca

SEQ ID NO: 492779 - DNA, 25 bp, Homo sapien
agccaggccatcagcagacgtgcga

SEQ ID NO: 492780 - DNA, 25 bp, Homo sapien
aggccatcagcagacgtgcgagtca

SEQ ID NO: 492781 - DNA, 25 bp, Homo sapien
atcagcagacgtgcgagtcaggaca

SEQ ID NO: 492782 - DNA, 25 bp, Homo sapien
cagcagacgtgcgagtcaggacaca

SEQ ID NO: 492783 - DNA, 25 bp, Homo sapien
gacgtgcgagtcaggacacaggcca

SEQ ID NO: 492784 - DNA, 25 bp, Homo sapien
ccacacgcaggtttatttccatctt

SEQ ID NO: 492785 - DNA, 25 bp, Homo sapien
cacacgcaggtttatttccatcttc

SEQ ID NO: 492786 - DNA, 25 bp, Homo sapien
acgcaggtttatttccatcttccag

SEQ ID NO: 492787 - DNA, 25 bp, Homo sapien
gcaggtttatttccatcttccaggg

SEQ ID NO: 492788 - DNA, 25 bp, Homo sapien
gggaaacataatacatctctcaatt

SEQ ID NO: 492789 - DNA, 25 bp, Homo sapien
aaatcccactcaacctagtataatg

SEQ ID NO: 492790 - DNA, 25 bp, Homo sapien
gattatttaatggtatctatggaaa

SEQ ID NO: 492791 - DNA, 25 bp, Homo sapien
gtgtatttgctctgtgcccacttgc

SEQ ID NO: 492792 - DNA, 25 bp, Homo sapien
tatttgctctgtgcccacttgccat

SEQ ID NO: 492793 - DNA, 25 bp, Homo sapien
taatgcagaggacagttcacggagc

SEQ ID NO: 492794 - DNA, 25 bp, Homo sapien
ggacagttcacggagcaactcaaat

SEQ ID NO: 492795 - DNA, 25 bp, Homo sapien
aactcaaataattgccacttttaca

SEQ ID NO: 492796 - DNA, 25 bp, Homo sapien
ttgccacttttacaatattgaagct

SEQ ID NO: 492797 - DNA, 25 bp, Homo sapien
acaatattgaagcttcctacgggaa

SEQ ID NO: 492798 - DNA, 25 bp, Homo sapien
attgaagcttcctacgggaaacata

SEQ ID NO: 492799 - DNA, 25 bp, Homo sapien
gaattgtagtgccatcggtttttac

SEQ ID NO: 492800 - DNA, 25 bp, Homo sapien
gtttttacttagagcccttgacgtg

SEQ ID NO: 492801 - DNA, 25 bp, Homo sapien
agagcccttgacgtgcttggaccaa

SEQ ID NO: 492802 - DNA, 25 bp, Homo sapien
gtgcttggaccaatatttccttcct

SEQ ID NO: 492803 - DNA, 25 bp, Homo sapien
atttccttccttcttatgaaccagg

SEQ ID NO: 492804 - DNA, 25 bp, Homo sapien
atgaaccaggtttttccttctgatt

SEQ ID NO: 492805 - DNA, 25 bp, Homo sapien
tccttctgattttcccttttcaaca

SEQ ID NO: 492806 - DNA, 25 bp, Homo sapien
tcccttttcaacattccttaccagt

SEQ ID NO: 492807 - DNA, 25 bp, Homo sapien
ttaccagtcaccaaagtttcctgtt

SEQ ID NO: 492808 - DNA, 25 bp, Homo sapien
atcatcacagagatctccacaactc

SEQ ID NO: 492809 - DNA, 25 bp, Homo sapien
acaactccttggcttaaacagctcc

SEQ ID NO: 492810 - DNA, 25 bp, Homo sapien
gtctgcctgtattttcgggattctt

SEQ ID NO: 492811 - DNA, 25 bp, Homo sapien
gggattctttgacatttggtggtac

SEQ ID NO: 492812 - DNA, 25 bp, Homo sapien
tggtactttattcttgctgggcata

SEQ ID NO: 492813 - DNA, 25 bp, Homo sapien
atactttctctctaggagggagcct

SEQ ID NO: 492814 - DNA, 25 bp, Homo sapien
gggagccttgtgagatccttcacag

SEQ ID NO: 492815 - DNA, 25 bp, Homo sapien
catgtgaagcatgctttgctgctat

SEQ ID NO: 492816 - DNA, 25 bp, Homo sapien
gagcatcagagagtgtacatcatgt

SEQ ID NO: 492817 - DNA, 25 bp, Homo sapien
gcttttcatgtagaactcagcagtt

SEQ ID NO: 492818 - DNA, 25 bp, Homo sapien
aaatctagccagagcccttcactgc

SEQ ID NO: 492819 - DNA, 25 bp, Homo sapien
gcttcaccagtctgtctactgtggt

SEQ ID NO: 492820 - DNA, 25 bp, Homo sapien
tactgtggtgatctgtagacttctg

SEQ ID NO: 492821 - DNA, 25 bp, Homo sapien
ggccttacttttatcaaatgtttct

SEQ ID NO: 492822 - DNA, 25 bp, Homo sapien
atcaaatgtttctcgacaaaagttt

SEQ ID NO: 492823 - DNA, 25 bp, Homo sapien
attaacttgatgtcagcaactcatg

SEQ ID NO: 492824 - DNA, 25 bp, Homo sapien
cagcaactcatggacttgacagcaa

SEQ ID NO: 492825 - DNA, 25 bp, Homo sapien
tggacttgacagcaaacctcaatct

SEQ ID NO: 492826 - DNA, 25 bp, Homo sapien
gcaaacctcaatctcctctggtctg

SEQ ID NO: 492827 - DNA, 25 bp, Homo sapien
gtctgccccttttcaaatcctaatg

SEQ ID NO: 492828 - DNA, 25 bp, Homo sapien
atcctaatggccgtatatctccttt

SEQ ID NO: 492829 - DNA, 25 bp, Homo sapien
ctcctttggcaagagctgggtccag

SEQ ID NO: 492830 - DNA, 25 bp, Homo sapien
agagctgggtccagcagtgttagca

SEQ ID NO: 492831 - DNA, 25 bp, Homo sapien
agtccttgtgtttgttataccaata

SEQ ID NO: 492832 - DNA, 25 bp, Homo sapien
acaggacatggctttgggaagttca

SEQ ID NO: 492833 - DNA, 25 bp, Homo sapien
aggatggtccagtgaaatacatact

SEQ ID NO: 492834 - DNA, 25 bp, Homo sapien
tacatactatacttttgcaccccag

SEQ ID NO: 492835 - DNA, 25 bp, Homo sapien
acttttgcaccccagctaagctgac

SEQ ID NO: 492836 - DNA, 25 bp, Homo sapien
gctaagctgacccatgatcagtaag

SEQ ID NO: 492837 - DNA, 25 bp, Homo sapien
gacccatgatcagtaagtaggaaat

SEQ ID NO: 492838 - DNA, 25 bp, Homo sapien
cccaaccccatttcagtgaactatg

SEQ ID NO: 492839 - DNA, 25 bp, Homo sapien
gtgaactatgaacctctattagata

SEQ ID NO: 492840 - DNA, 25 bp, Homo sapien
atgctggagggctttggccctttcc

SEQ ID NO: 492841 - DNA, 25 bp, Homo sapien
ttggccctttccctcaaggagctag

SEQ ID NO: 492842 - DNA, 25 bp, Homo sapien
ttccctcaaggagctagtctagtag

SEQ ID NO: 492843 - DNA, 25 bp, Homo sapien
agaaatcctcttttactgcctgtgg

SEQ ID NO: 492844 - DNA, 25 bp, Homo sapien
aaatcctcttttactgcctgtggac

SEQ ID NO: 492845 - DNA, 25 bp, Homo sapien
ggacaaaatccatccttcgttgaag

SEQ ID NO: 492846 - DNA, 25 bp, Homo sapien
aaagtggactaccatgtatccctat

SEQ ID NO: 492847 - DNA, 25 bp, Homo sapien
gactaccatgtatccctatatattg

SEQ ID NO: 492848 - DNA, 25 bp, Homo sapien
tccctatatattgtggctgtactag

SEQ ID NO: 492849 - DNA, 25 bp, Homo sapien
gtggctgtactagagtatatctcag

SEQ ID NO: 492850 - DNA, 25 bp, Homo sapien
gagtatatctcagctgatattttaa

SEQ ID NO: 492851 - DNA, 25 bp, Homo sapien
atccggcattatgaaatatctcagc

SEQ ID NO: 492852 - DNA, 25 bp, Homo sapien
atatctcagcaggacattaaagtgt

SEQ ID NO: 492853 - DNA, 25 bp, Homo sapien
attaaagtgtcaatgtgtgcggata

SEQ ID NO: 492854 - DNA, 25 bp, Homo sapien
agataaagagtctaccaaataccaa

SEQ ID NO: 492855 - DNA, 25 bp, Homo sapien
aactactctatcttcatgacaatgg

SEQ ID NO: 492856 - DNA, 25 bp, Homo sapien
tatcttcatgacaatgggtttgcaa

SEQ ID NO: 492857 - DNA, 25 bp, Homo sapien
tgtgtattatctgcctgtccaaccc

SEQ ID NO: 492858 - DNA, 25 bp, Homo sapien
ttatctgcctgtccaaccctcattg

SEQ ID NO: 492859 - DNA, 25 bp, Homo sapien
ctcattgccctcactatgtttgatt

SEQ ID NO: 492860 - DNA, 25 bp, Homo sapien
gccctcactatgtttgattgtccag

SEQ ID NO: 492861 - DNA, 25 bp, Homo sapien
gtttgattgtccagtaagccttaaa

SEQ ID NO: 492862 - DNA, 25 bp, Homo sapien
tcttgttaacagtatatggcctctc

SEQ ID NO: 492863 - DNA, 25 bp, Homo sapien
gttaacagtatatggcctctcaaag

SEQ ID NO: 492864 - DNA, 25 bp, Homo sapien
tctcaaagcgctggatcatcatgtg

SEQ ID NO: 492865 - DNA, 25 bp, Homo sapien
ccacaacaaggtacatttaggcaaa

SEQ ID NO: 492866 - DNA, 25 bp, Homo sapien
aaatataaagtctcacaatgccaat

SEQ ID NO: 492867 - DNA, 25 bp, Homo sapien
gtctcacaatgccaattattggtca

SEQ ID NO: 492868 - DNA, 25 bp, Homo sapien
gaaactcatatactccttggaaggc

SEQ ID NO: 492869 - DNA, 25 bp, Homo sapien
ctccttggaaggctaaattgataga

SEQ ID NO: 492870 - DNA, 25 bp, Homo sapien
agaatcatcttgtggaaagtttgtt

SEQ ID NO: 492871 - DNA, 25 bp, Homo sapien
aaagtttgttattacctatcagcgt

SEQ ID NO: 492872 - DNA, 25 bp, Homo sapien
ttacctatcagcgtatggatccaat

SEQ ID NO: 492873 - DNA, 25 bp, Homo sapien
ggatccaatactctaagaagacctc

SEQ ID NO: 492874 - DNA, 25 bp, Homo sapien
agacctcataattttacacctaggt

SEQ ID NO: 492875 - DNA, 25 bp, Homo sapien
agactggagacatgattgtgccact

SEQ ID NO: 492876 - DNA, 25 bp, Homo sapien
aattcgattcacaagatctatatga

SEQ ID NO: 492877 - DNA, 25 bp, Homo sapien
ttcaaatatcccaagaaagtctact

SEQ ID NO: 492878 - DNA, 25 bp, Homo sapien
agaaaagacatgcatgatcctggat

SEQ ID NO: 492879 - DNA, 25 bp, Homo sapien
aagacatgcatgatcctggatgggc

SEQ ID NO: 492880 - DNA, 25 bp, Homo sapien
atatcccaagaaagtctactaaaat

SEQ ID NO: 492881 - DNA, 25 bp, Homo sapien
acatgcatgatcctggatgggcaga

SEQ ID NO: 492882 - DNA, 25 bp, Homo sapien
tgcatgatcctggatgggcagactt

SEQ ID NO: 492883 - DNA, 25 bp, Homo sapien
atgatcctggatgggcagacttact

SEQ ID NO: 492884 - DNA, 25 bp, Homo sapien
tcctggatgggcagacttactatta

SEQ ID NO: 492885 - DNA, 25 bp, Homo sapien
gacttactattacagtgcaatgcct

SEQ ID NO: 492886 - DNA, 25 bp, Homo sapien
tttaatatatacttggacacaaaat

SEQ ID NO: 492887 - DNA, 25 bp, Homo sapien
agacccagaccagagccgggtgttt

SEQ ID NO: 492888 - DNA, 25 bp, Homo sapien
cagagccgggtgttttgtccacagt

SEQ ID NO: 492889 - DNA, 25 bp, Homo sapien
gttttgtccacagtactgctgctgc

SEQ ID NO: 492890 - DNA, 25 bp, Homo sapien
agtactgctgctgcttataccgtaa

SEQ ID NO: 492891 - DNA, 25 bp, Homo sapien
gctgctgcttataccgtaacgggaa

SEQ ID NO: 492892 - DNA, 25 bp, Homo sapien
taacgggaaaagtacacaacagtgt

SEQ ID NO: 492893 - DNA, 25 bp, Homo sapien
acattataggagcagaagtacatct

SEQ ID NO: 492894 - DNA, 25 bp, Homo sapien
aatatacttttaggtcacattgaaa

SEQ ID NO: 492895 - DNA, 25 bp, Homo sapien
atgttgctacattatgctcaataca

SEQ ID NO: 492896 - DNA, 25 bp, Homo sapien
attatgctcaatacagcaggctgtt

SEQ ID NO: 492897 - DNA, 25 bp, Homo sapien
caggctgttctgctagggaaattgt

SEQ ID NO: 492898 - DNA, 25 bp, Homo sapien
caagctgaaatgagtggctgcacca

SEQ ID NO: 492899 - DNA, 25 bp, Homo sapien
aatgagtggctgcaccagattctat

SEQ ID NO: 492900 - DNA, 25 bp, Homo sapien
ggctgcaccagattctatgagataa

SEQ ID NO: 492901 - DNA, 25 bp, Homo sapien
gaaggacatttttcaccaagttcaa

SEQ ID NO: 492902 - DNA, 25 bp, Homo sapien
ggacatttttcaccaagttcaaaga

SEQ ID NO: 492903 - DNA, 25 bp, Homo sapien
tttcaccaagttcaaagactgggat

SEQ ID NO: 492904 - DNA, 25 bp, Homo sapien
caaagactgggatacaaaggaattt

SEQ ID NO: 492905 - DNA, 25 bp, Homo sapien
aacccaaaagagcaaaatgacagta

SEQ ID NO: 492906 - DNA, 25 bp, Homo sapien
taaaatgacggtaggacatgacggg

SEQ ID NO: 492907 - DNA, 25 bp, Homo sapien
cagatccaaaatgctgacaggttca

SEQ ID NO: 492908 - DNA, 25 bp, Homo sapien
gctgacaggttcaaacaaaattgga

SEQ ID NO: 492909 - DNA, 25 bp, Homo sapien
gaagctcaagtttcatactcaacat

SEQ ID NO: 492910 - DNA, 25 bp, Homo sapien
tactcaacataatcttctgtgtgac

SEQ ID NO: 492911 - DNA, 25 bp, Homo sapien
aaggacaagccatgtagcctctctg

SEQ ID NO: 492912 - DNA, 25 bp, Homo sapien
ctctgtgcctatttcttcatgcata

SEQ ID NO: 492913 - DNA, 25 bp, Homo sapien
ttcttcatgcataaactgggactca

SEQ ID NO: 492914 - DNA, 25 bp, Homo sapien
aactgggactcataatatttgtaaa

SEQ ID NO: 492915 - DNA, 25 bp, Homo sapien
aatgtattgatactctcagggcaaa

SEQ ID NO: 492916 - DNA, 25 bp, Homo sapien
tactctcagggcaaattcactatat

SEQ ID NO: 492917 - DNA, 25 bp, Homo sapien
tattgctatacagttgagatcagtg

SEQ ID NO: 492918 - DNA, 25 bp, Homo sapien
gatctggttctaattgcctcaaagg

SEQ ID NO: 492919 - DNA, 25 bp, Homo sapien
aggaggctgacttagctgattggta

SEQ ID NO: 492920 - DNA, 25 bp, Homo sapien
aactgtgtttccctattatatccct

SEQ ID NO: 492921 - DNA, 25 bp, Homo sapien
tttccctattatatccctctggaga

SEQ ID NO: 492922 - DNA, 25 bp, Homo sapien
ttatatccctctggagactgagaat

SEQ ID NO: 492923 - DNA, 25 bp, Homo sapien
ttcttcaaagcagtactgtaacatg

SEQ ID NO: 492924 - DNA, 25 bp, Homo sapien
gaatgtatttatctcagtcaacaga

SEQ ID NO: 492925 - DNA, 25 bp, Homo sapien
gtcaacagaacttatatgcccactg

SEQ ID NO: 492926 - DNA, 25 bp, Homo sapien
cactgtatgtggagcttatttcaat

SEQ ID NO: 492927 - DNA, 25 bp, Homo sapien
tggcttagttagcagacctagaatc

SEQ ID NO: 492928 - DNA, 25 bp, Homo sapien
gacctagaatctgcccaggtgagac

SEQ ID NO: 492929 - DNA, 25 bp, Homo sapien
aggtatatgtcaaggcagagcccta

SEQ ID NO: 492930 - DNA, 25 bp, Homo sapien
aaggcagagccctatgaggaaggaa

SEQ ID NO: 492931 - DNA, 25 bp, Homo sapien
aaggaagcaatgtgtgtcaggcctc

SEQ ID NO: 492932 - DNA, 25 bp, Homo sapien
gagcctgcatgctgacactgtggcc

SEQ ID NO: 492933 - DNA, 25 bp, Homo sapien
atgctgacactgtggccgatctgga

SEQ ID NO: 492934 - DNA, 25 bp, Homo sapien
actgtggccgatctggactctagaa

SEQ ID NO: 492935 - DNA, 25 bp, Homo sapien
gccgatctggactctagaagtgcta

SEQ ID NO: 492936 - DNA, 25 bp, Homo sapien
gaagtgctagtttgaaatatatcca

SEQ ID NO: 492937 - DNA, 25 bp, Homo sapien
atatccattactgtcatttcctttt

SEQ ID NO: 492938 - DNA, 25 bp, Homo sapien
gaatgtcaggactgacttctccagc

SEQ ID NO: 492939 - DNA, 25 bp, Homo sapien
tccttggcatcccatcagcagagga

SEQ ID NO: 492940 - DNA, 25 bp, Homo sapien
gaggagatgcgtccctgttgcattt

SEQ ID NO: 492941 - DNA, 25 bp, Homo sapien
gtccctgttgcattttggcgtttgg

SEQ ID NO: 492942 - DNA, 25 bp, Homo sapien
gatttatttttgcaggatatggagt

SEQ ID NO: 492943 - DNA, 25 bp, Homo sapien
tatggagtgcaatgaactgagtcaa

SEQ ID NO: 492944 - DNA, 25 bp, Homo sapien
actgagtcaatatggcaaggtgtat

SEQ ID NO: 492945 - DNA, 25 bp, Homo sapien
gtgatctgtgggagttatgccattt

SEQ ID NO: 492946 - DNA, 25 bp, Homo sapien
ggagttatgccatttaacataggaa

SEQ ID NO: 492947 - DNA, 25 bp, Homo sapien
taggaagtgcatgggactttccctc

SEQ ID NO: 492948 - DNA, 25 bp, Homo sapien
actccagctcttactgtaccattag

SEQ ID NO: 492949 - DNA, 25 bp, Homo sapien
gatgcagaattctgttggtgtgcaa

SEQ ID NO: 492950 - DNA, 25 bp, Homo sapien
gtatagccttacattcaagcagaat

SEQ ID NO: 492951 - DNA, 25 bp, Homo sapien
gaaagcagcaatatctgttactaga

SEQ ID NO: 492952 - DNA, 25 bp, Homo sapien
ctgttactagagaacattcccatgt

SEQ ID NO: 492953 - DNA, 25 bp, Homo sapien
tcatctcatcatttcaccaaatctc

SEQ ID NO: 492954 - DNA, 25 bp, Homo sapien
tcattatgtcatttcatataatctc

SEQ ID NO: 492955 - DNA, 25 bp, Homo sapien
ttcatataatctcatttcatctcat

SEQ ID NO: 492956 - DNA, 25 bp, Homo sapien
ttcatctcatctcatatttttgata

SEQ ID NO: 492957 - DNA, 25 bp, Homo sapien
tctcatctcatatttttgatatcat

SEQ ID NO: 492958 - DNA, 25 bp, Homo sapien
ttcatatcatttttcatctcatttc

SEQ ID NO: 492959 - DNA, 25 bp, Homo sapien
catatcatttttcatctcatttcat

SEQ ID NO: 492960 - DNA, 25 bp, Homo sapien
tcatctcatttcatctcaattcatc

SEQ ID NO: 492961 - DNA, 25 bp, Homo sapien
catctcaattcatctcatcatttca

SEQ ID NO: 492962 - DNA, 25 bp, Homo sapien
catttcatctcctcatctcatcatt

SEQ ID NO: 492963 - DNA, 25 bp, Homo sapien
atctcatcatttcctcctttcatta

SEQ ID NO: 492964 - DNA, 25 bp, Homo sapien
aactgtattcaccacatagcactat

SEQ ID NO: 492965 - DNA, 25 bp, Homo sapien
cagtagaacagaatttattcctcct

SEQ ID NO: 492966 - DNA, 25 bp, Homo sapien
caatctctcataaccacaattctac

SEQ ID NO: 492967 - DNA, 25 bp, Homo sapien
ctactctctagatctatgagctcat

SEQ ID NO: 492968 - DNA, 25 bp, Homo sapien
atgagctcatttcttaagtccctgc

SEQ ID NO: 492969 - DNA, 25 bp, Homo sapien
catttcttaagtccctgcatttgag

SEQ ID NO: 492970 - DNA, 25 bp, Homo sapien
aagtccctgcatttgagtgagaaga

SEQ ID NO: 492971 - DNA, 25 bp, Homo sapien
gaagtatttatctttctgcgcatga

SEQ ID NO: 492972 - DNA, 25 bp, Homo sapien
ttctgcgcatgacttgctttgctta

SEQ ID NO: 492973 - DNA, 25 bp, Homo sapien
gctttgcttacctaattatctccag

SEQ ID NO: 492974 - DNA, 25 bp, Homo sapien
gcttacctaattatctccagattca

SEQ ID NO: 492975 - DNA, 25 bp, Homo sapien
tgttcagtaaattcaagttttgctt

SEQ ID NO: 492976 - DNA, 25 bp, Homo sapien
ttgattggcagttggttgaagccat

SEQ ID NO: 492977 - DNA, 25 bp, Homo sapien
ggctgactgtacttacttacatatc

SEQ ID NO: 492978 - DNA, 25 bp, Homo sapien
gtacttacttacatatctatctatc

SEQ ID NO: 492979 - DNA, 25 bp, Homo sapien
acatatctatctatctttgagtaac

SEQ ID NO: 492980 - DNA, 25 bp, Homo sapien
atctttgagtaacaaactctttggg

SEQ ID NO: 492981 - DNA, 25 bp, Homo sapien
ctgaagatgattacttatacctaat

SEQ ID NO: 492982 - DNA, 25 bp, Homo sapien
aaagagggaagtgtattgagcaaga

SEQ ID NO: 492983 - DNA, 25 bp, Homo sapien
atttgcatggattcaacatagtgct

SEQ ID NO: 492984 - DNA, 25 bp, Homo sapien
gattcaacatagtgcttggtgttca

SEQ ID NO: 492985 - DNA, 25 bp, Homo sapien
atagtgcttggtgttcagtaaattc

SEQ ID NO: 492986 - DNA, 25 bp, Homo sapien
gccttcagtggattcgggcaagtgc

SEQ ID NO: 492987 - DNA, 25 bp, Homo sapien
ttcgggcaagtgcaaagtctttggc

SEQ ID NO: 492988 - DNA, 25 bp, Homo sapien
gggcaagtgcaaagtctttggccta

SEQ ID NO: 492989 - DNA, 25 bp, Homo sapien
agtctttggcctattgtgtgacaaa

SEQ ID NO: 492990 - DNA, 25 bp, Homo sapien
ggcctattgtgtgacaaagaggtat

SEQ ID NO: 492991 - DNA, 25 bp, Homo sapien
taagaaaattccgtcaacaaggttg

SEQ ID NO: 492992 - DNA, 25 bp, Homo sapien
aattccgtcaacaaggttggagtag

SEQ ID NO: 492993 - DNA, 25 bp, Homo sapien
gggtggatttgtgtttctgactttt

SEQ ID NO: 492994 - DNA, 25 bp, Homo sapien
ctttaagcaaattccatatgttacc

SEQ ID NO: 492995 - DNA, 25 bp, Homo sapien
agcaaattccatatgttaccaaaag

SEQ ID NO: 492996 - DNA, 25 bp, Homo sapien
tatgttaccaaaagcacatgctgta

SEQ ID NO: 492997 - DNA, 25 bp, Homo sapien
gtattaatatcctttggcaagcaca

SEQ ID NO: 492998 - DNA, 25 bp, Homo sapien
tatcctttggcaagcacacatcatg

SEQ ID NO: 492999 - DNA, 25 bp, Homo sapien
acacatcatgagcacgtcaaaaatg

SEQ ID NO: 493000 - DNA, 25 bp, Homo sapien
acgtcaaaaatgcttcactctagga

SEQ ID NO: 493001 - DNA, 25 bp, Homo sapien
tcactctaggaaataggactgtaca

SEQ ID NO: 493002 - DNA, 25 bp, Homo sapien
ggactgtacaggcaaactctaagga

SEQ ID NO: 493003 - DNA, 25 bp, Homo sapien
gaaagtcagcatttctcaaaagctc

SEQ ID NO: 493004 - DNA, 25 bp, Homo sapien
atttctcaaaagctcatacatcctg

SEQ ID NO: 493005 - DNA, 25 bp, Homo sapien
aaaagctcatacatcctgaaaagta

SEQ ID NO: 493006 - DNA, 25 bp, Homo sapien
cctgaaaagtatctgaatgttctgt

SEQ ID NO: 493007 - DNA, 25 bp, Homo sapien
tccagtatagttctgttgactctta

SEQ ID NO: 493008 - DNA, 25 bp, Homo sapien
ggtcaagtagactcagtgtagggca

SEQ ID NO: 493009 - DNA, 25 bp, Homo sapien
gacaggtaggtaggacaggatctct

SEQ ID NO: 493010 - DNA, 25 bp, Homo sapien
taggtaggacaggatctcttaagat

SEQ ID NO: 493011 - DNA, 25 bp, Homo sapien
ggacaggatctcttaagatgggaaa

SEQ ID NO: 493012 - DNA, 25 bp, Homo sapien
ggagaggagggctgcttggccccag

SEQ ID NO: 493013 - DNA, 25 bp, Homo sapien
cttggccccagggaactgcagtgag

SEQ ID NO: 493014 - DNA, 25 bp, Homo sapien
gtgaggtggaactgagctccgctcc

SEQ ID NO: 493015 - DNA, 25 bp, Homo sapien
gtggaactgagctccgctcctgaat

SEQ ID NO: 493016 - DNA, 25 bp, Homo sapien
gctccgctcctgaatctccaaagga

SEQ ID NO: 493017 - DNA, 25 bp, Homo sapien
tgaatctccaaaggagcccatgctg

SEQ ID NO: 493018 - DNA, 25 bp, Homo sapien
gagtcattttttccagcatcctgtc

SEQ ID NO: 493019 - DNA, 25 bp, Homo sapien
gaagcatatgcagtgtgctttctgc

SEQ ID NO: 493020 - DNA, 25 bp, Homo sapien
tgcagtgtgctttctgcatttattt

SEQ ID NO: 493021 - DNA, 25 bp, Homo sapien
agaaattggtgaaaatgcctacgca

SEQ ID NO: 493022 - DNA, 25 bp, Homo sapien
aatgcctacgcaaagtgttgacagt

SEQ ID NO: 493023 - DNA, 25 bp, Homo sapien
tgttgacagtgtgaaagcagtgcga

SEQ ID NO: 493024 - DNA, 25 bp, Homo sapien
aaagcagtgcgagtgcggcctttta

SEQ ID NO: 493025 - DNA, 25 bp, Homo sapien
gagtgcggccttttagtcaggttag

SEQ ID NO: 493026 - DNA, 25 bp, Homo sapien
gttagtgatggatgttacgctgcct

SEQ ID NO: 493027 - DNA, 25 bp, Homo sapien
ggatgttacgctgccttgttgaaaa

SEQ ID NO: 493028 - DNA, 25 bp, Homo sapien
gaaaatttcactgactttgatttta

SEQ ID NO: 493029 - DNA, 25 bp, Homo sapien
ttaagctgcttgtcatttatggaat

SEQ ID NO: 493030 - DNA, 25 bp, Homo sapien
agtgcccctctgaacatatcattat

SEQ ID NO: 493031 - DNA, 25 bp, Homo sapien
gcccctctgaacatatcattattag

SEQ ID NO: 493032 - DNA, 25 bp, Homo sapien
ttgtgtgcatgacagcctttgttaa

SEQ ID NO: 493033 - DNA, 25 bp, Homo sapien
gtgtgcatgacagcctttgttaagg

SEQ ID NO: 493034 - DNA, 25 bp, Homo sapien
atgacagcctttgttaagggtgtct

SEQ ID NO: 493035 - DNA, 25 bp, Homo sapien
ggaatgccaggaaagaacttcttca

SEQ ID NO: 493036 - DNA, 25 bp, Homo sapien
gccaggaaagaacttcttcaactga

SEQ ID NO: 493037 - DNA, 25 bp, Homo sapien
gtgctctgagttttgggatggtcac

SEQ ID NO: 493038 - DNA, 25 bp, Homo sapien
gagttttgggatggtcacatgacac

SEQ ID NO: 493039 - DNA, 25 bp, Homo sapien
ggtcacatgacacaatccagcactt

SEQ ID NO: 493040 - DNA, 25 bp, Homo sapien
atgacacaatccagcacttgaacct

SEQ ID NO: 493041 - DNA, 25 bp, Homo sapien
aaaagttgcattacacagtacaaaa

SEQ ID NO: 493042 - DNA, 25 bp, Homo sapien
gttgcattacacagtacaaaataga

SEQ ID NO: 493043 - DNA, 25 bp, Homo sapien
gtgcgtgtctacacctagtattacg

SEQ ID NO: 493044 - DNA, 25 bp, Homo sapien
gtgtctacacctagtattacggctg

SEQ ID NO: 493045 - DNA, 25 bp, Homo sapien
gtctacacctagtattacggctggg

SEQ ID NO: 493046 - DNA, 25 bp, Homo sapien
tacacctagtattacggctgggact

SEQ ID NO: 493047 - DNA, 25 bp, Homo sapien
cacctagtattacggctgggactct

SEQ ID NO: 493048 - DNA, 25 bp, Homo sapien
ctagtattacggctgggactctcca

SEQ ID NO: 493049 - DNA, 25 bp, Homo sapien
agtattacggctgggactctccagc

SEQ ID NO: 493050 - DNA, 25 bp, Homo sapien
attacggctgggactctccagctgt

SEQ ID NO: 493051 - DNA, 25 bp, Homo sapien
acggctgggactctccagctgtttt

SEQ ID NO: 493052 - DNA, 25 bp, Homo sapien
tacagcactcgtacttttacatgat

SEQ ID NO: 493053 - DNA, 25 bp, Homo sapien
atgatgtgtgtgtgagtagctcttc

SEQ ID NO: 493054 - DNA, 25 bp, Homo sapien
tagctcttctgtccaaaccatgatt

SEQ ID NO: 493055 - DNA, 25 bp, Homo sapien
gaggttcaactacctgtagatcaaa

SEQ ID NO: 493056 - DNA, 25 bp, Homo sapien
ttctccccatgactatgttttctta

SEQ ID NO: 493057 - DNA, 25 bp, Homo sapien
gactatgttttcttaactttgcatt

SEQ ID NO: 493058 - DNA, 25 bp, Homo sapien
gcattgaatctatttactgggttac

SEQ ID NO: 493059 - DNA, 25 bp, Homo sapien
actgggttacattctatgtgtagtt

SEQ ID NO: 493060 - DNA, 25 bp, Homo sapien
taaaatgctcatgtcttattccaag

SEQ ID NO: 493061 - DNA, 25 bp, Homo sapien
ttattccaagcaccttcctccaaag

SEQ ID NO: 493062 - DNA, 25 bp, Homo sapien
caaagtccccataaagctgcatctc

SEQ ID NO: 493063 - DNA, 25 bp, Homo sapien
atgttttatatccagtcaagttgag

SEQ ID NO: 493064 - DNA, 25 bp, Homo sapien
aaatctttacaattggactgttaga

SEQ ID NO: 493065 - DNA, 25 bp, Homo sapien
tggactgttagaaaccttgcattat

SEQ ID NO: 493066 - DNA, 25 bp, Homo sapien
gaaaccttgcattatttgaacaaaa

SEQ ID NO: 493067 - DNA, 25 bp, Homo sapien
aaaagtgacgtatttgaagatcagt

SEQ ID NO: 493068 - DNA, 25 bp, Homo sapien
aaccaattcctgctcactaattatt

SEQ ID NO: 493069 - DNA, 25 bp, Homo sapien
aattcctgctcactaattatttttt

SEQ ID NO: 493070 - DNA, 25 bp, Homo sapien
ttttaaatgccatgaatggaggctt

SEQ ID NO: 493071 - DNA, 25 bp, Homo sapien
aatggaggcttggtttcactgaata

SEQ ID NO: 493072 - DNA, 25 bp, Homo sapien
ggcttggtttcactgaatatgcctt

SEQ ID NO: 493073 - DNA, 25 bp, Homo sapien
ggtttcactgaatatgcctttaaag

SEQ ID NO: 493074 - DNA, 25 bp, Homo sapien
atacatggtatgaaatgtcactcat

SEQ ID NO: 493075 - DNA, 25 bp, Homo sapien
gtcactcatttatctatacaatatg

SEQ ID NO: 493076 - DNA, 25 bp, Homo sapien
ttctctgccccgttataatcatcta

SEQ ID NO: 493077 - DNA, 25 bp, Homo sapien
tgccccgttataatcatctatttta

SEQ ID NO: 493078 - DNA, 25 bp, Homo sapien
aaaaaatatctacaatgctctggta

SEQ ID NO: 493079 - DNA, 25 bp, Homo sapien
ggtagattagtaaagcttcaaaaca

SEQ ID NO: 493080 - DNA, 25 bp, Homo sapien
caaaaattgagctccttggtcacaa

SEQ ID NO: 493081 - DNA, 25 bp, Homo sapien
gagctccttggtcacaaagtaggct

SEQ ID NO: 493082 - DNA, 25 bp, Homo sapien
aagtaggcttctaaagtcggatcta

SEQ ID NO: 493083 - DNA, 25 bp, Homo sapien
gtcggatctactcttgatcttctat

SEQ ID NO: 493084 - DNA, 25 bp, Homo sapien
aagcatatactttctcacacttata

SEQ ID NO: 493085 - DNA, 25 bp, Homo sapien
gtcttttagactcccagctgtacaa

SEQ ID NO: 493086 - DNA, 25 bp, Homo sapien
cttactaatgacctgcttcaaggag

SEQ ID NO: 493087 - DNA, 25 bp, Homo sapien
tactaatgacctgcttcaaggaggt

SEQ ID NO: 493088 - DNA, 25 bp, Homo sapien
atgacctgcttcaaggaggtggaca

SEQ ID NO: 493089 - DNA, 25 bp, Homo sapien
atcttgccgttgtgacaccttcatc

SEQ ID NO: 493090 - DNA, 25 bp, Homo sapien
tcttgccgttgtgacaccttcatca

SEQ ID NO: 493091 - DNA, 25 bp, Homo sapien
cttgccgttgtgacaccttcatcaa

SEQ ID NO: 493092 - DNA, 25 bp, Homo sapien
ttgccgttgtgacaccttcatcaat

SEQ ID NO: 493093 - DNA, 25 bp, Homo sapien
tgccgttgtgacaccttcatcaata

SEQ ID NO: 493094 - DNA, 25 bp, Homo sapien
gccgttgtgacaccttcatcaataa

SEQ ID NO: 493095 - DNA, 25 bp, Homo sapien
ccgttgtgacaccttcatcaataac

SEQ ID NO: 493096 - DNA, 25 bp, Homo sapien
aattttagccaactcatcattctga

SEQ ID NO: 493097 - DNA, 25 bp, Homo sapien
tcattctgaaatgtccctataaaga

SEQ ID NO: 493098 - DNA, 25 bp, Homo sapien
gtccctataaagaatgagtcgaact

SEQ ID NO: 493099 - DNA, 25 bp, Homo sapien
gagtcgaactagaccagaagccagc

SEQ ID NO: 493100 - DNA, 25 bp, Homo sapien
gggtagcaatgacctgtccacttca

SEQ ID NO: 493101 - DNA, 25 bp, Homo sapien
aatgacctgtccacttcaaacacag

SEQ ID NO: 493102 - DNA, 25 bp, Homo sapien
gccatcctcattggttaaaggcaca

SEQ ID NO: 493103 - DNA, 25 bp, Homo sapien
aaaggcacacgtgagactttcagtg

SEQ ID NO: 493104 - DNA, 25 bp, Homo sapien
ttcagtgggctctgctgagaaggaa

SEQ ID NO: 493105 - DNA, 25 bp, Homo sapien
cccaggagtcaggtatgcaggcatt

SEQ ID NO: 493106 - DNA, 25 bp, Homo sapien
gcattgcattgtcagtgtctgctct

SEQ ID NO: 493107 - DNA, 25 bp, Homo sapien
gcatgaacaccatctgtgcgagtca

SEQ ID NO: 493108 - DNA, 25 bp, Homo sapien
gaacaccatctgtgcgagtcattta

SEQ ID NO: 493109 - DNA, 25 bp, Homo sapien
caccatctgtgcgagtcatttactt

SEQ ID NO: 493110 - DNA, 25 bp, Homo sapien
ccatctgtgcgagtcatttacttat

SEQ ID NO: 493111 - DNA, 25 bp, Homo sapien
aagcttgcttcctgttcagttctgc

SEQ ID NO: 493112 - DNA, 25 bp, Homo sapien
ttcctgttcagttctgccaataggg

SEQ ID NO: 493113 - DNA, 25 bp, Homo sapien
gaaggagagaatatgcttcctgttt

SEQ ID NO: 493114 - DNA, 25 bp, Homo sapien
tttctgttcttgttaatgttgctta

SEQ ID NO: 493115 - DNA, 25 bp, Homo sapien
gttaatgttgcttacaggaccagca

SEQ ID NO: 493116 - DNA, 25 bp, Homo sapien
gcttacaggaccagcaatgcttctt

SEQ ID NO: 493117 - DNA, 25 bp, Homo sapien
tcttcacctagagacacttctccca

SEQ ID NO: 493118 - DNA, 25 bp, Homo sapien
gcatactgcctcctcagattaaata

SEQ ID NO: 493119 - DNA, 25 bp, Homo sapien
gattaaataattttcctaggacatg

SEQ ID NO: 493120 - DNA, 25 bp, Homo sapien
tcctaggacatgctaactgataagt

SEQ ID NO: 493121 - DNA, 25 bp, Homo sapien
gagtctaaatcaaacccaggcagtt

SEQ ID NO: 493122 - DNA, 25 bp, Homo sapien
ggcagttgggttccaaaattccagc

SEQ ID NO: 493123 - DNA, 25 bp, Homo sapien
aaattccagcgtttaaccaccacat

SEQ ID NO: 493124 - DNA, 25 bp, Homo sapien
gcgtttaaccaccacattgactggt

SEQ ID NO: 493125 - DNA, 25 bp, Homo sapien
ggtaaactgttcatcacaacctata

SEQ ID NO: 493126 - DNA, 25 bp, Homo sapien
agcccggccaggatactgggagttt

SEQ ID NO: 493127 - DNA, 25 bp, Homo sapien
cccaggttgacacagctggtcaagg

SEQ ID NO: 493128 - DNA, 25 bp, Homo sapien
acacagctggtcaaggatgggttag

SEQ ID NO: 493129 - DNA, 25 bp, Homo sapien
ttaccacaacaattctgactacaat

SEQ ID NO: 493130 - DNA, 25 bp, Homo sapien
cattttgaggaggatatttggctac

SEQ ID NO: 493131 - DNA, 25 bp, Homo sapien
tttggctactgtaaacatggctggt

SEQ ID NO: 493132 - DNA, 25 bp, Homo sapien
ggaaaatcacgattgtggcttgatg

SEQ ID NO: 493133 - DNA, 25 bp, Homo sapien
ttgatgtggcaagccgaaaccactt

SEQ ID NO: 493134 - DNA, 25 bp, Homo sapien
gaaaccacttggctctggaaatcta

SEQ ID NO: 493135 - DNA, 25 bp, Homo sapien
ggctctggaaatctaagttcatact

SEQ ID NO: 493136 - DNA, 25 bp, Homo sapien
actggtttaattaagctctctcctg

SEQ ID NO: 493137 - DNA, 25 bp, Homo sapien
ttaattaagctctctcctgacaacc

SEQ ID NO: 493138 - DNA, 25 bp, Homo sapien
atttggtacaatgaaggcagtgttt

SEQ ID NO: 493139 - DNA, 25 bp, Homo sapien
aatgggctaaacataaagttcttat

SEQ ID NO: 493140 - DNA, 25 bp, Homo sapien
gcagaggtgacgacagtgcccctat

SEQ ID NO: 493141 - DNA, 25 bp, Homo sapien
gaggtgacgacagtgcccctatatc

SEQ ID NO: 493142 - DNA, 25 bp, Homo sapien
acgacagtgcccctatatccttaac

SEQ ID NO: 493143 - DNA, 25 bp, Homo sapien
atatccttaacccatactcctctga

SEQ ID NO: 493144 - DNA, 25 bp, Homo sapien
actcctctgaggcaaacaggcatgg

SEQ ID NO: 493145 - DNA, 25 bp, Homo sapien
gatggaccggagaattggaacttca

SEQ ID NO: 493146 - DNA, 25 bp, Homo sapien
gaattggaacttcagaataggtcaa

SEQ ID NO: 493147 - DNA, 25 bp, Homo sapien
ataggtcaaaattccaaaaccatgg

SEQ ID NO: 493148 - DNA, 25 bp, Homo sapien
aaatagcttccagaatgtggtggtt

SEQ ID NO: 493149 - DNA, 25 bp, Homo sapien
gaatgtggtggttctgggcaacaaa

SEQ ID NO: 493150 - DNA, 25 bp, Homo sapien
tgtggtggttctgggcaacaaatga

SEQ ID NO: 493151 - DNA, 25 bp, Homo sapien
agaagctgcagcttgtcatcagcta

SEQ ID NO: 493152 - DNA, 25 bp, Homo sapien
ttgtcatcagctacactggctccaa

SEQ ID NO: 493153 - DNA, 25 bp, Homo sapien
gcagccaccaagtccagcaggaact

SEQ ID NO: 493154 - DNA, 25 bp, Homo sapien
agcaggaactgtctgggacctttgc

SEQ ID NO: 493155 - DNA, 25 bp, Homo sapien
aactgtctgggacctttgctcatct

SEQ ID NO: 493156 - DNA, 25 bp, Homo sapien
tttgctcatctgtgtcagcaagttg

SEQ ID NO: 493157 - DNA, 25 bp, Homo sapien
cagcaagttgacgtcacccgggaga

SEQ ID NO: 493158 - DNA, 25 bp, Homo sapien
ttttatgttcatttgctggagcgca

SEQ ID NO: 493159 - DNA, 25 bp, Homo sapien
gctggagcgcaagacgtgctgacac

SEQ ID NO: 493160 - DNA, 25 bp, Homo sapien
gtgctgacacagtgagttttctctg

SEQ ID NO: 493161 - DNA, 25 bp, Homo sapien
gttactcctgtatcattgctcataa

SEQ ID NO: 493162 - DNA, 25 bp, Homo sapien
gtagcaaatacagcagttcagcaat

SEQ ID NO: 493163 - DNA, 25 bp, Homo sapien
aatacagcagttcagcaatatcttg

SEQ ID NO: 493164 - DNA, 25 bp, Homo sapien
gcagttcagcaatatcttgtgctta

SEQ ID NO: 493165 - DNA, 25 bp, Homo sapien
atatcttgtgcttacagggtcctaa

SEQ ID NO: 493166 - DNA, 25 bp, Homo sapien
ttttttatttttcatggcaattgta

SEQ ID NO: 493167 - DNA, 25 bp, Homo sapien
ggcaattgtatattagtaacctggg

SEQ ID NO: 493168 - DNA, 25 bp, Homo sapien
gtttattgacaaccactctgatcca

SEQ ID NO: 493169 - DNA, 25 bp, Homo sapien
attgacaaccactctgatccatctg

SEQ ID NO: 493170 - DNA, 25 bp, Homo sapien
tctgatccatctgctgctattttta

SEQ ID NO: 493171 - DNA, 25 bp, Homo sapien
gctgctatttttactgctaatttgg

SEQ ID NO: 493172 - DNA, 25 bp, Homo sapien
actgctaatttggtgcacattaaaa

SEQ ID NO: 493173 - DNA, 25 bp, Homo sapien
aggagtcacaggcttcagagtacaa

SEQ ID NO: 493174 - DNA, 25 bp, Homo sapien
aggcttcagagtacaagttcccctc

SEQ ID NO: 493175 - DNA, 25 bp, Homo sapien
cagtgcctagaagccaaggagttga

SEQ ID NO: 493176 - DNA, 25 bp, Homo sapien
aaggagttgagaatctcctgatcca

SEQ ID NO: 493177 - DNA, 25 bp, Homo sapien
caggcctcttggctccaggcaagag

SEQ ID NO: 493178 - DNA, 25 bp, Homo sapien
ccaggcaagagcttagaggatgtca

SEQ ID NO: 493179 - DNA, 25 bp, Homo sapien
gggtaagaatcttcagcaaaactgt

SEQ ID NO: 493180 - DNA, 25 bp, Homo sapien
gcaaaactgtcactctaagtagagc

SEQ ID NO: 493181 - DNA, 25 bp, Homo sapien
aagtagagccagcagttacgggtct

SEQ ID NO: 493182 - DNA, 25 bp, Homo sapien
cagcagttacgggtctgataaaaac

SEQ ID NO: 493183 - DNA, 25 bp, Homo sapien
taaagtaaagcccaagctggtgagc

SEQ ID NO: 493184 - DNA, 25 bp, Homo sapien
gaagaagacctgtttccacgccttt

SEQ ID NO: 493185 - DNA, 25 bp, Homo sapien
gttctcctcacctatccaggagtga

SEQ ID NO: 493186 - DNA, 25 bp, Homo sapien
ccaggagtgaatcatcaccttccct

SEQ ID NO: 493187 - DNA, 25 bp, Homo sapien
gaaaggctggagcacttgttctctg

SEQ ID NO: 493188 - DNA, 25 bp, Homo sapien
ctggagcacttgttctctgggtgaa

SEQ ID NO: 493189 - DNA, 25 bp, Homo sapien
gcacttgttctctgggtgaaggacc

SEQ ID NO: 493190 - DNA, 25 bp, Homo sapien
cactggtttttgagatcggcattca

SEQ ID NO: 493191 - DNA, 25 bp, Homo sapien
ttttgagatcggcattcagcgctgt

SEQ ID NO: 493192 - DNA, 25 bp, Homo sapien
ggcattcagcgctgtcttatggcag

SEQ ID NO: 493193 - DNA, 25 bp, Homo sapien
gtgactgaggccctgaatttttact

SEQ ID NO: 493194 - DNA, 25 bp, Homo sapien
tgaggccctgaatttttacttctat

SEQ ID NO: 493195 - DNA, 25 bp, Homo sapien
tacctgaaccacaatttatttttgg

SEQ ID NO: 493196 - DNA, 25 bp, Homo sapien
accacaatttatttttggatcaggc

SEQ ID NO: 493197 - DNA, 25 bp, Homo sapien
ttggatcaggcataaatctcccctc

SEQ ID NO: 493198 - DNA, 25 bp, Homo sapien
ggatcaggcataaatctcccctcag

SEQ ID NO: 493199 - DNA, 25 bp, Homo sapien
tcaaacttgccaccttctgggcgac

SEQ ID NO: 493200 - DNA, 25 bp, Homo sapien
ttgccaccttctgggcgaccaaaat

SEQ ID NO: 493201 - DNA, 25 bp, Homo sapien
accttctgggcgaccaaaattcaca

SEQ ID NO: 493202 - DNA, 25 bp, Homo sapien
tctgggcgaccaaaattcacaaaag

SEQ ID NO: 493203 - DNA, 25 bp, Homo sapien
tgggcgaccaaaattcacaaaaggg

SEQ ID NO: 493204 - DNA, 25 bp, Homo sapien
ctgtatcgaaactgaatcaggtatg

SEQ ID NO: 493205 - DNA, 25 bp, Homo sapien
atcaggtatgattctgtaaccatgg

SEQ ID NO: 493206 - DNA, 25 bp, Homo sapien
tgaacaacaatgctattccgccctc

SEQ ID NO: 493207 - DNA, 25 bp, Homo sapien
ttggccatctggtagttttgtaaat

SEQ ID NO: 493208 - DNA, 25 bp, Homo sapien
gtaaattcaagcatagctccttcta

SEQ ID NO: 493209 - DNA, 25 bp, Homo sapien
caagcatagctccttctatggcctt

SEQ ID NO: 493210 - DNA, 25 bp, Homo sapien
ctcctttccctgcacagtagagagg

SEQ ID NO: 493211 - DNA, 25 bp, Homo sapien
ggacttttattggattgtgtttgta

SEQ ID NO: 493212 - DNA, 25 bp, Homo sapien
gtattgtaattgtgtgtttttccag

SEQ ID NO: 493213 - DNA, 25 bp, Homo sapien
tttttccagatgtgttttctagcca

SEQ ID NO: 493214 - DNA, 25 bp, Homo sapien
agatgtgttttctagccacaggaag

SEQ ID NO: 493215 - DNA, 25 bp, Homo sapien
ctagccacaggaagagatactcaaa

SEQ ID NO: 493216 - DNA, 25 bp, Homo sapien
gatactcaaataagtctttcaacag

SEQ ID NO: 493217 - DNA, 25 bp, Homo sapien
gaaagttcccttctcaacatagcaa

SEQ ID NO: 493218 - DNA, 25 bp, Homo sapien
tctcaacatagcaacgttagcaccc

SEQ ID NO: 493219 - DNA, 25 bp, Homo sapien
actgggaattctgccactatccagc

SEQ ID NO: 493220 - DNA, 25 bp, Homo sapien
gacagagcagtctaaaaagtggctt

SEQ ID NO: 493221 - DNA, 25 bp, Homo sapien
aagtggcttaaaacgtgctcagatt

SEQ ID NO: 493222 - DNA, 25 bp, Homo sapien
gctcagatttgttacctgatcctca

SEQ ID NO: 493223 - DNA, 25 bp, Homo sapien
gcccctagtggcaaattgacttaaa

SEQ ID NO: 493224 - DNA, 25 bp, Homo sapien
attagccatttgtagccagcaggtg

SEQ ID NO: 493225 - DNA, 25 bp, Homo sapien
atttgtagccagcaggtgttaatta

SEQ ID NO: 493226 - DNA, 25 bp, Homo sapien
aactgtccagtactgcatttcaggg

SEQ ID NO: 493227 - DNA, 25 bp, Homo sapien
gtactgcatttcagggaagcatgaa

SEQ ID NO: 493228 - DNA, 25 bp, Homo sapien
ggacttacttaatgtcacctgcatt

SEQ ID NO: 493229 - DNA, 25 bp, Homo sapien
gagaacactgcctttggaatcatgc

SEQ ID NO: 493230 - DNA, 25 bp, Homo sapien
ttaagtaacttgctccaggccagcc

SEQ ID NO: 493231 - DNA, 25 bp, Homo sapien
gaatcatgcaaagctaggttcagtc

SEQ ID NO: 493232 - DNA, 25 bp, Homo sapien
tcgttctactacttatttctaccac

SEQ ID NO: 493233 - DNA, 25 bp, Homo sapien
tacttatttctaccactttgagcaa

SEQ ID NO: 493234 - DNA, 25 bp, Homo sapien
ggaggtgttgatagtagctcctaca

SEQ ID NO: 493235 - DNA, 25 bp, Homo sapien
agcctgctggtcattgatcaccctg

SEQ ID NO: 493236 - DNA, 25 bp, Homo sapien
gatcaccctggtttcaaaccctgtt

SEQ ID NO: 493237 - DNA, 25 bp, Homo sapien
ttagctccgagcttcctagttggga

SEQ ID NO: 493238 - DNA, 25 bp, Homo sapien
gagcttcctagttgggacttactta

SEQ ID NO: 493239 - DNA, 25 bp, Homo sapien
aaaccacagtatttctaggtcagta

SEQ ID NO: 493240 - DNA, 25 bp, Homo sapien
taggtcagtataacacacctgcccc

SEQ ID NO: 493241 - DNA, 25 bp, Homo sapien
acctgccccagggacttacaggtgt

SEQ ID NO: 493242 - DNA, 25 bp, Homo sapien
ttcctcccttcactacgttttagat

SEQ ID NO: 493243 - DNA, 25 bp, Homo sapien
ctcccttcactacgttttagattct

SEQ ID NO: 493244 - DNA, 25 bp, Homo sapien
tcattcctgtcattaccatgctaac

SEQ ID NO: 493245 - DNA, 25 bp, Homo sapien
ctgttgggcaggtatgagcggcttg

SEQ ID NO: 493246 - DNA, 25 bp, Homo sapien
atgagcggcttgctggctgttcttc

SEQ ID NO: 493247 - DNA, 25 bp, Homo sapien
gttcttccttgccttttggtctgtt

SEQ ID NO: 493248 - DNA, 25 bp, Homo sapien
cttttggtctgtttctacttagctg

SEQ ID NO: 493249 - DNA, 25 bp, Homo sapien
gtctgtttctacttagctgactcct

SEQ ID NO: 493250 - DNA, 25 bp, Homo sapien
accaccagtctgatcagctgccatt

SEQ ID NO: 493251 - DNA, 25 bp, Homo sapien
ttctctcgccgctcttaggggaaaa

SEQ ID NO: 493252 - DNA, 25 bp, Homo sapien
aactgtacacattagcaacttcccc

SEQ ID NO: 493253 - DNA, 25 bp, Homo sapien
aacaacacattcttcatgatatcta

SEQ ID NO: 493254 - DNA, 25 bp, Homo sapien
cacattcttcatgatatctaagaga

SEQ ID NO: 493255 - DNA, 25 bp, Homo sapien
acacataatttgttatacttagagc

SEQ ID NO: 493256 - DNA, 25 bp, Homo sapien
ttagagctaagagattttcaatttc

SEQ ID NO: 493257 - DNA, 25 bp, Homo sapien
aattcaaatcgttcctttatcaaat

SEQ ID NO: 493258 - DNA, 25 bp, Homo sapien
caaatgtggaaagtgaggtctagag

SEQ ID NO: 493259 - DNA, 25 bp, Homo sapien
ggtctagagaggttatatgccttac

SEQ ID NO: 493260 - DNA, 25 bp, Homo sapien
agagaggttatatgccttacttatg

SEQ ID NO: 493261 - DNA, 25 bp, Homo sapien
gtctacttttagagagcactagcca

SEQ ID NO: 493262 - DNA, 25 bp, Homo sapien
gagcactagccagtatatgaccatg

SEQ ID NO: 493263 - DNA, 25 bp, Homo sapien
gtatatgaccatgtgattaatttct

SEQ ID NO: 493264 - DNA, 25 bp, Homo sapien
cactagataaaattacctggttcaa

SEQ ID NO: 493265 - DNA, 25 bp, Homo sapien
acacagacaggatagtttttatgct

SEQ ID NO: 493266 - DNA, 25 bp, Homo sapien
gaagtttttggccagctttagtttg

SEQ ID NO: 493267 - DNA, 25 bp, Homo sapien
gccagctttagtttgaggactcctt

SEQ ID NO: 493268 - DNA, 25 bp, Homo sapien
gaggactccttgataagcttgctaa

SEQ ID NO: 493269 - DNA, 25 bp, Homo sapien
gcttgctaaactttcagagtgccct

SEQ ID NO: 493270 - DNA, 25 bp, Homo sapien
aactttcagagtgccctgagacact

SEQ ID NO: 493271 - DNA, 25 bp, Homo sapien
agtgccctgagacacttccagccat

SEQ ID NO: 493272 - DNA, 25 bp, Homo sapien
aaccttgtcgtctggctccgagcct

SEQ ID NO: 493273 - DNA, 25 bp, Homo sapien
tccgagcctctgctgtgcgcaacag

SEQ ID NO: 493274 - DNA, 25 bp, Homo sapien
gtgcgcaacagcctctgtcccatgt

SEQ ID NO: 493275 - DNA, 25 bp, Homo sapien
atgtgctgccgtgagcccgacctgg

SEQ ID NO: 493276 - DNA, 25 bp, Homo sapien
atgagggcttcggtgatggcttcac

SEQ ID NO: 493277 - DNA, 25 bp, Homo sapien
tcggtgatggcttcacccgagagga

SEQ ID NO: 493278 - DNA, 25 bp, Homo sapien
agcccgccacggtggatgtatgtgc

SEQ ID NO: 493279 - DNA, 25 bp, Homo sapien
ccacggtggatgtatgtgcgctcac

SEQ ID NO: 493280 - DNA, 25 bp, Homo sapien
gatgtatgtgcgctcacctgagctt

SEQ ID NO: 493281 - DNA, 25 bp, Homo sapien
acctgagcttgcttgggcccagtgt

SEQ ID NO: 493282 - DNA, 25 bp, Homo sapien
gcagaaataaaatccccgcagccta

SEQ ID NO: 493283 - DNA, 25 bp, Homo sapien
cttcaacttggatgggaaagacttc

SEQ ID NO: 493284 - DNA, 25 bp, Homo sapien
ggaaagacttcctccaaggaccagt

SEQ ID NO: 493285 - DNA, 25 bp, Homo sapien
ctgctgggtctgtcaaaagaaagaa

SEQ ID NO: 493286 - DNA, 25 bp, Homo sapien
aagaaaaccctctgtgcacgttgtc

SEQ ID NO: 493287 - DNA, 25 bp, Homo sapien
gcacgttgtcatgaacttgccagca

SEQ ID NO: 493288 - DNA, 25 bp, Homo sapien
gtttcttagtgctttcaagtggctt

SEQ ID NO: 493289 - DNA, 25 bp, Homo sapien
ttcaagtggcttttagatgggcagc

SEQ ID NO: 493290 - DNA, 25 bp, Homo sapien
agcagtgagttccttcccatagtgc

SEQ ID NO: 493291 - DNA, 25 bp, Homo sapien
gttccttcccatagtgcattgttat

SEQ ID NO: 493292 - DNA, 25 bp, Homo sapien
gcttttccaaagatgctaaccctgc

SEQ ID NO: 493293 - DNA, 25 bp, Homo sapien
aaccctgctgaggatgttcggcaaa

SEQ ID NO: 493294 - DNA, 25 bp, Homo sapien
atccttttgggcagcctgaagactg

SEQ ID NO: 493295 - DNA, 25 bp, Homo sapien
tccttttgggcagcctgaagactgg

SEQ ID NO: 493296 - DNA, 25 bp, Homo sapien
ccttttgggcagcctgaagactggg

SEQ ID NO: 493297 - DNA, 25 bp, Homo sapien
tccacccacattccacttacccttt

SEQ ID NO: 493298 - DNA, 25 bp, Homo sapien
atcccagttggtaacattcccacct

SEQ ID NO: 493299 - DNA, 25 bp, Homo sapien
tcccagttggtaacattcccacctg

SEQ ID NO: 493300 - DNA, 25 bp, Homo sapien
cccagttggtaacattcccacctga

SEQ ID NO: 493301 - DNA, 25 bp, Homo sapien
ccagttggtaacattcccacctgat

SEQ ID NO: 493302 - DNA, 25 bp, Homo sapien
cagttggtaacattcccacctgatt

SEQ ID NO: 493303 - DNA, 25 bp, Homo sapien
gctgctgcagctgagttctggtttt

SEQ ID NO: 493304 - DNA, 25 bp, Homo sapien
tcacacacgtgcggccaggaggctg

SEQ ID NO: 493305 - DNA, 25 bp, Homo sapien
ttctattaaggcagtgtttcctaaa

SEQ ID NO: 493306 - DNA, 25 bp, Homo sapien
taaggcagtgtttcctaaatgtatt

SEQ ID NO: 493307 - DNA, 25 bp, Homo sapien
gtatttgacctcagtatcctttcta

SEQ ID NO: 493308 - DNA, 25 bp, Homo sapien
gtatcctttctatttacatcccaca

SEQ ID NO: 493309 - DNA, 25 bp, Homo sapien
atcctttctatttacatcccacaga

SEQ ID NO: 493310 - DNA, 25 bp, Homo sapien
cctttctatttacatcccacagaac

SEQ ID NO: 493311 - DNA, 25 bp, Homo sapien
acatcccacagaactggtgactatg

SEQ ID NO: 493312 - DNA, 25 bp, Homo sapien
gaactggtgactatgaaacactctg

SEQ ID NO: 493313 - DNA, 25 bp, Homo sapien
gaaacactctggtgaacactgggtt

SEQ ID NO: 493314 - DNA, 25 bp, Homo sapien
aacactctggtgaacactgggttag

SEQ ID NO: 493315 - DNA, 25 bp, Homo sapien
ctggtgaacactgggttagagagta

SEQ ID NO: 493316 - DNA, 25 bp, Homo sapien
gaatttactgaacaccaagcactat

SEQ ID NO: 493317 - DNA, 25 bp, Homo sapien
ttactgaacaccaagcactatgttg

SEQ ID NO: 493318 - DNA, 25 bp, Homo sapien
acaccaagcactatgttgaatccat

SEQ ID NO: 493319 - DNA, 25 bp, Homo sapien
gcactatgttgaatccatgcaaatg

SEQ ID NO: 493320 - DNA, 25 bp, Homo sapien
aggtataagtaatcatcttcagatg

SEQ ID NO: 493321 - DNA, 25 bp, Homo sapien
gtacacaggaggatgtatgtaggtt

SEQ ID NO: 493322 - DNA, 25 bp, Homo sapien
accatataacccattctctataatg

SEQ ID NO: 493323 - DNA, 25 bp, Homo sapien
cattctctataatgggacttgagca

SEQ ID NO: 493324 - DNA, 25 bp, Homo sapien
gacttgagcacccatggattctgat

SEQ ID NO: 493325 - DNA, 25 bp, Homo sapien
cttgagcacccatggattctgatat

SEQ ID NO: 493326 - DNA, 25 bp, Homo sapien
tgagcacccatggattctgatatca

SEQ ID NO: 493327 - DNA, 25 bp, Homo sapien
ttctttccagagaacgtggttttca

SEQ ID NO: 493328 - DNA, 25 bp, Homo sapien
tatttttccctcaaaagagagtcaa

SEQ ID NO: 493329 - DNA, 25 bp, Homo sapien
gagagtcaaatactgacagattcgt

SEQ ID NO: 493330 - DNA, 25 bp, Homo sapien
cgttctaaatatattgtttctgtca

SEQ ID NO: 493331 - DNA, 25 bp, Homo sapien
atgaagacaccatgaatatactttt

SEQ ID NO: 493332 - DNA, 25 bp, Homo sapien
tctatatagttcagcaatggcctga

SEQ ID NO: 493333 - DNA, 25 bp, Homo sapien
agcaatggcctgaatagaagcaacc

SEQ ID NO: 493334 - DNA, 25 bp, Homo sapien
ctgaatagaagcaaccaggcaccat

SEQ ID NO: 493335 - DNA, 25 bp, Homo sapien
accaggcaccatctcagcaatgttt

SEQ ID NO: 493336 - DNA, 25 bp, Homo sapien
gcaccatctcagcaatgttttctct

SEQ ID NO: 493337 - DNA, 25 bp, Homo sapien
gtttgtaattatttgctcctttgaa

SEQ ID NO: 493338 - DNA, 25 bp, Homo sapien
ttggattattttgctgaagatgacc

SEQ ID NO: 493339 - DNA, 25 bp, Homo sapien
gatgaccagctctgagatgtgagga

SEQ ID NO: 493340 - DNA, 25 bp, Homo sapien
catttttaacagcagagtagcctta

SEQ ID NO: 493341 - DNA, 25 bp, Homo sapien
agcagagtagccttaaatgacctga

SEQ ID NO: 493342 - DNA, 25 bp, Homo sapien
gaaatgcatcatattcttctcagtg

SEQ ID NO: 493343 - DNA, 25 bp, Homo sapien
tgacctgattccacagaggagccag

SEQ ID NO: 493344 - DNA, 25 bp, Homo sapien
aggagccaggaaacagtatgaaact

SEQ ID NO: 493345 - DNA, 25 bp, Homo sapien
atcatattcttctcagtgtcctggt

SEQ ID NO: 493346 - DNA, 25 bp, Homo sapien
ttcttctcagtgtcctggtagtgca

SEQ ID NO: 493347 - DNA, 25 bp, Homo sapien
agtgtcctggtagtgcattttcctt

SEQ ID NO: 493348 - DNA, 25 bp, Homo sapien
gtttttcagtgaattctgttgtaag

SEQ ID NO: 493349 - DNA, 25 bp, Homo sapien
aacaattgctaatcatttcctgggt

SEQ ID NO: 493350 - DNA, 25 bp, Homo sapien
taatcatttcctgggttccacttac

SEQ ID NO: 493351 - DNA, 25 bp, Homo sapien
aaaagagtttgtgtgtggccaggac

SEQ ID NO: 493352 - DNA, 25 bp, Homo sapien
ggccaggactaaacagctgcttctt

SEQ ID NO: 493353 - DNA, 25 bp, Homo sapien
aagagatagcctgtctcactttcca

SEQ ID NO: 493354 - DNA, 25 bp, Homo sapien
tgtctcactttccagaggtagcagt

SEQ ID NO: 493355 - DNA, 25 bp, Homo sapien
actttccagaggtagcagtcactaa

SEQ ID NO: 493356 - DNA, 25 bp, Homo sapien
gtagcagtcactaatactgtggtga

SEQ ID NO: 493357 - DNA, 25 bp, Homo sapien
tactgtggtgagtgattttactcaa

SEQ ID NO: 493358 - DNA, 25 bp, Homo sapien
ttgagcaccaacaatgtcacaagca

SEQ ID NO: 493359 - DNA, 25 bp, Homo sapien
caacaatgtcacaagcactgtgcta

SEQ ID NO: 493360 - DNA, 25 bp, Homo sapien
gcgtgaatgtactaattttttccta

SEQ ID NO: 493361 - DNA, 25 bp, Homo sapien
gtcattcattgtacagctgctctgg

SEQ ID NO: 493362 - DNA, 25 bp, Homo sapien
acagttgtttgaaagtcagcctctc

SEQ ID NO: 493363 - DNA, 25 bp, Homo sapien
cagcctctcggctttgtttcatgtg

SEQ ID NO: 493364 - DNA, 25 bp, Homo sapien
atgtgactgctgacacttctcaagt

SEQ ID NO: 493365 - DNA, 25 bp, Homo sapien
caagtgttctttgcataatgaggct

SEQ ID NO: 493366 - DNA, 25 bp, Homo sapien
gaggctggattttgtgcttcatcgt

SEQ ID NO: 493367 - DNA, 25 bp, Homo sapien
gtgcttcatcgttcattttaaacaa

SEQ ID NO: 493368 - DNA, 25 bp, Homo sapien
gaaaagtctcatgtggaaaccaaag

SEQ ID NO: 493369 - DNA, 25 bp, Homo sapien
aagcaatctagaaacagcctgttgg

SEQ ID NO: 493370 - DNA, 25 bp, Homo sapien
ctgttgggtgactgtgtcttctgta

SEQ ID NO: 493371 - DNA, 25 bp, Homo sapien
gcacacattgacactttaatgtcct

SEQ ID NO: 493372 - DNA, 25 bp, Homo sapien
cactttaatgtcctgctgagatatt

SEQ ID NO: 493373 - DNA, 25 bp, Homo sapien
gctgagatatttcataatgccggat

SEQ ID NO: 493374 - DNA, 25 bp, Homo sapien
gatatttcataatgccggatattaa

SEQ ID NO: 493375 - DNA, 25 bp, Homo sapien
tcataatgccggatattaaaaacat

SEQ ID NO: 493376 - DNA, 25 bp, Homo sapien
tatcagctgagatatactctagtac

SEQ ID NO: 493377 - DNA, 25 bp, Homo sapien
tcagctgagatatactctagtacag

SEQ ID NO: 493378 - DNA, 25 bp, Homo sapien
tcaacgaaggatggattttgtccac

SEQ ID NO: 493379 - DNA, 25 bp, Homo sapien
aggaaaggtcttctgaactcgctcc

SEQ ID NO: 493380 - DNA, 25 bp, Homo sapien
aaaggtcttctgaactcgctcctct

SEQ ID NO: 493381 - DNA, 25 bp, Homo sapien
gtcttctgaactcgctcctctacat

SEQ ID NO: 493382 - DNA, 25 bp, Homo sapien
gaggtgctcggctggtaacgttaaa

SEQ ID NO: 493383 - DNA, 25 bp, Homo sapien
aagaaggaataaggcgcccgacaga

SEQ ID NO: 493384 - DNA, 25 bp, Homo sapien
ggcgcccgacagaaggcgtttgtct

SEQ ID NO: 493385 - DNA, 25 bp, Homo sapien
aaggcgtttgtctttgttgtggagc

SEQ ID NO: 493386 - DNA, 25 bp, Homo sapien
tgtctttgttgtggagcatcagcgt

SEQ ID NO: 493387 - DNA, 25 bp, Homo sapien
gcatcagcgttaaggacagccggct

SEQ ID NO: 493388 - DNA, 25 bp, Homo sapien
ctgctgtgggagcaatttcctgctg

SEQ ID NO: 493389 - DNA, 25 bp, Homo sapien
tgctcgcccgtgtgataggtttcca

SEQ ID NO: 493390 - DNA, 25 bp, Homo sapien
aggtttccacagtaatctttatgct

SEQ ID NO: 493391 - DNA, 25 bp, Homo sapien
cagaggtgctgtactgtgttcttgc

SEQ ID NO: 493392 - DNA, 25 bp, Homo sapien
tactgtgttcttgcaacggtggagg

SEQ ID NO: 493393 - DNA, 25 bp, Homo sapien
gtactacaaaaactattattcaatg

SEQ ID NO: 493394 - DNA, 25 bp, Homo sapien
atatgcttataattgaagtaacagc

SEQ ID NO: 493395 - DNA, 25 bp, Homo sapien
gaagtaacagcactatatttaattt

SEQ ID NO: 493396 - DNA, 25 bp, Homo sapien
gtacattaatacgtatgctctccag

SEQ ID NO: 493397 - DNA, 25 bp, Homo sapien
attaatacgtatgctctccagtttt

SEQ ID NO: 493398 - DNA, 25 bp, Homo sapien
atacgtatgctctccagttttatta

SEQ ID NO: 493399 - DNA, 25 bp, Homo sapien
acaaaataaacctctctggctggct

SEQ ID NO: 493400 - DNA, 25 bp, Homo sapien
aaaataaacctctctggctggctgg

SEQ ID NO: 493401 - DNA, 25 bp, Homo sapien
ataaacctctctggctggctggtga

SEQ ID NO: 493402 - DNA, 25 bp, Homo sapien
aaacctctctggctggctggtgaga

SEQ ID NO: 493403 - DNA, 25 bp, Homo sapien
acctctctggctggctggtgagaag

SEQ ID NO: 493404 - DNA, 25 bp, Homo sapien
tggcactcaaggctttggccttcaa

SEQ ID NO: 493405 - DNA, 25 bp, Homo sapien
caaggctttggccttcaacggctcc

SEQ ID NO: 493406 - DNA, 25 bp, Homo sapien
tcaacggctcccctttgcgctttga

SEQ ID NO: 493407 - DNA, 25 bp, Homo sapien
tttgcgctttgacaagtaccggaac

SEQ ID NO: 493408 - DNA, 25 bp, Homo sapien
gtaccggaactcagattttgcccat

SEQ ID NO: 493409 - DNA, 25 bp, Homo sapien
gaactcagattttgcccatctcatt

SEQ ID NO: 493410 - DNA, 25 bp, Homo sapien
gcccatctcattcccttgacaatgt

SEQ ID NO: 493411 - DNA, 25 bp, Homo sapien
gacaatgttataccccaagaaccac

SEQ ID NO: 493412 - DNA, 25 bp, Homo sapien
taccccaagaaccacttggatctca

SEQ ID NO: 493413 - DNA, 25 bp, Homo sapien
ttcctggcctatctcggactgagag

SEQ ID NO: 493414 - DNA, 25 bp, Homo sapien
ggcctatctcggactgagagaaaga

SEQ ID NO: 493415 - DNA, 25 bp, Homo sapien
tctgacataatatccctcaacttcc

SEQ ID NO: 493416 - DNA, 25 bp, Homo sapien
tcaacttccgcagcgcaagcatgat

SEQ ID NO: 493417 - DNA, 25 bp, Homo sapien
gcagcgcaagcatgatcagctcaga

SEQ ID NO: 493418 - DNA, 25 bp, Homo sapien
tgatcagctcagactgtgaacagtc

SEQ ID NO: 493419 - DNA, 25 bp, Homo sapien
acagtgccaatgaccgcgtgccgta

SEQ ID NO: 493420 - DNA, 25 bp, Homo sapien
gaccgcgtgccgtatggcatttctg

SEQ ID NO: 493421 - DNA, 25 bp, Homo sapien
gaaatgctagaatcatcaagtggtt

SEQ ID NO: 493422 - DNA, 25 bp, Homo sapien
catcaagtggttatatagcatcaaa

SEQ ID NO: 493423 - DNA, 25 bp, Homo sapien
gcatcaaacaagctagagagtcaca

SEQ ID NO: 493424 - DNA, 25 bp, Homo sapien
gtcacagaaggtctcccatgtgtaa

SEQ ID NO: 493425 - DNA, 25 bp, Homo sapien
tctcccatgtgtaagacagtgcgtg

SEQ ID NO: 493426 - DNA, 25 bp, Homo sapien
gaacgaaagcatttaactggccagt

SEQ ID NO: 493427 - DNA, 25 bp, Homo sapien
atttaactggccagttttgattgca

SEQ ID NO: 493428 - DNA, 25 bp, Homo sapien
aatgaagtcctgtgaggccttccta

SEQ ID NO: 493429 - DNA, 25 bp, Homo sapien
tgtgaggccttcctatctccaagtc

SEQ ID NO: 493430 - DNA, 25 bp, Homo sapien
aagtctatgtattttctggagacca

SEQ ID NO: 493431 - DNA, 25 bp, Homo sapien
tggagaccaaaccagataccagata

SEQ ID NO: 493432 - DNA, 25 bp, Homo sapien
ggcttaaaccaagaccttgtctaga

SEQ ID NO: 493433 - DNA, 25 bp, Homo sapien
gtttgttgccaaggtagcactgtga

SEQ ID NO: 493434 - DNA, 25 bp, Homo sapien
gagaaatctcacttggatgttatgt

SEQ ID NO: 493435 - DNA, 25 bp, Homo sapien
caacagtctgactatgagtgaggaa

SEQ ID NO: 493436 - DNA, 25 bp, Homo sapien
gaggaaaatatctgggtcttttcgt

SEQ ID NO: 493437 - DNA, 25 bp, Homo sapien
ggaacaattgcagtttcctcctacc

SEQ ID NO: 493438 - DNA, 25 bp, Homo sapien
tcctacccttcatatggtctgtgta

SEQ ID NO: 493439 - DNA, 25 bp, Homo sapien
aactgatgtttgcttaacttatttt

SEQ ID NO: 493440 - DNA, 25 bp, Homo sapien
aagataatcacttttgccatggtta

SEQ ID NO: 493441 - DNA, 25 bp, Homo sapien
ggttataatcaaatctaagctttca

SEQ ID NO: 493442 - DNA, 25 bp, Homo sapien
ctaagctttcagacttgagagccat

SEQ ID NO: 493443 - DNA, 25 bp, Homo sapien
aatatctttgtagtggatgctgcat

SEQ ID NO: 493444 - DNA, 25 bp, Homo sapien
ggatgctgcataattacattcactt

SEQ ID NO: 493445 - DNA, 25 bp, Homo sapien
acattcacttctcttagactgtaaa

SEQ ID NO: 493446 - DNA, 25 bp, Homo sapien
gaatttatggtttaggctctgcaat

SEQ ID NO: 493447 - DNA, 25 bp, Homo sapien
taggctctgcaattagaggaacaat

SEQ ID NO: 493448 - DNA, 25 bp, Homo sapien
atatataatacctaacaagctgtaa

SEQ ID NO: 493449 - DNA, 25 bp, Homo sapien
tttcccaattcatgtacaaatctca

SEQ ID NO: 493450 - DNA, 25 bp, Homo sapien
atgtatatagcataatttcctggag

SEQ ID NO: 493451 - DNA, 25 bp, Homo sapien
gcataatttcctggagaacacaaat

SEQ ID NO: 493452 - DNA, 25 bp, Homo sapien
ctggagaacacaaattttgcagtga

SEQ ID NO: 493453 - DNA, 25 bp, Homo sapien
ttgcagtaagcatcagtttagccta

SEQ ID NO: 493454 - DNA, 25 bp, Homo sapien
gtaagcatcagtttagcctagagat

SEQ ID NO: 493455 - DNA, 25 bp, Homo sapien
cagtttagcctagagatgttgatct

SEQ ID NO: 493456 - DNA, 25 bp, Homo sapien
gcctagagatgttgatctttatttt

SEQ ID NO: 493457 - DNA, 25 bp, Homo sapien
attatttttcaccattctcattttc

SEQ ID NO: 493458 - DNA, 25 bp, Homo sapien
tttttcaccattctcattttcttca

SEQ ID NO: 493459 - DNA, 25 bp, Homo sapien
cctggcctggtgtttctttaggtat

SEQ ID NO: 493460 - DNA, 25 bp, Homo sapien
ggcctggtgtttctttaggtataat

SEQ ID NO: 493461 - DNA, 25 bp, Homo sapien
ggtgtttctttaggtataatgtctt

SEQ ID NO: 493462 - DNA, 25 bp, Homo sapien
gtataatgtctttaccagagagcta

SEQ ID NO: 493463 - DNA, 25 bp, Homo sapien
atgtctttaccagagagctaatgca

SEQ ID NO: 493464 - DNA, 25 bp, Homo sapien
ctttaccagagagctaatgcagact

SEQ ID NO: 493465 - DNA, 25 bp, Homo sapien
gactgtcatgggtgagattgttctc

SEQ ID NO: 493466 - DNA, 25 bp, Homo sapien
gtcatgggtgagattgttctctgat

SEQ ID NO: 493467 - DNA, 25 bp, Homo sapien
gtgagattgttctctgatgttcaat

SEQ ID NO: 493468 - DNA, 25 bp, Homo sapien
gattgttctctgatgttcaattccc

SEQ ID NO: 493469 - DNA, 25 bp, Homo sapien
ttgttctctgatgttcaattcccct

SEQ ID NO: 493470 - DNA, 25 bp, Homo sapien
ttctgtgagtctgtggtctttgcat

SEQ ID NO: 493471 - DNA, 25 bp, Homo sapien
tgtggtctttgcatcagcctccatc

SEQ ID NO: 493472 - DNA, 25 bp, Homo sapien
tttctgttaacatccaggacttggc

SEQ ID NO: 493473 - DNA, 25 bp, Homo sapien
ctgcgccggctttctgtttggtgtg

SEQ ID NO: 493474 - DNA, 25 bp, Homo sapien
tctgtttggtgtggccaacacagcc

SEQ ID NO: 493475 - DNA, 25 bp, Homo sapien
taggcggctacttgatggagaccac

SEQ ID NO: 493476 - DNA, 25 bp, Homo sapien
tacttgatggagaccacgggctcct

SEQ ID NO: 493477 - DNA, 25 bp, Homo sapien
tggacttgcctgttcaaccttgtgg

SEQ ID NO: 493478 - DNA, 25 bp, Homo sapien
ttgtggccatcatcagcaacctggg

SEQ ID NO: 493479 - DNA, 25 bp, Homo sapien
ttcctggtgtttggacaggctcaga

SEQ ID NO: 493480 - DNA, 25 bp, Homo sapien
agagggtggacctgagctctaccca

SEQ ID NO: 493481 - DNA, 25 bp, Homo sapien
gggtgacagcaaggcgccatctcaa

SEQ ID NO: 493482 - DNA, 25 bp, Homo sapien
gtgacagcaaggcgccatctcaaaa

SEQ ID NO: 493483 - DNA, 25 bp, Homo sapien
aatagaatacaattgtgggagactt

SEQ ID NO: 493484 - DNA, 25 bp, Homo sapien
gaatacaattgtgggagactttaat

SEQ ID NO: 493485 - DNA, 25 bp, Homo sapien
atacaattgtgggagactttaatac

SEQ ID NO: 493486 - DNA, 25 bp, Homo sapien
caattgtgggagactttaatacatc

SEQ ID NO: 493487 - DNA, 25 bp, Homo sapien
ttgtgggagactttaatacatcttg

SEQ ID NO: 493488 - DNA, 25 bp, Homo sapien
tgggagactttaatacatcttgaaa

SEQ ID NO: 493489 - DNA, 25 bp, Homo sapien
aagacttgattcattttcatagaaa

SEQ ID NO: 493490 - DNA, 25 bp, Homo sapien
gtatttggccatcttttataataat

SEQ ID NO: 493491 - DNA, 25 bp, Homo sapien
taaaaagagctatcattaaagcaag

SEQ ID NO: 493492 - DNA, 25 bp, Homo sapien
gaataaatatgttctatctaataca

SEQ ID NO: 493493 - DNA, 25 bp, Homo sapien
taaatatgttctatctaatacatgg

SEQ ID NO: 493494 - DNA, 25 bp, Homo sapien
aaatatgttctatctaatacatggg

SEQ ID NO: 493495 - DNA, 25 bp, Homo sapien
atatgttctatctaatacatgggac

SEQ ID NO: 493496 - DNA, 25 bp, Homo sapien
tatgttctatctaatacatgggaca

SEQ ID NO: 493497 - DNA, 25 bp, Homo sapien
atgttctatctaatacatgggacag

SEQ ID NO: 493498 - DNA, 25 bp, Homo sapien
tgttctatctaatacatgggacaga

SEQ ID NO: 493499 - DNA, 25 bp, Homo sapien
gttctatctaatacatgggacagat

SEQ ID NO: 493500 - DNA, 25 bp, Homo sapien
ttctatctaatacatgggacagatg

SEQ ID NO: 493501 - DNA, 25 bp, Homo sapien
tctatctaatacatgggacagatgt

SEQ ID NO: 493502 - DNA, 25 bp, Homo sapien
ctatctaatacatgggacagatgtt

SEQ ID NO: 493503 - DNA, 25 bp, Homo sapien
agcttctgtgagtctgtggtctttg

SEQ ID NO: 493504 - DNA, 25 bp, Homo sapien
ttctgtgagtctgtggtctttgcat

SEQ ID NO: 493505 - DNA, 25 bp, Homo sapien
ctgtggtctttgcatcagcctccat

SEQ ID NO: 493506 - DNA, 25 bp, Homo sapien
tggtctttgcatcagcctccatcgg

SEQ ID NO: 493507 - DNA, 25 bp, Homo sapien
gcctccagaccttcaaccacagtgg

SEQ ID NO: 493508 - DNA, 25 bp, Homo sapien
tttctgttaacatccaggacttggc

SEQ ID NO: 493509 - DNA, 25 bp, Homo sapien
gtcctgcgccggctttctgtttggt

SEQ ID NO: 493510 - DNA, 25 bp, Homo sapien
ctgcgccggctttctgtttggtgtg

SEQ ID NO: 493511 - DNA, 25 bp, Homo sapien
ccggctttctgtttggtgtggccaa

SEQ ID NO: 493512 - DNA, 25 bp, Homo sapien
gctttctgtttggtgtggccaacac

SEQ ID NO: 493513 - DNA, 25 bp, Homo sapien
tctgtttggtgtggccaacacagcc

SEQ ID NO: 493514 - DNA, 25 bp, Homo sapien
agaacatcctcagggcctgcgtggg

SEQ ID NO: 493515 - DNA, 25 bp, Homo sapien
ccacatgctcctggaacacaaaatg

SEQ ID NO: 493516 - DNA, 25 bp, Homo sapien
aacacaaaatggagcgcccagggcc

SEQ ID NO: 493517 - DNA, 25 bp, Homo sapien
gggcccagcctcaagcgagttggac

SEQ ID NO: 493518 - DNA, 25 bp, Homo sapien
tcaagcgagttggacccgtggctgc

SEQ ID NO: 493519 - DNA, 25 bp, Homo sapien
gccacctaccctatgttgaacaaga

SEQ ID NO: 493520 - DNA, 25 bp, Homo sapien
tgccaccaatggctgcaccggtgat

SEQ ID NO: 493521 - DNA, 25 bp, Homo sapien
gctgcaccggtgatgccaatgggca

SEQ ID NO: 493522 - DNA, 25 bp, Homo sapien
tgccaatgggcatctgcaagaggag

SEQ ID NO: 493523 - DNA, 25 bp, Homo sapien
tgaggccccggtcacacagtttctc

SEQ ID NO: 493524 - DNA, 25 bp, Homo sapien
gtcacacagtttctcggctcttcct

SEQ ID NO: 493525 - DNA, 25 bp, Homo sapien
cccttgggcactggtgagcgttgga

SEQ ID NO: 493526 - DNA, 25 bp, Homo sapien
ccttgggcactggtgagcgttggaa

SEQ ID NO: 493527 - DNA, 25 bp, Homo sapien
cttgggcactggtgagcgttggaac

SEQ ID NO: 493528 - DNA, 25 bp, Homo sapien
gcactggtgagcgttggaaccttgt

SEQ ID NO: 493529 - DNA, 25 bp, Homo sapien
cactggtgagcgttggaaccttgtc

SEQ ID NO: 493530 - DNA, 25 bp, Homo sapien
actggtgagcgttggaaccttgtcg

SEQ ID NO: 493531 - DNA, 25 bp, Homo sapien
ctggtgagcgttggaaccttgtcgt

SEQ ID NO: 493532 - DNA, 25 bp, Homo sapien
tggtgagcgttggaaccttgtcgtc

SEQ ID NO: 493533 - DNA, 25 bp, Homo sapien
ggtgagcgttggaaccttgtcgtct

SEQ ID NO: 493534 - DNA, 25 bp, Homo sapien
gtgagcgttggaaccttgtcgtctg

SEQ ID NO: 493535 - DNA, 25 bp, Homo sapien
tgagcgttggaaccttgtcgtctgg

SEQ ID NO: 493536 - DNA, 25 bp, Homo sapien
tgtccacgtgagactgcccagagac

SEQ ID NO: 493537 - DNA, 25 bp, Homo sapien
agagacagcagagctccacgtggtt

SEQ ID NO: 493538 - DNA, 25 bp, Homo sapien
gcagagctccacgtggttttaaggg

SEQ ID NO: 493539 - DNA, 25 bp, Homo sapien
gccgtatctcatgaccaggtgctaa

SEQ ID NO: 493540 - DNA, 25 bp, Homo sapien
gaccaggtgctaaatgacccgacat

SEQ ID NO: 493541 - DNA, 25 bp, Homo sapien
taaatgacccgacatgcatcacctg

SEQ ID NO: 493542 - DNA, 25 bp, Homo sapien
gcatcacctgcctttcgatgaccaa

SEQ ID NO: 493543 - DNA, 25 bp, Homo sapien
tggcgtctcacggtgatgcctgctc

SEQ ID NO: 493544 - DNA, 25 bp, Homo sapien
atgcctgctcctgacattggtgttc

SEQ ID NO: 493545 - DNA, 25 bp, Homo sapien
attggtgttcactgtagcaaactac

SEQ ID NO: 493546 - DNA, 25 bp, Homo sapien
tctggatgggaattttcatgtacat

SEQ ID NO: 493547 - DNA, 25 bp, Homo sapien
atccatgtcacaagggtaaagctta

SEQ ID NO: 493548 - DNA, 25 bp, Homo sapien
ggaacgccagggtgtaggatataaa

SEQ ID NO: 493549 - DNA, 25 bp, Homo sapien
aggatataaaaacgcactcttgaga

SEQ ID NO: 493550 - DNA, 25 bp, Homo sapien
gtgctgaaaacttgcatggtgcttt

SEQ ID NO: 493551 - DNA, 25 bp, Homo sapien
tggtgctttcagacattagccttgt

SEQ ID NO: 493552 - DNA, 25 bp, Homo sapien
cagacattagccttgttcaacaaat

SEQ ID NO: 493553 - DNA, 25 bp, Homo sapien
gtattgacagatccatagtgtgcat

SEQ ID NO: 493554 - DNA, 25 bp, Homo sapien
atccatagtgtgcatgggcagacac

SEQ ID NO: 493555 - DNA, 25 bp, Homo sapien
ggcagacacattttgcctctatgtc

SEQ ID NO: 493556 - DNA, 25 bp, Homo sapien
tttccagtaatcctaatttgcacga

SEQ ID NO: 493557 - DNA, 25 bp, Homo sapien
ttgcacgaagatataatgtccacat

SEQ ID NO: 493558 - DNA, 25 bp, Homo sapien
gggagcgatctctgaaatcgcccat

SEQ ID NO: 493559 - DNA, 25 bp, Homo sapien
gatctctgaaatcgcccattcagtc

SEQ ID NO: 493560 - DNA, 25 bp, Homo sapien
tgaaatcgcccattcagtccgactt

SEQ ID NO: 493561 - DNA, 25 bp, Homo sapien
aatcgcccattcagtccgacttgga

SEQ ID NO: 493562 - DNA, 25 bp, Homo sapien
ttcagtccgacttggatgcgttcca

SEQ ID NO: 493563 - DNA, 25 bp, Homo sapien
gacttggatgcgttccactcgggat

SEQ ID NO: 493564 - DNA, 25 bp, Homo sapien
gatgcgttccactcgggatttcaaa

SEQ ID NO: 493565 - DNA, 25 bp, Homo sapien
ttccactcgggatttcaaacatgcg

SEQ ID NO: 493566 - DNA, 25 bp, Homo sapien
actcgggatttcaaacatgcgccaa

SEQ ID NO: 493567 - DNA, 25 bp, Homo sapien
tcgggatttcaaacatgcgccaaag

SEQ ID NO: 493568 - DNA, 25 bp, Homo sapien
gatttcaaacatgcgccaaagaagt

SEQ ID NO: 493569 - DNA, 25 bp, Homo sapien
tgcactcaccaattgagccagctta

SEQ ID NO: 493570 - DNA, 25 bp, Homo sapien
ttgagccagcttataaactacccct

SEQ ID NO: 493571 - DNA, 25 bp, Homo sapien
tataaactacccctgctctaaacag

SEQ ID NO: 493572 - DNA, 25 bp, Homo sapien
actcatggagaagtcaaaccacagt

SEQ ID NO: 493573 - DNA, 25 bp, Homo sapien
aaacaggctatcctatccagcaagg

SEQ ID NO: 493574 - DNA, 25 bp, Homo sapien
atcctatccagcaaggtcactcaat

SEQ ID NO: 493575 - DNA, 25 bp, Homo sapien
gtcactcaatcctgtgaacagccag

SEQ ID NO: 493576 - DNA, 25 bp, Homo sapien
agaaaatgctgacacacctgacctt

SEQ ID NO: 493577 - DNA, 25 bp, Homo sapien
gcagttctacagaagaccaatttgt

SEQ ID NO: 493578 - DNA, 25 bp, Homo sapien
gaagcacaggaccttcaagtcacat

SEQ ID NO: 493579 - DNA, 25 bp, Homo sapien
caggaccttcaagtcacatggttac

SEQ ID NO: 493580 - DNA, 25 bp, Homo sapien
cccctgttctcttttgacactgaac

SEQ ID NO: 493581 - DNA, 25 bp, Homo sapien
tttttattatcatgatccctttatg

SEQ ID NO: 493582 - DNA, 25 bp, Homo sapien
gatccctttatgatatcaaactgaa

SEQ ID NO: 493583 - DNA, 25 bp, Homo sapien
ttataatcactaaatctcccatacc

SEQ ID NO: 493584 - DNA, 25 bp, Homo sapien
atacagatgagggattcttttatca

SEQ ID NO: 493585 - DNA, 25 bp, Homo sapien
tatcatgtagtgctttgaactatct

SEQ ID NO: 493586 - DNA, 25 bp, Homo sapien
gaactatctcaaatataggcaccca

SEQ ID NO: 493587 - DNA, 25 bp, Homo sapien
ggcaggaagtaagtgcccatcagga

SEQ ID NO: 493588 - DNA, 25 bp, Homo sapien
ggacaaaaggccttatctaccactt

SEQ ID NO: 493589 - DNA, 25 bp, Homo sapien
atctaccactttcttgtcatgcttt

SEQ ID NO: 493590 - DNA, 25 bp, Homo sapien
gtcatgctttcttttcaatcttttc

SEQ ID NO: 493591 - DNA, 25 bp, Homo sapien
gatgcaaagcacgttaatgtcattg

SEQ ID NO: 493592 - DNA, 25 bp, Homo sapien
caggaaatgccagcattggaatctt

SEQ ID NO: 493593 - DNA, 25 bp, Homo sapien
ggaatcttgtggcattagtaactac

SEQ ID NO: 493594 - DNA, 25 bp, Homo sapien
gtggcattagtaactaccttctttc

SEQ ID NO: 493595 - DNA, 25 bp, Homo sapien
gcattagtaactaccttctttctta

SEQ ID NO: 493596 - DNA, 25 bp, Homo sapien
tagtaactaccttctttcttataat

SEQ ID NO: 493597 - DNA, 25 bp, Homo sapien
ctaccttctttcttataatatgtgg

SEQ ID NO: 493598 - DNA, 25 bp, Homo sapien
atgtggaaggtactagtgaattctt

SEQ ID NO: 493599 - DNA, 25 bp, Homo sapien
ttcttttaaaagcaataccttagag

SEQ ID NO: 493600 - DNA, 25 bp, Homo sapien
taccttagagttagaacactatgtt

SEQ ID NO: 493601 - DNA, 25 bp, Homo sapien
agaacactatgttctttgcccaggg

SEQ ID NO: 493602 - DNA, 25 bp, Homo sapien
atctattggagaactggtgtacagg

SEQ ID NO: 493603 - DNA, 25 bp, Homo sapien
agaactggtgtacaggaggaacatt

SEQ ID NO: 493604 - DNA, 25 bp, Homo sapien
aaataaaagcatccctaatgttctt

SEQ ID NO: 493605 - DNA, 25 bp, Homo sapien
taatgttcttcctctagtcagtttg

SEQ ID NO: 493606 - DNA, 25 bp, Homo sapien
gttcttcctctagtcagtttgcttt

SEQ ID NO: 493607 - DNA, 25 bp, Homo sapien
ggaaattagtacagttctacaggaa

SEQ ID NO: 493608 - DNA, 25 bp, Homo sapien
tagtacagttctacaggaagccaga

SEQ ID NO: 493609 - DNA, 25 bp, Homo sapien
ggaagccagaagactgtactgtctg

SEQ ID NO: 493610 - DNA, 25 bp, Homo sapien
agaagactgtactgtctgtccacac

SEQ ID NO: 493611 - DNA, 25 bp, Homo sapien
agactgtactgtctgtccacaccat

SEQ ID NO: 493612 - DNA, 25 bp, Homo sapien
gtactgtctgtccacaccatggtct

SEQ ID NO: 493613 - DNA, 25 bp, Homo sapien
agacagaatccctcagaatctcaca

SEQ ID NO: 493614 - DNA, 25 bp, Homo sapien
aatctcacacttataacttcctacc

SEQ ID NO: 493615 - DNA, 25 bp, Homo sapien
acttcctaccttttacttgaatgct

SEQ ID NO: 493616 - DNA, 25 bp, Homo sapien
gaatgctttgccatattcaggacag

SEQ ID NO: 493617 - DNA, 25 bp, Homo sapien
gccatattcaggacagagactctca

SEQ ID NO: 493618 - DNA, 25 bp, Homo sapien
agagactctcacaaagttcagaaaa

SEQ ID NO: 493619 - DNA, 25 bp, Homo sapien
gaggacctattttctctggtagtgg

SEQ ID NO: 493620 - DNA, 25 bp, Homo sapien
gtggttgattactacattattttct

SEQ ID NO: 493621 - DNA, 25 bp, Homo sapien
acattattttcttaagtggctggtt

SEQ ID NO: 493622 - DNA, 25 bp, Homo sapien
gtggctggttttttagttactatgt

SEQ ID NO: 493623 - DNA, 25 bp, Homo sapien
ggtcgtttttctgttaatgatgcta

SEQ ID NO: 493624 - DNA, 25 bp, Homo sapien
aaaatatcgatggatgggaaggcaa

SEQ ID NO: 493625 - DNA, 25 bp, Homo sapien
aatgaattcattatggagggaccat

SEQ ID NO: 493626 - DNA, 25 bp, Homo sapien
aattcattatggagggaccattgac

SEQ ID NO: 493627 - DNA, 25 bp, Homo sapien
gaccattgacaagaatcggtgccaa

SEQ ID NO: 493628 - DNA, 25 bp, Homo sapien
aagaatcggtgccaaacatgaacgg

SEQ ID NO: 493629 - DNA, 25 bp, Homo sapien
aaacatgaacggcatatttttctgt

SEQ ID NO: 493630 - DNA, 25 bp, Homo sapien
gatcagttgtaaacctaatcatggc

SEQ ID NO: 493631 - DNA, 25 bp, Homo sapien
gtaaacctaatcatggccagactcg

SEQ ID NO: 493632 - DNA, 25 bp, Homo sapien
aaacctaatcatggccagactcggc

SEQ ID NO: 493633 - DNA, 25 bp, Homo sapien
acttgtgagcacaagcatgcatttg

SEQ ID NO: 493634 - DNA, 25 bp, Homo sapien
aagcatgcatttgaattagtatcca

SEQ ID NO: 493635 - DNA, 25 bp, Homo sapien
ggagacatgatttattgcagccatc

SEQ ID NO: 493636 - DNA, 25 bp, Homo sapien
atttattgcagccatccatcttggg

SEQ ID NO: 493637 - DNA, 25 bp, Homo sapien
atcacacccgggttgctaggagatt

SEQ ID NO: 493638 - DNA, 25 bp, Homo sapien
ctaggagattgtggcagcagctgtt

SEQ ID NO: 493639 - DNA, 25 bp, Homo sapien
gtggcagcagctgtttgctctgaat

SEQ ID NO: 493640 - DNA, 25 bp, Homo sapien
gttgtcaatcatcaaaggcaggtga

SEQ ID NO: 493641 - DNA, 25 bp, Homo sapien
aaggcaggtgaatagcattagaaac

SEQ ID NO: 493642 - DNA, 25 bp, Homo sapien
agcattagaaacacgctattgtcag

SEQ ID NO: 493643 - DNA, 25 bp, Homo sapien
gaaacacgctattgtcagacggaat

SEQ ID NO: 493644 - DNA, 25 bp, Homo sapien
cacgctattgtcagacggaataatt

SEQ ID NO: 493645 - DNA, 25 bp, Homo sapien
caagtacttgctctgggttgcctgt

SEQ ID NO: 493646 - DNA, 25 bp, Homo sapien
aggaagtggccctcagagtcaagga

SEQ ID NO: 493647 - DNA, 25 bp, Homo sapien
aaattctgcatgtagggcatatttt

SEQ ID NO: 493648 - DNA, 25 bp, Homo sapien
gatgggattatgcacacccttcagg

SEQ ID NO: 493649 - DNA, 25 bp, Homo sapien
cacccttcaggtgtcaagataaaga

SEQ ID NO: 493650 - DNA, 25 bp, Homo sapien
gagatctgttttgtctggagtcctg

SEQ ID NO: 493651 - DNA, 25 bp, Homo sapien
cagaatgagcttgctgacacacagc

SEQ ID NO: 493652 - DNA, 25 bp, Homo sapien
tctgttttgtctggagtcctggagt

SEQ ID NO: 493653 - DNA, 25 bp, Homo sapien
gacacacagcctaaatttgtaccgc

SEQ ID NO: 493654 - DNA, 25 bp, Homo sapien
atttgtaccgcatgtttcatactaa

SEQ ID NO: 493655 - DNA, 25 bp, Homo sapien
gcaagctccagaaagaatgctgaca

SEQ ID NO: 493656 - DNA, 25 bp, Homo sapien
tgctgacagaaaagggaccctagct

SEQ ID NO: 493657 - DNA, 25 bp, Homo sapien
gagttggccgggcgctgtggctcat

SEQ ID NO: 493658 - DNA, 25 bp, Homo sapien
agttggccgggcgctgtggctcatg

SEQ ID NO: 493659 - DNA, 25 bp, Homo sapien
gttggccgggcgctgtggctcatgc

SEQ ID NO: 493660 - DNA, 25 bp, Homo sapien
cggatcatctgaggttgtgagtttg

SEQ ID NO: 493661 - DNA, 25 bp, Homo sapien
ggatcatctgaggttgtgagtttga

SEQ ID NO: 493662 - DNA, 25 bp, Homo sapien
gatcatctgaggttgtgagtttgag

SEQ ID NO: 493663 - DNA, 25 bp, Homo sapien
tcatctgaggttgtgagtttgagac

SEQ ID NO: 493664 - DNA, 25 bp, Homo sapien
catctgaggttgtgagtttgagacc

SEQ ID NO: 493665 - DNA, 25 bp, Homo sapien
atctgaggttgtgagtttgagacca

SEQ ID NO: 493666 - DNA, 25 bp, Homo sapien
tctgaggttgtgagtttgagaccag

SEQ ID NO: 493667 - DNA, 25 bp, Homo sapien
aggagccctcactgattgagtgctg

SEQ ID NO: 493668 - DNA, 25 bp, Homo sapien
gcctgatatactactttggactctg

SEQ ID NO: 493669 - DNA, 25 bp, Homo sapien
aacagatatgggttctattctctat

SEQ ID NO: 493670 - DNA, 25 bp, Homo sapien
tattctctatttctactgtgtgtcg

SEQ ID NO: 493671 - DNA, 25 bp, Homo sapien
gtgtgtcgttaaacaaccgtcggag

SEQ ID NO: 493672 - DNA, 25 bp, Homo sapien
accgtcggagaccagatgacctgtt

SEQ ID NO: 493673 - DNA, 25 bp, Homo sapien
agatggctagtcctgtataactcga

SEQ ID NO: 493674 - DNA, 25 bp, Homo sapien
actcgactctgtatgtttcaatgta

SEQ ID NO: 493675 - DNA, 25 bp, Homo sapien
ttactgcaatgcttcacctgctgta

SEQ ID NO: 493676 - DNA, 25 bp, Homo sapien
aatgcttcacctgctgtacagtgtt

SEQ ID NO: 493677 - DNA, 25 bp, Homo sapien
gtacagtgtttgtgagatgctcttt

SEQ ID NO: 493678 - DNA, 25 bp, Homo sapien
ataccacacagccataggctgcagt

SEQ ID NO: 493679 - DNA, 25 bp, Homo sapien
gcagtgtggctgctgaagttcaatt

SEQ ID NO: 493680 - DNA, 25 bp, Homo sapien
gtgtggctgctgaagttcaattgat

SEQ ID NO: 493681 - DNA, 25 bp, Homo sapien
ggctgctgaagttcaattgatataa

SEQ ID NO: 493682 - DNA, 25 bp, Homo sapien
gatataaagtaaatcaggcttcaaa

SEQ ID NO: 493683 - DNA, 25 bp, Homo sapien
atcaggcttcaaaaagaatggtgct

SEQ ID NO: 493684 - DNA, 25 bp, Homo sapien
caaaaagaatggtgctgtgggtaca

SEQ ID NO: 493685 - DNA, 25 bp, Homo sapien
aagaatggtgctgtgggtacacaag

SEQ ID NO: 493686 - DNA, 25 bp, Homo sapien
aacgatagacactgaggactgcggc

SEQ ID NO: 493687 - DNA, 25 bp, Homo sapien
acgatagacactgaggactgcggcg

SEQ ID NO: 493688 - DNA, 25 bp, Homo sapien
gagggcaagggctgaaagactatgt

SEQ ID NO: 493689 - DNA, 25 bp, Homo sapien
tcctcgtcagcaatggaacaacgct

SEQ ID NO: 493690 - DNA, 25 bp, Homo sapien
agcaatggaacaacgctggatggag

SEQ ID NO: 493691 - DNA, 25 bp, Homo sapien
agatgatcagacttctccgagctaa

SEQ ID NO: 493692 - DNA, 25 bp, Homo sapien
aaaggaggaagcttgaacgcatcac

SEQ ID NO: 493693 - DNA, 25 bp, Homo sapien
ggaggaagcttgaacgcatcacaaa

SEQ ID NO: 493694 - DNA, 25 bp, Homo sapien
gaagcttgaacgcatcacaaagaag

SEQ ID NO: 493695 - DNA, 25 bp, Homo sapien
cttgaacgcatcacaaagaagctaa

SEQ ID NO: 493696 - DNA, 25 bp, Homo sapien
acaagcttcagtagccgactcgatc

SEQ ID NO: 493697 - DNA, 25 bp, Homo sapien
gcttcagtagccgactcgatcaagt

SEQ ID NO: 493698 - DNA, 25 bp, Homo sapien
tcagtagccgactcgatcaagtgga

SEQ ID NO: 493699 - DNA, 25 bp, Homo sapien
tagccgactcgatcaagtggaagaa

SEQ ID NO: 493700 - DNA, 25 bp, Homo sapien
ataacccagttgttcagacatgccc

SEQ ID NO: 493701 - DNA, 25 bp, Homo sapien
aacccagttgttcagacatgcccag

SEQ ID NO: 493702 - DNA, 25 bp, Homo sapien
ccagttgttcagacatgcccagatt

SEQ ID NO: 493703 - DNA, 25 bp, Homo sapien
gttgttcagacatgcccagattggc

SEQ ID NO: 493704 - DNA, 25 bp, Homo sapien
tcagacatgcccagattggcaacca

SEQ ID NO: 493705 - DNA, 25 bp, Homo sapien
aggaatgttccagtcgatgagtaga

SEQ ID NO: 493706 - DNA, 25 bp, Homo sapien
gttccagtcgatgagtagagcagct

SEQ ID NO: 493707 - DNA, 25 bp, Homo sapien
ccagtcgatgagtagagcagctttc

SEQ ID NO: 493708 - DNA, 25 bp, Homo sapien
tagagcagctttctgttattatact

SEQ ID NO: 493709 - DNA, 25 bp, Homo sapien
gacgacggaatttgtatcaacctac

SEQ ID NO: 493710 - DNA, 25 bp, Homo sapien
ggaatttgtatcaacctaccacatt

SEQ ID NO: 493711 - DNA, 25 bp, Homo sapien
ccctttgaagggtgggctaggccat

SEQ ID NO: 493712 - DNA, 25 bp, Homo sapien
aagggtgggctaggccattttgcca

SEQ ID NO: 493713 - DNA, 25 bp, Homo sapien
gtgggctaggccattttgccaagtt

SEQ ID NO: 493714 - DNA, 25 bp, Homo sapien
gggctaggccattttgccaagttct

SEQ ID NO: 493715 - DNA, 25 bp, Homo sapien
gctaggccattttgccaagttctag

SEQ ID NO: 493716 - DNA, 25 bp, Homo sapien
ggccattttgccaagttctagctct

SEQ ID NO: 493717 - DNA, 25 bp, Homo sapien
ccattttgccaagttctagctctca

SEQ ID NO: 493718 - DNA, 25 bp, Homo sapien
attttgccaagttctagctctcaca

SEQ ID NO: 493719 - DNA, 25 bp, Homo sapien
ttttgccaagttctagctctcacaa

SEQ ID NO: 493720 - DNA, 25 bp, Homo sapien
tcctctgctctggaactgactccct

SEQ ID NO: 493721 - DNA, 25 bp, Homo sapien
atgggaaggtggaaatttcaggcaa

SEQ ID NO: 493722 - DNA, 25 bp, Homo sapien
aagaagtcgaggaggatgcagtccc

SEQ ID NO: 493723 - DNA, 25 bp, Homo sapien
atgcagtcccggttgtgctccctcg

SEQ ID NO: 493724 - DNA, 25 bp, Homo sapien
gttgtgctccctcgactctgcaggg

SEQ ID NO: 493725 - DNA, 25 bp, Homo sapien
ggagcaacaagaaaaactgccgaat

SEQ ID NO: 493726 - DNA, 25 bp, Homo sapien
acagcagcaattctgacctgtccct

SEQ ID NO: 493727 - DNA, 25 bp, Homo sapien
agcaattctgacctgtcccttgtcc

SEQ ID NO: 493728 - DNA, 25 bp, Homo sapien
taccccttcccgatctaacaaatgg

SEQ ID NO: 493729 - DNA, 25 bp, Homo sapien
cttcccgatctaacaaatggccttt

SEQ ID NO: 493730 - DNA, 25 bp, Homo sapien
gatctaacaaatggcctttggttac

SEQ ID NO: 493731 - DNA, 25 bp, Homo sapien
aagtgccagatgtcgtggtcgtcaa

SEQ ID NO: 493732 - DNA, 25 bp, Homo sapien
tgccagatgtcgtggtcgtcaaaga

SEQ ID NO: 493733 - DNA, 25 bp, Homo sapien
ttctttccctcagtaggaatataga

SEQ ID NO: 493734 - DNA, 25 bp, Homo sapien
tttccctcagtaggaatatagaatg

SEQ ID NO: 493735 - DNA, 25 bp, Homo sapien
gatgaattttattagacaactttat

SEQ ID NO: 493736 - DNA, 25 bp, Homo sapien
tacttggtgacttttaatcttagga

SEQ ID NO: 493737 - DNA, 25 bp, Homo sapien
tggtgacttttaatcttaggaaact

SEQ ID NO: 493738 - DNA, 25 bp, Homo sapien
gtgacttttaatcttaggaaactct

SEQ ID NO: 493739 - DNA, 25 bp, Homo sapien
gacttttaatcttaggaaactctgc

SEQ ID NO: 493740 - DNA, 25 bp, Homo sapien
tttaatcttaggaaactctgccttc

SEQ ID NO: 493741 - DNA, 25 bp, Homo sapien
taatcttaggaaactctgccttcct

SEQ ID NO: 493742 - DNA, 25 bp, Homo sapien
atcttaggaaactctgccttccttt

SEQ ID NO: 493743 - DNA, 25 bp, Homo sapien
tcttaggaaactctgccttcctttt

SEQ ID NO: 493744 - DNA, 25 bp, Homo sapien
cataaatggaaaattggctctggaa

SEQ ID NO: 493745 - DNA, 25 bp, Homo sapien
ggctctggaataactgacaacatat

SEQ ID NO: 493746 - DNA, 25 bp, Homo sapien
ttcaagtatttcagtgcagtgtcac

SEQ ID NO: 493747 - DNA, 25 bp, Homo sapien
gtgcagtgtcactctcattaagaag

SEQ ID NO: 493748 - DNA, 25 bp, Homo sapien
gaatcagtaaatctatgtgactcta

SEQ ID NO: 493749 - DNA, 25 bp, Homo sapien
ggaatattctgccaattatctcaca

SEQ ID NO: 493750 - DNA, 25 bp, Homo sapien
ttatctcacatttctaaatatctgg

SEQ ID NO: 493751 - DNA, 25 bp, Homo sapien
tgtccttactttccctctggtaaat

SEQ ID NO: 493752 - DNA, 25 bp, Homo sapien
gttataaacagtgtaaggctcctaa

SEQ ID NO: 493753 - DNA, 25 bp, Homo sapien
ggctcctaagatagagtagctggta

SEQ ID NO: 493754 - DNA, 25 bp, Homo sapien
gtagctggtaggacttagaagagaa

SEQ ID NO: 493755 - DNA, 25 bp, Homo sapien
gggcaccagggtgttctgcggagac

SEQ ID NO: 493756 - DNA, 25 bp, Homo sapien
gagggcgacacctccagaccgagct

SEQ ID NO: 493757 - DNA, 25 bp, Homo sapien
agaccgagctcaatggtgcgcagca

SEQ ID NO: 493758 - DNA, 25 bp, Homo sapien
ctcaatggtgcgcagcaggttctcg

SEQ ID NO: 493759 - DNA, 25 bp, Homo sapien
gttctcggctgtgtcgttgaggcct

SEQ ID NO: 493760 - DNA, 25 bp, Homo sapien
gctgtgtcgttgaggcctggaatca

SEQ ID NO: 493761 - DNA, 25 bp, Homo sapien
aggcctggaatcacctcacagaagc

SEQ ID NO: 493762 - DNA, 25 bp, Homo sapien
tcacagaagcgctccgtgttcgccg

SEQ ID NO: 493763 - DNA, 25 bp, Homo sapien
gtgttcgccgtccacagcactatga

SEQ ID NO: 493764 - DNA, 25 bp, Homo sapien
tccacagcactatgactttgtccag

SEQ ID NO: 493765 - DNA, 25 bp, Homo sapien
gcgctagaccggaagtctcggatgt

SEQ ID NO: 493766 - DNA, 25 bp, Homo sapien
ggatactcacaaattcagtacctcc

SEQ ID NO: 493767 - DNA, 25 bp, Homo sapien
gatactcacaaattcagtacctcca

SEQ ID NO: 493768 - DNA, 25 bp, Homo sapien
attcagtacctccatcctatttcat

SEQ ID NO: 493769 - DNA, 25 bp, Homo sapien
tcagtacctccatcctatttcatta

SEQ ID NO: 493770 - DNA, 25 bp, Homo sapien
agtacctccatcctatttcattaaa

SEQ ID NO: 493771 - DNA, 25 bp, Homo sapien
gtacctccatcctatttcattaaag

SEQ ID NO: 493772 - DNA, 25 bp, Homo sapien
acctccatcctatttcattaaagct

SEQ ID NO: 493773 - DNA, 25 bp, Homo sapien
tccatcctatttcattaaagctctg

SEQ ID NO: 493774 - DNA, 25 bp, Homo sapien
catcctatttcattaaagctctgat

SEQ ID NO: 493775 - DNA, 25 bp, Homo sapien
cctatttcattaaagctctgattaa

SEQ ID NO: 493776 - DNA, 25 bp, Homo sapien
tttcattaaagctctgattaaacat

SEQ ID NO: 493777 - DNA, 25 bp, Homo sapien
gctcctgcctgaggagttcagatga

SEQ ID NO: 493778 - DNA, 25 bp, Homo sapien
gagttcagatgatgtttcggagaaa

SEQ ID NO: 493779 - DNA, 25 bp, Homo sapien
aaaagatgcaatcacagcttttcat

SEQ ID NO: 493780 - DNA, 25 bp, Homo sapien
agcttttcattgacctgttagggcc

SEQ ID NO: 493781 - DNA, 25 bp, Homo sapien
attgacctgttagggccttcctgta

SEQ ID NO: 493782 - DNA, 25 bp, Homo sapien
agccaggagtcctgtgtgggcttca

SEQ ID NO: 493783 - DNA, 25 bp, Homo sapien
gccaaatgtgcggatggcatatttt

SEQ ID NO: 493784 - DNA, 25 bp, Homo sapien
tttctcatcaaaactgctgtttgca

SEQ ID NO: 493785 - DNA, 25 bp, Homo sapien
tgctgtttgcaaggcagttatgcac

SEQ ID NO: 493786 - DNA, 25 bp, Homo sapien
gctataactgtttccagaggctgtt

SEQ ID NO: 493787 - DNA, 25 bp, Homo sapien
agaggctgttgatcagtatctgtta

SEQ ID NO: 493788 - DNA, 25 bp, Homo sapien
gtgtctctgcccacgtcgagcgtgc

SEQ ID NO: 493789 - DNA, 25 bp, Homo sapien
gagcgtgcccgagacccgagggaga

SEQ ID NO: 493790 - DNA, 25 bp, Homo sapien
agtattggccctggcggaacgcagc

SEQ ID NO: 493791 - DNA, 25 bp, Homo sapien
gcggaacgcagcaaccacgagggat

SEQ ID NO: 493792 - DNA, 25 bp, Homo sapien
aacgcagcaaccacgagggatccag

SEQ ID NO: 493793 - DNA, 25 bp, Homo sapien
ggatccagccagaggatgccacgcc

SEQ ID NO: 493794 - DNA, 25 bp, Homo sapien
ctacgcagggcagcacctaggatgg

SEQ ID NO: 493795 - DNA, 25 bp, Homo sapien
ggcagagacttgtcacatctttgtc

SEQ ID NO: 493796 - DNA, 25 bp, Homo sapien
atctttgtccccagcaaaggctaca

SEQ ID NO: 493797 - DNA, 25 bp, Homo sapien
tgtccccagcaaaggctacatgtta

SEQ ID NO: 493798 - DNA, 25 bp, Homo sapien
catgttacctccttcagttgataat

SEQ ID NO: 493799 - DNA, 25 bp, Homo sapien
ttcagaaagttgtccctgaggaatg

SEQ ID NO: 493800 - DNA, 25 bp, Homo sapien
ggaatgaaacacttctgagactcct

SEQ ID NO: 493801 - DNA, 25 bp, Homo sapien
agatgaaccctctgcatggtatccc

SEQ ID NO: 493802 - DNA, 25 bp, Homo sapien
gatttcttcagatttcggttgcctt

SEQ ID NO: 493803 - DNA, 25 bp, Homo sapien
ggttgccttttgaaacacttctctg

SEQ ID NO: 493804 - DNA, 25 bp, Homo sapien
gctatgaactcggaactttcgttgt

SEQ ID NO: 493805 - DNA, 25 bp, Homo sapien
gaagatgtgcaagaaatcctgtcga

SEQ ID NO: 493806 - DNA, 25 bp, Homo sapien
atggtatcccttgactgcccttaca

SEQ ID NO: 493807 - DNA, 25 bp, Homo sapien
tgcccttacacgaggcctgtgaaca

SEQ ID NO: 493808 - DNA, 25 bp, Homo sapien
tggcacgtgggctgtccttggacaa

SEQ ID NO: 493809 - DNA, 25 bp, Homo sapien
tggacaagtccctgttcagaaagtt

SEQ ID NO: 493810 - DNA, 25 bp, Homo sapien
aggagatggagctgtacgagctggc

SEQ ID NO: 493811 - DNA, 25 bp, Homo sapien
ccccgacgtgttcaagatcctggtg

SEQ ID NO: 493812 - DNA, 25 bp, Homo sapien
tgctgaagctgaacgtggcccccct

SEQ ID NO: 493813 - DNA, 25 bp, Homo sapien
ctcgccgtcttccagatgctcaagt

SEQ ID NO: 493814 - DNA, 25 bp, Homo sapien
tcgccgtcttccagatgctcaagtc

SEQ ID NO: 493815 - DNA, 25 bp, Homo sapien
agatgctcaagtccatgtgtgccgg

SEQ ID NO: 493816 - DNA, 25 bp, Homo sapien
atgctcaagtccatgtgtgccgggc

SEQ ID NO: 493817 - DNA, 25 bp, Homo sapien
gctcaagtccatgtgtgccgggcag

SEQ ID NO: 493818 - DNA, 25 bp, Homo sapien
tcaagtccatgtgtgccgggcagag

SEQ ID NO: 493819 - DNA, 25 bp, Homo sapien
gtgccgggcagaggctagcgagcga

SEQ ID NO: 493820 - DNA, 25 bp, Homo sapien
cggccgtgtctctgcccacgtcgag

SEQ ID NO: 493821 - DNA, 25 bp, Homo sapien
ggcattgcaggagctcccagagaga

SEQ ID NO: 493822 - DNA, 25 bp, Homo sapien
agagactgccttccctacactagaa

SEQ ID NO: 493823 - DNA, 25 bp, Homo sapien
tacactagaagtccccacaaaggct

SEQ ID NO: 493824 - DNA, 25 bp, Homo sapien
ccacaaaggcttctgagaccacaaa

SEQ ID NO: 493825 - DNA, 25 bp, Homo sapien
gagaccacaaaatacaaggccagac

SEQ ID NO: 493826 - DNA, 25 bp, Homo sapien
aaggccagacctagagtgtccacag

SEQ ID NO: 493827 - DNA, 25 bp, Homo sapien
agagtgtccacagcaggcctgtgct

SEQ ID NO: 493828 - DNA, 25 bp, Homo sapien
gcacagcgctcgaggtgtgctgtta

SEQ ID NO: 493829 - DNA, 25 bp, Homo sapien
cgctcgaggtgtgctgttaggctaa

SEQ ID NO: 493830 - DNA, 25 bp, Homo sapien
ggtgcagggctagacacgaagctta

SEQ ID NO: 493831 - DNA, 25 bp, Homo sapien
gggctagacacgaagcttaaactat

SEQ ID NO: 493832 - DNA, 25 bp, Homo sapien
acatggtgtttattgaggtttgaga

SEQ ID NO: 493833 - DNA, 25 bp, Homo sapien
gagtctcttgactgtgaagaatgta

SEQ ID NO: 493834 - DNA, 25 bp, Homo sapien
gaagaatgtacactgtctggttttg

SEQ ID NO: 493835 - DNA, 25 bp, Homo sapien
gtacactgtctggttttgacagcta

SEQ ID NO: 493836 - DNA, 25 bp, Homo sapien
gaaatgttgcttctagaaaatttgc

SEQ ID NO: 493837 - DNA, 25 bp, Homo sapien
gaaaatttgcctaggaggcgaatgt

SEQ ID NO: 493838 - DNA, 25 bp, Homo sapien
gtgaagcactcaccataattcccta

SEQ ID NO: 493839 - DNA, 25 bp, Homo sapien
cactcaccataattccctaaattca

SEQ ID NO: 493840 - DNA, 25 bp, Homo sapien
atgttagaacatttcttgctatggt

SEQ ID NO: 493841 - DNA, 25 bp, Homo sapien
tgaatttctgtacctttgtcattct

SEQ ID NO: 493842 - DNA, 25 bp, Homo sapien
tttgtcattctgttatttgcgctaa

SEQ ID NO: 493843 - DNA, 25 bp, Homo sapien
aattagattagctttgagtttgtac

SEQ ID NO: 493844 - DNA, 25 bp, Homo sapien
gagtttgtacaattgggaacataat

SEQ ID NO: 493845 - DNA, 25 bp, Homo sapien
ccttgttggaagtgtcaactgtctt

SEQ ID NO: 493846 - DNA, 25 bp, Homo sapien
gtgtcaactgtctttatgtctgctt

SEQ ID NO: 493847 - DNA, 25 bp, Homo sapien
aactgtctttatgtctgcttgtaaa

SEQ ID NO: 493848 - DNA, 25 bp, Homo sapien
ttatgtctgcttgtaaaagtttcaa

SEQ ID NO: 493849 - DNA, 25 bp, Homo sapien
tatgttttccctcaaaaaggcaacg

SEQ ID NO: 493850 - DNA, 25 bp, Homo sapien
ggcaacgttacttcatttgcttgaa

SEQ ID NO: 493851 - DNA, 25 bp, Homo sapien
ggaatgcttactgatattacttgat

SEQ ID NO: 493852 - DNA, 25 bp, Homo sapien
cttgatagtcatatatagcctagga

SEQ ID NO: 493853 - DNA, 25 bp, Homo sapien
atgatagttgtacttctttaaaaca

SEQ ID NO: 493854 - DNA, 25 bp, Homo sapien
agtgtgacaaccctcggtgtggata

SEQ ID NO: 493855 - DNA, 25 bp, Homo sapien
gacaaccctcggtgtggatataccc

SEQ ID NO: 493856 - DNA, 25 bp, Homo sapien
cggtgtggatatacccccgtggact

SEQ ID NO: 493857 - DNA, 25 bp, Homo sapien
ccacccccactttctataaatgtag

SEQ ID NO: 493858 - DNA, 25 bp, Homo sapien
aatgtaggcctagaatacgcttctc

SEQ ID NO: 493859 - DNA, 25 bp, Homo sapien
tagaatacgcttctctgttgcaaaa

SEQ ID NO: 493860 - DNA, 25 bp, Homo sapien
gcttccaccttgatgttgaaatatc

SEQ ID NO: 493861 - DNA, 25 bp, Homo sapien
gaacacagtttcaaatttctggaaa

SEQ ID NO: 493862 - DNA, 25 bp, Homo sapien
aagatgtttagggaagagctcgact

SEQ ID NO: 493863 - DNA, 25 bp, Homo sapien
gggaagagctcgactaaagaacaat

SEQ ID NO: 493864 - DNA, 25 bp, Homo sapien
gaacaatgaaataaatggtccaagg

SEQ ID NO: 493865 - DNA, 25 bp, Homo sapien
gtggcccacggacgcatagacaatg

SEQ ID NO: 493866 - DNA, 25 bp, Homo sapien
gacaatgtcgatgctttcatgaaca

SEQ ID NO: 493867 - DNA, 25 bp, Homo sapien
gatgctttcatgaacatccgcctgg

SEQ ID NO: 493868 - DNA, 25 bp, Homo sapien
caaagtcacctacacggaccgttgg

SEQ ID NO: 493869 - DNA, 25 bp, Homo sapien
tggatgacctctttgtgacaggccg

SEQ ID NO: 493870 - DNA, 25 bp, Homo sapien
tgacaggccgcaatgtccgctacgt

SEQ ID NO: 493871 - DNA, 25 bp, Homo sapien
gaacatcacctcgaccattgagcag

SEQ ID NO: 493872 - DNA, 25 bp, Homo sapien
gcagcagctgcagattatccatcgg

SEQ ID NO: 493873 - DNA, 25 bp, Homo sapien
tatccatcgggtgcgaaactttggt

SEQ ID NO: 493874 - DNA, 25 bp, Homo sapien
gcgaaactttggtggcaagggccaa

SEQ ID NO: 493875 - DNA, 25 bp, Homo sapien
aaaaactgtaagtgaggccctcagc

SEQ ID NO: 493876 - DNA, 25 bp, Homo sapien
gaggatctgtttgggaaacatagat

SEQ ID NO: 493877 - DNA, 25 bp, Homo sapien
acaaattgtatgtcattcttaatgc

SEQ ID NO: 493878 - DNA, 25 bp, Homo sapien
gtcattcttaatgctagtcttatag

SEQ ID NO: 493879 - DNA, 25 bp, Homo sapien
gctagtcttatagaataaatccata

SEQ ID NO: 493880 - DNA, 25 bp, Homo sapien
atgttcagtatgtttatgtcattct

SEQ ID NO: 493881 - DNA, 25 bp, Homo sapien
atgtcattctaaatgcagcaaattc

SEQ ID NO: 493882 - DNA, 25 bp, Homo sapien
gcagcaaattcaatgatagcagttc

SEQ ID NO: 493883 - DNA, 25 bp, Homo sapien
gatagcagttcaattgactcatagc

SEQ ID NO: 493884 - DNA, 25 bp, Homo sapien
gcagttcaattgactcatagcagtg

SEQ ID NO: 493885 - DNA, 25 bp, Homo sapien
aattgactcatagcagtgttttgta

SEQ ID NO: 493886 - DNA, 25 bp, Homo sapien
attggattaaagtcttgtttgtgaa

SEQ ID NO: 493887 - DNA, 25 bp, Homo sapien
cagcacagggcttggcacaaagaaa

SEQ ID NO: 493888 - DNA, 25 bp, Homo sapien
ttggcacaaagaaagggaggcccca

SEQ ID NO: 493889 - DNA, 25 bp, Homo sapien
gaggccagcggattaggcctgaaca

SEQ ID NO: 493890 - DNA, 25 bp, Homo sapien
taggcctgaacagggatcatccagc

SEQ ID NO: 493891 - DNA, 25 bp, Homo sapien
gaacagggatcatccagcccatcct

SEQ ID NO: 493892 - DNA, 25 bp, Homo sapien
tggctgattctgtaactttccctaa

SEQ ID NO: 493893 - DNA, 25 bp, Homo sapien
gctgattctgtaactttccctaaag

SEQ ID NO: 493894 - DNA, 25 bp, Homo sapien
tgattctgtaactttccctaaaggg

SEQ ID NO: 493895 - DNA, 25 bp, Homo sapien
gggaaaattggcttctgagataacc

SEQ ID NO: 493896 - DNA, 25 bp, Homo sapien
aattggcttctgagataacctggct

SEQ ID NO: 493897 - DNA, 25 bp, Homo sapien
ttggcttctgagataacctggctgc

SEQ ID NO: 493898 - DNA, 25 bp, Homo sapien
tagttccagggcagtaagtgtacaa

SEQ ID NO: 493899 - DNA, 25 bp, Homo sapien
ttcagtaccaatgagcaccactagg

SEQ ID NO: 493900 - DNA, 25 bp, Homo sapien
gttcatatctggtacaagatgtcca

SEQ ID NO: 493901 - DNA, 25 bp, Homo sapien
tgtccaggattcaaggaggctctta

SEQ ID NO: 493902 - DNA, 25 bp, Homo sapien
gaggctcttaaagacttgggattct

SEQ ID NO: 493903 - DNA, 25 bp, Homo sapien
gacttgggattctgtcaaagggtta

SEQ ID NO: 493904 - DNA, 25 bp, Homo sapien
gtcaaagggttatacaagccaactt

SEQ ID NO: 493905 - DNA, 25 bp, Homo sapien
agccaacttgaagggatttctacag

SEQ ID NO: 493906 - DNA, 25 bp, Homo sapien
atgtgtctgtttttaactcttaata

SEQ ID NO: 493907 - DNA, 25 bp, Homo sapien
aggaatcagaacttatttgcaaaac

SEQ ID NO: 493908 - DNA, 25 bp, Homo sapien
aaacagctaatagttccagggcagt

SEQ ID NO: 493909 - DNA, 25 bp, Homo sapien
tctttgattagccatctgcaagctg

SEQ ID NO: 493910 - DNA, 25 bp, Homo sapien
tctgcaagctggcatttctgagcga

SEQ ID NO: 493911 - DNA, 25 bp, Homo sapien
catttctgagcgagggacttttcaa

SEQ ID NO: 493912 - DNA, 25 bp, Homo sapien
ggctgctcaagtttcttggccaata

SEQ ID NO: 493913 - DNA, 25 bp, Homo sapien
tggccaataataggcgccgggttct

SEQ ID NO: 493914 - DNA, 25 bp, Homo sapien
gttatcttccccactacatggctct

SEQ ID NO: 493915 - DNA, 25 bp, Homo sapien
gccgggttctgtgcggtgggaacga

SEQ ID NO: 493916 - DNA, 25 bp, Homo sapien
ccactacatggctctcgtgagaatc

SEQ ID NO: 493917 - DNA, 25 bp, Homo sapien
atggctctcgtgagaatccgcggag

SEQ ID NO: 493918 - DNA, 25 bp, Homo sapien
gaatccgcggagatcacatttgtaa

SEQ ID NO: 493919 - DNA, 25 bp, Homo sapien
tccgcggagatcacatttgtaaaca

SEQ ID NO: 493920 - DNA, 25 bp, Homo sapien
gttattgagaggtcatctagctcca

SEQ ID NO: 493921 - DNA, 25 bp, Homo sapien
ttgagaggtcatctagctccagttc

SEQ ID NO: 493922 - DNA, 25 bp, Homo sapien
gagaggtcatctagctccagttcaa

SEQ ID NO: 493923 - DNA, 25 bp, Homo sapien
gaggtcatctagctccagttcaaaa

SEQ ID NO: 493924 - DNA, 25 bp, Homo sapien
atgtatatctgatgtttaagaggaa

SEQ ID NO: 493925 - DNA, 25 bp, Homo sapien
aaagcatatatattccaactttaaa

SEQ ID NO: 493926 - DNA, 25 bp, Homo sapien
gtgaatttattttgagtaacctcta

SEQ ID NO: 493927 - DNA, 25 bp, Homo sapien
tttgagtaacctctaattaactgta

SEQ ID NO: 493928 - DNA, 25 bp, Homo sapien
gagtaacctctaattaactgtattt

SEQ ID NO: 493929 - DNA, 25 bp, Homo sapien
ctgttgctgtatagttagaaatttc

SEQ ID NO: 493930 - DNA, 25 bp, Homo sapien
gaaatttcatggcaatattttttac

SEQ ID NO: 493931 - DNA, 25 bp, Homo sapien
tgtttgcaatgcatggaactgtcaa

SEQ ID NO: 493932 - DNA, 25 bp, Homo sapien
gaactgtcaaaggattcgtatctgg

SEQ ID NO: 493933 - DNA, 25 bp, Homo sapien
aaagaacctcatacaaaagtcattg

SEQ ID NO: 493934 - DNA, 25 bp, Homo sapien
cattgagtaaatgacagccatgcat

SEQ ID NO: 493935 - DNA, 25 bp, Homo sapien
gacagccatgcattagaacagcaat

SEQ ID NO: 493936 - DNA, 25 bp, Homo sapien
cttttggtctcaagatccctttaca

SEQ ID NO: 493937 - DNA, 25 bp, Homo sapien
aagatccctttacactcttcaaaag

SEQ ID NO: 493938 - DNA, 25 bp, Homo sapien
ctcttcaaaagtgagaaccccaaag

SEQ ID NO: 493939 - DNA, 25 bp, Homo sapien
caagacacaaaagcatacacaggaa

SEQ ID NO: 493940 - DNA, 25 bp, Homo sapien
gatgcataaaaacatggcttctgta

SEQ ID NO: 493941 - DNA, 25 bp, Homo sapien
ggcttctgtagaacaatagagactg

SEQ ID NO: 493942 - DNA, 25 bp, Homo sapien
atattgctgaggtcagacgccacaa

SEQ ID NO: 493943 - DNA, 25 bp, Homo sapien
gacgccacaattttcatgactttct

SEQ ID NO: 493944 - DNA, 25 bp, Homo sapien
agtagcacattttcgtgacttccgc

SEQ ID NO: 493945 - DNA, 25 bp, Homo sapien
cttccgctgtcctctgaaaaacaaa

SEQ ID NO: 493946 - DNA, 25 bp, Homo sapien
gattctgaccaagtctaaatcgagc

SEQ ID NO: 493947 - DNA, 25 bp, Homo sapien
aaatcgagcttttctactgacatga

SEQ ID NO: 493948 - DNA, 25 bp, Homo sapien
gaaactgttggaaactgatctcatt

SEQ ID NO: 493949 - DNA, 25 bp, Homo sapien
agaaatgattttcccctcaaggagg

SEQ ID NO: 493950 - DNA, 25 bp, Homo sapien
aggaggcgtctgtaattccagaaca

SEQ ID NO: 493951 - DNA, 25 bp, Homo sapien
aacagtccagacatcagctgtacct

SEQ ID NO: 493952 - DNA, 25 bp, Homo sapien
agctgtacctcatgctcagtagttt

SEQ ID NO: 493953 - DNA, 25 bp, Homo sapien
ccagcacagggcttggcacaaagaa

SEQ ID NO: 493954 - DNA, 25 bp, Homo sapien
agcacagggcttggcacaaagaaag

SEQ ID NO: 493955 - DNA, 25 bp, Homo sapien
acagggcttggcacaaagaaaggga

SEQ ID NO: 493956 - DNA, 25 bp, Homo sapien
ttggcacaaagaaagggaggcccca

SEQ ID NO: 493957 - DNA, 25 bp, Homo sapien
gaggccagcggattaggcctgaaca

SEQ ID NO: 493958 - DNA, 25 bp, Homo sapien
gcggattaggcctgaacagggatca

SEQ ID NO: 493959 - DNA, 25 bp, Homo sapien
attaggcctgaacagggatcatcca

SEQ ID NO: 493960 - DNA, 25 bp, Homo sapien
taggcctgaacagggatcatccagc

SEQ ID NO: 493961 - DNA, 25 bp, Homo sapien
gcctgaacagggatcatccagccca

SEQ ID NO: 493962 - DNA, 25 bp, Homo sapien
ctgaacagggatcatccagcccatc

SEQ ID NO: 493963 - DNA, 25 bp, Homo sapien
gaacagggatcatccagcccatcct

SEQ ID NO: 493964 - DNA, 25 bp, Homo sapien
agtccaatccccttattttactgat

SEQ ID NO: 493965 - DNA, 25 bp, Homo sapien
gttatcaatgttcagactaggccta

SEQ ID NO: 493966 - DNA, 25 bp, Homo sapien
taggcctacaatagccttgtaccct

SEQ ID NO: 493967 - DNA, 25 bp, Homo sapien
tgtacccttcagtcctattctaatt

SEQ ID NO: 493968 - DNA, 25 bp, Homo sapien
gtcctattctaattcaccttttgtg

SEQ ID NO: 493969 - DNA, 25 bp, Homo sapien
attcaccttttgtgacactattcag

SEQ ID NO: 493970 - DNA, 25 bp, Homo sapien
gacactattcagtaagcctggctag

SEQ ID NO: 493971 - DNA, 25 bp, Homo sapien
tggctaggctcttagtcccaggaaa

SEQ ID NO: 493972 - DNA, 25 bp, Homo sapien
ggtgccctaatttgaagctacagaa

SEQ ID NO: 493973 - DNA, 25 bp, Homo sapien
tagtggaggtcgtctagtgaccctt

SEQ ID NO: 493974 - DNA, 25 bp, Homo sapien
gtcgtctagtgacccttggacaagg

SEQ ID NO: 493975 - DNA, 25 bp, Homo sapien
gtttttactatgttgagctacttgc

SEQ ID NO: 493976 - DNA, 25 bp, Homo sapien
atgttgagctacttgcagtaagttc

SEQ ID NO: 493977 - DNA, 25 bp, Homo sapien
gcagtaagttcatttgtttttacta

SEQ ID NO: 493978 - DNA, 25 bp, Homo sapien
gtttttactatgttcacctgtttgc

SEQ ID NO: 493979 - DNA, 25 bp, Homo sapien
actatgttcacctgtttgcagtaat

SEQ ID NO: 493980 - DNA, 25 bp, Homo sapien
tgcagtaatacacagataactctta

SEQ ID NO: 493981 - DNA, 25 bp, Homo sapien
gataactcttagtgcatttacttca

SEQ ID NO: 493982 - DNA, 25 bp, Homo sapien
tagtgcatttacttcacaaagtact

SEQ ID NO: 493983 - DNA, 25 bp, Homo sapien
ttcacctttcactaagttgttgagg

SEQ ID NO: 493984 - DNA, 25 bp, Homo sapien
attggaaaagtgagaccaggcacag

SEQ ID NO: 493985 - DNA, 25 bp, Homo sapien
cagcacttagggaagacaagtcagg

SEQ ID NO: 493986 - DNA, 25 bp, Homo sapien
ctcattctcacctcagaaaccattt

SEQ ID NO: 493987 - DNA, 25 bp, Homo sapien
gaaaccatttacaacccagattatt

SEQ ID NO: 493988 - DNA, 25 bp, Homo sapien
gtaatttgcaccagactttccttag

SEQ ID NO: 493989 - DNA, 25 bp, Homo sapien
gcaccagactttccttagactgtta

SEQ ID NO: 493990 - DNA, 25 bp, Homo sapien
aatggacgtgtacttttggccagca

SEQ ID NO: 493991 - DNA, 25 bp, Homo sapien
tttggccagcaaagcacattatttt

SEQ ID NO: 493992 - DNA, 25 bp, Homo sapien
aagcacattattttggtgtaggtgg

SEQ ID NO: 493993 - DNA, 25 bp, Homo sapien
taggtggaggtgttcatctctttca

SEQ ID NO: 493994 - DNA, 25 bp, Homo sapien
ggtgttcatctctttcagaagtttg

SEQ ID NO: 493995 - DNA, 25 bp, Homo sapien
aagagatgtttttaagaccagaata

SEQ ID NO: 493996 - DNA, 25 bp, Homo sapien
aacattcactgagtatccaaaatga

SEQ ID NO: 493997 - DNA, 25 bp, Homo sapien
agcattcactgcgtcattgtaacat

SEQ ID NO: 493998 - DNA, 25 bp, Homo sapien
actgcgtcattgtaacatgaaggga

SEQ ID NO: 493999 - DNA, 25 bp, Homo sapien
ctaaggcaggagttgacatcgggca

SEQ ID NO: 494000 - DNA, 25 bp, Homo sapien
ttgacatcgggcaaccaaagaaatg

SEQ ID NO: 494001 - DNA, 25 bp, Homo sapien
cttcccatggctgcatcttaagatg

SEQ ID NO: 494002 - DNA, 25 bp, Homo sapien
atcttaagatggatgcacggagaaa

SEQ ID NO: 494003 - DNA, 25 bp, Homo sapien
gatgcacggagaaaccgtctgcctg

SEQ ID NO: 494004 - DNA, 25 bp, Homo sapien
ggagaaaccgtctgcctggctccct

SEQ ID NO: 494005 - DNA, 25 bp, Homo sapien
gatttcagaatcctagctccgggct

SEQ ID NO: 494006 - DNA, 25 bp, Homo sapien
ggctccactcgtgtggcagcaagac

SEQ ID NO: 494007 - DNA, 25 bp, Homo sapien
ccactcgtgtggcagcaagactgct

SEQ ID NO: 494008 - DNA, 25 bp, Homo sapien
attttccaagtagacataatctatt

SEQ ID NO: 494009 - DNA, 25 bp, Homo sapien
aaacatatttttctagtgacaaaga

SEQ ID NO: 494010 - DNA, 25 bp, Homo sapien
ttcttttcatactgcctgattggtt

SEQ ID NO: 494011 - DNA, 25 bp, Homo sapien
tcttttcatactgcctgattggttt

SEQ ID NO: 494012 - DNA, 25 bp, Homo sapien
tttcatactgcctgattggtttaat

SEQ ID NO: 494013 - DNA, 25 bp, Homo sapien
catactgcctgattggtttaataaa

SEQ ID NO: 494014 - DNA, 25 bp, Homo sapien
tactgcctgattggtttaataaaca

SEQ ID NO: 494015 - DNA, 25 bp, Homo sapien
agtatatatcattttatcatgttgt

SEQ ID NO: 494016 - DNA, 25 bp, Homo sapien
cattttatcatgttgtaactgatcc

SEQ ID NO: 494017 - DNA, 25 bp, Homo sapien
tatcatgttgtaactgatccaaaat

SEQ ID NO: 494018 - DNA, 25 bp, Homo sapien
catgttgtaactgatccaaaataat

SEQ ID NO: 494019 - DNA, 25 bp, Homo sapien
ggacttaggaacaaagaatcagtaa

SEQ ID NO: 494020 - DNA, 25 bp, Homo sapien
tgttagtaaacacttcagaaacttt

SEQ ID NO: 494021 - DNA, 25 bp, Homo sapien
aatattatgaacactgtctatatag

SEQ ID NO: 494022 - DNA, 25 bp, Homo sapien
acaagtagagtgtgctggtttcatc

SEQ ID NO: 494023 - DNA, 25 bp, Homo sapien
gtagagtgtgctggtttcatctttc

SEQ ID NO: 494024 - DNA, 25 bp, Homo sapien
atagcaggaatcacgtacagtctct

SEQ ID NO: 494025 - DNA, 25 bp, Homo sapien
gcaggaatcacgtacagtctctaat

SEQ ID NO: 494026 - DNA, 25 bp, Homo sapien
ggaatcacgtacagtctctaattaa

SEQ ID NO: 494027 - DNA, 25 bp, Homo sapien
acgtacagtctctaattaaaacata

SEQ ID NO: 494028 - DNA, 25 bp, Homo sapien
tagcctctttattgttttccgtaat

SEQ ID NO: 494029 - DNA, 25 bp, Homo sapien
gcctctttattgttttccgtaattg

SEQ ID NO: 494030 - DNA, 25 bp, Homo sapien
tcattatgtcatttcatataatctc

SEQ ID NO: 494031 - DNA, 25 bp, Homo sapien
ttcatataatctcatttcatctcat

SEQ ID NO: 494032 - DNA, 25 bp, Homo sapien
ttcatctcatctcatatttttgata

SEQ ID NO: 494033 - DNA, 25 bp, Homo sapien
tctcatctcatatttttgatatcat

SEQ ID NO: 494034 - DNA, 25 bp, Homo sapien
ctcatctcatatttttgatatcatt

SEQ ID NO: 494035 - DNA, 25 bp, Homo sapien
atctcatatttttgatatcattttt

SEQ ID NO: 494036 - DNA, 25 bp, Homo sapien
ttcatatcatttttcatctcatttc

SEQ ID NO: 494037 - DNA, 25 bp, Homo sapien
tcatatcatttttcatctcatttca

SEQ ID NO: 494038 - DNA, 25 bp, Homo sapien
catatcatttttcatctcatttcat

SEQ ID NO: 494039 - DNA, 25 bp, Homo sapien
catctcaattcatctcatcatttca

SEQ ID NO: 494040 - DNA, 25 bp, Homo sapien
tcatctcctcatctcatcatttcct

SEQ ID NO: 494041 - DNA, 25 bp, Homo sapien
tcaacatttttgtaatttggaaact

SEQ ID NO: 494042 - DNA, 25 bp, Homo sapien
aagagtgatttctgtttaatcgcaa

SEQ ID NO: 494043 - DNA, 25 bp, Homo sapien
tttctgtttaatcgcaatttgttgg

SEQ ID NO: 494044 - DNA, 25 bp, Homo sapien
aatcgcaatttgttggtaataccaa

SEQ ID NO: 494045 - DNA, 25 bp, Homo sapien
gaaattagtgaaatcttagtacctt

SEQ ID NO: 494046 - DNA, 25 bp, Homo sapien
tcttagtaccttaacttcaaacatt

SEQ ID NO: 494047 - DNA, 25 bp, Homo sapien
atagttcttgaatattttgctgtat

SEQ ID NO: 494048 - DNA, 25 bp, Homo sapien
gctgtatttatagcctcatatttag

SEQ ID NO: 494049 - DNA, 25 bp, Homo sapien
agcctcatatttaggcatttatgca

SEQ ID NO: 494050 - DNA, 25 bp, Homo sapien
gcatttatgcactgatgtgtcttca

SEQ ID NO: 494051 - DNA, 25 bp, Homo sapien
ttatgcactgatgtgtcttcaataa

SEQ ID NO: 494052 - DNA, 25 bp, Homo sapien
aatgttctgacgtaatctgtgctgc

SEQ ID NO: 494053 - DNA, 25 bp, Homo sapien
ttctgacgtaatctgtgctgcctag

SEQ ID NO: 494054 - DNA, 25 bp, Homo sapien
tgctgcctagcattttgttctccaa

SEQ ID NO: 494055 - DNA, 25 bp, Homo sapien
gcattttgttctccaagctgagtgg

SEQ ID NO: 494056 - DNA, 25 bp, Homo sapien
gctgagtggaataatgcctttcatt

SEQ ID NO: 494057 - DNA, 25 bp, Homo sapien
aatatcttccacatcctattgttgc

SEQ ID NO: 494058 - DNA, 25 bp, Homo sapien
cctattgttgcattaaatccctact

SEQ ID NO: 494059 - DNA, 25 bp, Homo sapien
aatccctactgatattttaatggta

SEQ ID NO: 494060 - DNA, 25 bp, Homo sapien
gtaattgtgatagtacctgaataac

SEQ ID NO: 494061 - DNA, 25 bp, Homo sapien
aagtgtgtagtcttactgagtacat

SEQ ID NO: 494062 - DNA, 25 bp, Homo sapien
ctgagtacatttgcttttcatggta

SEQ ID NO: 494063 - DNA, 25 bp, Homo sapien
tcctccttatttgtgttctaattga

SEQ ID NO: 494064 - DNA, 25 bp, Homo sapien
tatttgtgttctaattgacccagga

SEQ ID NO: 494065 - DNA, 25 bp, Homo sapien
tgtgttctaattgacccaggaattt

SEQ ID NO: 494066 - DNA, 25 bp, Homo sapien
tatttcctatggaaaatcactaggg

SEQ ID NO: 494067 - DNA, 25 bp, Homo sapien
ctcaggcagagcaggcgacactttg

SEQ ID NO: 494068 - DNA, 25 bp, Homo sapien
gaagaatacagtcttatatttaaag

SEQ ID NO: 494069 - DNA, 25 bp, Homo sapien
ctttttgaagtttatctctctttct

SEQ ID NO: 494070 - DNA, 25 bp, Homo sapien
gaagtttatctctctttctagtaaa

SEQ ID NO: 494071 - DNA, 25 bp, Homo sapien
ctctttctagtaaaatggtgcttac

SEQ ID NO: 494072 - DNA, 25 bp, Homo sapien
aatggtgcttactgtgaatggataa

SEQ ID NO: 494073 - DNA, 25 bp, Homo sapien
catttgttgatttcccattcgatga

SEQ ID NO: 494074 - DNA, 25 bp, Homo sapien
ggaaaaaccgagatcactttagtcg

SEQ ID NO: 494075 - DNA, 25 bp, Homo sapien
accgagatcactttagtcgatgcag

SEQ ID NO: 494076 - DNA, 25 bp, Homo sapien
gatcactttagtcgatgcagggccc

SEQ ID NO: 494077 - DNA, 25 bp, Homo sapien
atcactttagtcgatgcagggccca

SEQ ID NO: 494078 - DNA, 25 bp, Homo sapien
actttagtcgatgcagggcccacgt

SEQ ID NO: 494079 - DNA, 25 bp, Homo sapien
ttagtcgatgcagggcccacgtgat

SEQ ID NO: 494080 - DNA, 25 bp, Homo sapien
gggcccacgtgataagcagatgttt

SEQ ID NO: 494081 - DNA, 25 bp, Homo sapien
gcccacgtgataagcagatgtttta

SEQ ID NO: 494082 - DNA, 25 bp, Homo sapien
ttcctcatcctaggggagcgatctc

SEQ ID NO: 494083 - DNA, 25 bp, Homo sapien
aactggtggattatatcacttgaat

SEQ ID NO: 494084 - DNA, 25 bp, Homo sapien
tggattatatcacttgaatactggg

SEQ ID NO: 494085 - DNA, 25 bp, Homo sapien
gccttcagtggattcgggcaagtgc

SEQ ID NO: 494086 - DNA, 25 bp, Homo sapien
ttcgggcaagtgcaaagtctttggc

SEQ ID NO: 494087 - DNA, 25 bp, Homo sapien
agtctttggcctattgtgtgacaaa

SEQ ID NO: 494088 - DNA, 25 bp, Homo sapien
ggcctattgtgtgacaaagaggtat

SEQ ID NO: 494089 - DNA, 25 bp, Homo sapien
taagaaaattccgtcaacaaggttg

SEQ ID NO: 494090 - DNA, 25 bp, Homo sapien
aattccgtcaacaaggttggagtag

SEQ ID NO: 494091 - DNA, 25 bp, Homo sapien
gggtggatttgtgtttctgactttt

SEQ ID NO: 494092 - DNA, 25 bp, Homo sapien
taagcaaattccatatgttaccaaa

SEQ ID NO: 494093 - DNA, 25 bp, Homo sapien
atatgttaccaaaagcacatgctgt

SEQ ID NO: 494094 - DNA, 25 bp, Homo sapien
gcacatgctgtatattttcttcccc

SEQ ID NO: 494095 - DNA, 25 bp, Homo sapien
tcttccccttttgtgtgtatatagt

SEQ ID NO: 494096 - DNA, 25 bp, Homo sapien
gtcattataattttagtgctagtac

SEQ ID NO: 494097 - DNA, 25 bp, Homo sapien
agtgctagtacttgtgggttttctg

SEQ ID NO: 494098 - DNA, 25 bp, Homo sapien
tctgtatttgtatcaccttgaaatt

SEQ ID NO: 494099 - DNA, 25 bp, Homo sapien
gaaaatacttctttattcatgtttt

SEQ ID NO: 494100 - DNA, 25 bp, Homo sapien
ttattcatgttttcaatcacttaga

SEQ ID NO: 494101 - DNA, 25 bp, Homo sapien
cttcatcatttcagtgactttcctc

SEQ ID NO: 494102 - DNA, 25 bp, Homo sapien
atttcagtgactttcctccaactct

SEQ ID NO: 494103 - DNA, 25 bp, Homo sapien
ttcctccaactctctgaatctgcta

SEQ ID NO: 494104 - DNA, 25 bp, Homo sapien
cctcttattatatgtcccttagcag

SEQ ID NO: 494105 - DNA, 25 bp, Homo sapien
atatgtcccttagcagtacttttcc

SEQ ID NO: 494106 - DNA, 25 bp, Homo sapien
gcagtacttttccagttaggttcgt

SEQ ID NO: 494107 - DNA, 25 bp, Homo sapien
gagagccagttacgcgttagtatgt

SEQ ID NO: 494108 - DNA, 25 bp, Homo sapien
atgcaattcctgttggttagcctca

SEQ ID NO: 494109 - DNA, 25 bp, Homo sapien
ctgaaaacgtcactcctggatacat

SEQ ID NO: 494110 - DNA, 25 bp, Homo sapien
tagaacatcactgcgcatgtgcatc

SEQ ID NO: 494111 - DNA, 25 bp, Homo sapien
tggtgtctaacgttcctccagtttc

SEQ ID NO: 494112 - DNA, 25 bp, Homo sapien
tccagtttctggtgctctgatgcat

SEQ ID NO: 494113 - DNA, 25 bp, Homo sapien
ctgatgcattgcttttgggcttgtc

SEQ ID NO: 494114 - DNA, 25 bp, Homo sapien
tgggcttgtcttactacagcagctt

SEQ ID NO: 494115 - DNA, 25 bp, Homo sapien
gctttcttcggtcctcagtcattta

SEQ ID NO: 494116 - DNA, 25 bp, Homo sapien
accacttgtcatatgtcctttctag

SEQ ID NO: 494117 - DNA, 25 bp, Homo sapien
atgtcctttctagtttccagggata

SEQ ID NO: 494118 - DNA, 25 bp, Homo sapien
atttggtgcagcaggccaatccaag

SEQ ID NO: 494119 - DNA, 25 bp, Homo sapien
aatccaagaggctctgctgggccct

SEQ ID NO: 494120 - DNA, 25 bp, Homo sapien
aagatgtccccaatcaacatgctct

SEQ ID NO: 494121 - DNA, 25 bp, Homo sapien
caacatgctctacttcaatgacaag

SEQ ID NO: 494122 - DNA, 25 bp, Homo sapien
aatgacaagcagcagattatctacg

SEQ ID NO: 494123 - DNA, 25 bp, Homo sapien
gattatctacggcaagatccctggc

SEQ ID NO: 494124 - DNA, 25 bp, Homo sapien
ctacggcaagatccctggcatggtg

SEQ ID NO: 494125 - DNA, 25 bp, Homo sapien
ggtggatcgctgtggctgctcttaa

SEQ ID NO: 494126 - DNA, 25 bp, Homo sapien
tccggccagtgcgagtacatgttca

SEQ ID NO: 494127 - DNA, 25 bp, Homo sapien
ccagtgcgagtacatgttcatgcaa

SEQ ID NO: 494128 - DNA, 25 bp, Homo sapien
aaatatccgcatacccatttggtgc

SEQ ID NO: 494129 - DNA, 25 bp, Homo sapien
gtttctctcttttctaccctactca

SEQ ID NO: 494130 - DNA, 25 bp, Homo sapien
cctactcactactatctcttttgca

SEQ ID NO: 494131 - DNA, 25 bp, Homo sapien
ctaagcatagatctcacttctttga

SEQ ID NO: 494132 - DNA, 25 bp, Homo sapien
gtatattagtttctcctgctctttt

SEQ ID NO: 494133 - DNA, 25 bp, Homo sapien
ctgctcttttcctatagcagcctgt

SEQ ID NO: 494134 - DNA, 25 bp, Homo sapien
gtaactatcatgctatattataatc

SEQ ID NO: 494135 - DNA, 25 bp, Homo sapien
tattataatcatttgtctgtctccc

SEQ ID NO: 494136 - DNA, 25 bp, Homo sapien
tgtctgtctcccctaatagatgtca

SEQ ID NO: 494137 - DNA, 25 bp, Homo sapien
gtctcccctaatagatgtcaggctg

SEQ ID NO: 494138 - DNA, 25 bp, Homo sapien
atgtcaggctgttgaaagtgcttac

SEQ ID NO: 494139 - DNA, 25 bp, Homo sapien
gttgaaagtgcttactgaatctctt

SEQ ID NO: 494140 - DNA, 25 bp, Homo sapien
tgagccccaccagactcatttgtaa

SEQ ID NO: 494141 - DNA, 25 bp, Homo sapien
ctcatttgtaaatagcgctccttcc

SEQ ID NO: 494142 - DNA, 25 bp, Homo sapien
catttgtaaatagcgctccttcctc

SEQ ID NO: 494143 - DNA, 25 bp, Homo sapien
gggtgagggctgtgcccgccagaac

SEQ ID NO: 494144 - DNA, 25 bp, Homo sapien
gccagaaccgcccaggtgtctacat

SEQ ID NO: 494145 - DNA, 25 bp, Homo sapien
gaaccgcccaggtgtctacatccgt

SEQ ID NO: 494146 - DNA, 25 bp, Homo sapien
caccacaactggatccatcggatca

SEQ ID NO: 494147 - DNA, 25 bp, Homo sapien
ggatccatcggatcatccccaaact

SEQ ID NO: 494148 - DNA, 25 bp, Homo sapien
gatcatccccaaactgcagttccag

SEQ ID NO: 494149 - DNA, 25 bp, Homo sapien
agccagcgaggttgggcggccagaa

SEQ ID NO: 494150 - DNA, 25 bp, Homo sapien
ttgggcggccagaagtgagaccccc

SEQ ID NO: 494151 - DNA, 25 bp, Homo sapien
gcctgtgtcctgactcgcacgtctg

SEQ ID NO: 494152 - DNA, 25 bp, Homo sapien
cctgtgtcctgactcgcacgtctgc

SEQ ID NO: 494153 - DNA, 25 bp, Homo sapien
ctgtgtcctgactcgcacgtctgct

SEQ ID NO: 494154 - DNA, 25 bp, Homo sapien
tgtgtcctgactcgcacgtctgctg

SEQ ID NO: 494155 - DNA, 25 bp, Homo sapien
gtgtcctgactcgcacgtctgctga

SEQ ID NO: 494156 - DNA, 25 bp, Homo sapien
tgtcctgactcgcacgtctgctgat

SEQ ID NO: 494157 - DNA, 25 bp, Homo sapien
gtcctgactcgcacgtctgctgatg

SEQ ID NO: 494158 - DNA, 25 bp, Homo sapien
tcctgactcgcacgtctgctgatgg

SEQ ID NO: 494159 - DNA, 25 bp, Homo sapien
cctgactcgcacgtctgctgatggc

SEQ ID NO: 494160 - DNA, 25 bp, Homo sapien
ctgactcgcacgtctgctgatggcc

SEQ ID NO: 494161 - DNA, 25 bp, Homo sapien
tgactcgcacgtctgctgatggcct

SEQ ID NO: 494162 - DNA, 25 bp, Homo sapien
tgcggacgcgggtcctgtcactgca

SEQ ID NO: 494163 - DNA, 25 bp, Homo sapien
agaggccgaagcacgagtcagactg

SEQ ID NO: 494164 - DNA, 25 bp, Homo sapien
gccgaagcacgagtcagactgcatt

SEQ ID NO: 494165 - DNA, 25 bp, Homo sapien
ccttcttccagaggctatggctagt

SEQ ID NO: 494166 - DNA, 25 bp, Homo sapien
aggctatggctagttggcttgctcc

SEQ ID NO: 494167 - DNA, 25 bp, Homo sapien
tccacccctgagatgtgctggataa

SEQ ID NO: 494168 - DNA, 25 bp, Homo sapien
ccctgagatgtgctggataacttat

SEQ ID NO: 494169 - DNA, 25 bp, Homo sapien
gataacttatttatggactgttggg

SEQ ID NO: 494170 - DNA, 25 bp, Homo sapien
ggcaacaaatgccaaggtcagactt

SEQ ID NO: 494171 - DNA, 25 bp, Homo sapien
aggtcagacttggtaatgtccttga

SEQ ID NO: 494172 - DNA, 25 bp, Homo sapien
gacttggtaatgtccttgacctcac

SEQ ID NO: 494173 - DNA, 25 bp, Homo sapien
agctacttgggtgcatgaggcctga

SEQ ID NO: 494174 - DNA, 25 bp, Homo sapien
ggtgcatgaggcctgagaatcactt

SEQ ID NO: 494175 - DNA, 25 bp, Homo sapien
cttgagtccaagaagcagaggttgt

SEQ ID NO: 494176 - DNA, 25 bp, Homo sapien
ggatactcacaaattcagtacctcc

SEQ ID NO: 494177 - DNA, 25 bp, Homo sapien
attcagtacctccatcctatttcat

SEQ ID NO: 494178 - DNA, 25 bp, Homo sapien
agtacctccatcctatttcattaaa

SEQ ID NO: 494179 - DNA, 25 bp, Homo sapien
gtacctccatcctatttcattaaag

SEQ ID NO: 494180 - DNA, 25 bp, Homo sapien
acctccatcctatttcattaaagct

SEQ ID NO: 494181 - DNA, 25 bp, Homo sapien
tccatcctatttcattaaagctctg

SEQ ID NO: 494182 - DNA, 25 bp, Homo sapien
atcctatttcattaaagctctgatt

SEQ ID NO: 494183 - DNA, 25 bp, Homo sapien
tttcattaaagctctgattaaacat

SEQ ID NO: 494184 - DNA, 25 bp, Homo sapien
tgcatccagccctgctctgtgagac

SEQ ID NO: 494185 - DNA, 25 bp, Homo sapien
aagctgagagtaaatgggtagtttc

SEQ ID NO: 494186 - DNA, 25 bp, Homo sapien
tcagtctctttgttggccaggagtc

SEQ ID NO: 494187 - DNA, 25 bp, Homo sapien
ctctttgttggccaggagtccataa

SEQ ID NO: 494188 - DNA, 25 bp, Homo sapien
caggagtccataatggtgtgtgcat

SEQ ID NO: 494189 - DNA, 25 bp, Homo sapien
ttttcctgccaatctacaaacctag

SEQ ID NO: 494190 - DNA, 25 bp, Homo sapien
gccaatctacaaacctagcctacaa

SEQ ID NO: 494191 - DNA, 25 bp, Homo sapien
aaacctagcctacaaagcttcacct

SEQ ID NO: 494192 - DNA, 25 bp, Homo sapien
ctacaaagcttcacctctacaatat

SEQ ID NO: 494193 - DNA, 25 bp, Homo sapien
gcttcacctctacaatatgtactga

SEQ ID NO: 494194 - DNA, 25 bp, Homo sapien
ttatgattgagattattattggcca

SEQ ID NO: 494195 - DNA, 25 bp, Homo sapien
gatgagctaatatcttttcctctga

SEQ ID NO: 494196 - DNA, 25 bp, Homo sapien
atcttttcctctgaaggagtacttc

SEQ ID NO: 494197 - DNA, 25 bp, Homo sapien
gtagggctccaaaacctgtgcaatt

SEQ ID NO: 494198 - DNA, 25 bp, Homo sapien
aaacctgtgcaattcctaccagagc

SEQ ID NO: 494199 - DNA, 25 bp, Homo sapien
aattcctaccagagccgtgctgact

SEQ ID NO: 494200 - DNA, 25 bp, Homo sapien
agccgtgctgactcccgggccaagg

SEQ ID NO: 494201 - DNA, 25 bp, Homo sapien
aaagcctgcgcacctccgagaggaa

SEQ ID NO: 494202 - DNA, 25 bp, Homo sapien
acctccgagaggaagctccgcgaga

SEQ ID NO: 494203 - DNA, 25 bp, Homo sapien
agctgaggaccaacatcgtggcact

SEQ ID NO: 494204 - DNA, 25 bp, Homo sapien
catcgtggcactcctgcaaaaggtg

SEQ ID NO: 494205 - DNA, 25 bp, Homo sapien
acacagatgatgagctggacgccta

SEQ ID NO: 494206 - DNA, 25 bp, Homo sapien
gaactttcgaagatgctcctgggac

SEQ ID NO: 494207 - DNA, 25 bp, Homo sapien
atgctcctgggacttagtgtactct

SEQ ID NO: 494208 - DNA, 25 bp, Homo sapien
gggacttagtgtactctaacatcta

SEQ ID NO: 494209 - DNA, 25 bp, Homo sapien
acatctattaatccctggtacctta

SEQ ID NO: 494210 - DNA, 25 bp, Homo sapien
atccctggtaccttaggtgacttgt

SEQ ID NO: 494211 - DNA, 25 bp, Homo sapien
ggtgacttgtcatagaagtgctaca

SEQ ID NO: 494212 - DNA, 25 bp, Homo sapien
gtcatagaagtgctacatttacaag

SEQ ID NO: 494213 - DNA, 25 bp, Homo sapien
acaagtagtatgcaaggaggcccaa

SEQ ID NO: 494214 - DNA, 25 bp, Homo sapien
gaggcccaagaggacaaattcagtt

SEQ ID NO: 494215 - DNA, 25 bp, Homo sapien
ggaagcaattaacgttctctacttt

SEQ ID NO: 494216 - DNA, 25 bp, Homo sapien
atccccaatcttaccaaggcaagtg

SEQ ID NO: 494217 - DNA, 25 bp, Homo sapien
atactaagagatttgctttttctgg

SEQ ID NO: 494218 - DNA, 25 bp, Homo sapien
tactaagagatttgctttttctggg

SEQ ID NO: 494219 - DNA, 25 bp, Homo sapien
actaagagatttgctttttctgggt

SEQ ID NO: 494220 - DNA, 25 bp, Homo sapien
ctaagagatttgctttttctgggtg

SEQ ID NO: 494221 - DNA, 25 bp, Homo sapien
taagagatttgctttttctgggtgc

SEQ ID NO: 494222 - DNA, 25 bp, Homo sapien
aagagatttgctttttctgggtgcg

SEQ ID NO: 494223 - DNA, 25 bp, Homo sapien
agagatttgctttttctgggtgcgg

SEQ ID NO: 494224 - DNA, 25 bp, Homo sapien
gagatttgctttttctgggtgcggt

SEQ ID NO: 494225 - DNA, 25 bp, Homo sapien
agatttgctttttctgggtgcggtg

SEQ ID NO: 494226 - DNA, 25 bp, Homo sapien
atttgctttttctgggtgcggtggc

SEQ ID NO: 494227 - DNA, 25 bp, Homo sapien
tttgctttttctgggtgcggtggct

SEQ ID NO: 494228 - DNA, 25 bp, Homo sapien
gagttttctattagaattcaggata

SEQ ID NO: 494229 - DNA, 25 bp, Homo sapien
tcaggataagtaatataagcaatgc

SEQ ID NO: 494230 - DNA, 25 bp, Homo sapien
aagcaatgcaaattttctcattaat

SEQ ID NO: 494231 - DNA, 25 bp, Homo sapien
tttctcattaatttgaaggaatcgt

SEQ ID NO: 494232 - DNA, 25 bp, Homo sapien
aaggaatcgttaatagaatcagtct

SEQ ID NO: 494233 - DNA, 25 bp, Homo sapien
gtttactgtaacttaatactatgtc

SEQ ID NO: 494234 - DNA, 25 bp, Homo sapien
tactatgtcagtttagaagctgagt

SEQ ID NO: 494235 - DNA, 25 bp, Homo sapien
ttagaagctgagttttcatatttca

SEQ ID NO: 494236 - DNA, 25 bp, Homo sapien
catatttcattataatcttaagagt

SEQ ID NO: 494237 - DNA, 25 bp, Homo sapien
tacttttaagtcttgatcatattga

SEQ ID NO: 494238 - DNA, 25 bp, Homo sapien
gatcatattgaatgcttctgagttt

SEQ ID NO: 494239 - DNA, 25 bp, Homo sapien
gtaatggactagataattcaaactg

SEQ ID NO: 494240 - DNA, 25 bp, Homo sapien
aactgattagcccattccagaagaa

SEQ ID NO: 494241 - DNA, 25 bp, Homo sapien
gaacatccaaacctcaaggctcagg

SEQ ID NO: 494242 - DNA, 25 bp, Homo sapien
aaggctcaggatcccatagaccaga

SEQ ID NO: 494243 - DNA, 25 bp, Homo sapien
tagaccagagcccacctttttgata

SEQ ID NO: 494244 - DNA, 25 bp, Homo sapien
gagcccacctttttgataaacttag

SEQ ID NO: 494245 - DNA, 25 bp, Homo sapien
gaagcaagatagtttgtgacacata

SEQ ID NO: 494246 - DNA, 25 bp, Homo sapien
agtttgtgacacataagcttcccaa

SEQ ID NO: 494247 - DNA, 25 bp, Homo sapien
gacacataagcttcccaaaaactag

SEQ ID NO: 494248 - DNA, 25 bp, Homo sapien
ctgaatagtggtatatctgatggta

SEQ ID NO: 494249 - DNA, 25 bp, Homo sapien
gatggtatatgtttcttaaaggtcc

SEQ ID NO: 494250 - DNA, 25 bp, Homo sapien
gatgaatcaaggcaataatttctca

SEQ ID NO: 494251 - DNA, 25 bp, Homo sapien
tttatctcgactttttattttccat

SEQ ID NO: 494252 - DNA, 25 bp, Homo sapien
cattttttctagtacgcaaatagtg

SEQ ID NO: 494253 - DNA, 25 bp, Homo sapien
aaattgttttaatgcctggactttg

SEQ ID NO: 494254 - DNA, 25 bp, Homo sapien
atgcctggactttgaaacaagtaac

SEQ ID NO: 494255 - DNA, 25 bp, Homo sapien
taatctacgagcgaatttgccctcc

SEQ ID NO: 494256 - DNA, 25 bp, Homo sapien
catacaaatatgaatctggctgcaa

SEQ ID NO: 494257 - DNA, 25 bp, Homo sapien
tctggctgcaagaacaggatatcca

SEQ ID NO: 494258 - DNA, 25 bp, Homo sapien
tccaggtaactagagagtgggcatt

SEQ ID NO: 494259 - DNA, 25 bp, Homo sapien
tatctggtggagaagcctaggattt

SEQ ID NO: 494260 - DNA, 25 bp, Homo sapien
gaagcctaggatttcaactttttgt

SEQ ID NO: 494261 - DNA, 25 bp, Homo sapien
aatctcttctgttgcatttcctcac

SEQ ID NO: 494262 - DNA, 25 bp, Homo sapien
gttgcatttcctcacccctaagtaa

SEQ ID NO: 494263 - DNA, 25 bp, Homo sapien
ctcacccctaagtaacagctacatt

SEQ ID NO: 494264 - DNA, 25 bp, Homo sapien
cctaagtaacagctacatttaagta

SEQ ID NO: 494265 - DNA, 25 bp, Homo sapien
cgagatggtggtttagtggaataaa

SEQ ID NO: 494266 - DNA, 25 bp, Homo sapien
aagcttcatcacagatactttccag

SEQ ID NO: 494267 - DNA, 25 bp, Homo sapien
catcacagatactttccagtttctc

SEQ ID NO: 494268 - DNA, 25 bp, Homo sapien
aggaacatttggtatgatatgcata

SEQ ID NO: 494269 - DNA, 25 bp, Homo sapien
aattatttatccatttatgggcaaa

SEQ ID NO: 494270 - DNA, 25 bp, Homo sapien
gggcaaaatgatacaagtagcatct

SEQ ID NO: 494271 - DNA, 25 bp, Homo sapien
gtagcatcttgattgaacatcattt

SEQ ID NO: 494272 - DNA, 25 bp, Homo sapien
agacttttcattgtataggcacaac

SEQ ID NO: 494273 - DNA, 25 bp, Homo sapien
cttttcattgtataggcacaaccaa

SEQ ID NO: 494274 - DNA, 25 bp, Homo sapien
ataggcacaaccaaagagtcagact

SEQ ID NO: 494275 - DNA, 25 bp, Homo sapien
ggcacaaccaaagagtcagactggt

SEQ ID NO: 494276 - DNA, 25 bp, Homo sapien
caaagagtcagactggtttaaaact

SEQ ID NO: 494277 - DNA, 25 bp, Homo sapien
aaaaagtatcccacacagtggatgt

SEQ ID NO: 494278 - DNA, 25 bp, Homo sapien
aagtatcccacacagtggatgttgt

SEQ ID NO: 494279 - DNA, 25 bp, Homo sapien
tcccacacagtggatgttgtttcta

SEQ ID NO: 494280 - DNA, 25 bp, Homo sapien
cccacacagtggatgttgtttctaa

SEQ ID NO: 494281 - DNA, 25 bp, Homo sapien
acacagtggatgttgtttctaagaa

SEQ ID NO: 494282 - DNA, 25 bp, Homo sapien
ttaaaatttcgagcccacaaatcta

SEQ ID NO: 494283 - DNA, 25 bp, Homo sapien
atttctgtgcaaaaaggtaaggtga

SEQ ID NO: 494284 - DNA, 25 bp, Homo sapien
gctgtccatgagaattagacttcat

SEQ ID NO: 494285 - DNA, 25 bp, Homo sapien
tagacttcatattagcttcaattaa

SEQ ID NO: 494286 - DNA, 25 bp, Homo sapien
ttcaattaaaaagctcattccattt

SEQ ID NO: 494287 - DNA, 25 bp, Homo sapien
atttaggtgactgttcggcagtttg

SEQ ID NO: 494288 - DNA, 25 bp, Homo sapien
gtgactgttcggcagtttgatatat

SEQ ID NO: 494289 - DNA, 25 bp, Homo sapien
gatatatggccattgtcggccttaa

SEQ ID NO: 494290 - DNA, 25 bp, Homo sapien
tatggccattgtcggccttaaactg

SEQ ID NO: 494291 - DNA, 25 bp, Homo sapien
ggccttaaactgcactagtaacaag

SEQ ID NO: 494292 - DNA, 25 bp, Homo sapien
actagtaacaagcatggtatttatc

SEQ ID NO: 494293 - DNA, 25 bp, Homo sapien
gcatggtatttatcttgtattgaaa

SEQ ID NO: 494294 - DNA, 25 bp, Homo sapien
taccccttcttccatatcaatcaag

SEQ ID NO: 494295 - DNA, 25 bp, Homo sapien
atcaatcaagactgctcgtgctttt

SEQ ID NO: 494296 - DNA, 25 bp, Homo sapien
aatcaagactgctcgtgcttttaaa

SEQ ID NO: 494297 - DNA, 25 bp, Homo sapien
tcaagactgctcgtgcttttaaaga

SEQ ID NO: 494298 - DNA, 25 bp, Homo sapien
agactgctcgtgcttttaaagaaca

SEQ ID NO: 494299 - DNA, 25 bp, Homo sapien
ttcccttggaaatacttccaccatc

SEQ ID NO: 494300 - DNA, 25 bp, Homo sapien
tggaaatacttccaccatcaccaac

SEQ ID NO: 494301 - DNA, 25 bp, Homo sapien
accaaccactctggtgtccacattt

SEQ ID NO: 494302 - DNA, 25 bp, Homo sapien
aaagaagctgcttattgcctcatca

SEQ ID NO: 494303 - DNA, 25 bp, Homo sapien
cataaattcctttctggttgaccgc

SEQ ID NO: 494304 - DNA, 25 bp, Homo sapien
taaattcctttctggttgaccgcgg

SEQ ID NO: 494305 - DNA, 25 bp, Homo sapien
taggtcagtataacacacctgcccc

SEQ ID NO: 494306 - DNA, 25 bp, Homo sapien
ggtcagtataacacacctgccccag

SEQ ID NO: 494307 - DNA, 25 bp, Homo sapien
acctgccccagggacttacaggtgt

SEQ ID NO: 494308 - DNA, 25 bp, Homo sapien
aggcacgctgcagctaccatttcct

SEQ ID NO: 494309 - DNA, 25 bp, Homo sapien
ttcctcccttcactacgttttagat

SEQ ID NO: 494310 - DNA, 25 bp, Homo sapien
ctcccttcactacgttttagattct

SEQ ID NO: 494311 - DNA, 25 bp, Homo sapien
gttgggcaggtatgagcggcttgct

SEQ ID NO: 494312 - DNA, 25 bp, Homo sapien
gttcttccttgccttttggtctgtt

SEQ ID NO: 494313 - DNA, 25 bp, Homo sapien
cttttggtctgtttctacttagctg

SEQ ID NO: 494314 - DNA, 25 bp, Homo sapien
ttggtctgtttctacttagctgact

SEQ ID NO: 494315 - DNA, 25 bp, Homo sapien
gtctgtttctacttagctgactcct

SEQ ID NO: 494316 - DNA, 25 bp, Homo sapien
agatgtctagttgctttttataaga

SEQ ID NO: 494317 - DNA, 25 bp, Homo sapien
gaaggagaaaatccgacaacctgga

SEQ ID NO: 494318 - DNA, 25 bp, Homo sapien
atccgacaacctggaaagatttttg

SEQ ID NO: 494319 - DNA, 25 bp, Homo sapien
ttttcactgcttgtatgatgtttcc

SEQ ID NO: 494320 - DNA, 25 bp, Homo sapien
tgtttcccattcatacacctataaa

SEQ ID NO: 494321 - DNA, 25 bp, Homo sapien
aagaggccctttgaactgccttgtg

SEQ ID NO: 494322 - DNA, 25 bp, Homo sapien
aactgccttgtgttctgtgagaaac

SEQ ID NO: 494323 - DNA, 25 bp, Homo sapien
gaaggactgattgagaatgttccaa

SEQ ID NO: 494324 - DNA, 25 bp, Homo sapien
gttccaatccaaatgaatgcatcac

SEQ ID NO: 494325 - DNA, 25 bp, Homo sapien
atcacaacttacaatgctgctcatt

SEQ ID NO: 494326 - DNA, 25 bp, Homo sapien
atgctgctcattgttgtgagtacta

SEQ ID NO: 494327 - DNA, 25 bp, Homo sapien
taccccttcttccatatcaatcaag

SEQ ID NO: 494328 - DNA, 25 bp, Homo sapien
accccttcttccatatcaatcaaga

SEQ ID NO: 494329 - DNA, 25 bp, Homo sapien
cccttcttccatatcaatcaagact

SEQ ID NO: 494330 - DNA, 25 bp, Homo sapien
ccttcttccatatcaatcaagactg

SEQ ID NO: 494331 - DNA, 25 bp, Homo sapien
cttcttccatatcaatcaagactgc

SEQ ID NO: 494332 - DNA, 25 bp, Homo sapien
cataaattcctttctggttgaccgc

SEQ ID NO: 494333 - DNA, 25 bp, Homo sapien
ataaattcctttctggttgaccgcg

SEQ ID NO: 494334 - DNA, 25 bp, Homo sapien
taaattcctttctggttgaccgcgg

SEQ ID NO: 494335 - DNA, 25 bp, Homo sapien
tccgcactggccgacctgtacgacc

SEQ ID NO: 494336 - DNA, 25 bp, Homo sapien
cgcactggccgacctgtacgaccac

SEQ ID NO: 494337 - DNA, 25 bp, Homo sapien
cactggccgacctgtacgaccaccg

SEQ ID NO: 494338 - DNA, 25 bp, Homo sapien
acacactaatataccagcaccttga

SEQ ID NO: 494339 - DNA, 25 bp, Homo sapien
cactaatataccagcaccttgacct

SEQ ID NO: 494340 - DNA, 25 bp, Homo sapien
tccagaactgtgaggagtaagtgtt

SEQ ID NO: 494341 - DNA, 25 bp, Homo sapien
gtgaggagtaagtgttgtttaagcc

SEQ ID NO: 494342 - DNA, 25 bp, Homo sapien
gatggggagggctattttcataata

SEQ ID NO: 494343 - DNA, 25 bp, Homo sapien
tatatgtttggatagggagggacaa

SEQ ID NO: 494344 - DNA, 25 bp, Homo sapien
gggagggacaagatgcccaactcat

SEQ ID NO: 494345 - DNA, 25 bp, Homo sapien
gagggacaagatgcccaactcatct

SEQ ID NO: 494346 - DNA, 25 bp, Homo sapien
gcccaactcatcttaaaagtgctgt

SEQ ID NO: 494347 - DNA, 25 bp, Homo sapien
aaaagtgctgttgattcctgtgaaa

SEQ ID NO: 494348 - DNA, 25 bp, Homo sapien
agtgctgttgattcctgtgaaattt

SEQ ID NO: 494349 - DNA, 25 bp, Homo sapien
gggtgtctgtctctgttctccttgg

SEQ ID NO: 494350 - DNA, 25 bp, Homo sapien
gttctccttggcgtttccttcatgg

SEQ ID NO: 494351 - DNA, 25 bp, Homo sapien
tggcgtttccttcatggccgtgaat

SEQ ID NO: 494352 - DNA, 25 bp, Homo sapien
ttcatggccgtgaatcccagctcac

SEQ ID NO: 494353 - DNA, 25 bp, Homo sapien
atctgaaagcctttctgccttcctt

SEQ ID NO: 494354 - DNA, 25 bp, Homo sapien
tgccttccttcctgtagctgtcgct

SEQ ID NO: 494355 - DNA, 25 bp, Homo sapien
ctgtagctgtcgctttctcaggctt

SEQ ID NO: 494356 - DNA, 25 bp, Homo sapien
gatgtggcccttgagctgggcgggc

SEQ ID NO: 494357 - DNA, 25 bp, Homo sapien
gggcgggctccttgggtggattaga

SEQ ID NO: 494358 - DNA, 25 bp, Homo sapien
agctggccgagctgcaagcacctga

SEQ ID NO: 494359 - DNA, 25 bp, Homo sapien
gagctgcaagcacctgagttacctg

SEQ ID NO: 494360 - DNA, 25 bp, Homo sapien
tcttaaccaggcatacttatatttg

SEQ ID NO: 494361 - DNA, 25 bp, Homo sapien
ggcatacttatatttgctagttgga

SEQ ID NO: 494362 - DNA, 25 bp, Homo sapien
atttgctagttggaaaatcattctg

SEQ ID NO: 494363 - DNA, 25 bp, Homo sapien
tggattattgtatgagctatttggg

SEQ ID NO: 494364 - DNA, 25 bp, Homo sapien
gcaatctgcttaatggacattggta

SEQ ID NO: 494365 - DNA, 25 bp, Homo sapien
ggaagtgtcattctttacctcactc

SEQ ID NO: 494366 - DNA, 25 bp, Homo sapien
tttacctcactcctcaaacactttt

SEQ ID NO: 494367 - DNA, 25 bp, Homo sapien
caaacacttttctatccaaaggttg

SEQ ID NO: 494368 - DNA, 25 bp, Homo sapien
ttctatccaaaggttggtttgagtc

SEQ ID NO: 494369 - DNA, 25 bp, Homo sapien
ggtttgagtcagtattggcatcata

SEQ ID NO: 494370 - DNA, 25 bp, Homo sapien
ttggcatcatacaaccacttactgt

SEQ ID NO: 494371 - DNA, 25 bp, Homo sapien
caactttcgtctagtactgttcctt

SEQ ID NO: 494372 - DNA, 25 bp, Homo sapien
cgtctagtactgttccttaatctgt

SEQ ID NO: 494373 - DNA, 25 bp, Homo sapien
aaccaagagggctcattatcatgag

SEQ ID NO: 494374 - DNA, 25 bp, Homo sapien
agatttgtatgggatcctgatgaaa

SEQ ID NO: 494375 - DNA, 25 bp, Homo sapien
tggtaggaggtttcatgaggttcac

SEQ ID NO: 494376 - DNA, 25 bp, Homo sapien
atgaggttcacagattcctgaggtt

SEQ ID NO: 494377 - DNA, 25 bp, Homo sapien
gacaagtactagagcctaccaatga

SEQ ID NO: 494378 - DNA, 25 bp, Homo sapien
gagcctaccaatgactctagagcat

SEQ ID NO: 494379 - DNA, 25 bp, Homo sapien
gactctagagcatctgatcaccatg

SEQ ID NO: 494380 - DNA, 25 bp, Homo sapien
tcaccatgccactgatcaattctat

SEQ ID NO: 494381 - DNA, 25 bp, Homo sapien
atcaattctatccaactttcgtcta

SEQ ID NO: 494382 - DNA, 25 bp, Homo sapien
tgcagccactgacagtgttctccag

SEQ ID NO: 494383 - DNA, 25 bp, Homo sapien
gacagtgttctccagtcaactacag

SEQ ID NO: 494384 - DNA, 25 bp, Homo sapien
gttctccagtcaactacaggtgcac

SEQ ID NO: 494385 - DNA, 25 bp, Homo sapien
acaggtgcacatggtactacagctc

SEQ ID NO: 494386 - DNA, 25 bp, Homo sapien
gggaccacatgtactctgcccgtgt

SEQ ID NO: 494387 - DNA, 25 bp, Homo sapien
tgtcctgggccagcgatttctgctg

SEQ ID NO: 494388 - DNA, 25 bp, Homo sapien
cagcgatttctgctgccagctgaga

SEQ ID NO: 494389 - DNA, 25 bp, Homo sapien
gccagctgagaacaacaagccccaa

SEQ ID NO: 494390 - DNA, 25 bp, Homo sapien
caagccccaaagacaggtcctggat

SEQ ID NO: 494391 - DNA, 25 bp, Homo sapien
aaagacaggtcctggatgaagccct

SEQ ID NO: 494392 - DNA, 25 bp, Homo sapien
tggatgaagccctcctcagacgcct

SEQ ID NO: 494393 - DNA, 25 bp, Homo sapien
attgaaggtcaagtagactcagtgt

SEQ ID NO: 494394 - DNA, 25 bp, Homo sapien
ggtcaagtagactcagtgtagggca

SEQ ID NO: 494395 - DNA, 25 bp, Homo sapien
gacaggtaggtaggacaggatctct

SEQ ID NO: 494396 - DNA, 25 bp, Homo sapien
taggtaggacaggatctcttaagat

SEQ ID NO: 494397 - DNA, 25 bp, Homo sapien
ggacaggatctcttaagatgggaaa

SEQ ID NO: 494398 - DNA, 25 bp, Homo sapien
ggagaggagggctgcttggccccag

SEQ ID NO: 494399 - DNA, 25 bp, Homo sapien
cttggccccagggaactgcagtgag

SEQ ID NO: 494400 - DNA, 25 bp, Homo sapien
gtgaggtggaactgagctccgctcc

SEQ ID NO: 494401 - DNA, 25 bp, Homo sapien
gtggaactgagctccgctcctgaat

SEQ ID NO: 494402 - DNA, 25 bp, Homo sapien
tgagctccgctcctgaatctccaaa

SEQ ID NO: 494403 - DNA, 25 bp, Homo sapien
ctccgctcctgaatctccaaaggag

SEQ ID NO: 494404 - DNA, 25 bp, Homo sapien
gcatttgtctttcaaactgcagggt

SEQ ID NO: 494405 - DNA, 25 bp, Homo sapien
atcagtttttgtgggtgattgcaat

SEQ ID NO: 494406 - DNA, 25 bp, Homo sapien
agaacatctaagcacgtcacctaca

SEQ ID NO: 494407 - DNA, 25 bp, Homo sapien
agcacgtcacctacagttttgtgat

SEQ ID NO: 494408 - DNA, 25 bp, Homo sapien
gatggtgcatttttgcattgcagta

SEQ ID NO: 494409 - DNA, 25 bp, Homo sapien
gcattgcagtatagatctgtgcata

SEQ ID NO: 494410 - DNA, 25 bp, Homo sapien
atgcattaagtgtagcaaatcgtga

SEQ ID NO: 494411 - DNA, 25 bp, Homo sapien
aattttttactgctggtcatggtca

SEQ ID NO: 494412 - DNA, 25 bp, Homo sapien
agatacgctaggaaattgagtcact

SEQ ID NO: 494413 - DNA, 25 bp, Homo sapien
ttgagtcactaggagcatggatgta

SEQ ID NO: 494414 - DNA, 25 bp, Homo sapien
atgtacccatattctctaagacagg

SEQ ID NO: 494415 - DNA, 25 bp, Homo sapien
ggatgttttgttttacttgtgaact

SEQ ID NO: 494416 - DNA, 25 bp, Homo sapien
ttacttgtgaactgattgagtctta

SEQ ID NO: 494417 - DNA, 25 bp, Homo sapien
ctgattgagtcttaaggatagttta

SEQ ID NO: 494418 - DNA, 25 bp, Homo sapien
tatgaattgatcacttgttgctcag

SEQ ID NO: 494419 - DNA, 25 bp, Homo sapien
gaattgatcacttgttgctcagaat

SEQ ID NO: 494420 - DNA, 25 bp, Homo sapien
atcacttgttgctcagaatcattag

SEQ ID NO: 494421 - DNA, 25 bp, Homo sapien
gttgctcagaatcattagtataagt

SEQ ID NO: 494422 - DNA, 25 bp, Homo sapien
ggaaatagtttgaagtcatttttca

SEQ ID NO: 494423 - DNA, 25 bp, Homo sapien
gtcatttttcatagacttaactgtc

SEQ ID NO: 494424 - DNA, 25 bp, Homo sapien
agacttaactgtccaatgttgcaaa

SEQ ID NO: 494425 - DNA, 25 bp, Homo sapien
ctgtccaatgttgcaaatgtttctt

SEQ ID NO: 494426 - DNA, 25 bp, Homo sapien
caagcagctaacaaaggcgaggaga

SEQ ID NO: 494427 - DNA, 25 bp, Homo sapien
aagacgacgagaacattccgatgga

SEQ ID NO: 494428 - DNA, 25 bp, Homo sapien
cgagaacattccgatggagacagag

SEQ ID NO: 494429 - DNA, 25 bp, Homo sapien
tggtgaagaaggcacgtctactcct

SEQ ID NO: 494430 - DNA, 25 bp, Homo sapien
aagaaggcacgtctactcctgagga

SEQ ID NO: 494431 - DNA, 25 bp, Homo sapien
gcacgtctactcctgaggacaagga

SEQ ID NO: 494432 - DNA, 25 bp, Homo sapien
gatagtaacactggctcggagagca

SEQ ID NO: 494433 - DNA, 25 bp, Homo sapien
tggctcggagagcaacagtgcaaca

SEQ ID NO: 494434 - DNA, 25 bp, Homo sapien
aacagtgcaacagtggaggagccac

SEQ ID NO: 494435 - DNA, 25 bp, Homo sapien
aggagccaccaacagatcccatacc

SEQ ID NO: 494436 - DNA, 25 bp, Homo sapien
aagtgttgccttgttttgtgtgttc

SEQ ID NO: 494437 - DNA, 25 bp, Homo sapien
aaagagattctcctgttgaataaca

SEQ ID NO: 494438 - DNA, 25 bp, Homo sapien
cacatgaccaattggttacaatttt

SEQ ID NO: 494439 - DNA, 25 bp, Homo sapien
cattttcagtggtaggcaagtgtgt

SEQ ID NO: 494440 - DNA, 25 bp, Homo sapien
gtggtaggcaagtgtgttaatcttt

SEQ ID NO: 494441 - DNA, 25 bp, Homo sapien
aaaggccgtagaagaactgagtgat

SEQ ID NO: 494442 - DNA, 25 bp, Homo sapien
gtgatgttattagcagtgcaaatag

SEQ ID NO: 494443 - DNA, 25 bp, Homo sapien
aaattgccatcatctagaactgacc

SEQ ID NO: 494444 - DNA, 25 bp, Homo sapien
agaactgacctcatgtgcttgggaa

SEQ ID NO: 494445 - DNA, 25 bp, Homo sapien
actgacctcatgtgcttgggaaact

SEQ ID NO: 494446 - DNA, 25 bp, Homo sapien
catgtgcttgggaaactgaatcttc

SEQ ID NO: 494447 - DNA, 25 bp, Homo sapien
caatcataatgtgtagtgtagagaa

SEQ ID NO: 494448 - DNA, 25 bp, Homo sapien
gaagctctaaaggatgaagccaatc

SEQ ID NO: 494449 - DNA, 25 bp, Homo sapien
attgatatgcagtttacagtcctta

SEQ ID NO: 494450 - DNA, 25 bp, Homo sapien
ttacagtccttaatcatttcggttg

SEQ ID NO: 494451 - DNA, 25 bp, Homo sapien
atttcggttgaacagctccaggcta

SEQ ID NO: 494452 - DNA, 25 bp, Homo sapien
gctccaggctagttttctcttaaat

SEQ ID NO: 494453 - DNA, 25 bp, Homo sapien
gaaatatactgatgaacttgccact

SEQ ID NO: 494454 - DNA, 25 bp, Homo sapien
tgaacttgccactcagccaaggcga

SEQ ID NO: 494455 - DNA, 25 bp, Homo sapien
ccaaggcgactgcttaacacactga

SEQ ID NO: 494456 - DNA, 25 bp, Homo sapien
aacacactgagggaactcaacccta

SEQ ID NO: 494457 - DNA, 25 bp, Homo sapien
gaactcaaccctatgtatgaaggat

SEQ ID NO: 494458 - DNA, 25 bp, Homo sapien
cagcatgatgcacaggaagtattac

SEQ ID NO: 494459 - DNA, 25 bp, Homo sapien
aaatgttctctgcttgctaccaaag

SEQ ID NO: 494460 - DNA, 25 bp, Homo sapien
gcttgctaccaaaggacaaactctt

SEQ ID NO: 494461 - DNA, 25 bp, Homo sapien
tggaaatgaacactttctgctttcc

SEQ ID NO: 494462 - DNA, 25 bp, Homo sapien
tttccttcctccaaagaattaatag

SEQ ID NO: 494463 - DNA, 25 bp, Homo sapien
taatggcaaatccttcaagcaggga

SEQ ID NO: 494464 - DNA, 25 bp, Homo sapien
gggataaaagtcgatcttcaaacat

SEQ ID NO: 494465 - DNA, 25 bp, Homo sapien
gatgaccgcatctagattatttttt

SEQ ID NO: 494466 - DNA, 25 bp, Homo sapien
gattttcactatagctatgttacgc

SEQ ID NO: 494467 - DNA, 25 bp, Homo sapien
gttacgctaagctactgtccaatct

SEQ ID NO: 494468 - DNA, 25 bp, Homo sapien
aagctactgtccaatctcttgtgat

SEQ ID NO: 494469 - DNA, 25 bp, Homo sapien
atctcttgtgatgtgtaacttttac

SEQ ID NO: 494470 - DNA, 25 bp, Homo sapien
atctgtcacccgctatatcattcac

SEQ ID NO: 494471 - DNA, 25 bp, Homo sapien
tgtcacccgctatatcattcaccat

SEQ ID NO: 494472 - DNA, 25 bp, Homo sapien
gtcacccgctatatcattcaccatc

SEQ ID NO: 494473 - DNA, 25 bp, Homo sapien
acccgctatatcattcaccatcatg

SEQ ID NO: 494474 - DNA, 25 bp, Homo sapien
cccgctatatcattcaccatcatga

SEQ ID NO: 494475 - DNA, 25 bp, Homo sapien
ccgctatatcattcaccatcatgaa

SEQ ID NO: 494476 - DNA, 25 bp, Homo sapien
cgctatatcattcaccatcatgaac

SEQ ID NO: 494477 - DNA, 25 bp, Homo sapien
tcattcaccatcatgaacccgtgtt

SEQ ID NO: 494478 - DNA, 25 bp, Homo sapien
cattcaccatcatgaacccgtgttt

SEQ ID NO: 494479 - DNA, 25 bp, Homo sapien
attcaccatcatgaacccgtgtttc

SEQ ID NO: 494480 - DNA, 25 bp, Homo sapien
ttcaccatcatgaacccgtgtttct

SEQ ID NO: 494481 - DNA, 25 bp, Homo sapien
ttccacactccttgctgtgattctg

SEQ ID NO: 494482 - DNA, 25 bp, Homo sapien
tccttgctgtgattctgtcctaatc

SEQ ID NO: 494483 - DNA, 25 bp, Homo sapien
atgtgtgtcacagtgaagccagaag

SEQ ID NO: 494484 - DNA, 25 bp, Homo sapien
gaagccagaaggtgaattaacaact

SEQ ID NO: 494485 - DNA, 25 bp, Homo sapien
aactaagacaaatccagcatgctct

SEQ ID NO: 494486 - DNA, 25 bp, Homo sapien
ttgcctgccctgcatatgtgctcat

SEQ ID NO: 494487 - DNA, 25 bp, Homo sapien
gacggaggacacagagcatcgacac

SEQ ID NO: 494488 - DNA, 25 bp, Homo sapien
gcatcgacacaaattctacagctcc

SEQ ID NO: 494489 - DNA, 25 bp, Homo sapien
acacaaattctacagctcctcagag

SEQ ID NO: 494490 - DNA, 25 bp, Homo sapien
tctacagctcctcagagaacacagc

SEQ ID NO: 494491 - DNA, 25 bp, Homo sapien
gactcagatgagctgtaaaatccat

SEQ ID NO: 494492 - DNA, 25 bp, Homo sapien
taaacatcctaagtagctgctgaaa

SEQ ID NO: 494493 - DNA, 25 bp, Homo sapien
gctgctgaaatttccgttgtgtctt

SEQ ID NO: 494494 - DNA, 25 bp, Homo sapien
gaaatttccgttgtgtcttatagtt

SEQ ID NO: 494495 - DNA, 25 bp, Homo sapien
atagtttctttaggtctgtgttcct

SEQ ID NO: 494496 - DNA, 25 bp, Homo sapien
ggtctgtgttcctaagatgcttaaa

SEQ ID NO: 494497 - DNA, 25 bp, Homo sapien
tattttctctatacccttcctgtac

SEQ ID NO: 494498 - DNA, 25 bp, Homo sapien
acccttcctgtactgttctattttg

SEQ ID NO: 494499 - DNA, 25 bp, Homo sapien
actgttctattttggaaccagagaa

SEQ ID NO: 494500 - DNA, 25 bp, Homo sapien
ataactggcttggtaatgagctcat

SEQ ID NO: 494501 - DNA, 25 bp, Homo sapien
atgagctcattgtccttaacttttg

SEQ ID NO: 494502 - DNA, 25 bp, Homo sapien
gtccttaacttttgctttattgatt

SEQ ID NO: 494503 - DNA, 25 bp, Homo sapien
gagtagaaagcagcgttggcatttg

SEQ ID NO: 494504 - DNA, 25 bp, Homo sapien
gcagcgttggcatttgtaagaaagt

SEQ ID NO: 494505 - DNA, 25 bp, Homo sapien
ggacaggccctgttcaagatctgac

SEQ ID NO: 494506 - DNA, 25 bp, Homo sapien
ggccctgttcaagatctgaccagga

SEQ ID NO: 494507 - DNA, 25 bp, Homo sapien
ttcaagatctgaccaggacatcaga

SEQ ID NO: 494508 - DNA, 25 bp, Homo sapien
ttcttccttgcaggccacagctgag

SEQ ID NO: 494509 - DNA, 25 bp, Homo sapien
agctgagcagccttaactgacacct

SEQ ID NO: 494510 - DNA, 25 bp, Homo sapien
ttaactgacacctccttggcaccag

SEQ ID NO: 494511 - DNA, 25 bp, Homo sapien
ttctgcagctgtaagactgtggtgt

SEQ ID NO: 494512 - DNA, 25 bp, Homo sapien
tgtaagactgtggtgtttgccctcc

SEQ ID NO: 494513 - DNA, 25 bp, Homo sapien
agactgtggtgtttgccctccttga

SEQ ID NO: 494514 - DNA, 25 bp, Homo sapien
gaacccggcctgaaaatgtgctttt

SEQ ID NO: 494515 - DNA, 25 bp, Homo sapien
gtgcttttgttttagaaactgtcta

SEQ ID NO: 494516 - DNA, 25 bp, Homo sapien
gggactttctcttgcccgattccag

SEQ ID NO: 494517 - DNA, 25 bp, Homo sapien
gattccagcctgaggacaacaaatt

SEQ ID NO: 494518 - DNA, 25 bp, Homo sapien
acaacaaattggtcaacggcggaag

SEQ ID NO: 494519 - DNA, 25 bp, Homo sapien
caacggcggaagttgcctgacgaaa

SEQ ID NO: 494520 - DNA, 25 bp, Homo sapien
gcctgacgaaatgactgcaacatga

SEQ ID NO: 494521 - DNA, 25 bp, Homo sapien
gcaacatgaaatccagttttatgat

SEQ ID NO: 494522 - DNA, 25 bp, Homo sapien
tgatcataacaaaaccttccttccg

SEQ ID NO: 494523 - DNA, 25 bp, Homo sapien
gagaaacgtccttcagaatgcaaca

SEQ ID NO: 494524 - DNA, 25 bp, Homo sapien
aatgcaacaggcaattgtgagcccc

SEQ ID NO: 494525 - DNA, 25 bp, Homo sapien
gtgtgcagatgttgccttacattct

SEQ ID NO: 494526 - DNA, 25 bp, Homo sapien
tcctgatgtggtgtgcttcctaaga

SEQ ID NO: 494527 - DNA, 25 bp, Homo sapien
gtgcttcctaagagtacaaacctga

SEQ ID NO: 494528 - DNA, 25 bp, Homo sapien
tgtccaggcttgcaaagtctcaggc

SEQ ID NO: 494529 - DNA, 25 bp, Homo sapien
tgggactaaggcttgtgtttcctgc

SEQ ID NO: 494530 - DNA, 25 bp, Homo sapien
ctgccttgggtaggattttcttcta

SEQ ID NO: 494531 - DNA, 25 bp, Homo sapien
tctatgcatgttgggtgcttctcac

SEQ ID NO: 494532 - DNA, 25 bp, Homo sapien
ttttaacctaggcagattacttcag

SEQ ID NO: 494533 - DNA, 25 bp, Homo sapien
attacttcagagtcagcgtctgcct

SEQ ID NO: 494534 - DNA, 25 bp, Homo sapien
agcgtctgccttactatcctgtttc

SEQ ID NO: 494535 - DNA, 25 bp, Homo sapien
aggaatttccccttgtgtcaggcaa

SEQ ID NO: 494536 - DNA, 25 bp, Homo sapien
atttcatctgtcctcattctctgcg

SEQ ID NO: 494537 - DNA, 25 bp, Homo sapien
tgcgcctttcgcagagcttccagca

SEQ ID NO: 494538 - DNA, 25 bp, Homo sapien
gagcttccagcagcgaatttgccat

SEQ ID NO: 494539 - DNA, 25 bp, Homo sapien
ttccagcagcgaatttgccattttc

SEQ ID NO: 494540 - DNA, 25 bp, Homo sapien
cttccttgtagtaagacaccaactg

SEQ ID NO: 494541 - DNA, 25 bp, Homo sapien
agacaccaactgcttaaaacataag

SEQ ID NO: 494542 - DNA, 25 bp, Homo sapien
agagcattttaagaggtgcagcctc

SEQ ID NO: 494543 - DNA, 25 bp, Homo sapien
ggtgcagcctctggaagtggatcaa

SEQ ID NO: 494544 - DNA, 25 bp, Homo sapien
caaactagaactcatatgccatact

SEQ ID NO: 494545 - DNA, 25 bp, Homo sapien
atatgccatactagatatgtttgtc

SEQ ID NO: 494546 - DNA, 25 bp, Homo sapien
aggtgccgccatttcatctgtcctc

SEQ ID NO: 494547 - DNA, 25 bp, Homo sapien
gcagataattccttttagtttagct

SEQ ID NO: 494548 - DNA, 25 bp, Homo sapien
gaaatagttctccttaatgcaaata

SEQ ID NO: 494549 - DNA, 25 bp, Homo sapien
agttctccttaatgcaaatatgttg

SEQ ID NO: 494550 - DNA, 25 bp, Homo sapien
aatatgttggttctgctatagttcc

SEQ ID NO: 494551 - DNA, 25 bp, Homo sapien
tctgctatagttccatcctgttcaa

SEQ ID NO: 494552 - DNA, 25 bp, Homo sapien
atagttccatcctgttcaaaagtca

SEQ ID NO: 494553 - DNA, 25 bp, Homo sapien
aagagtggtgtttccttttgagcaa

SEQ ID NO: 494554 - DNA, 25 bp, Homo sapien
ggtgtttccttttgagcaattcttc

SEQ ID NO: 494555 - DNA, 25 bp, Homo sapien
tgagcaattcttcatccttaagtca

SEQ ID NO: 494556 - DNA, 25 bp, Homo sapien
catccttaagtcagcatgattataa

SEQ ID NO: 494557 - DNA, 25 bp, Homo sapien
agaaccctcagtgtaactctaattc

SEQ ID NO: 494558 - DNA, 25 bp, Homo sapien
aatggttttcaatctatggctgagg

SEQ ID NO: 494559 - DNA, 25 bp, Homo sapien
gggagtttttgtacctcacattcca

SEQ ID NO: 494560 - DNA, 25 bp, Homo sapien
ctcacattccaatgatgcagggatt

SEQ ID NO: 494561 - DNA, 25 bp, Homo sapien
cagggattgagcctctctgttggac

SEQ ID NO: 494562 - DNA, 25 bp, Homo sapien
tctctgttggactctttctcggcct

SEQ ID NO: 494563 - DNA, 25 bp, Homo sapien
ttctcggcctgcttttaagttctaa

SEQ ID NO: 494564 - DNA, 25 bp, Homo sapien
tttgctttgagtgttgggctgtcct

SEQ ID NO: 494565 - DNA, 25 bp, Homo sapien
cctgtcttggcctttgagttactca

SEQ ID NO: 494566 - DNA, 25 bp, Homo sapien
gagttactcagttaaacccattttg

SEQ ID NO: 494567 - DNA, 25 bp, Homo sapien
aacccattttgatctgaagcgactg

SEQ ID NO: 494568 - DNA, 25 bp, Homo sapien
agcgactgaaagcaggtcctggcca

SEQ ID NO: 494569 - DNA, 25 bp, Homo sapien
ggccctgttgagtctgcacagtccc

SEQ ID NO: 494570 - DNA, 25 bp, Homo sapien
tccctgcccagctgtgtcttctgtt

SEQ ID NO: 494571 - DNA, 25 bp, Homo sapien
tctgttggaagaaggaacctgcctt

SEQ ID NO: 494572 - DNA, 25 bp, Homo sapien
gaaggaacctgccttagctcagttt

SEQ ID NO: 494573 - DNA, 25 bp, Homo sapien
cctgccttagctcagtttccaggtg

SEQ ID NO: 494574 - DNA, 25 bp, Homo sapien
tgtagctaagaagatggcccattgg

SEQ ID NO: 494575 - DNA, 25 bp, Homo sapien
tggtgggagcaatgtcaccctgcct

SEQ ID NO: 494576 - DNA, 25 bp, Homo sapien
tccagctagctatgggcccagagtt

SEQ ID NO: 494577 - DNA, 25 bp, Homo sapien
tatgggcccagagtttctccctgag

SEQ ID NO: 494578 - DNA, 25 bp, Homo sapien
gttgctagcagggagatttctcttc

SEQ ID NO: 494579 - DNA, 25 bp, Homo sapien
gtgtctcctgagtgaggtagcgcct

SEQ ID NO: 494580 - DNA, 25 bp, Homo sapien
atgccctcaaagaagtcactgaagg

SEQ ID NO: 494581 - DNA, 25 bp, Homo sapien
aagtcactgaaggagcatcgggctg

SEQ ID NO: 494582 - DNA, 25 bp, Homo sapien
gagcatcgggctgacttggccgcat

SEQ ID NO: 494583 - DNA, 25 bp, Homo sapien
atcgggctgacttggccgcatggcc

SEQ ID NO: 494584 - DNA, 25 bp, Homo sapien
ggaagccctgcacacgatgcaggaa

SEQ ID NO: 494585 - DNA, 25 bp, Homo sapien
agtgggagatgctctgggtgtcggg

SEQ ID NO: 494586 - DNA, 25 bp, Homo sapien
tggtgcaccgactccggctcactgg

SEQ ID NO: 494587 - DNA, 25 bp, Homo sapien
actccggctcactgggtgtccagca

SEQ ID NO: 494588 - DNA, 25 bp, Homo sapien
ttgggtgccccaactcagtaaggcc

SEQ ID NO: 494589 - DNA, 25 bp, Homo sapien
gtgccccaactcagtaaggccaggg

SEQ ID NO: 494590 - DNA, 25 bp, Homo sapien
tttttcttgccgatgccctcaaaga

SEQ ID NO: 494591 - DNA, 25 bp, Homo sapien
tcccgggtcgctactactaataaat

SEQ ID NO: 494592 - DNA, 25 bp, Homo sapien
gggtcgctactactaataaattcgc

SEQ ID NO: 494593 - DNA, 25 bp, Homo sapien
agctgggacagcaaaacgtttcacc

SEQ ID NO: 494594 - DNA, 25 bp, Homo sapien
aaacgtttcaccagggttctcatgc

SEQ ID NO: 494595 - DNA, 25 bp, Homo sapien
tcaccagggttctcatgcagttcag

SEQ ID NO: 494596 - DNA, 25 bp, Homo sapien
ggttctcatgcagttcagaacccac

SEQ ID NO: 494597 - DNA, 25 bp, Homo sapien
agaacccactgtccacagatccaga

SEQ ID NO: 494598 - DNA, 25 bp, Homo sapien
gtccacagatccagacatttccctt

SEQ ID NO: 494599 - DNA, 25 bp, Homo sapien
ggacatactaaatttccactacagt

SEQ ID NO: 494600 - DNA, 25 bp, Homo sapien
tttccactacagttaggagacagtc

SEQ ID NO: 494601 - DNA, 25 bp, Homo sapien
aggagacagtcagtttgctttggga

SEQ ID NO: 494602 - DNA, 25 bp, Homo sapien
gggtgacagcaaggcgccatctcaa

SEQ ID NO: 494603 - DNA, 25 bp, Homo sapien
gtgacagcaaggcgccatctcaaaa

SEQ ID NO: 494604 - DNA, 25 bp, Homo sapien
caatagaatacaattgtgggagact

SEQ ID NO: 494605 - DNA, 25 bp, Homo sapien
aatagaatacaattgtgggagactt

SEQ ID NO: 494606 - DNA, 25 bp, Homo sapien
atagaatacaattgtgggagacttt

SEQ ID NO: 494607 - DNA, 25 bp, Homo sapien
tagaatacaattgtgggagacttta

SEQ ID NO: 494608 - DNA, 25 bp, Homo sapien
agaatacaattgtgggagactttaa

SEQ ID NO: 494609 - DNA, 25 bp, Homo sapien
gaatacaattgtgggagactttaat

SEQ ID NO: 494610 - DNA, 25 bp, Homo sapien
tgaaaattaaactggtttatcagtt

SEQ ID NO: 494611 - DNA, 25 bp, Homo sapien
ataaaaagagctatcattaaagcaa

SEQ ID NO: 494612 - DNA, 25 bp, Homo sapien
taaaaagagctatcattaaagcaag

SEQ ID NO: 494613 - DNA, 25 bp, Homo sapien
cctcttctagccctggagctgggac

SEQ ID NO: 494614 - DNA, 25 bp, Homo sapien
ggccagcctgactgggatgttccac

SEQ ID NO: 494615 - DNA, 25 bp, Homo sapien
tgggatgttccactggcacagagaa

SEQ ID NO: 494616 - DNA, 25 bp, Homo sapien
agagaagctcccagtgtctctggct

SEQ ID NO: 494617 - DNA, 25 bp, Homo sapien
tgtctctggctcatgtatacacaat

SEQ ID NO: 494618 - DNA, 25 bp, Homo sapien
tgtatacacaattctgaccctggga

SEQ ID NO: 494619 - DNA, 25 bp, Homo sapien
ggctgagccttaactttcagcttga

SEQ ID NO: 494620 - DNA, 25 bp, Homo sapien
aactttcagcttgatgactgggagc

SEQ ID NO: 494621 - DNA, 25 bp, Homo sapien
tggatgtccctagggagtctctaag

SEQ ID NO: 494622 - DNA, 25 bp, Homo sapien
agtctctaagggtcactccagcatt

SEQ ID NO: 494623 - DNA, 25 bp, Homo sapien
tcactccagcattagtatcccatga

SEQ ID NO: 494624 - DNA, 25 bp, Homo sapien
aggcactataccatttcagtggaga

SEQ ID NO: 494625 - DNA, 25 bp, Homo sapien
aagtcactggccagtttgaggtgct

SEQ ID NO: 494626 - DNA, 25 bp, Homo sapien
cagtttgaggtgcttccattggtct

SEQ ID NO: 494627 - DNA, 25 bp, Homo sapien
gtgcttccattggtctgggtaacta

SEQ ID NO: 494628 - DNA, 25 bp, Homo sapien
gggtaactagccatttcttcctgat

SEQ ID NO: 494629 - DNA, 25 bp, Homo sapien
atttcttcctgattgtgcctagtat

SEQ ID NO: 494630 - DNA, 25 bp, Homo sapien
gtgcctagtatatcccagacagttt

SEQ ID NO: 494631 - DNA, 25 bp, Homo sapien
cagacagtttgtttctatgcagaag

SEQ ID NO: 494632 - DNA, 25 bp, Homo sapien
gacatcatccatgctaaagtctgag

SEQ ID NO: 494633 - DNA, 25 bp, Homo sapien
aaagtctgagtcatctgcttccatt

SEQ ID NO: 494634 - DNA, 25 bp, Homo sapien
ccatttttgttattccccacatcca

SEQ ID NO: 494635 - DNA, 25 bp, Homo sapien
aagctgaagctattcgaatcctggc

SEQ ID NO: 494636 - DNA, 25 bp, Homo sapien
gatgcagcagcttcactgactgtgg

SEQ ID NO: 494637 - DNA, 25 bp, Homo sapien
ctgactgtggccgagcagtatgtca

SEQ ID NO: 494638 - DNA, 25 bp, Homo sapien
agcagtatgtcagcgcgttctccaa

SEQ ID NO: 494639 - DNA, 25 bp, Homo sapien
cagcgcgttctccaaactggccaag

SEQ ID NO: 494640 - DNA, 25 bp, Homo sapien
aaggactccaacactatcctactgc

SEQ ID NO: 494641 - DNA, 25 bp, Homo sapien
ggcgatgtcaccagcatggtggctc

SEQ ID NO: 494642 - DNA, 25 bp, Homo sapien
gggtgtatatggagccctcaccaaa

SEQ ID NO: 494643 - DNA, 25 bp, Homo sapien
agtgccagggactccagactcactc

SEQ ID NO: 494644 - DNA, 25 bp, Homo sapien
gagcagcagagatgtccagggtaca

SEQ ID NO: 494645 - DNA, 25 bp, Homo sapien
ccagggtacagatgcaagtcttgat

SEQ ID NO: 494646 - DNA, 25 bp, Homo sapien
ttgtggattgcttagaaagatcctt

SEQ ID NO: 494647 - DNA, 25 bp, Homo sapien
gattgcttagaaagatccttttggg

SEQ ID NO: 494648 - DNA, 25 bp, Homo sapien
atccttttgggcagcctgaagactg

SEQ ID NO: 494649 - DNA, 25 bp, Homo sapien
tccttttgggcagcctgaagactgg

SEQ ID NO: 494650 - DNA, 25 bp, Homo sapien
atcccagttggtaacattcccacct

SEQ ID NO: 494651 - DNA, 25 bp, Homo sapien
tcccagttggtaacattcccacctg

SEQ ID NO: 494652 - DNA, 25 bp, Homo sapien
ccagttggtaacattcccacctgat

SEQ ID NO: 494653 - DNA, 25 bp, Homo sapien
cagttggtaacattcccacctgatt

SEQ ID NO: 494654 - DNA, 25 bp, Homo sapien
gctgctgcagctgagttctggtttt

SEQ ID NO: 494655 - DNA, 25 bp, Homo sapien
tcacacacgtgcggccaggaggctg

SEQ ID NO: 494656 - DNA, 25 bp, Homo sapien
cccaagtccttttctgctggaaaat

SEQ ID NO: 494657 - DNA, 25 bp, Homo sapien
gtatgaagttcattttcggtagtct

SEQ ID NO: 494658 - DNA, 25 bp, Homo sapien
tcattttcggtagtcttccaacctc

SEQ ID NO: 494659 - DNA, 25 bp, Homo sapien
ttccaacctctcaggtgcctaataa

SEQ ID NO: 494660 - DNA, 25 bp, Homo sapien
aacctctcaggtgcctaataattta

SEQ ID NO: 494661 - DNA, 25 bp, Homo sapien
atagtcgagataggagaacgtgtct

SEQ ID NO: 494662 - DNA, 25 bp, Homo sapien
gaacgtgtctattagtctttgcatc

SEQ ID NO: 494663 - DNA, 25 bp, Homo sapien
tctaaaaggcagtgagttacgttcc

SEQ ID NO: 494664 - DNA, 25 bp, Homo sapien
agtgagttacgttcctgccttccac

SEQ ID NO: 494665 - DNA, 25 bp, Homo sapien
gtgtttctgacatagcaatgtttgt

SEQ ID NO: 494666 - DNA, 25 bp, Homo sapien
gtttgtttgatattggaacctggat

SEQ ID NO: 494667 - DNA, 25 bp, Homo sapien
attggaacctggattcatattttat

SEQ ID NO: 494668 - DNA, 25 bp, Homo sapien
cacggcagcatttcgaatgagtgca

SEQ ID NO: 494669 - DNA, 25 bp, Homo sapien
aatgagtgcagctctgtgtctgtca

SEQ ID NO: 494670 - DNA, 25 bp, Homo sapien
gtgcagctctgtgtctgtcagaaag

SEQ ID NO: 494671 - DNA, 25 bp, Homo sapien
atgtgagtcctctttttaatggtgc

SEQ ID NO: 494672 - DNA, 25 bp, Homo sapien
gctttttgtaacctttaatgctgag

SEQ ID NO: 494673 - DNA, 25 bp, Homo sapien
atgctgaggtacagagctgcttttc

SEQ ID NO: 494674 - DNA, 25 bp, Homo sapien
gagctgcttttcaatatttcataaa

SEQ ID NO: 494675 - DNA, 25 bp, Homo sapien
ggcagacaagagtggattttaaagc

SEQ ID NO: 494676 - DNA, 25 bp, Homo sapien
aaagctgttcttcaaacgtaatttg

SEQ ID NO: 494677 - DNA, 25 bp, Homo sapien
aacgtaatttgtcactggactctga

SEQ ID NO: 494678 - DNA, 25 bp, Homo sapien
ctggactctgacacacctggaaatt

SEQ ID NO: 494679 - DNA, 25 bp, Homo sapien
catattttcccttatgtgtagcctt

SEQ ID NO: 494680 - DNA, 25 bp, Homo sapien
tttcccttatgtgtagccttagtta

SEQ ID NO: 494681 - DNA, 25 bp, Homo sapien
tcccttatgtgtagccttagttata

SEQ ID NO: 494682 - DNA, 25 bp, Homo sapien
gtagccttagttatactattttgta

SEQ ID NO: 494683 - DNA, 25 bp, Homo sapien
tatatataaactctttcctgttctt

SEQ ID NO: 494684 - DNA, 25 bp, Homo sapien
tctttcctgttcttttacataagat

SEQ ID NO: 494685 - DNA, 25 bp, Homo sapien
agctgcatagtattttctcatgtta

SEQ ID NO: 494686 - DNA, 25 bp, Homo sapien
ctcatgttaatgtattgtagtttac

SEQ ID NO: 494687 - DNA, 25 bp, Homo sapien
gtagtttactaagtcataactttat

SEQ ID NO: 494688 - DNA, 25 bp, Homo sapien
tctaagcatagttctacatcttaac

SEQ ID NO: 494689 - DNA, 25 bp, Homo sapien
tctagtccctgtctacatattttcc

SEQ ID NO: 494690 - DNA, 25 bp, Homo sapien
aggaatcttttaagccacctgggct

SEQ ID NO: 494691 - DNA, 25 bp, Homo sapien
cttttaagccacctgggcttcaaag

SEQ ID NO: 494692 - DNA, 25 bp, Homo sapien
tctgcttttaaattggtaaccttgc

SEQ ID NO: 494693 - DNA, 25 bp, Homo sapien
aattggtaaccttgcttaattgcat

SEQ ID NO: 494694 - DNA, 25 bp, Homo sapien
ccttgcttaattgcatgttgccctg

SEQ ID NO: 494695 - DNA, 25 bp, Homo sapien
aataaccttgcaattgacatctctt

SEQ ID NO: 494696 - DNA, 25 bp, Homo sapien
cttgcaattgacatctctttttaaa

SEQ ID NO: 494697 - DNA, 25 bp, Homo sapien
tctcctatgactatgattttcttcg

SEQ ID NO: 494698 - DNA, 25 bp, Homo sapien
tatgactatgattttcttcgaacaa

SEQ ID NO: 494699 - DNA, 25 bp, Homo sapien
gattttcttcgaacaaagagtttga

SEQ ID NO: 494700 - DNA, 25 bp, Homo sapien
aagagtttgagaggccttgcttcgt

SEQ ID NO: 494701 - DNA, 25 bp, Homo sapien
ccattcaggtctgccctggagagca

SEQ ID NO: 494702 - DNA, 25 bp, Homo sapien
tctgccctggagagcagcccagcag

SEQ ID NO: 494703 - DNA, 25 bp, Homo sapien
agcagacccggccacgctcagtgag

SEQ ID NO: 494704 - DNA, 25 bp, Homo sapien
cagacccggccacgctcagtgagga

SEQ ID NO: 494705 - DNA, 25 bp, Homo sapien
acccggccacgctcagtgaggacga

SEQ ID NO: 494706 - DNA, 25 bp, Homo sapien
ccggccacgctcagtgaggacgaag

SEQ ID NO: 494707 - DNA, 25 bp, Homo sapien
cggccacgctcagtgaggacgaagc

SEQ ID NO: 494708 - DNA, 25 bp, Homo sapien
cgctcagtgaggacgaagcgcgcct

SEQ ID NO: 494709 - DNA, 25 bp, Homo sapien
agtgaggacgaagcgcgcctcctgc

SEQ ID NO: 494710 - DNA, 25 bp, Homo sapien
gagggctccagaatcattgcccaga

SEQ ID NO: 494711 - DNA, 25 bp, Homo sapien
gtggtgaagaacaactttgtgccca

SEQ ID NO: 494712 - DNA, 25 bp, Homo sapien
acttgtcttagtttctttccttgtg

SEQ ID NO: 494713 - DNA, 25 bp, Homo sapien
tttccttgtggtctatgctatttta

SEQ ID NO: 494714 - DNA, 25 bp, Homo sapien
gctattttacttgcgatttgttgga

SEQ ID NO: 494715 - DNA, 25 bp, Homo sapien
gatttgttggatattctccctgtca

SEQ ID NO: 494716 - DNA, 25 bp, Homo sapien
ggatattctccctgtcattaaagag

SEQ ID NO: 494717 - DNA, 25 bp, Homo sapien
aatggaagttagtttctctatgcaa

SEQ ID NO: 494718 - DNA, 25 bp, Homo sapien
gttagtttctctatgcaaatgcttt

SEQ ID NO: 494719 - DNA, 25 bp, Homo sapien
gaagctgataggtttagcattgatt

SEQ ID NO: 494720 - DNA, 25 bp, Homo sapien
cattgatttttgctggtgtccttca

SEQ ID NO: 494721 - DNA, 25 bp, Homo sapien
atttttgctggtgtccttcaacaag

SEQ ID NO: 494722 - DNA, 25 bp, Homo sapien
agggcagtaaggaacaggtgtccaa

SEQ ID NO: 494723 - DNA, 25 bp, Homo sapien
aattgaaagctttgctgcacaagaa

SEQ ID NO: 494724 - DNA, 25 bp, Homo sapien
gaaagctttgctgcacaagaaaaac

SEQ ID NO: 494725 - DNA, 25 bp, Homo sapien
gaagtttgtgaagtatgtggagcct

SEQ ID NO: 494726 - DNA, 25 bp, Homo sapien
gtatgtggagcctttttaatagtag

SEQ ID NO: 494727 - DNA, 25 bp, Homo sapien
taatagtaggagatgcccagtcccg

SEQ ID NO: 494728 - DNA, 25 bp, Homo sapien
atagtaggagatgcccagtcccggg

SEQ ID NO: 494729 - DNA, 25 bp, Homo sapien
cagtcccgggtagatgaccatttga

SEQ ID NO: 494730 - DNA, 25 bp, Homo sapien
aagaaccgaagaacctgatcgtgat

SEQ ID NO: 494731 - DNA, 25 bp, Homo sapien
gaacctgatcgtgatgagcgtctaa

SEQ ID NO: 494732 - DNA, 25 bp, Homo sapien
acctgatcgtgatgagcgtctaaaa

SEQ ID NO: 494733 - DNA, 25 bp, Homo sapien
atcgtgatgagcgtctaaaaaagga

SEQ ID NO: 494734 - DNA, 25 bp, Homo sapien
agcagacccggccacgctcagtgag

SEQ ID NO: 494735 - DNA, 25 bp, Homo sapien
gcagacccggccacgctcagtgagg

SEQ ID NO: 494736 - DNA, 25 bp, Homo sapien
cagacccggccacgctcagtgagga

SEQ ID NO: 494737 - DNA, 25 bp, Homo sapien
agacccggccacgctcagtgaggac

SEQ ID NO: 494738 - DNA, 25 bp, Homo sapien
gacccggccacgctcagtgaggacg

SEQ ID NO: 494739 - DNA, 25 bp, Homo sapien
acccggccacgctcagtgaggacga

SEQ ID NO: 494740 - DNA, 25 bp, Homo sapien
cagtgaggacgaagcgcgcctcctg

SEQ ID NO: 494741 - DNA, 25 bp, Homo sapien
agtgaggacgaagcgcgcctcctgc

SEQ ID NO: 494742 - DNA, 25 bp, Homo sapien
gtgaggacgaagcgcgcctcctgct

SEQ ID NO: 494743 - DNA, 25 bp, Homo sapien
tgaggacgaagcgcgcctcctgctg

SEQ ID NO: 494744 - DNA, 25 bp, Homo sapien
gcaagtgaagtacccagtgaactct

SEQ ID NO: 494745 - DNA, 25 bp, Homo sapien
agtgaactctctgaacgcccaaaag

SEQ ID NO: 494746 - DNA, 25 bp, Homo sapien
ctctgaacgcccaaaaggattttat

SEQ ID NO: 494747 - DNA, 25 bp, Homo sapien
gatcctcaactattggaaatcatgg

SEQ ID NO: 494748 - DNA, 25 bp, Homo sapien
aaatcatggactggtggccctggta

SEQ ID NO: 494749 - DNA, 25 bp, Homo sapien
gtggccctggtacagaaccatgact

SEQ ID NO: 494750 - DNA, 25 bp, Homo sapien
agaaccatgactggctgctgaattc

SEQ ID NO: 494751 - DNA, 25 bp, Homo sapien
ccaggacttggttcaacatttaaat

SEQ ID NO: 494752 - DNA, 25 bp, Homo sapien
ttgatagttgccctgattcccattt

SEQ ID NO: 494753 - DNA, 25 bp, Homo sapien
gttgccctgattcccattttgggtt

SEQ ID NO: 494754 - DNA, 25 bp, Homo sapien
tcccattttgggtttgtgaaaagtg

SEQ ID NO: 494755 - DNA, 25 bp, Homo sapien
ttttcaagccatgtccgcaaggtga

SEQ ID NO: 494756 - DNA, 25 bp, Homo sapien
atgtccgcaaggtgaaccgcttcca

SEQ ID NO: 494757 - DNA, 25 bp, Homo sapien
tgaaccgcttccacaagatccggaa

SEQ ID NO: 494758 - DNA, 25 bp, Homo sapien
gcttccacaagatccggaaccgggc

SEQ ID NO: 494759 - DNA, 25 bp, Homo sapien
agaccagcacctctacaagctggac

SEQ ID NO: 494760 - DNA, 25 bp, Homo sapien
acaagctggaccctgaccggcagta

SEQ ID NO: 494761 - DNA, 25 bp, Homo sapien
tgagcgtgaccagcggaggagacca

SEQ ID NO: 494762 - DNA, 25 bp, Homo sapien
aggacgacctcgtggtgtgcctgca

SEQ ID NO: 494763 - DNA, 25 bp, Homo sapien
agcctgtttgctcagcgactaaaga

SEQ ID NO: 494764 - DNA, 25 bp, Homo sapien
gtttgctcagcgactaaagacactt

SEQ ID NO: 494765 - DNA, 25 bp, Homo sapien
gactaaagacacttcgggacaaaga

SEQ ID NO: 494766 - DNA, 25 bp, Homo sapien
gagaatctgagattggaagcctcta

SEQ ID NO: 494767 - DNA, 25 bp, Homo sapien
agaatctgagattggaagcctctag

SEQ ID NO: 494768 - DNA, 25 bp, Homo sapien
gaatctgagattggaagcctctagg

SEQ ID NO: 494769 - DNA, 25 bp, Homo sapien
aatctgagattggaagcctctaggc

SEQ ID NO: 494770 - DNA, 25 bp, Homo sapien
atctgagattggaagcctctaggct

SEQ ID NO: 494771 - DNA, 25 bp, Homo sapien
tctgagattggaagcctctaggctg

SEQ ID NO: 494772 - DNA, 25 bp, Homo sapien
ctgagattggaagcctctaggctga

SEQ ID NO: 494773 - DNA, 25 bp, Homo sapien
tccatctcctgttcattctcagctg

SEQ ID NO: 494774 - DNA, 25 bp, Homo sapien
ccatctcctgttcattctcagctgg

SEQ ID NO: 494775 - DNA, 25 bp, Homo sapien
catctcctgttcattctcagctggc

SEQ ID NO: 494776 - DNA, 25 bp, Homo sapien
atctcctgttcattctcagctggcc

SEQ ID NO: 494777 - DNA, 25 bp, Homo sapien
gtagaaaggtatccaaggtgaagcc

SEQ ID NO: 494778 - DNA, 25 bp, Homo sapien
agcctgagacgaatggctttcccag

SEQ ID NO: 494779 - DNA, 25 bp, Homo sapien
aatggctttcccaggctaccttcca

SEQ ID NO: 494780 - DNA, 25 bp, Homo sapien
gctaccttccatcactgttgtacag

SEQ ID NO: 494781 - DNA, 25 bp, Homo sapien
gggtctctgctatggaaatgccatt

SEQ ID NO: 494782 - DNA, 25 bp, Homo sapien
cattttttgtgtctcctttctccta

SEQ ID NO: 494783 - DNA, 25 bp, Homo sapien
tttctcacatcctcttcatgattga

SEQ ID NO: 494784 - DNA, 25 bp, Homo sapien
caaggtgttgcctgcgagtctggtt

SEQ ID NO: 494785 - DNA, 25 bp, Homo sapien
gcctgcgagtctggttgtaagttca

SEQ ID NO: 494786 - DNA, 25 bp, Homo sapien
tggttgtaagttcagcctttggtgt

SEQ ID NO: 494787 - DNA, 25 bp, Homo sapien
tggtgtttgcactactgctatcata

SEQ ID NO: 494788 - DNA, 25 bp, Homo sapien
aataccacaacacttatggcctgtc

SEQ ID NO: 494789 - DNA, 25 bp, Homo sapien
cacaacacttatggcctgtcttgga

SEQ ID NO: 494790 - DNA, 25 bp, Homo sapien
atggcctgtcttggaggccttctgg

SEQ ID NO: 494791 - DNA, 25 bp, Homo sapien
ggattattggtgtgatatgtcttat

SEQ ID NO: 494792 - DNA, 25 bp, Homo sapien
gatatgtcttatcagctgcctctct

SEQ ID NO: 494793 - DNA, 25 bp, Homo sapien
cacagctatgtgaggaattacttac

SEQ ID NO: 494794 - DNA, 25 bp, Homo sapien
tacttacagaaaccaacctttgcat

SEQ ID NO: 494795 - DNA, 25 bp, Homo sapien
gcattaggtgagctttatcctcctc

SEQ ID NO: 494796 - DNA, 25 bp, Homo sapien
gtgagctttatcctcctctgataaa

SEQ ID NO: 494797 - DNA, 25 bp, Homo sapien
atcctcctctgataaatctctggga

SEQ ID NO: 494798 - DNA, 25 bp, Homo sapien
agcaactgttataggtttaccaaca

SEQ ID NO: 494799 - DNA, 25 bp, Homo sapien
gagcagacactagcttaaacaactg

SEQ ID NO: 494800 - DNA, 25 bp, Homo sapien
cactagcttaaacaactgtgaaggt

SEQ ID NO: 494801 - DNA, 25 bp, Homo sapien
aggtgctgctggcagcacatctgaa

SEQ ID NO: 494802 - DNA, 25 bp, Homo sapien
tgtggctgccttgcctgtaactcag

SEQ ID NO: 494803 - DNA, 25 bp, Homo sapien
gccttgcctgtaactcagcaaatga

SEQ ID NO: 494804 - DNA, 25 bp, Homo sapien
acagaggtgtcagagccagttgtca

SEQ ID NO: 494805 - DNA, 25 bp, Homo sapien
gtgtcagagccagttgtcactcagc

SEQ ID NO: 494806 - DNA, 25 bp, Homo sapien
gggacagctagtggttccaacagtc

SEQ ID NO: 494807 - DNA, 25 bp, Homo sapien
agctagtggttccaacagtcctacc

SEQ ID NO: 494808 - DNA, 25 bp, Homo sapien
aacagtcctacctcagattctgcat

SEQ ID NO: 494809 - DNA, 25 bp, Homo sapien
gcatctgtacagagagcagacacta

SEQ ID NO: 494810 - DNA, 25 bp, Homo sapien
atttctcgtggcaagaagggagctc

SEQ ID NO: 494811 - DNA, 25 bp, Homo sapien
agctcatcttctgggtcctgccaga

SEQ ID NO: 494812 - DNA, 25 bp, Homo sapien
gctcatcttctgggtcctgccagag

SEQ ID NO: 494813 - DNA, 25 bp, Homo sapien
ctcatcttctgggtcctgccagagg

SEQ ID NO: 494814 - DNA, 25 bp, Homo sapien
tcatcttctgggtcctgccagaggg

SEQ ID NO: 494815 - DNA, 25 bp, Homo sapien
catcttctgggtcctgccagagggc

SEQ ID NO: 494816 - DNA, 25 bp, Homo sapien
atcttctgggtcctgccagagggca

SEQ ID NO: 494817 - DNA, 25 bp, Homo sapien
tcttctgggtcctgccagagggcag

SEQ ID NO: 494818 - DNA, 25 bp, Homo sapien
cttctgggtcctgccagagggcagt

SEQ ID NO: 494819 - DNA, 25 bp, Homo sapien
tctgggtcctgccagagggcagtga

SEQ ID NO: 494820 - DNA, 25 bp, Homo sapien
ctgggtcctgccagagggcagtgag

SEQ ID NO: 494821 - DNA, 25 bp, Homo sapien
ttctcccaaacaagaaccaacatag

SEQ ID NO: 494822 - DNA, 25 bp, Homo sapien
accaacatagacagctatctgccct

SEQ ID NO: 494823 - DNA, 25 bp, Homo sapien
atagacagctatctgccctacccgg

SEQ ID NO: 494824 - DNA, 25 bp, Homo sapien
tgttctacccagctcagcctgcggg

SEQ ID NO: 494825 - DNA, 25 bp, Homo sapien
agcctgcgggtctttcagtacctgg

SEQ ID NO: 494826 - DNA, 25 bp, Homo sapien
cctgcgggtctttcagtacctggtg

SEQ ID NO: 494827 - DNA, 25 bp, Homo sapien
gcactcacgtcccagtgtcaagtca

SEQ ID NO: 494828 - DNA, 25 bp, Homo sapien
tcacgtcccagtgtcaagtcacaaa

SEQ ID NO: 494829 - DNA, 25 bp, Homo sapien
gtcaagtcacaaaaggcaagctcat

SEQ ID NO: 494830 - DNA, 25 bp, Homo sapien
aggcaagctcatcaagcaaatggtt

SEQ ID NO: 494831 - DNA, 25 bp, Homo sapien
gctcatcaagcaaatggttctagga

SEQ ID NO: 494832 - DNA, 25 bp, Homo sapien
gctgacaagtgtgaatcccgtgaag

SEQ ID NO: 494833 - DNA, 25 bp, Homo sapien
gtgtgaatcccgtgaagactttatt

SEQ ID NO: 494834 - DNA, 25 bp, Homo sapien
aatcccgtgaagactttattttgtg

SEQ ID NO: 494835 - DNA, 25 bp, Homo sapien
gcaaggttggtccttcgtaacaacg

SEQ ID NO: 494836 - DNA, 25 bp, Homo sapien
ggttggtccttcgtaacaacggatg

SEQ ID NO: 494837 - DNA, 25 bp, Homo sapien
ggtccttcgtaacaacggatgaaat

SEQ ID NO: 494838 - DNA, 25 bp, Homo sapien
agcgcccctgtccttggcatgtttt

SEQ ID NO: 494839 - DNA, 25 bp, Homo sapien
cctgtccttggcatgttttgtatca

SEQ ID NO: 494840 - DNA, 25 bp, Homo sapien
ccttggcatgttttgtatcagcgat

SEQ ID NO: 494841 - DNA, 25 bp, Homo sapien
gcatgttttgtatcagcgatcattc

SEQ ID NO: 494842 - DNA, 25 bp, Homo sapien
gcgatcattctgaactgtacatatt

SEQ ID NO: 494843 - DNA, 25 bp, Homo sapien
acataatatttacgtctaacagacc

SEQ ID NO: 494844 - DNA, 25 bp, Homo sapien
atatatttttgtttgacgcggacta

SEQ ID NO: 494845 - DNA, 25 bp, Homo sapien
ttgtttgacgcggactaaatcattt

SEQ ID NO: 494846 - DNA, 25 bp, Homo sapien
ggtaagttaggatttctatggcaat

SEQ ID NO: 494847 - DNA, 25 bp, Homo sapien
aaaacccacgcgaatggacacttgt

SEQ ID NO: 494848 - DNA, 25 bp, Homo sapien
tggacacttgtacccgatcataata

SEQ ID NO: 494849 - DNA, 25 bp, Homo sapien
gaaaagagccgcttgaatcgccgct

SEQ ID NO: 494850 - DNA, 25 bp, Homo sapien
ttctatggcaatgtgcaagtcgcac

SEQ ID NO: 494851 - DNA, 25 bp, Homo sapien
tgtgcaagtcgcactgaaatcctga

SEQ ID NO: 494852 - DNA, 25 bp, Homo sapien
tgaaatcctgaaaggccaagcctgg

SEQ ID NO: 494853 - DNA, 25 bp, Homo sapien
gcccgtccaggcttttcattaagga

SEQ ID NO: 494854 - DNA, 25 bp, Homo sapien
ttccaagtataacctgtcccagggt

SEQ ID NO: 494855 - DNA, 25 bp, Homo sapien
cagggtcctcttgctcagctgtgac

SEQ ID NO: 494856 - DNA, 25 bp, Homo sapien
agtctgttcaatttaactacttaga

SEQ ID NO: 494857 - DNA, 25 bp, Homo sapien
atagcaacaaaactgtcctaacgtt

SEQ ID NO: 494858 - DNA, 25 bp, Homo sapien
tgtcctaacgttttcactgttctgt

SEQ ID NO: 494859 - DNA, 25 bp, Homo sapien
ggatacccataatttcttaacactg

SEQ ID NO: 494860 - DNA, 25 bp, Homo sapien
cttaacactggaaacatcattctga

SEQ ID NO: 494861 - DNA, 25 bp, Homo sapien
ttctgaacgatgtaggaagcggtca

SEQ ID NO: 494862 - DNA, 25 bp, Homo sapien
ggaagcggtcagtaacgtgaatgat

SEQ ID NO: 494863 - DNA, 25 bp, Homo sapien
atgatgttattgtaccgtctccagc

SEQ ID NO: 494864 - DNA, 25 bp, Homo sapien
ttattgtaccgtctccagctttttc

SEQ ID NO: 494865 - DNA, 25 bp, Homo sapien
caggtgctcgctggccatcacagtt

SEQ ID NO: 494866 - DNA, 25 bp, Homo sapien
gccatcacagttgcgattccatgag

SEQ ID NO: 494867 - DNA, 25 bp, Homo sapien
gcgattccatgagtagctgctttat

SEQ ID NO: 494868 - DNA, 25 bp, Homo sapien
gactgctttttgtactatctggatg

SEQ ID NO: 494869 - DNA, 25 bp, Homo sapien
gatgtgcccagagttacttctgtac

SEQ ID NO: 494870 - DNA, 25 bp, Homo sapien
gagttacttctgtacaagctctgta

SEQ ID NO: 494871 - DNA, 25 bp, Homo sapien
gctctgtatctatgtccgttgagaa

SEQ ID NO: 494872 - DNA, 25 bp, Homo sapien
aagaacaccaacagtagcatgaaat

SEQ ID NO: 494873 - DNA, 25 bp, Homo sapien
atgtaaactgcagaagtcagagcaa

SEQ ID NO: 494874 - DNA, 25 bp, Homo sapien
gtcagagcaagtgcctacattttgt

SEQ ID NO: 494875 - DNA, 25 bp, Homo sapien
tttttggcattactacagagccatg

SEQ ID NO: 494876 - DNA, 25 bp, Homo sapien
tgagtttagctgctgatgtttgtcg

SEQ ID NO: 494877 - DNA, 25 bp, Homo sapien
atgtttgtcggtttatcaggcactc

SEQ ID NO: 494878 - DNA, 25 bp, Homo sapien
gtttgtcggtttatcaggcactcaa

SEQ ID NO: 494879 - DNA, 25 bp, Homo sapien
ttgtcggtttatcaggcactcaaaa

SEQ ID NO: 494880 - DNA, 25 bp, Homo sapien
ggcactcaaaaaactgcactctcta

SEQ ID NO: 494881 - DNA, 25 bp, Homo sapien
caaaaaactgcactctctattccct

SEQ ID NO: 494882 - DNA, 25 bp, Homo sapien
ggcatccttatttcctagacagatt

SEQ ID NO: 494883 - DNA, 25 bp, Homo sapien
tccttatttcctagacagatttgtg

SEQ ID NO: 494884 - DNA, 25 bp, Homo sapien
gtagatgctgggaacatgttttgct

SEQ ID NO: 494885 - DNA, 25 bp, Homo sapien
gggcttcctggaaggtaatgcagat

SEQ ID NO: 494886 - DNA, 25 bp, Homo sapien
ggaaggtaatgcagatgtgacgtca

SEQ ID NO: 494887 - DNA, 25 bp, Homo sapien
cctgcgtggccacccgcaacagctg

SEQ ID NO: 494888 - DNA, 25 bp, Homo sapien
tgccagtgccgcttcttccgcagcg

SEQ ID NO: 494889 - DNA, 25 bp, Homo sapien
cgcgtgctcagcctcaactgctgag

SEQ ID NO: 494890 - DNA, 25 bp, Homo sapien
gtgctcagcctcaactgctgagcgc

SEQ ID NO: 494891 - DNA, 25 bp, Homo sapien
ttctcgggcgggtgatccctaacag

SEQ ID NO: 494892 - DNA, 25 bp, Homo sapien
tctcgggcgggtgatccctaacagg

SEQ ID NO: 494893 - DNA, 25 bp, Homo sapien
gggtgatccctaacagggcggcttc

SEQ ID NO: 494894 - DNA, 25 bp, Homo sapien
gtgatccctaacagggcggcttccc

SEQ ID NO: 494895 - DNA, 25 bp, Homo sapien
gttccaggagatgggacttcaggga

SEQ ID NO: 494896 - DNA, 25 bp, Homo sapien
atgggacttcagggagacctggctt

SEQ ID NO: 494897 - DNA, 25 bp, Homo sapien
gacttcagggagacctggcttgggc

SEQ ID NO: 494898 - DNA, 25 bp, Homo sapien
gggtaacctgcatggtgacagctac

SEQ ID NO: 494899 - DNA, 25 bp, Homo sapien
taacctgcatggtgacagctactga

SEQ ID NO: 494900 - DNA, 25 bp, Homo sapien
acctgcatggtgacagctactgagg

SEQ ID NO: 494901 - DNA, 25 bp, Homo sapien
cagtggttaccaaagccaaggagag

SEQ ID NO: 494902 - DNA, 25 bp, Homo sapien
ggcctggccatggactgctctggaa

SEQ ID NO: 494903 - DNA, 25 bp, Homo sapien
gccatggactgctctggaattccga

SEQ ID NO: 494904 - DNA, 25 bp, Homo sapien
tggactgctctggaattccgagtgt

SEQ ID NO: 494905 - DNA, 25 bp, Homo sapien
ctgctctggaattccgagtgtgaac

SEQ ID NO: 494906 - DNA, 25 bp, Homo sapien
ctggaattccgagtgtgaactttca

SEQ ID NO: 494907 - DNA, 25 bp, Homo sapien
gtgtgaactttcagccaagaaggta

SEQ ID NO: 494908 - DNA, 25 bp, Homo sapien
tgaactttcagccaagaaggtagtg

SEQ ID NO: 494909 - DNA, 25 bp, Homo sapien
ttaaatattcagactgccccaactg

SEQ ID NO: 494910 - DNA, 25 bp, Homo sapien
gactgccccaactgataagttgtgt

SEQ ID NO: 494911 - DNA, 25 bp, Homo sapien
aagttgtgtttcttccacagtcgac

SEQ ID NO: 494912 - DNA, 25 bp, Homo sapien
gtttcttccacagtcgacatactga

SEQ ID NO: 494913 - DNA, 25 bp, Homo sapien
gacatactgatacctctcctgggat

SEQ ID NO: 494914 - DNA, 25 bp, Homo sapien
gatacctctcctgggatatctgttc

SEQ ID NO: 494915 - DNA, 25 bp, Homo sapien
tatctgttcagagtggccaaagtat

SEQ ID NO: 494916 - DNA, 25 bp, Homo sapien
ggccaaagtatgttgttgtcacagt

SEQ ID NO: 494917 - DNA, 25 bp, Homo sapien
tgttgttgtcacagtaactctaaaa

SEQ ID NO: 494918 - DNA, 25 bp, Homo sapien
gaagtttttccatagtgagactact

SEQ ID NO: 494919 - DNA, 25 bp, Homo sapien
tagtgagactactttaacacataaa

SEQ ID NO: 494920 - DNA, 25 bp, Homo sapien
aacgttctgcaaccattgatgctgg

SEQ ID NO: 494921 - DNA, 25 bp, Homo sapien
cacgtacgccgttaacatcaacaat

SEQ ID NO: 494922 - DNA, 25 bp, Homo sapien
aatcaaaccaccacgaacagcgttg

SEQ ID NO: 494923 - DNA, 25 bp, Homo sapien
gaacagcgttgataaccttggcatc

SEQ ID NO: 494924 - DNA, 25 bp, Homo sapien
ttggcatcaactgtgtcaccttcag

SEQ ID NO: 494925 - DNA, 25 bp, Homo sapien
aaagctcaagttttcccatgccttg

SEQ ID NO: 494926 - DNA, 25 bp, Homo sapien
gcatccaaacgcttctttgacaaca

SEQ ID NO: 494927 - DNA, 25 bp, Homo sapien
tgtgcagcgcgttcttgtgcagcaa

SEQ ID NO: 494928 - DNA, 25 bp, Homo sapien
tgtgcagcaacagccttacgtgaca

SEQ ID NO: 494929 - DNA, 25 bp, Homo sapien
acgtgcattagcagggtcaatttcg

SEQ ID NO: 494930 - DNA, 25 bp, Homo sapien
ggtcaatttcgataacttgtgcttt

SEQ ID NO: 494931 - DNA, 25 bp, Homo sapien
gaggctcctgagaatcaacccaact

SEQ ID NO: 494932 - DNA, 25 bp, Homo sapien
gctcctgagaatcaacccaactgaa

SEQ ID NO: 494933 - DNA, 25 bp, Homo sapien
gaatcaacccaactgaagcatttca

SEQ ID NO: 494934 - DNA, 25 bp, Homo sapien
attcacttgaatgagaaacgtgttt

SEQ ID NO: 494935 - DNA, 25 bp, Homo sapien
acgtgtttagtatcaaaagagccca

SEQ ID NO: 494936 - DNA, 25 bp, Homo sapien
gacactggtgtgaaaggtacaatct

SEQ ID NO: 494937 - DNA, 25 bp, Homo sapien
ggtacaatctcagaggttggtcaat

SEQ ID NO: 494938 - DNA, 25 bp, Homo sapien
ggttggtcaattaccgtggcacact

SEQ ID NO: 494939 - DNA, 25 bp, Homo sapien
aattaccgtggcacactttctggtc

SEQ ID NO: 494940 - DNA, 25 bp, Homo sapien
ctttctggtcactttgtacaatgta

SEQ ID NO: 494941 - DNA, 25 bp, Homo sapien
ctggtcactttgtacaatgtagatt

SEQ ID NO: 494942 - DNA, 25 bp, Homo sapien
aaacttcagaacctggatgcgctca

SEQ ID NO: 494943 - DNA, 25 bp, Homo sapien
ttcagaacctggatgcgctcaccaa

SEQ ID NO: 494944 - DNA, 25 bp, Homo sapien
tggatgcgctcaccaacctgacagt

SEQ ID NO: 494945 - DNA, 25 bp, Homo sapien
aacctgacagtcctcagtatgcaga

SEQ ID NO: 494946 - DNA, 25 bp, Homo sapien
agtcctcagtatgcagagcaaccgg

SEQ ID NO: 494947 - DNA, 25 bp, Homo sapien
gagcaaccggctgaccaagatcgag

SEQ ID NO: 494948 - DNA, 25 bp, Homo sapien
caaccggctgaccaagatcgagggt

SEQ ID NO: 494949 - DNA, 25 bp, Homo sapien
agatcgagggtctgcagaacctggt

SEQ ID NO: 494950 - DNA, 25 bp, Homo sapien
agggtctgcagaacctggtgaacct

SEQ ID NO: 494951 - DNA, 25 bp, Homo sapien
tgtaccttagccacaatggcatcga

SEQ ID NO: 494952 - DNA, 25 bp, Homo sapien
atggcatcgaggtcatcgagggcct

SEQ ID NO: 494953 - DNA, 25 bp, Homo sapien
ccaacccaagtaaagaacagccaag

SEQ ID NO: 494954 - DNA, 25 bp, Homo sapien
caacccaagtaaagaacagccaagt

SEQ ID NO: 494955 - DNA, 25 bp, Homo sapien
aacccaagtaaagaacagccaagtg

SEQ ID NO: 494956 - DNA, 25 bp, Homo sapien
acccaagtaaagaacagccaagtgg

SEQ ID NO: 494957 - DNA, 25 bp, Homo sapien
cccaagtaaagaacagccaagtggc

SEQ ID NO: 494958 - DNA, 25 bp, Homo sapien
ccaagtaaagaacagccaagtggcc

SEQ ID NO: 494959 - DNA, 25 bp, Homo sapien
caagtaaagaacagccaagtggcca

SEQ ID NO: 494960 - DNA, 25 bp, Homo sapien
aagtaaagaacagccaagtggccag

SEQ ID NO: 494961 - DNA, 25 bp, Homo sapien
taaagaacagccaagtggccaggtg

SEQ ID NO: 494962 - DNA, 25 bp, Homo sapien
aagaacagccaagtggccaggtgcg

SEQ ID NO: 494963 - DNA, 25 bp, Homo sapien
agaacagccaagtggccaggtgcgg

SEQ ID NO: 494964 - DNA, 25 bp, Homo sapien
aaagcaaagcccaggactgtctcgg

SEQ ID NO: 494965 - DNA, 25 bp, Homo sapien
tcggccatctgtgtctccaggatca

SEQ ID NO: 494966 - DNA, 25 bp, Homo sapien
tcacccctcactgggcatggagtat

SEQ ID NO: 494967 - DNA, 25 bp, Homo sapien
gtccagttaacgcttgctgagtgaa

SEQ ID NO: 494968 - DNA, 25 bp, Homo sapien
atgaatgaatactccatcctctgcc

SEQ ID NO: 494969 - DNA, 25 bp, Homo sapien
atcctctgcctggagaattacgcac

SEQ ID NO: 494970 - DNA, 25 bp, Homo sapien
gcctggagaattacgcactttagca

SEQ ID NO: 494971 - DNA, 25 bp, Homo sapien
gcactttagcatatccaaggctctg

SEQ ID NO: 494972 - DNA, 25 bp, Homo sapien
caaggctctgacaagtcctgcataa

SEQ ID NO: 494973 - DNA, 25 bp, Homo sapien
tccctcttcttttctttctgactat

SEQ ID NO: 494974 - DNA, 25 bp, Homo sapien
gattatcaatctggcaatagtcaag

SEQ ID NO: 494975 - DNA, 25 bp, Homo sapien
gaaaatgaagactcccgcagatttg

SEQ ID NO: 494976 - DNA, 25 bp, Homo sapien
tgaggcctcctgtgagtggcaccaa

SEQ ID NO: 494977 - DNA, 25 bp, Homo sapien
gcctcctgtgagtggcaccaatgga

SEQ ID NO: 494978 - DNA, 25 bp, Homo sapien
tcctgtgagtggcaccaatggactt

SEQ ID NO: 494979 - DNA, 25 bp, Homo sapien
gagtggcaccaatggacttgctacc

SEQ ID NO: 494980 - DNA, 25 bp, Homo sapien
ctacccacagaatctagttccattt

SEQ ID NO: 494981 - DNA, 25 bp, Homo sapien
cagaatctagttccattttagacaa

SEQ ID NO: 494982 - DNA, 25 bp, Homo sapien
atgaagctgcttagtaatctctgcc

SEQ ID NO: 494983 - DNA, 25 bp, Homo sapien
gaagctgcttagtaatctctgccaa

SEQ ID NO: 494984 - DNA, 25 bp, Homo sapien
gctgcttagtaatctctgccaagcc

SEQ ID NO: 494985 - DNA, 25 bp, Homo sapien
cttagtaatctctgccaagccatct

SEQ ID NO: 494986 - DNA, 25 bp, Homo sapien
ctgattccagaatctctacctttaa

SEQ ID NO: 494987 - DNA, 25 bp, Homo sapien
gaatctctacctttaaacactatgt

SEQ ID NO: 494988 - DNA, 25 bp, Homo sapien
acactatgttaccacttacttctct

SEQ ID NO: 494989 - DNA, 25 bp, Homo sapien
atgttaccacttacttctcttcaaa

SEQ ID NO: 494990 - DNA, 25 bp, Homo sapien
gatgtttccagtatttagaagtcaa

SEQ ID NO: 494991 - DNA, 25 bp, Homo sapien
aagtcaaatgcttcgtttttaatag

SEQ ID NO: 494992 - DNA, 25 bp, Homo sapien
ggaacttacacagtcttttatgttt

SEQ ID NO: 494993 - DNA, 25 bp, Homo sapien
gtcactgatgtggattctcccaaac

SEQ ID NO: 494994 - DNA, 25 bp, Homo sapien
gattctcccaaactcgatactttgt

SEQ ID NO: 494995 - DNA, 25 bp, Homo sapien
ggaatcaaaacagtgggtataccca

SEQ ID NO: 494996 - DNA, 25 bp, Homo sapien
ggtatacccaggttgtatatctaga

SEQ ID NO: 494997 - DNA, 25 bp, Homo sapien
aagacggcccctgtgttatacccag

SEQ ID NO: 494998 - DNA, 25 bp, Homo sapien
ggcccctgtgttatacccagggaag

SEQ ID NO: 494999 - DNA, 25 bp, Homo sapien
gtttgcatcttcatgattaggagac

SEQ ID NO: 495000 - DNA, 25 bp, Homo sapien
tctttcttgctaggtgctgaactga

SEQ ID NO: 495001 - DNA, 25 bp, Homo sapien
tcttgctaggtgctgaactgagtcc

SEQ ID NO: 495002 - DNA, 25 bp, Homo sapien
actgagtcctagttcaaatggctat

SEQ ID NO: 495003 - DNA, 25 bp, Homo sapien
gaatatttgaaaagctctcattgta

SEQ ID NO: 495004 - DNA, 25 bp, Homo sapien
tgattaggagaccttgcattccaag

SEQ ID NO: 495005 - DNA, 25 bp, Homo sapien
atgattgtcataccacagatataat

SEQ ID NO: 495006 - DNA, 25 bp, Homo sapien
atctgttttctcaagagcccgcttc

SEQ ID NO: 495007 - DNA, 25 bp, Homo sapien
cgcttcctggctgaaaattccttgg

SEQ ID NO: 495008 - DNA, 25 bp, Homo sapien
tctgcatattcccatgatcaacctt

SEQ ID NO: 495009 - DNA, 25 bp, Homo sapien
gcatattcccatgatcaaccttatt

SEQ ID NO: 495010 - DNA, 25 bp, Homo sapien
tattcccatgatcaaccttattttc

SEQ ID NO: 495011 - DNA, 25 bp, Homo sapien
gatcaaccttattttcaatgcacat

SEQ ID NO: 495012 - DNA, 25 bp, Homo sapien
ttcaatgcacattacttaaattttg

SEQ ID NO: 495013 - DNA, 25 bp, Homo sapien
agttgattctgacaagtcctttttc

SEQ ID NO: 495014 - DNA, 25 bp, Homo sapien
ttctgacaagtcctttttcaagctg

SEQ ID NO: 495015 - DNA, 25 bp, Homo sapien
gacaagtcctttttcaagctgaaca

SEQ ID NO: 495016 - DNA, 25 bp, Homo sapien
gaacaccaaaatagggaaactcctg

SEQ ID NO: 495017 - DNA, 25 bp, Homo sapien
tttccatgggccctgttcccattga

SEQ ID NO: 495018 - DNA, 25 bp, Homo sapien
atgggccctgttcccattgatgtat

SEQ ID NO: 495019 - DNA, 25 bp, Homo sapien
tcagcattcagtttgtcaatgaagt

SEQ ID NO: 495020 - DNA, 25 bp, Homo sapien
gcattcagtttgtcaatgaagtgat

SEQ ID NO: 495021 - DNA, 25 bp, Homo sapien
gaagtgatgaaagcttagagccagt

SEQ ID NO: 495022 - DNA, 25 bp, Homo sapien
aaagcttagagccagtatttatact

SEQ ID NO: 495023 - DNA, 25 bp, Homo sapien
gagccagtatttatactttgtggtt

SEQ ID NO: 495024 - DNA, 25 bp, Homo sapien
tactttgtggttaaaatacttgatt

SEQ ID NO: 495025 - DNA, 25 bp, Homo sapien
tacaaaaacagatgtttcctagaaa

SEQ ID NO: 495026 - DNA, 25 bp, Homo sapien
atgaacaaaaccctacgaaagaatg

SEQ ID NO: 495027 - DNA, 25 bp, Homo sapien
ccctacgaaagaatggcaacagcca

SEQ ID NO: 495028 - DNA, 25 bp, Homo sapien
gtctcccaaacacgcagctcaaggt

SEQ ID NO: 495029 - DNA, 25 bp, Homo sapien
aaacacgcagctcaaggtccacatc

SEQ ID NO: 495030 - DNA, 25 bp, Homo sapien
gtcctacatctcagtcttttgcaag

SEQ ID NO: 495031 - DNA, 25 bp, Homo sapien
ctcagtcttttgcaaggtgacactt

SEQ ID NO: 495032 - DNA, 25 bp, Homo sapien
ggtgacacttatctgattacctaat

SEQ ID NO: 495033 - DNA, 25 bp, Homo sapien
gattacctaattcacacgaaggtgt

SEQ ID NO: 495034 - DNA, 25 bp, Homo sapien
gaacggtggtatcaaaacatatcat

SEQ ID NO: 495035 - DNA, 25 bp, Homo sapien
aaacatatcattccccagtggttta

SEQ ID NO: 495036 - DNA, 25 bp, Homo sapien
taaaactctggtagctttccaggga

SEQ ID NO: 495037 - DNA, 25 bp, Homo sapien
tggtagctttccagggagtccaagt

SEQ ID NO: 495038 - DNA, 25 bp, Homo sapien
gagtccaagtggagtccagtctcct

SEQ ID NO: 495039 - DNA, 25 bp, Homo sapien
ccagtctccttagctgagttcacag

SEQ ID NO: 495040 - DNA, 25 bp, Homo sapien
tggcttcactctctggcatcaaaac

SEQ ID NO: 495041 - DNA, 25 bp, Homo sapien
cacgtattcaaagtttatgggtaca

SEQ ID NO: 495042 - DNA, 25 bp, Homo sapien
aagtttatgggtacaacaaagacat

SEQ ID NO: 495043 - DNA, 25 bp, Homo sapien
aacaaagacatagtacatgtacata

SEQ ID NO: 495044 - DNA, 25 bp, Homo sapien
taaactgtgaagaactttatcatac

SEQ ID NO: 495045 - DNA, 25 bp, Homo sapien
gaactttatcatacaggaaacttaa

SEQ ID NO: 495046 - DNA, 25 bp, Homo sapien
acaagaggtgtcaaaagacccaaat

SEQ ID NO: 495047 - DNA, 25 bp, Homo sapien
gacccaaattaggtgcattttactt

SEQ ID NO: 495048 - DNA, 25 bp, Homo sapien
taggtgcattttacttgtttatgat

SEQ ID NO: 495049 - DNA, 25 bp, Homo sapien
gtttatgatggcataaccattgctt

SEQ ID NO: 495050 - DNA, 25 bp, Homo sapien
tgatggcataaccattgctttaaaa

SEQ ID NO: 495051 - DNA, 25 bp, Homo sapien
cagtagaatattgaatttatgctct

SEQ ID NO: 495052 - DNA, 25 bp, Homo sapien
ggacccctgctctagtcagtaataa

SEQ ID NO: 495053 - DNA, 25 bp, Homo sapien
gtcagtaataaggtacttgtgccag

SEQ ID NO: 495054 - DNA, 25 bp, Homo sapien
ggtacttgtgccagaatataaatca

SEQ ID NO: 495055 - DNA, 25 bp, Homo sapien
aaatcaacacattgcttcctttatc

SEQ ID NO: 495056 - DNA, 25 bp, Homo sapien
caactgagccagtatgattagtgat

SEQ ID NO: 495057 - DNA, 25 bp, Homo sapien
ttcattctggcacaagcctctttca

SEQ ID NO: 495058 - DNA, 25 bp, Homo sapien
cattctggacagctcacaaatagtt

SEQ ID NO: 495059 - DNA, 25 bp, Homo sapien
gctcacaaatagttaatggaccatg

SEQ ID NO: 495060 - DNA, 25 bp, Homo sapien
atggaccatgctttgaatagccttc

SEQ ID NO: 495061 - DNA, 25 bp, Homo sapien
atgctttgaatagccttcctctaag

SEQ ID NO: 495062 - DNA, 25 bp, Homo sapien
ctttgaatagccttcctctaagcaa

SEQ ID NO: 495063 - DNA, 25 bp, Homo sapien
tcagatctggtcttggcgagctctc

SEQ ID NO: 495064 - DNA, 25 bp, Homo sapien
agatctggtcttggcgagctctcgc

SEQ ID NO: 495065 - DNA, 25 bp, Homo sapien
tcgccaggaccccaaggctgttggt

SEQ ID NO: 495066 - DNA, 25 bp, Homo sapien
ggaccccaaggctgttggtctgtct

SEQ ID NO: 495067 - DNA, 25 bp, Homo sapien
gtctggagctgagtggccgggcatc

SEQ ID NO: 495068 - DNA, 25 bp, Homo sapien
agtggccgggcatcggtcccaagca

SEQ ID NO: 495069 - DNA, 25 bp, Homo sapien
atcggtcccaagcatcaaagccttt

SEQ ID NO: 495070 - DNA, 25 bp, Homo sapien
gcatcaaagcctttggcctttctcc

SEQ ID NO: 495071 - DNA, 25 bp, Homo sapien
caggcctccacaaaggcctggcaga

SEQ ID NO: 495072 - DNA, 25 bp, Homo sapien
gacaaagcacagcagccgctcagag

SEQ ID NO: 495073 - DNA, 25 bp, Homo sapien
gctcagagacaggaatagaaatttc

SEQ ID NO: 495074 - DNA, 25 bp, Homo sapien
aggccccacggtgcttctcagtgga

SEQ ID NO: 495075 - DNA, 25 bp, Homo sapien
cccacggtgcttctcagtggacaat

SEQ ID NO: 495076 - DNA, 25 bp, Homo sapien
tcagtggacaatgatgcctcctccg

SEQ ID NO: 495077 - DNA, 25 bp, Homo sapien
ggacaatgatgcctcctccgggaag

SEQ ID NO: 495078 - DNA, 25 bp, Homo sapien
acaatgatgcctcctccgggaagcc

SEQ ID NO: 495079 - DNA, 25 bp, Homo sapien
gccgccaccgggaggaagcctgact

SEQ ID NO: 495080 - DNA, 25 bp, Homo sapien
gccaccgggaggaagcctgactgtc

SEQ ID NO: 495081 - DNA, 25 bp, Homo sapien
aagcctgactgtcctttggctgcat

SEQ ID NO: 495082 - DNA, 25 bp, Homo sapien
cctgactgtcctttggctgcatctc

SEQ ID NO: 495083 - DNA, 25 bp, Homo sapien
ctgcatctcccgaccatggccaagg

SEQ ID NO: 495084 - DNA, 25 bp, Homo sapien
ccacccagccgtaccagaaataaag

SEQ ID NO: 495085 - DNA, 25 bp, Homo sapien
ctactgttggtgttcttcttgttaa

SEQ ID NO: 495086 - DNA, 25 bp, Homo sapien
acagaagtaactctgggcacatcca

SEQ ID NO: 495087 - DNA, 25 bp, Homo sapien
gctctgacttctgcagtttacatta

SEQ ID NO: 495088 - DNA, 25 bp, Homo sapien
gggcacatccagatagtacaaaaag

SEQ ID NO: 495089 - DNA, 25 bp, Homo sapien
aaagcagtcataaagcagctactca

SEQ ID NO: 495090 - DNA, 25 bp, Homo sapien
aagcagctactcatggaatcgcaac

SEQ ID NO: 495091 - DNA, 25 bp, Homo sapien
catggaatcgcaactgtgatggcca

SEQ ID NO: 495092 - DNA, 25 bp, Homo sapien
aactgtgatggccagcgagcacctg

SEQ ID NO: 495093 - DNA, 25 bp, Homo sapien
ggccacaggtggtaggaaaagacaa

SEQ ID NO: 495094 - DNA, 25 bp, Homo sapien
gtacttcataaattaacagcagctt

SEQ ID NO: 495095 - DNA, 25 bp, Homo sapien
atatttcatgctactgttggtgttc

SEQ ID NO: 495096 - DNA, 25 bp, Homo sapien
aaaatctttacgatggcctcagcag

SEQ ID NO: 495097 - DNA, 25 bp, Homo sapien
gatggcctcagcagtacttagttct

SEQ ID NO: 495098 - DNA, 25 bp, Homo sapien
agcagtacttagttctgttcccacc

SEQ ID NO: 495099 - DNA, 25 bp, Homo sapien
gcttctcgttttgccctgttacaag

SEQ ID NO: 495100 - DNA, 25 bp, Homo sapien
cgttttgccctgttacaagtggata

SEQ ID NO: 495101 - DNA, 25 bp, Homo sapien
ggatagtggcagtggctctgattct

SEQ ID NO: 495102 - DNA, 25 bp, Homo sapien
tggcagtggctctgattctgaacct

SEQ ID NO: 495103 - DNA, 25 bp, Homo sapien
aggtcgaaatactggaaagtctcaa

SEQ ID NO: 495104 - DNA, 25 bp, Homo sapien
aagtctcaaactttaggaagcaagt

SEQ ID NO: 495105 - DNA, 25 bp, Homo sapien
ttaggaagcaagtcaactacaaatg

SEQ ID NO: 495106 - DNA, 25 bp, Homo sapien
caaatgagctcaggaatcttgcttt

SEQ ID NO: 495107 - DNA, 25 bp, Homo sapien
gtccccggagcttgtgtgcgataca

SEQ ID NO: 495108 - DNA, 25 bp, Homo sapien
gatacagagagcacctcggaagctg

SEQ ID NO: 495109 - DNA, 25 bp, Homo sapien
gctgaggcagctggtacttgacaga

SEQ ID NO: 495110 - DNA, 25 bp, Homo sapien
aggatggcgctgtcgaccatagtct

SEQ ID NO: 495111 - DNA, 25 bp, Homo sapien
tgtcgaccatagtctcccagaggaa

SEQ ID NO: 495112 - DNA, 25 bp, Homo sapien
gaaggctccccgtggctttctaaag

SEQ ID NO: 495113 - DNA, 25 bp, Homo sapien
ctttctaaagcgagtcttcaagcga

SEQ ID NO: 495114 - DNA, 25 bp, Homo sapien
agaagcctcaacttcgtctggagaa

SEQ ID NO: 495115 - DNA, 25 bp, Homo sapien
gaacgttcggactgaggtttttctg

SEQ ID NO: 495116 - DNA, 25 bp, Homo sapien
gaagaagcgtcatacggaccggatt

SEQ ID NO: 495117 - DNA, 25 bp, Homo sapien
accggattgttttcgctggcccagt

SEQ ID NO: 495118 - DNA, 25 bp, Homo sapien
ttgggttgtagtatcgacaggttac

SEQ ID NO: 495119 - DNA, 25 bp, Homo sapien
gcagatacttatgttgccacccaat

SEQ ID NO: 495120 - DNA, 25 bp, Homo sapien
tatgttgccacccaatcaaagaaac

SEQ ID NO: 495121 - DNA, 25 bp, Homo sapien
aaggcaaagaggacgcattcatcag

SEQ ID NO: 495122 - DNA, 25 bp, Homo sapien
gaggacgcattcatcagtagctgtg

SEQ ID NO: 495123 - DNA, 25 bp, Homo sapien
gtagctgtgagtctgcaaaaactgt

SEQ ID NO: 495124 - DNA, 25 bp, Homo sapien
aaatggaagctgtcctctcagccca

SEQ ID NO: 495125 - DNA, 25 bp, Homo sapien
caaagggagtgctgggatttccagt

SEQ ID NO: 495126 - DNA, 25 bp, Homo sapien
atttccagtggtcaaagcagatcat

SEQ ID NO: 495127 - DNA, 25 bp, Homo sapien
agcagatcataaacagttgggagca

SEQ ID NO: 495128 - DNA, 25 bp, Homo sapien
ggagcagaacccaggtcagaagatg

SEQ ID NO: 495129 - DNA, 25 bp, Homo sapien
tggtcagccccaccagattagtgct

SEQ ID NO: 495130 - DNA, 25 bp, Homo sapien
agattagtgcttctaccctaggcag

SEQ ID NO: 495131 - DNA, 25 bp, Homo sapien
gtgcttctaccctaggcagggcttt

SEQ ID NO: 495132 - DNA, 25 bp, Homo sapien
gcagggctttcttggtctaatggta

SEQ ID NO: 495133 - DNA, 25 bp, Homo sapien
ggctttcttggtctaatggtaataa

SEQ ID NO: 495134 - DNA, 25 bp, Homo sapien
atggtaataagcaccgacactgcta

SEQ ID NO: 495135 - DNA, 25 bp, Homo sapien
agcaccgacactgctaagcacttta

SEQ ID NO: 495136 - DNA, 25 bp, Homo sapien
cactgctaagcactttacgtgcatt

SEQ ID NO: 495137 - DNA, 25 bp, Homo sapien
atactttttagcacagtaactggct

SEQ ID NO: 495138 - DNA, 25 bp, Homo sapien
agcacagtaactggctttgtgggct

SEQ ID NO: 495139 - DNA, 25 bp, Homo sapien
ctttgtgggctctagagaagagtta

SEQ ID NO: 495140 - DNA, 25 bp, Homo sapien
ggagatccagagggcacctgcctgc

SEQ ID NO: 495141 - DNA, 25 bp, Homo sapien
ggatgggccggctccttattttcct

SEQ ID NO: 495142 - DNA, 25 bp, Homo sapien
cggctccttattttcctgggctgag

SEQ ID NO: 495143 - DNA, 25 bp, Homo sapien
tccttattttcctgggctgagccgt

SEQ ID NO: 495144 - DNA, 25 bp, Homo sapien
attttcctgggctgagccgtttgga

SEQ ID NO: 495145 - DNA, 25 bp, Homo sapien
acctgggtgaggactagggcatcaa

SEQ ID NO: 495146 - DNA, 25 bp, Homo sapien
actagggcatcaaggtcgtgtgtgt

SEQ ID NO: 495147 - DNA, 25 bp, Homo sapien
gcagcaagtgctttctatgcgtttc

SEQ ID NO: 495148 - DNA, 25 bp, Homo sapien
gcaagtgctttctatgcgtttcttc

SEQ ID NO: 495149 - DNA, 25 bp, Homo sapien
aagtgctttctatgcgtttcttcat

SEQ ID NO: 495150 - DNA, 25 bp, Homo sapien
gctttctatgcgtttcttcattaaa

SEQ ID NO: 495151 - DNA, 25 bp, Homo sapien
aactctgcagctttcaagctcatct

SEQ ID NO: 495152 - DNA, 25 bp, Homo sapien
gctttcaagctcatctgttatgcat

SEQ ID NO: 495153 - DNA, 25 bp, Homo sapien
gttatgcatagctttgcacttcaaa

SEQ ID NO: 495154 - DNA, 25 bp, Homo sapien
taagtacaaccaaccacctttccag

SEQ ID NO: 495155 - DNA, 25 bp, Homo sapien
gagattttaattagcccaactagaa

SEQ ID NO: 495156 - DNA, 25 bp, Homo sapien
gcccaactagaagcctagtgtgtgt

SEQ ID NO: 495157 - DNA, 25 bp, Homo sapien
gtgtgccaatggtggatctttgcta

SEQ ID NO: 495158 - DNA, 25 bp, Homo sapien
aatggtggatctttgctactgaatg

SEQ ID NO: 495159 - DNA, 25 bp, Homo sapien
gatctttgctactgaatgtgtttga

SEQ ID NO: 495160 - DNA, 25 bp, Homo sapien
gtgcaccctgaagaccacaaattaa

SEQ ID NO: 495161 - DNA, 25 bp, Homo sapien
tatcatgactggctttgggaaaatc

SEQ ID NO: 495162 - DNA, 25 bp, Homo sapien
gtcacagttgagtcatttgccagtt

SEQ ID NO: 495163 - DNA, 25 bp, Homo sapien
gacggagcaagtttgaccttggttc

SEQ ID NO: 495164 - DNA, 25 bp, Homo sapien
gaccttggttctgttgctgaagcaa

SEQ ID NO: 495165 - DNA, 25 bp, Homo sapien
aaatttggaacttttctgtctcagt

SEQ ID NO: 495166 - DNA, 25 bp, Homo sapien
agtgtgatccactaacccacaggat

SEQ ID NO: 495167 - DNA, 25 bp, Homo sapien
tggaaccttgaatagctctgcttgg

SEQ ID NO: 495168 - DNA, 25 bp, Homo sapien
ggttgtctttcctatgaaaatgcca

SEQ ID NO: 495169 - DNA, 25 bp, Homo sapien
aaatgccatctgtagaccttgtgag

SEQ ID NO: 495170 - DNA, 25 bp, Homo sapien
tagaccttgtgagtcagccgtccag

SEQ ID NO: 495171 - DNA, 25 bp, Homo sapien
agccgtccagatgtttgcaggtgaa

SEQ ID NO: 495172 - DNA, 25 bp, Homo sapien
tgcaggtgaattcctctgcttgaca

SEQ ID NO: 495173 - DNA, 25 bp, Homo sapien
tgtcacagcaatacctgggaccatg

SEQ ID NO: 495174 - DNA, 25 bp, Homo sapien
ggaccatgctctcctgggactgtga

SEQ ID NO: 495175 - DNA, 25 bp, Homo sapien
cctgggactgtgaggctccttttga

SEQ ID NO: 495176 - DNA, 25 bp, Homo sapien
ggctccttttgacgtacttttgaca

SEQ ID NO: 495177 - DNA, 25 bp, Homo sapien
cgtacttttgacatcaggcaggttt

SEQ ID NO: 495178 - DNA, 25 bp, Homo sapien
ttccagcaagtagatgcccctgtgt

SEQ ID NO: 495179 - DNA, 25 bp, Homo sapien
gtttcctgccttatatcttgtattt

SEQ ID NO: 495180 - DNA, 25 bp, Homo sapien
gtatttcgacttattacagagttga

SEQ ID NO: 495181 - DNA, 25 bp, Homo sapien
acagagttgagggttcttgcttaat

SEQ ID NO: 495182 - DNA, 25 bp, Homo sapien
gagggttcttgcttaatttagatca

SEQ ID NO: 495183 - DNA, 25 bp, Homo sapien
tgacttcaagtctcattttatctga

SEQ ID NO: 495184 - DNA, 25 bp, Homo sapien
gtgttcctataaaagcacatagtta

SEQ ID NO: 495185 - DNA, 25 bp, Homo sapien
atcaatgagcgatttttagcccaat

SEQ ID NO: 495186 - DNA, 25 bp, Homo sapien
caatgagcgatttttagcccaatgc

SEQ ID NO: 495187 - DNA, 25 bp, Homo sapien
gagcgatttttagcccaatgctcca

SEQ ID NO: 495188 - DNA, 25 bp, Homo sapien
gatttttagcccaatgctccaaaaa

SEQ ID NO: 495189 - DNA, 25 bp, Homo sapien
tgctgtgtggccatttctttctggg

SEQ ID NO: 495190 - DNA, 25 bp, Homo sapien
ggagccaggctccacggacaccaag

SEQ ID NO: 495191 - DNA, 25 bp, Homo sapien
ggacaccaaggtcacccagagacct

SEQ ID NO: 495192 - DNA, 25 bp, Homo sapien
ggtcacccagagacctagacttctg

SEQ ID NO: 495193 - DNA, 25 bp, Homo sapien
gagacctagacttctggtcaaagca

SEQ ID NO: 495194 - DNA, 25 bp, Homo sapien
gacttctggtcaaagcaagtgaaca

SEQ ID NO: 495195 - DNA, 25 bp, Homo sapien
ggatttcaagggaatgcctgtgttt

SEQ ID NO: 495196 - DNA, 25 bp, Homo sapien
aatgcctgtgtttggacaagaaaca

SEQ ID NO: 495197 - DNA, 25 bp, Homo sapien
aagaaacatatctgtggtggccagc

SEQ ID NO: 495198 - DNA, 25 bp, Homo sapien
ggtcccttggatatcttggttttca

SEQ ID NO: 495199 - DNA, 25 bp, Homo sapien
ttggttttcataaaactctgggact

SEQ ID NO: 495200 - DNA, 25 bp, Homo sapien
aaactctgggacttttgtgctactc

SEQ ID NO: 495201 - DNA, 25 bp, Homo sapien
ggacttttgtgctactctatgagga

SEQ ID NO: 495202 - DNA, 25 bp, Homo sapien
ctactctatgaggagaagtgccctt

SEQ ID NO: 495203 - DNA, 25 bp, Homo sapien
gtgcccttgaaaacaaatgtctatg

SEQ ID NO: 495204 - DNA, 25 bp, Homo sapien
aaacaaatgtctatgcagctaatgg

SEQ ID NO: 495205 - DNA, 25 bp, Homo sapien
gcagctaatgggataggaccttggt

SEQ ID NO: 495206 - DNA, 25 bp, Homo sapien
agtccactcatatgtctgatttgaa

SEQ ID NO: 495207 - DNA, 25 bp, Homo sapien
aaattctttcactgagctcttccat

SEQ ID NO: 495208 - DNA, 25 bp, Homo sapien
tttcactgagctcttccatattcct

SEQ ID NO: 495209 - DNA, 25 bp, Homo sapien
gatgcattactttggtatgttctca

SEQ ID NO: 495210 - DNA, 25 bp, Homo sapien
gttctcagatttgggtaaagccttc

SEQ ID NO: 495211 - DNA, 25 bp, Homo sapien
gtaaagccttcctcatgttctataa

SEQ ID NO: 495212 - DNA, 25 bp, Homo sapien
aaaattggttaactgctggtgagca

SEQ ID NO: 495213 - DNA, 25 bp, Homo sapien
ggtgagcacatctcttgaagttttg

SEQ ID NO: 495214 - DNA, 25 bp, Homo sapien
gaagttttgatatgggttgcacaac

SEQ ID NO: 495215 - DNA, 25 bp, Homo sapien
agagaccgacaataccgagtgcagt

SEQ ID NO: 495216 - DNA, 25 bp, Homo sapien
tgcagtcctcccttggtatctagtt

SEQ ID NO: 495217 - DNA, 25 bp, Homo sapien
agagccccatcaattgcattagacc

SEQ ID NO: 495218 - DNA, 25 bp, Homo sapien
gaccaagtgttcttggaccattgaa

SEQ ID NO: 495219 - DNA, 25 bp, Homo sapien
cagggcatcaccaacatgctttctt

SEQ ID NO: 495220 - DNA, 25 bp, Homo sapien
aacatgctttcttctgacgttgcac

SEQ ID NO: 495221 - DNA, 25 bp, Homo sapien
gacgttgcacagctgtcagatcctg

SEQ ID NO: 495222 - DNA, 25 bp, Homo sapien
gtatcttcggatacccttgatggaa

SEQ ID NO: 495223 - DNA, 25 bp, Homo sapien
gaaacagcagcagtgccggatcttc

SEQ ID NO: 495224 - DNA, 25 bp, Homo sapien
ggatcttcttgtaactcaccagcga

SEQ ID NO: 495225 - DNA, 25 bp, Homo sapien
aactcaccagcgaaagtcagcacta

SEQ ID NO: 495226 - DNA, 25 bp, Homo sapien
ggcttctccatttattccactagat

SEQ ID NO: 495227 - DNA, 25 bp, Homo sapien
tattccactagatgaactttcgtct

SEQ ID NO: 495228 - DNA, 25 bp, Homo sapien
gggctgcaactgtgattctgccttg

SEQ ID NO: 495229 - DNA, 25 bp, Homo sapien
gcaactgtgattctgccttgagagg

SEQ ID NO: 495230 - DNA, 25 bp, Homo sapien
ggaattaacctagccctgggtgtgc

SEQ ID NO: 495231 - DNA, 25 bp, Homo sapien
gtgctcttcccagactcatcaagaa

SEQ ID NO: 495232 - DNA, 25 bp, Homo sapien
caagaacctgagatgtgaagcactt

SEQ ID NO: 495233 - DNA, 25 bp, Homo sapien
ctgttccagagacctcaggactagg

SEQ ID NO: 495234 - DNA, 25 bp, Homo sapien
agacctcaggactagggcctcaagg

SEQ ID NO: 495235 - DNA, 25 bp, Homo sapien
caggactagggcctcaaggttaaag

SEQ ID NO: 495236 - DNA, 25 bp, Homo sapien
tgggttctaagatgcctaagggcct

SEQ ID NO: 495237 - DNA, 25 bp, Homo sapien
atgcctaagggcctgaaggttctgt

SEQ ID NO: 495238 - DNA, 25 bp, Homo sapien
gtggcaaatgccctggaaccagctt

SEQ ID NO: 495239 - DNA, 25 bp, Homo sapien
gtttattgccattatagcgcctgta

SEQ ID NO: 495240 - DNA, 25 bp, Homo sapien
taagtagatctgctttctgttcatc

SEQ ID NO: 495241 - DNA, 25 bp, Homo sapien
tctgttcatctctttgtcctgaatg

SEQ ID NO: 495242 - DNA, 25 bp, Homo sapien
tgtcctgaatggctttgtcttgaaa

SEQ ID NO: 495243 - DNA, 25 bp, Homo sapien
aaaagcatgagcatggccgcggcag

SEQ ID NO: 495244 - DNA, 25 bp, Homo sapien
cgtccctgagtatctgagcgtttaa

SEQ ID NO: 495245 - DNA, 25 bp, Homo sapien
ctgagcagtattagcggatcccgcg

SEQ ID NO: 495246 - DNA, 25 bp, Homo sapien
ggatcccgcgtagtgtcagtactaa

SEQ ID NO: 495247 - DNA, 25 bp, Homo sapien
aggtgactttctgaaactcccttgt

SEQ ID NO: 495248 - DNA, 25 bp, Homo sapien
tgtgaagaagccctgttctcgttgc

SEQ ID NO: 495249 - DNA, 25 bp, Homo sapien
ctcgttgccctaattcatcttttaa

SEQ ID NO: 495250 - DNA, 25 bp, Homo sapien
ttcagctctgcgtaggcctggtcca

SEQ ID NO: 495251 - DNA, 25 bp, Homo sapien
tggtccaggctgtcgttaatgatga

SEQ ID NO: 495252 - DNA, 25 bp, Homo sapien
gatgaccacatcaaacaggccgggc

SEQ ID NO: 495253 - DNA, 25 bp, Homo sapien
ttgctgctctccatgtcggcctggg

SEQ ID NO: 495254 - DNA, 25 bp, Homo sapien
tccatgtcggcctgggcagcagcca

SEQ ID NO: 495255 - DNA, 25 bp, Homo sapien
tctcctcggtttcagtgttgcgctg

SEQ ID NO: 495256 - DNA, 25 bp, Homo sapien
ggtttcagtgttgcgctgccgcagc

SEQ ID NO: 495257 - DNA, 25 bp, Homo sapien
agccgctgctccagcacgtgcagtg

SEQ ID NO: 495258 - DNA, 25 bp, Homo sapien
acagagatgtagatgggccgcagat

SEQ ID NO: 495259 - DNA, 25 bp, Homo sapien
agatcggtggccttgatgttccgca

SEQ ID NO: 495260 - DNA, 25 bp, Homo sapien
aggtccacgtccagcacacagatgc

SEQ ID NO: 495261 - DNA, 25 bp, Homo sapien
aggtgaggatgagccgcagcccttt

SEQ ID NO: 495262 - DNA, 25 bp, Homo sapien
gtacatggcgtgttacattcctgaa

SEQ ID NO: 495263 - DNA, 25 bp, Homo sapien
gcgtgttacattcctgaacctacta

SEQ ID NO: 495264 - DNA, 25 bp, Homo sapien
gaacctactatgtacggtgctttat

SEQ ID NO: 495265 - DNA, 25 bp, Homo sapien
tacggtgctttattgccagtgtgcg

SEQ ID NO: 495266 - DNA, 25 bp, Homo sapien
tattgccagtgtgcggtctttgttc

SEQ ID NO: 495267 - DNA, 25 bp, Homo sapien
tctttgttctcctccgtgaaaaact

SEQ ID NO: 495268 - DNA, 25 bp, Homo sapien
gaaaaactgtgtccgagaacactcg

SEQ ID NO: 495269 - DNA, 25 bp, Homo sapien
aagcaagtattgtagcactcggtga

SEQ ID NO: 495270 - DNA, 25 bp, Homo sapien
gtagcactcggtgaagcagtaagaa

SEQ ID NO: 495271 - DNA, 25 bp, Homo sapien
gcagtaagaagcttccttgtcaaaa

SEQ ID NO: 495272 - DNA, 25 bp, Homo sapien
atccacataactttctgaaaacaat

SEQ ID NO: 495273 - DNA, 25 bp, Homo sapien
gaaaacaattaatgctgtatgtgga

SEQ ID NO: 495274 - DNA, 25 bp, Homo sapien
tgtatgtggacagcttgttcagttc

SEQ ID NO: 495275 - DNA, 25 bp, Homo sapien
cagcttgttcagttcagattctcag

SEQ ID NO: 495276 - DNA, 25 bp, Homo sapien
agcttgttcagttcagattctcaga

SEQ ID NO: 495277 - DNA, 25 bp, Homo sapien
tgtctcagtttgataacatcggtaa

SEQ ID NO: 495278 - DNA, 25 bp, Homo sapien
gtctcagtttgataacatcggtaaa

SEQ ID NO: 495279 - DNA, 25 bp, Homo sapien
ctcagtttgataacatcggtaaagt

SEQ ID NO: 495280 - DNA, 25 bp, Homo sapien
agtttgataacatcggtaaagttca

SEQ ID NO: 495281 - DNA, 25 bp, Homo sapien
gataacatcggtaaagttcaaagtg

SEQ ID NO: 495282 - DNA, 25 bp, Homo sapien
aacatcggtaaagttcaaagtgata

SEQ ID NO: 495283 - DNA, 25 bp, Homo sapien
ggaagactgggctccaaagccacat

SEQ ID NO: 495284 - DNA, 25 bp, Homo sapien
aaagccacatgcctttgttggcagc

SEQ ID NO: 495285 - DNA, 25 bp, Homo sapien
gcctttgttggcagcgtcaagaatg

SEQ ID NO: 495286 - DNA, 25 bp, Homo sapien
cagcgtcaagaatgagaagactttt

SEQ ID NO: 495287 - DNA, 25 bp, Homo sapien
aaatgccgagaacaggaaagctact

SEQ ID NO: 495288 - DNA, 25 bp, Homo sapien
aggaaagctactgggcatagtcccc

SEQ ID NO: 495289 - DNA, 25 bp, Homo sapien
gcccttctggaaattaccccgagag

SEQ ID NO: 495290 - DNA, 25 bp, Homo sapien
gaaattaccccgagagccagggaag

SEQ ID NO: 495291 - DNA, 25 bp, Homo sapien
tcagcatcaagcaggcattttatgg

SEQ ID NO: 495292 - DNA, 25 bp, Homo sapien
gcaggcattttatgggaagctttct

SEQ ID NO: 495293 - DNA, 25 bp, Homo sapien
ttatgggaagctttctaaactccaa

SEQ ID NO: 495294 - DNA, 25 bp, Homo sapien
cggtgtgcttcgtgctgtagttatc

SEQ ID NO: 495295 - DNA, 25 bp, Homo sapien
tgtagttatcgttagttcctcttcc

SEQ ID NO: 495296 - DNA, 25 bp, Homo sapien
cgttagttcctcttcccgagatggg

SEQ ID NO: 495297 - DNA, 25 bp, Homo sapien
cgagagaccccagcgcctttgaaaa

SEQ ID NO: 495298 - DNA, 25 bp, Homo sapien
gaccccagcgcctttgaaaagcaag

SEQ ID NO: 495299 - DNA, 25 bp, Homo sapien
aaagcaaggtttgtgctgcgcttcc

SEQ ID NO: 495300 - DNA, 25 bp, Homo sapien
ctgcgcttccagttccgaaaagcag

SEQ ID NO: 495301 - DNA, 25 bp, Homo sapien
tccagttccgaaaagcagatgttta

SEQ ID NO: 495302 - DNA, 25 bp, Homo sapien
gcagatgtttaagcccttggactga

SEQ ID NO: 495303 - DNA, 25 bp, Homo sapien
gtgggatcgcagctccgaagacgga

SEQ ID NO: 495304 - DNA, 25 bp, Homo sapien
ccacgtgccctagattcatggcaga

SEQ ID NO: 495305 - DNA, 25 bp, Homo sapien
gtgtgctggcgaggacacagataaa

SEQ ID NO: 495306 - DNA, 25 bp, Homo sapien
gaattcggcggcatgtgtggtgtac

SEQ ID NO: 495307 - DNA, 25 bp, Homo sapien
gtggtgtacgaggacatgtcgcaca

SEQ ID NO: 495308 - DNA, 25 bp, Homo sapien
aggacatgtcgcacagccgctgcaa

SEQ ID NO: 495309 - DNA, 25 bp, Homo sapien
gtcccaccatggtcttttatgctgc

SEQ ID NO: 495310 - DNA, 25 bp, Homo sapien
accatggtcttttatgctgcccaaa

SEQ ID NO: 495311 - DNA, 25 bp, Homo sapien
gtcttttatgctgcccaaaccgata

SEQ ID NO: 495312 - DNA, 25 bp, Homo sapien
tgcccaaaccgataccttgctggaa

SEQ ID NO: 495313 - DNA, 25 bp, Homo sapien
accttgctggaattacctactgtgg

SEQ ID NO: 495314 - DNA, 25 bp, Homo sapien
gctggaattacctactgtgggaaaa

SEQ ID NO: 495315 - DNA, 25 bp, Homo sapien
ttgttattgccccattccattttcc

SEQ ID NO: 495316 - DNA, 25 bp, Homo sapien
agagctcctggcgacatcttggcgt

SEQ ID NO: 495317 - DNA, 25 bp, Homo sapien
acatcttggcgtggcagcctcttga

SEQ ID NO: 495318 - DNA, 25 bp, Homo sapien
gtggcagcctcttgactctgactct

SEQ ID NO: 495319 - DNA, 25 bp, Homo sapien
ttgactctgactctcctccttgagc

SEQ ID NO: 495320 - DNA, 25 bp, Homo sapien
gcgtctgggttctcagctatttcca

SEQ ID NO: 495321 - DNA, 25 bp, Homo sapien
gagccagctcaaatcagggtccagt

SEQ ID NO: 495322 - DNA, 25 bp, Homo sapien
gctcaaatcagggtccagtgggaac

SEQ ID NO: 495323 - DNA, 25 bp, Homo sapien
aagagggcccaagtcggagctcgga

SEQ ID NO: 495324 - DNA, 25 bp, Homo sapien
ggctgcctgcaatgcagggcatttg

SEQ ID NO: 495325 - DNA, 25 bp, Homo sapien
agtgccagccctggcagactgagga

SEQ ID NO: 495326 - DNA, 25 bp, Homo sapien
gactgaggagcctcccaggagcagc

SEQ ID NO: 495327 - DNA, 25 bp, Homo sapien
gggcataatagtttacctcatagag

SEQ ID NO: 495328 - DNA, 25 bp, Homo sapien
gtgtgaggacactaagattcccata

SEQ ID NO: 495329 - DNA, 25 bp, Homo sapien
gattcccatatagaaataggctcaa

SEQ ID NO: 495330 - DNA, 25 bp, Homo sapien
taggctcaatgaatagtagctgttt

SEQ ID NO: 495331 - DNA, 25 bp, Homo sapien
tgtaaagtgagtagcggtagttgat

SEQ ID NO: 495332 - DNA, 25 bp, Homo sapien
gtagttgatgggagctgttgaaaca

SEQ ID NO: 495333 - DNA, 25 bp, Homo sapien
ggtaaacagcattctagcaatcctt

SEQ ID NO: 495334 - DNA, 25 bp, Homo sapien
agcaatccttcgacttttgtgatag

SEQ ID NO: 495335 - DNA, 25 bp, Homo sapien
ttcgacttttgtgatagcaaaccat

SEQ ID NO: 495336 - DNA, 25 bp, Homo sapien
ggctgttttactaattaaaggacat

SEQ ID NO: 495337 - DNA, 25 bp, Homo sapien
aaaggacatccacaattcaatgtat

SEQ ID NO: 495338 - DNA, 25 bp, Homo sapien
gattgcatagtttgcacactgtgaa

SEQ ID NO: 495339 - DNA, 25 bp, Homo sapien
gggcttattatgtcaacaactggca

SEQ ID NO: 495340 - DNA, 25 bp, Homo sapien
atgtcaacaactggcatgagaaccc

SEQ ID NO: 495341 - DNA, 25 bp, Homo sapien
gaccctgaccatgtgacgtttgtga

SEQ ID NO: 495342 - DNA, 25 bp, Homo sapien
acgtttgtgacagctaggatcccct

SEQ ID NO: 495343 - DNA, 25 bp, Homo sapien
taggatccccttttcactggcttag

SEQ ID NO: 495344 - DNA, 25 bp, Homo sapien
actggcttagcgatctgaaagtcca

SEQ ID NO: 495345 - DNA, 25 bp, Homo sapien
aagcccagaggctgtatatttcatt

SEQ ID NO: 495346 - DNA, 25 bp, Homo sapien
aggctgtatatttcattagatccca

SEQ ID NO: 495347 - DNA, 25 bp, Homo sapien
aggatacagcttccttctgttttcc

SEQ ID NO: 495348 - DNA, 25 bp, Homo sapien
tgttttcctgggaggtcgccagaaa

SEQ ID NO: 495349 - DNA, 25 bp, Homo sapien
ggtggcgtgtgtgctggcgaggaca

SEQ ID NO: 495350 - DNA, 25 bp, Homo sapien
gtgtgctggcgaggacacagataaa

SEQ ID NO: 495351 - DNA, 25 bp, Homo sapien
gctggcgaggacacagataaagaaa

SEQ ID NO: 495352 - DNA, 25 bp, Homo sapien
gggataagaattcggcggcatgtgt

SEQ ID NO: 495353 - DNA, 25 bp, Homo sapien
aattcggcggcatgtgtggtgtacg

SEQ ID NO: 495354 - DNA, 25 bp, Homo sapien
gtggtgtacgaggacatgtcgcaca

SEQ ID NO: 495355 - DNA, 25 bp, Homo sapien
gtgtacgaggacatgtcgcacagcc

SEQ ID NO: 495356 - DNA, 25 bp, Homo sapien
gtacgaggacatgtcgcacagccgc

SEQ ID NO: 495357 - DNA, 25 bp, Homo sapien
acgaggacatgtcgcacagccgctg

SEQ ID NO: 495358 - DNA, 25 bp, Homo sapien
aggacatgtcgcacagccgctgcaa

SEQ ID NO: 495359 - DNA, 25 bp, Homo sapien
gacatgtcgcacagccgctgcaaca

SEQ ID NO: 495360 - DNA, 25 bp, Homo sapien
aattgggacatagttacagcagtgg

SEQ ID NO: 495361 - DNA, 25 bp, Homo sapien
attgggacatagttacagcagtgga

SEQ ID NO: 495362 - DNA, 25 bp, Homo sapien
ttgggacatagttacagcagtggaa

SEQ ID NO: 495363 - DNA, 25 bp, Homo sapien
tgggacatagttacagcagtggaat

SEQ ID NO: 495364 - DNA, 25 bp, Homo sapien
gggacatagttacagcagtggaata

SEQ ID NO: 495365 - DNA, 25 bp, Homo sapien
ggacatagttacagcagtggaataa

SEQ ID NO: 495366 - DNA, 25 bp, Homo sapien
gcagtggaataagtattcatttaga

SEQ ID NO: 495367 - DNA, 25 bp, Homo sapien
ggaataagtattcatttagaaatgt

SEQ ID NO: 495368 - DNA, 25 bp, Homo sapien
atgtgaatgagcagtaaaactgatg

SEQ ID NO: 495369 - DNA, 25 bp, Homo sapien
ttatactcagtctattcggtaaaat

SEQ ID NO: 495370 - DNA, 25 bp, Homo sapien
aatgtgcatacctggatttccttgg

SEQ ID NO: 495371 - DNA, 25 bp, Homo sapien
gccgagttacttgatattccctggt

SEQ ID NO: 495372 - DNA, 25 bp, Homo sapien
atattccctggtcatggcaaagcct

SEQ ID NO: 495373 - DNA, 25 bp, Homo sapien
cttctattgtcacttccattctttt

SEQ ID NO: 495374 - DNA, 25 bp, Homo sapien
ccattctttttccatagtccataga

SEQ ID NO: 495375 - DNA, 25 bp, Homo sapien
tacgtgacagtgatgagctgaccag

SEQ ID NO: 495376 - DNA, 25 bp, Homo sapien
gtacttcctatatcctaatgggttt

SEQ ID NO: 495377 - DNA, 25 bp, Homo sapien
gcatactcaccctttctgaacaaag

SEQ ID NO: 495378 - DNA, 25 bp, Homo sapien
aaaggctgctaggtgaccctgctgt

SEQ ID NO: 495379 - DNA, 25 bp, Homo sapien
tgctgttgccgctctgtatattcac

SEQ ID NO: 495380 - DNA, 25 bp, Homo sapien
gtatattcacttggttagcccacag

SEQ ID NO: 495381 - DNA, 25 bp, Homo sapien
ggttagcccacagattggtttggac

SEQ ID NO: 495382 - DNA, 25 bp, Homo sapien
cgtgtattaaagctatggatttttt

SEQ ID NO: 495383 - DNA, 25 bp, Homo sapien
ttcagcatcctaattcaccctttct

SEQ ID NO: 495384 - DNA, 25 bp, Homo sapien
catcctaattcaccctttctaactt

SEQ ID NO: 495385 - DNA, 25 bp, Homo sapien
gaaaaacatgacttaagacactgct

SEQ ID NO: 495386 - DNA, 25 bp, Homo sapien
acatgacttaagacactgcttctaa

SEQ ID NO: 495387 - DNA, 25 bp, Homo sapien
gacactgcttctaagtttggttgtt

SEQ ID NO: 495388 - DNA, 25 bp, Homo sapien
gcttctaagtttggttgttctttat

SEQ ID NO: 495389 - DNA, 25 bp, Homo sapien
gttctttatagtgtggatacccagt

SEQ ID NO: 495390 - DNA, 25 bp, Homo sapien
agtgtggatacccagttatctgtga

SEQ ID NO: 495391 - DNA, 25 bp, Homo sapien
ggatacccagttatctgtgagcgta

SEQ ID NO: 495392 - DNA, 25 bp, Homo sapien
tacccagttatctgtgagcgtatgg

SEQ ID NO: 495393 - DNA, 25 bp, Homo sapien
ggagagacacatactcagctagaga

SEQ ID NO: 495394 - DNA, 25 bp, Homo sapien
aaaatactaagttgcactgattact

SEQ ID NO: 495395 - DNA, 25 bp, Homo sapien
tagtcacaccataaaagtgccctgt

SEQ ID NO: 495396 - DNA, 25 bp, Homo sapien
gtgccctgtagtttcaaaaacacgt

SEQ ID NO: 495397 - DNA, 25 bp, Homo sapien
acacgtaagcaatgaaatgttagcc

SEQ ID NO: 495398 - DNA, 25 bp, Homo sapien
gttagccattatgtgttaaactact

SEQ ID NO: 495399 - DNA, 25 bp, Homo sapien
aaactacttaatctcatttctgtga

SEQ ID NO: 495400 - DNA, 25 bp, Homo sapien
cttgtccaaggccatatagctgtga

SEQ ID NO: 495401 - DNA, 25 bp, Homo sapien
ctcttttcagagttcatgctatcac

SEQ ID NO: 495402 - DNA, 25 bp, Homo sapien
gagttcatgctatcactcaacttta

SEQ ID NO: 495403 - DNA, 25 bp, Homo sapien
tgctatcactcaactttaaagtagg

SEQ ID NO: 495404 - DNA, 25 bp, Homo sapien
aattgggacatagttacagcagtgg

SEQ ID NO: 495405 - DNA, 25 bp, Homo sapien
attgggacatagttacagcagtgga

SEQ ID NO: 495406 - DNA, 25 bp, Homo sapien
ttgggacatagttacagcagtggaa

SEQ ID NO: 495407 - DNA, 25 bp, Homo sapien
tgggacatagttacagcagtggaat

SEQ ID NO: 495408 - DNA, 25 bp, Homo sapien
gggacatagttacagcagtggaata

SEQ ID NO: 495409 - DNA, 25 bp, Homo sapien
ggacatagttacagcagtggaataa

SEQ ID NO: 495410 - DNA, 25 bp, Homo sapien
gcagtggaataagtattcatttaga

SEQ ID NO: 495411 - DNA, 25 bp, Homo sapien
cagtggaataagtattcatttagaa

SEQ ID NO: 495412 - DNA, 25 bp, Homo sapien
tggaataagtattcatttagaaatg

SEQ ID NO: 495413 - DNA, 25 bp, Homo sapien
ggaataagtattcatttagaaatgt

SEQ ID NO: 495414 - DNA, 25 bp, Homo sapien
ttatactcagtctattcggtaaaat

SEQ ID NO: 495415 - DNA, 25 bp, Homo sapien
ttgttgcgccgttctctaagccact

SEQ ID NO: 495416 - DNA, 25 bp, Homo sapien
agccactcatgtccttagatcagat

SEQ ID NO: 495417 - DNA, 25 bp, Homo sapien
tgtcgggttctctcaagagtctaag

SEQ ID NO: 495418 - DNA, 25 bp, Homo sapien
ggcccgcaggatttaagcctttaat

SEQ ID NO: 495419 - DNA, 25 bp, Homo sapien
tttaatccacagcacattccaagca

SEQ ID NO: 495420 - DNA, 25 bp, Homo sapien
attccaagcacctacccggtggtag

SEQ ID NO: 495421 - DNA, 25 bp, Homo sapien
gtggtaggccctaacaaggaacaca

SEQ ID NO: 495422 - DNA, 25 bp, Homo sapien
caagtgacacgctgcctggcctgaa

SEQ ID NO: 495423 - DNA, 25 bp, Homo sapien
gcctggcctgaaaggtccgctcaga

SEQ ID NO: 495424 - DNA, 25 bp, Homo sapien
tcaagagtctaagatcgcaccctca

SEQ ID NO: 495425 - DNA, 25 bp, Homo sapien
ctttgttttctttcgcttagccttg

SEQ ID NO: 495426 - DNA, 25 bp, Homo sapien
actcaagtatgttgcattggtgctg

SEQ ID NO: 495427 - DNA, 25 bp, Homo sapien
aaacaactctagatatggtctctct

SEQ ID NO: 495428 - DNA, 25 bp, Homo sapien
caactctagatatggtctctcttcc

SEQ ID NO: 495429 - DNA, 25 bp, Homo sapien
actctagatatggtctctcttcctt

SEQ ID NO: 495430 - DNA, 25 bp, Homo sapien
ctcttccttttgtccctaaatgcta

SEQ ID NO: 495431 - DNA, 25 bp, Homo sapien
tccttttgtccctaaatgctacttt

SEQ ID NO: 495432 - DNA, 25 bp, Homo sapien
gcattggtgctgcaatcagtctcta

SEQ ID NO: 495433 - DNA, 25 bp, Homo sapien
ttggtgctgcaatcagtctctaaga

SEQ ID NO: 495434 - DNA, 25 bp, Homo sapien
tgctgcaatcagtctctaagaaaat

SEQ ID NO: 495435 - DNA, 25 bp, Homo sapien
aatgaaaagagcaagaagtcggatc

SEQ ID NO: 495436 - DNA, 25 bp, Homo sapien
caagccaataacgactttacaagat

SEQ ID NO: 495437 - DNA, 25 bp, Homo sapien
ctgcagaattatttccttcagggac

SEQ ID NO: 495438 - DNA, 25 bp, Homo sapien
tttccttcagggacagattttccaa

SEQ ID NO: 495439 - DNA, 25 bp, Homo sapien
ctaagaaactacctaccgtgtgtat

SEQ ID NO: 495440 - DNA, 25 bp, Homo sapien
tacctaccgtgtgtattctcttgac

SEQ ID NO: 495441 - DNA, 25 bp, Homo sapien
gaacccttcagctgctaagatccaa

SEQ ID NO: 495442 - DNA, 25 bp, Homo sapien
aagatccaagaaaacgcctcactgc

SEQ ID NO: 495443 - DNA, 25 bp, Homo sapien
tcactgccttaaccttaactgttct

SEQ ID NO: 495444 - DNA, 25 bp, Homo sapien
ttaactgttcttcctggcgctaaaa

SEQ ID NO: 495445 - DNA, 25 bp, Homo sapien
tcttcctggcgctaaaaagagctgt

SEQ ID NO: 495446 - DNA, 25 bp, Homo sapien
gcaaacaaagcaaccccaaaagagt

SEQ ID NO: 495447 - DNA, 25 bp, Homo sapien
gaacaattggagatttttatgcaga

SEQ ID NO: 495448 - DNA, 25 bp, Homo sapien
cttgaaaatgtctagtccttagttt

SEQ ID NO: 495449 - DNA, 25 bp, Homo sapien
aaatgtctagtccttagtttctgct

SEQ ID NO: 495450 - DNA, 25 bp, Homo sapien
atgtctagtccttagtttctgctgg

SEQ ID NO: 495451 - DNA, 25 bp, Homo sapien
tctagtccttagtttctgctggcat

SEQ ID NO: 495452 - DNA, 25 bp, Homo sapien
agtccttagtttctgctggcattca

SEQ ID NO: 495453 - DNA, 25 bp, Homo sapien
agcaaatgatttggagcttcttttc

SEQ ID NO: 495454 - DNA, 25 bp, Homo sapien
caaatgatttggagcttcttttcat

SEQ ID NO: 495455 - DNA, 25 bp, Homo sapien
attgggtccatcttgtgtaacacgt

SEQ ID NO: 495456 - DNA, 25 bp, Homo sapien
tgggtccatcttgtgtaacacgtgg

SEQ ID NO: 495457 - DNA, 25 bp, Homo sapien
gtccatcttgtgtaacacgtggctg

SEQ ID NO: 495458 - DNA, 25 bp, Homo sapien
atcttgtgtaacacgtggctggcag

SEQ ID NO: 495459 - DNA, 25 bp, Homo sapien
agtggccccggctgcatgagctgca

SEQ ID NO: 495460 - DNA, 25 bp, Homo sapien
atgagctgcaagtgtgtgctctcct

SEQ ID NO: 495461 - DNA, 25 bp, Homo sapien
tgtgtgctctcctgacgcagcacaa

SEQ ID NO: 495462 - DNA, 25 bp, Homo sapien
tgacgcagcacaagctcaggacatg

SEQ ID NO: 495463 - DNA, 25 bp, Homo sapien
cacaagctcaggacatggaggtgcc

SEQ ID NO: 495464 - DNA, 25 bp, Homo sapien
tcaggacatggaggtgccggatgca

SEQ ID NO: 495465 - DNA, 25 bp, Homo sapien
gaggtgactgcagaccctcccaggg

SEQ ID NO: 495466 - DNA, 25 bp, Homo sapien
tcccagggaggctgtgcacagactg

SEQ ID NO: 495467 - DNA, 25 bp, Homo sapien
acagactgtcttgaacatcccaaat

SEQ ID NO: 495468 - DNA, 25 bp, Homo sapien
gactgtcttgaacatcccaaatgcc

SEQ ID NO: 495469 - DNA, 25 bp, Homo sapien
ttgaacatcccaaatgccaccggaa

SEQ ID NO: 495470 - DNA, 25 bp, Homo sapien
ttcagggcagaaaatacagcaagat

SEQ ID NO: 495471 - DNA, 25 bp, Homo sapien
tttttatttcctaatacattccagg

SEQ ID NO: 495472 - DNA, 25 bp, Homo sapien
ttcctaatacattccaggatattgt

SEQ ID NO: 495473 - DNA, 25 bp, Homo sapien
cccctcaaggtacactatctgaagg

SEQ ID NO: 495474 - DNA, 25 bp, Homo sapien
accattacataaatagtgcctctgc

SEQ ID NO: 495475 - DNA, 25 bp, Homo sapien
aaacagtgactaaggagcccatctt

SEQ ID NO: 495476 - DNA, 25 bp, Homo sapien
gtgcctctgctaattaattactgct

SEQ ID NO: 495477 - DNA, 25 bp, Homo sapien
taattactgctggtcatactcattt

SEQ ID NO: 495478 - DNA, 25 bp, Homo sapien
taaggagcccatcttttgcagctat

SEQ ID NO: 495479 - DNA, 25 bp, Homo sapien
cttttgcagctatctttgtactaca

SEQ ID NO: 495480 - DNA, 25 bp, Homo sapien
acatttacacttacataattgcttt

SEQ ID NO: 495481 - DNA, 25 bp, Homo sapien
gtcccaccatggtcttttatgctgc

SEQ ID NO: 495482 - DNA, 25 bp, Homo sapien
accatggtcttttatgctgcccaaa

SEQ ID NO: 495483 - DNA, 25 bp, Homo sapien
atggtcttttatgctgcccaaaccg

SEQ ID NO: 495484 - DNA, 25 bp, Homo sapien
gtcttttatgctgcccaaaccgata

SEQ ID NO: 495485 - DNA, 25 bp, Homo sapien
tttatgctgcccaaaccgatacctt

SEQ ID NO: 495486 - DNA, 25 bp, Homo sapien
tgcccaaaccgataccttgctggaa

SEQ ID NO: 495487 - DNA, 25 bp, Homo sapien
cccaaaccgataccttgctggaatt

SEQ ID NO: 495488 - DNA, 25 bp, Homo sapien
accttgctggaattacctactgtgg

SEQ ID NO: 495489 - DNA, 25 bp, Homo sapien
cttgctggaattacctactgtggga

SEQ ID NO: 495490 - DNA, 25 bp, Homo sapien
gctggaattacctactgtgggaaaa

SEQ ID NO: 495491 - DNA, 25 bp, Homo sapien
ttgttattgccccattccattttcc

SEQ ID NO: 495492 - DNA, 25 bp, Homo sapien
tcataagtaggaagcctagctgggc

SEQ ID NO: 495493 - DNA, 25 bp, Homo sapien
gagtataagtgatttattacagctt

SEQ ID NO: 495494 - DNA, 25 bp, Homo sapien
cagcttatgaagagactgtgtgtgg

SEQ ID NO: 495495 - DNA, 25 bp, Homo sapien
tgtgtgggctgccagggtcccagct

SEQ ID NO: 495496 - DNA, 25 bp, Homo sapien
ttctcagccccaactgagaaagggt

SEQ ID NO: 495497 - DNA, 25 bp, Homo sapien
tgctgtgggtcacaaaccttcagtg

SEQ ID NO: 495498 - DNA, 25 bp, Homo sapien
tgtgggtcacaaaccttcagtggcc

SEQ ID NO: 495499 - DNA, 25 bp, Homo sapien
gtcacaaaccttcagtggcccaaaa

SEQ ID NO: 495500 - DNA, 25 bp, Homo sapien
caaaccttcagtggcccaaaaggtg

SEQ ID NO: 495501 - DNA, 25 bp, Homo sapien
tgacagatgacctggaaaaatcaag

SEQ ID NO: 495502 - DNA, 25 bp, Homo sapien
tattcataagcagggtattggtggt

SEQ ID NO: 495503 - DNA, 25 bp, Homo sapien
aaaaactggctttaaagcaggagct

SEQ ID NO: 495504 - DNA, 25 bp, Homo sapien
ccctaagccagacggggactagctt

SEQ ID NO: 495505 - DNA, 25 bp, Homo sapien
aagccagacggggactagctttggc

SEQ ID NO: 495506 - DNA, 25 bp, Homo sapien
ctcctggctgtgttcaagtggttct

SEQ ID NO: 495507 - DNA, 25 bp, Homo sapien
tcctggctgtgttcaagtggttctg

SEQ ID NO: 495508 - DNA, 25 bp, Homo sapien
cctggctgtgttcaagtggttctgc

SEQ ID NO: 495509 - DNA, 25 bp, Homo sapien
gtagctggggttagagcaccctgtc

SEQ ID NO: 495510 - DNA, 25 bp, Homo sapien
agctggggttagagcaccctgtcac

SEQ ID NO: 495511 - DNA, 25 bp, Homo sapien
ctggggttagagcaccctgtcacca

SEQ ID NO: 495512 - DNA, 25 bp, Homo sapien
tggggttagagcaccctgtcaccac

SEQ ID NO: 495513 - DNA, 25 bp, Homo sapien
gggttagagcaccctgtcaccacgc

SEQ ID NO: 495514 - DNA, 25 bp, Homo sapien
cccgtctctgcactgagatacataa

SEQ ID NO: 495515 - DNA, 25 bp, Homo sapien
caagggtagtttactgtctgttttg

SEQ ID NO: 495516 - DNA, 25 bp, Homo sapien
ggttttcagtgtcctagcggaatgc

SEQ ID NO: 495517 - DNA, 25 bp, Homo sapien
ttcagtgtcctagcggaatgcaagt

SEQ ID NO: 495518 - DNA, 25 bp, Homo sapien
aatgcaagtaggcagccagcccgtc

SEQ ID NO: 495519 - DNA, 25 bp, Homo sapien
cgtcactgcgcttctgttataccat

SEQ ID NO: 495520 - DNA, 25 bp, Homo sapien
actgcgcttctgttataccatcttt

SEQ ID NO: 495521 - DNA, 25 bp, Homo sapien
cttctgttataccatctttgcctga

SEQ ID NO: 495522 - DNA, 25 bp, Homo sapien
atctttgcctgactctctccggctt

SEQ ID NO: 495523 - DNA, 25 bp, Homo sapien
tccggcttctccattgaatggctaa

SEQ ID NO: 495524 - DNA, 25 bp, Homo sapien
tctccattgaatggctaatgtgtat

SEQ ID NO: 495525 - DNA, 25 bp, Homo sapien
atggagatggcagcaagtgtgaatc

SEQ ID NO: 495526 - DNA, 25 bp, Homo sapien
aagccttaagagtagacggaggaag

SEQ ID NO: 495527 - DNA, 25 bp, Homo sapien
caggcagatcagagctcagggtttg

SEQ ID NO: 495528 - DNA, 25 bp, Homo sapien
gcctgagtaagggtcctgctagaga

SEQ ID NO: 495529 - DNA, 25 bp, Homo sapien
taagggtcctgctagagaaactgca

SEQ ID NO: 495530 - DNA, 25 bp, Homo sapien
agttaccaactgctaatgtgccaag

SEQ ID NO: 495531 - DNA, 25 bp, Homo sapien
ctgctaatgtgccaagtataccaag

SEQ ID NO: 495532 - DNA, 25 bp, Homo sapien
gccaagtataccaagcacagcatgt

SEQ ID NO: 495533 - DNA, 25 bp, Homo sapien
agcacagcatgtgtcctgtagagga

SEQ ID NO: 495534 - DNA, 25 bp, Homo sapien
cctgtagaggagcattattttaaac

SEQ ID NO: 495535 - DNA, 25 bp, Homo sapien
aatgttctactatcatctaccaaaa

SEQ ID NO: 495536 - DNA, 25 bp, Homo sapien
gtatacatacccagtggccacccag

SEQ ID NO: 495537 - DNA, 25 bp, Homo sapien
ccacccagtgtcactgtggcaagtg

SEQ ID NO: 495538 - DNA, 25 bp, Homo sapien
tgtggcaagtgtgacagcgacagca

SEQ ID NO: 495539 - DNA, 25 bp, Homo sapien
gtgtgacagcgacagcactgattgt

SEQ ID NO: 495540 - DNA, 25 bp, Homo sapien
gacagcgacagcactgattgtactg

SEQ ID NO: 495541 - DNA, 25 bp, Homo sapien
actgattgtactgtgcgaggcctgg

SEQ ID NO: 495542 - DNA, 25 bp, Homo sapien
cccagctactgctcctttggtgaaa

SEQ ID NO: 495543 - DNA, 25 bp, Homo sapien
ataaagatcagtggacatttcaggc

SEQ ID NO: 495544 - DNA, 25 bp, Homo sapien
ctgaaggaccaagatattcagtctg

SEQ ID NO: 495545 - DNA, 25 bp, Homo sapien
gggattcagactctactgatccctg

SEQ ID NO: 495546 - DNA, 25 bp, Homo sapien
aactctgggaattgagaagtgctgg

SEQ ID NO: 495547 - DNA, 25 bp, Homo sapien
tcgctttaaagaagctgctactaga

SEQ ID NO: 495548 - DNA, 25 bp, Homo sapien
aagaagctgctactagaaattatag

SEQ ID NO: 495549 - DNA, 25 bp, Homo sapien
gctgctactagaaattatagatcat

SEQ ID NO: 495550 - DNA, 25 bp, Homo sapien
agatcatgattatcgatgtggttca

SEQ ID NO: 495551 - DNA, 25 bp, Homo sapien
atcatgattatcgatgtggttcata

SEQ ID NO: 495552 - DNA, 25 bp, Homo sapien
attatcgatgtggttcatacaaaaa

SEQ ID NO: 495553 - DNA, 25 bp, Homo sapien
aaaatccctgggaaactccaatgag

SEQ ID NO: 495554 - DNA, 25 bp, Homo sapien
aaatccctgggaaactccaatgagc

SEQ ID NO: 495555 - DNA, 25 bp, Homo sapien
atccctgggaaactccaatgagcag

SEQ ID NO: 495556 - DNA, 25 bp, Homo sapien
tccaatgagcaggtataaactcacg

SEQ ID NO: 495557 - DNA, 25 bp, Homo sapien
aatggcttgaactcgagtttaagac

SEQ ID NO: 495558 - DNA, 25 bp, Homo sapien
tctggtctggtgagctcctgaggcc

SEQ ID NO: 495559 - DNA, 25 bp, Homo sapien
tgaggccacacagcaccataaagtc

SEQ ID NO: 495560 - DNA, 25 bp, Homo sapien
ataaagtctcgcatctacaggcctt

SEQ ID NO: 495561 - DNA, 25 bp, Homo sapien
aggcctttgattacctcctgggatg

SEQ ID NO: 495562 - DNA, 25 bp, Homo sapien
ctgggatgggtgctcactatctacc

SEQ ID NO: 495563 - DNA, 25 bp, Homo sapien
cagcctgtggagtcaactgcagaat

SEQ ID NO: 495564 - DNA, 25 bp, Homo sapien
ctgcagaataaatcacaccctagcc

SEQ ID NO: 495565 - DNA, 25 bp, Homo sapien
acaccctagccctggcttggaggat

SEQ ID NO: 495566 - DNA, 25 bp, Homo sapien
gatccccgctttcacagatgctgga

SEQ ID NO: 495567 - DNA, 25 bp, Homo sapien
agatgctggacactgacagccaaat

SEQ ID NO: 495568 - DNA, 25 bp, Homo sapien
acactgacagccaaatgtcctcact

SEQ ID NO: 495569 - DNA, 25 bp, Homo sapien
attaacaccttgctctaagcaactg

SEQ ID NO: 495570 - DNA, 25 bp, Homo sapien
ctctaagcaactgagctgccacaaa

SEQ ID NO: 495571 - DNA, 25 bp, Homo sapien
tgagctgccacaaaaatcaacagtg

SEQ ID NO: 495572 - DNA, 25 bp, Homo sapien
tcaacagtggcttaagcattttgtt

SEQ ID NO: 495573 - DNA, 25 bp, Homo sapien
aaatcaggtcaatctgacaaccaat

SEQ ID NO: 495574 - DNA, 25 bp, Homo sapien
gacaaccaatagttcaagcagccac

SEQ ID NO: 495575 - DNA, 25 bp, Homo sapien
tgctgtgtccccataatgagccatt

SEQ ID NO: 495576 - DNA, 25 bp, Homo sapien
aagcagccactagaaaattgccaaa

SEQ ID NO: 495577 - DNA, 25 bp, Homo sapien
ctgtgtccccataatgagccattag

SEQ ID NO: 495578 - DNA, 25 bp, Homo sapien
atgagccattagctacatgtgcaag

SEQ ID NO: 495579 - DNA, 25 bp, Homo sapien
attagctacatgtgcaagacagctg

SEQ ID NO: 495580 - DNA, 25 bp, Homo sapien
tacatctctgtgttggaagaaaatg

SEQ ID NO: 495581 - DNA, 25 bp, Homo sapien
gaaaatgaagactcccgcagatttg

SEQ ID NO: 495582 - DNA, 25 bp, Homo sapien
cagtttggtttctttgaggcctcct

SEQ ID NO: 495583 - DNA, 25 bp, Homo sapien
tgaggcctcctgtgagtggcaccaa

SEQ ID NO: 495584 - DNA, 25 bp, Homo sapien
gcctcctgtgagtggcaccaatgga

SEQ ID NO: 495585 - DNA, 25 bp, Homo sapien
gagtggcaccaatggacttgctacc

SEQ ID NO: 495586 - DNA, 25 bp, Homo sapien
ctacccacagaatctagttccattt

SEQ ID NO: 495587 - DNA, 25 bp, Homo sapien
cagaatctagttccattttagacaa

SEQ ID NO: 495588 - DNA, 25 bp, Homo sapien
gaagctgcttagtaatctctgccaa

SEQ ID NO: 495589 - DNA, 25 bp, Homo sapien
cttagtaatctctgccaagccatct

SEQ ID NO: 495590 - DNA, 25 bp, Homo sapien
taatctctgccaagccatctcttaa

SEQ ID NO: 495591 - DNA, 25 bp, Homo sapien
cccacgcaatcgtcgcaaacaagat

SEQ ID NO: 495592 - DNA, 25 bp, Homo sapien
aacaagattgacctccctgaagccc

SEQ ID NO: 495593 - DNA, 25 bp, Homo sapien
tgaagcccaagccaatctgtcccag

SEQ ID NO: 495594 - DNA, 25 bp, Homo sapien
agctccgggatcacttgggacagga

SEQ ID NO: 495595 - DNA, 25 bp, Homo sapien
atcacttgggacaggaggtcatcgt

SEQ ID NO: 495596 - DNA, 25 bp, Homo sapien
aggtcatcgtgctgtcggcgttgac

SEQ ID NO: 495597 - DNA, 25 bp, Homo sapien
ttgaccggcgagaacctggagcagc

SEQ ID NO: 495598 - DNA, 25 bp, Homo sapien
gaaggtgctgtatgacgcctacgcg

SEQ ID NO: 495599 - DNA, 25 bp, Homo sapien
tgtatgacgcctacgcggaggccga

SEQ ID NO: 495600 - DNA, 25 bp, Homo sapien
gtgaattcggtggttttgaatgcat

SEQ ID NO: 495601 - DNA, 25 bp, Homo sapien
tttgaatgcataaagtgccttgtgg

SEQ ID NO: 495602 - DNA, 25 bp, Homo sapien
gttgttatccacttcagagctcatt

SEQ ID NO: 495603 - DNA, 25 bp, Homo sapien
ttgttatccacttcagagctcatta

SEQ ID NO: 495604 - DNA, 25 bp, Homo sapien
tgttatccacttcagagctcattaa

SEQ ID NO: 495605 - DNA, 25 bp, Homo sapien
gttatccacttcagagctcattaat

SEQ ID NO: 495606 - DNA, 25 bp, Homo sapien
ttatccacttcagagctcattaatg

SEQ ID NO: 495607 - DNA, 25 bp, Homo sapien
tatccacttcagagctcattaatgc

SEQ ID NO: 495608 - DNA, 25 bp, Homo sapien
atccacttcagagctcattaatgcc

SEQ ID NO: 495609 - DNA, 25 bp, Homo sapien
tccacttcagagctcattaatgcca

SEQ ID NO: 495610 - DNA, 25 bp, Homo sapien
ccacttcagagctcattaatgccac

SEQ ID NO: 495611 - DNA, 25 bp, Homo sapien
cacttcagagctcattaatgccaca

SEQ ID NO: 495612 - DNA, 25 bp, Homo sapien
acttcagagctcattaatgccacat

SEQ ID NO: 495613 - DNA, 25 bp, Homo sapien
ttctgacttgtttcttgagggactt

SEQ ID NO: 495614 - DNA, 25 bp, Homo sapien
gacttgtttcttgagggacttggaa

SEQ ID NO: 495615 - DNA, 25 bp, Homo sapien
gtccctgcggaatcttctacaggaa

SEQ ID NO: 495616 - DNA, 25 bp, Homo sapien
gggaaggtattattcacacagatgt

SEQ ID NO: 495617 - DNA, 25 bp, Homo sapien
acagatgtgtgtatgaagcctaaat

SEQ ID NO: 495618 - DNA, 25 bp, Homo sapien
gtatgaagcctaaataacatccaac

SEQ ID NO: 495619 - DNA, 25 bp, Homo sapien
tacaggaattgcagctcttcacgtc

SEQ ID NO: 495620 - DNA, 25 bp, Homo sapien
aattgcagctcttcacgtcatgcta

SEQ ID NO: 495621 - DNA, 25 bp, Homo sapien
tcttcacgtcatgctaggttaccag

SEQ ID NO: 495622 - DNA, 25 bp, Homo sapien
taggttaccagcatgggcttcccag

SEQ ID NO: 495623 - DNA, 25 bp, Homo sapien
ccagcatgggcttcccagagcactt

SEQ ID NO: 495624 - DNA, 25 bp, Homo sapien
ggttcccaggattccggcctgcagc

SEQ ID NO: 495625 - DNA, 25 bp, Homo sapien
gggctagcgcagtgcccagctcgct

SEQ ID NO: 495626 - DNA, 25 bp, Homo sapien
cagctcgctgggtgacctcgggcac

SEQ ID NO: 495627 - DNA, 25 bp, Homo sapien
agtttgcctatctgtatgttggagc

SEQ ID NO: 495628 - DNA, 25 bp, Homo sapien
gcctatctgtatgttggagcttcta

SEQ ID NO: 495629 - DNA, 25 bp, Homo sapien
ttggagcttctactccacatttctt

SEQ ID NO: 495630 - DNA, 25 bp, Homo sapien
ccgggctgcgactaggttggaccta

SEQ ID NO: 495631 - DNA, 25 bp, Homo sapien
acctagaagcacacgggaccaggct

SEQ ID NO: 495632 - DNA, 25 bp, Homo sapien
accaggctgggcgaagaacactgac

SEQ ID NO: 495633 - DNA, 25 bp, Homo sapien
gaagaacactgacgcccagagccga

SEQ ID NO: 495634 - DNA, 25 bp, Homo sapien
actgacgcccagagccgaataaaca

SEQ ID NO: 495635 - DNA, 25 bp, Homo sapien
gggtatacagggagcccctcccgtg

SEQ ID NO: 495636 - DNA, 25 bp, Homo sapien
acagccgcttgcacgtatagatact

SEQ ID NO: 495637 - DNA, 25 bp, Homo sapien
tatagatactgtggtcccctttctt

SEQ ID NO: 495638 - DNA, 25 bp, Homo sapien
gagtgtattgtgtaggtcccgtatt

SEQ ID NO: 495639 - DNA, 25 bp, Homo sapien
aggtcccgtatttaatgcctctgac

SEQ ID NO: 495640 - DNA, 25 bp, Homo sapien
ttaatgcctctgactgcctttgaag

SEQ ID NO: 495641 - DNA, 25 bp, Homo sapien
gcctttgaagcgcagccctctgtgg

SEQ ID NO: 495642 - DNA, 25 bp, Homo sapien
gagcctggctgttgtgtggtattta

SEQ ID NO: 495643 - DNA, 25 bp, Homo sapien
tggtatttatgctctctttgtctgc

SEQ ID NO: 495644 - DNA, 25 bp, Homo sapien
gtttctaaggaaatgcatgtgtgcc

SEQ ID NO: 495645 - DNA, 25 bp, Homo sapien
gcatgtgtgccctgagccgtgatga

SEQ ID NO: 495646 - DNA, 25 bp, Homo sapien
acaagcactgatagcctctctctgt

SEQ ID NO: 495647 - DNA, 25 bp, Homo sapien
ccttgttactctcgcacatgtgcat

SEQ ID NO: 495648 - DNA, 25 bp, Homo sapien
acatgtgcatggacgacacgtagga

SEQ ID NO: 495649 - DNA, 25 bp, Homo sapien
cacgtaggagagtgttacagcattg

SEQ ID NO: 495650 - DNA, 25 bp, Homo sapien
gaaaacacctgcatctgtcatagga

SEQ ID NO: 495651 - DNA, 25 bp, Homo sapien
gcacaactgctgtttgcccttctct

SEQ ID NO: 495652 - DNA, 25 bp, Homo sapien
gactggattaattgtggcacgttta

SEQ ID NO: 495653 - DNA, 25 bp, Homo sapien
gtggcacgtttatgcagcagttaac

SEQ ID NO: 495654 - DNA, 25 bp, Homo sapien
gcagcagttaactgtcagtggatta

SEQ ID NO: 495655 - DNA, 25 bp, Homo sapien
gagccagcgggcagatttcatatac

SEQ ID NO: 495656 - DNA, 25 bp, Homo sapien
ggcagatttcatatactcacacaag

SEQ ID NO: 495657 - DNA, 25 bp, Homo sapien
ggcagagactgccaccaactgagcc

SEQ ID NO: 495658 - DNA, 25 bp, Homo sapien
agagactgccaccaactgagccaca

SEQ ID NO: 495659 - DNA, 25 bp, Homo sapien
agacacatgcacctgcgaactactc

SEQ ID NO: 495660 - DNA, 25 bp, Homo sapien
tttcctggggaaactgcttactgtc

SEQ ID NO: 495661 - DNA, 25 bp, Homo sapien
cttactgtctaaataatcactttcg

SEQ ID NO: 495662 - DNA, 25 bp, Homo sapien
atcactttcgaaccatgtatgcatt

SEQ ID NO: 495663 - DNA, 25 bp, Homo sapien
tgtatgcattgagattttcttcccc

SEQ ID NO: 495664 - DNA, 25 bp, Homo sapien
gattttcttccccttgcaaatacga

SEQ ID NO: 495665 - DNA, 25 bp, Homo sapien
tttcttccccttgcaaatacgatag

SEQ ID NO: 495666 - DNA, 25 bp, Homo sapien
aaacgatgcgtgataattgccccct

SEQ ID NO: 495667 - DNA, 25 bp, Homo sapien
aacctgcaataaactatctacaaaa

SEQ ID NO: 495668 - DNA, 25 bp, Homo sapien
ctgttttagagtcaaaagtccaact

SEQ ID NO: 495669 - DNA, 25 bp, Homo sapien
agtccaacttagattatccacagag

SEQ ID NO: 495670 - DNA, 25 bp, Homo sapien
atccacagagatgtgtagcatcaca

SEQ ID NO: 495671 - DNA, 25 bp, Homo sapien
gcagccctttctactgtcttgcagt

SEQ ID NO: 495672 - DNA, 25 bp, Homo sapien
gcagtccttctatatcgaagcccat

SEQ ID NO: 495673 - DNA, 25 bp, Homo sapien
ttctatatcgaagcccatcttgcct

SEQ ID NO: 495674 - DNA, 25 bp, Homo sapien
tgccttttaggccagtagtggtcaa

SEQ ID NO: 495675 - DNA, 25 bp, Homo sapien
gggtcacagggaggttttgattaat

SEQ ID NO: 495676 - DNA, 25 bp, Homo sapien
gattgtgtttcaaagctctaaaaac

SEQ ID NO: 495677 - DNA, 25 bp, Homo sapien
ggcagtggcagtgaagagtacacta

SEQ ID NO: 495678 - DNA, 25 bp, Homo sapien
agagtacactatatttcgccaaggg

SEQ ID NO: 495679 - DNA, 25 bp, Homo sapien
ttctcgcctctgacggtgagcgcgg

SEQ ID NO: 495680 - DNA, 25 bp, Homo sapien
cggccgggcccaagcataagggcca

SEQ ID NO: 495681 - DNA, 25 bp, Homo sapien
ataagggccacaaggagcggcacaa

SEQ ID NO: 495682 - DNA, 25 bp, Homo sapien
acaaggagcggcacaagcaccatca

SEQ ID NO: 495683 - DNA, 25 bp, Homo sapien
aggagcggcacaagcaccatcacca

SEQ ID NO: 495684 - DNA, 25 bp, Homo sapien
gatggtgatcccagctcctgcggaa

SEQ ID NO: 495685 - DNA, 25 bp, Homo sapien
agctcctgcggaaccgatctcaagc

SEQ ID NO: 495686 - DNA, 25 bp, Homo sapien
ggaaccgatctcaagcacaaggaca

SEQ ID NO: 495687 - DNA, 25 bp, Homo sapien
gatctcaagcacaaggacaagcagg

SEQ ID NO: 495688 - DNA, 25 bp, Homo sapien
ggtaaaacccagagagccgatgatt

SEQ ID NO: 495689 - DNA, 25 bp, Homo sapien
gagccgatgattttgtcttgaagaa

SEQ ID NO: 495690 - DNA, 25 bp, Homo sapien
agacttcatcctagagtttcaggta

SEQ ID NO: 495691 - DNA, 25 bp, Homo sapien
agagtttcaggtaggctaatgctta

SEQ ID NO: 495692 - DNA, 25 bp, Homo sapien
ggctaatgcttagtgcctgagtatt

SEQ ID NO: 495693 - DNA, 25 bp, Homo sapien
aaacaggcacagttcacattgctag

SEQ ID NO: 495694 - DNA, 25 bp, Homo sapien
gttcacattgctagtatggtcctaa

SEQ ID NO: 495695 - DNA, 25 bp, Homo sapien
ttgctagtatggtcctaactttctg

SEQ ID NO: 495696 - DNA, 25 bp, Homo sapien
tgattcacattatactttctcttag

SEQ ID NO: 495697 - DNA, 25 bp, Homo sapien
acagtaggccttttgtttattaatg

SEQ ID NO: 495698 - DNA, 25 bp, Homo sapien
taatggaagagtactccccacacct

SEQ ID NO: 495699 - DNA, 25 bp, Homo sapien
cagattcttatatctccctggttac

SEQ ID NO: 495700 - DNA, 25 bp, Homo sapien
ccctggttacagtgcaatttggaga

SEQ ID NO: 495701 - DNA, 25 bp, Homo sapien
ggtatcctcagtaacacagaacgaa

SEQ ID NO: 495702 - DNA, 25 bp, Homo sapien
cacagaacgaaattacctttgtatt

SEQ ID NO: 495703 - DNA, 25 bp, Homo sapien
gtattattgtgattagttgttgctt

SEQ ID NO: 495704 - DNA, 25 bp, Homo sapien
ccctaatgattaaaccccgtgagat

SEQ ID NO: 495705 - DNA, 25 bp, Homo sapien
catgtttcctaacacttgtcctaca

SEQ ID NO: 495706 - DNA, 25 bp, Homo sapien
ttcctaacacttgtcctacattcat

SEQ ID NO: 495707 - DNA, 25 bp, Homo sapien
ctacattcattctcctgcttgtaat

SEQ ID NO: 495708 - DNA, 25 bp, Homo sapien
aaccccgtgagatacatatgatttc

SEQ ID NO: 495709 - DNA, 25 bp, Homo sapien
attctcctgcttgtaatgaaaatga

SEQ ID NO: 495710 - DNA, 25 bp, Homo sapien
gtccatttcattaggaacttttttg

SEQ ID NO: 495711 - DNA, 25 bp, Homo sapien
tgtcacataggtatcctcagtaaca

SEQ ID NO: 495712 - DNA, 25 bp, Homo sapien
tatgttcaaggttctgtcaaagcaa

SEQ ID NO: 495713 - DNA, 25 bp, Homo sapien
attattcttgtttttacctgatgga

SEQ ID NO: 495714 - DNA, 25 bp, Homo sapien
tgccataaatttctctccctgtatt

SEQ ID NO: 495715 - DNA, 25 bp, Homo sapien
tttctctccctgtattaaataaaag

SEQ ID NO: 495716 - DNA, 25 bp, Homo sapien
attttcctacaatgagccagctctt

SEQ ID NO: 495717 - DNA, 25 bp, Homo sapien
gagccagctcttcttaaatttacct

SEQ ID NO: 495718 - DNA, 25 bp, Homo sapien
tgaaaagaagtttatcctttcctgt

SEQ ID NO: 495719 - DNA, 25 bp, Homo sapien
tttcctgttttaataccacctgata

SEQ ID NO: 495720 - DNA, 25 bp, Homo sapien
tgttttaataccacctgatacccgt

SEQ ID NO: 495721 - DNA, 25 bp, Homo sapien
cacctgatacccgtttaacttactg

SEQ ID NO: 495722 - DNA, 25 bp, Homo sapien
taacttactgtgtttgattcttggg

SEQ ID NO: 495723 - DNA, 25 bp, Homo sapien
tgattcacattatactttctcttag

SEQ ID NO: 495724 - DNA, 25 bp, Homo sapien
tcttagttaataatacagtaggcct

SEQ ID NO: 495725 - DNA, 25 bp, Homo sapien
acagtaggccttttgtttattaatg

SEQ ID NO: 495726 - DNA, 25 bp, Homo sapien
taatggaagagtactccccacacct

SEQ ID NO: 495727 - DNA, 25 bp, Homo sapien
tggaagagtactccccacacctaag

SEQ ID NO: 495728 - DNA, 25 bp, Homo sapien
aagaccagattcttatatctccctg

SEQ ID NO: 495729 - DNA, 25 bp, Homo sapien
gattcttatatctccctggttacag

SEQ ID NO: 495730 - DNA, 25 bp, Homo sapien
ttatatctccctggttacagtgcaa

SEQ ID NO: 495731 - DNA, 25 bp, Homo sapien
atctccctggttacagtgcaatttg

SEQ ID NO: 495732 - DNA, 25 bp, Homo sapien
cctggttacagtgcaatttggagat

SEQ ID NO: 495733 - DNA, 25 bp, Homo sapien
cctggatggtaagatttgaaatatt

SEQ ID NO: 495734 - DNA, 25 bp, Homo sapien
tagtttagtaaaatttgcatctcaa

SEQ ID NO: 495735 - DNA, 25 bp, Homo sapien
ttgcatctcaaagtatcatttttat

SEQ ID NO: 495736 - DNA, 25 bp, Homo sapien
tatgggacgttttcagattggctaa

SEQ ID NO: 495737 - DNA, 25 bp, Homo sapien
tcagattggctaatatttgcattgt

SEQ ID NO: 495738 - DNA, 25 bp, Homo sapien
gtaaattttgtatgcagtttatcta

SEQ ID NO: 495739 - DNA, 25 bp, Homo sapien
aaatactgtcagtacaccagcgttt

SEQ ID NO: 495740 - DNA, 25 bp, Homo sapien
gtcagtacaccagcgtttaacatct

SEQ ID NO: 495741 - DNA, 25 bp, Homo sapien
gcgtttaacatctatattccaattt

SEQ ID NO: 495742 - DNA, 25 bp, Homo sapien
aattgtactgcaaaactattgtgtg

SEQ ID NO: 495743 - DNA, 25 bp, Homo sapien
tgtgtgctcttacacagtatgcatc

SEQ ID NO: 495744 - DNA, 25 bp, Homo sapien
acagtatgcatcatattgttgtctg

SEQ ID NO: 495745 - DNA, 25 bp, Homo sapien
acagtctggtagtagcagtgcccgc

SEQ ID NO: 495746 - DNA, 25 bp, Homo sapien
cagtgcccgcagtacagcttggagt

SEQ ID NO: 495747 - DNA, 25 bp, Homo sapien
ttggagtgctccaccagcgtgtagg

SEQ ID NO: 495748 - DNA, 25 bp, Homo sapien
taggtgtccccgtcaccgataaagg

SEQ ID NO: 495749 - DNA, 25 bp, Homo sapien
taaaggtcccacacgtgaggcagat

SEQ ID NO: 495750 - DNA, 25 bp, Homo sapien
aaccagtcccttggtgatttgctca

SEQ ID NO: 495751 - DNA, 25 bp, Homo sapien
tttgctcagagcacccatggcagga

SEQ ID NO: 495752 - DNA, 25 bp, Homo sapien
ggcccagtagtccttcttgcagaag

SEQ ID NO: 495753 - DNA, 25 bp, Homo sapien
atccttctcatagtactggtgcgac

SEQ ID NO: 495754 - DNA, 25 bp, Homo sapien
gacagggaggcactgcagtcacaac

SEQ ID NO: 495755 - DNA, 25 bp, Homo sapien
gcagtcacaacacctgaagcagtct

SEQ ID NO: 495756 - DNA, 25 bp, Homo sapien
ttggcccattgggtgctttgatgga

SEQ ID NO: 495757 - DNA, 25 bp, Homo sapien
cattgggtgctttgatggacatcat

SEQ ID NO: 495758 - DNA, 25 bp, Homo sapien
tggacatcatactgggtaggtgaca

SEQ ID NO: 495759 - DNA, 25 bp, Homo sapien
gtaggtgacaacgtcagtgggccac

SEQ ID NO: 495760 - DNA, 25 bp, Homo sapien
agtgggccaccatgtgccatgatgg

SEQ ID NO: 495761 - DNA, 25 bp, Homo sapien
gtgttggccatgtcgtcaccattct

SEQ ID NO: 495762 - DNA, 25 bp, Homo sapien
gtcgtcaccattctctctggcatgg

SEQ ID NO: 495763 - DNA, 25 bp, Homo sapien
gaatactccttggttttctctgaag

SEQ ID NO: 495764 - DNA, 25 bp, Homo sapien
actccttggttttctctgaagccca

SEQ ID NO: 495765 - DNA, 25 bp, Homo sapien
tactgaagtctgattctttcccggg

SEQ ID NO: 495766 - DNA, 25 bp, Homo sapien
aagtctgattctttcccgggaagcg

SEQ ID NO: 495767 - DNA, 25 bp, Homo sapien
taactctcaccgtgccctcagatga

SEQ ID NO: 495768 - DNA, 25 bp, Homo sapien
accgtgccctcagatgaagcacaga

SEQ ID NO: 495769 - DNA, 25 bp, Homo sapien
cagagaggttgttacttgcccgggc

SEQ ID NO: 495770 - DNA, 25 bp, Homo sapien
agaggttgttacttgcccgggccat

SEQ ID NO: 495771 - DNA, 25 bp, Homo sapien
ggctgggtcttgtgtccccatctgt

SEQ ID NO: 495772 - DNA, 25 bp, Homo sapien
tgtggacccctctagggtctgagat

SEQ ID NO: 495773 - DNA, 25 bp, Homo sapien
acccctctagggtctgagatgagat

SEQ ID NO: 495774 - DNA, 25 bp, Homo sapien
tgtccactcctcaggttggtgctct

SEQ ID NO: 495775 - DNA, 25 bp, Homo sapien
aggttggtgctctcacttcttgaaa

SEQ ID NO: 495776 - DNA, 25 bp, Homo sapien
gtgctctcacttcttgaaagctcta

SEQ ID NO: 495777 - DNA, 25 bp, Homo sapien
acttcttgaaagctctaggcacccc

SEQ ID NO: 495778 - DNA, 25 bp, Homo sapien
aataatcaaatagcccagaactggg

SEQ ID NO: 495779 - DNA, 25 bp, Homo sapien
gggccaagccaattctcgtcattga

SEQ ID NO: 495780 - DNA, 25 bp, Homo sapien
cgtcattgacaacatattcgggatt

SEQ ID NO: 495781 - DNA, 25 bp, Homo sapien
ttcgggattgtccatgggttttcat

SEQ ID NO: 495782 - DNA, 25 bp, Homo sapien
tgtccatgggttttcatacaggctg

SEQ ID NO: 495783 - DNA, 25 bp, Homo sapien
agctgatctttgattggcccagttt

SEQ ID NO: 495784 - DNA, 25 bp, Homo sapien
gattggcccagtttcgagcaataaa

SEQ ID NO: 495785 - DNA, 25 bp, Homo sapien
agtttcgagcaataaatccatccaa

SEQ ID NO: 495786 - DNA, 25 bp, Homo sapien
taaatccatccaacaaatctgttag

SEQ ID NO: 495787 - DNA, 25 bp, Homo sapien
aaatctgttagtccagctaaagcaa

SEQ ID NO: 495788 - DNA, 25 bp, Homo sapien
gctaaagcaaaaactcctagtgcaa

SEQ ID NO: 495789 - DNA, 25 bp, Homo sapien
tgccctcgtcctttgctgaagctga

SEQ ID NO: 495790 - DNA, 25 bp, Homo sapien
ggagtcactgccacgaaggttgccc

SEQ ID NO: 495791 - DNA, 25 bp, Homo sapien
tgccacgaaggttgcccagaacttt

SEQ ID NO: 495792 - DNA, 25 bp, Homo sapien
cccagaactttccttgctgcaaaaa

SEQ ID NO: 495793 - DNA, 25 bp, Homo sapien
cttgctgcaaaaagccccaagactt

SEQ ID NO: 495794 - DNA, 25 bp, Homo sapien
acagcttttgccatcgcgttctaaa

SEQ ID NO: 495795 - DNA, 25 bp, Homo sapien
atcgcgttctaaaagctgacagctt

SEQ ID NO: 495796 - DNA, 25 bp, Homo sapien
actgttctccctgagtagggtaaag

SEQ ID NO: 495797 - DNA, 25 bp, Homo sapien
tagggtaaagctacacttggcttcc

SEQ ID NO: 495798 - DNA, 25 bp, Homo sapien
aacaaatttttgtcagtctgctttt

SEQ ID NO: 495799 - DNA, 25 bp, Homo sapien
tttgtcagtctgcttttcaaatggg

SEQ ID NO: 495800 - DNA, 25 bp, Homo sapien
cattgagtgtgcaaaaaggcagcct

SEQ ID NO: 495801 - DNA, 25 bp, Homo sapien
aaaaaggcagccttacccatgggct

SEQ ID NO: 495802 - DNA, 25 bp, Homo sapien
ttacccatgggcttgtgtgtatcaa

SEQ ID NO: 495803 - DNA, 25 bp, Homo sapien
gggcttgtgtgtatcaaagtaccaa

SEQ ID NO: 495804 - DNA, 25 bp, Homo sapien
tgtgatcaagatccatagatttgct

SEQ ID NO: 495805 - DNA, 25 bp, Homo sapien
atagatttgctacattggacgttac

SEQ ID NO: 495806 - DNA, 25 bp, Homo sapien
gctacattggacgttacattcaggt

SEQ ID NO: 495807 - DNA, 25 bp, Homo sapien
ggacgttacattcaggttaaacact

SEQ ID NO: 495808 - DNA, 25 bp, Homo sapien
acaataactcaatggagattttcca

SEQ ID NO: 495809 - DNA, 25 bp, Homo sapien
gatttataaattctctctccgatgt

SEQ ID NO: 495810 - DNA, 25 bp, Homo sapien
tctctctccgatgtagaaatgtgta

SEQ ID NO: 495811 - DNA, 25 bp, Homo sapien
cctgtgacagggattcggaggccat

SEQ ID NO: 495812 - DNA, 25 bp, Homo sapien
ctgagtgacctgctccttggtgagt

SEQ ID NO: 495813 - DNA, 25 bp, Homo sapien
tgacctgctccttggtgagtgagaa

SEQ ID NO: 495814 - DNA, 25 bp, Homo sapien
ctccttggtgagtgagaagtcctag

SEQ ID NO: 495815 - DNA, 25 bp, Homo sapien
gagaagtcctagaactgagcaccat

SEQ ID NO: 495816 - DNA, 25 bp, Homo sapien
gtcctagaactgagcaccatggcat

SEQ ID NO: 495817 - DNA, 25 bp, Homo sapien
actgagcaccatggcatgcacctgt

SEQ ID NO: 495818 - DNA, 25 bp, Homo sapien
tgaagagccttctgggtacctagag

SEQ ID NO: 495819 - DNA, 25 bp, Homo sapien
agccttctgggtacctagaggtgct

SEQ ID NO: 495820 - DNA, 25 bp, Homo sapien
ttggatttaatcttggctgtcctgt

SEQ ID NO: 495821 - DNA, 25 bp, Homo sapien
atttaatcttggctgtcctgtgaca

SEQ ID NO: 495822 - DNA, 25 bp, Homo sapien
agtctggctcaagatatgaaaagga

SEQ ID NO: 495823 - DNA, 25 bp, Homo sapien
aaaagaaccacctagatccaaatct

SEQ ID NO: 495824 - DNA, 25 bp, Homo sapien
aaccacctagatccaaatctcagtc

SEQ ID NO: 495825 - DNA, 25 bp, Homo sapien
cagtcaagatcacagtctaggtcta

SEQ ID NO: 495826 - DNA, 25 bp, Homo sapien
gatcacagtctaggtctaggtcaaa

SEQ ID NO: 495827 - DNA, 25 bp, Homo sapien
aggtcaaaatctagatcaaggtctt

SEQ ID NO: 495828 - DNA, 25 bp, Homo sapien
agatcaaggtcttggactagtccta

SEQ ID NO: 495829 - DNA, 25 bp, Homo sapien
gactagtcctaagtccagtggccac

SEQ ID NO: 495830 - DNA, 25 bp, Homo sapien
ccagtggccactgatagtataaacc

SEQ ID NO: 495831 - DNA, 25 bp, Homo sapien
cactgatagtataaaccatggtcat

SEQ ID NO: 495832 - DNA, 25 bp, Homo sapien
catttttaggcatgtatcattcatt

SEQ ID NO: 495833 - DNA, 25 bp, Homo sapien
ctattttgctcggtttatcctaaga

SEQ ID NO: 495834 - DNA, 25 bp, Homo sapien
tgttttctaaacatcgtccagtgtt

SEQ ID NO: 495835 - DNA, 25 bp, Homo sapien
tgttgactggcttccttactttgca

SEQ ID NO: 495836 - DNA, 25 bp, Homo sapien
tccttactttgcacagtgaacacaa

SEQ ID NO: 495837 - DNA, 25 bp, Homo sapien
aactaaccacattaattcagctttg

SEQ ID NO: 495838 - DNA, 25 bp, Homo sapien
aattcagctttgtgaagtccctgct

SEQ ID NO: 495839 - DNA, 25 bp, Homo sapien
aagtccctgctctctgtgggtctat

SEQ ID NO: 495840 - DNA, 25 bp, Homo sapien
tgtgggtctatgagtcagcagcaac

SEQ ID NO: 495841 - DNA, 25 bp, Homo sapien
gtcagcagcaacattggcctaacct

SEQ ID NO: 495842 - DNA, 25 bp, Homo sapien
caccacatgtgtacagtgctgtttg

SEQ ID NO: 495843 - DNA, 25 bp, Homo sapien
gcagttgtactcattatccatccat

SEQ ID NO: 495844 - DNA, 25 bp, Homo sapien
gtcctacccacattaattaacctga

SEQ ID NO: 495845 - DNA, 25 bp, Homo sapien
attaacctgaggaagcacctccacc

SEQ ID NO: 495846 - DNA, 25 bp, Homo sapien
agatgccatctatccatcactctca

SEQ ID NO: 495847 - DNA, 25 bp, Homo sapien
cactctcaaccccaaagacaaagta

SEQ ID NO: 495848 - DNA, 25 bp, Homo sapien
caaagacaaagtaaagcggcctcca

SEQ ID NO: 495849 - DNA, 25 bp, Homo sapien
tttcttccagggaggtggacacaca

SEQ ID NO: 495850 - DNA, 25 bp, Homo sapien
gaaatcccaacctggcttggagaga

SEQ ID NO: 495851 - DNA, 25 bp, Homo sapien
attcacaagtggcatcaactatgat

SEQ ID NO: 495852 - DNA, 25 bp, Homo sapien
ggaacaggatgtggagacagcatca

SEQ ID NO: 495853 - DNA, 25 bp, Homo sapien
acagcatcagctccgccaagtggga

SEQ ID NO: 495854 - DNA, 25 bp, Homo sapien
agtgggacccactgaattaccccat

SEQ ID NO: 495855 - DNA, 25 bp, Homo sapien
gaaaggaagtcatcgcccacactcg

SEQ ID NO: 495856 - DNA, 25 bp, Homo sapien
tgggcccagagcaatttcctatttt

SEQ ID NO: 495857 - DNA, 25 bp, Homo sapien
gtgggcagacttgacctagtccaaa

SEQ ID NO: 495858 - DNA, 25 bp, Homo sapien
tagtccaaaggccaaggtctcccga

SEQ ID NO: 495859 - DNA, 25 bp, Homo sapien
aggtctcccgaggatttgacgctaa

SEQ ID NO: 495860 - DNA, 25 bp, Homo sapien
gatttgacgctaatcccgttggata

SEQ ID NO: 495861 - DNA, 25 bp, Homo sapien
ggatatttctcatacctccctcatg

SEQ ID NO: 495862 - DNA, 25 bp, Homo sapien
atgcctcatctggtattgttccttt

SEQ ID NO: 495863 - DNA, 25 bp, Homo sapien
tattgttcctttctggactgaatag

SEQ ID NO: 495864 - DNA, 25 bp, Homo sapien
gctgtggcaatagcgcctcacttag

SEQ ID NO: 495865 - DNA, 25 bp, Homo sapien
atccccatgttgacacgttgatgag

SEQ ID NO: 495866 - DNA, 25 bp, Homo sapien
gcaaaagcaagaatccactgtgggt

SEQ ID NO: 495867 - DNA, 25 bp, Homo sapien
aatccactgtgggtggagggacaac

SEQ ID NO: 495868 - DNA, 25 bp, Homo sapien
gagggacaaccaggcattgcttcta

SEQ ID NO: 495869 - DNA, 25 bp, Homo sapien
accaggcattgcttctatggacttc

SEQ ID NO: 495870 - DNA, 25 bp, Homo sapien
cttcagcctgattctgaatataaaa

SEQ ID NO: 495871 - DNA, 25 bp, Homo sapien
atcagtgtttatacaaagctccagg

SEQ ID NO: 495872 - DNA, 25 bp, Homo sapien
gtgtttatacaaagctccaggagat

SEQ ID NO: 495873 - DNA, 25 bp, Homo sapien
ctccaggagattgaaggacctagtg

SEQ ID NO: 495874 - DNA, 25 bp, Homo sapien
ggacctagtgtgagcataatggaaa

SEQ ID NO: 495875 - DNA, 25 bp, Homo sapien
aaaaacacaatcacttcctacacga

SEQ ID NO: 495876 - DNA, 25 bp, Homo sapien
tccaaccattccaccagcaaaagaa

SEQ ID NO: 495877 - DNA, 25 bp, Homo sapien
gggccttcaagatgttcaaggcact

SEQ ID NO: 495878 - DNA, 25 bp, Homo sapien
acttggattttctcctgtctctcat

SEQ ID NO: 495879 - DNA, 25 bp, Homo sapien
ggcctcagtgggtgcatgtgattat

SEQ ID NO: 495880 - DNA, 25 bp, Homo sapien
tgattatccacgtttcacctatgaa

SEQ ID NO: 495881 - DNA, 25 bp, Homo sapien
tgaggcagtgcatgttcttggccca

SEQ ID NO: 495882 - DNA, 25 bp, Homo sapien
gacagggcctcgattctgttttaaa

SEQ ID NO: 495883 - DNA, 25 bp, Homo sapien
ggcctcgattctgttttaaactcca

SEQ ID NO: 495884 - DNA, 25 bp, Homo sapien
gattctgttttaaactccagtagtc

SEQ ID NO: 495885 - DNA, 25 bp, Homo sapien
tcttggcccagagtaagtgcttagt

SEQ ID NO: 495886 - DNA, 25 bp, Homo sapien
tagtgaatgctttctaactccgaac

SEQ ID NO: 495887 - DNA, 25 bp, Homo sapien
aatgctttctaactccgaaccccag

SEQ ID NO: 495888 - DNA, 25 bp, Homo sapien
gtagttcttgattggtggctttaat

SEQ ID NO: 495889 - DNA, 25 bp, Homo sapien
attggtggctttaatccattatcat

SEQ ID NO: 495890 - DNA, 25 bp, Homo sapien
atccattatcattaggtatctcctt

SEQ ID NO: 495891 - DNA, 25 bp, Homo sapien
aggtatctccttgaacgttctcaaa

SEQ ID NO: 495892 - DNA, 25 bp, Homo sapien
tgcagctttcagaaaatccaggatt

SEQ ID NO: 495893 - DNA, 25 bp, Homo sapien
agcctccctgtcctgttattaccaa

SEQ ID NO: 495894 - DNA, 25 bp, Homo sapien
tattaccaacagcaggtacccgggt

SEQ ID NO: 495895 - DNA, 25 bp, Homo sapien
ccaacagcaggtacccgggtggtag

SEQ ID NO: 495896 - DNA, 25 bp, Homo sapien
agacaagaagcctcatgggatagat

SEQ ID NO: 495897 - DNA, 25 bp, Homo sapien
acatatcacactgtatcgtaaacat

SEQ ID NO: 495898 - DNA, 25 bp, Homo sapien
aagtacatttcttattagcttctta

SEQ ID NO: 495899 - DNA, 25 bp, Homo sapien
ttgccttccctcatgttgatgtcaa

SEQ ID NO: 495900 - DNA, 25 bp, Homo sapien
tgttgatgtcaagagcgttccctag

SEQ ID NO: 495901 - DNA, 25 bp, Homo sapien
tgtcaagagcgttccctagcaaact

SEQ ID NO: 495902 - DNA, 25 bp, Homo sapien
tcagggcacttctgaagggtcatat

SEQ ID NO: 495903 - DNA, 25 bp, Homo sapien
tagcaaactccccaaatgccaatct

SEQ ID NO: 495904 - DNA, 25 bp, Homo sapien
gtcatataatcttcagaccttctgt

SEQ ID NO: 495905 - DNA, 25 bp, Homo sapien
tcttcagaccttctgtaaggttggc

SEQ ID NO: 495906 - DNA, 25 bp, Homo sapien
taaggttggctgaagcttcctctca

SEQ ID NO: 495907 - DNA, 25 bp, Homo sapien
tctcagacttcatcacagctcaatg

SEQ ID NO: 495908 - DNA, 25 bp, Homo sapien
ttcatcacagctcaatgtcatcctt

SEQ ID NO: 495909 - DNA, 25 bp, Homo sapien
aatgtcatccttctctgaccagttc

SEQ ID NO: 495910 - DNA, 25 bp, Homo sapien
tgaaccccttggtccggagccttga

SEQ ID NO: 495911 - DNA, 25 bp, Homo sapien
tgactctgccctaggcctgctcaaa

SEQ ID NO: 495912 - DNA, 25 bp, Homo sapien
aaaccctaagaccactcctgaattg

SEQ ID NO: 495913 - DNA, 25 bp, Homo sapien
ctctccctctgcatgtgtctaaaag

SEQ ID NO: 495914 - DNA, 25 bp, Homo sapien
taaaaggtggtaccaggcatccctt

SEQ ID NO: 495915 - DNA, 25 bp, Homo sapien
tttcctggcttatggccaagcccta

SEQ ID NO: 495916 - DNA, 25 bp, Homo sapien
tgccctgacacttgatgtgacctat

SEQ ID NO: 495917 - DNA, 25 bp, Homo sapien
tgatgtgacctatgtgcttcccttt

SEQ ID NO: 495918 - DNA, 25 bp, Homo sapien
ttcccttttcatgtcccgataagaa

SEQ ID NO: 495919 - DNA, 25 bp, Homo sapien
gtcccgataagaagccaatgatccc

SEQ ID NO: 495920 - DNA, 25 bp, Homo sapien
aaatctactccagccacgatgagaa

SEQ ID NO: 495921 - DNA, 25 bp, Homo sapien
ctccaggacatcatgagcaggcagc

SEQ ID NO: 495922 - DNA, 25 bp, Homo sapien
gagagcaaccaagagcgaggagcaa

SEQ ID NO: 495923 - DNA, 25 bp, Homo sapien
cacggcttggtcgtcaggtagacag

SEQ ID NO: 495924 - DNA, 25 bp, Homo sapien
ggtagacagcatgtgggcagaacaa

SEQ ID NO: 495925 - DNA, 25 bp, Homo sapien
aatggaattggagagcatcctggtg

SEQ ID NO: 495926 - DNA, 25 bp, Homo sapien
gcagaagcacagcaggaactcccag

SEQ ID NO: 495927 - DNA, 25 bp, Homo sapien
gatgaagattcctcctgtgacccgg

SEQ ID NO: 495928 - DNA, 25 bp, Homo sapien
tgacccgggctacctgtagccaaaa

SEQ ID NO: 495929 - DNA, 25 bp, Homo sapien
aactggatccagttaatcctctcat

SEQ ID NO: 495930 - DNA, 25 bp, Homo sapien
agttaatcctctcatttctgaccca

SEQ ID NO: 495931 - DNA, 25 bp, Homo sapien
catttctgacccactttttcctttg

SEQ ID NO: 495932 - DNA, 25 bp, Homo sapien
gtttttgtcgaatgagtctatgaag

SEQ ID NO: 495933 - DNA, 25 bp, Homo sapien
gtctatgaagactcaatgcatccat

SEQ ID NO: 495934 - DNA, 25 bp, Homo sapien
aatgcatccatcttgggctgatcat

SEQ ID NO: 495935 - DNA, 25 bp, Homo sapien
atcttgggctgatcatgccacagat

SEQ ID NO: 495936 - DNA, 25 bp, Homo sapien
atgccacagatctcattccagctat

SEQ ID NO: 495937 - DNA, 25 bp, Homo sapien
tcattccagctatagtactgccaag

SEQ ID NO: 495938 - DNA, 25 bp, Homo sapien
gtttatcattgaattttacctgtgt

SEQ ID NO: 495939 - DNA, 25 bp, Homo sapien
gtgttgctctcttttaaagtaatga

SEQ ID NO: 495940 - DNA, 25 bp, Homo sapien
gatgcatgctttgtatcatattgaa

SEQ ID NO: 495941 - DNA, 25 bp, Homo sapien
ttaaatgatgtagctttggcaggtt

SEQ ID NO: 495942 - DNA, 25 bp, Homo sapien
gctttggcaggttttatttggttga

SEQ ID NO: 495943 - DNA, 25 bp, Homo sapien
ctcatttgtagttgacttgcttcct

SEQ ID NO: 495944 - DNA, 25 bp, Homo sapien
gacttgcttcctaaagtttgagact

SEQ ID NO: 495945 - DNA, 25 bp, Homo sapien
gagactttccagtatttcgaccttt

SEQ ID NO: 495946 - DNA, 25 bp, Homo sapien
ttaccttttccaggttcagaatcag

SEQ ID NO: 495947 - DNA, 25 bp, Homo sapien
ttcagaatcagagccactgccacta

SEQ ID NO: 495948 - DNA, 25 bp, Homo sapien
actgccactatccacttgtaacagg

SEQ ID NO: 495949 - DNA, 25 bp, Homo sapien
atccacttgtaacagggcaaaacga

SEQ ID NO: 495950 - DNA, 25 bp, Homo sapien
ggtggtgggaacagaactaagtact

SEQ ID NO: 495951 - DNA, 25 bp, Homo sapien
actaagtactgctgaggccatcgta

SEQ ID NO: 495952 - DNA, 25 bp, Homo sapien
gaggccatcgtaaagatttttcttt

SEQ ID NO: 495953 - DNA, 25 bp, Homo sapien
agattcctgagctcatttgcttcac

SEQ ID NO: 495954 - DNA, 25 bp, Homo sapien
gatatcgctgcttacaagcaacaag

SEQ ID NO: 495955 - DNA, 25 bp, Homo sapien
aagcaacaagatgactcagccgcaa

SEQ ID NO: 495956 - DNA, 25 bp, Homo sapien
tgactcagccgcaacattgggtgac

SEQ ID NO: 495957 - DNA, 25 bp, Homo sapien
gaggcatcaacataaaagagctggt

SEQ ID NO: 495958 - DNA, 25 bp, Homo sapien
aaagagctggttcgccagttctttt

SEQ ID NO: 495959 - DNA, 25 bp, Homo sapien
attagtgggcgctcacggtatgaaa

SEQ ID NO: 495960 - DNA, 25 bp, Homo sapien
gaggtgcgattatggcagcaccagt

SEQ ID NO: 495961 - DNA, 25 bp, Homo sapien
gcagcaccagtagtagccattgttg

SEQ ID NO: 495962 - DNA, 25 bp, Homo sapien
gaaaatcgactatctttaaccggat

SEQ ID NO: 495963 - DNA, 25 bp, Homo sapien
gactatctttaaccggatggccgga

SEQ ID NO: 495964 - DNA, 25 bp, Homo sapien
gatggccggagaacgtattgcaatt

SEQ ID NO: 495965 - DNA, 25 bp, Homo sapien
tgttggaaccactagctgtccccat

SEQ ID NO: 495966 - DNA, 25 bp, Homo sapien
actagctgtccccattgggctcatt

SEQ ID NO: 495967 - DNA, 25 bp, Homo sapien
attgggctcattctgccactatttt

SEQ ID NO: 495968 - DNA, 25 bp, Homo sapien
ccactattttgctgcctctgaagat

SEQ ID NO: 495969 - DNA, 25 bp, Homo sapien
gctgcctctgaagatgttctttgta

SEQ ID NO: 495970 - DNA, 25 bp, Homo sapien
gtagcaaactgaacacattccattt

SEQ ID NO: 495971 - DNA, 25 bp, Homo sapien
gaacacattccatttgtcctaggat

SEQ ID NO: 495972 - DNA, 25 bp, Homo sapien
gtcctaggatttccataaaagccac

SEQ ID NO: 495973 - DNA, 25 bp, Homo sapien
gggtctggttagtctcctgagccat

SEQ ID NO: 495974 - DNA, 25 bp, Homo sapien
gttagtctcctgagccatatttttc

SEQ ID NO: 495975 - DNA, 25 bp, Homo sapien
gggcaagtccttactttccagattt

SEQ ID NO: 495976 - DNA, 25 bp, Homo sapien
ttctgtgtgcactgcatacgctgca

SEQ ID NO: 495977 - DNA, 25 bp, Homo sapien
agccgtgggagttattctcccctag

SEQ ID NO: 495978 - DNA, 25 bp, Homo sapien
tctcccctagagatcgacttggcag

SEQ ID NO: 495979 - DNA, 25 bp, Homo sapien
gacttggcagcacgaaggattcttt

SEQ ID NO: 495980 - DNA, 25 bp, Homo sapien
gaaggattcttttctctttcatgct

SEQ ID NO: 495981 - DNA, 25 bp, Homo sapien
gtctgttttaacgtgggccaagcct

SEQ ID NO: 495982 - DNA, 25 bp, Homo sapien
atttgccagggcttgcctcaggcca

SEQ ID NO: 495983 - DNA, 25 bp, Homo sapien
aggccatgcagcattggcgctctgg

SEQ ID NO: 495984 - DNA, 25 bp, Homo sapien
cattggcgctctggctgcagcagct

SEQ ID NO: 495985 - DNA, 25 bp, Homo sapien
gcagcagctgagttgctcaaggcca

SEQ ID NO: 495986 - DNA, 25 bp, Homo sapien
gttgctcaaggccagtgtccaagtg

SEQ ID NO: 495987 - DNA, 25 bp, Homo sapien
taagtgcctaacttaggtctgaaac

SEQ ID NO: 495988 - DNA, 25 bp, Homo sapien
acttaggtctgaaacagcctgttta

SEQ ID NO: 495989 - DNA, 25 bp, Homo sapien
tattagtctgactctctcaaccata

SEQ ID NO: 495990 - DNA, 25 bp, Homo sapien
agtctgactctctcaaccataaaac

SEQ ID NO: 495991 - DNA, 25 bp, Homo sapien
gttttcttgagtatcttcaattcgt

SEQ ID NO: 495992 - DNA, 25 bp, Homo sapien
gagtatcttcaattcgttgaatgtg

SEQ ID NO: 495993 - DNA, 25 bp, Homo sapien
ttcattgctaactcaagccatcctt

SEQ ID NO: 495994 - DNA, 25 bp, Homo sapien
caagccatccttactattaaaccca

SEQ ID NO: 495995 - DNA, 25 bp, Homo sapien
acccaaatcagtcctttaagttcat

SEQ ID NO: 495996 - DNA, 25 bp, Homo sapien
cagtcctttaagttcattatggcct

SEQ ID NO: 495997 - DNA, 25 bp, Homo sapien
gttcattatggcctttctagtattt

SEQ ID NO: 495998 - DNA, 25 bp, Homo sapien
ctcagtcagtgcactgggcaagcta

SEQ ID NO: 495999 - DNA, 25 bp, Homo sapien
ggttaatgtccccaggagcagcaac

SEQ ID NO: 496000 - DNA, 25 bp, Homo sapien
agcaaccctgagtcaataaggagca

SEQ ID NO: 496001 - DNA, 25 bp, Homo sapien
ataaggagcaggacctcagcttcat

SEQ ID NO: 496002 - DNA, 25 bp, Homo sapien
tcagcttcattgtccttgagcagga

SEQ ID NO: 496003 - DNA, 25 bp, Homo sapien
gtgtattctacataaactctcagag

SEQ ID NO: 496004 - DNA, 25 bp, Homo sapien
cataaactctcagaggatgcccagc

SEQ ID NO: 496005 - DNA, 25 bp, Homo sapien
agcaggatggagtcccagttgcccg

SEQ ID NO: 496006 - DNA, 25 bp, Homo sapien
ggagtcccagttgcccgcagcagta

SEQ ID NO: 496007 - DNA, 25 bp, Homo sapien
agcagtaacccactcattcatgtac

SEQ ID NO: 496008 - DNA, 25 bp, Homo sapien
ggatggctcccaaataaacctcttg

SEQ ID NO: 496009 - DNA, 25 bp, Homo sapien
aagtgcccacgtgaatttgctggtg

SEQ ID NO: 496010 - DNA, 25 bp, Homo sapien
gcacttgtgtgtaaattctacttcc

SEQ ID NO: 496011 - DNA, 25 bp, Homo sapien
ttcctcttgtgtgttttaccaagta

SEQ ID NO: 496012 - DNA, 25 bp, Homo sapien
agtatttatactctggtgcaactaa

SEQ ID NO: 496013 - DNA, 25 bp, Homo sapien
ctctggtgcaactaactactgtgtg

SEQ ID NO: 496014 - DNA, 25 bp, Homo sapien
taactactgtgtgaggaattggtcc

SEQ ID NO: 496015 - DNA, 25 bp, Homo sapien
gaggaattggtccatgtgcaataaa

SEQ ID NO: 496016 - DNA, 25 bp, Homo sapien
actctacttctgttgtctagtatgt

SEQ ID NO: 496017 - DNA, 25 bp, Homo sapien
tatactcctttatcatggtactgta

SEQ ID NO: 496018 - DNA, 25 bp, Homo sapien
ggtactgtaactgtatccatattat

SEQ ID NO: 496019 - DNA, 25 bp, Homo sapien
ttttttatgtccaagtgcccacgtg

SEQ ID NO: 496020 - DNA, 25 bp, Homo sapien
ttcagtcaaattaacctgcgtgaat

SEQ ID NO: 496021 - DNA, 25 bp, Homo sapien
aacctgcgtgaatatcccaatctgg

SEQ ID NO: 496022 - DNA, 25 bp, Homo sapien
atcccaatctggtgacgatttacag

SEQ ID NO: 496023 - DNA, 25 bp, Homo sapien
gcttcaaacgtgttggtgcttccta

SEQ ID NO: 496024 - DNA, 25 bp, Homo sapien
gttggtgcttcctatgaacggcaga

SEQ ID NO: 496025 - DNA, 25 bp, Homo sapien
agagacacaccaatcctacttgaag

SEQ ID NO: 496026 - DNA, 25 bp, Homo sapien
tgaagccccaactggcctagcagaa

SEQ ID NO: 496027 - DNA, 25 bp, Homo sapien
tcaaccaagctgttcaccctgtgcg

SEQ ID NO: 496028 - DNA, 25 bp, Homo sapien
caccctgtgcgccaagagtcagtga

SEQ ID NO: 496029 - DNA, 25 bp, Homo sapien
agtcagtgagcctggaacatcctcc

SEQ ID NO: 496030 - DNA, 25 bp, Homo sapien
tgagatcctgagtgagtcgcccagc

SEQ ID NO: 496031 - DNA, 25 bp, Homo sapien
gttttgtctgactaacttgctgcta

SEQ ID NO: 496032 - DNA, 25 bp, Homo sapien
ttgctgctaaatgctatctttaggt

SEQ ID NO: 496033 - DNA, 25 bp, Homo sapien
gctatctttaggtgtgtgaaagttc

SEQ ID NO: 496034 - DNA, 25 bp, Homo sapien
gttctttgatatgttattgtccttt

SEQ ID NO: 496035 - DNA, 25 bp, Homo sapien
catcttgttaaatagccattgcttt

SEQ ID NO: 496036 - DNA, 25 bp, Homo sapien
tagccattgcttttgagaatcagat

SEQ ID NO: 496037 - DNA, 25 bp, Homo sapien
gggttaattgtgtctatatctttca

SEQ ID NO: 496038 - DNA, 25 bp, Homo sapien
gtgtctatatctttcaaaaactttt

SEQ ID NO: 496039 - DNA, 25 bp, Homo sapien
gaagttacagtagtaccattttgat

SEQ ID NO: 496040 - DNA, 25 bp, Homo sapien
gtagtaccattttgattagtctgaa

SEQ ID NO: 496041 - DNA, 25 bp, Homo sapien
gtctgaatgttttcaggccttgaaa

SEQ ID NO: 496042 - DNA, 25 bp, Homo sapien
tattataaacccacctcctaatagg

SEQ ID NO: 496043 - DNA, 25 bp, Homo sapien
acccacctcctaataggaagccaag

SEQ ID NO: 496044 - DNA, 25 bp, Homo sapien
ggaagccaagtactatttgatacag

SEQ ID NO: 496045 - DNA, 25 bp, Homo sapien
aagtactatttgatacagtggtaaa

SEQ ID NO: 496046 - DNA, 25 bp, Homo sapien
gaataatgctcattttcacagtcag

SEQ ID NO: 496047 - DNA, 25 bp, Homo sapien
aatatggttgaatttgatacacaca

SEQ ID NO: 496048 - DNA, 25 bp, Homo sapien
gatacacacaggaagttttcttgaa

SEQ ID NO: 496049 - DNA, 25 bp, Homo sapien
ttgaagaacaatcctttcgcttttc

SEQ ID NO: 496050 - DNA, 25 bp, Homo sapien
gaaactgtagattgttttcctgaca

SEQ ID NO: 496051 - DNA, 25 bp, Homo sapien
gtagattgttttcctgacagcaaaa

SEQ ID NO: 496052 - DNA, 25 bp, Homo sapien
gttttcctgacagcaaaagactaat

SEQ ID NO: 496053 - DNA, 25 bp, Homo sapien
ggtagagcattattacagaatcttt

SEQ ID NO: 496054 - DNA, 25 bp, Homo sapien
acagaatctttcaatcatgtaagaa

SEQ ID NO: 496055 - DNA, 25 bp, Homo sapien
gaattgtctaaaggcaagcatatct

SEQ ID NO: 496056 - DNA, 25 bp, Homo sapien
aaggcaagcatatctatactattaa

SEQ ID NO: 496057 - DNA, 25 bp, Homo sapien
gcatatctatactattaaccacatt

SEQ ID NO: 496058 - DNA, 25 bp, Homo sapien
taaccacattacacattttgttcta

SEQ ID NO: 496059 - DNA, 25 bp, Homo sapien
cattttgttctaattactggctttt

SEQ ID NO: 496060 - DNA, 25 bp, Homo sapien
tcttttggtgtcttaaggctttttg

SEQ ID NO: 496061 - DNA, 25 bp, Homo sapien
ttgaagcttattttactgtgagttt

SEQ ID NO: 496062 - DNA, 25 bp, Homo sapien
ggaattattggtccccttccaattg

SEQ ID NO: 496063 - DNA, 25 bp, Homo sapien
ggtccccttccaattgtaattatct

SEQ ID NO: 496064 - DNA, 25 bp, Homo sapien
agtagagacattgctgttcctgccc

SEQ ID NO: 496065 - DNA, 25 bp, Homo sapien
tggatttcacgcatcccatcctctg

SEQ ID NO: 496066 - DNA, 25 bp, Homo sapien
catcccatcctctggccagaaatgg

SEQ ID NO: 496067 - DNA, 25 bp, Homo sapien
gaaatggcctccgaactgtgcagct

SEQ ID NO: 496068 - DNA, 25 bp, Homo sapien
cctgcagcaccatttgtatcatagc

SEQ ID NO: 496069 - DNA, 25 bp, Homo sapien
gcaccatttgtatcatagcatatct

SEQ ID NO: 496070 - DNA, 25 bp, Homo sapien
atatctgttatgtgtcgttgctttc

SEQ ID NO: 496071 - DNA, 25 bp, Homo sapien
tatgtgtcgttgctttctgtgtctt

SEQ ID NO: 496072 - DNA, 25 bp, Homo sapien
ggcatggtattttattcatttctga

SEQ ID NO: 496073 - DNA, 25 bp, Homo sapien
atttctgacctccaattccctaagt

SEQ ID NO: 496074 - DNA, 25 bp, Homo sapien
tgacctccaattccctaagtggaga

SEQ ID NO: 496075 - DNA, 25 bp, Homo sapien
cagggcattagcagtgctttagcct

SEQ ID NO: 496076 - DNA, 25 bp, Homo sapien
agggcattagcagtgctttagcctg

SEQ ID NO: 496077 - DNA, 25 bp, Homo sapien
agctcctgatctatgatgcctccag

SEQ ID NO: 496078 - DNA, 25 bp, Homo sapien
gctcctgatctatgatgcctccagt

SEQ ID NO: 496079 - DNA, 25 bp, Homo sapien
ctcctgatctatgatgcctccagtt

SEQ ID NO: 496080 - DNA, 25 bp, Homo sapien
tcctgatctatgatgcctccagttt

SEQ ID NO: 496081 - DNA, 25 bp, Homo sapien
cctgatctatgatgcctccagtttg

SEQ ID NO: 496082 - DNA, 25 bp, Homo sapien
gggcttctgctgctctggctcccag

SEQ ID NO: 496083 - DNA, 25 bp, Homo sapien
ggcttctgctgctctggctcccagg

SEQ ID NO: 496084 - DNA, 25 bp, Homo sapien
caggtgccagatgtgccatccagtt

SEQ ID NO: 496085 - DNA, 25 bp, Homo sapien
ggtgccagatgtgccatccagttga

SEQ ID NO: 496086 - DNA, 25 bp, Homo sapien
tttgcattgtcctactctcagccca

SEQ ID NO: 496087 - DNA, 25 bp, Homo sapien
aaaagcaacctctcccctatgtggg

SEQ ID NO: 496088 - DNA, 25 bp, Homo sapien
tcccctatgtgggtcacgatgtgtg

SEQ ID NO: 496089 - DNA, 25 bp, Homo sapien
gggccccactgagattacacaggaa

SEQ ID NO: 496090 - DNA, 25 bp, Homo sapien
gtcacagtagacagagcagccagat

SEQ ID NO: 496091 - DNA, 25 bp, Homo sapien
agagcagccagatgccgtgcgtaga

SEQ ID NO: 496092 - DNA, 25 bp, Homo sapien
tgccgtgcgtagaccatgggacagt

SEQ ID NO: 496093 - DNA, 25 bp, Homo sapien
agtgattagtgacacatgccctgtg

SEQ ID NO: 496094 - DNA, 25 bp, Homo sapien
caccttgacccaaatgttcctgaat

SEQ ID NO: 496095 - DNA, 25 bp, Homo sapien
gttcctgaattgcaatactcctggg

SEQ ID NO: 496096 - DNA, 25 bp, Homo sapien
caatactcctgggaaattttggttg

SEQ ID NO: 496097 - DNA, 25 bp, Homo sapien
ttagaaacgaatgaatgttgctgct

SEQ ID NO: 496098 - DNA, 25 bp, Homo sapien
gaatgttgctgctcggaatctgaga

SEQ ID NO: 496099 - DNA, 25 bp, Homo sapien
aagtgcataatgacgctgcgagtat

SEQ ID NO: 496100 - DNA, 25 bp, Homo sapien
atgacgctgcgagtatcatcgtgat

SEQ ID NO: 496101 - DNA, 25 bp, Homo sapien
tgattagagctgggcctgccacaca

SEQ ID NO: 496102 - DNA, 25 bp, Homo sapien
agaagatgagttttaggattctctt

SEQ ID NO: 496103 - DNA, 25 bp, Homo sapien
ttacccctgcctcgcattctgtgga

SEQ ID NO: 496104 - DNA, 25 bp, Homo sapien
attctgtggactgcctggtatgtca

SEQ ID NO: 496105 - DNA, 25 bp, Homo sapien
gactgcctggtatgtcatggtcgct

SEQ ID NO: 496106 - DNA, 25 bp, Homo sapien
ggtatgtcatggtcgctcagcaaga

SEQ ID NO: 496107 - DNA, 25 bp, Homo sapien
atggtcgctcagcaagatttttaga

SEQ ID NO: 496108 - DNA, 25 bp, Homo sapien
tcttgccttgtctcttgccatattt

SEQ ID NO: 496109 - DNA, 25 bp, Homo sapien
gtctcttgccatatttgctgttttt

SEQ ID NO: 496110 - DNA, 25 bp, Homo sapien
ggtttagtacttgtgtctttatggc

SEQ ID NO: 496111 - DNA, 25 bp, Homo sapien
gtgtctttatggcacaggttcaatt

SEQ ID NO: 496112 - DNA, 25 bp, Homo sapien
ggcataggttgcaggaaagaatttc

SEQ ID NO: 496113 - DNA, 25 bp, Homo sapien
caggaaagaatttctgcatctggta

SEQ ID NO: 496114 - DNA, 25 bp, Homo sapien
ctgcatctggtacatgggcaagtaa

SEQ ID NO: 496115 - DNA, 25 bp, Homo sapien
tgggcaagtaagttatttagttcta

SEQ ID NO: 496116 - DNA, 25 bp, Homo sapien
tttcagtggctctctggtttcttaa

SEQ ID NO: 496117 - DNA, 25 bp, Homo sapien
gtggctctctggtttcttaacaaaa

SEQ ID NO: 496118 - DNA, 25 bp, Homo sapien
agcacagcactttctgatccaaact

SEQ ID NO: 496119 - DNA, 25 bp, Homo sapien
caacacagacagaagcggcaatgca

SEQ ID NO: 496120 - DNA, 25 bp, Homo sapien
agaagcggcaatgcatctcacgtgc

SEQ ID NO: 496121 - DNA, 25 bp, Homo sapien
aatgcatctcacgtgccgcgtggga

SEQ ID NO: 496122 - DNA, 25 bp, Homo sapien
tgccgcgtgggaacacagcattcta

SEQ ID NO: 496123 - DNA, 25 bp, Homo sapien
acagcattctaggtgtgcactgcgg

SEQ ID NO: 496124 - DNA, 25 bp, Homo sapien
aagttgtcactcagccacaaacggg

SEQ ID NO: 496125 - DNA, 25 bp, Homo sapien
gacggcgtacgattggttgacgcat

SEQ ID NO: 496126 - DNA, 25 bp, Homo sapien
gattggttgacgcatagttctttca

SEQ ID NO: 496127 - DNA, 25 bp, Homo sapien
gcatagttctttcaaaatggcttaa

SEQ ID NO: 496128 - DNA, 25 bp, Homo sapien
ggttctgtccaaacactggcagcag

SEQ ID NO: 496129 - DNA, 25 bp, Homo sapien
agcagagggagtgaccgccaccacg

SEQ ID NO: 496130 - DNA, 25 bp, Homo sapien
cctgccctcagtcttaggttagggc

SEQ ID NO: 496131 - DNA, 25 bp, Homo sapien
tgccctcagtcttaggttagggcct

SEQ ID NO: 496132 - DNA, 25 bp, Homo sapien
gccctcagtcttaggttagggcctt

SEQ ID NO: 496133 - DNA, 25 bp, Homo sapien
ttagggccttggtcagggctttgct

SEQ ID NO: 496134 - DNA, 25 bp, Homo sapien
agggccttggtcagggctttgctcc

SEQ ID NO: 496135 - DNA, 25 bp, Homo sapien
gggccttggtcagggctttgctccc

SEQ ID NO: 496136 - DNA, 25 bp, Homo sapien
ttggtcagggctttgctccctgtga

SEQ ID NO: 496137 - DNA, 25 bp, Homo sapien
ggtcagggctttgctccctgtgaca

SEQ ID NO: 496138 - DNA, 25 bp, Homo sapien
tcagggctttgctccctgtgacacc

SEQ ID NO: 496139 - DNA, 25 bp, Homo sapien
tgtgacacccacaccctcgagctag

SEQ ID NO: 496140 - DNA, 25 bp, Homo sapien
acaccctcgagctagcagcgtctcc

SEQ ID NO: 496141 - DNA, 25 bp, Homo sapien
agcctgtgatgagagctgcccctgg

SEQ ID NO: 496142 - DNA, 25 bp, Homo sapien
gagagctgcccctggcactatctga

SEQ ID NO: 496143 - DNA, 25 bp, Homo sapien
ggcactatctgagtggaaagctcat

SEQ ID NO: 496144 - DNA, 25 bp, Homo sapien
aaagctcattgggacagccatgcag

SEQ ID NO: 496145 - DNA, 25 bp, Homo sapien
ttgggacagccatgcagctatcaga

SEQ ID NO: 496146 - DNA, 25 bp, Homo sapien
tatcagagccgactgaagccctgtc

SEQ ID NO: 496147 - DNA, 25 bp, Homo sapien
tacccctcaggcacctgatgcttaa

SEQ ID NO: 496148 - DNA, 25 bp, Homo sapien
tgatgcttaacttgcctcctgggaa

SEQ ID NO: 496149 - DNA, 25 bp, Homo sapien
atgatctagcatttacttggaacaa

SEQ ID NO: 496150 - DNA, 25 bp, Homo sapien
ttttaagctgtataccaatgttcgt

SEQ ID NO: 496151 - DNA, 25 bp, Homo sapien
ttgacattgattttctaaccattag

SEQ ID NO: 496152 - DNA, 25 bp, Homo sapien
gagaaggcggaaacccacagtgtta

SEQ ID NO: 496153 - DNA, 25 bp, Homo sapien
ggaaacccacagtgttacctgactt

SEQ ID NO: 496154 - DNA, 25 bp, Homo sapien
gtgttacctgacttatgaaacttga

SEQ ID NO: 496155 - DNA, 25 bp, Homo sapien
tgaaacttgaaaccgcctctggagc

SEQ ID NO: 496156 - DNA, 25 bp, Homo sapien
tctggagccgccattctgcagagta

SEQ ID NO: 496157 - DNA, 25 bp, Homo sapien
aagggtttatgcttacgtctctggg

SEQ ID NO: 496158 - DNA, 25 bp, Homo sapien
tgtcacgagcgttcaaactgctgga

SEQ ID NO: 496159 - DNA, 25 bp, Homo sapien
gagcgttcaaactgctggaaatctc

SEQ ID NO: 496160 - DNA, 25 bp, Homo sapien
tgctggaaatctcaaaactgtactg

SEQ ID NO: 496161 - DNA, 25 bp, Homo sapien
aaacgtctacgtatgcatgctaaat

SEQ ID NO: 496162 - DNA, 25 bp, Homo sapien
ttattatttagcttctcccatcgcc

SEQ ID NO: 496163 - DNA, 25 bp, Homo sapien
aaatggttggatgaacttcagcatc

SEQ ID NO: 496164 - DNA, 25 bp, Homo sapien
gtgagttgtcacataataacagcag

SEQ ID NO: 496165 - DNA, 25 bp, Homo sapien
tatgtatttgcctatattgtgaacg

SEQ ID NO: 496166 - DNA, 25 bp, Homo sapien
atgtatttgcctatattgtgaacga

SEQ ID NO: 496167 - DNA, 25 bp, Homo sapien
tgtatttgcctatattgtgaacgaa

SEQ ID NO: 496168 - DNA, 25 bp, Homo sapien
gtatttgcctatattgtgaacgaat

SEQ ID NO: 496169 - DNA, 25 bp, Homo sapien
tatttgcctatattgtgaacgaatt

SEQ ID NO: 496170 - DNA, 25 bp, Homo sapien
atttgcctatattgtgaacgaatta

SEQ ID NO: 496171 - DNA, 25 bp, Homo sapien
gcctatattgtgaacgaattagcag

SEQ ID NO: 496172 - DNA, 25 bp, Homo sapien
cctatattgtgaacgaattagcagt

SEQ ID NO: 496173 - DNA, 25 bp, Homo sapien
ggaactcaaaagatagttaattctt

SEQ ID NO: 496174 - DNA, 25 bp, Homo sapien
agtacaccatttcacacttcttgag

SEQ ID NO: 496175 - DNA, 25 bp, Homo sapien
acacttcttgagttctgccgtttca

SEQ ID NO: 496176 - DNA, 25 bp, Homo sapien
gagttctgccgtttcaaatattaat

SEQ ID NO: 496177 - DNA, 25 bp, Homo sapien
atttctgctatatccatgacttgag

SEQ ID NO: 496178 - DNA, 25 bp, Homo sapien
aacgtttcacacgtgttaagcaaca

SEQ ID NO: 496179 - DNA, 25 bp, Homo sapien
aagcaacacttctttagctccacag

SEQ ID NO: 496180 - DNA, 25 bp, Homo sapien
acttctttagctccacagggacaaa

SEQ ID NO: 496181 - DNA, 25 bp, Homo sapien
atctttacagatgatcatgccaatc

SEQ ID NO: 496182 - DNA, 25 bp, Homo sapien
catgccaatctatctattctatcta

SEQ ID NO: 496183 - DNA, 25 bp, Homo sapien
tctgtcttctatctaatctatttaa

SEQ ID NO: 496184 - DNA, 25 bp, Homo sapien
tacatccaccttactttgtggctaa

SEQ ID NO: 496185 - DNA, 25 bp, Homo sapien
aatattttcacactaccttcttggc

SEQ ID NO: 496186 - DNA, 25 bp, Homo sapien
tcacactaccttcttggctgaaagt

SEQ ID NO: 496187 - DNA, 25 bp, Homo sapien
taccttcttggctgaaagttcacac

SEQ ID NO: 496188 - DNA, 25 bp, Homo sapien
gaaagttcacactcggaattccaga

SEQ ID NO: 496189 - DNA, 25 bp, Homo sapien
gaattccagagcagtccatggccag

SEQ ID NO: 496190 - DNA, 25 bp, Homo sapien
tctctccttggctttggtaaccact

SEQ ID NO: 496191 - DNA, 25 bp, Homo sapien
tggctttggtaaccactggccccag

SEQ ID NO: 496192 - DNA, 25 bp, Homo sapien
tggccccagggactcagcctgcttt

SEQ ID NO: 496193 - DNA, 25 bp, Homo sapien
tcagtagctgtcaccatgcaggtta

SEQ ID NO: 496194 - DNA, 25 bp, Homo sapien
accatgcaggttaccccttctgtcg

SEQ ID NO: 496195 - DNA, 25 bp, Homo sapien
aaacctcacagtaatattttcacac

SEQ ID NO: 496196 - DNA, 25 bp, Homo sapien
cccagtttggatgatacatgataaa

SEQ ID NO: 496197 - DNA, 25 bp, Homo sapien
tggatgatacatgataaatgggtca

SEQ ID NO: 496198 - DNA, 25 bp, Homo sapien
gacaaattttaaactagtcaagtgt

SEQ ID NO: 496199 - DNA, 25 bp, Homo sapien
actagtcaagtgtgatataatcaga

SEQ ID NO: 496200 - DNA, 25 bp, Homo sapien
gaaaggatgactgccttgttggtaa

SEQ ID NO: 496201 - DNA, 25 bp, Homo sapien
aaggatgactgccttgttggtaatg

SEQ ID NO: 496202 - DNA, 25 bp, Homo sapien
ggatgactgccttgttggtaatgga

SEQ ID NO: 496203 - DNA, 25 bp, Homo sapien
atgactgccttgttggtaatggatt

SEQ ID NO: 496204 - DNA, 25 bp, Homo sapien
gactgccttgttggtaatggatttg

SEQ ID NO: 496205 - DNA, 25 bp, Homo sapien
ctgccttgttggtaatggatttgag

SEQ ID NO: 496206 - DNA, 25 bp, Homo sapien
actggtataaaaattaatcactctc

SEQ ID NO: 496207 - DNA, 25 bp, Homo sapien
gcagccttgaaactcctgaactgaa

SEQ ID NO: 496208 - DNA, 25 bp, Homo sapien
actcctgaactgaagtgctcctctc

SEQ ID NO: 496209 - DNA, 25 bp, Homo sapien
ctcctgaactgaagtgctcctctca

SEQ ID NO: 496210 - DNA, 25 bp, Homo sapien
tcctgaactgaagtgctcctctcac

SEQ ID NO: 496211 - DNA, 25 bp, Homo sapien
tttctgcactgtcacacctggctaa

SEQ ID NO: 496212 - DNA, 25 bp, Homo sapien
ttctgcactgtcacacctggctaat

SEQ ID NO: 496213 - DNA, 25 bp, Homo sapien
ttcttttccagtaaatacatatttc

SEQ ID NO: 496214 - DNA, 25 bp, Homo sapien
tttccagtaaatacatatttctctt

SEQ ID NO: 496215 - DNA, 25 bp, Homo sapien
catatttctcttaatgtactgctaa

SEQ ID NO: 496216 - DNA, 25 bp, Homo sapien
atatttctcttaatgtactgctaaa

SEQ ID NO: 496217 - DNA, 25 bp, Homo sapien
gtactgctaaaagtaatgtatcttt

SEQ ID NO: 496218 - DNA, 25 bp, Homo sapien
atgtgagaacacatgctggagcgtg

SEQ ID NO: 496219 - DNA, 25 bp, Homo sapien
acatgctggagcgtgaatctacaaa

SEQ ID NO: 496220 - DNA, 25 bp, Homo sapien
gaatctacaaatacagtggacctgg

SEQ ID NO: 496221 - DNA, 25 bp, Homo sapien
gacctgggagagtgttcaaccgtaa

SEQ ID NO: 496222 - DNA, 25 bp, Homo sapien
gagagtgttcaaccgtaaaaccttg

SEQ ID NO: 496223 - DNA, 25 bp, Homo sapien
gagaaacgttatttatgtagagcat

SEQ ID NO: 496224 - DNA, 25 bp, Homo sapien
atgtagagcatgtaggaaaacctgg

SEQ ID NO: 496225 - DNA, 25 bp, Homo sapien
ggaaaacctggtatagcacttattt

SEQ ID NO: 496226 - DNA, 25 bp, Homo sapien
atggtattgcctttacatgcctcag

SEQ ID NO: 496227 - DNA, 25 bp, Homo sapien
atgcctcagccttaatagtgattcc

SEQ ID NO: 496228 - DNA, 25 bp, Homo sapien
tagtgattccttttgtattaatttc

SEQ ID NO: 496229 - DNA, 25 bp, Homo sapien
catattttcccttatgtgtagcctt

SEQ ID NO: 496230 - DNA, 25 bp, Homo sapien
attttcccttatgtgtagccttagt

SEQ ID NO: 496231 - DNA, 25 bp, Homo sapien
tttcccttatgtgtagccttagtta

SEQ ID NO: 496232 - DNA, 25 bp, Homo sapien
tcccttatgtgtagccttagttata

SEQ ID NO: 496233 - DNA, 25 bp, Homo sapien
gtgtagccttagttatactattttg

SEQ ID NO: 496234 - DNA, 25 bp, Homo sapien
gccttagttatactattttgtattc

SEQ ID NO: 496235 - DNA, 25 bp, Homo sapien
tatatataaactctttcctgttctt

SEQ ID NO: 496236 - DNA, 25 bp, Homo sapien
tctttcctgttcttttacataagat

SEQ ID NO: 496237 - DNA, 25 bp, Homo sapien
ctcatgttaatgtattgtagtttac

SEQ ID NO: 496238 - DNA, 25 bp, Homo sapien
gtagtttactaagtcataactttat

SEQ ID NO: 496239 - DNA, 25 bp, Homo sapien
tctaagcatagttctacatcttaac

SEQ ID NO: 496240 - DNA, 25 bp, Homo sapien
tccttttaacaaatggttggatgaa

SEQ ID NO: 496241 - DNA, 25 bp, Homo sapien
aaatggttggatgaacttcagcatc

SEQ ID NO: 496242 - DNA, 25 bp, Homo sapien
gtgagttgtcacataataacagcag

SEQ ID NO: 496243 - DNA, 25 bp, Homo sapien
cagtggaatatgtatttgcctatat

SEQ ID NO: 496244 - DNA, 25 bp, Homo sapien
tatgtatttgcctatattgtgaacg

SEQ ID NO: 496245 - DNA, 25 bp, Homo sapien
atgtatttgcctatattgtgaacga

SEQ ID NO: 496246 - DNA, 25 bp, Homo sapien
tgtatttgcctatattgtgaacgaa

SEQ ID NO: 496247 - DNA, 25 bp, Homo sapien
gtatttgcctatattgtgaacgaat

SEQ ID NO: 496248 - DNA, 25 bp, Homo sapien
atttgcctatattgtgaacgaatta

SEQ ID NO: 496249 - DNA, 25 bp, Homo sapien
gcctatattgtgaacgaattagcag

SEQ ID NO: 496250 - DNA, 25 bp, Homo sapien
ggaactcaaaagatagttaattctt

SEQ ID NO: 496251 - DNA, 25 bp, Homo sapien
cctcttgtttaattgatctgtccaa

SEQ ID NO: 496252 - DNA, 25 bp, Homo sapien
atctgtccaactctgagatcacttg

SEQ ID NO: 496253 - DNA, 25 bp, Homo sapien
gagatcacttggtaactggtttcat

SEQ ID NO: 496254 - DNA, 25 bp, Homo sapien
ggtttcatgtgtatccaaaaatcag

SEQ ID NO: 496255 - DNA, 25 bp, Homo sapien
gcatttggatttaagctttctgaat

SEQ ID NO: 496256 - DNA, 25 bp, Homo sapien
agctttctgaatttggtagtttaag

SEQ ID NO: 496257 - DNA, 25 bp, Homo sapien
aaataatgattttccaccagctctg

SEQ ID NO: 496258 - DNA, 25 bp, Homo sapien
tttaatgaacgatttatccagcagt

SEQ ID NO: 496259 - DNA, 25 bp, Homo sapien
gggattactttgtacatgcagataa

SEQ ID NO: 496260 - DNA, 25 bp, Homo sapien
gtacatgcagataagttttcgcaaa

SEQ ID NO: 496261 - DNA, 25 bp, Homo sapien
taagttttcgcaaacctatttccat

SEQ ID NO: 496262 - DNA, 25 bp, Homo sapien
agaggtatgtacagtcagtcccact

SEQ ID NO: 496263 - DNA, 25 bp, Homo sapien
gtcccactggaacttgtagaatcac

SEQ ID NO: 496264 - DNA, 25 bp, Homo sapien
atacttcatcttgttccattggcag

SEQ ID NO: 496265 - DNA, 25 bp, Homo sapien
ccacttctgagtgagcccagcattt

SEQ ID NO: 496266 - DNA, 25 bp, Homo sapien
tggtcacaaaacatcaacaaatctg

SEQ ID NO: 496267 - DNA, 25 bp, Homo sapien
aacaaatctgggttattgaccacaa

SEQ ID NO: 496268 - DNA, 25 bp, Homo sapien
tattgaccacaatcgaggcttctcc

SEQ ID NO: 496269 - DNA, 25 bp, Homo sapien
catcttcactgtgcggccgatgata

SEQ ID NO: 496270 - DNA, 25 bp, Homo sapien
gatgatagcggcagtgcacaggcaa

SEQ ID NO: 496271 - DNA, 25 bp, Homo sapien
agtgcacaggcaaaaaggcttgaaa

SEQ ID NO: 496272 - DNA, 25 bp, Homo sapien
ggcttgaaaacagtcaatgcactgt

SEQ ID NO: 496273 - DNA, 25 bp, Homo sapien
gttagtggtgtatgctcggcctcgt

SEQ ID NO: 496274 - DNA, 25 bp, Homo sapien
ggcctcgtggtccatatattctgca

SEQ ID NO: 496275 - DNA, 25 bp, Homo sapien
atattctgcacttttatatttgcca

SEQ ID NO: 496276 - DNA, 25 bp, Homo sapien
tttgccaccagaatggtagtttgct

SEQ ID NO: 496277 - DNA, 25 bp, Homo sapien
aaattacaactcttacaatctgaat

SEQ ID NO: 496278 - DNA, 25 bp, Homo sapien
gtggcaaatattttcccagacaggg

SEQ ID NO: 496279 - DNA, 25 bp, Homo sapien
gagtcctgcagattacagattactg

SEQ ID NO: 496280 - DNA, 25 bp, Homo sapien
cagattactggtgttttcatgcctt

SEQ ID NO: 496281 - DNA, 25 bp, Homo sapien
tggtgttttcatgccttgaggattc

SEQ ID NO: 496282 - DNA, 25 bp, Homo sapien
catgccttgaggattcttttatttt

SEQ ID NO: 496283 - DNA, 25 bp, Homo sapien
gtctaagtgaccaatggattgttca

SEQ ID NO: 496284 - DNA, 25 bp, Homo sapien
ggtttgcatttgtatgcttaagaca

SEQ ID NO: 496285 - DNA, 25 bp, Homo sapien
gcttaagacattgatttcctgttgg

SEQ ID NO: 496286 - DNA, 25 bp, Homo sapien
gatttcctgttggtagatgtatttt

SEQ ID NO: 496287 - DNA, 25 bp, Homo sapien
cacaatttagatgtagctgctttaa

SEQ ID NO: 496288 - DNA, 25 bp, Homo sapien
attgatgtatttcgacagagtcgtc

SEQ ID NO: 496289 - DNA, 25 bp, Homo sapien
gagtcgtctggaatgctttatcttc

SEQ ID NO: 496290 - DNA, 25 bp, Homo sapien
aaaaatgtactgtttgtgcaaatca

SEQ ID NO: 496291 - DNA, 25 bp, Homo sapien
atgatctgtttcacattccttggag

SEQ ID NO: 496292 - DNA, 25 bp, Homo sapien
gtttcacattccttggagtaccttg

SEQ ID NO: 496293 - DNA, 25 bp, Homo sapien
tccttggagtaccttgttagtgatg

SEQ ID NO: 496294 - DNA, 25 bp, Homo sapien
tatatacttctattttgtgtttgtt

SEQ ID NO: 496295 - DNA, 25 bp, Homo sapien
tgtgcttgtgttccttagagctctc

SEQ ID NO: 496296 - DNA, 25 bp, Homo sapien
tagagctctccttcaaagagcgccg

SEQ ID NO: 496297 - DNA, 25 bp, Homo sapien
tgactgttttcacgtgtgcccgtca

SEQ ID NO: 496298 - DNA, 25 bp, Homo sapien
cttgcctgtgggtgaaagctcaggt

SEQ ID NO: 496299 - DNA, 25 bp, Homo sapien
gagggtgtcctgtgtcccacacggt

SEQ ID NO: 496300 - DNA, 25 bp, Homo sapien
tgctgctgccagaatacgagtccca

SEQ ID NO: 496301 - DNA, 25 bp, Homo sapien
gaatacgagtcccattgagcctctc

SEQ ID NO: 496302 - DNA, 25 bp, Homo sapien
attgagcctctccaaagacggcctc

SEQ ID NO: 496303 - DNA, 25 bp, Homo sapien
gcctccaaggatctgaactcttggc

SEQ ID NO: 496304 - DNA, 25 bp, Homo sapien
cactggtatagtggcctcctgttct

SEQ ID NO: 496305 - DNA, 25 bp, Homo sapien
gttctcaccccattgttattttggc

SEQ ID NO: 496306 - DNA, 25 bp, Homo sapien
tatacaaaggcatgaatttctggag

SEQ ID NO: 496307 - DNA, 25 bp, Homo sapien
gctagcaagatagaagccacaatct

SEQ ID NO: 496308 - DNA, 25 bp, Homo sapien
gaactctgaaaagtttctcttccac

SEQ ID NO: 496309 - DNA, 25 bp, Homo sapien
gaaaagtttctcttccacaatctga

SEQ ID NO: 496310 - DNA, 25 bp, Homo sapien
gcttagggatggacaacttggcact

SEQ ID NO: 496311 - DNA, 25 bp, Homo sapien
aacttggcactggttatgtgttcca

SEQ ID NO: 496312 - DNA, 25 bp, Homo sapien
tatgtgttccaagtgaggtaacctt

SEQ ID NO: 496313 - DNA, 25 bp, Homo sapien
gaagccacaatctcttgtaatctat

SEQ ID NO: 496314 - DNA, 25 bp, Homo sapien
gtgaggtaaccttgttcccaggaat

SEQ ID NO: 496315 - DNA, 25 bp, Homo sapien
ctcttgtaatctatcatttttgctg

SEQ ID NO: 496316 - DNA, 25 bp, Homo sapien
catttttgctgtattctactggtta

SEQ ID NO: 496317 - DNA, 25 bp, Homo sapien
tttttgtagtttcataggtggttga

SEQ ID NO: 496318 - DNA, 25 bp, Homo sapien
ggtggttgaaatgaaagctgttgtc

SEQ ID NO: 496319 - DNA, 25 bp, Homo sapien
gtcttgtatttttgcctcctagaga

SEQ ID NO: 496320 - DNA, 25 bp, Homo sapien
tgcctcctagagatttttgctgtga

SEQ ID NO: 496321 - DNA, 25 bp, Homo sapien
tttttgctgtgagaattaattacca

SEQ ID NO: 496322 - DNA, 25 bp, Homo sapien
gggacattctggctcatgaatctga

SEQ ID NO: 496323 - DNA, 25 bp, Homo sapien
catgaatctgaattacttggactag

SEQ ID NO: 496324 - DNA, 25 bp, Homo sapien
tacaaagcagaggtcacagagaaac

SEQ ID NO: 496325 - DNA, 25 bp, Homo sapien
ttgccgtgtaacctcacgtattcac

SEQ ID NO: 496326 - DNA, 25 bp, Homo sapien
taacctcacgtattcacaggttctg

SEQ ID NO: 496327 - DNA, 25 bp, Homo sapien
gggattggcgcatggatgtctttgg

SEQ ID NO: 496328 - DNA, 25 bp, Homo sapien
tagtgtctggtgaaggctgatctct

SEQ ID NO: 496329 - DNA, 25 bp, Homo sapien
caaaagagcatttaatctcattcat

SEQ ID NO: 496330 - DNA, 25 bp, Homo sapien
tcattcattactcagtcacctctta

SEQ ID NO: 496331 - DNA, 25 bp, Homo sapien
cattactcagtcacctcttaaaggc

SEQ ID NO: 496332 - DNA, 25 bp, Homo sapien
gtctggtgaaggctgatctctgctt

SEQ ID NO: 496333 - DNA, 25 bp, Homo sapien
catcctttaatactgttgctttggg

SEQ ID NO: 496334 - DNA, 25 bp, Homo sapien
atccaaaccatagcaacataaatgt

SEQ ID NO: 496335 - DNA, 25 bp, Homo sapien
cacacaaagcagagtgctgggtaat

SEQ ID NO: 496336 - DNA, 25 bp, Homo sapien
ccaagatggcacctcattgctgcat

SEQ ID NO: 496337 - DNA, 25 bp, Homo sapien
tcattgctgcatcctccacagtgga

SEQ ID NO: 496338 - DNA, 25 bp, Homo sapien
ttgctgcatcctccacagtggagga

SEQ ID NO: 496339 - DNA, 25 bp, Homo sapien
tgtccagcaagacaacagtgaagct

SEQ ID NO: 496340 - DNA, 25 bp, Homo sapien
acagccccaggtacaaactgatgct

SEQ ID NO: 496341 - DNA, 25 bp, Homo sapien
tgatgctcaacaaacctcacagtct

SEQ ID NO: 496342 - DNA, 25 bp, Homo sapien
ccttcacctgaacttacctcagaag

SEQ ID NO: 496343 - DNA, 25 bp, Homo sapien
aaatcccagatgctgacaaagcaaa

SEQ ID NO: 496344 - DNA, 25 bp, Homo sapien
aaaaaagttgaccagcctccagaag

SEQ ID NO: 496345 - DNA, 25 bp, Homo sapien
ggtggtgaatgttgagctgcctatt

SEQ ID NO: 496346 - DNA, 25 bp, Homo sapien
gttgagctgcctattgaagccaact

SEQ ID NO: 496347 - DNA, 25 bp, Homo sapien
aagccaacttggtctggcagttagg

SEQ ID NO: 496348 - DNA, 25 bp, Homo sapien
ctggcagttagggaaagaccttctt

SEQ ID NO: 496349 - DNA, 25 bp, Homo sapien
agaccttcttaacatgtatattgag

SEQ ID NO: 496350 - DNA, 25 bp, Homo sapien
aagcaaagatggattgtgttcctat

SEQ ID NO: 496351 - DNA, 25 bp, Homo sapien
gtgttcctataaaagcacatagtta

SEQ ID NO: 496352 - DNA, 25 bp, Homo sapien
atcaatgagcgatttttagcccaat

SEQ ID NO: 496353 - DNA, 25 bp, Homo sapien
cgatttttagcccaatgctccaaaa

SEQ ID NO: 496354 - DNA, 25 bp, Homo sapien
tcatcctgtaccttggagatccagt

SEQ ID NO: 496355 - DNA, 25 bp, Homo sapien
tgctgtgtggccatttctttctggg

SEQ ID NO: 496356 - DNA, 25 bp, Homo sapien
ggagccaggctccacggacaccaag

SEQ ID NO: 496357 - DNA, 25 bp, Homo sapien
ggacaccaaggtcacccagagacct

SEQ ID NO: 496358 - DNA, 25 bp, Homo sapien
ggtcacccagagacctagacttctg

SEQ ID NO: 496359 - DNA, 25 bp, Homo sapien
gagacctagacttctggtcaaagca

SEQ ID NO: 496360 - DNA, 25 bp, Homo sapien
gacttctggtcaaagcaagtgaaca

SEQ ID NO: 496361 - DNA, 25 bp, Homo sapien
tttacaacatttggcatttcccctt

SEQ ID NO: 496362 - DNA, 25 bp, Homo sapien
atacttccaagctttactacttcct

SEQ ID NO: 496363 - DNA, 25 bp, Homo sapien
tactacttcctctgtaagtcatttc

SEQ ID NO: 496364 - DNA, 25 bp, Homo sapien
ctgtaagtcatttcagttatgccag

SEQ ID NO: 496365 - DNA, 25 bp, Homo sapien
gttatgccaggatatttgatgattt

SEQ ID NO: 496366 - DNA, 25 bp, Homo sapien
aagccaattatgctatccttattat

SEQ ID NO: 496367 - DNA, 25 bp, Homo sapien
taagctttggttatatttgggtgta

SEQ ID NO: 496368 - DNA, 25 bp, Homo sapien
atttgggtgtagtctttggctaagt

SEQ ID NO: 496369 - DNA, 25 bp, Homo sapien
agtgctaactgccttgagctgccaa

SEQ ID NO: 496370 - DNA, 25 bp, Homo sapien
gagctgccaattacctatttctgag

SEQ ID NO: 496371 - DNA, 25 bp, Homo sapien
gagaatttggtgactcttattggta

SEQ ID NO: 496372 - DNA, 25 bp, Homo sapien
agattggctcccgtgagtcaggctg

SEQ ID NO: 496373 - DNA, 25 bp, Homo sapien
ggctcccgtgagtcaggctgtgttt

SEQ ID NO: 496374 - DNA, 25 bp, Homo sapien
gggcagactttgtaagcatatgcta

SEQ ID NO: 496375 - DNA, 25 bp, Homo sapien
gtaagcatatgctaggtatccgata

SEQ ID NO: 496376 - DNA, 25 bp, Homo sapien
taggtatccgatagtcctgtagaat

SEQ ID NO: 496377 - DNA, 25 bp, Homo sapien
tagtgaagaaaccttatacagtttt

SEQ ID NO: 496378 - DNA, 25 bp, Homo sapien
ataaactataactcagacccaagct

SEQ ID NO: 496379 - DNA, 25 bp, Homo sapien
aactcagacccaagctacaaggttg

SEQ ID NO: 496380 - DNA, 25 bp, Homo sapien
caagctacaaggttggaattttggt

SEQ ID NO: 496381 - DNA, 25 bp, Homo sapien
aagtaccctgcctgtataattgcat

SEQ ID NO: 496382 - DNA, 25 bp, Homo sapien
gtataattgcatcagaatcccccac

SEQ ID NO: 496383 - DNA, 25 bp, Homo sapien
cttctggtgtcaatactataggagg

SEQ ID NO: 496384 - DNA, 25 bp, Homo sapien
aacagtcagggtcaacgtcatcttc

SEQ ID NO: 496385 - DNA, 25 bp, Homo sapien
tcatcttccctcaggacacaaatgg

SEQ ID NO: 496386 - DNA, 25 bp, Homo sapien
agaatttttctttcacgagaggtgg

SEQ ID NO: 496387 - DNA, 25 bp, Homo sapien
aaagcaaccaaacccattagcacca

SEQ ID NO: 496388 - DNA, 25 bp, Homo sapien
ttagcaccattccatcctatatgag

SEQ ID NO: 496389 - DNA, 25 bp, Homo sapien
cctatatgagaccttgcttggctat

SEQ ID NO: 496390 - DNA, 25 bp, Homo sapien
gaccttgcttggctatatgatttgt

SEQ ID NO: 496391 - DNA, 25 bp, Homo sapien
gatttgtggaattgcatttgtctat

SEQ ID NO: 496392 - DNA, 25 bp, Homo sapien
aacagttatgggtccccttctccag

SEQ ID NO: 496393 - DNA, 25 bp, Homo sapien
aaaggccctgtgctgtgtccataag

SEQ ID NO: 496394 - DNA, 25 bp, Homo sapien
tatctaagaggtctttgcatataga

SEQ ID NO: 496395 - DNA, 25 bp, Homo sapien
gaaatgtatatttgcctggcggact

SEQ ID NO: 496396 - DNA, 25 bp, Homo sapien
atttgcctggcggactatttgcgtt

SEQ ID NO: 496397 - DNA, 25 bp, Homo sapien
gcctggcggactatttgcgttgtgt

SEQ ID NO: 496398 - DNA, 25 bp, Homo sapien
ctatttgcgttgtgtggccttagtt

SEQ ID NO: 496399 - DNA, 25 bp, Homo sapien
cgttgtgtggccttagtttgtttat

SEQ ID NO: 496400 - DNA, 25 bp, Homo sapien
gtggccttagtttgtttattgacat

SEQ ID NO: 496401 - DNA, 25 bp, Homo sapien
gtttattgacattaacgagtgtttt

SEQ ID NO: 496402 - DNA, 25 bp, Homo sapien
gaataatccttttaacacagtgctt

SEQ ID NO: 496403 - DNA, 25 bp, Homo sapien
tttttgtagctgtctaagtgtgtta

SEQ ID NO: 496404 - DNA, 25 bp, Homo sapien
gttaaattgttaagctatttctttg

SEQ ID NO: 496405 - DNA, 25 bp, Homo sapien
gatgctgaaagtgaacctgttgcac

SEQ ID NO: 496406 - DNA, 25 bp, Homo sapien
tgttgcacaaaaaagtcagcttgat

SEQ ID NO: 496407 - DNA, 25 bp, Homo sapien
gtcagcttgatagaactgtctgcat

SEQ ID NO: 496408 - DNA, 25 bp, Homo sapien
gtctgcatttctgatgctggagcat

SEQ ID NO: 496409 - DNA, 25 bp, Homo sapien
gcatgtggtgagaccctcagtgtga

SEQ ID NO: 496410 - DNA, 25 bp, Homo sapien
tgagaccctcagtgtgaccagtgaa

SEQ ID NO: 496411 - DNA, 25 bp, Homo sapien
gtgtgaccagtgaagaaaacagcct

SEQ ID NO: 496412 - DNA, 25 bp, Homo sapien
ttcagaaaggttagaaagcccaaag

SEQ ID NO: 496413 - DNA, 25 bp, Homo sapien
gatgtaggaagagctgttcaggttt

SEQ ID NO: 496414 - DNA, 25 bp, Homo sapien
aagagctgttcaggttttgttcaaa

SEQ ID NO: 496415 - DNA, 25 bp, Homo sapien
ctgtgtgtaataaagcagatgctga

SEQ ID NO: 496416 - DNA, 25 bp, Homo sapien
ggtgtaatctaatgcccatgatgca

SEQ ID NO: 496417 - DNA, 25 bp, Homo sapien
aatgcccatgatgcaagtggcagag

SEQ ID NO: 496418 - DNA, 25 bp, Homo sapien
tagagaattagtgcacagcaataat

SEQ ID NO: 496419 - DNA, 25 bp, Homo sapien
ttgccaaaggaagcggttatagccc

SEQ ID NO: 496420 - DNA, 25 bp, Homo sapien
ggaagcggttatagcccattatata

SEQ ID NO: 496421 - DNA, 25 bp, Homo sapien
accttttaaaggacagacgcatact

SEQ ID NO: 496422 - DNA, 25 bp, Homo sapien
ggacagacgcatactcaggtttatt

SEQ ID NO: 496423 - DNA, 25 bp, Homo sapien
agacgcatactcaggtttattttac

SEQ ID NO: 496424 - DNA, 25 bp, Homo sapien
gtttattttacctgctgagcttctg

SEQ ID NO: 496425 - DNA, 25 bp, Homo sapien
ctgccttagaagttttcagaattgt

SEQ ID NO: 496426 - DNA, 25 bp, Homo sapien
agcagtgccgcaactttgacaaaca

SEQ ID NO: 496427 - DNA, 25 bp, Homo sapien
ggcttcttgcccgtgatggtcagca

SEQ ID NO: 496428 - DNA, 25 bp, Homo sapien
atggtcagcacgaagtcctcgcgga

SEQ ID NO: 496429 - DNA, 25 bp, Homo sapien
agtcctcgcggaactcgggccggat

SEQ ID NO: 496430 - DNA, 25 bp, Homo sapien
aactcgggccggatgtccttgcgca

SEQ ID NO: 496431 - DNA, 25 bp, Homo sapien
atgtccttgcgcagcttggccagca

SEQ ID NO: 496432 - DNA, 25 bp, Homo sapien
agccgggatgcccacttctgcttga

SEQ ID NO: 496433 - DNA, 25 bp, Homo sapien
acttctgcttgatctcgggcttctc

SEQ ID NO: 496434 - DNA, 25 bp, Homo sapien
ggatccccttaaacaaaatcaccat

SEQ ID NO: 496435 - DNA, 25 bp, Homo sapien
aaatcaccatgaccaggtccagccg

SEQ ID NO: 496436 - DNA, 25 bp, Homo sapien
accttgtcagcctggcgcaggcagt

SEQ ID NO: 496437 - DNA, 25 bp, Homo sapien
gcaggcagtcaatccgccggatctt

SEQ ID NO: 496438 - DNA, 25 bp, Homo sapien
gacactgataaaaatgtccagcaag

SEQ ID NO: 496439 - DNA, 25 bp, Homo sapien
tgtccagcaagacaacagtgaagct

SEQ ID NO: 496440 - DNA, 25 bp, Homo sapien
gcaagacaacagtgaagctggaaca

SEQ ID NO: 496441 - DNA, 25 bp, Homo sapien
acagccccaggtacaaactgatgct

SEQ ID NO: 496442 - DNA, 25 bp, Homo sapien
gccccaggtacaaactgatgctcaa

SEQ ID NO: 496443 - DNA, 25 bp, Homo sapien
gtacaaactgatgctcaacaaacct

SEQ ID NO: 496444 - DNA, 25 bp, Homo sapien
aactgatgctcaacaaacctcacag

SEQ ID NO: 496445 - DNA, 25 bp, Homo sapien
tgatgctcaacaaacctcacagtct

SEQ ID NO: 496446 - DNA, 25 bp, Homo sapien
gatgctcaacaaacctcacagtctc

SEQ ID NO: 496447 - DNA, 25 bp, Homo sapien
ccttcacctgaacttacctcagaag

SEQ ID NO: 496448 - DNA, 25 bp, Homo sapien
aaatcccagatgctgacaaagcaaa

SEQ ID NO: 496449 - DNA, 25 bp, Homo sapien
acacttgaaagagtagtccggcgac

SEQ ID NO: 496450 - DNA, 25 bp, Homo sapien
cttgaaagagtagtccggcgacact

SEQ ID NO: 496451 - DNA, 25 bp, Homo sapien
gagtagtccggcgacactctcaata

SEQ ID NO: 496452 - DNA, 25 bp, Homo sapien
tagtccggcgacactctcaataata

SEQ ID NO: 496453 - DNA, 25 bp, Homo sapien
tccggcgacactctcaataataacc

SEQ ID NO: 496454 - DNA, 25 bp, Homo sapien
ctgatctggagttttaagtggtttt

SEQ ID NO: 496455 - DNA, 25 bp, Homo sapien
tctggagttttaagtggttttgcca

SEQ ID NO: 496456 - DNA, 25 bp, Homo sapien
gcagagggcctgacaagtgacaacc

SEQ ID NO: 496457 - DNA, 25 bp, Homo sapien
gggcctgacaagtgacaaccccgct

SEQ ID NO: 496458 - DNA, 25 bp, Homo sapien
cagggccccctcagttctggctgtg

SEQ ID NO: 496459 - DNA, 25 bp, Homo sapien
acagcagggacatgttgggttggta

SEQ ID NO: 496460 - DNA, 25 bp, Homo sapien
cacacaggtgagaatagggctgctg

SEQ ID NO: 496461 - DNA, 25 bp, Homo sapien
aaacgttgaggccaaatcccagtca

SEQ ID NO: 496462 - DNA, 25 bp, Homo sapien
attccctctggtactgcataggcat

SEQ ID NO: 496463 - DNA, 25 bp, Homo sapien
gtactgcataggcatgagcctgcag

SEQ ID NO: 496464 - DNA, 25 bp, Homo sapien
aatgtcttccatacttcagacagag

SEQ ID NO: 496465 - DNA, 25 bp, Homo sapien
tccatacttcagacagaggctaggg

SEQ ID NO: 496466 - DNA, 25 bp, Homo sapien
gaggccaaatcccagtcataaagac

SEQ ID NO: 496467 - DNA, 25 bp, Homo sapien
cagggctgactggtggccaaatgtc

SEQ ID NO: 496468 - DNA, 25 bp, Homo sapien
gtggccaaatgtcaaggaaagtaac

SEQ ID NO: 496469 - DNA, 25 bp, Homo sapien
gcagaaagttgcaaacaagtgggtt

SEQ ID NO: 496470 - DNA, 25 bp, Homo sapien
ttgtatttcagataaccatcttggg

SEQ ID NO: 496471 - DNA, 25 bp, Homo sapien
gcccagggagtcactctgggccctg

SEQ ID NO: 496472 - DNA, 25 bp, Homo sapien
actctgacactgcagttagggaatt

SEQ ID NO: 496473 - DNA, 25 bp, Homo sapien
tgacactgcagttagggaatttttg

SEQ ID NO: 496474 - DNA, 25 bp, Homo sapien
tagggaatttttgtcgtcagcagcc

SEQ ID NO: 496475 - DNA, 25 bp, Homo sapien
gtcgtcagcagccaagcgcagctgt

SEQ ID NO: 496476 - DNA, 25 bp, Homo sapien
caagcgcagctgtcaggccagaagg

SEQ ID NO: 496477 - DNA, 25 bp, Homo sapien
ctgtcaggccagaaggagcagccgt

SEQ ID NO: 496478 - DNA, 25 bp, Homo sapien
gagcagccgtgcaggaggcatttca

SEQ ID NO: 496479 - DNA, 25 bp, Homo sapien
agccgtgcaggaggcatttcaggca

SEQ ID NO: 496480 - DNA, 25 bp, Homo sapien
tgcaggaggcatttcaggcatcgtt

SEQ ID NO: 496481 - DNA, 25 bp, Homo sapien
aggaggcatttcaggcatcgttgag

SEQ ID NO: 496482 - DNA, 25 bp, Homo sapien
tgtgtcccggcctggaagtgccgac

SEQ ID NO: 496483 - DNA, 25 bp, Homo sapien
ctggaagtgccgacacgcccagtga

SEQ ID NO: 496484 - DNA, 25 bp, Homo sapien
acacgcccagtgaggccgaacagag

SEQ ID NO: 496485 - DNA, 25 bp, Homo sapien
gccgaacagaggttccggaagaagc

SEQ ID NO: 496486 - DNA, 25 bp, Homo sapien
gactccggcaattcagcgatctgtg

SEQ ID NO: 496487 - DNA, 25 bp, Homo sapien
caattcagcgatctgtgggtccgcc

SEQ ID NO: 496488 - DNA, 25 bp, Homo sapien
gaggagagtgacatagtcccgcaac

SEQ ID NO: 496489 - DNA, 25 bp, Homo sapien
gagtgacatagtcccgcaactccag

SEQ ID NO: 496490 - DNA, 25 bp, Homo sapien
aactccaggtccctgtcctggacag

SEQ ID NO: 496491 - DNA, 25 bp, Homo sapien
ggacaggcacatctccactgaactg

SEQ ID NO: 496492 - DNA, 25 bp, Homo sapien
gtgggcattcccaccacagccagat

SEQ ID NO: 496493 - DNA, 25 bp, Homo sapien
aagccagaaggacgatgctgagcca

SEQ ID NO: 496494 - DNA, 25 bp, Homo sapien
gaaggacgatgctgagccatggatc

SEQ ID NO: 496495 - DNA, 25 bp, Homo sapien
cgatgctgagccatggatcgcggaa

SEQ ID NO: 496496 - DNA, 25 bp, Homo sapien
catggatcgcggaaggcgtcctctg

SEQ ID NO: 496497 - DNA, 25 bp, Homo sapien
tcgcggaaggcgtcctctggcctca

SEQ ID NO: 496498 - DNA, 25 bp, Homo sapien
tcacaggctgagttcttgcctctgt

SEQ ID NO: 496499 - DNA, 25 bp, Homo sapien
acaggctgagttcttgcctctgtgt

SEQ ID NO: 496500 - DNA, 25 bp, Homo sapien
ggctgagttcttgcctctgtgtcct

SEQ ID NO: 496501 - DNA, 25 bp, Homo sapien
gtccttcctggaagtcaggactctg

SEQ ID NO: 496502 - DNA, 25 bp, Homo sapien
gaagtcaggactctgcttcctcagg

SEQ ID NO: 496503 - DNA, 25 bp, Homo sapien
caccgcacactcgtggttcccaata

SEQ ID NO: 496504 - DNA, 25 bp, Homo sapien
aatgtacctctggtggagccgaagc

SEQ ID NO: 496505 - DNA, 25 bp, Homo sapien
tctggtggagccgaagcccacatgg

SEQ ID NO: 496506 - DNA, 25 bp, Homo sapien
ggctgacggcccagtactggtttca

SEQ ID NO: 496507 - DNA, 25 bp, Homo sapien
gtactggtttcagccatgtcaatct

SEQ ID NO: 496508 - DNA, 25 bp, Homo sapien
agccatgtcaatctgtggttagact

SEQ ID NO: 496509 - DNA, 25 bp, Homo sapien
gactagttacttacattgaggaatc

SEQ ID NO: 496510 - DNA, 25 bp, Homo sapien
tcctctttaagctcatttacttcta

SEQ ID NO: 496511 - DNA, 25 bp, Homo sapien
catttacttctatccttgtattatt

SEQ ID NO: 496512 - DNA, 25 bp, Homo sapien
ggacagctaaagattatacctcaag

SEQ ID NO: 496513 - DNA, 25 bp, Homo sapien
tctggaaggttctcgcatgggctaa

SEQ ID NO: 496514 - DNA, 25 bp, Homo sapien
tcgcatgggctaaaaatgtacctct

SEQ ID NO: 496515 - DNA, 25 bp, Homo sapien
aaaataaatcgctgacaagtgtgaa

SEQ ID NO: 496516 - DNA, 25 bp, Homo sapien
tgtgtatcctgtacagcaaggttgg

SEQ ID NO: 496517 - DNA, 25 bp, Homo sapien
gtgtatcctgtacagcaaggttggt

SEQ ID NO: 496518 - DNA, 25 bp, Homo sapien
tgtatcctgtacagcaaggttggtc

SEQ ID NO: 496519 - DNA, 25 bp, Homo sapien
gtatcctgtacagcaaggttggtcc

SEQ ID NO: 496520 - DNA, 25 bp, Homo sapien
tatcctgtacagcaaggttggtcct

SEQ ID NO: 496521 - DNA, 25 bp, Homo sapien
atcctgtacagcaaggttggtcctt

SEQ ID NO: 496522 - DNA, 25 bp, Homo sapien
gtacatatttatgttgcgagaggca

SEQ ID NO: 496523 - DNA, 25 bp, Homo sapien
tacatatttatgttgcgagaggcaa

SEQ ID NO: 496524 - DNA, 25 bp, Homo sapien
acatatttatgttgcgagaggcaaa

SEQ ID NO: 496525 - DNA, 25 bp, Homo sapien
ttatgttgcgagaggcaaagggcaa

SEQ ID NO: 496526 - DNA, 25 bp, Homo sapien
ggctattatagaggtgggtttgaac

SEQ ID NO: 496527 - DNA, 25 bp, Homo sapien
tgacaaaacgggaagcagcattaat

SEQ ID NO: 496528 - DNA, 25 bp, Homo sapien
cagcattaatactaggtgtaagccc

SEQ ID NO: 496529 - DNA, 25 bp, Homo sapien
ggtgtaagccctactgccaataaag

SEQ ID NO: 496530 - DNA, 25 bp, Homo sapien
gagatgctcatcgacgaattatgct

SEQ ID NO: 496531 - DNA, 25 bp, Homo sapien
gctcatcgacgaattatgcttttaa

SEQ ID NO: 496532 - DNA, 25 bp, Homo sapien
tatgcttttaaatcatcctgacaaa

SEQ ID NO: 496533 - DNA, 25 bp, Homo sapien
aatcatcctgacaaaggaggatctc

SEQ ID NO: 496534 - DNA, 25 bp, Homo sapien
ggaggatctccttatatagcagcca

SEQ ID NO: 496535 - DNA, 25 bp, Homo sapien
tatatagcagccaaaatcaatgaag

SEQ ID NO: 496536 - DNA, 25 bp, Homo sapien
gatttactagaaggtcaagctaaaa

SEQ ID NO: 496537 - DNA, 25 bp, Homo sapien
ccctcttttgtcttctgtgaagaca

SEQ ID NO: 496538 - DNA, 25 bp, Homo sapien
aagacaggacctatgcaacgcacag

SEQ ID NO: 496539 - DNA, 25 bp, Homo sapien
tatgcaacgcacagacacttttgga

SEQ ID NO: 496540 - DNA, 25 bp, Homo sapien
gcacagacacttttggagaccgtaa

SEQ ID NO: 496541 - DNA, 25 bp, Homo sapien
tatgtggtcccacctatcctcctgg

SEQ ID NO: 496542 - DNA, 25 bp, Homo sapien
atcctcctgggcctttttcaagtgc

SEQ ID NO: 496543 - DNA, 25 bp, Homo sapien
cctgggcctttttcaagtgctttgg

SEQ ID NO: 496544 - DNA, 25 bp, Homo sapien
ggctgtgactttcatactctgctct

SEQ ID NO: 496545 - DNA, 25 bp, Homo sapien
tgtgactttcatactctgctcttag

SEQ ID NO: 496546 - DNA, 25 bp, Homo sapien
actttcatactctgctcttagtcta

SEQ ID NO: 496547 - DNA, 25 bp, Homo sapien
catactctgctcttagtctaaaaaa

SEQ ID NO: 496548 - DNA, 25 bp, Homo sapien
gaatttaaccacaactgagacctaa

SEQ ID NO: 496549 - DNA, 25 bp, Homo sapien
actgagacctaagaaattgacctag

SEQ ID NO: 496550 - DNA, 25 bp, Homo sapien
ccactttaatgggagactgataaac

SEQ ID NO: 496551 - DNA, 25 bp, Homo sapien
gataaactggtaattagactgtgat

SEQ ID NO: 496552 - DNA, 25 bp, Homo sapien
tatgatggaaattagcttaagctgt

SEQ ID NO: 496553 - DNA, 25 bp, Homo sapien
agtagggactcttcttattcggtgg

SEQ ID NO: 496554 - DNA, 25 bp, Homo sapien
gactcttcttattcggtggaaaggc

SEQ ID NO: 496555 - DNA, 25 bp, Homo sapien
gaaaggctgttccaggtacaggcaa

SEQ ID NO: 496556 - DNA, 25 bp, Homo sapien
tgttccaggtacaggcaactggcct

SEQ ID NO: 496557 - DNA, 25 bp, Homo sapien
aactggcctggcaacttggatactt

SEQ ID NO: 496558 - DNA, 25 bp, Homo sapien
cttggatacttggaaccttgtattt

SEQ ID NO: 496559 - DNA, 25 bp, Homo sapien
aaggttaagttctagattgcttcat

SEQ ID NO: 496560 - DNA, 25 bp, Homo sapien
aagttctagattgcttcatgttgct

SEQ ID NO: 496561 - DNA, 25 bp, Homo sapien
ctagattgcttcatgttgcttatca

SEQ ID NO: 496562 - DNA, 25 bp, Homo sapien
cttcatgttgcttatcaatgtttta

SEQ ID NO: 496563 - DNA, 25 bp, Homo sapien
attagctgttaagttggctcaaccg

SEQ ID NO: 496564 - DNA, 25 bp, Homo sapien
aagttggctcaaccggaaattcagt

SEQ ID NO: 496565 - DNA, 25 bp, Homo sapien
caaccggaaattcagtatatccttt

SEQ ID NO: 496566 - DNA, 25 bp, Homo sapien
agtaagcagtgtgtctaaagaatga

SEQ ID NO: 496567 - DNA, 25 bp, Homo sapien
gaatgacatatggttgggtacagtg

SEQ ID NO: 496568 - DNA, 25 bp, Homo sapien
gggtacagtggctcgtgactgcaat

SEQ ID NO: 496569 - DNA, 25 bp, Homo sapien
tacagtggctcgtgactgcaatccc

SEQ ID NO: 496570 - DNA, 25 bp, Homo sapien
gaaaggaaatgtctgggttgcaata

SEQ ID NO: 496571 - DNA, 25 bp, Homo sapien
atgtctgggttgcaataagagttgt

SEQ ID NO: 496572 - DNA, 25 bp, Homo sapien
taaggtctgcgttgatgtgaatgcc

SEQ ID NO: 496573 - DNA, 25 bp, Homo sapien
gtctgcgttgatgtgaatgccggct

SEQ ID NO: 496574 - DNA, 25 bp, Homo sapien
tgcgttgatgtgaatgccggcttga

SEQ ID NO: 496575 - DNA, 25 bp, Homo sapien
tgtgaatgccggcttgaggtataat

SEQ ID NO: 496576 - DNA, 25 bp, Homo sapien
ccggcttgaggtataatgaggcata

SEQ ID NO: 496577 - DNA, 25 bp, Homo sapien
cagggagcttccaggttataggtac

SEQ ID NO: 496578 - DNA, 25 bp, Homo sapien
cctcatggcctgaaacaatctctca

SEQ ID NO: 496579 - DNA, 25 bp, Homo sapien
ggcctgaaacaatctctcaagttaa

SEQ ID NO: 496580 - DNA, 25 bp, Homo sapien
gagcttccaggttataggtacgttt

SEQ ID NO: 496581 - DNA, 25 bp, Homo sapien
agcaggttgtctgggcttcgtttga

SEQ ID NO: 496582 - DNA, 25 bp, Homo sapien
tctgggcttcgtttgattttcggca

SEQ ID NO: 496583 - DNA, 25 bp, Homo sapien
ctgttgctcctaagaaagcaagcgg

SEQ ID NO: 496584 - DNA, 25 bp, Homo sapien
tggcctggtttgaccctcgtagcca

SEQ ID NO: 496585 - DNA, 25 bp, Homo sapien
tttgaccctcgtagccagcccatgt

SEQ ID NO: 496586 - DNA, 25 bp, Homo sapien
acgcagacaccacgacaaagtgaga

SEQ ID NO: 496587 - DNA, 25 bp, Homo sapien
gtgagatgaactaagacctcttctt

SEQ ID NO: 496588 - DNA, 25 bp, Homo sapien
gaactaagacctcttcttgattcta

SEQ ID NO: 496589 - DNA, 25 bp, Homo sapien
tcttgattctaagcagggaacgcac

SEQ ID NO: 496590 - DNA, 25 bp, Homo sapien
tctaagcagggaacgcacagctcac

SEQ ID NO: 496591 - DNA, 25 bp, Homo sapien
accctgtcacatgcagcgatcataa

SEQ ID NO: 496592 - DNA, 25 bp, Homo sapien
tcatttttaaaccattttcatcagt

SEQ ID NO: 496593 - DNA, 25 bp, Homo sapien
atgcgtttttggaagaactttgcta

SEQ ID NO: 496594 - DNA, 25 bp, Homo sapien
agtttacagatctttataaggtgtt

SEQ ID NO: 496595 - DNA, 25 bp, Homo sapien
gtgatttctgaactaatggtgctaa

SEQ ID NO: 496596 - DNA, 25 bp, Homo sapien
gtgagattctctgttgtcatcggca

SEQ ID NO: 496597 - DNA, 25 bp, Homo sapien
ttctctgttgtcatcggcattccaa

SEQ ID NO: 496598 - DNA, 25 bp, Homo sapien
ttgtcatcggcattccaactttttc

SEQ ID NO: 496599 - DNA, 25 bp, Homo sapien
ggcattccaactttttctctttgtt

SEQ ID NO: 496600 - DNA, 25 bp, Homo sapien
ctctttgtttttgtccagtgttgca

SEQ ID NO: 496601 - DNA, 25 bp, Homo sapien
gtttttgtccagtgttgcatttgaa

SEQ ID NO: 496602 - DNA, 25 bp, Homo sapien
gcatttgaatatgtctgtttctata

SEQ ID NO: 496603 - DNA, 25 bp, Homo sapien
ggaagaggatttgctggtcactgtt

SEQ ID NO: 496604 - DNA, 25 bp, Homo sapien
gctggtcactgtttgctgacatggg

SEQ ID NO: 496605 - DNA, 25 bp, Homo sapien
gggtttccatggtgagttcaggcct

SEQ ID NO: 496606 - DNA, 25 bp, Homo sapien
tggcccttgagaaatgtccttgcac

SEQ ID NO: 496607 - DNA, 25 bp, Homo sapien
atgtccttgcacattgggcttcaaa

SEQ ID NO: 496608 - DNA, 25 bp, Homo sapien
attgggcttcaaactcctcttctag

SEQ ID NO: 496609 - DNA, 25 bp, Homo sapien
aaactcctcttctagggaatccatc

SEQ ID NO: 496610 - DNA, 25 bp, Homo sapien
ggaatccatcttggcctgaaagcag

SEQ ID NO: 496611 - DNA, 25 bp, Homo sapien
gaaagcagaggtacaacaccagccc

SEQ ID NO: 496612 - DNA, 25 bp, Homo sapien
ctgttttcagattggttgctctgga

SEQ ID NO: 496613 - DNA, 25 bp, Homo sapien
tttacttgcacagaggctgaccctg

SEQ ID NO: 496614 - DNA, 25 bp, Homo sapien
atctgctatgccatcaagcccctgt

SEQ ID NO: 496615 - DNA, 25 bp, Homo sapien
atcaagcccctgttttactttcaag

SEQ ID NO: 496616 - DNA, 25 bp, Homo sapien
gttttactttcaagcctacacacaa

SEQ ID NO: 496617 - DNA, 25 bp, Homo sapien
tacacacaatagacgttattccaat

SEQ ID NO: 496618 - DNA, 25 bp, Homo sapien
tccaattttaaatcctcttttccat

SEQ ID NO: 496619 - DNA, 25 bp, Homo sapien
aactctatccaactaagttcctcac

SEQ ID NO: 496620 - DNA, 25 bp, Homo sapien
ttcctcactctcctatcaatagttt

SEQ ID NO: 496621 - DNA, 25 bp, Homo sapien
atagtttatgtacagagttgcccac

SEQ ID NO: 496622 - DNA, 25 bp, Homo sapien
tgtttcattaatatcgttcctggcc

SEQ ID NO: 496623 - DNA, 25 bp, Homo sapien
attaatatcgttcctggccgggcac

SEQ ID NO: 496624 - DNA, 25 bp, Homo sapien
atctccgttgagaaatccacaatgg

SEQ ID NO: 496625 - DNA, 25 bp, Homo sapien
aaaaggcatatggacctgcaaagga

SEQ ID NO: 496626 - DNA, 25 bp, Homo sapien
catatggacctgcaaaggaggcccc

SEQ ID NO: 496627 - DNA, 25 bp, Homo sapien
accagacagacctagtttcaaacga

SEQ ID NO: 496628 - DNA, 25 bp, Homo sapien
tagtttcaaacgagggcactgcccc

SEQ ID NO: 496629 - DNA, 25 bp, Homo sapien
caggcacagaccctgatagtgggtt

SEQ ID NO: 496630 - DNA, 25 bp, Homo sapien
ccctgatagtgggtttgggtcacct

SEQ ID NO: 496631 - DNA, 25 bp, Homo sapien
tagtgggtttgggtcaccttggtat

SEQ ID NO: 496632 - DNA, 25 bp, Homo sapien
ggtcaccttggtatggaatgtatgt

SEQ ID NO: 496633 - DNA, 25 bp, Homo sapien
gaatgtatgtgctgaccccctaggt

SEQ ID NO: 496634 - DNA, 25 bp, Homo sapien
gaacagggatcttaggtctgcctct

SEQ ID NO: 496635 - DNA, 25 bp, Homo sapien
agggatcttaggtctgcctctctct

SEQ ID NO: 496636 - DNA, 25 bp, Homo sapien
aggtagtttacttcgcacacagcat

SEQ ID NO: 496637 - DNA, 25 bp, Homo sapien
ttcgcacacagcattgcctgactac

SEQ ID NO: 496638 - DNA, 25 bp, Homo sapien
gactacgcccacatgttgcggttgt

SEQ ID NO: 496639 - DNA, 25 bp, Homo sapien
ttgcggttgtcttgttgttactgtt

SEQ ID NO: 496640 - DNA, 25 bp, Homo sapien
ccacgcatgggcttttccatatgta

SEQ ID NO: 496641 - DNA, 25 bp, Homo sapien
tccatatgtagagaggccttcctcc

SEQ ID NO: 496642 - DNA, 25 bp, Homo sapien
cttcccagcacacttgatagcattg

SEQ ID NO: 496643 - DNA, 25 bp, Homo sapien
cacttgatagcattgtccagggtag

SEQ ID NO: 496644 - DNA, 25 bp, Homo sapien
cattgtccagggtagctaaagtgca

SEQ ID NO: 496645 - DNA, 25 bp, Homo sapien
gctaaagtgcattacctggctaata

SEQ ID NO: 496646 - DNA, 25 bp, Homo sapien
attgctgaggtaacttcataccttg

SEQ ID NO: 496647 - DNA, 25 bp, Homo sapien
cattttgttcatcaactgttctggt

SEQ ID NO: 496648 - DNA, 25 bp, Homo sapien
gttcatcaactgttctggtaactta

SEQ ID NO: 496649 - DNA, 25 bp, Homo sapien
aatgtatattgctccagttctaaag

SEQ ID NO: 496650 - DNA, 25 bp, Homo sapien
attgctccagttctaaagccagtta

SEQ ID NO: 496651 - DNA, 25 bp, Homo sapien
taaagccagttaaccctgtgccctc

SEQ ID NO: 496652 - DNA, 25 bp, Homo sapien
tgccctctaacttatgaaccttcat

SEQ ID NO: 496653 - DNA, 25 bp, Homo sapien
gaaccttcatttcaaaacagtatgt

SEQ ID NO: 496654 - DNA, 25 bp, Homo sapien
tgtgggaagtcctgtagtttgataa

SEQ ID NO: 496655 - DNA, 25 bp, Homo sapien
gaggataatttaccattttactact

SEQ ID NO: 496656 - DNA, 25 bp, Homo sapien
gttgatatcagttgaccattttatt

SEQ ID NO: 496657 - DNA, 25 bp, Homo sapien
ttttgatggactctttttgttggga

SEQ ID NO: 496658 - DNA, 25 bp, Homo sapien
gaatcgtagttaacgtatattgctg

SEQ ID NO: 496659 - DNA, 25 bp, Homo sapien
tcgtagttaacgtatattgctgtta

SEQ ID NO: 496660 - DNA, 25 bp, Homo sapien
tgtgaatttgggacataataacagc

SEQ ID NO: 496661 - DNA, 25 bp, Homo sapien
cagcagtggagtaagtatttagaag

SEQ ID NO: 496662 - DNA, 25 bp, Homo sapien
gtatttagaagtgtgaattcaccgt

SEQ ID NO: 496663 - DNA, 25 bp, Homo sapien
agaagtgtgaattcaccgtgaaata

SEQ ID NO: 496664 - DNA, 25 bp, Homo sapien
gaattcaccgtgaaataggtgagat

SEQ ID NO: 496665 - DNA, 25 bp, Homo sapien
aaagatacttaattcccgccttatg

SEQ ID NO: 496666 - DNA, 25 bp, Homo sapien
agatacttaattcccgccttatgcc

SEQ ID NO: 496667 - DNA, 25 bp, Homo sapien
ttaattcccgccttatgcctcagtc

SEQ ID NO: 496668 - DNA, 25 bp, Homo sapien
ccgccttatgcctcagtctattctg

SEQ ID NO: 496669 - DNA, 25 bp, Homo sapien
tgtgtgactcatcggctggcaggct

SEQ ID NO: 496670 - DNA, 25 bp, Homo sapien
gtgtgactcatcggctggcaggctt

SEQ ID NO: 496671 - DNA, 25 bp, Homo sapien
tgactcatcggctggcaggcttgct

SEQ ID NO: 496672 - DNA, 25 bp, Homo sapien
gactcatcggctggcaggcttgctg

SEQ ID NO: 496673 - DNA, 25 bp, Homo sapien
tcatcggctggcaggcttgctgagc

SEQ ID NO: 496674 - DNA, 25 bp, Homo sapien
catcggctggcaggcttgctgagca

SEQ ID NO: 496675 - DNA, 25 bp, Homo sapien
gctggcaggcttgctgagcagatca

SEQ ID NO: 496676 - DNA, 25 bp, Homo sapien
ctggcaggcttgctgagcagatcag

SEQ ID NO: 496677 - DNA, 25 bp, Homo sapien
gtgcccaccaatgtgggttccaaag

SEQ ID NO: 496678 - DNA, 25 bp, Homo sapien
tgcccaccaatgtgggttccaaagc

SEQ ID NO: 496679 - DNA, 25 bp, Homo sapien
ccaccaatgtgggttccaaagcctt

SEQ ID NO: 496680 - DNA, 25 bp, Homo sapien
gtggaaataatccatctttttttct

SEQ ID NO: 496681 - DNA, 25 bp, Homo sapien
ttctctctctgctttctgcctgagg

SEQ ID NO: 496682 - DNA, 25 bp, Homo sapien
tccttttggcaaaatgagcaggcag

SEQ ID NO: 496683 - DNA, 25 bp, Homo sapien
agcaggcagtgtaggcaggtaatca

SEQ ID NO: 496684 - DNA, 25 bp, Homo sapien
ggcagtgtaggcaggtaatcatcag

SEQ ID NO: 496685 - DNA, 25 bp, Homo sapien
tgtaggcaggtaatcatcagagaga

SEQ ID NO: 496686 - DNA, 25 bp, Homo sapien
atcagagagaaagcccatctttcta

SEQ ID NO: 496687 - DNA, 25 bp, Homo sapien
atctttctaagccagaggatgagga

SEQ ID NO: 496688 - DNA, 25 bp, Homo sapien
tgagagaaaacctgtctttccagcc

SEQ ID NO: 496689 - DNA, 25 bp, Homo sapien
gcaggaaaaaatgaccctatggtct

SEQ ID NO: 496690 - DNA, 25 bp, Homo sapien
aatgaccctatggtctgaagaatgt

SEQ ID NO: 496691 - DNA, 25 bp, Homo sapien
aaacactgttatatcagagcatcag

SEQ ID NO: 496692 - DNA, 25 bp, Homo sapien
gagcatcagtatgtgttcagaagca

SEQ ID NO: 496693 - DNA, 25 bp, Homo sapien
ttcagaagcatgtcctactttggcc

SEQ ID NO: 496694 - DNA, 25 bp, Homo sapien
tactttggccctatatggcaaaact

SEQ ID NO: 496695 - DNA, 25 bp, Homo sapien
gtaatttctgaagcatctatgttag

SEQ ID NO: 496696 - DNA, 25 bp, Homo sapien
gaagcatctatgttagggcctaatt

SEQ ID NO: 496697 - DNA, 25 bp, Homo sapien
agggcctaattgaagacagtctaat

SEQ ID NO: 496698 - DNA, 25 bp, Homo sapien
cagttgttttactttaccatgctca

SEQ ID NO: 496699 - DNA, 25 bp, Homo sapien
cagttgattattttgcagaaagcag

SEQ ID NO: 496700 - DNA, 25 bp, Homo sapien
tccttaccttcttgatttacaactg

SEQ ID NO: 496701 - DNA, 25 bp, Homo sapien
gatttacaactgatggatttgtcat

SEQ ID NO: 496702 - DNA, 25 bp, Homo sapien
actctttgccctaaagtattcagcg

SEQ ID NO: 496703 - DNA, 25 bp, Homo sapien
gtattcagcgatcagaattctggat

SEQ ID NO: 496704 - DNA, 25 bp, Homo sapien
gaattctggataccctgcaaaacac

SEQ ID NO: 496705 - DNA, 25 bp, Homo sapien
tggataccctgcaaaacacctccaa

SEQ ID NO: 496706 - DNA, 25 bp, Homo sapien
ctttgaaccctgtgttaacaatgag

SEQ ID NO: 496707 - DNA, 25 bp, Homo sapien
ttgtttatttgaaggctgggttctc

SEQ ID NO: 496708 - DNA, 25 bp, Homo sapien
gggtaggttgtaattgtgtgtctaa

SEQ ID NO: 496709 - DNA, 25 bp, Homo sapien
tgccttttgcattccccaatagcat

SEQ ID NO: 496710 - DNA, 25 bp, Homo sapien
gcattccccaatagcatgacaactg

SEQ ID NO: 496711 - DNA, 25 bp, Homo sapien
tttttcccatgttcctgcctcatca

SEQ ID NO: 496712 - DNA, 25 bp, Homo sapien
gcctcatcagggaattgtaagattt

SEQ ID NO: 496713 - DNA, 25 bp, Homo sapien
agccactgtgcctgtgcttctctgt

SEQ ID NO: 496714 - DNA, 25 bp, Homo sapien
ttgcttgccatgaatccgcatacct

SEQ ID NO: 496715 - DNA, 25 bp, Homo sapien
gaatccgcataccttggaatacact

SEQ ID NO: 496716 - DNA, 25 bp, Homo sapien
ggaatacactgtgaccccagttaag

SEQ ID NO: 496717 - DNA, 25 bp, Homo sapien
agttaagtgtcccttcgccaggaag

SEQ ID NO: 496718 - DNA, 25 bp, Homo sapien
ttcgccaggaagctgccgcaacgtc

SEQ ID NO: 496719 - DNA, 25 bp, Homo sapien
gcaacgtccagacctgggtcaagtt

SEQ ID NO: 496720 - DNA, 25 bp, Homo sapien
atagccttgacctgcttctgtcaca

SEQ ID NO: 496721 - DNA, 25 bp, Homo sapien
ttctgtcacagcactgatcacactg

SEQ ID NO: 496722 - DNA, 25 bp, Homo sapien
ggaccaagggccatatcccaagtga

SEQ ID NO: 496723 - DNA, 25 bp, Homo sapien
tcccaagtgactttgtacccagaaa

SEQ ID NO: 496724 - DNA, 25 bp, Homo sapien
taatgaggcagtgcatgttcttggc

SEQ ID NO: 496725 - DNA, 25 bp, Homo sapien
tgaggcagtgcatgttcttggccca

SEQ ID NO: 496726 - DNA, 25 bp, Homo sapien
aggcagtgcatgttcttggcccaga

SEQ ID NO: 496727 - DNA, 25 bp, Homo sapien
ttcttggcccagagtaagtgcttag

SEQ ID NO: 496728 - DNA, 25 bp, Homo sapien
cttggcccagagtaagtgcttagtg

SEQ ID NO: 496729 - DNA, 25 bp, Homo sapien
ggcccagagtaagtgcttagtgaat

SEQ ID NO: 496730 - DNA, 25 bp, Homo sapien
gcttagtgaatgctttctaactccg

SEQ ID NO: 496731 - DNA, 25 bp, Homo sapien
tagtgaatgctttctaactccgaac

SEQ ID NO: 496732 - DNA, 25 bp, Homo sapien
gtgaatgctttctaactccgaaccc

SEQ ID NO: 496733 - DNA, 25 bp, Homo sapien
aatgctttctaactccgaaccccag

SEQ ID NO: 496734 - DNA, 25 bp, Homo sapien
ggtgttgagcaaaaggggccttcaa

SEQ ID NO: 496735 - DNA, 25 bp, Homo sapien
tgatgctctgagcatcttcacccat

SEQ ID NO: 496736 - DNA, 25 bp, Homo sapien
atcttcacccatttggtcgttgaga

SEQ ID NO: 496737 - DNA, 25 bp, Homo sapien
gtcgttgagacatatctgtccatgt

SEQ ID NO: 496738 - DNA, 25 bp, Homo sapien
aagggaatctactcagagcctgtgt

SEQ ID NO: 496739 - DNA, 25 bp, Homo sapien
tctactcagagcctgtgtgtgctgc

SEQ ID NO: 496740 - DNA, 25 bp, Homo sapien
tgtgtgctgcccagtctaccaaata

SEQ ID NO: 496741 - DNA, 25 bp, Homo sapien
gctgcccagtctaccaaataattta

SEQ ID NO: 496742 - DNA, 25 bp, Homo sapien
agtggcttagagaatgtaactgacc

SEQ ID NO: 496743 - DNA, 25 bp, Homo sapien
gaccaaagtcacactgccaggaact

SEQ ID NO: 496744 - DNA, 25 bp, Homo sapien
gaactggaagcactaggatttgaca

SEQ ID NO: 496745 - DNA, 25 bp, Homo sapien
ggatttgacagcatatccaaatatg

SEQ ID NO: 496746 - DNA, 25 bp, Homo sapien
gaaactaggttacagaaggaagcag

SEQ ID NO: 496747 - DNA, 25 bp, Homo sapien
ggaagcagaatttgaaaaatcggct

SEQ ID NO: 496748 - DNA, 25 bp, Homo sapien
gagaaattttgaggcattgcaaata

SEQ ID NO: 496749 - DNA, 25 bp, Homo sapien
tcctgatttttcttattctgccagt

SEQ ID NO: 496750 - DNA, 25 bp, Homo sapien
gatttttcttattctgccagtagca

SEQ ID NO: 496751 - DNA, 25 bp, Homo sapien
cttattctgccagtagcaagataat

SEQ ID NO: 496752 - DNA, 25 bp, Homo sapien
taattagtgatgttcccagtagaaa

SEQ ID NO: 496753 - DNA, 25 bp, Homo sapien
gatgttcccagtagaaaggatcata

SEQ ID NO: 496754 - DNA, 25 bp, Homo sapien
aaggatcatatgtgccatcctcatg

SEQ ID NO: 496755 - DNA, 25 bp, Homo sapien
tcatatgtgccatcctcatggaatt

SEQ ID NO: 496756 - DNA, 25 bp, Homo sapien
gccatcctcatggaattatgatcat

SEQ ID NO: 496757 - DNA, 25 bp, Homo sapien
accatatgggtttctttcttcttcg

SEQ ID NO: 496758 - DNA, 25 bp, Homo sapien
aggagatccagagggcacctgcctg

SEQ ID NO: 496759 - DNA, 25 bp, Homo sapien
ggatgggccggctccttattttcct

SEQ ID NO: 496760 - DNA, 25 bp, Homo sapien
cggctccttattttcctgggctgag

SEQ ID NO: 496761 - DNA, 25 bp, Homo sapien
tccttattttcctgggctgagccgt

SEQ ID NO: 496762 - DNA, 25 bp, Homo sapien
attttcctgggctgagccgtttgga

SEQ ID NO: 496763 - DNA, 25 bp, Homo sapien
acctgggtgaggactagggcatcaa

SEQ ID NO: 496764 - DNA, 25 bp, Homo sapien
actagggcatcaaggtcgtgtgtgt

SEQ ID NO: 496765 - DNA, 25 bp, Homo sapien
gcagcaagtgctttctatgcgtttc

SEQ ID NO: 496766 - DNA, 25 bp, Homo sapien
aagtgctttctatgcgtttcttcat

SEQ ID NO: 496767 - DNA, 25 bp, Homo sapien
gctttctatgcgtttcttcattaaa

SEQ ID NO: 496768 - DNA, 25 bp, Homo sapien
cacccctcagcttgaggaccaatga

SEQ ID NO: 496769 - DNA, 25 bp, Homo sapien
cagcttgaggaccaatgactgaggt

SEQ ID NO: 496770 - DNA, 25 bp, Homo sapien
atgactgaggtctatgccagttcct

SEQ ID NO: 496771 - DNA, 25 bp, Homo sapien
tgaggtctatgccagttcctgatcc

SEQ ID NO: 496772 - DNA, 25 bp, Homo sapien
tcactctctggacctaccaggtgac

SEQ ID NO: 496773 - DNA, 25 bp, Homo sapien
tggacctaccaggtgactgctgctg

SEQ ID NO: 496774 - DNA, 25 bp, Homo sapien
ctgctgctgggtgactcccctgagg

SEQ ID NO: 496775 - DNA, 25 bp, Homo sapien
gggtgactcccctgaggcggctata

SEQ ID NO: 496776 - DNA, 25 bp, Homo sapien
tgaggcggctatacccttaagccag

SEQ ID NO: 496777 - DNA, 25 bp, Homo sapien
tccacccaggcctttctgtaaataa

SEQ ID NO: 496778 - DNA, 25 bp, Homo sapien
tctgtaaataaaagctcccaagttg

SEQ ID NO: 496779 - DNA, 25 bp, Homo sapien
tcaccagtaggttggacagcatata

SEQ ID NO: 496780 - DNA, 25 bp, Homo sapien
tttgcatcattttgtcccttgtaaa

SEQ ID NO: 496781 - DNA, 25 bp, Homo sapien
caagatgttctgcagattattcctt

SEQ ID NO: 496782 - DNA, 25 bp, Homo sapien
tgcagattattcctttaacggccgg

SEQ ID NO: 496783 - DNA, 25 bp, Homo sapien
cttttggctgtttcctaatgaaaca

SEQ ID NO: 496784 - DNA, 25 bp, Homo sapien
tatagccgtattgctagcaccttgt

SEQ ID NO: 496785 - DNA, 25 bp, Homo sapien
gctagcaccttgtagtatgtcatca

SEQ ID NO: 496786 - DNA, 25 bp, Homo sapien
gtagtatgtcatcattctgctcatg

SEQ ID NO: 496787 - DNA, 25 bp, Homo sapien
gctcatgattccaaggatcagcctg

SEQ ID NO: 496788 - DNA, 25 bp, Homo sapien
atcagcctggatgcctagaggacta

SEQ ID NO: 496789 - DNA, 25 bp, Homo sapien
gaggactagatcaccttagtttgat

SEQ ID NO: 496790 - DNA, 25 bp, Homo sapien
aaagtctaactcttctgcttgtctt

SEQ ID NO: 496791 - DNA, 25 bp, Homo sapien
ctaactcttctgcttgtctttacaa

SEQ ID NO: 496792 - DNA, 25 bp, Homo sapien
ctgcttgtctttacaatgctgtaca

SEQ ID NO: 496793 - DNA, 25 bp, Homo sapien
tgctgtacagtgagagctaatgttt

SEQ ID NO: 496794 - DNA, 25 bp, Homo sapien
aacaggatacttacagggatttgaa

SEQ ID NO: 496795 - DNA, 25 bp, Homo sapien
taatttaattcagtggtttccaact

SEQ ID NO: 496796 - DNA, 25 bp, Homo sapien
tcccctatgtcctgtgtcttaaaag

SEQ ID NO: 496797 - DNA, 25 bp, Homo sapien
aaagattatgtttaccaaactgcat

SEQ ID NO: 496798 - DNA, 25 bp, Homo sapien
atgtttaccaaactgcatttattaa

SEQ ID NO: 496799 - DNA, 25 bp, Homo sapien
ttatattttgctacataaaggcatg

SEQ ID NO: 496800 - DNA, 25 bp, Homo sapien
taaaggcatgtacaacacaaatcat

SEQ ID NO: 496801 - DNA, 25 bp, Homo sapien
tctctgctagcaccactccaaattg

SEQ ID NO: 496802 - DNA, 25 bp, Homo sapien
accactccaaattgctgcttcaaaa

SEQ ID NO: 496803 - DNA, 25 bp, Homo sapien
gaggatgagatacatggaccaatac

SEQ ID NO: 496804 - DNA, 25 bp, Homo sapien
ggaccaatacatcctatttaaaagg

SEQ ID NO: 496805 - DNA, 25 bp, Homo sapien
aaaagggagcttgctttctcactag

SEQ ID NO: 496806 - DNA, 25 bp, Homo sapien
gcttgctttctcactagggacttta

SEQ ID NO: 496807 - DNA, 25 bp, Homo sapien
agggactttagactgcctgacacac

SEQ ID NO: 496808 - DNA, 25 bp, Homo sapien
tagactgcctgacacacaggaaatg

SEQ ID NO: 496809 - DNA, 25 bp, Homo sapien
aaatcatattcagaccatcgtgcga

SEQ ID NO: 496810 - DNA, 25 bp, Homo sapien
atcgtgcgatggttatatctctggc

SEQ ID NO: 496811 - DNA, 25 bp, Homo sapien
gatggttatatctctggcctccctg

SEQ ID NO: 496812 - DNA, 25 bp, Homo sapien
tcctccagcgactcagagagcagct

SEQ ID NO: 496813 - DNA, 25 bp, Homo sapien
agagcagctccggatctgactcgga

SEQ ID NO: 496814 - DNA, 25 bp, Homo sapien
tccggatctgactcggagaccgaga

SEQ ID NO: 496815 - DNA, 25 bp, Homo sapien
actcggagaccgagagcagctccag

SEQ ID NO: 496816 - DNA, 25 bp, Homo sapien
gctgaaccggcatcctctaacaagt

SEQ ID NO: 496817 - DNA, 25 bp, Homo sapien
gctaaacaaagttaatccccacaag

SEQ ID NO: 496818 - DNA, 25 bp, Homo sapien
agcctcctattctgatccaaaatga

SEQ ID NO: 496819 - DNA, 25 bp, Homo sapien
gatccaaaatgaaagccacgggtca

SEQ ID NO: 496820 - DNA, 25 bp, Homo sapien
agccacgggtcagagagcaatcagt

SEQ ID NO: 496821 - DNA, 25 bp, Homo sapien
gagcaatcagtactacaacccggtg

SEQ ID NO: 496822 - DNA, 25 bp, Homo sapien
caacccggtgaaagaggacgtccag

SEQ ID NO: 496823 - DNA, 25 bp, Homo sapien
gtgtcctagtctatatgactacatt

SEQ ID NO: 496824 - DNA, 25 bp, Homo sapien
gaatctgcagtttaagccagtgaca

SEQ ID NO: 496825 - DNA, 25 bp, Homo sapien
gccagtgacacaacattttgcattt

SEQ ID NO: 496826 - DNA, 25 bp, Homo sapien
gtgattctcaccaaataatgcctcc

SEQ ID NO: 496827 - DNA, 25 bp, Homo sapien
gaggaaacctaataatgccccaaat

SEQ ID NO: 496828 - DNA, 25 bp, Homo sapien
gaaacctaataatgccccaaatcct

SEQ ID NO: 496829 - DNA, 25 bp, Homo sapien
tctttttactccatcttaatgacat

SEQ ID NO: 496830 - DNA, 25 bp, Homo sapien
gaattagagaactacaatgatctta

SEQ ID NO: 496831 - DNA, 25 bp, Homo sapien
taatttttcaggcacatttcataaa

SEQ ID NO: 496832 - DNA, 25 bp, Homo sapien
aactgaggcacggatctgtttttgc

SEQ ID NO: 496833 - DNA, 25 bp, Homo sapien
cacggatctgtttttgcctatgaaa

SEQ ID NO: 496834 - DNA, 25 bp, Homo sapien
tcctggcctttggaaacctgctgtt

SEQ ID NO: 496835 - DNA, 25 bp, Homo sapien
gaaacctgctgttcctgacgggcct

SEQ ID NO: 496836 - DNA, 25 bp, Homo sapien
tgaggaagaccttttggttcttctt

SEQ ID NO: 496837 - DNA, 25 bp, Homo sapien
ttcttccaacggcacaaactcaagg

SEQ ID NO: 496838 - DNA, 25 bp, Homo sapien
aactcaagggaaccagcttcctcct

SEQ ID NO: 496839 - DNA, 25 bp, Homo sapien
ggtgtggttatcgtgctcctacgct

SEQ ID NO: 496840 - DNA, 25 bp, Homo sapien
ggcatgttcctggaaacctacggat

SEQ ID NO: 496841 - DNA, 25 bp, Homo sapien
tacggattcttcagcctctttaagg

SEQ ID NO: 496842 - DNA, 25 bp, Homo sapien
tgggcaatgtctgcaacatcccctt

SEQ ID NO: 496843 - DNA, 25 bp, Homo sapien
gcgctgttccggagacttcaaggca

SEQ ID NO: 496844 - DNA, 25 bp, Homo sapien
ttcaaggcactagctcgatggtctg

SEQ ID NO: 496845 - DNA, 25 bp, Homo sapien
atgagagtggccccggctgcatgag

SEQ ID NO: 496846 - DNA, 25 bp, Homo sapien
gctgcatgagctgcaagtgtgtgct

SEQ ID NO: 496847 - DNA, 25 bp, Homo sapien
atgagctgcaagtgtgtgctctcct

SEQ ID NO: 496848 - DNA, 25 bp, Homo sapien
tgtgtgctctcctgacgcagcacaa

SEQ ID NO: 496849 - DNA, 25 bp, Homo sapien
tgacgcagcacaagctcaggacatg

SEQ ID NO: 496850 - DNA, 25 bp, Homo sapien
acgcagcacaagctcaggacatgga

SEQ ID NO: 496851 - DNA, 25 bp, Homo sapien
cacaagctcaggacatggaggtgcc

SEQ ID NO: 496852 - DNA, 25 bp, Homo sapien
tcaggacatggaggtgccggatgca

SEQ ID NO: 496853 - DNA, 25 bp, Homo sapien
acagactgtcttgaacatcccaaat

SEQ ID NO: 496854 - DNA, 25 bp, Homo sapien
gactgtcttgaacatcccaaatgcc

SEQ ID NO: 496855 - DNA, 25 bp, Homo sapien
ttgaacatcccaaatgccaccggaa

SEQ ID NO: 496856 - DNA, 25 bp, Homo sapien
ctgaggcttatagtggctaagaaac

SEQ ID NO: 496857 - DNA, 25 bp, Homo sapien
ttatagtggctaagaaacttgccca

SEQ ID NO: 496858 - DNA, 25 bp, Homo sapien
gcccaaagccactacctagaaaatg

SEQ ID NO: 496859 - DNA, 25 bp, Homo sapien
ggaatgtaggtttaactcctgacca

SEQ ID NO: 496860 - DNA, 25 bp, Homo sapien
tttaactcctgaccactatgctata

SEQ ID NO: 496861 - DNA, 25 bp, Homo sapien
aactcctgaccactatgctataaag

SEQ ID NO: 496862 - DNA, 25 bp, Homo sapien
tgctataaagtcaccacatgtcaaa

SEQ ID NO: 496863 - DNA, 25 bp, Homo sapien
gtcaccacatgtcaaactaattttc

SEQ ID NO: 496864 - DNA, 25 bp, Homo sapien
ttttcaagttgttgggacatgtccc

SEQ ID NO: 496865 - DNA, 25 bp, Homo sapien
tgggacatgtcccctactaggtttt

SEQ ID NO: 496866 - DNA, 25 bp, Homo sapien
gctattgctagccactgtgctaaac

SEQ ID NO: 496867 - DNA, 25 bp, Homo sapien
ataataagcagtgcactagctattc

SEQ ID NO: 496868 - DNA, 25 bp, Homo sapien
aataagcagtgcactagctattctc

SEQ ID NO: 496869 - DNA, 25 bp, Homo sapien
taagcagtgcactagctattctcaa

SEQ ID NO: 496870 - DNA, 25 bp, Homo sapien
aagcagtgcactagctattctcaat

SEQ ID NO: 496871 - DNA, 25 bp, Homo sapien
gcagtgcactagctattctcaataa

SEQ ID NO: 496872 - DNA, 25 bp, Homo sapien
cagtgcactagctattctcaataaa

SEQ ID NO: 496873 - DNA, 25 bp, Homo sapien
gtgcactagctattctcaataaaac

SEQ ID NO: 496874 - DNA, 25 bp, Homo sapien
gcactagctattctcaataaaacag

SEQ ID NO: 496875 - DNA, 25 bp, Homo sapien
cataggtaagaccaatattgtcaca

SEQ ID NO: 496876 - DNA, 25 bp, Homo sapien
tggggcaagtgagcatagtcaccgt

SEQ ID NO: 496877 - DNA, 25 bp, Homo sapien
acagccccgtgatgccccattttta

SEQ ID NO: 496878 - DNA, 25 bp, Homo sapien
tgttcccagggaacatcatgttttt

SEQ ID NO: 496879 - DNA, 25 bp, Homo sapien
gaacatcatgtttttgtgggcaaat

SEQ ID NO: 496880 - DNA, 25 bp, Homo sapien
tagtgtggtttgtccccttcctagc

SEQ ID NO: 496881 - DNA, 25 bp, Homo sapien
ttgttaccaagaaccaaggcaaatg

SEQ ID NO: 496882 - DNA, 25 bp, Homo sapien
tttgtccccttcctagcacatgtag

SEQ ID NO: 496883 - DNA, 25 bp, Homo sapien
gtgttaaattgtgctgctggctaat

SEQ ID NO: 496884 - DNA, 25 bp, Homo sapien
tgtgctgctggctaataggcctcat

SEQ ID NO: 496885 - DNA, 25 bp, Homo sapien
ggctaataggcctcatttcaattta

SEQ ID NO: 496886 - DNA, 25 bp, Homo sapien
ttgaggactggctttatgtctggcc

SEQ ID NO: 496887 - DNA, 25 bp, Homo sapien
agcacatgtagcctcaagtttgaat

SEQ ID NO: 496888 - DNA, 25 bp, Homo sapien
gcctcaagtttgaattcctgggaga

SEQ ID NO: 496889 - DNA, 25 bp, Homo sapien
gcgcttgcgagcacacacgcagaca

SEQ ID NO: 496890 - DNA, 25 bp, Homo sapien
ggaaaagaccagaggccgcagacgt

SEQ ID NO: 496891 - DNA, 25 bp, Homo sapien
ggaaaacttggctgattcgccggat

SEQ ID NO: 496892 - DNA, 25 bp, Homo sapien
gctgattcgccggatgaccatgtgc

SEQ ID NO: 496893 - DNA, 25 bp, Homo sapien
gccggatgaccatgtgcgctcaaga

SEQ ID NO: 496894 - DNA, 25 bp, Homo sapien
tgaccatgtgcgctcaagactgtac

SEQ ID NO: 496895 - DNA, 25 bp, Homo sapien
tgcgctcaagactgtacccgccaaa

SEQ ID NO: 496896 - DNA, 25 bp, Homo sapien
tgtacccgccaaacataaccttaat

SEQ ID NO: 496897 - DNA, 25 bp, Homo sapien
gacgtctcctcccagtctggagttg

SEQ ID NO: 496898 - DNA, 25 bp, Homo sapien
ccagtctggagttgggacgcactag

SEQ ID NO: 496899 - DNA, 25 bp, Homo sapien
ggtgtagaaaggtcaggatgtcccc

SEQ ID NO: 496900 - DNA, 25 bp, Homo sapien
gggacaacagccacctccgctcagg

SEQ ID NO: 496901 - DNA, 25 bp, Homo sapien
actagtgtggcctctgtggtcacct

SEQ ID NO: 496902 - DNA, 25 bp, Homo sapien
agtgtggcctctgtggtcacctctg

SEQ ID NO: 496903 - DNA, 25 bp, Homo sapien
tgccgagtctccagcaagccgacag

SEQ ID NO: 496904 - DNA, 25 bp, Homo sapien
gagtctccagcaagccgacaggcgg

SEQ ID NO: 496905 - DNA, 25 bp, Homo sapien
ctggcgctgcgcaaacagctggaga

SEQ ID NO: 496906 - DNA, 25 bp, Homo sapien
ggagaagacgctactcgagatcccc

SEQ ID NO: 496907 - DNA, 25 bp, Homo sapien
ggcaccacccagaactaccgggagt

SEQ ID NO: 496908 - DNA, 25 bp, Homo sapien
taccgggagtgggtcctggaaccat

SEQ ID NO: 496909 - DNA, 25 bp, Homo sapien
gagtgggtcctggaaccatactgcc

SEQ ID NO: 496910 - DNA, 25 bp, Homo sapien
tgggtcctggaaccatactgcccct

SEQ ID NO: 496911 - DNA, 25 bp, Homo sapien
tacgacataatgtaaagcaggcttc

SEQ ID NO: 496912 - DNA, 25 bp, Homo sapien
taaagcaggcttcggatagtggaac

SEQ ID NO: 496913 - DNA, 25 bp, Homo sapien
gttggagttgctgggactgtccatc

SEQ ID NO: 496914 - DNA, 25 bp, Homo sapien
gggactgtccatcgaggaaacactt

SEQ ID NO: 496915 - DNA, 25 bp, Homo sapien
gaggaaacacttgtttgggcatttt

SEQ ID NO: 496916 - DNA, 25 bp, Homo sapien
gactcatccgctgcccttttgtgga

SEQ ID NO: 496917 - DNA, 25 bp, Homo sapien
ccttgctcctggaacattaccgaaa

SEQ ID NO: 496918 - DNA, 25 bp, Homo sapien
ggaacattaccgaaaccatctgtta

SEQ ID NO: 496919 - DNA, 25 bp, Homo sapien
gaacaaagtgatctagaggcctttt

SEQ ID NO: 496920 - DNA, 25 bp, Homo sapien
gaggccttttataatgtaatcactg

SEQ ID NO: 496921 - DNA, 25 bp, Homo sapien
gtaatcactgtatgtggtaccaatg

SEQ ID NO: 496922 - DNA, 25 bp, Homo sapien
tggccagcccgctcagcgtggtaca

SEQ ID NO: 496923 - DNA, 25 bp, Homo sapien
ccgctcagcgtggtacaggtgcgca

SEQ ID NO: 496924 - DNA, 25 bp, Homo sapien
gccccatcaagagtacttggtgttg

SEQ ID NO: 496925 - DNA, 25 bp, Homo sapien
caggcagcaggtagccccgtagcag

SEQ ID NO: 496926 - DNA, 25 bp, Homo sapien
tacttggtgttggagatcttcttcc

SEQ ID NO: 496927 - DNA, 25 bp, Homo sapien
ggagatcttcttccagagcagagtc

SEQ ID NO: 496928 - DNA, 25 bp, Homo sapien
ttcttccagagcagagtcttgaggt

SEQ ID NO: 496929 - DNA, 25 bp, Homo sapien
agagtcttgaggtggctgagcacca

SEQ ID NO: 496930 - DNA, 25 bp, Homo sapien
tcttgaggtggctgagcaccagcga

SEQ ID NO: 496931 - DNA, 25 bp, Homo sapien
agcaccagcgagtgatgggcctcca

SEQ ID NO: 496932 - DNA, 25 bp, Homo sapien
tgatgggcctccacctggctggcca

SEQ ID NO: 496933 - DNA, 25 bp, Homo sapien
ggatgcatgtcaagcacattggaaa

SEQ ID NO: 496934 - DNA, 25 bp, Homo sapien
gcacattggaaagttcttacaacaa

SEQ ID NO: 496935 - DNA, 25 bp, Homo sapien
ttggaaagttcttacaacaattctg

SEQ ID NO: 496936 - DNA, 25 bp, Homo sapien
aacaattctgatggaggattttctc

SEQ ID NO: 496937 - DNA, 25 bp, Homo sapien
atggaggattttctctcccatcaac

SEQ ID NO: 496938 - DNA, 25 bp, Homo sapien
aggattttctctcccatcaaccaaa

SEQ ID NO: 496939 - DNA, 25 bp, Homo sapien
tcaaccaaacaccacttaagattaa

SEQ ID NO: 496940 - DNA, 25 bp, Homo sapien
acttaagattaacctgtggctcagt

SEQ ID NO: 496941 - DNA, 25 bp, Homo sapien
ttaacctgtggctcagtctacttaa

SEQ ID NO: 496942 - DNA, 25 bp, Homo sapien
cctgtggctcagtctacttaaataa

SEQ ID NO: 496943 - DNA, 25 bp, Homo sapien
gctcagtctacttaaataaatgcca

SEQ ID NO: 496944 - DNA, 25 bp, Homo sapien
ggcaggcgctgtggcccattcacag

SEQ ID NO: 496945 - DNA, 25 bp, Homo sapien
ggcccattcacagcttgaatgtaaa

SEQ ID NO: 496946 - DNA, 25 bp, Homo sapien
aaacattatgttgtgtgtctggcat

SEQ ID NO: 496947 - DNA, 25 bp, Homo sapien
tgtgtgtctggcatgagactgtgaa

SEQ ID NO: 496948 - DNA, 25 bp, Homo sapien
gaagaaaacagccaacaccacacac

SEQ ID NO: 496949 - DNA, 25 bp, Homo sapien
caccacacacacatcagctttatga

SEQ ID NO: 496950 - DNA, 25 bp, Homo sapien
atcagctttatgactctggaaaaat

SEQ ID NO: 496951 - DNA, 25 bp, Homo sapien
ctgctgtgccatcactcctttgtct

SEQ ID NO: 496952 - DNA, 25 bp, Homo sapien
aaagccagtccaatgtgaagccaga

SEQ ID NO: 496953 - DNA, 25 bp, Homo sapien
tgaagccagatctgtcgttcaccaa

SEQ ID NO: 496954 - DNA, 25 bp, Homo sapien
gatctgtcgttcaccaagagaagga

SEQ ID NO: 496955 - DNA, 25 bp, Homo sapien
tgtctccgatatctcaccgtgggaa

SEQ ID NO: 496956 - DNA, 25 bp, Homo sapien
tcaccgtgggaatgagtgcactgat

SEQ ID NO: 496957 - DNA, 25 bp, Homo sapien
gagtgcactgattcaaacgttgctg

SEQ ID NO: 496958 - DNA, 25 bp, Homo sapien
aaacgttgctgcactgaagctcaga

SEQ ID NO: 496959 - DNA, 25 bp, Homo sapien
gaagctcagacacacttgaaactcc

SEQ ID NO: 496960 - DNA, 25 bp, Homo sapien
gaaattacctacagttctgtgcaca

SEQ ID NO: 496961 - DNA, 25 bp, Homo sapien
gtgcacatacttttcaatactcccc

SEQ ID NO: 496962 - DNA, 25 bp, Homo sapien
aatactccccgacggaagagcaagg

SEQ ID NO: 496963 - DNA, 25 bp, Homo sapien
gacagtccagctgaagacaaatcag

SEQ ID NO: 496964 - DNA, 25 bp, Homo sapien
atttgctatcttgacaatggactta

SEQ ID NO: 496965 - DNA, 25 bp, Homo sapien
ggacttagtacccatgctttaaatt

SEQ ID NO: 496966 - DNA, 25 bp, Homo sapien
aagcagagtactatggttgtccaac

SEQ ID NO: 496967 - DNA, 25 bp, Homo sapien
gtactatggttgtccaacacaggcc

SEQ ID NO: 496968 - DNA, 25 bp, Homo sapien
gggaacacaattacatattgggcta

SEQ ID NO: 496969 - DNA, 25 bp, Homo sapien
gggctagattttgcccagttcaaaa

SEQ ID NO: 496970 - DNA, 25 bp, Homo sapien
gttatcaacttactttgttacttgt

SEQ ID NO: 496971 - DNA, 25 bp, Homo sapien
aaaggctagtcattctttcaggaga

SEQ ID NO: 496972 - DNA, 25 bp, Homo sapien
ctttcaggagaacatctaggatcat

SEQ ID NO: 496973 - DNA, 25 bp, Homo sapien
atagatgaaaaatcaagccccgatt

SEQ ID NO: 496974 - DNA, 25 bp, Homo sapien
aagccccgatttagaactgtcttct

SEQ ID NO: 496975 - DNA, 25 bp, Homo sapien
tacatttggttctttcctactcaga

SEQ ID NO: 496976 - DNA, 25 bp, Homo sapien
tctttcctactcagaactactcaga

SEQ ID NO: 496977 - DNA, 25 bp, Homo sapien
aaagctaacacatctctaactccag

SEQ ID NO: 496978 - DNA, 25 bp, Homo sapien
gagacattttccagaacatgctgtt

SEQ ID NO: 496979 - DNA, 25 bp, Homo sapien
acgcacaagtcagggctgccagtca

SEQ ID NO: 496980 - DNA, 25 bp, Homo sapien
caggcactagtgaggcggtaccatt

SEQ ID NO: 496981 - DNA, 25 bp, Homo sapien
cggtaccattattcctcatttgtta

SEQ ID NO: 496982 - DNA, 25 bp, Homo sapien
tatccaaatgttggccatgtgacca

SEQ ID NO: 496983 - DNA, 25 bp, Homo sapien
catgtgaccacaccaaaagctcatc

SEQ ID NO: 496984 - DNA, 25 bp, Homo sapien
caaaagctcatcctgggccactgag

SEQ ID NO: 496985 - DNA, 25 bp, Homo sapien
atcctgggccactgagactggtaat

SEQ ID NO: 496986 - DNA, 25 bp, Homo sapien
tgccagtcacctgggttgtcttcac

SEQ ID NO: 496987 - DNA, 25 bp, Homo sapien
tgaccccacccctggactgttgtgt

SEQ ID NO: 496988 - DNA, 25 bp, Homo sapien
taagttacaaaacttgggcaaatca

SEQ ID NO: 496989 - DNA, 25 bp, Homo sapien
gggcaaatcaatacagtactctttt

SEQ ID NO: 496990 - DNA, 25 bp, Homo sapien
acagtactcttttataatgaaacca

SEQ ID NO: 496991 - DNA, 25 bp, Homo sapien
gtgataattttcactccaaaaatat

SEQ ID NO: 496992 - DNA, 25 bp, Homo sapien
tcaaaacactggtttttaatggtgg

SEQ ID NO: 496993 - DNA, 25 bp, Homo sapien
ggtggtttatagcatagtaaggtat

SEQ ID NO: 496994 - DNA, 25 bp, Homo sapien
atttctccttttaagtgagctccct

SEQ ID NO: 496995 - DNA, 25 bp, Homo sapien
ccttttaagtgagctcccttgtgca

SEQ ID NO: 496996 - DNA, 25 bp, Homo sapien
acataaccagcccacgatacagcat

SEQ ID NO: 496997 - DNA, 25 bp, Homo sapien
ccagcccacgatacagcatactaaa

SEQ ID NO: 496998 - DNA, 25 bp, Homo sapien
cacaaagtacaaatccaaggaagtt

SEQ ID NO: 496999 - DNA, 25 bp, Homo sapien
gtatgtaacaattacccgagagtca

SEQ ID NO: 497000 - DNA, 25 bp, Homo sapien
acccgagagtcatttctacttgcaa

SEQ ID NO: 497001 - DNA, 25 bp, Homo sapien
ttctacttgcaaaaggattcgtaac

SEQ ID NO: 497002 - DNA, 25 bp, Homo sapien
gcgagtataattttcttgtcattgt

SEQ ID NO: 497003 - DNA, 25 bp, Homo sapien
cttgtcattgtatcatgcttgttaa

SEQ ID NO: 497004 - DNA, 25 bp, Homo sapien
aatgcagcatcttcagaacttgtcc

SEQ ID NO: 497005 - DNA, 25 bp, Homo sapien
gaacttgtcctgatggtgtcttatt

SEQ ID NO: 497006 - DNA, 25 bp, Homo sapien
gtgtcttattgtgtcagcaccaaat

SEQ ID NO: 497007 - DNA, 25 bp, Homo sapien
gtgtcagcaccaaatatttgtgcat

SEQ ID NO: 497008 - DNA, 25 bp, Homo sapien
taatgactatttatgcgttgactgt

SEQ ID NO: 497009 - DNA, 25 bp, Homo sapien
cagtccatgggacatttctaggtgt

SEQ ID NO: 497010 - DNA, 25 bp, Homo sapien
gagggctcacatttacttaacactt

SEQ ID NO: 497011 - DNA, 25 bp, Homo sapien
taacacttgtgtgcgcaaatctggg

SEQ ID NO: 497012 - DNA, 25 bp, Homo sapien
ttgtgtgcgcaaatctgggtttttc

SEQ ID NO: 497013 - DNA, 25 bp, Homo sapien
tttcttcctttccagaactatgact

SEQ ID NO: 497014 - DNA, 25 bp, Homo sapien
aaccctgtaagtagaacattgtcat

SEQ ID NO: 497015 - DNA, 25 bp, Homo sapien
ctcagagaagctcagaaatttgttc

SEQ ID NO: 497016 - DNA, 25 bp, Homo sapien
gaaatttgttcaagatcgcacagct

SEQ ID NO: 497017 - DNA, 25 bp, Homo sapien
gttcaagatcgcacagctagtaaat

SEQ ID NO: 497018 - DNA, 25 bp, Homo sapien
aagtaggattgtgaacccagggaat

SEQ ID NO: 497019 - DNA, 25 bp, Homo sapien
tgaacccagggaatctccagagcct

SEQ ID NO: 497020 - DNA, 25 bp, Homo sapien
tccagagcctctgtgtaaccatgat

SEQ ID NO: 497021 - DNA, 25 bp, Homo sapien
ctgcagtgtttctgtccggaggaaa

SEQ ID NO: 497022 - DNA, 25 bp, Homo sapien
ggaaatggatcttaggccactggac

SEQ ID NO: 497023 - DNA, 25 bp, Homo sapien
tggacaagaacctgcacccaagggc

SEQ ID NO: 497024 - DNA, 25 bp, Homo sapien
agccttcccactttgacagacactt

SEQ ID NO: 497025 - DNA, 25 bp, Homo sapien
gacagacacttttaactgtgttcct

SEQ ID NO: 497026 - DNA, 25 bp, Homo sapien
ttaactgtgttccttactgctgcca

SEQ ID NO: 497027 - DNA, 25 bp, Homo sapien
ttactgctgccacaatcagcatggt

SEQ ID NO: 497028 - DNA, 25 bp, Homo sapien
atcagcatggttgtatagtgcccca

SEQ ID NO: 497029 - DNA, 25 bp, Homo sapien
gtatagtgccccattaggccattta

SEQ ID NO: 497030 - DNA, 25 bp, Homo sapien
cattaggccatttacatacccagag

SEQ ID NO: 497031 - DNA, 25 bp, Homo sapien
atacccagagttatactcaagcaga

SEQ ID NO: 497032 - DNA, 25 bp, Homo sapien
tatggaggaattagtcacaaatgac

SEQ ID NO: 497033 - DNA, 25 bp, Homo sapien
ttcatcattttctgttgcaggaagc

SEQ ID NO: 497034 - DNA, 25 bp, Homo sapien
ttttctgttgcaggaagccactcca

SEQ ID NO: 497035 - DNA, 25 bp, Homo sapien
agccactccaccacagaatgctaat

SEQ ID NO: 497036 - DNA, 25 bp, Homo sapien
gaatgctaatatgccagtggtaccc

SEQ ID NO: 497037 - DNA, 25 bp, Homo sapien
aatatgccagtggtacccagtacct

SEQ ID NO: 497038 - DNA, 25 bp, Homo sapien
ggtacccagtacctcttgtatatag

SEQ ID NO: 497039 - DNA, 25 bp, Homo sapien
atattgttctgaaatgcttaacttc

SEQ ID NO: 497040 - DNA, 25 bp, Homo sapien
gtacagattaaactatttgcactaa

SEQ ID NO: 497041 - DNA, 25 bp, Homo sapien
tatttgcactaacacacgtgacgtg

SEQ ID NO: 497042 - DNA, 25 bp, Homo sapien
aacacacgtgacgtgcatgatttaa

SEQ ID NO: 497043 - DNA, 25 bp, Homo sapien
tgccttctgcttcccatagagattg

SEQ ID NO: 497044 - DNA, 25 bp, Homo sapien
agagattgtcccaactccataggtc

SEQ ID NO: 497045 - DNA, 25 bp, Homo sapien
aactccataggtccatagtcacaaa

SEQ ID NO: 497046 - DNA, 25 bp, Homo sapien
atgaggacagctttacatgtaacat

SEQ ID NO: 497047 - DNA, 25 bp, Homo sapien
acaccacccttaattaagaggcaag

SEQ ID NO: 497048 - DNA, 25 bp, Homo sapien
ggaagctatgacagatccctcccaa

SEQ ID NO: 497049 - DNA, 25 bp, Homo sapien
ccaaatgcagtaataggtcagctat

SEQ ID NO: 497050 - DNA, 25 bp, Homo sapien
gtcagctattactataccaacctcc

SEQ ID NO: 497051 - DNA, 25 bp, Homo sapien
ttattgatcacctctgaagttcagt

SEQ ID NO: 497052 - DNA, 25 bp, Homo sapien
gaagttcagtagcacactgcataat

SEQ ID NO: 497053 - DNA, 25 bp, Homo sapien
agcatgctgttgtttctacctaaaa

SEQ ID NO: 497054 - DNA, 25 bp, Homo sapien
accacttcaagctggttgctttgaa

SEQ ID NO: 497055 - DNA, 25 bp, Homo sapien
gctttgaatttcagactctcgtgtc

SEQ ID NO: 497056 - DNA, 25 bp, Homo sapien
gaatttcagactctcgtgtcctatc

SEQ ID NO: 497057 - DNA, 25 bp, Homo sapien
gtgtcctatcctaggctgaccattt

SEQ ID NO: 497058 - DNA, 25 bp, Homo sapien
tatcctaggctgaccatttcccatg

SEQ ID NO: 497059 - DNA, 25 bp, Homo sapien
ggctgaccatttcccatgcaccagt

SEQ ID NO: 497060 - DNA, 25 bp, Homo sapien
tgtgaggccagtcactccatcctct

SEQ ID NO: 497061 - DNA, 25 bp, Homo sapien
tccatcctctgttctgggatcttgc

SEQ ID NO: 497062 - DNA, 25 bp, Homo sapien
ttgcccaggtgccagaagagtgcca

SEQ ID NO: 497063 - DNA, 25 bp, Homo sapien
aagagtgccagtgaacttgcggata

SEQ ID NO: 497064 - DNA, 25 bp, Homo sapien
atggaagattgtacacgcagagtga

SEQ ID NO: 497065 - DNA, 25 bp, Homo sapien
tatatcagtctttttgaaaggatca

SEQ ID NO: 497066 - DNA, 25 bp, Homo sapien
gaaaggatcaacttggataaaataa

SEQ ID NO: 497067 - DNA, 25 bp, Homo sapien
atgctctatttgttagagctctatt

SEQ ID NO: 497068 - DNA, 25 bp, Homo sapien
ggaaacagattccatagatctaagt

SEQ ID NO: 497069 - DNA, 25 bp, Homo sapien
agatctaagtcaatgtttctccaga

SEQ ID NO: 497070 - DNA, 25 bp, Homo sapien
tttctccagaagcatgattttgtct

SEQ ID NO: 497071 - DNA, 25 bp, Homo sapien
gaagcatgattttgtctgccaaaag

SEQ ID NO: 497072 - DNA, 25 bp, Homo sapien
aaatagctctctttggccaaaatgc

SEQ ID NO: 497073 - DNA, 25 bp, Homo sapien
ggccaaaatgcaaaattacattgct

SEQ ID NO: 497074 - DNA, 25 bp, Homo sapien
gtactacagagcaaatttcaaattt

SEQ ID NO: 497075 - DNA, 25 bp, Homo sapien
aatttttcattatatcagtcttttt

SEQ ID NO: 497076 - DNA, 25 bp, Homo sapien
tggccttcagtttatgcacacatac

SEQ ID NO: 497077 - DNA, 25 bp, Homo sapien
gcacacatacatacaagagtcacgg

SEQ ID NO: 497078 - DNA, 25 bp, Homo sapien
agtcacggagaagagcagatcacca

SEQ ID NO: 497079 - DNA, 25 bp, Homo sapien
gagcagatcaccaagtcaacggttc

SEQ ID NO: 497080 - DNA, 25 bp, Homo sapien
tcaccaagtcaacggttcaactact

SEQ ID NO: 497081 - DNA, 25 bp, Homo sapien
ttcaactactttaccaatctccata

SEQ ID NO: 497082 - DNA, 25 bp, Homo sapien
tttaccaatctccataaatacggat

SEQ ID NO: 497083 - DNA, 25 bp, Homo sapien
gatgcccttctaaagaggattactt

SEQ ID NO: 497084 - DNA, 25 bp, Homo sapien
gaattctctaatgtttggatttctg

SEQ ID NO: 497085 - DNA, 25 bp, Homo sapien
taccaaagtttaatgaggccacagc

SEQ ID NO: 497086 - DNA, 25 bp, Homo sapien
gtttaatgaggccacagcatttttt

SEQ ID NO: 497087 - DNA, 25 bp, Homo sapien
tctttgatgaggatttgtaaacgaa

SEQ ID NO: 497088 - DNA, 25 bp, Homo sapien
gatttgtaaacgaaaacagactcga

SEQ ID NO: 497089 - DNA, 25 bp, Homo sapien
aaacagactcgaactattgtgtacc

SEQ ID NO: 497090 - DNA, 25 bp, Homo sapien
atagcacatgcacgtctgtcccaga

SEQ ID NO: 497091 - DNA, 25 bp, Homo sapien
gcacgtctgtcccagactttgacaa

SEQ ID NO: 497092 - DNA, 25 bp, Homo sapien
gcctaaagcaggagagacctcccta

SEQ ID NO: 497093 - DNA, 25 bp, Homo sapien
agcaggagagacctccctagggttt

SEQ ID NO: 497094 - DNA, 25 bp, Homo sapien
caggagagacctccctagggttttg

SEQ ID NO: 497095 - DNA, 25 bp, Homo sapien
caactggccattaccctagttctgc

SEQ ID NO: 497096 - DNA, 25 bp, Homo sapien
gaggattcgtcccattacaataatg

SEQ ID NO: 497097 - DNA, 25 bp, Homo sapien
ggattcgtcccattacaataatgaa

SEQ ID NO: 497098 - DNA, 25 bp, Homo sapien
gaagaactagatagaaaccccagtt

SEQ ID NO: 497099 - DNA, 25 bp, Homo sapien
acccagatccttaaacttaactatg

SEQ ID NO: 497100 - DNA, 25 bp, Homo sapien
gatccttaaacttaactatggtaca

SEQ ID NO: 497101 - DNA, 25 bp, Homo sapien
tggtacataatatccacacttagaa

SEQ ID NO: 497102 - DNA, 25 bp, Homo sapien
taatatccacacttagaactaacag

SEQ ID NO: 497103 - DNA, 25 bp, Homo sapien
gaactaacaggtgtttagtcacttt

SEQ ID NO: 497104 - DNA, 25 bp, Homo sapien
caggtgtttagtcactttaggactt

SEQ ID NO: 497105 - DNA, 25 bp, Homo sapien
gtatctctgctttcaactgaagtta

SEQ ID NO: 497106 - DNA, 25 bp, Homo sapien
caaaagatgttttctagccctaaat

SEQ ID NO: 497107 - DNA, 25 bp, Homo sapien
ctagccctaaattttatgacattgg

SEQ ID NO: 497108 - DNA, 25 bp, Homo sapien
ctaaattttatgacattgggtactt

SEQ ID NO: 497109 - DNA, 25 bp, Homo sapien
tatttacgcattattgacttcctat

SEQ ID NO: 497110 - DNA, 25 bp, Homo sapien
gcattattgacttcctattgagact

SEQ ID NO: 497111 - DNA, 25 bp, Homo sapien
ttgacttcctattgagactcaaaat

SEQ ID NO: 497112 - DNA, 25 bp, Homo sapien
aactggtaaagaattcaatggatca

SEQ ID NO: 497113 - DNA, 25 bp, Homo sapien
aattcagtaaatctgaagtcactgg

SEQ ID NO: 497114 - DNA, 25 bp, Homo sapien
gaagtcactggaataaaggccccta

SEQ ID NO: 497115 - DNA, 25 bp, Homo sapien
gtcactggaataaaggcccctaaga

SEQ ID NO: 497116 - DNA, 25 bp, Homo sapien
acagataagctattcacaacaagtg

SEQ ID NO: 497117 - DNA, 25 bp, Homo sapien
gctattcacaacaagtgtagttact

SEQ ID NO: 497118 - DNA, 25 bp, Homo sapien
gctaattcagttctaaaatgccaca

SEQ ID NO: 497119 - DNA, 25 bp, Homo sapien
aaatgccacatgcagtagcagtgaa

SEQ ID NO: 497120 - DNA, 25 bp, Homo sapien
caagtttggcgctattctggcccag

SEQ ID NO: 497121 - DNA, 25 bp, Homo sapien
ctggcccagggcatactggatgcag

SEQ ID NO: 497122 - DNA, 25 bp, Homo sapien
gcaggtggtcataatgtcacaatct

SEQ ID NO: 497123 - DNA, 25 bp, Homo sapien
gcagtccaggactgggcatactcat

SEQ ID NO: 497124 - DNA, 25 bp, Homo sapien
atactcatatgccttctgtggttgg

SEQ ID NO: 497125 - DNA, 25 bp, Homo sapien
tggttggcgtccttgtatttaccca

SEQ ID NO: 497126 - DNA, 25 bp, Homo sapien
ttgtatttacccagttttggttctg

SEQ ID NO: 497127 - DNA, 25 bp, Homo sapien
tcacacttcctgtcattggcttata

SEQ ID NO: 497128 - DNA, 25 bp, Homo sapien
tgtcattggcttatacccctacctg

SEQ ID NO: 497129 - DNA, 25 bp, Homo sapien
ctacctgtgtcattggccttaacaa

SEQ ID NO: 497130 - DNA, 25 bp, Homo sapien
gaactgtaaaccatccacatttgca

SEQ ID NO: 497131 - DNA, 25 bp, Homo sapien
ctgttcggacactatagtctaaatt

SEQ ID NO: 497132 - DNA, 25 bp, Homo sapien
tgaaactgtgtggtgttcgctaaaa

SEQ ID NO: 497133 - DNA, 25 bp, Homo sapien
gctaattaaggtcacaaacttcggt

SEQ ID NO: 497134 - DNA, 25 bp, Homo sapien
agtccaaatcttcttgatattgtga

SEQ ID NO: 497135 - DNA, 25 bp, Homo sapien
ttgatattgtgaaccgtaccccttc

SEQ ID NO: 497136 - DNA, 25 bp, Homo sapien
tagtttcttctggactttccttact

SEQ ID NO: 497137 - DNA, 25 bp, Homo sapien
ttatgattaaaattgggcctctact

SEQ ID NO: 497138 - DNA, 25 bp, Homo sapien
aattgggcctctactgtgatgattc

SEQ ID NO: 497139 - DNA, 25 bp, Homo sapien
ggcctctactgtgatgattcctatt

SEQ ID NO: 497140 - DNA, 25 bp, Homo sapien
gattcctatttcctctcatgtttta

SEQ ID NO: 497141 - DNA, 25 bp, Homo sapien
tttcctctcatgttttaaagtgcaa

SEQ ID NO: 497142 - DNA, 25 bp, Homo sapien
gcaggccatgcatgcaatggtgatt

SEQ ID NO: 497143 - DNA, 25 bp, Homo sapien
gcatgcaatggtgatttacagcctt

SEQ ID NO: 497144 - DNA, 25 bp, Homo sapien
gctgcagggagtcatgtttatgaaa

SEQ ID NO: 497145 - DNA, 25 bp, Homo sapien
tttacgtgtaattcctccaggtgat

SEQ ID NO: 497146 - DNA, 25 bp, Homo sapien
aattcctccaggtgatttatcccaa

SEQ ID NO: 497147 - DNA, 25 bp, Homo sapien
ggtgatttatcccaatttatgcaaa

SEQ ID NO: 497148 - DNA, 25 bp, Homo sapien
cctattttaaacagacacggagaag

SEQ ID NO: 497149 - DNA, 25 bp, Homo sapien
gtaaccgtttcctaacagcagcaag

SEQ ID NO: 497150 - DNA, 25 bp, Homo sapien
cagcagcaagaatgccccttccgtt

SEQ ID NO: 497151 - DNA, 25 bp, Homo sapien
ttccgtttgcctggtgaaaagaact

SEQ ID NO: 497152 - DNA, 25 bp, Homo sapien
aacagcagcttggaggcttcgagga

SEQ ID NO: 497153 - DNA, 25 bp, Homo sapien
tccaaagctgaactgccccgtgtct

SEQ ID NO: 497154 - DNA, 25 bp, Homo sapien
aactgccccgtgtctgattccgatt

SEQ ID NO: 497155 - DNA, 25 bp, Homo sapien
tgtctgattccgatttctcttgagc

SEQ ID NO: 497156 - DNA, 25 bp, Homo sapien
gattccgatttctcttgagcgcgtt

SEQ ID NO: 497157 - DNA, 25 bp, Homo sapien
gatttctcttgagcgcgtttcggag

SEQ ID NO: 497158 - DNA, 25 bp, Homo sapien
agcgcgtttcggagccggcccagaa

SEQ ID NO: 497159 - DNA, 25 bp, Homo sapien
gagggaagccagacacaccataccc

SEQ ID NO: 497160 - DNA, 25 bp, Homo sapien
gtcaagctgggtcacccggcactga

SEQ ID NO: 497161 - DNA, 25 bp, Homo sapien
acccggcactgagtgacgatcagca

SEQ ID NO: 497162 - DNA, 25 bp, Homo sapien
agcaaatactcagtggacgaaatat

SEQ ID NO: 497163 - DNA, 25 bp, Homo sapien
gtggacgaaatatttgcagtgcagt

SEQ ID NO: 497164 - DNA, 25 bp, Homo sapien
agcctccatgctctgagacaactgt

SEQ ID NO: 497165 - DNA, 25 bp, Homo sapien
catgctctgagacaactgtgggtag

SEQ ID NO: 497166 - DNA, 25 bp, Homo sapien
gacaactgtgggtaggtacatctct

SEQ ID NO: 497167 - DNA, 25 bp, Homo sapien
actgtgggtaggtacatctctgttg

SEQ ID NO: 497168 - DNA, 25 bp, Homo sapien
ggtaggtacatctctgttggtggaa

SEQ ID NO: 497169 - DNA, 25 bp, Homo sapien
gtacatctctgttggtggaaatgat

SEQ ID NO: 497170 - DNA, 25 bp, Homo sapien
ggaaatgatgcttaagaaccccaaa

SEQ ID NO: 497171 - DNA, 25 bp, Homo sapien
gaatcaaagcatttcaatcaatcca

SEQ ID NO: 497172 - DNA, 25 bp, Homo sapien
gcatttcaatcaatccacttagttg

SEQ ID NO: 497173 - DNA, 25 bp, Homo sapien
caggaagcatcccataaccaacctt

SEQ ID NO: 497174 - DNA, 25 bp, Homo sapien
gaagcatcccataaccaaccttcag

SEQ ID NO: 497175 - DNA, 25 bp, Homo sapien
ccgggcagcaacagccccggcagcg

SEQ ID NO: 497176 - DNA, 25 bp, Homo sapien
ccgacgcctgggtgcgcctgcctgc

SEQ ID NO: 497177 - DNA, 25 bp, Homo sapien
ggctgttgtgtctgcgactgctccc

SEQ ID NO: 497178 - DNA, 25 bp, Homo sapien
gctgttgtgtctgcgactgctcccg

SEQ ID NO: 497179 - DNA, 25 bp, Homo sapien
tgttgtgtctgcgactgctcccggc

SEQ ID NO: 497180 - DNA, 25 bp, Homo sapien
gttgtgtctgcgactgctcccggcc

SEQ ID NO: 497181 - DNA, 25 bp, Homo sapien
ttgtgtctgcgactgctcccggccg

SEQ ID NO: 497182 - DNA, 25 bp, Homo sapien
tgtgtctgcgactgctcccggccgg

SEQ ID NO: 497183 - DNA, 25 bp, Homo sapien
tctgcgactgctcccggccggaggt

SEQ ID NO: 497184 - DNA, 25 bp, Homo sapien
agggagctcagccgagccgccgctg

SEQ ID NO: 497185 - DNA, 25 bp, Homo sapien
agcgagccggctagaggccagcgcc

SEQ ID NO: 497186 - DNA, 25 bp, Homo sapien
agggcgcaagggtcccaagacgtct

SEQ ID NO: 497187 - DNA, 25 bp, Homo sapien
caagacgtctccaccgagaggcagc

SEQ ID NO: 497188 - DNA, 25 bp, Homo sapien
cagtgtcacccgcgacgcagcagag

SEQ ID NO: 497189 - DNA, 25 bp, Homo sapien
agaggtgcggcaagagcccccgaaa

SEQ ID NO: 497190 - DNA, 25 bp, Homo sapien
agagcccccgaaaggtctctcttgg

SEQ ID NO: 497191 - DNA, 25 bp, Homo sapien
gggtgacagtcaccgctgcccagaa

SEQ ID NO: 497192 - DNA, 25 bp, Homo sapien
tgacagtcaccgctgcccagaaggc

SEQ ID NO: 497193 - DNA, 25 bp, Homo sapien
gaaggcccccggactgagagcacct

SEQ ID NO: 497194 - DNA, 25 bp, Homo sapien
tccgttccggaggctacgggtctga

SEQ ID NO: 497195 - DNA, 25 bp, Homo sapien
ctacgggtctgagccggcgagagaa

SEQ ID NO: 497196 - DNA, 25 bp, Homo sapien
aaagagcgagcagccaaggaaggaa

SEQ ID NO: 497197 - DNA, 25 bp, Homo sapien
tcatccagcttttcaggaacaactg

SEQ ID NO: 497198 - DNA, 25 bp, Homo sapien
gatgaaccctctcccaatcttggga

SEQ ID NO: 497199 - DNA, 25 bp, Homo sapien
gaggacatcagggtctatgtgagac

SEQ ID NO: 497200 - DNA, 25 bp, Homo sapien
gacagggacttgaatgtttccttaa

SEQ ID NO: 497201 - DNA, 25 bp, Homo sapien
gctgtgaactggctgttgactaaga

SEQ ID NO: 497202 - DNA, 25 bp, Homo sapien
taagatgcagtctgccatgcctgtg

SEQ ID NO: 497203 - DNA, 25 bp, Homo sapien
aatcttgggatgtcaatcttccacg

SEQ ID NO: 497204 - DNA, 25 bp, Homo sapien
aatcttccacgcagctgtactaggg

SEQ ID NO: 497205 - DNA, 25 bp, Homo sapien
tgtactagggcttccagtgccaaag

SEQ ID NO: 497206 - DNA, 25 bp, Homo sapien
ttccagtgccaaagtcagatttttc

SEQ ID NO: 497207 - DNA, 25 bp, Homo sapien
tttcttcctttcgtatctgttgatg

SEQ ID NO: 497208 - DNA, 25 bp, Homo sapien
aaacagtgggaatgtttgacatctg

SEQ ID NO: 497209 - DNA, 25 bp, Homo sapien
atctgaatgcagagtgctcctaatt

SEQ ID NO: 497210 - DNA, 25 bp, Homo sapien
gaatgcagagtgctcctaattgagt

SEQ ID NO: 497211 - DNA, 25 bp, Homo sapien
tcctaattgagtctttagctactat

SEQ ID NO: 497212 - DNA, 25 bp, Homo sapien
gagtctttagctactatggagccag

SEQ ID NO: 497213 - DNA, 25 bp, Homo sapien
tctttagctactatggagccagaca

SEQ ID NO: 497214 - DNA, 25 bp, Homo sapien
ttagctactatggagccagacagca

SEQ ID NO: 497215 - DNA, 25 bp, Homo sapien
cagacagcagacctgaactgcagga

SEQ ID NO: 497216 - DNA, 25 bp, Homo sapien
aactgcaggagaaagcagcgttact

SEQ ID NO: 497217 - DNA, 25 bp, Homo sapien
agaaagcagcgttactgaagaaaac

SEQ ID NO: 497218 - DNA, 25 bp, Homo sapien
gggaagaaacaaacaagtgccatgt

SEQ ID NO: 497219 - DNA, 25 bp, Homo sapien
gcagcactgggcatttcaggcaata

SEQ ID NO: 497220 - DNA, 25 bp, Homo sapien
tcaggcaatagctctgaacaagccc

SEQ ID NO: 497221 - DNA, 25 bp, Homo sapien
taccatgcgggtaggtaaaccccag

SEQ ID NO: 497222 - DNA, 25 bp, Homo sapien
aaccccagaatatacagatgcccct

SEQ ID NO: 497223 - DNA, 25 bp, Homo sapien
tacagatgccccttacgatacatgg

SEQ ID NO: 497224 - DNA, 25 bp, Homo sapien
atgtggccgagagagcataagctta

SEQ ID NO: 497225 - DNA, 25 bp, Homo sapien
ttgaattccactgagcttttggctg

SEQ ID NO: 497226 - DNA, 25 bp, Homo sapien
cactgagcttttggctgtggaccca

SEQ ID NO: 497227 - DNA, 25 bp, Homo sapien
ggacgtggcatatgtctcgctgagc

SEQ ID NO: 497228 - DNA, 25 bp, Homo sapien
atatgtctcgctgagccttagtttc

SEQ ID NO: 497229 - DNA, 25 bp, Homo sapien
tagggagagcaatagtacctgcctc

SEQ ID NO: 497230 - DNA, 25 bp, Homo sapien
gggtagggctttaacatatgaaatt

SEQ ID NO: 497231 - DNA, 25 bp, Homo sapien
atacatttcaaaaagctgtgggaca

SEQ ID NO: 497232 - DNA, 25 bp, Homo sapien
ggtattcaatggtaccacatccaag

SEQ ID NO: 497233 - DNA, 25 bp, Homo sapien
tggtaccacatccaagcaagtcttg

SEQ ID NO: 497234 - DNA, 25 bp, Homo sapien
cactaattccgttgatgagggccct

SEQ ID NO: 497235 - DNA, 25 bp, Homo sapien
caagcaagtcttgtatggttaaaac

SEQ ID NO: 497236 - DNA, 25 bp, Homo sapien
tgagggccctatgctcatgactttg

SEQ ID NO: 497237 - DNA, 25 bp, Homo sapien
gccctatgctcatgactttgtctaa

SEQ ID NO: 497238 - DNA, 25 bp, Homo sapien
catgactttgtctaaacctaattaa

SEQ ID NO: 497239 - DNA, 25 bp, Homo sapien
tcaaaggcctcacttcccaatactg

SEQ ID NO: 497240 - DNA, 25 bp, Homo sapien
tcacttcccaatactgtcacattgt

SEQ ID NO: 497241 - DNA, 25 bp, Homo sapien
ttgtgagtcattcatccagcactgg

SEQ ID NO: 497242 - DNA, 25 bp, Homo sapien
agcactgggccttttaagctgaaga

SEQ ID NO: 497243 - DNA, 25 bp, Homo sapien
tttaagctgaagattcacccagtgt

SEQ ID NO: 497244 - DNA, 25 bp, Homo sapien
cacccagtgtctaaagttgtccttt

SEQ ID NO: 497245 - DNA, 25 bp, Homo sapien
gttgtccttttcttatagctagctt

SEQ ID NO: 497246 - DNA, 25 bp, Homo sapien
ctttcaagcatctttcctcctaaat

SEQ ID NO: 497247 - DNA, 25 bp, Homo sapien
ttcagcaagtttagcttatagcctt

SEQ ID NO: 497248 - DNA, 25 bp, Homo sapien
gcttatagccttgataaattcctct

SEQ ID NO: 497249 - DNA, 25 bp, Homo sapien
gataaattcctctgtgcttctgagc

SEQ ID NO: 497250 - DNA, 25 bp, Homo sapien
ttctgagcagcatccttctgcctct

SEQ ID NO: 497251 - DNA, 25 bp, Homo sapien
tctgcttagcagctctgcatttggt

SEQ ID NO: 497252 - DNA, 25 bp, Homo sapien
aatttactcccaggacaatctaagt

SEQ ID NO: 497253 - DNA, 25 bp, Homo sapien
ggacaatctaagttctgccacaagt

SEQ ID NO: 497254 - DNA, 25 bp, Homo sapien
aacaatggccctttcacaagctctt

SEQ ID NO: 497255 - DNA, 25 bp, Homo sapien
atggccctttcacaagctcttgcct

SEQ ID NO: 497256 - DNA, 25 bp, Homo sapien
gaagtccttcaacaaaactaataat

SEQ ID NO: 497257 - DNA, 25 bp, Homo sapien
aatagactagtgaaacctactcctc

SEQ ID NO: 497258 - DNA, 25 bp, Homo sapien
gaaacctactcctcacatgggtaag

SEQ ID NO: 497259 - DNA, 25 bp, Homo sapien
tcctcacatgggtaagagttgcagt

SEQ ID NO: 497260 - DNA, 25 bp, Homo sapien
cctgccaacctctggatacatcaat

SEQ ID NO: 497261 - DNA, 25 bp, Homo sapien
caacctctggatacatcaatgggaa

SEQ ID NO: 497262 - DNA, 25 bp, Homo sapien
aaccagggaagcatagacctatagt

SEQ ID NO: 497263 - DNA, 25 bp, Homo sapien
ataaaacccatagcctttggagata

SEQ ID NO: 497264 - DNA, 25 bp, Homo sapien
tggaaaatggtatctttcagatttc

SEQ ID NO: 497265 - DNA, 25 bp, Homo sapien
tcagatttctagaagttcaagtgtc

SEQ ID NO: 497266 - DNA, 25 bp, Homo sapien
gaagttcaagtgtcatacaacaaaa

SEQ ID NO: 497267 - DNA, 25 bp, Homo sapien
ccctttactcttatggacctcattt

SEQ ID NO: 497268 - DNA, 25 bp, Homo sapien
ggacctcatttcaatatactgttta

SEQ ID NO: 497269 - DNA, 25 bp, Homo sapien
tactgtttacagtttgatggaattg

SEQ ID NO: 497270 - DNA, 25 bp, Homo sapien
aatatttctcttgtactgtagttta

SEQ ID NO: 497271 - DNA, 25 bp, Homo sapien
ttgttccttgctatgatcaatgttt

SEQ ID NO: 497272 - DNA, 25 bp, Homo sapien
agtagagcacttatgatcacaaatt

SEQ ID NO: 497273 - DNA, 25 bp, Homo sapien
tttttggtttgattgcactacatta

SEQ ID NO: 497274 - DNA, 25 bp, Homo sapien
atgatgttgctctaatttccaatgc

SEQ ID NO: 497275 - DNA, 25 bp, Homo sapien
acaagtattctaagtcctgatcaac

SEQ ID NO: 497276 - DNA, 25 bp, Homo sapien
aagtattctaagtcctgatcaacaa

SEQ ID NO: 497277 - DNA, 25 bp, Homo sapien
gatgttgctctaatttccaatgcaa

SEQ ID NO: 497278 - DNA, 25 bp, Homo sapien
gttgctctaatttccaatgcaaaac

SEQ ID NO: 497279 - DNA, 25 bp, Homo sapien
tgataaatacggtctgtagcctgat

SEQ ID NO: 497280 - DNA, 25 bp, Homo sapien
aaatacggtctgtagcctgataaca

SEQ ID NO: 497281 - DNA, 25 bp, Homo sapien
atacggtctgtagcctgataacata

SEQ ID NO: 497282 - DNA, 25 bp, Homo sapien
acggtctgtagcctgataacatata

SEQ ID NO: 497283 - DNA, 25 bp, Homo sapien
gtctgtagcctgataacatataaga

SEQ ID NO: 497284 - DNA, 25 bp, Homo sapien
gaagtgtatcgaaaagtactgcaac

SEQ ID NO: 497285 - DNA, 25 bp, Homo sapien
gagtgctttgatctcagttgctaat

SEQ ID NO: 497286 - DNA, 25 bp, Homo sapien
cggaggccttgattggtgatttcat

SEQ ID NO: 497287 - DNA, 25 bp, Homo sapien
aacagatttctgcattacctctgcc

SEQ ID NO: 497288 - DNA, 25 bp, Homo sapien
ttacctctgcctgctttgtgggtcc

SEQ ID NO: 497289 - DNA, 25 bp, Homo sapien
ttgtgggtcccttagttggcgtaca

SEQ ID NO: 497290 - DNA, 25 bp, Homo sapien
cttagttggcgtacactttctgata

SEQ ID NO: 497291 - DNA, 25 bp, Homo sapien
ctttctgatagtgcctgccttatga

SEQ ID NO: 497292 - DNA, 25 bp, Homo sapien
gtgcctgccttatgaatgcctgaag

SEQ ID NO: 497293 - DNA, 25 bp, Homo sapien
atgcctgaagtctaatcctgacctt

SEQ ID NO: 497294 - DNA, 25 bp, Homo sapien
taatcctgaccttactttgttgccc

SEQ ID NO: 497295 - DNA, 25 bp, Homo sapien
tggaaccatttaacttgctgataca

SEQ ID NO: 497296 - DNA, 25 bp, Homo sapien
acacacgtacacatgtatatctctc

SEQ ID NO: 497297 - DNA, 25 bp, Homo sapien
tctctcaatatatatcaggtactca

SEQ ID NO: 497298 - DNA, 25 bp, Homo sapien
ggtactcaatatatactgtctccct

SEQ ID NO: 497299 - DNA, 25 bp, Homo sapien
actcaatatatactgtctcccttct

SEQ ID NO: 497300 - DNA, 25 bp, Homo sapien
ttcttccataccatatctcaactgt

SEQ ID NO: 497301 - DNA, 25 bp, Homo sapien
tccataccatatctcaactgtaggg

SEQ ID NO: 497302 - DNA, 25 bp, Homo sapien
ccatatctcaactgtagggtgacta

SEQ ID NO: 497303 - DNA, 25 bp, Homo sapien
tatctcaactgtagggtgactaatt

SEQ ID NO: 497304 - DNA, 25 bp, Homo sapien
ctgtagggtgactaattacgtttgt

SEQ ID NO: 497305 - DNA, 25 bp, Homo sapien
aatgagtctattttgacagcaatat

SEQ ID NO: 497306 - DNA, 25 bp, Homo sapien
ttttgtaagagcttacttcactttc

SEQ ID NO: 497307 - DNA, 25 bp, Homo sapien
gtattctggatctacacaaaattat

SEQ ID NO: 497308 - DNA, 25 bp, Homo sapien
ttaactgctcttattaatctgtgag

SEQ ID NO: 497309 - DNA, 25 bp, Homo sapien
atcctttgagatgaagtcgtgttct

SEQ ID NO: 497310 - DNA, 25 bp, Homo sapien
gctttgtttttgtaaggaaccatct

SEQ ID NO: 497311 - DNA, 25 bp, Homo sapien
ggaaccatctcttggtttggtcaca

SEQ ID NO: 497312 - DNA, 25 bp, Homo sapien
cttggtttggtcacatcagttcaca

SEQ ID NO: 497313 - DNA, 25 bp, Homo sapien
gtcacatcagttcacaacagccatt

SEQ ID NO: 497314 - DNA, 25 bp, Homo sapien
acaacagccatttgttttcaaggtc

SEQ ID NO: 497315 - DNA, 25 bp, Homo sapien
gtcaaggctccaggcaggttgttac

SEQ ID NO: 497316 - DNA, 25 bp, Homo sapien
gtttgcagcctgtcagtacttgcag

SEQ ID NO: 497317 - DNA, 25 bp, Homo sapien
cagtactggaataggttctaggcta

SEQ ID NO: 497318 - DNA, 25 bp, Homo sapien
gtgacatcctctttatttgaattga

SEQ ID NO: 497319 - DNA, 25 bp, Homo sapien
ctatttttaacctatcccatgaaca

SEQ ID NO: 497320 - DNA, 25 bp, Homo sapien
gaacaaatggtcttattcctgtttt

SEQ ID NO: 497321 - DNA, 25 bp, Homo sapien
atcagaagcttttatccaccctgtg

SEQ ID NO: 497322 - DNA, 25 bp, Homo sapien
aagcttttatccaccctgtgtataa

SEQ ID NO: 497323 - DNA, 25 bp, Homo sapien
ttatccaccctgtgtataaaccaca

SEQ ID NO: 497324 - DNA, 25 bp, Homo sapien
ttaattccagattaatttcccctgg

SEQ ID NO: 497325 - DNA, 25 bp, Homo sapien
atttcccctggatacctgtagatat

SEQ ID NO: 497326 - DNA, 25 bp, Homo sapien
atacctgtagatatctgggccatca

SEQ ID NO: 497327 - DNA, 25 bp, Homo sapien
atctgggccatcatgtgtctttaat

SEQ ID NO: 497328 - DNA, 25 bp, Homo sapien
gcctcccataatttttatgtgacat

SEQ ID NO: 497329 - DNA, 25 bp, Homo sapien
gtgttctatatgctgcccacattaa

SEQ ID NO: 497330 - DNA, 25 bp, Homo sapien
taaaggcgtcatccattctgatcca

SEQ ID NO: 497331 - DNA, 25 bp, Homo sapien
ttctgatccatcatatctactcctg

SEQ ID NO: 497332 - DNA, 25 bp, Homo sapien
tactcctgtccttttgctatgagat

SEQ ID NO: 497333 - DNA, 25 bp, Homo sapien
aggtatgtccgaactgagcagccag

SEQ ID NO: 497334 - DNA, 25 bp, Homo sapien
gctacatccttctccatcaattaat

SEQ ID NO: 497335 - DNA, 25 bp, Homo sapien
ggatctgcaccatatttcattagtt

SEQ ID NO: 497336 - DNA, 25 bp, Homo sapien
atagatggccttgtcttgtggccca

SEQ ID NO: 497337 - DNA, 25 bp, Homo sapien
cttgtggcccagtgcaatggagttg

SEQ ID NO: 497338 - DNA, 25 bp, Homo sapien
aatggagttgaattcaggtcccctc

SEQ ID NO: 497339 - DNA, 25 bp, Homo sapien
gttgatccacaatagcacctttcga

SEQ ID NO: 497340 - DNA, 25 bp, Homo sapien
tgtaactcatggctatggtgccttc

SEQ ID NO: 497341 - DNA, 25 bp, Homo sapien
cctcagccacacctcaaagaatatg

SEQ ID NO: 497342 - DNA, 25 bp, Homo sapien
atatgaacataaacagagcctcact

SEQ ID NO: 497343 - DNA, 25 bp, Homo sapien
agtcctgaggccctgcatgttctgc

SEQ ID NO: 497344 - DNA, 25 bp, Homo sapien
tgaggccctgcatgttctgcctgac

SEQ ID NO: 497345 - DNA, 25 bp, Homo sapien
ttctgcctgaccctgtgtttatgta

SEQ ID NO: 497346 - DNA, 25 bp, Homo sapien
gcctgaccctgtgtttatgtattgg

SEQ ID NO: 497347 - DNA, 25 bp, Homo sapien
atggtgccttccagattttcgggaa

SEQ ID NO: 497348 - DNA, 25 bp, Homo sapien
catgattggtgtcccccaaggcaca

SEQ ID NO: 497349 - DNA, 25 bp, Homo sapien
aaggcacagaaatccttatttcgga

SEQ ID NO: 497350 - DNA, 25 bp, Homo sapien
cttatttcggaggaaaagctacaca

SEQ ID NO: 497351 - DNA, 25 bp, Homo sapien
ttttgttttgcccttccaacactga

SEQ ID NO: 497352 - DNA, 25 bp, Homo sapien
ttgttttgcccttccaacactgaag

SEQ ID NO: 497353 - DNA, 25 bp, Homo sapien
gttttgcccttccaacactgaagaa

SEQ ID NO: 497354 - DNA, 25 bp, Homo sapien
ttgcccttccaacactgaagaatgt

SEQ ID NO: 497355 - DNA, 25 bp, Homo sapien
cactgaagaatgtaaccttgagctt

SEQ ID NO: 497356 - DNA, 25 bp, Homo sapien
aaccttgagcttcaattcaggaatt

SEQ ID NO: 497357 - DNA, 25 bp, Homo sapien
tcaattcaggaattggctgagctta

SEQ ID NO: 497358 - DNA, 25 bp, Homo sapien
attggctgagcttagaactttttct

SEQ ID NO: 497359 - DNA, 25 bp, Homo sapien
gctgagcttagaactttttctggaa

SEQ ID NO: 497360 - DNA, 25 bp, Homo sapien
gaactttttctggaatagtatctgc

SEQ ID NO: 497361 - DNA, 25 bp, Homo sapien
actttttctggaatagtatctgcat

SEQ ID NO: 497362 - DNA, 25 bp, Homo sapien
agcaagtgctgggacctttgggacc

SEQ ID NO: 497363 - DNA, 25 bp, Homo sapien
tgctgggacctttgggaccgagtca

SEQ ID NO: 497364 - DNA, 25 bp, Homo sapien
tgggacctttgggaccgagtcatat

SEQ ID NO: 497365 - DNA, 25 bp, Homo sapien
ggacctttgggaccgagtcatattc

SEQ ID NO: 497366 - DNA, 25 bp, Homo sapien
cctttgggaccgagtcatattctaa

SEQ ID NO: 497367 - DNA, 25 bp, Homo sapien
gggaccgagtcatattctaaaaaga

SEQ ID NO: 497368 - DNA, 25 bp, Homo sapien
gagtcatattctaaaaagagcacag

SEQ ID NO: 497369 - DNA, 25 bp, Homo sapien
ccactggcagtgtttgggcttttgg

SEQ ID NO: 497370 - DNA, 25 bp, Homo sapien
ctggcagtgtttgggcttttggtcc

SEQ ID NO: 497371 - DNA, 25 bp, Homo sapien
ggtccccagaacaggaggaggacat

SEQ ID NO: 497372 - DNA, 25 bp, Homo sapien
aacaggaggaggacatgtgatgact

SEQ ID NO: 497373 - DNA, 25 bp, Homo sapien
gcaaaatagcactgcttacgcctac

SEQ ID NO: 497374 - DNA, 25 bp, Homo sapien
taccccgtgaggtgctgtagatcct

SEQ ID NO: 497375 - DNA, 25 bp, Homo sapien
gatcctcagcctgttgaagggttga

SEQ ID NO: 497376 - DNA, 25 bp, Homo sapien
agtgagccctgtggatgctctgtat

SEQ ID NO: 497377 - DNA, 25 bp, Homo sapien
attagactctcctggctcctcactt

SEQ ID NO: 497378 - DNA, 25 bp, Homo sapien
ttcacctgcacatgtaggcttatcc

SEQ ID NO: 497379 - DNA, 25 bp, Homo sapien
aattgcaccatgttgggattcctgc

SEQ ID NO: 497380 - DNA, 25 bp, Homo sapien
gttgggattcctgctcaatgagtaa

SEQ ID NO: 497381 - DNA, 25 bp, Homo sapien
atcctttggaggttacttcatttct

SEQ ID NO: 497382 - DNA, 25 bp, Homo sapien
acttcatttctctaaaggtggcttt

SEQ ID NO: 497383 - DNA, 25 bp, Homo sapien
taaaggtggctttctcaactgcaaa

SEQ ID NO: 497384 - DNA, 25 bp, Homo sapien
ctgagaatagccgtggagccatgta

SEQ ID NO: 497385 - DNA, 25 bp, Homo sapien
gagaatagccgtggagccatgtaga

SEQ ID NO: 497386 - DNA, 25 bp, Homo sapien
aatagccgtggagccatgtagagag

SEQ ID NO: 497387 - DNA, 25 bp, Homo sapien
gtagagaggtgtagctcagcacatc

SEQ ID NO: 497388 - DNA, 25 bp, Homo sapien
agaggtgtagctcagcacatctcaa

SEQ ID NO: 497389 - DNA, 25 bp, Homo sapien
aggtgtagctcagcacatctcaact

SEQ ID NO: 497390 - DNA, 25 bp, Homo sapien
gtgtagctcagcacatctcaactac

SEQ ID NO: 497391 - DNA, 25 bp, Homo sapien
actaccagtcagcttccctttgaga

SEQ ID NO: 497392 - DNA, 25 bp, Homo sapien
ttgagaacttctgtgctcacttcct

SEQ ID NO: 497393 - DNA, 25 bp, Homo sapien
tcctgttttcagagattccagggca

SEQ ID NO: 497394 - DNA, 25 bp, Homo sapien
aatcagttgaacttcaaacctccta

SEQ ID NO: 497395 - DNA, 25 bp, Homo sapien
ccagggtccctgacggagcagcact

SEQ ID NO: 497396 - DNA, 25 bp, Homo sapien
gggtccctgacggagcagcactcag

SEQ ID NO: 497397 - DNA, 25 bp, Homo sapien
tgacggagcagcactcagcatgtga

SEQ ID NO: 497398 - DNA, 25 bp, Homo sapien
acggagcagcactcagcatgtgagt

SEQ ID NO: 497399 - DNA, 25 bp, Homo sapien
ggagcagcactcagcatgtgagtga

SEQ ID NO: 497400 - DNA, 25 bp, Homo sapien
cagcactcagcatgtgagtgaggcc

SEQ ID NO: 497401 - DNA, 25 bp, Homo sapien
gtgagtgaggccacagaaaaactct

SEQ ID NO: 497402 - DNA, 25 bp, Homo sapien
actgcttcttacctcacgggggtgg

SEQ ID NO: 497403 - DNA, 25 bp, Homo sapien
attccgttatcttcctccagttttg

SEQ ID NO: 497404 - DNA, 25 bp, Homo sapien
ttccgttatcttcctccagttttgt

SEQ ID NO: 497405 - DNA, 25 bp, Homo sapien
tcagttccaccaggtgtcaggactg

SEQ ID NO: 497406 - DNA, 25 bp, Homo sapien
tggcggccccgaatccctggtgttt

SEQ ID NO: 497407 - DNA, 25 bp, Homo sapien
gaatccctggtgtttcttgaccact

SEQ ID NO: 497408 - DNA, 25 bp, Homo sapien
tggtgtttcttgaccactcgcgacc

SEQ ID NO: 497409 - DNA, 25 bp, Homo sapien
gtctcttacaaggacactctcactg

SEQ ID NO: 497410 - DNA, 25 bp, Homo sapien
ttacaaggacactctcactggactt

SEQ ID NO: 497411 - DNA, 25 bp, Homo sapien
aggacactctcactggacttgaggc

SEQ ID NO: 497412 - DNA, 25 bp, Homo sapien
tcactggacttgaggcccctcaaat

SEQ ID NO: 497413 - DNA, 25 bp, Homo sapien
tgggagcggcgtattgatctagaaa

SEQ ID NO: 497414 - DNA, 25 bp, Homo sapien
gagcggcgtattgatctagaaacca

SEQ ID NO: 497415 - DNA, 25 bp, Homo sapien
tattgatctagaaaccaaaaccccg

SEQ ID NO: 497416 - DNA, 25 bp, Homo sapien
ctgacaaaaacttagaggcctggag

SEQ ID NO: 497417 - DNA, 25 bp, Homo sapien
aaagctgtacatttctgggaagttc

SEQ ID NO: 497418 - DNA, 25 bp, Homo sapien
gagcttcttttatatatagcaaaca

SEQ ID NO: 497419 - DNA, 25 bp, Homo sapien
aataactacagtatagcgctggtac

SEQ ID NO: 497420 - DNA, 25 bp, Homo sapien
aactacagtatagcgctggtacagt

SEQ ID NO: 497421 - DNA, 25 bp, Homo sapien
acagtatagcgctggtacagtacac

SEQ ID NO: 497422 - DNA, 25 bp, Homo sapien
agtatagcgctggtacagtacacta

SEQ ID NO: 497423 - DNA, 25 bp, Homo sapien
tatagcgctggtacagtacactaaa

SEQ ID NO: 497424 - DNA, 25 bp, Homo sapien
gaaacaataataaaaggcctccatt

SEQ ID NO: 497425 - DNA, 25 bp, Homo sapien
tatataccttgtggatgagagctat

SEQ ID NO: 497426 - DNA, 25 bp, Homo sapien
taccttgtggatgagagctatatac

SEQ ID NO: 497427 - DNA, 25 bp, Homo sapien
gtggatgagagctatatacttttac

SEQ ID NO: 497428 - DNA, 25 bp, Homo sapien
gatggagccgatagtcaagttcccg

SEQ ID NO: 497429 - DNA, 25 bp, Homo sapien
gtggacggcgcaacctatatcctgg

SEQ ID NO: 497430 - DNA, 25 bp, Homo sapien
gcgcaacctatatcctggtgatggt

SEQ ID NO: 497431 - DNA, 25 bp, Homo sapien
gtgatggtggatccagatgccccta

SEQ ID NO: 497432 - DNA, 25 bp, Homo sapien
gatgcccctagcagagcagaaccca

SEQ ID NO: 497433 - DNA, 25 bp, Homo sapien
agcagagcagaacccagacagagat

SEQ ID NO: 497434 - DNA, 25 bp, Homo sapien
gattctggagacattggctggtaac

SEQ ID NO: 497435 - DNA, 25 bp, Homo sapien
gtaacagatatcaagggcgccgacc

SEQ ID NO: 497436 - DNA, 25 bp, Homo sapien
cagttctttgtctatcttcaggaag

SEQ ID NO: 497437 - DNA, 25 bp, Homo sapien
tcaggaaggaaaagtcatctctctc

SEQ ID NO: 497438 - DNA, 25 bp, Homo sapien
aaggaaaagtcatctctctccttcc

SEQ ID NO: 497439 - DNA, 25 bp, Homo sapien
aatgagctgctgctactttaaagtg

SEQ ID NO: 497440 - DNA, 25 bp, Homo sapien
tgagctgctgctactttaaagtgtg

SEQ ID NO: 497441 - DNA, 25 bp, Homo sapien
gctgctgctactttaaagtgtggtc

SEQ ID NO: 497442 - DNA, 25 bp, Homo sapien
gctgctactttaaagtgtggtcatt

SEQ ID NO: 497443 - DNA, 25 bp, Homo sapien
gctactttaaagtgtggtcattatg

SEQ ID NO: 497444 - DNA, 25 bp, Homo sapien
agtgtggtcattatgatgaatgtga

SEQ ID NO: 497445 - DNA, 25 bp, Homo sapien
gtgaaaagagttttggcttgttcta

SEQ ID NO: 497446 - DNA, 25 bp, Homo sapien
agagttttggcttgttctaaataat

SEQ ID NO: 497447 - DNA, 25 bp, Homo sapien
tggcttgttctaaataatttttaca

SEQ ID NO: 497448 - DNA, 25 bp, Homo sapien
ttacaagttatggtacagacagttg

SEQ ID NO: 497449 - DNA, 25 bp, Homo sapien
ggtacagacagttgttacatatcaa

SEQ ID NO: 497450 - DNA, 25 bp, Homo sapien
ccaactacggcgctctatattttag

SEQ ID NO: 497451 - DNA, 25 bp, Homo sapien
aggattttcacccatgtgcatggaa

SEQ ID NO: 497452 - DNA, 25 bp, Homo sapien
cttacacgatatcccatacctttaa

SEQ ID NO: 497453 - DNA, 25 bp, Homo sapien
ccatacctttaatgcctttggcctt

SEQ ID NO: 497454 - DNA, 25 bp, Homo sapien
ctttggccttccattctgatttctc

SEQ ID NO: 497455 - DNA, 25 bp, Homo sapien
tgctttccctggtaggtatttgcca

SEQ ID NO: 497456 - DNA, 25 bp, Homo sapien
taggtatttgccaggcccaatgctt

SEQ ID NO: 497457 - DNA, 25 bp, Homo sapien
ccaggcccaatgctttaaccttaag

SEQ ID NO: 497458 - DNA, 25 bp, Homo sapien
gatactttgctttagatgtcagtct

SEQ ID NO: 497459 - DNA, 25 bp, Homo sapien
agatgtcagtctcgttaccagcagc

SEQ ID NO: 497460 - DNA, 25 bp, Homo sapien
taccagcagccttttgacccaacta

SEQ ID NO: 497461 - DNA, 25 bp, Homo sapien
gggcaggaaaaatctttctcaagcc

SEQ ID NO: 497462 - DNA, 25 bp, Homo sapien
ggaaaaatctttctcaagcctctcc

SEQ ID NO: 497463 - DNA, 25 bp, Homo sapien
aaaaatctttctcaagcctctccag

SEQ ID NO: 497464 - DNA, 25 bp, Homo sapien
ctagggcgggcttctctctctggac

SEQ ID NO: 497465 - DNA, 25 bp, Homo sapien
cagatttggggctccgaggccacag

SEQ ID NO: 497466 - DNA, 25 bp, Homo sapien
gagacgccgggcaggtcccagcgcg

SEQ ID NO: 497467 - DNA, 25 bp, Homo sapien
aggtcccagcgcgtgagccaaagtc

SEQ ID NO: 497468 - DNA, 25 bp, Homo sapien
gtcccagcgcgtgagccaaagtcgg

SEQ ID NO: 497469 - DNA, 25 bp, Homo sapien
cccagcgcgtgagccaaagtcggag

SEQ ID NO: 497470 - DNA, 25 bp, Homo sapien
tcagggaggtcctccgagccgtgac

SEQ ID NO: 497471 - DNA, 25 bp, Homo sapien
tccgagccgtgaccggagacatctg

SEQ ID NO: 497472 - DNA, 25 bp, Homo sapien
cagaaggcatggattgaggaagcaa

SEQ ID NO: 497473 - DNA, 25 bp, Homo sapien
ttgaggaagcaatctgggaaaggtt

SEQ ID NO: 497474 - DNA, 25 bp, Homo sapien
aagaattgccagagtcttggtcaag

SEQ ID NO: 497475 - DNA, 25 bp, Homo sapien
ctagcaagccaccctgcagaggtcg

SEQ ID NO: 497476 - DNA, 25 bp, Homo sapien
actcttgggaggaagctctctaact

SEQ ID NO: 497477 - DNA, 25 bp, Homo sapien
ggaagctctctaactggagggctat

SEQ ID NO: 497478 - DNA, 25 bp, Homo sapien
taactggagggctatcatttacaaa

SEQ ID NO: 497479 - DNA, 25 bp, Homo sapien
gggctatcatttacaaagccatgat

SEQ ID NO: 497480 - DNA, 25 bp, Homo sapien
aagccatgatactataaacactgag

SEQ ID NO: 497481 - DNA, 25 bp, Homo sapien
aaacactgagtattgagttaacaaa

SEQ ID NO: 497482 - DNA, 25 bp, Homo sapien
aaattgtaagactagtgtgttgaga

SEQ ID NO: 497483 - DNA, 25 bp, Homo sapien
atgaatggtttcaacggtgctatat

SEQ ID NO: 497484 - DNA, 25 bp, Homo sapien
aacggtgctatattaggttctctga

SEQ ID NO: 497485 - DNA, 25 bp, Homo sapien
gctatattaggttctctgattttca

SEQ ID NO: 497486 - DNA, 25 bp, Homo sapien
attaggttctctgattttcatgacc

SEQ ID NO: 497487 - DNA, 25 bp, Homo sapien
ttctctgattttcatgacctatgta

SEQ ID NO: 497488 - DNA, 25 bp, Homo sapien
tttcatgacctatgtatgtttggaa

SEQ ID NO: 497489 - DNA, 25 bp, Homo sapien
taaaatgtggatcgttttgttaccg

SEQ ID NO: 497490 - DNA, 25 bp, Homo sapien
atgtggatcgttttgttaccgattt

SEQ ID NO: 497491 - DNA, 25 bp, Homo sapien
tgttaccgatttaatattgccattt

SEQ ID NO: 497492 - DNA, 25 bp, Homo sapien
tgccattttaatttggtgtaacaat

SEQ ID NO: 497493 - DNA, 25 bp, Homo sapien
gtttttcaaagctatcctttgagga

SEQ ID NO: 497494 - DNA, 25 bp, Homo sapien
ccttgtttgtgcattccgttagtgt

SEQ ID NO: 497495 - DNA, 25 bp, Homo sapien
tgtttgtgcattccgttagtgtgct

SEQ ID NO: 497496 - DNA, 25 bp, Homo sapien
ttgtgcattccgttagtgtgctggg

SEQ ID NO: 497497 - DNA, 25 bp, Homo sapien
gtgttggataggactgatcccacct

SEQ ID NO: 497498 - DNA, 25 bp, Homo sapien
gttggataggactgatcccacctgc

SEQ ID NO: 497499 - DNA, 25 bp, Homo sapien
tggataggactgatcccacctgccc

SEQ ID NO: 497500 - DNA, 25 bp, Homo sapien
gctgggtcactgaggccgccccttt

SEQ ID NO: 497501 - DNA, 25 bp, Homo sapien
gaggccgcccctttctcaagagcgt

SEQ ID NO: 497502 - DNA, 25 bp, Homo sapien
ccctttctcaagagcgtctttgctt

SEQ ID NO: 497503 - DNA, 25 bp, Homo sapien
tttctcaagagcgtctttgcttcct

SEQ ID NO: 497504 - DNA, 25 bp, Homo sapien
tcaagagcgtctttgcttcctcctc

SEQ ID NO: 497505 - DNA, 25 bp, Homo sapien
tgcacactttacagcagcttccttt

SEQ ID NO: 497506 - DNA, 25 bp, Homo sapien
ttacagcagcttcctttctttccat

SEQ ID NO: 497507 - DNA, 25 bp, Homo sapien
gcactgcctagttaacagaagtctt

SEQ ID NO: 497508 - DNA, 25 bp, Homo sapien
gtaaaatggcattagatggctctat

SEQ ID NO: 497509 - DNA, 25 bp, Homo sapien
ggcattagatggctctatatttttt

SEQ ID NO: 497510 - DNA, 25 bp, Homo sapien
aagctatgtaattgttcagcgtcac

SEQ ID NO: 497511 - DNA, 25 bp, Homo sapien
aattgttcagcgtcacttttctaag

SEQ ID NO: 497512 - DNA, 25 bp, Homo sapien
gttcagcgtcacttttctaagtact

SEQ ID NO: 497513 - DNA, 25 bp, Homo sapien
gcgtcacttttctaagtacttatac

SEQ ID NO: 497514 - DNA, 25 bp, Homo sapien
aagtacttatacatatctaaacatg

SEQ ID NO: 497515 - DNA, 25 bp, Homo sapien
tatgctgggctggattaagctttgt

SEQ ID NO: 497516 - DNA, 25 bp, Homo sapien
tttctattaccttcaccatagtcat

SEQ ID NO: 497517 - DNA, 25 bp, Homo sapien
ttaccttcaccatagtcattctttc

SEQ ID NO: 497518 - DNA, 25 bp, Homo sapien
cttcaccatagtcattctttcctta

SEQ ID NO: 497519 - DNA, 25 bp, Homo sapien
tcaccatagtcattctttccttacg

SEQ ID NO: 497520 - DNA, 25 bp, Homo sapien
accatagtcattctttccttacgca

SEQ ID NO: 497521 - DNA, 25 bp, Homo sapien
catagtcattctttccttacgcaaa

SEQ ID NO: 497522 - DNA, 25 bp, Homo sapien
agtcattctttccttacgcaaagcc

SEQ ID NO: 497523 - DNA, 25 bp, Homo sapien
attctttccttacgcaaagcccaag

SEQ ID NO: 497524 - DNA, 25 bp, Homo sapien
tctttccttacgcaaagcccaagga

SEQ ID NO: 497525 - DNA, 25 bp, Homo sapien
ttacgcaaagcccaaggaatgagct

SEQ ID NO: 497526 - DNA, 25 bp, Homo sapien
aagcccaaggaatgagctgctgcta

SEQ ID NO: 497527 - DNA, 25 bp, Homo sapien
aaaatgtctgaacttcgcctctact

SEQ ID NO: 497528 - DNA, 25 bp, Homo sapien
gaacttcgcctctactgtgacctct

SEQ ID NO: 497529 - DNA, 25 bp, Homo sapien
attcatctcctagtgcagagaacat

SEQ ID NO: 497530 - DNA, 25 bp, Homo sapien
tgaatgaagcctcttctctgcttag

SEQ ID NO: 497531 - DNA, 25 bp, Homo sapien
cttctctgcttagtgccacgtgtaa

SEQ ID NO: 497532 - DNA, 25 bp, Homo sapien
acattcatcacaacgcttgaggaat

SEQ ID NO: 497533 - DNA, 25 bp, Homo sapien
gaatgtgtgaagatagccaatgcca

SEQ ID NO: 497534 - DNA, 25 bp, Homo sapien
gaagatagccaatgccaagtttaaa

SEQ ID NO: 497535 - DNA, 25 bp, Homo sapien
gccaagtttaaacctgagatgtttc

SEQ ID NO: 497536 - DNA, 25 bp, Homo sapien
acctgagatgtttcaactgcaccat

SEQ ID NO: 497537 - DNA, 25 bp, Homo sapien
agatgtttcaactgcaccatccgga

SEQ ID NO: 497538 - DNA, 25 bp, Homo sapien
catatcctttatggtttcagtgggc

SEQ ID NO: 497539 - DNA, 25 bp, Homo sapien
ctccaggctctggaactttatccaa

SEQ ID NO: 497540 - DNA, 25 bp, Homo sapien
ttatccaagtaagtggtcaagtctt

SEQ ID NO: 497541 - DNA, 25 bp, Homo sapien
ggtcaagtcttgatcgacatgttca

SEQ ID NO: 497542 - DNA, 25 bp, Homo sapien
agttagtttggtttctctgtctgtt

SEQ ID NO: 497543 - DNA, 25 bp, Homo sapien
tgtctgttcgtgacactgtgcacac

SEQ ID NO: 497544 - DNA, 25 bp, Homo sapien
tgtgcacacatcaaacaacctgacc

SEQ ID NO: 497545 - DNA, 25 bp, Homo sapien
ggtgctcgaaggtctccaggtgcct

SEQ ID NO: 497546 - DNA, 25 bp, Homo sapien
atcgcgatgcactactcggtgtgaa

SEQ ID NO: 497547 - DNA, 25 bp, Homo sapien
gaaagtccagacctcggagaagctg

SEQ ID NO: 497548 - DNA, 25 bp, Homo sapien
gagaagctgaaacatcatatccttt

SEQ ID NO: 497549 - DNA, 25 bp, Homo sapien
gaggtagtctctccaaacatgctca

SEQ ID NO: 497550 - DNA, 25 bp, Homo sapien
caaacatgctcacgtggatggtgcc

SEQ ID NO: 497551 - DNA, 25 bp, Homo sapien
gccaggaagcccctaggcaagtaaa

SEQ ID NO: 497552 - DNA, 25 bp, Homo sapien
acttctttggaagcctcaaatcact

SEQ ID NO: 497553 - DNA, 25 bp, Homo sapien
gcctcaaatcactttagcctcaaat

SEQ ID NO: 497554 - DNA, 25 bp, Homo sapien
agcctcaaataaaccttgacaccca

SEQ ID NO: 497555 - DNA, 25 bp, Homo sapien
ggtatcaggcaacccaccaaggcca

SEQ ID NO: 497556 - DNA, 25 bp, Homo sapien
aaggccatatatatctccgggttgc

SEQ ID NO: 497557 - DNA, 25 bp, Homo sapien
atatctccgggttgctgtggaaaaa

SEQ ID NO: 497558 - DNA, 25 bp, Homo sapien
gacagagtttcctaatccagacatt

SEQ ID NO: 497559 - DNA, 25 bp, Homo sapien
gaaacactaagtggtaccctcccat

SEQ ID NO: 497560 - DNA, 25 bp, Homo sapien
cacctattccacagagactgattta

SEQ ID NO: 497561 - DNA, 25 bp, Homo sapien
acctattccacagagactgatttat

SEQ ID NO: 497562 - DNA, 25 bp, Homo sapien
cctattccacagagactgatttata

SEQ ID NO: 497563 - DNA, 25 bp, Homo sapien
attccacagagactgatttataggg

SEQ ID NO: 497564 - DNA, 25 bp, Homo sapien
gactgatttatagggggcagcactt

SEQ ID NO: 497565 - DNA, 25 bp, Homo sapien
tttctggaaacccaagttctctttg

SEQ ID NO: 497566 - DNA, 25 bp, Homo sapien
ttctggaaacccaagttctctttga

SEQ ID NO: 497567 - DNA, 25 bp, Homo sapien
tctggaaacccaagttctctttgac

SEQ ID NO: 497568 - DNA, 25 bp, Homo sapien
ctggaaacccaagttctctttgact

SEQ ID NO: 497569 - DNA, 25 bp, Homo sapien
tggaaacccaagttctctttgactc

SEQ ID NO: 497570 - DNA, 25 bp, Homo sapien
tttagaggagggagttaccagggag

SEQ ID NO: 497571 - DNA, 25 bp, Homo sapien
tgggcagttccaggcttatagtcat

SEQ ID NO: 497572 - DNA, 25 bp, Homo sapien
cattattccctaacaaacggtcaag

SEQ ID NO: 497573 - DNA, 25 bp, Homo sapien
aacggtcaagacttaggctgcccaa

SEQ ID NO: 497574 - DNA, 25 bp, Homo sapien
aagactctactacccttgtagtcaa

SEQ ID NO: 497575 - DNA, 25 bp, Homo sapien
tcaaaaatccaaccaccttgacctt

SEQ ID NO: 497576 - DNA, 25 bp, Homo sapien
ttgacctttacctcattatctgacc

SEQ ID NO: 497577 - DNA, 25 bp, Homo sapien
atctgaccctttagcatggagtcct

SEQ ID NO: 497578 - DNA, 25 bp, Homo sapien
gagactgacttcatgcataatccat

SEQ ID NO: 497579 - DNA, 25 bp, Homo sapien
gcataatccataaagccaggttttc

SEQ ID NO: 497580 - DNA, 25 bp, Homo sapien
aaggtgacctgctttcttgtattcc

SEQ ID NO: 497581 - DNA, 25 bp, Homo sapien
cttgtattcctgcaagtacacggca

SEQ ID NO: 497582 - DNA, 25 bp, Homo sapien
acagtcatcttattacctgccaggg

SEQ ID NO: 497583 - DNA, 25 bp, Homo sapien
tcatctagccatggcaatgtttgcc

SEQ ID NO: 497584 - DNA, 25 bp, Homo sapien
aagcctttctttgttggatcaaata

SEQ ID NO: 497585 - DNA, 25 bp, Homo sapien
tacactattacacttccacactatt

SEQ ID NO: 497586 - DNA, 25 bp, Homo sapien
tagcctagtagttcagctacctgat

SEQ ID NO: 497587 - DNA, 25 bp, Homo sapien
tgccccattcttttagaagcacatg

SEQ ID NO: 497588 - DNA, 25 bp, Homo sapien
tagaagcacatgtctgccaaggagt

SEQ ID NO: 497589 - DNA, 25 bp, Homo sapien
ctgccaaggagtggtttgtactgct

SEQ ID NO: 497590 - DNA, 25 bp, Homo sapien
actgctgtgtttggtacatctagtc

SEQ ID NO: 497591 - DNA, 25 bp, Homo sapien
ttctgctataagttttccttacctg

SEQ ID NO: 497592 - DNA, 25 bp, Homo sapien
ttccttacctgtcctttagtgtaga

SEQ ID NO: 497593 - DNA, 25 bp, Homo sapien
tgtcagggacccatgcacaaatgta

SEQ ID NO: 497594 - DNA, 25 bp, Homo sapien
gggacccatgcacaaatgtagcctt

SEQ ID NO: 497595 - DNA, 25 bp, Homo sapien
gacccatgcacaaatgtagcctttt

SEQ ID NO: 497596 - DNA, 25 bp, Homo sapien
tgcacaaatgtagcctttttgatgc

SEQ ID NO: 497597 - DNA, 25 bp, Homo sapien
ttgatgcttgagaaagaatgccttt

SEQ ID NO: 497598 - DNA, 25 bp, Homo sapien
aagaatgcctttttgacttccgtga

SEQ ID NO: 497599 - DNA, 25 bp, Homo sapien
gaatgcctttttgacttccgtgaat

SEQ ID NO: 497600 - DNA, 25 bp, Homo sapien
atgcctttttgacttccgtgaataa

SEQ ID NO: 497601 - DNA, 25 bp, Homo sapien
gcctttttgacttccgtgaataaag

SEQ ID NO: 497602 - DNA, 25 bp, Homo sapien
gaataaagaataagtcacggctaat

SEQ ID NO: 497603 - DNA, 25 bp, Homo sapien
gtcacggctaatgagtaagtaacag

SEQ ID NO: 497604 - DNA, 25 bp, Homo sapien
aagcgcagccagttctgcatgtgca

SEQ ID NO: 497605 - DNA, 25 bp, Homo sapien
ggttgagggccttgtagtccacatt

SEQ ID NO: 497606 - DNA, 25 bp, Homo sapien
ttgtagtccacattgagcctgccat

SEQ ID NO: 497607 - DNA, 25 bp, Homo sapien
gcaccaggaactcctcgatggacgg

SEQ ID NO: 497608 - DNA, 25 bp, Homo sapien
aagcattgatctgcggcgacagctt

SEQ ID NO: 497609 - DNA, 25 bp, Homo sapien
gtgcttctgcatgtggttgtagaac

SEQ ID NO: 497610 - DNA, 25 bp, Homo sapien
tgtagtcagatagcacgcgctccga

SEQ ID NO: 497611 - DNA, 25 bp, Homo sapien
tgcggcgacagctttaggaacctct

SEQ ID NO: 497612 - DNA, 25 bp, Homo sapien
ttaggaacctctcgaccttttggat

SEQ ID NO: 497613 - DNA, 25 bp, Homo sapien
ctcgaccttttggatctcagggaag

SEQ ID NO: 497614 - DNA, 25 bp, Homo sapien
aggcggtcgccgtccacaatgtgga

SEQ ID NO: 497615 - DNA, 25 bp, Homo sapien
tcagctgcatcccttgtgcacagaa

SEQ ID NO: 497616 - DNA, 25 bp, Homo sapien
tgcacagaactgtttgccagcgttg

SEQ ID NO: 497617 - DNA, 25 bp, Homo sapien
tttgccagcgttgggtgggacaccc

SEQ ID NO: 497618 - DNA, 25 bp, Homo sapien
agacctcccttctgtggactgacct

SEQ ID NO: 497619 - DNA, 25 bp, Homo sapien
gataagcatgtgaaggagggccaac

SEQ ID NO: 497620 - DNA, 25 bp, Homo sapien
caactggcagctgcgggacccttgg

SEQ ID NO: 497621 - DNA, 25 bp, Homo sapien
ccacctgctgggtgaggacgagact

SEQ ID NO: 497622 - DNA, 25 bp, Homo sapien
ggtgaggacgagactgtttccatct

SEQ ID NO: 497623 - DNA, 25 bp, Homo sapien
tgtttccatctcaggcatgtatccc

SEQ ID NO: 497624 - DNA, 25 bp, Homo sapien
atctcaggcatgtatcccaccaagt

SEQ ID NO: 497625 - DNA, 25 bp, Homo sapien
aggcatgtatcccaccaagtgcctc

SEQ ID NO: 497626 - DNA, 25 bp, Homo sapien
tttatgatgtactaaaagccacagt

SEQ ID NO: 497627 - DNA, 25 bp, Homo sapien
gatgtactaaaagccacagtatgtg

SEQ ID NO: 497628 - DNA, 25 bp, Homo sapien
aagccacagtatgtggcaactgcaa

SEQ ID NO: 497629 - DNA, 25 bp, Homo sapien
gtggcaactgcaaaaggatcaggaa

SEQ ID NO: 497630 - DNA, 25 bp, Homo sapien
ggaatttagggtatgatctcggtca

SEQ ID NO: 497631 - DNA, 25 bp, Homo sapien
tagggtatgatctcggtcacgtgtc

SEQ ID NO: 497632 - DNA, 25 bp, Homo sapien
tatgatctcggtcacgtgtcccggg

SEQ ID NO: 497633 - DNA, 25 bp, Homo sapien
ctcggtcacgtgtcccgggcgctga

SEQ ID NO: 497634 - DNA, 25 bp, Homo sapien
gggttctcttgatgtaatgaaatgc

SEQ ID NO: 497635 - DNA, 25 bp, Homo sapien
agcatattttgatttgccatcaaga

SEQ ID NO: 497636 - DNA, 25 bp, Homo sapien
ttttgatttgccatcaagagcaata

SEQ ID NO: 497637 - DNA, 25 bp, Homo sapien
gagcacctgctcaagagtcagggac

SEQ ID NO: 497638 - DNA, 25 bp, Homo sapien
gtcagggacacacgcatcactaaat

SEQ ID NO: 497639 - DNA, 25 bp, Homo sapien
gatgtttgaggctgtactcccagga

SEQ ID NO: 497640 - DNA, 25 bp, Homo sapien
gcatcactaaatgcaagttcccagg

SEQ ID NO: 497641 - DNA, 25 bp, Homo sapien
ggaggacctggcaagctgcactctt

SEQ ID NO: 497642 - DNA, 25 bp, Homo sapien
tgtactcccaggatcctgtggaatt

SEQ ID NO: 497643 - DNA, 25 bp, Homo sapien
agactccggcaagcacggctcagag

SEQ ID NO: 497644 - DNA, 25 bp, Homo sapien
aagcacggctcagagagtggactcg

SEQ ID NO: 497645 - DNA, 25 bp, Homo sapien
gtggaattggatgttctctccctgc

SEQ ID NO: 497646 - DNA, 25 bp, Homo sapien
tgccacagcccttgtcaatgatatt

SEQ ID NO: 497647 - DNA, 25 bp, Homo sapien
atgatatttcacagagaccctggga

SEQ ID NO: 497648 - DNA, 25 bp, Homo sapien
atagaaaaccaccaccacggacctg

SEQ ID NO: 497649 - DNA, 25 bp, Homo sapien
caggtccagaccaaatacaagatca

SEQ ID NO: 497650 - DNA, 25 bp, Homo sapien
aaatacaagatcagcaccacaccgt

SEQ ID NO: 497651 - DNA, 25 bp, Homo sapien
tacaagatcagcaccacaccgtggt

SEQ ID NO: 497652 - DNA, 25 bp, Homo sapien
aattcaatgctgttgggttcgattc

SEQ ID NO: 497653 - DNA, 25 bp, Homo sapien
aatgctgttgggttcgattctgaga

SEQ ID NO: 497654 - DNA, 25 bp, Homo sapien
tcgattctgagagtagatttttcca

SEQ ID NO: 497655 - DNA, 25 bp, Homo sapien
agatttttccagacatgtctttcag

SEQ ID NO: 497656 - DNA, 25 bp, Homo sapien
gacatgtctttcaggtgaccctcaa

SEQ ID NO: 497657 - DNA, 25 bp, Homo sapien
gaaactgattaccactcatagggac

SEQ ID NO: 497658 - DNA, 25 bp, Homo sapien
ttaccactcatagggacaaaccgag

SEQ ID NO: 497659 - DNA, 25 bp, Homo sapien
cgggacccctgcacttcagtggata

SEQ ID NO: 497660 - DNA, 25 bp, Homo sapien
gatatagcagtgtgccagatgggaa

SEQ ID NO: 497661 - DNA, 25 bp, Homo sapien
gatgggaagccgctggtccgcgagc

SEQ ID NO: 497662 - DNA, 25 bp, Homo sapien
tgccgcagctgtgccgtggtgtcca

SEQ ID NO: 497663 - DNA, 25 bp, Homo sapien
tcaggcctgggtgctgagatcgaca

SEQ ID NO: 497664 - DNA, 25 bp, Homo sapien
ctgagatcgacagtgccgagtgcgt

SEQ ID NO: 497665 - DNA, 25 bp, Homo sapien
gacagtgccgagtgcgtgttccgca

SEQ ID NO: 497666 - DNA, 25 bp, Homo sapien
tgcgtgttccgcatgaaccaggcgc

SEQ ID NO: 497667 - DNA, 25 bp, Homo sapien
ccaccgtgggctttgaggcggatgt

SEQ ID NO: 497668 - DNA, 25 bp, Homo sapien
tgcgtgtcgtctcacacacaagcgt

SEQ ID NO: 497669 - DNA, 25 bp, Homo sapien
tgtcgtctcacacacaagcgtgccg

SEQ ID NO: 497670 - DNA, 25 bp, Homo sapien
tccttgggttcgtgaatgtacagaa

SEQ ID NO: 497671 - DNA, 25 bp, Homo sapien
aagactgtcatgctgtcatcatggc

SEQ ID NO: 497672 - DNA, 25 bp, Homo sapien
atgctgtcatcatggctggatctga

SEQ ID NO: 497673 - DNA, 25 bp, Homo sapien
gctggatctgatacggccaccgtgg

SEQ ID NO: 497674 - DNA, 25 bp, Homo sapien
accgtggaccttgaggtgacctcgg

SEQ ID NO: 497675 - DNA, 25 bp, Homo sapien
gacctcgggaatggagacagtgcat

SEQ ID NO: 497676 - DNA, 25 bp, Homo sapien
cctgggtttctgaagaccctgtaag

SEQ ID NO: 497677 - DNA, 25 bp, Homo sapien
ccctgtaagacagatctccttgcag

SEQ ID NO: 497678 - DNA, 25 bp, Homo sapien
ctgactgcccacattagggctttta

SEQ ID NO: 497679 - DNA, 25 bp, Homo sapien
ggtgaagttaccttgcattgtcata

SEQ ID NO: 497680 - DNA, 25 bp, Homo sapien
caattgctatttgtggtgtcttgca

SEQ ID NO: 497681 - DNA, 25 bp, Homo sapien
gggcagctgcagaacacgctgcatg

SEQ ID NO: 497682 - DNA, 25 bp, Homo sapien
cgggctgggccatgagatccgcact

SEQ ID NO: 497683 - DNA, 25 bp, Homo sapien
atgagatccgcactggcgtccgcac

SEQ ID NO: 497684 - DNA, 25 bp, Homo sapien
tggaggtgggcatcgccaagcacat

SEQ ID NO: 497685 - DNA, 25 bp, Homo sapien
gggcatcgccaagcacatccagaaa

SEQ ID NO: 497686 - DNA, 25 bp, Homo sapien
acatccagaaactggtgggcgtcag

SEQ ID NO: 497687 - DNA, 25 bp, Homo sapien
tcagggagtctgtcctgcctgagga

SEQ ID NO: 497688 - DNA, 25 bp, Homo sapien
agtctgtcctgcctgaggatgccat

SEQ ID NO: 497689 - DNA, 25 bp, Homo sapien
ccattctgcccctgatgaagttcct

SEQ ID NO: 497690 - DNA, 25 bp, Homo sapien
ggaggtggagctttgctacatgaac

SEQ ID NO: 497691 - DNA, 25 bp, Homo sapien
tttgctacatgaacaccaacttggt

SEQ ID NO: 497692 - DNA, 25 bp, Homo sapien
aggtgagcactttccccgctcacat

SEQ ID NO: 497693 - DNA, 25 bp, Homo sapien
tttccccgctcacattcaggatagg

SEQ ID NO: 497694 - DNA, 25 bp, Homo sapien
cgctcacattcaggatagggcgagg

SEQ ID NO: 497695 - DNA, 25 bp, Homo sapien
ggttggtaccgattcaccctcaggg

SEQ ID NO: 497696 - DNA, 25 bp, Homo sapien
cgattcaccctcagggcctagattt

SEQ ID NO: 497697 - DNA, 25 bp, Homo sapien
gggcttcagcttgctgcagataggt

SEQ ID NO: 497698 - DNA, 25 bp, Homo sapien
cttcagcttgctgcagataggtgct

SEQ ID NO: 497699 - DNA, 25 bp, Homo sapien
tgcagataggtgctcccttcactct

SEQ ID NO: 497700 - DNA, 25 bp, Homo sapien
acctgagccccgtaagcctggactg

SEQ ID NO: 497701 - DNA, 25 bp, Homo sapien
agcactgggtgcttggcgctcacga

SEQ ID NO: 497702 - DNA, 25 bp, Homo sapien
gcttggcgctcacgaccttcctggg

SEQ ID NO: 497703 - DNA, 25 bp, Homo sapien
ccctatatttcctggaccagctaaa

SEQ ID NO: 497704 - DNA, 25 bp, Homo sapien
ggaccagctaaagtccagtgtttcc

SEQ ID NO: 497705 - DNA, 25 bp, Homo sapien
tccttcttcattcacaaagctcttc

SEQ ID NO: 497706 - DNA, 25 bp, Homo sapien
attcacaaagctcttcttccctggg

SEQ ID NO: 497707 - DNA, 25 bp, Homo sapien
tgggccctggtatgtatgcctttct

SEQ ID NO: 497708 - DNA, 25 bp, Homo sapien
tttctctcctactgtctaatagcac

SEQ ID NO: 497709 - DNA, 25 bp, Homo sapien
aatagcacctcgtaaattgtcaatg

SEQ ID NO: 497710 - DNA, 25 bp, Homo sapien
ggtattcttgaattcccaactagat

SEQ ID NO: 497711 - DNA, 25 bp, Homo sapien
ctagattgtgagcttctggaagaca

SEQ ID NO: 497712 - DNA, 25 bp, Homo sapien
atgtctttgattgttgtctccccta

SEQ ID NO: 497713 - DNA, 25 bp, Homo sapien
accacagcccagtactttagttaca

SEQ ID NO: 497714 - DNA, 25 bp, Homo sapien
acatggcagggttagagaataaaaa

SEQ ID NO: 497715 - DNA, 25 bp, Homo sapien
gaacgtggtgtttgaagcaaaacag

SEQ ID NO: 497716 - DNA, 25 bp, Homo sapien
gtgtttgaagcaaaacagatctgta

SEQ ID NO: 497717 - DNA, 25 bp, Homo sapien
cttttatcagatgttgttgccttgt

SEQ ID NO: 497718 - DNA, 25 bp, Homo sapien
ttatcagatgttgttgccttgtgca

SEQ ID NO: 497719 - DNA, 25 bp, Homo sapien
atcagatgttgttgccttgtgcaaa

SEQ ID NO: 497720 - DNA, 25 bp, Homo sapien
taacatgcggagaataatacttata

SEQ ID NO: 497721 - DNA, 25 bp, Homo sapien
cttatatttgtggtagtagtgtgaa

SEQ ID NO: 497722 - DNA, 25 bp, Homo sapien
atttgtggtagtagtgtgaacatta

SEQ ID NO: 497723 - DNA, 25 bp, Homo sapien
gtatgtgaagtaccattcgagtggt

SEQ ID NO: 497724 - DNA, 25 bp, Homo sapien
gtgaagtaccattcgagtggtgaat

SEQ ID NO: 497725 - DNA, 25 bp, Homo sapien
aggtggaggcccatcactcgctggt

SEQ ID NO: 497726 - DNA, 25 bp, Homo sapien
aggcccatcactcgctggtgctcag

SEQ ID NO: 497727 - DNA, 25 bp, Homo sapien
tcgctggtgctcagccacctcaaga

SEQ ID NO: 497728 - DNA, 25 bp, Homo sapien
ggtgctcagccacctcaagactctg

SEQ ID NO: 497729 - DNA, 25 bp, Homo sapien
tctgctctggaagaagatctccaac

SEQ ID NO: 497730 - DNA, 25 bp, Homo sapien
gaagaagatctccaacaccaagtac

SEQ ID NO: 497731 - DNA, 25 bp, Homo sapien
agaagatctccaacaccaagtactc

SEQ ID NO: 497732 - DNA, 25 bp, Homo sapien
gatctccaacaccaagtactcttga

SEQ ID NO: 497733 - DNA, 25 bp, Homo sapien
tccaacaccaagtactcttgatggg

SEQ ID NO: 497734 - DNA, 25 bp, Homo sapien
tgcgcacctgtaccacgctgagcgg

SEQ ID NO: 497735 - DNA, 25 bp, Homo sapien
tgtaccacgctgagcgggctggcca

SEQ ID NO: 497736 - DNA, 25 bp, Homo sapien
attgtcttagaattgattgccagaa

SEQ ID NO: 497737 - DNA, 25 bp, Homo sapien
gattgccagaaattgcaagatgtaa

SEQ ID NO: 497738 - DNA, 25 bp, Homo sapien
atatcaaagtcagggatgaggagca

SEQ ID NO: 497739 - DNA, 25 bp, Homo sapien
gaggagcaggaggactattcaagat

SEQ ID NO: 497740 - DNA, 25 bp, Homo sapien
ttcaagataaacttctgtaacctat

SEQ ID NO: 497741 - DNA, 25 bp, Homo sapien
attacaaatggatctgaaatgtcag

SEQ ID NO: 497742 - DNA, 25 bp, Homo sapien
tgaaatgtcagttctagtatttaga

SEQ ID NO: 497743 - DNA, 25 bp, Homo sapien
gttctagtatttagagagacttctc

SEQ ID NO: 497744 - DNA, 25 bp, Homo sapien
gagacttctctaataataccgggtg

SEQ ID NO: 497745 - DNA, 25 bp, Homo sapien
ataataccgggtgatattatctttg

SEQ ID NO: 497746 - DNA, 25 bp, Homo sapien
gagtattgtgaactttctcggaaat

SEQ ID NO: 497747 - DNA, 25 bp, Homo sapien
gctggtcagccccctaggacctgag

SEQ ID NO: 497748 - DNA, 25 bp, Homo sapien
acctgagccccgtaagcctggactg

SEQ ID NO: 497749 - DNA, 25 bp, Homo sapien
agcagcactgggtgcttggcgctca

SEQ ID NO: 497750 - DNA, 25 bp, Homo sapien
gcagcactgggtgcttggcgctcac

SEQ ID NO: 497751 - DNA, 25 bp, Homo sapien
agcactgggtgcttggcgctcacga

SEQ ID NO: 497752 - DNA, 25 bp, Homo sapien
gcactgggtgcttggcgctcacgac

SEQ ID NO: 497753 - DNA, 25 bp, Homo sapien
gggtgcttggcgctcacgaccttcc

SEQ ID NO: 497754 - DNA, 25 bp, Homo sapien
ggtgcttggcgctcacgaccttcct

SEQ ID NO: 497755 - DNA, 25 bp, Homo sapien
tgcttggcgctcacgaccttcctgg

SEQ ID NO: 497756 - DNA, 25 bp, Homo sapien
gcttggcgctcacgaccttcctggg

SEQ ID NO: 497757 - DNA, 25 bp, Homo sapien
gctcacgaccttcctgggcccctgg

SEQ ID NO: 497758 - DNA, 25 bp, Homo sapien
actggttgagtccagagatgcctga

SEQ ID NO: 497759 - DNA, 25 bp, Homo sapien
gaaccttgcaaactttcctcattac

SEQ ID NO: 497760 - DNA, 25 bp, Homo sapien
gaaggagcttatctgccatttccta

SEQ ID NO: 497761 - DNA, 25 bp, Homo sapien
ctgccatttcctacacatgtgacat

SEQ ID NO: 497762 - DNA, 25 bp, Homo sapien
acacatgtgacatatggagaagcat

SEQ ID NO: 497763 - DNA, 25 bp, Homo sapien
aagcatgatcagctacttcacagtc

SEQ ID NO: 497764 - DNA, 25 bp, Homo sapien
tacttcacagtctctgcctttactc

SEQ ID NO: 497765 - DNA, 25 bp, Homo sapien
tttactctgcctccgcatacaatgg

SEQ ID NO: 497766 - DNA, 25 bp, Homo sapien
tctgcctccgcatacaatggctcag

SEQ ID NO: 497767 - DNA, 25 bp, Homo sapien
atggctcagccaactagcctaacga

SEQ ID NO: 497768 - DNA, 25 bp, Homo sapien
gtgaagctcagctctagatgaacaa

SEQ ID NO: 497769 - DNA, 25 bp, Homo sapien
tagacactaacttagttccaggttc

SEQ ID NO: 497770 - DNA, 25 bp, Homo sapien
agacactaacttagttccaggttcg

SEQ ID NO: 497771 - DNA, 25 bp, Homo sapien
gacactaacttagttccaggttcgg

SEQ ID NO: 497772 - DNA, 25 bp, Homo sapien
cactaacttagttccaggttcggtg

SEQ ID NO: 497773 - DNA, 25 bp, Homo sapien
acttagttccaggttcggtgccctg

SEQ ID NO: 497774 - DNA, 25 bp, Homo sapien
ccaatagcttaggtcccatggtggg

SEQ ID NO: 497775 - DNA, 25 bp, Homo sapien
attgtcaaaacagtgaggaaacatt

SEQ ID NO: 497776 - DNA, 25 bp, Homo sapien
ttgtcaaaacagtgaggaaacatta

SEQ ID NO: 497777 - DNA, 25 bp, Homo sapien
tgtcaaaacagtgaggaaacattaa

SEQ ID NO: 497778 - DNA, 25 bp, Homo sapien
gtcaaaacagtgaggaaacattaaa

SEQ ID NO: 497779 - DNA, 25 bp, Homo sapien
tcaaaacagtgaggaaacattaaaa

SEQ ID NO: 497780 - DNA, 25 bp, Homo sapien
aagcccagtgaccttactcgtatac

SEQ ID NO: 497781 - DNA, 25 bp, Homo sapien
gtgaccttactcgtataccgtgcca

SEQ ID NO: 497782 - DNA, 25 bp, Homo sapien
ttccaagtcctttaactcgttgcag

SEQ ID NO: 497783 - DNA, 25 bp, Homo sapien
actcgttgcagtctgtattttccac

SEQ ID NO: 497784 - DNA, 25 bp, Homo sapien
tcttctttgtggtctttttcctgaa

SEQ ID NO: 497785 - DNA, 25 bp, Homo sapien
ccagtccttggctgtatccatgtaa

SEQ ID NO: 497786 - DNA, 25 bp, Homo sapien
tggctgtatccatgtaatgatcttg

SEQ ID NO: 497787 - DNA, 25 bp, Homo sapien
gtaatgatcttggaccatggtagaa

SEQ ID NO: 497788 - DNA, 25 bp, Homo sapien
ggatcatatgaattgctgtctagcc

SEQ ID NO: 497789 - DNA, 25 bp, Homo sapien
gaattgctgtctagccttagtcaat

SEQ ID NO: 497790 - DNA, 25 bp, Homo sapien
gtctagccttagtcaataaacttgt

SEQ ID NO: 497791 - DNA, 25 bp, Homo sapien
catctgagtttcaaatgattgccta

SEQ ID NO: 497792 - DNA, 25 bp, Homo sapien
gattgcctaatcttacctgtaatca

SEQ ID NO: 497793 - DNA, 25 bp, Homo sapien
acccattaatggtgtggtctaagga

SEQ ID NO: 497794 - DNA, 25 bp, Homo sapien
aagagatgagactggcgcatattaa

SEQ ID NO: 497795 - DNA, 25 bp, Homo sapien
gcgcatattaaagatgcctgctatg

SEQ ID NO: 497796 - DNA, 25 bp, Homo sapien
gcctgctatgatgatgtggctgtca

SEQ ID NO: 497797 - DNA, 25 bp, Homo sapien
tgtggctgtcatggctacattatca

SEQ ID NO: 497798 - DNA, 25 bp, Homo sapien
taaatgttttcccagaatgaatctc

SEQ ID NO: 497799 - DNA, 25 bp, Homo sapien
gaatgaatctctatctctcttttag

SEQ ID NO: 497800 - DNA, 25 bp, Homo sapien
atctctcttttagaaacatcccatt

SEQ ID NO: 497801 - DNA, 25 bp, Homo sapien
aacatcccattttgtaagaccaagg

SEQ ID NO: 497802 - DNA, 25 bp, Homo sapien
agctctggaggttggtatagtaata

SEQ ID NO: 497803 - DNA, 25 bp, Homo sapien
ggttggtatagtaatagctgaccta

SEQ ID NO: 497804 - DNA, 25 bp, Homo sapien
atagctgacctattactgcatttgg

SEQ ID NO: 497805 - DNA, 25 bp, Homo sapien
gctgacctattactgcatttgggag

SEQ ID NO: 497806 - DNA, 25 bp, Homo sapien
ctattactgcatttgggagggatct

SEQ ID NO: 497807 - DNA, 25 bp, Homo sapien
tttgggagggatctgtcatagcttc

SEQ ID NO: 497808 - DNA, 25 bp, Homo sapien
gagggatctgtcatagcttccttgc

SEQ ID NO: 497809 - DNA, 25 bp, Homo sapien
catagcttccttgcctcttaattaa

SEQ ID NO: 497810 - DNA, 25 bp, Homo sapien
gcttccttgcctcttaattaagggt

SEQ ID NO: 497811 - DNA, 25 bp, Homo sapien
ttgcctcttaattaagggtggtgtt

SEQ ID NO: 497812 - DNA, 25 bp, Homo sapien
tttttcttttagattcatgttacat

SEQ ID NO: 497813 - DNA, 25 bp, Homo sapien
atttccaaatacctatgcatacaca

SEQ ID NO: 497814 - DNA, 25 bp, Homo sapien
atgcatacacatcagctaaggtagg

SEQ ID NO: 497815 - DNA, 25 bp, Homo sapien
actaacgatgactcgacaatcaaat

SEQ ID NO: 497816 - DNA, 25 bp, Homo sapien
ttttttgaagcacattcggactatc

SEQ ID NO: 497817 - DNA, 25 bp, Homo sapien
gcacattcggactatcaaagactgg

SEQ ID NO: 497818 - DNA, 25 bp, Homo sapien
atattactacacaagaggtttcaac

SEQ ID NO: 497819 - DNA, 25 bp, Homo sapien
gaggtttcaacaaaagacgtggtgc

SEQ ID NO: 497820 - DNA, 25 bp, Homo sapien
aaaagacgtggtgcaatcgttgcat

SEQ ID NO: 497821 - DNA, 25 bp, Homo sapien
atcgttgcatagttcatattctcag

SEQ ID NO: 497822 - DNA, 25 bp, Homo sapien
catattctcagttcaattttctgat

SEQ ID NO: 497823 - DNA, 25 bp, Homo sapien
atggtttcttgattgcaatttggca

SEQ ID NO: 497824 - DNA, 25 bp, Homo sapien
gggacatgggtgttcctgcatctcc

SEQ ID NO: 497825 - DNA, 25 bp, Homo sapien
gacatgggtgttcctgcatctccta

SEQ ID NO: 497826 - DNA, 25 bp, Homo sapien
acatgggtgttcctgcatctcctag

SEQ ID NO: 497827 - DNA, 25 bp, Homo sapien
atgggtgttcctgcatctcctagcg

SEQ ID NO: 497828 - DNA, 25 bp, Homo sapien
gggtgttcctgcatctcctagcgca

SEQ ID NO: 497829 - DNA, 25 bp, Homo sapien
tgttcctgcatctcctagcgcagtt

SEQ ID NO: 497830 - DNA, 25 bp, Homo sapien
gttcctgcatctcctagcgcagttc

SEQ ID NO: 497831 - DNA, 25 bp, Homo sapien
cctgctggtgggtggaagggtgcct

SEQ ID NO: 497832 - DNA, 25 bp, Homo sapien
tggaagggtgcctggtttaggcggg

SEQ ID NO: 497833 - DNA, 25 bp, Homo sapien
gggcctgcaaagggcactgcctgtg

SEQ ID NO: 497834 - DNA, 25 bp, Homo sapien
cgtggtgtctgtgggaattggtcct

SEQ ID NO: 497835 - DNA, 25 bp, Homo sapien
aacagtgtcttctaggaagcccaga

SEQ ID NO: 497836 - DNA, 25 bp, Homo sapien
aggaagcccagacacatggagaagt

SEQ ID NO: 497837 - DNA, 25 bp, Homo sapien
tctgagtgttttggccgatagtccc

SEQ ID NO: 497838 - DNA, 25 bp, Homo sapien
atagtcccagatgaggttccagcaa

SEQ ID NO: 497839 - DNA, 25 bp, Homo sapien
aggttccagcaacagctgggatcac

SEQ ID NO: 497840 - DNA, 25 bp, Homo sapien
aaactaaaaatatcttccctcatgg

SEQ ID NO: 497841 - DNA, 25 bp, Homo sapien
taaaaatatcttccctcatggagtt

SEQ ID NO: 497842 - DNA, 25 bp, Homo sapien
cctcatggagtttatgttatagtaa

SEQ ID NO: 497843 - DNA, 25 bp, Homo sapien
ttatagtaagacatacgtgtacctc

SEQ ID NO: 497844 - DNA, 25 bp, Homo sapien
gacatacgtgtacctctataataac

SEQ ID NO: 497845 - DNA, 25 bp, Homo sapien
gtgtacctctataataactattacg

SEQ ID NO: 497846 - DNA, 25 bp, Homo sapien
tgagacagggtcgtgcccagatgat

SEQ ID NO: 497847 - DNA, 25 bp, Homo sapien
gatggagaaatcgacccagaagcct

SEQ ID NO: 497848 - DNA, 25 bp, Homo sapien
aatcgacccagaagcctgaggaggt

SEQ ID NO: 497849 - DNA, 25 bp, Homo sapien
accctggatgggaactgagcgaacc

SEQ ID NO: 497850 - DNA, 25 bp, Homo sapien
tgggaactgagcgaacccgggcctc

SEQ ID NO: 497851 - DNA, 25 bp, Homo sapien
gaacccgggcctccgctcagagaga

SEQ ID NO: 497852 - DNA, 25 bp, Homo sapien
ccgctcagagagacgtggcaggacc

SEQ ID NO: 497853 - DNA, 25 bp, Homo sapien
cgtggcaggaccagcgaggaatcca

SEQ ID NO: 497854 - DNA, 25 bp, Homo sapien
aggaccagcgaggaatccagcctgt

SEQ ID NO: 497855 - DNA, 25 bp, Homo sapien
aggaatccagcctgtccacttccag

SEQ ID NO: 497856 - DNA, 25 bp, Homo sapien
cccgctgagtggaccggacctctga

SEQ ID NO: 497857 - DNA, 25 bp, Homo sapien
aagcttttcatacattggaactcca

SEQ ID NO: 497858 - DNA, 25 bp, Homo sapien
tacattggaactccacctgactttg

SEQ ID NO: 497859 - DNA, 25 bp, Homo sapien
gactttggaccaaccccagaacaga

SEQ ID NO: 497860 - DNA, 25 bp, Homo sapien
agagcagagccacctcctatagacg

SEQ ID NO: 497861 - DNA, 25 bp, Homo sapien
ctgctgctgtacacttcagcagctt

SEQ ID NO: 497862 - DNA, 25 bp, Homo sapien
gcagcttgcacaagggagctcactt

SEQ ID NO: 497863 - DNA, 25 bp, Homo sapien
tcaaaacagatgcagggcctctaaa

SEQ ID NO: 497864 - DNA, 25 bp, Homo sapien
ttactatctgattttgagggttcca

SEQ ID NO: 497865 - DNA, 25 bp, Homo sapien
gagggttccagtatttctgtgaaaa

SEQ ID NO: 497866 - DNA, 25 bp, Homo sapien
gtgaaaattcaacaagaactccttg

SEQ ID NO: 497867 - DNA, 25 bp, Homo sapien
ttgatattcagtctccttaaggtag

SEQ ID NO: 497868 - DNA, 25 bp, Homo sapien
gcccggccaggaaacacttgatttt

SEQ ID NO: 497869 - DNA, 25 bp, Homo sapien
ggccaggaaacacttgattttaact

SEQ ID NO: 497870 - DNA, 25 bp, Homo sapien
gaaacacttgattttaacttgctac

SEQ ID NO: 497871 - DNA, 25 bp, Homo sapien
cacttgattttaacttgctacttgg

SEQ ID NO: 497872 - DNA, 25 bp, Homo sapien
tggactactctgaaagtcctgtgta

SEQ ID NO: 497873 - DNA, 25 bp, Homo sapien
actactctgaaagtcctgtgtaatg

SEQ ID NO: 497874 - DNA, 25 bp, Homo sapien
actctgaaagtcctgtgtaatgatt

SEQ ID NO: 497875 - DNA, 25 bp, Homo sapien
ctgaaagtcctgtgtaatgattctg

SEQ ID NO: 497876 - DNA, 25 bp, Homo sapien
gaatatgacacattaattcatgcat

SEQ ID NO: 497877 - DNA, 25 bp, Homo sapien
tgacacattaattcatgcataataa

SEQ ID NO: 497878 - DNA, 25 bp, Homo sapien
tagtttgaattatgaacttaccttt

SEQ ID NO: 497879 - DNA, 25 bp, Homo sapien
aacagtgtcttctaggaagcccaga

SEQ ID NO: 497880 - DNA, 25 bp, Homo sapien
gtcttctaggaagcccagacacatg

SEQ ID NO: 497881 - DNA, 25 bp, Homo sapien
aggaagcccagacacatggagaagt

SEQ ID NO: 497882 - DNA, 25 bp, Homo sapien
acacatggagaagttctgagtgttt

SEQ ID NO: 497883 - DNA, 25 bp, Homo sapien
tctgagtgttttggccgatagtccc

SEQ ID NO: 497884 - DNA, 25 bp, Homo sapien
gtgttttggccgatagtcccagatg

SEQ ID NO: 497885 - DNA, 25 bp, Homo sapien
tttggccgatagtcccagatgaggt

SEQ ID NO: 497886 - DNA, 25 bp, Homo sapien
ggccgatagtcccagatgaggttcc

SEQ ID NO: 497887 - DNA, 25 bp, Homo sapien
gatagtcccagatgaggttccagca

SEQ ID NO: 497888 - DNA, 25 bp, Homo sapien
tagtcccagatgaggttccagcaac

SEQ ID NO: 497889 - DNA, 25 bp, Homo sapien
gatgaggttccagcaacagctggga

SEQ ID NO: 497890 - DNA, 25 bp, Homo sapien
ctgcattctcttagtcacagtgagt

SEQ ID NO: 497891 - DNA, 25 bp, Homo sapien
acagtgagttgcaggttcaccccag

SEQ ID NO: 497892 - DNA, 25 bp, Homo sapien
aggttcaccccagcgtcagtggcgg

SEQ ID NO: 497893 - DNA, 25 bp, Homo sapien
cctcatgtgaagtccccagcatgga

SEQ ID NO: 497894 - DNA, 25 bp, Homo sapien
gcatggaccctgacacatcgtaggt

SEQ ID NO: 497895 - DNA, 25 bp, Homo sapien
atcgtaggtcctcaacaaatgtcac

SEQ ID NO: 497896 - DNA, 25 bp, Homo sapien
aacaaatgtcactccctgttgtcac

SEQ ID NO: 497897 - DNA, 25 bp, Homo sapien
cctgttgtcactctgtttagtacta

SEQ ID NO: 497898 - DNA, 25 bp, Homo sapien
aactgttgggacctatatctgaatc

SEQ ID NO: 497899 - DNA, 25 bp, Homo sapien
tatctgaatctattagtctgcctaa

SEQ ID NO: 497900 - DNA, 25 bp, Homo sapien
gaaaagccaccatcaggattttgga

SEQ ID NO: 497901 - DNA, 25 bp, Homo sapien
gggagcctatcttgctcgggacagt

SEQ ID NO: 497902 - DNA, 25 bp, Homo sapien
tcgggacagtcgttccccagcgggt

SEQ ID NO: 497903 - DNA, 25 bp, Homo sapien
ggtccctgtccccagctttgacagt

SEQ ID NO: 497904 - DNA, 25 bp, Homo sapien
ctttgacagtctctcccgacaggat

SEQ ID NO: 497905 - DNA, 25 bp, Homo sapien
cccgacaggatgttaatcttctccc

SEQ ID NO: 497906 - DNA, 25 bp, Homo sapien
catggaagctccacgtggttgaagt

SEQ ID NO: 497907 - DNA, 25 bp, Homo sapien
gctccacgtggttgaagtaaactct

SEQ ID NO: 497908 - DNA, 25 bp, Homo sapien
aaaagtgagccacgcacagtgaccg

SEQ ID NO: 497909 - DNA, 25 bp, Homo sapien
agtgaggcactgaagctccagggcc

SEQ ID NO: 497910 - DNA, 25 bp, Homo sapien
ctcagggccaacacgtaggaggcac

SEQ ID NO: 497911 - DNA, 25 bp, Homo sapien
caacacgtaggaggcacacttctgc

SEQ ID NO: 497912 - DNA, 25 bp, Homo sapien
aaggttggctgaagttcctagtctc

SEQ ID NO: 497913 - DNA, 25 bp, Homo sapien
tgaagttcctagtctcaggccgtag

SEQ ID NO: 497914 - DNA, 25 bp, Homo sapien
gtctcaggccgtaggtgcctggcca

SEQ ID NO: 497915 - DNA, 25 bp, Homo sapien
tgcgctgtcactgacatctcattaa

SEQ ID NO: 497916 - DNA, 25 bp, Homo sapien
ggtgtttgaggctttaatgcaaccc

SEQ ID NO: 497917 - DNA, 25 bp, Homo sapien
tgaggctttaatgcaaccctttagc

SEQ ID NO: 497918 - DNA, 25 bp, Homo sapien
tagcccttggttctttttggtgcaa

SEQ ID NO: 497919 - DNA, 25 bp, Homo sapien
tttggtgcaagaattctggctgttt

SEQ ID NO: 497920 - DNA, 25 bp, Homo sapien
aattctggctgtttacctcagactc

SEQ ID NO: 497921 - DNA, 25 bp, Homo sapien
ctcagactcagacccctgaaatgtt

SEQ ID NO: 497922 - DNA, 25 bp, Homo sapien
agactcagacccctgaaatgttgcc

SEQ ID NO: 497923 - DNA, 25 bp, Homo sapien
aagtttgcccatctatgtagccact

SEQ ID NO: 497924 - DNA, 25 bp, Homo sapien
tcactttactggttttagcctgaac

SEQ ID NO: 497925 - DNA, 25 bp, Homo sapien
ctttcatcccctcagtgtatttact

SEQ ID NO: 497926 - DNA, 25 bp, Homo sapien
attgcttaagcctccacacagaagt

SEQ ID NO: 497927 - DNA, 25 bp, Homo sapien
gggcaccttggacagcactggcaaa

SEQ ID NO: 497928 - DNA, 25 bp, Homo sapien
gacagcactggcaaagcttctacag

SEQ ID NO: 497929 - DNA, 25 bp, Homo sapien
ataatatcataaacccttccgccac

SEQ ID NO: 497930 - DNA, 25 bp, Homo sapien
tagcctgaacaacaaccagagccag

SEQ ID NO: 497931 - DNA, 25 bp, Homo sapien
agagccaggccctagtttcttattt

SEQ ID NO: 497932 - DNA, 25 bp, Homo sapien
gtttcttatttctgacttctcacca

SEQ ID NO: 497933 - DNA, 25 bp, Homo sapien
ccatcccatctgcactggtaaagtt

SEQ ID NO: 497934 - DNA, 25 bp, Homo sapien
tgagcttcaggctgcgctggccatg

SEQ ID NO: 497935 - DNA, 25 bp, Homo sapien
ggtggggtcaaatacatcattgtca

SEQ ID NO: 497936 - DNA, 25 bp, Homo sapien
atcattgtcactcaggtggggccag

SEQ ID NO: 497937 - DNA, 25 bp, Homo sapien
ggccagggcctcaaatcctggatga

SEQ ID NO: 497938 - DNA, 25 bp, Homo sapien
cagggcctcaaatcctggatgaccc

SEQ ID NO: 497939 - DNA, 25 bp, Homo sapien
tcctgggtcctgacggcctgccgaa

SEQ ID NO: 497940 - DNA, 25 bp, Homo sapien
cagggaccgcatgccgcttggagaa

SEQ ID NO: 497941 - DNA, 25 bp, Homo sapien
cctcgccggagctagggagcggatg

SEQ ID NO: 497942 - DNA, 25 bp, Homo sapien
gatgtggtgggctggccggactcct

SEQ ID NO: 497943 - DNA, 25 bp, Homo sapien
tcctgggacatgtgggtggtggctt

SEQ ID NO: 497944 - DNA, 25 bp, Homo sapien
gtggtggcttgaccccgggcccatg

SEQ ID NO: 497945 - DNA, 25 bp, Homo sapien
ttgccataatttccaggccagtcac

SEQ ID NO: 497946 - DNA, 25 bp, Homo sapien
ggccagtcaccaggacagaggagat

SEQ ID NO: 497947 - DNA, 25 bp, Homo sapien
aactactatgcactactagccttag

SEQ ID NO: 497948 - DNA, 25 bp, Homo sapien
agccttagaggcactggtttcctgt

SEQ ID NO: 497949 - DNA, 25 bp, Homo sapien
atatcccctttatgttaatcccagc

SEQ ID NO: 497950 - DNA, 25 bp, Homo sapien
ggtttcctgttaccactttggcaag

SEQ ID NO: 497951 - DNA, 25 bp, Homo sapien
actttggcaagtatggatggtctaa

SEQ ID NO: 497952 - DNA, 25 bp, Homo sapien
ctaagtccagtagggcttcatccat

SEQ ID NO: 497953 - DNA, 25 bp, Homo sapien
ggcttcatccatggagccattagaa

SEQ ID NO: 497954 - DNA, 25 bp, Homo sapien
gtaggttgactttcacagcaattgt

SEQ ID NO: 497955 - DNA, 25 bp, Homo sapien
tgatccattttaactcatccttgcc

SEQ ID NO: 497956 - DNA, 25 bp, Homo sapien
aataagcagtgcactagctattctc

SEQ ID NO: 497957 - DNA, 25 bp, Homo sapien
taagcagtgcactagctattctcaa

SEQ ID NO: 497958 - DNA, 25 bp, Homo sapien
gcagtgcactagctattctcaataa

SEQ ID NO: 497959 - DNA, 25 bp, Homo sapien
agtgcactagctattctcaataaaa

SEQ ID NO: 497960 - DNA, 25 bp, Homo sapien
gcactagctattctcaataaaacag

SEQ ID NO: 497961 - DNA, 25 bp, Homo sapien
aacagaaaccacataggtaagacca

SEQ ID NO: 497962 - DNA, 25 bp, Homo sapien
cataggtaagaccaatattgtcaca

SEQ ID NO: 497963 - DNA, 25 bp, Homo sapien
atattgtcacattttggttttggct

SEQ ID NO: 497964 - DNA, 25 bp, Homo sapien
tggggcaagtgagcatagtcaccgt

SEQ ID NO: 497965 - DNA, 25 bp, Homo sapien
acagccccgtgatgccccattttta

SEQ ID NO: 497966 - DNA, 25 bp, Homo sapien
cccgtgatgccccatttttagatgg

SEQ ID NO: 497967 - DNA, 25 bp, Homo sapien
acatggcagggttagagaataaaaa

SEQ ID NO: 497968 - DNA, 25 bp, Homo sapien
gaacgtggtgtttgaagcaaaacag

SEQ ID NO: 497969 - DNA, 25 bp, Homo sapien
aaaacagatctgtattggcatcttg

SEQ ID NO: 497970 - DNA, 25 bp, Homo sapien
cttttatcagatgttgttgccttgt

SEQ ID NO: 497971 - DNA, 25 bp, Homo sapien
tatcagatgttgttgccttgtgcaa

SEQ ID NO: 497972 - DNA, 25 bp, Homo sapien
gccttgtgcaaatcacattttctct

SEQ ID NO: 497973 - DNA, 25 bp, Homo sapien
tcacattttctctgagtctccattt

SEQ ID NO: 497974 - DNA, 25 bp, Homo sapien
taacatgcggagaataatacttata

SEQ ID NO: 497975 - DNA, 25 bp, Homo sapien
cttatatttgtggtagtagtgtgaa

SEQ ID NO: 497976 - DNA, 25 bp, Homo sapien
gtatgtgaagtaccattcgagtggt

SEQ ID NO: 497977 - DNA, 25 bp, Homo sapien
gtgaagtaccattcgagtggtgaat

SEQ ID NO: 497978 - DNA, 25 bp, Homo sapien
agttcttatcaacttaattggatac

SEQ ID NO: 497979 - DNA, 25 bp, Homo sapien
ggatacttttagcaaataggaactt

SEQ ID NO: 497980 - DNA, 25 bp, Homo sapien
ttctcagcactgaacatgaattact

SEQ ID NO: 497981 - DNA, 25 bp, Homo sapien
gaacatgaattacttccttggagtt

SEQ ID NO: 497982 - DNA, 25 bp, Homo sapien
gggcgtaaaacagcatcattgtact

SEQ ID NO: 497983 - DNA, 25 bp, Homo sapien
gcatcattgtacttaagctatggat

SEQ ID NO: 497984 - DNA, 25 bp, Homo sapien
ttctttatttataactgtgccaagt

SEQ ID NO: 497985 - DNA, 25 bp, Homo sapien
gtattattttgctacttaccgtgtt

SEQ ID NO: 497986 - DNA, 25 bp, Homo sapien
gctacttaccgtgttattctgtgga

SEQ ID NO: 497987 - DNA, 25 bp, Homo sapien
tttaataaattagccctccttacat

SEQ ID NO: 497988 - DNA, 25 bp, Homo sapien
ttagccctccttacataaattaaat

SEQ ID NO: 497989 - DNA, 25 bp, Homo sapien
tctgagtgatctcaacagcctcacg

SEQ ID NO: 497990 - DNA, 25 bp, Homo sapien
tcaacagcctcacggcacattgaaa

SEQ ID NO: 497991 - DNA, 25 bp, Homo sapien
cagcctcacggcacattgaaaataa

SEQ ID NO: 497992 - DNA, 25 bp, Homo sapien
ataggccatggactttcccatctct

SEQ ID NO: 497993 - DNA, 25 bp, Homo sapien
atctctacccacttgtgcagtttct

SEQ ID NO: 497994 - DNA, 25 bp, Homo sapien
tctacccacttgtgcagtttctcct

SEQ ID NO: 497995 - DNA, 25 bp, Homo sapien
tctctcctcctcagttactaaagca

SEQ ID NO: 497996 - DNA, 25 bp, Homo sapien
tcagttactaaagcaatcttccttc

SEQ ID NO: 497997 - DNA, 25 bp, Homo sapien
gatatgtaaaaccagcagcaccaat

SEQ ID NO: 497998 - DNA, 25 bp, Homo sapien
agcagcaccaatagtgcctgacaaa

SEQ ID NO: 497999 - DNA, 25 bp, Homo sapien
tgcctgacaaaatataactgctcaa

SEQ ID NO: 498000 - DNA, 25 bp, Homo sapien
tcatgggctgagctgaaggcccaaa

SEQ ID NO: 498001 - DNA, 25 bp, Homo sapien
tgaaggcccaaaatcccgctagaat

SEQ ID NO: 498002 - DNA, 25 bp, Homo sapien
atcccgctagaatatatcctgactg

SEQ ID NO: 498003 - DNA, 25 bp, Homo sapien
gaggatatgacagcttaccagttaa

SEQ ID NO: 498004 - DNA, 25 bp, Homo sapien
taccagttaagagtacctcccagga

SEQ ID NO: 498005 - DNA, 25 bp, Homo sapien
actattaaaaaagctgctccccaag

SEQ ID NO: 498006 - DNA, 25 bp, Homo sapien
tccccaagcagattagctctctgtt

SEQ ID NO: 498007 - DNA, 25 bp, Homo sapien
gattagctctctgttaggattttac

SEQ ID NO: 498008 - DNA, 25 bp, Homo sapien
ggattttactagtggccattcagca

SEQ ID NO: 498009 - DNA, 25 bp, Homo sapien
agctctgctcatttgcttgatgcat

SEQ ID NO: 498010 - DNA, 25 bp, Homo sapien
tgatgcattttgagctttcatgggc

SEQ ID NO: 498011 - DNA, 25 bp, Homo sapien
agagcgaccagccacctctgtcttt

SEQ ID NO: 498012 - DNA, 25 bp, Homo sapien
ctctgtctttcagctgcattcactg

SEQ ID NO: 498013 - DNA, 25 bp, Homo sapien
tgcattcactgccttcatgtagaaa

SEQ ID NO: 498014 - DNA, 25 bp, Homo sapien
tgccttcatgtagaaatgctgctct

SEQ ID NO: 498015 - DNA, 25 bp, Homo sapien
gctgctctccaggaatgattaattc

SEQ ID NO: 498016 - DNA, 25 bp, Homo sapien
aattccattcttgtgttgtctgctg

SEQ ID NO: 498017 - DNA, 25 bp, Homo sapien
gtgttgtctgctgaatgaactttaa

SEQ ID NO: 498018 - DNA, 25 bp, Homo sapien
gaactttaatttcacaaactgccat

SEQ ID NO: 498019 - DNA, 25 bp, Homo sapien
taatttcacaaactgccatctttat

SEQ ID NO: 498020 - DNA, 25 bp, Homo sapien
atctttatgcttcctttgctccctt

SEQ ID NO: 498021 - DNA, 25 bp, Homo sapien
acatcatcttgtgaatcatagtagg

SEQ ID NO: 498022 - DNA, 25 bp, Homo sapien
gagacagaacagaataactcttcac

SEQ ID NO: 498023 - DNA, 25 bp, Homo sapien
tcttcacaaccttcaaagcagaaat

SEQ ID NO: 498024 - DNA, 25 bp, Homo sapien
gaaatatgtatgtcttgctgtggaa

SEQ ID NO: 498025 - DNA, 25 bp, Homo sapien
gaagactgggacttgttaaattcct

SEQ ID NO: 498026 - DNA, 25 bp, Homo sapien
gacttgttaaattcctattgattag

SEQ ID NO: 498027 - DNA, 25 bp, Homo sapien
tacaagttgacctttctctggcccc

SEQ ID NO: 498028 - DNA, 25 bp, Homo sapien
ccccagctctagtgtttgagtaaag

SEQ ID NO: 498029 - DNA, 25 bp, Homo sapien
ggagactgaggatgatttacttttt

SEQ ID NO: 498030 - DNA, 25 bp, Homo sapien
gaatttacctatggcattagcatag

SEQ ID NO: 498031 - DNA, 25 bp, Homo sapien
atggcattagcatagtaagcagata

SEQ ID NO: 498032 - DNA, 25 bp, Homo sapien
tagtaagcagatatttctacttttg

SEQ ID NO: 498033 - DNA, 25 bp, Homo sapien
gtgacgctgaacaattacatagctt

SEQ ID NO: 498034 - DNA, 25 bp, Homo sapien
atatagagccatctaatgccatttt

SEQ ID NO: 498035 - DNA, 25 bp, Homo sapien
aatgccattttacctcattcaactc

SEQ ID NO: 498036 - DNA, 25 bp, Homo sapien
ccattttacctcattcaactctttt

SEQ ID NO: 498037 - DNA, 25 bp, Homo sapien
aagacttctgttaactaggcagtgc

SEQ ID NO: 498038 - DNA, 25 bp, Homo sapien
gctgctgtaaagtgtgcagcacttc

SEQ ID NO: 498039 - DNA, 25 bp, Homo sapien
gtgcagcacttctaagtggagggaa

SEQ ID NO: 498040 - DNA, 25 bp, Homo sapien
ttagctttaacaagtaccccagagg

SEQ ID NO: 498041 - DNA, 25 bp, Homo sapien
taccccagagggaacattcgtgctt

SEQ ID NO: 498042 - DNA, 25 bp, Homo sapien
gagggaacattcgtgctttaaacaa

SEQ ID NO: 498043 - DNA, 25 bp, Homo sapien
gtgctttaaacaatgactttacaca

SEQ ID NO: 498044 - DNA, 25 bp, Homo sapien
gagtgttcacatatacaagcctgca

SEQ ID NO: 498045 - DNA, 25 bp, Homo sapien
aagcctgcatgagccctctgtgggt

SEQ ID NO: 498046 - DNA, 25 bp, Homo sapien
agccctctgtgggtaggtggtcaca

SEQ ID NO: 498047 - DNA, 25 bp, Homo sapien
aggtggtcacacttggcatctgcag

SEQ ID NO: 498048 - DNA, 25 bp, Homo sapien
ttggcatctgcagcattgacgtggc

SEQ ID NO: 498049 - DNA, 25 bp, Homo sapien
gctctgcaatttgaatcaccaccgt

SEQ ID NO: 498050 - DNA, 25 bp, Homo sapien
cactgttccccatgcaaaagctctg

SEQ ID NO: 498051 - DNA, 25 bp, Homo sapien
actgaccgctctctgtgtggagcaa

SEQ ID NO: 498052 - DNA, 25 bp, Homo sapien
aaagtgctgtcgtgcggtgaccacc

SEQ ID NO: 498053 - DNA, 25 bp, Homo sapien
gaccaccaggtgaagagcagcttgt

SEQ ID NO: 498054 - DNA, 25 bp, Homo sapien
gagcagcttgtattcagacatctag

SEQ ID NO: 498055 - DNA, 25 bp, Homo sapien
gatgactccctaaatggtttgcagc

SEQ ID NO: 498056 - DNA, 25 bp, Homo sapien
aaatggtttgcagctttggtatttg

SEQ ID NO: 498057 - DNA, 25 bp, Homo sapien
acatttcagttatgctttgtaggaa

SEQ ID NO: 498058 - DNA, 25 bp, Homo sapien
gaaaaacactttcctatgcattgaa

SEQ ID NO: 498059 - DNA, 25 bp, Homo sapien
cactttcctatgcattgaatgttct

SEQ ID NO: 498060 - DNA, 25 bp, Homo sapien
gaatgttctataactaaggagctta

SEQ ID NO: 498061 - DNA, 25 bp, Homo sapien
aaggagcttagtaatctactgctaa

SEQ ID NO: 498062 - DNA, 25 bp, Homo sapien
aaaatctcactgaaatctccagttt

SEQ ID NO: 498063 - DNA, 25 bp, Homo sapien
atctccagtttaagcgatttaagca

SEQ ID NO: 498064 - DNA, 25 bp, Homo sapien
tacagctcttggcaaatatttgttt

SEQ ID NO: 498065 - DNA, 25 bp, Homo sapien
atgggaataaaggtttcagtactca

SEQ ID NO: 498066 - DNA, 25 bp, Homo sapien
gcccggccaggaaacacttgatttt

SEQ ID NO: 498067 - DNA, 25 bp, Homo sapien
ggccaggaaacacttgattttaact

SEQ ID NO: 498068 - DNA, 25 bp, Homo sapien
gaaacacttgattttaacttgctac

SEQ ID NO: 498069 - DNA, 25 bp, Homo sapien
cacttgattttaacttgctacttgg

SEQ ID NO: 498070 - DNA, 25 bp, Homo sapien
tttaacttgctacttggactactct

SEQ ID NO: 498071 - DNA, 25 bp, Homo sapien
gactactctgaaagtcctgtgtaat

SEQ ID NO: 498072 - DNA, 25 bp, Homo sapien
ctgaaagtcctgtgtaatgattctg

SEQ ID NO: 498073 - DNA, 25 bp, Homo sapien
gtcctgtgtaatgattctgaacata

SEQ ID NO: 498074 - DNA, 25 bp, Homo sapien
gaatatgacacattaattcatgcat

SEQ ID NO: 498075 - DNA, 25 bp, Homo sapien
tagtttgaattatgaacttaccttt

SEQ ID NO: 498076 - DNA, 25 bp, Homo sapien
acccaggctgaagtcgcccaggctg

SEQ ID NO: 498077 - DNA, 25 bp, Homo sapien
tcttcagacaccagaagattccttc

SEQ ID NO: 498078 - DNA, 25 bp, Homo sapien
agaagattccttcgctcttgctgtc

SEQ ID NO: 498079 - DNA, 25 bp, Homo sapien
tcttgctgtcgcctctgcctaagac

SEQ ID NO: 498080 - DNA, 25 bp, Homo sapien
aggcacttacgggactcactcatag

SEQ ID NO: 498081 - DNA, 25 bp, Homo sapien
tacgggactcactcatagacctcct

SEQ ID NO: 498082 - DNA, 25 bp, Homo sapien
tggctgccctgagcaccctatgtgg

SEQ ID NO: 498083 - DNA, 25 bp, Homo sapien
gcaccctatgtggaatgactacgcc

SEQ ID NO: 498084 - DNA, 25 bp, Homo sapien
atgtggaatgactacgcctccagct

SEQ ID NO: 498085 - DNA, 25 bp, Homo sapien
tgtcctgttacatttccctctattg

SEQ ID NO: 498086 - DNA, 25 bp, Homo sapien
ttacatttccctctattgtccagat

SEQ ID NO: 498087 - DNA, 25 bp, Homo sapien
ctctattgtccagatccgcttgttt

SEQ ID NO: 498088 - DNA, 25 bp, Homo sapien
ctgcctcttaagatgcctctgatga

SEQ ID NO: 498089 - DNA, 25 bp, Homo sapien
gcctctgatgattcctttcacaaag

SEQ ID NO: 498090 - DNA, 25 bp, Homo sapien
tgggaagcagctttctgtcggccca

SEQ ID NO: 498091 - DNA, 25 bp, Homo sapien
tcggcccagtgcctagccttggaga

SEQ ID NO: 498092 - DNA, 25 bp, Homo sapien
gagaccacctctccatagagggcta

SEQ ID NO: 498093 - DNA, 25 bp, Homo sapien
tagagggctaccaggatctccttca

SEQ ID NO: 498094 - DNA, 25 bp, Homo sapien
ggccccagggcatgattaggagacc

SEQ ID NO: 498095 - DNA, 25 bp, Homo sapien
ttaggagaccccagtcctttcagaa

SEQ ID NO: 498096 - DNA, 25 bp, Homo sapien
gtcctttcagaatgggtcaacaata

SEQ ID NO: 498097 - DNA, 25 bp, Homo sapien
actcatggttcagaatggctccctt

SEQ ID NO: 498098 - DNA, 25 bp, Homo sapien
ttgctgcctctaggctgttctggaa

SEQ ID NO: 498099 - DNA, 25 bp, Homo sapien
ggagctcgctcatgttgtctctgaa

SEQ ID NO: 498100 - DNA, 25 bp, Homo sapien
aagagcaattacctcatattctaat

SEQ ID NO: 498101 - DNA, 25 bp, Homo sapien
tttttaaagacatggaaggctctga

SEQ ID NO: 498102 - DNA, 25 bp, Homo sapien
cctcctgaaggctattcctatgtga

SEQ ID NO: 498103 - DNA, 25 bp, Homo sapien
gaaggctattcctatgtgaggtatt

SEQ ID NO: 498104 - DNA, 25 bp, Homo sapien
tattgtttacgggtggcctttcact

SEQ ID NO: 498105 - DNA, 25 bp, Homo sapien
tacgggtggcctttcactatttcca

SEQ ID NO: 498106 - DNA, 25 bp, Homo sapien
tcactatttccaaatcagcgatgaa

SEQ ID NO: 498107 - DNA, 25 bp, Homo sapien
aacccagcagggtacagagggcatt

SEQ ID NO: 498108 - DNA, 25 bp, Homo sapien
catttgtgggagcagttaggaaacc

SEQ ID NO: 498109 - DNA, 25 bp, Homo sapien
gaaaccaggacgtccagcttctgcc

SEQ ID NO: 498110 - DNA, 25 bp, Homo sapien
actaggagcaatgaaacccagaatc

SEQ ID NO: 498111 - DNA, 25 bp, Homo sapien
agaatcctcataaaccatcacctag

SEQ ID NO: 498112 - DNA, 25 bp, Homo sapien
aaaccatcacctagcaggctgtcaa

SEQ ID NO: 498113 - DNA, 25 bp, Homo sapien
ggctgtcaacaggtgcatctgctga

SEQ ID NO: 498114 - DNA, 25 bp, Homo sapien
catctgctgatgctgtctgggataa

SEQ ID NO: 498115 - DNA, 25 bp, Homo sapien
gctgtctgggataatggcattgatg

SEQ ID NO: 498116 - DNA, 25 bp, Homo sapien
aatgtcatgaccctgtatgtaaagc

SEQ ID NO: 498117 - DNA, 25 bp, Homo sapien
aacttcaaatctgactgtttcccat

SEQ ID NO: 498118 - DNA, 25 bp, Homo sapien
aaatctgactgtttcccattacctg

SEQ ID NO: 498119 - DNA, 25 bp, Homo sapien
attacctgctgaagtatgtctcctg

SEQ ID NO: 498120 - DNA, 25 bp, Homo sapien
tgaagtatgtctcctgtttcttttc

SEQ ID NO: 498121 - DNA, 25 bp, Homo sapien
gtggtatggcaacaggtacgtaaac

SEQ ID NO: 498122 - DNA, 25 bp, Homo sapien
atggcaacaggtacgtaaacatact

SEQ ID NO: 498123 - DNA, 25 bp, Homo sapien
aacaggtacgtaaacatactgataa

SEQ ID NO: 498124 - DNA, 25 bp, Homo sapien
aatgcattaagttttggcctaacct

SEQ ID NO: 498125 - DNA, 25 bp, Homo sapien
gcattaagttttggcctaacctggc

SEQ ID NO: 498126 - DNA, 25 bp, Homo sapien
taacctggccccaaccatttcagtg

SEQ ID NO: 498127 - DNA, 25 bp, Homo sapien
tggccccaaccatttcagtggtctc

SEQ ID NO: 498128 - DNA, 25 bp, Homo sapien
ccaaccatttcagtggtctcttttg

SEQ ID NO: 498129 - DNA, 25 bp, Homo sapien
ggtctcttttgaatagatatcttat

SEQ ID NO: 498130 - DNA, 25 bp, Homo sapien
agatatcttatgtttacaactcaat

SEQ ID NO: 498131 - DNA, 25 bp, Homo sapien
ataatctttatagagcactggccct

SEQ ID NO: 498132 - DNA, 25 bp, Homo sapien
tgagcttcttttatatatagcaaac

SEQ ID NO: 498133 - DNA, 25 bp, Homo sapien
gcttcttttatatatagcaaacaat

SEQ ID NO: 498134 - DNA, 25 bp, Homo sapien
aataactacagtatagcgctggtac

SEQ ID NO: 498135 - DNA, 25 bp, Homo sapien
aactacagtatagcgctggtacagt

SEQ ID NO: 498136 - DNA, 25 bp, Homo sapien
acagtatagcgctggtacagtacac

SEQ ID NO: 498137 - DNA, 25 bp, Homo sapien
agtatagcgctggtacagtacacta

SEQ ID NO: 498138 - DNA, 25 bp, Homo sapien
tatagcgctggtacagtacactaaa

SEQ ID NO: 498139 - DNA, 25 bp, Homo sapien
tatataccttgtggatgagagctat

SEQ ID NO: 498140 - DNA, 25 bp, Homo sapien
ataccttgtggatgagagctatata

SEQ ID NO: 498141 - DNA, 25 bp, Homo sapien
ccttgtggatgagagctatatactt

SEQ ID NO: 498142 - DNA, 25 bp, Homo sapien
tggatgagagctatatacttttaca

SEQ ID NO: 498143 - DNA, 25 bp, Homo sapien
ctgagattctgtgggattcgcacct

SEQ ID NO: 498144 - DNA, 25 bp, Homo sapien
agattctgtgggattcgcacctggc

SEQ ID NO: 498145 - DNA, 25 bp, Homo sapien
ttctgtgggattcgcacctggccta

SEQ ID NO: 498146 - DNA, 25 bp, Homo sapien
caaataggtgggtactagcacggct

SEQ ID NO: 498147 - DNA, 25 bp, Homo sapien
ataggtgggtactagcacggctaat

SEQ ID NO: 498148 - DNA, 25 bp, Homo sapien
gaatatttgaaaaggtgttgaacac

SEQ ID NO: 498149 - DNA, 25 bp, Homo sapien
ggtgttgaacactaataattttgga

SEQ ID NO: 498150 - DNA, 25 bp, Homo sapien
gaacactaataattttggaaagcct

SEQ ID NO: 498151 - DNA, 25 bp, Homo sapien
ggtgggtactagcacggctaatttt

SEQ ID NO: 498152 - DNA, 25 bp, Homo sapien
ggtctgttatgtgttcaggctggcc

SEQ ID NO: 498153 - DNA, 25 bp, Homo sapien
gttatgtgttcaggctggccccaga

SEQ ID NO: 498154 - DNA, 25 bp, Homo sapien
aggtgagcactttccccgctcacat

SEQ ID NO: 498155 - DNA, 25 bp, Homo sapien
tttccccgctcacattcaggatagg

SEQ ID NO: 498156 - DNA, 25 bp, Homo sapien
cgctcacattcaggatagggcgagg

SEQ ID NO: 498157 - DNA, 25 bp, Homo sapien
gggttggtaccgattcaccctcagg

SEQ ID NO: 498158 - DNA, 25 bp, Homo sapien
gttggtaccgattcaccctcagggc

SEQ ID NO: 498159 - DNA, 25 bp, Homo sapien
cgattcaccctcagggcctagattt

SEQ ID NO: 498160 - DNA, 25 bp, Homo sapien
gggcttcagcttgctgcagataggt

SEQ ID NO: 498161 - DNA, 25 bp, Homo sapien
cttcagcttgctgcagataggtgct

SEQ ID NO: 498162 - DNA, 25 bp, Homo sapien
tgcagataggtgctcccttcactct

SEQ ID NO: 498163 - DNA, 25 bp, Homo sapien
cagataggtgctcccttcactctca

SEQ ID NO: 498164 - DNA, 25 bp, Homo sapien
cgtaagcctggactggccacgccct

SEQ ID NO: 498165 - DNA, 25 bp, Homo sapien
aaactttgtaaaatgcgagaacaga

SEQ ID NO: 498166 - DNA, 25 bp, Homo sapien
agaagcaaaagacactacgctctgt

SEQ ID NO: 498167 - DNA, 25 bp, Homo sapien
gcaaaagacactacgctctgtcatt

SEQ ID NO: 498168 - DNA, 25 bp, Homo sapien
aaagacactacgctctgtcatttta

SEQ ID NO: 498169 - DNA, 25 bp, Homo sapien
gacactacgctctgtcattttatct

SEQ ID NO: 498170 - DNA, 25 bp, Homo sapien
aactgaaatgttttttagacaatca

SEQ ID NO: 498171 - DNA, 25 bp, Homo sapien
gttttttagacaatcaaatgttagg

SEQ ID NO: 498172 - DNA, 25 bp, Homo sapien
tgttaggtaagtgcaaaaacttgtt

SEQ ID NO: 498173 - DNA, 25 bp, Homo sapien
tgttttttcttactggtgtagaaat

SEQ ID NO: 498174 - DNA, 25 bp, Homo sapien
ctggtgtagaaattaatgccttttt

SEQ ID NO: 498175 - DNA, 25 bp, Homo sapien
ttcaatgtttcctttatagtgttaa

SEQ ID NO: 498176 - DNA, 25 bp, Homo sapien
ggcccggcaccctgagatcctgatg

SEQ ID NO: 498177 - DNA, 25 bp, Homo sapien
cggcaccctgagatcctgatgccag

SEQ ID NO: 498178 - DNA, 25 bp, Homo sapien
gggctgctcatggtcgaggacacgg

SEQ ID NO: 498179 - DNA, 25 bp, Homo sapien
acacgggtgggtgctcctgaacagc

SEQ ID NO: 498180 - DNA, 25 bp, Homo sapien
agcagtcccctagggcagctcagga

SEQ ID NO: 498181 - DNA, 25 bp, Homo sapien
agctcaggagctccggccacctgaa

SEQ ID NO: 498182 - DNA, 25 bp, Homo sapien
aggagctccggccacctgaactggc

SEQ ID NO: 498183 - DNA, 25 bp, Homo sapien
tgaactggcccttccatgggcagga

SEQ ID NO: 498184 - DNA, 25 bp, Homo sapien
atgggcaggaccactcctgtgggca

SEQ ID NO: 498185 - DNA, 25 bp, Homo sapien
ggtgagacccttggctgcagaagct

SEQ ID NO: 498186 - DNA, 25 bp, Homo sapien
tgagacccttggctgcagaagctgc

SEQ ID NO: 498187 - DNA, 25 bp, Homo sapien
acatttctattggtcttggctgggc

SEQ ID NO: 498188 - DNA, 25 bp, Homo sapien
acctgtacccagtcagctgcagggt

SEQ ID NO: 498189 - DNA, 25 bp, Homo sapien
agctgcagggtctagctcttcttat

SEQ ID NO: 498190 - DNA, 25 bp, Homo sapien
tagctcttcttatcttggctgggat

SEQ ID NO: 498191 - DNA, 25 bp, Homo sapien
ttggctgggatctcacacatgtcta

SEQ ID NO: 498192 - DNA, 25 bp, Homo sapien
acacatgtctaggatcagctgcttt

SEQ ID NO: 498193 - DNA, 25 bp, Homo sapien
gatcagctgctttactagtctagga

SEQ ID NO: 498194 - DNA, 25 bp, Homo sapien
gacaggtggactactcagttctcct

SEQ ID NO: 498195 - DNA, 25 bp, Homo sapien
agaaatgttgccatgtttacagcat

SEQ ID NO: 498196 - DNA, 25 bp, Homo sapien
aacatttgtttagctcatgaatctg

SEQ ID NO: 498197 - DNA, 25 bp, Homo sapien
ctgtgggttgggtgaacatttctat

SEQ ID NO: 498198 - DNA, 25 bp, Homo sapien
ggtgctctgaaaacccacaggatcc

SEQ ID NO: 498199 - DNA, 25 bp, Homo sapien
cttctttcaccaattgctaacatag

SEQ ID NO: 498200 - DNA, 25 bp, Homo sapien
acatagaccttgttgggatcacgat

SEQ ID NO: 498201 - DNA, 25 bp, Homo sapien
ttgggatcacgatggcttcacaagc

SEQ ID NO: 498202 - DNA, 25 bp, Homo sapien
cacaagccagctgttgggtttgcta

SEQ ID NO: 498203 - DNA, 25 bp, Homo sapien
gggtttgctatgtcactgtggctca

SEQ ID NO: 498204 - DNA, 25 bp, Homo sapien
agtcacatccctgcgtgtatactgt

SEQ ID NO: 498205 - DNA, 25 bp, Homo sapien
atccctgcgtgtatactgtctgcgg

SEQ ID NO: 498206 - DNA, 25 bp, Homo sapien
ggcacatatgtatccatttagagct

SEQ ID NO: 498207 - DNA, 25 bp, Homo sapien
gagctaaaggaatcagtgtacacta

SEQ ID NO: 498208 - DNA, 25 bp, Homo sapien
gtgtacactacagctaatcctaata

SEQ ID NO: 498209 - DNA, 25 bp, Homo sapien
ttttttgtcactcatgcctagttcc

SEQ ID NO: 498210 - DNA, 25 bp, Homo sapien
tacttacctggccttacctacatct

SEQ ID NO: 498211 - DNA, 25 bp, Homo sapien
tgcagggctccttctttgactattc

SEQ ID NO: 498212 - DNA, 25 bp, Homo sapien
tctttgactattcacctggtggctt

SEQ ID NO: 498213 - DNA, 25 bp, Homo sapien
tggtggcttttactcctccttcaag

SEQ ID NO: 498214 - DNA, 25 bp, Homo sapien
tcaagacccaactcacagatgactt

SEQ ID NO: 498215 - DNA, 25 bp, Homo sapien
tcacagatgacttctctggagtctt

SEQ ID NO: 498216 - DNA, 25 bp, Homo sapien
gagtcttccctgaatgctctaggca

SEQ ID NO: 498217 - DNA, 25 bp, Homo sapien
agacctttaatttccacagtagagc

SEQ ID NO: 498218 - DNA, 25 bp, Homo sapien
caatgggtttgtgcttgcagtcctt

SEQ ID NO: 498219 - DNA, 25 bp, Homo sapien
gcagtccttctgctcattctttatt

SEQ ID NO: 498220 - DNA, 25 bp, Homo sapien
tagtacttgaagttgagcctttgtg

SEQ ID NO: 498221 - DNA, 25 bp, Homo sapien
tgagcctttgtggtgggacttttta

SEQ ID NO: 498222 - DNA, 25 bp, Homo sapien
gtattttatgactcctcattcctgg

SEQ ID NO: 498223 - DNA, 25 bp, Homo sapien
tggcccagagggttgtctttgaaac

SEQ ID NO: 498224 - DNA, 25 bp, Homo sapien
ctgtttctaacccttgtgttgtgtg

SEQ ID NO: 498225 - DNA, 25 bp, Homo sapien
cttgtgttgtgtgtttctgtctgag

SEQ ID NO: 498226 - DNA, 25 bp, Homo sapien
tgtgaccaggcctttgagctcttgt

SEQ ID NO: 498227 - DNA, 25 bp, Homo sapien
aggcctttgagctcttgtcatctgt

SEQ ID NO: 498228 - DNA, 25 bp, Homo sapien
tctgtggagagaatcatgcaaattt

SEQ ID NO: 498229 - DNA, 25 bp, Homo sapien
agttcttccaagagacttccatgtc

SEQ ID NO: 498230 - DNA, 25 bp, Homo sapien
ttccaagagacttccatgtcctggt

SEQ ID NO: 498231 - DNA, 25 bp, Homo sapien
aacagccccggcagcggcgcaggct

SEQ ID NO: 498232 - DNA, 25 bp, Homo sapien
ccgacgcctgggtgcgcctgcctgc

SEQ ID NO: 498233 - DNA, 25 bp, Homo sapien
ggctgttgtgtctgcgactgctccc

SEQ ID NO: 498234 - DNA, 25 bp, Homo sapien
gctgttgtgtctgcgactgctcccg

SEQ ID NO: 498235 - DNA, 25 bp, Homo sapien
tgttgtgtctgcgactgctcccggc

SEQ ID NO: 498236 - DNA, 25 bp, Homo sapien
tgtgtctgcgactgctcccggccgg

SEQ ID NO: 498237 - DNA, 25 bp, Homo sapien
tctgcgactgctcccggccggaggt

SEQ ID NO: 498238 - DNA, 25 bp, Homo sapien
ggtgcagggagctcagccgagccgc

SEQ ID NO: 498239 - DNA, 25 bp, Homo sapien
cgccgctgccatcccggagcgagca

SEQ ID NO: 498240 - DNA, 25 bp, Homo sapien
taagagccgcggagggagcgagcga

SEQ ID NO: 498241 - DNA, 25 bp, Homo sapien
agcgagccggctagaggccagcgcc

SEQ ID NO: 498242 - DNA, 25 bp, Homo sapien
gaaagcacctccgttgtggacggtc

SEQ ID NO: 498243 - DNA, 25 bp, Homo sapien
gatgagcgctaccagtttcatttgt

SEQ ID NO: 498244 - DNA, 25 bp, Homo sapien
catttgtaggcagggagttctccgc

SEQ ID NO: 498245 - DNA, 25 bp, Homo sapien
agttctccgcggatgcatggtggca

SEQ ID NO: 498246 - DNA, 25 bp, Homo sapien
gtggcagtctgctttgatggcagca

SEQ ID NO: 498247 - DNA, 25 bp, Homo sapien
gcagtttctgcttaggtgacctaga

SEQ ID NO: 498248 - DNA, 25 bp, Homo sapien
gtgacctagaggtcctcagcagtat

SEQ ID NO: 498249 - DNA, 25 bp, Homo sapien
tcagcagtatcctccacacctattt

SEQ ID NO: 498250 - DNA, 25 bp, Homo sapien
tatttattgaggtgcacctgctggg

SEQ ID NO: 498251 - DNA, 25 bp, Homo sapien
gaggatctcggtgaaaggccttagt

SEQ ID NO: 498252 - DNA, 25 bp, Homo sapien
tgaggtggcttgtagctagctactt

SEQ ID NO: 498253 - DNA, 25 bp, Homo sapien
aaccatttgtatctaatgtgtacag

SEQ ID NO: 498254 - DNA, 25 bp, Homo sapien
tgtgtacagtgtaaaattgacttta

SEQ ID NO: 498255 - DNA, 25 bp, Homo sapien
gtgctattttttcttaatcagaaag

SEQ ID NO: 498256 - DNA, 25 bp, Homo sapien
ggaaaattctcaaggccttttgaag

SEQ ID NO: 498257 - DNA, 25 bp, Homo sapien
tctcaaggccttttgaagagcataa

SEQ ID NO: 498258 - DNA, 25 bp, Homo sapien
caaggccttttgaagagcataagaa

SEQ ID NO: 498259 - DNA, 25 bp, Homo sapien
aaaattatcttggtgagaagacaaa

SEQ ID NO: 498260 - DNA, 25 bp, Homo sapien
gcttttttcccggaattcatcagaa

SEQ ID NO: 498261 - DNA, 25 bp, Homo sapien
tttttcccggaattcatcagaactt

SEQ ID NO: 498262 - DNA, 25 bp, Homo sapien
ttcccggaattcatcagaactttga

SEQ ID NO: 498263 - DNA, 25 bp, Homo sapien
aatgcaggggcttttcttccctaga

SEQ ID NO: 498264 - DNA, 25 bp, Homo sapien
tatatcagtctttttgaaaggatca

SEQ ID NO: 498265 - DNA, 25 bp, Homo sapien
gaaaggatcaacttggataaaataa

SEQ ID NO: 498266 - DNA, 25 bp, Homo sapien
atgctctatttgttagagctctatt

SEQ ID NO: 498267 - DNA, 25 bp, Homo sapien
ggaaacagattccatagatctaagt

SEQ ID NO: 498268 - DNA, 25 bp, Homo sapien
gattccatagatctaagtcaatgtt

SEQ ID NO: 498269 - DNA, 25 bp, Homo sapien
agatctaagtcaatgtttctccaga

SEQ ID NO: 498270 - DNA, 25 bp, Homo sapien
gaagcatgattttgtctgccaaaag

SEQ ID NO: 498271 - DNA, 25 bp, Homo sapien
aagcatgattttgtctgccaaaaga

SEQ ID NO: 498272 - DNA, 25 bp, Homo sapien
ccaaaagaaaatagctctctttggc

SEQ ID NO: 498273 - DNA, 25 bp, Homo sapien
ggccaaaatgcaaaattacattgct

SEQ ID NO: 498274 - DNA, 25 bp, Homo sapien
aatttttcattatatcagtcttttt

SEQ ID NO: 498275 - DNA, 25 bp, Homo sapien
tattcctcagtggagagtcgttctc

SEQ ID NO: 498276 - DNA, 25 bp, Homo sapien
gtggagagtcgttctcatgctgacg

SEQ ID NO: 498277 - DNA, 25 bp, Homo sapien
ctcattattcctttacatgcagaat

SEQ ID NO: 498278 - DNA, 25 bp, Homo sapien
tgaaatatctctacaaacctcaatt

SEQ ID NO: 498279 - DNA, 25 bp, Homo sapien
aacctcaattagttctactctacac

SEQ ID NO: 498280 - DNA, 25 bp, Homo sapien
tactctacactttcactatcatcaa

SEQ ID NO: 498281 - DNA, 25 bp, Homo sapien
tcatcaacactgagactatcctgtc

SEQ ID NO: 498282 - DNA, 25 bp, Homo sapien
tcctgtctcacctacaaatgtggaa

SEQ ID NO: 498283 - DNA, 25 bp, Homo sapien
tacattgttcgatttttcagcagac

SEQ ID NO: 498284 - DNA, 25 bp, Homo sapien
gcaaattgaactgcagtttttcagc

SEQ ID NO: 498285 - DNA, 25 bp, Homo sapien
gtttttcagcatatacacaatgtct

SEQ ID NO: 498286 - DNA, 25 bp, Homo sapien
atgacgcctttaatgtgggcagcat

SEQ ID NO: 498287 - DNA, 25 bp, Homo sapien
gacgcctttaatgtgggcagcatat

SEQ ID NO: 498288 - DNA, 25 bp, Homo sapien
gtgggcagcatatagaacacatagt

SEQ ID NO: 498289 - DNA, 25 bp, Homo sapien
gttaaccttggtgacaagtatcaca

SEQ ID NO: 498290 - DNA, 25 bp, Homo sapien
gccttcttctggaagctggagctaa

SEQ ID NO: 498291 - DNA, 25 bp, Homo sapien
cttcttctggaagctggagctaatg

SEQ ID NO: 498292 - DNA, 25 bp, Homo sapien
gaagctggagctaatgttgatgccc

SEQ ID NO: 498293 - DNA, 25 bp, Homo sapien
agctggagctaatgttgatgcccag

SEQ ID NO: 498294 - DNA, 25 bp, Homo sapien
ccagaatatcaagggcgaatcagcg

SEQ ID NO: 498295 - DNA, 25 bp, Homo sapien
atcaaccacttacaagaggcaaggc

SEQ ID NO: 498296 - DNA, 25 bp, Homo sapien
agcaaaaggatatgacaatccgtcc

SEQ ID NO: 498297 - DNA, 25 bp, Homo sapien
aagtatgcccagtacctttaagata

SEQ ID NO: 498298 - DNA, 25 bp, Homo sapien
gaagctggtctgaagtacaccttga

SEQ ID NO: 498299 - DNA, 25 bp, Homo sapien
atatatgtacagttcatcacacact

SEQ ID NO: 498300 - DNA, 25 bp, Homo sapien
cacacactgtatttatttgctggag

SEQ ID NO: 498301 - DNA, 25 bp, Homo sapien
atttgctggagtgtaaattctcgga

SEQ ID NO: 498302 - DNA, 25 bp, Homo sapien
tcttttctcctccaacttgaaaaca

SEQ ID NO: 498303 - DNA, 25 bp, Homo sapien
caagaaatagattccccttccaaca

SEQ ID NO: 498304 - DNA, 25 bp, Homo sapien
ttccaacacagtctgagtgagttct

SEQ ID NO: 498305 - DNA, 25 bp, Homo sapien
gttctgtggagctatctgaagggat

SEQ ID NO: 498306 - DNA, 25 bp, Homo sapien
atctgaagggatgagcaatgggcca

SEQ ID NO: 498307 - DNA, 25 bp, Homo sapien
atacagtaggcgacatgctttcttg

SEQ ID NO: 498308 - DNA, 25 bp, Homo sapien
ctctgtaaacagaacctctttggat

SEQ ID NO: 498309 - DNA, 25 bp, Homo sapien
gaacctctttggataatcttgtgaa

SEQ ID NO: 498310 - DNA, 25 bp, Homo sapien
tctcctcccctgagaaaatccagta

SEQ ID NO: 498311 - DNA, 25 bp, Homo sapien
taagtacagtttcccttcagtctga

SEQ ID NO: 498312 - DNA, 25 bp, Homo sapien
cttcagtctgaaaggcatagtgcaa

SEQ ID NO: 498313 - DNA, 25 bp, Homo sapien
ggatgatttacttccaccagtatat

SEQ ID NO: 498314 - DNA, 25 bp, Homo sapien
atctttgtccgaactctgtctcgaa

SEQ ID NO: 498315 - DNA, 25 bp, Homo sapien
cgaactctgtctcgaacttttaaag

SEQ ID NO: 498316 - DNA, 25 bp, Homo sapien
gctgcccagcatcaggaccggtctt

SEQ ID NO: 498317 - DNA, 25 bp, Homo sapien
tcaggaccggtcttctttctaacaa

SEQ ID NO: 498318 - DNA, 25 bp, Homo sapien
aaatgacccctgaccaagaaccttg

SEQ ID NO: 498319 - DNA, 25 bp, Homo sapien
gaagacttggtttgatccaagccaa

SEQ ID NO: 498320 - DNA, 25 bp, Homo sapien
ggtttgatccaagccaaagtttgaa

SEQ ID NO: 498321 - DNA, 25 bp, Homo sapien
gaagtagaacgaacatgtccaggtc

SEQ ID NO: 498322 - DNA, 25 bp, Homo sapien
gaacatgtccaggtctttcagaacg

SEQ ID NO: 498323 - DNA, 25 bp, Homo sapien
ccaggtctttcagaacgaaggttca

SEQ ID NO: 498324 - DNA, 25 bp, Homo sapien
tagaaaagttcctccagaattaaag

SEQ ID NO: 498325 - DNA, 25 bp, Homo sapien
cttggttaacttacaggttgcttat

SEQ ID NO: 498326 - DNA, 25 bp, Homo sapien
ggttgcttataatggtgatcctgaa

SEQ ID NO: 498327 - DNA, 25 bp, Homo sapien
gtgccctaatccaatttgcaacata

SEQ ID NO: 498328 - DNA, 25 bp, Homo sapien
aagcaatatcaagtacggaagcagt

SEQ ID NO: 498329 - DNA, 25 bp, Homo sapien
agcagtattaaacaatcgctttatt

SEQ ID NO: 498330 - DNA, 25 bp, Homo sapien
gaagtggcctgaacagaatgctgga

SEQ ID NO: 498331 - DNA, 25 bp, Homo sapien
tgaacagaatgctggaacccaggct

SEQ ID NO: 498332 - DNA, 25 bp, Homo sapien
aggctggactcggacacactaaggt

SEQ ID NO: 498333 - DNA, 25 bp, Homo sapien
gactcggacacactaaggttttgat

SEQ ID NO: 498334 - DNA, 25 bp, Homo sapien
gaagatctaacctaagagtaagcta

SEQ ID NO: 498335 - DNA, 25 bp, Homo sapien
gagtaagctaaccacagggattctt

SEQ ID NO: 498336 - DNA, 25 bp, Homo sapien
cacagggattcttttgtagaacact

SEQ ID NO: 498337 - DNA, 25 bp, Homo sapien
gtagaacactttttatgcagatgaa

SEQ ID NO: 498338 - DNA, 25 bp, Homo sapien
gtaatttccccgaattggcatacca

SEQ ID NO: 498339 - DNA, 25 bp, Homo sapien
cgaattggcataccacggcgtggac

SEQ ID NO: 498340 - DNA, 25 bp, Homo sapien
accacggcgtggacagctgatattt

SEQ ID NO: 498341 - DNA, 25 bp, Homo sapien
agctctggaggttggtatagtaata

SEQ ID NO: 498342 - DNA, 25 bp, Homo sapien
ggttggtatagtaatagctgaccta

SEQ ID NO: 498343 - DNA, 25 bp, Homo sapien
atagctgacctattactgcatttgg

SEQ ID NO: 498344 - DNA, 25 bp, Homo sapien
ctattactgcatttgggagggatct

SEQ ID NO: 498345 - DNA, 25 bp, Homo sapien
ggagggatctgtcatagcttccttg

SEQ ID NO: 498346 - DNA, 25 bp, Homo sapien
catagcttccttgcctcttaattaa

SEQ ID NO: 498347 - DNA, 25 bp, Homo sapien
cttgcctcttaattaagggtggtgt

SEQ ID NO: 498348 - DNA, 25 bp, Homo sapien
tttttcttttagattcatgttacat

SEQ ID NO: 498349 - DNA, 25 bp, Homo sapien
agctgtcctcatttgtgactatgga

SEQ ID NO: 498350 - DNA, 25 bp, Homo sapien
cctcatttgtgactatggacctatg

SEQ ID NO: 498351 - DNA, 25 bp, Homo sapien
tggacctatggagttgggacaatct

SEQ ID NO: 498352 - DNA, 25 bp, Homo sapien
atttggacccgtaccatggggctca

SEQ ID NO: 498353 - DNA, 25 bp, Homo sapien
gacccgtaccatggggctcaggaca

SEQ ID NO: 498354 - DNA, 25 bp, Homo sapien
ctccttcgaggctgtgctgggtgca

SEQ ID NO: 498355 - DNA, 25 bp, Homo sapien
tgctgggtgcagaaccgccagagcc

SEQ ID NO: 498356 - DNA, 25 bp, Homo sapien
gctgggtgcagaaccgccagagcca

SEQ ID NO: 498357 - DNA, 25 bp, Homo sapien
ctgggtgcagaaccgccagagccac

SEQ ID NO: 498358 - DNA, 25 bp, Homo sapien
aaccgccagagccacccaaaaggtg

SEQ ID NO: 498359 - DNA, 25 bp, Homo sapien
ccgccagagccacccaaaaggtgtt

SEQ ID NO: 498360 - DNA, 25 bp, Homo sapien
gccagagccacccaaaaggtgtttc

SEQ ID NO: 498361 - DNA, 25 bp, Homo sapien
ccagagccacccaaaaggtgtttct

SEQ ID NO: 498362 - DNA, 25 bp, Homo sapien
agagccacccaaaaggtgtttctct

SEQ ID NO: 498363 - DNA, 25 bp, Homo sapien
caacaccagcctgctcgtcaacatc

SEQ ID NO: 498364 - DNA, 25 bp, Homo sapien
gggacaacagccacctccgctcagg

SEQ ID NO: 498365 - DNA, 25 bp, Homo sapien
actagtgtggcctctgtggtcacct

SEQ ID NO: 498366 - DNA, 25 bp, Homo sapien
agtgtggcctctgtggtcacctctg

SEQ ID NO: 498367 - DNA, 25 bp, Homo sapien
ctctgccgagtctccagcaagccga

SEQ ID NO: 498368 - DNA, 25 bp, Homo sapien
caagctggcgctgcgcaaacagctg

SEQ ID NO: 498369 - DNA, 25 bp, Homo sapien
ctggcgctgcgcaaacagctggaga

SEQ ID NO: 498370 - DNA, 25 bp, Homo sapien
taccgggagtgggtcctggaaccat

SEQ ID NO: 498371 - DNA, 25 bp, Homo sapien
ggagtgggtcctggaaccatactgc

SEQ ID NO: 498372 - DNA, 25 bp, Homo sapien
agtgggtcctggaaccatactgccc

SEQ ID NO: 498373 - DNA, 25 bp, Homo sapien
tgggtcctggaaccatactgcccct

SEQ ID NO: 498374 - DNA, 25 bp, Homo sapien
gtaaccgcgggttgcacgcatgcgt

SEQ ID NO: 498375 - DNA, 25 bp, Homo sapien
cacgcatgcgtgctgaaaagccttt

SEQ ID NO: 498376 - DNA, 25 bp, Homo sapien
atgcgtgctgaaaagcctttcaccc

SEQ ID NO: 498377 - DNA, 25 bp, Homo sapien
tgaaaagcctttcaccctcacgtgg

SEQ ID NO: 498378 - DNA, 25 bp, Homo sapien
gcctttcaccctcacgtggtttctt

SEQ ID NO: 498379 - DNA, 25 bp, Homo sapien
ttcttttttaaccagtcatcaagcg

SEQ ID NO: 498380 - DNA, 25 bp, Homo sapien
taaccagtcatcaagcgaggctcgc

SEQ ID NO: 498381 - DNA, 25 bp, Homo sapien
atcaagcgaggctcgcgcgcaggcc

SEQ ID NO: 498382 - DNA, 25 bp, Homo sapien
tggcggggaagctgaaacctctgaa

SEQ ID NO: 498383 - DNA, 25 bp, Homo sapien
aacctctgaatgtggaggcgccaga

SEQ ID NO: 498384 - DNA, 25 bp, Homo sapien
gggcaagtgggctgcactcctttct

SEQ ID NO: 498385 - DNA, 25 bp, Homo sapien
acatgataatgattcccagcccagg

SEQ ID NO: 498386 - DNA, 25 bp, Homo sapien
atgataatgattcccagcccaggag

SEQ ID NO: 498387 - DNA, 25 bp, Homo sapien
agcgtccgtcctgtaacgtgcttct

SEQ ID NO: 498388 - DNA, 25 bp, Homo sapien
gtccgtcctgtaacgtgcttctgtt

SEQ ID NO: 498389 - DNA, 25 bp, Homo sapien
cgtcctgtaacgtgcttctgtttgt

SEQ ID NO: 498390 - DNA, 25 bp, Homo sapien
tcctgtaacgtgcttctgtttgtta

SEQ ID NO: 498391 - DNA, 25 bp, Homo sapien
gtttgttatggtagaacagccctgt

SEQ ID NO: 498392 - DNA, 25 bp, Homo sapien
tgttatggtagaacagccctgtgtt

SEQ ID NO: 498393 - DNA, 25 bp, Homo sapien
ggtagaacagccctgtgttaatata

SEQ ID NO: 498394 - DNA, 25 bp, Homo sapien
acagccctgtgttaatatattgaag

SEQ ID NO: 498395 - DNA, 25 bp, Homo sapien
gccctgtgttaatatattgaagtca

SEQ ID NO: 498396 - DNA, 25 bp, Homo sapien
gaaagacttcaaattgatattcaac

SEQ ID NO: 498397 - DNA, 25 bp, Homo sapien
aattgatattcaacacttgtgtttg

SEQ ID NO: 498398 - DNA, 25 bp, Homo sapien
gatattcaacacttgtgtttgaaca

SEQ ID NO: 498399 - DNA, 25 bp, Homo sapien
gagaagaaaaactacctgtggtagg

SEQ ID NO: 498400 - DNA, 25 bp, Homo sapien
actacctgtggtaggaattggaaag

SEQ ID NO: 498401 - DNA, 25 bp, Homo sapien
aggaattggaaagcatctgtgtggt

SEQ ID NO: 498402 - DNA, 25 bp, Homo sapien
gaattggaaagcatctgtgtggtat

SEQ ID NO: 498403 - DNA, 25 bp, Homo sapien
ttggaaagcatctgtgtggtatggc

SEQ ID NO: 498404 - DNA, 25 bp, Homo sapien
gaaagcatctgtgtggtatggcaac

SEQ ID NO: 498405 - DNA, 25 bp, Homo sapien
aaagcatctgtgtggtatggcaaca

SEQ ID NO: 498406 - DNA, 25 bp, Homo sapien
aagcatctgtgtggtatggcaacag

SEQ ID NO: 498407 - DNA, 25 bp, Homo sapien
agagcgaccagccacctctgtcttt

SEQ ID NO: 498408 - DNA, 25 bp, Homo sapien
ctctgtctttcagctgcattcactg

SEQ ID NO: 498409 - DNA, 25 bp, Homo sapien
agctgcattcactgccttcatgtag

SEQ ID NO: 498410 - DNA, 25 bp, Homo sapien
gcattcactgccttcatgtagaaat

SEQ ID NO: 498411 - DNA, 25 bp, Homo sapien
tgccttcatgtagaaatgctgctct

SEQ ID NO: 498412 - DNA, 25 bp, Homo sapien
gctgctctccaggaatgattaattc

SEQ ID NO: 498413 - DNA, 25 bp, Homo sapien
gaatgattaattccattcttgtgtt

SEQ ID NO: 498414 - DNA, 25 bp, Homo sapien
gaactttaatttcacaaactgccat

SEQ ID NO: 498415 - DNA, 25 bp, Homo sapien
taatttcacaaactgccatctttat

SEQ ID NO: 498416 - DNA, 25 bp, Homo sapien
acatcatcttgtgaatcatagtagg

SEQ ID NO: 498417 - DNA, 25 bp, Homo sapien
tcatagtaggataagattccattat

SEQ ID NO: 498418 - DNA, 25 bp, Homo sapien
ttctggtccagtctactcttgttac

SEQ ID NO: 498419 - DNA, 25 bp, Homo sapien
ctcttgttactcttcaccatgtaga

SEQ ID NO: 498420 - DNA, 25 bp, Homo sapien
ggtatgttcctgaagtgtcgactca

SEQ ID NO: 498421 - DNA, 25 bp, Homo sapien
agtgtcgactcacagtttctgctaa

SEQ ID NO: 498422 - DNA, 25 bp, Homo sapien
gtttctgctaactgggccttattga

SEQ ID NO: 498423 - DNA, 25 bp, Homo sapien
cttattgaagcctggtctggtctgc

SEQ ID NO: 498424 - DNA, 25 bp, Homo sapien
tctggtctgcaacttgtagtgtcgt

SEQ ID NO: 498425 - DNA, 25 bp, Homo sapien
tataacgtcgtagggtgttcacctg

SEQ ID NO: 498426 - DNA, 25 bp, Homo sapien
gctggaacagatcaacctcaggaat

SEQ ID NO: 498427 - DNA, 25 bp, Homo sapien
aatgtcagtgtcgtgctcgggagaa

SEQ ID NO: 498428 - DNA, 25 bp, Homo sapien
cttccttttatttcggacactctgg

SEQ ID NO: 498429 - DNA, 25 bp, Homo sapien
attttctcgggattattgctcttct

SEQ ID NO: 498430 - DNA, 25 bp, Homo sapien
attgctcttctgtctataaattttg

SEQ ID NO: 498431 - DNA, 25 bp, Homo sapien
aaattttgaatgatactgtgcctta

SEQ ID NO: 498432 - DNA, 25 bp, Homo sapien
gatactgtgccttaattggttttca

SEQ ID NO: 498433 - DNA, 25 bp, Homo sapien
gggctattgtagttcccagattcaa

SEQ ID NO: 498434 - DNA, 25 bp, Homo sapien
tcccagattcaatccaccgaagtgt

SEQ ID NO: 498435 - DNA, 25 bp, Homo sapien
aagtgttcactgtcatctgttaggg

SEQ ID NO: 498436 - DNA, 25 bp, Homo sapien
cactgtcatctgttagggaattttt

SEQ ID NO: 498437 - DNA, 25 bp, Homo sapien
gtctttgcctggatccatagcgaga

SEQ ID NO: 498438 - DNA, 25 bp, Homo sapien
ggatccatagcgagagtgctctgta

SEQ ID NO: 498439 - DNA, 25 bp, Homo sapien
tttgtatttttgcacactgagatat

SEQ ID NO: 498440 - DNA, 25 bp, Homo sapien
aatcttccatatccgcaagttcact

SEQ ID NO: 498441 - DNA, 25 bp, Homo sapien
aagttcactggcactcttctggcac

SEQ ID NO: 498442 - DNA, 25 bp, Homo sapien
tggcacctgggcaagatcccagaac

SEQ ID NO: 498443 - DNA, 25 bp, Homo sapien
ggagtgactggcctcacagagctta

SEQ ID NO: 498444 - DNA, 25 bp, Homo sapien
tcacagagcttagtgcccgactcag

SEQ ID NO: 498445 - DNA, 25 bp, Homo sapien
tggtgcatgggaaatggtcagccta

SEQ ID NO: 498446 - DNA, 25 bp, Homo sapien
atggtcagcctaggataggacacga

SEQ ID NO: 498447 - DNA, 25 bp, Homo sapien
taggacacgagagtctgaaattcaa

SEQ ID NO: 498448 - DNA, 25 bp, Homo sapien
ttcaaagcaaccagcttgaagtggt

SEQ ID NO: 498449 - DNA, 25 bp, Homo sapien
tcaagacgaggatctggactgatgt

SEQ ID NO: 498450 - DNA, 25 bp, Homo sapien
gtagccacggaagcatgaactgtat

SEQ ID NO: 498451 - DNA, 25 bp, Homo sapien
tttaactttattatgaggccacaca

SEQ ID NO: 498452 - DNA, 25 bp, Homo sapien
ggccacacatattttcctgtgtttc

SEQ ID NO: 498453 - DNA, 25 bp, Homo sapien
cacatattttcctgtgtttctatat

SEQ ID NO: 498454 - DNA, 25 bp, Homo sapien
ctgtgtttctatatatagtttggaa

SEQ ID NO: 498455 - DNA, 25 bp, Homo sapien
ggaaaactatccttaatagtctgtt

SEQ ID NO: 498456 - DNA, 25 bp, Homo sapien
ttaatagtctgttttatatgcctta

SEQ ID NO: 498457 - DNA, 25 bp, Homo sapien
aagagcatcataatctgacctgagc

SEQ ID NO: 498458 - DNA, 25 bp, Homo sapien
ataatctgacctgagcatccacttg

SEQ ID NO: 498459 - DNA, 25 bp, Homo sapien
atctgacctgagcatccacttggag

SEQ ID NO: 498460 - DNA, 25 bp, Homo sapien
tgacctgagcatccacttggagagt

SEQ ID NO: 498461 - DNA, 25 bp, Homo sapien
gagcatccacttggagagtgttttt

SEQ ID NO: 498462 - DNA, 25 bp, Homo sapien
atcttaagagctgtactgacttgag

SEQ ID NO: 498463 - DNA, 25 bp, Homo sapien
gagacaagctctaactttttaaaca

SEQ ID NO: 498464 - DNA, 25 bp, Homo sapien
gcgtttattcacttcattatgttca

SEQ ID NO: 498465 - DNA, 25 bp, Homo sapien
atgttcattaagctttcatcttaga

SEQ ID NO: 498466 - DNA, 25 bp, Homo sapien
gaataccagtttcaccatttgggag

SEQ ID NO: 498467 - DNA, 25 bp, Homo sapien
gtttcaccatttgggagctgtttgt

SEQ ID NO: 498468 - DNA, 25 bp, Homo sapien
gagctgtttgtaatatgtgcaacct

SEQ ID NO: 498469 - DNA, 25 bp, Homo sapien
gcaaccttataaatagtgttttcca

SEQ ID NO: 498470 - DNA, 25 bp, Homo sapien
aaactgtgtcccaggactgcaaatc

SEQ ID NO: 498471 - DNA, 25 bp, Homo sapien
gtgtcccaggactgcaaatctttaa

SEQ ID NO: 498472 - DNA, 25 bp, Homo sapien
tgtctttttataatctcttccttta

SEQ ID NO: 498473 - DNA, 25 bp, Homo sapien
tgggcaaagcctggccgcgaaacgc

SEQ ID NO: 498474 - DNA, 25 bp, Homo sapien
ggagacccaacgttgttatcgtcag

SEQ ID NO: 498475 - DNA, 25 bp, Homo sapien
gttatcgtcaggagctgtgcaaact

SEQ ID NO: 498476 - DNA, 25 bp, Homo sapien
gtgcaaactgatgtgtgaacggcta

SEQ ID NO: 498477 - DNA, 25 bp, Homo sapien
gaacggctaaaactcagcacgtgga

SEQ ID NO: 498478 - DNA, 25 bp, Homo sapien
gaaagtgcagctaggagtcctgcaa

SEQ ID NO: 498479 - DNA, 25 bp, Homo sapien
gagtcctgcaatcaatgaatgcctt

SEQ ID NO: 498480 - DNA, 25 bp, Homo sapien
gaacatgccgatcctgaggctttgg

SEQ ID NO: 498481 - DNA, 25 bp, Homo sapien
ttggctgaaattctgcttgaaactt

SEQ ID NO: 498482 - DNA, 25 bp, Homo sapien
aaaataagacctactcatctgtgag

SEQ ID NO: 498483 - DNA, 25 bp, Homo sapien
atctgtgatagaattgctgcttaaa

SEQ ID NO: 498484 - DNA, 25 bp, Homo sapien
attaatttgtattgccccatggctg

SEQ ID NO: 498485 - DNA, 25 bp, Homo sapien
ttgtattgccccatggctgacaaaa

SEQ ID NO: 498486 - DNA, 25 bp, Homo sapien
tgccccatggctgacaaaagccttt

SEQ ID NO: 498487 - DNA, 25 bp, Homo sapien
ccatttttgaagagggtgaagtttg

SEQ ID NO: 498488 - DNA, 25 bp, Homo sapien
aaaaaccatcagtcatgtgagcaga

SEQ ID NO: 498489 - DNA, 25 bp, Homo sapien
cagtcatgtgagcagattttttaga

SEQ ID NO: 498490 - DNA, 25 bp, Homo sapien
acacacacgaaacttgaaatggctt

SEQ ID NO: 498491 - DNA, 25 bp, Homo sapien
atggctttgctttggctgtcgtctt

SEQ ID NO: 498492 - DNA, 25 bp, Homo sapien
ctttgctttggctgtcgtcttctgc

SEQ ID NO: 498493 - DNA, 25 bp, Homo sapien
tcgtcttctgccgtgtgccagatga

SEQ ID NO: 498494 - DNA, 25 bp, Homo sapien
gccgtgtgccagatgagcttgtgat

SEQ ID NO: 498495 - DNA, 25 bp, Homo sapien
catccttgccgaggtgttgtgagga

SEQ ID NO: 498496 - DNA, 25 bp, Homo sapien
aggtgcgacttggagagcaccctgc

SEQ ID NO: 498497 - DNA, 25 bp, Homo sapien
gtgtacagagagcttgtcagaccat

SEQ ID NO: 498498 - DNA, 25 bp, Homo sapien
agagagcttgtcagaccataactca

SEQ ID NO: 498499 - DNA, 25 bp, Homo sapien
atctctactctttatgactttgggc

SEQ ID NO: 498500 - DNA, 25 bp, Homo sapien
acgtggccaccattgcccattgaca

SEQ ID NO: 498501 - DNA, 25 bp, Homo sapien
ttgcccattgacactacctccgaaa

SEQ ID NO: 498502 - DNA, 25 bp, Homo sapien
attgtcacagccctagtctaagccc

SEQ ID NO: 498503 - DNA, 25 bp, Homo sapien
ttgcttactctctttgagtctcggt

SEQ ID NO: 498504 - DNA, 25 bp, Homo sapien
tgagtctcggtttcttgatctgtaa

SEQ ID NO: 498505 - DNA, 25 bp, Homo sapien
gggaaagcaggtgcatccttgccga

SEQ ID NO: 498506 - DNA, 25 bp, Homo sapien
ttcactgaagaacgcaattgcttta

SEQ ID NO: 498507 - DNA, 25 bp, Homo sapien
aaagcaaaccatgtcctgagatgtc

SEQ ID NO: 498508 - DNA, 25 bp, Homo sapien
accatgtcctgagatgtctgtgtta

SEQ ID NO: 498509 - DNA, 25 bp, Homo sapien
ctgagatgtctgtgttaatagtgca

SEQ ID NO: 498510 - DNA, 25 bp, Homo sapien
ttgaggttgctgtagcaatggcatt

SEQ ID NO: 498511 - DNA, 25 bp, Homo sapien
aactttaacttgaacattctcatcg

SEQ ID NO: 498512 - DNA, 25 bp, Homo sapien
aacattctcatcgatacttcctgga

SEQ ID NO: 498513 - DNA, 25 bp, Homo sapien
tctcatcgatacttcctggacatat

SEQ ID NO: 498514 - DNA, 25 bp, Homo sapien
acttcctggacatattttgtgtttt

SEQ ID NO: 498515 - DNA, 25 bp, Homo sapien
gtatttatttgccttgttcatatgt

SEQ ID NO: 498516 - DNA, 25 bp, Homo sapien
tgccttgttcatatgttcaattttc

SEQ ID NO: 498517 - DNA, 25 bp, Homo sapien
cacagaggtactgagtggtaagtaa

SEQ ID NO: 498518 - DNA, 25 bp, Homo sapien
gtaagtaacttttaccctgcctgag

SEQ ID NO: 498519 - DNA, 25 bp, Homo sapien
gtaacttttaccctgcctgagattc

SEQ ID NO: 498520 - DNA, 25 bp, Homo sapien
accctgcctgagattcctcaggaga

SEQ ID NO: 498521 - DNA, 25 bp, Homo sapien
taagactgtaagtccatgctgcctg

SEQ ID NO: 498522 - DNA, 25 bp, Homo sapien
atgctgcctggctactagagagcaa

SEQ ID NO: 498523 - DNA, 25 bp, Homo sapien
gctttcttaccaccagtgctgagga

SEQ ID NO: 498524 - DNA, 25 bp, Homo sapien
gtactgaacggaaacggagttgtct

SEQ ID NO: 498525 - DNA, 25 bp, Homo sapien
gaaacggagttgtctttgtactctt

SEQ ID NO: 498526 - DNA, 25 bp, Homo sapien
ctttgtactcttgagttgtacctta

SEQ ID NO: 498527 - DNA, 25 bp, Homo sapien
cttgagttgtaccttattcttccac

SEQ ID NO: 498528 - DNA, 25 bp, Homo sapien
gattaggacaagatcacacattcta

SEQ ID NO: 498529 - DNA, 25 bp, Homo sapien
tcacacattctatctgtgtctgtgg

SEQ ID NO: 498530 - DNA, 25 bp, Homo sapien
gctgcatattttgcaaaaccagaaa

SEQ ID NO: 498531 - DNA, 25 bp, Homo sapien
cagaaacaaaatcgcagactgccgt

SEQ ID NO: 498532 - DNA, 25 bp, Homo sapien
agactgccgtggtttagaccattta

SEQ ID NO: 498533 - DNA, 25 bp, Homo sapien
atttctgttcacttttatgctacca

SEQ ID NO: 498534 - DNA, 25 bp, Homo sapien
atgctaccagtatgactttataggg

SEQ ID NO: 498535 - DNA, 25 bp, Homo sapien
gccttttaattagccacctgggaat

SEQ ID NO: 498536 - DNA, 25 bp, Homo sapien
tagccacctgggaattactctttta

SEQ ID NO: 498537 - DNA, 25 bp, Homo sapien
aaaagaacatgataccactccaagt

SEQ ID NO: 498538 - DNA, 25 bp, Homo sapien
tccaagtaaatcattgccactaggg

SEQ ID NO: 498539 - DNA, 25 bp, Homo sapien
ccagggtccctgacggagcagcact

SEQ ID NO: 498540 - DNA, 25 bp, Homo sapien
gggtccctgacggagcagcactcag

SEQ ID NO: 498541 - DNA, 25 bp, Homo sapien
tccctgacggagcagcactcagcat

SEQ ID NO: 498542 - DNA, 25 bp, Homo sapien
ctgacggagcagcactcagcatgtg

SEQ ID NO: 498543 - DNA, 25 bp, Homo sapien
tgacggagcagcactcagcatgtga

SEQ ID NO: 498544 - DNA, 25 bp, Homo sapien
acggagcagcactcagcatgtgagt

SEQ ID NO: 498545 - DNA, 25 bp, Homo sapien
ggagcagcactcagcatgtgagtga

SEQ ID NO: 498546 - DNA, 25 bp, Homo sapien
cagcactcagcatgtgagtgaggcc

SEQ ID NO: 498547 - DNA, 25 bp, Homo sapien
actgcttcttacctcacgggggtgg

SEQ ID NO: 498548 - DNA, 25 bp, Homo sapien
attccgttatcttcctccagttttg

SEQ ID NO: 498549 - DNA, 25 bp, Homo sapien
ttccgttatcttcctccagttttgt

SEQ ID NO: 498550 - DNA, 25 bp, Homo sapien
gatgaataactttgacaggctggaa

SEQ ID NO: 498551 - DNA, 25 bp, Homo sapien
gctggaaaaaggtgacatttcaggt

SEQ ID NO: 498552 - DNA, 25 bp, Homo sapien
acatttcaggtagagcgtgtcacat

SEQ ID NO: 498553 - DNA, 25 bp, Homo sapien
aggtagagcgtgtcacatggatgta

SEQ ID NO: 498554 - DNA, 25 bp, Homo sapien
taaataccaaaggtcaaggacatgg

SEQ ID NO: 498555 - DNA, 25 bp, Homo sapien
ggtgactgtggcttgcattctatcc

SEQ ID NO: 498556 - DNA, 25 bp, Homo sapien
tgtggcttgcattctatccgtatca

SEQ ID NO: 498557 - DNA, 25 bp, Homo sapien
cttgcattctatccgtatcactatt

SEQ ID NO: 498558 - DNA, 25 bp, Homo sapien
gcattctatccgtatcactattaat

SEQ ID NO: 498559 - DNA, 25 bp, Homo sapien
cgtatcactattaattaccttctaa

SEQ ID NO: 498560 - DNA, 25 bp, Homo sapien
agggggctcttcacatgctgtgtgc

SEQ ID NO: 498561 - DNA, 25 bp, Homo sapien
gggcaggaaaaatctttctcaagcc

SEQ ID NO: 498562 - DNA, 25 bp, Homo sapien
ggaaaaatctttctcaagcctctcc

SEQ ID NO: 498563 - DNA, 25 bp, Homo sapien
aaaaatctttctcaagcctctccag

SEQ ID NO: 498564 - DNA, 25 bp, Homo sapien
cagatttggggctccgaggccacag

SEQ ID NO: 498565 - DNA, 25 bp, Homo sapien
gagacgccgggcaggtcccagcgcg

SEQ ID NO: 498566 - DNA, 25 bp, Homo sapien
aggtcccagcgcgtgagccaaagtc

SEQ ID NO: 498567 - DNA, 25 bp, Homo sapien
gtcccagcgcgtgagccaaagtcgg

SEQ ID NO: 498568 - DNA, 25 bp, Homo sapien
cccagcgcgtgagccaaagtcggag

SEQ ID NO: 498569 - DNA, 25 bp, Homo sapien
ggaggtcctccgagccgtgaccgga

SEQ ID NO: 498570 - DNA, 25 bp, Homo sapien
tccgagccgtgaccggagacatctg

SEQ ID NO: 498571 - DNA, 25 bp, Homo sapien
gagccgtgaccggagacatctgggc

SEQ ID NO: 498572 - DNA, 25 bp, Homo sapien
ggaagcggaccaccagccagtgcaa

SEQ ID NO: 498573 - DNA, 25 bp, Homo sapien
accagccagtgcaagtcagagcctc

SEQ ID NO: 498574 - DNA, 25 bp, Homo sapien
tcccctgctgcgtacaagcaagcgt

SEQ ID NO: 498575 - DNA, 25 bp, Homo sapien
acaagcaagcgtaccatctacaccg

SEQ ID NO: 498576 - DNA, 25 bp, Homo sapien
ggcggccgccctggtacaatgaaca

SEQ ID NO: 498577 - DNA, 25 bp, Homo sapien
cgcaatccaaagaggccttcgccat

SEQ ID NO: 498578 - DNA, 25 bp, Homo sapien
caaagaggccttcgccatcggcttg

SEQ ID NO: 498579 - DNA, 25 bp, Homo sapien
gaccactgtggccagaatgatcatc

SEQ ID NO: 498580 - DNA, 25 bp, Homo sapien
cagaatgatcatcgaggccctggat

SEQ ID NO: 498581 - DNA, 25 bp, Homo sapien
atgtgccctgggtggtcttgctgtc

SEQ ID NO: 498582 - DNA, 25 bp, Homo sapien
gctgtccatggactccttctacaag

SEQ ID NO: 498583 - DNA, 25 bp, Homo sapien
atgcagcgagtctggtatttcaggc

SEQ ID NO: 498584 - DNA, 25 bp, Homo sapien
tctggtatttcaggctggactccct

SEQ ID NO: 498585 - DNA, 25 bp, Homo sapien
tgctgttcccacaatcagccggtct

SEQ ID NO: 498586 - DNA, 25 bp, Homo sapien
gccggtctccagacactgagagggt

SEQ ID NO: 498587 - DNA, 25 bp, Homo sapien
ggagttctgggatcccacagtttaa

SEQ ID NO: 498588 - DNA, 25 bp, Homo sapien
agtttaactgtctgatcccaacttc

SEQ ID NO: 498589 - DNA, 25 bp, Homo sapien
actgtctgatcccaacttccagtga

SEQ ID NO: 498590 - DNA, 25 bp, Homo sapien
gtgaccatcacattcacttctggac

SEQ ID NO: 498591 - DNA, 25 bp, Homo sapien
cttctggacagtattcaacacatct

SEQ ID NO: 498592 - DNA, 25 bp, Homo sapien
gacagtattcaacacatctgatagg

SEQ ID NO: 498593 - DNA, 25 bp, Homo sapien
gggcatcatgggtcccaacaagatt

SEQ ID NO: 498594 - DNA, 25 bp, Homo sapien
gtttgactgctcctcatagtcacag

SEQ ID NO: 498595 - DNA, 25 bp, Homo sapien
ctgggcttccgatgctccctctgaa

SEQ ID NO: 498596 - DNA, 25 bp, Homo sapien
cgatgctccctctgaaccactgaaa

SEQ ID NO: 498597 - DNA, 25 bp, Homo sapien
gggctcacaccatgtgtgcttctag

SEQ ID NO: 498598 - DNA, 25 bp, Homo sapien
accatgtgtgcttctagtctgtctt

SEQ ID NO: 498599 - DNA, 25 bp, Homo sapien
cctctcaaagtctggtagattacga

SEQ ID NO: 498600 - DNA, 25 bp, Homo sapien
gtctggtagattacgacagctctga

SEQ ID NO: 498601 - DNA, 25 bp, Homo sapien
aatccacagagcagtgtttagctaa

SEQ ID NO: 498602 - DNA, 25 bp, Homo sapien
ttagctaacagtaaacagacatctt

SEQ ID NO: 498603 - DNA, 25 bp, Homo sapien
gacatctttacaccagcaagcaact

SEQ ID NO: 498604 - DNA, 25 bp, Homo sapien
gcaagcaactaaggagattcaggat

SEQ ID NO: 498605 - DNA, 25 bp, Homo sapien
gagactgattgtcacagaattttct

SEQ ID NO: 498606 - DNA, 25 bp, Homo sapien
gaattttctaattacccacatgtgg

SEQ ID NO: 498607 - DNA, 25 bp, Homo sapien
tacccacatgtggagcgatttccta

SEQ ID NO: 498608 - DNA, 25 bp, Homo sapien
tgtggagcgatttcctaatgtgaaa

SEQ ID NO: 498609 - DNA, 25 bp, Homo sapien
atacttttcttgatggtatgagatc

SEQ ID NO: 498610 - DNA, 25 bp, Homo sapien
gatcagtaccattggacatacacag

SEQ ID NO: 498611 - DNA, 25 bp, Homo sapien
gcaactaaaatgctgaccttacagg

SEQ ID NO: 498612 - DNA, 25 bp, Homo sapien
ttttccaagtcacttcttgcaatat

SEQ ID NO: 498613 - DNA, 25 bp, Homo sapien
gaccttacaggttcatggtttcatt

SEQ ID NO: 498614 - DNA, 25 bp, Homo sapien
tcatttttggtcttcatgaaaagct

SEQ ID NO: 498615 - DNA, 25 bp, Homo sapien
ggtcttcatgaaaagcttgaattct

SEQ ID NO: 498616 - DNA, 25 bp, Homo sapien
tgtcctctgcttgataaaccacctg

SEQ ID NO: 498617 - DNA, 25 bp, Homo sapien
gataaaccacctgagctttggtcat

SEQ ID NO: 498618 - DNA, 25 bp, Homo sapien
ctttggtcattagcagtctcctgtg

SEQ ID NO: 498619 - DNA, 25 bp, Homo sapien
cactcaggtagtgtctgcacaggcc

SEQ ID NO: 498620 - DNA, 25 bp, Homo sapien
gtctgcacaggccactctatgtctt

SEQ ID NO: 498621 - DNA, 25 bp, Homo sapien
cttttccatgctgaagaaattcctt

SEQ ID NO: 498622 - DNA, 25 bp, Homo sapien
ttccaggccatgtctgtgttcctcc

SEQ ID NO: 498623 - DNA, 25 bp, Homo sapien
ttttgagcatgttcatcctccaagc

SEQ ID NO: 498624 - DNA, 25 bp, Homo sapien
tcctccaagctgaatgcagggtctt

SEQ ID NO: 498625 - DNA, 25 bp, Homo sapien
cagggtcttgggtagtggtcctcac

SEQ ID NO: 498626 - DNA, 25 bp, Homo sapien
gatgagggactgcacccaccagagt

SEQ ID NO: 498627 - DNA, 25 bp, Homo sapien
tgttcctcacatgccttgtctataa

SEQ ID NO: 498628 - DNA, 25 bp, Homo sapien
gcagtagttgggtattgttagcttt

SEQ ID NO: 498629 - DNA, 25 bp, Homo sapien
gaaacaaaagccctactggtcttct

SEQ ID NO: 498630 - DNA, 25 bp, Homo sapien
gccctactggtcttctaattttgga

SEQ ID NO: 498631 - DNA, 25 bp, Homo sapien
atatctggacagtacaaagtgaatt

SEQ ID NO: 498632 - DNA, 25 bp, Homo sapien
aaccatttgtaactacctagattca

SEQ ID NO: 498633 - DNA, 25 bp, Homo sapien
acctagattcaatcaggatttcctt

SEQ ID NO: 498634 - DNA, 25 bp, Homo sapien
tcaggatttccttgatttgtgcaaa

SEQ ID NO: 498635 - DNA, 25 bp, Homo sapien
gctacttgtataaaaacctatggtt

SEQ ID NO: 498636 - DNA, 25 bp, Homo sapien
gggttcatcataatagtctcattgt

SEQ ID NO: 498637 - DNA, 25 bp, Homo sapien
atagtctcattgttagcatatccta

SEQ ID NO: 498638 - DNA, 25 bp, Homo sapien
ctttaggcagagttgttgagctcag

SEQ ID NO: 498639 - DNA, 25 bp, Homo sapien
gatttttcttaggaagtaccagata

SEQ ID NO: 498640 - DNA, 25 bp, Homo sapien
gtaccagatacaaaaacccatgagg

SEQ ID NO: 498641 - DNA, 25 bp, Homo sapien
caaaaacccatgagggattcctgga

SEQ ID NO: 498642 - DNA, 25 bp, Homo sapien
aaaatctggcatcatttctttacag

SEQ ID NO: 498643 - DNA, 25 bp, Homo sapien
ggcatcatttctttacaggacacat

SEQ ID NO: 498644 - DNA, 25 bp, Homo sapien
ggaggcccttggtctttgccattgc

SEQ ID NO: 498645 - DNA, 25 bp, Homo sapien
ttgccattgctgttggcaggccttg

SEQ ID NO: 498646 - DNA, 25 bp, Homo sapien
ttgcccatcactttagaggttttta

SEQ ID NO: 498647 - DNA, 25 bp, Homo sapien
tagaggtttttaagcctgttgaact

SEQ ID NO: 498648 - DNA, 25 bp, Homo sapien
aattatctcagctgtgctttagaca

SEQ ID NO: 498649 - DNA, 25 bp, Homo sapien
ggtctgttccataacaggatccaca

SEQ ID NO: 498650 - DNA, 25 bp, Homo sapien
gtgagggctgtgtggtatcaccttt

SEQ ID NO: 498651 - DNA, 25 bp, Homo sapien
atcacctttttagctttatctctgg

SEQ ID NO: 498652 - DNA, 25 bp, Homo sapien
ttatctctgggcagctcaaaggact

SEQ ID NO: 498653 - DNA, 25 bp, Homo sapien
gctcaaaggactgaggctggttgct

SEQ ID NO: 498654 - DNA, 25 bp, Homo sapien
tctcacccatcgctgtttgacataa

SEQ ID NO: 498655 - DNA, 25 bp, Homo sapien
gtttgacataacctcctgattctat

SEQ ID NO: 498656 - DNA, 25 bp, Homo sapien
aacctcctgattctattattgtcac

SEQ ID NO: 498657 - DNA, 25 bp, Homo sapien
ttattgtcacagcattaacctccac

SEQ ID NO: 498658 - DNA, 25 bp, Homo sapien
cacagcattaacctccacagtaaaa

SEQ ID NO: 498659 - DNA, 25 bp, Homo sapien
aaaacgatctgcagacaacctttgg

SEQ ID NO: 498660 - DNA, 25 bp, Homo sapien
gactccctcgtaatcaactacttta

SEQ ID NO: 498661 - DNA, 25 bp, Homo sapien
caatggctcaaaactgttcttgcaa

SEQ ID NO: 498662 - DNA, 25 bp, Homo sapien
gttcttgcaacacgtgaggcagcct

SEQ ID NO: 498663 - DNA, 25 bp, Homo sapien
agtcccgcttctagctggcgaaggc

SEQ ID NO: 498664 - DNA, 25 bp, Homo sapien
tgtaccttctcttcccatgtgtgaa

SEQ ID NO: 498665 - DNA, 25 bp, Homo sapien
gtgtgaacgggatgtaccggtactt

SEQ ID NO: 498666 - DNA, 25 bp, Homo sapien
gtaccggtacttaatcatgtgcttg

SEQ ID NO: 498667 - DNA, 25 bp, Homo sapien
atcatgtgcttgatttgcctcttca

SEQ ID NO: 498668 - DNA, 25 bp, Homo sapien
ttgcctcttcatcgtgatacagaag

SEQ ID NO: 498669 - DNA, 25 bp, Homo sapien
gaagtacatcaccagaatcggccag

SEQ ID NO: 498670 - DNA, 25 bp, Homo sapien
gaatcggccagaacaccgggacgtt

SEQ ID NO: 498671 - DNA, 25 bp, Homo sapien
ggcagaaaataaccatcaacctaga

SEQ ID NO: 498672 - DNA, 25 bp, Homo sapien
aaccatcaacctagaattgggcact

SEQ ID NO: 498673 - DNA, 25 bp, Homo sapien
atcaacctagaattgggcactcagc

SEQ ID NO: 498674 - DNA, 25 bp, Homo sapien
aggtacatggaaactgaatttaaca

SEQ ID NO: 498675 - DNA, 25 bp, Homo sapien
gaatttaacatctacctacactttt

SEQ ID NO: 498676 - DNA, 25 bp, Homo sapien
ttttaatgacaaatgacagaccaat

SEQ ID NO: 498677 - DNA, 25 bp, Homo sapien
agtctgagatagaagtgatgggcaa

SEQ ID NO: 498678 - DNA, 25 bp, Homo sapien
gacagaccaataattgattcctcaa

SEQ ID NO: 498679 - DNA, 25 bp, Homo sapien
attgattcctcaataaaacaatgga

SEQ ID NO: 498680 - DNA, 25 bp, Homo sapien
gtagaattgtacattcagaatgctg

SEQ ID NO: 498681 - DNA, 25 bp, Homo sapien
tgtacattcagaatgctggcagaaa

SEQ ID NO: 498682 - DNA, 25 bp, Homo sapien
ggtggaggccgctaagcatggtaga

SEQ ID NO: 498683 - DNA, 25 bp, Homo sapien
aggaagtctatccacaggcagttgt

SEQ ID NO: 498684 - DNA, 25 bp, Homo sapien
tatccacaggcagttgtgttcccag

SEQ ID NO: 498685 - DNA, 25 bp, Homo sapien
catcctgcatggttcacaccaagag

SEQ ID NO: 498686 - DNA, 25 bp, Homo sapien
ttcacaccaagagaaccttcagatc

SEQ ID NO: 498687 - DNA, 25 bp, Homo sapien
aagagaaccttcagatcctaccagc

SEQ ID NO: 498688 - DNA, 25 bp, Homo sapien
tcagatcctaccagcaaccgtagca

SEQ ID NO: 498689 - DNA, 25 bp, Homo sapien
tcccagaagccagtaaagagaccag

SEQ ID NO: 498690 - DNA, 25 bp, Homo sapien
aagccagtaaagagaccaggagcca

SEQ ID NO: 498691 - DNA, 25 bp, Homo sapien
tccctgcctgatgtccctggtggag

SEQ ID NO: 498692 - DNA, 25 bp, Homo sapien
ctccgggcgggcaagcctctgattt

SEQ ID NO: 498693 - DNA, 25 bp, Homo sapien
actctgagggttaaactgaagatac

SEQ ID NO: 498694 - DNA, 25 bp, Homo sapien
taaatttcttaggaaacaaactgtg

SEQ ID NO: 498695 - DNA, 25 bp, Homo sapien
acaaactgtgacatcgcttttaaaa

SEQ ID NO: 498696 - DNA, 25 bp, Homo sapien
gtgtttttgagttggcttggactag

SEQ ID NO: 498697 - DNA, 25 bp, Homo sapien
aagttcactgctggcaatggttatg

SEQ ID NO: 498698 - DNA, 25 bp, Homo sapien
ttcactgctggcaatggttatgcca

SEQ ID NO: 498699 - DNA, 25 bp, Homo sapien
caatggttatgccagtagttaagtt

SEQ ID NO: 498700 - DNA, 25 bp, Homo sapien
tggttatgccagtagttaagttaaa

SEQ ID NO: 498701 - DNA, 25 bp, Homo sapien
cagattgatgtcttgtataaccaga

SEQ ID NO: 498702 - DNA, 25 bp, Homo sapien
gtataaccagacaatcatcttcaag

SEQ ID NO: 498703 - DNA, 25 bp, Homo sapien
aaccagacaatcatcttcaagcaaa

SEQ ID NO: 498704 - DNA, 25 bp, Homo sapien
tcactgtgtgaggtgcgcatgtcca

SEQ ID NO: 498705 - DNA, 25 bp, Homo sapien
atggccatggccgtggcctctgttg

SEQ ID NO: 498706 - DNA, 25 bp, Homo sapien
tgttgccctcagcaatccttgggtt

SEQ ID NO: 498707 - DNA, 25 bp, Homo sapien
agcaatccttgggttggacctgctc

SEQ ID NO: 498708 - DNA, 25 bp, Homo sapien
ctcatgtctccgtcagtgtttaaat

SEQ ID NO: 498709 - DNA, 25 bp, Homo sapien
aaatctgaagccaacaatcctctct

SEQ ID NO: 498710 - DNA, 25 bp, Homo sapien
ccaacaatcctctctccatttttat

SEQ ID NO: 498711 - DNA, 25 bp, Homo sapien
actctcgggctcgagggctgctcgt

SEQ ID NO: 498712 - DNA, 25 bp, Homo sapien
ggctgctcgttgtcggagagcacaa

SEQ ID NO: 498713 - DNA, 25 bp, Homo sapien
gtcggagagcacaatcacgtcaggt

SEQ ID NO: 498714 - DNA, 25 bp, Homo sapien
tctcggacttcatgtcactgtgtga

SEQ ID NO: 498715 - DNA, 25 bp, Homo sapien
ggacagtttgtgtatgaatcatttt

SEQ ID NO: 498716 - DNA, 25 bp, Homo sapien
gaattagggcaatcttttttgttgg

SEQ ID NO: 498717 - DNA, 25 bp, Homo sapien
gaagtagaataaattgtgctccaat

SEQ ID NO: 498718 - DNA, 25 bp, Homo sapien
attgtgctccaatttcaggtgctta

SEQ ID NO: 498719 - DNA, 25 bp, Homo sapien
tgtgctccaatttcaggtgcttatg

SEQ ID NO: 498720 - DNA, 25 bp, Homo sapien
gctccaatttcaggtgcttatgaaa

SEQ ID NO: 498721 - DNA, 25 bp, Homo sapien
attgtaccacaacctgaatattatg

SEQ ID NO: 498722 - DNA, 25 bp, Homo sapien
tattatgttgtgtaaatccctccag

SEQ ID NO: 498723 - DNA, 25 bp, Homo sapien
atgttgtgtaaatccctccagccat

SEQ ID NO: 498724 - DNA, 25 bp, Homo sapien
gggcaacttttagataaggaatgaa

SEQ ID NO: 498725 - DNA, 25 bp, Homo sapien
gaatgaaattacttgtggtataatc

SEQ ID NO: 498726 - DNA, 25 bp, Homo sapien
gatctgacacctcacctggcaatga

SEQ ID NO: 498727 - DNA, 25 bp, Homo sapien
agccgtttccctctgttggatcttc

SEQ ID NO: 498728 - DNA, 25 bp, Homo sapien
ttggatcttccagccttattctcaa

SEQ ID NO: 498729 - DNA, 25 bp, Homo sapien
tccagccttattctcaacagttcat

SEQ ID NO: 498730 - DNA, 25 bp, Homo sapien
acagttcatttttagttcacattct

SEQ ID NO: 498731 - DNA, 25 bp, Homo sapien
gttcacattcttgaccgaatctcag

SEQ ID NO: 498732 - DNA, 25 bp, Homo sapien
atctcagtagctcagttaatctttt

SEQ ID NO: 498733 - DNA, 25 bp, Homo sapien
taatctttttatgtctgctctgctc

SEQ ID NO: 498734 - DNA, 25 bp, Homo sapien
atgtctgctctgctcttgggtcata

SEQ ID NO: 498735 - DNA, 25 bp, Homo sapien
tgctcttgggtcatatgttccgtga

SEQ ID NO: 498736 - DNA, 25 bp, Homo sapien
atatgttccgtgaggtttcttaggg

SEQ ID NO: 498737 - DNA, 25 bp, Homo sapien
gtactgtttgacaagcccacccggg

SEQ ID NO: 498738 - DNA, 25 bp, Homo sapien
acctccatcaaggaattccgggaga

SEQ ID NO: 498739 - DNA, 25 bp, Homo sapien
gaattccgggagatgaccctcggct

SEQ ID NO: 498740 - DNA, 25 bp, Homo sapien
tgaccctcggcttcctcaaggcgaa

SEQ ID NO: 498741 - DNA, 25 bp, Homo sapien
tcctcaaggcgaacctgggagacct

SEQ ID NO: 498742 - DNA, 25 bp, Homo sapien
cgctggttggccaggtcctgctcat

SEQ ID NO: 498743 - DNA, 25 bp, Homo sapien
tcctgctcatggctgacttcaacaa

SEQ ID NO: 498744 - DNA, 25 bp, Homo sapien
gacttcaacaaggacaaccgggtgt

SEQ ID NO: 498745 - DNA, 25 bp, Homo sapien
tgtgggccctgctgcagcgtaacga

SEQ ID NO: 498746 - DNA, 25 bp, Homo sapien
tgctgcagcgtaacgagttcctgct

SEQ ID NO: 498747 - DNA, 25 bp, Homo sapien
gaaggagcacgcctccagactgctg

SEQ ID NO: 498748 - DNA, 25 bp, Homo sapien
cgtttgtacattccatcacacccag

SEQ ID NO: 498749 - DNA, 25 bp, Homo sapien
tcacacccagcaatagctgtacatt

SEQ ID NO: 498750 - DNA, 25 bp, Homo sapien
gtacattgtagtcagcaaccatttt

SEQ ID NO: 498751 - DNA, 25 bp, Homo sapien
gttttttcacgactgaacaccagct

SEQ ID NO: 498752 - DNA, 25 bp, Homo sapien
gaacaccagctgctatcaagcaagc

SEQ ID NO: 498753 - DNA, 25 bp, Homo sapien
tcaagcaagcttatatcatgtaaat

SEQ ID NO: 498754 - DNA, 25 bp, Homo sapien
ggatgtgtcacaagagacttttgac

SEQ ID NO: 498755 - DNA, 25 bp, Homo sapien
acaattctgaggaaccttgtgtcca

SEQ ID NO: 498756 - DNA, 25 bp, Homo sapien
aggaaccttgtgtccagttgttaca

SEQ ID NO: 498757 - DNA, 25 bp, Homo sapien
taagctttgaacctaacctgcatcc

SEQ ID NO: 498758 - DNA, 25 bp, Homo sapien
ccatttccagcctcttttcaagctg

SEQ ID NO: 498759 - DNA, 25 bp, Homo sapien
ccaccctgacatcataacacaatag

SEQ ID NO: 498760 - DNA, 25 bp, Homo sapien
ggttttctgtagtgtatttttcatc

SEQ ID NO: 498761 - DNA, 25 bp, Homo sapien
gtatttttcatcagttgtttctcaa

SEQ ID NO: 498762 - DNA, 25 bp, Homo sapien
cagttgtttctcaaagtcatcgtac

SEQ ID NO: 498763 - DNA, 25 bp, Homo sapien
agtcatcgtacttctgcttctgttt

SEQ ID NO: 498764 - DNA, 25 bp, Homo sapien
actgatggtgttcctgctactttaa

SEQ ID NO: 498765 - DNA, 25 bp, Homo sapien
ggtgttcctgctactttaaatgtct

SEQ ID NO: 498766 - DNA, 25 bp, Homo sapien
aaatgtctacttccaacatccttga

SEQ ID NO: 498767 - DNA, 25 bp, Homo sapien
tccaacatccttgaatttgcaagtg

SEQ ID NO: 498768 - DNA, 25 bp, Homo sapien
gaaggacaacaatctctgagagacg

SEQ ID NO: 498769 - DNA, 25 bp, Homo sapien
ggatggacactaagccctgggcaca

SEQ ID NO: 498770 - DNA, 25 bp, Homo sapien
tctcttgagcagttagcagacctaa

SEQ ID NO: 498771 - DNA, 25 bp, Homo sapien
gcagacctaaagcaagcctgaattg

SEQ ID NO: 498772 - DNA, 25 bp, Homo sapien
gcctgaattggctatgcagtacatt

SEQ ID NO: 498773 - DNA, 25 bp, Homo sapien
accagttttccagaacactcttagc

SEQ ID NO: 498774 - DNA, 25 bp, Homo sapien
aacactcttagctatgttgacatga

SEQ ID NO: 498775 - DNA, 25 bp, Homo sapien
gttgacatgaggcagttccttccag

SEQ ID NO: 498776 - DNA, 25 bp, Homo sapien
agttccttccaggtgattctgtttc

SEQ ID NO: 498777 - DNA, 25 bp, Homo sapien
gattctgtttccttaagtattatat

SEQ ID NO: 498778 - DNA, 25 bp, Homo sapien
attattgttatctttacctcctgag

SEQ ID NO: 498779 - DNA, 25 bp, Homo sapien
ttacctcctgagtaataagcatggt

SEQ ID NO: 498780 - DNA, 25 bp, Homo sapien
ataagcatggtgtcagttttgtaca

SEQ ID NO: 498781 - DNA, 25 bp, Homo sapien
taaatcaaaggtggtttgtctagca

SEQ ID NO: 498782 - DNA, 25 bp, Homo sapien
gggaagaaagatgaccttctcccca

SEQ ID NO: 498783 - DNA, 25 bp, Homo sapien
cagcaccatttttgtttcacaccag

SEQ ID NO: 498784 - DNA, 25 bp, Homo sapien
agcaccatttttgtttcacaccagg

SEQ ID NO: 498785 - DNA, 25 bp, Homo sapien
gcaccatttttgtttcacaccaggc

SEQ ID NO: 498786 - DNA, 25 bp, Homo sapien
tcacaccaggcttgtggcattttgg

SEQ ID NO: 498787 - DNA, 25 bp, Homo sapien
caggcttgtggcattttggtgctca

SEQ ID NO: 498788 - DNA, 25 bp, Homo sapien
aggcttgtggcattttggtgctcac

SEQ ID NO: 498789 - DNA, 25 bp, Homo sapien
gcttgtggcattttggtgctcacag

SEQ ID NO: 498790 - DNA, 25 bp, Homo sapien
ttgtggcattttggtgctcacaggg

SEQ ID NO: 498791 - DNA, 25 bp, Homo sapien
ctcacaggggttttgccttctgacc

SEQ ID NO: 498792 - DNA, 25 bp, Homo sapien
gacatactgcagaagtcctgttggc

SEQ ID NO: 498793 - DNA, 25 bp, Homo sapien
agataggacggcctcctggtcctga

SEQ ID NO: 498794 - DNA, 25 bp, Homo sapien
tggaatactgcactgacagagagtc

SEQ ID NO: 498795 - DNA, 25 bp, Homo sapien
gagagtcatactccttagctgctgg

SEQ ID NO: 498796 - DNA, 25 bp, Homo sapien
ttagctgctggcttggccctgggca

SEQ ID NO: 498797 - DNA, 25 bp, Homo sapien
agcaatttgataggtatgtctgatc

SEQ ID NO: 498798 - DNA, 25 bp, Homo sapien
gtatgtctgatctcaatgtgcctga

SEQ ID NO: 498799 - DNA, 25 bp, Homo sapien
tctgatctcaatgtgcctgagcagc

SEQ ID NO: 498800 - DNA, 25 bp, Homo sapien
gagcagctctatcagtacatggttg

SEQ ID NO: 498801 - DNA, 25 bp, Homo sapien
tggttggaggacataggcgctttca

SEQ ID NO: 498802 - DNA, 25 bp, Homo sapien
taggcgctttcaaacaggaatgcat

SEQ ID NO: 498803 - DNA, 25 bp, Homo sapien
ggtaggtccacaacttggacccaca

SEQ ID NO: 498804 - DNA, 25 bp, Homo sapien
tggacccacaagataatgacagtgt

SEQ ID NO: 498805 - DNA, 25 bp, Homo sapien
gtgtggctgtgtaagactataaacc

SEQ ID NO: 498806 - DNA, 25 bp, Homo sapien
gactataaaccacagagatgatctc

SEQ ID NO: 498807 - DNA, 25 bp, Homo sapien
gatgatctcagtaaggatggaaaac

SEQ ID NO: 498808 - DNA, 25 bp, Homo sapien
ttttaaaaaggtcatcctcatgaaa

SEQ ID NO: 498809 - DNA, 25 bp, Homo sapien
tcctacagaggaatgacagctcgcg

SEQ ID NO: 498810 - DNA, 25 bp, Homo sapien
acagctcgcgaagcttcttaaagta

SEQ ID NO: 498811 - DNA, 25 bp, Homo sapien
aaagtacaacattcaagcaccacag

SEQ ID NO: 498812 - DNA, 25 bp, Homo sapien
gtacaacattcaagcaccacagcac

SEQ ID NO: 498813 - DNA, 25 bp, Homo sapien
acagcacatgcctaagggaagcatt

SEQ ID NO: 498814 - DNA, 25 bp, Homo sapien
gtttggacgcggaggataatcctgt

SEQ ID NO: 498815 - DNA, 25 bp, Homo sapien
ctaatagttcactgggtttggccct

SEQ ID NO: 498816 - DNA, 25 bp, Homo sapien
gtttggcccttagtgttgacttcag

SEQ ID NO: 498817 - DNA, 25 bp, Homo sapien
gttgacttcagtatgctgagacgga

SEQ ID NO: 498818 - DNA, 25 bp, Homo sapien
gctgagacggaaaccaacacgccta

SEQ ID NO: 498819 - DNA, 25 bp, Homo sapien
aaccaacacgcctagagctaaagct

SEQ ID NO: 498820 - DNA, 25 bp, Homo sapien
gagaacattcgaaaggacctggaga

SEQ ID NO: 498821 - DNA, 25 bp, Homo sapien
gagccattgggcttagcagtgatcc

SEQ ID NO: 498822 - DNA, 25 bp, Homo sapien
gcttagcagtgatcccaagagccgg

SEQ ID NO: 498823 - DNA, 25 bp, Homo sapien
gagccgggaacaaatgatcaatgat

SEQ ID NO: 498824 - DNA, 25 bp, Homo sapien
tgatcggattggttataaaccccaa

SEQ ID NO: 498825 - DNA, 25 bp, Homo sapien
atgggcgaacacgatgggcctcttc

SEQ ID NO: 498826 - DNA, 25 bp, Homo sapien
atgtttttgtggagtgtgatggctt

SEQ ID NO: 498827 - DNA, 25 bp, Homo sapien
atgggcctcttcttggcccagcggg

SEQ ID NO: 498828 - DNA, 25 bp, Homo sapien
gaagaccgccttctcagtgatgaag

SEQ ID NO: 498829 - DNA, 25 bp, Homo sapien
tgctcgtgtgccaggtacatctgac

SEQ ID NO: 498830 - DNA, 25 bp, Homo sapien
tgtgccaggtacatctgacactcat

SEQ ID NO: 498831 - DNA, 25 bp, Homo sapien
gtacatctgacactcatctagccgg

SEQ ID NO: 498832 - DNA, 25 bp, Homo sapien
tagccggcccttctcaaagtagtgg

SEQ ID NO: 498833 - DNA, 25 bp, Homo sapien
cggcccttctcaaagtagtggtaag

SEQ ID NO: 498834 - DNA, 25 bp, Homo sapien
ggcaggacgacggaagctactcagt

SEQ ID NO: 498835 - DNA, 25 bp, Homo sapien
tactcagtcctccaggacggatggg

SEQ ID NO: 498836 - DNA, 25 bp, Homo sapien
ctcaaggccctcagacaagtattct

SEQ ID NO: 498837 - DNA, 25 bp, Homo sapien
aaggccctcagacaagtattctaag

SEQ ID NO: 498838 - DNA, 25 bp, Homo sapien
gatgtcttgcttcttctaatttact

SEQ ID NO: 498839 - DNA, 25 bp, Homo sapien
tgtatttgggtgtattgcttctgat

SEQ ID NO: 498840 - DNA, 25 bp, Homo sapien
ttgcttctgatgataaatacggtct

SEQ ID NO: 498841 - DNA, 25 bp, Homo sapien
aagaaaggcatattcctgagggtcc

SEQ ID NO: 498842 - DNA, 25 bp, Homo sapien
ctgagggtccatttcctattattac

SEQ ID NO: 498843 - DNA, 25 bp, Homo sapien
gcaaaacggatggataatcataccc

SEQ ID NO: 498844 - DNA, 25 bp, Homo sapien
taatcatacccaaagtcagcatctg

SEQ ID NO: 498845 - DNA, 25 bp, Homo sapien
atacccaaagtcagcatctggatga

SEQ ID NO: 498846 - DNA, 25 bp, Homo sapien
cagcatctggatgaagaagtgtatc

SEQ ID NO: 498847 - DNA, 25 bp, Homo sapien
attctgctttatagaagctattctc

SEQ ID NO: 498848 - DNA, 25 bp, Homo sapien
gagcatatatgtagatcttcatttc

SEQ ID NO: 498849 - DNA, 25 bp, Homo sapien
atttcccaggatgattactaccttg

SEQ ID NO: 498850 - DNA, 25 bp, Homo sapien
ggatgattactaccttggattttaa

SEQ ID NO: 498851 - DNA, 25 bp, Homo sapien
ggattttaaggcttctttcttcaca

SEQ ID NO: 498852 - DNA, 25 bp, Homo sapien
ttcttcacaagttctgactcttcta

SEQ ID NO: 498853 - DNA, 25 bp, Homo sapien
aagttctgactcttctataagcaca

SEQ ID NO: 498854 - DNA, 25 bp, Homo sapien
tcagaatgctgactctcctttaggt

SEQ ID NO: 498855 - DNA, 25 bp, Homo sapien
atgctgactctcctttaggtagtca

SEQ ID NO: 498856 - DNA, 25 bp, Homo sapien
taggtagtcagaatgggtcttccaa

SEQ ID NO: 498857 - DNA, 25 bp, Homo sapien
ataaatatgcctattttcctttggg

SEQ ID NO: 498858 - DNA, 25 bp, Homo sapien
acagaggcgcggctcagtaattgaa

SEQ ID NO: 498859 - DNA, 25 bp, Homo sapien
attgaaggcctgaaacgcccatgtg

SEQ ID NO: 498860 - DNA, 25 bp, Homo sapien
acgcccatgtgccactgactaggag

SEQ ID NO: 498861 - DNA, 25 bp, Homo sapien
tgactaggaggcttccctgctgcgg

SEQ ID NO: 498862 - DNA, 25 bp, Homo sapien
tgcggcacttcatgacccagcggcg

SEQ ID NO: 498863 - DNA, 25 bp, Homo sapien
cggcccagtgaagccaccgtggtgt

SEQ ID NO: 498864 - DNA, 25 bp, Homo sapien
gaagccaccgtggtgtccagcatgg

SEQ ID NO: 498865 - DNA, 25 bp, Homo sapien
tggtgtccagcatggccgcgctgct

SEQ ID NO: 498866 - DNA, 25 bp, Homo sapien
cgggccatccagaaacttgctctac

SEQ ID NO: 498867 - DNA, 25 bp, Homo sapien
aaacttgctctacccgccgcgggtg

SEQ ID NO: 498868 - DNA, 25 bp, Homo sapien
caggagcctatttagggcgccggac

SEQ ID NO: 498869 - DNA, 25 bp, Homo sapien
gagagttgttggagctctaagacaa

SEQ ID NO: 498870 - DNA, 25 bp, Homo sapien
gttggagctctaagacaatacaaat

SEQ ID NO: 498871 - DNA, 25 bp, Homo sapien
atctgctttacaactagtatagacc

SEQ ID NO: 498872 - DNA, 25 bp, Homo sapien
agacctaaggtcatttgctttcaat

SEQ ID NO: 498873 - DNA, 25 bp, Homo sapien
atttgctttcaattagaggctccag

SEQ ID NO: 498874 - DNA, 25 bp, Homo sapien
ttagaggctccagagtcttcatagt

SEQ ID NO: 498875 - DNA, 25 bp, Homo sapien
ggctccagagtcttcatagtggaaa

SEQ ID NO: 498876 - DNA, 25 bp, Homo sapien
ttcttagttaagttgtagcacgtga

SEQ ID NO: 498877 - DNA, 25 bp, Homo sapien
gttgtagcacgtgaatacttactta

SEQ ID NO: 498878 - DNA, 25 bp, Homo sapien
gcacgtgaatacttacttacatgtt

SEQ ID NO: 498879 - DNA, 25 bp, Homo sapien
aaatatacttcttgcatagtttaat

SEQ ID NO: 498880 - DNA, 25 bp, Homo sapien
gttcggtgtccgtacggcagaacat

SEQ ID NO: 498881 - DNA, 25 bp, Homo sapien
gtacggcagaacatattctctctga

SEQ ID NO: 498882 - DNA, 25 bp, Homo sapien
ttctctctgagaagcttgcggtgga

SEQ ID NO: 498883 - DNA, 25 bp, Homo sapien
gaagcttgcggtggaactggcccat

SEQ ID NO: 498884 - DNA, 25 bp, Homo sapien
ggaactggcccatggaaatgtcttt

SEQ ID NO: 498885 - DNA, 25 bp, Homo sapien
ctggcccatggaaatgtctttagaa

SEQ ID NO: 498886 - DNA, 25 bp, Homo sapien
gaagagaagaaccacctggctctgt

SEQ ID NO: 498887 - DNA, 25 bp, Homo sapien
cctggctctgttcttgactctggaa

SEQ ID NO: 498888 - DNA, 25 bp, Homo sapien
gttgccagattaatttcctttagag

SEQ ID NO: 498889 - DNA, 25 bp, Homo sapien
aaaaataagcgagcggtgcgttgca

SEQ ID NO: 498890 - DNA, 25 bp, Homo sapien
ttgcaggtaacggagccagagccct

SEQ ID NO: 498891 - DNA, 25 bp, Homo sapien
agcaaacaattgatcccagaagggc

SEQ ID NO: 498892 - DNA, 25 bp, Homo sapien
gaagggcaaattgtttgagtcagta

SEQ ID NO: 498893 - DNA, 25 bp, Homo sapien
ttgtaacgtaattgcagtgcattta

SEQ ID NO: 498894 - DNA, 25 bp, Homo sapien
gcagtgcatttagacaggcatctat

SEQ ID NO: 498895 - DNA, 25 bp, Homo sapien
ggcatctatttggacctgtttctat

SEQ ID NO: 498896 - DNA, 25 bp, Homo sapien
ggacctgtttctatctctaaatgaa

SEQ ID NO: 498897 - DNA, 25 bp, Homo sapien
gaggtttacatatttctctgacatt

SEQ ID NO: 498898 - DNA, 25 bp, Homo sapien
tatttctctgacatttatatagttc

SEQ ID NO: 498899 - DNA, 25 bp, Homo sapien
atagttcttatgtccatttcagttg

SEQ ID NO: 498900 - DNA, 25 bp, Homo sapien
tatgtccatttcagttgaccagccg

SEQ ID NO: 498901 - DNA, 25 bp, Homo sapien
tgaccagccgctggtgattaaagtt

SEQ ID NO: 498902 - DNA, 25 bp, Homo sapien
caaacttagtattaggcaggtacac

SEQ ID NO: 498903 - DNA, 25 bp, Homo sapien
gcaggtacacagataagattttcca

SEQ ID NO: 498904 - DNA, 25 bp, Homo sapien
gattttccattcttaacattctcac

SEQ ID NO: 498905 - DNA, 25 bp, Homo sapien
aacattctcactgtaatgcacgaca

SEQ ID NO: 498906 - DNA, 25 bp, Homo sapien
atgcacgacatttgaagcacctgga

SEQ ID NO: 498907 - DNA, 25 bp, Homo sapien
gaagcacctggatgtgctatcaatc

SEQ ID NO: 498908 - DNA, 25 bp, Homo sapien
tgtgctatcaatcaggtgggaaatt

SEQ ID NO: 498909 - DNA, 25 bp, Homo sapien
ttggaagcattgagaaacattggtc

SEQ ID NO: 498910 - DNA, 25 bp, Homo sapien
ctcctgccccacaatatattattca

SEQ ID NO: 498911 - DNA, 25 bp, Homo sapien
gttcaaatcgatttatcactgaaag

SEQ ID NO: 498912 - DNA, 25 bp, Homo sapien
gaaaatgtgttttgaccaaacttag

SEQ ID NO: 498913 - DNA, 25 bp, Homo sapien
gcaacattatgtattcttgaaccta

SEQ ID NO: 498914 - DNA, 25 bp, Homo sapien
ttgaacctattatggctgtggaagt

SEQ ID NO: 498915 - DNA, 25 bp, Homo sapien
gttgtagctccaaatgaatttcagg

SEQ ID NO: 498916 - DNA, 25 bp, Homo sapien
aattgcaggaattaaccgacgccat

SEQ ID NO: 498917 - DNA, 25 bp, Homo sapien
tttacactgtatgcagatgtccctc

SEQ ID NO: 498918 - DNA, 25 bp, Homo sapien
agatgtccctctaaatgatatgttt

SEQ ID NO: 498919 - DNA, 25 bp, Homo sapien
gtttggttattccactgaacttagg

SEQ ID NO: 498920 - DNA, 25 bp, Homo sapien
gaacttaggtcatgcacagagggaa

SEQ ID NO: 498921 - DNA, 25 bp, Homo sapien
gagtatagcaggtatcagccatgtt

SEQ ID NO: 498922 - DNA, 25 bp, Homo sapien
gtatcagccatgtttaccatccaca

SEQ ID NO: 498923 - DNA, 25 bp, Homo sapien
taccatccacacaagaagacgtcat

SEQ ID NO: 498924 - DNA, 25 bp, Homo sapien
gtaattgaaggcctgaaacgcccat

SEQ ID NO: 498925 - DNA, 25 bp, Homo sapien
ttgaaggcctgaaacgcccatgtgc

SEQ ID NO: 498926 - DNA, 25 bp, Homo sapien
tgaaacgcccatgtgccactgacta

SEQ ID NO: 498927 - DNA, 25 bp, Homo sapien
acgcccatgtgccactgactaggag

SEQ ID NO: 498928 - DNA, 25 bp, Homo sapien
catgtgccactgactaggaggcttc

SEQ ID NO: 498929 - DNA, 25 bp, Homo sapien
tgactaggaggcttccctgctgcgg

SEQ ID NO: 498930 - DNA, 25 bp, Homo sapien
tgctgcggcacttcatgacccagcg

SEQ ID NO: 498931 - DNA, 25 bp, Homo sapien
tgcggcacttcatgacccagcggcg

SEQ ID NO: 498932 - DNA, 25 bp, Homo sapien
cggcccagtgaagccaccgtggtgt

SEQ ID NO: 498933 - DNA, 25 bp, Homo sapien
accgtggtgtccagcatggccgcgc

SEQ ID NO: 498934 - DNA, 25 bp, Homo sapien
tggtgtccagcatggccgcgctgct

SEQ ID NO: 498935 - DNA, 25 bp, Homo sapien
ctcatggaggtaaagctccctaggg

SEQ ID NO: 498936 - DNA, 25 bp, Homo sapien
tggaggtaaagctccctagggaaga

SEQ ID NO: 498937 - DNA, 25 bp, Homo sapien
ggtgggcctaaagcattggcagtca

SEQ ID NO: 498938 - DNA, 25 bp, Homo sapien
gcctaaagcattggcagtcactgtg

SEQ ID NO: 498939 - DNA, 25 bp, Homo sapien
gtgttccagaacgttttaggcatgg

SEQ ID NO: 498940 - DNA, 25 bp, Homo sapien
acgttttaggcatggtggctgataa

SEQ ID NO: 498941 - DNA, 25 bp, Homo sapien
tggctgataagtacacctgtgctga

SEQ ID NO: 498942 - DNA, 25 bp, Homo sapien
aagtacacctgtgctgagtctggtt

SEQ ID NO: 498943 - DNA, 25 bp, Homo sapien
acacctgtgctgagtctggttttga

SEQ ID NO: 498944 - DNA, 25 bp, Homo sapien
ctgtgctgagtctggttttgaatat

SEQ ID NO: 498945 - DNA, 25 bp, Homo sapien
tgaatatttagctctttctctccac

SEQ ID NO: 498946 - DNA, 25 bp, Homo sapien
gcacacatacatacaagagtcacgg

SEQ ID NO: 498947 - DNA, 25 bp, Homo sapien
agtcacggagaagagcagatcacca

SEQ ID NO: 498948 - DNA, 25 bp, Homo sapien
gagaagagcagatcaccaagtcaac

SEQ ID NO: 498949 - DNA, 25 bp, Homo sapien
gcagatcaccaagtcaacggttcaa

SEQ ID NO: 498950 - DNA, 25 bp, Homo sapien
tcaccaagtcaacggttcaactact

SEQ ID NO: 498951 - DNA, 25 bp, Homo sapien
tttaccaatctccataaatacggat

SEQ ID NO: 498952 - DNA, 25 bp, Homo sapien
gatgcccttctaaagaggattactt

SEQ ID NO: 498953 - DNA, 25 bp, Homo sapien
gaattctctaatgtttggatttctg

SEQ ID NO: 498954 - DNA, 25 bp, Homo sapien
taccaaagtttaatgaggccacagc

SEQ ID NO: 498955 - DNA, 25 bp, Homo sapien
gtttaatgaggccacagcatttttt

SEQ ID NO: 498956 - DNA, 25 bp, Homo sapien
agttcatattatttgctatttaaag

SEQ ID NO: 498957 - DNA, 25 bp, Homo sapien
gggacatgggtgttcctgcatctcc

SEQ ID NO: 498958 - DNA, 25 bp, Homo sapien
acatgggtgttcctgcatctcctag

SEQ ID NO: 498959 - DNA, 25 bp, Homo sapien
atgggtgttcctgcatctcctagcg

SEQ ID NO: 498960 - DNA, 25 bp, Homo sapien
gggtgttcctgcatctcctagcgca

SEQ ID NO: 498961 - DNA, 25 bp, Homo sapien
tgttcctgcatctcctagcgcagtt

SEQ ID NO: 498962 - DNA, 25 bp, Homo sapien
atctcctagcgcagttcctgctggt

SEQ ID NO: 498963 - DNA, 25 bp, Homo sapien
cctgctggtgggtggaagggtgcct

SEQ ID NO: 498964 - DNA, 25 bp, Homo sapien
tggaagggtgcctggtttaggcggg

SEQ ID NO: 498965 - DNA, 25 bp, Homo sapien
tgcaaagggcactgcctgtggccac

SEQ ID NO: 498966 - DNA, 25 bp, Homo sapien
ctgcctgtggccacgtggtgtctgt

SEQ ID NO: 498967 - DNA, 25 bp, Homo sapien
cgtggtgtctgtgggaattggtcct

SEQ ID NO: 498968 - DNA, 25 bp, Homo sapien
tattaatataaaaacctgccgggct

SEQ ID NO: 498969 - DNA, 25 bp, Homo sapien
ttaatataaaaacctgccgggctca

SEQ ID NO: 498970 - DNA, 25 bp, Homo sapien
aatataaaaacctgccgggctcagt

SEQ ID NO: 498971 - DNA, 25 bp, Homo sapien
atataaaaacctgccgggctcagtg

SEQ ID NO: 498972 - DNA, 25 bp, Homo sapien
aaattagacggatgtggtgtcgcac

SEQ ID NO: 498973 - DNA, 25 bp, Homo sapien
attagacggatgtggtgtcgcacac

SEQ ID NO: 498974 - DNA, 25 bp, Homo sapien
ttagacggatgtggtgtcgcacact

SEQ ID NO: 498975 - DNA, 25 bp, Homo sapien
tagacggatgtggtgtcgcacactt

SEQ ID NO: 498976 - DNA, 25 bp, Homo sapien
agacggatgtggtgtcgcacacttg

SEQ ID NO: 498977 - DNA, 25 bp, Homo sapien
acggatgtggtgtcgcacacttgta

SEQ ID NO: 498978 - DNA, 25 bp, Homo sapien
cggatgtggtgtcgcacacttgtaa

SEQ ID NO: 498979 - DNA, 25 bp, Homo sapien
aagagactaatttcagttatacttt

SEQ ID NO: 498980 - DNA, 25 bp, Homo sapien
acttttaagcttagaatgtatgttc

SEQ ID NO: 498981 - DNA, 25 bp, Homo sapien
gtatcataagagttttcaacataga

SEQ ID NO: 498982 - DNA, 25 bp, Homo sapien
aataaccacatactttccatctacc

SEQ ID NO: 498983 - DNA, 25 bp, Homo sapien
acatactttccatctaccttccttt

SEQ ID NO: 498984 - DNA, 25 bp, Homo sapien
gttaacgggttgtttatcatataat

SEQ ID NO: 498985 - DNA, 25 bp, Homo sapien
gtctattatctgtttaagtctcata

SEQ ID NO: 498986 - DNA, 25 bp, Homo sapien
ttaagtctcataactctatttttag

SEQ ID NO: 498987 - DNA, 25 bp, Homo sapien
ttttagtttgctgaagacttgaaag

SEQ ID NO: 498988 - DNA, 25 bp, Homo sapien
gacttgaaagtgaatcgcatatatc

SEQ ID NO: 498989 - DNA, 25 bp, Homo sapien
gaatcgcatatatcatgacacttct

SEQ ID NO: 498990 - DNA, 25 bp, Homo sapien
ccatgtgccatgttaacctgtgtta

SEQ ID NO: 498991 - DNA, 25 bp, Homo sapien
tcaggagagctcttagacaacaagc

SEQ ID NO: 498992 - DNA, 25 bp, Homo sapien
ttaagtgctcagtgttccaggccag

SEQ ID NO: 498993 - DNA, 25 bp, Homo sapien
tgctcagtgttccaggccagagtac

SEQ ID NO: 498994 - DNA, 25 bp, Homo sapien
agagggagggacactttgctgtctt

SEQ ID NO: 498995 - DNA, 25 bp, Homo sapien
aagttccattggcagggttcagacc

SEQ ID NO: 498996 - DNA, 25 bp, Homo sapien
tcagtcctttctttttaattgtatt

SEQ ID NO: 498997 - DNA, 25 bp, Homo sapien
tgtattgattcttttcctcggtaat

SEQ ID NO: 498998 - DNA, 25 bp, Homo sapien
cctcggtaataaataagtccatcct

SEQ ID NO: 498999 - DNA, 25 bp, Homo sapien
agggttcagacctgccattgtggac

SEQ ID NO: 499000 - DNA, 25 bp, Homo sapien
tattgggtagttaaccatgtgccat

SEQ ID NO: 499001 - DNA, 25 bp, Homo sapien
tgtggtttctgcaaatttgtaactg

SEQ ID NO: 499002 - DNA, 25 bp, Homo sapien
ttgtaactgcctctgttttaggagt

SEQ ID NO: 499003 - DNA, 25 bp, Homo sapien
ataagtattacttccttgtggtcta

SEQ ID NO: 499004 - DNA, 25 bp, Homo sapien
ttacttccttgtggtctattgtgaa

SEQ ID NO: 499005 - DNA, 25 bp, Homo sapien
aaagtagacccttgcatatactatt

SEQ ID NO: 499006 - DNA, 25 bp, Homo sapien
ttgcatatactattcttgtttgtgt

SEQ ID NO: 499007 - DNA, 25 bp, Homo sapien
attcttgtttgtgttcatcttaatg

SEQ ID NO: 499008 - DNA, 25 bp, Homo sapien
atcttaatgtttttgtacagctaaa

SEQ ID NO: 499009 - DNA, 25 bp, Homo sapien
agagttagtttcatcaacctaatga

SEQ ID NO: 499010 - DNA, 25 bp, Homo sapien
ttccttggaatttatcgtatattgt

SEQ ID NO: 499011 - DNA, 25 bp, Homo sapien
tcgtatattgtattcactgagatta

SEQ ID NO: 499012 - DNA, 25 bp, Homo sapien
aaccaagattcccagtgaagcacct

SEQ ID NO: 499013 - DNA, 25 bp, Homo sapien
agattcccagtgaagcacctgaggc

SEQ ID NO: 499014 - DNA, 25 bp, Homo sapien
cttcattgcccacatggatagacgg

SEQ ID NO: 499015 - DNA, 25 bp, Homo sapien
tgcccacatggatagacggagctgt

SEQ ID NO: 499016 - DNA, 25 bp, Homo sapien
cagagaacttttcccgcaacaggtg

SEQ ID NO: 499017 - DNA, 25 bp, Homo sapien
aacttttcccgcaacaggtgcagga

SEQ ID NO: 499018 - DNA, 25 bp, Homo sapien
accaccaacttgaattccgtcatca

SEQ ID NO: 499019 - DNA, 25 bp, Homo sapien
tgaattccgtcatcaatgctcaccg

SEQ ID NO: 499020 - DNA, 25 bp, Homo sapien
gtcatcaatgctcaccgtcaatatg

SEQ ID NO: 499021 - DNA, 25 bp, Homo sapien
aatgctcaccgtcaatatgtttaca

SEQ ID NO: 499022 - DNA, 25 bp, Homo sapien
gctcaccgtcaatatgtttacaagt

SEQ ID NO: 499023 - DNA, 25 bp, Homo sapien
cctcagctttggcacttttgttgat

SEQ ID NO: 499024 - DNA, 25 bp, Homo sapien
gttgctaaggagcagtgaccttgct

SEQ ID NO: 499025 - DNA, 25 bp, Homo sapien
aagactgaataatccacccactgaa

SEQ ID NO: 499026 - DNA, 25 bp, Homo sapien
atccacccactgaatagctaacctg

SEQ ID NO: 499027 - DNA, 25 bp, Homo sapien
ttcctttgtggatctccccaaatcc

SEQ ID NO: 499028 - DNA, 25 bp, Homo sapien
aaatccattgttgtcaccaggccct

SEQ ID NO: 499029 - DNA, 25 bp, Homo sapien
gaacctcctcagttccttcacagtg

SEQ ID NO: 499030 - DNA, 25 bp, Homo sapien
ttcacagtgcaaccctgtgtacttg

SEQ ID NO: 499031 - DNA, 25 bp, Homo sapien
tacttggcccgcaacccaatagtat

SEQ ID NO: 499032 - DNA, 25 bp, Homo sapien
tagtattgtgcctcacttcaccttc

SEQ ID NO: 499033 - DNA, 25 bp, Homo sapien
ctcccttctggacataaaacctcat

SEQ ID NO: 499034 - DNA, 25 bp, Homo sapien
atgcttgatacggtgcaaaagttaa

SEQ ID NO: 499035 - DNA, 25 bp, Homo sapien
aatgccttctttttatgtggtgcaa

SEQ ID NO: 499036 - DNA, 25 bp, Homo sapien
tgcaatatgaaatacaccaagactg

SEQ ID NO: 499037 - DNA, 25 bp, Homo sapien
gtgtcttgacattctgatggaccca

SEQ ID NO: 499038 - DNA, 25 bp, Homo sapien
ctgatggacccaggtaaagttgtta

SEQ ID NO: 499039 - DNA, 25 bp, Homo sapien
aataatttagacacctgtgtaccag

SEQ ID NO: 499040 - DNA, 25 bp, Homo sapien
acctgtgtaccagcaacaattgatt

SEQ ID NO: 499041 - DNA, 25 bp, Homo sapien
tagtgtctatactatcccttagaat

SEQ ID NO: 499042 - DNA, 25 bp, Homo sapien
aaggtttatgattttcctgatacta

SEQ ID NO: 499043 - DNA, 25 bp, Homo sapien
cctgatactaagatgcagtcacata

SEQ ID NO: 499044 - DNA, 25 bp, Homo sapien
tcttttgtgcatattcctatacaaa

SEQ ID NO: 499045 - DNA, 25 bp, Homo sapien
tttatcttttttcttgcagattctg

SEQ ID NO: 499046 - DNA, 25 bp, Homo sapien
tcttgcagattctgggcatgcacaa

SEQ ID NO: 499047 - DNA, 25 bp, Homo sapien
gattctgggcatgcacaacatctgc

SEQ ID NO: 499048 - DNA, 25 bp, Homo sapien
tctgggcatgcacaacatctgcaaa

SEQ ID NO: 499049 - DNA, 25 bp, Homo sapien
atgcacaacatctgcaaaccctggc

SEQ ID NO: 499050 - DNA, 25 bp, Homo sapien
cagttgcaagcactgtgttgtcaga

SEQ ID NO: 499051 - DNA, 25 bp, Homo sapien
gcaagcactgtgttgtcagatcttc

SEQ ID NO: 499052 - DNA, 25 bp, Homo sapien
agcactgtgttgtcagatcttccac

SEQ ID NO: 499053 - DNA, 25 bp, Homo sapien
actgtgttgtcagatcttccacatt

SEQ ID NO: 499054 - DNA, 25 bp, Homo sapien
tgttgtcagatcttccacattttca

SEQ ID NO: 499055 - DNA, 25 bp, Homo sapien
ttgtcagatcttccacattttcaag

SEQ ID NO: 499056 - DNA, 25 bp, Homo sapien
gctcaggcactgatgcagcagcaag

SEQ ID NO: 499057 - DNA, 25 bp, Homo sapien
tgatgcagcagcaagcggccctgat

SEQ ID NO: 499058 - DNA, 25 bp, Homo sapien
agcaagcggccctgatggcatcagt

SEQ ID NO: 499059 - DNA, 25 bp, Homo sapien
atcagtcgcgcagggcggctacctg

SEQ ID NO: 499060 - DNA, 25 bp, Homo sapien
tgccgcccagatgcagcagatggcg

SEQ ID NO: 499061 - DNA, 25 bp, Homo sapien
atcaacgcgctacacggcagccaga

SEQ ID NO: 499062 - DNA, 25 bp, Homo sapien
gagcctcgtccagtctggtggtcaa

SEQ ID NO: 499063 - DNA, 25 bp, Homo sapien
agtctggtggtcaagttcgccgaca

SEQ ID NO: 499064 - DNA, 25 bp, Homo sapien
gacaccgacaaggagcgcacgatgc

SEQ ID NO: 499065 - DNA, 25 bp, Homo sapien
cacgatgcggcgaatgcagcagatg

SEQ ID NO: 499066 - DNA, 25 bp, Homo sapien
agatgggcatgttcaaccccatggc

SEQ ID NO: 499067 - DNA, 25 bp, Homo sapien
ggtggatgaccagtaattgctttct

SEQ ID NO: 499068 - DNA, 25 bp, Homo sapien
ggatgaccagtaattgctttcttat

SEQ ID NO: 499069 - DNA, 25 bp, Homo sapien
gaccagtaattgctttcttattgaa

SEQ ID NO: 499070 - DNA, 25 bp, Homo sapien
gtaattgctttcttattgaagttaa

SEQ ID NO: 499071 - DNA, 25 bp, Homo sapien
tatgggctagaggagttaactgtta

SEQ ID NO: 499072 - DNA, 25 bp, Homo sapien
tattaattttagcaaagcccaaggg

SEQ ID NO: 499073 - DNA, 25 bp, Homo sapien
agcccaagggaaatagttcagaact

SEQ ID NO: 499074 - DNA, 25 bp, Homo sapien
gttcagaactgaaacatgtagtcca

SEQ ID NO: 499075 - DNA, 25 bp, Homo sapien
ctgaaacatgtagtccaagtgatga

SEQ ID NO: 499076 - DNA, 25 bp, Homo sapien
aaaacatcacagtatataagacctc

SEQ ID NO: 499077 - DNA, 25 bp, Homo sapien
taagtacttagtcttaggggcctat

SEQ ID NO: 499078 - DNA, 25 bp, Homo sapien
atatattgtttactactcaccacag

SEQ ID NO: 499079 - DNA, 25 bp, Homo sapien
ttactactcaccacagatctgcagg

SEQ ID NO: 499080 - DNA, 25 bp, Homo sapien
atctgcaggagttcactgatctcta

SEQ ID NO: 499081 - DNA, 25 bp, Homo sapien
gttcactgatctctaggatctgcct

SEQ ID NO: 499082 - DNA, 25 bp, Homo sapien
taggatctgccttaactccaactta

SEQ ID NO: 499083 - DNA, 25 bp, Homo sapien
ctgccttaactccaacttacatgtt

SEQ ID NO: 499084 - DNA, 25 bp, Homo sapien
ttggtcactattacaaactgtcatc

SEQ ID NO: 499085 - DNA, 25 bp, Homo sapien
ctattacaaactgtcatcccagaat

SEQ ID NO: 499086 - DNA, 25 bp, Homo sapien
ttccatgtgggaattccctcccagt

SEQ ID NO: 499087 - DNA, 25 bp, Homo sapien
ccctcccagtatttcttaggaaatg

SEQ ID NO: 499088 - DNA, 25 bp, Homo sapien
gttttttgaatccataatccctaga

SEQ ID NO: 499089 - DNA, 25 bp, Homo sapien
taaatgccttgtatagtcttagcat

SEQ ID NO: 499090 - DNA, 25 bp, Homo sapien
gtgttaacaggcacctaagagaact

SEQ ID NO: 499091 - DNA, 25 bp, Homo sapien
aaagctcatagtcctgaccttgaaa

SEQ ID NO: 499092 - DNA, 25 bp, Homo sapien
tgctttaaaactactgaatcttgtc

SEQ ID NO: 499093 - DNA, 25 bp, Homo sapien
tgtcttcaaacaagcttttcgtgga

SEQ ID NO: 499094 - DNA, 25 bp, Homo sapien
aacaagcttttcgtggaagaccaat

SEQ ID NO: 499095 - DNA, 25 bp, Homo sapien
ataagtggagattccccctttctag

SEQ ID NO: 499096 - DNA, 25 bp, Homo sapien
tagccatctccccaatgtcatggag

SEQ ID NO: 499097 - DNA, 25 bp, Homo sapien
tcatggagttttaggacagagcagt

SEQ ID NO: 499098 - DNA, 25 bp, Homo sapien
gacagagcagtgaatgtaccactta

SEQ ID NO: 499099 - DNA, 25 bp, Homo sapien
gaatgtaccacttatctcatggata

SEQ ID NO: 499100 - DNA, 25 bp, Homo sapien
gctcaggcactgatgcagcagcaag

SEQ ID NO: 499101 - DNA, 25 bp, Homo sapien
tcaggcactgatgcagcagcaagcg

SEQ ID NO: 499102 - DNA, 25 bp, Homo sapien
tggctgccttcgctgccgcccagat

SEQ ID NO: 499103 - DNA, 25 bp, Homo sapien
gccgacaccgacaaggagcgcacga

SEQ ID NO: 499104 - DNA, 25 bp, Homo sapien
cgacaccgacaaggagcgcacgatg

SEQ ID NO: 499105 - DNA, 25 bp, Homo sapien
gacaccgacaaggagcgcacgatgc

SEQ ID NO: 499106 - DNA, 25 bp, Homo sapien
acaccgacaaggagcgcacgatgcg

SEQ ID NO: 499107 - DNA, 25 bp, Homo sapien
caccgacaaggagcgcacgatgcgg

SEQ ID NO: 499108 - DNA, 25 bp, Homo sapien
cacgatgcggcgaatgcagcagatg

SEQ ID NO: 499109 - DNA, 25 bp, Homo sapien
cagatgggcatgttcaaccccatgg

SEQ ID NO: 499110 - DNA, 25 bp, Homo sapien
agatgggcatgttcaaccccatggc

SEQ ID NO: 499111 - DNA, 25 bp, Homo sapien
gaagatcagattcaccttgtgcagc

SEQ ID NO: 499112 - DNA, 25 bp, Homo sapien
attcaccttgtgcagctaactcttt

SEQ ID NO: 499113 - DNA, 25 bp, Homo sapien
ttccacctctctttgttctgctgaa

SEQ ID NO: 499114 - DNA, 25 bp, Homo sapien
ttgttctgctgaatgatgtccacca

SEQ ID NO: 499115 - DNA, 25 bp, Homo sapien
atgatgtccaccaggttgttcttga

SEQ ID NO: 499116 - DNA, 25 bp, Homo sapien
ttcaggtccactgctgcaagggagt

SEQ ID NO: 499117 - DNA, 25 bp, Homo sapien
gaataggacccatcactcatggagc

SEQ ID NO: 499118 - DNA, 25 bp, Homo sapien
gccttttgtatttgatcgtcttagt

SEQ ID NO: 499119 - DNA, 25 bp, Homo sapien
gatcgtcttagtgcatcagcaatgt

SEQ ID NO: 499120 - DNA, 25 bp, Homo sapien
gtctttaaggtgtttcgggcctatg

SEQ ID NO: 499121 - DNA, 25 bp, Homo sapien
ttcgggcctatgaatgtgtctcatc

SEQ ID NO: 499122 - DNA, 25 bp, Homo sapien
gaacaatttcctcagaacctcttaa

SEQ ID NO: 499123 - DNA, 25 bp, Homo sapien
gcagtgcaaaccctcttccgctgag

SEQ ID NO: 499124 - DNA, 25 bp, Homo sapien
tccgctgagcagctgtctgaactat

SEQ ID NO: 499125 - DNA, 25 bp, Homo sapien
gtctgaactataggccccagtgctg

SEQ ID NO: 499126 - DNA, 25 bp, Homo sapien
ccagtgctgaagaccagttgtgcta

SEQ ID NO: 499127 - DNA, 25 bp, Homo sapien
agttgtgctaagataccggcatgga

SEQ ID NO: 499128 - DNA, 25 bp, Homo sapien
tggagattgtgccatccgtggtata

SEQ ID NO: 499129 - DNA, 25 bp, Homo sapien
atccgtggtataggctggctggtat

SEQ ID NO: 499130 - DNA, 25 bp, Homo sapien
ataggctggctggtatgaagtcatt

SEQ ID NO: 499131 - DNA, 25 bp, Homo sapien
gaagtcattggcctgtatgccagag

SEQ ID NO: 499132 - DNA, 25 bp, Homo sapien
ggcggtactctgaacaatttcctca

SEQ ID NO: 499133 - DNA, 25 bp, Homo sapien
ccgggctgcaggttcgtactgaaaa

SEQ ID NO: 499134 - DNA, 25 bp, Homo sapien
ggctgcaggttcgtactgaaaaagc

SEQ ID NO: 499135 - DNA, 25 bp, Homo sapien
atactgtgatgatacgggatgacat

SEQ ID NO: 499136 - DNA, 25 bp, Homo sapien
gatgatacgggatgacatcatttca

SEQ ID NO: 499137 - DNA, 25 bp, Homo sapien
catcatttcaggttgggcatacaaa

SEQ ID NO: 499138 - DNA, 25 bp, Homo sapien
gtaaggaagctaaactaagactata

SEQ ID NO: 499139 - DNA, 25 bp, Homo sapien
taagactatactcaccaggccattt

SEQ ID NO: 499140 - DNA, 25 bp, Homo sapien
ctatactcaccaggccatttagaag

SEQ ID NO: 499141 - DNA, 25 bp, Homo sapien
ttaaataatgcctccactatttttt

SEQ ID NO: 499142 - DNA, 25 bp, Homo sapien
tttcttagacatagcttttaatggg

SEQ ID NO: 499143 - DNA, 25 bp, Homo sapien
tggaattttgttattaatacccatt

SEQ ID NO: 499144 - DNA, 25 bp, Homo sapien
atagatgttattcgatccgtcatgt

SEQ ID NO: 499145 - DNA, 25 bp, Homo sapien
tagatgttattcgatccgtcatgta

SEQ ID NO: 499146 - DNA, 25 bp, Homo sapien
agatgttattcgatccgtcatgtac

SEQ ID NO: 499147 - DNA, 25 bp, Homo sapien
gatgttattcgatccgtcatgtact

SEQ ID NO: 499148 - DNA, 25 bp, Homo sapien
atgttattcgatccgtcatgtactt

SEQ ID NO: 499149 - DNA, 25 bp, Homo sapien
gttattcgatccgtcatgtactttg

SEQ ID NO: 499150 - DNA, 25 bp, Homo sapien
ttattcgatccgtcatgtactttga

SEQ ID NO: 499151 - DNA, 25 bp, Homo sapien
tattcgatccgtcatgtactttgaa

SEQ ID NO: 499152 - DNA, 25 bp, Homo sapien
attcgatccgtcatgtactttgaac

SEQ ID NO: 499153 - DNA, 25 bp, Homo sapien
ttcgatccgtcatgtactttgaact

SEQ ID NO: 499154 - DNA, 25 bp, Homo sapien
tcgatccgtcatgtactttgaacta

SEQ ID NO: 499155 - DNA, 25 bp, Homo sapien
ttcccgggttagtgtgcctgacaac

SEQ ID NO: 499156 - DNA, 25 bp, Homo sapien
gtgtgcctgacaacactgaagaaaa

SEQ ID NO: 499157 - DNA, 25 bp, Homo sapien
ccagaattacttcgttttatacatt

SEQ ID NO: 499158 - DNA, 25 bp, Homo sapien
tttatacatttcacttctcttctga

SEQ ID NO: 499159 - DNA, 25 bp, Homo sapien
tcacttctcttctgaaatcacagca

SEQ ID NO: 499160 - DNA, 25 bp, Homo sapien
ttctgaaatcacagcaatgccagtt

SEQ ID NO: 499161 - DNA, 25 bp, Homo sapien
gttgaatggacctcccagaatcacg

SEQ ID NO: 499162 - DNA, 25 bp, Homo sapien
ggccacctttgagaatcagggtcaa

SEQ ID NO: 499163 - DNA, 25 bp, Homo sapien
agaatcagggtcaaacttggaaggg

SEQ ID NO: 499164 - DNA, 25 bp, Homo sapien
tgcatttgtcacacttcctcggaca

SEQ ID NO: 499165 - DNA, 25 bp, Homo sapien
acacttcctcggacactaatttgga

SEQ ID NO: 499166 - DNA, 25 bp, Homo sapien
cctgttgcttgcaggctcgcctgag

SEQ ID NO: 499167 - DNA, 25 bp, Homo sapien
gcaggctcgcctgagctgaaaggca

SEQ ID NO: 499168 - DNA, 25 bp, Homo sapien
ggccttctttacaccctggagaact

SEQ ID NO: 499169 - DNA, 25 bp, Homo sapien
ctggagaacttcacagggaatctgt

SEQ ID NO: 499170 - DNA, 25 bp, Homo sapien
agggaatctgtgtctgtaacacaaa

SEQ ID NO: 499171 - DNA, 25 bp, Homo sapien
acaaaggcttcctggtccagatgta

SEQ ID NO: 499172 - DNA, 25 bp, Homo sapien
tcctggtccagatgtagatactaag

SEQ ID NO: 499173 - DNA, 25 bp, Homo sapien
gatactaaggctgactggttattta

SEQ ID NO: 499174 - DNA, 25 bp, Homo sapien
actggttatttaagtcctgcggact

SEQ ID NO: 499175 - DNA, 25 bp, Homo sapien
ctgcggacttactctgccaaaatta

SEQ ID NO: 499176 - DNA, 25 bp, Homo sapien
aattcttataaagtatccccttcat

SEQ ID NO: 499177 - DNA, 25 bp, Homo sapien
aatgtttcattatcaaattgtcgac

SEQ ID NO: 499178 - DNA, 25 bp, Homo sapien
aaattgtcgacatcattaatatata

SEQ ID NO: 499179 - DNA, 25 bp, Homo sapien
taatgttgggaagagatcactattt

SEQ ID NO: 499180 - DNA, 25 bp, Homo sapien
gagatcactattttgaagcacagct

SEQ ID NO: 499181 - DNA, 25 bp, Homo sapien
tgaagcacagctttacagatgagta

SEQ ID NO: 499182 - DNA, 25 bp, Homo sapien
ggtggttataattgcagagtattcc

SEQ ID NO: 499183 - DNA, 25 bp, Homo sapien
tataattgcagagtattccatgaat

SEQ ID NO: 499184 - DNA, 25 bp, Homo sapien
ttccatgaatagtacactgacacag

SEQ ID NO: 499185 - DNA, 25 bp, Homo sapien
actgacacaggggttttactttgag

SEQ ID NO: 499186 - DNA, 25 bp, Homo sapien
tactttgaggaccagtgtagtcaag

SEQ ID NO: 499187 - DNA, 25 bp, Homo sapien
tgaggaccagtgtagtcaagggaaa

SEQ ID NO: 499188 - DNA, 25 bp, Homo sapien
agacaacgcgcttttgctgaactgt

SEQ ID NO: 499189 - DNA, 25 bp, Homo sapien
gcgcttttgctgaactgtccatttt

SEQ ID NO: 499190 - DNA, 25 bp, Homo sapien
tgctgaactgtccattttggtggtt

SEQ ID NO: 499191 - DNA, 25 bp, Homo sapien
agcaggatgggcgatagagatatat

SEQ ID NO: 499192 - DNA, 25 bp, Homo sapien
acatattctatatatctaatgccta

SEQ ID NO: 499193 - DNA, 25 bp, Homo sapien
tatctaatgcctaaatatgggtatt

SEQ ID NO: 499194 - DNA, 25 bp, Homo sapien
gaagattaaactggactagccttat

SEQ ID NO: 499195 - DNA, 25 bp, Homo sapien
taaactggactagccttatttgcaa

SEQ ID NO: 499196 - DNA, 25 bp, Homo sapien
ggactagccttatttgcaagtgaag

SEQ ID NO: 499197 - DNA, 25 bp, Homo sapien
gaaggatctggtgctgctttcagat

SEQ ID NO: 499198 - DNA, 25 bp, Homo sapien
tctggtgctgctttcagatgtttat

SEQ ID NO: 499199 - DNA, 25 bp, Homo sapien
ctgttcatgtgtagcctacaacaga

SEQ ID NO: 499200 - DNA, 25 bp, Homo sapien
gtgtagcctacaacagaactataag

SEQ ID NO: 499201 - DNA, 25 bp, Homo sapien
gcctacaacagaactataagaccta

SEQ ID NO: 499202 - DNA, 25 bp, Homo sapien
taagacctatagacatttatatgaa

SEQ ID NO: 499203 - DNA, 25 bp, Homo sapien
agccaatagaaatctcagataattg

SEQ ID NO: 499204 - DNA, 25 bp, Homo sapien
ttgaatgtatagaaactagcagttt

SEQ ID NO: 499205 - DNA, 25 bp, Homo sapien
gttgatttaacagatcctattccat

SEQ ID NO: 499206 - DNA, 25 bp, Homo sapien
aacagatcctattccatgtcctttg

SEQ ID NO: 499207 - DNA, 25 bp, Homo sapien
cagatcctattccatgtcctttgaa

SEQ ID NO: 499208 - DNA, 25 bp, Homo sapien
gatcctattccatgtcctttgaata

SEQ ID NO: 499209 - DNA, 25 bp, Homo sapien
tccatgtcctttgaatatttataga

SEQ ID NO: 499210 - DNA, 25 bp, Homo sapien
tgactattcctctactctcctctca

SEQ ID NO: 499211 - DNA, 25 bp, Homo sapien
tttctctcttacctgcctatgcttg

SEQ ID NO: 499212 - DNA, 25 bp, Homo sapien
tctctcttacctgcctatgcttgaa

SEQ ID NO: 499213 - DNA, 25 bp, Homo sapien
tcctgcctttcaagaccaatgtaca

SEQ ID NO: 499214 - DNA, 25 bp, Homo sapien
ctgcctttcaagaccaatgtacacc

SEQ ID NO: 499215 - DNA, 25 bp, Homo sapien
tgcctttcaagaccaatgtacacct

SEQ ID NO: 499216 - DNA, 25 bp, Homo sapien
gcctttcaagaccaatgtacacctt

SEQ ID NO: 499217 - DNA, 25 bp, Homo sapien
tttcaagaccaatgtacaccttaca

SEQ ID NO: 499218 - DNA, 25 bp, Homo sapien
tcaagaccaatgtacaccttacaca

SEQ ID NO: 499219 - DNA, 25 bp, Homo sapien
aagaccaatgtacaccttacacata

SEQ ID NO: 499220 - DNA, 25 bp, Homo sapien
gaccaatgtacaccttacacatact

SEQ ID NO: 499221 - DNA, 25 bp, Homo sapien
gaaggttatgggtctctttatcgtg

SEQ ID NO: 499222 - DNA, 25 bp, Homo sapien
ggtctctttatcgtggtctgacaac

SEQ ID NO: 499223 - DNA, 25 bp, Homo sapien
cgtggtctgacaactcatctagtga

SEQ ID NO: 499224 - DNA, 25 bp, Homo sapien
gagacagattccaaacacagccatt

SEQ ID NO: 499225 - DNA, 25 bp, Homo sapien
aacacagccattatgatggccacct

SEQ ID NO: 499226 - DNA, 25 bp, Homo sapien
gaattggtggtttacctactcaatg

SEQ ID NO: 499227 - DNA, 25 bp, Homo sapien
acctactcaatggatagcagcacga

SEQ ID NO: 499228 - DNA, 25 bp, Homo sapien
gcagcacgaggactgctgtactgca

SEQ ID NO: 499229 - DNA, 25 bp, Homo sapien
agattacagtggaccatgggataca

SEQ ID NO: 499230 - DNA, 25 bp, Homo sapien
gatacagaagccagcatggcagaca

SEQ ID NO: 499231 - DNA, 25 bp, Homo sapien
taatcacaccacattacttggcctt

SEQ ID NO: 499232 - DNA, 25 bp, Homo sapien
agccctgcagtctagtgtcagccaa

SEQ ID NO: 499233 - DNA, 25 bp, Homo sapien
tgcagtctagtgtcagccaagaact

SEQ ID NO: 499234 - DNA, 25 bp, Homo sapien
tagtgtcagccaagaactccaggat

SEQ ID NO: 499235 - DNA, 25 bp, Homo sapien
cagccaagaactccaggatgaactg

SEQ ID NO: 499236 - DNA, 25 bp, Homo sapien
ccgggcgccacactaaactataaat

SEQ ID NO: 499237 - DNA, 25 bp, Homo sapien
gggcgccacactaaactataaatgt

SEQ ID NO: 499238 - DNA, 25 bp, Homo sapien
ctataaatgtctccaaagtcacaca

SEQ ID NO: 499239 - DNA, 25 bp, Homo sapien
cagaactgtctctggcagtcgaata

SEQ ID NO: 499240 - DNA, 25 bp, Homo sapien
gtctctggcagtcgaatatcactag

SEQ ID NO: 499241 - DNA, 25 bp, Homo sapien
ggcagtcgaatatcactagagaaaa

SEQ ID NO: 499242 - DNA, 25 bp, Homo sapien
tttgtatgcaaagatggctctcccc

SEQ ID NO: 499243 - DNA, 25 bp, Homo sapien
aaagcatttgctagggaatcatgca

SEQ ID NO: 499244 - DNA, 25 bp, Homo sapien
tagggaatcatgcagatggtccaaa

SEQ ID NO: 499245 - DNA, 25 bp, Homo sapien
agaaaagcattcatctgtcccggga

SEQ ID NO: 499246 - DNA, 25 bp, Homo sapien
agcattcatctgtcccgggatagaa

SEQ ID NO: 499247 - DNA, 25 bp, Homo sapien
catctgtcccgggatagaagtagag

SEQ ID NO: 499248 - DNA, 25 bp, Homo sapien
taggcaggcgctagaccctaaagaa

SEQ ID NO: 499249 - DNA, 25 bp, Homo sapien
gagagcagtccagagcaggtgaaaa

SEQ ID NO: 499250 - DNA, 25 bp, Homo sapien
agcaggtgaaaagagcagagctcat

SEQ ID NO: 499251 - DNA, 25 bp, Homo sapien
ttgcctaaagcagcattcctcaaac

SEQ ID NO: 499252 - DNA, 25 bp, Homo sapien
ttcctcaaacttctcactcgaagca

SEQ ID NO: 499253 - DNA, 25 bp, Homo sapien
ctcactcgaagcattaagttacggt

SEQ ID NO: 499254 - DNA, 25 bp, Homo sapien
agctcacatcaagttccatcaaatg

SEQ ID NO: 499255 - DNA, 25 bp, Homo sapien
ttccatcaaatgtctaaggtgtcca

SEQ ID NO: 499256 - DNA, 25 bp, Homo sapien
gtctaaggtgtccaatttcttctgg

SEQ ID NO: 499257 - DNA, 25 bp, Homo sapien
tttcttctggaagtgacaccaattt

SEQ ID NO: 499258 - DNA, 25 bp, Homo sapien
gacaccaatttgttattactagcaa

SEQ ID NO: 499259 - DNA, 25 bp, Homo sapien
aagactttcaatggcaaattacaca

SEQ ID NO: 499260 - DNA, 25 bp, Homo sapien
aagtgtaccggcaatgttgacagtt

SEQ ID NO: 499261 - DNA, 25 bp, Homo sapien
gttgacagttggttccgactaatat

SEQ ID NO: 499262 - DNA, 25 bp, Homo sapien
gagcttgtaggtttaaaattgcctc

SEQ ID NO: 499263 - DNA, 25 bp, Homo sapien
aaattgcctctggaatataacgaat

SEQ ID NO: 499264 - DNA, 25 bp, Homo sapien
ggtacaagttgagattttccagaga

SEQ ID NO: 499265 - DNA, 25 bp, Homo sapien
cgggagttcattgcaccagttacac

SEQ ID NO: 499266 - DNA, 25 bp, Homo sapien
gttacactgaaggtctttgcaggct

SEQ ID NO: 499267 - DNA, 25 bp, Homo sapien
ggtctttgcaggctattatacgaag

SEQ ID NO: 499268 - DNA, 25 bp, Homo sapien
tacgaagggatttgcactactgaat

SEQ ID NO: 499269 - DNA, 25 bp, Homo sapien
tagtaaaatactcccctgaacgaca

SEQ ID NO: 499270 - DNA, 25 bp, Homo sapien
tgaacgacagcgttctcttcgtcct

SEQ ID NO: 499271 - DNA, 25 bp, Homo sapien
aagactttcagggaggtggttgcaa

SEQ ID NO: 499272 - DNA, 25 bp, Homo sapien
ggtggttgcaaatttctaaggtaca

SEQ ID NO: 499273 - DNA, 25 bp, Homo sapien
aattgctctattgagtcaccacgaa

SEQ ID NO: 499274 - DNA, 25 bp, Homo sapien
agtcaccacgaaaaggctggagctt

SEQ ID NO: 499275 - DNA, 25 bp, Homo sapien
aaggctggagcttcatgcatcctgg

SEQ ID NO: 499276 - DNA, 25 bp, Homo sapien
ctgaggccttgttcccacgtggcct

SEQ ID NO: 499277 - DNA, 25 bp, Homo sapien
aaaggagagttgcagcccacctaag

SEQ ID NO: 499278 - DNA, 25 bp, Homo sapien
agagttgcagcccacctaagagagt

SEQ ID NO: 499279 - DNA, 25 bp, Homo sapien
agtgggtggacaaatagccttatta

SEQ ID NO: 499280 - DNA, 25 bp, Homo sapien
tagccttattattaacctaagttgg

SEQ ID NO: 499281 - DNA, 25 bp, Homo sapien
gaaacatggctttttgagtgtcttc

SEQ ID NO: 499282 - DNA, 25 bp, Homo sapien
ggctttttgagtgtcttcattcaca

SEQ ID NO: 499283 - DNA, 25 bp, Homo sapien
gagtgtcttcattcacagatgcagt

SEQ ID NO: 499284 - DNA, 25 bp, Homo sapien
gcagcccacctaagagagtccaaag

SEQ ID NO: 499285 - DNA, 25 bp, Homo sapien
tcattcacagatgcagtcacaaaat

SEQ ID NO: 499286 - DNA, 25 bp, Homo sapien
cctggtggtgttttataggaactgg

SEQ ID NO: 499287 - DNA, 25 bp, Homo sapien
tttggactcttctagtaataacgta

SEQ ID NO: 499288 - DNA, 25 bp, Homo sapien
tggactcttctagtaataacgtagc

SEQ ID NO: 499289 - DNA, 25 bp, Homo sapien
ggactcttctagtaataacgtagct

SEQ ID NO: 499290 - DNA, 25 bp, Homo sapien
gactcttctagtaataacgtagctt

SEQ ID NO: 499291 - DNA, 25 bp, Homo sapien
ctcttctagtaataacgtagcttaa

SEQ ID NO: 499292 - DNA, 25 bp, Homo sapien
aataacgtagcttaaaacacacatt

SEQ ID NO: 499293 - DNA, 25 bp, Homo sapien
cttaaaacacacattgcatagctgt

SEQ ID NO: 499294 - DNA, 25 bp, Homo sapien
aacacacattgcatagctgtacaaa

SEQ ID NO: 499295 - DNA, 25 bp, Homo sapien
accaagacaaacacactagcctagg

SEQ ID NO: 499296 - DNA, 25 bp, Homo sapien
ccaagacaaacacactagcctaggc

SEQ ID NO: 499297 - DNA, 25 bp, Homo sapien
acactagcctaggcctatgcagggt

SEQ ID NO: 499298 - DNA, 25 bp, Homo sapien
atattttcagttgtgcttattgtgc

SEQ ID NO: 499299 - DNA, 25 bp, Homo sapien
tattgtgcagttgtacttaaataca

SEQ ID NO: 499300 - DNA, 25 bp, Homo sapien
gatgtaattcaagctgctttacccc

SEQ ID NO: 499301 - DNA, 25 bp, Homo sapien
tgtgggtagaactaaaatggctttt

SEQ ID NO: 499302 - DNA, 25 bp, Homo sapien
aagatatatctgctggtgagcttca

SEQ ID NO: 499303 - DNA, 25 bp, Homo sapien
gctggtgagcttcaggctttttatg

SEQ ID NO: 499304 - DNA, 25 bp, Homo sapien
tttttatgatgatggcatttcaccc

SEQ ID NO: 499305 - DNA, 25 bp, Homo sapien
gcatttcacccttctgtttacagtg

SEQ ID NO: 499306 - DNA, 25 bp, Homo sapien
acccttctgtttacagtgtcaactg

SEQ ID NO: 499307 - DNA, 25 bp, Homo sapien
aaccccggaagtgtcagttactgtg

SEQ ID NO: 499308 - DNA, 25 bp, Homo sapien
cagttactgtgaaagaggcatattt

SEQ ID NO: 499309 - DNA, 25 bp, Homo sapien
gcattgcaaaaagtaccattggcca

SEQ ID NO: 499310 - DNA, 25 bp, Homo sapien
gtaccattggccaggcttacaagtc

SEQ ID NO: 499311 - DNA, 25 bp, Homo sapien
ggccaggcttacaagtcagccacaa

SEQ ID NO: 499312 - DNA, 25 bp, Homo sapien
attgactccagttgaaggtgagaaa

SEQ ID NO: 499313 - DNA, 25 bp, Homo sapien
tacaagtcagccacaatgagtcggt

SEQ ID NO: 499314 - DNA, 25 bp, Homo sapien
gtcagccacaatgagtcggtataac

SEQ ID NO: 499315 - DNA, 25 bp, Homo sapien
gagtcggtataactactgtgttatt

SEQ ID NO: 499316 - DNA, 25 bp, Homo sapien
tgtgttattctttttctagacaaat

SEQ ID NO: 499317 - DNA, 25 bp, Homo sapien
aaattttgactcttctacttttatg

SEQ ID NO: 499318 - DNA, 25 bp, Homo sapien
gtgagaaatctgtaccaatcattca

SEQ ID NO: 499319 - DNA, 25 bp, Homo sapien
gaaatctgtaccaatcattcaaaaa

SEQ ID NO: 499320 - DNA, 25 bp, Homo sapien
gacagtttcctctttgcacatgttt

SEQ ID NO: 499321 - DNA, 25 bp, Homo sapien
cagtttcctctttgcacatgtttaa

SEQ ID NO: 499322 - DNA, 25 bp, Homo sapien
agtttcctctttgcacatgtttaac

SEQ ID NO: 499323 - DNA, 25 bp, Homo sapien
acatgtttaacatttggctgttata

SEQ ID NO: 499324 - DNA, 25 bp, Homo sapien
aacatttggctgttataatatatgg

SEQ ID NO: 499325 - DNA, 25 bp, Homo sapien
taaatattggtaataggtcggcaac

SEQ ID NO: 499326 - DNA, 25 bp, Homo sapien
tattggtaataggtcggcaacagca

SEQ ID NO: 499327 - DNA, 25 bp, Homo sapien
ttggtaataggtcggcaacagcaac

SEQ ID NO: 499328 - DNA, 25 bp, Homo sapien
gaagtacaactcaatagatggcatt

SEQ ID NO: 499329 - DNA, 25 bp, Homo sapien
gtacaactcaatagatggcattaaa

SEQ ID NO: 499330 - DNA, 25 bp, Homo sapien
ggcattaaaacatattgtagtgtgg

SEQ ID NO: 499331 - DNA, 25 bp, Homo sapien
aaccaaagtgcattgtacgcccttt

SEQ ID NO: 499332 - DNA, 25 bp, Homo sapien
acgccctttggccagtcttgtatgt

SEQ ID NO: 499333 - DNA, 25 bp, Homo sapien
cagtcttgtatgtgccttgatccaa

SEQ ID NO: 499334 - DNA, 25 bp, Homo sapien
gccttgatccaacgctacatgtatt

SEQ ID NO: 499335 - DNA, 25 bp, Homo sapien
actccacaaatttttcatactcctt

SEQ ID NO: 499336 - DNA, 25 bp, Homo sapien
gaaaaattatggtcttattgctgaa

SEQ ID NO: 499337 - DNA, 25 bp, Homo sapien
gtacagaataattgtgcttgctttt

SEQ ID NO: 499338 - DNA, 25 bp, Homo sapien
gcttgctttttcaggattgtgttac

SEQ ID NO: 499339 - DNA, 25 bp, Homo sapien
aattgcccagcacattagtcctaaa

SEQ ID NO: 499340 - DNA, 25 bp, Homo sapien
attagtcctaaacgtcccatgtatt

SEQ ID NO: 499341 - DNA, 25 bp, Homo sapien
taaacgtcccatgtatttttctagg

SEQ ID NO: 499342 - DNA, 25 bp, Homo sapien
gggccacccggagatgcctgcagat

SEQ ID NO: 499343 - DNA, 25 bp, Homo sapien
agcctgagatgcagggcacccctga

SEQ ID NO: 499344 - DNA, 25 bp, Homo sapien
gacgatgagccctctgagcccgagc

SEQ ID NO: 499345 - DNA, 25 bp, Homo sapien
acactcatctatcgcaacatgcagc

SEQ ID NO: 499346 - DNA, 25 bp, Homo sapien
aacatgcagcgctggaaacgcatcc

SEQ ID NO: 499347 - DNA, 25 bp, Homo sapien
gctggaaacgcatccgccagaggtg

SEQ ID NO: 499348 - DNA, 25 bp, Homo sapien
tggaaggaggcctctcatcggaacc

SEQ ID NO: 499349 - DNA, 25 bp, Homo sapien
tcatcggaaccagcttcgttactca

SEQ ID NO: 499350 - DNA, 25 bp, Homo sapien
agcttcgttactcagaaagcatgaa

SEQ ID NO: 499351 - DNA, 25 bp, Homo sapien
gaaagcatgaagatcctacgagaga

SEQ ID NO: 499352 - DNA, 25 bp, Homo sapien
ctacgagagatgtacgaacgacagt

SEQ ID NO: 499353 - DNA, 25 bp, Homo sapien
ctctaccctgatgttgcatgagacc

SEQ ID NO: 499354 - DNA, 25 bp, Homo sapien
taccctgatgttgcatgagacctgg

SEQ ID NO: 499355 - DNA, 25 bp, Homo sapien
ctgatgttgcatgagacctggtaac

SEQ ID NO: 499356 - DNA, 25 bp, Homo sapien
gttgcatgagacctggtaacagtgt

SEQ ID NO: 499357 - DNA, 25 bp, Homo sapien
tgagacctggtaacagtgtctccct

SEQ ID NO: 499358 - DNA, 25 bp, Homo sapien
agctccttgccaaagcctctgttga

SEQ ID NO: 499359 - DNA, 25 bp, Homo sapien
tctgttgagacctgggcttcttgta

SEQ ID NO: 499360 - DNA, 25 bp, Homo sapien
agacctgggcttcttgtagcccctt

SEQ ID NO: 499361 - DNA, 25 bp, Homo sapien
ctggccagctgcacagcctgtggga

SEQ ID NO: 499362 - DNA, 25 bp, Homo sapien
gtatggtgaccccacctaagcattt

SEQ ID NO: 499363 - DNA, 25 bp, Homo sapien
tatggtgaccccacctaagcatttt

SEQ ID NO: 499364 - DNA, 25 bp, Homo sapien
aggatcggtgtgtgagacccgcgag

SEQ ID NO: 499365 - DNA, 25 bp, Homo sapien
agacccgcgagtgggcacgtctctg

SEQ ID NO: 499366 - DNA, 25 bp, Homo sapien
cgagtgggcacgtctctgaatgtga

SEQ ID NO: 499367 - DNA, 25 bp, Homo sapien
ctgaatgtgaggtctcgggcagcac

SEQ ID NO: 499368 - DNA, 25 bp, Homo sapien
gtagaacgagtgtgagcgtctccac

SEQ ID NO: 499369 - DNA, 25 bp, Homo sapien
agtgtgagcgtctccacgcagtggc

SEQ ID NO: 499370 - DNA, 25 bp, Homo sapien
gggcgtctcttgcatgctgttggtg

SEQ ID NO: 499371 - DNA, 25 bp, Homo sapien
ctctcccactgagtcacaggtttga

SEQ ID NO: 499372 - DNA, 25 bp, Homo sapien
gtcacaggtttgagattcccagaga

SEQ ID NO: 499373 - DNA, 25 bp, Homo sapien
gagaggccaaagacagctacaggaa

SEQ ID NO: 499374 - DNA, 25 bp, Homo sapien
ggctcagctgagagagagtcacaga

SEQ ID NO: 499375 - DNA, 25 bp, Homo sapien
ggagctttaacagggttgccacacc

SEQ ID NO: 499376 - DNA, 25 bp, Homo sapien
ggttgccacaccatttggaggtttt

SEQ ID NO: 499377 - DNA, 25 bp, Homo sapien
gctactattgctaacagatcccagg

SEQ ID NO: 499378 - DNA, 25 bp, Homo sapien
gatcccaggtttatgtcctttgtca

SEQ ID NO: 499379 - DNA, 25 bp, Homo sapien
tttgtcaatcccctttctggcagac

SEQ ID NO: 499380 - DNA, 25 bp, Homo sapien
tctggcagacggtcctttaatagga

SEQ ID NO: 499381 - DNA, 25 bp, Homo sapien
aagccattagcaatgatccggagct

SEQ ID NO: 499382 - DNA, 25 bp, Homo sapien
ggactcctaagggatggatatctga

SEQ ID NO: 499383 - DNA, 25 bp, Homo sapien
tgatccggagcttttagaggcttta

SEQ ID NO: 499384 - DNA, 25 bp, Homo sapien
tatcctaaacttttcaagcctgaag

SEQ ID NO: 499385 - DNA, 25 bp, Homo sapien
gaactgcctgattacaggagcttta

SEQ ID NO: 499386 - DNA, 25 bp, Homo sapien
atgtgacttgctaaggtaaaggtga

SEQ ID NO: 499387 - DNA, 25 bp, Homo sapien
gataacatatcagtttcaagcctaa

SEQ ID NO: 499388 - DNA, 25 bp, Homo sapien
tatcagtttcaagcctaagccttaa

SEQ ID NO: 499389 - DNA, 25 bp, Homo sapien
taagccttaagaggccttgggtatt

SEQ ID NO: 499390 - DNA, 25 bp, Homo sapien
ttgttctctttctatctgtgccatt

SEQ ID NO: 499391 - DNA, 25 bp, Homo sapien
tatctgtgccatttccatgagaaaa

SEQ ID NO: 499392 - DNA, 25 bp, Homo sapien
tccatgagaaaaacatgtctctgct

SEQ ID NO: 499393 - DNA, 25 bp, Homo sapien
ctgctagctcattggttgagggaag

SEQ ID NO: 499394 - DNA, 25 bp, Homo sapien
gagttaagctgaattcaatgaacac

SEQ ID NO: 499395 - DNA, 25 bp, Homo sapien
cagtgaacttcaggatggtctgtta

SEQ ID NO: 499396 - DNA, 25 bp, Homo sapien
ttcaggatggtctgttaataaacat

SEQ ID NO: 499397 - DNA, 25 bp, Homo sapien
tttattcctaatgcctaaatcaggg

SEQ ID NO: 499398 - DNA, 25 bp, Homo sapien
taatgcctaaatcagggcctaggta

SEQ ID NO: 499399 - DNA, 25 bp, Homo sapien
aatcagggcctaggtagtgagctgt

SEQ ID NO: 499400 - DNA, 25 bp, Homo sapien
gtagtgagctgtgggcacatattaa

SEQ ID NO: 499401 - DNA, 25 bp, Homo sapien
gtgggcacatattaagtattggtta

SEQ ID NO: 499402 - DNA, 25 bp, Homo sapien
atggacattatctataaaagctttt

SEQ ID NO: 499403 - DNA, 25 bp, Homo sapien
cttttgtggaaatggctagagctag

SEQ ID NO: 499404 - DNA, 25 bp, Homo sapien
tggctagagctagggtaaggaaaca

SEQ ID NO: 499405 - DNA, 25 bp, Homo sapien
taaagctgtcaaggaaaatctgggc

SEQ ID NO: 499406 - DNA, 25 bp, Homo sapien
aaaatctgggctaagagtaggatat

SEQ ID NO: 499407 - DNA, 25 bp, Homo sapien
ggatgatggataaggcatgagacat

SEQ ID NO: 499408 - DNA, 25 bp, Homo sapien
ctactggatacaactcagatcttaa

SEQ ID NO: 499409 - DNA, 25 bp, Homo sapien
ggaacacaacaggttattctggtac

SEQ ID NO: 499410 - DNA, 25 bp, Homo sapien
gttaacccaggagaagcatttacaa

SEQ ID NO: 499411 - DNA, 25 bp, Homo sapien
acagtttcagtgcattacaggtcct

SEQ ID NO: 499412 - DNA, 25 bp, Homo sapien
attacaggtcctgctcaggttccaa

SEQ ID NO: 499413 - DNA, 25 bp, Homo sapien
tcaggttccaatgatgtccccaaat

SEQ ID NO: 499414 - DNA, 25 bp, Homo sapien
gatgtccccaaatggttctgtgcct

SEQ ID NO: 499415 - DNA, 25 bp, Homo sapien
ttctgtgcctcctatctatgtgcct

SEQ ID NO: 499416 - DNA, 25 bp, Homo sapien
tcctatctatgtgcctcctggatat

SEQ ID NO: 499417 - DNA, 25 bp, Homo sapien
ggatatgccccacaggttattgaag

SEQ ID NO: 499418 - DNA, 25 bp, Homo sapien
gaagagttgtcgtggtccctcaggc

SEQ ID NO: 499419 - DNA, 25 bp, Homo sapien
gagtgcagtgatgtttgccatttgc

SEQ ID NO: 499420 - DNA, 25 bp, Homo sapien
tggacaaccaacacccgggttgctc

SEQ ID NO: 499421 - DNA, 25 bp, Homo sapien
acccgggttgctcctttgattagag

SEQ ID NO: 499422 - DNA, 25 bp, Homo sapien
gttgctcctttgattagagaccaga

SEQ ID NO: 499423 - DNA, 25 bp, Homo sapien
gagaccagatcagataattatgctt

SEQ ID NO: 499424 - DNA, 25 bp, Homo sapien
tacgtttacattcttctcttttcta

SEQ ID NO: 499425 - DNA, 25 bp, Homo sapien
ttctcttttctatgaaaggcagggc

SEQ ID NO: 499426 - DNA, 25 bp, Homo sapien
gaagtgttcacatggctctcatgta

SEQ ID NO: 499427 - DNA, 25 bp, Homo sapien
atggctctcatgtacttttaaatta

SEQ ID NO: 499428 - DNA, 25 bp, Homo sapien
ggaactgaggtttacatacgtttgt

SEQ ID NO: 499429 - DNA, 25 bp, Homo sapien
catacgtttgtgtggtgacatttta

SEQ ID NO: 499430 - DNA, 25 bp, Homo sapien
cccaccacggtgatctgtttaggaa

SEQ ID NO: 499431 - DNA, 25 bp, Homo sapien
ccaccacggtgatctgtttaggaat

SEQ ID NO: 499432 - DNA, 25 bp, Homo sapien
caccacggtgatctgtttaggaatg

SEQ ID NO: 499433 - DNA, 25 bp, Homo sapien
cacggtgatctgtttaggaatggac

SEQ ID NO: 499434 - DNA, 25 bp, Homo sapien
ggacacatgacccatctgtgaccaa

SEQ ID NO: 499435 - DNA, 25 bp, Homo sapien
acacatgacccatctgtgaccaatg

SEQ ID NO: 499436 - DNA, 25 bp, Homo sapien
gtgaccaatgagagtgaatttcagg

SEQ ID NO: 499437 - DNA, 25 bp, Homo sapien
gaccaatgagagtgaatttcaggat

SEQ ID NO: 499438 - DNA, 25 bp, Homo sapien
aatttcaggatttattctctctttc

SEQ ID NO: 499439 - DNA, 25 bp, Homo sapien
ctctctttctctataaggatgtgag

SEQ ID NO: 499440 - DNA, 25 bp, Homo sapien
tttctctataaggatgtgaggtctg

SEQ ID NO: 499441 - DNA, 25 bp, Homo sapien
tgtccttgctgtctccgtactgcag

SEQ ID NO: 499442 - DNA, 25 bp, Homo sapien
gtactgcagctttctttctcggtat

SEQ ID NO: 499443 - DNA, 25 bp, Homo sapien
agctttctttctcggtatcttcttt

SEQ ID NO: 499444 - DNA, 25 bp, Homo sapien
ttctcggtatcttctttctctatct

SEQ ID NO: 499445 - DNA, 25 bp, Homo sapien
atcttcatctcctctttcagagtct

SEQ ID NO: 499446 - DNA, 25 bp, Homo sapien
ctcctctttcagagtcttcatcttt

SEQ ID NO: 499447 - DNA, 25 bp, Homo sapien
aggagctgccggtcgcgtgtctcct

SEQ ID NO: 499448 - DNA, 25 bp, Homo sapien
tgtggtgggccacggtctgccggag

SEQ ID NO: 499449 - DNA, 25 bp, Homo sapien
tttcctctgctgtgagacttttctg

SEQ ID NO: 499450 - DNA, 25 bp, Homo sapien
agacttttctgcctctcgatgtttc

SEQ ID NO: 499451 - DNA, 25 bp, Homo sapien
tgcctctcgatgtttctccttcagc

SEQ ID NO: 499452 - DNA, 25 bp, Homo sapien
acaacatttccgtggctgactccgc

SEQ ID NO: 499453 - DNA, 25 bp, Homo sapien
tttccgtggctgactccgccaacta

SEQ ID NO: 499454 - DNA, 25 bp, Homo sapien
gccaactacagctgcgtctacgtgg

SEQ ID NO: 499455 - DNA, 25 bp, Homo sapien
tacagctgcgtctacgtggacctaa

SEQ ID NO: 499456 - DNA, 25 bp, Homo sapien
agctgcgtctacgtggacctaaagc

SEQ ID NO: 499457 - DNA, 25 bp, Homo sapien
ctgcgtctacgtggacctaaagcca

SEQ ID NO: 499458 - DNA, 25 bp, Homo sapien
gtctacgtggacctaaagccacctt

SEQ ID NO: 499459 - DNA, 25 bp, Homo sapien
tacgtggacctaaagccacctttcg

SEQ ID NO: 499460 - DNA, 25 bp, Homo sapien
gccgagatgccgtcctgcgctgcga

SEQ ID NO: 499461 - DNA, 25 bp, Homo sapien
acgaaggccgtgaagacggtccgca

SEQ ID NO: 499462 - DNA, 25 bp, Homo sapien
gaaggccgtgaagacggtccgcacc

SEQ ID NO: 499463 - DNA, 25 bp, Homo sapien
aaatatgagagccatttagccagtg

SEQ ID NO: 499464 - DNA, 25 bp, Homo sapien
gagagccatttagccagtgatgcat

SEQ ID NO: 499465 - DNA, 25 bp, Homo sapien
tttagccagtgatgcatatttttct

SEQ ID NO: 499466 - DNA, 25 bp, Homo sapien
attctctataaggatcggattggta

SEQ ID NO: 499467 - DNA, 25 bp, Homo sapien
tattaactgttcaaacctgcccaga

SEQ ID NO: 499468 - DNA, 25 bp, Homo sapien
aaacctgcccagacttaactacatg

SEQ ID NO: 499469 - DNA, 25 bp, Homo sapien
tgcccagacttaactacatgtaact

SEQ ID NO: 499470 - DNA, 25 bp, Homo sapien
gaaggtccaaatcaaagtgcctgat

SEQ ID NO: 499471 - DNA, 25 bp, Homo sapien
tcaaagtgcctgattgtccttctgt

SEQ ID NO: 499472 - DNA, 25 bp, Homo sapien
tgctgtctctgctgtgtgacatact

SEQ ID NO: 499473 - DNA, 25 bp, Homo sapien
gtgacatactgcagaattattctct

SEQ ID NO: 499474 - DNA, 25 bp, Homo sapien
attgttcaacaataagggcaaaggg

SEQ ID NO: 499475 - DNA, 25 bp, Homo sapien
gcaaagggagagaatcataacatct

SEQ ID NO: 499476 - DNA, 25 bp, Homo sapien
gaatcataacatctgattaaacaga

SEQ ID NO: 499477 - DNA, 25 bp, Homo sapien
aactaactatataaggatggtccca

SEQ ID NO: 499478 - DNA, 25 bp, Homo sapien
aggatggtcccagctgtgtcaaaag

SEQ ID NO: 499479 - DNA, 25 bp, Homo sapien
gtcccagctgtgtcaaaaggaagct

SEQ ID NO: 499480 - DNA, 25 bp, Homo sapien
gcttgtttgtaatacgtgtgcataa

SEQ ID NO: 499481 - DNA, 25 bp, Homo sapien
gtttgtaatacgtgtgcataaaaat

SEQ ID NO: 499482 - DNA, 25 bp, Homo sapien
gaggtgaacacaattattttaaggc

SEQ ID NO: 499483 - DNA, 25 bp, Homo sapien
tttaaggcagttaaattatctctgt

SEQ ID NO: 499484 - DNA, 25 bp, Homo sapien
agagcaagattccgttcccaagaaa

SEQ ID NO: 499485 - DNA, 25 bp, Homo sapien
tgccatgcctgacggtacagaacga

SEQ ID NO: 499486 - DNA, 25 bp, Homo sapien
gcctgacggtacagaacgatcgcgt

SEQ ID NO: 499487 - DNA, 25 bp, Homo sapien
cctggaacggttgtcaaggcccagc

SEQ ID NO: 499488 - DNA, 25 bp, Homo sapien
cctcgaaaaagttcattgacacaaa

SEQ ID NO: 499489 - DNA, 25 bp, Homo sapien
aaatggaatttgctgctcacacatg

SEQ ID NO: 499490 - DNA, 25 bp, Homo sapien
tgctgctcacacatggacaggtcaa

SEQ ID NO: 499491 - DNA, 25 bp, Homo sapien
acacatggacaggtcaaagtatttt

SEQ ID NO: 499492 - DNA, 25 bp, Homo sapien
ggaaggcatctacaaaaccgtgtgt

SEQ ID NO: 499493 - DNA, 25 bp, Homo sapien
aaaccgtgtgttgagtgccatgcct

SEQ ID NO: 499494 - DNA, 25 bp, Homo sapien
gtgttgagtgccatgcctgacggta

SEQ ID NO: 499495 - DNA, 25 bp, Homo sapien
gagtgccatgcctgacggtacagaa

SEQ ID NO: 499496 - DNA, 25 bp, Homo sapien
cctgaggatggccagcagagaaaca

SEQ ID NO: 499497 - DNA, 25 bp, Homo sapien
aggatggccagcagagaaacaagaa

SEQ ID NO: 499498 - DNA, 25 bp, Homo sapien
ctccctggctgctggagagttgaat

SEQ ID NO: 499499 - DNA, 25 bp, Homo sapien
ccctggctgctggagagttgaatgc

SEQ ID NO: 499500 - DNA, 25 bp, Homo sapien
ggagagttgaatgccagccaccagc

SEQ ID NO: 499501 - DNA, 25 bp, Homo sapien
agagttgaatgccagccaccagcca

SEQ ID NO: 499502 - DNA, 25 bp, Homo sapien
agttgaatgccagccaccagccatg

SEQ ID NO: 499503 - DNA, 25 bp, Homo sapien
ttgaatgccagccaccagccatggg

SEQ ID NO: 499504 - DNA, 25 bp, Homo sapien
gaatgccagccaccagccatgggtg

SEQ ID NO: 499505 - DNA, 25 bp, Homo sapien
accagccatgggtgccagagtttgt

SEQ ID NO: 499506 - DNA, 25 bp, Homo sapien
tccccgccgcaagtcctgaggatgg

SEQ ID NO: 499507 - DNA, 25 bp, Homo sapien
ttcccattaacctacacactgattt

SEQ ID NO: 499508 - DNA, 25 bp, Homo sapien
cactgatttttatgctactccttgt

SEQ ID NO: 499509 - DNA, 25 bp, Homo sapien
gaaacaaaattctggtttgactcag

SEQ ID NO: 499510 - DNA, 25 bp, Homo sapien
ttggaatgtgtaccccgtttatgtg

SEQ ID NO: 499511 - DNA, 25 bp, Homo sapien
gtgtaccccgtttatgtgaagaatt

SEQ ID NO: 499512 - DNA, 25 bp, Homo sapien
tgtgaagaattatgacctatcagtc

SEQ ID NO: 499513 - DNA, 25 bp, Homo sapien
tgacctatcagtcatagctaaatag

SEQ ID NO: 499514 - DNA, 25 bp, Homo sapien
tagtgaacctcaaaagtgttaactt

SEQ ID NO: 499515 - DNA, 25 bp, Homo sapien
ctattcatgtgaggtttggtatctt

SEQ ID NO: 499516 - DNA, 25 bp, Homo sapien
atcttgcatttatgtacatggctgt

SEQ ID NO: 499517 - DNA, 25 bp, Homo sapien
aaattatgtgcatttactctgtatt

SEQ ID NO: 499518 - DNA, 25 bp, Homo sapien
aatactgttctaaattattcaggcc

SEQ ID NO: 499519 - DNA, 25 bp, Homo sapien
tattcaggcctatagtttccattac

SEQ ID NO: 499520 - DNA, 25 bp, Homo sapien
actggagtcctccattgtgtggcca

SEQ ID NO: 499521 - DNA, 25 bp, Homo sapien
tgtgtggccacacagtgtcgttgat

SEQ ID NO: 499522 - DNA, 25 bp, Homo sapien
ggccacacagtgtcgttgatttaaa

SEQ ID NO: 499523 - DNA, 25 bp, Homo sapien
atttaaaggagccagtgcttcccct

SEQ ID NO: 499524 - DNA, 25 bp, Homo sapien
tctccccaggtagttggtcagctgt

SEQ ID NO: 499525 - DNA, 25 bp, Homo sapien
agctgtggactctgtgacctttgtc

SEQ ID NO: 499526 - DNA, 25 bp, Homo sapien
gtctaaacctgtgttgtaagatctt

SEQ ID NO: 499527 - DNA, 25 bp, Homo sapien
gtaagatcttgggacttcctctctt

SEQ ID NO: 499528 - DNA, 25 bp, Homo sapien
tttctcttcttagtctctctcttta

SEQ ID NO: 499529 - DNA, 25 bp, Homo sapien
gtccgaaataccaaccgtgaaactg

SEQ ID NO: 499530 - DNA, 25 bp, Homo sapien
tgggtaaaaagcttcaggaggtgat

SEQ ID NO: 499531 - DNA, 25 bp, Homo sapien
gtaatttgtggctttttagagagaa

SEQ ID NO: 499532 - DNA, 25 bp, Homo sapien
gaaggatactttgacagttttcatt

SEQ ID NO: 499533 - DNA, 25 bp, Homo sapien
cagttttcatttgtcgtctacatgt

SEQ ID NO: 499534 - DNA, 25 bp, Homo sapien
gtcgtctacatgtatatggtacgtt

SEQ ID NO: 499535 - DNA, 25 bp, Homo sapien
gtatatggtacgtttcattctgcct

SEQ ID NO: 499536 - DNA, 25 bp, Homo sapien
tggtacgtttcattctgccttttaa

SEQ ID NO: 499537 - DNA, 25 bp, Homo sapien
gtacgtttcattctgccttttaatt

SEQ ID NO: 499538 - DNA, 25 bp, Homo sapien
tggtattttactatgaaaactactt

SEQ ID NO: 499539 - DNA, 25 bp, Homo sapien
tgtatttccaatgttataagttgtg

SEQ ID NO: 499540 - DNA, 25 bp, Homo sapien
gagatttcagatgactttccagttc

SEQ ID NO: 499541 - DNA, 25 bp, Homo sapien
gactttccagttcagcatatgggac

SEQ ID NO: 499542 - DNA, 25 bp, Homo sapien
gcatatgggacaaatttcgggactt

SEQ ID NO: 499543 - DNA, 25 bp, Homo sapien
aacttgccagctacgaatttctcta

SEQ ID NO: 499544 - DNA, 25 bp, Homo sapien
gctacgaatttctctaatttggttc

SEQ ID NO: 499545 - DNA, 25 bp, Homo sapien
taatttggttcatctggtggcccac

SEQ ID NO: 499546 - DNA, 25 bp, Homo sapien
ggtggcccacttgttgaagacaaaa

SEQ ID NO: 499547 - DNA, 25 bp, Homo sapien
agacaaaatcgctttccctttccat

SEQ ID NO: 499548 - DNA, 25 bp, Homo sapien
tccctttccatcttaaaggtagttg

SEQ ID NO: 499549 - DNA, 25 bp, Homo sapien
gaattggacaaacccagagtccgtt

SEQ ID NO: 499550 - DNA, 25 bp, Homo sapien
caagagtatctgacaacccaaagct

SEQ ID NO: 499551 - DNA, 25 bp, Homo sapien
ggcggactctacggcgttttgtaga

SEQ ID NO: 499552 - DNA, 25 bp, Homo sapien
gggtgccatactaccttaaatgcta

SEQ ID NO: 499553 - DNA, 25 bp, Homo sapien
actaccttaaatgctaatgctagat

SEQ ID NO: 499554 - DNA, 25 bp, Homo sapien
agagggaggcatggtatattaaaat

SEQ ID NO: 499555 - DNA, 25 bp, Homo sapien
attgataatctgtgtgaatatgttt

SEQ ID NO: 499556 - DNA, 25 bp, Homo sapien
agatgtttatataccttttgaagag

SEQ ID NO: 499557 - DNA, 25 bp, Homo sapien
atataccttttgaagagacccagta

SEQ ID NO: 499558 - DNA, 25 bp, Homo sapien
aagagacccagtagcccatagcaca

SEQ ID NO: 499559 - DNA, 25 bp, Homo sapien
agtagcccatagcacaaatcttgtg

SEQ ID NO: 499560 - DNA, 25 bp, Homo sapien
gcacaaatcttgtggaaatccgata

SEQ ID NO: 499561 - DNA, 25 bp, Homo sapien
aatccgatatgttttaatgtggcta

SEQ ID NO: 499562 - DNA, 25 bp, Homo sapien
tagcctgactgcgtgtctgcccatg

SEQ ID NO: 499563 - DNA, 25 bp, Homo sapien
agcctgactgcgtgtctgcccatgc

SEQ ID NO: 499564 - DNA, 25 bp, Homo sapien
cctgactgcgtgtctgcccatgcag

SEQ ID NO: 499565 - DNA, 25 bp, Homo sapien
ctgactgcgtgtctgcccatgcagg

SEQ ID NO: 499566 - DNA, 25 bp, Homo sapien
tgactgcgtgtctgcccatgcaggg

SEQ ID NO: 499567 - DNA, 25 bp, Homo sapien
gcgtgtctgcccatgcaggggaaca

SEQ ID NO: 499568 - DNA, 25 bp, Homo sapien
gcccatgcaggggaacacggtgctc

SEQ ID NO: 499569 - DNA, 25 bp, Homo sapien
gaacacggtgctcggggcttaagcc

SEQ ID NO: 499570 - DNA, 25 bp, Homo sapien
agcctcggcgtttgcacagtccctg

SEQ ID NO: 499571 - DNA, 25 bp, Homo sapien
cacagtccctgcctgaggcctgagc

SEQ ID NO: 499572 - DNA, 25 bp, Homo sapien
ctgacctccgttctgcctctggtgg

SEQ ID NO: 499573 - DNA, 25 bp, Homo sapien
agctgggcatcaccaattgtcatat

SEQ ID NO: 499574 - DNA, 25 bp, Homo sapien
gggcatcaccaattgtcatataaaa

SEQ ID NO: 499575 - DNA, 25 bp, Homo sapien
acttttccttgcacatcacaatctg

SEQ ID NO: 499576 - DNA, 25 bp, Homo sapien
ttccttgcacatcacaatctgatag

SEQ ID NO: 499577 - DNA, 25 bp, Homo sapien
gatagagaaatggttcactgttgtt

SEQ ID NO: 499578 - DNA, 25 bp, Homo sapien
aagacaacgcttcaaaacaatgatt

SEQ ID NO: 499579 - DNA, 25 bp, Homo sapien
gcttcaaatgctgaatgaccaaaga

SEQ ID NO: 499580 - DNA, 25 bp, Homo sapien
atggtcaacattgagttctttggca

SEQ ID NO: 499581 - DNA, 25 bp, Homo sapien
tctttggcaacttcttgtgtcattg

SEQ ID NO: 499582 - DNA, 25 bp, Homo sapien
ggcaacttcttgtgtcattgtaaga

SEQ ID NO: 499583 - DNA, 25 bp, Homo sapien
gatgaccgctcttaattggttgttg

SEQ ID NO: 499584 - DNA, 25 bp, Homo sapien
ggactgtgcccgtgctcacctggct

SEQ ID NO: 499585 - DNA, 25 bp, Homo sapien
tcacctggctaccaccgtagcgaca

SEQ ID NO: 499586 - DNA, 25 bp, Homo sapien
cgtagcgacactgccggcctaagga

SEQ ID NO: 499587 - DNA, 25 bp, Homo sapien
gacactgccggcctaaggaagtacc

SEQ ID NO: 499588 - DNA, 25 bp, Homo sapien
cactgccggcctaaggaagtacctt

SEQ ID NO: 499589 - DNA, 25 bp, Homo sapien
tgccggcctaaggaagtaccttcgg

SEQ ID NO: 499590 - DNA, 25 bp, Homo sapien
acatgggccccgacggaagcggctc

SEQ ID NO: 499591 - DNA, 25 bp, Homo sapien
gaagcggctccgagccggcttctct

SEQ ID NO: 499592 - DNA, 25 bp, Homo sapien
gcaggttcgcagacccaccggagct

SEQ ID NO: 499593 - DNA, 25 bp, Homo sapien
acccaccggagctcccgagagaggg

SEQ ID NO: 499594 - DNA, 25 bp, Homo sapien
gagctcccgagagagggccgctcta

SEQ ID NO: 499595 - DNA, 25 bp, Homo sapien
gaaatagcttgtactactgaattaa

SEQ ID NO: 499596 - DNA, 25 bp, Homo sapien
catgtttatgaaaagtgtgctgatt

SEQ ID NO: 499597 - DNA, 25 bp, Homo sapien
aagacttctagtatttggctcaaat

SEQ ID NO: 499598 - DNA, 25 bp, Homo sapien
acacacatacacctaaaatggccta

SEQ ID NO: 499599 - DNA, 25 bp, Homo sapien
atacacctaaaatggcctaaagcag

SEQ ID NO: 499600 - DNA, 25 bp, Homo sapien
ggcctaaagcagacatccatgtaat

SEQ ID NO: 499601 - DNA, 25 bp, Homo sapien
gacatccatgtaattacagttgcaa

SEQ ID NO: 499602 - DNA, 25 bp, Homo sapien
aaataagtactgttgtataccagga

SEQ ID NO: 499603 - DNA, 25 bp, Homo sapien
ctgttgtataccaggatatgtgaga

SEQ ID NO: 499604 - DNA, 25 bp, Homo sapien
atgtagtaggtcacttttcaccctt

SEQ ID NO: 499605 - DNA, 25 bp, Homo sapien
cttttcacccttgtagctataaaat

SEQ ID NO: 499606 - DNA, 25 bp, Homo sapien
gtaagactcaatctactcttcaagt

SEQ ID NO: 499607 - DNA, 25 bp, Homo sapien
tcttcaagttgatgtaccctctatg

SEQ ID NO: 499608 - DNA, 25 bp, Homo sapien
gtaccctctatgactgtaattcctg

SEQ ID NO: 499609 - DNA, 25 bp, Homo sapien
aatctgcagttatgctgtggtgatc

SEQ ID NO: 499610 - DNA, 25 bp, Homo sapien
ctgtggtgatcttaagcgtgtcttg

SEQ ID NO: 499611 - DNA, 25 bp, Homo sapien
cgtgtcttgagttccatgcaaattc

SEQ ID NO: 499612 - DNA, 25 bp, Homo sapien
gtgtccataatcaaatcatcatctt

SEQ ID NO: 499613 - DNA, 25 bp, Homo sapien
tcttgcaatgcaagggctaccccat

SEQ ID NO: 499614 - DNA, 25 bp, Homo sapien
agggctaccccataattatcagaca

SEQ ID NO: 499615 - DNA, 25 bp, Homo sapien
ataacatcagcttcagtgcctgttc

SEQ ID NO: 499616 - DNA, 25 bp, Homo sapien
gcttcagtgcctgttcacaatacaa

SEQ ID NO: 499617 - DNA, 25 bp, Homo sapien
caagcatgctaacctaagttaattc

SEQ ID NO: 499618 - DNA, 25 bp, Homo sapien
tgctaacctaagttaattcaagttt

SEQ ID NO: 499619 - DNA, 25 bp, Homo sapien
tttccttcactggaagatttttcca

SEQ ID NO: 499620 - DNA, 25 bp, Homo sapien
ttcataaccaactattcactattat

SEQ ID NO: 499621 - DNA, 25 bp, Homo sapien
ttcactattataacatgtttcccag

SEQ ID NO: 499622 - DNA, 25 bp, Homo sapien
acatgtttcccagtgtaaatgagta

SEQ ID NO: 499623 - DNA, 25 bp, Homo sapien
aggagtgaccctcatatttaagtta

SEQ ID NO: 499624 - DNA, 25 bp, Homo sapien
gagtgaccctcatatttaagttatt

SEQ ID NO: 499625 - DNA, 25 bp, Homo sapien
ttttatatttgactggacattgttc

SEQ ID NO: 499626 - DNA, 25 bp, Homo sapien
atatttgactggacattgttcagaa

SEQ ID NO: 499627 - DNA, 25 bp, Homo sapien
ttgactggacattgttcagaagtgt

SEQ ID NO: 499628 - DNA, 25 bp, Homo sapien
tgcccttttgttctcacctggagga

SEQ ID NO: 499629 - DNA, 25 bp, Homo sapien
ccttttgttctcacctggaggaggt

SEQ ID NO: 499630 - DNA, 25 bp, Homo sapien
gtgaaactggcctgagcccagagga

SEQ ID NO: 499631 - DNA, 25 bp, Homo sapien
agcacaagcaagtcaagctctccaa

SEQ ID NO: 499632 - DNA, 25 bp, Homo sapien
gcaagtcaagctctccaagaagtga

SEQ ID NO: 499633 - DNA, 25 bp, Homo sapien
tctccaagaagtgagcagcctggcc

SEQ ID NO: 499634 - DNA, 25 bp, Homo sapien
aagtgagcagcctggcccctgctgt

SEQ ID NO: 499635 - DNA, 25 bp, Homo sapien
tgctgtcggacctgagcctcctggc

SEQ ID NO: 499636 - DNA, 25 bp, Homo sapien
ctggctcccagcctgtaaatatgta

SEQ ID NO: 499637 - DNA, 25 bp, Homo sapien
gctcccagcctgtaaatatgtatag

SEQ ID NO: 499638 - DNA, 25 bp, Homo sapien
aaatatgtatagacctgttttgtca

SEQ ID NO: 499639 - DNA, 25 bp, Homo sapien
atcctgctcgcttttcctttaaaga

SEQ ID NO: 499640 - DNA, 25 bp, Homo sapien
ataggcatatggtttactatggcgt

SEQ ID NO: 499641 - DNA, 25 bp, Homo sapien
gtttactatggcgtgtgtactctcc

SEQ ID NO: 499642 - DNA, 25 bp, Homo sapien
tatggcgtgtgtactctccttgtaa

SEQ ID NO: 499643 - DNA, 25 bp, Homo sapien
actctccttgtaatgttctgttctc

SEQ ID NO: 499644 - DNA, 25 bp, Homo sapien
gttctgttctcaagctaacatctat

SEQ ID NO: 499645 - DNA, 25 bp, Homo sapien
atctattcttctagagaacctctct

SEQ ID NO: 499646 - DNA, 25 bp, Homo sapien
tctctcttaggctgacaacgctgtg

SEQ ID NO: 499647 - DNA, 25 bp, Homo sapien
acaacgctgtggatctgggctccca

SEQ ID NO: 499648 - DNA, 25 bp, Homo sapien
gacctttgttattgatgtttgtagc

SEQ ID NO: 499649 - DNA, 25 bp, Homo sapien
atgtttgtagccaaggagaattatc

SEQ ID NO: 499650 - DNA, 25 bp, Homo sapien
caggtgaatctcttcctttaagcca

SEQ ID NO: 499651 - DNA, 25 bp, Homo sapien
ctttaagccatttttgtctcctgtg

SEQ ID NO: 499652 - DNA, 25 bp, Homo sapien
gtctcctgtgaatacagccttatct

SEQ ID NO: 499653 - DNA, 25 bp, Homo sapien
ttttccattcattaccctctttgtt

SEQ ID NO: 499654 - DNA, 25 bp, Homo sapien
tttgttccctttacttctcaacctg

SEQ ID NO: 499655 - DNA, 25 bp, Homo sapien
ctcaacctgtgctatatacatgctg

SEQ ID NO: 499656 - DNA, 25 bp, Homo sapien
tgtgctatatacatgctgttctctc

SEQ ID NO: 499657 - DNA, 25 bp, Homo sapien
gctgttctctctgttgagattgcct

SEQ ID NO: 499658 - DNA, 25 bp, Homo sapien
gattgccttatttccatctaacatt

SEQ ID NO: 499659 - DNA, 25 bp, Homo sapien
ttatttccatctaacattctctctc

SEQ ID NO: 499660 - DNA, 25 bp, Homo sapien
gtaatcataaacttgaactctctcc

SEQ ID NO: 499661 - DNA, 25 bp, Homo sapien
accaccccaggacaagttagagcac

SEQ ID NO: 499662 - DNA, 25 bp, Homo sapien
gttagagcactgtttagctcctttg

SEQ ID NO: 499663 - DNA, 25 bp, Homo sapien
tttagctcctttgtctgtgtgatag

SEQ ID NO: 499664 - DNA, 25 bp, Homo sapien
gtgtgatagacctaagaactgtatt

SEQ ID NO: 499665 - DNA, 25 bp, Homo sapien
gaactgtattagtgttgtaccagcc

SEQ ID NO: 499666 - DNA, 25 bp, Homo sapien
ttgtaccagcctattaacctcttgt

SEQ ID NO: 499667 - DNA, 25 bp, Homo sapien
agcctattaacctcttgtctgtgca

SEQ ID NO: 499668 - DNA, 25 bp, Homo sapien
ttaacctcttgtctgtgcacagctt

SEQ ID NO: 499669 - DNA, 25 bp, Homo sapien
gcttcaaatgttaccgtctagttag

SEQ ID NO: 499670 - DNA, 25 bp, Homo sapien
tgttaccgtctagttagatttttat

SEQ ID NO: 499671 - DNA, 25 bp, Homo sapien
aagtttcaaagcacacctgtttggc

SEQ ID NO: 499672 - DNA, 25 bp, Homo sapien
aagtattgcattctgccgtgtttat

SEQ ID NO: 499673 - DNA, 25 bp, Homo sapien
cattctgccgtgtttataggtgttc

SEQ ID NO: 499674 - DNA, 25 bp, Homo sapien
gtgtttataggtgttcactttcctc

SEQ ID NO: 499675 - DNA, 25 bp, Homo sapien
gttcactttcctccagagctgatta

SEQ ID NO: 499676 - DNA, 25 bp, Homo sapien
gagctgattaactactgacatgact

SEQ ID NO: 499677 - DNA, 25 bp, Homo sapien
ttggctttctcatccagaaattatg

SEQ ID NO: 499678 - DNA, 25 bp, Homo sapien
tatggaaacagggtctgtcagtggc

SEQ ID NO: 499679 - DNA, 25 bp, Homo sapien
gaggccgtgctgtgttttacttgga

SEQ ID NO: 499680 - DNA, 25 bp, Homo sapien
gttttacttggatgacacaatgcag

SEQ ID NO: 499681 - DNA, 25 bp, Homo sapien
cacaatgcagtttacttgcctcttc

SEQ ID NO: 499682 - DNA, 25 bp, Homo sapien
gctcaccctagacaatgacatataa

SEQ ID NO: 499683 - DNA, 25 bp, Homo sapien
tctgctattgagtcagctgtacctt

SEQ ID NO: 499684 - DNA, 25 bp, Homo sapien
aatgtgttatttgtatggcccttat

SEQ ID NO: 499685 - DNA, 25 bp, Homo sapien
aaggtgtttgctgtaattctgttaa

SEQ ID NO: 499686 - DNA, 25 bp, Homo sapien
gttaaaagacttcgcctatgccata

SEQ ID NO: 499687 - DNA, 25 bp, Homo sapien
ttcgcctatgccatactggtgtata

SEQ ID NO: 499688 - DNA, 25 bp, Homo sapien
ctggtgtataaaaactgccgcaatt

SEQ ID NO: 499689 - DNA, 25 bp, Homo sapien
aaaactgccgcaattggacgccggt

SEQ ID NO: 499690 - DNA, 25 bp, Homo sapien
tggacgccggtgtggtactcatttc

SEQ ID NO: 499691 - DNA, 25 bp, Homo sapien
ggtactcatttcagtatacctgaac

SEQ ID NO: 499692 - DNA, 25 bp, Homo sapien
attttgtgcaatggctttatctaaa

SEQ ID NO: 499693 - DNA, 25 bp, Homo sapien
atgacgcttcgtgaaagcactttgt

SEQ ID NO: 499694 - DNA, 25 bp, Homo sapien
gttgaactatgttagaaaaggccat

SEQ ID NO: 499695 - DNA, 25 bp, Homo sapien
gaaaaggccattaatttgcctgcaa

SEQ ID NO: 499696 - DNA, 25 bp, Homo sapien
aaggccattaatttgcctgcaaatt

SEQ ID NO: 499697 - DNA, 25 bp, Homo sapien
atttgcctgcaaattgttaacagaa

SEQ ID NO: 499698 - DNA, 25 bp, Homo sapien
gcctgcaaattgttaacagaagggt

SEQ ID NO: 499699 - DNA, 25 bp, Homo sapien
gggtattaaaaccacagctaagtag

SEQ ID NO: 499700 - DNA, 25 bp, Homo sapien
aaaaccacagctaagtagctctatt

SEQ ID NO: 499701 - DNA, 25 bp, Homo sapien
cagctaagtagctctattataatac

SEQ ID NO: 499702 - DNA, 25 bp, Homo sapien
gctctattataatacttatccagtg

SEQ ID NO: 499703 - DNA, 25 bp, Homo sapien
cttatccagtgactaaaaccaactt

SEQ ID NO: 499704 - DNA, 25 bp, Homo sapien
tatccagtgactaaaaccaacttaa

SEQ ID NO: 499705 - DNA, 25 bp, Homo sapien
aaagactgagctgtttaagaatttt

SEQ ID NO: 499706 - DNA, 25 bp, Homo sapien
gactgagctgtttaagaattttttg

SEQ ID NO: 499707 - DNA, 25 bp, Homo sapien
ttttggggaacatttctagcagtga

SEQ ID NO: 499708 - DNA, 25 bp, Homo sapien
tttttggcctttaatgatagcgtaa

SEQ ID NO: 499709 - DNA, 25 bp, Homo sapien
ttttggcctttaatgatagcgtaaa

SEQ ID NO: 499710 - DNA, 25 bp, Homo sapien
taatgatagcgtaaagacaggagcc

SEQ ID NO: 499711 - DNA, 25 bp, Homo sapien
aagacaggagccttacaacttaggc

SEQ ID NO: 499712 - DNA, 25 bp, Homo sapien
gacaggagccttacaacttaggcaa

SEQ ID NO: 499713 - DNA, 25 bp, Homo sapien
aggagccttacaacttaggcaaagc

SEQ ID NO: 499714 - DNA, 25 bp, Homo sapien
gagccttacaacttaggcaaagcat

SEQ ID NO: 499715 - DNA, 25 bp, Homo sapien
ccttacaacttaggcaaagcatttc

SEQ ID NO: 499716 - DNA, 25 bp, Homo sapien
atgaacagctgttttatcatcctac

SEQ ID NO: 499717 - DNA, 25 bp, Homo sapien
tacataacccttaggaactcttcag

SEQ ID NO: 499718 - DNA, 25 bp, Homo sapien
acataacccttaggaactcttcagg

SEQ ID NO: 499719 - DNA, 25 bp, Homo sapien
ataacccttaggaactcttcaggct

SEQ ID NO: 499720 - DNA, 25 bp, Homo sapien
taacccttaggaactcttcaggctt

SEQ ID NO: 499721 - DNA, 25 bp, Homo sapien
ttaggaactcttcaggctttaaaag

SEQ ID NO: 499722 - DNA, 25 bp, Homo sapien
taggaactcttcaggctttaaaagg

SEQ ID NO: 499723 - DNA, 25 bp, Homo sapien
gaactcttcaggctttaaaaggcaa

SEQ ID NO: 499724 - DNA, 25 bp, Homo sapien
actcttcaggctttaaaaggcaagg

SEQ ID NO: 499725 - DNA, 25 bp, Homo sapien
ttcaggctttaaaaggcaaggagca

SEQ ID NO: 499726 - DNA, 25 bp, Homo sapien
ttctcaactatgtgaaatctgtttc

SEQ ID NO: 499727 - DNA, 25 bp, Homo sapien
tgggttggtctcaggatttgttccg

SEQ ID NO: 499728 - DNA, 25 bp, Homo sapien
tcaggatttgttccgcgccttgtgg

SEQ ID NO: 499729 - DNA, 25 bp, Homo sapien
cgcgccttgtggagatcgctgtcaa

SEQ ID NO: 499730 - DNA, 25 bp, Homo sapien
gagcacgtgggcacggaccaattcg

SEQ ID NO: 499731 - DNA, 25 bp, Homo sapien
ggcacggaccaattcgggaacaaat

SEQ ID NO: 499732 - DNA, 25 bp, Homo sapien
attcgggaacaaatactactacatc

SEQ ID NO: 499733 - DNA, 25 bp, Homo sapien
atactactacatcccgcagtacaag

SEQ ID NO: 499734 - DNA, 25 bp, Homo sapien
tacatcccgcagtacaagaactgga

SEQ ID NO: 499735 - DNA, 25 bp, Homo sapien
actggagaggacaaactattcgaga

SEQ ID NO: 499736 - DNA, 25 bp, Homo sapien
gaacaagaaagactccacctactat

SEQ ID NO: 499737 - DNA, 25 bp, Homo sapien
aagactccacctactatggaggaaa

SEQ ID NO: 499738 - DNA, 25 bp, Homo sapien
atcagatacaccaaactgttgatgg

SEQ ID NO: 499739 - DNA, 25 bp, Homo sapien
gatggtatttaaatgtgacttcaag

SEQ ID NO: 499740 - DNA, 25 bp, Homo sapien
gatatgtaagtctgttctaatctac

SEQ ID NO: 499741 - DNA, 25 bp, Homo sapien
gttctaatctacagttcacatatcg

SEQ ID NO: 499742 - DNA, 25 bp, Homo sapien
gttcacatatcgacagttactctgg

SEQ ID NO: 499743 - DNA, 25 bp, Homo sapien
ttggtggatgttgattaagtgcctg

SEQ ID NO: 499744 - DNA, 25 bp, Homo sapien
taagtgcctgtgttttgtttcctcc

SEQ ID NO: 499745 - DNA, 25 bp, Homo sapien
ttcctcctctggataccaaataggt

SEQ ID NO: 499746 - DNA, 25 bp, Homo sapien
ggtgtatgctacttttttggtgaac

SEQ ID NO: 499747 - DNA, 25 bp, Homo sapien
tggtgaacttatttcttggaagatt

SEQ ID NO: 499748 - DNA, 25 bp, Homo sapien
ggaagatttggctatgctattcagg

SEQ ID NO: 499749 - DNA, 25 bp, Homo sapien
tctccatgtcagaagcaagcctgct

SEQ ID NO: 499750 - DNA, 25 bp, Homo sapien
agcctgctctttgataaatctgtct

SEQ ID NO: 499751 - DNA, 25 bp, Homo sapien
gataaatctgtcttcctgaaaatct

SEQ ID NO: 499752 - DNA, 25 bp, Homo sapien
gaaatgaccctccttggatcagttt

SEQ ID NO: 499753 - DNA, 25 bp, Homo sapien
aaacttgttctaactcgtctcttgg

SEQ ID NO: 499754 - DNA, 25 bp, Homo sapien
taactcgtctcttggcattcagcta

SEQ ID NO: 499755 - DNA, 25 bp, Homo sapien
attcagctactcctagatcttttgg

SEQ ID NO: 499756 - DNA, 25 bp, Homo sapien
gataaatgatccctcgagttcagtt

SEQ ID NO: 499757 - DNA, 25 bp, Homo sapien
gagttcagttagtattctgtccaga

SEQ ID NO: 499758 - DNA, 25 bp, Homo sapien
gtgtttagctcactttcttagcagt

SEQ ID NO: 499759 - DNA, 25 bp, Homo sapien
cagtgtgtaagctttctccatgtca

SEQ ID NO: 499760 - DNA, 25 bp, Homo sapien
ggctcacaccaacttgtaggctgtg

SEQ ID NO: 499761 - DNA, 25 bp, Homo sapien
tgtaggctgtgggagctttgccata

SEQ ID NO: 499762 - DNA, 25 bp, Homo sapien
gaagaagacaaggaacttcattata

SEQ ID NO: 499763 - DNA, 25 bp, Homo sapien
gtaccaggtagaggacattattatt

SEQ ID NO: 499764 - DNA, 25 bp, Homo sapien
gaggacattattattcaaaggatta

SEQ ID NO: 499765 - DNA, 25 bp, Homo sapien
aaggattatgcacagctcagtgaag

SEQ ID NO: 499766 - DNA, 25 bp, Homo sapien
agttacaatttttctcgcagctttg

SEQ ID NO: 499767 - DNA, 25 bp, Homo sapien
aatttttctcgcagctttgttgcta

SEQ ID NO: 499768 - DNA, 25 bp, Homo sapien
ttctcgcagctttgttgctattatt

SEQ ID NO: 499769 - DNA, 25 bp, Homo sapien
gctcatttcattatgtgccttgctc

SEQ ID NO: 499770 - DNA, 25 bp, Homo sapien
ttcattatgtgccttgctccctgat

SEQ ID NO: 499771 - DNA, 25 bp, Homo sapien
ccccaagcctcttagggtgagacat

SEQ ID NO: 499772 - DNA, 25 bp, Homo sapien
ccattgttgctggtccctaaatagc

SEQ ID NO: 499773 - DNA, 25 bp, Homo sapien
taaatagcagcaccctttgaaggat

SEQ ID NO: 499774 - DNA, 25 bp, Homo sapien
gaaggatccttgaaccatgaccaca

SEQ ID NO: 499775 - DNA, 25 bp, Homo sapien
gaccacaccgcaacaaagagtcctt

SEQ ID NO: 499776 - DNA, 25 bp, Homo sapien
aagagtccttcatcaaactcgcttc

SEQ ID NO: 499777 - DNA, 25 bp, Homo sapien
gtttcctgcaagaaccctgactgct

SEQ ID NO: 499778 - DNA, 25 bp, Homo sapien
gcaagaaccctgactgctgaagccg

SEQ ID NO: 499779 - DNA, 25 bp, Homo sapien
gccggattttgactaagcttctacc

SEQ ID NO: 499780 - DNA, 25 bp, Homo sapien
gcttctaccttgtaaaccgtgactg

SEQ ID NO: 499781 - DNA, 25 bp, Homo sapien
ccttgtaaaccgtgactgtgggatt

SEQ ID NO: 499782 - DNA, 25 bp, Homo sapien
gaagaattttgttgtcatctgccag

SEQ ID NO: 499783 - DNA, 25 bp, Homo sapien
ttatcacaggactcattgaatgcaa

SEQ ID NO: 499784 - DNA, 25 bp, Homo sapien
atgtgagtaagttcccttttgattc

SEQ ID NO: 499785 - DNA, 25 bp, Homo sapien
gggaatcagcgattttccctgtgga

SEQ ID NO: 499786 - DNA, 25 bp, Homo sapien
ggattaagacaaaccaacgccagaa

SEQ ID NO: 499787 - DNA, 25 bp, Homo sapien
aacgccagaaggtctcctgtgctta

SEQ ID NO: 499788 - DNA, 25 bp, Homo sapien
tattttaaccatctgctcccatcgt

SEQ ID NO: 499789 - DNA, 25 bp, Homo sapien
atcgtgaaccctggagcatgcattt

SEQ ID NO: 499790 - DNA, 25 bp, Homo sapien
ggagcatgcatttcctagaagtggt

SEQ ID NO: 499791 - DNA, 25 bp, Homo sapien
gaagtggtttcatagctcctgtgtg

SEQ ID NO: 499792 - DNA, 25 bp, Homo sapien
atagctcctgtgtgttcatggaaaa

SEQ ID NO: 499793 - DNA, 25 bp, Homo sapien
gacatgctcaggaaagcttcacgag

SEQ ID NO: 499794 - DNA, 25 bp, Homo sapien
gagagaacagcttcaaaatcctccc

SEQ ID NO: 499795 - DNA, 25 bp, Homo sapien
aaaatcctccctatgacactgaatg

SEQ ID NO: 499796 - DNA, 25 bp, Homo sapien
gccagttacatacaatagccttatt

SEQ ID NO: 499797 - DNA, 25 bp, Homo sapien
gccttattactgctaatcactgtca

SEQ ID NO: 499798 - DNA, 25 bp, Homo sapien
gtcacttcattcacctctatttgag

SEQ ID NO: 499799 - DNA, 25 bp, Homo sapien
gtatctgatgaactagaatccttgt

SEQ ID NO: 499800 - DNA, 25 bp, Homo sapien
aactagaatccttgtcagtattggg

SEQ ID NO: 499801 - DNA, 25 bp, Homo sapien
gttgcaatatctagtcaaactttga

SEQ ID NO: 499802 - DNA, 25 bp, Homo sapien
caaactttgagtgtactggttctgt

SEQ ID NO: 499803 - DNA, 25 bp, Homo sapien
actggttctgtgaaccacctgaaaa

SEQ ID NO: 499804 - DNA, 25 bp, Homo sapien
tggcaaaggcctccctaaaaggccg

SEQ ID NO: 499805 - DNA, 25 bp, Homo sapien
taaaaggccgcatttctgacctgag

SEQ ID NO: 499806 - DNA, 25 bp, Homo sapien
aaaggccgcatttctgacctgagcc

SEQ ID NO: 499807 - DNA, 25 bp, Homo sapien
atttctgacctgagccccgggtctc

SEQ ID NO: 499808 - DNA, 25 bp, Homo sapien
agccccgggtctcggctgtttcgag

SEQ ID NO: 499809 - DNA, 25 bp, Homo sapien
tgtttcgagccccgcctcggacttg

SEQ ID NO: 499810 - DNA, 25 bp, Homo sapien
tccgggtgagcctgtctggcgcctt

SEQ ID NO: 499811 - DNA, 25 bp, Homo sapien
ggtgagcctgtctggcgccttcctc

SEQ ID NO: 499812 - DNA, 25 bp, Homo sapien
tgagagctgggtcccgggagatgga

SEQ ID NO: 499813 - DNA, 25 bp, Homo sapien
gtcccgggagatggaagcctcccag

SEQ ID NO: 499814 - DNA, 25 bp, Homo sapien
cttcccgggcgctctgaggcttctt

SEQ ID NO: 499815 - DNA, 25 bp, Homo sapien
gccgtcatctgcatgagaagggcca

SEQ ID NO: 499816 - DNA, 25 bp, Homo sapien
cgtcatctgcatgagaagggccacc

SEQ ID NO: 499817 - DNA, 25 bp, Homo sapien
ggctcggattccagacagccccatg

SEQ ID NO: 499818 - DNA, 25 bp, Homo sapien
agcagcccggccttccgggtgacag

SEQ ID NO: 499819 - DNA, 25 bp, Homo sapien
ttccgggtgacaggctccttcttaa

SEQ ID NO: 499820 - DNA, 25 bp, Homo sapien
gggtgacaggctccttcttaatcct

SEQ ID NO: 499821 - DNA, 25 bp, Homo sapien
tctgtgtccgagtccttctgctccc

SEQ ID NO: 499822 - DNA, 25 bp, Homo sapien
ttggcgcccgcggtgaagggcagct

SEQ ID NO: 499823 - DNA, 25 bp, Homo sapien
tgaagggcagcttccgcttgctggc

SEQ ID NO: 499824 - DNA, 25 bp, Homo sapien
ggcagcttccgcttgctggctcgct

SEQ ID NO: 499825 - DNA, 25 bp, Homo sapien
gccacgctccagttttggggtcttg

SEQ ID NO: 499826 - DNA, 25 bp, Homo sapien
tgtccttctaagcattttaaattct

SEQ ID NO: 499827 - DNA, 25 bp, Homo sapien
cactggcttgaaatgtgcctactac

SEQ ID NO: 499828 - DNA, 25 bp, Homo sapien
tggcttgaaatgtgcctactacaga

SEQ ID NO: 499829 - DNA, 25 bp, Homo sapien
cttgaaatgtgcctactacagaaat

SEQ ID NO: 499830 - DNA, 25 bp, Homo sapien
aaatgtgcctactacagaaatatgc

SEQ ID NO: 499831 - DNA, 25 bp, Homo sapien
gcctactacagaaatatgcatacag

SEQ ID NO: 499832 - DNA, 25 bp, Homo sapien
actacagaaatatgcatacagaagc

SEQ ID NO: 499833 - DNA, 25 bp, Homo sapien
ttgtgtgaactgcagaatcttatac

SEQ ID NO: 499834 - DNA, 25 bp, Homo sapien
tgtgtgaactgcagaatcttataca

SEQ ID NO: 499835 - DNA, 25 bp, Homo sapien
gattccttgatgaagtatatactct

SEQ ID NO: 499836 - DNA, 25 bp, Homo sapien
tactctaaaatacagtcttctacca

SEQ ID NO: 499837 - DNA, 25 bp, Homo sapien
ggtactgataacaaagttccaaaag

SEQ ID NO: 499838 - DNA, 25 bp, Homo sapien
cactaaaacatgtaattggcctatt

SEQ ID NO: 499839 - DNA, 25 bp, Homo sapien
attacatcaatagttttaagtgggt

SEQ ID NO: 499840 - DNA, 25 bp, Homo sapien
ttaagtgggtaatgttcttgaacaa

SEQ ID NO: 499841 - DNA, 25 bp, Homo sapien
gttcttgaacaatattagagccata

SEQ ID NO: 499842 - DNA, 25 bp, Homo sapien
tagagccataaaattgaagccagta

SEQ ID NO: 499843 - DNA, 25 bp, Homo sapien
tagcttgaacaatatggaggccttc

SEQ ID NO: 499844 - DNA, 25 bp, Homo sapien
caatatggaggccttcttactgtag

SEQ ID NO: 499845 - DNA, 25 bp, Homo sapien
atggaggccttcttactgtagggaa

SEQ ID NO: 499846 - DNA, 25 bp, Homo sapien
actgtagggaagaggtgtctagctt

SEQ ID NO: 499847 - DNA, 25 bp, Homo sapien
gaagaggtgtctagcttagaaggat

SEQ ID NO: 499848 - DNA, 25 bp, Homo sapien
ccgccgccgctgtgattgggtggaa

SEQ ID NO: 499849 - DNA, 25 bp, Homo sapien
ccgccgctgtgattgggtggaagat

SEQ ID NO: 499850 - DNA, 25 bp, Homo sapien
tgattgggtggaagatggcgctggc

SEQ ID NO: 499851 - DNA, 25 bp, Homo sapien
tggcgctggccggatggaaatccta

SEQ ID NO: 499852 - DNA, 25 bp, Homo sapien
ggcgctggccggatggaaatcctaa

SEQ ID NO: 499853 - DNA, 25 bp, Homo sapien
gcgctggccggatggaaatcctaat

SEQ ID NO: 499854 - DNA, 25 bp, Homo sapien
cgctggccggatggaaatcctaatg

SEQ ID NO: 499855 - DNA, 25 bp, Homo sapien
ctggccggatggaaatcctaatgac

SEQ ID NO: 499856 - DNA, 25 bp, Homo sapien
ggccggatggaaatcctaatgacag

SEQ ID NO: 499857 - DNA, 25 bp, Homo sapien
ccggatggaaatcctaatgacagtc

SEQ ID NO: 499858 - DNA, 25 bp, Homo sapien
caaattcgcctccatctgtaccatg

SEQ ID NO: 499859 - DNA, 25 bp, Homo sapien
ataactgcaaactgaatgattcctg

SEQ ID NO: 499860 - DNA, 25 bp, Homo sapien
taggagtttcttgtttgccctcttg

SEQ ID NO: 499861 - DNA, 25 bp, Homo sapien
gattcctgggcatcataatggatgt

SEQ ID NO: 499862 - DNA, 25 bp, Homo sapien
aatggatgtttctttctacttaggt

SEQ ID NO: 499863 - DNA, 25 bp, Homo sapien
ttctttctacttaggtgtctcccct

SEQ ID NO: 499864 - DNA, 25 bp, Homo sapien
cttcctgctcttggctagatatctg

SEQ ID NO: 499865 - DNA, 25 bp, Homo sapien
gatatctgccttctctaacaatgtc

SEQ ID NO: 499866 - DNA, 25 bp, Homo sapien
tgccctcttgtgtaattacggtctt

SEQ ID NO: 499867 - DNA, 25 bp, Homo sapien
tttcagtaatgtcctgtttgccctt

SEQ ID NO: 499868 - DNA, 25 bp, Homo sapien
gtttgcccttcttatcagcatctat

SEQ ID NO: 499869 - DNA, 25 bp, Homo sapien
gcatctatctagctacattctgaca

SEQ ID NO: 499870 - DNA, 25 bp, Homo sapien
tagttccaactaagcataagaggtg

SEQ ID NO: 499871 - DNA, 25 bp, Homo sapien
tgagaacgtacactgcagggccacc

SEQ ID NO: 499872 - DNA, 25 bp, Homo sapien
gcactgatgttaaaactggctcccc

SEQ ID NO: 499873 - DNA, 25 bp, Homo sapien
cccagacttgtagtgctgtcttcag

SEQ ID NO: 499874 - DNA, 25 bp, Homo sapien
ttacacgccacctcttgtgacatag

SEQ ID NO: 499875 - DNA, 25 bp, Homo sapien
gccacctcttgtgacataggtcatt

SEQ ID NO: 499876 - DNA, 25 bp, Homo sapien
ataggtcattggtcaagccgctgga

SEQ ID NO: 499877 - DNA, 25 bp, Homo sapien
ggtcaagccgctggaatgctacaga

SEQ ID NO: 499878 - DNA, 25 bp, Homo sapien
gccgctggaatgctacagaggtttt

SEQ ID NO: 499879 - DNA, 25 bp, Homo sapien
gttttgccttcctactataaaagcg

SEQ ID NO: 499880 - DNA, 25 bp, Homo sapien
agcgaaattttcagttcatttctga

SEQ ID NO: 499881 - DNA, 25 bp, Homo sapien
gtgtgacagaggctttattcaggcc

SEQ ID NO: 499882 - DNA, 25 bp, Homo sapien
ttattcaggcctcacagctttgcag

SEQ ID NO: 499883 - DNA, 25 bp, Homo sapien
cacagctttgcaggcattaaaatct

SEQ ID NO: 499884 - DNA, 25 bp, Homo sapien
tctacgtatttgatggaaccacaca

SEQ ID NO: 499885 - DNA, 25 bp, Homo sapien
gtaatgtgtaagagcatcctgaagc

SEQ ID NO: 499886 - DNA, 25 bp, Homo sapien
gcatcctgaagctcttactctaaga

SEQ ID NO: 499887 - DNA, 25 bp, Homo sapien
gactgtaactgtaggtgaggattca

SEQ ID NO: 499888 - DNA, 25 bp, Homo sapien
gaggattcatacaaagagtgactca

SEQ ID NO: 499889 - DNA, 25 bp, Homo sapien
gagtgactcagtctctagttctttg

SEQ ID NO: 499890 - DNA, 25 bp, Homo sapien
ctcagtctctagttctttgattcac

SEQ ID NO: 499891 - DNA, 25 bp, Homo sapien
actgcacaataattacacgttccaa

SEQ ID NO: 499892 - DNA, 25 bp, Homo sapien
agactgttttttgtgtgaaggaaat

SEQ ID NO: 499893 - DNA, 25 bp, Homo sapien
gagaattaggtcacttactacagca

SEQ ID NO: 499894 - DNA, 25 bp, Homo sapien
ggtcacttactacagcacaaattgc

SEQ ID NO: 499895 - DNA, 25 bp, Homo sapien
gcacaaattgcatgtctatctaaat

SEQ ID NO: 499896 - DNA, 25 bp, Homo sapien
gcatgtctatctaaattgacgttta

SEQ ID NO: 499897 - DNA, 25 bp, Homo sapien
attgacgtttaagtgcaaaagcatg

SEQ ID NO: 499898 - DNA, 25 bp, Homo sapien
gatattactcatgcagttttactgg

SEQ ID NO: 499899 - DNA, 25 bp, Homo sapien
gcagttttactggaaaaccatacag

SEQ ID NO: 499900 - DNA, 25 bp, Homo sapien
acttccctaaactcaagatactaca

SEQ ID NO: 499901 - DNA, 25 bp, Homo sapien
gatactacaccagaagtgggcagta

SEQ ID NO: 499902 - DNA, 25 bp, Homo sapien
gtgggcagtactcactatgttcagg

SEQ ID NO: 499903 - DNA, 25 bp, Homo sapien
aatggctttccccgcactcagcatg

SEQ ID NO: 499904 - DNA, 25 bp, Homo sapien
gctgtggaggatggtgcgcatcggt

SEQ ID NO: 499905 - DNA, 25 bp, Homo sapien
tggtgcgcatcggtggacagcccct

SEQ ID NO: 499906 - DNA, 25 bp, Homo sapien
atgaatgtggcatcgtggcacagat

SEQ ID NO: 499907 - DNA, 25 bp, Homo sapien
tgaatgtggcatcgtggcacagatt

SEQ ID NO: 499908 - DNA, 25 bp, Homo sapien
gaatgtggcatcgtggcacagattg

SEQ ID NO: 499909 - DNA, 25 bp, Homo sapien
aatgtggcatcgtggcacagattgc

SEQ ID NO: 499910 - DNA, 25 bp, Homo sapien
atgtggcatcgtggcacagattgca

SEQ ID NO: 499911 - DNA, 25 bp, Homo sapien
atctctgcctactacatcagcacct

SEQ ID NO: 499912 - DNA, 25 bp, Homo sapien
cctactacatcagcaccttcaactt

SEQ ID NO: 499913 - DNA, 25 bp, Homo sapien
cccgaggacggtatcggcagcgtca

SEQ ID NO: 499914 - DNA, 25 bp, Homo sapien
tttgtcacaatgaaccaaccttaga

SEQ ID NO: 499915 - DNA, 25 bp, Homo sapien
aatgaaccaaccttagatccccatt

SEQ ID NO: 499916 - DNA, 25 bp, Homo sapien
accaaccttagatccccattgtaag

SEQ ID NO: 499917 - DNA, 25 bp, Homo sapien
ccccattgtaaggatctcactcatt

SEQ ID NO: 499918 - DNA, 25 bp, Homo sapien
gtaaggatctcactcattagaaaat

SEQ ID NO: 499919 - DNA, 25 bp, Homo sapien
aatgtttgaactggtttctaacagc

SEQ ID NO: 499920 - DNA, 25 bp, Homo sapien
atagagtatgttctgatgactttaa

SEQ ID NO: 499921 - DNA, 25 bp, Homo sapien
aaatatggctggatctaatgttgta

SEQ ID NO: 499922 - DNA, 25 bp, Homo sapien
ggctggatctaatgttgtatttttc

SEQ ID NO: 499923 - DNA, 25 bp, Homo sapien
tgaagtttaagcagttggtcatttt

SEQ ID NO: 499924 - DNA, 25 bp, Homo sapien
cagatttgaggagttggatgtgcaa

SEQ ID NO: 499925 - DNA, 25 bp, Homo sapien
acacagggcagggatcccacgcagg

SEQ ID NO: 499926 - DNA, 25 bp, Homo sapien
agggatcccacgcagggcacagatc

SEQ ID NO: 499927 - DNA, 25 bp, Homo sapien
gcagggcacagatcccacgcagggc

SEQ ID NO: 499928 - DNA, 25 bp, Homo sapien
acagatcccacgcagggcagggcca

SEQ ID NO: 499929 - DNA, 25 bp, Homo sapien
cagatcccacgcagggcagggccag

SEQ ID NO: 499930 - DNA, 25 bp, Homo sapien
ccctgtagatctcctcccaggcagg

SEQ ID NO: 499931 - DNA, 25 bp, Homo sapien
aggcaggaccagagccacagtcact

SEQ ID NO: 499932 - DNA, 25 bp, Homo sapien
acagtcacttccacactatctcctt

SEQ ID NO: 499933 - DNA, 25 bp, Homo sapien
ttccctagaaacctctgcagactct

SEQ ID NO: 499934 - DNA, 25 bp, Homo sapien
tagaaacctctgcagactcttcctc

SEQ ID NO: 499935 - DNA, 25 bp, Homo sapien
ttcctcctctcctcgatacacaggg

SEQ ID NO: 499936 - DNA, 25 bp, Homo sapien
aaggtgtccagagtcagagctcctg

SEQ ID NO: 499937 - DNA, 25 bp, Homo sapien
ctgtggcctggtccttcagctccta

SEQ ID NO: 499938 - DNA, 25 bp, Homo sapien
ggtccttcagctcctacttaatgga

SEQ ID NO: 499939 - DNA, 25 bp, Homo sapien
tcctacttaatggaagcctcgcaga

SEQ ID NO: 499940 - DNA, 25 bp, Homo sapien
taatggaagcctcgcagatgcaaga

SEQ ID NO: 499941 - DNA, 25 bp, Homo sapien
ctcgcagatgcaagatggctccagc

SEQ ID NO: 499942 - DNA, 25 bp, Homo sapien
aggcccagcatcacttcttctcagt

SEQ ID NO: 499943 - DNA, 25 bp, Homo sapien
catcacttcttctcagtgtcccaaa

SEQ ID NO: 499944 - DNA, 25 bp, Homo sapien
cagtgtcccaaagccagaagagagg

SEQ ID NO: 499945 - DNA, 25 bp, Homo sapien
taaacttggccagaattgcatcaca

SEQ ID NO: 499946 - DNA, 25 bp, Homo sapien
gccagaattgcatcacagacccttt

SEQ ID NO: 499947 - DNA, 25 bp, Homo sapien
gtttctattcgttggttgtggacct

SEQ ID NO: 499948 - DNA, 25 bp, Homo sapien
attcgttggttgtggacctggacaa

SEQ ID NO: 499949 - DNA, 25 bp, Homo sapien
ggacctggacaaagtccaagtctgt

SEQ ID NO: 499950 - DNA, 25 bp, Homo sapien
ataggactctggacaatctcacacc

SEQ ID NO: 499951 - DNA, 25 bp, Homo sapien
gactctggacaatctcacaccttag

SEQ ID NO: 499952 - DNA, 25 bp, Homo sapien
gacattgctccaagatgttctcctg

SEQ ID NO: 499953 - DNA, 25 bp, Homo sapien
tgctccaagatgttctcctgatgta

SEQ ID NO: 499954 - DNA, 25 bp, Homo sapien
aagatgttctcctgatgtagcttga

SEQ ID NO: 499955 - DNA, 25 bp, Homo sapien
gttctcctgatgtagcttgagatat

SEQ ID NO: 499956 - DNA, 25 bp, Homo sapien
aaaggccctgcacaggtggctgttt

SEQ ID NO: 499957 - DNA, 25 bp, Homo sapien
tggctgtttcttgtctgttatgtca

SEQ ID NO: 499958 - DNA, 25 bp, Homo sapien
tagggcagtctgacaacctctgatg

SEQ ID NO: 499959 - DNA, 25 bp, Homo sapien
gtaattcacatatcttgctctcatt

SEQ ID NO: 499960 - DNA, 25 bp, Homo sapien
ctcatttttcctttcgaagtgatat

SEQ ID NO: 499961 - DNA, 25 bp, Homo sapien
agtgatatccactcgaacgggatca

SEQ ID NO: 499962 - DNA, 25 bp, Homo sapien
aacgggatcaaatctgtaagctgga

SEQ ID NO: 499963 - DNA, 25 bp, Homo sapien
ggagatacaacttccactacataag

SEQ ID NO: 499964 - DNA, 25 bp, Homo sapien
agaaccatcatcataaccattgggt

SEQ ID NO: 499965 - DNA, 25 bp, Homo sapien
gatccagaaggtatatcatgaacca

SEQ ID NO: 499966 - DNA, 25 bp, Homo sapien
cacaaaactcccatctgtcttaagg

SEQ ID NO: 499967 - DNA, 25 bp, Homo sapien
taaccattgggttcattagaaagtc

SEQ ID NO: 499968 - DNA, 25 bp, Homo sapien
ttagaaagtctgtccagccccacga

SEQ ID NO: 499969 - DNA, 25 bp, Homo sapien
ggaagatgacacacccaatttaggt

SEQ ID NO: 499970 - DNA, 25 bp, Homo sapien
ccaatttaggtaatgctgcacttct

SEQ ID NO: 499971 - DNA, 25 bp, Homo sapien
gcacttcttgttataattggttatt

SEQ ID NO: 499972 - DNA, 25 bp, Homo sapien
attagcccttcatgatctgtctggt

SEQ ID NO: 499973 - DNA, 25 bp, Homo sapien
gaaaatgtgcctttattatcagaac

SEQ ID NO: 499974 - DNA, 25 bp, Homo sapien
atcagaacagtggtgtgcgcatttc

SEQ ID NO: 499975 - DNA, 25 bp, Homo sapien
gtgcgcatttctgattatggagcta

SEQ ID NO: 499976 - DNA, 25 bp, Homo sapien
aaacatttgggtgttgcagttttgc

SEQ ID NO: 499977 - DNA, 25 bp, Homo sapien
gcagttttgcacttgtagatacaac

SEQ ID NO: 499978 - DNA, 25 bp, Homo sapien
tgtgctcctgggatcgccaagtgca

SEQ ID NO: 499979 - DNA, 25 bp, Homo sapien
gccaagtgcaggcacggcatcgcat

SEQ ID NO: 499980 - DNA, 25 bp, Homo sapien
ttggctagcccacgctacttaagag

SEQ ID NO: 499981 - DNA, 25 bp, Homo sapien
gacactcacagattccacatgggat

SEQ ID NO: 499982 - DNA, 25 bp, Homo sapien
ccacatgggatggtacattatgtac

SEQ ID NO: 499983 - DNA, 25 bp, Homo sapien
tagagaaccttcgagggaggctctg

SEQ ID NO: 499984 - DNA, 25 bp, Homo sapien
accttcgagggaggctctggaactt

SEQ ID NO: 499985 - DNA, 25 bp, Homo sapien
tgcctcccggaactgaaatcctgtc

SEQ ID NO: 499986 - DNA, 25 bp, Homo sapien
atacattctgattatttgatagcca

SEQ ID NO: 499987 - DNA, 25 bp, Homo sapien
tgattatttgatagccaggtgtttg

SEQ ID NO: 499988 - DNA, 25 bp, Homo sapien
gccaggtgtttggattaaggttgcc

SEQ ID NO: 499989 - DNA, 25 bp, Homo sapien
tgtttggattaaggttgcccccctg

SEQ ID NO: 499990 - DNA, 25 bp, Homo sapien
ggtccccgacaagagggatggattt

SEQ ID NO: 499991 - DNA, 25 bp, Homo sapien
aatgagcactattttggattagtca

SEQ ID NO: 499992 - DNA, 25 bp, Homo sapien
ttttgggaatacctgctactgcaat

SEQ ID NO: 499993 - DNA, 25 bp, Homo sapien
tttgggaatacctgctactgcaatt

SEQ ID NO: 499994 - DNA, 25 bp, Homo sapien
ttgggaatacctgctactgcaattc

SEQ ID NO: 499995 - DNA, 25 bp, Homo sapien
tgggaatacctgctactgcaattca

SEQ ID NO: 499996 - DNA, 25 bp, Homo sapien
gggaatacctgctactgcaattcag

SEQ ID NO: 499997 - DNA, 25 bp, Homo sapien
ggaatacctgctactgcaattcagt

SEQ ID NO: 499998 - DNA, 25 bp, Homo sapien
gaatacctgctactgcaattcagtt

SEQ ID NO: 499999 - DNA, 25 bp, Homo sapien
aatacctgctactgcaattcagttc

SEQ ID NO: 500000 - DNA, 25 bp, Homo sapien
gtgttaggtagctattacagtatta

SEQ ID NO: 500001 - DNA, 25 bp, Homo sapien
ttatgtattatctgagtgcccattt

SEQ ID NO: 500002 - DNA, 25 bp, Homo sapien
agtgcccattttggcagtgggtttc

SEQ ID NO: 500003 - DNA, 25 bp, Homo sapien
agtgggtttctagttgtgttttgct

SEQ ID NO: 500004 - DNA, 25 bp, Homo sapien
ttgtgttttgctgagacccagggct

SEQ ID NO: 500005 - DNA, 25 bp, Homo sapien
gacccagggctgctgtacagattaa

SEQ ID NO: 500006 - DNA, 25 bp, Homo sapien
gtaggactaagggacatttcagcaa

SEQ ID NO: 500007 - DNA, 25 bp, Homo sapien
agcaagctgggctctaacccttttc

SEQ ID NO: 500008 - DNA, 25 bp, Homo sapien
ttagcaaatctagactcactggtta

SEQ ID NO: 500009 - DNA, 25 bp, Homo sapien
gactcactggttaaagtatgccttg

SEQ ID NO: 500010 - DNA, 25 bp, Homo sapien
gtatgccttggtttaactattagtt

SEQ ID NO: 500011 - DNA, 25 bp, Homo sapien
ttgccattttctggattagcacaga

SEQ ID NO: 500012 - DNA, 25 bp, Homo sapien
ttagcacagaagcttgtatcaatga

SEQ ID NO: 500013 - DNA, 25 bp, Homo sapien
tttctgttcaaactctctccttcta

SEQ ID NO: 500014 - DNA, 25 bp, Homo sapien
aactctctccttctatttgtgtttc

SEQ ID NO: 500015 - DNA, 25 bp, Homo sapien
ctctccttctatttgtgtttccttc

SEQ ID NO: 500016 - DNA, 25 bp, Homo sapien
ctccaccacactgtgttggtcaaat

SEQ ID NO: 500017 - DNA, 25 bp, Homo sapien
gatactattctatgaaaccctgagc

SEQ ID NO: 500018 - DNA, 25 bp, Homo sapien
ctattctatgaaaccctgagctata

SEQ ID NO: 500019 - DNA, 25 bp, Homo sapien
ctgagctatagttgtcaaaagtaac

SEQ ID NO: 500020 - DNA, 25 bp, Homo sapien
atggattgtgattagtcctctgtgg

SEQ ID NO: 500021 - DNA, 25 bp, Homo sapien
gtcctctgtgggtgcttccttccct

SEQ ID NO: 500022 - DNA, 25 bp, Homo sapien
gatggagaatttatgcccacaagca

SEQ ID NO: 500023 - DNA, 25 bp, Homo sapien
tttatgcccacaagcacaggctagt

SEQ ID NO: 500024 - DNA, 25 bp, Homo sapien
aagcacaggctagtgtccattttct

SEQ ID NO: 500025 - DNA, 25 bp, Homo sapien
acaggctagtgtccattttctaata

SEQ ID NO: 500026 - DNA, 25 bp, Homo sapien
gtccattttctaataactcagcttt

SEQ ID NO: 500027 - DNA, 25 bp, Homo sapien
cagctttttgctgagtacttagcat

SEQ ID NO: 500028 - DNA, 25 bp, Homo sapien
tacatgttaagtttcaagtttccca

SEQ ID NO: 500029 - DNA, 25 bp, Homo sapien
taagtttcaagtttcccacttcatt

SEQ ID NO: 500030 - DNA, 25 bp, Homo sapien
ttcttctggttctaacttgtgttat

SEQ ID NO: 500031 - DNA, 25 bp, Homo sapien
ggttctaacttgtgttatctctttt

SEQ ID NO: 500032 - DNA, 25 bp, Homo sapien
gtgttgttctattggctagaaagac

SEQ ID NO: 500033 - DNA, 25 bp, Homo sapien
ggttgcggaacagaaagtcccgcgt

SEQ ID NO: 500034 - DNA, 25 bp, Homo sapien
aaagtcccgcgtggagttgaaggct

SEQ ID NO: 500035 - DNA, 25 bp, Homo sapien
gctgcgctggaataggagccgacgt

SEQ ID NO: 500036 - DNA, 25 bp, Homo sapien
gacgtggcccgggtgatggtgatgg

SEQ ID NO: 500037 - DNA, 25 bp, Homo sapien
cctgcgacgtgaaggccgtctggcc

SEQ ID NO: 500038 - DNA, 25 bp, Homo sapien
gccgaagccagctcgtgcgaactgg

SEQ ID NO: 500039 - DNA, 25 bp, Homo sapien
ggttgagcttgaaggcgcccatgcc

SEQ ID NO: 500040 - DNA, 25 bp, Homo sapien
tgaaggcgcccatgccgtcggcgaa

SEQ ID NO: 500041 - DNA, 25 bp, Homo sapien
gcgaacgggttgatgcccaggccca

SEQ ID NO: 500042 - DNA, 25 bp, Homo sapien
gacgcgccaaaggtggtcacgccga

SEQ ID NO: 500043 - DNA, 25 bp, Homo sapien
gtggtcacgccgatcgctgggtact

SEQ ID NO: 500044 - DNA, 25 bp, Homo sapien
aaatggcagtgcaaaatttctgagt

SEQ ID NO: 500045 - DNA, 25 bp, Homo sapien
gtgcaaaatttctgagtctttacaa

SEQ ID NO: 500046 - DNA, 25 bp, Homo sapien
gagtctttacaacatacggatatag

SEQ ID NO: 500047 - DNA, 25 bp, Homo sapien
catacggatatagtatttcctcctc

SEQ ID NO: 500048 - DNA, 25 bp, Homo sapien
aaaagttataacatggctgaaaaga

SEQ ID NO: 500049 - DNA, 25 bp, Homo sapien
ttgcaatttgttgaggttttacaag

SEQ ID NO: 500050 - DNA, 25 bp, Homo sapien
aagagatacagcaagtctaactctc

SEQ ID NO: 500051 - DNA, 25 bp, Homo sapien
aaaacctgtatttatttgagctatt

SEQ ID NO: 500052 - DNA, 25 bp, Homo sapien
tgagctatttaaggatctatttatg

SEQ ID NO: 500053 - DNA, 25 bp, Homo sapien
agcactattatcagttctgcctagg

SEQ ID NO: 500054 - DNA, 25 bp, Homo sapien
cagttctgcctaggtaaatgtaaga

SEQ ID NO: 500055 - DNA, 25 bp, Homo sapien
ctgctgctttgccaacctaagcaaa

SEQ ID NO: 500056 - DNA, 25 bp, Homo sapien
gaaaatacggcttctcttgcattat

SEQ ID NO: 500057 - DNA, 25 bp, Homo sapien
tcttgcattattttcccttttggtt

SEQ ID NO: 500058 - DNA, 25 bp, Homo sapien
ctagaagtacgttcagatgctttgg

SEQ ID NO: 500059 - DNA, 25 bp, Homo sapien
gtatgatttgctagctctctcacca

SEQ ID NO: 500060 - DNA, 25 bp, Homo sapien
tcaccacttaactcactgtgaggat

SEQ ID NO: 500061 - DNA, 25 bp, Homo sapien
gcatgctttttgtaattaactggtg

SEQ ID NO: 500062 - DNA, 25 bp, Homo sapien
taactggtgctttgaaaatcttttt

SEQ ID NO: 500063 - DNA, 25 bp, Homo sapien
aaccaaagttatgctcatccagaca

SEQ ID NO: 500064 - DNA, 25 bp, Homo sapien
tcatccagacaagctgacctttgag

SEQ ID NO: 500065 - DNA, 25 bp, Homo sapien
agttaatttcagcacaactcattct

SEQ ID NO: 500066 - DNA, 25 bp, Homo sapien
ttccccttccctaatatgctaatga

SEQ ID NO: 500067 - DNA, 25 bp, Homo sapien
tgttttcccctgttaggctagtctt

SEQ ID NO: 500068 - DNA, 25 bp, Homo sapien
cctgttaggctagtcttactgtgat

SEQ ID NO: 500069 - DNA, 25 bp, Homo sapien
atgagaagtgtacctggctttcctt

SEQ ID NO: 500070 - DNA, 25 bp, Homo sapien
gctttccttttcctgggtggagaca

SEQ ID NO: 500071 - DNA, 25 bp, Homo sapien
agcatcagagtgtgttaagtcccat

SEQ ID NO: 500072 - DNA, 25 bp, Homo sapien
gagtgtgttaagtcccatctactgt

SEQ ID NO: 500073 - DNA, 25 bp, Homo sapien
taagtcccatctactgtatcaaggc

SEQ ID NO: 500074 - DNA, 25 bp, Homo sapien
caaggccagagtgtggctccatgct

SEQ ID NO: 500075 - DNA, 25 bp, Homo sapien
cagagtgtggctccatgctcttagg

SEQ ID NO: 500076 - DNA, 25 bp, Homo sapien
catgctcttaggaagggtttcccaa

SEQ ID NO: 500077 - DNA, 25 bp, Homo sapien
gtaaatatggcctttttctcgtcct

SEQ ID NO: 500078 - DNA, 25 bp, Homo sapien
tatggcctttttctcgtccttatta

SEQ ID NO: 500079 - DNA, 25 bp, Homo sapien
ggataaataaattctcacctgctta

SEQ ID NO: 500080 - DNA, 25 bp, Homo sapien
aattctcacctgcttaattttagtg

SEQ ID NO: 500081 - DNA, 25 bp, Homo sapien
acctgcttaattttagtgcaattga

SEQ ID NO: 500082 - DNA, 25 bp, Homo sapien
tgcaattgaaacacataagcctttt

SEQ ID NO: 500083 - DNA, 25 bp, Homo sapien
gagaaattcccatgaaaacctacta

SEQ ID NO: 500084 - DNA, 25 bp, Homo sapien
aaaacctactagtcagcaatgggaa

SEQ ID NO: 500085 - DNA, 25 bp, Homo sapien
actagtcagcaatgggaagttgtat

SEQ ID NO: 500086 - DNA, 25 bp, Homo sapien
tcaagggataaacctatccctgttt

SEQ ID NO: 500087 - DNA, 25 bp, Homo sapien
cctgttttcttcctgcactgtatga

SEQ ID NO: 500088 - DNA, 25 bp, Homo sapien
gaagcctgttaaaagcaaggtctcc

SEQ ID NO: 500089 - DNA, 25 bp, Homo sapien
ctgttaaaagcaaggtctccccaca

SEQ ID NO: 500090 - DNA, 25 bp, Homo sapien
ttaaaagcaaggtctccccacaagc

SEQ ID NO: 500091 - DNA, 25 bp, Homo sapien
accccgtgccttttgatctagcaca

SEQ ID NO: 500092 - DNA, 25 bp, Homo sapien
cccgtgccttttgatctagcacaga

SEQ ID NO: 500093 - DNA, 25 bp, Homo sapien
tgccttttgatctagcacagaccct

SEQ ID NO: 500094 - DNA, 25 bp, Homo sapien
ttttgatctagcacagacccttcac

SEQ ID NO: 500095 - DNA, 25 bp, Homo sapien
tttgatctagcacagacccttcacc

SEQ ID NO: 500096 - DNA, 25 bp, Homo sapien
tcacctcgatgcagccagtagcttg

SEQ ID NO: 500097 - DNA, 25 bp, Homo sapien
agccagtagcttggatccttgtggg

SEQ ID NO: 500098 - DNA, 25 bp, Homo sapien
ccagtagcttggatccttgtgggca

SEQ ID NO: 500099 - DNA, 25 bp, Homo sapien
tcagcgacggcgaatgattcccagc

SEQ ID NO: 500100 - DNA, 25 bp, Homo sapien
gtaggtgttatttttgcggcgcgtc

SEQ ID NO: 500101 - DNA, 25 bp, Homo sapien
aggtgttatttttgcggcgcgtcgc

SEQ ID NO: 500102 - DNA, 25 bp, Homo sapien
gcgcgtcgcgggagttgtggacgac

SEQ ID NO: 500103 - DNA, 25 bp, Homo sapien
tggacgacgtggaagagctgcctgt

SEQ ID NO: 500104 - DNA, 25 bp, Homo sapien
gaagatgagacgaaacgatctcgat

SEQ ID NO: 500105 - DNA, 25 bp, Homo sapien
acgatctcgatagggttacattctg

SEQ ID NO: 500106 - DNA, 25 bp, Homo sapien
cgatagggttacattctgaggcgag

SEQ ID NO: 500107 - DNA, 25 bp, Homo sapien
ttgggtaagagttccgaatttggtg

SEQ ID NO: 500108 - DNA, 25 bp, Homo sapien
cacgatggagacaggcgagaataac

SEQ ID NO: 500109 - DNA, 25 bp, Homo sapien
gacaggcgagaataacattctatat

SEQ ID NO: 500110 - DNA, 25 bp, Homo sapien
gacttgccgtctggcattttagttt

SEQ ID NO: 500111 - DNA, 25 bp, Homo sapien
gccgtctggcattttagtttaatac

SEQ ID NO: 500112 - DNA, 25 bp, Homo sapien
aagagattcttgaccttatttctaa

SEQ ID NO: 500113 - DNA, 25 bp, Homo sapien
tgaccttatttctaaacgtctagag

SEQ ID NO: 500114 - DNA, 25 bp, Homo sapien
taaacgtctagagctctgaaatgtc

SEQ ID NO: 500115 - DNA, 25 bp, Homo sapien
ggtattaaactatttgcctgttgta

SEQ ID NO: 500116 - DNA, 25 bp, Homo sapien
aactatttgcctgttgtacaaagaa

SEQ ID NO: 500117 - DNA, 25 bp, Homo sapien
gttaagactcgtgaaaagaattact

SEQ ID NO: 500118 - DNA, 25 bp, Homo sapien
ggtactgtgaaataactgcgatttt

SEQ ID NO: 500119 - DNA, 25 bp, Homo sapien
gcaaaacatacttggaaatgctgat

SEQ ID NO: 500120 - DNA, 25 bp, Homo sapien
aaatgctgattgatttttatgcttg

SEQ ID NO: 500121 - DNA, 25 bp, Homo sapien
tatgccttgttagtgtaaatgtgac

SEQ ID NO: 500122 - DNA, 25 bp, Homo sapien
gtgactgtggaactgtatgagtatt

SEQ ID NO: 500123 - DNA, 25 bp, Homo sapien
aaagcagtccctaatcatcaaaagt

SEQ ID NO: 500124 - DNA, 25 bp, Homo sapien
cttgatgtagtcatataaccacact

SEQ ID NO: 500125 - DNA, 25 bp, Homo sapien
accacactaagaactcttccaggtg

SEQ ID NO: 500126 - DNA, 25 bp, Homo sapien
cttccaggtgacttcaaaacatagg

SEQ ID NO: 500127 - DNA, 25 bp, Homo sapien
taggacagtacatctctagtagaat

SEQ ID NO: 500128 - DNA, 25 bp, Homo sapien
ctagtagaatatgccctgagaatga

SEQ ID NO: 500129 - DNA, 25 bp, Homo sapien
aaggagagcctagagtagcaggatc

SEQ ID NO: 500130 - DNA, 25 bp, Homo sapien
ggatcaaggatgaaagctggacttc

SEQ ID NO: 500131 - DNA, 25 bp, Homo sapien
gctggacttcaaatatgccttgtta

SEQ ID NO: 500132 - DNA, 25 bp, Homo sapien
ggtatattcgttcatccaatacatg

SEQ ID NO: 500133 - DNA, 25 bp, Homo sapien
gttcatccaatacatgtcgtacacg

SEQ ID NO: 500134 - DNA, 25 bp, Homo sapien
atgtcgtacacgttgagcaccacta

SEQ ID NO: 500135 - DNA, 25 bp, Homo sapien
gttgagcaccactaactggttagcc

SEQ ID NO: 500136 - DNA, 25 bp, Homo sapien
tttctatatcatcttctaggaagtc

SEQ ID NO: 500137 - DNA, 25 bp, Homo sapien
cttctaggaagtccgtgctccctaa

SEQ ID NO: 500138 - DNA, 25 bp, Homo sapien
atggccaccataagcaaattctctg

SEQ ID NO: 500139 - DNA, 25 bp, Homo sapien
attctctgccatagacttcaattcc

SEQ ID NO: 500140 - DNA, 25 bp, Homo sapien
gccatagacttcaattcctgaatga

SEQ ID NO: 500141 - DNA, 25 bp, Homo sapien
gaatgaaaaactccaattccaatgg

SEQ ID NO: 500142 - DNA, 25 bp, Homo sapien
tccaatggatgaggtatattcgttc

SEQ ID NO: 500143 - DNA, 25 bp, Homo sapien
acattgggaccaaatagaggctcac

SEQ ID NO: 500144 - DNA, 25 bp, Homo sapien
aatagaggctcacagatatttggat

SEQ ID NO: 500145 - DNA, 25 bp, Homo sapien
gaggctcacagatatttggattatt

SEQ ID NO: 500146 - DNA, 25 bp, Homo sapien
caaaggagactgttacaccttaatt

SEQ ID NO: 500147 - DNA, 25 bp, Homo sapien
ttttgtgatatgtggaagacgctat

SEQ ID NO: 500148 - DNA, 25 bp, Homo sapien
gagactgttacaccttaattaactt

SEQ ID NO: 500149 - DNA, 25 bp, Homo sapien
ggaagacgctatgtgaagttttacc

SEQ ID NO: 500150 - DNA, 25 bp, Homo sapien
attaactttttttactgatgcaaat

SEQ ID NO: 500151 - DNA, 25 bp, Homo sapien
ggaagtagtgaaagctatgacctaa

SEQ ID NO: 500152 - DNA, 25 bp, Homo sapien
gctatgacctaaaacattgggacca

SEQ ID NO: 500153 - DNA, 25 bp, Homo sapien
atgacctaaaacattgggaccaaat

SEQ ID NO: 500154 - DNA, 25 bp, Homo sapien
aagcagccctgtgtcttacatgtct

SEQ ID NO: 500155 - DNA, 25 bp, Homo sapien
agccctgtgtcttacatgtctacat

SEQ ID NO: 500156 - DNA, 25 bp, Homo sapien
cctgtgtcttacatgtctacattta

SEQ ID NO: 500157 - DNA, 25 bp, Homo sapien
cctggctaaaggcatgtctgcattt

SEQ ID NO: 500158 - DNA, 25 bp, Homo sapien
aaggcatgtctgcatttatgcgagg

SEQ ID NO: 500159 - DNA, 25 bp, Homo sapien
ctgcatttatgcgaggtgtgttgac

SEQ ID NO: 500160 - DNA, 25 bp, Homo sapien
catttatgcgaggtgtgttgaccgg

SEQ ID NO: 500161 - DNA, 25 bp, Homo sapien
ggagctaggactgagattcgcctgt

SEQ ID NO: 500162 - DNA, 25 bp, Homo sapien
ctaggactgagattcgcctgtgtaa

SEQ ID NO: 500163 - DNA, 25 bp, Homo sapien
actgagattcgcctgtgtaaaatgc

SEQ ID NO: 500164 - DNA, 25 bp, Homo sapien
gattcgcctgtgtaaaatgcacaaa

SEQ ID NO: 500165 - DNA, 25 bp, Homo sapien
aaatctgtcaacaatgtaactgcat

SEQ ID NO: 500166 - DNA, 25 bp, Homo sapien
ctgtcaacaatgtaactgcattttt

SEQ ID NO: 500167 - DNA, 25 bp, Homo sapien
ttacattatggtatattcagtcaat

SEQ ID NO: 500168 - DNA, 25 bp, Homo sapien
gtcaatgaaagagttttttggcaat

SEQ ID NO: 500169 - DNA, 25 bp, Homo sapien
gttttttggcaatataaattctgac

SEQ ID NO: 500170 - DNA, 25 bp, Homo sapien
ttggcaatataaattctgacagtat

SEQ ID NO: 500171 - DNA, 25 bp, Homo sapien
ggacaggagaacaacacaagaccat

SEQ ID NO: 500172 - DNA, 25 bp, Homo sapien
caggagaacaacacaagaccattat

SEQ ID NO: 500173 - DNA, 25 bp, Homo sapien
ggagaacaacacaagaccattatat

SEQ ID NO: 500174 - DNA, 25 bp, Homo sapien
caagaccattatattcagtgaagaa

SEQ ID NO: 500175 - DNA, 25 bp, Homo sapien
gaaggcaaaatatcaaatctgtcaa

SEQ ID NO: 500176 - DNA, 25 bp, Homo sapien
gagagtgatgtgtcacttcaactgt

SEQ ID NO: 500177 - DNA, 25 bp, Homo sapien
gtgtgtaatatgtcagacacgtcct

SEQ ID NO: 500178 - DNA, 25 bp, Homo sapien
gacacgtcctacaataacaggcgtc

SEQ ID NO: 500179 - DNA, 25 bp, Homo sapien
aacaggcgtcatatttgtattattt

SEQ ID NO: 500180 - DNA, 25 bp, Homo sapien
gccgcagatggagtcagaatgtgaa

SEQ ID NO: 500181 - DNA, 25 bp, Homo sapien
agaaaataatgtcaccgccaaaggt

SEQ ID NO: 500182 - DNA, 25 bp, Homo sapien
gagtcacgttttgtaggatctgttt

SEQ ID NO: 500183 - DNA, 25 bp, Homo sapien
gtaggatctgttttcttatacttaa

SEQ ID NO: 500184 - DNA, 25 bp, Homo sapien
cagacttctgctacggtaattgcca

SEQ ID NO: 500185 - DNA, 25 bp, Homo sapien
aattgccagtattcatggcttcctt

SEQ ID NO: 500186 - DNA, 25 bp, Homo sapien
atcactggatccatctactgttttc

SEQ ID NO: 500187 - DNA, 25 bp, Homo sapien
tgagtctccccaatgtaggtaggaa

SEQ ID NO: 500188 - DNA, 25 bp, Homo sapien
tgtaggtaggaagtgctttccctaa

SEQ ID NO: 500189 - DNA, 25 bp, Homo sapien
ggaagtgctttccctaaaatgctca

SEQ ID NO: 500190 - DNA, 25 bp, Homo sapien
aagcaaatcagagcaatgctgcatt

SEQ ID NO: 500191 - DNA, 25 bp, Homo sapien
gcaatgctgcattccatgtgatttc

SEQ ID NO: 500192 - DNA, 25 bp, Homo sapien
caattgccaatttgtttgacttgta

SEQ ID NO: 500193 - DNA, 25 bp, Homo sapien
attatttccttgtgaattactcatc

SEQ ID NO: 500194 - DNA, 25 bp, Homo sapien
tgtgaattactcatcactaaatgct

SEQ ID NO: 500195 - DNA, 25 bp, Homo sapien
tcctcaatgtctatggaatgatcac

SEQ ID NO: 500196 - DNA, 25 bp, Homo sapien
gaatgatcacagcatagaaaatgtt

SEQ ID NO: 500197 - DNA, 25 bp, Homo sapien
atgttggctttcaaggatttattaa

SEQ ID NO: 500198 - DNA, 25 bp, Homo sapien
ggcagcatcaggtccatggcggcgg

SEQ ID NO: 500199 - DNA, 25 bp, Homo sapien
tacggcgccttctgcaagacgctca

SEQ ID NO: 500200 - DNA, 25 bp, Homo sapien
ggcggctgcgcaagaacttctttta

SEQ ID NO: 500201 - DNA, 25 bp, Homo sapien
cttttacttctatattctggcctcg

SEQ ID NO: 500202 - DNA, 25 bp, Homo sapien
tacttctatattctggcctcggtga

SEQ ID NO: 500203 - DNA, 25 bp, Homo sapien
atattctggcctcggtgattctcaa

SEQ ID NO: 500204 - DNA, 25 bp, Homo sapien
tggcctcggtgattctcaacgtcca

SEQ ID NO: 500205 - DNA, 25 bp, Homo sapien
aacgtccacctgcaggtatatattt

SEQ ID NO: 500206 - DNA, 25 bp, Homo sapien
gcaggtatatatttagagccactaa

SEQ ID NO: 500207 - DNA, 25 bp, Homo sapien
gagccactaactttgtggcatttgg

SEQ ID NO: 500208 - DNA, 25 bp, Homo sapien
gggctcctcgtcaggatggctgact

SEQ ID NO: 500209 - DNA, 25 bp, Homo sapien
gaaacctgaatagcctttaattctt

SEQ ID NO: 500210 - DNA, 25 bp, Homo sapien
atgtaaatcggttttcgccacgtgt

SEQ ID NO: 500211 - DNA, 25 bp, Homo sapien
ttttcgccacgtgtgtttgttcaca

SEQ ID NO: 500212 - DNA, 25 bp, Homo sapien
gccacgtgtgtttgttcacattcta

SEQ ID NO: 500213 - DNA, 25 bp, Homo sapien
acttaatgggattctcacggtctgt

SEQ ID NO: 500214 - DNA, 25 bp, Homo sapien
gattctcacggtctgtgtctttgtg

SEQ ID NO: 500215 - DNA, 25 bp, Homo sapien
tgtgtctttgtgtcacgtgtataaa

SEQ ID NO: 500216 - DNA, 25 bp, Homo sapien
tgtcacgtgtataaaatgggcttgt

SEQ ID NO: 500217 - DNA, 25 bp, Homo sapien
gtgatgtaagcgtttcatctggtca

SEQ ID NO: 500218 - DNA, 25 bp, Homo sapien
tcatctggtcagtggttcctttgat

SEQ ID NO: 500219 - DNA, 25 bp, Homo sapien
ttcctttgatattgtactgctgctg

SEQ ID NO: 500220 - DNA, 25 bp, Homo sapien
gaggactcaggtgtgtgaaatgtat

SEQ ID NO: 500221 - DNA, 25 bp, Homo sapien
gccagttggttttgagttggtctcc

SEQ ID NO: 500222 - DNA, 25 bp, Homo sapien
tttgagttggtctccgcaggcaaca

SEQ ID NO: 500223 - DNA, 25 bp, Homo sapien
gcaggcaacatcacttctgggattt

SEQ ID NO: 500224 - DNA, 25 bp, Homo sapien
ctgggatttggtttactggagcctt

SEQ ID NO: 500225 - DNA, 25 bp, Homo sapien
ggaagctggcagatcccatcaaagg

SEQ ID NO: 500226 - DNA, 25 bp, Homo sapien
agatcccatcaaaggccagagcaga

SEQ ID NO: 500227 - DNA, 25 bp, Homo sapien
aaggccagagcagacagacctactg

SEQ ID NO: 500228 - DNA, 25 bp, Homo sapien
gacagacctactgcttgaagtaaac

SEQ ID NO: 500229 - DNA, 25 bp, Homo sapien
gcaaggaagccaatttgtgcgttca

SEQ ID NO: 500230 - DNA, 25 bp, Homo sapien
aatttgtgcgttcatctcttattaa

SEQ ID NO: 500231 - DNA, 25 bp, Homo sapien
tagtcctttatggaaagtcaaacca

SEQ ID NO: 500232 - DNA, 25 bp, Homo sapien
aattgctagcagttttgagttgaaa

SEQ ID NO: 500233 - DNA, 25 bp, Homo sapien
ggtaccgtaacaaaaactcagcaga

SEQ ID NO: 500234 - DNA, 25 bp, Homo sapien
aacatttataatggccctttcagac

SEQ ID NO: 500235 - DNA, 25 bp, Homo sapien
gagggaccatttttgaatgccattt

SEQ ID NO: 500236 - DNA, 25 bp, Homo sapien
atgccattttcagagttgacatcta

SEQ ID NO: 500237 - DNA, 25 bp, Homo sapien
aatggccctttcagacccatatact

SEQ ID NO: 500238 - DNA, 25 bp, Homo sapien
ccctttcagacccatatacttacaa

SEQ ID NO: 500239 - DNA, 25 bp, Homo sapien
gacccatatacttacaaatgacatt

SEQ ID NO: 500240 - DNA, 25 bp, Homo sapien
gacattgtataactacctacatatg

SEQ ID NO: 500241 - DNA, 25 bp, Homo sapien
gtgacagaatttagtcctttatgga

SEQ ID NO: 500242 - DNA, 25 bp, Homo sapien
tactgaaacatactctgtgggcggg

SEQ ID NO: 500243 - DNA, 25 bp, Homo sapien
gaaacgcgattctgattatttgaca

SEQ ID NO: 500244 - DNA, 25 bp, Homo sapien
aaaagtttgcaaaccactggtctag

SEQ ID NO: 500245 - DNA, 25 bp, Homo sapien
ggtctagataagtagctcttagcct

SEQ ID NO: 500246 - DNA, 25 bp, Homo sapien
atcatctgggcaacttttataacct

SEQ ID NO: 500247 - DNA, 25 bp, Homo sapien
tttataacctaccaatcctggcctc

SEQ ID NO: 500248 - DNA, 25 bp, Homo sapien
gcctcttcctccaaagattctgact

SEQ ID NO: 500249 - DNA, 25 bp, Homo sapien
gggaccattgttatgcggttatagc

SEQ ID NO: 500250 - DNA, 25 bp, Homo sapien
cggttatagccgacgtctaggtgct

SEQ ID NO: 500251 - DNA, 25 bp, Homo sapien
tctaggtgctacctgaggtcttcaa

SEQ ID NO: 500252 - DNA, 25 bp, Homo sapien
gaggtcttcaaagctaaaggtcagt

SEQ ID NO: 500253 - DNA, 25 bp, Homo sapien
gcacagccgggcctttggactcctg

SEQ ID NO: 500254 - DNA, 25 bp, Homo sapien
ctttggactcctggatgctagagtg

SEQ ID NO: 500255 - DNA, 25 bp, Homo sapien
ttggactcctggatgctagagtgac

SEQ ID NO: 500256 - DNA, 25 bp, Homo sapien
tggactcctggatgctagagtgacc

SEQ ID NO: 500257 - DNA, 25 bp, Homo sapien
ggactcctggatgctagagtgacct

SEQ ID NO: 500258 - DNA, 25 bp, Homo sapien
gactcctggatgctagagtgacctg

SEQ ID NO: 500259 - DNA, 25 bp, Homo sapien
actcctggatgctagagtgacctgg

SEQ ID NO: 500260 - DNA, 25 bp, Homo sapien
tcctggatgctagagtgacctgggc

SEQ ID NO: 500261 - DNA, 25 bp, Homo sapien
gatgctagagtgacctgggcgctga

SEQ ID NO: 500262 - DNA, 25 bp, Homo sapien
gctagagtgacctgggcgctgagga

SEQ ID NO: 500263 - DNA, 25 bp, Homo sapien
gtgacctgggcgctgaggagggccc

SEQ ID NO: 500264 - DNA, 25 bp, Homo sapien
aaatgacattcagtaagctatgcat

SEQ ID NO: 500265 - DNA, 25 bp, Homo sapien
gacattcagtaagctatgcatattt

SEQ ID NO: 500266 - DNA, 25 bp, Homo sapien
gctatgcatatttaagctgtagcat

SEQ ID NO: 500267 - DNA, 25 bp, Homo sapien
gcatatttaagctgtagcatgtgat

SEQ ID NO: 500268 - DNA, 25 bp, Homo sapien
agctgtagcatgtgataaatcttga

SEQ ID NO: 500269 - DNA, 25 bp, Homo sapien
gtagcatgtgataaatcttgagttt

SEQ ID NO: 500270 - DNA, 25 bp, Homo sapien
atcttgagtttcatataatcccatg

SEQ ID NO: 500271 - DNA, 25 bp, Homo sapien
cttgagtttcatataatcccatgaa

SEQ ID NO: 500272 - DNA, 25 bp, Homo sapien
atcccatgaaaccattaacatagtc

SEQ ID NO: 500273 - DNA, 25 bp, Homo sapien
gaaaccattaacatagtcacaataa

SEQ ID NO: 500274 - DNA, 25 bp, Homo sapien
taatgaacttaacacctttatattt

SEQ ID NO: 500275 - DNA, 25 bp, Homo sapien
ggctcacaccaacttgtaggctgtg

SEQ ID NO: 500276 - DNA, 25 bp, Homo sapien
ctcacaccaacttgtaggctgtggg

SEQ ID NO: 500277 - DNA, 25 bp, Homo sapien
gaagaagacaaggaacttcattata

SEQ ID NO: 500278 - DNA, 25 bp, Homo sapien
gtaccaggtagaggacattattatt

SEQ ID NO: 500279 - DNA, 25 bp, Homo sapien
gaggacattattattcaaaggatta

SEQ ID NO: 500280 - DNA, 25 bp, Homo sapien
agttacaatttttctcgcagctttg

SEQ ID NO: 500281 - DNA, 25 bp, Homo sapien
aatttttctcgcagctttgttgcta

SEQ ID NO: 500282 - DNA, 25 bp, Homo sapien
ttctcgcagctttgttgctattatt

SEQ ID NO: 500283 - DNA, 25 bp, Homo sapien
gctcatttcattatgtgccttgctc

SEQ ID NO: 500284 - DNA, 25 bp, Homo sapien
atttcattatgtgccttgctccctg

SEQ ID NO: 500285 - DNA, 25 bp, Homo sapien
ttcattatgtgccttgctccctgat

SEQ ID NO: 500286 - DNA, 25 bp, Homo sapien
gatactcctctgtgaatgctcctgc

SEQ ID NO: 500287 - DNA, 25 bp, Homo sapien
tactcctctgtgaatgctcctgcca

SEQ ID NO: 500288 - DNA, 25 bp, Homo sapien
ttcagaaattgcatggccactccag

SEQ ID NO: 500289 - DNA, 25 bp, Homo sapien
aaattgcatggccactccagcgtca

SEQ ID NO: 500290 - DNA, 25 bp, Homo sapien
gcatggccactccagcgtcatcgga

SEQ ID NO: 500291 - DNA, 25 bp, Homo sapien
agcgtcatcggactctctcttatta

SEQ ID NO: 500292 - DNA, 25 bp, Homo sapien
catcggactctctcttattacaaag

SEQ ID NO: 500293 - DNA, 25 bp, Homo sapien
attacaaagatcactgcccaggacc

SEQ ID NO: 500294 - DNA, 25 bp, Homo sapien
aagatcactgcccaggaccatcttc

SEQ ID NO: 500295 - DNA, 25 bp, Homo sapien
ccaaagggagagttccagaggaatc

SEQ ID NO: 500296 - DNA, 25 bp, Homo sapien
agaggaatccatgaagaattcccat

SEQ ID NO: 500297 - DNA, 25 bp, Homo sapien
gaaagaatatccagagaggctctct

SEQ ID NO: 500298 - DNA, 25 bp, Homo sapien
gagaggctctctcaaagatcaggga

SEQ ID NO: 500299 - DNA, 25 bp, Homo sapien
gggagatgtattcccatgccatgca

SEQ ID NO: 500300 - DNA, 25 bp, Homo sapien
ttcccagcatttctgcatggtcaag

SEQ ID NO: 500301 - DNA, 25 bp, Homo sapien
atttctgcatggtcaagtgagcttt

SEQ ID NO: 500302 - DNA, 25 bp, Homo sapien
agtgagctttatgctcatgagcttt

SEQ ID NO: 500303 - DNA, 25 bp, Homo sapien
gattttaaatcctcaacttgttcta

SEQ ID NO: 500304 - DNA, 25 bp, Homo sapien
caacttgttctagcttgtgatccct

SEQ ID NO: 500305 - DNA, 25 bp, Homo sapien
ttgtgatccctcaaagttgggtcat

SEQ ID NO: 500306 - DNA, 25 bp, Homo sapien
gttgggtcatacgttagtgctagat

SEQ ID NO: 500307 - DNA, 25 bp, Homo sapien
attttcacttttccactgatcagag

SEQ ID NO: 500308 - DNA, 25 bp, Homo sapien
atgtccggcatggaaggatctccag

SEQ ID NO: 500309 - DNA, 25 bp, Homo sapien
gcatggaaggatctccaggagacaa

SEQ ID NO: 500310 - DNA, 25 bp, Homo sapien
gatctccaggagacaatgttaaaag

SEQ ID NO: 500311 - DNA, 25 bp, Homo sapien
gaaagacaatacctgtaatacatat

SEQ ID NO: 500312 - DNA, 25 bp, Homo sapien
acctgtaatacatatgatactagtg

SEQ ID NO: 500313 - DNA, 25 bp, Homo sapien
cacacaaatactgtatagtgtactt

SEQ ID NO: 500314 - DNA, 25 bp, Homo sapien
tcaagaggatggactatggtacaca

SEQ ID NO: 500315 - DNA, 25 bp, Homo sapien
gatggactatggtacacatgatgaa

SEQ ID NO: 500316 - DNA, 25 bp, Homo sapien
aagagagagtcctacatgtccggca

SEQ ID NO: 500317 - DNA, 25 bp, Homo sapien
gagagagtcctacatgtccggcatg

SEQ ID NO: 500318 - DNA, 25 bp, Homo sapien
gagtcctacatgtccggcatggaag

SEQ ID NO: 500319 - DNA, 25 bp, Homo sapien
cttctctcagccagctgtttaagcc

SEQ ID NO: 500320 - DNA, 25 bp, Homo sapien
gctgtttaagcctgcggcgccagcc

SEQ ID NO: 500321 - DNA, 25 bp, Homo sapien
acggagggccgtgtgacactctcgt

SEQ ID NO: 500322 - DNA, 25 bp, Homo sapien
gacactctcgtggtatgtatgggag

SEQ ID NO: 500323 - DNA, 25 bp, Homo sapien
gcagccaccagggagtggccatttg

SEQ ID NO: 500324 - DNA, 25 bp, Homo sapien
catagaggttttgtattgagggcca

SEQ ID NO: 500325 - DNA, 25 bp, Homo sapien
gagggccagtgatgatgttttgata

SEQ ID NO: 500326 - DNA, 25 bp, Homo sapien
tgatatttatttcctgctacttaaa

SEQ ID NO: 500327 - DNA, 25 bp, Homo sapien
gtgaattgtacctatttctgatgat

SEQ ID NO: 500328 - DNA, 25 bp, Homo sapien
atttctgatgatgtcggtcttgcaa

SEQ ID NO: 500329 - DNA, 25 bp, Homo sapien
cggtcttgcaaagcgacagattcat

SEQ ID NO: 500330 - DNA, 25 bp, Homo sapien
tgagccaagcagacacggatgtccc

SEQ ID NO: 500331 - DNA, 25 bp, Homo sapien
aagcagacacggatgtcccctcttc

SEQ ID NO: 500332 - DNA, 25 bp, Homo sapien
cagacacggatgtcccctcttctgg

SEQ ID NO: 500333 - DNA, 25 bp, Homo sapien
aggagggtagtgctcccaggcctca

SEQ ID NO: 500334 - DNA, 25 bp, Homo sapien
caggagtccagacagagacccccaa

SEQ ID NO: 500335 - DNA, 25 bp, Homo sapien
cccaaagcctgactgccaacagaaa

SEQ ID NO: 500336 - DNA, 25 bp, Homo sapien
aagcctgactgccaacagaaaccct

SEQ ID NO: 500337 - DNA, 25 bp, Homo sapien
caacagaaaccctctcctagtgagg

SEQ ID NO: 500338 - DNA, 25 bp, Homo sapien
atgccaggaggcaggcccctctgct

SEQ ID NO: 500339 - DNA, 25 bp, Homo sapien
ctgccaacactgcccagcttgtgag

SEQ ID NO: 500340 - DNA, 25 bp, Homo sapien
cccagcttgtgaggccaggaggagc

SEQ ID NO: 500341 - DNA, 25 bp, Homo sapien
aaacagtttctctcaagccacatgc

SEQ ID NO: 500342 - DNA, 25 bp, Homo sapien
ttctctcaagccacatgcattctat

SEQ ID NO: 500343 - DNA, 25 bp, Homo sapien
atgcattctatgctggctgaaaatt

SEQ ID NO: 500344 - DNA, 25 bp, Homo sapien
agatgttcatccgacaagcttttcc

SEQ ID NO: 500345 - DNA, 25 bp, Homo sapien
atccgacaagcttttccccatgtga

SEQ ID NO: 500346 - DNA, 25 bp, Homo sapien
tagccagagtttatcacaggtacaa

SEQ ID NO: 500347 - DNA, 25 bp, Homo sapien
aggcggtatgactgtgcatgttctc

SEQ ID NO: 500348 - DNA, 25 bp, Homo sapien
gtgcatgttctctagctgatgttga

SEQ ID NO: 500349 - DNA, 25 bp, Homo sapien
gaaacttgtactgtcttgatcattt

SEQ ID NO: 500350 - DNA, 25 bp, Homo sapien
aaatatcaggtttagtccgctttcg

SEQ ID NO: 500351 - DNA, 25 bp, Homo sapien
tccgctttcgggaatatctgcatgc

SEQ ID NO: 500352 - DNA, 25 bp, Homo sapien
gtacacaacagaccctctttgaaag

SEQ ID NO: 500353 - DNA, 25 bp, Homo sapien
aagcccagcttcatcattatctttt

SEQ ID NO: 500354 - DNA, 25 bp, Homo sapien
attatcttttccacgaagctgtccc

SEQ ID NO: 500355 - DNA, 25 bp, Homo sapien
acagtcatacttctttggatttcca

SEQ ID NO: 500356 - DNA, 25 bp, Homo sapien
tggatttccacagcacttacctttt

SEQ ID NO: 500357 - DNA, 25 bp, Homo sapien
tggttaagccccttccaacaataat

SEQ ID NO: 500358 - DNA, 25 bp, Homo sapien
tgtggagcacatacatctgttgcat

SEQ ID NO: 500359 - DNA, 25 bp, Homo sapien
acatctgttgcatgttgtgctagac

SEQ ID NO: 500360 - DNA, 25 bp, Homo sapien
atgttgtgctagacattcactcatt

SEQ ID NO: 500361 - DNA, 25 bp, Homo sapien
tattcaccaaacaagcaccgaccgt

SEQ ID NO: 500362 - DNA, 25 bp, Homo sapien
cgaccgtttgccagatactgtgcaa

SEQ ID NO: 500363 - DNA, 25 bp, Homo sapien
tggccagaactgtaatactttatga

SEQ ID NO: 500364 - DNA, 25 bp, Homo sapien
atcagcaatatgtagtatcagcatg

SEQ ID NO: 500365 - DNA, 25 bp, Homo sapien
cagcatggaatttaggacctctctt

SEQ ID NO: 500366 - DNA, 25 bp, Homo sapien
aatttaggacctctcttactcattc

SEQ ID NO: 500367 - DNA, 25 bp, Homo sapien
ggacctctcttactcattcctgtgt

SEQ ID NO: 500368 - DNA, 25 bp, Homo sapien
gtgtcccccatagtaccaaaaacag

SEQ ID NO: 500369 - DNA, 25 bp, Homo sapien
acagtgcctgccaaaatagattaaa

SEQ ID NO: 500370 - DNA, 25 bp, Homo sapien
gtttattgtattagctgtttagagc

SEQ ID NO: 500371 - DNA, 25 bp, Homo sapien
agatatttacaaattccagggaagt

SEQ ID NO: 500372 - DNA, 25 bp, Homo sapien
tgaaaaaggtacagctacttttggg

SEQ ID NO: 500373 - DNA, 25 bp, Homo sapien
gatcatggatgtgtatcttatagat

SEQ ID NO: 500374 - DNA, 25 bp, Homo sapien
catttggcgtttgttgccctgggca

SEQ ID NO: 500375 - DNA, 25 bp, Homo sapien
gttgccctgggcataaaatacccta

SEQ ID NO: 500376 - DNA, 25 bp, Homo sapien
gcataaaataccctaggacccctct

SEQ ID NO: 500377 - DNA, 25 bp, Homo sapien
tttctatttcgcctggctcagaagt

SEQ ID NO: 500378 - DNA, 25 bp, Homo sapien
gctcagaagttttgacgtggctact

SEQ ID NO: 500379 - DNA, 25 bp, Homo sapien
tgttccgaatttaatcgacctcact

SEQ ID NO: 500380 - DNA, 25 bp, Homo sapien
gacgtggctactgaaatacaagaca

SEQ ID NO: 500381 - DNA, 25 bp, Homo sapien
agacaaggcctgctacttactagtg

SEQ ID NO: 500382 - DNA, 25 bp, Homo sapien
cctgctacttactagtgctgctttt

SEQ ID NO: 500383 - DNA, 25 bp, Homo sapien
tagcacagctcctggcaaaaccgaa

SEQ ID NO: 500384 - DNA, 25 bp, Homo sapien
accgaataagtgctatctacgtcag

SEQ ID NO: 500385 - DNA, 25 bp, Homo sapien
agcttgggagacagaagtctctgtg

SEQ ID NO: 500386 - DNA, 25 bp, Homo sapien
gtctctgtgggctgatgttcatgga

SEQ ID NO: 500387 - DNA, 25 bp, Homo sapien
gatgttcatggaaaactccggagtc

SEQ ID NO: 500388 - DNA, 25 bp, Homo sapien
tgttcatggaaaactccggagtcat

SEQ ID NO: 500389 - DNA, 25 bp, Homo sapien
aactccggagtcatatagatgcttt

SEQ ID NO: 500390 - DNA, 25 bp, Homo sapien
tccggagtcatatagatgctttgag

SEQ ID NO: 500391 - DNA, 25 bp, Homo sapien
atagatgctttgagggagcagaaca

SEQ ID NO: 500392 - DNA, 25 bp, Homo sapien
gcagaacatggagctccgagaaaag

SEQ ID NO: 500393 - DNA, 25 bp, Homo sapien
tccgagaaaagctgagagctctgca

SEQ ID NO: 500394 - DNA, 25 bp, Homo sapien
aagccaggaagaaatctgcagcgtc

SEQ ID NO: 500395 - DNA, 25 bp, Homo sapien
ccaggaagaaatctgcagcgtcccc

SEQ ID NO: 500396 - DNA, 25 bp, Homo sapien
ctttccaagaattcatcaaatccca

SEQ ID NO: 500397 - DNA, 25 bp, Homo sapien
gaattcatcaaatcccaaagcatgg

SEQ ID NO: 500398 - DNA, 25 bp, Homo sapien
tttacaacaactctcgaccacatgt

SEQ ID NO: 500399 - DNA, 25 bp, Homo sapien
tacaacaactctcgaccacatgtcg

SEQ ID NO: 500400 - DNA, 25 bp, Homo sapien
atgaagttttgactcatctgtcatt

SEQ ID NO: 500401 - DNA, 25 bp, Homo sapien
atctgtcattcacctgacctcctgc

SEQ ID NO: 500402 - DNA, 25 bp, Homo sapien
ctcgacagatttttgcagggaaaaa

SEQ ID NO: 500403 - DNA, 25 bp, Homo sapien
gcagggaaaaagcttctacgatcat

SEQ ID NO: 500404 - DNA, 25 bp, Homo sapien
gaaaaagcttctacgatcatcagga

SEQ ID NO: 500405 - DNA, 25 bp, Homo sapien
agcttctacgatcatcaggatgcag

SEQ ID NO: 500406 - DNA, 25 bp, Homo sapien
tctacgatcatcaggatgcagaaaa

SEQ ID NO: 500407 - DNA, 25 bp, Homo sapien
agatgcggcatcttcaacgagaata

SEQ ID NO: 500408 - DNA, 25 bp, Homo sapien
gcggcatcttcaacgagaatattta

SEQ ID NO: 500409 - DNA, 25 bp, Homo sapien
gtaatcagcataatgacccttcaaa

SEQ ID NO: 500410 - DNA, 25 bp, Homo sapien
tgacccttcaaaaacaacttatatt

SEQ ID NO: 500411 - DNA, 25 bp, Homo sapien
ttccattttgacaactatactcacg

SEQ ID NO: 500412 - DNA, 25 bp, Homo sapien
gacaactatactcacgaagatactt

SEQ ID NO: 500413 - DNA, 25 bp, Homo sapien
cgaagatacttctagtcctcagagt

SEQ ID NO: 500414 - DNA, 25 bp, Homo sapien
tagtcctcagagtaggcctttggct

SEQ ID NO: 500415 - DNA, 25 bp, Homo sapien
taggcctttggcttcggatttgaaa

SEQ ID NO: 500416 - DNA, 25 bp, Homo sapien
cagaactctcaagcatcattaggat

SEQ ID NO: 500417 - DNA, 25 bp, Homo sapien
tcaagcatcattaggattcctcaag

SEQ ID NO: 500418 - DNA, 25 bp, Homo sapien
gctgtagggcagcagaatctattct

SEQ ID NO: 500419 - DNA, 25 bp, Homo sapien
gggcagcagaatctattctcagtaa

SEQ ID NO: 500420 - DNA, 25 bp, Homo sapien
agatattctgtattggattttacca

SEQ ID NO: 500421 - DNA, 25 bp, Homo sapien
gtattggattttaccagcttgactt

SEQ ID NO: 500422 - DNA, 25 bp, Homo sapien
gacttttactgctcagatgctttct

SEQ ID NO: 500423 - DNA, 25 bp, Homo sapien
ccccttagacgctgtaattctcttg

SEQ ID NO: 500424 - DNA, 25 bp, Homo sapien
ttagacgctgtaattctcttgggaa

SEQ ID NO: 500425 - DNA, 25 bp, Homo sapien
ctcttgggaagagtaactattctta

SEQ ID NO: 500426 - DNA, 25 bp, Homo sapien
tttttacagatacccaccttagttg

SEQ ID NO: 500427 - DNA, 25 bp, Homo sapien
gatacccaccttagttgtaaattgg

SEQ ID NO: 500428 - DNA, 25 bp, Homo sapien
ggatagtttatatttctgggacttt

SEQ ID NO: 500429 - DNA, 25 bp, Homo sapien
gattgtgctataatccctatttagt

SEQ ID NO: 500430 - DNA, 25 bp, Homo sapien
gctataatccctatttagttcaaaa

SEQ ID NO: 500431 - DNA, 25 bp, Homo sapien
accagaattcttccatgtgaaatgg

SEQ ID NO: 500432 - DNA, 25 bp, Homo sapien
gaaatggaccaaactcatattattg

SEQ ID NO: 500433 - DNA, 25 bp, Homo sapien
taatgcagtatgacatcccacaggg

SEQ ID NO: 500434 - DNA, 25 bp, Homo sapien
gaatgtctgtagtgggtgactgtta

SEQ ID NO: 500435 - DNA, 25 bp, Homo sapien
aatgaacggtgaacagactggtaac

SEQ ID NO: 500436 - DNA, 25 bp, Homo sapien
gactggtaacttgtttgagttccca

SEQ ID NO: 500437 - DNA, 25 bp, Homo sapien
gtttgagttcccatgacagatttga

SEQ ID NO: 500438 - DNA, 25 bp, Homo sapien
gttcccatgacagatttgagacttg

SEQ ID NO: 500439 - DNA, 25 bp, Homo sapien
gagacttgtcaatagcaaatcattt

SEQ ID NO: 500440 - DNA, 25 bp, Homo sapien
gcattgctcaccttttgcgtgaaga

SEQ ID NO: 500441 - DNA, 25 bp, Homo sapien
gaaaagacctgtcccttagagccag

SEQ ID NO: 500442 - DNA, 25 bp, Homo sapien
gtcccttagagccagtttttgctta

SEQ ID NO: 500443 - DNA, 25 bp, Homo sapien
tcacccagtggaccacgtgaatgaa

SEQ ID NO: 500444 - DNA, 25 bp, Homo sapien
ggatgcagtgcatgctttagaagca

SEQ ID NO: 500445 - DNA, 25 bp, Homo sapien
atgctttagaagcaccgcatacctc

SEQ ID NO: 500446 - DNA, 25 bp, Homo sapien
gcatacctccttttacaggtacaga

SEQ ID NO: 500447 - DNA, 25 bp, Homo sapien
acagagtaagtggtctggctactga

SEQ ID NO: 500448 - DNA, 25 bp, Homo sapien
gtctggctactgagggaaagagtca

SEQ ID NO: 500449 - DNA, 25 bp, Homo sapien
tttgaatccgagtcttctgtaagac

SEQ ID NO: 500450 - DNA, 25 bp, Homo sapien
gtcttctgtaagacaatgacttcat

SEQ ID NO: 500451 - DNA, 25 bp, Homo sapien
taatattaagtgaacctcccgtgcc

SEQ ID NO: 500452 - DNA, 25 bp, Homo sapien
tattaagtgaacctcccgtgccttt

SEQ ID NO: 500453 - DNA, 25 bp, Homo sapien
gcttaaatatatttgcctagttgat

SEQ ID NO: 500454 - DNA, 25 bp, Homo sapien
ataaagaggctgtggaacaactgaa

SEQ ID NO: 500455 - DNA, 25 bp, Homo sapien
tgaaggagaactttcagaccctaaa

SEQ ID NO: 500456 - DNA, 25 bp, Homo sapien
gagaactttcagaccctaaaacagt

SEQ ID NO: 500457 - DNA, 25 bp, Homo sapien
tttcagaccctaaaacagttatatt

SEQ ID NO: 500458 - DNA, 25 bp, Homo sapien
aaaattttctagtgggctgtgcaat

SEQ ID NO: 500459 - DNA, 25 bp, Homo sapien
gctgtgcaattgctgggttgtcccc

SEQ ID NO: 500460 - DNA, 25 bp, Homo sapien
aatgattttacccaagcctaagtat

SEQ ID NO: 500461 - DNA, 25 bp, Homo sapien
tacccaagcctaagtattaaagtat

SEQ ID NO: 500462 - DNA, 25 bp, Homo sapien
gattctatcatgaggtatttggctg

SEQ ID NO: 500463 - DNA, 25 bp, Homo sapien
tctatcatgaggtatttggctggga

SEQ ID NO: 500464 - DNA, 25 bp, Homo sapien
atcatgaggtatttggctgggagct

SEQ ID NO: 500465 - DNA, 25 bp, Homo sapien
tctctgtgcttcagtctccctgtct

SEQ ID NO: 500466 - DNA, 25 bp, Homo sapien
gtgcttcagtctccctgtcttgtaa

SEQ ID NO: 500467 - DNA, 25 bp, Homo sapien
gcttcagtctccctgtcttgtaaaa

SEQ ID NO: 500468 - DNA, 25 bp, Homo sapien
cttcagtctccctgtcttgtaaaat

SEQ ID NO: 500469 - DNA, 25 bp, Homo sapien
tcagtctccctgtcttgtaaaatgg

SEQ ID NO: 500470 - DNA, 25 bp, Homo sapien
aattagagataatgtctgtaaagca

SEQ ID NO: 500471 - DNA, 25 bp, Homo sapien
aaagcatttaaggttcttgaagaag

SEQ ID NO: 500472 - DNA, 25 bp, Homo sapien
ggttcttgaagaaggcactatataa

SEQ ID NO: 500473 - DNA, 25 bp, Homo sapien
taaagagaagctcaatctcagcaaa

SEQ ID NO: 500474 - DNA, 25 bp, Homo sapien
gaagctcaatctcagcaaaataagg

SEQ ID NO: 500475 - DNA, 25 bp, Homo sapien
agaaaccatctcagatccaactaat

SEQ ID NO: 500476 - DNA, 25 bp, Homo sapien
gatccaactaatatttagcgtgcat

SEQ ID NO: 500477 - DNA, 25 bp, Homo sapien
gcgtgcatacaaatcaaaagctgga

SEQ ID NO: 500478 - DNA, 25 bp, Homo sapien
aacaggaatacattgctagtgagca

SEQ ID NO: 500479 - DNA, 25 bp, Homo sapien
gacaattgtgtatcacccattaaat

SEQ ID NO: 500480 - DNA, 25 bp, Homo sapien
attttaaaagtcacataccctgtga

SEQ ID NO: 500481 - DNA, 25 bp, Homo sapien
acataccctgtgacctaacaattcc

SEQ ID NO: 500482 - DNA, 25 bp, Homo sapien
gtcctaaagaaacatacatgtgttc

SEQ ID NO: 500483 - DNA, 25 bp, Homo sapien
tcacaagatagcctgtacaatgatg

SEQ ID NO: 500484 - DNA, 25 bp, Homo sapien
ctgtgttttagctcattctcttagg

SEQ ID NO: 500485 - DNA, 25 bp, Homo sapien
gttttagctcattctcttaggacat

SEQ ID NO: 500486 - DNA, 25 bp, Homo sapien
tctcttaggacattcttagaagtta

SEQ ID NO: 500487 - DNA, 25 bp, Homo sapien
gaagttagaaacatttctgctggga

SEQ ID NO: 500488 - DNA, 25 bp, Homo sapien
tctgctgggatcgttggagggaact

SEQ ID NO: 500489 - DNA, 25 bp, Homo sapien
gagggaacttcaaactttggaatct

SEQ ID NO: 500490 - DNA, 25 bp, Homo sapien
aactttggaatctttcctgcaagaa

SEQ ID NO: 500491 - DNA, 25 bp, Homo sapien
tggaatctttcctgcaagaaattct

SEQ ID NO: 500492 - DNA, 25 bp, Homo sapien
cctgcaagaaattctttaccaaaga

SEQ ID NO: 500493 - DNA, 25 bp, Homo sapien
ttctttaccaaagaaaggcaggtgt

SEQ ID NO: 500494 - DNA, 25 bp, Homo sapien
gcaggtgtttcttaaagggatgcaa

SEQ ID NO: 500495 - DNA, 25 bp, Homo sapien
attgataagcactgacatttttgga

SEQ ID NO: 500496 - DNA, 25 bp, Homo sapien
aagcactgacatttttggaaagatc

SEQ ID NO: 500497 - DNA, 25 bp, Homo sapien
gacatttttggaaagatcttactaa

SEQ ID NO: 500498 - DNA, 25 bp, Homo sapien
tagaacaatgtgtgtagtatgccat

SEQ ID NO: 500499 - DNA, 25 bp, Homo sapien
caatgtgtgtagtatgccatttata

SEQ ID NO: 500500 - DNA, 25 bp, Homo sapien
ttctgtgtacatttacatacaaaag

SEQ ID NO: 500501 - DNA, 25 bp, Homo sapien
tgtagagtctgaagtagcacctgta

SEQ ID NO: 500502 - DNA, 25 bp, Homo sapien
acaaaagcatagtgtctcagaagaa

SEQ ID NO: 500503 - DNA, 25 bp, Homo sapien
gagtctgaagtagcacctgtactag

SEQ ID NO: 500504 - DNA, 25 bp, Homo sapien
aagtagcacctgtactagaaaaggg

SEQ ID NO: 500505 - DNA, 25 bp, Homo sapien
aacaatgtggaatactagctgtgtg

SEQ ID NO: 500506 - DNA, 25 bp, Homo sapien
gcagaaccgaggtcgggagcccatt

SEQ ID NO: 500507 - DNA, 25 bp, Homo sapien
gggagcccattgatgtctgagcctg

SEQ ID NO: 500508 - DNA, 25 bp, Homo sapien
cattgatgtctgagcctgccggagg

SEQ ID NO: 500509 - DNA, 25 bp, Homo sapien
attgggtcctgggcctctgtgatga

SEQ ID NO: 500510 - DNA, 25 bp, Homo sapien
tgaggcaggcacacctgtcggtctt

SEQ ID NO: 500511 - DNA, 25 bp, Homo sapien
aggcacacctgtcggtcttggcttg

SEQ ID NO: 500512 - DNA, 25 bp, Homo sapien
gtcggtcttggcttgctgctagaac

SEQ ID NO: 500513 - DNA, 25 bp, Homo sapien
gtcttggcttgctgctagaactagg

SEQ ID NO: 500514 - DNA, 25 bp, Homo sapien
ggcttgctgctagaactagggcctt

SEQ ID NO: 500515 - DNA, 25 bp, Homo sapien
tgctgctagaactagggccttctgc

SEQ ID NO: 500516 - DNA, 25 bp, Homo sapien
agaactagggccttctgctcgccca

SEQ ID NO: 500517 - DNA, 25 bp, Homo sapien
ataggttataatagccatattcttt

SEQ ID NO: 500518 - DNA, 25 bp, Homo sapien
taggttataatagccatattcttta

SEQ ID NO: 500519 - DNA, 25 bp, Homo sapien
taatagccatattctttattacttt

SEQ ID NO: 500520 - DNA, 25 bp, Homo sapien
tttacatgccataaagtttaccctt

SEQ ID NO: 500521 - DNA, 25 bp, Homo sapien
ttacatgccataaagtttaccctta

SEQ ID NO: 500522 - DNA, 25 bp, Homo sapien
aagaaatcctaaatccattagcagt

SEQ ID NO: 500523 - DNA, 25 bp, Homo sapien
agaaatcctaaatccattagcagtt

SEQ ID NO: 500524 - DNA, 25 bp, Homo sapien
gaaatcctaaatccattagcagtta

SEQ ID NO: 500525 - DNA, 25 bp, Homo sapien
aatcctaaatccattagcagttact

SEQ ID NO: 500526 - DNA, 25 bp, Homo sapien
cattagcagttacttcccattcttc

SEQ ID NO: 500527 - DNA, 25 bp, Homo sapien
attagcagttacttcccattcttcc

SEQ ID NO: 500528 - DNA, 25 bp, Homo sapien
ctttccaagaattcatcaaatccca

SEQ ID NO: 500529 - DNA, 25 bp, Homo sapien
gaattcatcaaatcccaaagcatgg

SEQ ID NO: 500530 - DNA, 25 bp, Homo sapien
tttacaacaactctcgaccacatgt

SEQ ID NO: 500531 - DNA, 25 bp, Homo sapien
tacaacaactctcgaccacatgtcg

SEQ ID NO: 500532 - DNA, 25 bp, Homo sapien
atgaagttttgactcatctgtcatt

SEQ ID NO: 500533 - DNA, 25 bp, Homo sapien
tttgactcatctgtcattcacctga

SEQ ID NO: 500534 - DNA, 25 bp, Homo sapien
aactgactaccacatcttcaatcat

SEQ ID NO: 500535 - DNA, 25 bp, Homo sapien
ctcgacagatttttgcagggaaaaa

SEQ ID NO: 500536 - DNA, 25 bp, Homo sapien
gcagggaaaaagcttctacgatcat

SEQ ID NO: 500537 - DNA, 25 bp, Homo sapien
gaaaaagcttctacgatcatcagga

SEQ ID NO: 500538 - DNA, 25 bp, Homo sapien
agcttctacgatcatcaggatgcag

SEQ ID NO: 500539 - DNA, 25 bp, Homo sapien
tcatcctccactagcactaaatttg

SEQ ID NO: 500540 - DNA, 25 bp, Homo sapien
ccactagcactaaatttgtcacttt

SEQ ID NO: 500541 - DNA, 25 bp, Homo sapien
agggaaacaccacctgtcattctgt

SEQ ID NO: 500542 - DNA, 25 bp, Homo sapien
ttctccatagctcttcaatctttac

SEQ ID NO: 500543 - DNA, 25 bp, Homo sapien
agctcttcaatctttacatgccgca

SEQ ID NO: 500544 - DNA, 25 bp, Homo sapien
ttacatgccgcaagacttttttgat

SEQ ID NO: 500545 - DNA, 25 bp, Homo sapien
ttttgatagctcgtactcatcccag

SEQ ID NO: 500546 - DNA, 25 bp, Homo sapien
gtactcatcccagtgtctcctgaaa

SEQ ID NO: 500547 - DNA, 25 bp, Homo sapien
tgtctcctgaaaccccatcatgtaa

SEQ ID NO: 500548 - DNA, 25 bp, Homo sapien
gcaagagctgaggtgccaataccaa

SEQ ID NO: 500549 - DNA, 25 bp, Homo sapien
ggtgccaataccaaaagaccatggg

SEQ ID NO: 500550 - DNA, 25 bp, Homo sapien
caggacagagggtgtttgtggtgaa

SEQ ID NO: 500551 - DNA, 25 bp, Homo sapien
gcagaaccgaggtcgggagcccatt

SEQ ID NO: 500552 - DNA, 25 bp, Homo sapien
aaccgaggtcgggagcccattgatg

SEQ ID NO: 500553 - DNA, 25 bp, Homo sapien
accgaggtcgggagcccattgatgt

SEQ ID NO: 500554 - DNA, 25 bp, Homo sapien
gtcgggagcccattgatgtctgagc

SEQ ID NO: 500555 - DNA, 25 bp, Homo sapien
tcgggagcccattgatgtctgagcc

SEQ ID NO: 500556 - DNA, 25 bp, Homo sapien
gggagcccattgatgtctgagcctg

SEQ ID NO: 500557 - DNA, 25 bp, Homo sapien
ggagcccattgatgtctgagcctgc

SEQ ID NO: 500558 - DNA, 25 bp, Homo sapien
agcccattgatgtctgagcctgccg

SEQ ID NO: 500559 - DNA, 25 bp, Homo sapien
gagaagcggattgggtcctgggcct

SEQ ID NO: 500560 - DNA, 25 bp, Homo sapien
attgggtcctgggcctctgtgatga

SEQ ID NO: 500561 - DNA, 25 bp, Homo sapien
gtataatttgcttttgtgcactaat

SEQ ID NO: 500562 - DNA, 25 bp, Homo sapien
gcttttgtgcactaatgttggtgtt

SEQ ID NO: 500563 - DNA, 25 bp, Homo sapien
gattgtttcaactaatgatttggtg

SEQ ID NO: 500564 - DNA, 25 bp, Homo sapien
ggagtccagtaaaaaccagacaact

SEQ ID NO: 500565 - DNA, 25 bp, Homo sapien
acaactgccagatacattttaagag

SEQ ID NO: 500566 - DNA, 25 bp, Homo sapien
gagctttaacacatggattcttttc

SEQ ID NO: 500567 - DNA, 25 bp, Homo sapien
attaggaatctttctcaggctattg

SEQ ID NO: 500568 - DNA, 25 bp, Homo sapien
gaatctttctcaggctattggtaca

SEQ ID NO: 500569 - DNA, 25 bp, Homo sapien
tcaggctattggtacatattgtcac

SEQ ID NO: 500570 - DNA, 25 bp, Homo sapien
catattgtcacattgttttcatggg

SEQ ID NO: 500571 - DNA, 25 bp, Homo sapien
gttttcatgggagatagtaccagtt

SEQ ID NO: 500572 - DNA, 25 bp, Homo sapien
ttaggtcttacctgtgcatccacca

SEQ ID NO: 500573 - DNA, 25 bp, Homo sapien
caccatctaccctatgctaaaagga

SEQ ID NO: 500574 - DNA, 25 bp, Homo sapien
tggctcagaagtggtggccaccagt

SEQ ID NO: 500575 - DNA, 25 bp, Homo sapien
gctaaaaggattattctgcacagta

SEQ ID NO: 500576 - DNA, 25 bp, Homo sapien
ctgcacagtagaataatcgcgtatt

SEQ ID NO: 500577 - DNA, 25 bp, Homo sapien
atcgcgtattcacggattcttacaa

SEQ ID NO: 500578 - DNA, 25 bp, Homo sapien
tatctatgtatcacagagagcattt

SEQ ID NO: 500579 - DNA, 25 bp, Homo sapien
accagtgctaagctgggtcacacta

SEQ ID NO: 500580 - DNA, 25 bp, Homo sapien
gtcacactaccagttccagtttggg

SEQ ID NO: 500581 - DNA, 25 bp, Homo sapien
gaaattgcatctttaattatctgtg

SEQ ID NO: 500582 - DNA, 25 bp, Homo sapien
attatctgtgtttaggtcttacctg

SEQ ID NO: 500583 - DNA, 25 bp, Homo sapien
aaggttctcgtgtggcacactcgga

SEQ ID NO: 500584 - DNA, 25 bp, Homo sapien
aggttctcgtgtggcacactcggac

SEQ ID NO: 500585 - DNA, 25 bp, Homo sapien
ggttctcgtgtggcacactcggaca

SEQ ID NO: 500586 - DNA, 25 bp, Homo sapien
gttctcgtgtggcacactcggacag

SEQ ID NO: 500587 - DNA, 25 bp, Homo sapien
ttctcgtgtggcacactcggacaga

SEQ ID NO: 500588 - DNA, 25 bp, Homo sapien
tctcgtgtggcacactcggacagag

SEQ ID NO: 500589 - DNA, 25 bp, Homo sapien
ctcgtgtggcacactcggacagaga

SEQ ID NO: 500590 - DNA, 25 bp, Homo sapien
tcgtgtggcacactcggacagagaa

SEQ ID NO: 500591 - DNA, 25 bp, Homo sapien
cgtgtggcacactcggacagagaag

SEQ ID NO: 500592 - DNA, 25 bp, Homo sapien
gtgtggcacactcggacagagaagg

SEQ ID NO: 500593 - DNA, 25 bp, Homo sapien
tgtggcacactcggacagagaaggt

SEQ ID NO: 500594 - DNA, 25 bp, Homo sapien
caagtttctcaacaggaggaactta

SEQ ID NO: 500595 - DNA, 25 bp, Homo sapien
ggaggaacttaaataactatgccaa

SEQ ID NO: 500596 - DNA, 25 bp, Homo sapien
aactatgccaagaattctgtgaata

SEQ ID NO: 500597 - DNA, 25 bp, Homo sapien
tattgcatcaaactacttgtcctta

SEQ ID NO: 500598 - DNA, 25 bp, Homo sapien
acttgtccttaagcacttagtctaa

SEQ ID NO: 500599 - DNA, 25 bp, Homo sapien
gcacttagtctaatgctaactgcaa

SEQ ID NO: 500600 - DNA, 25 bp, Homo sapien
ggtgctcagtggatgtttagccgat

SEQ ID NO: 500601 - DNA, 25 bp, Homo sapien
ggatgtttagccgatacgttgaaat

SEQ ID NO: 500602 - DNA, 25 bp, Homo sapien
attacggtttgattgatatttcttg

SEQ ID NO: 500603 - DNA, 25 bp, Homo sapien
gccaaagcacatatcatcaaaccat

SEQ ID NO: 500604 - DNA, 25 bp, Homo sapien
gcacatatcatcaaaccatttcatg

SEQ ID NO: 500605 - DNA, 25 bp, Homo sapien
aaactgattctgtgggcgacaagag

SEQ ID NO: 500606 - DNA, 25 bp, Homo sapien
gagtctatagtaaacgttatgacag

SEQ ID NO: 500607 - DNA, 25 bp, Homo sapien
atgacagattctttgaatgcgctaa

SEQ ID NO: 500608 - DNA, 25 bp, Homo sapien
gaatgcgctaatctcagactggact

SEQ ID NO: 500609 - DNA, 25 bp, Homo sapien
ctcagactggactaaagttgggatt

SEQ ID NO: 500610 - DNA, 25 bp, Homo sapien
tttgtacttgagttcagtgcattgc

SEQ ID NO: 500611 - DNA, 25 bp, Homo sapien
gtgcattgctgttctgggcatagga

SEQ ID NO: 500612 - DNA, 25 bp, Homo sapien
aaatccaggttgctggtgatgaaca

SEQ ID NO: 500613 - DNA, 25 bp, Homo sapien
agctgtgtcaccatggttgtctctg

SEQ ID NO: 500614 - DNA, 25 bp, Homo sapien
gttgtctctgtcagtcatgtgacca

SEQ ID NO: 500615 - DNA, 25 bp, Homo sapien
catgtgaccacccttacccttgtaa

SEQ ID NO: 500616 - DNA, 25 bp, Homo sapien
actgagctgtgcataatcctttgaa

SEQ ID NO: 500617 - DNA, 25 bp, Homo sapien
gaataataatgtcctctacctggta

SEQ ID NO: 500618 - DNA, 25 bp, Homo sapien
atgtcctctacctggtacattataa

SEQ ID NO: 500619 - DNA, 25 bp, Homo sapien
gaagttccttgtcttcttcatgctt

SEQ ID NO: 500620 - DNA, 25 bp, Homo sapien
gtatacttctacattgtatctacct

SEQ ID NO: 500621 - DNA, 25 bp, Homo sapien
ttgtatctacctatggcaaagctcc

SEQ ID NO: 500622 - DNA, 25 bp, Homo sapien
tatggcaaagctcccacagcctaca

SEQ ID NO: 500623 - DNA, 25 bp, Homo sapien
acagcctacaagttggtgtgagcct

SEQ ID NO: 500624 - DNA, 25 bp, Homo sapien
aagttggtgtgagccttgactcttg

SEQ ID NO: 500625 - DNA, 25 bp, Homo sapien
gagccttgactcttgttttttaaag

SEQ ID NO: 500626 - DNA, 25 bp, Homo sapien
gggagggagcaatcccagttaaata

SEQ ID NO: 500627 - DNA, 25 bp, Homo sapien
gggaggtgatatccatttgcctgat

SEQ ID NO: 500628 - DNA, 25 bp, Homo sapien
tccatttgcctgatacatagtatgt

SEQ ID NO: 500629 - DNA, 25 bp, Homo sapien
gtgttcaatacacatttgctaaaga

SEQ ID NO: 500630 - DNA, 25 bp, Homo sapien
atacctaacatctctaatttgcagt

SEQ ID NO: 500631 - DNA, 25 bp, Homo sapien
tgcagtcattcccaagagtaattat

SEQ ID NO: 500632 - DNA, 25 bp, Homo sapien
aaatatgtggcaaatttctttgcct

SEQ ID NO: 500633 - DNA, 25 bp, Homo sapien
taattttgacataactgctgtaacc

SEQ ID NO: 500634 - DNA, 25 bp, Homo sapien
gctgtaaccatccagaaacggcatt

SEQ ID NO: 500635 - DNA, 25 bp, Homo sapien
gattactgattgtcattctgccacc

SEQ ID NO: 500636 - DNA, 25 bp, Homo sapien
cattctgccaccctggagtatataa

SEQ ID NO: 500637 - DNA, 25 bp, Homo sapien
attactgttattcttccatagtagg

SEQ ID NO: 500638 - DNA, 25 bp, Homo sapien
aaggcggtattactcctacagtgta

SEQ ID NO: 500639 - DNA, 25 bp, Homo sapien
gtgaaatcaacccaaacataacatg

SEQ ID NO: 500640 - DNA, 25 bp, Homo sapien
acatgcatgacaaacacagattggg

SEQ ID NO: 500641 - DNA, 25 bp, Homo sapien
gggcgaaggccctgaacctacatag

SEQ ID NO: 500642 - DNA, 25 bp, Homo sapien
ggccctgaacctacatagacatttt

SEQ ID NO: 500643 - DNA, 25 bp, Homo sapien
tagacattttatatcagcatacaga

SEQ ID NO: 500644 - DNA, 25 bp, Homo sapien
tccttcagtcctctaccaaagaata

SEQ ID NO: 500645 - DNA, 25 bp, Homo sapien
cagttgattcagtaagactgcgaca

SEQ ID NO: 500646 - DNA, 25 bp, Homo sapien
gactgcgacaatttaatactgttac

SEQ ID NO: 500647 - DNA, 25 bp, Homo sapien
aatactgttacgcttgctttgatac

SEQ ID NO: 500648 - DNA, 25 bp, Homo sapien
gacattagccatttaatgccttttt

SEQ ID NO: 500649 - DNA, 25 bp, Homo sapien
ttccacacaaaaccagagtcccatc

SEQ ID NO: 500650 - DNA, 25 bp, Homo sapien
tcaatgcagcctgacacgcctttga

SEQ ID NO: 500651 - DNA, 25 bp, Homo sapien
agcctgacacgcctttgaccagaac

SEQ ID NO: 500652 - DNA, 25 bp, Homo sapien
tttgaccagaactgcaacatttcaa

SEQ ID NO: 500653 - DNA, 25 bp, Homo sapien
agatctgttgggaaatcctaattaa

SEQ ID NO: 500654 - DNA, 25 bp, Homo sapien
caggtggcacaatcacatcctgcct

SEQ ID NO: 500655 - DNA, 25 bp, Homo sapien
atcctgcctaaaacttctggcccac

SEQ ID NO: 500656 - DNA, 25 bp, Homo sapien
agaaacctttctctgcttaacacca

SEQ ID NO: 500657 - DNA, 25 bp, Homo sapien
tttctctgcttaacaccaaaacctg

SEQ ID NO: 500658 - DNA, 25 bp, Homo sapien
ttaacaccaaaacctgcacttcaag

SEQ ID NO: 500659 - DNA, 25 bp, Homo sapien
cctgcacttcaaggtttctttaggg

SEQ ID NO: 500660 - DNA, 25 bp, Homo sapien
aaaggaatttgtcttctattaggag

SEQ ID NO: 500661 - DNA, 25 bp, Homo sapien
gtcttctattaggagacacagactt

SEQ ID NO: 500662 - DNA, 25 bp, Homo sapien
ttgctttattctattctctttgtac

SEQ ID NO: 500663 - DNA, 25 bp, Homo sapien
tctttgtacttggagagcgtaatca

SEQ ID NO: 500664 - DNA, 25 bp, Homo sapien
ggagagcgtaatcaacttgtctcat

SEQ ID NO: 500665 - DNA, 25 bp, Homo sapien
aatcaacttgtctcataatgggcta

SEQ ID NO: 500666 - DNA, 25 bp, Homo sapien
acttgtctcataatgggctagtgat

SEQ ID NO: 500667 - DNA, 25 bp, Homo sapien
caagggtgatagttggaaacagtca

SEQ ID NO: 500668 - DNA, 25 bp, Homo sapien
ggaaacagtcattacaacatggtta

SEQ ID NO: 500669 - DNA, 25 bp, Homo sapien
taccctactcctttcaaagcacttt

SEQ ID NO: 500670 - DNA, 25 bp, Homo sapien
gcactttatatccctcttgaaatac

SEQ ID NO: 500671 - DNA, 25 bp, Homo sapien
ccagagacggcttcccgggttagtg

SEQ ID NO: 500672 - DNA, 25 bp, Homo sapien
cagagacggcttcccgggttagtgt

SEQ ID NO: 500673 - DNA, 25 bp, Homo sapien
gatagttcaggcccagagacggctt

SEQ ID NO: 500674 - DNA, 25 bp, Homo sapien
atagttcaggcccagagacggcttc

SEQ ID NO: 500675 - DNA, 25 bp, Homo sapien
tagttcaggcccagagacggcttcc

SEQ ID NO: 500676 - DNA, 25 bp, Homo sapien
agttcaggcccagagacggcttccc

SEQ ID NO: 500677 - DNA, 25 bp, Homo sapien
gttcaggcccagagacggcttcccg

SEQ ID NO: 500678 - DNA, 25 bp, Homo sapien
ttcaggcccagagacggcttcccgg

SEQ ID NO: 500679 - DNA, 25 bp, Homo sapien
tcaggcccagagacggcttcccggg

SEQ ID NO: 500680 - DNA, 25 bp, Homo sapien
caggcccagagacggcttcccgggt

SEQ ID NO: 500681 - DNA, 25 bp, Homo sapien
gcccagagacggcttcccgggttag

SEQ ID NO: 500682 - DNA, 25 bp, Homo sapien
gaaagcttgctatgaagccccttca

SEQ ID NO: 500683 - DNA, 25 bp, Homo sapien
tgaagccccttcactttaaacttat

SEQ ID NO: 500684 - DNA, 25 bp, Homo sapien
ttggcattctaataacaactccatt

SEQ ID NO: 500685 - DNA, 25 bp, Homo sapien
atcacagattctaacacaatgccaa

SEQ ID NO: 500686 - DNA, 25 bp, Homo sapien
gattctaacacaatgccaattctgc

SEQ ID NO: 500687 - DNA, 25 bp, Homo sapien
acacaatgccaattctgcttttatt

SEQ ID NO: 500688 - DNA, 25 bp, Homo sapien
atacatgtattatgggaccagaatg

SEQ ID NO: 500689 - DNA, 25 bp, Homo sapien
gcattagctgaccatttttataatc

SEQ ID NO: 500690 - DNA, 25 bp, Homo sapien
aaataagcagactctctgttgaaat

SEQ ID NO: 500691 - DNA, 25 bp, Homo sapien
gactctctgttgaaatttttccagg

SEQ ID NO: 500692 - DNA, 25 bp, Homo sapien
tccaggtgaagtttgaattagagtc

SEQ ID NO: 500693 - DNA, 25 bp, Homo sapien
atagatagatctaagcagatgcctt

SEQ ID NO: 500694 - DNA, 25 bp, Homo sapien
agatgccttcagagccctggaataa

SEQ ID NO: 500695 - DNA, 25 bp, Homo sapien
agagccctggaataatcctagctgg

SEQ ID NO: 500696 - DNA, 25 bp, Homo sapien
atgggacatgaaaacaactctggcc

SEQ ID NO: 500697 - DNA, 25 bp, Homo sapien
gctgttgcatggtgtgacataggaa

SEQ ID NO: 500698 - DNA, 25 bp, Homo sapien
aaaatgttgctgtatgaataggaag

SEQ ID NO: 500699 - DNA, 25 bp, Homo sapien
aaggagggtcttcctgtcaatgaga

SEQ ID NO: 500700 - DNA, 25 bp, Homo sapien
gagaattaatgttttcctaatgatt

SEQ ID NO: 500701 - DNA, 25 bp, Homo sapien
agagcttctttatcaagttatcatc

SEQ ID NO: 500702 - DNA, 25 bp, Homo sapien
agttatcatcagtcctcttgaatta

SEQ ID NO: 500703 - DNA, 25 bp, Homo sapien
tcagtcctcttgaattatttctgaa

SEQ ID NO: 500704 - DNA, 25 bp, Homo sapien
gtaggacagaaatgagaagccccaa

SEQ ID NO: 500705 - DNA, 25 bp, Homo sapien
aaggtagtattttctactctgacta

SEQ ID NO: 500706 - DNA, 25 bp, Homo sapien
tactctgactactttcctgttgtta

SEQ ID NO: 500707 - DNA, 25 bp, Homo sapien
cctgttgttactactactatgctaa

SEQ ID NO: 500708 - DNA, 25 bp, Homo sapien
aatactatgcatacattatcttgtt

SEQ ID NO: 500709 - DNA, 25 bp, Homo sapien
cagttgcctcaatggtagagagctc

SEQ ID NO: 500710 - DNA, 25 bp, Homo sapien
tagagagctcagcatcactggaggt

SEQ ID NO: 500711 - DNA, 25 bp, Homo sapien
gctcagcatcactggaggtggtcac

SEQ ID NO: 500712 - DNA, 25 bp, Homo sapien
aggtggtcacacagaggtagcatgt

SEQ ID NO: 500713 - DNA, 25 bp, Homo sapien
gtagcatgtgccctagttacagaat

SEQ ID NO: 500714 - DNA, 25 bp, Homo sapien
gtgccctagttacagaatctattaa

SEQ ID NO: 500715 - DNA, 25 bp, Homo sapien
tattttcaccagaaatccagatggg

SEQ ID NO: 500716 - DNA, 25 bp, Homo sapien
gggcaatacctctgccatatctaag

SEQ ID NO: 500717 - DNA, 25 bp, Homo sapien
ctgccatatctaagaatctgttctg

SEQ ID NO: 500718 - DNA, 25 bp, Homo sapien
atctgttctggttcaagggctatct

SEQ ID NO: 500719 - DNA, 25 bp, Homo sapien
agggctatctgagttttaaacttct

SEQ ID NO: 500720 - DNA, 25 bp, Homo sapien
tcatgttttgccatggaatccagtt

SEQ ID NO: 500721 - DNA, 25 bp, Homo sapien
gaatccagttcttcctcaagtgctt

SEQ ID NO: 500722 - DNA, 25 bp, Homo sapien
ccatgctccctataatctctgagta

SEQ ID NO: 500723 - DNA, 25 bp, Homo sapien
tctctgagtaatcttccttttccac

SEQ ID NO: 500724 - DNA, 25 bp, Homo sapien
gggcaatctggaatatccttttctt

SEQ ID NO: 500725 - DNA, 25 bp, Homo sapien
cttttcttgaggaatattttcacca

SEQ ID NO: 500726 - DNA, 25 bp, Homo sapien
tgccttggcaagcatgctaacctaa

SEQ ID NO: 500727 - DNA, 25 bp, Homo sapien
gcatgctaacctaagttaattcaag

SEQ ID NO: 500728 - DNA, 25 bp, Homo sapien
tttccttcactggaagatttttcca

SEQ ID NO: 500729 - DNA, 25 bp, Homo sapien
ttcataaccaactattcactattat

SEQ ID NO: 500730 - DNA, 25 bp, Homo sapien
ttcactattataacatgtttcccag

SEQ ID NO: 500731 - DNA, 25 bp, Homo sapien
acatgtttcccagtgtaaatgagta

SEQ ID NO: 500732 - DNA, 25 bp, Homo sapien
gcgtgcagatgaggagtgaccctca

SEQ ID NO: 500733 - DNA, 25 bp, Homo sapien
aggagtgaccctcatatttaagtta

SEQ ID NO: 500734 - DNA, 25 bp, Homo sapien
gagtgaccctcatatttaagttatt

SEQ ID NO: 500735 - DNA, 25 bp, Homo sapien
ttttatatttgactggacattgttc

SEQ ID NO: 500736 - DNA, 25 bp, Homo sapien
ttgactggacattgttcagaagtgt

SEQ ID NO: 500737 - DNA, 25 bp, Homo sapien
acacattgctgatgcactaagacga

SEQ ID NO: 500738 - DNA, 25 bp, Homo sapien
attgctgatgcactaagacgatcaa

SEQ ID NO: 500739 - DNA, 25 bp, Homo sapien
aagacgatcaaatacaaaaggctcc

SEQ ID NO: 500740 - DNA, 25 bp, Homo sapien
aaggctccatgagtgatgggtccta

SEQ ID NO: 500741 - DNA, 25 bp, Homo sapien
atgagtgatgggtcctattccccag

SEQ ID NO: 500742 - DNA, 25 bp, Homo sapien
gatgggtcctattccccagactact

SEQ ID NO: 500743 - DNA, 25 bp, Homo sapien
agactactcccttgcagcagtggac

SEQ ID NO: 500744 - DNA, 25 bp, Homo sapien
tcccttgcagcagtggacctgaaga

SEQ ID NO: 500745 - DNA, 25 bp, Homo sapien
cagcagtggacctgaagagtttcaa

SEQ ID NO: 500746 - DNA, 25 bp, Homo sapien
gaacaacctggtggacatcattcag

SEQ ID NO: 500747 - DNA, 25 bp, Homo sapien
gtggacatcattcagcagaacaaag

SEQ ID NO: 500748 - DNA, 25 bp, Homo sapien
caggtataggagtttgttgactaaa

SEQ ID NO: 500749 - DNA, 25 bp, Homo sapien
gaaaatcattactacttgggtcaga

SEQ ID NO: 500750 - DNA, 25 bp, Homo sapien
actacttgggtcagaagcaatgcaa

SEQ ID NO: 500751 - DNA, 25 bp, Homo sapien
gcaatgcaagtcaagcttaggtcta

SEQ ID NO: 500752 - DNA, 25 bp, Homo sapien
gcttaggtctatggtttttgctcct

SEQ ID NO: 500753 - DNA, 25 bp, Homo sapien
aggtctatggtttttgctcctgatc

SEQ ID NO: 500754 - DNA, 25 bp, Homo sapien
gctcctgatcagtaatatgtagatg

SEQ ID NO: 500755 - DNA, 25 bp, Homo sapien
tagatggcatgtgttctcttaccct

SEQ ID NO: 500756 - DNA, 25 bp, Homo sapien
ctcttaccctctctaaatctggaaa

SEQ ID NO: 500757 - DNA, 25 bp, Homo sapien
aagatgcatttcatagtacctctaa

SEQ ID NO: 500758 - DNA, 25 bp, Homo sapien
tagtacctctaatctcaaaaatttt

SEQ ID NO: 500759 - DNA, 25 bp, Homo sapien
ccctttgctctttctgaaagtagtt

SEQ ID NO: 500760 - DNA, 25 bp, Homo sapien
atatgactgcctaaacaatgttttg

SEQ ID NO: 500761 - DNA, 25 bp, Homo sapien
ggagcagcatactctgtgcaatctt

SEQ ID NO: 500762 - DNA, 25 bp, Homo sapien
actctgtgcaatcttttgagacttg

SEQ ID NO: 500763 - DNA, 25 bp, Homo sapien
ttccactcagcagagacttcttgac

SEQ ID NO: 500764 - DNA, 25 bp, Homo sapien
agagacttcttgacgttgccatgtg

SEQ ID NO: 500765 - DNA, 25 bp, Homo sapien
tcttgacgttgccatgtgtggctgt

SEQ ID NO: 500766 - DNA, 25 bp, Homo sapien
attgttatgcatagtccattgtgaa

SEQ ID NO: 500767 - DNA, 25 bp, Homo sapien
gtatggcagtgtagccatcctcctg

SEQ ID NO: 500768 - DNA, 25 bp, Homo sapien
atcctcctgctggtaggcacttgag

SEQ ID NO: 500769 - DNA, 25 bp, Homo sapien
ggcacttgagatgcttccaggtttt

SEQ ID NO: 500770 - DNA, 25 bp, Homo sapien
cattattgggcatatacccagtgga

SEQ ID NO: 500771 - DNA, 25 bp, Homo sapien
gggcatatacccagtggaatgtaaa

SEQ ID NO: 500772 - DNA, 25 bp, Homo sapien
gtggaatgtaaatcatcctgccata

SEQ ID NO: 500773 - DNA, 25 bp, Homo sapien
tcatcctgccataaaaacacatgca

SEQ ID NO: 500774 - DNA, 25 bp, Homo sapien
tactcccatataatctctgtcttca

SEQ ID NO: 500775 - DNA, 25 bp, Homo sapien
ctcccatataatctctgtcttcata

SEQ ID NO: 500776 - DNA, 25 bp, Homo sapien
ctctgtcttcataaataatcttttg

SEQ ID NO: 500777 - DNA, 25 bp, Homo sapien
aatcttttgtaacgcttatacactg

SEQ ID NO: 500778 - DNA, 25 bp, Homo sapien
gccattgtgaaaagtagcgtagcaa

SEQ ID NO: 500779 - DNA, 25 bp, Homo sapien
aaagtagcgtagcaattccttgaaa

SEQ ID NO: 500780 - DNA, 25 bp, Homo sapien
tagcgtagcaattccttgaaaaact

SEQ ID NO: 500781 - DNA, 25 bp, Homo sapien
gcatgttcagtagaaatgaatgtgt

SEQ ID NO: 500782 - DNA, 25 bp, Homo sapien
aagtcatagaaatcataaagtcgaa

SEQ ID NO: 500783 - DNA, 25 bp, Homo sapien
gtcgaaaaattatgcatcaaaccat

SEQ ID NO: 500784 - DNA, 25 bp, Homo sapien
tatgcatcaaaccatcatacatatg

SEQ ID NO: 500785 - DNA, 25 bp, Homo sapien
catcatacatatgggactgtctgta

SEQ ID NO: 500786 - DNA, 25 bp, Homo sapien
ctgtctgtaatgtatcatccaaagc

SEQ ID NO: 500787 - DNA, 25 bp, Homo sapien
gtatcatccaaagcagaacactttt

SEQ ID NO: 500788 - DNA, 25 bp, Homo sapien
atccaaagcagaacacttttaatag

SEQ ID NO: 500789 - DNA, 25 bp, Homo sapien
ttaaaaatactgagctgaaggtgaa

SEQ ID NO: 500790 - DNA, 25 bp, Homo sapien
gaatgattatatggtacttaaagta

SEQ ID NO: 500791 - DNA, 25 bp, Homo sapien
gtatgtgtatcacaaaagtgatgca

SEQ ID NO: 500792 - DNA, 25 bp, Homo sapien
tgagcaggacctgtaatgcactgaa

SEQ ID NO: 500793 - DNA, 25 bp, Homo sapien
atgcactgaaactgtccatcttctc

SEQ ID NO: 500794 - DNA, 25 bp, Homo sapien
tgtccatcttctcttcttattgtaa

SEQ ID NO: 500795 - DNA, 25 bp, Homo sapien
gaacaccattgtcttcaataacctg

SEQ ID NO: 500796 - DNA, 25 bp, Homo sapien
cttattgtaaatgcttctcctgggt

SEQ ID NO: 500797 - DNA, 25 bp, Homo sapien
gcttctcctgggttaacttgtacca

SEQ ID NO: 500798 - DNA, 25 bp, Homo sapien
aataacctgttgtgttccatctgca

SEQ ID NO: 500799 - DNA, 25 bp, Homo sapien
gatctgagttgtatccagtagtggt

SEQ ID NO: 500800 - DNA, 25 bp, Homo sapien
gtggtggatgttctgccattatcaa

SEQ ID NO: 500801 - DNA, 25 bp, Homo sapien
gggcatatccaggaggcacatagat

SEQ ID NO: 500802 - DNA, 25 bp, Homo sapien
ggacatcattggaacctgagcagga

SEQ ID NO: 500803 - DNA, 25 bp, Homo sapien
aacactttcctgaatgccattactc

SEQ ID NO: 500804 - DNA, 25 bp, Homo sapien
tgaatgccattactcatgccctcaa

SEQ ID NO: 500805 - DNA, 25 bp, Homo sapien
ttactcatgccctcaaagctttcat

SEQ ID NO: 500806 - DNA, 25 bp, Homo sapien
tgccctcaaagctttcatatctgta

SEQ ID NO: 500807 - DNA, 25 bp, Homo sapien
agctttcatatctgtagcctactcc

SEQ ID NO: 500808 - DNA, 25 bp, Homo sapien
atctgtagcctactcctgtaaaggg

SEQ ID NO: 500809 - DNA, 25 bp, Homo sapien
tactcctgtaaagggtttctcctgt

SEQ ID NO: 500810 - DNA, 25 bp, Homo sapien
ttctagtttgcaaaggtatgccaac

SEQ ID NO: 500811 - DNA, 25 bp, Homo sapien
ttgcaaaggtatgccaacgaatctg

SEQ ID NO: 500812 - DNA, 25 bp, Homo sapien
gccaacgaatctggcaacctggtat

SEQ ID NO: 500813 - DNA, 25 bp, Homo sapien
ttttctattgtacctaaagcagtct

SEQ ID NO: 500814 - DNA, 25 bp, Homo sapien
gtgtgagccactgctgccagtctga

SEQ ID NO: 500815 - DNA, 25 bp, Homo sapien
gctgccagtctgaagtatattttaa

SEQ ID NO: 500816 - DNA, 25 bp, Homo sapien
aaatgacattcagtaagctatgcat

SEQ ID NO: 500817 - DNA, 25 bp, Homo sapien
gacattcagtaagctatgcatattt

SEQ ID NO: 500818 - DNA, 25 bp, Homo sapien
gctatgcatatttaagctgtagcat

SEQ ID NO: 500819 - DNA, 25 bp, Homo sapien
agctgtagcatgtgataaatcttga

SEQ ID NO: 500820 - DNA, 25 bp, Homo sapien
gtagcatgtgataaatcttgagttt

SEQ ID NO: 500821 - DNA, 25 bp, Homo sapien
atcttgagtttcatataatcccatg

SEQ ID NO: 500822 - DNA, 25 bp, Homo sapien
atcccatgaaaccattaacatagtc

SEQ ID NO: 500823 - DNA, 25 bp, Homo sapien
gaaaccattaacatagtcacaataa

SEQ ID NO: 500824 - DNA, 25 bp, Homo sapien
taatgaacttaacacctttatattt

SEQ ID NO: 500825 - DNA, 25 bp, Homo sapien
aggacacacctccaagacccttgga

SEQ ID NO: 500826 - DNA, 25 bp, Homo sapien
aagacccttggaggctgttggagca

SEQ ID NO: 500827 - DNA, 25 bp, Homo sapien
ggagcaggtactatcctggttgact

SEQ ID NO: 500828 - DNA, 25 bp, Homo sapien
tcctggttgactccaccaaggtgaa

SEQ ID NO: 500829 - DNA, 25 bp, Homo sapien
tcctctttgttgttcttgtatagac

SEQ ID NO: 500830 - DNA, 25 bp, Homo sapien
gtatagacttttcaattgctgtatg

SEQ ID NO: 500831 - DNA, 25 bp, Homo sapien
cttttcaattgctgtatgtgggatc

SEQ ID NO: 500832 - DNA, 25 bp, Homo sapien
gtatgtgggatcagcccagacgcca

SEQ ID NO: 500833 - DNA, 25 bp, Homo sapien
gacgccagcaacaaactagcaagag

SEQ ID NO: 500834 - DNA, 25 bp, Homo sapien
ggtgtttttatggtataagtctcta

SEQ ID NO: 500835 - DNA, 25 bp, Homo sapien
aaaattcctctcattgccacttttt

SEQ ID NO: 500836 - DNA, 25 bp, Homo sapien
ttgtagttatattttctgtgtgctt

SEQ ID NO: 500837 - DNA, 25 bp, Homo sapien
aaaattggtgagttcagtagctttg

SEQ ID NO: 500838 - DNA, 25 bp, Homo sapien
ggtgagttcagtagctttggtatta

SEQ ID NO: 500839 - DNA, 25 bp, Homo sapien
cagtagctttggtattatgagtgca

SEQ ID NO: 500840 - DNA, 25 bp, Homo sapien
gctttggtattatgagtgcaaatca

SEQ ID NO: 500841 - DNA, 25 bp, Homo sapien
tcataatagctccaatgtgaaaaaa

SEQ ID NO: 500842 - DNA, 25 bp, Homo sapien
gtataacttgtcacttaatgttaga

SEQ ID NO: 500843 - DNA, 25 bp, Homo sapien
gtgtaataaataatctctgtaccaa

SEQ ID NO: 500844 - DNA, 25 bp, Homo sapien
taatctctgtaccaaatagtaattt

SEQ ID NO: 500845 - DNA, 25 bp, Homo sapien
tgtttttatgtttccaaccctcttg

SEQ ID NO: 500846 - DNA, 25 bp, Homo sapien
ttatgtttccaaccctcttgaatta

SEQ ID NO: 500847 - DNA, 25 bp, Homo sapien
tactaccttgttacagttggtttag

SEQ ID NO: 500848 - DNA, 25 bp, Homo sapien
cagttggtttagtgtagtggattat

SEQ ID NO: 500849 - DNA, 25 bp, Homo sapien
tgtagtggattattgacatgacatc

SEQ ID NO: 500850 - DNA, 25 bp, Homo sapien
catgattttgttttctacccttcaa

SEQ ID NO: 500851 - DNA, 25 bp, Homo sapien
tgtgtacttgtacataaaaccaaaa

SEQ ID NO: 500852 - DNA, 25 bp, Homo sapien
tcaaggtgttggctcagatttattc

SEQ ID NO: 500853 - DNA, 25 bp, Homo sapien
caaggtgttggctcagatttattct

SEQ ID NO: 500854 - DNA, 25 bp, Homo sapien
aggtgttggctcagatttattctta

SEQ ID NO: 500855 - DNA, 25 bp, Homo sapien
gtgttggctcagatttattcttaat

SEQ ID NO: 500856 - DNA, 25 bp, Homo sapien
gctcagatttattcttaattggatg

SEQ ID NO: 500857 - DNA, 25 bp, Homo sapien
gatgtttaaagcatgtactaccttg

SEQ ID NO: 500858 - DNA, 25 bp, Homo sapien
tgctttactggactaatttcaacct

SEQ ID NO: 500859 - DNA, 25 bp, Homo sapien
ggactaatttcaacctccagcacac

SEQ ID NO: 500860 - DNA, 25 bp, Homo sapien
caccaccaatgaatagcagtaatac

SEQ ID NO: 500861 - DNA, 25 bp, Homo sapien
tagcagtaataccagcataattgtc

SEQ ID NO: 500862 - DNA, 25 bp, Homo sapien
gcataattgtctgcagttctgctga

SEQ ID NO: 500863 - DNA, 25 bp, Homo sapien
agttctgctgagatacgtgctctat

SEQ ID NO: 500864 - DNA, 25 bp, Homo sapien
gatacgtgctctattttattggctt

SEQ ID NO: 500865 - DNA, 25 bp, Homo sapien
gctctattttattggcttggctgta

SEQ ID NO: 500866 - DNA, 25 bp, Homo sapien
ttttattggcttggctgtaggtttt

SEQ ID NO: 500867 - DNA, 25 bp, Homo sapien
gaggctaatctcttacaggaaaggt

SEQ ID NO: 500868 - DNA, 25 bp, Homo sapien
gcttcctgtgcatcctctgtgatga

SEQ ID NO: 500869 - DNA, 25 bp, Homo sapien
ccaggcatagtggggcctttgtaga

SEQ ID NO: 500870 - DNA, 25 bp, Homo sapien
caggcatagtggggcctttgtagaa

SEQ ID NO: 500871 - DNA, 25 bp, Homo sapien
aggcatagtggggcctttgtagaaa

SEQ ID NO: 500872 - DNA, 25 bp, Homo sapien
gcatagtggggcctttgtagaaaaa

SEQ ID NO: 500873 - DNA, 25 bp, Homo sapien
acatagcttttctatgagaagatga

SEQ ID NO: 500874 - DNA, 25 bp, Homo sapien
catagcttttctatgagaagatgat

SEQ ID NO: 500875 - DNA, 25 bp, Homo sapien
atagcttttctatgagaagatgatc

SEQ ID NO: 500876 - DNA, 25 bp, Homo sapien
tagctgggaccacacccagtcattt

SEQ ID NO: 500877 - DNA, 25 bp, Homo sapien
agctgggaccacacccagtcatttt

SEQ ID NO: 500878 - DNA, 25 bp, Homo sapien
gctgggaccacacccagtcattttt

SEQ ID NO: 500879 - DNA, 25 bp, Homo sapien
ctgggaccacacccagtcatttttt

SEQ ID NO: 500880 - DNA, 25 bp, Homo sapien
gatgcagcatcctggctgtggcctg

SEQ ID NO: 500881 - DNA, 25 bp, Homo sapien
gcagcagtggcatggacaagcaact

SEQ ID NO: 500882 - DNA, 25 bp, Homo sapien
gcaactgctaattcgagacttacta

SEQ ID NO: 500883 - DNA, 25 bp, Homo sapien
acttactattggcttcacagcacac

SEQ ID NO: 500884 - DNA, 25 bp, Homo sapien
cacagcacaccctacagtgagcagg

SEQ ID NO: 500885 - DNA, 25 bp, Homo sapien
gatgagaccgtggaacagctacctg

SEQ ID NO: 500886 - DNA, 25 bp, Homo sapien
ggaacagctacctgcttttggttaa

SEQ ID NO: 500887 - DNA, 25 bp, Homo sapien
acctgcttttggttaagattgccag

SEQ ID NO: 500888 - DNA, 25 bp, Homo sapien
cagatatcattaggacacagtagca

SEQ ID NO: 500889 - DNA, 25 bp, Homo sapien
aatgaactcagcttgtttttcctaa

SEQ ID NO: 500890 - DNA, 25 bp, Homo sapien
gaaggtggtatatatctgcaaacat

SEQ ID NO: 500891 - DNA, 25 bp, Homo sapien
ctctaccctgatgttgcatgagacc

SEQ ID NO: 500892 - DNA, 25 bp, Homo sapien
taccctgatgttgcatgagacctgg

SEQ ID NO: 500893 - DNA, 25 bp, Homo sapien
ccctgatgttgcatgagacctggta

SEQ ID NO: 500894 - DNA, 25 bp, Homo sapien
ctgatgttgcatgagacctggtaac

SEQ ID NO: 500895 - DNA, 25 bp, Homo sapien
gttgcatgagacctggtaacagtgt

SEQ ID NO: 500896 - DNA, 25 bp, Homo sapien
tgagacctggtaacagtgtctccct

SEQ ID NO: 500897 - DNA, 25 bp, Homo sapien
agctccttgccaaagcctctgttga

SEQ ID NO: 500898 - DNA, 25 bp, Homo sapien
tgagacctgggcttcttgtagcccc

SEQ ID NO: 500899 - DNA, 25 bp, Homo sapien
acctgggcttcttgtagccccttct

SEQ ID NO: 500900 - DNA, 25 bp, Homo sapien
gtatggtgaccccacctaagcattt

SEQ ID NO: 500901 - DNA, 25 bp, Homo sapien
tatggtgaccccacctaagcatttt

SEQ ID NO: 500902 - DNA, 25 bp, Homo sapien
tacgttgcttgggttaagacacttt

SEQ ID NO: 500903 - DNA, 25 bp, Homo sapien
gacactttgctaaaattacagcctg

SEQ ID NO: 500904 - DNA, 25 bp, Homo sapien
acagcctgaatcctttctttagttg

SEQ ID NO: 500905 - DNA, 25 bp, Homo sapien
gtgtgtgccagtttttcttgtctca

SEQ ID NO: 500906 - DNA, 25 bp, Homo sapien
tcttgtctcaggtagatactcccac

SEQ ID NO: 500907 - DNA, 25 bp, Homo sapien
gtctcaggtagatactcccactgtg

SEQ ID NO: 500908 - DNA, 25 bp, Homo sapien
ctacagacttttcatacttacctcc

SEQ ID NO: 500909 - DNA, 25 bp, Homo sapien
gattggttggtattatcaacactgt

SEQ ID NO: 500910 - DNA, 25 bp, Homo sapien
tcaacactgttgtttgcagtctcat

SEQ ID NO: 500911 - DNA, 25 bp, Homo sapien
gcagtctcattaaagcatgctctta

SEQ ID NO: 500912 - DNA, 25 bp, Homo sapien
gctcttaaggagtacatatggtcat

SEQ ID NO: 500913 - DNA, 25 bp, Homo sapien
taaagccgatcacctttaaggtcat

SEQ ID NO: 500914 - DNA, 25 bp, Homo sapien
gatcacctttaaggtcattcggaaa

SEQ ID NO: 500915 - DNA, 25 bp, Homo sapien
aagcggtccttgttttcgcggtgtg

SEQ ID NO: 500916 - DNA, 25 bp, Homo sapien
gtgtgggtcgtaacagcagtctcat

SEQ ID NO: 500917 - DNA, 25 bp, Homo sapien
gctcttgggcgttggagagtcccac

SEQ ID NO: 500918 - DNA, 25 bp, Homo sapien
ggagagtcccactcgggttgtgcca

SEQ ID NO: 500919 - DNA, 25 bp, Homo sapien
cactcgggttgtgccacaggacaat

SEQ ID NO: 500920 - DNA, 25 bp, Homo sapien
gctctgccgcaggaactggatgttg

SEQ ID NO: 500921 - DNA, 25 bp, Homo sapien
tgttgttggcgctgtcggccagctc

SEQ ID NO: 500922 - DNA, 25 bp, Homo sapien
tactgctccaccgagagtacgtagt

SEQ ID NO: 500923 - DNA, 25 bp, Homo sapien
gagagtacgtagtacccgtcgtagc

SEQ ID NO: 500924 - DNA, 25 bp, Homo sapien
tcccatgcaaattgaatcttcatta

SEQ ID NO: 500925 - DNA, 25 bp, Homo sapien
aattgaatcttcattaacacatttt

SEQ ID NO: 500926 - DNA, 25 bp, Homo sapien
aaggctttactgtattaggtaacat

SEQ ID NO: 500927 - DNA, 25 bp, Homo sapien
ttctaggcaagaagctcaacttttt

SEQ ID NO: 500928 - DNA, 25 bp, Homo sapien
gcttaaatagtaactcatggttttc

SEQ ID NO: 500929 - DNA, 25 bp, Homo sapien
gggttgttgtcagtatgttaaacat

SEQ ID NO: 500930 - DNA, 25 bp, Homo sapien
aggaggaggatgcatattgtactat

SEQ ID NO: 500931 - DNA, 25 bp, Homo sapien
tgcattcaaatttatcactgttttt

SEQ ID NO: 500932 - DNA, 25 bp, Homo sapien
tttctgacagactttccctttgtcc

SEQ ID NO: 500933 - DNA, 25 bp, Homo sapien
ttccctttgtcctttctagttatga

SEQ ID NO: 500934 - DNA, 25 bp, Homo sapien
gtcctttctagttatgacttgggaa

SEQ ID NO: 500935 - DNA, 25 bp, Homo sapien
atggtcaagtactggaagggccagc

SEQ ID NO: 500936 - DNA, 25 bp, Homo sapien
atctgtgtcacacccaagctggtgg

SEQ ID NO: 500937 - DNA, 25 bp, Homo sapien
ggagcacctcaaaagtgcccagtat

SEQ ID NO: 500938 - DNA, 25 bp, Homo sapien
gcccagtataagaaaccacccatca

SEQ ID NO: 500939 - DNA, 25 bp, Homo sapien
cagtataagaaaccacccatcacag

SEQ ID NO: 500940 - DNA, 25 bp, Homo sapien
agcacaagcaagtcaagctctccaa

SEQ ID NO: 500941 - DNA, 25 bp, Homo sapien
gcaagtcaagctctccaagaagtga

SEQ ID NO: 500942 - DNA, 25 bp, Homo sapien
aagctctccaagaagtgagcagcct

SEQ ID NO: 500943 - DNA, 25 bp, Homo sapien
ctggctcccagcctgtaaatatgta

SEQ ID NO: 500944 - DNA, 25 bp, Homo sapien
gctcccagcctgtaaatatgtatag

SEQ ID NO: 500945 - DNA, 25 bp, Homo sapien
aaatatgtatagacctgttttgtca

SEQ ID NO: 500946 - DNA, 25 bp, Homo sapien
gtcatagacacaatttctcttctgt

SEQ ID NO: 500947 - DNA, 25 bp, Homo sapien
atttctcttctgtatgccactagtt

SEQ ID NO: 500948 - DNA, 25 bp, Homo sapien
acatttctaaattctgagcggtctc

SEQ ID NO: 500949 - DNA, 25 bp, Homo sapien
tgagcggtctcagttaggcctgtat

SEQ ID NO: 500950 - DNA, 25 bp, Homo sapien
cagttaggcctgtatgtgtgtacat

SEQ ID NO: 500951 - DNA, 25 bp, Homo sapien
gtgtgtacatgtccaagtaaagctg

SEQ ID NO: 500952 - DNA, 25 bp, Homo sapien
gaaaatgtcagtcttgacacagctg

SEQ ID NO: 500953 - DNA, 25 bp, Homo sapien
acacagctgtgtcttagtatgagaa

SEQ ID NO: 500954 - DNA, 25 bp, Homo sapien
aagaatgagtctctttttggtggct

SEQ ID NO: 500955 - DNA, 25 bp, Homo sapien
ttggtggctaagtagaatcttccta

SEQ ID NO: 500956 - DNA, 25 bp, Homo sapien
gaatcttcctaaaaccattgtcata

SEQ ID NO: 500957 - DNA, 25 bp, Homo sapien
aatatagtttgcttccgtgttaagt

SEQ ID NO: 500958 - DNA, 25 bp, Homo sapien
gtttgcttccgtgttaagttgtggt

SEQ ID NO: 500959 - DNA, 25 bp, Homo sapien
ccgtgttaagttgtggttgagctat

SEQ ID NO: 500960 - DNA, 25 bp, Homo sapien
ttgagctatggagtgaccctggagc

SEQ ID NO: 500961 - DNA, 25 bp, Homo sapien
cacaggcctgagctcagcaagggtt

SEQ ID NO: 500962 - DNA, 25 bp, Homo sapien
agctcagcaagggttcaattcaaga

SEQ ID NO: 500963 - DNA, 25 bp, Homo sapien
gcaagggttcaattcaagagagatg

SEQ ID NO: 500964 - DNA, 25 bp, Homo sapien
gagagatgacgtctccacttggata

SEQ ID NO: 500965 - DNA, 25 bp, Homo sapien
gacgtctccacttggataatggcag

SEQ ID NO: 500966 - DNA, 25 bp, Homo sapien
ctccacttggataatggcagacagt

SEQ ID NO: 500967 - DNA, 25 bp, Homo sapien
acagtgtgggtagcggccatgcact

SEQ ID NO: 500968 - DNA, 25 bp, Homo sapien
tgctcatagagatcactaaggataa

SEQ ID NO: 500969 - DNA, 25 bp, Homo sapien
aggataatcctgcttattaagtgat

SEQ ID NO: 500970 - DNA, 25 bp, Homo sapien
gttggtttgaattgtctctggtggt

SEQ ID NO: 500971 - DNA, 25 bp, Homo sapien
aattgtctctggtggtagtctagga

SEQ ID NO: 500972 - DNA, 25 bp, Homo sapien
ttgtggtaccaatgaggattttatt

SEQ ID NO: 500973 - DNA, 25 bp, Homo sapien
gggccagatgagagaaccattttct

SEQ ID NO: 500974 - DNA, 25 bp, Homo sapien
gaaccattttctttgtaagcttagc

SEQ ID NO: 500975 - DNA, 25 bp, Homo sapien
ctctagccagctccagatgaaattt

SEQ ID NO: 500976 - DNA, 25 bp, Homo sapien
tgaaattttggctaattatcccttt

SEQ ID NO: 500977 - DNA, 25 bp, Homo sapien
ttatccctttagaaaagtcaggctt

SEQ ID NO: 500978 - DNA, 25 bp, Homo sapien
gaactgggctctaggtcaattaacc

SEQ ID NO: 500979 - DNA, 25 bp, Homo sapien
gcatctgccggctttgtgcaggcag

SEQ ID NO: 500980 - DNA, 25 bp, Homo sapien
gacggtttccacagcgagcgccagc

SEQ ID NO: 500981 - DNA, 25 bp, Homo sapien
ggtcctgtccacattttgatacgca

SEQ ID NO: 500982 - DNA, 25 bp, Homo sapien
attttgatacgcagatcacttgagc

SEQ ID NO: 500983 - DNA, 25 bp, Homo sapien
gagcttgtcaattagggttctgcca

SEQ ID NO: 500984 - DNA, 25 bp, Homo sapien
gtcaattagggttctgccattctga

SEQ ID NO: 500985 - DNA, 25 bp, Homo sapien
agtttctaaagcagagtcggcctca

SEQ ID NO: 500986 - DNA, 25 bp, Homo sapien
gcagagtcggcctcagaagccaaaa

SEQ ID NO: 500987 - DNA, 25 bp, Homo sapien
ggtgctcaaacctttaagacttcat

SEQ ID NO: 500988 - DNA, 25 bp, Homo sapien
agacttcatctccatgtgaagggct

SEQ ID NO: 500989 - DNA, 25 bp, Homo sapien
atgtgaagggctcactgtttctacc

SEQ ID NO: 500990 - DNA, 25 bp, Homo sapien
ggaaagaagactgggacagacacag

SEQ ID NO: 500991 - DNA, 25 bp, Homo sapien
atagatgttattcgatccgtcatgt

SEQ ID NO: 500992 - DNA, 25 bp, Homo sapien
agatgttattcgatccgtcatgtac

SEQ ID NO: 500993 - DNA, 25 bp, Homo sapien
gatgttattcgatccgtcatgtact

SEQ ID NO: 500994 - DNA, 25 bp, Homo sapien
atgttattcgatccgtcatgtactt

SEQ ID NO: 500995 - DNA, 25 bp, Homo sapien
gttattcgatccgtcatgtactttg

SEQ ID NO: 500996 - DNA, 25 bp, Homo sapien
ttattcgatccgtcatgtactttga

SEQ ID NO: 500997 - DNA, 25 bp, Homo sapien
tattcgatccgtcatgtactttgaa

SEQ ID NO: 500998 - DNA, 25 bp, Homo sapien
attcgatccgtcatgtactttgaac

SEQ ID NO: 500999 - DNA, 25 bp, Homo sapien
tcgatccgtcatgtactttgaacta

SEQ ID NO: 501000 - DNA, 25 bp, Homo sapien
ttgaggaacagcacaatcagcttcg

SEQ ID NO: 501001 - DNA, 25 bp, Homo sapien
ccttcaaggagccatgggtctgtgc

SEQ ID NO: 501002 - DNA, 25 bp, Homo sapien
aggagccatgggtctgtgctgactc

SEQ ID NO: 501003 - DNA, 25 bp, Homo sapien
gtctgtgctgactctggccttacaa

SEQ ID NO: 501004 - DNA, 25 bp, Homo sapien
tgactctggccttacaaccttccag

SEQ ID NO: 501005 - DNA, 25 bp, Homo sapien
agcctcctttgctggcattgatggg

SEQ ID NO: 501006 - DNA, 25 bp, Homo sapien
gtggatccaaatttattgtgcatat

SEQ ID NO: 501007 - DNA, 25 bp, Homo sapien
gatccaaatttattgtgcatattct

SEQ ID NO: 501008 - DNA, 25 bp, Homo sapien
ggttttcaaaagatggcttattcac

SEQ ID NO: 501009 - DNA, 25 bp, Homo sapien
tcaaaagatggcttattcacatgga

SEQ ID NO: 501010 - DNA, 25 bp, Homo sapien
aatgtacaccagtttagccctgggc

SEQ ID NO: 501011 - DNA, 25 bp, Homo sapien
ggccctccctttaccttcatatgtg

SEQ ID NO: 501012 - DNA, 25 bp, Homo sapien
cagaatgtattgtctcagacaggat

SEQ ID NO: 501013 - DNA, 25 bp, Homo sapien
gtctcagacaggatttcagttccgg

SEQ ID NO: 501014 - DNA, 25 bp, Homo sapien
acaggatttcagttccgggaggcag

SEQ ID NO: 501015 - DNA, 25 bp, Homo sapien
cagagcctccctcgaaggttctcta

SEQ ID NO: 501016 - DNA, 25 bp, Homo sapien
ctcgaaggttctctactactgtatt

SEQ ID NO: 501017 - DNA, 25 bp, Homo sapien
gaaggttctctactactgtattctg

SEQ ID NO: 501018 - DNA, 25 bp, Homo sapien
gttctctactactgtattctgtaca

SEQ ID NO: 501019 - DNA, 25 bp, Homo sapien
gtacataatgtaccatcccatgtgg

SEQ ID NO: 501020 - DNA, 25 bp, Homo sapien
atcccatgtggaatctgtgagtgtc

SEQ ID NO: 501021 - DNA, 25 bp, Homo sapien
aactccgaattccatatgtaatagg

SEQ ID NO: 501022 - DNA, 25 bp, Homo sapien
tgtaataggatgcaagtctaagcgt

SEQ ID NO: 501023 - DNA, 25 bp, Homo sapien
agcttgggagacagaagtctctgtg

SEQ ID NO: 501024 - DNA, 25 bp, Homo sapien
gtctctgtgggctgatgttcatgga

SEQ ID NO: 501025 - DNA, 25 bp, Homo sapien
gatgttcatggaaaactccggagtc

SEQ ID NO: 501026 - DNA, 25 bp, Homo sapien
aactccggagtcatatagatgcttt

SEQ ID NO: 501027 - DNA, 25 bp, Homo sapien
atagatgctttgagggagcagaaca

SEQ ID NO: 501028 - DNA, 25 bp, Homo sapien
gcagaacatggagctccgagaaaag

SEQ ID NO: 501029 - DNA, 25 bp, Homo sapien
tccgagaaaagctgagagctctgca

SEQ ID NO: 501030 - DNA, 25 bp, Homo sapien
gccaggaagaaatctgcagcgtccc

SEQ ID NO: 501031 - DNA, 25 bp, Homo sapien
agaatcgcacactctggcattggaa

SEQ ID NO: 501032 - DNA, 25 bp, Homo sapien
aatacccaaatacgctggccacaag

SEQ ID NO: 501033 - DNA, 25 bp, Homo sapien
gtgccactctcctgggacaaagatc

SEQ ID NO: 501034 - DNA, 25 bp, Homo sapien
gcatagtggggcctttgtagaaaaa

SEQ ID NO: 501035 - DNA, 25 bp, Homo sapien
gggcctttgtagaaaaacatagctt

SEQ ID NO: 501036 - DNA, 25 bp, Homo sapien
ggcctttgtagaaaaacatagcttt

SEQ ID NO: 501037 - DNA, 25 bp, Homo sapien
gcctttgtagaaaaacatagctttt

SEQ ID NO: 501038 - DNA, 25 bp, Homo sapien
atagcttttctatgagaagatgatc

SEQ ID NO: 501039 - DNA, 25 bp, Homo sapien
agcttttctatgagaagatgatcaa

SEQ ID NO: 501040 - DNA, 25 bp, Homo sapien
gcttttctatgagaagatgatcaat

SEQ ID NO: 501041 - DNA, 25 bp, Homo sapien
tagctgggaccacacccagtcattt

SEQ ID NO: 501042 - DNA, 25 bp, Homo sapien
agctgggaccacacccagtcatttt

SEQ ID NO: 501043 - DNA, 25 bp, Homo sapien
gctgggaccacacccagtcattttt

SEQ ID NO: 501044 - DNA, 25 bp, Homo sapien
ctgggaccacacccagtcatttttt

SEQ ID NO: 501045 - DNA, 25 bp, Homo sapien
aatgcttgctgctccatctttattc

SEQ ID NO: 501046 - DNA, 25 bp, Homo sapien
ccatctttattcatcgttaatgtta

SEQ ID NO: 501047 - DNA, 25 bp, Homo sapien
aatgttaatttatgacaactcaggg

SEQ ID NO: 501048 - DNA, 25 bp, Homo sapien
taacaagcctagtttggttacaggt

SEQ ID NO: 501049 - DNA, 25 bp, Homo sapien
ggttacaggtacacacaagcttgaa

SEQ ID NO: 501050 - DNA, 25 bp, Homo sapien
gaatatttctctgcactgaaatgaa

SEQ ID NO: 501051 - DNA, 25 bp, Homo sapien
atgaaagtggcatagttcatcacca

SEQ ID NO: 501052 - DNA, 25 bp, Homo sapien
gtagagcatcttatcagccatagaa

SEQ ID NO: 501053 - DNA, 25 bp, Homo sapien
caaagtgtctgtcaaaaacaggcat

SEQ ID NO: 501054 - DNA, 25 bp, Homo sapien
aggtggatgtagcaaatctctgtca

SEQ ID NO: 501055 - DNA, 25 bp, Homo sapien
atgtagcaaatctctgtcactgctt

SEQ ID NO: 501056 - DNA, 25 bp, Homo sapien
ataaacatcacatgctgctggcctt

SEQ ID NO: 501057 - DNA, 25 bp, Homo sapien
gctgctggccttcttacaaaatgag

SEQ ID NO: 501058 - DNA, 25 bp, Homo sapien
agtgaagtgcttggctctgcgagat

SEQ ID NO: 501059 - DNA, 25 bp, Homo sapien
atatcttcaccactcttcacaatta

SEQ ID NO: 501060 - DNA, 25 bp, Homo sapien
ttcacaattacgtcctcttgcattc

SEQ ID NO: 501061 - DNA, 25 bp, Homo sapien
actgatccttcagaattgtgtggcc

SEQ ID NO: 501062 - DNA, 25 bp, Homo sapien
ttgtgtggcctttcaactttctgaa

SEQ ID NO: 501063 - DNA, 25 bp, Homo sapien
aactttctgaaaggccttcactgtc

SEQ ID NO: 501064 - DNA, 25 bp, Homo sapien
ggccttcactgtctcttaattcaaa

SEQ ID NO: 501065 - DNA, 25 bp, Homo sapien
atacaagtcagatcaccttacaatt

SEQ ID NO: 501066 - DNA, 25 bp, Homo sapien
gagcactctgttgaaaatggcagta

SEQ ID NO: 501067 - DNA, 25 bp, Homo sapien
attgttcaacaataagggcaaaggg

SEQ ID NO: 501068 - DNA, 25 bp, Homo sapien
gttcaacaataagggcaaagggaga

SEQ ID NO: 501069 - DNA, 25 bp, Homo sapien
gcaaagggagagaatcataacatct

SEQ ID NO: 501070 - DNA, 25 bp, Homo sapien
gaatcataacatctgattaaacaga

SEQ ID NO: 501071 - DNA, 25 bp, Homo sapien
aactaactatataaggatggtccca

SEQ ID NO: 501072 - DNA, 25 bp, Homo sapien
ctaactatataaggatggtcccagc

SEQ ID NO: 501073 - DNA, 25 bp, Homo sapien
gcttgtttgtaatacgtgtgcataa

SEQ ID NO: 501074 - DNA, 25 bp, Homo sapien
gtttgtaatacgtgtgcataaaaat

SEQ ID NO: 501075 - DNA, 25 bp, Homo sapien
gaggtgaacacaattattttaaggc

SEQ ID NO: 501076 - DNA, 25 bp, Homo sapien
tttaaggcagttaaattatctctgt

SEQ ID NO: 501077 - DNA, 25 bp, Homo sapien
agagcaagattccgttcccaagaaa

SEQ ID NO: 501078 - DNA, 25 bp, Homo sapien
tgagccaagcagacacggatgtccc

SEQ ID NO: 501079 - DNA, 25 bp, Homo sapien
cagacacggatgtcccctcttctgg

SEQ ID NO: 501080 - DNA, 25 bp, Homo sapien
aggagggtagtgctcccaggcctca

SEQ ID NO: 501081 - DNA, 25 bp, Homo sapien
caggcctcaggagtccagacagaga

SEQ ID NO: 501082 - DNA, 25 bp, Homo sapien
cccaaagcctgactgccaacagaaa

SEQ ID NO: 501083 - DNA, 25 bp, Homo sapien
aagcctgactgccaacagaaaccct

SEQ ID NO: 501084 - DNA, 25 bp, Homo sapien
caacagaaaccctctcctagtgagg

SEQ ID NO: 501085 - DNA, 25 bp, Homo sapien
atgccaggaggcaggcccctctgct

SEQ ID NO: 501086 - DNA, 25 bp, Homo sapien
tgctgccaacactgcccagcttgtg

SEQ ID NO: 501087 - DNA, 25 bp, Homo sapien
cccagcttgtgaggccaggaggagc

SEQ ID NO: 501088 - DNA, 25 bp, Homo sapien
aggaggagcccctgtcccactcggt

SEQ ID NO: 501089 - DNA, 25 bp, Homo sapien
gagaactttccatctcttcttaata

SEQ ID NO: 501090 - DNA, 25 bp, Homo sapien
ccatctcttcttaataacagtgcaa

SEQ ID NO: 501091 - DNA, 25 bp, Homo sapien
acagtgcaagattttgtaaattctt

SEQ ID NO: 501092 - DNA, 25 bp, Homo sapien
gcttaaattactgaagtacctggga

SEQ ID NO: 501093 - DNA, 25 bp, Homo sapien
aattactgaagtacctgggagaagt

SEQ ID NO: 501094 - DNA, 25 bp, Homo sapien
gtaaaattaaacttcggagcacaat

SEQ ID NO: 501095 - DNA, 25 bp, Homo sapien
ttaaacttcggagcacaatgaaatg

SEQ ID NO: 501096 - DNA, 25 bp, Homo sapien
tgaaatgccgattatttttaccttg

SEQ ID NO: 501097 - DNA, 25 bp, Homo sapien
gtttatgtgttcaaaatgccttggt

SEQ ID NO: 501098 - DNA, 25 bp, Homo sapien
aaaatgccttggtaaattggatgac

SEQ ID NO: 501099 - DNA, 25 bp, Homo sapien
gccttggtaaattggatgacctcta

SEQ ID NO: 501100 - DNA, 25 bp, Homo sapien
gggaagttcctcttggaaaagatat

SEQ ID NO: 501101 - DNA, 25 bp, Homo sapien
aaggtggtgtgagcatcaggtatat

SEQ ID NO: 501102 - DNA, 25 bp, Homo sapien
agaaaggaactctttgcctgaactg

SEQ ID NO: 501103 - DNA, 25 bp, Homo sapien
ctttgcctgaactgggcttggtttt

SEQ ID NO: 501104 - DNA, 25 bp, Homo sapien
ggcttggttttccaagtgctgcttt

SEQ ID NO: 501105 - DNA, 25 bp, Homo sapien
gaagacccagagatgcagagcttat

SEQ ID NO: 501106 - DNA, 25 bp, Homo sapien
gagatgcagagcttatggtagttca

SEQ ID NO: 501107 - DNA, 25 bp, Homo sapien
gcttatggtagttcataaatcttca

SEQ ID NO: 501108 - DNA, 25 bp, Homo sapien
cataaatcttcatgttctattatct

SEQ ID NO: 501109 - DNA, 25 bp, Homo sapien
ctattatctttcatctgccaataaa

SEQ ID NO: 501110 - DNA, 25 bp, Homo sapien
attttcaataatgtccaccattgct

SEQ ID NO: 501111 - DNA, 25 bp, Homo sapien
aacagtgtatccatcacgttagccc

SEQ ID NO: 501112 - DNA, 25 bp, Homo sapien
agtgtatccatcacgttagccctgc

SEQ ID NO: 501113 - DNA, 25 bp, Homo sapien
tgtatccatcacgttagccctgctg

SEQ ID NO: 501114 - DNA, 25 bp, Homo sapien
gggaagggacccacattcacctgcc

SEQ ID NO: 501115 - DNA, 25 bp, Homo sapien
ctgccccttgatcccatatctatta

SEQ ID NO: 501116 - DNA, 25 bp, Homo sapien
atctattaccgtgtccataggaata

SEQ ID NO: 501117 - DNA, 25 bp, Homo sapien
taccgtgtccataggaataataggt

SEQ ID NO: 501118 - DNA, 25 bp, Homo sapien
aataataggtaagggctctgtctct

SEQ ID NO: 501119 - DNA, 25 bp, Homo sapien
ataggtaagggctctgtctctgtca

SEQ ID NO: 501120 - DNA, 25 bp, Homo sapien
aggtaagggctctgtctctgtcaag

SEQ ID NO: 501121 - DNA, 25 bp, Homo sapien
taagggctctgtctctgtcaagcca

SEQ ID NO: 501122 - DNA, 25 bp, Homo sapien
gaaatccgatacatatacagcctac

SEQ ID NO: 501123 - DNA, 25 bp, Homo sapien
gatacatatacagcctacagtgcaa

SEQ ID NO: 501124 - DNA, 25 bp, Homo sapien
acagcctacagtgcaaaatatttaa

SEQ ID NO: 501125 - DNA, 25 bp, Homo sapien
aactacatacaaagttgtgatcaac

SEQ ID NO: 501126 - DNA, 25 bp, Homo sapien
atcaacagcatcctaagataaatat

SEQ ID NO: 501127 - DNA, 25 bp, Homo sapien
aaggatatactttgaggtgtacaga

SEQ ID NO: 501128 - DNA, 25 bp, Homo sapien
tgaggtgtacagattaagcatataa

SEQ ID NO: 501129 - DNA, 25 bp, Homo sapien
agagttgctttgttatgccttcagc

SEQ ID NO: 501130 - DNA, 25 bp, Homo sapien
gctttgttatgccttcagcaaatag

SEQ ID NO: 501131 - DNA, 25 bp, Homo sapien
tgccttcagcaaatagcttcatttt

SEQ ID NO: 501132 - DNA, 25 bp, Homo sapien
cttcattttgccaatactgaataaa

SEQ ID NO: 501133 - DNA, 25 bp, Homo sapien
tagcctgactgcgtgtctgcccatg

SEQ ID NO: 501134 - DNA, 25 bp, Homo sapien
tgactgcgtgtctgcccatgcaggg

SEQ ID NO: 501135 - DNA, 25 bp, Homo sapien
gcccatgcaggggaacacggtgctc

SEQ ID NO: 501136 - DNA, 25 bp, Homo sapien
agcctcggcgtttgcacagtccctg

SEQ ID NO: 501137 - DNA, 25 bp, Homo sapien
gcgtttgcacagtccctgcctgagg

SEQ ID NO: 501138 - DNA, 25 bp, Homo sapien
ttgcacagtccctgcctgaggcctg

SEQ ID NO: 501139 - DNA, 25 bp, Homo sapien
ctgacctccgttctgcctctggtgg

SEQ ID NO: 501140 - DNA, 25 bp, Homo sapien
aggtgagtcctgacagtgcctctcc

SEQ ID NO: 501141 - DNA, 25 bp, Homo sapien
ggcctccaaggaaagtattttgaca

SEQ ID NO: 501142 - DNA, 25 bp, Homo sapien
gaaagtattttgacatctctctctc

SEQ ID NO: 501143 - DNA, 25 bp, Homo sapien
ctctctctcttctgtttttattgac

SEQ ID NO: 501144 - DNA, 25 bp, Homo sapien
agcacaccaagcactggcggacaga

SEQ ID NO: 501145 - DNA, 25 bp, Homo sapien
gcggacagacaattggaaaaccatt

SEQ ID NO: 501146 - DNA, 25 bp, Homo sapien
tccccggcttggtcagaggtcagtt

SEQ ID NO: 501147 - DNA, 25 bp, Homo sapien
gcttggtcagaggtcagttctttat

SEQ ID NO: 501148 - DNA, 25 bp, Homo sapien
ggtcagttctttatcagactccaca

SEQ ID NO: 501149 - DNA, 25 bp, Homo sapien
agactccacaaggacgagactgaca

SEQ ID NO: 501150 - DNA, 25 bp, Homo sapien
gactgacaagcgagtctgactactc

SEQ ID NO: 501151 - DNA, 25 bp, Homo sapien
gagtctgactactcctctgagggct

SEQ ID NO: 501152 - DNA, 25 bp, Homo sapien
gctccagtgtggaatcgctgaagcc

SEQ ID NO: 501153 - DNA, 25 bp, Homo sapien
ggagcacaggaagcgagcctccctg

SEQ ID NO: 501154 - DNA, 25 bp, Homo sapien
agcgagcctccctgtcggagaagaa

SEQ ID NO: 501155 - DNA, 25 bp, Homo sapien
agggccatttgcttgcattactttg

SEQ ID NO: 501156 - DNA, 25 bp, Homo sapien
gaatttaatgttgcgcttgtgcact

SEQ ID NO: 501157 - DNA, 25 bp, Homo sapien
gttgcgcttgtgcactgtgttaata

SEQ ID NO: 501158 - DNA, 25 bp, Homo sapien
tggattggacgttgtgactcttgcc

SEQ ID NO: 501159 - DNA, 25 bp, Homo sapien
acgttgtgactcttgccttttaaga

SEQ ID NO: 501160 - DNA, 25 bp, Homo sapien
ttgaagctcttaaaatgtacatatt

SEQ ID NO: 501161 - DNA, 25 bp, Homo sapien
ggttcttctatctcaaattatttaa

SEQ ID NO: 501162 - DNA, 25 bp, Homo sapien
aataattctatgcaattttgtggca

SEQ ID NO: 501163 - DNA, 25 bp, Homo sapien
aattttgtggcatgatgtttcttcc

SEQ ID NO: 501164 - DNA, 25 bp, Homo sapien
gatgtttcttccacttgtaatttta

SEQ ID NO: 501165 - DNA, 25 bp, Homo sapien
ttatgtgctttcatcacaaatccaa

SEQ ID NO: 501166 - DNA, 25 bp, Homo sapien
ttgctgtgtcaacctacaagatagt

SEQ ID NO: 501167 - DNA, 25 bp, Homo sapien
gattcttggaagttggtatggacca

SEQ ID NO: 501168 - DNA, 25 bp, Homo sapien
gtatggaccagaaagcattcccagg

SEQ ID NO: 501169 - DNA, 25 bp, Homo sapien
gcattcccaggacatttaggctatg

SEQ ID NO: 501170 - DNA, 25 bp, Homo sapien
taggctatggctgagttctctaaga

SEQ ID NO: 501171 - DNA, 25 bp, Homo sapien
gttctctaagactcagggtgggaat

SEQ ID NO: 501172 - DNA, 25 bp, Homo sapien
gggtgggaattataatccctggtct

SEQ ID NO: 501173 - DNA, 25 bp, Homo sapien
aatccctggtctaagctgatatgaa

SEQ ID NO: 501174 - DNA, 25 bp, Homo sapien
ggagttatatgctttgagattttct

SEQ ID NO: 501175 - DNA, 25 bp, Homo sapien
gagattttctgccagttaaactaaa

SEQ ID NO: 501176 - DNA, 25 bp, Homo sapien
ccccactgtatactgtaaacatctt

SEQ ID NO: 501177 - DNA, 25 bp, Homo sapien
gactggaaagaggagcttttcttcc

SEQ ID NO: 501178 - DNA, 25 bp, Homo sapien
ttcttccaggcatgttccagtttca

SEQ ID NO: 501179 - DNA, 25 bp, Homo sapien
ggcatgttccagtttcaccctaaga

SEQ ID NO: 501180 - DNA, 25 bp, Homo sapien
ttcaccctaagactgaccttcaaat

SEQ ID NO: 501181 - DNA, 25 bp, Homo sapien
gaccttcaaataatcaggttgtact

SEQ ID NO: 501182 - DNA, 25 bp, Homo sapien
gtcatcgagatgatagcttttttcc

SEQ ID NO: 501183 - DNA, 25 bp, Homo sapien
agagcaataaactccaggtcttata

SEQ ID NO: 501184 - DNA, 25 bp, Homo sapien
aactccaggtcttataagaatgtac

SEQ ID NO: 501185 - DNA, 25 bp, Homo sapien
gtacatacaataaaggtggtgccag

SEQ ID NO: 501186 - DNA, 25 bp, Homo sapien
aataaaggtggtgccagcagttttt

SEQ ID NO: 501187 - DNA, 25 bp, Homo sapien
ctaaagagtcacatgtagaaaagcc

SEQ ID NO: 501188 - DNA, 25 bp, Homo sapien
attaattttcggtcatttcaaatga

SEQ ID NO: 501189 - DNA, 25 bp, Homo sapien
catttcaaatgaggtatatttctta

SEQ ID NO: 501190 - DNA, 25 bp, Homo sapien
tgtcctcaaagcaacgtttcccacc

SEQ ID NO: 501191 - DNA, 25 bp, Homo sapien
ccacctccttttactgagtactgaa

SEQ ID NO: 501192 - DNA, 25 bp, Homo sapien
gaaaaagttttagcaaagtcacaga

SEQ ID NO: 501193 - DNA, 25 bp, Homo sapien
gcaaagtcacagattaggttgaatt

SEQ ID NO: 501194 - DNA, 25 bp, Homo sapien
gttaccaataacttccatcaaagca

SEQ ID NO: 501195 - DNA, 25 bp, Homo sapien
ataacttccatcaaagcagagtagg

SEQ ID NO: 501196 - DNA, 25 bp, Homo sapien
agcagagtaggatatatggtaacat

SEQ ID NO: 501197 - DNA, 25 bp, Homo sapien
atatggtaacattaattttcggtca

SEQ ID NO: 501198 - DNA, 25 bp, Homo sapien
gtaacattaattttcggtcatttca

SEQ ID NO: 501199 - DNA, 25 bp, Homo sapien
gccacactagctgcttttgttgtta

SEQ ID NO: 501200 - DNA, 25 bp, Homo sapien
taaataggctagtttcttctgcttc

SEQ ID NO: 501201 - DNA, 25 bp, Homo sapien
cttctgcttcaagggttttcagctc

SEQ ID NO: 501202 - DNA, 25 bp, Homo sapien
aagggttttcagctcattctcactc

SEQ ID NO: 501203 - DNA, 25 bp, Homo sapien
attctcactctctggtatatgcatc

SEQ ID NO: 501204 - DNA, 25 bp, Homo sapien
tggtatatgcatcccaaggccggct

SEQ ID NO: 501205 - DNA, 25 bp, Homo sapien
aaggccggctccttatcctctgggt

SEQ ID NO: 501206 - DNA, 25 bp, Homo sapien
ttatcctctgggttcggtgttgcct

SEQ ID NO: 501207 - DNA, 25 bp, Homo sapien
ggtgttgcctcctcagaatagcagc

SEQ ID NO: 501208 - DNA, 25 bp, Homo sapien
ttttaaccactgtcccctattcaat

SEQ ID NO: 501209 - DNA, 25 bp, Homo sapien
actgtcccctattcaatgctttctt

SEQ ID NO: 501210 - DNA, 25 bp, Homo sapien
ttccacatgggatggtacattatgt

SEQ ID NO: 501211 - DNA, 25 bp, Homo sapien
cacatgggatggtacattatgtaca

SEQ ID NO: 501212 - DNA, 25 bp, Homo sapien
tagagaaccttcgagggaggctctg

SEQ ID NO: 501213 - DNA, 25 bp, Homo sapien
ctgcctcccggaactgaaatcctgt

SEQ ID NO: 501214 - DNA, 25 bp, Homo sapien
gcctcccggaactgaaatcctgtct

SEQ ID NO: 501215 - DNA, 25 bp, Homo sapien
atacattctgattatttgatagcca

SEQ ID NO: 501216 - DNA, 25 bp, Homo sapien
tgattatttgatagccaggtgtttg

SEQ ID NO: 501217 - DNA, 25 bp, Homo sapien
gccaggtgtttggattaaggttgcc

SEQ ID NO: 501218 - DNA, 25 bp, Homo sapien
tgtttggattaaggttgcccccctg

SEQ ID NO: 501219 - DNA, 25 bp, Homo sapien
aggtccccgacaagagggatggatt

SEQ ID NO: 501220 - DNA, 25 bp, Homo sapien
gtccccgacaagagggatggatttt

SEQ ID NO: 501221 - DNA, 25 bp, Homo sapien
cagcactttgcgacctgcggcccag

SEQ ID NO: 501222 - DNA, 25 bp, Homo sapien
agccagcagcccctgtgtttactgt

SEQ ID NO: 501223 - DNA, 25 bp, Homo sapien
gcagcccctgtgtttactgtcgtca

SEQ ID NO: 501224 - DNA, 25 bp, Homo sapien
tactgtcgtcagaaaggtcttgtgt

SEQ ID NO: 501225 - DNA, 25 bp, Homo sapien
gtcagaaaggtcttgtgttttggtt

SEQ ID NO: 501226 - DNA, 25 bp, Homo sapien
attatttcatccaaatctcccgtta

SEQ ID NO: 501227 - DNA, 25 bp, Homo sapien
atttcatccaaatctcccgttatat

SEQ ID NO: 501228 - DNA, 25 bp, Homo sapien
tcatccaaatctcccgttatatatc

SEQ ID NO: 501229 - DNA, 25 bp, Homo sapien
aaatctcccgttatatatctgtgaa

SEQ ID NO: 501230 - DNA, 25 bp, Homo sapien
gacaaataagtcatcatgatcacga

SEQ ID NO: 501231 - DNA, 25 bp, Homo sapien
tcatcatgatcacgaaggacactga

SEQ ID NO: 501232 - DNA, 25 bp, Homo sapien
tttggactcttctagtaataacgta

SEQ ID NO: 501233 - DNA, 25 bp, Homo sapien
ttggactcttctagtaataacgtag

SEQ ID NO: 501234 - DNA, 25 bp, Homo sapien
tggactcttctagtaataacgtagc

SEQ ID NO: 501235 - DNA, 25 bp, Homo sapien
ggactcttctagtaataacgtagct

SEQ ID NO: 501236 - DNA, 25 bp, Homo sapien
gactcttctagtaataacgtagctt

SEQ ID NO: 501237 - DNA, 25 bp, Homo sapien
actcttctagtaataacgtagctta

SEQ ID NO: 501238 - DNA, 25 bp, Homo sapien
ctcttctagtaataacgtagcttaa

SEQ ID NO: 501239 - DNA, 25 bp, Homo sapien
tcttctagtaataacgtagcttaaa

SEQ ID NO: 501240 - DNA, 25 bp, Homo sapien
cttaaaacacacattgcatagctgt

SEQ ID NO: 501241 - DNA, 25 bp, Homo sapien
accaagacaaacacactagcctagg

SEQ ID NO: 501242 - DNA, 25 bp, Homo sapien
ccaagacaaacacactagcctaggc

SEQ ID NO: 501243 - DNA, 25 bp, Homo sapien
gcctggcagcaggtgcaacagcagc

SEQ ID NO: 501244 - DNA, 25 bp, Homo sapien
ctggcagcaggtgcaacagcagctg

SEQ ID NO: 501245 - DNA, 25 bp, Homo sapien
ggccaaggcctgtgcagtacgtgga

SEQ ID NO: 501246 - DNA, 25 bp, Homo sapien
gcagtacgtggagaggacccccaat

SEQ ID NO: 501247 - DNA, 25 bp, Homo sapien
caatccccggctgcagaactttgtg

SEQ ID NO: 501248 - DNA, 25 bp, Homo sapien
gctgcagaactttgtgcccattgac

SEQ ID NO: 501249 - DNA, 25 bp, Homo sapien
gcagaactttgtgcccattgaccta

SEQ ID NO: 501250 - DNA, 25 bp, Homo sapien
gaactttgtgcccattgacctagac

SEQ ID NO: 501251 - DNA, 25 bp, Homo sapien
tttgtgcccattgacctagacgagt

SEQ ID NO: 501252 - DNA, 25 bp, Homo sapien
acctagacgagtggtgggcgcagca

SEQ ID NO: 501253 - DNA, 25 bp, Homo sapien
gggcgcagcagttcctggcgagaat

SEQ ID NO: 501254 - DNA, 25 bp, Homo sapien
cggagttcgtcgtcccggatctgac

SEQ ID NO: 501255 - DNA, 25 bp, Homo sapien
tcgtcccggatctgaccggcttcaa

SEQ ID NO: 501256 - DNA, 25 bp, Homo sapien
agctcaagccctacgtgagctacct

SEQ ID NO: 501257 - DNA, 25 bp, Homo sapien
tacgtgagctacctcgcccctgaga

SEQ ID NO: 501258 - DNA, 25 bp, Homo sapien
tacctcgcccctgagagcgaggaga

SEQ ID NO: 501259 - DNA, 25 bp, Homo sapien
cgcgcagctcttcagcgaagccgtg

SEQ ID NO: 501260 - DNA, 25 bp, Homo sapien
cgcctgccatcgaaaaggacttcaa

SEQ ID NO: 501261 - DNA, 25 bp, Homo sapien
ctgccatcgaaaaggacttcaagga

SEQ ID NO: 501262 - DNA, 25 bp, Homo sapien
catcgaaaaggacttcaaggacggt

SEQ ID NO: 501263 - DNA, 25 bp, Homo sapien
agggaaagctcttccagctctaccc

SEQ ID NO: 501264 - DNA, 25 bp, Homo sapien
caggaacttcctgcgctagctgggc

SEQ ID NO: 501265 - DNA, 25 bp, Homo sapien
catcataattgctagggtgtaccag

SEQ ID NO: 501266 - DNA, 25 bp, Homo sapien
ggtgtaccaggcaatcttgcagcct

SEQ ID NO: 501267 - DNA, 25 bp, Homo sapien
cttaggtattcctttgtagcaaagc

SEQ ID NO: 501268 - DNA, 25 bp, Homo sapien
ttgcagcctggcacaagctattgag

SEQ ID NO: 501269 - DNA, 25 bp, Homo sapien
aagctattgagtaactatcgctata

SEQ ID NO: 501270 - DNA, 25 bp, Homo sapien
atcgctataggcatttttaagtacg

SEQ ID NO: 501271 - DNA, 25 bp, Homo sapien
ttaagtacgattctcttgttttcca

SEQ ID NO: 501272 - DNA, 25 bp, Homo sapien
catttgtgtggtggcctattttcta

SEQ ID NO: 501273 - DNA, 25 bp, Homo sapien
tattttctatgcatgcagccacctt

SEQ ID NO: 501274 - DNA, 25 bp, Homo sapien
aaaagcctaatacaagagtggtctg

SEQ ID NO: 501275 - DNA, 25 bp, Homo sapien
ctctcatgaaaactctacctgcaca

SEQ ID NO: 501276 - DNA, 25 bp, Homo sapien
tggagggctactttgtgcccctgca

SEQ ID NO: 501277 - DNA, 25 bp, Homo sapien
tgaccccggacagctttgaacagaa

SEQ ID NO: 501278 - DNA, 25 bp, Homo sapien
cagaaggtcttgaatgtctcctttg

SEQ ID NO: 501279 - DNA, 25 bp, Homo sapien
tcctttgcctttgagctcatgcaag

SEQ ID NO: 501280 - DNA, 25 bp, Homo sapien
ttggaaaagccaaaaccgcggccag

SEQ ID NO: 501281 - DNA, 25 bp, Homo sapien
aaccgcggccagaagacatagtcaa

SEQ ID NO: 501282 - DNA, 25 bp, Homo sapien
agacatagtcaactgtgacctgaaa

SEQ ID NO: 501283 - DNA, 25 bp, Homo sapien
tgacctgaaatctacactacgagtg

SEQ ID NO: 501284 - DNA, 25 bp, Homo sapien
gagtgttgtacaacctcttcaccaa

SEQ ID NO: 501285 - DNA, 25 bp, Homo sapien
ctcttcaccaagtaccgtaacgtgg

SEQ ID NO: 501286 - DNA, 25 bp, Homo sapien
ccaagagttcttgctgttggcgtac

SEQ ID NO: 501287 - DNA, 25 bp, Homo sapien
actgagacgcagctgtgtgaaatat

SEQ ID NO: 501288 - DNA, 25 bp, Homo sapien
gacgcagctgtgtgaaatatgattt

SEQ ID NO: 501289 - DNA, 25 bp, Homo sapien
agtcgggatcctgcacctggtcagg

SEQ ID NO: 501290 - DNA, 25 bp, Homo sapien
ggatcctgcacctggtcaggagaga

SEQ ID NO: 501291 - DNA, 25 bp, Homo sapien
tcctgcacctggtcaggagagagaa

SEQ ID NO: 501292 - DNA, 25 bp, Homo sapien
gaagatcagggtgcagctgagactc

SEQ ID NO: 501293 - DNA, 25 bp, Homo sapien
gaatgccctggagttgtgagggtgt

SEQ ID NO: 501294 - DNA, 25 bp, Homo sapien
tgtgagggtcgcgttcctgctgtct

SEQ ID NO: 501295 - DNA, 25 bp, Homo sapien
tttttctgtcccactgagacgcagc

SEQ ID NO: 501296 - DNA, 25 bp, Homo sapien
ttctgtcccactgagacgcagctgt

SEQ ID NO: 501297 - DNA, 25 bp, Homo sapien
gtcccactgagacgcagctgtgtga

SEQ ID NO: 501298 - DNA, 25 bp, Homo sapien
aggcctgattaagatggtccatcta

SEQ ID NO: 501299 - DNA, 25 bp, Homo sapien
ggtccatctactggtcttgtcaggt

SEQ ID NO: 501300 - DNA, 25 bp, Homo sapien
aaatgtgggtgaccttcgtctcagg

SEQ ID NO: 501301 - DNA, 25 bp, Homo sapien
tctcaggcttcctgcttttccgaag

SEQ ID NO: 501302 - DNA, 25 bp, Homo sapien
gacataccttcggactagtgcagag

SEQ ID NO: 501303 - DNA, 25 bp, Homo sapien
ctccatgggctgtgccttcatcaac

SEQ ID NO: 501304 - DNA, 25 bp, Homo sapien
ttcatcaacctctgcatcttggctt

SEQ ID NO: 501305 - DNA, 25 bp, Homo sapien
gcttcacagcatgcttgggctcagc

SEQ ID NO: 501306 - DNA, 25 bp, Homo sapien
atgcttgggctcagctcacattctg

SEQ ID NO: 501307 - DNA, 25 bp, Homo sapien
attctgggaggccagccagctttac

SEQ ID NO: 501308 - DNA, 25 bp, Homo sapien
tgagccttacgctggccactgtcaa

SEQ ID NO: 501309 - DNA, 25 bp, Homo sapien
agcctggacaacaatgtgagattgt

SEQ ID NO: 501310 - DNA, 25 bp, Homo sapien
aacaatgtgagattgtggctccaaa

SEQ ID NO: 501311 - DNA, 25 bp, Homo sapien
aatgtgagattgtggctccaaaaaa

SEQ ID NO: 501312 - DNA, 25 bp, Homo sapien
atctcatctataaggcatgaaagta

SEQ ID NO: 501313 - DNA, 25 bp, Homo sapien
aagtagaattttacaagttgtacag

SEQ ID NO: 501314 - DNA, 25 bp, Homo sapien
atagaaggcttggagtggacactac

SEQ ID NO: 501315 - DNA, 25 bp, Homo sapien
gaaggcttggagtggacactacatt

SEQ ID NO: 501316 - DNA, 25 bp, Homo sapien
ggcttggagtggacactacattaaa

SEQ ID NO: 501317 - DNA, 25 bp, Homo sapien
ggagtggacactacattaaaaggat

SEQ ID NO: 501318 - DNA, 25 bp, Homo sapien
gtggacactacattaaaaggataaa

SEQ ID NO: 501319 - DNA, 25 bp, Homo sapien
aggcagaggcaggcatctatagtcc

SEQ ID NO: 501320 - DNA, 25 bp, Homo sapien
acactacctagaaaagccattcagt

SEQ ID NO: 501321 - DNA, 25 bp, Homo sapien
agccattcagtactggctctagtcc

SEQ ID NO: 501322 - DNA, 25 bp, Homo sapien
ctctagtccccgtgagatgtaaaga

SEQ ID NO: 501323 - DNA, 25 bp, Homo sapien
actgcccattttaccagctcacatt

SEQ ID NO: 501324 - DNA, 25 bp, Homo sapien
cccatcagcttggaagggtgctaga

SEQ ID NO: 501325 - DNA, 25 bp, Homo sapien
aagggtgctagaggcccatcaagga

SEQ ID NO: 501326 - DNA, 25 bp, Homo sapien
agggcttctgccattatagggttgt

SEQ ID NO: 501327 - DNA, 25 bp, Homo sapien
ttatagggttgtgccttgctagtca

SEQ ID NO: 501328 - DNA, 25 bp, Homo sapien
gggccaaaatgtcccctggctctgc

SEQ ID NO: 501329 - DNA, 25 bp, Homo sapien
gctctgctccctagggtgattctaa

SEQ ID NO: 501330 - DNA, 25 bp, Homo sapien
ggtgattctaacagcccagggtcct

SEQ ID NO: 501331 - DNA, 25 bp, Homo sapien
gacctgaaccaatcactctatacat

SEQ ID NO: 501332 - DNA, 25 bp, Homo sapien
atcactctatacatctttagatacg

SEQ ID NO: 501333 - DNA, 25 bp, Homo sapien
acatctttagatacgttgtctgttt

SEQ ID NO: 501334 - DNA, 25 bp, Homo sapien
tacgttgtctgttttcaaatgggca

SEQ ID NO: 501335 - DNA, 25 bp, Homo sapien
gtctgttttcaaatgggcatggcaa

SEQ ID NO: 501336 - DNA, 25 bp, Homo sapien
aatgggcatggcaaggatgcataca

SEQ ID NO: 501337 - DNA, 25 bp, Homo sapien
ggcaaggatgcatacatttccctcc

SEQ ID NO: 501338 - DNA, 25 bp, Homo sapien
aaggatgcatacatttccctccttt

SEQ ID NO: 501339 - DNA, 25 bp, Homo sapien
gaaacagtacattgttcaggaaaac

SEQ ID NO: 501340 - DNA, 25 bp, Homo sapien
caaattgtagttttgctgcccgcca

SEQ ID NO: 501341 - DNA, 25 bp, Homo sapien
attgtagttttgctgcccgccacca

SEQ ID NO: 501342 - DNA, 25 bp, Homo sapien
ctaggtttatagagtgatgtaattc

SEQ ID NO: 501343 - DNA, 25 bp, Homo sapien
tagagtgatgtaattcaactgaaga

SEQ ID NO: 501344 - DNA, 25 bp, Homo sapien
aaggaggtatccattgattctttta

SEQ ID NO: 501345 - DNA, 25 bp, Homo sapien
gaggtatccattgattcttttatat

SEQ ID NO: 501346 - DNA, 25 bp, Homo sapien
gttatttttatagctcttcacatat

SEQ ID NO: 501347 - DNA, 25 bp, Homo sapien
aagagctttcatgtacatttacgtg

SEQ ID NO: 501348 - DNA, 25 bp, Homo sapien
gctttcatgtacatttacgtgttta

SEQ ID NO: 501349 - DNA, 25 bp, Homo sapien
ttacccaacaatcttgtgaagttga

SEQ ID NO: 501350 - DNA, 25 bp, Homo sapien
agatatattgaaactttcttaggac

SEQ ID NO: 501351 - DNA, 25 bp, Homo sapien
ctttcttaggacatgtagcaagtaa

SEQ ID NO: 501352 - DNA, 25 bp, Homo sapien
atgtagcaagtaaacagtggagccc

SEQ ID NO: 501353 - DNA, 25 bp, Homo sapien
aattatattccattcccagagagag

SEQ ID NO: 501354 - DNA, 25 bp, Homo sapien
agaatgcgctttggattgtttagtc

SEQ ID NO: 501355 - DNA, 25 bp, Homo sapien
gattgtttagtcctctgattaacga

SEQ ID NO: 501356 - DNA, 25 bp, Homo sapien
ctcttcctgccaagaactaggtgaa

SEQ ID NO: 501357 - DNA, 25 bp, Homo sapien
attgcatatgcaagccctggccaca

SEQ ID NO: 501358 - DNA, 25 bp, Homo sapien
tggccacagctgcacttacaggatg

SEQ ID NO: 501359 - DNA, 25 bp, Homo sapien
ttacaggatgcctcatagacgatga

SEQ ID NO: 501360 - DNA, 25 bp, Homo sapien
aaaggccaacccgaggctggcagat

SEQ ID NO: 501361 - DNA, 25 bp, Homo sapien
ggctggcagatctgaccccaaggag

SEQ ID NO: 501362 - DNA, 25 bp, Homo sapien
tgagcctttgccattcactacttac

SEQ ID NO: 501363 - DNA, 25 bp, Homo sapien
agtttgtttctggaggattttcctg

SEQ ID NO: 501364 - DNA, 25 bp, Homo sapien
ttcttctaccgactgctaggcacac

SEQ ID NO: 501365 - DNA, 25 bp, Homo sapien
actgctaggcacaccagtgggttca

SEQ ID NO: 501366 - DNA, 25 bp, Homo sapien
ttgaaagaggcccttgcaccgggct

SEQ ID NO: 501367 - DNA, 25 bp, Homo sapien
ttgcaccgggctttgcaaggaagcc

SEQ ID NO: 501368 - DNA, 25 bp, Homo sapien
agactagaatcctgcgatctggtga

SEQ ID NO: 501369 - DNA, 25 bp, Homo sapien
gatctggtgagactgccgccttaaa

SEQ ID NO: 501370 - DNA, 25 bp, Homo sapien
gactgccgccttaaaatgcaccaaa

SEQ ID NO: 501371 - DNA, 25 bp, Homo sapien
gcaccaaacagtttttgaacctgga

SEQ ID NO: 501372 - DNA, 25 bp, Homo sapien
aaaacatctgcaagactgccaccgt

SEQ ID NO: 501373 - DNA, 25 bp, Homo sapien
actgccaccgtgtatttttctcaag

SEQ ID NO: 501374 - DNA, 25 bp, Homo sapien
agtaacaggctatccacagttttgg

SEQ ID NO: 501375 - DNA, 25 bp, Homo sapien
atacgtgtatgtgctggtctcatcc

SEQ ID NO: 501376 - DNA, 25 bp, Homo sapien
tttgtgcaaatgaacttctcctttt

SEQ ID NO: 501377 - DNA, 25 bp, Homo sapien
ttctccttttgaccagtaaccacct

SEQ ID NO: 501378 - DNA, 25 bp, Homo sapien
tgaccagtaaccaccttccttcaag

SEQ ID NO: 501379 - DNA, 25 bp, Homo sapien
aagtctcagatctcgaccattgaaa

SEQ ID NO: 501380 - DNA, 25 bp, Homo sapien
gatctcgaccattgaaaaggtttct

SEQ ID NO: 501381 - DNA, 25 bp, Homo sapien
aaaggtttcttcatctgggtcttgc

SEQ ID NO: 501382 - DNA, 25 bp, Homo sapien
cttcatctgggtcttgcaggaggca

SEQ ID NO: 501383 - DNA, 25 bp, Homo sapien
tcttgcaggaggcaggcaacaccag

SEQ ID NO: 501384 - DNA, 25 bp, Homo sapien
gcaacaccaggagcagaaatgaaag

SEQ ID NO: 501385 - DNA, 25 bp, Homo sapien
agaagtgctatgtggcgagaaaaaa

SEQ ID NO: 501386 - DNA, 25 bp, Homo sapien
gctagggtgctttttgtgctgaatt

SEQ ID NO: 501387 - DNA, 25 bp, Homo sapien
agggtgctttttgtgctgaattctc

SEQ ID NO: 501388 - DNA, 25 bp, Homo sapien
gaattctccacattgttaactgcca

SEQ ID NO: 501389 - DNA, 25 bp, Homo sapien
ttctccacattgttaactgccaaag

SEQ ID NO: 501390 - DNA, 25 bp, Homo sapien
cacattgttaactgccaaagctagt

SEQ ID NO: 501391 - DNA, 25 bp, Homo sapien
gttaactgccaaagctagttttaga

SEQ ID NO: 501392 - DNA, 25 bp, Homo sapien
actgccaaagctagttttagagaat

SEQ ID NO: 501393 - DNA, 25 bp, Homo sapien
agcaaaatactcccaggtctcactc

SEQ ID NO: 501394 - DNA, 25 bp, Homo sapien
tgtgatcgaatggtatatattagaa

SEQ ID NO: 501395 - DNA, 25 bp, Homo sapien
tatattagaaattacatctgttgta

SEQ ID NO: 501396 - DNA, 25 bp, Homo sapien
gtgagcaattaaacatggttgactt

SEQ ID NO: 501397 - DNA, 25 bp, Homo sapien
ttctcacggacagacaggtggtgct

SEQ ID NO: 501398 - DNA, 25 bp, Homo sapien
aggcggtggttgacagagtcaccca

SEQ ID NO: 501399 - DNA, 25 bp, Homo sapien
agagtcacccaccaggtggatgctg

SEQ ID NO: 501400 - DNA, 25 bp, Homo sapien
gtggatgctggcacccatgatgaag

SEQ ID NO: 501401 - DNA, 25 bp, Homo sapien
agatgatgatgctcacgtacgtgat

SEQ ID NO: 501402 - DNA, 25 bp, Homo sapien
gggaccgctcgatgagcttgagcaa

SEQ ID NO: 501403 - DNA, 25 bp, Homo sapien
taggccatgtggaagtagtccccaa

SEQ ID NO: 501404 - DNA, 25 bp, Homo sapien
tagtccccaacactgggcttgttga

SEQ ID NO: 501405 - DNA, 25 bp, Homo sapien
ctgggcttgttgagtggaaaccact

SEQ ID NO: 501406 - DNA, 25 bp, Homo sapien
ccactcgagagggaataccagcatg

SEQ ID NO: 501407 - DNA, 25 bp, Homo sapien
accagcatggcaatgggacgcccaa

SEQ ID NO: 501408 - DNA, 25 bp, Homo sapien
aagttggtctctgcagatgactgta

SEQ ID NO: 501409 - DNA, 25 bp, Homo sapien
gatgactgtaaatgactacctggag

SEQ ID NO: 501410 - DNA, 25 bp, Homo sapien
ctacctggaggtcgattaaagtgcg

SEQ ID NO: 501411 - DNA, 25 bp, Homo sapien
aagtgcggtactgcgggattcagcc

SEQ ID NO: 501412 - DNA, 25 bp, Homo sapien
ggattcagccgatttccttcttcct

SEQ ID NO: 501413 - DNA, 25 bp, Homo sapien
ttcttcctctgactgcccggaaata

SEQ ID NO: 501414 - DNA, 25 bp, Homo sapien
gactgcccggaaatatcagccaaag

SEQ ID NO: 501415 - DNA, 25 bp, Homo sapien
tctaaggacatatggaattggctat

SEQ ID NO: 501416 - DNA, 25 bp, Homo sapien
taattcatatgctttcaatcaacga

SEQ ID NO: 501417 - DNA, 25 bp, Homo sapien
caatcaacgaagcacatgtaatgga

SEQ ID NO: 501418 - DNA, 25 bp, Homo sapien
aacaacttccttgtatcagaagatc

SEQ ID NO: 501419 - DNA, 25 bp, Homo sapien
gaataagtttttcttacttgtcatc

SEQ ID NO: 501420 - DNA, 25 bp, Homo sapien
gtttttcttacttgtcatcttaatt

SEQ ID NO: 501421 - DNA, 25 bp, Homo sapien
gtcatcttaatttgtttaggtttct

SEQ ID NO: 501422 - DNA, 25 bp, Homo sapien
gaataaatgatgtttgctctgaaga

SEQ ID NO: 501423 - DNA, 25 bp, Homo sapien
taaatgatgtttgctctgaagagaa

SEQ ID NO: 501424 - DNA, 25 bp, Homo sapien
gaagagaattgatgaccaactagaa

SEQ ID NO: 501425 - DNA, 25 bp, Homo sapien
aaaattctcctatgtgttggatgca

SEQ ID NO: 501426 - DNA, 25 bp, Homo sapien
tctcctatgtgttggatgcattaaa

SEQ ID NO: 501427 - DNA, 25 bp, Homo sapien
tacaaaattctatccttaaccttct

SEQ ID NO: 501428 - DNA, 25 bp, Homo sapien
aataattctggagtaacaatcgacc

SEQ ID NO: 501429 - DNA, 25 bp, Homo sapien
tctggagtaacaatcgaccatgctt

SEQ ID NO: 501430 - DNA, 25 bp, Homo sapien
ttcccttaatacctgggtgttgtat

SEQ ID NO: 501431 - DNA, 25 bp, Homo sapien
acctgggtgttgtattagatctcat

SEQ ID NO: 501432 - DNA, 25 bp, Homo sapien
gatctcataatttgacaagttaacc

SEQ ID NO: 501433 - DNA, 25 bp, Homo sapien
taaccttttagaaatccacatatat

SEQ ID NO: 501434 - DNA, 25 bp, Homo sapien
gaaatccacatatatctcaaatctg

SEQ ID NO: 501435 - DNA, 25 bp, Homo sapien
atatctcaaatctggctactgcaaa

SEQ ID NO: 501436 - DNA, 25 bp, Homo sapien
ctggctactgcaaaaccagttttga

SEQ ID NO: 501437 - DNA, 25 bp, Homo sapien
gcaaaaccagttttgacaggtcaga

SEQ ID NO: 501438 - DNA, 25 bp, Homo sapien
ataggtataaatagccaacactcag

SEQ ID NO: 501439 - DNA, 25 bp, Homo sapien
aacactcagtgaacaaaatccttta

SEQ ID NO: 501440 - DNA, 25 bp, Homo sapien
aatcctttaagcattttggttacat

SEQ ID NO: 501441 - DNA, 25 bp, Homo sapien
tttctttgtctgttgttggcataga

SEQ ID NO: 501442 - DNA, 25 bp, Homo sapien
ctgttgttggcatagattcttttgt

SEQ ID NO: 501443 - DNA, 25 bp, Homo sapien
gtttatatatgtcaattggtttcct

SEQ ID NO: 501444 - DNA, 25 bp, Homo sapien
tcctttcttagcttgatattgccta

SEQ ID NO: 501445 - DNA, 25 bp, Homo sapien
cttgatattgcctagctttgttgtt

SEQ ID NO: 501446 - DNA, 25 bp, Homo sapien
gaaatcatttttggtagcaatatct

SEQ ID NO: 501447 - DNA, 25 bp, Homo sapien
catttttggtagcaatatctttgaa

SEQ ID NO: 501448 - DNA, 25 bp, Homo sapien
gtgactgtgagtgcaaatagaatta

SEQ ID NO: 501449 - DNA, 25 bp, Homo sapien
gcagtaagaagctactctagctaat

SEQ ID NO: 501450 - DNA, 25 bp, Homo sapien
gctactctagctaatttgccatttt

SEQ ID NO: 501451 - DNA, 25 bp, Homo sapien
tagctaatttgccattttacttaaa

SEQ ID NO: 501452 - DNA, 25 bp, Homo sapien
actgtgagagattgtgtctgcccct

SEQ ID NO: 501453 - DNA, 25 bp, Homo sapien
ggacccacagggagactataatctc

SEQ ID NO: 501454 - DNA, 25 bp, Homo sapien
tagtgcctctgttcctgaattacat

SEQ ID NO: 501455 - DNA, 25 bp, Homo sapien
gcctctgttcctgaattacataaga

SEQ ID NO: 501456 - DNA, 25 bp, Homo sapien
aagaatgtaccatgccgggaagcca

SEQ ID NO: 501457 - DNA, 25 bp, Homo sapien
accatgccgggaagccagagacctg

SEQ ID NO: 501458 - DNA, 25 bp, Homo sapien
tcacatcgtgtatgtctctccttga

SEQ ID NO: 501459 - DNA, 25 bp, Homo sapien
atgtctctccttgatttgtgttgtg

SEQ ID NO: 501460 - DNA, 25 bp, Homo sapien
gatttgtgttgtgtccagtttggtt

SEQ ID NO: 501461 - DNA, 25 bp, Homo sapien
atttggcaagtggaggaggctttta

SEQ ID NO: 501462 - DNA, 25 bp, Homo sapien
tggaggaggcttttatgtgactttt

SEQ ID NO: 501463 - DNA, 25 bp, Homo sapien
aagtatttcaaatcagctggcaggt

SEQ ID NO: 501464 - DNA, 25 bp, Homo sapien
aatcagctggcaggttcaagccttt

SEQ ID NO: 501465 - DNA, 25 bp, Homo sapien
agcctttctgcactgtagactttcc

SEQ ID NO: 501466 - DNA, 25 bp, Homo sapien
actgtagactttccacactctggaa

SEQ ID NO: 501467 - DNA, 25 bp, Homo sapien
catccgggaggtgcatgagtccaat

SEQ ID NO: 501468 - DNA, 25 bp, Homo sapien
tgagtccaatgggaatgcaaccgtg

SEQ ID NO: 501469 - DNA, 25 bp, Homo sapien
ggaatgcaaccgtgatgccgctgtc

SEQ ID NO: 501470 - DNA, 25 bp, Homo sapien
gtcctatgcccagtgacagcacagg

SEQ ID NO: 501471 - DNA, 25 bp, Homo sapien
acagcacaggtcacgtaagttacag

SEQ ID NO: 501472 - DNA, 25 bp, Homo sapien
cagaggattattgtcatattgctaa

SEQ ID NO: 501473 - DNA, 25 bp, Homo sapien
agcttggcaggatgcatacggccct

SEQ ID NO: 501474 - DNA, 25 bp, Homo sapien
aggacgagcggcagacgcgtgccca

SEQ ID NO: 501475 - DNA, 25 bp, Homo sapien
acgagcggcagacgcgtgcccatgg

SEQ ID NO: 501476 - DNA, 25 bp, Homo sapien
gcgggaaggacctggcgcttcctcc

SEQ ID NO: 501477 - DNA, 25 bp, Homo sapien
ccgccggccgggatgtcacggcttt

SEQ ID NO: 501478 - DNA, 25 bp, Homo sapien
gggatgtcacggctttgggcacttt

SEQ ID NO: 501479 - DNA, 25 bp, Homo sapien
tgggcactttggtttggtaagctgt

SEQ ID NO: 501480 - DNA, 25 bp, Homo sapien
ggcactttggtttggtaagctgtac

SEQ ID NO: 501481 - DNA, 25 bp, Homo sapien
gcactttggtttggtaagctgtacc

SEQ ID NO: 501482 - DNA, 25 bp, Homo sapien
actttggtttggtaagctgtaccag

SEQ ID NO: 501483 - DNA, 25 bp, Homo sapien
tttggtttggtaagctgtaccagac

SEQ ID NO: 501484 - DNA, 25 bp, Homo sapien
ggtttggtaagctgtaccagacaga

SEQ ID NO: 501485 - DNA, 25 bp, Homo sapien
gttcttgctgaggtagtaacagccc

SEQ ID NO: 501486 - DNA, 25 bp, Homo sapien
gaggtagtaacagcccaatcttggg

SEQ ID NO: 501487 - DNA, 25 bp, Homo sapien
caatcttgggctgttaaatcctagg

SEQ ID NO: 501488 - DNA, 25 bp, Homo sapien
aaatcctaggaaatctcgaatcata

SEQ ID NO: 501489 - DNA, 25 bp, Homo sapien
gggtaaagttgtagcttatatgcaa

SEQ ID NO: 501490 - DNA, 25 bp, Homo sapien
gcttatatgcaatactacttggagg

SEQ ID NO: 501491 - DNA, 25 bp, Homo sapien
atactacttggaggaattcttctac

SEQ ID NO: 501492 - DNA, 25 bp, Homo sapien
ggaggaattcttctactaatttgta

SEQ ID NO: 501493 - DNA, 25 bp, Homo sapien
ttttgcttatacactctgattccta

SEQ ID NO: 501494 - DNA, 25 bp, Homo sapien
tctgattcctataatacagtgctat

SEQ ID NO: 501495 - DNA, 25 bp, Homo sapien
tgctataagctatgcacagaaaata

SEQ ID NO: 501496 - DNA, 25 bp, Homo sapien
atgggggctaggcttgccatcacct

SEQ ID NO: 501497 - DNA, 25 bp, Homo sapien
acctccagtttggcttctgagcaga

SEQ ID NO: 501498 - DNA, 25 bp, Homo sapien
tcaagtctgaaacccccatggatga

SEQ ID NO: 501499 - DNA, 25 bp, Homo sapien
ccatggatgaggtcagctccttgtc

SEQ ID NO: 501500 - DNA, 25 bp, Homo sapien
ggatgaggtcagctccttgtctgct

SEQ ID NO: 501501 - DNA, 25 bp, Homo sapien
aggtcagctccttgtctgctgggtg

SEQ ID NO: 501502 - DNA, 25 bp, Homo sapien
ctccttgtctgctgggtggcccctg

SEQ ID NO: 501503 - DNA, 25 bp, Homo sapien
tggaggcagaaccagcaacaactct

SEQ ID NO: 501504 - DNA, 25 bp, Homo sapien
agcaacaactctgggcgtgcctgtg

SEQ ID NO: 501505 - DNA, 25 bp, Homo sapien
ctgtgtctgcacatgtggatgtaca

SEQ ID NO: 501506 - DNA, 25 bp, Homo sapien
catgtggatgtacatatgtctgtat

SEQ ID NO: 501507 - DNA, 25 bp, Homo sapien
gagacacagggtaaagctgcatcac

SEQ ID NO: 501508 - DNA, 25 bp, Homo sapien
gtaaagctgcatcacggaccaaaca

SEQ ID NO: 501509 - DNA, 25 bp, Homo sapien
gggaacatcaggatcagtaactcac

SEQ ID NO: 501510 - DNA, 25 bp, Homo sapien
aggatcagtaactcaccacaggaat

SEQ ID NO: 501511 - DNA, 25 bp, Homo sapien
ggaattcctactcctgggaaataga

SEQ ID NO: 501512 - DNA, 25 bp, Homo sapien
gaattcttcactagtggctgactgt

SEQ ID NO: 501513 - DNA, 25 bp, Homo sapien
ggctgactgtgacatatctttccaa

SEQ ID NO: 501514 - DNA, 25 bp, Homo sapien
tctttccaagagttaaccccagact

SEQ ID NO: 501515 - DNA, 25 bp, Homo sapien
tcttaagaatatgggcttttcttcc

SEQ ID NO: 501516 - DNA, 25 bp, Homo sapien
tttcaaagcagcatgactggacaat

SEQ ID NO: 501517 - DNA, 25 bp, Homo sapien
gggagagggcgtgatcatttataaa

SEQ ID NO: 501518 - DNA, 25 bp, Homo sapien
tgggagcattgctagccttctaccc

SEQ ID NO: 501519 - DNA, 25 bp, Homo sapien
gggctatcgaggagacccagtgaga

SEQ ID NO: 501520 - DNA, 25 bp, Homo sapien
agcattttgttcatccccagggtag

SEQ ID NO: 501521 - DNA, 25 bp, Homo sapien
tttgttcatccccagggtagctgcc

SEQ ID NO: 501522 - DNA, 25 bp, Homo sapien
gcactctgcctctgggagagaggaa

SEQ ID NO: 501523 - DNA, 25 bp, Homo sapien
ctgtacagagcctttggctttatgt

SEQ ID NO: 501524 - DNA, 25 bp, Homo sapien
gagcctttggctttatgtgtttatg

SEQ ID NO: 501525 - DNA, 25 bp, Homo sapien
ttggctttatgtgtttatgttcttc

SEQ ID NO: 501526 - DNA, 25 bp, Homo sapien
gtttatgttcttcacatgcatatgt

SEQ ID NO: 501527 - DNA, 25 bp, Homo sapien
tgtatgtgtgtatatctttcccccc

SEQ ID NO: 501528 - DNA, 25 bp, Homo sapien
ttccccccatcaattggtacaattt

SEQ ID NO: 501529 - DNA, 25 bp, Homo sapien
gctggcaaaggcgtttaatagaaat

SEQ ID NO: 501530 - DNA, 25 bp, Homo sapien
ctggcaaaggcgtttaatagaaatg

SEQ ID NO: 501531 - DNA, 25 bp, Homo sapien
caaaggcgtttaatagaaatgagat

SEQ ID NO: 501532 - DNA, 25 bp, Homo sapien
tgagatgagggcaggccgcccctcc

SEQ ID NO: 501533 - DNA, 25 bp, Homo sapien
gcccagctagcgcaggaagttcctg

SEQ ID NO: 501534 - DNA, 25 bp, Homo sapien
cccagctagcgcaggaagttcctgg

SEQ ID NO: 501535 - DNA, 25 bp, Homo sapien
ccagctagcgcaggaagttcctggg

SEQ ID NO: 501536 - DNA, 25 bp, Homo sapien
gggtagagctggaagagctttccct

SEQ ID NO: 501537 - DNA, 25 bp, Homo sapien
taccgtccttgaagtccttttcgat

SEQ ID NO: 501538 - DNA, 25 bp, Homo sapien
cttgaagtccttttcgatggcaggc

SEQ ID NO: 501539 - DNA, 25 bp, Homo sapien
ttgaagtccttttcgatggcaggcg

SEQ ID NO: 501540 - DNA, 25 bp, Homo sapien
gaaattgctaccaaactcatttaat

SEQ ID NO: 501541 - DNA, 25 bp, Homo sapien
aactcatttaatttggcataagact

SEQ ID NO: 501542 - DNA, 25 bp, Homo sapien
aaataccaactgttctatatttctt

SEQ ID NO: 501543 - DNA, 25 bp, Homo sapien
tagttattaatattgatacctctga

SEQ ID NO: 501544 - DNA, 25 bp, Homo sapien
tattttattcttaaatcttcagtga

SEQ ID NO: 501545 - DNA, 25 bp, Homo sapien
atcttcagtgattccttttactata

SEQ ID NO: 501546 - DNA, 25 bp, Homo sapien
gattccttttactatagattcatga

SEQ ID NO: 501547 - DNA, 25 bp, Homo sapien
agattcatgacagctaattagtact

SEQ ID NO: 501548 - DNA, 25 bp, Homo sapien
gtactaactgatttagaggtttcct

SEQ ID NO: 501549 - DNA, 25 bp, Homo sapien
ggtttcctttcccatcatatggaat

SEQ ID NO: 501550 - DNA, 25 bp, Homo sapien
agatacaaactactgcaattagaaa

SEQ ID NO: 501551 - DNA, 25 bp, Homo sapien
ggagagcaagaggtcccgagtcccc

SEQ ID NO: 501552 - DNA, 25 bp, Homo sapien
cctcctagtctttcatcctgaattt

SEQ ID NO: 501553 - DNA, 25 bp, Homo sapien
gtctttcatcctgaatttgcacaga

SEQ ID NO: 501554 - DNA, 25 bp, Homo sapien
tgaatttgcacagaggaaagcgggt

SEQ ID NO: 501555 - DNA, 25 bp, Homo sapien
ggtgcccggcatggccatcctgatg

SEQ ID NO: 501556 - DNA, 25 bp, Homo sapien
tggcgggatccccatgcaccttgtc

SEQ ID NO: 501557 - DNA, 25 bp, Homo sapien
gtccttctccactgatactggcagc

SEQ ID NO: 501558 - DNA, 25 bp, Homo sapien
tgatactggcagctcggctcctgga

SEQ ID NO: 501559 - DNA, 25 bp, Homo sapien
gcagctcggctcctggacccaagat

SEQ ID NO: 501560 - DNA, 25 bp, Homo sapien
tgggagctgtcccatgtttccatgg

SEQ ID NO: 501561 - DNA, 25 bp, Homo sapien
ggtcaccaactactcaccagaaggg

SEQ ID NO: 501562 - DNA, 25 bp, Homo sapien
ggattacactgagccttagttgaat

SEQ ID NO: 501563 - DNA, 25 bp, Homo sapien
gaattcattttcacctcagttctca

SEQ ID NO: 501564 - DNA, 25 bp, Homo sapien
tcacctcagttctcatttgcatatg

SEQ ID NO: 501565 - DNA, 25 bp, Homo sapien
atgtatactgctcacttttctccct

SEQ ID NO: 501566 - DNA, 25 bp, Homo sapien
ttccttggccctctaatacttgagt

SEQ ID NO: 501567 - DNA, 25 bp, Homo sapien
atacttgagtacttcctctttctaa

SEQ ID NO: 501568 - DNA, 25 bp, Homo sapien
acttcctctttctaaactatacctg

SEQ ID NO: 501569 - DNA, 25 bp, Homo sapien
atacctggccagtaaagcattcttt

SEQ ID NO: 501570 - DNA, 25 bp, Homo sapien
gaaagtcactagcatatttctttag

SEQ ID NO: 501571 - DNA, 25 bp, Homo sapien
acagagttcagagactccagtccct

SEQ ID NO: 501572 - DNA, 25 bp, Homo sapien
gactccagtccctcagaaagaagta

SEQ ID NO: 501573 - DNA, 25 bp, Homo sapien
gctggcaaaggcgtttaatagaaat

SEQ ID NO: 501574 - DNA, 25 bp, Homo sapien
ctggcaaaggcgtttaatagaaatg

SEQ ID NO: 501575 - DNA, 25 bp, Homo sapien
tggcaaaggcgtttaatagaaatga

SEQ ID NO: 501576 - DNA, 25 bp, Homo sapien
ggcaaaggcgtttaatagaaatgag

SEQ ID NO: 501577 - DNA, 25 bp, Homo sapien
gcaaaggcgtttaatagaaatgaga

SEQ ID NO: 501578 - DNA, 25 bp, Homo sapien
caaaggcgtttaatagaaatgagat

SEQ ID NO: 501579 - DNA, 25 bp, Homo sapien
aaaggcgtttaatagaaatgagatg

SEQ ID NO: 501580 - DNA, 25 bp, Homo sapien
aaggcgtttaatagaaatgagatga

SEQ ID NO: 501581 - DNA, 25 bp, Homo sapien
gcccagctagcgcaggaagttcctg

SEQ ID NO: 501582 - DNA, 25 bp, Homo sapien
cccagctagcgcaggaagttcctgg

SEQ ID NO: 501583 - DNA, 25 bp, Homo sapien
ccagctagcgcaggaagttcctggg

SEQ ID NO: 501584 - DNA, 25 bp, Homo sapien
gttttacctcaatttgaacagataa

SEQ ID NO: 501585 - DNA, 25 bp, Homo sapien
gaacagataagtttgcctgcatgct

SEQ ID NO: 501586 - DNA, 25 bp, Homo sapien
gctggacatgcctcagaaccatgaa

SEQ ID NO: 501587 - DNA, 25 bp, Homo sapien
gaaccatgaatagcccgtactagat

SEQ ID NO: 501588 - DNA, 25 bp, Homo sapien
ccgtactagatcttgggaacatgga

SEQ ID NO: 501589 - DNA, 25 bp, Homo sapien
acatggatcttagagtcactttgga

SEQ ID NO: 501590 - DNA, 25 bp, Homo sapien
gggcttgttaaaggacgcgtatgta

SEQ ID NO: 501591 - DNA, 25 bp, Homo sapien
ggacgcgtatgtagggcccgtacct

SEQ ID NO: 501592 - DNA, 25 bp, Homo sapien
tagggcccgtacctactggcagttg

SEQ ID NO: 501593 - DNA, 25 bp, Homo sapien
acctactggcagttgggttcaggga

SEQ ID NO: 501594 - DNA, 25 bp, Homo sapien
aaatgggattgacttggccttcagg

SEQ ID NO: 501595 - DNA, 25 bp, Homo sapien
aaaatctgctatagtaaagttctgt

SEQ ID NO: 501596 - DNA, 25 bp, Homo sapien
tccctattcaccaaaagtttatact

SEQ ID NO: 501597 - DNA, 25 bp, Homo sapien
gggacaaaacaagtgcataaagcta

SEQ ID NO: 501598 - DNA, 25 bp, Homo sapien
aaatttagccagtacatttataact

SEQ ID NO: 501599 - DNA, 25 bp, Homo sapien
gtacatttataactgtttcattcag

SEQ ID NO: 501600 - DNA, 25 bp, Homo sapien
tttcattcagttgatcagagaagca

SEQ ID NO: 501601 - DNA, 25 bp, Homo sapien
cagagaagcatcacgattgctggaa

SEQ ID NO: 501602 - DNA, 25 bp, Homo sapien
attgctggaaaatatcggacctgga

SEQ ID NO: 501603 - DNA, 25 bp, Homo sapien
gttactaagccttttattcagatag

SEQ ID NO: 501604 - DNA, 25 bp, Homo sapien
tattcagatagcacactaaattggg

SEQ ID NO: 501605 - DNA, 25 bp, Homo sapien
gggtcaaaaatctgctatagtaaag

SEQ ID NO: 501606 - DNA, 25 bp, Homo sapien
gtaagtacttgttcattgtggaaat

SEQ ID NO: 501607 - DNA, 25 bp, Homo sapien
gaaatgtgtccttgactaaaaccat

SEQ ID NO: 501608 - DNA, 25 bp, Homo sapien
gtccttgactaaaaccatacgtggc

SEQ ID NO: 501609 - DNA, 25 bp, Homo sapien
catacgtggctatggaaaccatgtt

SEQ ID NO: 501610 - DNA, 25 bp, Homo sapien
ggaaaccatgtttgtagttctgaat

SEQ ID NO: 501611 - DNA, 25 bp, Homo sapien
gtagttctgaatacacaggttttgt

SEQ ID NO: 501612 - DNA, 25 bp, Homo sapien
caattggatttaagtagatcactga

SEQ ID NO: 501613 - DNA, 25 bp, Homo sapien
agatcactgaatgttattgtttatg

SEQ ID NO: 501614 - DNA, 25 bp, Homo sapien
gaaacttaactttttgtatgctgct

SEQ ID NO: 501615 - DNA, 25 bp, Homo sapien
gtatgctgcttataaacatgatcta

SEQ ID NO: 501616 - DNA, 25 bp, Homo sapien
tactttcttaatctactgatacagg

SEQ ID NO: 501617 - DNA, 25 bp, Homo sapien
gggcaggaatgaacagcaaccagca

SEQ ID NO: 501618 - DNA, 25 bp, Homo sapien
gcaaccagcacagagcattgctaaa

SEQ ID NO: 501619 - DNA, 25 bp, Homo sapien
gtagctaggcttcttctgataggaa

SEQ ID NO: 501620 - DNA, 25 bp, Homo sapien
aaccagaaaccactagatgttctat

SEQ ID NO: 501621 - DNA, 25 bp, Homo sapien
gatgttctattatcatagcttttgt

SEQ ID NO: 501622 - DNA, 25 bp, Homo sapien
attaatgtagctagtagggaccagt

SEQ ID NO: 501623 - DNA, 25 bp, Homo sapien
tgcttgtggctgaggcagtaatgct

SEQ ID NO: 501624 - DNA, 25 bp, Homo sapien
cagtaatgctaaggctttagctctt

SEQ ID NO: 501625 - DNA, 25 bp, Homo sapien
taacccactgccatggtggcactgg

SEQ ID NO: 501626 - DNA, 25 bp, Homo sapien
tggcactggttttgcctgaggtcat

SEQ ID NO: 501627 - DNA, 25 bp, Homo sapien
ttttgcctgaggtcattgctagggc

SEQ ID NO: 501628 - DNA, 25 bp, Homo sapien
taaagggagagtccatctggaagct

SEQ ID NO: 501629 - DNA, 25 bp, Homo sapien
aagctggagtatatcctgacccaga

SEQ ID NO: 501630 - DNA, 25 bp, Homo sapien
acgacattgaagatttgcagccgga

SEQ ID NO: 501631 - DNA, 25 bp, Homo sapien
gatttgcagccggaaagtttatatg

SEQ ID NO: 501632 - DNA, 25 bp, Homo sapien
taaacaatttacaatcctagacagt

SEQ ID NO: 501633 - DNA, 25 bp, Homo sapien
attacttctttgtgagttatgacag

SEQ ID NO: 501634 - DNA, 25 bp, Homo sapien
ttatgacagcagtgtaacatgtgat

SEQ ID NO: 501635 - DNA, 25 bp, Homo sapien
tgtgataagacatgtaaggcctttc

SEQ ID NO: 501636 - DNA, 25 bp, Homo sapien
gtaaggcctttcagatttgtgcaat

SEQ ID NO: 501637 - DNA, 25 bp, Homo sapien
taatatttcctatgcagattgcctc

SEQ ID NO: 501638 - DNA, 25 bp, Homo sapien
tatgcagattgcctcaaacagcttt

SEQ ID NO: 501639 - DNA, 25 bp, Homo sapien
atgtgcctaaagagcatgaagacaa

SEQ ID NO: 501640 - DNA, 25 bp, Homo sapien
tacacctaaaccaacactctttact

SEQ ID NO: 501641 - DNA, 25 bp, Homo sapien
aagcacctgagtggtctaagaaaca

SEQ ID NO: 501642 - DNA, 25 bp, Homo sapien
aaagatgaagacctagtgttttgga

SEQ ID NO: 501643 - DNA, 25 bp, Homo sapien
gacctagtgttttggatgggaagca

SEQ ID NO: 501644 - DNA, 25 bp, Homo sapien
gggaagcacctgtagaccattatat

SEQ ID NO: 501645 - DNA, 25 bp, Homo sapien
tgtagaccattatatactcctgaag

SEQ ID NO: 501646 - DNA, 25 bp, Homo sapien
tatactcctgaagttctttttctga

SEQ ID NO: 501647 - DNA, 25 bp, Homo sapien
cctgaagttctttttctgatggaaa

SEQ ID NO: 501648 - DNA, 25 bp, Homo sapien
aaattcagcttaatcgtgtactcag

SEQ ID NO: 501649 - DNA, 25 bp, Homo sapien
aatcgtgtactcagcattttttaaa

SEQ ID NO: 501650 - DNA, 25 bp, Homo sapien
gaagtcatatacatgtaagctacaa

SEQ ID NO: 501651 - DNA, 25 bp, Homo sapien
gaaaagcctttttcaacatatccct

SEQ ID NO: 501652 - DNA, 25 bp, Homo sapien
aagcctttttcaacatatccctaag

SEQ ID NO: 501653 - DNA, 25 bp, Homo sapien
gcctttttcaacatatccctaagct

SEQ ID NO: 501654 - DNA, 25 bp, Homo sapien
tttttcaacatatccctaagctaag

SEQ ID NO: 501655 - DNA, 25 bp, Homo sapien
acatatccctaagctaagggaagag

SEQ ID NO: 501656 - DNA, 25 bp, Homo sapien
aggaaggaataacaactcagtgaaa

SEQ ID NO: 501657 - DNA, 25 bp, Homo sapien
caactcagtgaaaagatggtctcca

SEQ ID NO: 501658 - DNA, 25 bp, Homo sapien
tgaaaagatggtctccagtttctga

SEQ ID NO: 501659 - DNA, 25 bp, Homo sapien
ctgaatgaaaaagctacagctgaga

SEQ ID NO: 501660 - DNA, 25 bp, Homo sapien
aaagctacagctgagaaataaaata

SEQ ID NO: 501661 - DNA, 25 bp, Homo sapien
tctggatctatctgttgatgagtcc

SEQ ID NO: 501662 - DNA, 25 bp, Homo sapien
tctgttgatgagtccgaagcctttc

SEQ ID NO: 501663 - DNA, 25 bp, Homo sapien
gaagcctttctctcaaatctagtag

SEQ ID NO: 501664 - DNA, 25 bp, Homo sapien
acaagaccatctttgctaaagtaga

SEQ ID NO: 501665 - DNA, 25 bp, Homo sapien
gcaggaattatcaacttccagagac

SEQ ID NO: 501666 - DNA, 25 bp, Homo sapien
ttccagagacccaaggatccaaata

SEQ ID NO: 501667 - DNA, 25 bp, Homo sapien
attaaatgactggtctcagaaactg

SEQ ID NO: 501668 - DNA, 25 bp, Homo sapien
actgaactcattaatgtctctggtt

SEQ ID NO: 501669 - DNA, 25 bp, Homo sapien
gtctctggttaacaaaactacgcat

SEQ ID NO: 501670 - DNA, 25 bp, Homo sapien
aaactacgcatctcatagccaaaga

SEQ ID NO: 501671 - DNA, 25 bp, Homo sapien
gatacataatctacaataagggtct

SEQ ID NO: 501672 - DNA, 25 bp, Homo sapien
ttctgagctgaataagttcaggagc

SEQ ID NO: 501673 - DNA, 25 bp, Homo sapien
aagttcaggagcagattattaagat

SEQ ID NO: 501674 - DNA, 25 bp, Homo sapien
gattattaagatctgccattctgaa

SEQ ID NO: 501675 - DNA, 25 bp, Homo sapien
taagatctgccattctgaaacgctg

SEQ ID NO: 501676 - DNA, 25 bp, Homo sapien
gatctgccattctgaaacgctggtc

SEQ ID NO: 501677 - DNA, 25 bp, Homo sapien
tgccattctgaaacgctggtctttt

SEQ ID NO: 501678 - DNA, 25 bp, Homo sapien
ttctgaaacgctggtctttttctcc

SEQ ID NO: 501679 - DNA, 25 bp, Homo sapien
tgaaacgctggtctttttctccttc

SEQ ID NO: 501680 - DNA, 25 bp, Homo sapien
ccttcctatagtgcaccataaaatt

SEQ ID NO: 501681 - DNA, 25 bp, Homo sapien
gtgcaccataaaattctgtttgatc

SEQ ID NO: 501682 - DNA, 25 bp, Homo sapien
gtttgatcagattatattacataca

SEQ ID NO: 501683 - DNA, 25 bp, Homo sapien
acagagagggatctttggaccttct

SEQ ID NO: 501684 - DNA, 25 bp, Homo sapien
cttctggaaaatggtaaggccccag

SEQ ID NO: 501685 - DNA, 25 bp, Homo sapien
aaggccccaggtagattatggctcc

SEQ ID NO: 501686 - DNA, 25 bp, Homo sapien
tagattatggctcctctgccctgga

SEQ ID NO: 501687 - DNA, 25 bp, Homo sapien
tttcttctgagtgggacttgatctc

SEQ ID NO: 501688 - DNA, 25 bp, Homo sapien
gtgggacttgatctcatttctgcat

SEQ ID NO: 501689 - DNA, 25 bp, Homo sapien
atttctgcattcacagcaaggtgga

SEQ ID NO: 501690 - DNA, 25 bp, Homo sapien
caaggtggaactgtctggcaagagc

SEQ ID NO: 501691 - DNA, 25 bp, Homo sapien
ggcaagagcttaaattaggacctgt

SEQ ID NO: 501692 - DNA, 25 bp, Homo sapien
gtttgagatccagtgagatgccaga

SEQ ID NO: 501693 - DNA, 25 bp, Homo sapien
agatgccagagattagtcaataggt

SEQ ID NO: 501694 - DNA, 25 bp, Homo sapien
gcagaattaaaaaccccttcaacat

SEQ ID NO: 501695 - DNA, 25 bp, Homo sapien
aacatctcaaagtctcctttaaaat

SEQ ID NO: 501696 - DNA, 25 bp, Homo sapien
gacgattccacataaaaggaaggga

SEQ ID NO: 501697 - DNA, 25 bp, Homo sapien
gattccacataaaaggaagggacca

SEQ ID NO: 501698 - DNA, 25 bp, Homo sapien
tttacctcaggaagaatctcattag

SEQ ID NO: 501699 - DNA, 25 bp, Homo sapien
ctcaggaagaatctcattagtttat

SEQ ID NO: 501700 - DNA, 25 bp, Homo sapien
agtttattctgtaaatagttcctag

SEQ ID NO: 501701 - DNA, 25 bp, Homo sapien
gtttattctgtaaatagttcctagt

SEQ ID NO: 501702 - DNA, 25 bp, Homo sapien
tattctgtaaatagttcctagtaaa

SEQ ID NO: 501703 - DNA, 25 bp, Homo sapien
tctgtaaatagttcctagtaaaatg

SEQ ID NO: 501704 - DNA, 25 bp, Homo sapien
aatgataaagacttgatttttcaaa

SEQ ID NO: 501705 - DNA, 25 bp, Homo sapien
ggaccgtgcctggatcaggtcagac

SEQ ID NO: 501706 - DNA, 25 bp, Homo sapien
aggtcagacctgtcgattcccgcaa

SEQ ID NO: 501707 - DNA, 25 bp, Homo sapien
gtcgattcccgcaagattttcaaga

SEQ ID NO: 501708 - DNA, 25 bp, Homo sapien
ttttcaagagcattcaccattctgt

SEQ ID NO: 501709 - DNA, 25 bp, Homo sapien
attcttctagctgagcaagtcgaag

SEQ ID NO: 501710 - DNA, 25 bp, Homo sapien
aagtcgaaggtcaacagtctgcagg

SEQ ID NO: 501711 - DNA, 25 bp, Homo sapien
ttctctttcattgatttcttccaac

SEQ ID NO: 501712 - DNA, 25 bp, Homo sapien
ttcttccaacctcattgacatattt

SEQ ID NO: 501713 - DNA, 25 bp, Homo sapien
agctgtagccatcagcgctattgat

SEQ ID NO: 501714 - DNA, 25 bp, Homo sapien
gctgctttgccggagaagatacgtt

SEQ ID NO: 501715 - DNA, 25 bp, Homo sapien
agatacgttgcctcacattcagaag

SEQ ID NO: 501716 - DNA, 25 bp, Homo sapien
ggcggccttttagatgttaaatatt

SEQ ID NO: 501717 - DNA, 25 bp, Homo sapien
tgtaccaggaactctatcacagata

SEQ ID NO: 501718 - DNA, 25 bp, Homo sapien
cacaaataaggtactgctgattcaa

SEQ ID NO: 501719 - DNA, 25 bp, Homo sapien
ttcaaaagaaaatcccttgtcctca

SEQ ID NO: 501720 - DNA, 25 bp, Homo sapien
agggaggctttcctagaccttgaga

SEQ ID NO: 501721 - DNA, 25 bp, Homo sapien
tttcctagaccttgagactcgtatt

SEQ ID NO: 501722 - DNA, 25 bp, Homo sapien
actcgtatttattgtcagctcttta

SEQ ID NO: 501723 - DNA, 25 bp, Homo sapien
gaagtgctgtactttacagtcgttt

SEQ ID NO: 501724 - DNA, 25 bp, Homo sapien
aggcagtggcctgtcaaggttgcaa

SEQ ID NO: 501725 - DNA, 25 bp, Homo sapien
gcctgtcaaggttgcaatctgccta

SEQ ID NO: 501726 - DNA, 25 bp, Homo sapien
gttgcaatctgcctaatattcataa

SEQ ID NO: 501727 - DNA, 25 bp, Homo sapien
gttcatgtgaattgctttcagccag

SEQ ID NO: 501728 - DNA, 25 bp, Homo sapien
gccaggttgggtatccaagctcaat

SEQ ID NO: 501729 - DNA, 25 bp, Homo sapien
gctcaatgttctggtgttaagccat

SEQ ID NO: 501730 - DNA, 25 bp, Homo sapien
ggaagtgttgccatgagaccagctt

SEQ ID NO: 501731 - DNA, 25 bp, Homo sapien
aagtagccctgaggtgcagctgtaa

SEQ ID NO: 501732 - DNA, 25 bp, Homo sapien
tgtaaggtgacccagtgcagtcctg

SEQ ID NO: 501733 - DNA, 25 bp, Homo sapien
agtgcagtcctgaggccagagccct

SEQ ID NO: 501734 - DNA, 25 bp, Homo sapien
ttggaactaattcccagggcactga

SEQ ID NO: 501735 - DNA, 25 bp, Homo sapien
atgtcagagggtgttacagtgctac

SEQ ID NO: 501736 - DNA, 25 bp, Homo sapien
agtgctacacgagatgactcctgca

SEQ ID NO: 501737 - DNA, 25 bp, Homo sapien
agatgactcctgcaagttgcttgct

SEQ ID NO: 501738 - DNA, 25 bp, Homo sapien
ttgaaggcaaaagtcaattcagctc

SEQ ID NO: 501739 - DNA, 25 bp, Homo sapien
tcagctcttgagaaaaggtgtcttt

SEQ ID NO: 501740 - DNA, 25 bp, Homo sapien
tgtctttccagcctgaatttttcag

SEQ ID NO: 501741 - DNA, 25 bp, Homo sapien
tgaatttttcagattgactagacca

SEQ ID NO: 501742 - DNA, 25 bp, Homo sapien
gcagaatctctcaacctgatcttag

SEQ ID NO: 501743 - DNA, 25 bp, Homo sapien
caacctgatcttagtatttcctaga

SEQ ID NO: 501744 - DNA, 25 bp, Homo sapien
tagtatttcctagaaagcacttgac

SEQ ID NO: 501745 - DNA, 25 bp, Homo sapien
acttgacattgtgtgaggtctcacc

SEQ ID NO: 501746 - DNA, 25 bp, Homo sapien
ggtctcacctgaaggaacttggtgg

SEQ ID NO: 501747 - DNA, 25 bp, Homo sapien
gagggaggcagtgtccttcctgaca

SEQ ID NO: 501748 - DNA, 25 bp, Homo sapien
gcagtgtccttcctgacagcacttg

SEQ ID NO: 501749 - DNA, 25 bp, Homo sapien
gggctttggctgtgacgcggtcggg

SEQ ID NO: 501750 - DNA, 25 bp, Homo sapien
agtcactctgccgaaggcgctgacg

SEQ ID NO: 501751 - DNA, 25 bp, Homo sapien
gtcactctgccgaaggcgctgacgg

SEQ ID NO: 501752 - DNA, 25 bp, Homo sapien
tcactctgccgaaggcgctgacggc

SEQ ID NO: 501753 - DNA, 25 bp, Homo sapien
actctgccgaaggcgctgacggcat

SEQ ID NO: 501754 - DNA, 25 bp, Homo sapien
cgaaggcgctgacggcatcgcggcc

SEQ ID NO: 501755 - DNA, 25 bp, Homo sapien
ggcgctgacggcatcgcggccggaa

SEQ ID NO: 501756 - DNA, 25 bp, Homo sapien
atcgcggccggaacctctgggcccg

SEQ ID NO: 501757 - DNA, 25 bp, Homo sapien
aaacttcgctggaaatgagtagcca

SEQ ID NO: 501758 - DNA, 25 bp, Homo sapien
aacttcgctggaaatgagtagccag

SEQ ID NO: 501759 - DNA, 25 bp, Homo sapien
gctggaaatgagtagccaggaagtt

SEQ ID NO: 501760 - DNA, 25 bp, Homo sapien
ctggaggcagtcatccccaaagaaa

SEQ ID NO: 501761 - DNA, 25 bp, Homo sapien
agggcaaggtgttcctgtttcaaag

SEQ ID NO: 501762 - DNA, 25 bp, Homo sapien
aggtgttcctgtttcaaagcggtga

SEQ ID NO: 501763 - DNA, 25 bp, Homo sapien
aaaatcgcacggacaattttgagct

SEQ ID NO: 501764 - DNA, 25 bp, Homo sapien
gagctgcaaaaattggccccaggaa

SEQ ID NO: 501765 - DNA, 25 bp, Homo sapien
tggccccaggaaacttctgagcttg

SEQ ID NO: 501766 - DNA, 25 bp, Homo sapien
aggcagaacctggaattgtagcatc

SEQ ID NO: 501767 - DNA, 25 bp, Homo sapien
ggaattgtagcatccaaggacaaaa

SEQ ID NO: 501768 - DNA, 25 bp, Homo sapien
aatgtttgccagcaaatcttggctg

SEQ ID NO: 501769 - DNA, 25 bp, Homo sapien
atacaccacctaagaagtcaatgca

SEQ ID NO: 501770 - DNA, 25 bp, Homo sapien
gagtattcctggaggcagtcatccc

SEQ ID NO: 501771 - DNA, 25 bp, Homo sapien
tggacttaatcgtccacatcactgt

SEQ ID NO: 501772 - DNA, 25 bp, Homo sapien
gttccaaaggtgcttccacactttc

SEQ ID NO: 501773 - DNA, 25 bp, Homo sapien
aaaggtgcttccacactttcaagta

SEQ ID NO: 501774 - DNA, 25 bp, Homo sapien
aggtgcttccacactttcaagtatc

SEQ ID NO: 501775 - DNA, 25 bp, Homo sapien
gtgcttccacactttcaagtatctt

SEQ ID NO: 501776 - DNA, 25 bp, Homo sapien
tatagcaatgccccactcctggtac

SEQ ID NO: 501777 - DNA, 25 bp, Homo sapien
actcctggtaccaaattcctgtatt

SEQ ID NO: 501778 - DNA, 25 bp, Homo sapien
tcctggtaccaaattcctgtattag

SEQ ID NO: 501779 - DNA, 25 bp, Homo sapien
ggtaccaaattcctgtattagtctg

SEQ ID NO: 501780 - DNA, 25 bp, Homo sapien
cactgtcagcattttggttaaaacc

SEQ ID NO: 501781 - DNA, 25 bp, Homo sapien
ctgtcagcattttggttaaaaccat

SEQ ID NO: 501782 - DNA, 25 bp, Homo sapien
agctgtggttcacccgcgggagtca

SEQ ID NO: 501783 - DNA, 25 bp, Homo sapien
ggaggatgcctgagacaattgcctt

SEQ ID NO: 501784 - DNA, 25 bp, Homo sapien
ggatgcctgagacaattgccttgaa

SEQ ID NO: 501785 - DNA, 25 bp, Homo sapien
gcctgagacaattgccttgaagatg

SEQ ID NO: 501786 - DNA, 25 bp, Homo sapien
gaaagtgtttcactgtttattttct

SEQ ID NO: 501787 - DNA, 25 bp, Homo sapien
tctccatgggatgtagcaggcaagc

SEQ ID NO: 501788 - DNA, 25 bp, Homo sapien
gtagcaggcaagcatgcttaggaca

SEQ ID NO: 501789 - DNA, 25 bp, Homo sapien
ggttctcttttgaacacttgtcgtg

SEQ ID NO: 501790 - DNA, 25 bp, Homo sapien
ttttgaacacttgtcgtgctgcagc

SEQ ID NO: 501791 - DNA, 25 bp, Homo sapien
tgtcgtgctgcagcaagagcatctt

SEQ ID NO: 501792 - DNA, 25 bp, Homo sapien
gggctgtggagctgtggttcacccg

SEQ ID NO: 501793 - DNA, 25 bp, Homo sapien
gaaatcaaccagaatttggctgagg

SEQ ID NO: 501794 - DNA, 25 bp, Homo sapien
gctgaggaggctggtctgaacatca

SEQ ID NO: 501795 - DNA, 25 bp, Homo sapien
aggaggctggtctgaacatcactca

SEQ ID NO: 501796 - DNA, 25 bp, Homo sapien
gatagcagtgaagccgagattatag

SEQ ID NO: 501797 - DNA, 25 bp, Homo sapien
agtgaagccgagattatagatgaaa

SEQ ID NO: 501798 - DNA, 25 bp, Homo sapien
atgaagataccagagtacatggcct

SEQ ID NO: 501799 - DNA, 25 bp, Homo sapien
gccttgcccttcagatctctgagaa

SEQ ID NO: 501800 - DNA, 25 bp, Homo sapien
gatctctgagaacttgtttagcaac

SEQ ID NO: 501801 - DNA, 25 bp, Homo sapien
gcaacaaagtcctcaatgccttgaa

SEQ ID NO: 501802 - DNA, 25 bp, Homo sapien
gtggatggagtaacagacataaacc

SEQ ID NO: 501803 - DNA, 25 bp, Homo sapien
gaggggatgcccatgaatgttttgt

SEQ ID NO: 501804 - DNA, 25 bp, Homo sapien
gtcattttccacagcatcgcattca

SEQ ID NO: 501805 - DNA, 25 bp, Homo sapien
atcgcattcaccatgagacctgttt

SEQ ID NO: 501806 - DNA, 25 bp, Homo sapien
atgagacctgtttgcacgtcctgtc

SEQ ID NO: 501807 - DNA, 25 bp, Homo sapien
gtcctgtctggctatgggtttatac

SEQ ID NO: 501808 - DNA, 25 bp, Homo sapien
aagatgggtcaagtcgcccagcaca

SEQ ID NO: 501809 - DNA, 25 bp, Homo sapien
gcccagcacaagtgttgccacttag

SEQ ID NO: 501810 - DNA, 25 bp, Homo sapien
gccacttagtgggacctggtgacac

SEQ ID NO: 501811 - DNA, 25 bp, Homo sapien
ggtgacactgcccacagtcagagct

SEQ ID NO: 501812 - DNA, 25 bp, Homo sapien
tggtaccttctctgcccttgtaact

SEQ ID NO: 501813 - DNA, 25 bp, Homo sapien
tctgcccttgtaactgacactcatc

SEQ ID NO: 501814 - DNA, 25 bp, Homo sapien
gctgttgttgagttttatcttcctg

SEQ ID NO: 501815 - DNA, 25 bp, Homo sapien
gctgtagttgggtaattccaagtgc

SEQ ID NO: 501816 - DNA, 25 bp, Homo sapien
ttccaagtgctgatagtactattca

SEQ ID NO: 501817 - DNA, 25 bp, Homo sapien
tgtgtcagatgaaacaaatgccaag

SEQ ID NO: 501818 - DNA, 25 bp, Homo sapien
tattaacaagccatgccttatgtgt

SEQ ID NO: 501819 - DNA, 25 bp, Homo sapien
gccatgccttatgtgtttcatctta

SEQ ID NO: 501820 - DNA, 25 bp, Homo sapien
aaaatgatttgacgtgcttgctcac

SEQ ID NO: 501821 - DNA, 25 bp, Homo sapien
tgacgtgcttgctcacttgattgac

SEQ ID NO: 501822 - DNA, 25 bp, Homo sapien
tgctcacttgattgacttggtcaga

SEQ ID NO: 501823 - DNA, 25 bp, Homo sapien
gacttggtcagatatttgaatgatg

SEQ ID NO: 501824 - DNA, 25 bp, Homo sapien
ttacctagattctaatccttgattc

SEQ ID NO: 501825 - DNA, 25 bp, Homo sapien
ctaatccttgattctagttatataa

SEQ ID NO: 501826 - DNA, 25 bp, Homo sapien
ggtagccatgagaaacctagagcgc

SEQ ID NO: 501827 - DNA, 25 bp, Homo sapien
aaacctagagcgctcactggacttt

SEQ ID NO: 501828 - DNA, 25 bp, Homo sapien
ctcactggacttttgcgaggtggaa

SEQ ID NO: 501829 - DNA, 25 bp, Homo sapien
tcgagtgggctcagtacgttaggac

SEQ ID NO: 501830 - DNA, 25 bp, Homo sapien
gtacgttaggactcagcgtggccgc

SEQ ID NO: 501831 - DNA, 25 bp, Homo sapien
agcgtggccgccaaagcattggttg

SEQ ID NO: 501832 - DNA, 25 bp, Homo sapien
ggcgtctttcactaatttttcctag

SEQ ID NO: 501833 - DNA, 25 bp, Homo sapien
taggttttctctcctatcgggctct

SEQ ID NO: 501834 - DNA, 25 bp, Homo sapien
atcgggctctgtggtcctttcacca

SEQ ID NO: 501835 - DNA, 25 bp, Homo sapien
acccatcttcactttggtggcctga

SEQ ID NO: 501836 - DNA, 25 bp, Homo sapien
gtggcctgacgctaacgctgcgagt

SEQ ID NO: 501837 - DNA, 25 bp, Homo sapien
acctccacgcttcagcgtcaaaaga

SEQ ID NO: 501838 - DNA, 25 bp, Homo sapien
caatatagatagatgggtgccgggc

SEQ ID NO: 501839 - DNA, 25 bp, Homo sapien
atgactccgggtcctgaattttctg

SEQ ID NO: 501840 - DNA, 25 bp, Homo sapien
tcctgaattttctgtcgaccttaag

SEQ ID NO: 501841 - DNA, 25 bp, Homo sapien
gtcgaccttaagtttcttgtcacga

SEQ ID NO: 501842 - DNA, 25 bp, Homo sapien
tcttgtcacgagatgacggccatca

SEQ ID NO: 501843 - DNA, 25 bp, Homo sapien
tgacggccatcaccgggtcgagaaa

SEQ ID NO: 501844 - DNA, 25 bp, Homo sapien
gaaaacggccgactggccagccttg

SEQ ID NO: 501845 - DNA, 25 bp, Homo sapien
tttccggcggagtcatagtggcgct

SEQ ID NO: 501846 - DNA, 25 bp, Homo sapien
atagtggcgctatactctcggacag

SEQ ID NO: 501847 - DNA, 25 bp, Homo sapien
tatactctcggacaggttatcctgt

SEQ ID NO: 501848 - DNA, 25 bp, Homo sapien
tctctggctgctaaagttacttctc

SEQ ID NO: 501849 - DNA, 25 bp, Homo sapien
gttacttctcttactttgatcttag

SEQ ID NO: 501850 - DNA, 25 bp, Homo sapien
gaatattaagtctctgcgctcactg

SEQ ID NO: 501851 - DNA, 25 bp, Homo sapien
gctcactgtgggtatctcaggacat

SEQ ID NO: 501852 - DNA, 25 bp, Homo sapien
attcccctgggttgccatctttggt

SEQ ID NO: 501853 - DNA, 25 bp, Homo sapien
atctttggtgttcagaccccaggga

SEQ ID NO: 501854 - DNA, 25 bp, Homo sapien
gggatcaactccagggaattctctg

SEQ ID NO: 501855 - DNA, 25 bp, Homo sapien
ccctcttatgggagaacttctgtgt

SEQ ID NO: 501856 - DNA, 25 bp, Homo sapien
gagtgacccttcaaatatcccaatt

SEQ ID NO: 501857 - DNA, 25 bp, Homo sapien
ttctcttcttgctggcctatgtgaa

SEQ ID NO: 501858 - DNA, 25 bp, Homo sapien
taactacatttctctctggctgcta

SEQ ID NO: 501859 - DNA, 25 bp, Homo sapien
ttttgttttgaagctctatactctg

SEQ ID NO: 501860 - DNA, 25 bp, Homo sapien
gttttgaagctctatactctgggta

SEQ ID NO: 501861 - DNA, 25 bp, Homo sapien
gaagctctatactctgggtacacaa

SEQ ID NO: 501862 - DNA, 25 bp, Homo sapien
gggtacacaacagaagctggccttt

SEQ ID NO: 501863 - DNA, 25 bp, Homo sapien
cacaacagaagctggccttttctct

SEQ ID NO: 501864 - DNA, 25 bp, Homo sapien
caaacacgaaggtatgaaagcatga

SEQ ID NO: 501865 - DNA, 25 bp, Homo sapien
cagatgagtttaatgtgcacagaaa

SEQ ID NO: 501866 - DNA, 25 bp, Homo sapien
gtgcacagaaagctttaggctacct

SEQ ID NO: 501867 - DNA, 25 bp, Homo sapien
tttaggctacctatgttttcaagta

SEQ ID NO: 501868 - DNA, 25 bp, Homo sapien
atgttttcaagtagagatctcagga

SEQ ID NO: 501869 - DNA, 25 bp, Homo sapien
agagatctcaggatttttggaaaat

SEQ ID NO: 501870 - DNA, 25 bp, Homo sapien
atgcctgcacagttcctgtttctgc

SEQ ID NO: 501871 - DNA, 25 bp, Homo sapien
tttctgctgccttatatctactgca

SEQ ID NO: 501872 - DNA, 25 bp, Homo sapien
cttatatctactgcaggaatgtcaa

SEQ ID NO: 501873 - DNA, 25 bp, Homo sapien
ctactgcaggaatgtcaaattcttt

SEQ ID NO: 501874 - DNA, 25 bp, Homo sapien
cgcctggcctaatggcagtgttttt

SEQ ID NO: 501875 - DNA, 25 bp, Homo sapien
gcagttggcctttgttgagaaaatg

SEQ ID NO: 501876 - DNA, 25 bp, Homo sapien
aaaatgtgtgactttgcccaagccc

SEQ ID NO: 501877 - DNA, 25 bp, Homo sapien
tgtgactttgcccaagcccagtaac

SEQ ID NO: 501878 - DNA, 25 bp, Homo sapien
agcccagtaacttggagccttgaat

SEQ ID NO: 501879 - DNA, 25 bp, Homo sapien
tggagccttgaatttgagatgctgg

SEQ ID NO: 501880 - DNA, 25 bp, Homo sapien
atgctggaaagggagtccttcctcc

SEQ ID NO: 501881 - DNA, 25 bp, Homo sapien
ggcaaagttgtaaaggttaccatca

SEQ ID NO: 501882 - DNA, 25 bp, Homo sapien
tatttttggataaagactctgcaca

SEQ ID NO: 501883 - DNA, 25 bp, Homo sapien
gactctgcacaaaactgtaccaggg

SEQ ID NO: 501884 - DNA, 25 bp, Homo sapien
caaaactgtaccagggcaataaaca

SEQ ID NO: 501885 - DNA, 25 bp, Homo sapien
aagcaagcattgctattgacaatgg

SEQ ID NO: 501886 - DNA, 25 bp, Homo sapien
ggaagagcagctgagttcatccgaa

SEQ ID NO: 501887 - DNA, 25 bp, Homo sapien
gcagctgagttcatccgaaggcgaa

SEQ ID NO: 501888 - DNA, 25 bp, Homo sapien
tcatccgaaggcgaaactactttga

SEQ ID NO: 501889 - DNA, 25 bp, Homo sapien
ggcgaaactactttgataaatctaa

SEQ ID NO: 501890 - DNA, 25 bp, Homo sapien
atatgctcggagaacgtgagcctcc

SEQ ID NO: 501891 - DNA, 25 bp, Homo sapien
gctcggagaacgtgagcctccaaag

SEQ ID NO: 501892 - DNA, 25 bp, Homo sapien
ttcttgattactttaccatgtggac

SEQ ID NO: 501893 - DNA, 25 bp, Homo sapien
actttaccatgtggacatatgggat

SEQ ID NO: 501894 - DNA, 25 bp, Homo sapien
gtagattagtaatgcacagctttca

SEQ ID NO: 501895 - DNA, 25 bp, Homo sapien
atttaagacacatgcctgccttagg

SEQ ID NO: 501896 - DNA, 25 bp, Homo sapien
atgcctgccttagggacctggtttt

SEQ ID NO: 501897 - DNA, 25 bp, Homo sapien
taacgtttataatggccacccgact

SEQ ID NO: 501898 - DNA, 25 bp, Homo sapien
tttataatggccacccgacttgtac

SEQ ID NO: 501899 - DNA, 25 bp, Homo sapien
cacccgacttgtacctgggtaatgt

SEQ ID NO: 501900 - DNA, 25 bp, Homo sapien
ttccccagagttctcaattagcatg

SEQ ID NO: 501901 - DNA, 25 bp, Homo sapien
gcatgaatttactacagtcagagtt

SEQ ID NO: 501902 - DNA, 25 bp, Homo sapien
tactacagtcagagtttcctttaaa

SEQ ID NO: 501903 - DNA, 25 bp, Homo sapien
gcatgacatcacttggcttaaacac

SEQ ID NO: 501904 - DNA, 25 bp, Homo sapien
aacaccatggtgtccacaatgtcct

SEQ ID NO: 501905 - DNA, 25 bp, Homo sapien
tggctcagatgctttccggtgcaca

SEQ ID NO: 501906 - DNA, 25 bp, Homo sapien
gcatccacggctagttcaaactttg

SEQ ID NO: 501907 - DNA, 25 bp, Homo sapien
caaactttgagcttagcgtcttgaa

SEQ ID NO: 501908 - DNA, 25 bp, Homo sapien
gataccctcataagtggtaccattt

SEQ ID NO: 501909 - DNA, 25 bp, Homo sapien
ggtaccatttttcacctttacatca

SEQ ID NO: 501910 - DNA, 25 bp, Homo sapien
acctttacatcacaagtggagccca

SEQ ID NO: 501911 - DNA, 25 bp, Homo sapien
gtggagcccacaacagctgtaagga

SEQ ID NO: 501912 - DNA, 25 bp, Homo sapien
catggcaatggctgaatcggtgaac

SEQ ID NO: 501913 - DNA, 25 bp, Homo sapien
atcggtgaacttgtctttagtagca

SEQ ID NO: 501914 - DNA, 25 bp, Homo sapien
agtatttataacctgccttatttca

SEQ ID NO: 501915 - DNA, 25 bp, Homo sapien
gccttatttcattaaattcctctca

SEQ ID NO: 501916 - DNA, 25 bp, Homo sapien
ggaaaacacaatgtatctcttgcag

SEQ ID NO: 501917 - DNA, 25 bp, Homo sapien
acaatgtatctcttgcagcacaggt

SEQ ID NO: 501918 - DNA, 25 bp, Homo sapien
gtatctcttgcagcacaggtaccat

SEQ ID NO: 501919 - DNA, 25 bp, Homo sapien
cttgcagcacaggtaccatgcaggg

SEQ ID NO: 501920 - DNA, 25 bp, Homo sapien
taggatggatgcctaagtaaaccat

SEQ ID NO: 501921 - DNA, 25 bp, Homo sapien
ggatgcctaagtaaaccataggtat

SEQ ID NO: 501922 - DNA, 25 bp, Homo sapien
taggtatggtaaagaagcactccaa

SEQ ID NO: 501923 - DNA, 25 bp, Homo sapien
aagaataatgcttaccactcactcc

SEQ ID NO: 501924 - DNA, 25 bp, Homo sapien
ataatgcttaccactcactcctctt

SEQ ID NO: 501925 - DNA, 25 bp, Homo sapien
aacacataatgttacgttttaggag

SEQ ID NO: 501926 - DNA, 25 bp, Homo sapien
cgtaaggaagtgtcgtgtcgctcat

SEQ ID NO: 501927 - DNA, 25 bp, Homo sapien
gttgggtaacagtggcctcatgttt

SEQ ID NO: 501928 - DNA, 25 bp, Homo sapien
tgtgtgtacacagagcccttaggtt

SEQ ID NO: 501929 - DNA, 25 bp, Homo sapien
gtacacagagcccttaggttctgct

SEQ ID NO: 501930 - DNA, 25 bp, Homo sapien
taggttctgctctgtttctttgcca

SEQ ID NO: 501931 - DNA, 25 bp, Homo sapien
ctctgtttctttgccaggtgaatgt

SEQ ID NO: 501932 - DNA, 25 bp, Homo sapien
gtgaatgtttgtggcatgcgctgct

SEQ ID NO: 501933 - DNA, 25 bp, Homo sapien
atgtttgtggcatgcgctgctgtcc

SEQ ID NO: 501934 - DNA, 25 bp, Homo sapien
tctgtcctgcgcagggttcagctgt

SEQ ID NO: 501935 - DNA, 25 bp, Homo sapien
tgtgcggcgccctgatttcctccat

SEQ ID NO: 501936 - DNA, 25 bp, Homo sapien
tgccagctgggcacgtcaggacctc

SEQ ID NO: 501937 - DNA, 25 bp, Homo sapien
acccacacgatgccacaggtcaggg

SEQ ID NO: 501938 - DNA, 25 bp, Homo sapien
gactagggagccctcccattgcctt

SEQ ID NO: 501939 - DNA, 25 bp, Homo sapien
ttgccttcctggcccgggatagaag

SEQ ID NO: 501940 - DNA, 25 bp, Homo sapien
accctggctgaagtcagcttgacct

SEQ ID NO: 501941 - DNA, 25 bp, Homo sapien
ggctgaagtcagcttgacctaggtc

SEQ ID NO: 501942 - DNA, 25 bp, Homo sapien
ctgaagtcagcttgacctaggtctt

SEQ ID NO: 501943 - DNA, 25 bp, Homo sapien
gaagtcagcttgacctaggtcttga

SEQ ID NO: 501944 - DNA, 25 bp, Homo sapien
agtcagcttgacctaggtcttgacc

SEQ ID NO: 501945 - DNA, 25 bp, Homo sapien
agcttgacctaggtcttgaccctca

SEQ ID NO: 501946 - DNA, 25 bp, Homo sapien
atgaaggagtcggagccctgggtcc

SEQ ID NO: 501947 - DNA, 25 bp, Homo sapien
tgttagcgttgttaatactacctgc

SEQ ID NO: 501948 - DNA, 25 bp, Homo sapien
gttaatactacctgcttttggatag

SEQ ID NO: 501949 - DNA, 25 bp, Homo sapien
actacctgcttttggatagaatgta

SEQ ID NO: 501950 - DNA, 25 bp, Homo sapien
agagctattgttcacataactcaac

SEQ ID NO: 501951 - DNA, 25 bp, Homo sapien
aactcaacagttagtgattgtcaag

SEQ ID NO: 501952 - DNA, 25 bp, Homo sapien
gggaacacgacagacttctgttccg

SEQ ID NO: 501953 - DNA, 25 bp, Homo sapien
aaataacactgtgactccaacctca

SEQ ID NO: 501954 - DNA, 25 bp, Homo sapien
acaacctgtgcgaaagtctaccttt

SEQ ID NO: 501955 - DNA, 25 bp, Homo sapien
aaagtctacctttgatgcagccagt

SEQ ID NO: 501956 - DNA, 25 bp, Homo sapien
ctacctttgatgcagccagtttcat

SEQ ID NO: 501957 - DNA, 25 bp, Homo sapien
tttgatgcagccagtttcattggag

SEQ ID NO: 501958 - DNA, 25 bp, Homo sapien
gttttttaccattgacattctggca

SEQ ID NO: 501959 - DNA, 25 bp, Homo sapien
attctggcatattctgactccttct

SEQ ID NO: 501960 - DNA, 25 bp, Homo sapien
ttttcaccattgttcaattggcaga

SEQ ID NO: 501961 - DNA, 25 bp, Homo sapien
gtaagagttcctttgttctgatcgt

SEQ ID NO: 501962 - DNA, 25 bp, Homo sapien
agttcctttgttctgatcgtttgtc

SEQ ID NO: 501963 - DNA, 25 bp, Homo sapien
gatcgtttgtcactgtatttacatg

SEQ ID NO: 501964 - DNA, 25 bp, Homo sapien
gttctgtatagtagtctgacttacg

SEQ ID NO: 501965 - DNA, 25 bp, Homo sapien
tagtctgacttacgtaaccaattag

SEQ ID NO: 501966 - DNA, 25 bp, Homo sapien
accaattagttgtgtatgtattagc

SEQ ID NO: 501967 - DNA, 25 bp, Homo sapien
gactttgaggtgatgtcttagtcat

SEQ ID NO: 501968 - DNA, 25 bp, Homo sapien
tttttctctacagtttccccataat

SEQ ID NO: 501969 - DNA, 25 bp, Homo sapien
ctaactccacctaggctgccaggga

SEQ ID NO: 501970 - DNA, 25 bp, Homo sapien
acctaggctgccagggaccggagtc

SEQ ID NO: 501971 - DNA, 25 bp, Homo sapien
cagggaccggagtcagctggttcaa

SEQ ID NO: 501972 - DNA, 25 bp, Homo sapien
accggagtcagctggttcaaggcca

SEQ ID NO: 501973 - DNA, 25 bp, Homo sapien
ccggagtcagctggttcaaggccat

SEQ ID NO: 501974 - DNA, 25 bp, Homo sapien
ccagcccactgctaaaatctgtttt

SEQ ID NO: 501975 - DNA, 25 bp, Homo sapien
actacatgagaaagggactcccatt

SEQ ID NO: 501976 - DNA, 25 bp, Homo sapien
gagaaagggactcccatttgccctt

SEQ ID NO: 501977 - DNA, 25 bp, Homo sapien
tttctcctacagtcccttttgtctt

SEQ ID NO: 501978 - DNA, 25 bp, Homo sapien
ctcctacagtcccttttgtcttgtc

SEQ ID NO: 501979 - DNA, 25 bp, Homo sapien
ttgtcttgtctgtcctggctgtctg

SEQ ID NO: 501980 - DNA, 25 bp, Homo sapien
gaagatcatttccttctctttaagg

SEQ ID NO: 501981 - DNA, 25 bp, Homo sapien
tcccagaagtcacacagaacatttc

SEQ ID NO: 501982 - DNA, 25 bp, Homo sapien
ttatattactttggccagaacttgg

SEQ ID NO: 501983 - DNA, 25 bp, Homo sapien
gaacttggtcatatggccacattta

SEQ ID NO: 501984 - DNA, 25 bp, Homo sapien
ggccacatttagttccagaatgatt

SEQ ID NO: 501985 - DNA, 25 bp, Homo sapien
agtcttttattgatccctgtgccca

SEQ ID NO: 501986 - DNA, 25 bp, Homo sapien
ccttgtggtgcaagatgtctcctcc

SEQ ID NO: 501987 - DNA, 25 bp, Homo sapien
gaaaatattggaggcctttttcaag

SEQ ID NO: 501988 - DNA, 25 bp, Homo sapien
tgtctcctccaagctctaggcatta

SEQ ID NO: 501989 - DNA, 25 bp, Homo sapien
aggcattacatctgctatcctgctg

SEQ ID NO: 501990 - DNA, 25 bp, Homo sapien
acatctgctatcctgctgtcagaaa

SEQ ID NO: 501991 - DNA, 25 bp, Homo sapien
tataaaactgtattaagcatggcct

SEQ ID NO: 501992 - DNA, 25 bp, Homo sapien
ttaagcatggcctaagtatttatta

SEQ ID NO: 501993 - DNA, 25 bp, Homo sapien
tgatctgtgtagtatgttccatcag

SEQ ID NO: 501994 - DNA, 25 bp, Homo sapien
gtatgttccatcagaaatatttctt

SEQ ID NO: 501995 - DNA, 25 bp, Homo sapien
ttcttactagtgctttaagctccag

SEQ ID NO: 501996 - DNA, 25 bp, Homo sapien
taagctccagagtaaacagtcattt

SEQ ID NO: 501997 - DNA, 25 bp, Homo sapien
aatggagttcactgggcaggtttcc

SEQ ID NO: 501998 - DNA, 25 bp, Homo sapien
ggcaggtttcccctttaatctagat

SEQ ID NO: 501999 - DNA, 25 bp, Homo sapien
caggtttcccctttaatctagatag

SEQ ID NO: 502000 - DNA, 25 bp, Homo sapien
gatttaaggcactgttttgctaact

SEQ ID NO: 502001 - DNA, 25 bp, Homo sapien
atttgttgcacataacttttttggt

SEQ ID NO: 502002 - DNA, 25 bp, Homo sapien
ggactttattaactaacttcctgca

SEQ ID NO: 502003 - DNA, 25 bp, Homo sapien
acttcctgcagttgtgttcctgtaa

SEQ ID NO: 502004 - DNA, 25 bp, Homo sapien
gtgttcctgtaaactcagtagtgat

SEQ ID NO: 502005 - DNA, 25 bp, Homo sapien
gaacctggtgtttaactctggatcc

SEQ ID NO: 502006 - DNA, 25 bp, Homo sapien
aactctggatccattcactgtacag

SEQ ID NO: 502007 - DNA, 25 bp, Homo sapien
cattcactgtacaggatgtgttgta

SEQ ID NO: 502008 - DNA, 25 bp, Homo sapien
atgctgaggcagtaagagggaattc

SEQ ID NO: 502009 - DNA, 25 bp, Homo sapien
agagggaattcatttgtggcataat

SEQ ID NO: 502010 - DNA, 25 bp, Homo sapien
gacagacaaattccatactactact

SEQ ID NO: 502011 - DNA, 25 bp, Homo sapien
attccatactactactaatgtggtt

SEQ ID NO: 502012 - DNA, 25 bp, Homo sapien
gtggttaattatttctagttcgata

SEQ ID NO: 502013 - DNA, 25 bp, Homo sapien
ggaggtgactggaacacggatccac

SEQ ID NO: 502014 - DNA, 25 bp, Homo sapien
aacacggatccacccctggaggaag

SEQ ID NO: 502015 - DNA, 25 bp, Homo sapien
tcagctcagcgttctactctcatcg

SEQ ID NO: 502016 - DNA, 25 bp, Homo sapien
agcgttctactctcatcgctcttac

SEQ ID NO: 502017 - DNA, 25 bp, Homo sapien
ttactcccgcctttttagtgcctgc

SEQ ID NO: 502018 - DNA, 25 bp, Homo sapien
tagtgcctgccctactccaggataa

SEQ ID NO: 502019 - DNA, 25 bp, Homo sapien
actccaggataattgtgcttttctt

SEQ ID NO: 502020 - DNA, 25 bp, Homo sapien
ttcagttaaatgttagcattgctat

SEQ ID NO: 502021 - DNA, 25 bp, Homo sapien
attattgcaaagcagcacatgcttg

SEQ ID NO: 502022 - DNA, 25 bp, Homo sapien
agcagcacatgcttgttacaaaaac

SEQ ID NO: 502023 - DNA, 25 bp, Homo sapien
gaaaaagctacttccaaatcctact

SEQ ID NO: 502024 - DNA, 25 bp, Homo sapien
aggcacaggataggccagaccctta

SEQ ID NO: 502025 - DNA, 25 bp, Homo sapien
ggataggccagacccttattaggtt

SEQ ID NO: 502026 - DNA, 25 bp, Homo sapien
gtgtaaagaccaagtgtcactgata

SEQ ID NO: 502027 - DNA, 25 bp, Homo sapien
gtcactgatacgcttgtccagattt

SEQ ID NO: 502028 - DNA, 25 bp, Homo sapien
ccagattttcttgtggactttggcc

SEQ ID NO: 502029 - DNA, 25 bp, Homo sapien
gactttggccagtatttagagttta

SEQ ID NO: 502030 - DNA, 25 bp, Homo sapien
agaaacttgctataattaggccatc

SEQ ID NO: 502031 - DNA, 25 bp, Homo sapien
gtatttgccttttccaagtgttttg

SEQ ID NO: 502032 - DNA, 25 bp, Homo sapien
gccatcaaaatatatcctgccactc

SEQ ID NO: 502033 - DNA, 25 bp, Homo sapien
atatatcctgccactcctggtaact

SEQ ID NO: 502034 - DNA, 25 bp, Homo sapien
tttcacactgggagtcaagttcaag

SEQ ID NO: 502035 - DNA, 25 bp, Homo sapien
tcaagtaattacctgtgtcacgaac

SEQ ID NO: 502036 - DNA, 25 bp, Homo sapien
gcatgcagccagcaagcttcggaaa

SEQ ID NO: 502037 - DNA, 25 bp, Homo sapien
gcttcggaaaaccacagcatcaaag

SEQ ID NO: 502038 - DNA, 25 bp, Homo sapien
agacatcccaaataacatgcccagc

SEQ ID NO: 502039 - DNA, 25 bp, Homo sapien
catgatggctttaaagtgtggcttt

SEQ ID NO: 502040 - DNA, 25 bp, Homo sapien
tgcccagctagctctgtactacaga

SEQ ID NO: 502041 - DNA, 25 bp, Homo sapien
gagccctgctactaatcaattactg

SEQ ID NO: 502042 - DNA, 25 bp, Homo sapien
tatcgctaaagatgtccttcctctg

SEQ ID NO: 502043 - DNA, 25 bp, Homo sapien
gtgtggctttagactgctgaccagc

SEQ ID NO: 502044 - DNA, 25 bp, Homo sapien
agggtcaattgttcacagcgatgca

SEQ ID NO: 502045 - DNA, 25 bp, Homo sapien
cagcgatgcacttcattttatcaag

SEQ ID NO: 502046 - DNA, 25 bp, Homo sapien
aacatgacctgcatcctggtctgct

SEQ ID NO: 502047 - DNA, 25 bp, Homo sapien
gggagctagcactggacgcagccct

SEQ ID NO: 502048 - DNA, 25 bp, Homo sapien
agctagcactggacgcagccctggg

SEQ ID NO: 502049 - DNA, 25 bp, Homo sapien
acacagttttcaggactctggcctc

SEQ ID NO: 502050 - DNA, 25 bp, Homo sapien
agttttcaggactctggcctcagag

SEQ ID NO: 502051 - DNA, 25 bp, Homo sapien
tttcaggactctggcctcagaggac

SEQ ID NO: 502052 - DNA, 25 bp, Homo sapien
tctggcctcagaggacatcccagat

SEQ ID NO: 502053 - DNA, 25 bp, Homo sapien
gggctggactgcaaggccactgtca

SEQ ID NO: 502054 - DNA, 25 bp, Homo sapien
ctgcaaggccactgtcattgctgaa

SEQ ID NO: 502055 - DNA, 25 bp, Homo sapien
tttattctcagatctgccaggtctc

SEQ ID NO: 502056 - DNA, 25 bp, Homo sapien
tattctcagatctgccaggtctcag

SEQ ID NO: 502057 - DNA, 25 bp, Homo sapien
gggagtgcttacacttatggagcta

SEQ ID NO: 502058 - DNA, 25 bp, Homo sapien
ggagtgcttacacttatggagctaa

SEQ ID NO: 502059 - DNA, 25 bp, Homo sapien
gagtgcttacacttatggagctaac

SEQ ID NO: 502060 - DNA, 25 bp, Homo sapien
agtgcttacacttatggagctaaca

SEQ ID NO: 502061 - DNA, 25 bp, Homo sapien
gtgcttacacttatggagctaacat

SEQ ID NO: 502062 - DNA, 25 bp, Homo sapien
tgcttacacttatggagctaacatt

SEQ ID NO: 502063 - DNA, 25 bp, Homo sapien
gcttacacttatggagctaacattt

SEQ ID NO: 502064 - DNA, 25 bp, Homo sapien
ttacacttatggagctaacattttc

SEQ ID NO: 502065 - DNA, 25 bp, Homo sapien
acacttatggagctaacattttcag

SEQ ID NO: 502066 - DNA, 25 bp, Homo sapien
cacttatggagctaacattttcaga

SEQ ID NO: 502067 - DNA, 25 bp, Homo sapien
acttatggagctaacattttcagag

SEQ ID NO: 502068 - DNA, 25 bp, Homo sapien
ttagtctagggcttttgtcctccac

SEQ ID NO: 502069 - DNA, 25 bp, Homo sapien
ttttgtcctccacagtctaggcagg

SEQ ID NO: 502070 - DNA, 25 bp, Homo sapien
cacagtctaggcagggcatctttgt

SEQ ID NO: 502071 - DNA, 25 bp, Homo sapien
tctaggcagggcatctttgtatgtg

SEQ ID NO: 502072 - DNA, 25 bp, Homo sapien
cgggagttgtccaggtttaagattg

SEQ ID NO: 502073 - DNA, 25 bp, Homo sapien
tgtccaggtttaagattgtttgttt

SEQ ID NO: 502074 - DNA, 25 bp, Homo sapien
gtttgttttccatcagatccacaag

SEQ ID NO: 502075 - DNA, 25 bp, Homo sapien
gtgggctgaaatccaggttatacct

SEQ ID NO: 502076 - DNA, 25 bp, Homo sapien
aggttatacctattcactatgactt

SEQ ID NO: 502077 - DNA, 25 bp, Homo sapien
tgtaattatttcagttccccgaagt

SEQ ID NO: 502078 - DNA, 25 bp, Homo sapien
tcagttccccgaagttgtatctcaa

SEQ ID NO: 502079 - DNA, 25 bp, Homo sapien
ataggcaaatccatggtgacaaagc

SEQ ID NO: 502080 - DNA, 25 bp, Homo sapien
gtgacaaagccaattagtagttatc

SEQ ID NO: 502081 - DNA, 25 bp, Homo sapien
aagccaattagtagttatcaggaac

SEQ ID NO: 502082 - DNA, 25 bp, Homo sapien
ataatgaatagatgggagtgaccct

SEQ ID NO: 502083 - DNA, 25 bp, Homo sapien
aagggagtgactgcgtaatgcgtat

SEQ ID NO: 502084 - DNA, 25 bp, Homo sapien
gaattacagctggtctgatggtagt

SEQ ID NO: 502085 - DNA, 25 bp, Homo sapien
aaagttggtatatagcccctcactg

SEQ ID NO: 502086 - DNA, 25 bp, Homo sapien
ggtatatagcccctcactgctaaat

SEQ ID NO: 502087 - DNA, 25 bp, Homo sapien
atatagcccctcactgctaaatctg

SEQ ID NO: 502088 - DNA, 25 bp, Homo sapien
gagtgacccttaagaaagcatgcta

SEQ ID NO: 502089 - DNA, 25 bp, Homo sapien
atgaaatatcccaaaataggcaaat

SEQ ID NO: 502090 - DNA, 25 bp, Homo sapien
tcttttccacagagggcttaactga

SEQ ID NO: 502091 - DNA, 25 bp, Homo sapien
agagggcttaactgagaaccgtatt

SEQ ID NO: 502092 - DNA, 25 bp, Homo sapien
gggcttaactgagaaccgtattgat

SEQ ID NO: 502093 - DNA, 25 bp, Homo sapien
gcttaactgagaaccgtattgattt

SEQ ID NO: 502094 - DNA, 25 bp, Homo sapien
ctgagaaccgtattgatttttattt

SEQ ID NO: 502095 - DNA, 25 bp, Homo sapien
ttagttacctccctctagttttatg

SEQ ID NO: 502096 - DNA, 25 bp, Homo sapien
agttacctccctctagttttatgtg

SEQ ID NO: 502097 - DNA, 25 bp, Homo sapien
gttacctccctctagttttatgtga

SEQ ID NO: 502098 - DNA, 25 bp, Homo sapien
tacctccctctagttttatgtgaaa

SEQ ID NO: 502099 - DNA, 25 bp, Homo sapien
tagaatcagggaggacgggacttat

SEQ ID NO: 502100 - DNA, 25 bp, Homo sapien
ggacgggacttatgctgtggtaggc

SEQ ID NO: 502101 - DNA, 25 bp, Homo sapien
ttgaggtagatagccaagtttgtct

SEQ ID NO: 502102 - DNA, 25 bp, Homo sapien
gatagccaagtttgtctgtttttgt

SEQ ID NO: 502103 - DNA, 25 bp, Homo sapien
tgttttttatagttacagagtctca

SEQ ID NO: 502104 - DNA, 25 bp, Homo sapien
atagctcactgagattgccaggttc

SEQ ID NO: 502105 - DNA, 25 bp, Homo sapien
gattgccaggttcgacaaagaggaa

SEQ ID NO: 502106 - DNA, 25 bp, Homo sapien
gatatagggtagacttgactctgct

SEQ ID NO: 502107 - DNA, 25 bp, Homo sapien
acttgactctgctttatccgggaaa

SEQ ID NO: 502108 - DNA, 25 bp, Homo sapien
gactctgctttatccgggaaagctt

SEQ ID NO: 502109 - DNA, 25 bp, Homo sapien
atgctttacattactattcctatct

SEQ ID NO: 502110 - DNA, 25 bp, Homo sapien
cattactattcctatcttttacttt

SEQ ID NO: 502111 - DNA, 25 bp, Homo sapien
caagttcaaaggcatgagggtgatt

SEQ ID NO: 502112 - DNA, 25 bp, Homo sapien
aatgtggtcagggtagctaggcaac

SEQ ID NO: 502113 - DNA, 25 bp, Homo sapien
tagctaggcaacagtagcatcacca

SEQ ID NO: 502114 - DNA, 25 bp, Homo sapien
taaacggcaacaacaatggcaggct

SEQ ID NO: 502115 - DNA, 25 bp, Homo sapien
acggcaacaacaatggcaggctttc

SEQ ID NO: 502116 - DNA, 25 bp, Homo sapien
aacaatggcaggctttcagtttccc

SEQ ID NO: 502117 - DNA, 25 bp, Homo sapien
tcagtttcccccttaatgatgctgt

SEQ ID NO: 502118 - DNA, 25 bp, Homo sapien
ttgtaggtgaagagaaccagaagca

SEQ ID NO: 502119 - DNA, 25 bp, Homo sapien
gccaggaagtggatctttttaggga

SEQ ID NO: 502120 - DNA, 25 bp, Homo sapien
ctttttagggatgtggcattttgct

SEQ ID NO: 502121 - DNA, 25 bp, Homo sapien
aataaactgtgttgggcccctgcaa

SEQ ID NO: 502122 - DNA, 25 bp, Homo sapien
ataaactgtgttgggcccctgcaaa

SEQ ID NO: 502123 - DNA, 25 bp, Homo sapien
ggagagggtccctcctgggtagctg

SEQ ID NO: 502124 - DNA, 25 bp, Homo sapien
agctggagagtagagggtcccgcct

SEQ ID NO: 502125 - DNA, 25 bp, Homo sapien
cagtgggacccttcaggaccctggg

SEQ ID NO: 502126 - DNA, 25 bp, Homo sapien
tgggacccttcaggaccctgggctg

SEQ ID NO: 502127 - DNA, 25 bp, Homo sapien
tgggctggaaccaccaccactggtc

SEQ ID NO: 502128 - DNA, 25 bp, Homo sapien
actggtcctgtctcaagtgcactta

SEQ ID NO: 502129 - DNA, 25 bp, Homo sapien
ggtcctgtctcaagtgcacttaggg

SEQ ID NO: 502130 - DNA, 25 bp, Homo sapien
cctgtctccatttccagttccagga

SEQ ID NO: 502131 - DNA, 25 bp, Homo sapien
atttgcccctgtgccttatacacgt

SEQ ID NO: 502132 - DNA, 25 bp, Homo sapien
gggagccaccaagcactttggagct

SEQ ID NO: 502133 - DNA, 25 bp, Homo sapien
agccaccaagcactttggagctggc

SEQ ID NO: 502134 - DNA, 25 bp, Homo sapien
ggaaatgttttccaaaccacagtct

SEQ ID NO: 502135 - DNA, 25 bp, Homo sapien
cagtctctttagaactaagcctatt

SEQ ID NO: 502136 - DNA, 25 bp, Homo sapien
taagcctatttgaaacggtcggtgt

SEQ ID NO: 502137 - DNA, 25 bp, Homo sapien
gaaacggtcggtgtaggcttactga

SEQ ID NO: 502138 - DNA, 25 bp, Homo sapien
cggtgtaggcttactgagatcagga

SEQ ID NO: 502139 - DNA, 25 bp, Homo sapien
aggagacagggaggccccgcacatc

SEQ ID NO: 502140 - DNA, 25 bp, Homo sapien
gccccgcacatcacacagataaagt

SEQ ID NO: 502141 - DNA, 25 bp, Homo sapien
gtaattaatacttttgctgcctcaa

SEQ ID NO: 502142 - DNA, 25 bp, Homo sapien
tttgctgcctcaagttgttttttaa

SEQ ID NO: 502143 - DNA, 25 bp, Homo sapien
atgagaatcatgctgcaatatgatc

SEQ ID NO: 502144 - DNA, 25 bp, Homo sapien
gcaatatgatcattctagagcaaat

SEQ ID NO: 502145 - DNA, 25 bp, Homo sapien
aaatcagaaactataatgcttccaa

SEQ ID NO: 502146 - DNA, 25 bp, Homo sapien
taatgcttccaacattgttcctttt

SEQ ID NO: 502147 - DNA, 25 bp, Homo sapien
gattgttaggtactttattgtctct

SEQ ID NO: 502148 - DNA, 25 bp, Homo sapien
tgttaggtactttattgtctcttga

SEQ ID NO: 502149 - DNA, 25 bp, Homo sapien
agattccatatactttaggggttgc

SEQ ID NO: 502150 - DNA, 25 bp, Homo sapien
gagaaattgagaaaacattgcatta

SEQ ID NO: 502151 - DNA, 25 bp, Homo sapien
cttgtagattacattgagcagtata

SEQ ID NO: 502152 - DNA, 25 bp, Homo sapien
gagcagtatagacatcttcccaata

SEQ ID NO: 502153 - DNA, 25 bp, Homo sapien
gtatagacatcttcccaatatttca

SEQ ID NO: 502154 - DNA, 25 bp, Homo sapien
gacatcttcccaatatttcaacttt

SEQ ID NO: 502155 - DNA, 25 bp, Homo sapien
aagcatgctaaagaatgtggtttaa

SEQ ID NO: 502156 - DNA, 25 bp, Homo sapien
tgactagcaaggcacaaccctataa

SEQ ID NO: 502157 - DNA, 25 bp, Homo sapien
aggcacaaccctataatggcagaag

SEQ ID NO: 502158 - DNA, 25 bp, Homo sapien
ataatggcagaagcccttctttccc

SEQ ID NO: 502159 - DNA, 25 bp, Homo sapien
agacccacttccttgatgggcctct

SEQ ID NO: 502160 - DNA, 25 bp, Homo sapien
tccttgatgggcctctagcaccctt

SEQ ID NO: 502161 - DNA, 25 bp, Homo sapien
tctagcacccttccaagctgatggg

SEQ ID NO: 502162 - DNA, 25 bp, Homo sapien
gaaggggctgtactgtttctttaca

SEQ ID NO: 502163 - DNA, 25 bp, Homo sapien
tttctttacatctcacggggactag

SEQ ID NO: 502164 - DNA, 25 bp, Homo sapien
gggactagagccagtactgaatggc

SEQ ID NO: 502165 - DNA, 25 bp, Homo sapien
gtactgaatggcttttctaggtagt

SEQ ID NO: 502166 - DNA, 25 bp, Homo sapien
atggcttttctaggtagtgtgttag

SEQ ID NO: 502167 - DNA, 25 bp, Homo sapien
agaaagggcctattcacgtttcctg

SEQ ID NO: 502168 - DNA, 25 bp, Homo sapien
attcacgtttcctggagacgccgga

SEQ ID NO: 502169 - DNA, 25 bp, Homo sapien
agacgccggagtgcccagcttgtgc

SEQ ID NO: 502170 - DNA, 25 bp, Homo sapien
ttgtgctcaccactcaagcagctct

SEQ ID NO: 502171 - DNA, 25 bp, Homo sapien
agaattgcagaatttccctctcggc

SEQ ID NO: 502172 - DNA, 25 bp, Homo sapien
tcggcccgaatgagccattaccaaa

SEQ ID NO: 502173 - DNA, 25 bp, Homo sapien
agtgaagttagtttggccttccaag

SEQ ID NO: 502174 - DNA, 25 bp, Homo sapien
ttggccttccaaggttaggtggtgt

SEQ ID NO: 502175 - DNA, 25 bp, Homo sapien
tgcgggaccgaggttcagaatttct

SEQ ID NO: 502176 - DNA, 25 bp, Homo sapien
cactcctcagaatgcaactctgtac

SEQ ID NO: 502177 - DNA, 25 bp, Homo sapien
aatgcaactctgtacgacgaaggaa

SEQ ID NO: 502178 - DNA, 25 bp, Homo sapien
agcttgttcccatcatacccgtaat

SEQ ID NO: 502179 - DNA, 25 bp, Homo sapien
gcttgttcccatcatacccgtaatg

SEQ ID NO: 502180 - DNA, 25 bp, Homo sapien
cttgttcccatcatacccgtaatgc

SEQ ID NO: 502181 - DNA, 25 bp, Homo sapien
ttgttcccatcatacccgtaatgct

SEQ ID NO: 502182 - DNA, 25 bp, Homo sapien
tgttcccatcatacccgtaatgctt

SEQ ID NO: 502183 - DNA, 25 bp, Homo sapien
gttcccatcatacccgtaatgcttt

SEQ ID NO: 502184 - DNA, 25 bp, Homo sapien
ccatcatacccgtaatgctttcttt

SEQ ID NO: 502185 - DNA, 25 bp, Homo sapien
catcatacccgtaatgctttctttt

SEQ ID NO: 502186 - DNA, 25 bp, Homo sapien
atcatacccgtaatgctttcttttt

SEQ ID NO: 502187 - DNA, 25 bp, Homo sapien
tcttttttcctttattgccaatctt

SEQ ID NO: 502188 - DNA, 25 bp, Homo sapien
tttcctttattgccaatctttgaac

SEQ ID NO: 502189 - DNA, 25 bp, Homo sapien
attaaggctttcatccctgggacct

SEQ ID NO: 502190 - DNA, 25 bp, Homo sapien
tcatccctgggacctcaagataatg

SEQ ID NO: 502191 - DNA, 25 bp, Homo sapien
gggacctcaagataatggtggtatt

SEQ ID NO: 502192 - DNA, 25 bp, Homo sapien
aatggggccctcattcaatatgact

SEQ ID NO: 502193 - DNA, 25 bp, Homo sapien
gataccagggtagcaggcacagaat

SEQ ID NO: 502194 - DNA, 25 bp, Homo sapien
cagaattttatgtgaagtgaccgga

SEQ ID NO: 502195 - DNA, 25 bp, Homo sapien
tgaagtgaccggaaatggttacctt

SEQ ID NO: 502196 - DNA, 25 bp, Homo sapien
taccttcaaggcaaagagagattcc

SEQ ID NO: 502197 - DNA, 25 bp, Homo sapien
aggctcattatagaggaaatcatcc

SEQ ID NO: 502198 - DNA, 25 bp, Homo sapien
catccttatctacactttgatcctg

SEQ ID NO: 502199 - DNA, 25 bp, Homo sapien
tatctacactttgatcctggacttc

SEQ ID NO: 502200 - DNA, 25 bp, Homo sapien
gaggacacagactgcgaccagaaca

SEQ ID NO: 502201 - DNA, 25 bp, Homo sapien
gactgcgaccagaacagaaatatga

SEQ ID NO: 502202 - DNA, 25 bp, Homo sapien
tgaaaatgtgaatgacagcgtcccc

SEQ ID NO: 502203 - DNA, 25 bp, Homo sapien
gtctcttaagtctcagaatctcccc

SEQ ID NO: 502204 - DNA, 25 bp, Homo sapien
ttaagtctcagaatctcccctagct

SEQ ID NO: 502205 - DNA, 25 bp, Homo sapien
agtggttgtcccctcaaagctgtcc

SEQ ID NO: 502206 - DNA, 25 bp, Homo sapien
ctttgtgtatctcctccagctaccg

SEQ ID NO: 502207 - DNA, 25 bp, Homo sapien
tgtatctcctccagctaccgcagag

SEQ ID NO: 502208 - DNA, 25 bp, Homo sapien
agagcccacaaacccaggcatctat

SEQ ID NO: 502209 - DNA, 25 bp, Homo sapien
aacccaggcatctatcaaagtccct

SEQ ID NO: 502210 - DNA, 25 bp, Homo sapien
aaagtccctcattcatgagggtggt

SEQ ID NO: 502211 - DNA, 25 bp, Homo sapien
tagaaactttaaatcgccccagagt

SEQ ID NO: 502212 - DNA, 25 bp, Homo sapien
aaatcgccccagagtttgcctgttt

SEQ ID NO: 502213 - DNA, 25 bp, Homo sapien
ccagagtttgcctgtttccatattt

SEQ ID NO: 502214 - DNA, 25 bp, Homo sapien
tattttattaccttataatcttcgg

SEQ ID NO: 502215 - DNA, 25 bp, Homo sapien
tataatcttcgggagtgcttacact

SEQ ID NO: 502216 - DNA, 25 bp, Homo sapien
gagtgcttacacttatggagctaac

SEQ ID NO: 502217 - DNA, 25 bp, Homo sapien
tggagctaacattttcagagataca

SEQ ID NO: 502218 - DNA, 25 bp, Homo sapien
gagatacagcttcttatagtaacac

SEQ ID NO: 502219 - DNA, 25 bp, Homo sapien
gatacagcttcttatagtaacacta

SEQ ID NO: 502220 - DNA, 25 bp, Homo sapien
tacagcttcttatagtaacactaaa

SEQ ID NO: 502221 - DNA, 25 bp, Homo sapien
agcttcttatagtaacactaaaact

SEQ ID NO: 502222 - DNA, 25 bp, Homo sapien
gcggctttatattcaggagaatctg

SEQ ID NO: 502223 - DNA, 25 bp, Homo sapien
atctggcttataataggactttgca

SEQ ID NO: 502224 - DNA, 25 bp, Homo sapien
gtcagcagtcagcaaattaacatca

SEQ ID NO: 502225 - DNA, 25 bp, Homo sapien
taacatcatcatactcttccatttt

SEQ ID NO: 502226 - DNA, 25 bp, Homo sapien
actcttccatttttagtttctgttg

SEQ ID NO: 502227 - DNA, 25 bp, Homo sapien
gtttctgttggattttcatcaagtc

SEQ ID NO: 502228 - DNA, 25 bp, Homo sapien
gattttcatcaagtcaatgggctga

SEQ ID NO: 502229 - DNA, 25 bp, Homo sapien
tagtctggttgatttcttcgctttg

SEQ ID NO: 502230 - DNA, 25 bp, Homo sapien
ttcttcgctttggtgccctaatgaa

SEQ ID NO: 502231 - DNA, 25 bp, Homo sapien
ttggtgccctaatgaagagctcaca

SEQ ID NO: 502232 - DNA, 25 bp, Homo sapien
gagaagtctgccctgttcatcctta

SEQ ID NO: 502233 - DNA, 25 bp, Homo sapien
gtccttttggctatggttgcggttc

SEQ ID NO: 502234 - DNA, 25 bp, Homo sapien
tgcggttcccctgtaaagcaagtgt

SEQ ID NO: 502235 - DNA, 25 bp, Homo sapien
aagcacggctgaggctgagtcagtt

SEQ ID NO: 502236 - DNA, 25 bp, Homo sapien
tcagttgaccgttgaggaagaccta

SEQ ID NO: 502237 - DNA, 25 bp, Homo sapien
ctaaggagctgtccagttcttggct

SEQ ID NO: 502238 - DNA, 25 bp, Homo sapien
tttttcactgtgactgcacagcggt

SEQ ID NO: 502239 - DNA, 25 bp, Homo sapien
gcacagcggtttccttcttcatagt

SEQ ID NO: 502240 - DNA, 25 bp, Homo sapien
tcttcatagtcccttgctgtagtca

SEQ ID NO: 502241 - DNA, 25 bp, Homo sapien
agcatgctagtgttttcctcttgta

SEQ ID NO: 502242 - DNA, 25 bp, Homo sapien
tttcctcttgtacctgcttatgcag

SEQ ID NO: 502243 - DNA, 25 bp, Homo sapien
cctgcttatgcagagctcagatata

SEQ ID NO: 502244 - DNA, 25 bp, Homo sapien
tttaaacacggaatgattggcaata

SEQ ID NO: 502245 - DNA, 25 bp, Homo sapien
ggttattatcagagattttcctttt

SEQ ID NO: 502246 - DNA, 25 bp, Homo sapien
aaacagttattcattaattccacaa

SEQ ID NO: 502247 - DNA, 25 bp, Homo sapien
atttatcaggcttctattatatgtg

SEQ ID NO: 502248 - DNA, 25 bp, Homo sapien
gcttctattatatgtgaggcactga

SEQ ID NO: 502249 - DNA, 25 bp, Homo sapien
gctgggcatggctgtaaaggaacca

SEQ ID NO: 502250 - DNA, 25 bp, Homo sapien
gctgtaaaggaaccatctaggaagt

SEQ ID NO: 502251 - DNA, 25 bp, Homo sapien
tctaggaagtaattatgcaatcatt

SEQ ID NO: 502252 - DNA, 25 bp, Homo sapien
tgcaatcatttctgaacctgtttca

SEQ ID NO: 502253 - DNA, 25 bp, Homo sapien
atcagtgttgggtttatcagtgttt

SEQ ID NO: 502254 - DNA, 25 bp, Homo sapien
taacattgtttgatagtcccctcac

SEQ ID NO: 502255 - DNA, 25 bp, Homo sapien
gagatacagcttcttatagtaacac

SEQ ID NO: 502256 - DNA, 25 bp, Homo sapien
agatacagcttcttatagtaacact

SEQ ID NO: 502257 - DNA, 25 bp, Homo sapien
gatacagcttcttatagtaacacta

SEQ ID NO: 502258 - DNA, 25 bp, Homo sapien
atacagcttcttatagtaacactaa

SEQ ID NO: 502259 - DNA, 25 bp, Homo sapien
tacagcttcttatagtaacactaaa

SEQ ID NO: 502260 - DNA, 25 bp, Homo sapien
acagcttcttatagtaacactaaaa

SEQ ID NO: 502261 - DNA, 25 bp, Homo sapien
cagcttcttatagtaacactaaaac

SEQ ID NO: 502262 - DNA, 25 bp, Homo sapien
agcttcttatagtaacactaaaact

SEQ ID NO: 502263 - DNA, 25 bp, Homo sapien
acctataattataactatatggtag

SEQ ID NO: 502264 - DNA, 25 bp, Homo sapien
cctataattataactatatggtagt

SEQ ID NO: 502265 - DNA, 25 bp, Homo sapien
gaaatttactaatgactgaagaaca

SEQ ID NO: 502266 - DNA, 25 bp, Homo sapien
gaacatttgtattggattttaagtc

SEQ ID NO: 502267 - DNA, 25 bp, Homo sapien
gggaactgaaaccaaattggactat

SEQ ID NO: 502268 - DNA, 25 bp, Homo sapien
gataatcttttgtttcaccagcttt

SEQ ID NO: 502269 - DNA, 25 bp, Homo sapien
atcttttgtttcaccagctttctac

SEQ ID NO: 502270 - DNA, 25 bp, Homo sapien
gtttcaccagctttctacttataca

SEQ ID NO: 502271 - DNA, 25 bp, Homo sapien
ttcaccagctttctacttatacact

SEQ ID NO: 502272 - DNA, 25 bp, Homo sapien
tccttggcttttgggcttattttct

SEQ ID NO: 502273 - DNA, 25 bp, Homo sapien
cttattttcttgcactggtgcagat

SEQ ID NO: 502274 - DNA, 25 bp, Homo sapien
gcactggtgcagatctggtaaacat

SEQ ID NO: 502275 - DNA, 25 bp, Homo sapien
gatctggtaaacattaaaggcttga

SEQ ID NO: 502276 - DNA, 25 bp, Homo sapien
tacctatcccaagctatacactaag

SEQ ID NO: 502277 - DNA, 25 bp, Homo sapien
gctatacactaagatttttcaggat

SEQ ID NO: 502278 - DNA, 25 bp, Homo sapien
ggcacagagagctttaagggaatct

SEQ ID NO: 502279 - DNA, 25 bp, Homo sapien
agggaatctgtttctagtcttcgga

SEQ ID NO: 502280 - DNA, 25 bp, Homo sapien
agtcttcggagatcttgtttatgtt

SEQ ID NO: 502281 - DNA, 25 bp, Homo sapien
gttttttgcattgtcttttccaaag

SEQ ID NO: 502282 - DNA, 25 bp, Homo sapien
gtcttttccaaagtctcttacttgt

SEQ ID NO: 502283 - DNA, 25 bp, Homo sapien
agtctcttacttgttaccttttgct

SEQ ID NO: 502284 - DNA, 25 bp, Homo sapien
tacttgttaccttttgctgttatgt

SEQ ID NO: 502285 - DNA, 25 bp, Homo sapien
gctgttatgtatttcccattatgca

SEQ ID NO: 502286 - DNA, 25 bp, Homo sapien
atttcccattatgcattgatccaag

SEQ ID NO: 502287 - DNA, 25 bp, Homo sapien
aacagagcacccacttattctttgc

SEQ ID NO: 502288 - DNA, 25 bp, Homo sapien
tattctttgcccttggatgttctgc

SEQ ID NO: 502289 - DNA, 25 bp, Homo sapien
aacctgtccttgctaagactgtgag

SEQ ID NO: 502290 - DNA, 25 bp, Homo sapien
gactgtgagttcagctaagcaaggc

SEQ ID NO: 502291 - DNA, 25 bp, Homo sapien
agagagtggtagtgtgttccaagaa

SEQ ID NO: 502292 - DNA, 25 bp, Homo sapien
gaagatgggacaacctgagtggaaa

SEQ ID NO: 502293 - DNA, 25 bp, Homo sapien
aacctgagtggaaagccatggcagt

SEQ ID NO: 502294 - DNA, 25 bp, Homo sapien
atagcatgttgtgttcttggaatta

SEQ ID NO: 502295 - DNA, 25 bp, Homo sapien
tttacagttgttggatctaggtgat

SEQ ID NO: 502296 - DNA, 25 bp, Homo sapien
aaaggctcaccaactttttatcagt

SEQ ID NO: 502297 - DNA, 25 bp, Homo sapien
gattttctgccaacagagcacccac

SEQ ID NO: 502298 - DNA, 25 bp, Homo sapien
tcatgatgcttctcagaccggcaac

SEQ ID NO: 502299 - DNA, 25 bp, Homo sapien
tctcagaccggcaacatcagcatca

SEQ ID NO: 502300 - DNA, 25 bp, Homo sapien
tcagcatcactggaacttgttaaaa

SEQ ID NO: 502301 - DNA, 25 bp, Homo sapien
aaaatggacactctcagaacccaca

SEQ ID NO: 502302 - DNA, 25 bp, Homo sapien
acaccagacccaccaaatcagtttg

SEQ ID NO: 502303 - DNA, 25 bp, Homo sapien
agaactgccattcagtagagaatta

SEQ ID NO: 502304 - DNA, 25 bp, Homo sapien
agagaattatttgcctactgtaaat

SEQ ID NO: 502305 - DNA, 25 bp, Homo sapien
tctaaggatttatgatgggctattt

SEQ ID NO: 502306 - DNA, 25 bp, Homo sapien
atttttgacccataggctcagagaa

SEQ ID NO: 502307 - DNA, 25 bp, Homo sapien
gacccataggctcagagaatcctgc

SEQ ID NO: 502308 - DNA, 25 bp, Homo sapien
ggaattgtaggcgtgcgaccacacc

SEQ ID NO: 502309 - DNA, 25 bp, Homo sapien
tctttgtttccatcagaataaccaa

SEQ ID NO: 502310 - DNA, 25 bp, Homo sapien
gaataaccaaaagcatttaaacgtg

SEQ ID NO: 502311 - DNA, 25 bp, Homo sapien
tccccagtgcctctgtatggcccta

SEQ ID NO: 502312 - DNA, 25 bp, Homo sapien
tttctccatccatctagactccaga

SEQ ID NO: 502313 - DNA, 25 bp, Homo sapien
ccatccatctagactccagaaacaa

SEQ ID NO: 502314 - DNA, 25 bp, Homo sapien
gactccagaaacaaaaatcaacaca

SEQ ID NO: 502315 - DNA, 25 bp, Homo sapien
agagtattcattatggcaggtgtct

SEQ ID NO: 502316 - DNA, 25 bp, Homo sapien
tcattatggcaggtgtctgtctgta

SEQ ID NO: 502317 - DNA, 25 bp, Homo sapien
gggcatgcgcacatggcaatcctga

SEQ ID NO: 502318 - DNA, 25 bp, Homo sapien
atgcgcacatggcaatcctgaccac

SEQ ID NO: 502319 - DNA, 25 bp, Homo sapien
atggcaatcctgaccaccacctgag

SEQ ID NO: 502320 - DNA, 25 bp, Homo sapien
taactcgagttagttcttatttcct

SEQ ID NO: 502321 - DNA, 25 bp, Homo sapien
gagttagttcttatttcctctgttt

SEQ ID NO: 502322 - DNA, 25 bp, Homo sapien
ttttattctaagtacactgattctg

SEQ ID NO: 502323 - DNA, 25 bp, Homo sapien
cactgattctgtgaatgtacctttt

SEQ ID NO: 502324 - DNA, 25 bp, Homo sapien
aatgaattaatttgatatgctctaa

SEQ ID NO: 502325 - DNA, 25 bp, Homo sapien
ctctaaatacataaaggtgcttcaa

SEQ ID NO: 502326 - DNA, 25 bp, Homo sapien
tcctgaggtttttcggtcttgttca

SEQ ID NO: 502327 - DNA, 25 bp, Homo sapien
ggaagaattcttgcctgccatacag

SEQ ID NO: 502328 - DNA, 25 bp, Homo sapien
ttcttgcctgccatacagaaactct

SEQ ID NO: 502329 - DNA, 25 bp, Homo sapien
tacagaaactctctagcactccctg

SEQ ID NO: 502330 - DNA, 25 bp, Homo sapien
tagcactccctgaccttaagctttt

SEQ ID NO: 502331 - DNA, 25 bp, Homo sapien
atcctgtctctactaccgtgtttac

SEQ ID NO: 502332 - DNA, 25 bp, Homo sapien
cgtgtttacccaaaatccagagaag

SEQ ID NO: 502333 - DNA, 25 bp, Homo sapien
tccagagaaggcaagttccagaacc

SEQ ID NO: 502334 - DNA, 25 bp, Homo sapien
cttcattacttggttcccgtgcgac

SEQ ID NO: 502335 - DNA, 25 bp, Homo sapien
gacgacagattgtctatcctctgga

SEQ ID NO: 502336 - DNA, 25 bp, Homo sapien
gaaaagcttggcataaacgctccat

SEQ ID NO: 502337 - DNA, 25 bp, Homo sapien
taaacgctccatcaaaggcggtctc

SEQ ID NO: 502338 - DNA, 25 bp, Homo sapien
aaggcggtctccaaggatccgatga

SEQ ID NO: 502339 - DNA, 25 bp, Homo sapien
ccaaggatccgatgagttatgcttt

SEQ ID NO: 502340 - DNA, 25 bp, Homo sapien
gaaggagatcctgcgtttaggcttt

SEQ ID NO: 502341 - DNA, 25 bp, Homo sapien
gtttaggctttaaatcctgtctcta

SEQ ID NO: 502342 - DNA, 25 bp, Homo sapien
ccttattatcagatgtattttttct

SEQ ID NO: 502343 - DNA, 25 bp, Homo sapien
ttcttttaagtttcaatgttgttat

SEQ ID NO: 502344 - DNA, 25 bp, Homo sapien
agtttcaatgttgttataattctca

SEQ ID NO: 502345 - DNA, 25 bp, Homo sapien
gtttcaatgttgttataattctcaa

SEQ ID NO: 502346 - DNA, 25 bp, Homo sapien
ttcaatgttgttataattctcaacc

SEQ ID NO: 502347 - DNA, 25 bp, Homo sapien
aattctcaaccagaaatttaatact

SEQ ID NO: 502348 - DNA, 25 bp, Homo sapien
taaatttagcttgtgcttttgaatt

SEQ ID NO: 502349 - DNA, 25 bp, Homo sapien
aaatttagcttgtgcttttgaatta

SEQ ID NO: 502350 - DNA, 25 bp, Homo sapien
gtgcttttgaattacaggagaaggg

SEQ ID NO: 502351 - DNA, 25 bp, Homo sapien
tttgaattacaggagaagggaatca

SEQ ID NO: 502352 - DNA, 25 bp, Homo sapien
cataatttaataaaacgcttactag

SEQ ID NO: 502353 - DNA, 25 bp, Homo sapien
ccttccaacctcagcattctgagta

SEQ ID NO: 502354 - DNA, 25 bp, Homo sapien
tgggatcacaggtgctccccatcac

SEQ ID NO: 502355 - DNA, 25 bp, Homo sapien
actgcctctgccttcaggtagcaat

SEQ ID NO: 502356 - DNA, 25 bp, Homo sapien
tgcctctgccttcaggtagcaattt

SEQ ID NO: 502357 - DNA, 25 bp, Homo sapien
gcctctgccttcaggtagcaatttt

SEQ ID NO: 502358 - DNA, 25 bp, Homo sapien
cctctgccttcaggtagcaatttta

SEQ ID NO: 502359 - DNA, 25 bp, Homo sapien
tctgccttcaggtagcaattttatt

SEQ ID NO: 502360 - DNA, 25 bp, Homo sapien
tcaggtagcaattttattagcaaac

SEQ ID NO: 502361 - DNA, 25 bp, Homo sapien
gtagcaattttattagcaaactata

SEQ ID NO: 502362 - DNA, 25 bp, Homo sapien
tagcaaactataagcctaaagtaat

SEQ ID NO: 502363 - DNA, 25 bp, Homo sapien
attctcactgtgatattcattacta

SEQ ID NO: 502364 - DNA, 25 bp, Homo sapien
atgactaagtagttatgtgaagaaa

SEQ ID NO: 502365 - DNA, 25 bp, Homo sapien
gaatggaacattgctagaagagtta

SEQ ID NO: 502366 - DNA, 25 bp, Homo sapien
tggaacattgctagaagagttagaa

SEQ ID NO: 502367 - DNA, 25 bp, Homo sapien
agagttagaagtcattgctccagag

SEQ ID NO: 502368 - DNA, 25 bp, Homo sapien
gagttagaagtcattgctccagaga

SEQ ID NO: 502369 - DNA, 25 bp, Homo sapien
agttagaagtcattgctccagagaa

SEQ ID NO: 502370 - DNA, 25 bp, Homo sapien
gttagaagtcattgctccagagaat

SEQ ID NO: 502371 - DNA, 25 bp, Homo sapien
ttagaagtcattgctccagagaatt

SEQ ID NO: 502372 - DNA, 25 bp, Homo sapien
taaaacccatggaggtaactaccag

SEQ ID NO: 502373 - DNA, 25 bp, Homo sapien
aacccatggaggtaactaccagaag

SEQ ID NO: 502374 - DNA, 25 bp, Homo sapien
ccatggaggtaactaccagaaggaa

SEQ ID NO: 502375 - DNA, 25 bp, Homo sapien
acttatgaggcctgggtccagtacc

SEQ ID NO: 502376 - DNA, 25 bp, Homo sapien
tgaggcctgggtccagtaccatcct

SEQ ID NO: 502377 - DNA, 25 bp, Homo sapien
gaaattggccaaatcgagctgtgga

SEQ ID NO: 502378 - DNA, 25 bp, Homo sapien
ttggccaaatcgagctgtggagttt

SEQ ID NO: 502379 - DNA, 25 bp, Homo sapien
gccaaatcgagctgtggagtttagt

SEQ ID NO: 502380 - DNA, 25 bp, Homo sapien
cgagctgtggagtttagtacatcat

SEQ ID NO: 502381 - DNA, 25 bp, Homo sapien
aggagacgcaatccaccaccacgaa

SEQ ID NO: 502382 - DNA, 25 bp, Homo sapien
acgaactcttcatccgatcagcacg

SEQ ID NO: 502383 - DNA, 25 bp, Homo sapien
tcttcatccgatcagcacgagccat

SEQ ID NO: 502384 - DNA, 25 bp, Homo sapien
atccgatcagcacgagccattcatg

SEQ ID NO: 502385 - DNA, 25 bp, Homo sapien
acgagccattcatgtgctgaaacac

SEQ ID NO: 502386 - DNA, 25 bp, Homo sapien
attagtgatattctcatgcctggac

SEQ ID NO: 502387 - DNA, 25 bp, Homo sapien
gtgatattctcatgcctggacaaaa

SEQ ID NO: 502388 - DNA, 25 bp, Homo sapien
ctcatgcctggacaaaatctttaat

SEQ ID NO: 502389 - DNA, 25 bp, Homo sapien
gaagacttctctataatttcaatta

SEQ ID NO: 502390 - DNA, 25 bp, Homo sapien
gcttaagaacttttagtctacatat

SEQ ID NO: 502391 - DNA, 25 bp, Homo sapien
attgtacaactggtgattgttcaaa

SEQ ID NO: 502392 - DNA, 25 bp, Homo sapien
gttcaaattgttgtactactactct

SEQ ID NO: 502393 - DNA, 25 bp, Homo sapien
gttgtactactactcttcaattgta

SEQ ID NO: 502394 - DNA, 25 bp, Homo sapien
ttcaattgtactgtgcagggaagtt

SEQ ID NO: 502395 - DNA, 25 bp, Homo sapien
gggaacagttcatactatagagagt

SEQ ID NO: 502396 - DNA, 25 bp, Homo sapien
gtgtaaatcgattagctatttatcc

SEQ ID NO: 502397 - DNA, 25 bp, Homo sapien
ttcccaggtacttaaaatacaagtg

SEQ ID NO: 502398 - DNA, 25 bp, Homo sapien
atacaagtgccagtaagtggttctt

SEQ ID NO: 502399 - DNA, 25 bp, Homo sapien
acaagtgccagtaagtggttcttat

SEQ ID NO: 502400 - DNA, 25 bp, Homo sapien
agtgccagtaagtggttcttatgtg

SEQ ID NO: 502401 - DNA, 25 bp, Homo sapien
ttatttcccttttcttctgatattt

SEQ ID NO: 502402 - DNA, 25 bp, Homo sapien
ataggaaacacttcattctttataa

SEQ ID NO: 502403 - DNA, 25 bp, Homo sapien
tgttaatcttatgtgctttctaaaa

SEQ ID NO: 502404 - DNA, 25 bp, Homo sapien
atgtgctttctaaaaaatgttgtga

SEQ ID NO: 502405 - DNA, 25 bp, Homo sapien
ttgtgaaataccaaacttatggatt

SEQ ID NO: 502406 - DNA, 25 bp, Homo sapien
accaaacttatggattatcactagg

SEQ ID NO: 502407 - DNA, 25 bp, Homo sapien
gattatcactaggttatcaagcata

SEQ ID NO: 502408 - DNA, 25 bp, Homo sapien
tgatatgctggcattcattgttaca

SEQ ID NO: 502409 - DNA, 25 bp, Homo sapien
cattcattgttacagcccatcatcc

SEQ ID NO: 502410 - DNA, 25 bp, Homo sapien
cccagccatcaatccaggacatggg

SEQ ID NO: 502411 - DNA, 25 bp, Homo sapien
ttgttctgacgttgggcttcttctg

SEQ ID NO: 502412 - DNA, 25 bp, Homo sapien
tgacgttgggcttcttctgctccac

SEQ ID NO: 502413 - DNA, 25 bp, Homo sapien
ttctgctccaccagtactttctgtg

SEQ ID NO: 502414 - DNA, 25 bp, Homo sapien
tttggatcctcattggtcactgtgc

SEQ ID NO: 502415 - DNA, 25 bp, Homo sapien
agaagatgtgtcagtaaacttttgc

SEQ ID NO: 502416 - DNA, 25 bp, Homo sapien
cattggtcactgtgccagagtggtt

SEQ ID NO: 502417 - DNA, 25 bp, Homo sapien
agagtggttgtgtttgtctgctccc

SEQ ID NO: 502418 - DNA, 25 bp, Homo sapien
tgtttgtctgctccctagacaggaa

SEQ ID NO: 502419 - DNA, 25 bp, Homo sapien
atccttccagctgactcatggtttg

SEQ ID NO: 502420 - DNA, 25 bp, Homo sapien
atatccacagtggtagggcacacac

SEQ ID NO: 502421 - DNA, 25 bp, Homo sapien
gggcacacactgaagttggcttttc

SEQ ID NO: 502422 - DNA, 25 bp, Homo sapien
tggcttttcagccagcactgaatgt

SEQ ID NO: 502423 - DNA, 25 bp, Homo sapien
cagccagcactgaatgtatccatca

SEQ ID NO: 502424 - DNA, 25 bp, Homo sapien
gtatccatcaggacatgcgtcttca

SEQ ID NO: 502425 - DNA, 25 bp, Homo sapien
ggacatgcgtcttcaggtgcctgat

SEQ ID NO: 502426 - DNA, 25 bp, Homo sapien
tagtcaggctgtgggaacggtctct

SEQ ID NO: 502427 - DNA, 25 bp, Homo sapien
gaacggtctctgcagagcttcataa

SEQ ID NO: 502428 - DNA, 25 bp, Homo sapien
gagcttcataactgggaatttgatt

SEQ ID NO: 502429 - DNA, 25 bp, Homo sapien
gaagtccatgtcatatgtgtaacta

SEQ ID NO: 502430 - DNA, 25 bp, Homo sapien
gtggtttcccctatgttgttatcat

SEQ ID NO: 502431 - DNA, 25 bp, Homo sapien
ggtttcccctatgttgttatcataa

SEQ ID NO: 502432 - DNA, 25 bp, Homo sapien
gtttcccctatgttgttatcataat

SEQ ID NO: 502433 - DNA, 25 bp, Homo sapien
ttcccctatgttgttatcataatag

SEQ ID NO: 502434 - DNA, 25 bp, Homo sapien
atcataatagagagggagttctcac

SEQ ID NO: 502435 - DNA, 25 bp, Homo sapien
gttttaaagacagcagtttcccctg

SEQ ID NO: 502436 - DNA, 25 bp, Homo sapien
tttaaagacagcagtttcccctgct

SEQ ID NO: 502437 - DNA, 25 bp, Homo sapien
taaagacagcagtttcccctgctgt

SEQ ID NO: 502438 - DNA, 25 bp, Homo sapien
agcagtttcccctgctgtcactgtc

SEQ ID NO: 502439 - DNA, 25 bp, Homo sapien
gaaggtgcttgtttctccctctgcc

SEQ ID NO: 502440 - DNA, 25 bp, Homo sapien
aggtgcttgtttctccctctgccat

SEQ ID NO: 502441 - DNA, 25 bp, Homo sapien
cacggcttcgctgaagagctgcgcg

SEQ ID NO: 502442 - DNA, 25 bp, Homo sapien
ggtagctcacgtagggcttgagctt

SEQ ID NO: 502443 - DNA, 25 bp, Homo sapien
ctcacgtagggcttgagcttgaagc

SEQ ID NO: 502444 - DNA, 25 bp, Homo sapien
ttgaagccggtcagatccgggacga

SEQ ID NO: 502445 - DNA, 25 bp, Homo sapien
ggtcagatccgggacgacgaactcc

SEQ ID NO: 502446 - DNA, 25 bp, Homo sapien
gggacgacgaactccgggaccatct

SEQ ID NO: 502447 - DNA, 25 bp, Homo sapien
atctccttgatctgcacgaacctcc

SEQ ID NO: 502448 - DNA, 25 bp, Homo sapien
aacctccagcccgaggtgaggaagc

SEQ ID NO: 502449 - DNA, 25 bp, Homo sapien
ccgaggtgaggaagccgatgccctt

SEQ ID NO: 502450 - DNA, 25 bp, Homo sapien
tgaggaagccgatgcccttggcgcc

SEQ ID NO: 502451 - DNA, 25 bp, Homo sapien
ttgaagtccttttcgatggcaggcg

SEQ ID NO: 502452 - DNA, 25 bp, Homo sapien
tctaccacggcctgagaggaagagc

SEQ ID NO: 502453 - DNA, 25 bp, Homo sapien
agaggaagagcatcgttcccgctcc

SEQ ID NO: 502454 - DNA, 25 bp, Homo sapien
gaagagcatcgttcccgctcctatg

SEQ ID NO: 502455 - DNA, 25 bp, Homo sapien
actcctgcccgcctgaagtggatgc

SEQ ID NO: 502456 - DNA, 25 bp, Homo sapien
gaagcggcagcagcgaatgatcaag

SEQ ID NO: 502457 - DNA, 25 bp, Homo sapien
gcggcagcagcgaatgatcaagaac

SEQ ID NO: 502458 - DNA, 25 bp, Homo sapien
agcgaatgatcaagaaccgggagtc

SEQ ID NO: 502459 - DNA, 25 bp, Homo sapien
atcaagaaccgggagtcagcctgcc

SEQ ID NO: 502460 - DNA, 25 bp, Homo sapien
aagaaccgggagtcagcctgccagt

SEQ ID NO: 502461 - DNA, 25 bp, Homo sapien
gagtcagcctgccagtcccggagaa

SEQ ID NO: 502462 - DNA, 25 bp, Homo sapien
cagcctgccagtcccggagaaagaa

SEQ ID NO: 502463 - DNA, 25 bp, Homo sapien
agcctgaaacaggaactcacatgag

SEQ ID NO: 502464 - DNA, 25 bp, Homo sapien
gaactcacatgagactcagggccac

SEQ ID NO: 502465 - DNA, 25 bp, Homo sapien
tcagggccaccaggaaatgcttaaa

SEQ ID NO: 502466 - DNA, 25 bp, Homo sapien
atacatactctttcccaaaagcaaa

SEQ ID NO: 502467 - DNA, 25 bp, Homo sapien
agcaaatctataattctgtttcaat

SEQ ID NO: 502468 - DNA, 25 bp, Homo sapien
ttaaatggcaacaatgctgacagca

SEQ ID NO: 502469 - DNA, 25 bp, Homo sapien
agatcctctgattccaattaccatt

SEQ ID NO: 502470 - DNA, 25 bp, Homo sapien
tctgattccaattaccatttgtttt

SEQ ID NO: 502471 - DNA, 25 bp, Homo sapien
ttacccaattctatttgctagaggt

SEQ ID NO: 502472 - DNA, 25 bp, Homo sapien
ggtagtaagtactctggcactcata

SEQ ID NO: 502473 - DNA, 25 bp, Homo sapien
gtactctggcactcataaatcacat

SEQ ID NO: 502474 - DNA, 25 bp, Homo sapien
gtgactgtgatgcagttggattcaa

SEQ ID NO: 502475 - DNA, 25 bp, Homo sapien
gattcaactggtttacactgctctt

SEQ ID NO: 502476 - DNA, 25 bp, Homo sapien
aaaaaggttggactgcactgtagca

SEQ ID NO: 502477 - DNA, 25 bp, Homo sapien
gcactgtagcatgcttatgggttga

SEQ ID NO: 502478 - DNA, 25 bp, Homo sapien
aggcagaggacttggccgtcagcca

SEQ ID NO: 502479 - DNA, 25 bp, Homo sapien
agccagccagcacaggcgtaagaaa

SEQ ID NO: 502480 - DNA, 25 bp, Homo sapien
tagcatgagaagtttcacgagcctg

SEQ ID NO: 502481 - DNA, 25 bp, Homo sapien
tcacgagcctgaaaccattgagaca

SEQ ID NO: 502482 - DNA, 25 bp, Homo sapien
ttgagacagtgattacaacctccat

SEQ ID NO: 502483 - DNA, 25 bp, Homo sapien
ggcaaatcttaaacttaacgatcct

SEQ ID NO: 502484 - DNA, 25 bp, Homo sapien
aacgatccttgaaatttcctgcctg

SEQ ID NO: 502485 - DNA, 25 bp, Homo sapien
agcagtcctgttctaaatcctctta

SEQ ID NO: 502486 - DNA, 25 bp, Homo sapien
taaatcctcttattcttttggtttg

SEQ ID NO: 502487 - DNA, 25 bp, Homo sapien
aggcaacgtggagaggctgaaaaca

SEQ ID NO: 502488 - DNA, 25 bp, Homo sapien
tgcagagacgtttgacaatgagtca

SEQ ID NO: 502489 - DNA, 25 bp, Homo sapien
gagatgacatttacctagcactata

SEQ ID NO: 502490 - DNA, 25 bp, Homo sapien
ataaaccctggttgcctctgaagaa

SEQ ID NO: 502491 - DNA, 25 bp, Homo sapien
gaaactgccttcattgtatatatgt

SEQ ID NO: 502492 - DNA, 25 bp, Homo sapien
tgtaatcaacatgggaacttttagg

SEQ ID NO: 502493 - DNA, 25 bp, Homo sapien
aatcccaattttcaggagtggtggt

SEQ ID NO: 502494 - DNA, 25 bp, Homo sapien
gtggtggtgtcaataaacgctctgt

SEQ ID NO: 502495 - DNA, 25 bp, Homo sapien
gtcaataaacgctctgtggccagtg

SEQ ID NO: 502496 - DNA, 25 bp, Homo sapien
actgagacgcagctgtgtgaaatat

SEQ ID NO: 502497 - DNA, 25 bp, Homo sapien
gagacgcagctgtgtgaaatatgat

SEQ ID NO: 502498 - DNA, 25 bp, Homo sapien
acgcagctgtgtgaaatatgatttg

SEQ ID NO: 502499 - DNA, 25 bp, Homo sapien
agtcgggatcctgcacctggtcagg

SEQ ID NO: 502500 - DNA, 25 bp, Homo sapien
ggatcctgcacctggtcaggagaga

SEQ ID NO: 502501 - DNA, 25 bp, Homo sapien
tcctgcacctggtcaggagagagaa

SEQ ID NO: 502502 - DNA, 25 bp, Homo sapien
gaatgccctggagttgtgagggtgt

SEQ ID NO: 502503 - DNA, 25 bp, Homo sapien
tttttctgtcccactgagacgcagc

SEQ ID NO: 502504 - DNA, 25 bp, Homo sapien
ttctgtcccactgagacgcagctgt

SEQ ID NO: 502505 - DNA, 25 bp, Homo sapien
gtcccactgagacgcagctgtgtga

SEQ ID NO: 502506 - DNA, 25 bp, Homo sapien
cccactgagacgcagctgtgtgaaa

SEQ ID NO: 502507 - DNA, 25 bp, Homo sapien
gtgcaacacaacctcagccaagaag

SEQ ID NO: 502508 - DNA, 25 bp, Homo sapien
agagaaaggagtcccctacctgcca

SEQ ID NO: 502509 - DNA, 25 bp, Homo sapien
aactgttgtctgaaaactgtctcat

SEQ ID NO: 502510 - DNA, 25 bp, Homo sapien
gaaaactgtctcatattgtctcaag

SEQ ID NO: 502511 - DNA, 25 bp, Homo sapien
ttgtctcaagttgtcattcattgtg

SEQ ID NO: 502512 - DNA, 25 bp, Homo sapien
tcattgtgaattagacctgtttaac

SEQ ID NO: 502513 - DNA, 25 bp, Homo sapien
gtaatctgcaacatgcttcactgtc

SEQ ID NO: 502514 - DNA, 25 bp, Homo sapien
gcaacatgcttcactgtctaatttt

SEQ ID NO: 502515 - DNA, 25 bp, Homo sapien
tgtctaattttccagagcccctcat

SEQ ID NO: 502516 - DNA, 25 bp, Homo sapien
gagcccctcatataaggaactgtat

SEQ ID NO: 502517 - DNA, 25 bp, Homo sapien
gagctggctgcctgacagataaaaa

SEQ ID NO: 502518 - DNA, 25 bp, Homo sapien
tcccttcaagggaggacttccccag

SEQ ID NO: 502519 - DNA, 25 bp, Homo sapien
gaggttctgactggtgttttacaac

SEQ ID NO: 502520 - DNA, 25 bp, Homo sapien
gttttacaactgagtccaaggcttt

SEQ ID NO: 502521 - DNA, 25 bp, Homo sapien
ccctaattctcatctgtcagatcca

SEQ ID NO: 502522 - DNA, 25 bp, Homo sapien
catctgtcagatccagtgtattcct

SEQ ID NO: 502523 - DNA, 25 bp, Homo sapien
cagtgtattcctaagctgggacaaa

SEQ ID NO: 502524 - DNA, 25 bp, Homo sapien
cctaagctgggacaaagcctctgtt

SEQ ID NO: 502525 - DNA, 25 bp, Homo sapien
agccagggctgagtgtggaaattac

SEQ ID NO: 502526 - DNA, 25 bp, Homo sapien
aattacagtgactgcttcttctcag

SEQ ID NO: 502527 - DNA, 25 bp, Homo sapien
ttctcagcttctctggttgaaagca

SEQ ID NO: 502528 - DNA, 25 bp, Homo sapien
ttctctggttgaaagcaagctggcg

SEQ ID NO: 502529 - DNA, 25 bp, Homo sapien
ctgtcactccctgaaacactattaa

SEQ ID NO: 502530 - DNA, 25 bp, Homo sapien
gaaacactattaatagctctgccga

SEQ ID NO: 502531 - DNA, 25 bp, Homo sapien
aatagctctgccgatagctggtgtt

SEQ ID NO: 502532 - DNA, 25 bp, Homo sapien
ctgccgatagctggtgttgtcacaa

SEQ ID NO: 502533 - DNA, 25 bp, Homo sapien
gccgatagctggtgttgtcacaact

SEQ ID NO: 502534 - DNA, 25 bp, Homo sapien
atagctggtgttgtcacaactgcct

SEQ ID NO: 502535 - DNA, 25 bp, Homo sapien
gctggtgttgtcacaactgcctgga

SEQ ID NO: 502536 - DNA, 25 bp, Homo sapien
tcacaactgcctggaatccgaaggt

SEQ ID NO: 502537 - DNA, 25 bp, Homo sapien
ttggtactagctgtaagcggaacac

SEQ ID NO: 502538 - DNA, 25 bp, Homo sapien
tactagctgtaagcggaacaccctg

SEQ ID NO: 502539 - DNA, 25 bp, Homo sapien
tgtaagcggaacaccctgccccagg

SEQ ID NO: 502540 - DNA, 25 bp, Homo sapien
gtaatctagaaaactgagaaggtct

SEQ ID NO: 502541 - DNA, 25 bp, Homo sapien
actgagaaggtctgattgataaatc

SEQ ID NO: 502542 - DNA, 25 bp, Homo sapien
agaaggtctgattgataaatcatca

SEQ ID NO: 502543 - DNA, 25 bp, Homo sapien
gtatggtatataatgtcaatgttaa

SEQ ID NO: 502544 - DNA, 25 bp, Homo sapien
gataacaaacacagcattcccaaca

SEQ ID NO: 502545 - DNA, 25 bp, Homo sapien
taacaaacacagcattcccaacaga

SEQ ID NO: 502546 - DNA, 25 bp, Homo sapien
aacaaacacagcattcccaacagag

SEQ ID NO: 502547 - DNA, 25 bp, Homo sapien
caaacacagcattcccaacagagct

SEQ ID NO: 502548 - DNA, 25 bp, Homo sapien
acacagcattcccaacagagctgta

SEQ ID NO: 502549 - DNA, 25 bp, Homo sapien
gcattcccaacagagctgtaatcta

SEQ ID NO: 502550 - DNA, 25 bp, Homo sapien
ttcccaacagagctgtaatctagaa

SEQ ID NO: 502551 - DNA, 25 bp, Homo sapien
agagtcaaggtctgacgccacctca

SEQ ID NO: 502552 - DNA, 25 bp, Homo sapien
gtctgacgccacctcaaggtgacag

SEQ ID NO: 502553 - DNA, 25 bp, Homo sapien
ggtgacagctcatctccagcacagc

SEQ ID NO: 502554 - DNA, 25 bp, Homo sapien
cacagcacaggcgtgtgcacacaga

SEQ ID NO: 502555 - DNA, 25 bp, Homo sapien
acaggcgtgtgcacacagaggtgtt

SEQ ID NO: 502556 - DNA, 25 bp, Homo sapien
tcagaaaactgcctcacctgagaca

SEQ ID NO: 502557 - DNA, 25 bp, Homo sapien
tcacctgagacaagtgcctgctgga

SEQ ID NO: 502558 - DNA, 25 bp, Homo sapien
ggtgtgattccaggcctggtgtcac

SEQ ID NO: 502559 - DNA, 25 bp, Homo sapien
gtgtcacatgacaccagcatgcatt

SEQ ID NO: 502560 - DNA, 25 bp, Homo sapien
gacaccagcatgcattgcaggatta

SEQ ID NO: 502561 - DNA, 25 bp, Homo sapien
gcaggattattagtgtattttgagt

SEQ ID NO: 502562 - DNA, 25 bp, Homo sapien
tacagcaacaaataggaactcctgg

SEQ ID NO: 502563 - DNA, 25 bp, Homo sapien
gaactcctggccaatgagagctctt

SEQ ID NO: 502564 - DNA, 25 bp, Homo sapien
gagagctcttgaccagtgaatcacc

SEQ ID NO: 502565 - DNA, 25 bp, Homo sapien
agtgaatcaccagccgatacgaacg

SEQ ID NO: 502566 - DNA, 25 bp, Homo sapien
cgatacgaacgtcttgccaacaaaa

SEQ ID NO: 502567 - DNA, 25 bp, Homo sapien
caaggcttctgtaaactgggaccaa

SEQ ID NO: 502568 - DNA, 25 bp, Homo sapien
aaactgggaccaatgattacctcat

SEQ ID NO: 502569 - DNA, 25 bp, Homo sapien
accaatgattacctcatagggctgt

SEQ ID NO: 502570 - DNA, 25 bp, Homo sapien
gatgaaatacctgtgaaagtgccta

SEQ ID NO: 502571 - DNA, 25 bp, Homo sapien
aaagtgcctaggcagtgccagccaa

SEQ ID NO: 502572 - DNA, 25 bp, Homo sapien
cagccaaataggaggcattcaatga

SEQ ID NO: 502573 - DNA, 25 bp, Homo sapien
ttttacatgcaagttcagatcacct

SEQ ID NO: 502574 - DNA, 25 bp, Homo sapien
tttacatgcaagttcagatcacctc

SEQ ID NO: 502575 - DNA, 25 bp, Homo sapien
ttacatgcaagttcagatcacctct

SEQ ID NO: 502576 - DNA, 25 bp, Homo sapien
tacatgcaagttcagatcacctctt

SEQ ID NO: 502577 - DNA, 25 bp, Homo sapien
cagatcacctctttctcttaagaca

SEQ ID NO: 502578 - DNA, 25 bp, Homo sapien
aaatctgggccgggagtgagccact

SEQ ID NO: 502579 - DNA, 25 bp, Homo sapien
atctgggccgggagtgagccactgc

SEQ ID NO: 502580 - DNA, 25 bp, Homo sapien
atacaaaaagtagcctagtggtagt

SEQ ID NO: 502581 - DNA, 25 bp, Homo sapien
aaagtagcctagtggtagtgggcac

SEQ ID NO: 502582 - DNA, 25 bp, Homo sapien
agtagcctagtggtagtgggcacct

SEQ ID NO: 502583 - DNA, 25 bp, Homo sapien
tagcctagtggtagtgggcacctgt

SEQ ID NO: 502584 - DNA, 25 bp, Homo sapien
tttagcacctccatggttctcatat

SEQ ID NO: 502585 - DNA, 25 bp, Homo sapien
ggttctcatatacccatgtctgtaa

SEQ ID NO: 502586 - DNA, 25 bp, Homo sapien
gattcgcttatatagatgacttagg

SEQ ID NO: 502587 - DNA, 25 bp, Homo sapien
ctttagaaggtgaacaagccaactt

SEQ ID NO: 502588 - DNA, 25 bp, Homo sapien
aagccaacttgtgatggcctgcctt

SEQ ID NO: 502589 - DNA, 25 bp, Homo sapien
gccttttgcttttggcagttgggat

SEQ ID NO: 502590 - DNA, 25 bp, Homo sapien
gagaacaattgactctcccattggt

SEQ ID NO: 502591 - DNA, 25 bp, Homo sapien
tcccattggttgttagatagttgaa

SEQ ID NO: 502592 - DNA, 25 bp, Homo sapien
aatggtgcgttggtggtcatactta

SEQ ID NO: 502593 - DNA, 25 bp, Homo sapien
ggtcatacttagtgttctaggctgt

SEQ ID NO: 502594 - DNA, 25 bp, Homo sapien
gtgttctaggctgtgaaatcatgga

SEQ ID NO: 502595 - DNA, 25 bp, Homo sapien
gagaccgagtctcaactatattgtc

SEQ ID NO: 502596 - DNA, 25 bp, Homo sapien
gaacttctttccctccaagtgataa

SEQ ID NO: 502597 - DNA, 25 bp, Homo sapien
ttctttccctccaagtgataacctt

SEQ ID NO: 502598 - DNA, 25 bp, Homo sapien
tccctccaagtgataaccttttcca

SEQ ID NO: 502599 - DNA, 25 bp, Homo sapien
tccaagtgataaccttttccagaca

SEQ ID NO: 502600 - DNA, 25 bp, Homo sapien
gtgataaccttttccagacaagtca

SEQ ID NO: 502601 - DNA, 25 bp, Homo sapien
tcagcttaaaaactgacccaaaggc

SEQ ID NO: 502602 - DNA, 25 bp, Homo sapien
gacccaaaggccctgaagtacacag

SEQ ID NO: 502603 - DNA, 25 bp, Homo sapien
caaaggccctgaagtacacagtttt

SEQ ID NO: 502604 - DNA, 25 bp, Homo sapien
ggccctgaagtacacagttttcttg

SEQ ID NO: 502605 - DNA, 25 bp, Homo sapien
ctgaagtacacagttttcttggaga

SEQ ID NO: 502606 - DNA, 25 bp, Homo sapien
gacgattccacataaaaggaaggga

SEQ ID NO: 502607 - DNA, 25 bp, Homo sapien
gattccacataaaaggaagggacca

SEQ ID NO: 502608 - DNA, 25 bp, Homo sapien
ctcaggaagaatctcattagtttat

SEQ ID NO: 502609 - DNA, 25 bp, Homo sapien
agtttattctgtaaatagttcctag

SEQ ID NO: 502610 - DNA, 25 bp, Homo sapien
gtttattctgtaaatagttcctagt

SEQ ID NO: 502611 - DNA, 25 bp, Homo sapien
tttattctgtaaatagttcctagta

SEQ ID NO: 502612 - DNA, 25 bp, Homo sapien
ttattctgtaaatagttcctagtaa

SEQ ID NO: 502613 - DNA, 25 bp, Homo sapien
tattctgtaaatagttcctagtaaa

SEQ ID NO: 502614 - DNA, 25 bp, Homo sapien
ttctgtaaatagttcctagtaaaat

SEQ ID NO: 502615 - DNA, 25 bp, Homo sapien
ctgtaaatagttcctagtaaaatga

SEQ ID NO: 502616 - DNA, 25 bp, Homo sapien
gtaaatagttcctagtaaaatgata

SEQ ID NO: 502617 - DNA, 25 bp, Homo sapien
tagtgcaattaaaaccctgaaaaca

SEQ ID NO: 502618 - DNA, 25 bp, Homo sapien
gtgcaattaaaaccctgaaaacaca

SEQ ID NO: 502619 - DNA, 25 bp, Homo sapien
gatccttgttgactctgcttggttg

SEQ ID NO: 502620 - DNA, 25 bp, Homo sapien
atccttgttgactctgcttggttga

SEQ ID NO: 502621 - DNA, 25 bp, Homo sapien
tccttgttgactctgcttggttgaa

SEQ ID NO: 502622 - DNA, 25 bp, Homo sapien
ccttgttgactctgcttggttgaag

SEQ ID NO: 502623 - DNA, 25 bp, Homo sapien
cttgttgactctgcttggttgaagc

SEQ ID NO: 502624 - DNA, 25 bp, Homo sapien
ttgttgactctgcttggttgaagca

SEQ ID NO: 502625 - DNA, 25 bp, Homo sapien
tgttgactctgcttggttgaagcag

SEQ ID NO: 502626 - DNA, 25 bp, Homo sapien
gttgactctgcttggttgaagcagg

SEQ ID NO: 502627 - DNA, 25 bp, Homo sapien
tgactctgcttggttgaagcaggaa

SEQ ID NO: 502628 - DNA, 25 bp, Homo sapien
tcccgtttgatcttggttggaggtg

SEQ ID NO: 502629 - DNA, 25 bp, Homo sapien
gaagcaccaggttatcagactgaaa

SEQ ID NO: 502630 - DNA, 25 bp, Homo sapien
gaaaatctgggacaaactgttcatc

SEQ ID NO: 502631 - DNA, 25 bp, Homo sapien
aggaacttgtgcttcagctaaccaa

SEQ ID NO: 502632 - DNA, 25 bp, Homo sapien
aagcctcttgaagttgactgagatc

SEQ ID NO: 502633 - DNA, 25 bp, Homo sapien
gactgagatcctgaaatagctcttc

SEQ ID NO: 502634 - DNA, 25 bp, Homo sapien
agaatcgtgagccagatctgtgtcc

SEQ ID NO: 502635 - DNA, 25 bp, Homo sapien
gggaggcttcctatcataggcacaa

SEQ ID NO: 502636 - DNA, 25 bp, Homo sapien
gaggcacttttctccatagttagca

SEQ ID NO: 502637 - DNA, 25 bp, Homo sapien
tagttagcaccaagagcctgctcat

SEQ ID NO: 502638 - DNA, 25 bp, Homo sapien
gagcctgctcatggctacaagacga

SEQ ID NO: 502639 - DNA, 25 bp, Homo sapien
gttcagcaatggaactagtttctgc

SEQ ID NO: 502640 - DNA, 25 bp, Homo sapien
gcaatggaactagtttctgcagatc

SEQ ID NO: 502641 - DNA, 25 bp, Homo sapien
ctgcagatcaagcaaagatgtgtct

SEQ ID NO: 502642 - DNA, 25 bp, Homo sapien
aaagatgtgtcttgggcatggaacc

SEQ ID NO: 502643 - DNA, 25 bp, Homo sapien
gtgtcttgggcatggaaccaaagtt

SEQ ID NO: 502644 - DNA, 25 bp, Homo sapien
aatgaaatattcaacccctgctgtg

SEQ ID NO: 502645 - DNA, 25 bp, Homo sapien
tgaaatattcaacccctgctgtgca

SEQ ID NO: 502646 - DNA, 25 bp, Homo sapien
ccatggaaacactagtcctgataat

SEQ ID NO: 502647 - DNA, 25 bp, Homo sapien
gaaacactagtcctgataataaaca

SEQ ID NO: 502648 - DNA, 25 bp, Homo sapien
gtgaagcacgaggaatacctatgaa

SEQ ID NO: 502649 - DNA, 25 bp, Homo sapien
atacctatgaagagctatttacaat

SEQ ID NO: 502650 - DNA, 25 bp, Homo sapien
gctgacggcatcgcggccggaacct

SEQ ID NO: 502651 - DNA, 25 bp, Homo sapien
tgacggcatcgcggccggaacctct

SEQ ID NO: 502652 - DNA, 25 bp, Homo sapien
gacggcatcgcggccggaacctctg

SEQ ID NO: 502653 - DNA, 25 bp, Homo sapien
acggcatcgcggccggaacctctgg

SEQ ID NO: 502654 - DNA, 25 bp, Homo sapien
gcatcgcggccggaacctctgggcc

SEQ ID NO: 502655 - DNA, 25 bp, Homo sapien
catcgcggccggaacctctgggccc

SEQ ID NO: 502656 - DNA, 25 bp, Homo sapien
atcgcggccggaacctctgggcccg

SEQ ID NO: 502657 - DNA, 25 bp, Homo sapien
tcgcggccggaacctctgggcccgg

SEQ ID NO: 502658 - DNA, 25 bp, Homo sapien
aaacttcgctggaaatgagtagcca

SEQ ID NO: 502659 - DNA, 25 bp, Homo sapien
aacttcgctggaaatgagtagccag

SEQ ID NO: 502660 - DNA, 25 bp, Homo sapien
gctggaaatgagtagccaggaagtt

SEQ ID NO: 502661 - DNA, 25 bp, Homo sapien
ctttcctcttttgagtcttctctgc

SEQ ID NO: 502662 - DNA, 25 bp, Homo sapien
ttttcctctctatctctttactttc

SEQ ID NO: 502663 - DNA, 25 bp, Homo sapien
ttcctctctatctctttactttctt

SEQ ID NO: 502664 - DNA, 25 bp, Homo sapien
ctctctatctctttactttcttcct

SEQ ID NO: 502665 - DNA, 25 bp, Homo sapien
aaagacataaaatgccatccgtggg

SEQ ID NO: 502666 - DNA, 25 bp, Homo sapien
tcacgtgatctcctcggtccgtggt

SEQ ID NO: 502667 - DNA, 25 bp, Homo sapien
acgtgatctcctcggtccgtggttt

SEQ ID NO: 502668 - DNA, 25 bp, Homo sapien
gatctcctcggtccgtggttttctg

SEQ ID NO: 502669 - DNA, 25 bp, Homo sapien
tcctcggtccgtggttttctgtgga

SEQ ID NO: 502670 - DNA, 25 bp, Homo sapien
ctcggtccgtggttttctgtggatt

SEQ ID NO: 502671 - DNA, 25 bp, Homo sapien
cggtccgtggttttctgtggattct

SEQ ID NO: 502672 - DNA, 25 bp, Homo sapien
gggtgctgcatatcggtcaccaggc

SEQ ID NO: 502673 - DNA, 25 bp, Homo sapien
atatcggtcaccaggcacccagggc

SEQ ID NO: 502674 - DNA, 25 bp, Homo sapien
aacacaaagtgtgccttagacattc

SEQ ID NO: 502675 - DNA, 25 bp, Homo sapien
caaagtgtgccttagacattctcaa

SEQ ID NO: 502676 - DNA, 25 bp, Homo sapien
gacattctcaagtcatcagcgtcac

SEQ ID NO: 502677 - DNA, 25 bp, Homo sapien
ttctcaagtcatcagcgtcaccctt

SEQ ID NO: 502678 - DNA, 25 bp, Homo sapien
gtccacacccattcttggctaatgt

SEQ ID NO: 502679 - DNA, 25 bp, Homo sapien
ccacacccattcttggctaatgtaa

SEQ ID NO: 502680 - DNA, 25 bp, Homo sapien
acccattcttggctaatgtaatgaa

SEQ ID NO: 502681 - DNA, 25 bp, Homo sapien
tttttgataccttgggaatttctat

SEQ ID NO: 502682 - DNA, 25 bp, Homo sapien
tgataccttgggaatttctatgcag

SEQ ID NO: 502683 - DNA, 25 bp, Homo sapien
gggtcttaaaggtaagcgccctcat

SEQ ID NO: 502684 - DNA, 25 bp, Homo sapien
ccctcatacatgactgaaactttgt

SEQ ID NO: 502685 - DNA, 25 bp, Homo sapien
gtgagaggtcttatatttgaatgga

SEQ ID NO: 502686 - DNA, 25 bp, Homo sapien
tggacccttaatgatttatgtgaaa

SEQ ID NO: 502687 - DNA, 25 bp, Homo sapien
gtctctgtgagagaacgtgcctcct

SEQ ID NO: 502688 - DNA, 25 bp, Homo sapien
agagaacgtgcctcctcactcattt

SEQ ID NO: 502689 - DNA, 25 bp, Homo sapien
atttgtctctgtctgttttcatagc

SEQ ID NO: 502690 - DNA, 25 bp, Homo sapien
gttttcatagccatcaatatagtaa

SEQ ID NO: 502691 - DNA, 25 bp, Homo sapien
actatattcttgaatacccttgaag

SEQ ID NO: 502692 - DNA, 25 bp, Homo sapien
gaaatccgttttctattgtgcattg

SEQ ID NO: 502693 - DNA, 25 bp, Homo sapien
attgtgcattgctatacgaagtgaa

SEQ ID NO: 502694 - DNA, 25 bp, Homo sapien
cctttggtcggaacgatgagcacca

SEQ ID NO: 502695 - DNA, 25 bp, Homo sapien
cggaacgatgagcaccatgccagga

SEQ ID NO: 502696 - DNA, 25 bp, Homo sapien
cctgcttttatgacatagatcttga

SEQ ID NO: 502697 - DNA, 25 bp, Homo sapien
gacatagatcttgataccgaaacag

SEQ ID NO: 502698 - DNA, 25 bp, Homo sapien
gttaaaggcttgttctaagtggaca

SEQ ID NO: 502699 - DNA, 25 bp, Homo sapien
gttctaagtggacaaggctctcaca

SEQ ID NO: 502700 - DNA, 25 bp, Homo sapien
tggacaaggctctcacaggacccga

SEQ ID NO: 502701 - DNA, 25 bp, Homo sapien
aaggctctcacaggacccgatgcag

SEQ ID NO: 502702 - DNA, 25 bp, Homo sapien
gacccgatgcagactcctgaaacag

SEQ ID NO: 502703 - DNA, 25 bp, Homo sapien
cctgaaacagactactctttgcctt

SEQ ID NO: 502704 - DNA, 25 bp, Homo sapien
aacagactactctttgcctttttgc

SEQ ID NO: 502705 - DNA, 25 bp, Homo sapien
aacctcactccacagtgggcaagtt

SEQ ID NO: 502706 - DNA, 25 bp, Homo sapien
aggctccactacgttgctgttattc

SEQ ID NO: 502707 - DNA, 25 bp, Homo sapien
tggcattttgtaaaaccaccccagc

SEQ ID NO: 502708 - DNA, 25 bp, Homo sapien
tttgtaaaaccaccccagcctgtgt

SEQ ID NO: 502709 - DNA, 25 bp, Homo sapien
agcctgtgtgactttcaatgcctgt

SEQ ID NO: 502710 - DNA, 25 bp, Homo sapien
gactttcaatgcctgtccgatttgg

SEQ ID NO: 502711 - DNA, 25 bp, Homo sapien
gcctgtccgatttggctgggaaaat

SEQ ID NO: 502712 - DNA, 25 bp, Homo sapien
gaaaatattttagatccccagggct

SEQ ID NO: 502713 - DNA, 25 bp, Homo sapien
atccccagggctacatactgttttt

SEQ ID NO: 502714 - DNA, 25 bp, Homo sapien
tttttataccctcctctttgtgtca

SEQ ID NO: 502715 - DNA, 25 bp, Homo sapien
ctcctctttgtgtcagtgatggaaa

SEQ ID NO: 502716 - DNA, 25 bp, Homo sapien
gtattaaacatgtccagttttttgg

SEQ ID NO: 502717 - DNA, 25 bp, Homo sapien
ggctttgagggaaaacacacagggt

SEQ ID NO: 502718 - DNA, 25 bp, Homo sapien
ggaattgggctaaatgacttcttac

SEQ ID NO: 502719 - DNA, 25 bp, Homo sapien
taaatgacttcttacaggccccttt

SEQ ID NO: 502720 - DNA, 25 bp, Homo sapien
tacaggcccctttctgattctttaa

SEQ ID NO: 502721 - DNA, 25 bp, Homo sapien
gaaaggcaagccatattgatccagt

SEQ ID NO: 502722 - DNA, 25 bp, Homo sapien
caagccatattgatccagttgttat

SEQ ID NO: 502723 - DNA, 25 bp, Homo sapien
gatccagttgttatagtgaactcat

SEQ ID NO: 502724 - DNA, 25 bp, Homo sapien
gtgaactcatggtaatggtttgtga

SEQ ID NO: 502725 - DNA, 25 bp, Homo sapien
tttctatgtagatgagttggtatga

SEQ ID NO: 502726 - DNA, 25 bp, Homo sapien
taagggactgtttaaatctttgatt

SEQ ID NO: 502727 - DNA, 25 bp, Homo sapien
aaatgtcgtggtattgtaacaatat

SEQ ID NO: 502728 - DNA, 25 bp, Homo sapien
agaaggttacagactcccctgaaga

SEQ ID NO: 502729 - DNA, 25 bp, Homo sapien
tgaagaaccagctttcctacgcttt

SEQ ID NO: 502730 - DNA, 25 bp, Homo sapien
gaaccagctttcctacgctttttat

SEQ ID NO: 502731 - DNA, 25 bp, Homo sapien
aaatgactgcaattccagactaaaa

SEQ ID NO: 502732 - DNA, 25 bp, Homo sapien
aaaaacatgcttcagccctgtttca

SEQ ID NO: 502733 - DNA, 25 bp, Homo sapien
gcttcagccctgtttcaagacatta

SEQ ID NO: 502734 - DNA, 25 bp, Homo sapien
gacattatgcttcttttaacagtcc

SEQ ID NO: 502735 - DNA, 25 bp, Homo sapien
gcttcttttaacagtccaaattagt

SEQ ID NO: 502736 - DNA, 25 bp, Homo sapien
ctaaatctttgtttcacacttgtaa

SEQ ID NO: 502737 - DNA, 25 bp, Homo sapien
agatcagtagtctctattcaaactt

SEQ ID NO: 502738 - DNA, 25 bp, Homo sapien
aacattcccttgtcaaccaagaata

SEQ ID NO: 502739 - DNA, 25 bp, Homo sapien
tactcaaagctacttgtattggaaa

SEQ ID NO: 502740 - DNA, 25 bp, Homo sapien
ttgtattggaaatggcagaaggcct

SEQ ID NO: 502741 - DNA, 25 bp, Homo sapien
gaaggcctaaatccaaatttcttat

SEQ ID NO: 502742 - DNA, 25 bp, Homo sapien
taaattcttacttctgccagtggag

SEQ ID NO: 502743 - DNA, 25 bp, Homo sapien
ctgccagtggaggtttatgcctgaa

SEQ ID NO: 502744 - DNA, 25 bp, Homo sapien
gaggtttatgcctgaaaggtcatgg

SEQ ID NO: 502745 - DNA, 25 bp, Homo sapien
gggtcctgtctgtaaatagacctaa

SEQ ID NO: 502746 - DNA, 25 bp, Homo sapien
tagacctaaagagaagtgcagtatt

SEQ ID NO: 502747 - DNA, 25 bp, Homo sapien
tcatcccactagtcttttattgcag

SEQ ID NO: 502748 - DNA, 25 bp, Homo sapien
tttattgcagtcttttattgtcatt

SEQ ID NO: 502749 - DNA, 25 bp, Homo sapien
tccagggttagtgttcaaccattcg

SEQ ID NO: 502750 - DNA, 25 bp, Homo sapien
cttattgttttaatacagtactatg

SEQ ID NO: 502751 - DNA, 25 bp, Homo sapien
cagggttagtgttcaaccattcgga

SEQ ID NO: 502752 - DNA, 25 bp, Homo sapien
gttagtgttcaaccattcggaaaat

SEQ ID NO: 502753 - DNA, 25 bp, Homo sapien
tagtgttcaaccattcggaaaattt

SEQ ID NO: 502754 - DNA, 25 bp, Homo sapien
gtatcaaaatcaaaacttcatctta

SEQ ID NO: 502755 - DNA, 25 bp, Homo sapien
aatttgtatactgaatcctgcctct

SEQ ID NO: 502756 - DNA, 25 bp, Homo sapien
tcaaccattcggaaaattttcccat

SEQ ID NO: 502757 - DNA, 25 bp, Homo sapien
ttgtattaacactgtttccatctta

SEQ ID NO: 502758 - DNA, 25 bp, Homo sapien
agactagtgtagaattcccaataac

SEQ ID NO: 502759 - DNA, 25 bp, Homo sapien
tagtgtagaattcccaataacttac

SEQ ID NO: 502760 - DNA, 25 bp, Homo sapien
ggcagatgacctttaacaagctgtg

SEQ ID NO: 502761 - DNA, 25 bp, Homo sapien
aacaagctgtgattcctgagagagg

SEQ ID NO: 502762 - DNA, 25 bp, Homo sapien
gagagaggaacacctgcaccaactg

SEQ ID NO: 502763 - DNA, 25 bp, Homo sapien
caactgcccaggaaacacacggaat

SEQ ID NO: 502764 - DNA, 25 bp, Homo sapien
ggaaacacacggaattccgtctcat

SEQ ID NO: 502765 - DNA, 25 bp, Homo sapien
acggaattccgtctcatttcattgt

SEQ ID NO: 502766 - DNA, 25 bp, Homo sapien
gaattccgtctcatttcattgtcct

SEQ ID NO: 502767 - DNA, 25 bp, Homo sapien
gtctcatttcattgtcctccctttt

SEQ ID NO: 502768 - DNA, 25 bp, Homo sapien
atttcattgtcctcccttttgtcca

SEQ ID NO: 502769 - DNA, 25 bp, Homo sapien
cttttgtccactcatgcattcaaca

SEQ ID NO: 502770 - DNA, 25 bp, Homo sapien
tcctgagaacttacacctgaaacca

SEQ ID NO: 502771 - DNA, 25 bp, Homo sapien
atttccaccagactgtcttgagtag

SEQ ID NO: 502772 - DNA, 25 bp, Homo sapien
gtcttgagtagtgacttctttggtg

SEQ ID NO: 502773 - DNA, 25 bp, Homo sapien
gtgaggcaagaaggatatacattat

SEQ ID NO: 502774 - DNA, 25 bp, Homo sapien
tttaagataacagaagtgaccaatg

SEQ ID NO: 502775 - DNA, 25 bp, Homo sapien
gaccaatgtaatttcacaacaccta

SEQ ID NO: 502776 - DNA, 25 bp, Homo sapien
gtaatttcacaacacctaaggattt

SEQ ID NO: 502777 - DNA, 25 bp, Homo sapien
ttttttggttgatcaggttactgta

SEQ ID NO: 502778 - DNA, 25 bp, Homo sapien
tgtagatttttactgattgtcctgg

SEQ ID NO: 502779 - DNA, 25 bp, Homo sapien
tcctggatgaatagactgtgctttt

SEQ ID NO: 502780 - DNA, 25 bp, Homo sapien
cttccttcttggtttcccatagtat

SEQ ID NO: 502781 - DNA, 25 bp, Homo sapien
tggtttcccatagtataataagcat

SEQ ID NO: 502782 - DNA, 25 bp, Homo sapien
cagtatgttttatgcttactcaaag

SEQ ID NO: 502783 - DNA, 25 bp, Homo sapien
gcttactcaaagttaactggctcag

SEQ ID NO: 502784 - DNA, 25 bp, Homo sapien
ttaactggctcagagttttaaaagc

SEQ ID NO: 502785 - DNA, 25 bp, Homo sapien
aaagctttcccggataaagcagagt

SEQ ID NO: 502786 - DNA, 25 bp, Homo sapien
tttcccggataaagcagagtcaagt

SEQ ID NO: 502787 - DNA, 25 bp, Homo sapien
agcagagtcaagtctaccctatatc

SEQ ID NO: 502788 - DNA, 25 bp, Homo sapien
gagtcaagtctaccctatatcccca

SEQ ID NO: 502789 - DNA, 25 bp, Homo sapien
gtcgaacctggcaatctcagtgagc

SEQ ID NO: 502790 - DNA, 25 bp, Homo sapien
gaacctggcaatctcagtgagctat

SEQ ID NO: 502791 - DNA, 25 bp, Homo sapien
tattttccagtatcctaatacatgc

SEQ ID NO: 502792 - DNA, 25 bp, Homo sapien
tcctaatacatgcatacttatcttt

SEQ ID NO: 502793 - DNA, 25 bp, Homo sapien
acttttgaataataggctggacact

SEQ ID NO: 502794 - DNA, 25 bp, Homo sapien
ggctggacacttagtttgacttgaa

SEQ ID NO: 502795 - DNA, 25 bp, Homo sapien
gaaagagctcaatgctcatcggaaa

SEQ ID NO: 502796 - DNA, 25 bp, Homo sapien
acatgagccatgagattcttccttg

SEQ ID NO: 502797 - DNA, 25 bp, Homo sapien
aggacaattttctccactcacatcc

SEQ ID NO: 502798 - DNA, 25 bp, Homo sapien
ctccactcacatccacatttgaaaa

SEQ ID NO: 502799 - DNA, 25 bp, Homo sapien
atgagattcttccttgtgctgcagc

SEQ ID NO: 502800 - DNA, 25 bp, Homo sapien
ataggtaactctactttcacaaatg

SEQ ID NO: 502801 - DNA, 25 bp, Homo sapien
gtgcaatctggaaagaacataccta

SEQ ID NO: 502802 - DNA, 25 bp, Homo sapien
tgtgtttttcaccatccattatctc

SEQ ID NO: 502803 - DNA, 25 bp, Homo sapien
caccatccattatctctgaactttg

SEQ ID NO: 502804 - DNA, 25 bp, Homo sapien
taggggaaccattgaactttgaaat

SEQ ID NO: 502805 - DNA, 25 bp, Homo sapien
tcttcctgcccatgtgattgcggtg

SEQ ID NO: 502806 - DNA, 25 bp, Homo sapien
atttgttcagaatcagactccatta

SEQ ID NO: 502807 - DNA, 25 bp, Homo sapien
tcagaatcagactccattattttac

SEQ ID NO: 502808 - DNA, 25 bp, Homo sapien
gcccatgtgattgcggtgcagtagt

SEQ ID NO: 502809 - DNA, 25 bp, Homo sapien
gaaagttagcccagttttttatgtg

SEQ ID NO: 502810 - DNA, 25 bp, Homo sapien
agcccagttttttatgtgctattaa

SEQ ID NO: 502811 - DNA, 25 bp, Homo sapien
gtatgtacacagaatgtagtgctcc

SEQ ID NO: 502812 - DNA, 25 bp, Homo sapien
tgcggtgcagtagtttctgttgtat

SEQ ID NO: 502813 - DNA, 25 bp, Homo sapien
tgtataatagtgtggacagcagctc

SEQ ID NO: 502814 - DNA, 25 bp, Homo sapien
aaggagggaatgctactgataattt

SEQ ID NO: 502815 - DNA, 25 bp, Homo sapien
aagaatatggtggtctcatggagta

SEQ ID NO: 502816 - DNA, 25 bp, Homo sapien
gtctcatggagtagctgaccactaa

SEQ ID NO: 502817 - DNA, 25 bp, Homo sapien
gggaatcacttatcagtttttagca

SEQ ID NO: 502818 - DNA, 25 bp, Homo sapien
attttggcaattagaagtagactca

SEQ ID NO: 502819 - DNA, 25 bp, Homo sapien
ggataactgacatcgttttgttaag

SEQ ID NO: 502820 - DNA, 25 bp, Homo sapien
gaagttaactgtatcatagctcact

SEQ ID NO: 502821 - DNA, 25 bp, Homo sapien
tagctcactactgccagagcggcaa

SEQ ID NO: 502822 - DNA, 25 bp, Homo sapien
gattacaatttggttgctggcagcc

SEQ ID NO: 502823 - DNA, 25 bp, Homo sapien
aatttggttgctggcagccattctg

SEQ ID NO: 502824 - DNA, 25 bp, Homo sapien
agccattctgggtttcttgatttta

SEQ ID NO: 502825 - DNA, 25 bp, Homo sapien
cttgattttagtactccaaagaata

SEQ ID NO: 502826 - DNA, 25 bp, Homo sapien
tgctgtgtgcttcttaagtgaggta

SEQ ID NO: 502827 - DNA, 25 bp, Homo sapien
aagtgaggtaagtaacttccataga

SEQ ID NO: 502828 - DNA, 25 bp, Homo sapien
aaaatttccatcagttcattcatga

SEQ ID NO: 502829 - DNA, 25 bp, Homo sapien
aacgtttccaagaatcagataaaag

SEQ ID NO: 502830 - DNA, 25 bp, Homo sapien
agaaggcagctgctcatttccagca

SEQ ID NO: 502831 - DNA, 25 bp, Homo sapien
gtagctgcatagagtacaaggactg

SEQ ID NO: 502832 - DNA, 25 bp, Homo sapien
acaaggactggtaggcctgttggct

SEQ ID NO: 502833 - DNA, 25 bp, Homo sapien
aggcctgttggctgttcctgtttaa

SEQ ID NO: 502834 - DNA, 25 bp, Homo sapien
ttggctgttcctgtttaaggagaca

SEQ ID NO: 502835 - DNA, 25 bp, Homo sapien
tcctgtttaaggagacaagatgggc

SEQ ID NO: 502836 - DNA, 25 bp, Homo sapien
aagatgggcatggaacagggaccac

SEQ ID NO: 502837 - DNA, 25 bp, Homo sapien
acagacccctaccagctgatgaatg

SEQ ID NO: 502838 - DNA, 25 bp, Homo sapien
gacccctaccagctgatgaatgcag

SEQ ID NO: 502839 - DNA, 25 bp, Homo sapien
accagctgatgaatgcagtgaacac

SEQ ID NO: 502840 - DNA, 25 bp, Homo sapien
aatgcagtgaacacactggacaggg

SEQ ID NO: 502841 - DNA, 25 bp, Homo sapien
ggatgtcctcaaccagctacacgta

SEQ ID NO: 502842 - DNA, 25 bp, Homo sapien
aaccagctacacgtacagctcatgg

SEQ ID NO: 502843 - DNA, 25 bp, Homo sapien
ccagctacacgtacagctcatggag

SEQ ID NO: 502844 - DNA, 25 bp, Homo sapien
gtacagctcatggagctgaggagct

SEQ ID NO: 502845 - DNA, 25 bp, Homo sapien
gctgcaagggttacaagcagtgtaa

SEQ ID NO: 502846 - DNA, 25 bp, Homo sapien
ttacaagcagtgtaacccccggact

SEQ ID NO: 502847 - DNA, 25 bp, Homo sapien
ccccggactcgaaacatggacctgg

SEQ ID NO: 502848 - DNA, 25 bp, Homo sapien
tgcattcacaattacttttcacaaa

SEQ ID NO: 502849 - DNA, 25 bp, Homo sapien
caattacttttcacaaaggtgttgg

SEQ ID NO: 502850 - DNA, 25 bp, Homo sapien
aggtgttggaaatggcatttttatt

SEQ ID NO: 502851 - DNA, 25 bp, Homo sapien
ttattttacacagatagttgcacat

SEQ ID NO: 502852 - DNA, 25 bp, Homo sapien
acacagatagttgcacatatataga

SEQ ID NO: 502853 - DNA, 25 bp, Homo sapien
aacttacttgtaaagctactgatac

SEQ ID NO: 502854 - DNA, 25 bp, Homo sapien
aagctactgatacagatgggccgca

SEQ ID NO: 502855 - DNA, 25 bp, Homo sapien
actgatacagatgggccgcatggtt

SEQ ID NO: 502856 - DNA, 25 bp, Homo sapien
gggaaagctcctctgtgaaaagagc

SEQ ID NO: 502857 - DNA, 25 bp, Homo sapien
gtgaaaagagcatgtttattcctct

SEQ ID NO: 502858 - DNA, 25 bp, Homo sapien
tcctcttttaactgctattaaacaa

SEQ ID NO: 502859 - DNA, 25 bp, Homo sapien
gcatttgttgattcaatactgccca

SEQ ID NO: 502860 - DNA, 25 bp, Homo sapien
gttgattcaatactgcccactatgt

SEQ ID NO: 502861 - DNA, 25 bp, Homo sapien
tgcccactatgtacactgacaatta

SEQ ID NO: 502862 - DNA, 25 bp, Homo sapien
gaggatcgttgagccctaggaagtc

SEQ ID NO: 502863 - DNA, 25 bp, Homo sapien
gacataatttaatttcagctcatgg

SEQ ID NO: 502864 - DNA, 25 bp, Homo sapien
tcagctcatggtatgaatggagaca

SEQ ID NO: 502865 - DNA, 25 bp, Homo sapien
taaggcaatatagtgcccttaaata

SEQ ID NO: 502866 - DNA, 25 bp, Homo sapien
gttgaagttcataagggaccatcat

SEQ ID NO: 502867 - DNA, 25 bp, Homo sapien
gttcataagggaccatcattaagat

SEQ ID NO: 502868 - DNA, 25 bp, Homo sapien
tgcactctggccttgatgatagagt

SEQ ID NO: 502869 - DNA, 25 bp, Homo sapien
cttgatgatagagtgagaaccagtc

SEQ ID NO: 502870 - DNA, 25 bp, Homo sapien
aatacaccaaggatatcggcaccat

SEQ ID NO: 502871 - DNA, 25 bp, Homo sapien
ggatatcggcaccattacacaaaat

SEQ ID NO: 502872 - DNA, 25 bp, Homo sapien
gaagtttttggttgtattagtcata

SEQ ID NO: 502873 - DNA, 25 bp, Homo sapien
gttgagtgcagaaatctctgcttct

SEQ ID NO: 502874 - DNA, 25 bp, Homo sapien
atctctgcttctaaaattatttgta

SEQ ID NO: 502875 - DNA, 25 bp, Homo sapien
agagattacaggaaacaaatgcttt

SEQ ID NO: 502876 - DNA, 25 bp, Homo sapien
ttttgtttcagttctaggtcccttg

SEQ ID NO: 502877 - DNA, 25 bp, Homo sapien
ttcagttctaggtcccttgtcacag

SEQ ID NO: 502878 - DNA, 25 bp, Homo sapien
cccttgtcacagcttggtttttaga

SEQ ID NO: 502879 - DNA, 25 bp, Homo sapien
cagtatattactcttgacagtttga

SEQ ID NO: 502880 - DNA, 25 bp, Homo sapien
tgacagtttgaatttcttcacctaa

SEQ ID NO: 502881 - DNA, 25 bp, Homo sapien
aaatgaaaaagcttcggcacatgaa

SEQ ID NO: 502882 - DNA, 25 bp, Homo sapien
aaagcttcggcacatgaagacatgg

SEQ ID NO: 502883 - DNA, 25 bp, Homo sapien
tcaccacgcatctgtcccagtgact

SEQ ID NO: 502884 - DNA, 25 bp, Homo sapien
cccagtgactacagcttttaactcc

SEQ ID NO: 502885 - DNA, 25 bp, Homo sapien
agtgactacagcttttaactcctcc

SEQ ID NO: 502886 - DNA, 25 bp, Homo sapien
tgactacagcttttaactcctccag

SEQ ID NO: 502887 - DNA, 25 bp, Homo sapien
tacagcttttaactcctccagcaga

SEQ ID NO: 502888 - DNA, 25 bp, Homo sapien
cctccagcagacatctagtcaggat

SEQ ID NO: 502889 - DNA, 25 bp, Homo sapien
gcagacatctagtcaggatctgaaa

SEQ ID NO: 502890 - DNA, 25 bp, Homo sapien
gaaactgccaaaatgttctatgcta

SEQ ID NO: 502891 - DNA, 25 bp, Homo sapien
ccaaaatgttctatgctaggctgtc

SEQ ID NO: 502892 - DNA, 25 bp, Homo sapien
taaggtcgtgggagcgggactgcaa

SEQ ID NO: 502893 - DNA, 25 bp, Homo sapien
gggactgcaacaagcaatgccagat

SEQ ID NO: 502894 - DNA, 25 bp, Homo sapien
gcaacaagcaatgccagataactga

SEQ ID NO: 502895 - DNA, 25 bp, Homo sapien
gccagataactgagaaatcatgttc

SEQ ID NO: 502896 - DNA, 25 bp, Homo sapien
ttgtggactatttcagacaaccagg

SEQ ID NO: 502897 - DNA, 25 bp, Homo sapien
agacaaccaggttccgacagtccag

SEQ ID NO: 502898 - DNA, 25 bp, Homo sapien
gttccgacagtccagcccagaactt

SEQ ID NO: 502899 - DNA, 25 bp, Homo sapien
gggagagattaagcgctcattaagc

SEQ ID NO: 502900 - DNA, 25 bp, Homo sapien
gattaagcgctcattaagcagagga

SEQ ID NO: 502901 - DNA, 25 bp, Homo sapien
ttaagcagaggagcccactttgagg

SEQ ID NO: 502902 - DNA, 25 bp, Homo sapien
tttgaggagagcaaagcacaagctt

SEQ ID NO: 502903 - DNA, 25 bp, Homo sapien
gaatctgaaatattaccccttgtct

SEQ ID NO: 502904 - DNA, 25 bp, Homo sapien
tctgaaatattaccccttgtctaga

SEQ ID NO: 502905 - DNA, 25 bp, Homo sapien
gttctcaaaatcataaaccatggct

SEQ ID NO: 502906 - DNA, 25 bp, Homo sapien
aaaccatggctactcttgggaacca

SEQ ID NO: 502907 - DNA, 25 bp, Homo sapien
tcttgggaaccacccggccatgtgg

SEQ ID NO: 502908 - DNA, 25 bp, Homo sapien
ccggccatgtggtcgccaagtagag

SEQ ID NO: 502909 - DNA, 25 bp, Homo sapien
gtggtcgccaagtagagcaagcccc

SEQ ID NO: 502910 - DNA, 25 bp, Homo sapien
tttctcttcccaatcacgtggctga

SEQ ID NO: 502911 - DNA, 25 bp, Homo sapien
caatcacgtggctgagtgtggatga

SEQ ID NO: 502912 - DNA, 25 bp, Homo sapien
gagaagggcgattaacacttttgac

SEQ ID NO: 502913 - DNA, 25 bp, Homo sapien
gggcgattaacacttttgacagtat

SEQ ID NO: 502914 - DNA, 25 bp, Homo sapien
ttgtatggttattgcttgttctttg

SEQ ID NO: 502915 - DNA, 25 bp, Homo sapien
tttaacctgttttctcttagcaaat

SEQ ID NO: 502916 - DNA, 25 bp, Homo sapien
gttttctcttagcaaatcacagctc

SEQ ID NO: 502917 - DNA, 25 bp, Homo sapien
atcacagctcatgcagattttcaaa

SEQ ID NO: 502918 - DNA, 25 bp, Homo sapien
gccttgttatacaaagtgttctttc

SEQ ID NO: 502919 - DNA, 25 bp, Homo sapien
tgttctttcatcattctattaaatt

SEQ ID NO: 502920 - DNA, 25 bp, Homo sapien
gttatagttatttctgctgtgcctt

SEQ ID NO: 502921 - DNA, 25 bp, Homo sapien
ctgctgtgcctttgttaatgaataa

SEQ ID NO: 502922 - DNA, 25 bp, Homo sapien
atcagtgacatcatctggactctcc

SEQ ID NO: 502923 - DNA, 25 bp, Homo sapien
tctggactctcctttgtttttgctg

SEQ ID NO: 502924 - DNA, 25 bp, Homo sapien
tgctggtttggagttaggacatcta

SEQ ID NO: 502925 - DNA, 25 bp, Homo sapien
ctcctctgatggatggcttgcaggg

SEQ ID NO: 502926 - DNA, 25 bp, Homo sapien
cctctgatggatggcttgcagggca

SEQ ID NO: 502927 - DNA, 25 bp, Homo sapien
ggcttgcagggcagcccctggtaac

SEQ ID NO: 502928 - DNA, 25 bp, Homo sapien
tggtaaccagcccagtcaggcccca

SEQ ID NO: 502929 - DNA, 25 bp, Homo sapien
taagaaacttttagggaccctgcag

SEQ ID NO: 502930 - DNA, 25 bp, Homo sapien
ggaggaagaattttgtagagctgcc

SEQ ID NO: 502931 - DNA, 25 bp, Homo sapien
ttggtgaccaatgccagccagagtc

SEQ ID NO: 502932 - DNA, 25 bp, Homo sapien
gtgaccaatgccagccagagtcctg

SEQ ID NO: 502933 - DNA, 25 bp, Homo sapien
ccaatgccagccagagtcctgcggg

SEQ ID NO: 502934 - DNA, 25 bp, Homo sapien
gtagggccctggaagtctcccaggt

SEQ ID NO: 502935 - DNA, 25 bp, Homo sapien
agggccctggaagtctcccaggtct

SEQ ID NO: 502936 - DNA, 25 bp, Homo sapien
aaagactgttaagaggaggctattt

SEQ ID NO: 502937 - DNA, 25 bp, Homo sapien
gaggctatttgatgacataacactt

SEQ ID NO: 502938 - DNA, 25 bp, Homo sapien
tcattctgtttatcagttctcgcaa

SEQ ID NO: 502939 - DNA, 25 bp, Homo sapien
gtttatcagttctcgcaatctgtat

SEQ ID NO: 502940 - DNA, 25 bp, Homo sapien
gttctcgcaatctgtataaatgcat

SEQ ID NO: 502941 - DNA, 25 bp, Homo sapien
aatgcattttagaactgatagacag

SEQ ID NO: 502942 - DNA, 25 bp, Homo sapien
ctttgataagaatacatgccactgt

SEQ ID NO: 502943 - DNA, 25 bp, Homo sapien
tacatgccactgtacattcagatat

SEQ ID NO: 502944 - DNA, 25 bp, Homo sapien
aaatttgcaaacacattgttctata

SEQ ID NO: 502945 - DNA, 25 bp, Homo sapien
cacattgttctatatgtaagggtac

SEQ ID NO: 502946 - DNA, 25 bp, Homo sapien
gtaagggtactgtatgtaaaactct

SEQ ID NO: 502947 - DNA, 25 bp, Homo sapien
ctttggccagatgtgccgttagagt

SEQ ID NO: 502948 - DNA, 25 bp, Homo sapien
gttagagtgcatagtatccctgggc

SEQ ID NO: 502949 - DNA, 25 bp, Homo sapien
atccctgggcactggacgttatgag

SEQ ID NO: 502950 - DNA, 25 bp, Homo sapien
gagaaacacggtaacatacacaagc

SEQ ID NO: 502951 - DNA, 25 bp, Homo sapien
gttatcaacagtgctacagatacag

SEQ ID NO: 502952 - DNA, 25 bp, Homo sapien
ataatgcttgatggcctgttacctc

SEQ ID NO: 502953 - DNA, 25 bp, Homo sapien
ctgttacctcctgacacctatttta

SEQ ID NO: 502954 - DNA, 25 bp, Homo sapien
gacacctattttagattcaatcctg

SEQ ID NO: 502955 - DNA, 25 bp, Homo sapien
gattcaatcctgtaatgtgtgaaaa

SEQ ID NO: 502956 - DNA, 25 bp, Homo sapien
gtgtgaaaacatacctctagatgaa

SEQ ID NO: 502957 - DNA, 25 bp, Homo sapien
aaaagctggatcagctgcagttgga

SEQ ID NO: 502958 - DNA, 25 bp, Homo sapien
agctatactcattgttgaccctctt

SEQ ID NO: 502959 - DNA, 25 bp, Homo sapien
ttgaccctcttgtagacctgtgaga

SEQ ID NO: 502960 - DNA, 25 bp, Homo sapien
agcaactaagccttgggatcactga

SEQ ID NO: 502961 - DNA, 25 bp, Homo sapien
ggatcactgacacacctaaaaccct

SEQ ID NO: 502962 - DNA, 25 bp, Homo sapien
accctgcctaactaactgaaacact

SEQ ID NO: 502963 - DNA, 25 bp, Homo sapien
ggaccccatcacctcagatatgaga

SEQ ID NO: 502964 - DNA, 25 bp, Homo sapien
aaatggtttctctgtatgtttatta

SEQ ID NO: 502965 - DNA, 25 bp, Homo sapien
gattgatgcataggtctcgtctgtt

SEQ ID NO: 502966 - DNA, 25 bp, Homo sapien
aggtctcgtctgttttggttaggat

SEQ ID NO: 502967 - DNA, 25 bp, Homo sapien
ggttaggatgactgcatcatggaca

SEQ ID NO: 502968 - DNA, 25 bp, Homo sapien
atggacatcattttcagctatactc

SEQ ID NO: 502969 - DNA, 25 bp, Homo sapien
agggcgcggcatgggcgtcctggcc

SEQ ID NO: 502970 - DNA, 25 bp, Homo sapien
cgaatgagcaagtggacgagcaagc

SEQ ID NO: 502971 - DNA, 25 bp, Homo sapien
ggcgccaagggcatcggcttcctca

SEQ ID NO: 502972 - DNA, 25 bp, Homo sapien
agggcatcggcttcctcacctcggg

SEQ ID NO: 502973 - DNA, 25 bp, Homo sapien
tcacctcgggctggaggttcgtgca

SEQ ID NO: 502974 - DNA, 25 bp, Homo sapien
ttcgtgcagatcaaggagatggtcc

SEQ ID NO: 502975 - DNA, 25 bp, Homo sapien
gatggtcccggagttcgtcgtcccg

SEQ ID NO: 502976 - DNA, 25 bp, Homo sapien
cccggagttcgtcgtcccggatctg

SEQ ID NO: 502977 - DNA, 25 bp, Homo sapien
ttgctgcgacgcagcggtcggaagc

SEQ ID NO: 502978 - DNA, 25 bp, Homo sapien
cagcggtcggaagcggagcaaggtc

SEQ ID NO: 502979 - DNA, 25 bp, Homo sapien
gagcaaggtcgaggccgggttggcg

SEQ ID NO: 502980 - DNA, 25 bp, Homo sapien
cacggatgcagaaggcagcctggcc

SEQ ID NO: 502981 - DNA, 25 bp, Homo sapien
aggtggagtaagacagagtgacaaa

SEQ ID NO: 502982 - DNA, 25 bp, Homo sapien
gtgacaaaggctgcgtcctggaggc

SEQ ID NO: 502983 - DNA, 25 bp, Homo sapien
ggaagccacacctgcaggacccgag

SEQ ID NO: 502984 - DNA, 25 bp, Homo sapien
tgcaggacccgagtcggaactcaga

SEQ ID NO: 502985 - DNA, 25 bp, Homo sapien
gacccgagtcggaactcagaggctg

SEQ ID NO: 502986 - DNA, 25 bp, Homo sapien
actcagaggctggtacagccgcggt

SEQ ID NO: 502987 - DNA, 25 bp, Homo sapien
gccgcggtgcttgtcctgtagataa

SEQ ID NO: 502988 - DNA, 25 bp, Homo sapien
gcggtgcttgtcctgtagataagaa

SEQ ID NO: 502989 - DNA, 25 bp, Homo sapien
tccatgcctggattcatgcacggcc

SEQ ID NO: 502990 - DNA, 25 bp, Homo sapien
atgcacggccccacagggtgaggcc

SEQ ID NO: 502991 - DNA, 25 bp, Homo sapien
aaaaggtactagttctgcatttcag

SEQ ID NO: 502992 - DNA, 25 bp, Homo sapien
tctgcatttcagagttggcttgttg

SEQ ID NO: 502993 - DNA, 25 bp, Homo sapien
gagttggcttgttgaaccaggctat

SEQ ID NO: 502994 - DNA, 25 bp, Homo sapien
tgaaccaggctatatgcttccaaga

SEQ ID NO: 502995 - DNA, 25 bp, Homo sapien
atatgcttccaagatttaaatgttt

SEQ ID NO: 502996 - DNA, 25 bp, Homo sapien
gtattatactctcaattgtgtttta

SEQ ID NO: 502997 - DNA, 25 bp, Homo sapien
aaatctcttacagaaatctctacct

SEQ ID NO: 502998 - DNA, 25 bp, Homo sapien
tacagaaatctctacctcaggcact

SEQ ID NO: 502999 - DNA, 25 bp, Homo sapien
gaaatctctacctcaggcactaagt

SEQ ID NO: 503000 - DNA, 25 bp, Homo sapien
ctctacctcaggcactaagtgttat

SEQ ID NO: 503001 - DNA, 25 bp, Homo sapien
ctaagtgttatgacatgggtagcat

SEQ ID NO: 503002 - DNA, 25 bp, Homo sapien
ggcgccaagggcatcggcttcctca

SEQ ID NO: 503003 - DNA, 25 bp, Homo sapien
aagggcatcggcttcctcacctcgg

SEQ ID NO: 503004 - DNA, 25 bp, Homo sapien
agggcatcggcttcctcacctcggg

SEQ ID NO: 503005 - DNA, 25 bp, Homo sapien
tcacctcgggctggaggttcgtgca

SEQ ID NO: 503006 - DNA, 25 bp, Homo sapien
acctcgggctggaggttcgtgcaga

SEQ ID NO: 503007 - DNA, 25 bp, Homo sapien
ctcgggctggaggttcgtgcagatc

SEQ ID NO: 503008 - DNA, 25 bp, Homo sapien
cgggctggaggttcgtgcagatcaa

SEQ ID NO: 503009 - DNA, 25 bp, Homo sapien
ttcgtgcagatcaaggagatggtcc

SEQ ID NO: 503010 - DNA, 25 bp, Homo sapien
gatggtcccggagttcgtcgtcccg

SEQ ID NO: 503011 - DNA, 25 bp, Homo sapien
tcccggagttcgtcgtcccggatct

SEQ ID NO: 503012 - DNA, 25 bp, Homo sapien
cccggagttcgtcgtcccggatctg

SEQ ID NO: 503013 - DNA, 25 bp, Homo sapien
ttgctctaaaacctccttaactgac

SEQ ID NO: 503014 - DNA, 25 bp, Homo sapien
ttaactgacttccttgattgtccaa

SEQ ID NO: 503015 - DNA, 25 bp, Homo sapien
gacttccttgattgtccaatgctct

SEQ ID NO: 503016 - DNA, 25 bp, Homo sapien
ttgattgtccaatgctctccattac

SEQ ID NO: 503017 - DNA, 25 bp, Homo sapien
tccaatgctctccattacctctgta

SEQ ID NO: 503018 - DNA, 25 bp, Homo sapien
tgtctagtgggcacccctgcatgct

SEQ ID NO: 503019 - DNA, 25 bp, Homo sapien
tgcatgcttcttctaaccactgagt

SEQ ID NO: 503020 - DNA, 25 bp, Homo sapien
tgcttcttctaaccactgagtgtca

SEQ ID NO: 503021 - DNA, 25 bp, Homo sapien
ctgagtgtcacaatgcctaccaaga

SEQ ID NO: 503022 - DNA, 25 bp, Homo sapien
caatgcctaccaagaatgcgtttgc

SEQ ID NO: 503023 - DNA, 25 bp, Homo sapien
aagaatgcgtttgcaggttcctaaa

SEQ ID NO: 503024 - DNA, 25 bp, Homo sapien
gattgtaaagccagcatttgaagcc

SEQ ID NO: 503025 - DNA, 25 bp, Homo sapien
agccagcatttgaagcctaagtatt

SEQ ID NO: 503026 - DNA, 25 bp, Homo sapien
gcctaagtattgaaagtctttgaca

SEQ ID NO: 503027 - DNA, 25 bp, Homo sapien
ggtcaaaaacctgcttgtcttgtta

SEQ ID NO: 503028 - DNA, 25 bp, Homo sapien
ttctgaaatcagacttgacatcttt

SEQ ID NO: 503029 - DNA, 25 bp, Homo sapien
agaagctacatgtaagcatcatcat

SEQ ID NO: 503030 - DNA, 25 bp, Homo sapien
gtaagcatcatcatgtttattaaat

SEQ ID NO: 503031 - DNA, 25 bp, Homo sapien
attacaatgagaactctcactcaat

SEQ ID NO: 503032 - DNA, 25 bp, Homo sapien
ccaaggacatggaatctctctctaa

SEQ ID NO: 503033 - DNA, 25 bp, Homo sapien
ggacatggaatctctctctaatttt

SEQ ID NO: 503034 - DNA, 25 bp, Homo sapien
catggaatctctctctaattttact

SEQ ID NO: 503035 - DNA, 25 bp, Homo sapien
ccattctcttggttgtcacattatt

SEQ ID NO: 503036 - DNA, 25 bp, Homo sapien
taagtaccttgttaaaggccacctg

SEQ ID NO: 503037 - DNA, 25 bp, Homo sapien
ggaacataacatcctggtcatttta

SEQ ID NO: 503038 - DNA, 25 bp, Homo sapien
aacatcctggtcattttaactacta

SEQ ID NO: 503039 - DNA, 25 bp, Homo sapien
taactactaatgctgtcatgaaagg

SEQ ID NO: 503040 - DNA, 25 bp, Homo sapien
ccagggcaggtgtgaatagagcatt

SEQ ID NO: 503041 - DNA, 25 bp, Homo sapien
agagcattctagcataagcagccaa

SEQ ID NO: 503042 - DNA, 25 bp, Homo sapien
taagcagccaacaattagagcaact

SEQ ID NO: 503043 - DNA, 25 bp, Homo sapien
tagtgtgtggatagcaaatctttgc

SEQ ID NO: 503044 - DNA, 25 bp, Homo sapien
atctttgctgtcttggaagttacta

SEQ ID NO: 503045 - DNA, 25 bp, Homo sapien
aatgctacttgagaccattctcttg

SEQ ID NO: 503046 - DNA, 25 bp, Homo sapien
gtacagatagtaaattggcagttga

SEQ ID NO: 503047 - DNA, 25 bp, Homo sapien
caatgggctgtgactgttgtggaaa

SEQ ID NO: 503048 - DNA, 25 bp, Homo sapien
aaagcactcttctgggcattgggtt

SEQ ID NO: 503049 - DNA, 25 bp, Homo sapien
ttactggaagaactcaatttaggtc

SEQ ID NO: 503050 - DNA, 25 bp, Homo sapien
actcttctgggcattgggttgggaa

SEQ ID NO: 503051 - DNA, 25 bp, Homo sapien
aaagaacagttgatgctgagaagca

SEQ ID NO: 503052 - DNA, 25 bp, Homo sapien
gcaggtctaggcaaggcttatttaa

SEQ ID NO: 503053 - DNA, 25 bp, Homo sapien
ggcttatttaagaggagtgtcgttg

SEQ ID NO: 503054 - DNA, 25 bp, Homo sapien
aagtggctaagacagggttcttcag

SEQ ID NO: 503055 - DNA, 25 bp, Homo sapien
cagggttcttcaggtttagttggca

SEQ ID NO: 503056 - DNA, 25 bp, Homo sapien
agttggcaagtatatgatcactacc

SEQ ID NO: 503057 - DNA, 25 bp, Homo sapien
actatactgtttttcaatggtctgt

SEQ ID NO: 503058 - DNA, 25 bp, Homo sapien
caatggtctgttaaaacatcataca

SEQ ID NO: 503059 - DNA, 25 bp, Homo sapien
agtttattgtcatgtattggctaac

SEQ ID NO: 503060 - DNA, 25 bp, Homo sapien
gtcatgtattggctaactttcaggg

SEQ ID NO: 503061 - DNA, 25 bp, Homo sapien
atcaggttaatttgtgcctgcccca

SEQ ID NO: 503062 - DNA, 25 bp, Homo sapien
gttaatttgtgcctgccccagccat

SEQ ID NO: 503063 - DNA, 25 bp, Homo sapien
ccagccatctctactttattctgag

SEQ ID NO: 503064 - DNA, 25 bp, Homo sapien
tttattctgaggtattccacaatcc

SEQ ID NO: 503065 - DNA, 25 bp, Homo sapien
gtattccacaatcctcttgttgcag

SEQ ID NO: 503066 - DNA, 25 bp, Homo sapien
aatcctcttgttgcaggtgctgcta

SEQ ID NO: 503067 - DNA, 25 bp, Homo sapien
ttcaactgtaaaaaatcatctgtgt

SEQ ID NO: 503068 - DNA, 25 bp, Homo sapien
gaaagagtgcacaccagtgttccaa

SEQ ID NO: 503069 - DNA, 25 bp, Homo sapien
gagtgcacaccagtgttccaagtgc

SEQ ID NO: 503070 - DNA, 25 bp, Homo sapien
gtcatcaaatgtttaagaagcctaa

SEQ ID NO: 503071 - DNA, 25 bp, Homo sapien
gcaactagaaggattacctcctgaa

SEQ ID NO: 503072 - DNA, 25 bp, Homo sapien
agccaggatcagtggatgtagcatc

SEQ ID NO: 503073 - DNA, 25 bp, Homo sapien
ggatgtagcatccataactgtgagc

SEQ ID NO: 503074 - DNA, 25 bp, Homo sapien
aactgtgagcacatctgactctgaa

SEQ ID NO: 503075 - DNA, 25 bp, Homo sapien
gagcacatctgactctgaaccatca

SEQ ID NO: 503076 - DNA, 25 bp, Homo sapien
atcactccccaggtctaaaagcaaa

SEQ ID NO: 503077 - DNA, 25 bp, Homo sapien
aagtcccattaattctagtttcagt

SEQ ID NO: 503078 - DNA, 25 bp, Homo sapien
gtttcagtaaatctaaagcaagtat

SEQ ID NO: 503079 - DNA, 25 bp, Homo sapien
agaaagatagatgccctctctcttc

SEQ ID NO: 503080 - DNA, 25 bp, Homo sapien
ttcatcttcacttgaaataccggat

SEQ ID NO: 503081 - DNA, 25 bp, Homo sapien
tgaaataccggatgattttggaggt

SEQ ID NO: 503082 - DNA, 25 bp, Homo sapien
attttggaggtaggtctgaagatcc

SEQ ID NO: 503083 - DNA, 25 bp, Homo sapien
ggtaggtctgaagatccaagagatt

SEQ ID NO: 503084 - DNA, 25 bp, Homo sapien
taacagctataaaacccaagcaggt

SEQ ID NO: 503085 - DNA, 25 bp, Homo sapien
acccaagcaggtagtagcaaaacag

SEQ ID NO: 503086 - DNA, 25 bp, Homo sapien
agaaagacatttttccagtagaaga

SEQ ID NO: 503087 - DNA, 25 bp, Homo sapien
gtagaagaaattcctcagattcctt

SEQ ID NO: 503088 - DNA, 25 bp, Homo sapien
aaattcctcagattccttctgtagg

SEQ ID NO: 503089 - DNA, 25 bp, Homo sapien
gaggacaagatttatggttatagga

SEQ ID NO: 503090 - DNA, 25 bp, Homo sapien
agcttcccttaactctgtagcctgg

SEQ ID NO: 503091 - DNA, 25 bp, Homo sapien
ttcccttaactctgtagcctggcag

SEQ ID NO: 503092 - DNA, 25 bp, Homo sapien
taactctgtagcctggcagtctgac

SEQ ID NO: 503093 - DNA, 25 bp, Homo sapien
tgtagcctggcagtctgacccaaag

SEQ ID NO: 503094 - DNA, 25 bp, Homo sapien
agcctggcagtctgacccaaagttg

SEQ ID NO: 503095 - DNA, 25 bp, Homo sapien
gcagtctgacccaaagttgccctca

SEQ ID NO: 503096 - DNA, 25 bp, Homo sapien
aagttgccctcacccaaaggttctg

SEQ ID NO: 503097 - DNA, 25 bp, Homo sapien
ttgccctcacccaaaggttctggct

SEQ ID NO: 503098 - DNA, 25 bp, Homo sapien
tcccccataagttggaggataaaat

SEQ ID NO: 503099 - DNA, 25 bp, Homo sapien
taaaatgggtatcaatgctaatatt

SEQ ID NO: 503100 - DNA, 25 bp, Homo sapien
ttctctgtaatctgctatgaaagaa

SEQ ID NO: 503101 - DNA, 25 bp, Homo sapien
gtcccatttggactccggggtctgc

SEQ ID NO: 503102 - DNA, 25 bp, Homo sapien
gggtacgctatctgccgggactccc

SEQ ID NO: 503103 - DNA, 25 bp, Homo sapien
ttagaaggagcaagtgcgtccaaat

SEQ ID NO: 503104 - DNA, 25 bp, Homo sapien
gagcaagtgcgtccaaatggtttga

SEQ ID NO: 503105 - DNA, 25 bp, Homo sapien
agatagaacagttgaccagttttgt

SEQ ID NO: 503106 - DNA, 25 bp, Homo sapien
tgtgctataaagtgaccagggcgta

SEQ ID NO: 503107 - DNA, 25 bp, Homo sapien
tgctataaagtgaccagggcgtagt

SEQ ID NO: 503108 - DNA, 25 bp, Homo sapien
gaccagggcgtagtgagtacagtta

SEQ ID NO: 503109 - DNA, 25 bp, Homo sapien
gagtacagttagtaccgcacacgtt

SEQ ID NO: 503110 - DNA, 25 bp, Homo sapien
gtacagttagtaccgcacacgttag

SEQ ID NO: 503111 - DNA, 25 bp, Homo sapien
ggcgactccgcggtcgtgtggacgg

SEQ ID NO: 503112 - DNA, 25 bp, Homo sapien
aagatgcaaccccatgggctgcctg

SEQ ID NO: 503113 - DNA, 25 bp, Homo sapien
acagaagtgcttccagctccagttg

SEQ ID NO: 503114 - DNA, 25 bp, Homo sapien
cagctccagttgctcatctgagaac

SEQ ID NO: 503115 - DNA, 25 bp, Homo sapien
ccttcagagaatgtcatccctaatg

SEQ ID NO: 503116 - DNA, 25 bp, Homo sapien
atccctaatgacacatgcccgaatg

SEQ ID NO: 503117 - DNA, 25 bp, Homo sapien
tgacacatgcccgaatgaaggagcg

SEQ ID NO: 503118 - DNA, 25 bp, Homo sapien
agcttgtcctgccttcgtattgaat

SEQ ID NO: 503119 - DNA, 25 bp, Homo sapien
ctgccttcgtattgaatgttgcctg

SEQ ID NO: 503120 - DNA, 25 bp, Homo sapien
atgttgcctgtctgcctccttaata

SEQ ID NO: 503121 - DNA, 25 bp, Homo sapien
taatagcgggcctctgtgtgagcat

SEQ ID NO: 503122 - DNA, 25 bp, Homo sapien
ctgtgtgagcatttgacaagactta

SEQ ID NO: 503123 - DNA, 25 bp, Homo sapien
ggagtcagtttttcaatatgcctca

SEQ ID NO: 503124 - DNA, 25 bp, Homo sapien
gtcagtttttcaatatgcctcagaa

SEQ ID NO: 503125 - DNA, 25 bp, Homo sapien
ttcaatatgcctcagaaacccctta

SEQ ID NO: 503126 - DNA, 25 bp, Homo sapien
tcaatatgcctcagaaaccccttaa

SEQ ID NO: 503127 - DNA, 25 bp, Homo sapien
aaatgtgcttacctttttactatgt

SEQ ID NO: 503128 - DNA, 25 bp, Homo sapien
gtgcttacctttttactatgtaatt

SEQ ID NO: 503129 - DNA, 25 bp, Homo sapien
tactatgtaattccccttttagaat

SEQ ID NO: 503130 - DNA, 25 bp, Homo sapien
caatgtattttgtatagcgaggagt

SEQ ID NO: 503131 - DNA, 25 bp, Homo sapien
attttgtatagcgaggagtaggtat

SEQ ID NO: 503132 - DNA, 25 bp, Homo sapien
aatccaacaaacaaatgtgttcaca

SEQ ID NO: 503133 - DNA, 25 bp, Homo sapien
aaatgtgttcacaaactaaattatt

SEQ ID NO: 503134 - DNA, 25 bp, Homo sapien
gcacctcgtgcatgcactggatgta

SEQ ID NO: 503135 - DNA, 25 bp, Homo sapien
atgcactggatgtagccggcagcga

SEQ ID NO: 503136 - DNA, 25 bp, Homo sapien
atgtagccggcagcgaagcgctcgc

SEQ ID NO: 503137 - DNA, 25 bp, Homo sapien
tcacgcagcggcatggactcgagca

SEQ ID NO: 503138 - DNA, 25 bp, Homo sapien
gtcagctccagcacttcggcgttct

SEQ ID NO: 503139 - DNA, 25 bp, Homo sapien
ggcatggactcgagcagatggttca

SEQ ID NO: 503140 - DNA, 25 bp, Homo sapien
tcggcgttctccagcttggcctgca

SEQ ID NO: 503141 - DNA, 25 bp, Homo sapien
gcaggctctcgttgatccgcgcgcg

SEQ ID NO: 503142 - DNA, 25 bp, Homo sapien
gatggttcaggagctcggcagcgac

SEQ ID NO: 503143 - DNA, 25 bp, Homo sapien
gcctggcacgtggacacgaacgtgt

SEQ ID NO: 503144 - DNA, 25 bp, Homo sapien
tggacacgaacgtgtgcacctcgtg

SEQ ID NO: 503145 - DNA, 25 bp, Homo sapien
tgatttagacatttgccagtgcacc

SEQ ID NO: 503146 - DNA, 25 bp, Homo sapien
gccagtgcaccaaaccatgagagat

SEQ ID NO: 503147 - DNA, 25 bp, Homo sapien
gagagattgtccgacctaatgccac

SEQ ID NO: 503148 - DNA, 25 bp, Homo sapien
atgccacctggcagatgtgtaccca

SEQ ID NO: 503149 - DNA, 25 bp, Homo sapien
agatttttctgtagctccatgtttc

SEQ ID NO: 503150 - DNA, 25 bp, Homo sapien
gtagctccatgtttcccataaaggg

SEQ ID NO: 503151 - DNA, 25 bp, Homo sapien
gatcttcctttggaaccaggcacat

SEQ ID NO: 503152 - DNA, 25 bp, Homo sapien
atttggccccttctcagtgactgca

SEQ ID NO: 503153 - DNA, 25 bp, Homo sapien
gactgcactgtggaactcttcttaa

SEQ ID NO: 503154 - DNA, 25 bp, Homo sapien
gctcaagactcagccacaatatgca

SEQ ID NO: 503155 - DNA, 25 bp, Homo sapien
aattgctttaatgccatattacggc

SEQ ID NO: 503156 - DNA, 25 bp, Homo sapien
gaatttttctctatttccagcacgc

SEQ ID NO: 503157 - DNA, 25 bp, Homo sapien
tttctctatttccagcacgctgatt

SEQ ID NO: 503158 - DNA, 25 bp, Homo sapien
agttggagtaaagggatattcattc

SEQ ID NO: 503159 - DNA, 25 bp, Homo sapien
cattccatgttaaaagtggcttcat

SEQ ID NO: 503160 - DNA, 25 bp, Homo sapien
aagtggcttcatagctactgacaaa

SEQ ID NO: 503161 - DNA, 25 bp, Homo sapien
cttcatagctactgacaaatgtctg

SEQ ID NO: 503162 - DNA, 25 bp, Homo sapien
aatgtctgaactattgtcgtgccct

SEQ ID NO: 503163 - DNA, 25 bp, Homo sapien
tgaactattgtcgtgcccttcaaaa

SEQ ID NO: 503164 - DNA, 25 bp, Homo sapien
tattgtcgtgcccttcaaaactgga

SEQ ID NO: 503165 - DNA, 25 bp, Homo sapien
tatacttgtatgttccagcaattta

SEQ ID NO: 503166 - DNA, 25 bp, Homo sapien
gtatgttccagcaatttaagatata

SEQ ID NO: 503167 - DNA, 25 bp, Homo sapien
cctcctggcgcggacaagtcaggag

SEQ ID NO: 503168 - DNA, 25 bp, Homo sapien
gtggccctttttacctcatgaggga

SEQ ID NO: 503169 - DNA, 25 bp, Homo sapien
tcatgagggaactgccaggtagcac

SEQ ID NO: 503170 - DNA, 25 bp, Homo sapien
aactgccaggtagcacagagctgac

SEQ ID NO: 503171 - DNA, 25 bp, Homo sapien
ccaggtagcacagagctgacaggca

SEQ ID NO: 503172 - DNA, 25 bp, Homo sapien
gctgacaggcagcacgaatctgatc

SEQ ID NO: 503173 - DNA, 25 bp, Homo sapien
agcacgaatctgatcacacactaca

SEQ ID NO: 503174 - DNA, 25 bp, Homo sapien
atcacacactacaacttggaacaag

SEQ ID NO: 503175 - DNA, 25 bp, Homo sapien
caagcctataataaattctgtggga

SEQ ID NO: 503176 - DNA, 25 bp, Homo sapien
aatttcacggcactgtttggggctc

SEQ ID NO: 503177 - DNA, 25 bp, Homo sapien
actcggcttcggaccaggaaagcct

SEQ ID NO: 503178 - DNA, 25 bp, Homo sapien
ggtagagccacctagaaatgcatat

SEQ ID NO: 503179 - DNA, 25 bp, Homo sapien
gctagggtgctttttgtgctgaatt

SEQ ID NO: 503180 - DNA, 25 bp, Homo sapien
agggtgctttttgtgctgaattctc

SEQ ID NO: 503181 - DNA, 25 bp, Homo sapien
gaattctccacattgttaactgcca

SEQ ID NO: 503182 - DNA, 25 bp, Homo sapien
ttctccacattgttaactgccaaag

SEQ ID NO: 503183 - DNA, 25 bp, Homo sapien
cacattgttaactgccaaagctagt

SEQ ID NO: 503184 - DNA, 25 bp, Homo sapien
actgccaaagctagttttagagaat

SEQ ID NO: 503185 - DNA, 25 bp, Homo sapien
aagcaaaatactcccaggtctcact

SEQ ID NO: 503186 - DNA, 25 bp, Homo sapien
ccaggtctcactccagaacataaaa

SEQ ID NO: 503187 - DNA, 25 bp, Homo sapien
tgtgatcgaatggtatatattagaa

SEQ ID NO: 503188 - DNA, 25 bp, Homo sapien
gtgagcaattaaacatggttgactt

SEQ ID NO: 503189 - DNA, 25 bp, Homo sapien
acgcgctcagcctgatgtgtttaca

SEQ ID NO: 503190 - DNA, 25 bp, Homo sapien
catggtactgtatgtatgggagagc

SEQ ID NO: 503191 - DNA, 25 bp, Homo sapien
atgggagagcagactgcaccctcca

SEQ ID NO: 503192 - DNA, 25 bp, Homo sapien
aacaacagatgaaagccagtgagcc

SEQ ID NO: 503193 - DNA, 25 bp, Homo sapien
gaaagccagtgagcctactaaccgt

SEQ ID NO: 503194 - DNA, 25 bp, Homo sapien
agtgagcctactaaccgtgccatct

SEQ ID NO: 503195 - DNA, 25 bp, Homo sapien
taaccgtgccatcttgcaaactaca

SEQ ID NO: 503196 - DNA, 25 bp, Homo sapien
tgccatcttgcaaactacactttaa

SEQ ID NO: 503197 - DNA, 25 bp, Homo sapien
aaccaatatgtgcagtatacgttga

SEQ ID NO: 503198 - DNA, 25 bp, Homo sapien
tatgaacatactttcctatttctgt

SEQ ID NO: 503199 - DNA, 25 bp, Homo sapien
ctatttctgttctttgaaaatgtca

SEQ ID NO: 503200 - DNA, 25 bp, Homo sapien
tttaaacacggaatgattggcaata

SEQ ID NO: 503201 - DNA, 25 bp, Homo sapien
aaacagttattcattaattccacaa

SEQ ID NO: 503202 - DNA, 25 bp, Homo sapien
atttatcaggcttctattatatgtg

SEQ ID NO: 503203 - DNA, 25 bp, Homo sapien
caggcttctattatatgtgaggcac

SEQ ID NO: 503204 - DNA, 25 bp, Homo sapien
ctattatatgtgaggcactgagctg

SEQ ID NO: 503205 - DNA, 25 bp, Homo sapien
gctgggcatggctgtaaaggaacca

SEQ ID NO: 503206 - DNA, 25 bp, Homo sapien
gctgtaaaggaaccatctaggaagt

SEQ ID NO: 503207 - DNA, 25 bp, Homo sapien
tctaggaagtaattatgcaatcatt

SEQ ID NO: 503208 - DNA, 25 bp, Homo sapien
tgcaatcatttctgaacctgtttca

SEQ ID NO: 503209 - DNA, 25 bp, Homo sapien
atcagtgttgggtttatcagtgttt

SEQ ID NO: 503210 - DNA, 25 bp, Homo sapien
ttatcagtgtttaacattgtttgat

SEQ ID NO: 503211 - DNA, 25 bp, Homo sapien
aagaagaggatcctgaacggaaaag

SEQ ID NO: 503212 - DNA, 25 bp, Homo sapien
gaagaatcgacatagtccagaccac

SEQ ID NO: 503213 - DNA, 25 bp, Homo sapien
atagtccagaccacccaggtatggg

SEQ ID NO: 503214 - DNA, 25 bp, Homo sapien
agcagcctacgctaataggaccact

SEQ ID NO: 503215 - DNA, 25 bp, Homo sapien
tacgctaataggaccactggactct

SEQ ID NO: 503216 - DNA, 25 bp, Homo sapien
aataggaccactggactctttgcca

SEQ ID NO: 503217 - DNA, 25 bp, Homo sapien
taggaccactggactctttgccagg

SEQ ID NO: 503218 - DNA, 25 bp, Homo sapien
ggatggcttttcctgctgtactgaa

SEQ ID NO: 503219 - DNA, 25 bp, Homo sapien
ggcttttcctgctgtactgaacctg

SEQ ID NO: 503220 - DNA, 25 bp, Homo sapien
ctgctgtactgaacctgctgataaa

SEQ ID NO: 503221 - DNA, 25 bp, Homo sapien
gggctcagttgagactaagtaaatt

SEQ ID NO: 503222 - DNA, 25 bp, Homo sapien
atgatagttgcctctgcgagagtga

SEQ ID NO: 503223 - DNA, 25 bp, Homo sapien
tgatagttgcctctgcgagagtgat

SEQ ID NO: 503224 - DNA, 25 bp, Homo sapien
tttcagaaggccttaaatatgttta

SEQ ID NO: 503225 - DNA, 25 bp, Homo sapien
gccttaaatatgtttatgagctctg

SEQ ID NO: 503226 - DNA, 25 bp, Homo sapien
atgagctctggggtttggaactaga

SEQ ID NO: 503227 - DNA, 25 bp, Homo sapien
gaactagattgcaagggtggaaccc

SEQ ID NO: 503228 - DNA, 25 bp, Homo sapien
aagggtggaacccaagctctgccat

SEQ ID NO: 503229 - DNA, 25 bp, Homo sapien
ggtggaacccaagctctgccatttc

SEQ ID NO: 503230 - DNA, 25 bp, Homo sapien
gctctgccatttcctagttatgtga

SEQ ID NO: 503231 - DNA, 25 bp, Homo sapien
tgccatttcctagttatgtgacctt

SEQ ID NO: 503232 - DNA, 25 bp, Homo sapien
tttcctagttatgtgaccttgggca

SEQ ID NO: 503233 - DNA, 25 bp, Homo sapien
tgatcattacaagccacataaacaa

SEQ ID NO: 503234 - DNA, 25 bp, Homo sapien
gctcttgggagtattcactaatttt

SEQ ID NO: 503235 - DNA, 25 bp, Homo sapien
aagaacacaaagtggtcctgactaa

SEQ ID NO: 503236 - DNA, 25 bp, Homo sapien
gtggtcctgactaaagagattgaaa

SEQ ID NO: 503237 - DNA, 25 bp, Homo sapien
ggaaagaaggccagattcatcaaat

SEQ ID NO: 503238 - DNA, 25 bp, Homo sapien
aatcatttgggtattcctttggaat

SEQ ID NO: 503239 - DNA, 25 bp, Homo sapien
ggaatatggacttaacatgcctcta

SEQ ID NO: 503240 - DNA, 25 bp, Homo sapien
tggacttaacatgcctctagtttct

SEQ ID NO: 503241 - DNA, 25 bp, Homo sapien
ttaacatgcctctagtttctttttc

SEQ ID NO: 503242 - DNA, 25 bp, Homo sapien
atttctaatacggtgaatgttgatc

SEQ ID NO: 503243 - DNA, 25 bp, Homo sapien
gaatgttgatcattacaagccacat

SEQ ID NO: 503244 - DNA, 25 bp, Homo sapien
cagaataagctgatgtttggtggca

SEQ ID NO: 503245 - DNA, 25 bp, Homo sapien
cagaggagttattagttgcgtgaac

SEQ ID NO: 503246 - DNA, 25 bp, Homo sapien
gttgcgtgaactgtcaagagattgc

SEQ ID NO: 503247 - DNA, 25 bp, Homo sapien
ggctatcacaaaactagggttcttc

SEQ ID NO: 503248 - DNA, 25 bp, Homo sapien
tgcagtgcaggagggcaacagaaac

SEQ ID NO: 503249 - DNA, 25 bp, Homo sapien
tacaaggtgcagacttgagtcatgt

SEQ ID NO: 503250 - DNA, 25 bp, Homo sapien
gcagacttgagtcatgtaagatcta

SEQ ID NO: 503251 - DNA, 25 bp, Homo sapien
gaaccaaagtaactagagtcagtca

SEQ ID NO: 503252 - DNA, 25 bp, Homo sapien
gagtcagtcaagcacaaagctgtga

SEQ ID NO: 503253 - DNA, 25 bp, Homo sapien
gaatcatactgaattttaggaacaa

SEQ ID NO: 503254 - DNA, 25 bp, Homo sapien
ttatgcatttaatgacacattgcca

SEQ ID NO: 503255 - DNA, 25 bp, Homo sapien
gcattgtgtcctggatcgtctggga

SEQ ID NO: 503256 - DNA, 25 bp, Homo sapien
cattgtgtcctggatcgtctgggag

SEQ ID NO: 503257 - DNA, 25 bp, Homo sapien
attgtgtcctggatcgtctgggagc

SEQ ID NO: 503258 - DNA, 25 bp, Homo sapien
ttgtgtcctggatcgtctgggagcc

SEQ ID NO: 503259 - DNA, 25 bp, Homo sapien
tgtgtcctggatcgtctgggagccc

SEQ ID NO: 503260 - DNA, 25 bp, Homo sapien
gtgtcctggatcgtctgggagccca

SEQ ID NO: 503261 - DNA, 25 bp, Homo sapien
tgtcctggatcgtctgggagcccag

SEQ ID NO: 503262 - DNA, 25 bp, Homo sapien
gtcctggatcgtctgggagcccagt

SEQ ID NO: 503263 - DNA, 25 bp, Homo sapien
tcctggatcgtctgggagcccagtg

SEQ ID NO: 503264 - DNA, 25 bp, Homo sapien
cctggatcgtctgggagcccagtgt

SEQ ID NO: 503265 - DNA, 25 bp, Homo sapien
gtatggttacctcctagaaacttca

SEQ ID NO: 503266 - DNA, 25 bp, Homo sapien
ttacctcctagaaacttcacttcca

SEQ ID NO: 503267 - DNA, 25 bp, Homo sapien
gatgcacaattcaaacccaggtctc

SEQ ID NO: 503268 - DNA, 25 bp, Homo sapien
gttttcattttaccgtgctacagga

SEQ ID NO: 503269 - DNA, 25 bp, Homo sapien
ggagcaagaacaagagcccaggtaa

SEQ ID NO: 503270 - DNA, 25 bp, Homo sapien
aagagcccaggtaaaggaatttgca

SEQ ID NO: 503271 - DNA, 25 bp, Homo sapien
ggaatttgcaagtctggccggcatg

SEQ ID NO: 503272 - DNA, 25 bp, Homo sapien
gtctggccggcatggaaagcaaact

SEQ ID NO: 503273 - DNA, 25 bp, Homo sapien
gaaagcaaactcctttcttcatttt

SEQ ID NO: 503274 - DNA, 25 bp, Homo sapien
ttcagtttgcccctatttgttcagt

SEQ ID NO: 503275 - DNA, 25 bp, Homo sapien
gtttgcccctatttgttcagtttgc

SEQ ID NO: 503276 - DNA, 25 bp, Homo sapien
tataagggctttattcatgcctgat

SEQ ID NO: 503277 - DNA, 25 bp, Homo sapien
gggctttattcatgcctgatttgtt

SEQ ID NO: 503278 - DNA, 25 bp, Homo sapien
ttattcatgcctgatttgtttacat

SEQ ID NO: 503279 - DNA, 25 bp, Homo sapien
gatttgtttacatgaggacttctga

SEQ ID NO: 503280 - DNA, 25 bp, Homo sapien
tgtttacatgaggacttctgaaatt

SEQ ID NO: 503281 - DNA, 25 bp, Homo sapien
tcctgaagaccgaaaagttgaatga

SEQ ID NO: 503282 - DNA, 25 bp, Homo sapien
gttgaatgatttattgttacttata

SEQ ID NO: 503283 - DNA, 25 bp, Homo sapien
gtgattaaaatcttgccccagcaca

SEQ ID NO: 503284 - DNA, 25 bp, Homo sapien
ttgccccagcacagtaataaaaatc

SEQ ID NO: 503285 - DNA, 25 bp, Homo sapien
gtaacaatcttgaagagctaatttt

SEQ ID NO: 503286 - DNA, 25 bp, Homo sapien
aatactattattgtcatcccaagaa

SEQ ID NO: 503287 - DNA, 25 bp, Homo sapien
atgatcctttcctctcagagaagag

SEQ ID NO: 503288 - DNA, 25 bp, Homo sapien
tcctctcagagaagagtgtgtcaat

SEQ ID NO: 503289 - DNA, 25 bp, Homo sapien
tcaatggaggtggaaccttccccga

SEQ ID NO: 503290 - DNA, 25 bp, Homo sapien
acagctactccctgtgcgaggagcc

SEQ ID NO: 503291 - DNA, 25 bp, Homo sapien
tactccctgtgcgaggagcctcggg

SEQ ID NO: 503292 - DNA, 25 bp, Homo sapien
ccagtgacagcttcaatgacgatga

SEQ ID NO: 503293 - DNA, 25 bp, Homo sapien
acagcttcaatgacgatgaggtgga

SEQ ID NO: 503294 - DNA, 25 bp, Homo sapien
aagtgagaaatggtacctgtctaca

SEQ ID NO: 503295 - DNA, 25 bp, Homo sapien
atggtacctgtctacagacttccct

SEQ ID NO: 503296 - DNA, 25 bp, Homo sapien
aggactcgttccgtctgtcactctg

SEQ ID NO: 503297 - DNA, 25 bp, Homo sapien
gttccgtctgtcactctgaccatca

SEQ ID NO: 503298 - DNA, 25 bp, Homo sapien
ttcccaggtacttaaaatacaagtg

SEQ ID NO: 503299 - DNA, 25 bp, Homo sapien
ggtacttaaaatacaagtgccagta

SEQ ID NO: 503300 - DNA, 25 bp, Homo sapien
atacaagtgccagtaagtggttctt

SEQ ID NO: 503301 - DNA, 25 bp, Homo sapien
acaagtgccagtaagtggttcttat

SEQ ID NO: 503302 - DNA, 25 bp, Homo sapien
agtgccagtaagtggttcttatgtg

SEQ ID NO: 503303 - DNA, 25 bp, Homo sapien
tgttaatcttatgtgctttctaaaa

SEQ ID NO: 503304 - DNA, 25 bp, Homo sapien
gttaatcttatgtgctttctaaaaa

SEQ ID NO: 503305 - DNA, 25 bp, Homo sapien
aatcttatgtgctttctaaaaaatg

SEQ ID NO: 503306 - DNA, 25 bp, Homo sapien
atgtgctttctaaaaaatgttgtga

SEQ ID NO: 503307 - DNA, 25 bp, Homo sapien
ttgtgaaataccaaacttatggatt

SEQ ID NO: 503308 - DNA, 25 bp, Homo sapien
accaaacttatggattatcactagg

SEQ ID NO: 503309 - DNA, 25 bp, Homo sapien
tagctgttataatggcagatctgtc

SEQ ID NO: 503310 - DNA, 25 bp, Homo sapien
ggcagatctgtcattccaaaagaaa

SEQ ID NO: 503311 - DNA, 25 bp, Homo sapien
gaaagctagctaccctagtgaggct

SEQ ID NO: 503312 - DNA, 25 bp, Homo sapien
gatgggctcaatcacatggtctgct

SEQ ID NO: 503313 - DNA, 25 bp, Homo sapien
cacatggtctgctctgaagtatact

SEQ ID NO: 503314 - DNA, 25 bp, Homo sapien
gaagtatacttctgatttcctcatt

SEQ ID NO: 503315 - DNA, 25 bp, Homo sapien
tgatttcctcatttgctgtgtgttc

SEQ ID NO: 503316 - DNA, 25 bp, Homo sapien
ttaagaggaatggaatctgcagaca

SEQ ID NO: 503317 - DNA, 25 bp, Homo sapien
tctcttaaatttgatcctctcccat

SEQ ID NO: 503318 - DNA, 25 bp, Homo sapien
gatcctctcccatagtatccatgga

SEQ ID NO: 503319 - DNA, 25 bp, Homo sapien
tgattacatatcatgcccaaactga

SEQ ID NO: 503320 - DNA, 25 bp, Homo sapien
ggagggtatccatttcctggtgata

SEQ ID NO: 503321 - DNA, 25 bp, Homo sapien
gtatccatttcctggtgatatcctt

SEQ ID NO: 503322 - DNA, 25 bp, Homo sapien
tcctggtgatatccttccattcaaa

SEQ ID NO: 503323 - DNA, 25 bp, Homo sapien
gatatccttccattcaaagcgggta

SEQ ID NO: 503324 - DNA, 25 bp, Homo sapien
cttccattcaaagcgggtatcccag

SEQ ID NO: 503325 - DNA, 25 bp, Homo sapien
tcaaagcgggtatcccagaacaggt

SEQ ID NO: 503326 - DNA, 25 bp, Homo sapien
gagagatctctgcttgtgtgagaaa

SEQ ID NO: 503327 - DNA, 25 bp, Homo sapien
gagctggcctagaaccgctgctaga

SEQ ID NO: 503328 - DNA, 25 bp, Homo sapien
tagaaccgctgctagactatctcca

SEQ ID NO: 503329 - DNA, 25 bp, Homo sapien
aaccgctgctagactatctccaaag

SEQ ID NO: 503330 - DNA, 25 bp, Homo sapien
gtccaaatacagaatactaggtcca

SEQ ID NO: 503331 - DNA, 25 bp, Homo sapien
agcttctttgggagtgctgctaacc

SEQ ID NO: 503332 - DNA, 25 bp, Homo sapien
ggagtgctgctaaccttgaaattat

SEQ ID NO: 503333 - DNA, 25 bp, Homo sapien
ggcagcagagttacatggttcttca

SEQ ID NO: 503334 - DNA, 25 bp, Homo sapien
gttcttcaaatcatgtctgaaccta

SEQ ID NO: 503335 - DNA, 25 bp, Homo sapien
ctattcttggaatcttctctataat

SEQ ID NO: 503336 - DNA, 25 bp, Homo sapien
taagggaagttctcttaccccactg

SEQ ID NO: 503337 - DNA, 25 bp, Homo sapien
cactgccacatacctctgttttaaa

SEQ ID NO: 503338 - DNA, 25 bp, Homo sapien
agataagtccactaactgtgagtaa

SEQ ID NO: 503339 - DNA, 25 bp, Homo sapien
atataggcattaaccacacacttta

SEQ ID NO: 503340 - DNA, 25 bp, Homo sapien
aatgggtataatttcctggctgcct

SEQ ID NO: 503341 - DNA, 25 bp, Homo sapien
cttcctcagcccattaggttaaaca

SEQ ID NO: 503342 - DNA, 25 bp, Homo sapien
aagtgcttcttctatttataaggtt

SEQ ID NO: 503343 - DNA, 25 bp, Homo sapien
tgaataacccttttagcattgaaaa

SEQ ID NO: 503344 - DNA, 25 bp, Homo sapien
ggagctgtgtaatggcagcgaaaca

SEQ ID NO: 503345 - DNA, 25 bp, Homo sapien
ggcagcgaaacatgtagctgtcttt

SEQ ID NO: 503346 - DNA, 25 bp, Homo sapien
cgaaacatgtagctgtctttgttct

SEQ ID NO: 503347 - DNA, 25 bp, Homo sapien
gtctttgttctatagaaatgctttt

SEQ ID NO: 503348 - DNA, 25 bp, Homo sapien
tcttcagagaagctgatctttgtta

SEQ ID NO: 503349 - DNA, 25 bp, Homo sapien
gaagctgatctttgttaatgtcttg

SEQ ID NO: 503350 - DNA, 25 bp, Homo sapien
taatgtcttgattctgttcgcaaag

SEQ ID NO: 503351 - DNA, 25 bp, Homo sapien
gtcttgattctgttcgcaaagcaca

SEQ ID NO: 503352 - DNA, 25 bp, Homo sapien
tgattctgttcgcaaagcacagact

SEQ ID NO: 503353 - DNA, 25 bp, Homo sapien
taaatgcctagatggattaaatgta

SEQ ID NO: 503354 - DNA, 25 bp, Homo sapien
atgtagtatgtgaatgttctatgta

SEQ ID NO: 503355 - DNA, 25 bp, Homo sapien
agtgacttgaatgatttttcctaac

SEQ ID NO: 503356 - DNA, 25 bp, Homo sapien
gaatgatttttcctaacttgtttgc

SEQ ID NO: 503357 - DNA, 25 bp, Homo sapien
gatttttcctaacttgtttgcaact

SEQ ID NO: 503358 - DNA, 25 bp, Homo sapien
acttgtttgcaactgatagctcata

SEQ ID NO: 503359 - DNA, 25 bp, Homo sapien
gcaactgatagctcatattgaatgt

SEQ ID NO: 503360 - DNA, 25 bp, Homo sapien
atgtaaactttgtatcgttgggaag

SEQ ID NO: 503361 - DNA, 25 bp, Homo sapien
ggaagaattacccaatcagagattt

SEQ ID NO: 503362 - DNA, 25 bp, Homo sapien
tttgttacagagttgttacactaga

SEQ ID NO: 503363 - DNA, 25 bp, Homo sapien
cttcaaacaatatacagtcttgtgt

SEQ ID NO: 503364 - DNA, 25 bp, Homo sapien
gcatattttttcagataggacagct

SEQ ID NO: 503365 - DNA, 25 bp, Homo sapien
taggacagctcaaccttacgatgcc

SEQ ID NO: 503366 - DNA, 25 bp, Homo sapien
ttacgatgcctacctgatgccaggt

SEQ ID NO: 503367 - DNA, 25 bp, Homo sapien
atgccaggtgatgcttattttcttc

SEQ ID NO: 503368 - DNA, 25 bp, Homo sapien
tcttcctaaagtaggttactggtca

SEQ ID NO: 503369 - DNA, 25 bp, Homo sapien
gttactggtcatatcttttttccaa

SEQ ID NO: 503370 - DNA, 25 bp, Homo sapien
aaatattaaatgcaccttgccagat

SEQ ID NO: 503371 - DNA, 25 bp, Homo sapien
aatgcaccttgccagatattctcct

SEQ ID NO: 503372 - DNA, 25 bp, Homo sapien
tctcctgcagctctaaggaaaggaa

SEQ ID NO: 503373 - DNA, 25 bp, Homo sapien
gtagaatctactattgagccaccaa

SEQ ID NO: 503374 - DNA, 25 bp, Homo sapien
gaaaccctggcaattaattcagcat

SEQ ID NO: 503375 - DNA, 25 bp, Homo sapien
tgtgtgactctacctgcactctgtg

SEQ ID NO: 503376 - DNA, 25 bp, Homo sapien
tctgtgtttatatcctgtgccctaa

SEQ ID NO: 503377 - DNA, 25 bp, Homo sapien
aagcccaggtaaattcctgctggcc

SEQ ID NO: 503378 - DNA, 25 bp, Homo sapien
cttggaactccaaggtttggctgac

SEQ ID NO: 503379 - DNA, 25 bp, Homo sapien
gctgaccagcagactggctccctga

SEQ ID NO: 503380 - DNA, 25 bp, Homo sapien
tcagcctcaaatccccagtttttga

SEQ ID NO: 503381 - DNA, 25 bp, Homo sapien
gaatgtggatttctgtctgtaatta

SEQ ID NO: 503382 - DNA, 25 bp, Homo sapien
gcaatgcaacaagttggctcttgag

SEQ ID NO: 503383 - DNA, 25 bp, Homo sapien
gaatggcagtaaactgagggcccta

SEQ ID NO: 503384 - DNA, 25 bp, Homo sapien
actgagggccctaagagtgtggtct

SEQ ID NO: 503385 - DNA, 25 bp, Homo sapien
ctaagagtgtggtctgcagggtcaa

SEQ ID NO: 503386 - DNA, 25 bp, Homo sapien
aacccagtatcatgtctgtctgtgt

SEQ ID NO: 503387 - DNA, 25 bp, Homo sapien
cccagtatcatgtctgtctgtgtgt

SEQ ID NO: 503388 - DNA, 25 bp, Homo sapien
tgtgtgtctctcaaggtgagagtct

SEQ ID NO: 503389 - DNA, 25 bp, Homo sapien
ctcaaggtgagagtctgatttttat

SEQ ID NO: 503390 - DNA, 25 bp, Homo sapien
tggttctctctcgttttttagggag

SEQ ID NO: 503391 - DNA, 25 bp, Homo sapien
ggaagaaagtaccaagttgcattga

SEQ ID NO: 503392 - DNA, 25 bp, Homo sapien
agaaagtaccaagttgcattgagct

SEQ ID NO: 503393 - DNA, 25 bp, Homo sapien
gcattgagctgtaattaaggaacat

SEQ ID NO: 503394 - DNA, 25 bp, Homo sapien
ggaacattataatttatgacacatt

SEQ ID NO: 503395 - DNA, 25 bp, Homo sapien
ttatgacacatttctatacttgcaa

SEQ ID NO: 503396 - DNA, 25 bp, Homo sapien
gacacatttctatacttgcaaaaat

SEQ ID NO: 503397 - DNA, 25 bp, Homo sapien
ttcctaaagcttgccctttgagtat

SEQ ID NO: 503398 - DNA, 25 bp, Homo sapien
gcttgccctttgagtattatctgga

SEQ ID NO: 503399 - DNA, 25 bp, Homo sapien
attatctggagaacccaagctgtct

SEQ ID NO: 503400 - DNA, 25 bp, Homo sapien
ggagaacccaagctgtctctggatt

SEQ ID NO: 503401 - DNA, 25 bp, Homo sapien
tctctggattggcacccttaaagac

SEQ ID NO: 503402 - DNA, 25 bp, Homo sapien
gcacccttaaagacagatacattgg

SEQ ID NO: 503403 - DNA, 25 bp, Homo sapien
gccagtgcctcaactcttgattctg

SEQ ID NO: 503404 - DNA, 25 bp, Homo sapien
tgattctgatgaggtttctgggaag

SEQ ID NO: 503405 - DNA, 25 bp, Homo sapien
tggagtctccttaccatggacaata

SEQ ID NO: 503406 - DNA, 25 bp, Homo sapien
gcaaagcaatatcttgttcaggtta

SEQ ID NO: 503407 - DNA, 25 bp, Homo sapien
tgttcaggttagtacccgcaaaacg

SEQ ID NO: 503408 - DNA, 25 bp, Homo sapien
tcccactcagtactggacatgaggc

SEQ ID NO: 503409 - DNA, 25 bp, Homo sapien
acatgaggctatgtcatcaccactt

SEQ ID NO: 503410 - DNA, 25 bp, Homo sapien
atgtcatcaccacttaatgccagca

SEQ ID NO: 503411 - DNA, 25 bp, Homo sapien
atgccagcaccacttaaatgatgtt

SEQ ID NO: 503412 - DNA, 25 bp, Homo sapien
gccctgtacttgctggaggcacatg

SEQ ID NO: 503413 - DNA, 25 bp, Homo sapien
gaggcacatgcccatatcacgtagg

SEQ ID NO: 503414 - DNA, 25 bp, Homo sapien
atatcacgtagggtgtcagggcaga

SEQ ID NO: 503415 - DNA, 25 bp, Homo sapien
gacttcctcccacgcagaagaggga

SEQ ID NO: 503416 - DNA, 25 bp, Homo sapien
aagagggaggcctccgcagaattct

SEQ ID NO: 503417 - DNA, 25 bp, Homo sapien
agaattctctgccatgtgcttctag

SEQ ID NO: 503418 - DNA, 25 bp, Homo sapien
tctaggcttcctcaactcagaaatt

SEQ ID NO: 503419 - DNA, 25 bp, Homo sapien
gtcagagcgattcctggaaccctga

SEQ ID NO: 503420 - DNA, 25 bp, Homo sapien
gcgattcctggaaccctgagggcat

SEQ ID NO: 503421 - DNA, 25 bp, Homo sapien
tgagggcatctcctggcacctctgt

SEQ ID NO: 503422 - DNA, 25 bp, Homo sapien
ttagagcctctgctcgttcacccgt

SEQ ID NO: 503423 - DNA, 25 bp, Homo sapien
aggccttgctgggtacttctgagcc

SEQ ID NO: 503424 - DNA, 25 bp, Homo sapien
tgagcccttgggattcaaagtggca

SEQ ID NO: 503425 - DNA, 25 bp, Homo sapien
gggccactgttgtgggctttgctca

SEQ ID NO: 503426 - DNA, 25 bp, Homo sapien
ggctttgctcagtgtcactgggcaa

SEQ ID NO: 503427 - DNA, 25 bp, Homo sapien
gtcactgggcaaagtgtgtcccttc

SEQ ID NO: 503428 - DNA, 25 bp, Homo sapien
acctggcccagaaagggtgccgcag

SEQ ID NO: 503429 - DNA, 25 bp, Homo sapien
tgccgcagcaaggagtgatatggtt

SEQ ID NO: 503430 - DNA, 25 bp, Homo sapien
gctattaaaacctgttctttttctg

SEQ ID NO: 503431 - DNA, 25 bp, Homo sapien
tctttttctgtcttgataaacacac

SEQ ID NO: 503432 - DNA, 25 bp, Homo sapien
gtcttgataaacacacttcaatctt

SEQ ID NO: 503433 - DNA, 25 bp, Homo sapien
atgggacagtatattttaggaccta

SEQ ID NO: 503434 - DNA, 25 bp, Homo sapien
aaatgtatgatcagcttgtaagtac

SEQ ID NO: 503435 - DNA, 25 bp, Homo sapien
cagcttgtaagtacaggtgctcaaa

SEQ ID NO: 503436 - DNA, 25 bp, Homo sapien
caatcatgctttttactctgtagga

SEQ ID NO: 503437 - DNA, 25 bp, Homo sapien
tagatatcctatccttcacttgttt

SEQ ID NO: 503438 - DNA, 25 bp, Homo sapien
agattatttgctgagataacctctc

SEQ ID NO: 503439 - DNA, 25 bp, Homo sapien
gataacctctcaaaagaacctctca

SEQ ID NO: 503440 - DNA, 25 bp, Homo sapien
aaggttaacaagagcctatatctta

SEQ ID NO: 503441 - DNA, 25 bp, Homo sapien
gaaactgtagtctaatggtaactga

SEQ ID NO: 503442 - DNA, 25 bp, Homo sapien
ggtaactgatgatctgaatccgtct

SEQ ID NO: 503443 - DNA, 25 bp, Homo sapien
tgatctgaatccgtctctctgataa

SEQ ID NO: 503444 - DNA, 25 bp, Homo sapien
tctctctgataacctcctttccatt

SEQ ID NO: 503445 - DNA, 25 bp, Homo sapien
gtaactacgtgaatgctgttggcag

SEQ ID NO: 503446 - DNA, 25 bp, Homo sapien
agggtctgggtacctcagtctcttg

SEQ ID NO: 503447 - DNA, 25 bp, Homo sapien
aaatccaccattgtgaagttgccaa

SEQ ID NO: 503448 - DNA, 25 bp, Homo sapien
ttcccctgccaagtacatgttgtca

SEQ ID NO: 503449 - DNA, 25 bp, Homo sapien
acatgttgtcagagtcagccctata

SEQ ID NO: 503450 - DNA, 25 bp, Homo sapien
gagtcagccctataatgttcatttc

SEQ ID NO: 503451 - DNA, 25 bp, Homo sapien
gtgggattatggatctctgcagaaa

SEQ ID NO: 503452 - DNA, 25 bp, Homo sapien
gattggacatttgctgttcagatgt

SEQ ID NO: 503453 - DNA, 25 bp, Homo sapien
ttatctcagaatcctgtgacctcca

SEQ ID NO: 503454 - DNA, 25 bp, Homo sapien
aatcctgtgacctccaggttgtttt

SEQ ID NO: 503455 - DNA, 25 bp, Homo sapien
ctccaggttgttttataatctattt

SEQ ID NO: 503456 - DNA, 25 bp, Homo sapien
taacattcctcagatagataggcaa

SEQ ID NO: 503457 - DNA, 25 bp, Homo sapien
ggcaaataggacattccttctgtgt

SEQ ID NO: 503458 - DNA, 25 bp, Homo sapien
tctgtgtcacagaagtatcgtggta

SEQ ID NO: 503459 - DNA, 25 bp, Homo sapien
agtatcgtggtagtggcagtctaca

SEQ ID NO: 503460 - DNA, 25 bp, Homo sapien
ggcagtctacagtttatatgattca

SEQ ID NO: 503461 - DNA, 25 bp, Homo sapien
aagaacaaccagtcatgtggccaaa

SEQ ID NO: 503462 - DNA, 25 bp, Homo sapien
gatgttcacttggagtttacttttt

SEQ ID NO: 503463 - DNA, 25 bp, Homo sapien
acaagttttttgtttcacttcatct

SEQ ID NO: 503464 - DNA, 25 bp, Homo sapien
aaagtaagtgatagggatgctcatc

SEQ ID NO: 503465 - DNA, 25 bp, Homo sapien
gatagggatgctcatcattctgcta

SEQ ID NO: 503466 - DNA, 25 bp, Homo sapien
agggatgctcatcattctgctacct

SEQ ID NO: 503467 - DNA, 25 bp, Homo sapien
gatgctcatcattctgctacctatt

SEQ ID NO: 503468 - DNA, 25 bp, Homo sapien
tgctcatcattctgctacctattat

SEQ ID NO: 503469 - DNA, 25 bp, Homo sapien
catcattctgctacctattatcaca

SEQ ID NO: 503470 - DNA, 25 bp, Homo sapien
attctgctacctattatcacaatga

SEQ ID NO: 503471 - DNA, 25 bp, Homo sapien
ctgctacctattatcacaatgaaaa

SEQ ID NO: 503472 - DNA, 25 bp, Homo sapien
aaaacaatcataaatagtacacagg

SEQ ID NO: 503473 - DNA, 25 bp, Homo sapien
acaggaaaggtgagaaatagcggat

SEQ ID NO: 503474 - DNA, 25 bp, Homo sapien
tatgtcacgccaccttgctcgctga

SEQ ID NO: 503475 - DNA, 25 bp, Homo sapien
ttgctcgctgatctaactcttctcc

SEQ ID NO: 503476 - DNA, 25 bp, Homo sapien
tggtgagctccttcgggatgagact

SEQ ID NO: 503477 - DNA, 25 bp, Homo sapien
ggatgagactggtgtcccaggatct

SEQ ID NO: 503478 - DNA, 25 bp, Homo sapien
gaagctgccacataggagacacatg

SEQ ID NO: 503479 - DNA, 25 bp, Homo sapien
gacacatggtgaacagtgagcaggc

SEQ ID NO: 503480 - DNA, 25 bp, Homo sapien
gagagcctagctctggaaagcagct

SEQ ID NO: 503481 - DNA, 25 bp, Homo sapien
ggtctccaccctggttcataagagg

SEQ ID NO: 503482 - DNA, 25 bp, Homo sapien
accctggttcataagaggctaatgc

SEQ ID NO: 503483 - DNA, 25 bp, Homo sapien
tccctgggacctatctagagcgagg

SEQ ID NO: 503484 - DNA, 25 bp, Homo sapien
agtctttctcttgcagcatcctgac

SEQ ID NO: 503485 - DNA, 25 bp, Homo sapien
ggtgttgtttacgatcaagaaaaga

SEQ ID NO: 503486 - DNA, 25 bp, Homo sapien
acctttgactggacacagttccgca

SEQ ID NO: 503487 - DNA, 25 bp, Homo sapien
gactggacacagttccgcatcattt

SEQ ID NO: 503488 - DNA, 25 bp, Homo sapien
agttccgcatcatttcccgtttgga

SEQ ID NO: 503489 - DNA, 25 bp, Homo sapien
ttcccgtttggacaagaagtcggat

SEQ ID NO: 503490 - DNA, 25 bp, Homo sapien
agagcctggaacagtatttttatag

SEQ ID NO: 503491 - DNA, 25 bp, Homo sapien
ggccatgtgccggaatgtctgtcgt

SEQ ID NO: 503492 - DNA, 25 bp, Homo sapien
atgtgccggaatgtctgtcgtctac

SEQ ID NO: 503493 - DNA, 25 bp, Homo sapien
gtctgtcgtctacccacatggaaag

SEQ ID NO: 503494 - DNA, 25 bp, Homo sapien
tacccacatggaaagatggcggtcc

SEQ ID NO: 503495 - DNA, 25 bp, Homo sapien
ggaaagatggcggtcccccagatac

SEQ ID NO: 503496 - DNA, 25 bp, Homo sapien
ctgctcaaacttgaagtgggtagga

SEQ ID NO: 503497 - DNA, 25 bp, Homo sapien
tttgattaagatgcagattctgact

SEQ ID NO: 503498 - DNA, 25 bp, Homo sapien
ttaaatctgagatgggcaagagtct

SEQ ID NO: 503499 - DNA, 25 bp, Homo sapien
atgggcaagagtctgcatttctgac

SEQ ID NO: 503500 - DNA, 25 bp, Homo sapien
cataggtgatgccagtgttcctgac

SEQ ID NO: 503501 - DNA, 25 bp, Homo sapien
aggtgatgccagtgttcctgactac

SEQ ID NO: 503502 - DNA, 25 bp, Homo sapien
gtagcagagttacagattatcccac

SEQ ID NO: 503503 - DNA, 25 bp, Homo sapien
agttacagattatcccacattttgg

SEQ ID NO: 503504 - DNA, 25 bp, Homo sapien
gatgtttgcagtgatttgcctggat

SEQ ID NO: 503505 - DNA, 25 bp, Homo sapien
atttgcctggatgtagttggtctga

SEQ ID NO: 503506 - DNA, 25 bp, Homo sapien
gcctggatgtagttggtctgagatt

SEQ ID NO: 503507 - DNA, 25 bp, Homo sapien
caggtttatataaagtggcgttcct

SEQ ID NO: 503508 - DNA, 25 bp, Homo sapien
gctatctgtgatacggaatatgaac

SEQ ID NO: 503509 - DNA, 25 bp, Homo sapien
gattctcatagcagctaagctgttc

SEQ ID NO: 503510 - DNA, 25 bp, Homo sapien
tagcagctaagctgttccccaggca

SEQ ID NO: 503511 - DNA, 25 bp, Homo sapien
taagctgttccccaggcagtggttc

SEQ ID NO: 503512 - DNA, 25 bp, Homo sapien
gtggttctcaaggtgtgcttccaag

SEQ ID NO: 503513 - DNA, 25 bp, Homo sapien
ggttctcaaggtgtgcttccaagaa

SEQ ID NO: 503514 - DNA, 25 bp, Homo sapien
agcagcggcatcacacatgcaaatt

SEQ ID NO: 503515 - DNA, 25 bp, Homo sapien
atgcaaattactggactctgcccca

SEQ ID NO: 503516 - DNA, 25 bp, Homo sapien
tctgccccagatccacagaattgga

SEQ ID NO: 503517 - DNA, 25 bp, Homo sapien
gggcttagcattctgttttaacaag

SEQ ID NO: 503518 - DNA, 25 bp, Homo sapien
ctctctgcagaggtagtgacttgtg

SEQ ID NO: 503519 - DNA, 25 bp, Homo sapien
tgacttgtgatgtgagctgagacct

SEQ ID NO: 503520 - DNA, 25 bp, Homo sapien
atgtgagctgagacctctgtcctgg

SEQ ID NO: 503521 - DNA, 25 bp, Homo sapien
tctgtcctgggaagaccaaaagaaa

SEQ ID NO: 503522 - DNA, 25 bp, Homo sapien
ggccctgaggctgaaatgtgcccat

SEQ ID NO: 503523 - DNA, 25 bp, Homo sapien
aaatgtgcccatgtgttctaagaaa

SEQ ID NO: 503524 - DNA, 25 bp, Homo sapien
gaaatgcagcgatgctggtgtgcct

SEQ ID NO: 503525 - DNA, 25 bp, Homo sapien
gagtagttcccgaaggaccttgtgg

SEQ ID NO: 503526 - DNA, 25 bp, Homo sapien
gggtgatatagaggacttcgctttt

SEQ ID NO: 503527 - DNA, 25 bp, Homo sapien
cttcgcttttgctctgagtgaggtg

SEQ ID NO: 503528 - DNA, 25 bp, Homo sapien
ggtgggagccatagaagcttctaag

SEQ ID NO: 503529 - DNA, 25 bp, Homo sapien
actgtccccccagccattcactcct

SEQ ID NO: 503530 - DNA, 25 bp, Homo sapien
tgtccccccagccattcactcctac

SEQ ID NO: 503531 - DNA, 25 bp, Homo sapien
aagggggattggcacccagtggccg

SEQ ID NO: 503532 - DNA, 25 bp, Homo sapien
agggggattggcacccagtggccgg

SEQ ID NO: 503533 - DNA, 25 bp, Homo sapien
gggggattggcacccagtggccggg

SEQ ID NO: 503534 - DNA, 25 bp, Homo sapien
gggattggcacccagtggccgggga

SEQ ID NO: 503535 - DNA, 25 bp, Homo sapien
ggattggcacccagtggccggggag

SEQ ID NO: 503536 - DNA, 25 bp, Homo sapien
gattggcacccagtggccggggagc

SEQ ID NO: 503537 - DNA, 25 bp, Homo sapien
attggcacccagtggccggggagcg

SEQ ID NO: 503538 - DNA, 25 bp, Homo sapien
ttggcacccagtggccggggagcgt

SEQ ID NO: 503539 - DNA, 25 bp, Homo sapien
tggcacccagtggccggggagcgtg

SEQ ID NO: 503540 - DNA, 25 bp, Homo sapien
tatttttaaggagacctggccaggc

SEQ ID NO: 503541 - DNA, 25 bp, Homo sapien
tgttcatggaatccactccatccac

SEQ ID NO: 503542 - DNA, 25 bp, Homo sapien
acccttgctgagttccgaacttctt

SEQ ID NO: 503543 - DNA, 25 bp, Homo sapien
gagttccgaacttcttcactgtctt

SEQ ID NO: 503544 - DNA, 25 bp, Homo sapien
tcaccagacttttcttagctggagt

SEQ ID NO: 503545 - DNA, 25 bp, Homo sapien
agacttttcttagctggagtgtggc

SEQ ID NO: 503546 - DNA, 25 bp, Homo sapien
tagctggagtgtggctttgagatca

SEQ ID NO: 503547 - DNA, 25 bp, Homo sapien
gttacgtgacccgattgatttataa

SEQ ID NO: 503548 - DNA, 25 bp, Homo sapien
gacccgattgatttataacttgtat

SEQ ID NO: 503549 - DNA, 25 bp, Homo sapien
ataacttgtatgcttaacccaggag

SEQ ID NO: 503550 - DNA, 25 bp, Homo sapien
ttgtatgcttaacccaggagtgatt

SEQ ID NO: 503551 - DNA, 25 bp, Homo sapien
gaatattggcatgtagcactcctca

SEQ ID NO: 503552 - DNA, 25 bp, Homo sapien
ttggcatgtagcactcctcaaaaca

SEQ ID NO: 503553 - DNA, 25 bp, Homo sapien
gtagcactcctcaaaacatagaaag

SEQ ID NO: 503554 - DNA, 25 bp, Homo sapien
aacaaatcaattctgcctggaggac

SEQ ID NO: 503555 - DNA, 25 bp, Homo sapien
aatcaattctgcctggaggacctcc

SEQ ID NO: 503556 - DNA, 25 bp, Homo sapien
cttctttggttctgaggccgttgga

SEQ ID NO: 503557 - DNA, 25 bp, Homo sapien
cccgatctcaacacccagtggtttt

SEQ ID NO: 503558 - DNA, 25 bp, Homo sapien
tcaacacccagtggttttgacagaa

SEQ ID NO: 503559 - DNA, 25 bp, Homo sapien
gaagcttcaagcaaccttacgatgg

SEQ ID NO: 503560 - DNA, 25 bp, Homo sapien
gattctatggttggaaacctgccag

SEQ ID NO: 503561 - DNA, 25 bp, Homo sapien
ggccgttggagttggactgagccat

SEQ ID NO: 503562 - DNA, 25 bp, Homo sapien
agatagccactgagtacctgcttca

SEQ ID NO: 503563 - DNA, 25 bp, Homo sapien
tgagtacctgcttcaaatcaccctg

SEQ ID NO: 503564 - DNA, 25 bp, Homo sapien
aaatcaccctgcacgttttctcttt

SEQ ID NO: 503565 - DNA, 25 bp, Homo sapien
ccctgcacgttttctctttggaaag

SEQ ID NO: 503566 - DNA, 25 bp, Homo sapien
tctctttggaaagataagcactgga

SEQ ID NO: 503567 - DNA, 25 bp, Homo sapien
aagcactggagaaccatctcgttac

SEQ ID NO: 503568 - DNA, 25 bp, Homo sapien
accatctcgttaccttcagcagaaa

SEQ ID NO: 503569 - DNA, 25 bp, Homo sapien
atctcgttaccttcagcagaaatgg

SEQ ID NO: 503570 - DNA, 25 bp, Homo sapien
agacattaagaatgccgcagtggac

SEQ ID NO: 503571 - DNA, 25 bp, Homo sapien
gaatgccgcagtggacagcagttat

SEQ ID NO: 503572 - DNA, 25 bp, Homo sapien
gacagcagttatgcaaggttcagca

SEQ ID NO: 503573 - DNA, 25 bp, Homo sapien
gtcagagtcagagctttgcagcttt

SEQ ID NO: 503574 - DNA, 25 bp, Homo sapien
agtcagagctttgcagctttgaggg

SEQ ID NO: 503575 - DNA, 25 bp, Homo sapien
cccgtttctcatattttaaccatat

SEQ ID NO: 503576 - DNA, 25 bp, Homo sapien
taaccatatgttcggtagataacta

SEQ ID NO: 503577 - DNA, 25 bp, Homo sapien
acagtatgatctggttggcattttc

SEQ ID NO: 503578 - DNA, 25 bp, Homo sapien
tggcattttcttcctgatgatggga

SEQ ID NO: 503579 - DNA, 25 bp, Homo sapien
ttcttcctgatgatgggagcgtcat

SEQ ID NO: 503580 - DNA, 25 bp, Homo sapien
atgggagcgtcattcttttgtcttc

SEQ ID NO: 503581 - DNA, 25 bp, Homo sapien
tcttttgtcttcatggttacttgtg

SEQ ID NO: 503582 - DNA, 25 bp, Homo sapien
gtcttcatggttacttgtgtgatat

SEQ ID NO: 503583 - DNA, 25 bp, Homo sapien
acttgtgtgatataacatacatctg

SEQ ID NO: 503584 - DNA, 25 bp, Homo sapien
ttcccgctacagaatcgctcatcgg

SEQ ID NO: 503585 - DNA, 25 bp, Homo sapien
agaatcgctcatcggcgaggctcag

SEQ ID NO: 503586 - DNA, 25 bp, Homo sapien
aaggcaggctgcaaatgacccagaa

SEQ ID NO: 503587 - DNA, 25 bp, Homo sapien
gagggagtctcaatactcctttgca

SEQ ID NO: 503588 - DNA, 25 bp, Homo sapien
ctgagtcccctctgtagtgcctctg

SEQ ID NO: 503589 - DNA, 25 bp, Homo sapien
tgccagacacacactgcctgagttg

SEQ ID NO: 503590 - DNA, 25 bp, Homo sapien
cacactgcctgagttgaagagacac

SEQ ID NO: 503591 - DNA, 25 bp, Homo sapien
gacacaggccacacatttcaggctg

SEQ ID NO: 503592 - DNA, 25 bp, Homo sapien
acacatttcaggctggttgccagcg

SEQ ID NO: 503593 - DNA, 25 bp, Homo sapien
ggttgccagcggacgtcagcactca

SEQ ID NO: 503594 - DNA, 25 bp, Homo sapien
agcggacgtcagcactcacggcctg

SEQ ID NO: 503595 - DNA, 25 bp, Homo sapien
actccccaagttcagtaggatagta

SEQ ID NO: 503596 - DNA, 25 bp, Homo sapien
agaagtcgtgctaagttgatttcat

SEQ ID NO: 503597 - DNA, 25 bp, Homo sapien
aaatgtcacgtctcacatcctgtgg

SEQ ID NO: 503598 - DNA, 25 bp, Homo sapien
gtctcacatcctgtggtccaaaggt

SEQ ID NO: 503599 - DNA, 25 bp, Homo sapien
tcctgtggtccaaaggtactagttt

SEQ ID NO: 503600 - DNA, 25 bp, Homo sapien
tctgttcacttgctgataagaaatt

SEQ ID NO: 503601 - DNA, 25 bp, Homo sapien
agttgctttatggtttacaagtaat

SEQ ID NO: 503602 - DNA, 25 bp, Homo sapien
gttaacctaaattaagtagcacgca

SEQ ID NO: 503603 - DNA, 25 bp, Homo sapien
agtagcacgcactttgtttacatgc

SEQ ID NO: 503604 - DNA, 25 bp, Homo sapien
acgcactttgtttacatgcttcagt

SEQ ID NO: 503605 - DNA, 25 bp, Homo sapien
gtttacatgcttcagtatattgtgg

SEQ ID NO: 503606 - DNA, 25 bp, Homo sapien
tagtgcaattaaaaccctgaaaaca

SEQ ID NO: 503607 - DNA, 25 bp, Homo sapien
gtgcaattaaaaccctgaaaacaca

SEQ ID NO: 503608 - DNA, 25 bp, Homo sapien
gatccttgttgactctgcttggttg

SEQ ID NO: 503609 - DNA, 25 bp, Homo sapien
atccttgttgactctgcttggttga

SEQ ID NO: 503610 - DNA, 25 bp, Homo sapien
tccttgttgactctgcttggttgaa

SEQ ID NO: 503611 - DNA, 25 bp, Homo sapien
ccttgttgactctgcttggttgaag

SEQ ID NO: 503612 - DNA, 25 bp, Homo sapien
cttgttgactctgcttggttgaagc

SEQ ID NO: 503613 - DNA, 25 bp, Homo sapien
ttgttgactctgcttggttgaagca

SEQ ID NO: 503614 - DNA, 25 bp, Homo sapien
gttgactctgcttggttgaagcagg

SEQ ID NO: 503615 - DNA, 25 bp, Homo sapien
tgactctgcttggttgaagcaggaa

SEQ ID NO: 503616 - DNA, 25 bp, Homo sapien
aacacgttagatattccgtcttgag

SEQ ID NO: 503617 - DNA, 25 bp, Homo sapien
tagcagtgatttttatccaatcttg

SEQ ID NO: 503618 - DNA, 25 bp, Homo sapien
gatttttatccaatcttgtttccaa

SEQ ID NO: 503619 - DNA, 25 bp, Homo sapien
gtttccaaaaaccatgtctcccagg

SEQ ID NO: 503620 - DNA, 25 bp, Homo sapien
ttccaaaaaccatgtctcccagggc

SEQ ID NO: 503621 - DNA, 25 bp, Homo sapien
aaaagccatcatgtaaattaccagt

SEQ ID NO: 503622 - DNA, 25 bp, Homo sapien
atcacttccatagtgacgatactcc

SEQ ID NO: 503623 - DNA, 25 bp, Homo sapien
ttttttgtctaggtagtcagtctgc

SEQ ID NO: 503624 - DNA, 25 bp, Homo sapien
ttgtctaggtagtcagtctgcactt

SEQ ID NO: 503625 - DNA, 25 bp, Homo sapien
gtctaggtagtcagtctgcacttaa

SEQ ID NO: 503626 - DNA, 25 bp, Homo sapien
gtagtcagtctgcacttaaatatca

SEQ ID NO: 503627 - DNA, 25 bp, Homo sapien
agtctgcacttaaatatcaatcatt

SEQ ID NO: 503628 - DNA, 25 bp, Homo sapien
gatgaaatttaaagtcaaccggaga

SEQ ID NO: 503629 - DNA, 25 bp, Homo sapien
gtcaaccggagaacccaaaaatcag

SEQ ID NO: 503630 - DNA, 25 bp, Homo sapien
ggtgatagaccattacaggacttgt

SEQ ID NO: 503631 - DNA, 25 bp, Homo sapien
tagaccattacaggacttgtcaaat

SEQ ID NO: 503632 - DNA, 25 bp, Homo sapien
acaggacttgtcaaataccagtttt

SEQ ID NO: 503633 - DNA, 25 bp, Homo sapien
aagatctatcttcagaacggacaag

SEQ ID NO: 503634 - DNA, 25 bp, Homo sapien
ctatcttcagaacggacaagcagaa

SEQ ID NO: 503635 - DNA, 25 bp, Homo sapien
gaagaaggtgtactcctttctattt

SEQ ID NO: 503636 - DNA, 25 bp, Homo sapien
tctattttaaagagccaagcctcag

SEQ ID NO: 503637 - DNA, 25 bp, Homo sapien
gagccaagcctcagagacaagatga

SEQ ID NO: 503638 - DNA, 25 bp, Homo sapien
ggattctggtttttctgaattttca

SEQ ID NO: 503639 - DNA, 25 bp, Homo sapien
tgccccatcttgtactacagttgtc

SEQ ID NO: 503640 - DNA, 25 bp, Homo sapien
gtactacagttgtcttattcgtatt

SEQ ID NO: 503641 - DNA, 25 bp, Homo sapien
cagttgtcttattcgtattgtttat

SEQ ID NO: 503642 - DNA, 25 bp, Homo sapien
gttaggactgggtcttactcatctt

SEQ ID NO: 503643 - DNA, 25 bp, Homo sapien
atgtgccttccttatgcttcaaaga

SEQ ID NO: 503644 - DNA, 25 bp, Homo sapien
atgcttcaaagaatttaccatctaa

SEQ ID NO: 503645 - DNA, 25 bp, Homo sapien
ttccacatactctactcatctgaac

SEQ ID NO: 503646 - DNA, 25 bp, Homo sapien
gaactttgaatgcagaatctttaaa

SEQ ID NO: 503647 - DNA, 25 bp, Homo sapien
ggaattaatctccacccattagctt

SEQ ID NO: 503648 - DNA, 25 bp, Homo sapien
ccattagctttaccctgacatcagg

SEQ ID NO: 503649 - DNA, 25 bp, Homo sapien
tgacatcaggattgccaaatccaat

SEQ ID NO: 503650 - DNA, 25 bp, Homo sapien
aaacaatttctggagcactgcttgc

SEQ ID NO: 503651 - DNA, 25 bp, Homo sapien
gcactgcttgctgacaatctcgtag

SEQ ID NO: 503652 - DNA, 25 bp, Homo sapien
aatctcgtagttctctgctgcattt

SEQ ID NO: 503653 - DNA, 25 bp, Homo sapien
tgcatttgagtgcattttgtggcca

SEQ ID NO: 503654 - DNA, 25 bp, Homo sapien
tggccagtccatcagggcgtaccat

SEQ ID NO: 503655 - DNA, 25 bp, Homo sapien
cagggcgtaccatgggattatattt

SEQ ID NO: 503656 - DNA, 25 bp, Homo sapien
acaaaatctgtccatttgccggagg

SEQ ID NO: 503657 - DNA, 25 bp, Homo sapien
tatttgaatgtgtggtgcatccttc

SEQ ID NO: 503658 - DNA, 25 bp, Homo sapien
ggatgtgtgagggaccttgaacctc

SEQ ID NO: 503659 - DNA, 25 bp, Homo sapien
ggaccttgaacctcagctgtattaa

SEQ ID NO: 503660 - DNA, 25 bp, Homo sapien
tattaaactgtagcgcctccagtca

SEQ ID NO: 503661 - DNA, 25 bp, Homo sapien
tagattctaaggttcaagattttta

SEQ ID NO: 503662 - DNA, 25 bp, Homo sapien
caataattccaagttcatatagaac

SEQ ID NO: 503663 - DNA, 25 bp, Homo sapien
gaactgataatgtagcaagccccaa

SEQ ID NO: 503664 - DNA, 25 bp, Homo sapien
gataatgtagcaagccccaagtatg

SEQ ID NO: 503665 - DNA, 25 bp, Homo sapien
tgtagcaagccccaagtatgataat

SEQ ID NO: 503666 - DNA, 25 bp, Homo sapien
tagcaagccccaagtatgataatag

SEQ ID NO: 503667 - DNA, 25 bp, Homo sapien
tatgataataggcagactattccca

SEQ ID NO: 503668 - DNA, 25 bp, Homo sapien
tttctgtctagtttccagccattga

SEQ ID NO: 503669 - DNA, 25 bp, Homo sapien
tctgtctagtttccagccattgaag

SEQ ID NO: 503670 - DNA, 25 bp, Homo sapien
gtctagtttccagccattgaagtga

SEQ ID NO: 503671 - DNA, 25 bp, Homo sapien
gtttccagccattgaagtgaactgc

SEQ ID NO: 503672 - DNA, 25 bp, Homo sapien
aaagatacttctccaaagtgttctc

SEQ ID NO: 503673 - DNA, 25 bp, Homo sapien
gatacttctccaaagtgttctcatg

SEQ ID NO: 503674 - DNA, 25 bp, Homo sapien
acttctccaaagtgttctcatgtgg

SEQ ID NO: 503675 - DNA, 25 bp, Homo sapien
tctccaaagtgttctcatgtggcct

SEQ ID NO: 503676 - DNA, 25 bp, Homo sapien
tccaaagtgttctcatgtggcctca

SEQ ID NO: 503677 - DNA, 25 bp, Homo sapien
aaagtgttctcatgtggcctcaccc

SEQ ID NO: 503678 - DNA, 25 bp, Homo sapien
agtgttctcatgtggcctcacccag

SEQ ID NO: 503679 - DNA, 25 bp, Homo sapien
tgtggcctcacccaggtcttgtgta

SEQ ID NO: 503680 - DNA, 25 bp, Homo sapien
gcctcacccaggtcttgtgtattat

SEQ ID NO: 503681 - DNA, 25 bp, Homo sapien
cacccaggtcttgtgtattatttgg

SEQ ID NO: 503682 - DNA, 25 bp, Homo sapien
atggatcttaaaaactgcagtattc

SEQ ID NO: 503683 - DNA, 25 bp, Homo sapien
agcactgtgaccgaaagcagcccaa

SEQ ID NO: 503684 - DNA, 25 bp, Homo sapien
cactgtgaccgaaagcagcccaagt

SEQ ID NO: 503685 - DNA, 25 bp, Homo sapien
cttcttccttttgggtacacgctct

SEQ ID NO: 503686 - DNA, 25 bp, Homo sapien
ttccttttgggtacacgctctttat

SEQ ID NO: 503687 - DNA, 25 bp, Homo sapien
tttgggtacacgctctttatctctc

SEQ ID NO: 503688 - DNA, 25 bp, Homo sapien
tgggtacacgctctttatctctcct

SEQ ID NO: 503689 - DNA, 25 bp, Homo sapien
gtacacgctctttatctctccttct

SEQ ID NO: 503690 - DNA, 25 bp, Homo sapien
gggtacaggcatgttcaccacagtc

SEQ ID NO: 503691 - DNA, 25 bp, Homo sapien
tatgccagccacttggaggtctgca

SEQ ID NO: 503692 - DNA, 25 bp, Homo sapien
atgccagccacttggaggtctgcag

SEQ ID NO: 503693 - DNA, 25 bp, Homo sapien
aattttctcctgacataaaataatt

SEQ ID NO: 503694 - DNA, 25 bp, Homo sapien
ggtctatacttgaaaagttctccca

SEQ ID NO: 503695 - DNA, 25 bp, Homo sapien
aagttctcccaatatgcagttactg

SEQ ID NO: 503696 - DNA, 25 bp, Homo sapien
tgcagttactgtttcccattcaatc

SEQ ID NO: 503697 - DNA, 25 bp, Homo sapien
gtttcccattcaatccctatacatt

SEQ ID NO: 503698 - DNA, 25 bp, Homo sapien
acattgtactgtgttcatatctaat

SEQ ID NO: 503699 - DNA, 25 bp, Homo sapien
atcagatgaggtcagcttgccactt

SEQ ID NO: 503700 - DNA, 25 bp, Homo sapien
ggtcagcttgccacttgatatagat

SEQ ID NO: 503701 - DNA, 25 bp, Homo sapien
gagatgatcaaatgcacttatcctg

SEQ ID NO: 503702 - DNA, 25 bp, Homo sapien
tgcacttatcctgtgaatacaactg

SEQ ID NO: 503703 - DNA, 25 bp, Homo sapien
gaatacaactgcttgtgtacacatg

SEQ ID NO: 503704 - DNA, 25 bp, Homo sapien
cactggagacaaaattagacctttc

SEQ ID NO: 503705 - DNA, 25 bp, Homo sapien
gagggctctaatttctctattgtgc

SEQ ID NO: 503706 - DNA, 25 bp, Homo sapien
tctattgtgccttttcttgtctctc

SEQ ID NO: 503707 - DNA, 25 bp, Homo sapien
tctagaacatgtgcctctcttactt

SEQ ID NO: 503708 - DNA, 25 bp, Homo sapien
atgtgcctctcttacttttcagaat

SEQ ID NO: 503709 - DNA, 25 bp, Homo sapien
gaatactttttccatgagccatctt

SEQ ID NO: 503710 - DNA, 25 bp, Homo sapien
ctttttccatgagccatcttcaatt

SEQ ID NO: 503711 - DNA, 25 bp, Homo sapien
attctttgttgtacatgtatctgca

SEQ ID NO: 503712 - DNA, 25 bp, Homo sapien
ttgtacatgtatctgcaagcccatt

SEQ ID NO: 503713 - DNA, 25 bp, Homo sapien
tttcctaatagtttgtgaccttctg

SEQ ID NO: 503714 - DNA, 25 bp, Homo sapien
atagtttgtgaccttctgagatgaa

SEQ ID NO: 503715 - DNA, 25 bp, Homo sapien
aaccccttgtggaactaccacactg

SEQ ID NO: 503716 - DNA, 25 bp, Homo sapien
ccatctcaaaagaagggctcctgtg

SEQ ID NO: 503717 - DNA, 25 bp, Homo sapien
catctcaaaagaagggctcctgtgt

SEQ ID NO: 503718 - DNA, 25 bp, Homo sapien
atctcaaaagaagggctcctgtgtc

SEQ ID NO: 503719 - DNA, 25 bp, Homo sapien
aaagaagggctcctgtgtctacgtc

SEQ ID NO: 503720 - DNA, 25 bp, Homo sapien
aagaagggctcctgtgtctacgtca

SEQ ID NO: 503721 - DNA, 25 bp, Homo sapien
agaagggctcctgtgtctacgtcat

SEQ ID NO: 503722 - DNA, 25 bp, Homo sapien
gaagggctcctgtgtctacgtcatg

SEQ ID NO: 503723 - DNA, 25 bp, Homo sapien
aagggctcctgtgtctacgtcatgg

SEQ ID NO: 503724 - DNA, 25 bp, Homo sapien
ggctcctgtgtctacgtcatggtgg

SEQ ID NO: 503725 - DNA, 25 bp, Homo sapien
gctcctgtgtctacgtcatggtggg

SEQ ID NO: 503726 - DNA, 25 bp, Homo sapien
cctgtgtctacgtcatggtggggct

SEQ ID NO: 503727 - DNA, 25 bp, Homo sapien
gttgataaaaacctttagcatggtg

SEQ ID NO: 503728 - DNA, 25 bp, Homo sapien
cagtttgcttttcatgtgcataagt

SEQ ID NO: 503729 - DNA, 25 bp, Homo sapien
tgtgcataagttgactcatttgttt

SEQ ID NO: 503730 - DNA, 25 bp, Homo sapien
ttgaaacaccatatagccaccataa

SEQ ID NO: 503731 - DNA, 25 bp, Homo sapien
accatatagccaccataagtcctga

SEQ ID NO: 503732 - DNA, 25 bp, Homo sapien
atagccaccataagtcctgacaaaa

SEQ ID NO: 503733 - DNA, 25 bp, Homo sapien
ggaaggtccatgtcccaccttccta

SEQ ID NO: 503734 - DNA, 25 bp, Homo sapien
atgtcccaccttcctatgaaatttt

SEQ ID NO: 503735 - DNA, 25 bp, Homo sapien
ccaccttcctatgaaattttggcct

SEQ ID NO: 503736 - DNA, 25 bp, Homo sapien
ttttggcctattcacaagtctaccc

SEQ ID NO: 503737 - DNA, 25 bp, Homo sapien
aagtctacccccacataagagaagt

SEQ ID NO: 503738 - DNA, 25 bp, Homo sapien
actgtgttagaatttgactattcga

SEQ ID NO: 503739 - DNA, 25 bp, Homo sapien
gaataatagtctttgccctctggaa

SEQ ID NO: 503740 - DNA, 25 bp, Homo sapien
ttgccctctggaaggccacaatgta

SEQ ID NO: 503741 - DNA, 25 bp, Homo sapien
gtagaagtaattctctgtatcagat

SEQ ID NO: 503742 - DNA, 25 bp, Homo sapien
gtatcagatatttccttgagtgtta

SEQ ID NO: 503743 - DNA, 25 bp, Homo sapien
gtaatcatgttgtaaatcccagtgt

SEQ ID NO: 503744 - DNA, 25 bp, Homo sapien
taaatcccagtgtaagtcaagaagc

SEQ ID NO: 503745 - DNA, 25 bp, Homo sapien
tcaagaagcaatatcaccaccacca

SEQ ID NO: 503746 - DNA, 25 bp, Homo sapien
caccacctccctatgattttgtgat

SEQ ID NO: 503747 - DNA, 25 bp, Homo sapien
acctactgttactccaaatactgtg

SEQ ID NO: 503748 - DNA, 25 bp, Homo sapien
ctgttactccaaatactgtgttaga

SEQ ID NO: 503749 - DNA, 25 bp, Homo sapien
acatatgcaatggattagtatttct

SEQ ID NO: 503750 - DNA, 25 bp, Homo sapien
atatgcaatggattagtatttcttg

SEQ ID NO: 503751 - DNA, 25 bp, Homo sapien
ctatattatcactttcaacctcatg

SEQ ID NO: 503752 - DNA, 25 bp, Homo sapien
atattatcactttcaacctcatgtt

SEQ ID NO: 503753 - DNA, 25 bp, Homo sapien
ttatcactttcaacctcatgtttct

SEQ ID NO: 503754 - DNA, 25 bp, Homo sapien
gaaaaactcctcactgacagtgcac

SEQ ID NO: 503755 - DNA, 25 bp, Homo sapien
aaaaactcctcactgacagtgcacc

SEQ ID NO: 503756 - DNA, 25 bp, Homo sapien
tgcacccagcccctgactgggtttt

SEQ ID NO: 503757 - DNA, 25 bp, Homo sapien
cagcccctgactgggttttcaggat

SEQ ID NO: 503758 - DNA, 25 bp, Homo sapien
taaagtccctaaaacatgaatctgt

SEQ ID NO: 503759 - DNA, 25 bp, Homo sapien
gtccctaaaacatgaatctgttctt

SEQ ID NO: 503760 - DNA, 25 bp, Homo sapien
ggcttctatttgactgctgttgtga

SEQ ID NO: 503761 - DNA, 25 bp, Homo sapien
gctgttgtgaccctgtttgcaaaat

SEQ ID NO: 503762 - DNA, 25 bp, Homo sapien
tgacactctgtggattatttgctct

SEQ ID NO: 503763 - DNA, 25 bp, Homo sapien
gattattttgacgtttccaagagca

SEQ ID NO: 503764 - DNA, 25 bp, Homo sapien
ctctcttcagcaaacttgagccttt

SEQ ID NO: 503765 - DNA, 25 bp, Homo sapien
gcaaacttgagccttttcatctaat

SEQ ID NO: 503766 - DNA, 25 bp, Homo sapien
ttcatctaattccatgtcactcacg

SEQ ID NO: 503767 - DNA, 25 bp, Homo sapien
gtcactcacggccataactttcctt

SEQ ID NO: 503768 - DNA, 25 bp, Homo sapien
ataactttccttgaccattcttcac

SEQ ID NO: 503769 - DNA, 25 bp, Homo sapien
tcttcaccccatgtcttacataata

SEQ ID NO: 503770 - DNA, 25 bp, Homo sapien
aattgtggtcttgatcctggattta

SEQ ID NO: 503771 - DNA, 25 bp, Homo sapien
gtatttttcacactatgtactctag

SEQ ID NO: 503772 - DNA, 25 bp, Homo sapien
atgtactctaggttcctggaggtga

SEQ ID NO: 503773 - DNA, 25 bp, Homo sapien
gaatctggacttagagttcttggct

SEQ ID NO: 503774 - DNA, 25 bp, Homo sapien
tagagttcttggctacctctggctg

SEQ ID NO: 503775 - DNA, 25 bp, Homo sapien
atgcagtgaattcccacatcatgtt

SEQ ID NO: 503776 - DNA, 25 bp, Homo sapien
ggacgggtagattgactttttctca

SEQ ID NO: 503777 - DNA, 25 bp, Homo sapien
gactttttctcaggcatcaatctgt

SEQ ID NO: 503778 - DNA, 25 bp, Homo sapien
ggcatcaatctgttacaaggttcat

SEQ ID NO: 503779 - DNA, 25 bp, Homo sapien
atgttttaaattactcagccactaa

SEQ ID NO: 503780 - DNA, 25 bp, Homo sapien
tgtgcatggcgtcattaacataatc

SEQ ID NO: 503781 - DNA, 25 bp, Homo sapien
aatcattgcctgaaccgtatttttc

SEQ ID NO: 503782 - DNA, 25 bp, Homo sapien
aaagtgatttgtcaagatggagcaa

SEQ ID NO: 503783 - DNA, 25 bp, Homo sapien
gatggagcaaggtatttaccagtct

SEQ ID NO: 503784 - DNA, 25 bp, Homo sapien
tttaccagtctaaaacctaatgctg

SEQ ID NO: 503785 - DNA, 25 bp, Homo sapien
gctgtaggtactgctgggtcactgt

SEQ ID NO: 503786 - DNA, 25 bp, Homo sapien
tactgctgggtcactgttgctataa

SEQ ID NO: 503787 - DNA, 25 bp, Homo sapien
gtcactgttgctataaatggtcact

SEQ ID NO: 503788 - DNA, 25 bp, Homo sapien
tgctataaatggtcactggagcaga

SEQ ID NO: 503789 - DNA, 25 bp, Homo sapien
atcaaggatcagtttcacccacatt

SEQ ID NO: 503790 - DNA, 25 bp, Homo sapien
ggatcagtttcacccacatttaaag

SEQ ID NO: 503791 - DNA, 25 bp, Homo sapien
tcagtttcacccacatttaaaggac

SEQ ID NO: 503792 - DNA, 25 bp, Homo sapien
aaaggactacttgactcatttctgt

SEQ ID NO: 503793 - DNA, 25 bp, Homo sapien
cttttttctacaatctggtgtggtt

SEQ ID NO: 503794 - DNA, 25 bp, Homo sapien
gcttcaggcatgttgaaaacacttg

SEQ ID NO: 503795 - DNA, 25 bp, Homo sapien
aaacacttggtggatcttcagaaac

SEQ ID NO: 503796 - DNA, 25 bp, Homo sapien
cagaaacctgactaaggccatgtaa

SEQ ID NO: 503797 - DNA, 25 bp, Homo sapien
ggccatgtaaacttatagagagctg

SEQ ID NO: 503798 - DNA, 25 bp, Homo sapien
gctgagagtagccagaatcttcata

SEQ ID NO: 503799 - DNA, 25 bp, Homo sapien
aaatattccactatcagttcttgat

SEQ ID NO: 503800 - DNA, 25 bp, Homo sapien
atcagttcttgattgccgacgaatg

SEQ ID NO: 503801 - DNA, 25 bp, Homo sapien
cttgattgccgacgaatgaatggtt

SEQ ID NO: 503802 - DNA, 25 bp, Homo sapien
tgaatggttgaccttcatcttccca

SEQ ID NO: 503803 - DNA, 25 bp, Homo sapien
acttctctccatagctttggcaaga

SEQ ID NO: 503804 - DNA, 25 bp, Homo sapien
atgtccatgtgcataactgcttgga

SEQ ID NO: 503805 - DNA, 25 bp, Homo sapien
tgtccatgtgcataactgcttggat

SEQ ID NO: 503806 - DNA, 25 bp, Homo sapien
gtccatgtgcataactgcttggatt

SEQ ID NO: 503807 - DNA, 25 bp, Homo sapien
ccatgtgcataactgcttggatttc

SEQ ID NO: 503808 - DNA, 25 bp, Homo sapien
catgtgcataactgcttggatttct

SEQ ID NO: 503809 - DNA, 25 bp, Homo sapien
gtgcataactgcttggatttcttct

SEQ ID NO: 503810 - DNA, 25 bp, Homo sapien
tgcataactgcttggatttcttctt

SEQ ID NO: 503811 - DNA, 25 bp, Homo sapien
gcataactgcttggatttcttcttt

SEQ ID NO: 503812 - DNA, 25 bp, Homo sapien
cataactgcttggatttcttctttt

SEQ ID NO: 503813 - DNA, 25 bp, Homo sapien
ataactgcttggatttcttctttta

SEQ ID NO: 503814 - DNA, 25 bp, Homo sapien
taactgcttggatttcttcttttaa

SEQ ID NO: 503815 - DNA, 25 bp, Homo sapien
gatgttttcaaacacacagccccat

SEQ ID NO: 503816 - DNA, 25 bp, Homo sapien
cccatcctactcaaaccaagtgaag

SEQ ID NO: 503817 - DNA, 25 bp, Homo sapien
caattctagaattggctgtgccatg

SEQ ID NO: 503818 - DNA, 25 bp, Homo sapien
attggctgtgccatgtaggtttttt

SEQ ID NO: 503819 - DNA, 25 bp, Homo sapien
tttagaatttgaactgatttccttc

SEQ ID NO: 503820 - DNA, 25 bp, Homo sapien
ttgatgaggtggcaactgtccccat

SEQ ID NO: 503821 - DNA, 25 bp, Homo sapien
gaggtggcaactgtccccattgtaa

SEQ ID NO: 503822 - DNA, 25 bp, Homo sapien
ggcaactgtccccattgtaatggtc

SEQ ID NO: 503823 - DNA, 25 bp, Homo sapien
gtccccattgtaatggtcaccattg

SEQ ID NO: 503824 - DNA, 25 bp, Homo sapien
aatggtcaccattgcagcgaggata

SEQ ID NO: 503825 - DNA, 25 bp, Homo sapien
atggtcaccattgcagcgaggatag

SEQ ID NO: 503826 - DNA, 25 bp, Homo sapien
gaatttcagactacaggacttttaa

SEQ ID NO: 503827 - DNA, 25 bp, Homo sapien
aatatcacacatcttttctttatgt

SEQ ID NO: 503828 - DNA, 25 bp, Homo sapien
tggaaacattcaacagttctcttct

SEQ ID NO: 503829 - DNA, 25 bp, Homo sapien
tctcttctagctctttcaactatac

SEQ ID NO: 503830 - DNA, 25 bp, Homo sapien
agctctttcaactatacaatacatt

SEQ ID NO: 503831 - DNA, 25 bp, Homo sapien
cttgtgaattatagagtcgtccctc

SEQ ID NO: 503832 - DNA, 25 bp, Homo sapien
gtgaattatagagtcgtccctcatt

SEQ ID NO: 503833 - DNA, 25 bp, Homo sapien
tcgtccctcattatctgaggcaagg

SEQ ID NO: 503834 - DNA, 25 bp, Homo sapien
tgaggcaaggaggatttggaaccct

SEQ ID NO: 503835 - DNA, 25 bp, Homo sapien
tggaaccctcagatacagaaggctg

SEQ ID NO: 503836 - DNA, 25 bp, Homo sapien
gaaggctgactgtatttatatgttt

SEQ ID NO: 503837 - DNA, 25 bp, Homo sapien
attgctcagccccaatgagaaagca

SEQ ID NO: 503838 - DNA, 25 bp, Homo sapien
gagaaagcagatacacctaagccat

SEQ ID NO: 503839 - DNA, 25 bp, Homo sapien
cagatacacctaagccatcatcaac

SEQ ID NO: 503840 - DNA, 25 bp, Homo sapien
atcatcaaccactaacatctcaact

SEQ ID NO: 503841 - DNA, 25 bp, Homo sapien
aacatctcaacttgccagttgctgg

SEQ ID NO: 503842 - DNA, 25 bp, Homo sapien
tcaacttgccagttgctgggtgctg

SEQ ID NO: 503843 - DNA, 25 bp, Homo sapien
tgtttcccctggagacctgactggt

SEQ ID NO: 503844 - DNA, 25 bp, Homo sapien
acctgactggtctgtggttcccaca

SEQ ID NO: 503845 - DNA, 25 bp, Homo sapien
ttcccacaggaacagggttgtcttt

SEQ ID NO: 503846 - DNA, 25 bp, Homo sapien
caggaacagggttgtcttttgagcc

SEQ ID NO: 503847 - DNA, 25 bp, Homo sapien
gttatttcactcatctctaataaag

SEQ ID NO: 503848 - DNA, 25 bp, Homo sapien
gctggaattcttaacttattgacct

SEQ ID NO: 503849 - DNA, 25 bp, Homo sapien
aacttattgaccttatatcctacat

SEQ ID NO: 503850 - DNA, 25 bp, Homo sapien
tgaccttatatcctacatattatag

SEQ ID NO: 503851 - DNA, 25 bp, Homo sapien
aggactttgtaaatttaggctgata

SEQ ID NO: 503852 - DNA, 25 bp, Homo sapien
gatggtgctactatattctaattgt

SEQ ID NO: 503853 - DNA, 25 bp, Homo sapien
gacattattcatttgctgcttggct

SEQ ID NO: 503854 - DNA, 25 bp, Homo sapien
catttgctgcttggcttgatggcat

SEQ ID NO: 503855 - DNA, 25 bp, Homo sapien
gctgcttggcttgatggcataacaa

SEQ ID NO: 503856 - DNA, 25 bp, Homo sapien
ggaaacagtatcacccttccagaat

SEQ ID NO: 503857 - DNA, 25 bp, Homo sapien
atcacccttccagaatctctattta

SEQ ID NO: 503858 - DNA, 25 bp, Homo sapien
tccagaatctctatttacagctaca

SEQ ID NO: 503859 - DNA, 25 bp, Homo sapien
gtacaaaagtggatacaatacaatg

SEQ ID NO: 503860 - DNA, 25 bp, Homo sapien
tacaaaagtggatacaatacaatgg

SEQ ID NO: 503861 - DNA, 25 bp, Homo sapien
acaaaagtggatacaatacaatgga

SEQ ID NO: 503862 - DNA, 25 bp, Homo sapien
caaaagtggatacaatacaatggaa

SEQ ID NO: 503863 - DNA, 25 bp, Homo sapien
aaaagtggatacaatacaatggaaa

SEQ ID NO: 503864 - DNA, 25 bp, Homo sapien
tggatacaatacaatggaaaaatgc

SEQ ID NO: 503865 - DNA, 25 bp, Homo sapien
ggatacaatacaatggaaaaatgca

SEQ ID NO: 503866 - DNA, 25 bp, Homo sapien
gatacaatacaatggaaaaatgcat

SEQ ID NO: 503867 - DNA, 25 bp, Homo sapien
tacaatacaatggaaaaatgcatag

SEQ ID NO: 503868 - DNA, 25 bp, Homo sapien
acaatacaatggaaaaatgcataga

SEQ ID NO: 503869 - DNA, 25 bp, Homo sapien
caatacaatggaaaaatgcatagaa

SEQ ID NO: 503870 - DNA, 25 bp, Homo sapien
atggggccatttattctttggacca

SEQ ID NO: 503871 - DNA, 25 bp, Homo sapien
gaccactggctacttctgaagttct

SEQ ID NO: 503872 - DNA, 25 bp, Homo sapien
ggctacttctgaagttctggcttcc

SEQ ID NO: 503873 - DNA, 25 bp, Homo sapien
ctctctaggaggagtcgtgtattca

SEQ ID NO: 503874 - DNA, 25 bp, Homo sapien
gaggagtcgtgtattcaagctttta

SEQ ID NO: 503875 - DNA, 25 bp, Homo sapien
gtcgtgtattcaagcttttaagtta

SEQ ID NO: 503876 - DNA, 25 bp, Homo sapien
aatgagttttacttctcttctgact

SEQ ID NO: 503877 - DNA, 25 bp, Homo sapien
acttctcttctgacttgatttttaa

SEQ ID NO: 503878 - DNA, 25 bp, Homo sapien
tgttcattttgaagtgggaatttga

SEQ ID NO: 503879 - DNA, 25 bp, Homo sapien
gaatttgaggtgtttgtaatgtcat

SEQ ID NO: 503880 - DNA, 25 bp, Homo sapien
taatgtcatgttactgttctgaaag

SEQ ID NO: 503881 - DNA, 25 bp, Homo sapien
gatgtttacatcaacctgcaaaaag

SEQ ID NO: 503882 - DNA, 25 bp, Homo sapien
aaagtcaatgttgaagaggtctcat

SEQ ID NO: 503883 - DNA, 25 bp, Homo sapien
gaggtctcattgtatctcacagaat

SEQ ID NO: 503884 - DNA, 25 bp, Homo sapien
gacatttctgggacagtagcaacat

SEQ ID NO: 503885 - DNA, 25 bp, Homo sapien
gtagcaacataaggtccatcccaaa

SEQ ID NO: 503886 - DNA, 25 bp, Homo sapien
acataaggtccatcccaaaactttg

SEQ ID NO: 503887 - DNA, 25 bp, Homo sapien
ccaaaactttggctcattatcatta

SEQ ID NO: 503888 - DNA, 25 bp, Homo sapien
ggctcattatcattaatatcctgca

SEQ ID NO: 503889 - DNA, 25 bp, Homo sapien
tcctgcactttgatgatgaattctg

SEQ ID NO: 503890 - DNA, 25 bp, Homo sapien
gctttctggtttctatgtccacagc

SEQ ID NO: 503891 - DNA, 25 bp, Homo sapien
gtccacagcctgagcacgaagagtg

SEQ ID NO: 503892 - DNA, 25 bp, Homo sapien
gaatattactcttgcatcaagctgt

SEQ ID NO: 503893 - DNA, 25 bp, Homo sapien
caagctgtttcttttgctaactgct

SEQ ID NO: 503894 - DNA, 25 bp, Homo sapien
gttaacagttaactagcactgctaa

SEQ ID NO: 503895 - DNA, 25 bp, Homo sapien
gatttttttcccatacaggcacatg

SEQ ID NO: 503896 - DNA, 25 bp, Homo sapien
ggcacatgatggctccgctacttac

SEQ ID NO: 503897 - DNA, 25 bp, Homo sapien
ggctccgctacttacttgagattca

SEQ ID NO: 503898 - DNA, 25 bp, Homo sapien
gagattcattattgtatcagccttt

SEQ ID NO: 503899 - DNA, 25 bp, Homo sapien
atcagcctttgatcattttgcatct

SEQ ID NO: 503900 - DNA, 25 bp, Homo sapien
tctgtgcatagcgtttctgcagaag

SEQ ID NO: 503901 - DNA, 25 bp, Homo sapien
acagtagtctcaaatctttcctcat

SEQ ID NO: 503902 - DNA, 25 bp, Homo sapien
aatgctcttgcatgattttttaaca

SEQ ID NO: 503903 - DNA, 25 bp, Homo sapien
gcctcagcactaggaaggagtggac

SEQ ID NO: 503904 - DNA, 25 bp, Homo sapien
ttggcgcacgcagcagcttgaataa

SEQ ID NO: 503905 - DNA, 25 bp, Homo sapien
aatctgaaagtcactacgctgcgta

SEQ ID NO: 503906 - DNA, 25 bp, Homo sapien
ctacgctgcgtaagagaagccaaat

SEQ ID NO: 503907 - DNA, 25 bp, Homo sapien
ataaagcgcatgctgtgtacagagg

SEQ ID NO: 503908 - DNA, 25 bp, Homo sapien
agggtgtcgagaatgcctcctacgt

SEQ ID NO: 503909 - DNA, 25 bp, Homo sapien
gagaatgcctcctacgtgacggaaa

SEQ ID NO: 503910 - DNA, 25 bp, Homo sapien
gcctcctacgtgacggaaagcagat

SEQ ID NO: 503911 - DNA, 25 bp, Homo sapien
aaagcagatccgtggttccctgcag

SEQ ID NO: 503912 - DNA, 25 bp, Homo sapien
gcaggagcagattccaaaggcacag

SEQ ID NO: 503913 - DNA, 25 bp, Homo sapien
acaggaagaagcttgcaggtagaat

SEQ ID NO: 503914 - DNA, 25 bp, Homo sapien
gcatagatggtctataatgctgacc

SEQ ID NO: 503915 - DNA, 25 bp, Homo sapien
taatgctgaccacagatttcttaga

SEQ ID NO: 503916 - DNA, 25 bp, Homo sapien
gctgaccacagatttcttagaaatg

SEQ ID NO: 503917 - DNA, 25 bp, Homo sapien
acagatttcttagaaatgctgctct

SEQ ID NO: 503918 - DNA, 25 bp, Homo sapien
agttttgcctccagtggaagcagaa

SEQ ID NO: 503919 - DNA, 25 bp, Homo sapien
tttcagctgttaaatcctaaaaatc

SEQ ID NO: 503920 - DNA, 25 bp, Homo sapien
gccctaaatccttaaaatacaaatg

SEQ ID NO: 503921 - DNA, 25 bp, Homo sapien
tccagtaattgaacaaatcctattt

SEQ ID NO: 503922 - DNA, 25 bp, Homo sapien
aatcctatttaatgacatccttgta

SEQ ID NO: 503923 - DNA, 25 bp, Homo sapien
ttaatgacatccttgtagcatagat

SEQ ID NO: 503924 - DNA, 25 bp, Homo sapien
atccttgtagcatagatggtctata

SEQ ID NO: 503925 - DNA, 25 bp, Homo sapien
gcaagtgttttagtatggcccacat

SEQ ID NO: 503926 - DNA, 25 bp, Homo sapien
tatggcccacatgtaaagcttacag

SEQ ID NO: 503927 - DNA, 25 bp, Homo sapien
aagggtcctgtgtatactggcttac

SEQ ID NO: 503928 - DNA, 25 bp, Homo sapien
actggcttacttgttgagttggaga

SEQ ID NO: 503929 - DNA, 25 bp, Homo sapien
tggagaactattgccgtattcctct

SEQ ID NO: 503930 - DNA, 25 bp, Homo sapien
gtattcctctgctaagctcagggtg

SEQ ID NO: 503931 - DNA, 25 bp, Homo sapien
taagctcagggtgcattcgtggaaa

SEQ ID NO: 503932 - DNA, 25 bp, Homo sapien
ggtgcattcgtggaaaccctactgc

SEQ ID NO: 503933 - DNA, 25 bp, Homo sapien
gcaactggcccattgtgcatacaaa

SEQ ID NO: 503934 - DNA, 25 bp, Homo sapien
gtgcatacaaagctggaactgagat

SEQ ID NO: 503935 - DNA, 25 bp, Homo sapien
cagatttgcattgccttgatcacct

SEQ ID NO: 503936 - DNA, 25 bp, Homo sapien
taaacgtcttcattcccttccactt

SEQ ID NO: 503937 - DNA, 25 bp, Homo sapien
gaatcagaactattacaaaagcatc

SEQ ID NO: 503938 - DNA, 25 bp, Homo sapien
acaaaagcatcatgaaggatttcag

SEQ ID NO: 503939 - DNA, 25 bp, Homo sapien
aggatttcagatgggtatggtttca

SEQ ID NO: 503940 - DNA, 25 bp, Homo sapien
ggtatggtttcaaattccctctctt

SEQ ID NO: 503941 - DNA, 25 bp, Homo sapien
gtttcaaattccctctctttatagt

SEQ ID NO: 503942 - DNA, 25 bp, Homo sapien
caaattccctctctttatagttatt

SEQ ID NO: 503943 - DNA, 25 bp, Homo sapien
atttgtatgaaagaccagttttgga

SEQ ID NO: 503944 - DNA, 25 bp, Homo sapien
cagttttggatggtctttgaatata

SEQ ID NO: 503945 - DNA, 25 bp, Homo sapien
agcagtaatttcactacatcccttt

SEQ ID NO: 503946 - DNA, 25 bp, Homo sapien
atttcactacatcccttttctctga

SEQ ID NO: 503947 - DNA, 25 bp, Homo sapien
caataccaaatatactatgcctttt

SEQ ID NO: 503948 - DNA, 25 bp, Homo sapien
ctaaggcatgatgttgcagtagcat

SEQ ID NO: 503949 - DNA, 25 bp, Homo sapien
gcatccttgtacatgtagctaggag

SEQ ID NO: 503950 - DNA, 25 bp, Homo sapien
gtacaagggcaaggagtgtgtcttt

SEQ ID NO: 503951 - DNA, 25 bp, Homo sapien
tagaaatcacctattgccctctaga

SEQ ID NO: 503952 - DNA, 25 bp, Homo sapien
attgccctctagaaaagctgtaccc

SEQ ID NO: 503953 - DNA, 25 bp, Homo sapien
agaaaagctgtacccttttccagtg

SEQ ID NO: 503954 - DNA, 25 bp, Homo sapien
ggcagtcctgtgtaatggtgtccat

SEQ ID NO: 503955 - DNA, 25 bp, Homo sapien
gtccatttcatcacacccttaaaac

SEQ ID NO: 503956 - DNA, 25 bp, Homo sapien
atcacacccttaaaacactcagctt

SEQ ID NO: 503957 - DNA, 25 bp, Homo sapien
agctttaacaaacatgcagattttt

SEQ ID NO: 503958 - DNA, 25 bp, Homo sapien
taataaattttacgaactctgaggt

SEQ ID NO: 503959 - DNA, 25 bp, Homo sapien
aagtgaggtttaatttatatacaat

SEQ ID NO: 503960 - DNA, 25 bp, Homo sapien
cagatttttaagtattcatttgaga

SEQ ID NO: 503961 - DNA, 25 bp, Homo sapien
ttgagatgttttgacaactgtatat

SEQ ID NO: 503962 - DNA, 25 bp, Homo sapien
gatgttttgacaactgtatatatac

SEQ ID NO: 503963 - DNA, 25 bp, Homo sapien
ccatcactggaatcagatatagaat

SEQ ID NO: 503964 - DNA, 25 bp, Homo sapien
gatatagaatattccccttaaatat

SEQ ID NO: 503965 - DNA, 25 bp, Homo sapien
tagaatattccccttaaatattgtc

SEQ ID NO: 503966 - DNA, 25 bp, Homo sapien
gtctgtggcttacctacttattttc

SEQ ID NO: 503967 - DNA, 25 bp, Homo sapien
ctgtggcttacctacttattttcat

SEQ ID NO: 503968 - DNA, 25 bp, Homo sapien
atgaatgttttacttgtgatgaaga

SEQ ID NO: 503969 - DNA, 25 bp, Homo sapien
gattatttccatcagtctcattcct

SEQ ID NO: 503970 - DNA, 25 bp, Homo sapien
ggttgtccaactctgaatgtactgg

SEQ ID NO: 503971 - DNA, 25 bp, Homo sapien
agtctcattcctcttgacaaaaatc

SEQ ID NO: 503972 - DNA, 25 bp, Homo sapien
atctgagttgatggtgagcatgtac

SEQ ID NO: 503973 - DNA, 25 bp, Homo sapien
gtgagcatgtacttcattcctgact

SEQ ID NO: 503974 - DNA, 25 bp, Homo sapien
attcctgactccaaagggtacaata

SEQ ID NO: 503975 - DNA, 25 bp, Homo sapien
gggagtgactttactattacaacct

SEQ ID NO: 503976 - DNA, 25 bp, Homo sapien
tactattacaaccttccccttgaag

SEQ ID NO: 503977 - DNA, 25 bp, Homo sapien
aaggacaaacagtagtctcagcctt

SEQ ID NO: 503978 - DNA, 25 bp, Homo sapien
ctggaaaccattgaagtatacattt

SEQ ID NO: 503979 - DNA, 25 bp, Homo sapien
aatgggtgtgctaaatggtatatga

SEQ ID NO: 503980 - DNA, 25 bp, Homo sapien
caaccctatgaactggtcagcctaa

SEQ ID NO: 503981 - DNA, 25 bp, Homo sapien
gaactggtcagcctaattatctaga

SEQ ID NO: 503982 - DNA, 25 bp, Homo sapien
agtagtacagagtcagtcagcatat

SEQ ID NO: 503983 - DNA, 25 bp, Homo sapien
gggtgggattccatcacaggtctgt

SEQ ID NO: 503984 - DNA, 25 bp, Homo sapien
atcacaggtctgtctatctccaatg

SEQ ID NO: 503985 - DNA, 25 bp, Homo sapien
ctgtctatctccaatgccattatgt

SEQ ID NO: 503986 - DNA, 25 bp, Homo sapien
gtgttcttttacttacatctgaaat

SEQ ID NO: 503987 - DNA, 25 bp, Homo sapien
atctgaaatacttaggacctgattc

SEQ ID NO: 503988 - DNA, 25 bp, Homo sapien
gacctgattcagactcagtactcct

SEQ ID NO: 503989 - DNA, 25 bp, Homo sapien
tcagtactcctgagcaaaaggaatt

SEQ ID NO: 503990 - DNA, 25 bp, Homo sapien
ggaattagcctttattgatgtagaa

SEQ ID NO: 503991 - DNA, 25 bp, Homo sapien
cttctccaaaattcatcaattagga

SEQ ID NO: 503992 - DNA, 25 bp, Homo sapien
tgtttaagaccacagaacatctgca

SEQ ID NO: 503993 - DNA, 25 bp, Homo sapien
cagaacatctgcataggctgtaaat

SEQ ID NO: 503994 - DNA, 25 bp, Homo sapien
ataggctgtaaatttcgttgaatga

SEQ ID NO: 503995 - DNA, 25 bp, Homo sapien
gatgagttagtactgctgcctgtgc

SEQ ID NO: 503996 - DNA, 25 bp, Homo sapien
tagtactgctgcctgtgcttcagag

SEQ ID NO: 503997 - DNA, 25 bp, Homo sapien
tgcctgtgcttcagagctgtcttat

SEQ ID NO: 503998 - DNA, 25 bp, Homo sapien
gcttcagagctgtcttattaccaca

SEQ ID NO: 503999 - DNA, 25 bp, Homo sapien
gtcttattaccacaaggccggcaag

SEQ ID NO: 504000 - DNA, 25 bp, Homo sapien
cccctgaaatgtaccgatttatatg

SEQ ID NO: 504001 - DNA, 25 bp, Homo sapien
acaaattaaagcctggctatcctgg

SEQ ID NO: 504002 - DNA, 25 bp, Homo sapien
aatcaggacagtttagctatttttt

SEQ ID NO: 504003 - DNA, 25 bp, Homo sapien
aaagggatgccctaaaggtagcagg

SEQ ID NO: 504004 - DNA, 25 bp, Homo sapien
gatgccctaaaggtagcaggcaggc

SEQ ID NO: 504005 - DNA, 25 bp, Homo sapien
aaggtagcaggcaggcagacagatt

SEQ ID NO: 504006 - DNA, 25 bp, Homo sapien
cagacagatttgctttaattaggag

SEQ ID NO: 504007 - DNA, 25 bp, Homo sapien
tcctcagagttacaaaaccaaaatt

SEQ ID NO: 504008 - DNA, 25 bp, Homo sapien
ggagaaaggagtccactgaccatat

SEQ ID NO: 504009 - DNA, 25 bp, Homo sapien
aggagtccactgaccatataaagag

SEQ ID NO: 504010 - DNA, 25 bp, Homo sapien
gagtccactgaccatataaagagag

SEQ ID NO: 504011 - DNA, 25 bp, Homo sapien
agtccactgaccatataaagagagt

SEQ ID NO: 504012 - DNA, 25 bp, Homo sapien
tccactgaccatataaagagagtaa

SEQ ID NO: 504013 - DNA, 25 bp, Homo sapien
atgtgtgactgctcatggttaatgc

SEQ ID NO: 504014 - DNA, 25 bp, Homo sapien
agaggcttccagtctcactgacaca

SEQ ID NO: 504015 - DNA, 25 bp, Homo sapien
ccagtctcactgacacaggagggct

SEQ ID NO: 504016 - DNA, 25 bp, Homo sapien
tgggctccacttcatccagatgaag

SEQ ID NO: 504017 - DNA, 25 bp, Homo sapien
ttcacagttgagtgcatcccagcat

SEQ ID NO: 504018 - DNA, 25 bp, Homo sapien
atcccagcattctgttccgggcagg

SEQ ID NO: 504019 - DNA, 25 bp, Homo sapien
ctgttccgggcaggcatttcaggaa

SEQ ID NO: 504020 - DNA, 25 bp, Homo sapien
gcatttcaggaagaccgccttgtag

SEQ ID NO: 504021 - DNA, 25 bp, Homo sapien
gaccgccttgtaggtattacatccc

SEQ ID NO: 504022 - DNA, 25 bp, Homo sapien
gtaggtattacatccctggtgtcgt

SEQ ID NO: 504023 - DNA, 25 bp, Homo sapien
cctggtgtcgtattttgcctgttaa

SEQ ID NO: 504024 - DNA, 25 bp, Homo sapien
tattttcattacgttgtactcctaa

SEQ ID NO: 504025 - DNA, 25 bp, Homo sapien
tgtactcctaaaaaagggaagctgt

SEQ ID NO: 504026 - DNA, 25 bp, Homo sapien
atttaggtcagcactctgcatccat

SEQ ID NO: 504027 - DNA, 25 bp, Homo sapien
ggtcagcactctgcatccatgagta

SEQ ID NO: 504028 - DNA, 25 bp, Homo sapien
gcatccatgagtattgtagatattt

SEQ ID NO: 504029 - DNA, 25 bp, Homo sapien
aatccgattggattactatggaaaa

SEQ ID NO: 504030 - DNA, 25 bp, Homo sapien
aaagcaacttgcctgttctgtttct

SEQ ID NO: 504031 - DNA, 25 bp, Homo sapien
aacttgcctgttctgtttctttgca

SEQ ID NO: 504032 - DNA, 25 bp, Homo sapien
gtttctttgcatactttgtgaccta

SEQ ID NO: 504033 - DNA, 25 bp, Homo sapien
ttgcatactttgtgacctaacagtt

SEQ ID NO: 504034 - DNA, 25 bp, Homo sapien
aataaacttgatgtggagcattcca

SEQ ID NO: 504035 - DNA, 25 bp, Homo sapien
aaactgctctcactctcatttccag

SEQ ID NO: 504036 - DNA, 25 bp, Homo sapien
tcatttccagaccaagggcctctgg

SEQ ID NO: 504037 - DNA, 25 bp, Homo sapien
cctctggcggcctgtagggagccat

SEQ ID NO: 504038 - DNA, 25 bp, Homo sapien
ggagccatgggcaatcacagcaacc

SEQ ID NO: 504039 - DNA, 25 bp, Homo sapien
ctctgaggccaaggaagttcaggta

SEQ ID NO: 504040 - DNA, 25 bp, Homo sapien
ggaagttcaggtatgagctgtacct

SEQ ID NO: 504041 - DNA, 25 bp, Homo sapien
tcagtcctcactgggtgtcttctca

SEQ ID NO: 504042 - DNA, 25 bp, Homo sapien
gtttcattgcttgtgcaaggaagat

SEQ ID NO: 504043 - DNA, 25 bp, Homo sapien
aaggaagatacggaagccacacaat

SEQ ID NO: 504044 - DNA, 25 bp, Homo sapien
cggaagccacacaatgggttggttc

SEQ ID NO: 504045 - DNA, 25 bp, Homo sapien
tagcccttcccagactgactatagg

SEQ ID NO: 504046 - DNA, 25 bp, Homo sapien
tggctgatacatattatctttaata

SEQ ID NO: 504047 - DNA, 25 bp, Homo sapien
acataaagcatttccatagtgaata

SEQ ID NO: 504048 - DNA, 25 bp, Homo sapien
gatggcttaggtttatggctttgaa

SEQ ID NO: 504049 - DNA, 25 bp, Homo sapien
atggctttgaattaagtgcatgatt

SEQ ID NO: 504050 - DNA, 25 bp, Homo sapien
agtgcatgattatatcctggaataa

SEQ ID NO: 504051 - DNA, 25 bp, Homo sapien
gaacattttaattgcactctccatt

SEQ ID NO: 504052 - DNA, 25 bp, Homo sapien
taattgcactctccatttaaactgt

SEQ ID NO: 504053 - DNA, 25 bp, Homo sapien
ttgcactctccatttaaactgtttc

SEQ ID NO: 504054 - DNA, 25 bp, Homo sapien
aactgtttcaggatataaagtgaca

SEQ ID NO: 504055 - DNA, 25 bp, Homo sapien
ataacaaaacagtaggagcctcaaa

SEQ ID NO: 504056 - DNA, 25 bp, Homo sapien
acgacgtgcgcctggctgatacata

SEQ ID NO: 504057 - DNA, 25 bp, Homo sapien
ggtgacactgctccctgaattaagg

SEQ ID NO: 504058 - DNA, 25 bp, Homo sapien
gttgcgagcaccaagtacaaggact

SEQ ID NO: 504059 - DNA, 25 bp, Homo sapien
aaggactagacgcatatttacctgc

SEQ ID NO: 504060 - DNA, 25 bp, Homo sapien
tttacctgcgtatctgagagttcca

SEQ ID NO: 504061 - DNA, 25 bp, Homo sapien
agcttccagatgatccttgcacaga

SEQ ID NO: 504062 - DNA, 25 bp, Homo sapien
aacctaccttctttccagaggatgt

SEQ ID NO: 504063 - DNA, 25 bp, Homo sapien
ggatgtctttctcctctggagagta

SEQ ID NO: 504064 - DNA, 25 bp, Homo sapien
gatgcttgctcttgggaaacggaat

SEQ ID NO: 504065 - DNA, 25 bp, Homo sapien
aaacggaatgaccttggcgctggct

SEQ ID NO: 504066 - DNA, 25 bp, Homo sapien
atgcatcccacagccagtttagaga

SEQ ID NO: 504067 - DNA, 25 bp, Homo sapien
aatggcattgacagctgctctttag

SEQ ID NO: 504068 - DNA, 25 bp, Homo sapien
tcgatctcctggactcaactaatcc

SEQ ID NO: 504069 - DNA, 25 bp, Homo sapien
gaattctgtcctttgaaaggtctct

SEQ ID NO: 504070 - DNA, 25 bp, Homo sapien
tgcctcagccttctgggtagttgag

SEQ ID NO: 504071 - DNA, 25 bp, Homo sapien
gtcctttgaaaggtctctagaacaa

SEQ ID NO: 504072 - DNA, 25 bp, Homo sapien
gaaggcagacatcatgcaacatgct

SEQ ID NO: 504073 - DNA, 25 bp, Homo sapien
gcaacatgctcaagggctattcatt

SEQ ID NO: 504074 - DNA, 25 bp, Homo sapien
caagggctattcattttaagctgaa

SEQ ID NO: 504075 - DNA, 25 bp, Homo sapien
attttaagctgaaacatacatgtgt

SEQ ID NO: 504076 - DNA, 25 bp, Homo sapien
acatgtgtagaaagcatccttgtac

SEQ ID NO: 504077 - DNA, 25 bp, Homo sapien
aaagcatccttgtacttataatccc

SEQ ID NO: 504078 - DNA, 25 bp, Homo sapien
gtctctagaacaaaggagtcttatt

SEQ ID NO: 504079 - DNA, 25 bp, Homo sapien
gtttcttttagtttcagtacaatct

SEQ ID NO: 504080 - DNA, 25 bp, Homo sapien
ggaaatgtcaattcacatggtctgg

SEQ ID NO: 504081 - DNA, 25 bp, Homo sapien
gtcaattcacatggtctggtagaga

SEQ ID NO: 504082 - DNA, 25 bp, Homo sapien
agaatgactctaatgctctactatt

SEQ ID NO: 504083 - DNA, 25 bp, Homo sapien
gactctaatgctctactattcaggt

SEQ ID NO: 504084 - DNA, 25 bp, Homo sapien
aagggtgatcacttccatgagcact

SEQ ID NO: 504085 - DNA, 25 bp, Homo sapien
ccatgagcactgtaagcccttgaat

SEQ ID NO: 504086 - DNA, 25 bp, Homo sapien
caggaggagtactgggttccagcat

SEQ ID NO: 504087 - DNA, 25 bp, Homo sapien
ggcttataggcaaatacttatagtt

SEQ ID NO: 504088 - DNA, 25 bp, Homo sapien
actgggttccagcatttaataagag

SEQ ID NO: 504089 - DNA, 25 bp, Homo sapien
catttaataagaggacccatggttt

SEQ ID NO: 504090 - DNA, 25 bp, Homo sapien
ttccggaaacagaactgcagttaag

SEQ ID NO: 504091 - DNA, 25 bp, Homo sapien
cagaactgcagttaagaccctcgaa

SEQ ID NO: 504092 - DNA, 25 bp, Homo sapien
gaccctcgaaaagatctaagaaagt

SEQ ID NO: 504093 - DNA, 25 bp, Homo sapien
gatctaagaaagtgtgcatcctaaa

SEQ ID NO: 504094 - DNA, 25 bp, Homo sapien
gcatcctaaaacacctgacgaattt

SEQ ID NO: 504095 - DNA, 25 bp, Homo sapien
gaatttcagaatgtgacaaagcgca

SEQ ID NO: 504096 - DNA, 25 bp, Homo sapien
aagcgcagaggatgcattatttcaa

SEQ ID NO: 504097 - DNA, 25 bp, Homo sapien
aacagaaggctaaaatttgcaggaa

SEQ ID NO: 504098 - DNA, 25 bp, Homo sapien
taaaccgggaatcctcggactggat

SEQ ID NO: 504099 - DNA, 25 bp, Homo sapien
cctcggactggattgtaagcaagat

SEQ ID NO: 504100 - DNA, 25 bp, Homo sapien
gctgaaggtattaaggctgtgatat

SEQ ID NO: 504101 - DNA, 25 bp, Homo sapien
gggccatttattctttggaccactg

SEQ ID NO: 504102 - DNA, 25 bp, Homo sapien
gaccactggctacttctgaagttct

SEQ ID NO: 504103 - DNA, 25 bp, Homo sapien
ggctacttctgaagttctggcttcc

SEQ ID NO: 504104 - DNA, 25 bp, Homo sapien
ggcttccttctctctaggaggagtc

SEQ ID NO: 504105 - DNA, 25 bp, Homo sapien
ggaggagtcgtgtattcaagctttt

SEQ ID NO: 504106 - DNA, 25 bp, Homo sapien
gtcgtgtattcaagcttttaagtta

SEQ ID NO: 504107 - DNA, 25 bp, Homo sapien
aatgagttttacttctcttctgact

SEQ ID NO: 504108 - DNA, 25 bp, Homo sapien
acttctcttctgacttgatttttaa

SEQ ID NO: 504109 - DNA, 25 bp, Homo sapien
tgttcattttgaagtgggaatttga

SEQ ID NO: 504110 - DNA, 25 bp, Homo sapien
gaatttgaggtgtttgtaatgtcat

SEQ ID NO: 504111 - DNA, 25 bp, Homo sapien
taatgtcatgttactgttctgaaag

SEQ ID NO: 504112 - DNA, 25 bp, Homo sapien
aaaccagcctcccaggaatgccatt

SEQ ID NO: 504113 - DNA, 25 bp, Homo sapien
ataaagaagagagcctgactcctct

SEQ ID NO: 504114 - DNA, 25 bp, Homo sapien
agagagcctgactcctctcctgagg

SEQ ID NO: 504115 - DNA, 25 bp, Homo sapien
tgagccagcaggatccacggagcag

SEQ ID NO: 504116 - DNA, 25 bp, Homo sapien
aggatccacggagcagaggtcatct

SEQ ID NO: 504117 - DNA, 25 bp, Homo sapien
atccacggagcagaggtcatctgtc

SEQ ID NO: 504118 - DNA, 25 bp, Homo sapien
catcctgtgtacttccacattggtt

SEQ ID NO: 504119 - DNA, 25 bp, Homo sapien
gtacttccacattggtttaaccaga

SEQ ID NO: 504120 - DNA, 25 bp, Homo sapien
gaggaaaaccgaaatctacaattgt

SEQ ID NO: 504121 - DNA, 25 bp, Homo sapien
aaatgtgcgtagaatcagccataca

SEQ ID NO: 504122 - DNA, 25 bp, Homo sapien
cgtagaatcagccatacaaattgtg

SEQ ID NO: 504123 - DNA, 25 bp, Homo sapien
gtgcagcctgaaggatcagtgtagt

SEQ ID NO: 504124 - DNA, 25 bp, Homo sapien
ggatcagtgtagtaatgccaggaaa

SEQ ID NO: 504125 - DNA, 25 bp, Homo sapien
atgccaggaaagtgctttttaccta

SEQ ID NO: 504126 - DNA, 25 bp, Homo sapien
tgctttttacctaagacttccttct

SEQ ID NO: 504127 - DNA, 25 bp, Homo sapien
ttacctaagacttccttctcagctt

SEQ ID NO: 504128 - DNA, 25 bp, Homo sapien
agaccctaatatgcattttgatttg

SEQ ID NO: 504129 - DNA, 25 bp, Homo sapien
aagtgtcatgtgatgtttgcattac

SEQ ID NO: 504130 - DNA, 25 bp, Homo sapien
gtttgcattacttttaactgctatg

SEQ ID NO: 504131 - DNA, 25 bp, Homo sapien
gcattacttttaactgctatgtata

SEQ ID NO: 504132 - DNA, 25 bp, Homo sapien
ggaaagtgtgtcttttgacttcatc

SEQ ID NO: 504133 - DNA, 25 bp, Homo sapien
gtgtcttttgacttcatcagttatt

SEQ ID NO: 504134 - DNA, 25 bp, Homo sapien
gaaagattttagcatgcataccaat

SEQ ID NO: 504135 - DNA, 25 bp, Homo sapien
gattttagcatgcataccaatatag

SEQ ID NO: 504136 - DNA, 25 bp, Homo sapien
attacgcaatatataagcacaccta

SEQ ID NO: 504137 - DNA, 25 bp, Homo sapien
tataagcacacctaattaacagatt

SEQ ID NO: 504138 - DNA, 25 bp, Homo sapien
tctattgttacataattgccatgtg

SEQ ID NO: 504139 - DNA, 25 bp, Homo sapien
gccatgtggacttgtttatgattat

SEQ ID NO: 504140 - DNA, 25 bp, Homo sapien
tgtagagtagcatttaagatttaac

SEQ ID NO: 504141 - DNA, 25 bp, Homo sapien
gcatttaagatttaactgtagcaaa

SEQ ID NO: 504142 - DNA, 25 bp, Homo sapien
gcaaaaattactttaaccgctgtat

SEQ ID NO: 504143 - DNA, 25 bp, Homo sapien
taaccgctgtatttaagttagcatg

SEQ ID NO: 504144 - DNA, 25 bp, Homo sapien
cgctgtatttaagttagcatgttaa

SEQ ID NO: 504145 - DNA, 25 bp, Homo sapien
gcaaatgccacttgtagactcaaac

SEQ ID NO: 504146 - DNA, 25 bp, Homo sapien
gactcaaactctggacttcattctc

SEQ ID NO: 504147 - DNA, 25 bp, Homo sapien
gagtaaatcctatgaacctgactag

SEQ ID NO: 504148 - DNA, 25 bp, Homo sapien
acctgactagggtggcaactgaagt

SEQ ID NO: 504149 - DNA, 25 bp, Homo sapien
gaagttgtagtactttctgtcttca

SEQ ID NO: 504150 - DNA, 25 bp, Homo sapien
gtgaacctggagtatgttggaagaa

SEQ ID NO: 504151 - DNA, 25 bp, Homo sapien
gttaggttcattagagacacctctt

SEQ ID NO: 504152 - DNA, 25 bp, Homo sapien
gagacacctctttcataactgctgt

SEQ ID NO: 504153 - DNA, 25 bp, Homo sapien
aactgctgtcacctagaatgtctat

SEQ ID NO: 504154 - DNA, 25 bp, Homo sapien
aatgtctattctctaagcaccttct

SEQ ID NO: 504155 - DNA, 25 bp, Homo sapien
attctctaagcaccttcttgaaaga

SEQ ID NO: 504156 - DNA, 25 bp, Homo sapien
ggaaaagggtactgccggtctagca

SEQ ID NO: 504157 - DNA, 25 bp, Homo sapien
ccagcgcgtgggacctgtttgtgtc

SEQ ID NO: 504158 - DNA, 25 bp, Homo sapien
gcttccttgggaacggcacagtcac

SEQ ID NO: 504159 - DNA, 25 bp, Homo sapien
actcaccctgccatttgcggaaatg

SEQ ID NO: 504160 - DNA, 25 bp, Homo sapien
ttgcggaaatgacctggtgcacttt

SEQ ID NO: 504161 - DNA, 25 bp, Homo sapien
ctttgactgttaagcaatgcgttat

SEQ ID NO: 504162 - DNA, 25 bp, Homo sapien
caatgcgttattgctgtagtcaagg

SEQ ID NO: 504163 - DNA, 25 bp, Homo sapien
ctgtagtcaaggttagtgcaagcaa

SEQ ID NO: 504164 - DNA, 25 bp, Homo sapien
gtgcaagcaaggaaacattcccagt

SEQ ID NO: 504165 - DNA, 25 bp, Homo sapien
ttcccagtaaggtatttgtttccat

SEQ ID NO: 504166 - DNA, 25 bp, Homo sapien
gcttctgtcagaaacttgctaggac

SEQ ID NO: 504167 - DNA, 25 bp, Homo sapien
ggctttcacagtggtcttaaggtat

SEQ ID NO: 504168 - DNA, 25 bp, Homo sapien
gctttcacagtggtcttaaggtatg

SEQ ID NO: 504169 - DNA, 25 bp, Homo sapien
ctttcacagtggtcttaaggtatgg

SEQ ID NO: 504170 - DNA, 25 bp, Homo sapien
tttcacagtggtcttaaggtatggg

SEQ ID NO: 504171 - DNA, 25 bp, Homo sapien
ttcacagtggtcttaaggtatgggt

SEQ ID NO: 504172 - DNA, 25 bp, Homo sapien
tcacagtggtcttaaggtatgggtg

SEQ ID NO: 504173 - DNA, 25 bp, Homo sapien
cacagtggtcttaaggtatgggtga

SEQ ID NO: 504174 - DNA, 25 bp, Homo sapien
acagtggtcttaaggtatgggtgag

SEQ ID NO: 504175 - DNA, 25 bp, Homo sapien
cagtggtcttaaggtatgggtgaga

SEQ ID NO: 504176 - DNA, 25 bp, Homo sapien
aatagtccccccacatgacaggtgt

SEQ ID NO: 504177 - DNA, 25 bp, Homo sapien
ggtgtcttcagcttgccatattgat

SEQ ID NO: 504178 - DNA, 25 bp, Homo sapien
ttcagcttgccatattgatccaaag

SEQ ID NO: 504179 - DNA, 25 bp, Homo sapien
gccatattgatccaaagttcataca

SEQ ID NO: 504180 - DNA, 25 bp, Homo sapien
attagacttttatgtcagtggattg

SEQ ID NO: 504181 - DNA, 25 bp, Homo sapien
atgtcagtggattgtgcttgcagaa

SEQ ID NO: 504182 - DNA, 25 bp, Homo sapien
ttgtgcttgcagaaatacagaagta

SEQ ID NO: 504183 - DNA, 25 bp, Homo sapien
aagtaacatactgaccctaggtgag

SEQ ID NO: 504184 - DNA, 25 bp, Homo sapien
ccctaggtgaggagtttcttacatg

SEQ ID NO: 504185 - DNA, 25 bp, Homo sapien
tttcttacatggttaactggattga

SEQ ID NO: 504186 - DNA, 25 bp, Homo sapien
ctttccttcttagaccaggtaacat

SEQ ID NO: 504187 - DNA, 25 bp, Homo sapien
aattttatgacactaattgctaaag

SEQ ID NO: 504188 - DNA, 25 bp, Homo sapien
tgacactaattgctaaagtttattt

SEQ ID NO: 504189 - DNA, 25 bp, Homo sapien
gaattatttttggagctgaaatctt

SEQ ID NO: 504190 - DNA, 25 bp, Homo sapien
tttttggagctgaaatctttgtaat

SEQ ID NO: 504191 - DNA, 25 bp, Homo sapien
aagcaactagtttctaattcccagt

SEQ ID NO: 504192 - DNA, 25 bp, Homo sapien
tagtttctaattcccagtttctgta

SEQ ID NO: 504193 - DNA, 25 bp, Homo sapien
tctaattcccagtttctgtatagaa

SEQ ID NO: 504194 - DNA, 25 bp, Homo sapien
cccagtttctgtatagaatcgcaca

SEQ ID NO: 504195 - DNA, 25 bp, Homo sapien
ttctgtatagaatcgcacaagtggt

SEQ ID NO: 504196 - DNA, 25 bp, Homo sapien
cgcacaagtggtttatggagtgttt

SEQ ID NO: 504197 - DNA, 25 bp, Homo sapien
atggagtgtttggattgtaattata

SEQ ID NO: 504198 - DNA, 25 bp, Homo sapien
gtttcccatgagcagagatgattga

SEQ ID NO: 504199 - DNA, 25 bp, Homo sapien
gagacctgggtccatctgattacat

SEQ ID NO: 504200 - DNA, 25 bp, Homo sapien
ggtccatctgattacatattgctgt

SEQ ID NO: 504201 - DNA, 25 bp, Homo sapien
ttgtgagcataatcgttggctggtt

SEQ ID NO: 504202 - DNA, 25 bp, Homo sapien
taatcgttggctggtttatgcactg

SEQ ID NO: 504203 - DNA, 25 bp, Homo sapien
tggtttatgcactgaacctccttgc

SEQ ID NO: 504204 - DNA, 25 bp, Homo sapien
ccttgctctgggatcataatcatat

SEQ ID NO: 504205 - DNA, 25 bp, Homo sapien
atttgctacccaatacatttatttg

SEQ ID NO: 504206 - DNA, 25 bp, Homo sapien
gttatatctgacaagcactgggaaa

SEQ ID NO: 504207 - DNA, 25 bp, Homo sapien
gctttatctaacagcagtttttata

SEQ ID NO: 504208 - DNA, 25 bp, Homo sapien
atatgggctatctgaatcttatctt

SEQ ID NO: 504209 - DNA, 25 bp, Homo sapien
ggtgatgacagaatcagcttttgta

SEQ ID NO: 504210 - DNA, 25 bp, Homo sapien
gtgatgacagaatcagcttttgtaa

SEQ ID NO: 504211 - DNA, 25 bp, Homo sapien
tgatgacagaatcagcttttgtaat

SEQ ID NO: 504212 - DNA, 25 bp, Homo sapien
tgtaattatgtataatagctcatgc

SEQ ID NO: 504213 - DNA, 25 bp, Homo sapien
gtaattatgtataatagctcatgca

SEQ ID NO: 504214 - DNA, 25 bp, Homo sapien
taattatgtataatagctcatgcat

SEQ ID NO: 504215 - DNA, 25 bp, Homo sapien
aattatgtataatagctcatgcatg

SEQ ID NO: 504216 - DNA, 25 bp, Homo sapien
attatgtataatagctcatgcatgt

SEQ ID NO: 504217 - DNA, 25 bp, Homo sapien
ttatgtataatagctcatgcatgtg

SEQ ID NO: 504218 - DNA, 25 bp, Homo sapien
tatgtataatagctcatgcatgtgt

SEQ ID NO: 504219 - DNA, 25 bp, Homo sapien
atgtataatagctcatgcatgtgtc

SEQ ID NO: 504220 - DNA, 25 bp, Homo sapien
taatacggagtgctggatgaggaaa

SEQ ID NO: 504221 - DNA, 25 bp, Homo sapien
aaatgtaactgaccaacagaaggat

SEQ ID NO: 504222 - DNA, 25 bp, Homo sapien
gtaactgaccaacagaaggatgttt

SEQ ID NO: 504223 - DNA, 25 bp, Homo sapien
caaatatggcagacaaaaggtggat

SEQ ID NO: 504224 - DNA, 25 bp, Homo sapien
gcagacaaaaggtggatgtatttaa

SEQ ID NO: 504225 - DNA, 25 bp, Homo sapien
ataaagagctttaatgaatcaataa

SEQ ID NO: 504226 - DNA, 25 bp, Homo sapien
ataaaaggcatgaccagactgtttc

SEQ ID NO: 504227 - DNA, 25 bp, Homo sapien
taaaaggcatgaccagactgtttct

SEQ ID NO: 504228 - DNA, 25 bp, Homo sapien
aaaaggcatgaccagactgtttcta

SEQ ID NO: 504229 - DNA, 25 bp, Homo sapien
aaaggcatgaccagactgtttctac

SEQ ID NO: 504230 - DNA, 25 bp, Homo sapien
aaggcatgaccagactgtttctaca

SEQ ID NO: 504231 - DNA, 25 bp, Homo sapien
ctaggtataaaaggtgactcagagt

SEQ ID NO: 504232 - DNA, 25 bp, Homo sapien
cagagtagagagtaagatgtcagca

SEQ ID NO: 504233 - DNA, 25 bp, Homo sapien
ataagatgtcagcaaaagtgcctca

SEQ ID NO: 504234 - DNA, 25 bp, Homo sapien
aagtgcctcaaattttaactgcgtc

SEQ ID NO: 504235 - DNA, 25 bp, Homo sapien
gcctcaaattttaactgcgtcaagt

SEQ ID NO: 504236 - DNA, 25 bp, Homo sapien
aactgcgtcaagttaagggcattgt

SEQ ID NO: 504237 - DNA, 25 bp, Homo sapien
agttaagggcattgtaaatactgta

SEQ ID NO: 504238 - DNA, 25 bp, Homo sapien
actgtagttttatgtagcttgcaac

SEQ ID NO: 504239 - DNA, 25 bp, Homo sapien
atgtagcttgcaacttctactgaaa

SEQ ID NO: 504240 - DNA, 25 bp, Homo sapien
aagcccattaatgcaaatctaagcc

SEQ ID NO: 504241 - DNA, 25 bp, Homo sapien
gcaaatctaagccttcatagacttt

SEQ ID NO: 504242 - DNA, 25 bp, Homo sapien
tcagaggactctagacaacaactta

SEQ ID NO: 504243 - DNA, 25 bp, Homo sapien
gacaacaacttagcaactgaagctt

SEQ ID NO: 504244 - DNA, 25 bp, Homo sapien
agaattaagcgccttgagcaagaaa

SEQ ID NO: 504245 - DNA, 25 bp, Homo sapien
gaaaacttcaagagtcaacacagac

SEQ ID NO: 504246 - DNA, 25 bp, Homo sapien
gtcaacacagactgtccaagctctg

SEQ ID NO: 504247 - DNA, 25 bp, Homo sapien
gtccaagctctgcagtattcaactg

SEQ ID NO: 504248 - DNA, 25 bp, Homo sapien
ttcaactgttgatggtccactaaca

SEQ ID NO: 504249 - DNA, 25 bp, Homo sapien
gatggtccactaacagcaagcaaag

SEQ ID NO: 504250 - DNA, 25 bp, Homo sapien
gaatcaagtcatttggaacagcaac

SEQ ID NO: 504251 - DNA, 25 bp, Homo sapien
tgctgtgaggcaagaactagatgat

SEQ ID NO: 504252 - DNA, 25 bp, Homo sapien
gaactagatgatgcttttagacaaa

SEQ ID NO: 504253 - DNA, 25 bp, Homo sapien
gggttattctataccaaatccaagt

SEQ ID NO: 504254 - DNA, 25 bp, Homo sapien
aatccaagtgtttacatccaagatg

SEQ ID NO: 504255 - DNA, 25 bp, Homo sapien
gatgtcacagaggtaacttcctttt

SEQ ID NO: 504256 - DNA, 25 bp, Homo sapien
taacttccttttgtaccttattgag

SEQ ID NO: 504257 - DNA, 25 bp, Homo sapien
gtaccttattgagctctggaaacag

SEQ ID NO: 504258 - DNA, 25 bp, Homo sapien
atatttaaattttccgccagcgttg

SEQ ID NO: 504259 - DNA, 25 bp, Homo sapien
gtcagctgcttgttgagtactggtt

SEQ ID NO: 504260 - DNA, 25 bp, Homo sapien
gtctgatgctttcatacttggtttc

SEQ ID NO: 504261 - DNA, 25 bp, Homo sapien
tttccgccagcgttgtacataatat

SEQ ID NO: 504262 - DNA, 25 bp, Homo sapien
agtaaatttctaccaccctcgcaca

SEQ ID NO: 504263 - DNA, 25 bp, Homo sapien
ccctcgcacaccagaaatttcaatg

SEQ ID NO: 504264 - DNA, 25 bp, Homo sapien
tagaagtcgaagcagtagcagtagc

SEQ ID NO: 504265 - DNA, 25 bp, Homo sapien
gtagcagtagcagttctagtagcag

SEQ ID NO: 504266 - DNA, 25 bp, Homo sapien
gcagttctagtagcagttcaaccag

SEQ ID NO: 504267 - DNA, 25 bp, Homo sapien
agcagttcaaccagtagcagcagtg

SEQ ID NO: 504268 - DNA, 25 bp, Homo sapien
agttcaaccagtagcagcagtggaa

SEQ ID NO: 504269 - DNA, 25 bp, Homo sapien
cagtggaagtagttccagcagtgga

SEQ ID NO: 504270 - DNA, 25 bp, Homo sapien
agttccagcagtggaagtagtagca

SEQ ID NO: 504271 - DNA, 25 bp, Homo sapien
agtagtagcagtcgcagtagttcca

SEQ ID NO: 504272 - DNA, 25 bp, Homo sapien
gcagtagttccagtagcagctccag

SEQ ID NO: 504273 - DNA, 25 bp, Homo sapien
agttccagtagcagctccagtacaa

SEQ ID NO: 504274 - DNA, 25 bp, Homo sapien
gcagctccagtacaagtggcagcag

SEQ ID NO: 504275 - DNA, 25 bp, Homo sapien
cactgttccatggtcagcaagtcat

SEQ ID NO: 504276 - DNA, 25 bp, Homo sapien
tggtcagcaagtcatatttcataat

SEQ ID NO: 504277 - DNA, 25 bp, Homo sapien
gaatacagctattctatggctactt

SEQ ID NO: 504278 - DNA, 25 bp, Homo sapien
tctatggctacttttagtgtttttg

SEQ ID NO: 504279 - DNA, 25 bp, Homo sapien
gtgtttatggaattaccagtatctt

SEQ ID NO: 504280 - DNA, 25 bp, Homo sapien
ggaaccttggaagtctatcactcta

SEQ ID NO: 504281 - DNA, 25 bp, Homo sapien
tggaagtctatcactctaaatgaaa

SEQ ID NO: 504282 - DNA, 25 bp, Homo sapien
aatgaaagtctgtcactctacatga

SEQ ID NO: 504283 - DNA, 25 bp, Homo sapien
gtcactctacatgaattatgtgctc

SEQ ID NO: 504284 - DNA, 25 bp, Homo sapien
atgtgctcaaatttgaccaactcag

SEQ ID NO: 504285 - DNA, 25 bp, Homo sapien
gaccaactcagtttaagacacaaaa

SEQ ID NO: 504286 - DNA, 25 bp, Homo sapien
gttttcttagattattacagcagtg

SEQ ID NO: 504287 - DNA, 25 bp, Homo sapien
catagatgtaagttctggatgcaca

SEQ ID NO: 504288 - DNA, 25 bp, Homo sapien
tgtaagttctggatgcacagtagtt

SEQ ID NO: 504289 - DNA, 25 bp, Homo sapien
ttctggatgcacagtagttgttgct

SEQ ID NO: 504290 - DNA, 25 bp, Homo sapien
gatgcacagtagttgttgcttagct

SEQ ID NO: 504291 - DNA, 25 bp, Homo sapien
gcacagtagttgttgcttagctgta

SEQ ID NO: 504292 - DNA, 25 bp, Homo sapien
cagtagttgttgcttagctgtaagc

SEQ ID NO: 504293 - DNA, 25 bp, Homo sapien
gttgttgcttagctgtaagctggaa

SEQ ID NO: 504294 - DNA, 25 bp, Homo sapien
agctggaaatttcaaggcagaaaca

SEQ ID NO: 504295 - DNA, 25 bp, Homo sapien
ttatgtgtatacgtgagattatggg

SEQ ID NO: 504296 - DNA, 25 bp, Homo sapien
gacaaaagtaatgcatagagattta

SEQ ID NO: 504297 - DNA, 25 bp, Homo sapien
gggtattattacatattatcagtga

SEQ ID NO: 504298 - DNA, 25 bp, Homo sapien
caacactcctacttgttaatccaac

SEQ ID NO: 504299 - DNA, 25 bp, Homo sapien
attagggtcaaccagaaatctgcaa

SEQ ID NO: 504300 - DNA, 25 bp, Homo sapien
agaaatctgcaattgactgtcaaaa

SEQ ID NO: 504301 - DNA, 25 bp, Homo sapien
gactgtcaaaactgagctcagttaa

SEQ ID NO: 504302 - DNA, 25 bp, Homo sapien
gagctcagttaaagtaagattcaat

SEQ ID NO: 504303 - DNA, 25 bp, Homo sapien
agattcaattctaacatggatgtgc

SEQ ID NO: 504304 - DNA, 25 bp, Homo sapien
aacatggatgtgcacgttcctaaat

SEQ ID NO: 504305 - DNA, 25 bp, Homo sapien
gtgcacgttcctaaatatcttatga

SEQ ID NO: 504306 - DNA, 25 bp, Homo sapien
aaaagtctgtattctaccatgcctt

SEQ ID NO: 504307 - DNA, 25 bp, Homo sapien
gtattctaccatgcctttcaaaagt

SEQ ID NO: 504308 - DNA, 25 bp, Homo sapien
gaagatttagagcatatttacctgg

SEQ ID NO: 504309 - DNA, 25 bp, Homo sapien
gagcatatttacctggattttactt

SEQ ID NO: 504310 - DNA, 25 bp, Homo sapien
ggattttacttatttgctagcaaaa

SEQ ID NO: 504311 - DNA, 25 bp, Homo sapien
aattcccccttgtcacagaaaccag

SEQ ID NO: 504312 - DNA, 25 bp, Homo sapien
ccagggactcttcaggatttgagat

SEQ ID NO: 504313 - DNA, 25 bp, Homo sapien
ctcttcaggatttgagatggccttg

SEQ ID NO: 504314 - DNA, 25 bp, Homo sapien
tattttagttgatacattcttctgc

SEQ ID NO: 504315 - DNA, 25 bp, Homo sapien
cattcttctgcccattataattctc

SEQ ID NO: 504316 - DNA, 25 bp, Homo sapien
ctgcccattataattctcacctgaa

SEQ ID NO: 504317 - DNA, 25 bp, Homo sapien
gaaaaagcctgatgtgggtcttaca

SEQ ID NO: 504318 - DNA, 25 bp, Homo sapien
agcctgatgtgggtcttacataaat

SEQ ID NO: 504319 - DNA, 25 bp, Homo sapien
acagccagacatggtgatagcccta

SEQ ID NO: 504320 - DNA, 25 bp, Homo sapien
gccagacatggtgatagccctaaat

SEQ ID NO: 504321 - DNA, 25 bp, Homo sapien
ttttctttattgaccctaggaggat

SEQ ID NO: 504322 - DNA, 25 bp, Homo sapien
ccctaggaggatttgagttgctgca

SEQ ID NO: 504323 - DNA, 25 bp, Homo sapien
aaattgccatgttcactaattgtga

SEQ ID NO: 504324 - DNA, 25 bp, Homo sapien
tgccatgttcactaattgtgagcac

SEQ ID NO: 504325 - DNA, 25 bp, Homo sapien
aaatatgcttttagtactgctttgc

SEQ ID NO: 504326 - DNA, 25 bp, Homo sapien
gcttttagtactgctttgcttatgt

SEQ ID NO: 504327 - DNA, 25 bp, Homo sapien
ttatccttttctttgactttcattt

SEQ ID NO: 504328 - DNA, 25 bp, Homo sapien
attttctgatcattatgagctgtaa

SEQ ID NO: 504329 - DNA, 25 bp, Homo sapien
gaatcaatattggatattctcccaa

SEQ ID NO: 504330 - DNA, 25 bp, Homo sapien
gctccccagagacaatgctcagtat

SEQ ID NO: 504331 - DNA, 25 bp, Homo sapien
gagacaatgctcagtattcattcat

SEQ ID NO: 504332 - DNA, 25 bp, Homo sapien
gtattcattcatacacagacgatgg

SEQ ID NO: 504333 - DNA, 25 bp, Homo sapien
cagacgatggaagaagccacttctt

SEQ ID NO: 504334 - DNA, 25 bp, Homo sapien
agctcttcccacacgtgtgttagga

SEQ ID NO: 504335 - DNA, 25 bp, Homo sapien
taggaaatgcccgtgaacttgccct

SEQ ID NO: 504336 - DNA, 25 bp, Homo sapien
aacttgccctctgggctttttaatg

SEQ ID NO: 504337 - DNA, 25 bp, Homo sapien
gctttttaatgagaggcttggcgca

SEQ ID NO: 504338 - DNA, 25 bp, Homo sapien
aggcttggcgcatgcggcacccagc

SEQ ID NO: 504339 - DNA, 25 bp, Homo sapien
tgcttccctgcaagccagcgacttg

SEQ ID NO: 504340 - DNA, 25 bp, Homo sapien
gccgagcagaatgagctctgctcct

SEQ ID NO: 504341 - DNA, 25 bp, Homo sapien
acccgcgagcgcatccgcgtggaag

SEQ ID NO: 504342 - DNA, 25 bp, Homo sapien
agcgcatccgcgtggaagccttcaa

SEQ ID NO: 504343 - DNA, 25 bp, Homo sapien
gtggaagccttcaacttggccttcg

SEQ ID NO: 504344 - DNA, 25 bp, Homo sapien
aagccttcaacttggccttcgccga

SEQ ID NO: 504345 - DNA, 25 bp, Homo sapien
cttcgccgagctccgcaaattgctg

SEQ ID NO: 504346 - DNA, 25 bp, Homo sapien
ccccggacaagaagctctccaagat

SEQ ID NO: 504347 - DNA, 25 bp, Homo sapien
agctctccaagatcgagatcctgcg

SEQ ID NO: 504348 - DNA, 25 bp, Homo sapien
aagatcgagatcctgcgcctggcca

SEQ ID NO: 504349 - DNA, 25 bp, Homo sapien
tggccatctgctacatctcctatct

SEQ ID NO: 504350 - DNA, 25 bp, Homo sapien
ctatctcaaccacgtcctggacgtg

SEQ ID NO: 504351 - DNA, 25 bp, Homo sapien
aaccacgtcctggacgtgtagggcg

SEQ ID NO: 504352 - DNA, 25 bp, Homo sapien
agccagagtctgatcacactcacgc

SEQ ID NO: 504353 - DNA, 25 bp, Homo sapien
agagtctgatcacactcacgccaca

SEQ ID NO: 504354 - DNA, 25 bp, Homo sapien
gagcaaagcccaaacttgatggcct

SEQ ID NO: 504355 - DNA, 25 bp, Homo sapien
aacttgatggcctacatggttctcc

SEQ ID NO: 504356 - DNA, 25 bp, Homo sapien
tgatggcctacatggttctccacca

SEQ ID NO: 504357 - DNA, 25 bp, Homo sapien
tgtcttccgccccttatgtaagcca

SEQ ID NO: 504358 - DNA, 25 bp, Homo sapien
ttatgtaagccacttcagccacgcc

SEQ ID NO: 504359 - DNA, 25 bp, Homo sapien
ggcctctgcgctacatagcggccta

SEQ ID NO: 504360 - DNA, 25 bp, Homo sapien
atagcggcctatttcctttcctctt

SEQ ID NO: 504361 - DNA, 25 bp, Homo sapien
ttcaccttcaagtccatgcttaatt

SEQ ID NO: 504362 - DNA, 25 bp, Homo sapien
cttcaagtccatgcttaatttccca

SEQ ID NO: 504363 - DNA, 25 bp, Homo sapien
tggatctgcaacttaccccgtcaga

SEQ ID NO: 504364 - DNA, 25 bp, Homo sapien
cagtgtcccggttcatgcaggtgcg

SEQ ID NO: 504365 - DNA, 25 bp, Homo sapien
tatacgtcagtataccagaatagac

SEQ ID NO: 504366 - DNA, 25 bp, Homo sapien
gacttaattcagaaactgcctttgc

SEQ ID NO: 504367 - DNA, 25 bp, Homo sapien
tcagaaactgcctttgccaaacaaa

SEQ ID NO: 504368 - DNA, 25 bp, Homo sapien
gagaagcactactgaaaggatggag

SEQ ID NO: 504369 - DNA, 25 bp, Homo sapien
aaggatggagaaccctgcatcttgc

SEQ ID NO: 504370 - DNA, 25 bp, Homo sapien
tgcatcttgcctttgtgggattaag

SEQ ID NO: 504371 - DNA, 25 bp, Homo sapien
acaaactttcattgccatcacaatc

SEQ ID NO: 504372 - DNA, 25 bp, Homo sapien
gccatcacaatcttttgctgcataa

SEQ ID NO: 504373 - DNA, 25 bp, Homo sapien
ttgctgcataactatttcagttgat

SEQ ID NO: 504374 - DNA, 25 bp, Homo sapien
ccgccggcgcgccacggccaagtac

SEQ ID NO: 504375 - DNA, 25 bp, Homo sapien
cacccgcgagcgcatccgcgtggaa

SEQ ID NO: 504376 - DNA, 25 bp, Homo sapien
cttcgccgagctccgcaaattgctg

SEQ ID NO: 504377 - DNA, 25 bp, Homo sapien
agctccgcaaattgctgcccacgct

SEQ ID NO: 504378 - DNA, 25 bp, Homo sapien
catctgctacatctcctatctcaac

SEQ ID NO: 504379 - DNA, 25 bp, Homo sapien
ctatctcaaccacgtcctggacgtg

SEQ ID NO: 504380 - DNA, 25 bp, Homo sapien
tatctcaaccacgtcctggacgtgt

SEQ ID NO: 504381 - DNA, 25 bp, Homo sapien
atctcaaccacgtcctggacgtgta

SEQ ID NO: 504382 - DNA, 25 bp, Homo sapien
tctcaaccacgtcctggacgtgtag

SEQ ID NO: 504383 - DNA, 25 bp, Homo sapien
tcaaccacgtcctggacgtgtaggg

SEQ ID NO: 504384 - DNA, 25 bp, Homo sapien
aaccacgtcctggacgtgtagggcg

SEQ ID NO: 504385 - DNA, 25 bp, Homo sapien
aagaatcacatgacccctttcaata

SEQ ID NO: 504386 - DNA, 25 bp, Homo sapien
tgacccctttcaataatttatgtag

SEQ ID NO: 504387 - DNA, 25 bp, Homo sapien
atttctcatagagttttcagtcatg

SEQ ID NO: 504388 - DNA, 25 bp, Homo sapien
tttcagtcatgtgctgtggtgtgat

SEQ ID NO: 504389 - DNA, 25 bp, Homo sapien
ggtgtgattgtttctggacattcat

SEQ ID NO: 504390 - DNA, 25 bp, Homo sapien
ttgctatttaacgtccattgaaaac

SEQ ID NO: 504391 - DNA, 25 bp, Homo sapien
gaaaacatggctttcttttgcgcat

SEQ ID NO: 504392 - DNA, 25 bp, Homo sapien
tcttttgcgcattctgttactttca

SEQ ID NO: 504393 - DNA, 25 bp, Homo sapien
gcgcattctgttactttcagctgta

SEQ ID NO: 504394 - DNA, 25 bp, Homo sapien
atttcatgatgaactttccttggga

SEQ ID NO: 504395 - DNA, 25 bp, Homo sapien
aaagtgcatctttctgcctacaaga

SEQ ID NO: 504396 - DNA, 25 bp, Homo sapien
cagaccccactgagttgtcagcaaa

SEQ ID NO: 504397 - DNA, 25 bp, Homo sapien
actgagttgtcagcaaacaggcaca

SEQ ID NO: 504398 - DNA, 25 bp, Homo sapien
tgtcagcaaacaggcacaagacgct

SEQ ID NO: 504399 - DNA, 25 bp, Homo sapien
gcagtgggggctttccagagcctca

SEQ ID NO: 504400 - DNA, 25 bp, Homo sapien
tctcctttctgccaaaggcctgaag

SEQ ID NO: 504401 - DNA, 25 bp, Homo sapien
tctgccaaaggcctgaagccgtcca

SEQ ID NO: 504402 - DNA, 25 bp, Homo sapien
gaagccgtccactgcttggactttg

SEQ ID NO: 504403 - DNA, 25 bp, Homo sapien
cactgcttggactttgttccatttc

SEQ ID NO: 504404 - DNA, 25 bp, Homo sapien
ggactttgttccatttcaggttctc

SEQ ID NO: 504405 - DNA, 25 bp, Homo sapien
ctttgttccatttcaggttctccaa

SEQ ID NO: 504406 - DNA, 25 bp, Homo sapien
tgttccatttcaggttctccaaggg

SEQ ID NO: 504407 - DNA, 25 bp, Homo sapien
agccattcactcctactgatgagac

SEQ ID NO: 504408 - DNA, 25 bp, Homo sapien
tactgatgagacaagatgcggtgat

SEQ ID NO: 504409 - DNA, 25 bp, Homo sapien
tgcggtgatgacagaatcagctttt

SEQ ID NO: 504410 - DNA, 25 bp, Homo sapien
gtataatagctcatgcatgtgtcaa

SEQ ID NO: 504411 - DNA, 25 bp, Homo sapien
gcatgtgtcaatgtcataactgtct

SEQ ID NO: 504412 - DNA, 25 bp, Homo sapien
taactgtctttatacgcttctgcac

SEQ ID NO: 504413 - DNA, 25 bp, Homo sapien
tctttatacgcttctgcactctggg

SEQ ID NO: 504414 - DNA, 25 bp, Homo sapien
aagggggattggcacccagtggccg

SEQ ID NO: 504415 - DNA, 25 bp, Homo sapien
ttggcacccagtggccggggagcgt

SEQ ID NO: 504416 - DNA, 25 bp, Homo sapien
gtcccttgcttcattcttgtgacaa

SEQ ID NO: 504417 - DNA, 25 bp, Homo sapien
tgacaagataaaactgggcacagct

SEQ ID NO: 504418 - DNA, 25 bp, Homo sapien
gagcagtgaacaaatccacaggaca

SEQ ID NO: 504419 - DNA, 25 bp, Homo sapien
aaatccacaggacagcagctaagta

SEQ ID NO: 504420 - DNA, 25 bp, Homo sapien
gacagcagctaagtaggaggcctaa

SEQ ID NO: 504421 - DNA, 25 bp, Homo sapien
gtaggaggcctaaacatcacctggg

SEQ ID NO: 504422 - DNA, 25 bp, Homo sapien
aagtcagatgcgtatttgcggacct

SEQ ID NO: 504423 - DNA, 25 bp, Homo sapien
agatgcgtatttgcggacctcagaa

SEQ ID NO: 504424 - DNA, 25 bp, Homo sapien
atttgcggacctcagaaaaatttga

SEQ ID NO: 504425 - DNA, 25 bp, Homo sapien
tgatgaaacacctcctccaaatgaa

SEQ ID NO: 504426 - DNA, 25 bp, Homo sapien
aacacctcctccaaatgaaggcata

SEQ ID NO: 504427 - DNA, 25 bp, Homo sapien
aaacagtgactccaacccaagagag

SEQ ID NO: 504428 - DNA, 25 bp, Homo sapien
gtgactccaacccaagagagcagtg

SEQ ID NO: 504429 - DNA, 25 bp, Homo sapien
tatatgatattgctttttctcctct

SEQ ID NO: 504430 - DNA, 25 bp, Homo sapien
gtgctcctggtgtcgacttggcagt

SEQ ID NO: 504431 - DNA, 25 bp, Homo sapien
aagagggaccctgtcgctagcaaaa

SEQ ID NO: 504432 - DNA, 25 bp, Homo sapien
gagggaccctgtcgctagcaaaagc

SEQ ID NO: 504433 - DNA, 25 bp, Homo sapien
ggaccctgtcgctagcaaaagcgga

SEQ ID NO: 504434 - DNA, 25 bp, Homo sapien
cctgtcgctagcaaaagcggagagt

SEQ ID NO: 504435 - DNA, 25 bp, Homo sapien
attatgtatatcttaatgatcggtc

SEQ ID NO: 504436 - DNA, 25 bp, Homo sapien
aatgatcggtcattttcccagtttg

SEQ ID NO: 504437 - DNA, 25 bp, Homo sapien
tttcccagtttgtaatatatgtgta

SEQ ID NO: 504438 - DNA, 25 bp, Homo sapien
atatatgtgtagaaattgcctgtat

SEQ ID NO: 504439 - DNA, 25 bp, Homo sapien
gaaattgcctgtatatgatattgct

SEQ ID NO: 504440 - DNA, 25 bp, Homo sapien
acaacactgggctattaggaataac

SEQ ID NO: 504441 - DNA, 25 bp, Homo sapien
catgatacaagtgcactgtggcagt

SEQ ID NO: 504442 - DNA, 25 bp, Homo sapien
caagtgcactgtggcagtgccgctt

SEQ ID NO: 504443 - DNA, 25 bp, Homo sapien
ggcagtgccgcttgctcaggaccca

SEQ ID NO: 504444 - DNA, 25 bp, Homo sapien
tgtgtgtgctccctcgttaagttca

SEQ ID NO: 504445 - DNA, 25 bp, Homo sapien
tgtgctccctcgttaagttcatttg

SEQ ID NO: 504446 - DNA, 25 bp, Homo sapien
gctccctcgttaagttcatttgctg

SEQ ID NO: 504447 - DNA, 25 bp, Homo sapien
ccctcgttaagttcatttgctgtta

SEQ ID NO: 504448 - DNA, 25 bp, Homo sapien
gttcatttgctgttattacacacac

SEQ ID NO: 504449 - DNA, 25 bp, Homo sapien
tgttattacacacacaggccttcct

SEQ ID NO: 504450 - DNA, 25 bp, Homo sapien
caggccttcctgtctggtcgttaga

SEQ ID NO: 504451 - DNA, 25 bp, Homo sapien
ccgcctctcctcttggaggacaggg

SEQ ID NO: 504452 - DNA, 25 bp, Homo sapien
ctctcctcttggaggacagggcagc

SEQ ID NO: 504453 - DNA, 25 bp, Homo sapien
ttcggcacgaggaacttgaggctct

SEQ ID NO: 504454 - DNA, 25 bp, Homo sapien
tcggcacgaggaacttgaggctctg

SEQ ID NO: 504455 - DNA, 25 bp, Homo sapien
ggccacagtgcgtccagtctcctgt

SEQ ID NO: 504456 - DNA, 25 bp, Homo sapien
cctgccacgtgtcttttgcaaagct

SEQ ID NO: 504457 - DNA, 25 bp, Homo sapien
tgccacgtgtcttttgcaaagctcc

SEQ ID NO: 504458 - DNA, 25 bp, Homo sapien
ccacgtgtcttttgcaaagctcctt

SEQ ID NO: 504459 - DNA, 25 bp, Homo sapien
acgtgtcttttgcaaagctccttgg

SEQ ID NO: 504460 - DNA, 25 bp, Homo sapien
gtgtcttttgcaaagctccttggat

SEQ ID NO: 504461 - DNA, 25 bp, Homo sapien
ctaactcaaatctttcaagccccgc

SEQ ID NO: 504462 - DNA, 25 bp, Homo sapien
gctgggttccccagccaggagtgaa

SEQ ID NO: 504463 - DNA, 25 bp, Homo sapien
gggctcctatcagcaatggaccttc

SEQ ID NO: 504464 - DNA, 25 bp, Homo sapien
agcaatggaccttcccgccttggga

SEQ ID NO: 504465 - DNA, 25 bp, Homo sapien
cgccttgggagcctcttaggtatta

SEQ ID NO: 504466 - DNA, 25 bp, Homo sapien
taggctatgaatcagcgccacgtgc

SEQ ID NO: 504467 - DNA, 25 bp, Homo sapien
atcagcgccacgtgcaaaggcttgg

SEQ ID NO: 504468 - DNA, 25 bp, Homo sapien
aagccatgtggtcttgcaccccagg

SEQ ID NO: 504469 - DNA, 25 bp, Homo sapien
gcaccccaggcaagaaaagtcagct

SEQ ID NO: 504470 - DNA, 25 bp, Homo sapien
tcagctggagggtttacagcacttt

SEQ ID NO: 504471 - DNA, 25 bp, Homo sapien
tcaccatgactaagagaccactcgg

SEQ ID NO: 504472 - DNA, 25 bp, Homo sapien
taagagaccactcggtcctagcctc

SEQ ID NO: 504473 - DNA, 25 bp, Homo sapien
ttctggttcttgattgtttgggtct

SEQ ID NO: 504474 - DNA, 25 bp, Homo sapien
ttcttgattgtttgggtctgaattt

SEQ ID NO: 504475 - DNA, 25 bp, Homo sapien
tttggaatatgaatagattccccgt

SEQ ID NO: 504476 - DNA, 25 bp, Homo sapien
tttatgtccccttagaatattttag

SEQ ID NO: 504477 - DNA, 25 bp, Homo sapien
ccttagaatattttagggagcctat

SEQ ID NO: 504478 - DNA, 25 bp, Homo sapien
tttagggagcctataattattttct

SEQ ID NO: 504479 - DNA, 25 bp, Homo sapien
aagtctctttaagaagcaattactt

SEQ ID NO: 504480 - DNA, 25 bp, Homo sapien
acatcagattgaataacccaccttg

SEQ ID NO: 504481 - DNA, 25 bp, Homo sapien
gattgaataacccaccttgctgttc

SEQ ID NO: 504482 - DNA, 25 bp, Homo sapien
tgaataacccaccttgctgttcagc

SEQ ID NO: 504483 - DNA, 25 bp, Homo sapien
tgttcagcccacatcctactggaaa

SEQ ID NO: 504484 - DNA, 25 bp, Homo sapien
ggaccctcgggctgcaagcactgct

SEQ ID NO: 504485 - DNA, 25 bp, Homo sapien
cctcgggctgcaagcactgctgctg

SEQ ID NO: 504486 - DNA, 25 bp, Homo sapien
tccccaggaagtcaatgtgaggccc

SEQ ID NO: 504487 - DNA, 25 bp, Homo sapien
aagtcaatgtgaggcccgagacccc

SEQ ID NO: 504488 - DNA, 25 bp, Homo sapien
tgaggcccgagacccctcaagcggt

SEQ ID NO: 504489 - DNA, 25 bp, Homo sapien
ctcaagcggtgagggcccctgttga

SEQ ID NO: 504490 - DNA, 25 bp, Homo sapien
ggcccctgttgaacatggagggttc

SEQ ID NO: 504491 - DNA, 25 bp, Homo sapien
tgaacatggagggttcctaacccca

SEQ ID NO: 504492 - DNA, 25 bp, Homo sapien
taaccccaaactcgtgccagaagaa

SEQ ID NO: 504493 - DNA, 25 bp, Homo sapien
ccacccaggagctgaggctgatgga

SEQ ID NO: 504494 - DNA, 25 bp, Homo sapien
caggctgtcgtctcgtcgaggagcc

SEQ ID NO: 504495 - DNA, 25 bp, Homo sapien
ctttaagctgtgtattatagaaccg

SEQ ID NO: 504496 - DNA, 25 bp, Homo sapien
agctgtgtattatagaaccgttttg

SEQ ID NO: 504497 - DNA, 25 bp, Homo sapien
agaaccgttttgtgtagcattggaa

SEQ ID NO: 504498 - DNA, 25 bp, Homo sapien
aaccgttttgtgtagcattggaata

SEQ ID NO: 504499 - DNA, 25 bp, Homo sapien
tttgtgtagcattggaatattgtcc

SEQ ID NO: 504500 - DNA, 25 bp, Homo sapien
ggaatattgtccattttgtaagtca

SEQ ID NO: 504501 - DNA, 25 bp, Homo sapien
attgtccattttgtaagtcattgtg

SEQ ID NO: 504502 - DNA, 25 bp, Homo sapien
gtccattttgtaagtcattgtgaat

SEQ ID NO: 504503 - DNA, 25 bp, Homo sapien
ttgtaagtcattgtgaatgttctta

SEQ ID NO: 504504 - DNA, 25 bp, Homo sapien
ttaaaagttgacattgaagaaccta

SEQ ID NO: 504505 - DNA, 25 bp, Homo sapien
aacctaagtggatgatgggatttgg

SEQ ID NO: 504506 - DNA, 25 bp, Homo sapien
gatagtcaactactcatgtggcttt

SEQ ID NO: 504507 - DNA, 25 bp, Homo sapien
ggctttatgattataaaacccactg

SEQ ID NO: 504508 - DNA, 25 bp, Homo sapien
aaattgggtcccttgattctcttga

SEQ ID NO: 504509 - DNA, 25 bp, Homo sapien
gtcccttgattctcttgatttttcc

SEQ ID NO: 504510 - DNA, 25 bp, Homo sapien
tgatttttcctaagccttactccct

SEQ ID NO: 504511 - DNA, 25 bp, Homo sapien
cttactccctaaagtctccaatttg

SEQ ID NO: 504512 - DNA, 25 bp, Homo sapien
ggtatttgatacttgatctctcctt

SEQ ID NO: 504513 - DNA, 25 bp, Homo sapien
gatacttgatctctccttgaagtaa

SEQ ID NO: 504514 - DNA, 25 bp, Homo sapien
atattggactggaaggcctgagacc

SEQ ID NO: 504515 - DNA, 25 bp, Homo sapien
ggaaggcctgagacctcgataagaa

SEQ ID NO: 504516 - DNA, 25 bp, Homo sapien
gaagaaacatgaaccccagagccac

SEQ ID NO: 504517 - DNA, 25 bp, Homo sapien
ggatgtcatcatctttgggtttcat

SEQ ID NO: 504518 - DNA, 25 bp, Homo sapien
ttgggtttcatctgagagcatcact

SEQ ID NO: 504519 - DNA, 25 bp, Homo sapien
gcatcactcagcatctcacacatag

SEQ ID NO: 504520 - DNA, 25 bp, Homo sapien
ttaaatgagctttcctcatccggct

SEQ ID NO: 504521 - DNA, 25 bp, Homo sapien
ggctccctaagcaagcgctgttggc

SEQ ID NO: 504522 - DNA, 25 bp, Homo sapien
gagtgactaagtgctccacctgtgg

SEQ ID NO: 504523 - DNA, 25 bp, Homo sapien
acctgtgggtgtccttcttaatgtg

SEQ ID NO: 504524 - DNA, 25 bp, Homo sapien
gtccttcttaatgtgctgcttttgt

SEQ ID NO: 504525 - DNA, 25 bp, Homo sapien
tctgtataaattcacaccacctcac

SEQ ID NO: 504526 - DNA, 25 bp, Homo sapien
actcccaaaagtacttcctgtggct

SEQ ID NO: 504527 - DNA, 25 bp, Homo sapien
aagtacttcctgtggctcagaaaaa

SEQ ID NO: 504528 - DNA, 25 bp, Homo sapien
ctgattgttgttatttaagtaccac

SEQ ID NO: 504529 - DNA, 25 bp, Homo sapien
ttttgtgacctgtaactcagatgag

SEQ ID NO: 504530 - DNA, 25 bp, Homo sapien
gactttctaaaatttctggtcattt

SEQ ID NO: 504531 - DNA, 25 bp, Homo sapien
ttttttctagacagctcaactgaac

SEQ ID NO: 504532 - DNA, 25 bp, Homo sapien
agctcaactgaactgctgctgtatt

SEQ ID NO: 504533 - DNA, 25 bp, Homo sapien
tgaactgctgctgtattgcgatact

SEQ ID NO: 504534 - DNA, 25 bp, Homo sapien
gctgtattgcgatacttctggtgca

SEQ ID NO: 504535 - DNA, 25 bp, Homo sapien
gatacttctggtgcataaaaagcta

SEQ ID NO: 504536 - DNA, 25 bp, Homo sapien
aactcagatgagcagatgttcaaat

SEQ ID NO: 504537 - DNA, 25 bp, Homo sapien
caatttatttagtactctggttagc

SEQ ID NO: 504538 - DNA, 25 bp, Homo sapien
gtactctggttagctgattgttgtt

SEQ ID NO: 504539 - DNA, 25 bp, Homo sapien
gatactggactgtgtgagccacacg

SEQ ID NO: 504540 - DNA, 25 bp, Homo sapien
tgcggctctggatatcagccatgaa

SEQ ID NO: 504541 - DNA, 25 bp, Homo sapien
atcagccatgaagtgggaccccaca

SEQ ID NO: 504542 - DNA, 25 bp, Homo sapien
tctgtgctcttctcatggataagag

SEQ ID NO: 504543 - DNA, 25 bp, Homo sapien
gagcattttccagggcttcttgaat

SEQ ID NO: 504544 - DNA, 25 bp, Homo sapien
gaacaaccctaatgcctttgacttt

SEQ ID NO: 504545 - DNA, 25 bp, Homo sapien
ggctgtgctgagtctcactgtccac

SEQ ID NO: 504546 - DNA, 25 bp, Homo sapien
gaattccccagcttgttgggagtct

SEQ ID NO: 504547 - DNA, 25 bp, Homo sapien
ttgttgggagtctacgtcacggctt

SEQ ID NO: 504548 - DNA, 25 bp, Homo sapien
gtcacggcttgtcttgggaaccaat

SEQ ID NO: 504549 - DNA, 25 bp, Homo sapien
gaaccaatccgtctctctttctttt

SEQ ID NO: 504550 - DNA, 25 bp, Homo sapien
tagggtgggccatccactgtcaggc

SEQ ID NO: 504551 - DNA, 25 bp, Homo sapien
ggtgggccatccactgtcaggccag

SEQ ID NO: 504552 - DNA, 25 bp, Homo sapien
gtcaggccagtgtctcaagaaagcc

SEQ ID NO: 504553 - DNA, 25 bp, Homo sapien
agtgtctcaagaaagcctgaccagc

SEQ ID NO: 504554 - DNA, 25 bp, Homo sapien
agaaagcctgaccagctgagctgct

SEQ ID NO: 504555 - DNA, 25 bp, Homo sapien
gttagtttgtgatcaacgattcact

SEQ ID NO: 504556 - DNA, 25 bp, Homo sapien
gtgatcaacgattcactacaattga

SEQ ID NO: 504557 - DNA, 25 bp, Homo sapien
tgaagtgttactttgtcagaatatt

SEQ ID NO: 504558 - DNA, 25 bp, Homo sapien
gtgtgacatgctagattccctggat

SEQ ID NO: 504559 - DNA, 25 bp, Homo sapien
gacatgctagattccctggatgtag

SEQ ID NO: 504560 - DNA, 25 bp, Homo sapien
atgctagattccctggatgtagctg

SEQ ID NO: 504561 - DNA, 25 bp, Homo sapien
ccacatctcttttccggatacatta

SEQ ID NO: 504562 - DNA, 25 bp, Homo sapien
ggatacattataattctggacccct

SEQ ID NO: 504563 - DNA, 25 bp, Homo sapien
attctggacccctatttatctcaaa

SEQ ID NO: 504564 - DNA, 25 bp, Homo sapien
ggacccctatttatctcaaaactct

SEQ ID NO: 504565 - DNA, 25 bp, Homo sapien
atctcaaaactcttaatatatgcag

SEQ ID NO: 504566 - DNA, 25 bp, Homo sapien
cttaatatatgcagaccaacaggtc

SEQ ID NO: 504567 - DNA, 25 bp, Homo sapien
gaccaacaggtctttgcattccttt

SEQ ID NO: 504568 - DNA, 25 bp, Homo sapien
ataactggttgtgacaaagcttgtt

SEQ ID NO: 504569 - DNA, 25 bp, Homo sapien
aaagcttgttgttgatcagattcac

SEQ ID NO: 504570 - DNA, 25 bp, Homo sapien
gcttgttgttgatcagattcactgt

SEQ ID NO: 504571 - DNA, 25 bp, Homo sapien
atgtgattggtctaaaatatttgta

SEQ ID NO: 504572 - DNA, 25 bp, Homo sapien
ttattgtattacctgcttggttgca

SEQ ID NO: 504573 - DNA, 25 bp, Homo sapien
gaggaggactactataggataaatt

SEQ ID NO: 504574 - DNA, 25 bp, Homo sapien
tagagcaatttctcatgggtcacga

SEQ ID NO: 504575 - DNA, 25 bp, Homo sapien
ttctcatgggtcacgagggatagta

SEQ ID NO: 504576 - DNA, 25 bp, Homo sapien
gatatcggcttgatcatctgagtca

SEQ ID NO: 504577 - DNA, 25 bp, Homo sapien
atcggcttgatcatctgagtcagtg

SEQ ID NO: 504578 - DNA, 25 bp, Homo sapien
catctgagtcagtgggctcattgtg

SEQ ID NO: 504579 - DNA, 25 bp, Homo sapien
gggctcattgtggaaacatatggaa

SEQ ID NO: 504580 - DNA, 25 bp, Homo sapien
atatggaatcctttatgctttttct

SEQ ID NO: 504581 - DNA, 25 bp, Homo sapien
tacatgaaataaagccagagttgat

SEQ ID NO: 504582 - DNA, 25 bp, Homo sapien
tgctgcagatgtcatacagcatcac

SEQ ID NO: 504583 - DNA, 25 bp, Homo sapien
actgtacccagtgctccatggatct

SEQ ID NO: 504584 - DNA, 25 bp, Homo sapien
gctccatggatctcaggttatcttt

SEQ ID NO: 504585 - DNA, 25 bp, Homo sapien
gtcatcttcatgtccaaagttcaat

SEQ ID NO: 504586 - DNA, 25 bp, Homo sapien
agaaacagcatagccttcaggtcaa

SEQ ID NO: 504587 - DNA, 25 bp, Homo sapien
ttcaggtcaacttgatactcttccc

SEQ ID NO: 504588 - DNA, 25 bp, Homo sapien
catctcattccttctcactagaata

SEQ ID NO: 504589 - DNA, 25 bp, Homo sapien
agaatagccacattcataattggaa

SEQ ID NO: 504590 - DNA, 25 bp, Homo sapien
tgttaatttacccatagtcatgagg

SEQ ID NO: 504591 - DNA, 25 bp, Homo sapien
agggatcagcagcatcacggtctga

SEQ ID NO: 504592 - DNA, 25 bp, Homo sapien
gcagcatcacggtctgatgaacatt

SEQ ID NO: 504593 - DNA, 25 bp, Homo sapien
gaacattttcagcactgtacccagt

SEQ ID NO: 504594 - DNA, 25 bp, Homo sapien
gcataatgaagctatttttgctgtc

SEQ ID NO: 504595 - DNA, 25 bp, Homo sapien
ttaatatgttctagtattcttctga

SEQ ID NO: 504596 - DNA, 25 bp, Homo sapien
tttgcagtgactgtatttgtcccag

SEQ ID NO: 504597 - DNA, 25 bp, Homo sapien
gcagtgactgtatttgtcccagtaa

SEQ ID NO: 504598 - DNA, 25 bp, Homo sapien
tttgtcccagtaatgtggttcctct

SEQ ID NO: 504599 - DNA, 25 bp, Homo sapien
ccagtaatgtggttcctctctttat

SEQ ID NO: 504600 - DNA, 25 bp, Homo sapien
agtaatgtggttcctctctttattt

SEQ ID NO: 504601 - DNA, 25 bp, Homo sapien
cctctctttatttctgtaggtaaat

SEQ ID NO: 504602 - DNA, 25 bp, Homo sapien
tgctagaatgagatgttggactgtt

SEQ ID NO: 504603 - DNA, 25 bp, Homo sapien
tttttcatctttccagagatatatt

SEQ ID NO: 504604 - DNA, 25 bp, Homo sapien
tctttccagagatatattatgcaat

SEQ ID NO: 504605 - DNA, 25 bp, Homo sapien
ggtaattatggaaactcctcaaaga

SEQ ID NO: 504606 - DNA, 25 bp, Homo sapien
gtctttcacacactagtttccatag

SEQ ID NO: 504607 - DNA, 25 bp, Homo sapien
gtttccatagttcgagaattctgtt

SEQ ID NO: 504608 - DNA, 25 bp, Homo sapien
ttctgttttttaccattgggctgtg

SEQ ID NO: 504609 - DNA, 25 bp, Homo sapien
ttaccattgggctgtgaatgttcac

SEQ ID NO: 504610 - DNA, 25 bp, Homo sapien
gaatgttcacaatatcagtcctgtt

SEQ ID NO: 504611 - DNA, 25 bp, Homo sapien
atcagtcctgttgaattcctatgag

SEQ ID NO: 504612 - DNA, 25 bp, Homo sapien
attcctatgaggtaatcacaatgtg

SEQ ID NO: 504613 - DNA, 25 bp, Homo sapien
gtgtatatgttcattttctaggtat

SEQ ID NO: 504614 - DNA, 25 bp, Homo sapien
atgtatggctttttattctgtggaa

SEQ ID NO: 504615 - DNA, 25 bp, Homo sapien
tgtggaagtaaaatcctgaacgttt

SEQ ID NO: 504616 - DNA, 25 bp, Homo sapien
gaagaaagaacacattactccagat

SEQ ID NO: 504617 - DNA, 25 bp, Homo sapien
gaacacattactccagatctcacta

SEQ ID NO: 504618 - DNA, 25 bp, Homo sapien
gatctcactactcattgataaccac

SEQ ID NO: 504619 - DNA, 25 bp, Homo sapien
actactcattgataaccactgttaa

SEQ ID NO: 504620 - DNA, 25 bp, Homo sapien
accactgttaagtttctggtgaaca

SEQ ID NO: 504621 - DNA, 25 bp, Homo sapien
ggtgaacatctttctgagcacctct

SEQ ID NO: 504622 - DNA, 25 bp, Homo sapien
gagcacctctcttacaattttacat

SEQ ID NO: 504623 - DNA, 25 bp, Homo sapien
atgtaatagttgttttctgatgtca

SEQ ID NO: 504624 - DNA, 25 bp, Homo sapien
gttgttttctgatgtcaatgactag

SEQ ID NO: 504625 - DNA, 25 bp, Homo sapien
gtttgtctcatcatttacttaagca

SEQ ID NO: 504626 - DNA, 25 bp, Homo sapien
catttacttaagcaaacttaccctg

SEQ ID NO: 504627 - DNA, 25 bp, Homo sapien
tattttctgagtggatgtgattaaa

SEQ ID NO: 504628 - DNA, 25 bp, Homo sapien
atattcagacgtttagtgtatgatt

SEQ ID NO: 504629 - DNA, 25 bp, Homo sapien
gagtaattaaatccatcctgtcttt

SEQ ID NO: 504630 - DNA, 25 bp, Homo sapien
aaatccatcctgtcttttacacaat

SEQ ID NO: 504631 - DNA, 25 bp, Homo sapien
tttacacaatggacaaatcaagtta

SEQ ID NO: 504632 - DNA, 25 bp, Homo sapien
gatagcttagcttgttttctggtgc

SEQ ID NO: 504633 - DNA, 25 bp, Homo sapien
agcttgttttctggtgctgttgacc

SEQ ID NO: 504634 - DNA, 25 bp, Homo sapien
tttctggtgctgttgacctgcaaga

SEQ ID NO: 504635 - DNA, 25 bp, Homo sapien
ggtgctgttgacctgcaagagaata

SEQ ID NO: 504636 - DNA, 25 bp, Homo sapien
atacttttgcatatacaggtgaaag

SEQ ID NO: 504637 - DNA, 25 bp, Homo sapien
gaaagttttgcaatttatgtataca

SEQ ID NO: 504638 - DNA, 25 bp, Homo sapien
aggacagcgagctactgaccttcag

SEQ ID NO: 504639 - DNA, 25 bp, Homo sapien
agcgagctactgaccttcagcctct

SEQ ID NO: 504640 - DNA, 25 bp, Homo sapien
tatgtggaggccctacacagttgcc

SEQ ID NO: 504641 - DNA, 25 bp, Homo sapien
ctacacagttgcctgcagatcctga

SEQ ID NO: 504642 - DNA, 25 bp, Homo sapien
tgcagatcctgatcgcgcttctggg

SEQ ID NO: 504643 - DNA, 25 bp, Homo sapien
atcctgatcgcgcttctgggctttg

SEQ ID NO: 504644 - DNA, 25 bp, Homo sapien
ttctgggctttgtctgtggctgcca

SEQ ID NO: 504645 - DNA, 25 bp, Homo sapien
gctgccaggtggtcagcgtgtttac

SEQ ID NO: 504646 - DNA, 25 bp, Homo sapien
gtttacggaggaagaggacagcttt

SEQ ID NO: 504647 - DNA, 25 bp, Homo sapien
cagctttgatttcattggtggattt

SEQ ID NO: 504648 - DNA, 25 bp, Homo sapien
attggtggatttgatccatttcctc

SEQ ID NO: 504649 - DNA, 25 bp, Homo sapien
gaacagaagggtaactttctcccag

SEQ ID NO: 504650 - DNA, 25 bp, Homo sapien
gaagggtaactttctcccagacaca

SEQ ID NO: 504651 - DNA, 25 bp, Homo sapien
gtaactttctcccagacacattggt

SEQ ID NO: 504652 - DNA, 25 bp, Homo sapien
tttctcccagacacattggtagtta

SEQ ID NO: 504653 - DNA, 25 bp, Homo sapien
cacattggtagttagtggcaaagac

SEQ ID NO: 504654 - DNA, 25 bp, Homo sapien
tggcaaagacagtggtacttgaggc

SEQ ID NO: 504655 - DNA, 25 bp, Homo sapien
gggtctcatgactcaaggacttagt

SEQ ID NO: 504656 - DNA, 25 bp, Homo sapien
gactcaaggacttagttgcacaaat

SEQ ID NO: 504657 - DNA, 25 bp, Homo sapien
ggcttccttcacagttgtgtgtgta

SEQ ID NO: 504658 - DNA, 25 bp, Homo sapien
gtatgcatgcatttatcacgatatg

SEQ ID NO: 504659 - DNA, 25 bp, Homo sapien
tatcacgatatgcaccaaagagcct

SEQ ID NO: 504660 - DNA, 25 bp, Homo sapien
gtaatttcccatctcatggagtcac

SEQ ID NO: 504661 - DNA, 25 bp, Homo sapien
gtcacagagttttcttgccaactgc

SEQ ID NO: 504662 - DNA, 25 bp, Homo sapien
tgggaatgatcagtagcctcagtgt

SEQ ID NO: 504663 - DNA, 25 bp, Homo sapien
gtgtgttttctgatccactccatcc

SEQ ID NO: 504664 - DNA, 25 bp, Homo sapien
tccatcctgtattatcatctgcgaa

SEQ ID NO: 504665 - DNA, 25 bp, Homo sapien
catctgcgaataccgtttttccttt

SEQ ID NO: 504666 - DNA, 25 bp, Homo sapien
aatgtgtctttcaaagctgacttga

SEQ ID NO: 504667 - DNA, 25 bp, Homo sapien
gacttgaatttctcacctttcgagt

SEQ ID NO: 504668 - DNA, 25 bp, Homo sapien
acctttcgagttacctgccatttgg

SEQ ID NO: 504669 - DNA, 25 bp, Homo sapien
cctgccatttggactcacttatttg

SEQ ID NO: 504670 - DNA, 25 bp, Homo sapien
gacccagcgtaatacctgtatgctc

SEQ ID NO: 504671 - DNA, 25 bp, Homo sapien
gtgacccagagctataatcatccat

SEQ ID NO: 504672 - DNA, 25 bp, Homo sapien
ataatcatccatcaagtcttccaca

SEQ ID NO: 504673 - DNA, 25 bp, Homo sapien
agtcttccacaataattcccaactc

SEQ ID NO: 504674 - DNA, 25 bp, Homo sapien
ttcccaactcataaattgctttcct

SEQ ID NO: 504675 - DNA, 25 bp, Homo sapien
caaaagctattgttcataatggcat

SEQ ID NO: 504676 - DNA, 25 bp, Homo sapien
ggcatttctaaagcttttgggcact

SEQ ID NO: 504677 - DNA, 25 bp, Homo sapien
gcttttgggcactgtgtaccaggat

SEQ ID NO: 504678 - DNA, 25 bp, Homo sapien
gaaatgaggagcctgtcttttaata

SEQ ID NO: 504679 - DNA, 25 bp, Homo sapien
atattccagtatttgtgtgtttgat

SEQ ID NO: 504680 - DNA, 25 bp, Homo sapien
gtacatatatctatttctctaggga

SEQ ID NO: 504681 - DNA, 25 bp, Homo sapien
gaagtaagtggagaagggcctacct

SEQ ID NO: 504682 - DNA, 25 bp, Homo sapien
gagagatacctctgaagctgctaag

SEQ ID NO: 504683 - DNA, 25 bp, Homo sapien
gaagctgctaagaaatactggaaat

SEQ ID NO: 504684 - DNA, 25 bp, Homo sapien
agaatactacaatctcactctccgc

SEQ ID NO: 504685 - DNA, 25 bp, Homo sapien
actctccgcttttgctagcgacagg

SEQ ID NO: 504686 - DNA, 25 bp, Homo sapien
ttttgctagcgacagggtccctctt

SEQ ID NO: 504687 - DNA, 25 bp, Homo sapien
tgcctctccttgactgccaagtcga

SEQ ID NO: 504688 - DNA, 25 bp, Homo sapien
gactgccaagtcgacaccaggagca

SEQ ID NO: 504689 - DNA, 25 bp, Homo sapien
gcaccgagtgggaggagaaccccaa

SEQ ID NO: 504690 - DNA, 25 bp, Homo sapien
ttacatatagataaacacgcagttt

SEQ ID NO: 504691 - DNA, 25 bp, Homo sapien
gataacagtaaaagcgccctacagg

SEQ ID NO: 504692 - DNA, 25 bp, Homo sapien
cgccctacagggagtgagagatacc

SEQ ID NO: 504693 - DNA, 25 bp, Homo sapien
cttcaatatcattcagctgtttttc

SEQ ID NO: 504694 - DNA, 25 bp, Homo sapien
gaatggattgattcctgcctttatt

SEQ ID NO: 504695 - DNA, 25 bp, Homo sapien
ttcttttttcttcacacatcgaata

SEQ ID NO: 504696 - DNA, 25 bp, Homo sapien
acacatcgaatacccaaattttgga

SEQ ID NO: 504697 - DNA, 25 bp, Homo sapien
acaaaggtctgcgttcttgtccaaa

SEQ ID NO: 504698 - DNA, 25 bp, Homo sapien
gcgttcttgtccaaattctgcttca

SEQ ID NO: 504699 - DNA, 25 bp, Homo sapien
attctgcttcatagtagccgtctct

SEQ ID NO: 504700 - DNA, 25 bp, Homo sapien
gtctctgcagtcttttccaactaaa

SEQ ID NO: 504701 - DNA, 25 bp, Homo sapien
atatgggtcattctttgttactaat

SEQ ID NO: 504702 - DNA, 25 bp, Homo sapien
actaatgtaattctcacttttcctt

SEQ ID NO: 504703 - DNA, 25 bp, Homo sapien
cttttccttttccataatagttcat

SEQ ID NO: 504704 - DNA, 25 bp, Homo sapien
tggctccaggagacacagggcccag

SEQ ID NO: 504705 - DNA, 25 bp, Homo sapien
acccaggttgctgtcggcaggctga

SEQ ID NO: 504706 - DNA, 25 bp, Homo sapien
tcggcaggctgaagacactagaatc

SEQ ID NO: 504707 - DNA, 25 bp, Homo sapien
gacactagaatcctgacctgtacat

SEQ ID NO: 504708 - DNA, 25 bp, Homo sapien
tgacctgtacattctgcccttgcct

SEQ ID NO: 504709 - DNA, 25 bp, Homo sapien
cttgcctcccagtggtatttgaata

SEQ ID NO: 504710 - DNA, 25 bp, Homo sapien
atgtaactcattactgtctcctgtt

SEQ ID NO: 504711 - DNA, 25 bp, Homo sapien
ttactgtctcctgttatttatctca

SEQ ID NO: 504712 - DNA, 25 bp, Homo sapien
gttatttatctcagtagtcccctct

SEQ ID NO: 504713 - DNA, 25 bp, Homo sapien
tagcccctattaactctgcattaag

SEQ ID NO: 504714 - DNA, 25 bp, Homo sapien
ctctgcattaagcattccacataat

SEQ ID NO: 504715 - DNA, 25 bp, Homo sapien
agccctgtgacttacactgcattaa

SEQ ID NO: 504716 - DNA, 25 bp, Homo sapien
atttcttagaacatagtccctgatc

SEQ ID NO: 504717 - DNA, 25 bp, Homo sapien
atagtccctgatcattatcacttta

SEQ ID NO: 504718 - DNA, 25 bp, Homo sapien
atagagtgccagcattgtttcccag

SEQ ID NO: 504719 - DNA, 25 bp, Homo sapien
caaatcttgggttcattccaggtaa

SEQ ID NO: 504720 - DNA, 25 bp, Homo sapien
ttccaggtaaactgaactactgcat

SEQ ID NO: 504721 - DNA, 25 bp, Homo sapien
gaactactgcattgtttctatctta

SEQ ID NO: 504722 - DNA, 25 bp, Homo sapien
aatactttttagatatcctagatgc

SEQ ID NO: 504723 - DNA, 25 bp, Homo sapien
gatatcctagatgcatctttcaact

SEQ ID NO: 504724 - DNA, 25 bp, Homo sapien
gcatctttcaacttctaacattctg

SEQ ID NO: 504725 - DNA, 25 bp, Homo sapien
acattctgtagtttaggagttctca

SEQ ID NO: 504726 - DNA, 25 bp, Homo sapien
agcttgttactggaatcttatgtgc

SEQ ID NO: 504727 - DNA, 25 bp, Homo sapien
tggtgctcaaagaaggatcaatccg

SEQ ID NO: 504728 - DNA, 25 bp, Homo sapien
gatcaatccggttgcatccttcaat

SEQ ID NO: 504729 - DNA, 25 bp, Homo sapien
gcatccttcaatttcccttttagaa

SEQ ID NO: 504730 - DNA, 25 bp, Homo sapien
ttcaatttcccttttagaatgactt

SEQ ID NO: 504731 - DNA, 25 bp, Homo sapien
tacagtaggctatgttagcctttat

SEQ ID NO: 504732 - DNA, 25 bp, Homo sapien
tagcctttattttggtggttctcaa

SEQ ID NO: 504733 - DNA, 25 bp, Homo sapien
tattttggtggttctcaaatacctg

SEQ ID NO: 504734 - DNA, 25 bp, Homo sapien
gagtattatgctggtggcctttcat

SEQ ID NO: 504735 - DNA, 25 bp, Homo sapien
gtggcctttcataaaggttactgaa

SEQ ID NO: 504736 - DNA, 25 bp, Homo sapien
atgaatgtgaataggcctatatact

SEQ ID NO: 504737 - DNA, 25 bp, Homo sapien
ccttctatccctagccaaggaagtt

SEQ ID NO: 504738 - DNA, 25 bp, Homo sapien
aaggaagttcatcctgactccccaa

SEQ ID NO: 504739 - DNA, 25 bp, Homo sapien
atcaaaaggagtgtttcgtcacctt

SEQ ID NO: 504740 - DNA, 25 bp, Homo sapien
tgaagtttagtggtctctcctatcc

SEQ ID NO: 504741 - DNA, 25 bp, Homo sapien
ctggttttcctttactgtgctttgc

SEQ ID NO: 504742 - DNA, 25 bp, Homo sapien
ctgtgctttgcaaaacttattcatg

SEQ ID NO: 504743 - DNA, 25 bp, Homo sapien
acttattcatgttttattgggtgac

SEQ ID NO: 504744 - DNA, 25 bp, Homo sapien
gactttgtatttacactttcctcag

SEQ ID NO: 504745 - DNA, 25 bp, Homo sapien
actttcctcagatagtctgttgtca

SEQ ID NO: 504746 - DNA, 25 bp, Homo sapien
tatccctggccaaggaagtatgcaa

SEQ ID NO: 504747 - DNA, 25 bp, Homo sapien
tttgaagtttaggtgatctcttcct

SEQ ID NO: 504748 - DNA, 25 bp, Homo sapien
ggagccattttacaagcagcaccat

SEQ ID NO: 504749 - DNA, 25 bp, Homo sapien
acaagcagcaccatgggtgttatgg

SEQ ID NO: 504750 - DNA, 25 bp, Homo sapien
gggattttattacatttgttctgct

SEQ ID NO: 504751 - DNA, 25 bp, Homo sapien
tacatttgttctgctcttaagagtt

SEQ ID NO: 504752 - DNA, 25 bp, Homo sapien
ctgctcttaagagttgaaagtcttt

SEQ ID NO: 504753 - DNA, 25 bp, Homo sapien
aatgtgtaagtctgtcgtttgttct

SEQ ID NO: 504754 - DNA, 25 bp, Homo sapien
gtcgtttgttcttgacttctgtcat

SEQ ID NO: 504755 - DNA, 25 bp, Homo sapien
cttgacttctgtcatgttttcaaga

SEQ ID NO: 504756 - DNA, 25 bp, Homo sapien
gtaaagtagttgtctagactctagt

SEQ ID NO: 504757 - DNA, 25 bp, Homo sapien
taatctcagttcatcaacgaatcgg

SEQ ID NO: 504758 - DNA, 25 bp, Homo sapien
ctcagttcatcaacgaatcggtata

SEQ ID NO: 504759 - DNA, 25 bp, Homo sapien
tattgggaaccaaaaggtctcacct

SEQ ID NO: 504760 - DNA, 25 bp, Homo sapien
tattaatgaccacagagactctcct

SEQ ID NO: 504761 - DNA, 25 bp, Homo sapien
gagactctcctaaagcaattctgga

SEQ ID NO: 504762 - DNA, 25 bp, Homo sapien
gaagtcaaaacagctggagtctagt

SEQ ID NO: 504763 - DNA, 25 bp, Homo sapien
agtctagtttaatgggaaccctcat

SEQ ID NO: 504764 - DNA, 25 bp, Homo sapien
gggaaccctcattaattagacaaga

SEQ ID NO: 504765 - DNA, 25 bp, Homo sapien
aaggctatgaccacagcagctggta

SEQ ID NO: 504766 - DNA, 25 bp, Homo sapien
agcagccctgcagtgaagtagactc

SEQ ID NO: 504767 - DNA, 25 bp, Homo sapien
gggcacatcatcatttgaacttgta

SEQ ID NO: 504768 - DNA, 25 bp, Homo sapien
gaacttgtacacctgactgtgggca

SEQ ID NO: 504769 - DNA, 25 bp, Homo sapien
gactgtgggcaaagacctgtattta

SEQ ID NO: 504770 - DNA, 25 bp, Homo sapien
aattattctgggagctatgggtcaa

SEQ ID NO: 504771 - DNA, 25 bp, Homo sapien
attctgggagctatgggtcaaagtt

SEQ ID NO: 504772 - DNA, 25 bp, Homo sapien
gggtcaaagttgataggcacaaaca

SEQ ID NO: 504773 - DNA, 25 bp, Homo sapien
tcaatccaactttagattttcaagc

SEQ ID NO: 504774 - DNA, 25 bp, Homo sapien
gaagttagaaattgttattgccaga

SEQ ID NO: 504775 - DNA, 25 bp, Homo sapien
gaaattgttattgccagaaaatagc

SEQ ID NO: 504776 - DNA, 25 bp, Homo sapien
gaattagaggacagtggcctaccct

SEQ ID NO: 504777 - DNA, 25 bp, Homo sapien
ttagaggacagtggcctaccctaaa

SEQ ID NO: 504778 - DNA, 25 bp, Homo sapien
gaggacagtggcctaccctaaataa

SEQ ID NO: 504779 - DNA, 25 bp, Homo sapien
gacagtggcctaccctaaataaaga

SEQ ID NO: 504780 - DNA, 25 bp, Homo sapien
gtggcctaccctaaataaagacatg

SEQ ID NO: 504781 - DNA, 25 bp, Homo sapien
taattacctttggatacctgaaatt

SEQ ID NO: 504782 - DNA, 25 bp, Homo sapien
gatacctgaaattcccaagcttggt

SEQ ID NO: 504783 - DNA, 25 bp, Homo sapien
tcccaagcttggttacaatgtaatg

SEQ ID NO: 504784 - DNA, 25 bp, Homo sapien
gtaatgctcagtataaggctgtgca

SEQ ID NO: 504785 - DNA, 25 bp, Homo sapien
gaataatggtggtcgatgggatata

SEQ ID NO: 504786 - DNA, 25 bp, Homo sapien
aaatgggatctagagggcttcgagt

SEQ ID NO: 504787 - DNA, 25 bp, Homo sapien
aagccaatcatgttgaacgaacact

SEQ ID NO: 504788 - DNA, 25 bp, Homo sapien
tagagtgaggcgtatgcagtcataa

SEQ ID NO: 504789 - DNA, 25 bp, Homo sapien
gaagggtggacaggagattacattt

SEQ ID NO: 504790 - DNA, 25 bp, Homo sapien
ggataagcactcagacttggtctct

SEQ ID NO: 504791 - DNA, 25 bp, Homo sapien
gcactcagacttggtctcttttaaa

SEQ ID NO: 504792 - DNA, 25 bp, Homo sapien
gaaagctcactgtaaatttgtagga

SEQ ID NO: 504793 - DNA, 25 bp, Homo sapien
gattcagcagtctctaattgtgcca

SEQ ID NO: 504794 - DNA, 25 bp, Homo sapien
gattagattgccattgctacccatg

SEQ ID NO: 504795 - DNA, 25 bp, Homo sapien
gctacccatgggagctgctacttaa

SEQ ID NO: 504796 - DNA, 25 bp, Homo sapien
tgctacttaattattcccacctcaa

SEQ ID NO: 504797 - DNA, 25 bp, Homo sapien
aaattcccagctctcaagttagcac

SEQ ID NO: 504798 - DNA, 25 bp, Homo sapien
aagttagcactactcctttgcaatt

SEQ ID NO: 504799 - DNA, 25 bp, Homo sapien
tactcctttgcaatttactccttct

SEQ ID NO: 504800 - DNA, 25 bp, Homo sapien
tactccttctctgctcgtataaata

SEQ ID NO: 504801 - DNA, 25 bp, Homo sapien
gttggtggccactatacctttgaag

SEQ ID NO: 504802 - DNA, 25 bp, Homo sapien
tttgaagaggttgcccacttctaca

SEQ ID NO: 504803 - DNA, 25 bp, Homo sapien
aattctaattcctcaggtttggcct

SEQ ID NO: 504804 - DNA, 25 bp, Homo sapien
tctaattcctcaggtttggcctttt

SEQ ID NO: 504805 - DNA, 25 bp, Homo sapien
ctcaggtttggccttttaagttatg

SEQ ID NO: 504806 - DNA, 25 bp, Homo sapien
taagttatggctgaagacctttaat

SEQ ID NO: 504807 - DNA, 25 bp, Homo sapien
actcagtgccatacaatagtgtttt

SEQ ID NO: 504808 - DNA, 25 bp, Homo sapien
tccttagaaacaagacaaagccttt

SEQ ID NO: 504809 - DNA, 25 bp, Homo sapien
tagggtattcaaagtggagtaacgt

SEQ ID NO: 504810 - DNA, 25 bp, Homo sapien
ggtttacaggttatctgaatctaca

SEQ ID NO: 504811 - DNA, 25 bp, Homo sapien
ttatctggacatgattttgctatgc

SEQ ID NO: 504812 - DNA, 25 bp, Homo sapien
ctggacatgattttgctatgcagtt

SEQ ID NO: 504813 - DNA, 25 bp, Homo sapien
gattttgctatgcagttgtgataat

SEQ ID NO: 504814 - DNA, 25 bp, Homo sapien
taaaatccagcttagatgtaatata

SEQ ID NO: 504815 - DNA, 25 bp, Homo sapien
aatccagcttagatgtaatataagt

SEQ ID NO: 504816 - DNA, 25 bp, Homo sapien
gtaatataagtaggccaagtgtggt

SEQ ID NO: 504817 - DNA, 25 bp, Homo sapien
gttagttatagagttgtctttgcag

SEQ ID NO: 504818 - DNA, 25 bp, Homo sapien
agttatagagttgtctttgcaggaa

SEQ ID NO: 504819 - DNA, 25 bp, Homo sapien
ttatagagttgtctttgcaggaaaa

SEQ ID NO: 504820 - DNA, 25 bp, Homo sapien
taaagttcagtgagtcaagtgggcc

SEQ ID NO: 504821 - DNA, 25 bp, Homo sapien
gtataagctaagaaactggcaacag

SEQ ID NO: 504822 - DNA, 25 bp, Homo sapien
ataagctaagaaactggcaacagca

SEQ ID NO: 504823 - DNA, 25 bp, Homo sapien
tggcaacagcagtgtatacacatgt

SEQ ID NO: 504824 - DNA, 25 bp, Homo sapien
ggcaacagcagtgtatacacatgta

SEQ ID NO: 504825 - DNA, 25 bp, Homo sapien
tcatagccttcctagcaactcttag

SEQ ID NO: 504826 - DNA, 25 bp, Homo sapien
aactcttaggcctgcgtgctgtgtt

SEQ ID NO: 504827 - DNA, 25 bp, Homo sapien
ctgcgtgctgtgttttcatgatctc

SEQ ID NO: 504828 - DNA, 25 bp, Homo sapien
aagcggcactttgatgttttttcag

SEQ ID NO: 504829 - DNA, 25 bp, Homo sapien
ctgaccgtcctcagttttgtgaagc

SEQ ID NO: 504830 - DNA, 25 bp, Homo sapien
agtatcactgtggatatttatccca

SEQ ID NO: 504831 - DNA, 25 bp, Homo sapien
aaatgttatgtcttttgataccaaa

SEQ ID NO: 504832 - DNA, 25 bp, Homo sapien
aatcaaaaacgattcttggtggctg

SEQ ID NO: 504833 - DNA, 25 bp, Homo sapien
tttgtgaagcaacagcctctgtgcc

SEQ ID NO: 504834 - DNA, 25 bp, Homo sapien
tgcatgctctgttgacggtctagtc

SEQ ID NO: 504835 - DNA, 25 bp, Homo sapien
tagtcttgagagagaacctgctgct

SEQ ID NO: 504836 - DNA, 25 bp, Homo sapien
attttctgcagtttacaatacaata

SEQ ID NO: 504837 - DNA, 25 bp, Homo sapien
gtttacaatacaataactctttgag

SEQ ID NO: 504838 - DNA, 25 bp, Homo sapien
ttctctatagccttttttgactggg

SEQ ID NO: 504839 - DNA, 25 bp, Homo sapien
gttaattagtacactttgttcttgt

SEQ ID NO: 504840 - DNA, 25 bp, Homo sapien
cactttgttcttgtactagctatgt

SEQ ID NO: 504841 - DNA, 25 bp, Homo sapien
gttcttgtactagctatgtttctat

SEQ ID NO: 504842 - DNA, 25 bp, Homo sapien
gtttctataagatatggtgccctgt

SEQ ID NO: 504843 - DNA, 25 bp, Homo sapien
agatatggtgccctgtgtatcccag

SEQ ID NO: 504844 - DNA, 25 bp, Homo sapien
tatggtgccctgtgtatcccagaga

SEQ ID NO: 504845 - DNA, 25 bp, Homo sapien
tgccctgtgtatcccagagatgcta

SEQ ID NO: 504846 - DNA, 25 bp, Homo sapien
tgtatcccagagatgctagaaaact

SEQ ID NO: 504847 - DNA, 25 bp, Homo sapien
tggcatggcgtctgtctcaggaaaa

SEQ ID NO: 504848 - DNA, 25 bp, Homo sapien
gaaattccatggcaacagtcccaac

SEQ ID NO: 504849 - DNA, 25 bp, Homo sapien
ggcaacagtcccaacatgtttgaga

SEQ ID NO: 504850 - DNA, 25 bp, Homo sapien
ccaacatgtttgagacttcagctaa

SEQ ID NO: 504851 - DNA, 25 bp, Homo sapien
cagtatatcactgtatttccgtaat

SEQ ID NO: 504852 - DNA, 25 bp, Homo sapien
ggagttgctcattacgttcttgaaa

SEQ ID NO: 504853 - DNA, 25 bp, Homo sapien
gttcttgaaatatcgcacatcctgt

SEQ ID NO: 504854 - DNA, 25 bp, Homo sapien
cgcacatcctgttggttcttcaaag

SEQ ID NO: 504855 - DNA, 25 bp, Homo sapien
ggaagcctttccaccagattagtgt

SEQ ID NO: 504856 - DNA, 25 bp, Homo sapien
agattagtgttcaagtctttgcaga

SEQ ID NO: 504857 - DNA, 25 bp, Homo sapien
gtctttgcagaggagaccaactttt

SEQ ID NO: 504858 - DNA, 25 bp, Homo sapien
aatgtgtatcatgagcaccttacaa

SEQ ID NO: 504859 - DNA, 25 bp, Homo sapien
tcatgagcaccttacaaatttttaa

SEQ ID NO: 504860 - DNA, 25 bp, Homo sapien
aaaggtctctcaaatttatcagtaa

SEQ ID NO: 504861 - DNA, 25 bp, Homo sapien
acatatacagtctaacgttaatgag

SEQ ID NO: 504862 - DNA, 25 bp, Homo sapien
aagatattttggtgggcagtttgct

SEQ ID NO: 504863 - DNA, 25 bp, Homo sapien
ttggtgggcagtttgctttaaataa

SEQ ID NO: 504864 - DNA, 25 bp, Homo sapien
aatgggatcatgtacgttctctgca

SEQ ID NO: 504865 - DNA, 25 bp, Homo sapien
tacgttctctgcatctcacatttct

SEQ ID NO: 504866 - DNA, 25 bp, Homo sapien
aacaatgtaggatgagaatttctct

SEQ ID NO: 504867 - DNA, 25 bp, Homo sapien
gtgtatacccagttattacatatgg

SEQ ID NO: 504868 - DNA, 25 bp, Homo sapien
gggttttattctacatattatactg

SEQ ID NO: 504869 - DNA, 25 bp, Homo sapien
tttccatattaattaccccaatctt

SEQ ID NO: 504870 - DNA, 25 bp, Homo sapien
gtaaattttcctgtgtgtctagtca

SEQ ID NO: 504871 - DNA, 25 bp, Homo sapien
tttcctgtgtgtctagtcaagcaac

SEQ ID NO: 504872 - DNA, 25 bp, Homo sapien
tgtctagtcaagcaacacaaacaag

SEQ ID NO: 504873 - DNA, 25 bp, Homo sapien
aaagcgtaatatctggagtgttcta

SEQ ID NO: 504874 - DNA, 25 bp, Homo sapien
ggagtgttctatttcatggaccaaa

SEQ ID NO: 504875 - DNA, 25 bp, Homo sapien
tttcatggaccaaacagaacggaag

SEQ ID NO: 504876 - DNA, 25 bp, Homo sapien
gaacggaagagaactttgtgtttgt

SEQ ID NO: 504877 - DNA, 25 bp, Homo sapien
ttcctgttcaggatggctagggcga

SEQ ID NO: 504878 - DNA, 25 bp, Homo sapien
cctttgtgccaacctcttttgttct

SEQ ID NO: 504879 - DNA, 25 bp, Homo sapien
gaagggatacagattctcagtaact

SEQ ID NO: 504880 - DNA, 25 bp, Homo sapien
tacaggcatgagtttttccaataga

SEQ ID NO: 504881 - DNA, 25 bp, Homo sapien
attcttctaaacaccatcttgcagc

SEQ ID NO: 504882 - DNA, 25 bp, Homo sapien
ctaaacaccatcttgcagcaactga

SEQ ID NO: 504883 - DNA, 25 bp, Homo sapien
tactgatattatccttgttctatgg

SEQ ID NO: 504884 - DNA, 25 bp, Homo sapien
gtagtttgtctaagtttacattatc

SEQ ID NO: 504885 - DNA, 25 bp, Homo sapien
atcagtgagcaattgagccagattt

SEQ ID NO: 504886 - DNA, 25 bp, Homo sapien
gtgtctggtatctaatctgtgtaaa

SEQ ID NO: 504887 - DNA, 25 bp, Homo sapien
aaataagtgttactgggctggacca

SEQ ID NO: 504888 - DNA, 25 bp, Homo sapien
tactgggctggaccaaacaattttg

SEQ ID NO: 504889 - DNA, 25 bp, Homo sapien
aacaattttgaggtagtcacaattc

SEQ ID NO: 504890 - DNA, 25 bp, Homo sapien
agtcacaattcagtgttaggattac

SEQ ID NO: 504891 - DNA, 25 bp, Homo sapien
cacccttcaggaagtggacgtttcg

SEQ ID NO: 504892 - DNA, 25 bp, Homo sapien
aagtggacgtttcgttatcttctga

SEQ ID NO: 504893 - DNA, 25 bp, Homo sapien
gacgtttcgttatcttctgatcctt

SEQ ID NO: 504894 - DNA, 25 bp, Homo sapien
cgtttcgttatcttctgatccttgc

SEQ ID NO: 504895 - DNA, 25 bp, Homo sapien
ttatcttctgatccttgcaccttct

SEQ ID NO: 504896 - DNA, 25 bp, Homo sapien
tctgatccttgcaccttcttttggg

SEQ ID NO: 504897 - DNA, 25 bp, Homo sapien
tctcggaaaacaaactactaagtcg

SEQ ID NO: 504898 - DNA, 25 bp, Homo sapien
acaaactactaagtcggcatccggg

SEQ ID NO: 504899 - DNA, 25 bp, Homo sapien
tcggcatccggggtaactacagtgg

SEQ ID NO: 504900 - DNA, 25 bp, Homo sapien
aactacagtggagagggtttccgcg

SEQ ID NO: 504901 - DNA, 25 bp, Homo sapien
tggagagggtttccgcggagacgcg

SEQ ID NO: 504902 - DNA, 25 bp, Homo sapien
aagtatgaaagcatcagacttctgt

SEQ ID NO: 504903 - DNA, 25 bp, Homo sapien
gtttgatggcttacagcaaccagta

SEQ ID NO: 504904 - DNA, 25 bp, Homo sapien
gcaaccagtactcaacaagcagctg

SEQ ID NO: 504905 - DNA, 25 bp, Homo sapien
ggacattgtgatacaggaactgttt

SEQ ID NO: 504906 - DNA, 25 bp, Homo sapien
ggaactgtttccagagctcaataag

SEQ ID NO: 504907 - DNA, 25 bp, Homo sapien
ggaagttacctctgtgacatcttgg

SEQ ID NO: 504908 - DNA, 25 bp, Homo sapien
catcttggatgtaaacacttggatt

SEQ ID NO: 504909 - DNA, 25 bp, Homo sapien
taacccattgaaatttctgctgtgc

SEQ ID NO: 504910 - DNA, 25 bp, Homo sapien
aaatttctgctgtgcgagggtggta

SEQ ID NO: 504911 - DNA, 25 bp, Homo sapien
atatattatgtacatcgctgtctga

SEQ ID NO: 504912 - DNA, 25 bp, Homo sapien
atcgctgtctgaaattttagttatt

SEQ ID NO: 504913 - DNA, 25 bp, Homo sapien
ctgctaaggccaaggaaatcccatt

SEQ ID NO: 504914 - DNA, 25 bp, Homo sapien
gctaaggccaaggaaatcccatttt

SEQ ID NO: 504915 - DNA, 25 bp, Homo sapien
aggctttcctttgttagcttctctt

SEQ ID NO: 504916 - DNA, 25 bp, Homo sapien
tttcctttgttagcttctctttcta

SEQ ID NO: 504917 - DNA, 25 bp, Homo sapien
cctttgttagcttctctttctagta

SEQ ID NO: 504918 - DNA, 25 bp, Homo sapien
gttagcttctctttctagtagtaaa

SEQ ID NO: 504919 - DNA, 25 bp, Homo sapien
gcttctctttctagtagtaaaggta

SEQ ID NO: 504920 - DNA, 25 bp, Homo sapien
agtcagatttttcctacctagtgtt

SEQ ID NO: 504921 - DNA, 25 bp, Homo sapien
gatttttcctacctagtgttggcag

SEQ ID NO: 504922 - DNA, 25 bp, Homo sapien
ttttcctacctagtgttggcagtgg

SEQ ID NO: 504923 - DNA, 25 bp, Homo sapien
cctacctagtgttggcagtggaaca

SEQ ID NO: 504924 - DNA, 25 bp, Homo sapien
aatcaggacagtttagctatttttt

SEQ ID NO: 504925 - DNA, 25 bp, Homo sapien
atcaggacagtttagctattttttt

SEQ ID NO: 504926 - DNA, 25 bp, Homo sapien
gggatgccctaaaggtagcaggcag

SEQ ID NO: 504927 - DNA, 25 bp, Homo sapien
cagacagatttgctttaattaggag

SEQ ID NO: 504928 - DNA, 25 bp, Homo sapien
tcctcagagttacaaaaccaaaatt

SEQ ID NO: 504929 - DNA, 25 bp, Homo sapien
aggagtccactgaccatataaagag

SEQ ID NO: 504930 - DNA, 25 bp, Homo sapien
ggagtccactgaccatataaagaga

SEQ ID NO: 504931 - DNA, 25 bp, Homo sapien
gagtccactgaccatataaagagag

SEQ ID NO: 504932 - DNA, 25 bp, Homo sapien
agtccactgaccatataaagagagt

SEQ ID NO: 504933 - DNA, 25 bp, Homo sapien
gtccactgaccatataaagagagta

SEQ ID NO: 504934 - DNA, 25 bp, Homo sapien
tccactgaccatataaagagagtaa

SEQ ID NO: 504935 - DNA, 25 bp, Homo sapien
aaagcttagcttctggacctgaggg

SEQ ID NO: 504936 - DNA, 25 bp, Homo sapien
gacctgagggtctgtgaacctgcaa

SEQ ID NO: 504937 - DNA, 25 bp, Homo sapien
agggtctgtgaacctgcaacatcag

SEQ ID NO: 504938 - DNA, 25 bp, Homo sapien
gaacctgcaacatcagtgtcatctg

SEQ ID NO: 504939 - DNA, 25 bp, Homo sapien
atcagtgtcatctgggagctcatta

SEQ ID NO: 504940 - DNA, 25 bp, Homo sapien
ggcactggaccagtatctgtatttc

SEQ ID NO: 504941 - DNA, 25 bp, Homo sapien
gggtgtatgtgcttattatagctca

SEQ ID NO: 504942 - DNA, 25 bp, Homo sapien
atgtgcttattatagctcatgtcta

SEQ ID NO: 504943 - DNA, 25 bp, Homo sapien
tatcaggacacatctctgaagattt

SEQ ID NO: 504944 - DNA, 25 bp, Homo sapien
gacaatctgtggtggaggttttgaa

SEQ ID NO: 504945 - DNA, 25 bp, Homo sapien
aggttttgaattcttgtcggcaagc

SEQ ID NO: 504946 - DNA, 25 bp, Homo sapien
tttccttgaaatgctcttctgaaaa

SEQ ID NO: 504947 - DNA, 25 bp, Homo sapien
tactaaaacagtagaaccctcagtt

SEQ ID NO: 504948 - DNA, 25 bp, Homo sapien
aacagtagaaccctcagttagccag

SEQ ID NO: 504949 - DNA, 25 bp, Homo sapien
tagaaccctcagttagccaggcagt

SEQ ID NO: 504950 - DNA, 25 bp, Homo sapien
ccctcagttagccaggcagtcatca

SEQ ID NO: 504951 - DNA, 25 bp, Homo sapien
gaaatgctcttctgaaaatgataaa

SEQ ID NO: 504952 - DNA, 25 bp, Homo sapien
tctgtcacataaaaggtgtcctgag

SEQ ID NO: 504953 - DNA, 25 bp, Homo sapien
gctaaaactgattacaatgctattg

SEQ ID NO: 504954 - DNA, 25 bp, Homo sapien
ggatgagcaagttgatctgctgaga

SEQ ID NO: 504955 - DNA, 25 bp, Homo sapien
gcaagttgatctgctgagatgtgaa

SEQ ID NO: 504956 - DNA, 25 bp, Homo sapien
gatctgctgagatgtgaaaacaaat

SEQ ID NO: 504957 - DNA, 25 bp, Homo sapien
agcgggctcgagtgctacgcctgta

SEQ ID NO: 504958 - DNA, 25 bp, Homo sapien
ggctcgagtgctacgcctgtatcgg

SEQ ID NO: 504959 - DNA, 25 bp, Homo sapien
gggtccaccaggatgactgcgctat

SEQ ID NO: 504960 - DNA, 25 bp, Homo sapien
atgactgcgctatcggcaggtcccg

SEQ ID NO: 504961 - DNA, 25 bp, Homo sapien
gcaggtcccgacgagtccagtgtca

SEQ ID NO: 504962 - DNA, 25 bp, Homo sapien
gagtccagtgtcaccaggaccagac

SEQ ID NO: 504963 - DNA, 25 bp, Homo sapien
agtgtcaccaggaccagaccgcctg

SEQ ID NO: 504964 - DNA, 25 bp, Homo sapien
cagggcaatggcagaatgacagttg

SEQ ID NO: 504965 - DNA, 25 bp, Homo sapien
gacagttggcaatttctcagtccct

SEQ ID NO: 504966 - DNA, 25 bp, Homo sapien
gcaatttctcagtccctgtgtacat

SEQ ID NO: 504967 - DNA, 25 bp, Homo sapien
tcagtccctgtgtacatcagaacct

SEQ ID NO: 504968 - DNA, 25 bp, Homo sapien
ttgtgactaaagacagacattgctt

SEQ ID NO: 504969 - DNA, 25 bp, Homo sapien
gacattgcttaaacctgttccaatt

SEQ ID NO: 504970 - DNA, 25 bp, Homo sapien
ttaacttttactgtagccctttgat

SEQ ID NO: 504971 - DNA, 25 bp, Homo sapien
actgtagccctttgattccagagag

SEQ ID NO: 504972 - DNA, 25 bp, Homo sapien
aagcagtttttgcactagaaatttt

SEQ ID NO: 504973 - DNA, 25 bp, Homo sapien
gaaatttttgctgttcccaatctaa

SEQ ID NO: 504974 - DNA, 25 bp, Homo sapien
gctgttcccaatctaaacttttctg

SEQ ID NO: 504975 - DNA, 25 bp, Homo sapien
gcactttaatatcttatttatgcct

SEQ ID NO: 504976 - DNA, 25 bp, Homo sapien
tgttttgttgctccaatttttaact

SEQ ID NO: 504977 - DNA, 25 bp, Homo sapien
agatttaagaactcagcctcactag

SEQ ID NO: 504978 - DNA, 25 bp, Homo sapien
agcctcactagatcaacggaccaaa

SEQ ID NO: 504979 - DNA, 25 bp, Homo sapien
tatttagaagcctttactcagcccc

SEQ ID NO: 504980 - DNA, 25 bp, Homo sapien
gttctgtgctaggagcttgagctct

SEQ ID NO: 504981 - DNA, 25 bp, Homo sapien
gagcttgagctctacaggtaaggca

SEQ ID NO: 504982 - DNA, 25 bp, Homo sapien
aaggcagagctaccggtgaatgaaa

SEQ ID NO: 504983 - DNA, 25 bp, Homo sapien
aatcatggtggaaagcccctggcat

SEQ ID NO: 504984 - DNA, 25 bp, Homo sapien
aagcccctggcatcacatgtgcatg

SEQ ID NO: 504985 - DNA, 25 bp, Homo sapien
tgtgcatgctgtaggcaggacctga

SEQ ID NO: 504986 - DNA, 25 bp, Homo sapien
agctgcctccgctgcaggttcagat

SEQ ID NO: 504987 - DNA, 25 bp, Homo sapien
aggttcagatgcaccgctgcagctg

SEQ ID NO: 504988 - DNA, 25 bp, Homo sapien
gcagctgtccttcagttagttcaca

SEQ ID NO: 504989 - DNA, 25 bp, Homo sapien
cagttagttcacagggctgcaagag

SEQ ID NO: 504990 - DNA, 25 bp, Homo sapien
gatcttactggtagttgtctctagt

SEQ ID NO: 504991 - DNA, 25 bp, Homo sapien
aagtaaattaatgatggaccatccc

SEQ ID NO: 504992 - DNA, 25 bp, Homo sapien
ctacttgttagtcattagagagaac

SEQ ID NO: 504993 - DNA, 25 bp, Homo sapien
aacaaggctgaaggcttttaaccat

SEQ ID NO: 504994 - DNA, 25 bp, Homo sapien
attcatatagcataacctgaggttg

SEQ ID NO: 504995 - DNA, 25 bp, Homo sapien
aacctgaggttggagaggaccactt

SEQ ID NO: 504996 - DNA, 25 bp, Homo sapien
aggaccacttgggagcctgtaacca

SEQ ID NO: 504997 - DNA, 25 bp, Homo sapien
gggagcctgtaaccaaaactagaag

SEQ ID NO: 504998 - DNA, 25 bp, Homo sapien
aagttggtatcattaacagggcaat

SEQ ID NO: 504999 - DNA, 25 bp, Homo sapien
aatgacttgacccttctttcaactg

SEQ ID NO: 505000 - DNA, 25 bp, Homo sapien
tgacccttctttcaactgatcttac

SEQ ID NO: 505001 - DNA, 25 bp, Homo sapien
atctgaaccccgctaaaggcagctg

SEQ ID NO: 505002 - DNA, 25 bp, Homo sapien
tgaaccccgctaaaggcagctgttt

SEQ ID NO: 505003 - DNA, 25 bp, Homo sapien
aaccccgctaaaggcagctgtttca

SEQ ID NO: 505004 - DNA, 25 bp, Homo sapien
ccgctaaaggcagctgtttcacagt

SEQ ID NO: 505005 - DNA, 25 bp, Homo sapien
agacccttttgcacaactctcttta

SEQ ID NO: 505006 - DNA, 25 bp, Homo sapien
cccttttgcacaactctctttaagt

SEQ ID NO: 505007 - DNA, 25 bp, Homo sapien
gcacaactctctttaagtttccttt

SEQ ID NO: 505008 - DNA, 25 bp, Homo sapien
gctaaaggcagctgtttcacagtct

SEQ ID NO: 505009 - DNA, 25 bp, Homo sapien
aaaggcagctgtttcacagtctgtc

SEQ ID NO: 505010 - DNA, 25 bp, Homo sapien
aggcagctgtttcacagtctgtctc

SEQ ID NO: 505011 - DNA, 25 bp, Homo sapien
cagctgtttcacagtctgtctccct

SEQ ID NO: 505012 - DNA, 25 bp, Homo sapien
gaagactatcatatcacaccattat

SEQ ID NO: 505013 - DNA, 25 bp, Homo sapien
attccaactagtgaacattatgttt

SEQ ID NO: 505014 - DNA, 25 bp, Homo sapien
tgttttagatgggtagtactagcta

SEQ ID NO: 505015 - DNA, 25 bp, Homo sapien
gaaacccaagctaagcatggacata

SEQ ID NO: 505016 - DNA, 25 bp, Homo sapien
atattgaagagaatgtcagcaccat

SEQ ID NO: 505017 - DNA, 25 bp, Homo sapien
cacatgtgatgactgaggttaattc

SEQ ID NO: 505018 - DNA, 25 bp, Homo sapien
gaggttaattcagtctgtcaattac

SEQ ID NO: 505019 - DNA, 25 bp, Homo sapien
tataattgccttcttgtaaccctaa

SEQ ID NO: 505020 - DNA, 25 bp, Homo sapien
tgccttcttgtaaccctaagtatgg

SEQ ID NO: 505021 - DNA, 25 bp, Homo sapien
aagtctttcatctgttttcctatgg

SEQ ID NO: 505022 - DNA, 25 bp, Homo sapien
ctttcatctgttttcctatggaata

SEQ ID NO: 505023 - DNA, 25 bp, Homo sapien
gggtagatgatctgcctttcaggtt

SEQ ID NO: 505024 - DNA, 25 bp, Homo sapien
tagatgatctgcctttcaggttatc

SEQ ID NO: 505025 - DNA, 25 bp, Homo sapien
cagtcttttctgagttcatctcttc

SEQ ID NO: 505026 - DNA, 25 bp, Homo sapien
atttcttccatcttctgatagcaat

SEQ ID NO: 505027 - DNA, 25 bp, Homo sapien
tagcaatttcctgaatgcctgccag

SEQ ID NO: 505028 - DNA, 25 bp, Homo sapien
gaatgcctgccagctaaccattaag

SEQ ID NO: 505029 - DNA, 25 bp, Homo sapien
gccagctaaccattaagccagtgtt

SEQ ID NO: 505030 - DNA, 25 bp, Homo sapien
aagccagtgttcagtattttagcat

SEQ ID NO: 505031 - DNA, 25 bp, Homo sapien
aagggaccaatttctgtgtcagcat

SEQ ID NO: 505032 - DNA, 25 bp, Homo sapien
ttctgtgtcagcatgggctagcttg

SEQ ID NO: 505033 - DNA, 25 bp, Homo sapien
tcatctcttctgtacgttttgtcaa

SEQ ID NO: 505034 - DNA, 25 bp, Homo sapien
gctagttgcattatactgggtcatg

SEQ ID NO: 505035 - DNA, 25 bp, Homo sapien
aagaaaatgttattgtggatcccac

SEQ ID NO: 505036 - DNA, 25 bp, Homo sapien
tgtggatcccacagtactatattac

SEQ ID NO: 505037 - DNA, 25 bp, Homo sapien
ggatcccacagtactatattacact

SEQ ID NO: 505038 - DNA, 25 bp, Homo sapien
gcattatactgggtcatgaaaaatt

SEQ ID NO: 505039 - DNA, 25 bp, Homo sapien
aaagcaaacctcaaacattattggg

SEQ ID NO: 505040 - DNA, 25 bp, Homo sapien
attgggtatcaattaccacctggtt

SEQ ID NO: 505041 - DNA, 25 bp, Homo sapien
gtatcaattaccacctggttgtatt

SEQ ID NO: 505042 - DNA, 25 bp, Homo sapien
aatagtaacttatcaatgccatgta

SEQ ID NO: 505043 - DNA, 25 bp, Homo sapien
ttaaataacttgtggaatctttcct

SEQ ID NO: 505044 - DNA, 25 bp, Homo sapien
taacttgtggaatctttcctaatga

SEQ ID NO: 505045 - DNA, 25 bp, Homo sapien
atgatccaagtaaggactcctggga

SEQ ID NO: 505046 - DNA, 25 bp, Homo sapien
gagatggttgcatccatggcagata

SEQ ID NO: 505047 - DNA, 25 bp, Homo sapien
aaggattcactttggcgtgggtgtc

SEQ ID NO: 505048 - DNA, 25 bp, Homo sapien
cgtgggtgtcatgctaggctttatt

SEQ ID NO: 505049 - DNA, 25 bp, Homo sapien
gagtctcacatttgtccagcattga

SEQ ID NO: 505050 - DNA, 25 bp, Homo sapien
gatacgatcctcatcaaaatcagtg

SEQ ID NO: 505051 - DNA, 25 bp, Homo sapien
atcagtggactgtgtgtagaccaat

SEQ ID NO: 505052 - DNA, 25 bp, Homo sapien
ttggtgctgctgtaatcgataacta

SEQ ID NO: 505053 - DNA, 25 bp, Homo sapien
gataactacctttatgtcgtcggtg

SEQ ID NO: 505054 - DNA, 25 bp, Homo sapien
atgtcgtcggtggtcactcagggtc

SEQ ID NO: 505055 - DNA, 25 bp, Homo sapien
cagggtcttcctatctgaatacagt

SEQ ID NO: 505056 - DNA, 25 bp, Homo sapien
accctgaatcttactgagtccctct

SEQ ID NO: 505057 - DNA, 25 bp, Homo sapien
gaatcttactgagtccctctgggca

SEQ ID NO: 505058 - DNA, 25 bp, Homo sapien
cttactgagtccctctgggcagcag

SEQ ID NO: 505059 - DNA, 25 bp, Homo sapien
cgtcccaaatgtggcctcagcttgt

SEQ ID NO: 505060 - DNA, 25 bp, Homo sapien
cttccccaaactatgcattcattca

SEQ ID NO: 505061 - DNA, 25 bp, Homo sapien
taaatgagcctttgctgtatgccag

SEQ ID NO: 505062 - DNA, 25 bp, Homo sapien
aatgagcctttgctgtatgccagac

SEQ ID NO: 505063 - DNA, 25 bp, Homo sapien
tgccagacccagttctaggctcttg

SEQ ID NO: 505064 - DNA, 25 bp, Homo sapien
tctaggctcttgcagccctggtaga

SEQ ID NO: 505065 - DNA, 25 bp, Homo sapien
tcccgctttcccagagggtcacttg

SEQ ID NO: 505066 - DNA, 25 bp, Homo sapien
tttcccagagggtcacttggcaggg

SEQ ID NO: 505067 - DNA, 25 bp, Homo sapien
ccggactcgcaacgccgagcttggg

SEQ ID NO: 505068 - DNA, 25 bp, Homo sapien
ggcatccgatccttggccgggccct

SEQ ID NO: 505069 - DNA, 25 bp, Homo sapien
ggagggccgggacgcgcagccgccg

SEQ ID NO: 505070 - DNA, 25 bp, Homo sapien
gccgccgagcgtgaccaagtttgga

SEQ ID NO: 505071 - DNA, 25 bp, Homo sapien
ccgccgagcgtgaccaagtttggaa

SEQ ID NO: 505072 - DNA, 25 bp, Homo sapien
gccgagcgtgaccaagtttggaaac

SEQ ID NO: 505073 - DNA, 25 bp, Homo sapien
tgaccaagtttggaaacgcgcgcgg

SEQ ID NO: 505074 - DNA, 25 bp, Homo sapien
ctccgtggccccaagatcacaaggg

SEQ ID NO: 505075 - DNA, 25 bp, Homo sapien
gtggccccaagatcacaagggcgta

SEQ ID NO: 505076 - DNA, 25 bp, Homo sapien
ccaagatcacaagggcgtagcgaag

SEQ ID NO: 505077 - DNA, 25 bp, Homo sapien
tagcgaaggcgagccggcgatcgca

SEQ ID NO: 505078 - DNA, 25 bp, Homo sapien
attacttttatactcgtgttaacat

SEQ ID NO: 505079 - DNA, 25 bp, Homo sapien
aacattttcatctgtgccttttggt

SEQ ID NO: 505080 - DNA, 25 bp, Homo sapien
tcatctgtgccttttggtaatttaa

SEQ ID NO: 505081 - DNA, 25 bp, Homo sapien
atttctattatgaatttctggtgcc

SEQ ID NO: 505082 - DNA, 25 bp, Homo sapien
atttctggtgcctatgagctagcta

SEQ ID NO: 505083 - DNA, 25 bp, Homo sapien
gagctagctatcacctacctgaaag

SEQ ID NO: 505084 - DNA, 25 bp, Homo sapien
gcttagaggtgaaggtactgtttct

SEQ ID NO: 505085 - DNA, 25 bp, Homo sapien
tgtttctaaaaacacatcactgtga

SEQ ID NO: 505086 - DNA, 25 bp, Homo sapien
atcactgtgatacctttctatcctc

SEQ ID NO: 505087 - DNA, 25 bp, Homo sapien
tgtgatacctttctatcctcacatt

SEQ ID NO: 505088 - DNA, 25 bp, Homo sapien
acattttcaagcttgcctcttttct

SEQ ID NO: 505089 - DNA, 25 bp, Homo sapien
tgggcttcccttatatctcaggaga

SEQ ID NO: 505090 - DNA, 25 bp, Homo sapien
atatctcaggagattgccctataaa

SEQ ID NO: 505091 - DNA, 25 bp, Homo sapien
taagctggtaattttcacacaaaga

SEQ ID NO: 505092 - DNA, 25 bp, Homo sapien
aaaatacgttccgtcgtcacagact

SEQ ID NO: 505093 - DNA, 25 bp, Homo sapien
agactctactcctaaacttagctaa

SEQ ID NO: 505094 - DNA, 25 bp, Homo sapien
agctaactaactatcttgcaaatgc

SEQ ID NO: 505095 - DNA, 25 bp, Homo sapien
aactatcttgcaaatgcctgcagtt

SEQ ID NO: 505096 - DNA, 25 bp, Homo sapien
gcagctttaggatggcagttagtga

SEQ ID NO: 505097 - DNA, 25 bp, Homo sapien
cagttagtgactgccctggaacagg

SEQ ID NO: 505098 - DNA, 25 bp, Homo sapien
gtgactgccctggaacaggattaaa

SEQ ID NO: 505099 - DNA, 25 bp, Homo sapien
ttaaaggaggctgtgtcaggttcag

SEQ ID NO: 505100 - DNA, 25 bp, Homo sapien
ttttgataaatcctgacattgacct

SEQ ID NO: 505101 - DNA, 25 bp, Homo sapien
gataaatcctgacattgacctaatt

SEQ ID NO: 505102 - DNA, 25 bp, Homo sapien
aatcctgacattgacctaattgaca

SEQ ID NO: 505103 - DNA, 25 bp, Homo sapien
tcctgacattgacctaattgacata

SEQ ID NO: 505104 - DNA, 25 bp, Homo sapien
gacattgacctaattgacataggta

SEQ ID NO: 505105 - DNA, 25 bp, Homo sapien
tatgtttgtatatgtgctaataatt

SEQ ID NO: 505106 - DNA, 25 bp, Homo sapien
taattttctaatttcggaacacgat

SEQ ID NO: 505107 - DNA, 25 bp, Homo sapien
tctaatttcggaacacgatgatgtt

SEQ ID NO: 505108 - DNA, 25 bp, Homo sapien
ttcggaacacgatgatgttatgact

SEQ ID NO: 505109 - DNA, 25 bp, Homo sapien
acacgatgatgttatgactattgat

SEQ ID NO: 505110 - DNA, 25 bp, Homo sapien
gatgatgttatgactattgatttaa

SEQ ID NO: 505111 - DNA, 25 bp, Homo sapien
gtgcttcactcagtctagaaaacct

SEQ ID NO: 505112 - DNA, 25 bp, Homo sapien
tagaaaacctgcttgtcatagccaa

SEQ ID NO: 505113 - DNA, 25 bp, Homo sapien
gctcctggcctccagtttagaagga

SEQ ID NO: 505114 - DNA, 25 bp, Homo sapien
tgtcctgacagttcccagcttgcag

SEQ ID NO: 505115 - DNA, 25 bp, Homo sapien
agctgctggtccacgcttatgttcg

SEQ ID NO: 505116 - DNA, 25 bp, Homo sapien
tgtgacaccctccaaggctgcaact

SEQ ID NO: 505117 - DNA, 25 bp, Homo sapien
ggctgcaactttcatccgtaatgga

SEQ ID NO: 505118 - DNA, 25 bp, Homo sapien
aatggattcgtttacacttggtcaa

SEQ ID NO: 505119 - DNA, 25 bp, Homo sapien
tacacttggtcaaggctctcgacaa

SEQ ID NO: 505120 - DNA, 25 bp, Homo sapien
aggtctctcctctaggtcaggagca

SEQ ID NO: 505121 - DNA, 25 bp, Homo sapien
aggagcatatctagggacatctgtg

SEQ ID NO: 505122 - DNA, 25 bp, Homo sapien
gcacttggttgaaaattgtacttga

SEQ ID NO: 505123 - DNA, 25 bp, Homo sapien
tgaatacatacatgcatgctgctaa

SEQ ID NO: 505124 - DNA, 25 bp, Homo sapien
atacatgcatgctgctaaactagaa

SEQ ID NO: 505125 - DNA, 25 bp, Homo sapien
catgcatgctgctaaactagaactt

SEQ ID NO: 505126 - DNA, 25 bp, Homo sapien
atgcatgctgctaaactagaacttt

SEQ ID NO: 505127 - DNA, 25 bp, Homo sapien
gcatgctgctaaactagaactttaa

SEQ ID NO: 505128 - DNA, 25 bp, Homo sapien
gctgctaaactagaactttaatttt

SEQ ID NO: 505129 - DNA, 25 bp, Homo sapien
aaataacaggtccaagttagagtga

SEQ ID NO: 505130 - DNA, 25 bp, Homo sapien
aacaggtccaagttagagtgatgtg

SEQ ID NO: 505131 - DNA, 25 bp, Homo sapien
caggtccaagttagagtgatgtgtg

SEQ ID NO: 505132 - DNA, 25 bp, Homo sapien
ccaagttagagtgatgtgtgtatat

SEQ ID NO: 505133 - DNA, 25 bp, Homo sapien
tctggctggcgaccgtgctattctg

SEQ ID NO: 505134 - DNA, 25 bp, Homo sapien
tggcgaccgtgctattctgtctgtc

SEQ ID NO: 505135 - DNA, 25 bp, Homo sapien
attctgtctgtccacctaactgtgg

SEQ ID NO: 505136 - DNA, 25 bp, Homo sapien
taactgtgggctcccagatcaccac

SEQ ID NO: 505137 - DNA, 25 bp, Homo sapien
gggtgacaggctagctgtgctccca

SEQ ID NO: 505138 - DNA, 25 bp, Homo sapien
ggctagctgtgctcccatagcagag

SEQ ID NO: 505139 - DNA, 25 bp, Homo sapien
gggaatcacatctggtgagcagcta

SEQ ID NO: 505140 - DNA, 25 bp, Homo sapien
tgagcagctatgtcgtgccaggcac

SEQ ID NO: 505141 - DNA, 25 bp, Homo sapien
ggcactgtgctgtgtattgcacaca

SEQ ID NO: 505142 - DNA, 25 bp, Homo sapien
gtattgcacacatctcaaaccttgt

SEQ ID NO: 505143 - DNA, 25 bp, Homo sapien
acatctcaaaccttgtgacaaatgt

SEQ ID NO: 505144 - DNA, 25 bp, Homo sapien
aggccagttctctgaatgtcgagga

SEQ ID NO: 505145 - DNA, 25 bp, Homo sapien
aatgtcgaggagttccaggatctct

SEQ ID NO: 505146 - DNA, 25 bp, Homo sapien
gagttccaggatctctggcctcagt

SEQ ID NO: 505147 - DNA, 25 bp, Homo sapien
gcctcagttgtccttggttattgat

SEQ ID NO: 505148 - DNA, 25 bp, Homo sapien
ccgagtgtcgccttggctcaactgt

SEQ ID NO: 505149 - DNA, 25 bp, Homo sapien
gtctgtgcccggaaagtttggcatc

SEQ ID NO: 505150 - DNA, 25 bp, Homo sapien
aagtttggcatcattcgtccaggct

SEQ ID NO: 505151 - DNA, 25 bp, Homo sapien
aggctgtgccctggaaagtactaca

SEQ ID NO: 505152 - DNA, 25 bp, Homo sapien
ggaaagtactacagccatcctccaa

SEQ ID NO: 505153 - DNA, 25 bp, Homo sapien
acagaagtacggactgctcccctca

SEQ ID NO: 505154 - DNA, 25 bp, Homo sapien
atgcgtcctacctgtgaaactctgg

SEQ ID NO: 505155 - DNA, 25 bp, Homo sapien
gagagttttgaatggcttttgttat

SEQ ID NO: 505156 - DNA, 25 bp, Homo sapien
agggatgtgcgaattcctggctcgc

SEQ ID NO: 505157 - DNA, 25 bp, Homo sapien
aatgattctctgtgtatccctttac

SEQ ID NO: 505158 - DNA, 25 bp, Homo sapien
tgtatccctttaccagccttgcatt

SEQ ID NO: 505159 - DNA, 25 bp, Homo sapien
cagccttgcattcaaactagttatg

SEQ ID NO: 505160 - DNA, 25 bp, Homo sapien
cactgaagaggatcttttcctgtta

SEQ ID NO: 505161 - DNA, 25 bp, Homo sapien
ttcctgttattgttgcagtctggtg

SEQ ID NO: 505162 - DNA, 25 bp, Homo sapien
cctggctcgctgataagttctgtga

SEQ ID NO: 505163 - DNA, 25 bp, Homo sapien
agttctgtgaccaagcatgcaatgt

SEQ ID NO: 505164 - DNA, 25 bp, Homo sapien
gcatgcaatgtcttgtcctgtgggt

SEQ ID NO: 505165 - DNA, 25 bp, Homo sapien
gcgactgtgggcaaggtatgtttac

SEQ ID NO: 505166 - DNA, 25 bp, Homo sapien
tcatagtttctagggctttctttac

SEQ ID NO: 505167 - DNA, 25 bp, Homo sapien
ttctagggctttctttacaaattct

SEQ ID NO: 505168 - DNA, 25 bp, Homo sapien
agggctttctttacaaattcttcat

SEQ ID NO: 505169 - DNA, 25 bp, Homo sapien
gctttctttacaaattcttcatctt

SEQ ID NO: 505170 - DNA, 25 bp, Homo sapien
tctttgaattcaaccacaccacaac

SEQ ID NO: 505171 - DNA, 25 bp, Homo sapien
caaccccttgattttccttccgcat

SEQ ID NO: 505172 - DNA, 25 bp, Homo sapien
ttccgcatccttaaagagctccacg

SEQ ID NO: 505173 - DNA, 25 bp, Homo sapien
atccttaaagagctccacgtatgta

SEQ ID NO: 505174 - DNA, 25 bp, Homo sapien
aagagctccacgtatgtaacctcac

SEQ ID NO: 505175 - DNA, 25 bp, Homo sapien
caactttctctctcattagatcttt

SEQ ID NO: 505176 - DNA, 25 bp, Homo sapien
ctctctcattagatctttaatagct

SEQ ID NO: 505177 - DNA, 25 bp, Homo sapien
ggagaacgccatgagcttttgagct

SEQ ID NO: 505178 - DNA, 25 bp, Homo sapien
gcttttgagcttgtgtattttgcga

SEQ ID NO: 505179 - DNA, 25 bp, Homo sapien
cttgtgtattttgcgagaggctcga

SEQ ID NO: 505180 - DNA, 25 bp, Homo sapien
gaggctcgagtgtgaacagtagact

SEQ ID NO: 505181 - DNA, 25 bp, Homo sapien
aggaagctataaaatgtgggccaag

SEQ ID NO: 505182 - DNA, 25 bp, Homo sapien
ggaatgtctgcaggaccgggtttca

SEQ ID NO: 505183 - DNA, 25 bp, Homo sapien
aggaccgggtttcagagcaccctat

SEQ ID NO: 505184 - DNA, 25 bp, Homo sapien
agagcaccctatcgtggcggataaa

SEQ ID NO: 505185 - DNA, 25 bp, Homo sapien
aaagagccactaacagcttttttct

SEQ ID NO: 505186 - DNA, 25 bp, Homo sapien
gaagggtctggcaactatgaaccta

SEQ ID NO: 505187 - DNA, 25 bp, Homo sapien
aacgtttgctattctaaggccgaga

SEQ ID NO: 505188 - DNA, 25 bp, Homo sapien
atttgcctattgaccctgcagttag

SEQ ID NO: 505189 - DNA, 25 bp, Homo sapien
tgcagttagcatgctgtcaccctga

SEQ ID NO: 505190 - DNA, 25 bp, Homo sapien
tagcatgctgtcaccctgaatcata

SEQ ID NO: 505191 - DNA, 25 bp, Homo sapien
gctgtcaccctgaatcataatcgct

SEQ ID NO: 505192 - DNA, 25 bp, Homo sapien
ctgaatcataatcgctcctttgcac

SEQ ID NO: 505193 - DNA, 25 bp, Homo sapien
taatcgctcctttgcacctctaaaa

SEQ ID NO: 505194 - DNA, 25 bp, Homo sapien
tgagcctctgcgtaaggctgaacgt

SEQ ID NO: 505195 - DNA, 25 bp, Homo sapien
aaggctgaacgtctcactgactgag

SEQ ID NO: 505196 - DNA, 25 bp, Homo sapien
gaacgtctcactgactgagctagtc

SEQ ID NO: 505197 - DNA, 25 bp, Homo sapien
gactgagctagtcttcttgttgctc

SEQ ID NO: 505198 - DNA, 25 bp, Homo sapien
agtcttcttgttgctcgggtgcatt

SEQ ID NO: 505199 - DNA, 25 bp, Homo sapien
gaattcagaactactttcctctgtg

SEQ ID NO: 505200 - DNA, 25 bp, Homo sapien
tcagaactactttcctctgtgacac

SEQ ID NO: 505201 - DNA, 25 bp, Homo sapien
tgaaaatgtttcatgttctctgctg

SEQ ID NO: 505202 - DNA, 25 bp, Homo sapien
atgttctctgctgtgaaactcttaa

SEQ ID NO: 505203 - DNA, 25 bp, Homo sapien
ctctgctgtgaaactcttaaaacaa

SEQ ID NO: 505204 - DNA, 25 bp, Homo sapien
aacaaggagtgtattttagagacaa

SEQ ID NO: 505205 - DNA, 25 bp, Homo sapien
ttgtgtctctgttgctttatataat

SEQ ID NO: 505206 - DNA, 25 bp, Homo sapien
tataatctggtttctatctgacgag

SEQ ID NO: 505207 - DNA, 25 bp, Homo sapien
ctggtttctatctgacgagtttttc

SEQ ID NO: 505208 - DNA, 25 bp, Homo sapien
ctgacgagtttttcatatctcatga

SEQ ID NO: 505209 - DNA, 25 bp, Homo sapien
ttttcatatctcatgaatggtgcgc

SEQ ID NO: 505210 - DNA, 25 bp, Homo sapien
atgttgacagtggtgtagcccttta

SEQ ID NO: 505211 - DNA, 25 bp, Homo sapien
tttaggagaaatggcgctccctgcg

SEQ ID NO: 505212 - DNA, 25 bp, Homo sapien
gctccctgcggctggtattaggtta

SEQ ID NO: 505213 - DNA, 25 bp, Homo sapien
ttaggttaccattggcaccgaagga

SEQ ID NO: 505214 - DNA, 25 bp, Homo sapien
ggaaaagatcatcgcctctatcaga

SEQ ID NO: 505215 - DNA, 25 bp, Homo sapien
atatccataatttcagagctgccct

SEQ ID NO: 505216 - DNA, 25 bp, Homo sapien
tcggaggctctcactggcaaatgac

SEQ ID NO: 505217 - DNA, 25 bp, Homo sapien
atcgcctctatcagacacttagggt

SEQ ID NO: 505218 - DNA, 25 bp, Homo sapien
agggtcctggtctggcaattttggc

SEQ ID NO: 505219 - DNA, 25 bp, Homo sapien
aattttggcctgatgtgatgccaca

SEQ ID NO: 505220 - DNA, 25 bp, Homo sapien
gtgatgccacaagacccaacagaga

SEQ ID NO: 505221 - DNA, 25 bp, Homo sapien
aatgcacagcggtattgatgagtag

SEQ ID NO: 505222 - DNA, 25 bp, Homo sapien
attgatgagtagatccttggattca

SEQ ID NO: 505223 - DNA, 25 bp, Homo sapien
agaggttggctgaaacgcaccatgc

SEQ ID NO: 505224 - DNA, 25 bp, Homo sapien
tgaaacgcaccatgcctgcttccat

SEQ ID NO: 505225 - DNA, 25 bp, Homo sapien
tgcttccatcttttgctctgtaaag

SEQ ID NO: 505226 - DNA, 25 bp, Homo sapien
aaagttgtgaattgctcatgcctat

SEQ ID NO: 505227 - DNA, 25 bp, Homo sapien
gatggcacatgggattccttctcaa

SEQ ID NO: 505228 - DNA, 25 bp, Homo sapien
tccttctcaaggcaaagttaccata

SEQ ID NO: 505229 - DNA, 25 bp, Homo sapien
cataacggtggatgagtacagctca

SEQ ID NO: 505230 - DNA, 25 bp, Homo sapien
aggcattcacgcactacaacatcaa

SEQ ID NO: 505231 - DNA, 25 bp, Homo sapien
gattccagcctccacatgtacatat

SEQ ID NO: 505232 - DNA, 25 bp, Homo sapien
tcatccccctgtttaggagctatta

SEQ ID NO: 505233 - DNA, 25 bp, Homo sapien
aatccaaaccattctttgttccatg

SEQ ID NO: 505234 - DNA, 25 bp, Homo sapien
gccaaaatcactttagagcttctca

SEQ ID NO: 505235 - DNA, 25 bp, Homo sapien
cactttagagcttctcaactattta

SEQ ID NO: 505236 - DNA, 25 bp, Homo sapien
actatttatgaagagctatcctgct

SEQ ID NO: 505237 - DNA, 25 bp, Homo sapien
cctgcttttattgaaagtcactaga

SEQ ID NO: 505238 - DNA, 25 bp, Homo sapien
aagtcactagagttgaatgtggtaa

SEQ ID NO: 505239 - DNA, 25 bp, Homo sapien
ggtaagaaaccacttagcctatgta

SEQ ID NO: 505240 - DNA, 25 bp, Homo sapien
acttagcctatgtattggacgagaa

SEQ ID NO: 505241 - DNA, 25 bp, Homo sapien
ttggacgagaaaatcagtatcatga

SEQ ID NO: 505242 - DNA, 25 bp, Homo sapien
gaattaagagaacccttgtagagtt

SEQ ID NO: 505243 - DNA, 25 bp, Homo sapien
tattctctctcttctgctgatgaaa

SEQ ID NO: 505244 - DNA, 25 bp, Homo sapien
ctcttctgctgatgaaagacctttc

SEQ ID NO: 505245 - DNA, 25 bp, Homo sapien
agacctttcatcagttcaaagcttt

SEQ ID NO: 505246 - DNA, 25 bp, Homo sapien
tcaaagcttttcttaagctcttttt

SEQ ID NO: 505247 - DNA, 25 bp, Homo sapien
atcacatagacatattacatcggct

SEQ ID NO: 505248 - DNA, 25 bp, Homo sapien
gacatattacatcggctaaagcaag

SEQ ID NO: 505249 - DNA, 25 bp, Homo sapien
ggctaaagcaagacttggcccacaa

SEQ ID NO: 505250 - DNA, 25 bp, Homo sapien
gacttggcccacaaatacctatttg

SEQ ID NO: 505251 - DNA, 25 bp, Homo sapien
aaagcaaggctgttgtagctgaagt

SEQ ID NO: 505252 - DNA, 25 bp, Homo sapien
gctgaagttacatagggaatcccaa

SEQ ID NO: 505253 - DNA, 25 bp, Homo sapien
tacatagggaatcccaaactctgcc

SEQ ID NO: 505254 - DNA, 25 bp, Homo sapien
tacaaaagtggatacaatacaatgg

SEQ ID NO: 505255 - DNA, 25 bp, Homo sapien
aaaagtggatacaatacaatggaaa

SEQ ID NO: 505256 - DNA, 25 bp, Homo sapien
ggatacaatacaatggaaaaatgca

SEQ ID NO: 505257 - DNA, 25 bp, Homo sapien
gagtacaaaaccttcaagctgagtg

SEQ ID NO: 505258 - DNA, 25 bp, Homo sapien
gtgcagaaagcaccgtcttttacta

SEQ ID NO: 505259 - DNA, 25 bp, Homo sapien
gaaagcaccgtcttttactagaaga

SEQ ID NO: 505260 - DNA, 25 bp, Homo sapien
agcaccgtcttttactagaagaaga

SEQ ID NO: 505261 - DNA, 25 bp, Homo sapien
aaatgttggtcaatgaactgactca

SEQ ID NO: 505262 - DNA, 25 bp, Homo sapien
gttggtcaatgaactgactcattcg

SEQ ID NO: 505263 - DNA, 25 bp, Homo sapien
gtcaatgaactgactcattcgaaag

SEQ ID NO: 505264 - DNA, 25 bp, Homo sapien
gaactgactcattcgaaagaaaaag

SEQ ID NO: 505265 - DNA, 25 bp, Homo sapien
cggccactcccatagtttttaattg

SEQ ID NO: 505266 - DNA, 25 bp, Homo sapien
cactcccatagtttttaattgataa

SEQ ID NO: 505267 - DNA, 25 bp, Homo sapien
aattgataacacactttgattttct

SEQ ID NO: 505268 - DNA, 25 bp, Homo sapien
ttttctaaataagcagtcatgacat

SEQ ID NO: 505269 - DNA, 25 bp, Homo sapien
taagcagtcatgacatctacacatg

SEQ ID NO: 505270 - DNA, 25 bp, Homo sapien
gacatctacacatgagtttttctct

SEQ ID NO: 505271 - DNA, 25 bp, Homo sapien
gctaaaatgtaagcctcttaatttt

SEQ ID NO: 505272 - DNA, 25 bp, Homo sapien
ttttcctgttgcattggttaggatt

SEQ ID NO: 505273 - DNA, 25 bp, Homo sapien
ggattgccaggaatattgtaataac

SEQ ID NO: 505274 - DNA, 25 bp, Homo sapien
gtaataacagcacttgttccttttt

SEQ ID NO: 505275 - DNA, 25 bp, Homo sapien
ttttattttgcagtgagaggttaga

SEQ ID NO: 505276 - DNA, 25 bp, Homo sapien
gtatcttctggaggtgttcaggatg

SEQ ID NO: 505277 - DNA, 25 bp, Homo sapien
aggtgttcaggatgtggagcttcct

SEQ ID NO: 505278 - DNA, 25 bp, Homo sapien
atatggttgtatactcaaattgtac

SEQ ID NO: 505279 - DNA, 25 bp, Homo sapien
aaattgtacatcacgtttgtcaaac

SEQ ID NO: 505280 - DNA, 25 bp, Homo sapien
gaagacattccaatactgcttaatt

SEQ ID NO: 505281 - DNA, 25 bp, Homo sapien
gcactttatttttagctgctgaact

SEQ ID NO: 505282 - DNA, 25 bp, Homo sapien
ttttagctgctgaactgccaaaaca

SEQ ID NO: 505283 - DNA, 25 bp, Homo sapien
gccaaaacagtgttgccattttcaa

SEQ ID NO: 505284 - DNA, 25 bp, Homo sapien
gttgccattttcaagggcagggaaa

SEQ ID NO: 505285 - DNA, 25 bp, Homo sapien
aaggtgtatttttgtcgtatgtgat

SEQ ID NO: 505286 - DNA, 25 bp, Homo sapien
gaatattttgctgcacatgcatcaa

SEQ ID NO: 505287 - DNA, 25 bp, Homo sapien
atgtgggtttagtaattgacctatt

SEQ ID NO: 505288 - DNA, 25 bp, Homo sapien
ttctattcagttttgtctcaaatag

SEQ ID NO: 505289 - DNA, 25 bp, Homo sapien
attgcttcactaattcatccagatt

SEQ ID NO: 505290 - DNA, 25 bp, Homo sapien
catccagattagttttaagtgtgta

SEQ ID NO: 505291 - DNA, 25 bp, Homo sapien
gtatatgtatttgctcaccagatca

SEQ ID NO: 505292 - DNA, 25 bp, Homo sapien
gtatttgctcaccagatcattttct

SEQ ID NO: 505293 - DNA, 25 bp, Homo sapien
gatcattttcttgggaccttgaact

SEQ ID NO: 505294 - DNA, 25 bp, Homo sapien
tcttgggaccttgaactgtgaatgt

SEQ ID NO: 505295 - DNA, 25 bp, Homo sapien
ctgtgaatgttttgtcctaaccatt

SEQ ID NO: 505296 - DNA, 25 bp, Homo sapien
gaacaatttaataacggccctcctg

SEQ ID NO: 505297 - DNA, 25 bp, Homo sapien
ggccctcctgttctagtttgcctaa

SEQ ID NO: 505298 - DNA, 25 bp, Homo sapien
acctatactcagatgttcacagcaa

SEQ ID NO: 505299 - DNA, 25 bp, Homo sapien
gtaacacaaatgtacatcagtggat

SEQ ID NO: 505300 - DNA, 25 bp, Homo sapien
attgtgtacaccaatactatggagg

SEQ ID NO: 505301 - DNA, 25 bp, Homo sapien
caatactatggagggctgctcagac

SEQ ID NO: 505302 - DNA, 25 bp, Homo sapien
agggctgctcagacataaagaaatg

SEQ ID NO: 505303 - DNA, 25 bp, Homo sapien
gaaatgatttattgacacttactac

SEQ ID NO: 505304 - DNA, 25 bp, Homo sapien
attgacacttactacaacatggatg

SEQ ID NO: 505305 - DNA, 25 bp, Homo sapien
atctcaaaagtgctgttgtatttta

SEQ ID NO: 505306 - DNA, 25 bp, Homo sapien
tttatcatatgactcagcaactcca

SEQ ID NO: 505307 - DNA, 25 bp, Homo sapien
ctcagcaactccacacttaggtatt

SEQ ID NO: 505308 - DNA, 25 bp, Homo sapien
cacacttaggtatttaccctagatg

SEQ ID NO: 505309 - DNA, 25 bp, Homo sapien
gtaacataatatctaccttaatcaa

SEQ ID NO: 505310 - DNA, 25 bp, Homo sapien
atatttatagtttaggccaggagcc

SEQ ID NO: 505311 - DNA, 25 bp, Homo sapien
tatagtttaggccaggagcctggca

SEQ ID NO: 505312 - DNA, 25 bp, Homo sapien
gagcctggcaaagtaaagatgacac

SEQ ID NO: 505313 - DNA, 25 bp, Homo sapien
gacacagatgtaatgcttgataagt

SEQ ID NO: 505314 - DNA, 25 bp, Homo sapien
acctgtgaagtgaatcccctgtgaa

SEQ ID NO: 505315 - DNA, 25 bp, Homo sapien
aagtgaatcccctgtgaagaaaaga

SEQ ID NO: 505316 - DNA, 25 bp, Homo sapien
ggtctctaacaatataaacctgtat

SEQ ID NO: 505317 - DNA, 25 bp, Homo sapien
aaacctgtatcaggaaaccctgtga

SEQ ID NO: 505318 - DNA, 25 bp, Homo sapien
tttatttgatgcactcagatacaaa

SEQ ID NO: 505319 - DNA, 25 bp, Homo sapien
cactcagatacaaattcatgctata

SEQ ID NO: 505320 - DNA, 25 bp, Homo sapien
gaagtcatttgataagaggccatgg

SEQ ID NO: 505321 - DNA, 25 bp, Homo sapien
aaaatagtttgttctcacccagtgt

SEQ ID NO: 505322 - DNA, 25 bp, Homo sapien
agtttgttctcacccagtgtattta

SEQ ID NO: 505323 - DNA, 25 bp, Homo sapien
gtgtatttaaatggccttctggact

SEQ ID NO: 505324 - DNA, 25 bp, Homo sapien
cttctggacttgttaattgccctca

SEQ ID NO: 505325 - DNA, 25 bp, Homo sapien
taattgccctcagccagcactttag

SEQ ID NO: 505326 - DNA, 25 bp, Homo sapien
agcactttaggacatctggttggat

SEQ ID NO: 505327 - DNA, 25 bp, Homo sapien
ggacatctggttggatggctctgat

SEQ ID NO: 505328 - DNA, 25 bp, Homo sapien
tctgaccattcattttgcctctaat

SEQ ID NO: 505329 - DNA, 25 bp, Homo sapien
attggtcagatccatgaggtctttt

SEQ ID NO: 505330 - DNA, 25 bp, Homo sapien
ctttgtgccttgtatgataggtgct

SEQ ID NO: 505331 - DNA, 25 bp, Homo sapien
ggttccacactcctctgtcatttaa

SEQ ID NO: 505332 - DNA, 25 bp, Homo sapien
ttcacacatcacctcgttctgacat

SEQ ID NO: 505333 - DNA, 25 bp, Homo sapien
ctcgttctgacatcaagggtgcgtc

SEQ ID NO: 505334 - DNA, 25 bp, Homo sapien
tcaagggtgcgtcacagccacagtg

SEQ ID NO: 505335 - DNA, 25 bp, Homo sapien
cacagtgaggcctcgcctgggcaga

SEQ ID NO: 505336 - DNA, 25 bp, Homo sapien
tcgcctgggcagagcaactctgggt

SEQ ID NO: 505337 - DNA, 25 bp, Homo sapien
gggcagagcaactctgggtgcccca

SEQ ID NO: 505338 - DNA, 25 bp, Homo sapien
gcaggcaagcctaatgggaacccga

SEQ ID NO: 505339 - DNA, 25 bp, Homo sapien
gaacccgaggcaaaaggaaacatca

SEQ ID NO: 505340 - DNA, 25 bp, Homo sapien
acatcagtaatacgaatcctgtctt

SEQ ID NO: 505341 - DNA, 25 bp, Homo sapien
aatcctgtctttaaaactgtgatgt

SEQ ID NO: 505342 - DNA, 25 bp, Homo sapien
cagcgttgtttctcctcaaaggttt

SEQ ID NO: 505343 - DNA, 25 bp, Homo sapien
tcaaaggtttgtgttcgttctcgtt

SEQ ID NO: 505344 - DNA, 25 bp, Homo sapien
cgttctcgttgttgggatgcctgta

SEQ ID NO: 505345 - DNA, 25 bp, Homo sapien
ggttgtggatggaggaacttctttt

SEQ ID NO: 505346 - DNA, 25 bp, Homo sapien
gagcttcgaactgtgcttcttgaac

SEQ ID NO: 505347 - DNA, 25 bp, Homo sapien
gaacagtgaaggatttcctcatgac

SEQ ID NO: 505348 - DNA, 25 bp, Homo sapien
ggatttcctcatgacaaattttgat

SEQ ID NO: 505349 - DNA, 25 bp, Homo sapien
gaatcactgctctacagtccggaag

SEQ ID NO: 505350 - DNA, 25 bp, Homo sapien
tacttttcagtattcgagaaccaat

SEQ ID NO: 505351 - DNA, 25 bp, Homo sapien
tagagttttctcaagcagtcgtcag

SEQ ID NO: 505352 - DNA, 25 bp, Homo sapien
caagcagtcgtcagcgttgtttctc

SEQ ID NO: 505353 - DNA, 25 bp, Homo sapien
gtgagagtaactgtgcttggaatag

SEQ ID NO: 505354 - DNA, 25 bp, Homo sapien
cttggaatagaaaagccctgctgca

SEQ ID NO: 505355 - DNA, 25 bp, Homo sapien
agccctgctgcatcgagacacaatg

SEQ ID NO: 505356 - DNA, 25 bp, Homo sapien
gcagctgcggcagtgtacagagaaa

SEQ ID NO: 505357 - DNA, 25 bp, Homo sapien
ggttcagtacctgctacataccaga

SEQ ID NO: 505358 - DNA, 25 bp, Homo sapien
tgctacataccagatctattacatg

SEQ ID NO: 505359 - DNA, 25 bp, Homo sapien
ggaaatatcatgagtcacaggcaag

SEQ ID NO: 505360 - DNA, 25 bp, Homo sapien
atgagtcacaggcaagaccagctga

SEQ ID NO: 505361 - DNA, 25 bp, Homo sapien
gaccagctgaaagaggttccgcaac

SEQ ID NO: 505362 - DNA, 25 bp, Homo sapien
aagaggttccgcaactgtgtcattt

SEQ ID NO: 505363 - DNA, 25 bp, Homo sapien
actgtgtcatttggagagctaggaa

SEQ ID NO: 505364 - DNA, 25 bp, Homo sapien
ctctgtatactgtatcagcagcttt

SEQ ID NO: 505365 - DNA, 25 bp, Homo sapien
gtatactgtatcagcagctttgtgt

SEQ ID NO: 505366 - DNA, 25 bp, Homo sapien
gtatcagcagctttgtgtaaaaatg

SEQ ID NO: 505367 - DNA, 25 bp, Homo sapien
gcagctttgtgtaaaaatggcaatc

SEQ ID NO: 505368 - DNA, 25 bp, Homo sapien
aaaatggcaatcaagagagtctaat

SEQ ID NO: 505369 - DNA, 25 bp, Homo sapien
aaaatcttcgcagatctttgatatc

SEQ ID NO: 505370 - DNA, 25 bp, Homo sapien
atcgtactgaggtaacttccacgta

SEQ ID NO: 505371 - DNA, 25 bp, Homo sapien
tactgaggtaacttccacgtagccc

SEQ ID NO: 505372 - DNA, 25 bp, Homo sapien
ttgccacgcggcaccggtgggcctt

SEQ ID NO: 505373 - DNA, 25 bp, Homo sapien
tgccaaggcctgtgacagaattcgc

SEQ ID NO: 505374 - DNA, 25 bp, Homo sapien
gcctgtgacagaattcgctgttaag

SEQ ID NO: 505375 - DNA, 25 bp, Homo sapien
gcagaattcaatctccgagacattc

SEQ ID NO: 505376 - DNA, 25 bp, Homo sapien
gagacattccccagcctcatgcaga

SEQ ID NO: 505377 - DNA, 25 bp, Homo sapien
tgggccttctctttggacctgggac

SEQ ID NO: 505378 - DNA, 25 bp, Homo sapien
ctccttgctcttgggacaccagaga

SEQ ID NO: 505379 - DNA, 25 bp, Homo sapien
accagagaacccatcttggctcagt

SEQ ID NO: 505380 - DNA, 25 bp, Homo sapien
actcttccacctctttttgcctgaa

SEQ ID NO: 505381 - DNA, 25 bp, Homo sapien
ttttgcctgaatggcctttgggcac

SEQ ID NO: 505382 - DNA, 25 bp, Homo sapien
cctttgggcacaaggtcagaggctg

SEQ ID NO: 505383 - DNA, 25 bp, Homo sapien
gccctgaacagaagccatgagatct

SEQ ID NO: 505384 - DNA, 25 bp, Homo sapien
acagaagccatgagatctggactca

SEQ ID NO: 505385 - DNA, 25 bp, Homo sapien
agagcccaggcaatggcactgacgc

SEQ ID NO: 505386 - DNA, 25 bp, Homo sapien
gccatccgagcttgagctgggcgca

SEQ ID NO: 505387 - DNA, 25 bp, Homo sapien
catccgagcttgagctgggcgcaca

SEQ ID NO: 505388 - DNA, 25 bp, Homo sapien
tgtggccctgtaacattccctcgat

SEQ ID NO: 505389 - DNA, 25 bp, Homo sapien
ttcctccccgcagtggttttgaaat

SEQ ID NO: 505390 - DNA, 25 bp, Homo sapien
atcacagacctcgtgtatataaaat

SEQ ID NO: 505391 - DNA, 25 bp, Homo sapien
tcacagacctcgtgtatataaaata

SEQ ID NO: 505392 - DNA, 25 bp, Homo sapien
cacagacctcgtgtatataaaatat

SEQ ID NO: 505393 - DNA, 25 bp, Homo sapien
acagacctcgtgtatataaaatatg

SEQ ID NO: 505394 - DNA, 25 bp, Homo sapien
tatgcagaacttgttttccgttccc

SEQ ID NO: 505395 - DNA, 25 bp, Homo sapien
ttccgttcccctgccagttttatat

SEQ ID NO: 505396 - DNA, 25 bp, Homo sapien
caggagtgccagccacagccggaac

SEQ ID NO: 505397 - DNA, 25 bp, Homo sapien
aactatacgtttgaattcaatatgg

SEQ ID NO: 505398 - DNA, 25 bp, Homo sapien
tacatacaatgcatgaatcataatg

SEQ ID NO: 505399 - DNA, 25 bp, Homo sapien
taatttttatggtttaatcagtcta

SEQ ID NO: 505400 - DNA, 25 bp, Homo sapien
tggtttaatcagtctaattgttttg

SEQ ID NO: 505401 - DNA, 25 bp, Homo sapien
ctaattgttttgactgttatagaaa

SEQ ID NO: 505402 - DNA, 25 bp, Homo sapien
gttatagaaaccaaatattttactg

SEQ ID NO: 505403 - DNA, 25 bp, Homo sapien
ggactaatattgtcaaaaactgctg

SEQ ID NO: 505404 - DNA, 25 bp, Homo sapien
aaactgctgttattaacttcacttg

SEQ ID NO: 505405 - DNA, 25 bp, Homo sapien
gctgttattaacttcacttgagttg

SEQ ID NO: 505406 - DNA, 25 bp, Homo sapien
acttgagttgtttaacttccttctg

SEQ ID NO: 505407 - DNA, 25 bp, Homo sapien
tgagttgtttaacttccttctgttt

SEQ ID NO: 505408 - DNA, 25 bp, Homo sapien
gggcgggcccggctcgggctcacgt

SEQ ID NO: 505409 - DNA, 25 bp, Homo sapien
ggttcccccgccttgacagcggagg

SEQ ID NO: 505410 - DNA, 25 bp, Homo sapien
caccaaggcccttggactaagcggg

SEQ ID NO: 505411 - DNA, 25 bp, Homo sapien
gcagggacagcctccaggtagagct

SEQ ID NO: 505412 - DNA, 25 bp, Homo sapien
gggacagcctccaggtagagctgtt

SEQ ID NO: 505413 - DNA, 25 bp, Homo sapien
gacagcctccaggtagagctgttcg

SEQ ID NO: 505414 - DNA, 25 bp, Homo sapien
acagcctccaggtagagctgttcgc

SEQ ID NO: 505415 - DNA, 25 bp, Homo sapien
agcctccaggtagagctgttcgccg

SEQ ID NO: 505416 - DNA, 25 bp, Homo sapien
gcctccaggtagagctgttcgccgg

SEQ ID NO: 505417 - DNA, 25 bp, Homo sapien
cctccaggtagagctgttcgccggg

SEQ ID NO: 505418 - DNA, 25 bp, Homo sapien
tgcagagcccgcatcccaaccctga

SEQ ID NO: 505419 - DNA, 25 bp, Homo sapien
taaaatccagcttagatgtaatata

SEQ ID NO: 505420 - DNA, 25 bp, Homo sapien
gtaatataagtaggccaagtgtggt

SEQ ID NO: 505421 - DNA, 25 bp, Homo sapien
gttagttatagagttgtctttgcag

SEQ ID NO: 505422 - DNA, 25 bp, Homo sapien
agttatagagttgtctttgcaggaa

SEQ ID NO: 505423 - DNA, 25 bp, Homo sapien
ttatagagttgtctttgcaggaaaa

SEQ ID NO: 505424 - DNA, 25 bp, Homo sapien
gaggttatagcgagctatgatcaca

SEQ ID NO: 505425 - DNA, 25 bp, Homo sapien
taaagttcagtgagtcaagtgggcc

SEQ ID NO: 505426 - DNA, 25 bp, Homo sapien
tcagtgagtcaagtgggcccatttc

SEQ ID NO: 505427 - DNA, 25 bp, Homo sapien
gtataagctaagaaactggcaacag

SEQ ID NO: 505428 - DNA, 25 bp, Homo sapien
ataagctaagaaactggcaacagca

SEQ ID NO: 505429 - DNA, 25 bp, Homo sapien
ggcaacagcagtgtatacacatgta

SEQ ID NO: 505430 - DNA, 25 bp, Homo sapien
gagctgcttgactcaccggcttcct

SEQ ID NO: 505431 - DNA, 25 bp, Homo sapien
ttgactcaccggcttcctatttgat

SEQ ID NO: 505432 - DNA, 25 bp, Homo sapien
tgactcaccggcttcctatttgatg

SEQ ID NO: 505433 - DNA, 25 bp, Homo sapien
gactcaccggcttcctatttgatgc

SEQ ID NO: 505434 - DNA, 25 bp, Homo sapien
actcaccggcttcctatttgatgca

SEQ ID NO: 505435 - DNA, 25 bp, Homo sapien
tcaccggcttcctatttgatgcacc

SEQ ID NO: 505436 - DNA, 25 bp, Homo sapien
accggcttcctatttgatgcaccca

SEQ ID NO: 505437 - DNA, 25 bp, Homo sapien
cggcttcctatttgatgcacccagg

SEQ ID NO: 505438 - DNA, 25 bp, Homo sapien
ggcttcctatttgatgcacccaggc

SEQ ID NO: 505439 - DNA, 25 bp, Homo sapien
gcttcctatttgatgcacccaggcc

SEQ ID NO: 505440 - DNA, 25 bp, Homo sapien
tttgatgcacccaggcccccttgtg

SEQ ID NO: 505441 - DNA, 25 bp, Homo sapien
cagcctcggccatggtgctgagcct

SEQ ID NO: 505442 - DNA, 25 bp, Homo sapien
agcctcctggccgtgaccctcggag

SEQ ID NO: 505443 - DNA, 25 bp, Homo sapien
cgtcctctgcggcatgtccatggac

SEQ ID NO: 505444 - DNA, 25 bp, Homo sapien
tcctctgcggcatgtccatggacct

SEQ ID NO: 505445 - DNA, 25 bp, Homo sapien
atgtccatggacctcccactatacg

SEQ ID NO: 505446 - DNA, 25 bp, Homo sapien
accaaaccccaggtctggctgccag

SEQ ID NO: 505447 - DNA, 25 bp, Homo sapien
aacctgaagttgtcagctcagaaag

SEQ ID NO: 505448 - DNA, 25 bp, Homo sapien
gaagttgtcagctcagaaagcgacc

SEQ ID NO: 505449 - DNA, 25 bp, Homo sapien
agttgtcagctcagaaagcgacctt

SEQ ID NO: 505450 - DNA, 25 bp, Homo sapien
ttgtcagctcagaaagcgaccttgc

SEQ ID NO: 505451 - DNA, 25 bp, Homo sapien
gtcagctcagaaagcgaccttgccc

SEQ ID NO: 505452 - DNA, 25 bp, Homo sapien
caaagagacagctcactggtgacca

SEQ ID NO: 505453 - DNA, 25 bp, Homo sapien
tcactggtgaccatgctttgggatt

SEQ ID NO: 505454 - DNA, 25 bp, Homo sapien
tgctttgggattttcatagtttgag

SEQ ID NO: 505455 - DNA, 25 bp, Homo sapien
gctctaccacccagcgagttaaaga

SEQ ID NO: 505456 - DNA, 25 bp, Homo sapien
gtgagcagcttgttttcaggagatc

SEQ ID NO: 505457 - DNA, 25 bp, Homo sapien
ggttaccaggttgccacgtatttga

SEQ ID NO: 505458 - DNA, 25 bp, Homo sapien
gagatctgcatcttgatctggcctg

SEQ ID NO: 505459 - DNA, 25 bp, Homo sapien
atctggcctgctattaggatctgtg

SEQ ID NO: 505460 - DNA, 25 bp, Homo sapien
atttgaagtggtgtgagagctactc

SEQ ID NO: 505461 - DNA, 25 bp, Homo sapien
gagagctactcgtttggaaccgttg

SEQ ID NO: 505462 - DNA, 25 bp, Homo sapien
ggaaccgttgtggattttcaaatag

SEQ ID NO: 505463 - DNA, 25 bp, Homo sapien
ggatgaacaaaatgaatctccctgt

SEQ ID NO: 505464 - DNA, 25 bp, Homo sapien
aatctccctgttcattttgagccta

SEQ ID NO: 505465 - DNA, 25 bp, Homo sapien
gagcctacatagacatagagaccaa

SEQ ID NO: 505466 - DNA, 25 bp, Homo sapien
actctcttcagagtgaatacccagg

SEQ ID NO: 505467 - DNA, 25 bp, Homo sapien
aatacccagggtcaggacagactca

SEQ ID NO: 505468 - DNA, 25 bp, Homo sapien
ggacagactcagcaaaccttctata

SEQ ID NO: 505469 - DNA, 25 bp, Homo sapien
ttctatatcacttaattctgcccag

SEQ ID NO: 505470 - DNA, 25 bp, Homo sapien
ctaaagtgcctttgggatcatcaga

SEQ ID NO: 505471 - DNA, 25 bp, Homo sapien
tgggatcatcagagactgtctataa

SEQ ID NO: 505472 - DNA, 25 bp, Homo sapien
gatctggatgtcagtgtatcaaatc

SEQ ID NO: 505473 - DNA, 25 bp, Homo sapien
gtgtatcaaatcttatcaaatccat

SEQ ID NO: 505474 - DNA, 25 bp, Homo sapien
gaagtcttactcaacttgctttttt

SEQ ID NO: 505475 - DNA, 25 bp, Homo sapien
cattcttgcgcttatatgcatggat

SEQ ID NO: 505476 - DNA, 25 bp, Homo sapien
tccttgccattttttaatcacacat

SEQ ID NO: 505477 - DNA, 25 bp, Homo sapien
atgcatggatggtttacttgctcta

SEQ ID NO: 505478 - DNA, 25 bp, Homo sapien
acttgctctatagtattctgtgtga

SEQ ID NO: 505479 - DNA, 25 bp, Homo sapien
taagtgttcattttcctatcagttg

SEQ ID NO: 505480 - DNA, 25 bp, Homo sapien
ttgactgtcccctggtacacatatg

SEQ ID NO: 505481 - DNA, 25 bp, Homo sapien
atcacacatgtatgttctccaaaca

SEQ ID NO: 505482 - DNA, 25 bp, Homo sapien
gttctccaaacatactgtttcattt

SEQ ID NO: 505483 - DNA, 25 bp, Homo sapien
gaagctttctacatatagtgtctga

SEQ ID NO: 505484 - DNA, 25 bp, Homo sapien
atagtgtctgaatgtgaagtcttac

SEQ ID NO: 505485 - DNA, 25 bp, Homo sapien
gaattcagaactactttcctctgtg

SEQ ID NO: 505486 - DNA, 25 bp, Homo sapien
tcagaactactttcctctgtgacac

SEQ ID NO: 505487 - DNA, 25 bp, Homo sapien
atgttctctgctgtgaaactcttaa

SEQ ID NO: 505488 - DNA, 25 bp, Homo sapien
ctctgctgtgaaactcttaaaacaa

SEQ ID NO: 505489 - DNA, 25 bp, Homo sapien
aacaaggagtgtattttagagacaa

SEQ ID NO: 505490 - DNA, 25 bp, Homo sapien
atataatctggtttctatctgacga

SEQ ID NO: 505491 - DNA, 25 bp, Homo sapien
aatctggtttctatctgacgagttt

SEQ ID NO: 505492 - DNA, 25 bp, Homo sapien
ctggtttctatctgacgagtttttc

SEQ ID NO: 505493 - DNA, 25 bp, Homo sapien
gtttctatctgacgagtttttcata

SEQ ID NO: 505494 - DNA, 25 bp, Homo sapien
ctgacgagtttttcatatctcatga

SEQ ID NO: 505495 - DNA, 25 bp, Homo sapien
ttttcatatctcatgaatggtgcgc

SEQ ID NO: 505496 - DNA, 25 bp, Homo sapien
ataccatttttatactccacatcgc

SEQ ID NO: 505497 - DNA, 25 bp, Homo sapien
actttatttctgctacgagtaattt

SEQ ID NO: 505498 - DNA, 25 bp, Homo sapien
aacttgcaaactgacttttgggaca

SEQ ID NO: 505499 - DNA, 25 bp, Homo sapien
gaacttggaactttgggttgactcg

SEQ ID NO: 505500 - DNA, 25 bp, Homo sapien
gactcggtttgagttttgtgtcaaa

SEQ ID NO: 505501 - DNA, 25 bp, Homo sapien
gtgtcaaagaagatttcccgcggct

SEQ ID NO: 505502 - DNA, 25 bp, Homo sapien
atttcccgcggctgaagaggttggt

SEQ ID NO: 505503 - DNA, 25 bp, Homo sapien
gttggtgttcctgttacgtgtttca

SEQ ID NO: 505504 - DNA, 25 bp, Homo sapien
acgtgtttcaggtgagaagcagcaa

SEQ ID NO: 505505 - DNA, 25 bp, Homo sapien
agcagcaaagcgtcttaatgttcaa

SEQ ID NO: 505506 - DNA, 25 bp, Homo sapien
tcaaaacgcctctctttggtctgga

SEQ ID NO: 505507 - DNA, 25 bp, Homo sapien
gtgcattttgcaagtttgacttgtg

SEQ ID NO: 505508 - DNA, 25 bp, Homo sapien
gtgtaaaatagattacctctcctgt

SEQ ID NO: 505509 - DNA, 25 bp, Homo sapien
taaaatagattacctctcctgtctt

SEQ ID NO: 505510 - DNA, 25 bp, Homo sapien
acactgtataccatcctgcctcatg

SEQ ID NO: 505511 - DNA, 25 bp, Homo sapien
tgtataccatcctgcctcatgtcaa

SEQ ID NO: 505512 - DNA, 25 bp, Homo sapien
tttcttatttccaaacctcataggc

SEQ ID NO: 505513 - DNA, 25 bp, Homo sapien
atgaacagttgaaagttttgacttc

SEQ ID NO: 505514 - DNA, 25 bp, Homo sapien
tgacttctttggactcaattgaatt

SEQ ID NO: 505515 - DNA, 25 bp, Homo sapien
tctttggactcaattgaattcacta

SEQ ID NO: 505516 - DNA, 25 bp, Homo sapien
ggactcaattgaattcactaaaaca

SEQ ID NO: 505517 - DNA, 25 bp, Homo sapien
taaaatatgatgtgtgtgcattttg

SEQ ID NO: 505518 - DNA, 25 bp, Homo sapien
ccctgagggctcatgtgtggcattg

SEQ ID NO: 505519 - DNA, 25 bp, Homo sapien
agcagtgaccagaacaccacaaggc

SEQ ID NO: 505520 - DNA, 25 bp, Homo sapien
agaacaccacaaggcccacaagatg

SEQ ID NO: 505521 - DNA, 25 bp, Homo sapien
accacaaggcccacaagatgttttg

SEQ ID NO: 505522 - DNA, 25 bp, Homo sapien
caaggcccacaagatgttttgaatg

SEQ ID NO: 505523 - DNA, 25 bp, Homo sapien
tgagggaacatttaatgtcatttgt

SEQ ID NO: 505524 - DNA, 25 bp, Homo sapien
gtcatttgttaggagatagaaacca

SEQ ID NO: 505525 - DNA, 25 bp, Homo sapien
aaaggacaaggaccacgctcattcc

SEQ ID NO: 505526 - DNA, 25 bp, Homo sapien
aaggaccacgctcattccgtggaga

SEQ ID NO: 505527 - DNA, 25 bp, Homo sapien
gaccacgctcattccgtggagaaga

SEQ ID NO: 505528 - DNA, 25 bp, Homo sapien
tccgtggagaagaggtgaactccct

SEQ ID NO: 505529 - DNA, 25 bp, Homo sapien
tttcccaagtcagctttttactatg

SEQ ID NO: 505530 - DNA, 25 bp, Homo sapien
tactatgattacgtcctagcctcag

SEQ ID NO: 505531 - DNA, 25 bp, Homo sapien
ttacgtcctagcctcagatgtggtc

SEQ ID NO: 505532 - DNA, 25 bp, Homo sapien
agatgtggtctaccatcactacttc

SEQ ID NO: 505533 - DNA, 25 bp, Homo sapien
atcactacttcctggacaagctgct

SEQ ID NO: 505534 - DNA, 25 bp, Homo sapien
tgctcaccaccatggtgtacctttc

SEQ ID NO: 505535 - DNA, 25 bp, Homo sapien
atggtgtacctttcccagccaggga

SEQ ID NO: 505536 - DNA, 25 bp, Homo sapien
cagcaccgactatgaatttttagat

SEQ ID NO: 505537 - DNA, 25 bp, Homo sapien
caacactgttggctgaatatccaga

SEQ ID NO: 505538 - DNA, 25 bp, Homo sapien
gaatatccagagtcatcagtcaaac

SEQ ID NO: 505539 - DNA, 25 bp, Homo sapien
gagtcatcagtcaaactttttaagg

SEQ ID NO: 505540 - DNA, 25 bp, Homo sapien
tgtttatactgattcctgggataga

SEQ ID NO: 505541 - DNA, 25 bp, Homo sapien
tgattcctgggatagataagtctgt

SEQ ID NO: 505542 - DNA, 25 bp, Homo sapien
ggatagataagtctgtcttctccac

SEQ ID NO: 505543 - DNA, 25 bp, Homo sapien
agataagtctgtcttctccacataa

SEQ ID NO: 505544 - DNA, 25 bp, Homo sapien
ataagtctgtcttctccacataatg

SEQ ID NO: 505545 - DNA, 25 bp, Homo sapien
taagtctgtcttctccacataatga

SEQ ID NO: 505546 - DNA, 25 bp, Homo sapien
tttatacagtggcagttactttagc

SEQ ID NO: 505547 - DNA, 25 bp, Homo sapien
tggcagttactttagccactttaaa

SEQ ID NO: 505548 - DNA, 25 bp, Homo sapien
gcagttactttagccactttaaaag

SEQ ID NO: 505549 - DNA, 25 bp, Homo sapien
agttaagaagtgtcagtacagccaa

SEQ ID NO: 505550 - DNA, 25 bp, Homo sapien
gaagtgtcagtacagccaagaaaaa

SEQ ID NO: 505551 - DNA, 25 bp, Homo sapien
ggatgtttctagatcaacgctggaa

SEQ ID NO: 505552 - DNA, 25 bp, Homo sapien
gatcaacgctggaagaaccaggatc

SEQ ID NO: 505553 - DNA, 25 bp, Homo sapien
agtgtggtctgggagtcaaagtcat

SEQ ID NO: 505554 - DNA, 25 bp, Homo sapien
gaagcaagccagaacctcatcagtg

SEQ ID NO: 505555 - DNA, 25 bp, Homo sapien
gaacctcatcagtggtgtccatgaa

SEQ ID NO: 505556 - DNA, 25 bp, Homo sapien
gtggtgtccatgaatctgaaggtac

SEQ ID NO: 505557 - DNA, 25 bp, Homo sapien
aactcaacatgtgtccagcactatt

SEQ ID NO: 505558 - DNA, 25 bp, Homo sapien
cagcactattcagttttatctcata

SEQ ID NO: 505559 - DNA, 25 bp, Homo sapien
aaatccaaacacattgtcagcatct

SEQ ID NO: 505560 - DNA, 25 bp, Homo sapien
gtcagcatctgctttgaaggtaagc

SEQ ID NO: 505561 - DNA, 25 bp, Homo sapien
gtgccttagaggttaggatgtttct

SEQ ID NO: 505562 - DNA, 25 bp, Homo sapien
gcctgcacttgacgaattaccttga

SEQ ID NO: 505563 - DNA, 25 bp, Homo sapien
tgacgaattaccttgaccaacgggc

SEQ ID NO: 505564 - DNA, 25 bp, Homo sapien
tgaccaacgggccaaaggcacagag

SEQ ID NO: 505565 - DNA, 25 bp, Homo sapien
acagagctccaaggcatcatctttc

SEQ ID NO: 505566 - DNA, 25 bp, Homo sapien
tctttccttaaaatcctgagtgttt

SEQ ID NO: 505567 - DNA, 25 bp, Homo sapien
ctgggccatgccatggctctgaaga

SEQ ID NO: 505568 - DNA, 25 bp, Homo sapien
atggctctgaagatgccccgtgttc

SEQ ID NO: 505569 - DNA, 25 bp, Homo sapien
atgccccgtgttcttaggaggtgct

SEQ ID NO: 505570 - DNA, 25 bp, Homo sapien
aaataagcccctgaacgtgcttgca

SEQ ID NO: 505571 - DNA, 25 bp, Homo sapien
aacgtgcttgcaggccagtttgtgt

SEQ ID NO: 505572 - DNA, 25 bp, Homo sapien
cagtttgtgtgcctgcacttgacga

SEQ ID NO: 505573 - DNA, 25 bp, Homo sapien
gactcggagatcatgcagcagaagc

SEQ ID NO: 505574 - DNA, 25 bp, Homo sapien
ctcggagatcatgcagcagaagcag

SEQ ID NO: 505575 - DNA, 25 bp, Homo sapien
gaaggaggaacccaagtagctttgt

SEQ ID NO: 505576 - DNA, 25 bp, Homo sapien
gaggaacccaagtagctttgtggct

SEQ ID NO: 505577 - DNA, 25 bp, Homo sapien
ggaacccaagtagctttgtggcttc

SEQ ID NO: 505578 - DNA, 25 bp, Homo sapien
acccaagtagctttgtggcttcgtg

SEQ ID NO: 505579 - DNA, 25 bp, Homo sapien
aagtagctttgtggcttcgtgtcca

SEQ ID NO: 505580 - DNA, 25 bp, Homo sapien
gtagctttgtggcttcgtgtccaac

SEQ ID NO: 505581 - DNA, 25 bp, Homo sapien
agctttgtggcttcgtgtccaaccc

SEQ ID NO: 505582 - DNA, 25 bp, Homo sapien
tgtggcttcgtgtccaaccctcttg

SEQ ID NO: 505583 - DNA, 25 bp, Homo sapien
ttgcccttcgcctgtgtgcctggag

SEQ ID NO: 505584 - DNA, 25 bp, Homo sapien
gtatacgatgtacacttgggacaga

SEQ ID NO: 505585 - DNA, 25 bp, Homo sapien
gtacacttgggacagagttttctaa

SEQ ID NO: 505586 - DNA, 25 bp, Homo sapien
agagttttctaatatgttgccaatg

SEQ ID NO: 505587 - DNA, 25 bp, Homo sapien
gccaatgtttttgtagtgtcaccac

SEQ ID NO: 505588 - DNA, 25 bp, Homo sapien
tttgtagtgtcaccacaggtctttt

SEQ ID NO: 505589 - DNA, 25 bp, Homo sapien
gtgtttttcccatttgttatagagt

SEQ ID NO: 505590 - DNA, 25 bp, Homo sapien
aatgacttagcgtaattaagccctc

SEQ ID NO: 505591 - DNA, 25 bp, Homo sapien
tagcgtaattaagccctcaagtatg

SEQ ID NO: 505592 - DNA, 25 bp, Homo sapien
ctcaagtatgtgtgagagagcgcgt

SEQ ID NO: 505593 - DNA, 25 bp, Homo sapien
actggaactattttaggtggcaaat

SEQ ID NO: 505594 - DNA, 25 bp, Homo sapien
ttaggtggcaaattgtaacgcaaaa

SEQ ID NO: 505595 - DNA, 25 bp, Homo sapien
attcactttcagtgcttcgggtttg

SEQ ID NO: 505596 - DNA, 25 bp, Homo sapien
ggtttgcagcttctaggtgccagaa

SEQ ID NO: 505597 - DNA, 25 bp, Homo sapien
ggtgccagaattcaagcttccagaa

SEQ ID NO: 505598 - DNA, 25 bp, Homo sapien
atccagtttcttcctacatgctgaa

SEQ ID NO: 505599 - DNA, 25 bp, Homo sapien
aaagtgctgttccttgggccttggc

SEQ ID NO: 505600 - DNA, 25 bp, Homo sapien
gccttggcactcatgtgtttgttag

SEQ ID NO: 505601 - DNA, 25 bp, Homo sapien
tttgttagctccactgacatccgga

SEQ ID NO: 505602 - DNA, 25 bp, Homo sapien
agcctggctttgatgccatgccttg

SEQ ID NO: 505603 - DNA, 25 bp, Homo sapien
catgccttgcaccatcactatgagg

SEQ ID NO: 505604 - DNA, 25 bp, Homo sapien
atcactatgaggcatgctgcatctc

SEQ ID NO: 505605 - DNA, 25 bp, Homo sapien
tgcatctcatatacacccctggtgc

SEQ ID NO: 505606 - DNA, 25 bp, Homo sapien
cgttactaactggacaacagggaag

SEQ ID NO: 505607 - DNA, 25 bp, Homo sapien
ggtgctggccccacattagtgcctg

SEQ ID NO: 505608 - DNA, 25 bp, Homo sapien
gctctacttctaaccagggacacgg

SEQ ID NO: 505609 - DNA, 25 bp, Homo sapien
taaccagggacacggatcttccatt

SEQ ID NO: 505610 - DNA, 25 bp, Homo sapien
attctctacatccaccggactgcag

SEQ ID NO: 505611 - DNA, 25 bp, Homo sapien
ggactgcagcccaagtctggacctg

SEQ ID NO: 505612 - DNA, 25 bp, Homo sapien
gctgcagtgggcatattaccgtatg

SEQ ID NO: 505613 - DNA, 25 bp, Homo sapien
taccgtatggatatctttttctttc

SEQ ID NO: 505614 - DNA, 25 bp, Homo sapien
tttaaagtgaggagattcttcaggg

SEQ ID NO: 505615 - DNA, 25 bp, Homo sapien
gggtcaggctgagaatgtaataagc

SEQ ID NO: 505616 - DNA, 25 bp, Homo sapien
atgtaataagcctgacattggaaca

SEQ ID NO: 505617 - DNA, 25 bp, Homo sapien
taattcatcaactagtgcaattaaa

SEQ ID NO: 505618 - DNA, 25 bp, Homo sapien
taaaattaatgggcagggcctttct

SEQ ID NO: 505619 - DNA, 25 bp, Homo sapien
gcagggcctttctggaccctgtttt

SEQ ID NO: 505620 - DNA, 25 bp, Homo sapien
acacgttagatattccgtcttgagg

SEQ ID NO: 505621 - DNA, 25 bp, Homo sapien
cacgttagatattccgtcttgaggg

SEQ ID NO: 505622 - DNA, 25 bp, Homo sapien
acgttagatattccgtcttgagggg

SEQ ID NO: 505623 - DNA, 25 bp, Homo sapien
gttagatattccgtcttgaggggat

SEQ ID NO: 505624 - DNA, 25 bp, Homo sapien
gatattccgtcttgaggggattgga

SEQ ID NO: 505625 - DNA, 25 bp, Homo sapien
gggattggagtaggctacagtgagg

SEQ ID NO: 505626 - DNA, 25 bp, Homo sapien
tttggatgtatctggacttttaaaa

SEQ ID NO: 505627 - DNA, 25 bp, Homo sapien
ttggatgtatctggacttttaaaaa

SEQ ID NO: 505628 - DNA, 25 bp, Homo sapien
taatgcctgcagtcattgtctgaga

SEQ ID NO: 505629 - DNA, 25 bp, Homo sapien
tgagaactgcccgagagtcccaaag

SEQ ID NO: 505630 - DNA, 25 bp, Homo sapien
agatcgacactattgattggtacaa

SEQ ID NO: 505631 - DNA, 25 bp, Homo sapien
aaacgtaatatttcctggcagacca

SEQ ID NO: 505632 - DNA, 25 bp, Homo sapien
ggcagaccaagaggcacattagcaa

SEQ ID NO: 505633 - DNA, 25 bp, Homo sapien
gcaactacttgggtttgaccaggaa

SEQ ID NO: 505634 - DNA, 25 bp, Homo sapien
agatgaaccaccaattgcaactccc

SEQ ID NO: 505635 - DNA, 25 bp, Homo sapien
tgcaactccctgaacctggacttga

SEQ ID NO: 505636 - DNA, 25 bp, Homo sapien
cctggacttgaccagtctgtggtat

SEQ ID NO: 505637 - DNA, 25 bp, Homo sapien
cagaaggtgttccagaggcaagtaa

SEQ ID NO: 505638 - DNA, 25 bp, Homo sapien
gatctgaatttgactgctttcttga

SEQ ID NO: 505639 - DNA, 25 bp, Homo sapien
ataatatgcaagctaattggacttt

SEQ ID NO: 505640 - DNA, 25 bp, Homo sapien
gaagtagtccactttttgctagcat

SEQ ID NO: 505641 - DNA, 25 bp, Homo sapien
gctagcatactattctgagacttac

SEQ ID NO: 505642 - DNA, 25 bp, Homo sapien
ctgagacttacattaatttgggaaa

SEQ ID NO: 505643 - DNA, 25 bp, Homo sapien
tgggaaaagtcaagggtcaacaaat

SEQ ID NO: 505644 - DNA, 25 bp, Homo sapien
aagggtcaacaaattttgtgtctgt

SEQ ID NO: 505645 - DNA, 25 bp, Homo sapien
attatataggctttgcaggctgtgt

SEQ ID NO: 505646 - DNA, 25 bp, Homo sapien
caggctgtgtgatttctgttgcagt

SEQ ID NO: 505647 - DNA, 25 bp, Homo sapien
gttgcagttattcagctttgccatg

SEQ ID NO: 505648 - DNA, 25 bp, Homo sapien
agctttgccatgtagtgtgaacaca

SEQ ID NO: 505649 - DNA, 25 bp, Homo sapien
tagtgtgaacacatcatagatatat

SEQ ID NO: 505650 - DNA, 25 bp, Homo sapien
tgccaaatttagtgtgtacctgttt

SEQ ID NO: 505651 - DNA, 25 bp, Homo sapien
gtacctgttttacttcattctttag

SEQ ID NO: 505652 - DNA, 25 bp, Homo sapien
gtgtgagcgatctgcagaactggca

SEQ ID NO: 505653 - DNA, 25 bp, Homo sapien
gagcgatctgcagaactggcattag

SEQ ID NO: 505654 - DNA, 25 bp, Homo sapien
cgatctgcagaactggcattagagg

SEQ ID NO: 505655 - DNA, 25 bp, Homo sapien
gggtggaccgcgatgcattttaaag

SEQ ID NO: 505656 - DNA, 25 bp, Homo sapien
tggaccgcgatgcattttaaaggtt

SEQ ID NO: 505657 - DNA, 25 bp, Homo sapien
ccgcgatgcattttaaaggttggga

SEQ ID NO: 505658 - DNA, 25 bp, Homo sapien
aagagctaagccattggattccttt

SEQ ID NO: 505659 - DNA, 25 bp, Homo sapien
aagccattggattccttttcttgaa

SEQ ID NO: 505660 - DNA, 25 bp, Homo sapien
gaaggagtggaattgtgtaagataa

SEQ ID NO: 505661 - DNA, 25 bp, Homo sapien
tctcaggcagcccagcactttctga

SEQ ID NO: 505662 - DNA, 25 bp, Homo sapien
ctttctgagaggtcaaagtctggac

SEQ ID NO: 505663 - DNA, 25 bp, Homo sapien
ggaccatcagcctctttgatttgaa

SEQ ID NO: 505664 - DNA, 25 bp, Homo sapien
aaaacccctgaggagcagctcaggc

SEQ ID NO: 505665 - DNA, 25 bp, Homo sapien
agcagctcaggcctggcactggtcc

SEQ ID NO: 505666 - DNA, 25 bp, Homo sapien
actggtcccctacagagggcctctg

SEQ ID NO: 505667 - DNA, 25 bp, Homo sapien
acaaagggtttcctgtcatggagac

SEQ ID NO: 505668 - DNA, 25 bp, Homo sapien
gccctgccactaatgccaaatcaag

SEQ ID NO: 505669 - DNA, 25 bp, Homo sapien
aaatcaagccatcaacccgagcttt

SEQ ID NO: 505670 - DNA, 25 bp, Homo sapien
caacccgagctttcaaaggccagga

SEQ ID NO: 505671 - DNA, 25 bp, Homo sapien
ggtttcctgtcatggagacacctct

SEQ ID NO: 505672 - DNA, 25 bp, Homo sapien
agcatcgctgtccttgtcggtgaga

SEQ ID NO: 505673 - DNA, 25 bp, Homo sapien
tgagaccctggctttagggcagaca

SEQ ID NO: 505674 - DNA, 25 bp, Homo sapien
agggcagacaggaccacgtttcata

SEQ ID NO: 505675 - DNA, 25 bp, Homo sapien
cacgtttcataagttcatgctgtcc

SEQ ID NO: 505676 - DNA, 25 bp, Homo sapien
tgtcccagcagaggaataacgccag

SEQ ID NO: 505677 - DNA, 25 bp, Homo sapien
gtccatgagaaatctgcccttgtga

SEQ ID NO: 505678 - DNA, 25 bp, Homo sapien
tgtgaagttggaatcccctcaacct

SEQ ID NO: 505679 - DNA, 25 bp, Homo sapien
ctcaccccgctgacttgaatgaagc

SEQ ID NO: 505680 - DNA, 25 bp, Homo sapien
tgaagcgactgagacgggctatgat

SEQ ID NO: 505681 - DNA, 25 bp, Homo sapien
ggagcagatccggttgctcgacctt

SEQ ID NO: 505682 - DNA, 25 bp, Homo sapien
tcccttgcaccaacacatgtagtta

SEQ ID NO: 505683 - DNA, 25 bp, Homo sapien
agttgtttcttcctcccagtgggat

SEQ ID NO: 505684 - DNA, 25 bp, Homo sapien
ctcccagtgggattatggtctcgtg

SEQ ID NO: 505685 - DNA, 25 bp, Homo sapien
cagtgggattatggtctcgtgcaga

SEQ ID NO: 505686 - DNA, 25 bp, Homo sapien
gggattatggtctcgtgcagacctt

SEQ ID NO: 505687 - DNA, 25 bp, Homo sapien
tatggtctcgtgcagaccttgcatt

SEQ ID NO: 505688 - DNA, 25 bp, Homo sapien
gtctcgtgcagaccttgcattgagt

SEQ ID NO: 505689 - DNA, 25 bp, Homo sapien
tcgtgcagaccttgcattgagtgtt

SEQ ID NO: 505690 - DNA, 25 bp, Homo sapien
tgcagaccttgcattgagtgttaca

SEQ ID NO: 505691 - DNA, 25 bp, Homo sapien
agaccttgcattgagtgttacagct

SEQ ID NO: 505692 - DNA, 25 bp, Homo sapien
ttaaagggggcacggacctgaccat

SEQ ID NO: 505693 - DNA, 25 bp, Homo sapien
taaaattacaaatattagcccggag

SEQ ID NO: 505694 - DNA, 25 bp, Homo sapien
ctcgccctgaggctgttagaagcag

SEQ ID NO: 505695 - DNA, 25 bp, Homo sapien
agaagcagcttgtcataggcagcaa

SEQ ID NO: 505696 - DNA, 25 bp, Homo sapien
gcagcttgtcataggcagcaaaatt

SEQ ID NO: 505697 - DNA, 25 bp, Homo sapien
gcaacatctcttctctaaacagatc

SEQ ID NO: 505698 - DNA, 25 bp, Homo sapien
taaacagatcaattcttgctgggat

SEQ ID NO: 505699 - DNA, 25 bp, Homo sapien
atcaattcttgctgggatgcctcaa

SEQ ID NO: 505700 - DNA, 25 bp, Homo sapien
ctgggatgcctcaatggtctcatta

SEQ ID NO: 505701 - DNA, 25 bp, Homo sapien
gatgcctcaatggtctcattatgct

SEQ ID NO: 505702 - DNA, 25 bp, Homo sapien
gagaccacttggtatttccgaagaa

SEQ ID NO: 505703 - DNA, 25 bp, Homo sapien
agccgggtctcactcgcaagtacaa

SEQ ID NO: 505704 - DNA, 25 bp, Homo sapien
gggtctcactcgcaagtacaatatg

SEQ ID NO: 505705 - DNA, 25 bp, Homo sapien
ctgctattctgtctcgatggtttca

SEQ ID NO: 505706 - DNA, 25 bp, Homo sapien
gtctcgatggtttcagaacacagta

SEQ ID NO: 505707 - DNA, 25 bp, Homo sapien
gacagatagctgctacatagccaga

SEQ ID NO: 505708 - DNA, 25 bp, Homo sapien
gctacatagccagaatgcctttaat

SEQ ID NO: 505709 - DNA, 25 bp, Homo sapien
gcctttaataggctaatagcagcaa

SEQ ID NO: 505710 - DNA, 25 bp, Homo sapien
gcagcaaatctgtattctcttgaga

SEQ ID NO: 505711 - DNA, 25 bp, Homo sapien
gaagaccttaacagcgaagaggctt

SEQ ID NO: 505712 - DNA, 25 bp, Homo sapien
gaagaggctttatttctgcagaaga

SEQ ID NO: 505713 - DNA, 25 bp, Homo sapien
gaagaatgtacaagaggcccacttg

SEQ ID NO: 505714 - DNA, 25 bp, Homo sapien
ggcccacttgtggaacagcatgttg

SEQ ID NO: 505715 - DNA, 25 bp, Homo sapien
tgtggaacagcatgttgaagacccc

SEQ ID NO: 505716 - DNA, 25 bp, Homo sapien
atctgcatcgcccttctgtgtgcag

SEQ ID NO: 505717 - DNA, 25 bp, Homo sapien
ttctgtgtgcagtcacatcgagact

SEQ ID NO: 505718 - DNA, 25 bp, Homo sapien
catcgagactgcacacagcatgcat

SEQ ID NO: 505719 - DNA, 25 bp, Homo sapien
cagcatgcatctcctcttggaaaat

SEQ ID NO: 505720 - DNA, 25 bp, Homo sapien
aatatcttttgcctccgagttgttt

SEQ ID NO: 505721 - DNA, 25 bp, Homo sapien
gcctccgagttgttttaagcaatta

SEQ ID NO: 505722 - DNA, 25 bp, Homo sapien
taagcaattagaatcaggtcctgaa

SEQ ID NO: 505723 - DNA, 25 bp, Homo sapien
gtcctgaatccccagactgttcaga

SEQ ID NO: 505724 - DNA, 25 bp, Homo sapien
ccccactgtgtacctttgagaggaa

SEQ ID NO: 505725 - DNA, 25 bp, Homo sapien
aaggagtgcgtttgttttcatctgc

SEQ ID NO: 505726 - DNA, 25 bp, Homo sapien
aaaaccatggttgtgatcatgtggg

SEQ ID NO: 505727 - DNA, 25 bp, Homo sapien
ggatcccaccagttctgcctggctt

SEQ ID NO: 505728 - DNA, 25 bp, Homo sapien
catccccagaggcactaaaagcagt

SEQ ID NO: 505729 - DNA, 25 bp, Homo sapien
aagcagtattttaaggttggtgtct

SEQ ID NO: 505730 - DNA, 25 bp, Homo sapien
taaggttggtgtcttactccctgga

SEQ ID NO: 505731 - DNA, 25 bp, Homo sapien
gtcttactccctggaagcctgaaat

SEQ ID NO: 505732 - DNA, 25 bp, Homo sapien
cctggaagcctgaaatgggtggaat

SEQ ID NO: 505733 - DNA, 25 bp, Homo sapien
gcggtaaggcttgagtaaaactagg

SEQ ID NO: 505734 - DNA, 25 bp, Homo sapien
cagaggttcttatttgtcgatttta

SEQ ID NO: 505735 - DNA, 25 bp, Homo sapien
ttttataatttgaccacagcatctg

SEQ ID NO: 505736 - DNA, 25 bp, Homo sapien
tttgaccacagcatctgaactccct

SEQ ID NO: 505737 - DNA, 25 bp, Homo sapien
cctctctccctggaataagtatttt

SEQ ID NO: 505738 - DNA, 25 bp, Homo sapien
actaacaggtgatgggctttgtgcc

SEQ ID NO: 505739 - DNA, 25 bp, Homo sapien
tgcccactccagagatattgtggga

SEQ ID NO: 505740 - DNA, 25 bp, Homo sapien
tcccggcatcaggagtcattgaaca

SEQ ID NO: 505741 - DNA, 25 bp, Homo sapien
caggagtcattgaacaatcatggat

SEQ ID NO: 505742 - DNA, 25 bp, Homo sapien
catggattgttgtgtttgggatttt

SEQ ID NO: 505743 - DNA, 25 bp, Homo sapien
gtgtgctgcatgcacatgcgtccaa

SEQ ID NO: 505744 - DNA, 25 bp, Homo sapien
atgcacatgcgtccaagacttacgg

SEQ ID NO: 505745 - DNA, 25 bp, Homo sapien
tgcgtccaagacttacgggtggttt

SEQ ID NO: 505746 - DNA, 25 bp, Homo sapien
gtgctagcaacagtgtcaatgtcat

SEQ ID NO: 505747 - DNA, 25 bp, Homo sapien
gtcaatgtcattgttaactatattt

SEQ ID NO: 505748 - DNA, 25 bp, Homo sapien
atatttcatatttgaggtctcattg

SEQ ID NO: 505749 - DNA, 25 bp, Homo sapien
gtcctgagtgttccaggagctcttt

SEQ ID NO: 505750 - DNA, 25 bp, Homo sapien
tgagtgttccaggagctctttggtt

SEQ ID NO: 505751 - DNA, 25 bp, Homo sapien
ttggcttcttttgatggaagaatcc

SEQ ID NO: 505752 - DNA, 25 bp, Homo sapien
gatggaagaatcctgcttcacagac

SEQ ID NO: 505753 - DNA, 25 bp, Homo sapien
aagcgttgccgctggctgtgccctc

SEQ ID NO: 505754 - DNA, 25 bp, Homo sapien
tggcactctgactgcatgctgatga

SEQ ID NO: 505755 - DNA, 25 bp, Homo sapien
actctgactgcatgctgatgagcaa

SEQ ID NO: 505756 - DNA, 25 bp, Homo sapien
gcaggtctgagaggcgaaacgaatc

SEQ ID NO: 505757 - DNA, 25 bp, Homo sapien
tgagaggcgaaacgaatctcccggc

SEQ ID NO: 505758 - DNA, 25 bp, Homo sapien
aattagaggcttctcatctgccttg

SEQ ID NO: 505759 - DNA, 25 bp, Homo sapien
agaggcttctcatctgccttggtcc

SEQ ID NO: 505760 - DNA, 25 bp, Homo sapien
ctgtcactatcatttgacttgaaca

SEQ ID NO: 505761 - DNA, 25 bp, Homo sapien
gacttgaacatttgtggtattgtaa

SEQ ID NO: 505762 - DNA, 25 bp, Homo sapien
aattgcttaagccatacgttctctt

SEQ ID NO: 505763 - DNA, 25 bp, Homo sapien
aagccatacgttctcttaaacagga

SEQ ID NO: 505764 - DNA, 25 bp, Homo sapien
atacgttctcttaaacaggatgttt

SEQ ID NO: 505765 - DNA, 25 bp, Homo sapien
ctttgtctgttatggttaatactcc

SEQ ID NO: 505766 - DNA, 25 bp, Homo sapien
ttttcttgagttcatcacttttgac

SEQ ID NO: 505767 - DNA, 25 bp, Homo sapien
cacttttgactcttgtatgagatgt

SEQ ID NO: 505768 - DNA, 25 bp, Homo sapien
tttgtcataaaagatagccttccac

SEQ ID NO: 505769 - DNA, 25 bp, Homo sapien
agccttccactacttcactaaatga

SEQ ID NO: 505770 - DNA, 25 bp, Homo sapien
atttcagagtaaacactgtgattct

SEQ ID NO: 505771 - DNA, 25 bp, Homo sapien
ggtctgaatgccgagtccctgaatt

SEQ ID NO: 505772 - DNA, 25 bp, Homo sapien
tgaatgccgagtccctgaattcacc

SEQ ID NO: 505773 - DNA, 25 bp, Homo sapien
gccgagtccctgaattcacccagga

SEQ ID NO: 505774 - DNA, 25 bp, Homo sapien
gatgaatagaatatacacactgtgc

SEQ ID NO: 505775 - DNA, 25 bp, Homo sapien
gaatatacacactgtgctaggtgta

SEQ ID NO: 505776 - DNA, 25 bp, Homo sapien
cactgtgctaggtgtatatatacat

SEQ ID NO: 505777 - DNA, 25 bp, Homo sapien
gatatggaaatgactgttctgctgt

SEQ ID NO: 505778 - DNA, 25 bp, Homo sapien
atggaaatgactgttctgctgttaa

SEQ ID NO: 505779 - DNA, 25 bp, Homo sapien
gaaatgactgttctgctgttaagat

SEQ ID NO: 505780 - DNA, 25 bp, Homo sapien
atgactgttctgctgttaagataat

SEQ ID NO: 505781 - DNA, 25 bp, Homo sapien
ctgttctgctgttaagataatgtat

SEQ ID NO: 505782 - DNA, 25 bp, Homo sapien
tatgtcgtttccatttttcatgttt

SEQ ID NO: 505783 - DNA, 25 bp, Homo sapien
tattttttctatgttcacatcagca

SEQ ID NO: 505784 - DNA, 25 bp, Homo sapien
acatcagcattcacttccgttaaat

SEQ ID NO: 505785 - DNA, 25 bp, Homo sapien
gcattcacttccgttaaatttgcca

SEQ ID NO: 505786 - DNA, 25 bp, Homo sapien
tctgttgttattattcctgtaggat

SEQ ID NO: 505787 - DNA, 25 bp, Homo sapien
ggatttattgtacctcacagtattt

SEQ ID NO: 505788 - DNA, 25 bp, Homo sapien
gtttcccaaaataagcatcattagt

SEQ ID NO: 505789 - DNA, 25 bp, Homo sapien
gataagctagctatgtctaggagct

SEQ ID NO: 505790 - DNA, 25 bp, Homo sapien
tgtctaggagctttatcttttcacc

SEQ ID NO: 505791 - DNA, 25 bp, Homo sapien
ttttcacctccttcagaggatgcta

SEQ ID NO: 505792 - DNA, 25 bp, Homo sapien
cacctccttcagaggatgctatggg

SEQ ID NO: 505793 - DNA, 25 bp, Homo sapien
cctctgcccttctgagtaaactgta

SEQ ID NO: 505794 - DNA, 25 bp, Homo sapien
gtaaactgtagggacatcactattc

SEQ ID NO: 505795 - DNA, 25 bp, Homo sapien
tgtagggacatcactattcagaaat

SEQ ID NO: 505796 - DNA, 25 bp, Homo sapien
gcattcttcccctgaaagtcagatc

SEQ ID NO: 505797 - DNA, 25 bp, Homo sapien
tgccaagctgtcattctggaagctt

SEQ ID NO: 505798 - DNA, 25 bp, Homo sapien
gtcattctggaagcttgcacaggtt

SEQ ID NO: 505799 - DNA, 25 bp, Homo sapien
gggacttggcattcaaagctcaaat

SEQ ID NO: 505800 - DNA, 25 bp, Homo sapien
aatgaacttggcttcaaagtcaccc

SEQ ID NO: 505801 - DNA, 25 bp, Homo sapien
acggttcactcagctttacacaaag

SEQ ID NO: 505802 - DNA, 25 bp, Homo sapien
gagagaggcctcacatcatgccatt

SEQ ID NO: 505803 - DNA, 25 bp, Homo sapien
aaaactgaaagaggctacctcagga

SEQ ID NO: 505804 - DNA, 25 bp, Homo sapien
tgctctgcgcgctgaccggactggc

SEQ ID NO: 505805 - DNA, 25 bp, Homo sapien
cgcgggctctttggccgctgccgaa

SEQ ID NO: 505806 - DNA, 25 bp, Homo sapien
ctccgcgaggagactcagctcagag

SEQ ID NO: 505807 - DNA, 25 bp, Homo sapien
cgcgaggagactcagctcagagcac

SEQ ID NO: 505808 - DNA, 25 bp, Homo sapien
acacatggctgtgcaacgccgtcta

SEQ ID NO: 505809 - DNA, 25 bp, Homo sapien
atggctgtgcaacgccgtctagatg

SEQ ID NO: 505810 - DNA, 25 bp, Homo sapien
gtgcaacgccgtctagatgtcatgg

SEQ ID NO: 505811 - DNA, 25 bp, Homo sapien
aacgccgtctagatgtcatggagga

SEQ ID NO: 505812 - DNA, 25 bp, Homo sapien
cgccgtctagatgtcatggaggaga

SEQ ID NO: 505813 - DNA, 25 bp, Homo sapien
tatagggcgaattggagctccaccg

SEQ ID NO: 505814 - DNA, 25 bp, Homo sapien
tagggcgaattggagctccaccgcg

SEQ ID NO: 505815 - DNA, 25 bp, Homo sapien
gaagatctgggcaattttggccttg

SEQ ID NO: 505816 - DNA, 25 bp, Homo sapien
aattttggccttgactctttcctgg

SEQ ID NO: 505817 - DNA, 25 bp, Homo sapien
agagctcaagcttagaagccagccc

SEQ ID NO: 505818 - DNA, 25 bp, Homo sapien
cctgctatttccagcctcctgaagg

SEQ ID NO: 505819 - DNA, 25 bp, Homo sapien
gcctcctgaaggctcagcacggtga

SEQ ID NO: 505820 - DNA, 25 bp, Homo sapien
tcagcacggtgaggcctgacatcct

SEQ ID NO: 505821 - DNA, 25 bp, Homo sapien
gcaacagggagacctacaggatgtt

SEQ ID NO: 505822 - DNA, 25 bp, Homo sapien
aggttgccagatgtgagacttgagt

SEQ ID NO: 505823 - DNA, 25 bp, Homo sapien
gagacttgagtagcatttgtacaca

SEQ ID NO: 505824 - DNA, 25 bp, Homo sapien
gtagcatttgtacacatggccctgt

SEQ ID NO: 505825 - DNA, 25 bp, Homo sapien
atggccctgtattgtccttgaagaa

SEQ ID NO: 505826 - DNA, 25 bp, Homo sapien
gtatgctctgttcagtctgtgtcag

SEQ ID NO: 505827 - DNA, 25 bp, Homo sapien
gtctgtgtcaggcagtatgcttgtc

SEQ ID NO: 505828 - DNA, 25 bp, Homo sapien
ctgtgtcaggcagtatgcttgtcct

SEQ ID NO: 505829 - DNA, 25 bp, Homo sapien
gtgtcaggcagtatgcttgtcctga

SEQ ID NO: 505830 - DNA, 25 bp, Homo sapien
aggcagtatgcttgtcctgaagaga

SEQ ID NO: 505831 - DNA, 25 bp, Homo sapien
agtatgcttgtcctgaagagaggtt

SEQ ID NO: 505832 - DNA, 25 bp, Homo sapien
ttttgtttgaaaacacaatcagctc

SEQ ID NO: 505833 - DNA, 25 bp, Homo sapien
aatcagctctgacagttagacatgc

SEQ ID NO: 505834 - DNA, 25 bp, Homo sapien
gcacacagacgccatagctggattg

SEQ ID NO: 505835 - DNA, 25 bp, Homo sapien
caaatgctgcaatttagcttaaggt

SEQ ID NO: 505836 - DNA, 25 bp, Homo sapien
ttttaactagtccaacacagtcaga

SEQ ID NO: 505837 - DNA, 25 bp, Homo sapien
ggagctcttcccagcaggcggagct

SEQ ID NO: 505838 - DNA, 25 bp, Homo sapien
aaagttctttctgctatagccctgg

SEQ ID NO: 505839 - DNA, 25 bp, Homo sapien
ttgttggctccgaagggatggctcc

SEQ ID NO: 505840 - DNA, 25 bp, Homo sapien
agggatggctccagggtttccccat

SEQ ID NO: 505841 - DNA, 25 bp, Homo sapien
tttccccatgggacagctagggctg

SEQ ID NO: 505842 - DNA, 25 bp, Homo sapien
tggtgagtgggaataccccgccttc

SEQ ID NO: 505843 - DNA, 25 bp, Homo sapien
tctccccaagaaaggccaaacagtg

SEQ ID NO: 505844 - DNA, 25 bp, Homo sapien
ggccaaacagtgtcatgagctggag

SEQ ID NO: 505845 - DNA, 25 bp, Homo sapien
gttgctgaaacctagaacatgtggc

SEQ ID NO: 505846 - DNA, 25 bp, Homo sapien
tgagtccgggcctgcggtagtccta

SEQ ID NO: 505847 - DNA, 25 bp, Homo sapien
ggtagtcctatgcatcagctgcagc

SEQ ID NO: 505848 - DNA, 25 bp, Homo sapien
ggtgggtgggtactgaggtttcctg

SEQ ID NO: 505849 - DNA, 25 bp, Homo sapien
ctcttctttgtgattgtctgtagta

SEQ ID NO: 505850 - DNA, 25 bp, Homo sapien
tcttctttgtgattgtctgtagtat

SEQ ID NO: 505851 - DNA, 25 bp, Homo sapien
ttctttgtgattgtctgtagtatgc

SEQ ID NO: 505852 - DNA, 25 bp, Homo sapien
tctttgtgattgtctgtagtatgct

SEQ ID NO: 505853 - DNA, 25 bp, Homo sapien
ctttgtgattgtctgtagtatgctt

SEQ ID NO: 505854 - DNA, 25 bp, Homo sapien
ttgtgattgtctgtagtatgctttg

SEQ ID NO: 505855 - DNA, 25 bp, Homo sapien
gtgattgtctgtagtatgctttgaa

SEQ ID NO: 505856 - DNA, 25 bp, Homo sapien
gattgtctgtagtatgctttgaagg

SEQ ID NO: 505857 - DNA, 25 bp, Homo sapien
attgtctgtagtatgctttgaaggt

SEQ ID NO: 505858 - DNA, 25 bp, Homo sapien
tgtctgtagtatgctttgaaggtgc

SEQ ID NO: 505859 - DNA, 25 bp, Homo sapien
agcagtgagttattacccacaattt

SEQ ID NO: 505860 - DNA, 25 bp, Homo sapien
gagttattacccacaatttaaagca

SEQ ID NO: 505861 - DNA, 25 bp, Homo sapien
tgaatctttaagttaggtatctacc

SEQ ID NO: 505862 - DNA, 25 bp, Homo sapien
agttaggtatctaccttcccaccag

SEQ ID NO: 505863 - DNA, 25 bp, Homo sapien
tttttctatgatgaggttttaacca

SEQ ID NO: 505864 - DNA, 25 bp, Homo sapien
gaggttttaaccattattcagggtg

SEQ ID NO: 505865 - DNA, 25 bp, Homo sapien
cattattcagggtggtcttttgttt

SEQ ID NO: 505866 - DNA, 25 bp, Homo sapien
agatttacggtgtgtattttataca

SEQ ID NO: 505867 - DNA, 25 bp, Homo sapien
ctgttttttgcagtctttaagtgcc

SEQ ID NO: 505868 - DNA, 25 bp, Homo sapien
gtctttaagtgccatgccaattgtt

SEQ ID NO: 505869 - DNA, 25 bp, Homo sapien
gtgccatgccaattgttcttatatt

SEQ ID NO: 505870 - DNA, 25 bp, Homo sapien
gagggtctcttgattcctaaccgcc

SEQ ID NO: 505871 - DNA, 25 bp, Homo sapien
actgctccaccgctgaacttcgggt

SEQ ID NO: 505872 - DNA, 25 bp, Homo sapien
gaaattgggctgatgtgagctcccc

SEQ ID NO: 505873 - DNA, 25 bp, Homo sapien
ttgggctgatgtgagctccccgtca

SEQ ID NO: 505874 - DNA, 25 bp, Homo sapien
acccgccatggagccggctgtgtgt

SEQ ID NO: 505875 - DNA, 25 bp, Homo sapien
gttcatcagatacagttctccctta

SEQ ID NO: 505876 - DNA, 25 bp, Homo sapien
agatacagttctcccttaaccttgt

SEQ ID NO: 505877 - DNA, 25 bp, Homo sapien
ctccattgcccttggctttttctgg

SEQ ID NO: 505878 - DNA, 25 bp, Homo sapien
tgtgtctcagtctccgtcagtctgt

SEQ ID NO: 505879 - DNA, 25 bp, Homo sapien
tcagtctgtctttctccgctcttct

SEQ ID NO: 505880 - DNA, 25 bp, Homo sapien
gaagggagggtctcttgattcctaa

SEQ ID NO: 505881 - DNA, 25 bp, Homo sapien
ttcccttttccattctccgagggct

SEQ ID NO: 505882 - DNA, 25 bp, Homo sapien
tttccattctccgagggcttaacca

SEQ ID NO: 505883 - DNA, 25 bp, Homo sapien
ttctccgagggcttaaccagctggt

SEQ ID NO: 505884 - DNA, 25 bp, Homo sapien
tccgagggcttaaccagctggtgaa

SEQ ID NO: 505885 - DNA, 25 bp, Homo sapien
ggcttaaccagctggtgaaggttct

SEQ ID NO: 505886 - DNA, 25 bp, Homo sapien
accagctggtgaaggttcttaacca

SEQ ID NO: 505887 - DNA, 25 bp, Homo sapien
tggtgaaggttcttaaccagcaaag

SEQ ID NO: 505888 - DNA, 25 bp, Homo sapien
gaaggttcttaaccagcaaaggagg

SEQ ID NO: 505889 - DNA, 25 bp, Homo sapien
gcggcaccttctgagaggcgcatgc

SEQ ID NO: 505890 - DNA, 25 bp, Homo sapien
gcaccttctgagaggcgcatgctca

SEQ ID NO: 505891 - DNA, 25 bp, Homo sapien
ctgagaggcgcatgctcagtgagtc

SEQ ID NO: 505892 - DNA, 25 bp, Homo sapien
ttgatctctaaaacatagttctgaa

SEQ ID NO: 505893 - DNA, 25 bp, Homo sapien
ttttctgtactctaaatcttttaag

SEQ ID NO: 505894 - DNA, 25 bp, Homo sapien
taagtaagtcttctatatttgctgt

SEQ ID NO: 505895 - DNA, 25 bp, Homo sapien
gcaaataaagctttcctttgacagt

SEQ ID NO: 505896 - DNA, 25 bp, Homo sapien
agctttcctttgacagtgaccttgg

SEQ ID NO: 505897 - DNA, 25 bp, Homo sapien
tttgacagtgaccttggctcagttt

SEQ ID NO: 505898 - DNA, 25 bp, Homo sapien
gacagtgaccttggctcagtttagg

SEQ ID NO: 505899 - DNA, 25 bp, Homo sapien
tagccatgatattcatcaatagaat

SEQ ID NO: 505900 - DNA, 25 bp, Homo sapien
attaactcctatgttgtgttagtgg

SEQ ID NO: 505901 - DNA, 25 bp, Homo sapien
tcctatgttgtgttagtggtatacc

SEQ ID NO: 505902 - DNA, 25 bp, Homo sapien
agtggtataccagatttgtatgtat

SEQ ID NO: 505903 - DNA, 25 bp, Homo sapien
gcaaaccaaaatcggcgagcgccag

SEQ ID NO: 505904 - DNA, 25 bp, Homo sapien
gcgagcgccagcttgcttccctaga

SEQ ID NO: 505905 - DNA, 25 bp, Homo sapien
attcataacatgcttgctcaaatca

SEQ ID NO: 505906 - DNA, 25 bp, Homo sapien
caatcaccttattttacatccgctc

SEQ ID NO: 505907 - DNA, 25 bp, Homo sapien
attttacatccgctccagggagaaa

SEQ ID NO: 505908 - DNA, 25 bp, Homo sapien
atgaagacatggtcctacgttgttc

SEQ ID NO: 505909 - DNA, 25 bp, Homo sapien
gacatggtcctacgttgttctgtaa

SEQ ID NO: 505910 - DNA, 25 bp, Homo sapien
tggtcctacgttgttctgtaattat

SEQ ID NO: 505911 - DNA, 25 bp, Homo sapien
ccctgtgattgctcctgttttataa

SEQ ID NO: 505912 - DNA, 25 bp, Homo sapien
aagtgccttctgatatgcctggcaa

SEQ ID NO: 505913 - DNA, 25 bp, Homo sapien
gatatgcctggcaaaccaaaatcgg

SEQ ID NO: 505914 - DNA, 25 bp, Homo sapien
tcctgatcctctttgtggtaggtgg

SEQ ID NO: 505915 - DNA, 25 bp, Homo sapien
gagaggccagattccgttgatattg

SEQ ID NO: 505916 - DNA, 25 bp, Homo sapien
ggcatcgttgaagccaggaacccag

SEQ ID NO: 505917 - DNA, 25 bp, Homo sapien
ggaacccaggtaatcgtgctgtcca

SEQ ID NO: 505918 - DNA, 25 bp, Homo sapien
acgactcctgaagccacttaacatt

SEQ ID NO: 505919 - DNA, 25 bp, Homo sapien
agccacttaacattcctgagctgtt

SEQ ID NO: 505920 - DNA, 25 bp, Homo sapien
gagctgttatttgcaactgaccgac

SEQ ID NO: 505921 - DNA, 25 bp, Homo sapien
gactgcatccagaccttggcttctg

SEQ ID NO: 505922 - DNA, 25 bp, Homo sapien
attgaacacatgtcttcaggcctca

SEQ ID NO: 505923 - DNA, 25 bp, Homo sapien
gcctcactgatctccttaaaactgg

SEQ ID NO: 505924 - DNA, 25 bp, Homo sapien
tgttcatgaaggtgagccggcctca

SEQ ID NO: 505925 - DNA, 25 bp, Homo sapien
tgaagatgtgcccatccttgacccc

SEQ ID NO: 505926 - DNA, 25 bp, Homo sapien
cacacgtgttgactgcggcatttgt

SEQ ID NO: 505927 - DNA, 25 bp, Homo sapien
gactgcggcatttgtttgtaattat

SEQ ID NO: 505928 - DNA, 25 bp, Homo sapien
atgaaaacatctaagtttccatcta

SEQ ID NO: 505929 - DNA, 25 bp, Homo sapien
tgggagtgcccaacagtggagttct

SEQ ID NO: 505930 - DNA, 25 bp, Homo sapien
gtgcccaacagtggagttctagaga

SEQ ID NO: 505931 - DNA, 25 bp, Homo sapien
cagtggagttctagagagcagtaaa

SEQ ID NO: 505932 - DNA, 25 bp, Homo sapien
aaaaataaatggactagagctgcac

SEQ ID NO: 505933 - DNA, 25 bp, Homo sapien
accacctggccacagaagtatatgt

SEQ ID NO: 505934 - DNA, 25 bp, Homo sapien
ctggccacagaagtatatgtccaat

SEQ ID NO: 505935 - DNA, 25 bp, Homo sapien
tatatgtccaatatgatgctggtgt

SEQ ID NO: 505936 - DNA, 25 bp, Homo sapien
gactataggtacacagcaccaaatt

SEQ ID NO: 505937 - DNA, 25 bp, Homo sapien
taggtacacagcaccaaattttctg

SEQ ID NO: 505938 - DNA, 25 bp, Homo sapien
ggtacacagcaccaaattttctgta

SEQ ID NO: 505939 - DNA, 25 bp, Homo sapien
gtacacagcaccaaattttctgtag

SEQ ID NO: 505940 - DNA, 25 bp, Homo sapien
acacagcaccaaattttctgtagag

SEQ ID NO: 505941 - DNA, 25 bp, Homo sapien
tgctttgtagcccacactagtgttg

SEQ ID NO: 505942 - DNA, 25 bp, Homo sapien
gctttgtagcccacactagtgttga

SEQ ID NO: 505943 - DNA, 25 bp, Homo sapien
ctttgtagcccacactagtgttgaa

SEQ ID NO: 505944 - DNA, 25 bp, Homo sapien
tttgtagcccacactagtgttgaac

SEQ ID NO: 505945 - DNA, 25 bp, Homo sapien
ttgtagcccacactagtgttgaact

SEQ ID NO: 505946 - DNA, 25 bp, Homo sapien
gtagcccacactagtgttgaactcc

SEQ ID NO: 505947 - DNA, 25 bp, Homo sapien
gggtgtttctgcacttggctatgtg

SEQ ID NO: 505948 - DNA, 25 bp, Homo sapien
ggctatgtgtgtcttgtctgatgtc

SEQ ID NO: 505949 - DNA, 25 bp, Homo sapien
gtctgatgtctgtcttctgtagctt

SEQ ID NO: 505950 - DNA, 25 bp, Homo sapien
tagctttgcctctatcagggctgga

SEQ ID NO: 505951 - DNA, 25 bp, Homo sapien
atggttcctgcctcacttgtgggag

SEQ ID NO: 505952 - DNA, 25 bp, Homo sapien
gctggaccagcctgggtttcatctc

SEQ ID NO: 505953 - DNA, 25 bp, Homo sapien
ggtttcatctcccacagtaaagcta

SEQ ID NO: 505954 - DNA, 25 bp, Homo sapien
taagtaagccccacagaccttactg

SEQ ID NO: 505955 - DNA, 25 bp, Homo sapien
ctgccattaatgctgtgctcactat

SEQ ID NO: 505956 - DNA, 25 bp, Homo sapien
ggattttaaggatgtcagactgctg

SEQ ID NO: 505957 - DNA, 25 bp, Homo sapien
cagactgctgtagatgactcaataa

SEQ ID NO: 505958 - DNA, 25 bp, Homo sapien
caccagtaaggaagcaactaaattt

SEQ ID NO: 505959 - DNA, 25 bp, Homo sapien
gttctttgaaaaaggctaacctgag

SEQ ID NO: 505960 - DNA, 25 bp, Homo sapien
aaaggctaacctgagctaggtaaag

SEQ ID NO: 505961 - DNA, 25 bp, Homo sapien
aaggttatatcattcacttttgaaa

SEQ ID NO: 505962 - DNA, 25 bp, Homo sapien
tgaaataaaccatcgagaacacaaa

SEQ ID NO: 505963 - DNA, 25 bp, Homo sapien
tatacaaacttgaaagggttcacct

SEQ ID NO: 505964 - DNA, 25 bp, Homo sapien
ggaatgctatacagctgggaacagc

SEQ ID NO: 505965 - DNA, 25 bp, Homo sapien
cagctgggaacagcagactttctct

SEQ ID NO: 505966 - DNA, 25 bp, Homo sapien
gaaagggttcaccttgccctagcaa

SEQ ID NO: 505967 - DNA, 25 bp, Homo sapien
ttttccccctgaggatcactgacaa

SEQ ID NO: 505968 - DNA, 25 bp, Homo sapien
ggatcactgacaaaaaacactgcac

SEQ ID NO: 505969 - DNA, 25 bp, Homo sapien
atgttatgaagcctcgtgtatcaag

SEQ ID NO: 505970 - DNA, 25 bp, Homo sapien
aagcctcgtgtatcaaggagcccat

SEQ ID NO: 505971 - DNA, 25 bp, Homo sapien
ctcgtgtatcaaggagcccatcgaa

SEQ ID NO: 505972 - DNA, 25 bp, Homo sapien
aggactctgcccaacaaagacttag

SEQ ID NO: 505973 - DNA, 25 bp, Homo sapien
tctgcccaacaaagacttagctaag

SEQ ID NO: 505974 - DNA, 25 bp, Homo sapien
ttagctaagcagtgaccagaaccca

SEQ ID NO: 505975 - DNA, 25 bp, Homo sapien
taagcagtgaccagaacccaccaaa

SEQ ID NO: 505976 - DNA, 25 bp, Homo sapien
gaacccaccaaaaactaggctgcat

SEQ ID NO: 505977 - DNA, 25 bp, Homo sapien
aaaaactaggctgcattgctttgaa

SEQ ID NO: 505978 - DNA, 25 bp, Homo sapien
caatcattttgccatttgtgaaagt

SEQ ID NO: 505979 - DNA, 25 bp, Homo sapien
tcgtaagatgttaacccttggtatt

SEQ ID NO: 505980 - DNA, 25 bp, Homo sapien
actgagcaggcttccctcctgcaag

SEQ ID NO: 505981 - DNA, 25 bp, Homo sapien
aaggagagactctaccgataatgtg

SEQ ID NO: 505982 - DNA, 25 bp, Homo sapien
gagactctaccgataatgtgttaag

SEQ ID NO: 505983 - DNA, 25 bp, Homo sapien
accgataatgtgttaagatcagatt

SEQ ID NO: 505984 - DNA, 25 bp, Homo sapien
gatcagattaatgcaggaaatacac

SEQ ID NO: 505985 - DNA, 25 bp, Homo sapien
acagtgtaataacagtggctgtcat

SEQ ID NO: 505986 - DNA, 25 bp, Homo sapien
tggctgtcattgcaatggttatttc

SEQ ID NO: 505987 - DNA, 25 bp, Homo sapien
cattgcaatggttatttctgttaaa

SEQ ID NO: 505988 - DNA, 25 bp, Homo sapien
tgtgagatctacactacggatttct

SEQ ID NO: 505989 - DNA, 25 bp, Homo sapien
agaattccctctcagttagccgggg

SEQ ID NO: 505990 - DNA, 25 bp, Homo sapien
cgcacagaaggaaggcagccacgca

SEQ ID NO: 505991 - DNA, 25 bp, Homo sapien
tctgctttgtagaaattatatgttt

SEQ ID NO: 505992 - DNA, 25 bp, Homo sapien
tacagattgggggttgtgccatact

SEQ ID NO: 505993 - DNA, 25 bp, Homo sapien
agattgggggttgtgccatactgtt

SEQ ID NO: 505994 - DNA, 25 bp, Homo sapien
taccagtctttaaagcaacatccag

SEQ ID NO: 505995 - DNA, 25 bp, Homo sapien
accagtctttaaagcaacatccaga

SEQ ID NO: 505996 - DNA, 25 bp, Homo sapien
ccagtctttaaagcaacatccagaa

SEQ ID NO: 505997 - DNA, 25 bp, Homo sapien
atgatcatctggaatgatacttagt

SEQ ID NO: 505998 - DNA, 25 bp, Homo sapien
gatcatctggaatgatacttagtgt

SEQ ID NO: 505999 - DNA, 25 bp, Homo sapien
tcatctggaatgatacttagtgtat

SEQ ID NO: 506000 - DNA, 25 bp, Homo sapien
catctggaatgatacttagtgtata

SEQ ID NO: 506001 - DNA, 25 bp, Homo sapien
ctggaatgatacttagtgtatatat

SEQ ID NO: 506002 - DNA, 25 bp, Homo sapien
ggtagtctgttttgaaactaagcac

SEQ ID NO: 506003 - DNA, 25 bp, Homo sapien
cacttgtgtctgaaagatgcagata

SEQ ID NO: 506004 - DNA, 25 bp, Homo sapien
tacacagtgggctctgtttgctgca

SEQ ID NO: 506005 - DNA, 25 bp, Homo sapien
agagtgaaacttttaactgcttagc

SEQ ID NO: 506006 - DNA, 25 bp, Homo sapien
aactgcttagcacacttgccagtga

SEQ ID NO: 506007 - DNA, 25 bp, Homo sapien
ttgccagtgaaatatacctgacaga

SEQ ID NO: 506008 - DNA, 25 bp, Homo sapien
ctgacagagcagaggttataacttt

SEQ ID NO: 506009 - DNA, 25 bp, Homo sapien
ggttataactttggctctaattact

SEQ ID NO: 506010 - DNA, 25 bp, Homo sapien
agtaatggtaagacaacgtgagttt

SEQ ID NO: 506011 - DNA, 25 bp, Homo sapien
gtttacatgctgtttacaatggcat

SEQ ID NO: 506012 - DNA, 25 bp, Homo sapien
tattgcctactattttaaagatgtt

SEQ ID NO: 506013 - DNA, 25 bp, Homo sapien
ttgagatgtgacaagtgttaggact

SEQ ID NO: 506014 - DNA, 25 bp, Homo sapien
gtgttaggacttgtcacagatttct

SEQ ID NO: 506015 - DNA, 25 bp, Homo sapien
ggacttgtcacagatttctaactct

SEQ ID NO: 506016 - DNA, 25 bp, Homo sapien
agatttctaactctgccgcataaac

SEQ ID NO: 506017 - DNA, 25 bp, Homo sapien
actctgccgcataaactataaatct

SEQ ID NO: 506018 - DNA, 25 bp, Homo sapien
aaatctgtaaggtggtacacagcgt

SEQ ID NO: 506019 - DNA, 25 bp, Homo sapien
gtacacagcgtgtcttgttagcaaa

SEQ ID NO: 506020 - DNA, 25 bp, Homo sapien
acagcgtgtcttgttagcaaaattt

SEQ ID NO: 506021 - DNA, 25 bp, Homo sapien
tatgatcacatgtagaagtagcttc

SEQ ID NO: 506022 - DNA, 25 bp, Homo sapien
gaatttcttgtagtcataaatgttt

SEQ ID NO: 506023 - DNA, 25 bp, Homo sapien
aatgtagacatggttaactgggaaa

SEQ ID NO: 506024 - DNA, 25 bp, Homo sapien
gatttgtcttgatggaatcattgtt

SEQ ID NO: 506025 - DNA, 25 bp, Homo sapien
ttgtcttgatggaatcattgtttag

SEQ ID NO: 506026 - DNA, 25 bp, Homo sapien
gtcttgatggaatcattgtttagaa

SEQ ID NO: 506027 - DNA, 25 bp, Homo sapien
gatggaatcattgtttagaatgtaa

SEQ ID NO: 506028 - DNA, 25 bp, Homo sapien
ggccacttaattccattagtcctct

SEQ ID NO: 506029 - DNA, 25 bp, Homo sapien
cacttaattccattagtcctctttt

SEQ ID NO: 506030 - DNA, 25 bp, Homo sapien
gtcctctttttatactgaatatttt

SEQ ID NO: 506031 - DNA, 25 bp, Homo sapien
tttattagatacatgttattccctt

SEQ ID NO: 506032 - DNA, 25 bp, Homo sapien
tattagatacatgttattccctttt

SEQ ID NO: 506033 - DNA, 25 bp, Homo sapien
ttagatacatgttattccctttttt

SEQ ID NO: 506034 - DNA, 25 bp, Homo sapien
tttccttttttagtcaatattgtgt

SEQ ID NO: 506035 - DNA, 25 bp, Homo sapien
aaagaatgtcaaagaaagcagctgg

SEQ ID NO: 506036 - DNA, 25 bp, Homo sapien
agcagctgggactaatgaactttac

SEQ ID NO: 506037 - DNA, 25 bp, Homo sapien
gaactttacattagccatattccat

SEQ ID NO: 506038 - DNA, 25 bp, Homo sapien
ttccattatttcagcttaagtcaaa

SEQ ID NO: 506039 - DNA, 25 bp, Homo sapien
agcttaagtcaaatgtcggtcctca

SEQ ID NO: 506040 - DNA, 25 bp, Homo sapien
gtcaaatgtcggtcctcatgaggca

SEQ ID NO: 506041 - DNA, 25 bp, Homo sapien
gtcctcatgaggcaactggctttga

SEQ ID NO: 506042 - DNA, 25 bp, Homo sapien
aactggctttgacaggagctacgct

SEQ ID NO: 506043 - DNA, 25 bp, Homo sapien
aggagctacgctaattaccacttac

SEQ ID NO: 506044 - DNA, 25 bp, Homo sapien
tacgctaattaccacttaccaacct

SEQ ID NO: 506045 - DNA, 25 bp, Homo sapien
tttttcattttccagagagacaaga

SEQ ID NO: 506046 - DNA, 25 bp, Homo sapien
gattctgtacttaaaaggtactgtc

SEQ ID NO: 506047 - DNA, 25 bp, Homo sapien
ggtactgtcaatatctcactcttgg

SEQ ID NO: 506048 - DNA, 25 bp, Homo sapien
gatatgagctctaaatatgagaagc

SEQ ID NO: 506049 - DNA, 25 bp, Homo sapien
aagcaagttatatgtgttcacctga

SEQ ID NO: 506050 - DNA, 25 bp, Homo sapien
agctgacggacaaagcaaaccctct

SEQ ID NO: 506051 - DNA, 25 bp, Homo sapien
acgtgtgtggaatacagccggtgaa

SEQ ID NO: 506052 - DNA, 25 bp, Homo sapien
ggaatacagccggtgaaaaataatc

SEQ ID NO: 506053 - DNA, 25 bp, Homo sapien
atcactgtagttagaatcacataca

SEQ ID NO: 506054 - DNA, 25 bp, Homo sapien
aaatgattgaatcctccaagaaggt

SEQ ID NO: 506055 - DNA, 25 bp, Homo sapien
gaatcctccaagaaggtatttcaaa

SEQ ID NO: 506056 - DNA, 25 bp, Homo sapien
gggaaatgctatacttataagaatt

SEQ ID NO: 506057 - DNA, 25 bp, Homo sapien
ttttttaattcatcaagcctttcgt

SEQ ID NO: 506058 - DNA, 25 bp, Homo sapien
catcaagcctttcgttttcaaacca

SEQ ID NO: 506059 - DNA, 25 bp, Homo sapien
aaaccaccatttgtcagccttgagg

SEQ ID NO: 506060 - DNA, 25 bp, Homo sapien
tcagccttgaggtagagagacatat

SEQ ID NO: 506061 - DNA, 25 bp, Homo sapien
actttcttaagagatcatgtaacta

SEQ ID NO: 506062 - DNA, 25 bp, Homo sapien
agggataatttcaacccactgcctc

SEQ ID NO: 506063 - DNA, 25 bp, Homo sapien
ccactgcctcttaccagaaacattt

SEQ ID NO: 506064 - DNA, 25 bp, Homo sapien
atctgtaactgctttagtgttaaca

SEQ ID NO: 506065 - DNA, 25 bp, Homo sapien
tgttaacagggtgcaaggtggtttt

SEQ ID NO: 506066 - DNA, 25 bp, Homo sapien
gcaaggtggtttttgtcccgtattg

SEQ ID NO: 506067 - DNA, 25 bp, Homo sapien
aaggttctcatttattgtgattgta

SEQ ID NO: 506068 - DNA, 25 bp, Homo sapien
ggaatcttttccgtaatgctattta

SEQ ID NO: 506069 - DNA, 25 bp, Homo sapien
aacaatggcctctctttgtgtccat

SEQ ID NO: 506070 - DNA, 25 bp, Homo sapien
gtgtccatatatgccttacaccgtg

SEQ ID NO: 506071 - DNA, 25 bp, Homo sapien
ccgtgctgacctgggtatcatccat

SEQ ID NO: 506072 - DNA, 25 bp, Homo sapien
ggtatcatccatgtgctctgaagca

SEQ ID NO: 506073 - DNA, 25 bp, Homo sapien
agcatccaactttactttgcaggtg

SEQ ID NO: 506074 - DNA, 25 bp, Homo sapien
ggtgcatcaatgtagtcctgtccct

SEQ ID NO: 506075 - DNA, 25 bp, Homo sapien
ctgtccctgaactgagtaaccgtgt

SEQ ID NO: 506076 - DNA, 25 bp, Homo sapien
tgagtaaccgtgttcctgaaaagta

SEQ ID NO: 506077 - DNA, 25 bp, Homo sapien
ggcatggcacttgtgattgcaccat

SEQ ID NO: 506078 - DNA, 25 bp, Homo sapien
gctattaaattggtctcccatctcc

SEQ ID NO: 506079 - DNA, 25 bp, Homo sapien
gaatgttatggctgcactgaaggga

SEQ ID NO: 506080 - DNA, 25 bp, Homo sapien
ctgcactgaagggaaatgtcacggt

SEQ ID NO: 506081 - DNA, 25 bp, Homo sapien
tgtcacggtaaatagctgccaaatt

SEQ ID NO: 506082 - DNA, 25 bp, Homo sapien
gctgccaaattatggatcatgccga

SEQ ID NO: 506083 - DNA, 25 bp, Homo sapien
attatggatcatgccgaagtgtcac

SEQ ID NO: 506084 - DNA, 25 bp, Homo sapien
ggatcatgccgaagtgtcacaactg

SEQ ID NO: 506085 - DNA, 25 bp, Homo sapien
tgccgaagtgtcacaactgcactaa

SEQ ID NO: 506086 - DNA, 25 bp, Homo sapien
aagtgtcacaactgcactaaagaca

SEQ ID NO: 506087 - DNA, 25 bp, Homo sapien
atgtagctgctagcatgcatgcaca

SEQ ID NO: 506088 - DNA, 25 bp, Homo sapien
gctgctagcatgcatgcacaacaat

SEQ ID NO: 506089 - DNA, 25 bp, Homo sapien
aatggcttcactgaatgttatggct

SEQ ID NO: 506090 - DNA, 25 bp, Homo sapien
cccattctcacaattatccttcaaa

SEQ ID NO: 506091 - DNA, 25 bp, Homo sapien
aaaaatctatgttcaaatgctttaa

SEQ ID NO: 506092 - DNA, 25 bp, Homo sapien
ttatcacacgatacaagagtatgac

SEQ ID NO: 506093 - DNA, 25 bp, Homo sapien
gagtatgactttgtcagccttctag

SEQ ID NO: 506094 - DNA, 25 bp, Homo sapien
actttgtcagccttctagagttctt

SEQ ID NO: 506095 - DNA, 25 bp, Homo sapien
caatgaagacttgatttctgtcaat

SEQ ID NO: 506096 - DNA, 25 bp, Homo sapien
ctacctgaattttgtgcatgttaca

SEQ ID NO: 506097 - DNA, 25 bp, Homo sapien
tgtagttgtaaccttttctaattca

SEQ ID NO: 506098 - DNA, 25 bp, Homo sapien
ttcaggatgaatacgagatggttgt

SEQ ID NO: 506099 - DNA, 25 bp, Homo sapien
agatggttgtgattgtgcagtgtac

SEQ ID NO: 506100 - DNA, 25 bp, Homo sapien
gtgcagtgtaccaataaagttcgag

SEQ ID NO: 506101 - DNA, 25 bp, Homo sapien
tgccaaatttagtgtgtacctgttt

SEQ ID NO: 506102 - DNA, 25 bp, Homo sapien
gtgtgagcgatctgcagaactggca

SEQ ID NO: 506103 - DNA, 25 bp, Homo sapien
gtgagcgatctgcagaactggcatt

SEQ ID NO: 506104 - DNA, 25 bp, Homo sapien
gagcgatctgcagaactggcattag

SEQ ID NO: 506105 - DNA, 25 bp, Homo sapien
cgatctgcagaactggcattagagg

SEQ ID NO: 506106 - DNA, 25 bp, Homo sapien
gggtggaccgcgatgcattttaaag

SEQ ID NO: 506107 - DNA, 25 bp, Homo sapien
tggaccgcgatgcattttaaaggtt

SEQ ID NO: 506108 - DNA, 25 bp, Homo sapien
ccgcgatgcattttaaaggttggga

SEQ ID NO: 506109 - DNA, 25 bp, Homo sapien
taaaggttgggaaagagctaagcca

SEQ ID NO: 506110 - DNA, 25 bp, Homo sapien
aagagctaagccattggattccttt

SEQ ID NO: 506111 - DNA, 25 bp, Homo sapien
gaaggagtggaattgtgtaagataa

SEQ ID NO: 506112 - DNA, 25 bp, Homo sapien
acaccggccagtaagcgcgcgtaat

SEQ ID NO: 506113 - DNA, 25 bp, Homo sapien
tgctctgcgcgctgaccggactggc

SEQ ID NO: 506114 - DNA, 25 bp, Homo sapien
tccgcgaggagactcagctcagagc

SEQ ID NO: 506115 - DNA, 25 bp, Homo sapien
gtaagcgcgcgtaatacgactcact

SEQ ID NO: 506116 - DNA, 25 bp, Homo sapien
agctcagagcacagcgtgtgacaga

SEQ ID NO: 506117 - DNA, 25 bp, Homo sapien
agagcacagcgtgtgacagacacat

SEQ ID NO: 506118 - DNA, 25 bp, Homo sapien
acacatggctgtgcaacgccgtcta

SEQ ID NO: 506119 - DNA, 25 bp, Homo sapien
gtgcaacgccgtctagatgtcatgg

SEQ ID NO: 506120 - DNA, 25 bp, Homo sapien
aacgccgtctagatgtcatggagga

SEQ ID NO: 506121 - DNA, 25 bp, Homo sapien
tatagggcgaattggagctccaccg

SEQ ID NO: 506122 - DNA, 25 bp, Homo sapien
tagggcgaattggagctccaccgcg

SEQ ID NO: 506123 - DNA, 25 bp, Homo sapien
ctgaggcctcggcaatgggcatgat

SEQ ID NO: 506124 - DNA, 25 bp, Homo sapien
agggcaccctgctagagctgggtgt

SEQ ID NO: 506125 - DNA, 25 bp, Homo sapien
aaaaggcttgagacagatccctggc

SEQ ID NO: 506126 - DNA, 25 bp, Homo sapien
agatccctggccttgaggacgtgct

SEQ ID NO: 506127 - DNA, 25 bp, Homo sapien
ttgaggacgtgcttcgcatgcagcc

SEQ ID NO: 506128 - DNA, 25 bp, Homo sapien
gacgtgcttcgcatgcagcctgcaa

SEQ ID NO: 506129 - DNA, 25 bp, Homo sapien
atgcagcctgcaacccagggagtgc

SEQ ID NO: 506130 - DNA, 25 bp, Homo sapien
aagtgcatttgtttatggagcacat

SEQ ID NO: 506131 - DNA, 25 bp, Homo sapien
gcacatatttgtgtggcaggtacca

SEQ ID NO: 506132 - DNA, 25 bp, Homo sapien
ttgtgtggcaggtaccattctagat

SEQ ID NO: 506133 - DNA, 25 bp, Homo sapien
ggagattcagaaataagcccccctc

SEQ ID NO: 506134 - DNA, 25 bp, Homo sapien
atcctccgcgagctcaggcgttggc

SEQ ID NO: 506135 - DNA, 25 bp, Homo sapien
tccgcgagctcaggcgttggcattt

SEQ ID NO: 506136 - DNA, 25 bp, Homo sapien
tcttggtctagtgaccaccagcctg

SEQ ID NO: 506137 - DNA, 25 bp, Homo sapien
tggacagctacggagaacccgcctt

SEQ ID NO: 506138 - DNA, 25 bp, Homo sapien
cagctacggagaacccgccttaggt

SEQ ID NO: 506139 - DNA, 25 bp, Homo sapien
ccgccttaggtagaaagaaagtgat

SEQ ID NO: 506140 - DNA, 25 bp, Homo sapien
ttcctttgcaagagtttgacccggg

SEQ ID NO: 506141 - DNA, 25 bp, Homo sapien
tgcaagagtttgacccgggacccta

SEQ ID NO: 506142 - DNA, 25 bp, Homo sapien
tgacccgggaccctaactgcttaat

SEQ ID NO: 506143 - DNA, 25 bp, Homo sapien
ccgggaccctaactgcttaatgcat

SEQ ID NO: 506144 - DNA, 25 bp, Homo sapien
ggaccctaactgcttaatgcatatt

SEQ ID NO: 506145 - DNA, 25 bp, Homo sapien
aaaattttgtctgacagctgggcgt

SEQ ID NO: 506146 - DNA, 25 bp, Homo sapien
aaattttgtctgacagctgggcgtg

SEQ ID NO: 506147 - DNA, 25 bp, Homo sapien
aattttgtctgacagctgggcgtgg

SEQ ID NO: 506148 - DNA, 25 bp, Homo sapien
attttgtctgacagctgggcgtggt

SEQ ID NO: 506149 - DNA, 25 bp, Homo sapien
ttttgtctgacagctgggcgtggtt

SEQ ID NO: 506150 - DNA, 25 bp, Homo sapien
tttgtctgacagctgggcgtggttg

SEQ ID NO: 506151 - DNA, 25 bp, Homo sapien
aggtgggcggctcacgaggagatca

SEQ ID NO: 506152 - DNA, 25 bp, Homo sapien
ggtgggcggctcacgaggagatcaa

SEQ ID NO: 506153 - DNA, 25 bp, Homo sapien
tgggcggctcacgaggagatcaaga

SEQ ID NO: 506154 - DNA, 25 bp, Homo sapien
gggcggctcacgaggagatcaagac

SEQ ID NO: 506155 - DNA, 25 bp, Homo sapien
ggcggctcacgaggagatcaagacc

SEQ ID NO: 506156 - DNA, 25 bp, Homo sapien
tgcctagaagagtccctccacataa

SEQ ID NO: 506157 - DNA, 25 bp, Homo sapien
gagtccctccacataataggtgctg

SEQ ID NO: 506158 - DNA, 25 bp, Homo sapien
gcatcagacatctaatactcacctt

SEQ ID NO: 506159 - DNA, 25 bp, Homo sapien
tactcaccttaaagtagggctgcac

SEQ ID NO: 506160 - DNA, 25 bp, Homo sapien
agggctgcacctaagtcatccaaga

SEQ ID NO: 506161 - DNA, 25 bp, Homo sapien
agggattttgtcatcttgttctaaa

SEQ ID NO: 506162 - DNA, 25 bp, Homo sapien
ttgttctaaaactctccaggacccg

SEQ ID NO: 506163 - DNA, 25 bp, Homo sapien
ccggactgcacaaacatcctttgtt

SEQ ID NO: 506164 - DNA, 25 bp, Homo sapien
atcctttgttaagccaattcctgat

SEQ ID NO: 506165 - DNA, 25 bp, Homo sapien
aagccaattcctgattaccatcaca

SEQ ID NO: 506166 - DNA, 25 bp, Homo sapien
gtaatcttcagtttatttctggtaa

SEQ ID NO: 506167 - DNA, 25 bp, Homo sapien
ccctcagagttccagtagttgccaa

SEQ ID NO: 506168 - DNA, 25 bp, Homo sapien
agagttccagtagttgccaaccctg

SEQ ID NO: 506169 - DNA, 25 bp, Homo sapien
agtagttgccaaccctgctaacatg

SEQ ID NO: 506170 - DNA, 25 bp, Homo sapien
ttgccaaccctgctaacatggtttt

SEQ ID NO: 506171 - DNA, 25 bp, Homo sapien
cctgctaacatggttttgcacatct

SEQ ID NO: 506172 - DNA, 25 bp, Homo sapien
atggttttgcacatctagcatccag

SEQ ID NO: 506173 - DNA, 25 bp, Homo sapien
tgcacatctagcatccagaacagtg

SEQ ID NO: 506174 - DNA, 25 bp, Homo sapien
agaacagtgagaatgtatttctgct

SEQ ID NO: 506175 - DNA, 25 bp, Homo sapien
tgctgttttaaggtacccagttcat

SEQ ID NO: 506176 - DNA, 25 bp, Homo sapien
gttacagcaatcctaggaagctaat

SEQ ID NO: 506177 - DNA, 25 bp, Homo sapien
taggaagctaatactctgacagaaa

SEQ ID NO: 506178 - DNA, 25 bp, Homo sapien
gttactgcttaaagacggaatttca

SEQ ID NO: 506179 - DNA, 25 bp, Homo sapien
aaatttctccagtcctacatttctg

SEQ ID NO: 506180 - DNA, 25 bp, Homo sapien
tccagtcctacatttctgaattgac

SEQ ID NO: 506181 - DNA, 25 bp, Homo sapien
ctgaattgacttctagcacatcaaa

SEQ ID NO: 506182 - DNA, 25 bp, Homo sapien
gacttctagcacatcaaaaatattt

SEQ ID NO: 506183 - DNA, 25 bp, Homo sapien
atttcagtcattatcagtctcatta

SEQ ID NO: 506184 - DNA, 25 bp, Homo sapien
gtctcattaactgaaatgccaaatg

SEQ ID NO: 506185 - DNA, 25 bp, Homo sapien
gccaaatgctaaatgcagtgttctt

SEQ ID NO: 506186 - DNA, 25 bp, Homo sapien
ttaatggagtgggttgcccatccct

SEQ ID NO: 506187 - DNA, 25 bp, Homo sapien
ttgcccatccctgaaatgtcttatt

SEQ ID NO: 506188 - DNA, 25 bp, Homo sapien
tgtcttattttcaagtgcctggcct

SEQ ID NO: 506189 - DNA, 25 bp, Homo sapien
atttcaagcagggtcatcttggaac

SEQ ID NO: 506190 - DNA, 25 bp, Homo sapien
gcagggtcatcttggaacaggacac

SEQ ID NO: 506191 - DNA, 25 bp, Homo sapien
aacaggacacaggatagccaaaaac

SEQ ID NO: 506192 - DNA, 25 bp, Homo sapien
aaacaatccattgatacacttggtg

SEQ ID NO: 506193 - DNA, 25 bp, Homo sapien
aatccattgatacacttggtgacat

SEQ ID NO: 506194 - DNA, 25 bp, Homo sapien
atacacttggtgacattaattgaga

SEQ ID NO: 506195 - DNA, 25 bp, Homo sapien
gggagtcagagaaagtttgcatcaa

SEQ ID NO: 506196 - DNA, 25 bp, Homo sapien
gagaaagtttgcatcaaaatgtcat

SEQ ID NO: 506197 - DNA, 25 bp, Homo sapien
gtcatcagggattcatttccatcat

SEQ ID NO: 506198 - DNA, 25 bp, Homo sapien
tttccatcatttcaagcagggtcat

SEQ ID NO: 506199 - DNA, 25 bp, Homo sapien
ccatcatttcaagcagggtcatctt

SEQ ID NO: 506200 - DNA, 25 bp, Homo sapien
tacctacctctgtaaattgctgcaa

SEQ ID NO: 506201 - DNA, 25 bp, Homo sapien
gaattacatgaggtatttcctgtca

SEQ ID NO: 506202 - DNA, 25 bp, Homo sapien
gtatttcctgtcaatctccttgaac

SEQ ID NO: 506203 - DNA, 25 bp, Homo sapien
actatctattagttcttcattctga

SEQ ID NO: 506204 - DNA, 25 bp, Homo sapien
agttcttcattctgatgtttctaaa

SEQ ID NO: 506205 - DNA, 25 bp, Homo sapien
caaactaatcttatgctgtttctaa

SEQ ID NO: 506206 - DNA, 25 bp, Homo sapien
taatctaaatcttgatgctgcctgt

SEQ ID NO: 506207 - DNA, 25 bp, Homo sapien
gatgctgcctgtcatactaataaag

SEQ ID NO: 506208 - DNA, 25 bp, Homo sapien
tccatccaagttgcttgtcttgtct

SEQ ID NO: 506209 - DNA, 25 bp, Homo sapien
ttgcttgtcttgtctgtccctcagt

SEQ ID NO: 506210 - DNA, 25 bp, Homo sapien
gtttcctcatctgttcagagggtac

SEQ ID NO: 506211 - DNA, 25 bp, Homo sapien
aatcacgatttttgctcgtggcctt

SEQ ID NO: 506212 - DNA, 25 bp, Homo sapien
tcgtggccttctgggtttatccgta

SEQ ID NO: 506213 - DNA, 25 bp, Homo sapien
gggtttatccgtacgccgaagacag

SEQ ID NO: 506214 - DNA, 25 bp, Homo sapien
caggcacctgtattacatgctaagg

SEQ ID NO: 506215 - DNA, 25 bp, Homo sapien
tttggaatcgcctttgaaatgtaat

SEQ ID NO: 506216 - DNA, 25 bp, Homo sapien
gaaatgtaatttccctcaccttggc

SEQ ID NO: 506217 - DNA, 25 bp, Homo sapien
tttcaggcagcagatttaacccatg

SEQ ID NO: 506218 - DNA, 25 bp, Homo sapien
gatttaacccatggcaactgtaact

SEQ ID NO: 506219 - DNA, 25 bp, Homo sapien
ggcaactgtaactcatcttgtgtga

SEQ ID NO: 506220 - DNA, 25 bp, Homo sapien
catcttgtgtgagtggcggtttata

SEQ ID NO: 506221 - DNA, 25 bp, Homo sapien
tagtattgtatcctgtggcatcata

SEQ ID NO: 506222 - DNA, 25 bp, Homo sapien
agtatcagactactgtcccctgtgc

SEQ ID NO: 506223 - DNA, 25 bp, Homo sapien
gtgctcagcctgatactgttactca

SEQ ID NO: 506224 - DNA, 25 bp, Homo sapien
tgatactgttactcattgcgctgga

SEQ ID NO: 506225 - DNA, 25 bp, Homo sapien
cattgcgctggagttggtcaacatt

SEQ ID NO: 506226 - DNA, 25 bp, Homo sapien
ctgtttgtgggaagaatgcgcatga

SEQ ID NO: 506227 - DNA, 25 bp, Homo sapien
agaatgcgcatgagtatcagcagta

SEQ ID NO: 506228 - DNA, 25 bp, Homo sapien
gtatcagcagtacctaaagtttgta

SEQ ID NO: 506229 - DNA, 25 bp, Homo sapien
gatcttgcagtacacggagaacctg

SEQ ID NO: 506230 - DNA, 25 bp, Homo sapien
tggcttacaccagttacgaaaagaa

SEQ ID NO: 506231 - DNA, 25 bp, Homo sapien
gaaactatcaatcttacacatacag

SEQ ID NO: 506232 - DNA, 25 bp, Homo sapien
gttaatacatttagccaagaaatcc

SEQ ID NO: 506233 - DNA, 25 bp, Homo sapien
aggctgccatcgtggtctatgacat

SEQ ID NO: 506234 - DNA, 25 bp, Homo sapien
aacacagatacatttgcacgggcca

SEQ ID NO: 506235 - DNA, 25 bp, Homo sapien
aaggagctacagaggcaggccagcc

SEQ ID NO: 506236 - DNA, 25 bp, Homo sapien
acatcgtcattgcactcgcgggtaa

SEQ ID NO: 506237 - DNA, 25 bp, Homo sapien
gtaacaaggcagacctggccagcaa

SEQ ID NO: 506238 - DNA, 25 bp, Homo sapien
acctggccagcaagagagccgtgga

SEQ ID NO: 506239 - DNA, 25 bp, Homo sapien
gagccgtggaattccaggaagcaca

SEQ ID NO: 506240 - DNA, 25 bp, Homo sapien
aagcctatgcagacgacaacagttt

SEQ ID NO: 506241 - DNA, 25 bp, Homo sapien
gaacgaaatcttcatggcaatagct

SEQ ID NO: 506242 - DNA, 25 bp, Homo sapien
agctaagaagcttcccaagaacgag

SEQ ID NO: 506243 - DNA, 25 bp, Homo sapien
aagaacgagccccagaatgcaactg

SEQ ID NO: 506244 - DNA, 25 bp, Homo sapien
gccccgaatttcaccttaaaccatg

SEQ ID NO: 506245 - DNA, 25 bp, Homo sapien
cgaatttcaccttaaaccatgatga

SEQ ID NO: 506246 - DNA, 25 bp, Homo sapien
ttaaaccatgatgaaccaagcccag

SEQ ID NO: 506247 - DNA, 25 bp, Homo sapien
gtctgagcctgagaaatcctggcat

SEQ ID NO: 506248 - DNA, 25 bp, Homo sapien
agtggattctgaagcccgggacgat

SEQ ID NO: 506249 - DNA, 25 bp, Homo sapien
aagcccgggacgatggcaggttcga

SEQ ID NO: 506250 - DNA, 25 bp, Homo sapien
acgatggcaggttcgagagagaatt

SEQ ID NO: 506251 - DNA, 25 bp, Homo sapien
gagcctgagaaatcctggcatttgt

SEQ ID NO: 506252 - DNA, 25 bp, Homo sapien
gagaaatcctggcatttgtagccca

SEQ ID NO: 506253 - DNA, 25 bp, Homo sapien
atcctggcatttgtagcccagggct

SEQ ID NO: 506254 - DNA, 25 bp, Homo sapien
tagcccagggctgcgaggaagccac

SEQ ID NO: 506255 - DNA, 25 bp, Homo sapien
gtaacgtgcctgtgggagtgaccaa

SEQ ID NO: 506256 - DNA, 25 bp, Homo sapien
cctgtgggagtgaccaagggccacc

SEQ ID NO: 506257 - DNA, 25 bp, Homo sapien
tgggagtgaccaagggccacccgcc

SEQ ID NO: 506258 - DNA, 25 bp, Homo sapien
ccgcccaagggaaaatgttcattct

SEQ ID NO: 506259 - DNA, 25 bp, Homo sapien
gttcattcttcatcagctttgctaa

SEQ ID NO: 506260 - DNA, 25 bp, Homo sapien
agctttgctaattctgctttgaggc

SEQ ID NO: 506261 - DNA, 25 bp, Homo sapien
ctgctttgaggcagtaaaatgcaaa

SEQ ID NO: 506262 - DNA, 25 bp, Homo sapien
tattttgtactctttatattagaat

SEQ ID NO: 506263 - DNA, 25 bp, Homo sapien
gaatttgtaactagattgatgtatt

SEQ ID NO: 506264 - DNA, 25 bp, Homo sapien
aattcaatgttttagttgtgtgata

SEQ ID NO: 506265 - DNA, 25 bp, Homo sapien
aacatattcattctattggaatttg

SEQ ID NO: 506266 - DNA, 25 bp, Homo sapien
tccacgccaacttctttcaaagctg

SEQ ID NO: 506267 - DNA, 25 bp, Homo sapien
atctgttgctttgatggagagccac

SEQ ID NO: 506268 - DNA, 25 bp, Homo sapien
atggagagccacctgtttcatgctg

SEQ ID NO: 506269 - DNA, 25 bp, Homo sapien
gtttcatgctgtcccaaaggtggag

SEQ ID NO: 506270 - DNA, 25 bp, Homo sapien
ggtggagaaacatcagaactcttaa

SEQ ID NO: 506271 - DNA, 25 bp, Homo sapien
tcagaactcttaactcctttagcca

SEQ ID NO: 506272 - DNA, 25 bp, Homo sapien
ctttctctttcgttctagttgttct

SEQ ID NO: 506273 - DNA, 25 bp, Homo sapien
gttcttttagtacagcagcacgtgc

SEQ ID NO: 506274 - DNA, 25 bp, Homo sapien
cagcagcacgtgcatttgcatgggc

SEQ ID NO: 506275 - DNA, 25 bp, Homo sapien
atgggccttcagtgattcgattttt

SEQ ID NO: 506276 - DNA, 25 bp, Homo sapien
attcgatttttttgcgcctcatgtc

SEQ ID NO: 506277 - DNA, 25 bp, Homo sapien
attcctgccaggtacttccagtctg

SEQ ID NO: 506278 - DNA, 25 bp, Homo sapien
aggtacttccagtctgattccagga

SEQ ID NO: 506279 - DNA, 25 bp, Homo sapien
acttccagtctgattccaggaatgc

SEQ ID NO: 506280 - DNA, 25 bp, Homo sapien
ggaatgcctcaacaggttcctcctt

SEQ ID NO: 506281 - DNA, 25 bp, Homo sapien
tccttcagagtctgctggccagatt

SEQ ID NO: 506282 - DNA, 25 bp, Homo sapien
gagtctgctggccagattgaccaga

SEQ ID NO: 506283 - DNA, 25 bp, Homo sapien
ggccagattgaccagaacttcaaaa

SEQ ID NO: 506284 - DNA, 25 bp, Homo sapien
ataaattacaaggaggcttttcagc

SEQ ID NO: 506285 - DNA, 25 bp, Homo sapien
ggcttttcagcatgaagttgctcat

SEQ ID NO: 506286 - DNA, 25 bp, Homo sapien
tcatgaaatgcctcctggctccaaa

SEQ ID NO: 506287 - DNA, 25 bp, Homo sapien
ctggctccaaatctcctttttaggt

SEQ ID NO: 506288 - DNA, 25 bp, Homo sapien
gctttagtatcccatgtctgccgtt

SEQ ID NO: 506289 - DNA, 25 bp, Homo sapien
agtatcccatgtctgccgttttcta

SEQ ID NO: 506290 - DNA, 25 bp, Homo sapien
aaagataatattttctcattgactc

SEQ ID NO: 506291 - DNA, 25 bp, Homo sapien
gactctgtttttgattaattttaca

SEQ ID NO: 506292 - DNA, 25 bp, Homo sapien
gtagtagaacttgttaacatcatgt

SEQ ID NO: 506293 - DNA, 25 bp, Homo sapien
aacatcatgttaagggtgctttagt

SEQ ID NO: 506294 - DNA, 25 bp, Homo sapien
aagggtgctttagtatcacagtctg

SEQ ID NO: 506295 - DNA, 25 bp, Homo sapien
ggtgctttagtatcacagtctgtga

SEQ ID NO: 506296 - DNA, 25 bp, Homo sapien
tcacagtctgtgatatatcagaaag

SEQ ID NO: 506297 - DNA, 25 bp, Homo sapien
cagaaagggcattagagctatctct

SEQ ID NO: 506298 - DNA, 25 bp, Homo sapien
gcattagagctatctctatgagcca

SEQ ID NO: 506299 - DNA, 25 bp, Homo sapien
gctcctgggcctccgggaagacggg

SEQ ID NO: 506300 - DNA, 25 bp, Homo sapien
gaagacgggcccctgtttgccatct

SEQ ID NO: 506301 - DNA, 25 bp, Homo sapien
ctgctgcgtgtggagcctcgagtgg

SEQ ID NO: 506302 - DNA, 25 bp, Homo sapien
agtgggccctggctgccactaccgt

SEQ ID NO: 506303 - DNA, 25 bp, Homo sapien
tgccactaccgtacagaggccgtgt

SEQ ID NO: 506304 - DNA, 25 bp, Homo sapien
actaccgtacagaggccgtgtcgcg

SEQ ID NO: 506305 - DNA, 25 bp, Homo sapien
tacagaggccgtgtcgcgctgggct

SEQ ID NO: 506306 - DNA, 25 bp, Homo sapien
gggtcaggaagaattctgccaagta

SEQ ID NO: 506307 - DNA, 25 bp, Homo sapien
aattctgccaagtatctttactgtc

SEQ ID NO: 506308 - DNA, 25 bp, Homo sapien
aagtggtcacagaaatttgtgatct

SEQ ID NO: 506309 - DNA, 25 bp, Homo sapien
gtgatctgaaaacccggctcccttc

SEQ ID NO: 506310 - DNA, 25 bp, Homo sapien
ggcttggatccagattagaattgat

SEQ ID NO: 506311 - DNA, 25 bp, Homo sapien
ttagaattgatctttgttttcactt

SEQ ID NO: 506312 - DNA, 25 bp, Homo sapien
aaggtgacagctatactggtccaac

SEQ ID NO: 506313 - DNA, 25 bp, Homo sapien
tatactggtccaacatcgcctgctt

SEQ ID NO: 506314 - DNA, 25 bp, Homo sapien
atcgcctgcttattgtcagggtaca

SEQ ID NO: 506315 - DNA, 25 bp, Homo sapien
tcaaacttctccctgtagaccgtaa

SEQ ID NO: 506316 - DNA, 25 bp, Homo sapien
gtagaccgtaaggatgaattccaca

SEQ ID NO: 506317 - DNA, 25 bp, Homo sapien
gaattccacaataggatccttttta

SEQ ID NO: 506318 - DNA, 25 bp, Homo sapien
ttaaattgttgcctagtcctgccaa

SEQ ID NO: 506319 - DNA, 25 bp, Homo sapien
ttgcctagtcctgccaaggttatta

SEQ ID NO: 506320 - DNA, 25 bp, Homo sapien
gccaaggttattatgtgcatctgtt

SEQ ID NO: 506321 - DNA, 25 bp, Homo sapien
gctaattctagacactaacatctgg

SEQ ID NO: 506322 - DNA, 25 bp, Homo sapien
taccggtctggtatggacatgaaca

SEQ ID NO: 506323 - DNA, 25 bp, Homo sapien
agtgcctttcaacttatccctgaat

SEQ ID NO: 506324 - DNA, 25 bp, Homo sapien
acttatccctgaatttttctcttct

SEQ ID NO: 506325 - DNA, 25 bp, Homo sapien
tttctcttctcaaagttctaggcag

SEQ ID NO: 506326 - DNA, 25 bp, Homo sapien
gcagtaattttaatgccctcaaatt

SEQ ID NO: 506327 - DNA, 25 bp, Homo sapien
gctgattacttagagcttataaatt

SEQ ID NO: 506328 - DNA, 25 bp, Homo sapien
aaattagctacactttatgacacta

SEQ ID NO: 506329 - DNA, 25 bp, Homo sapien
tagagctatgacttatgcatatcat

SEQ ID NO: 506330 - DNA, 25 bp, Homo sapien
gcatatcatacctgtcaagctacct

SEQ ID NO: 506331 - DNA, 25 bp, Homo sapien
atacctgtcaagctacctagcacca

SEQ ID NO: 506332 - DNA, 25 bp, Homo sapien
ctgccccgggttttggagaggatgt

SEQ ID NO: 506333 - DNA, 25 bp, Homo sapien
agaggatgtgcccaataggcttgtc

SEQ ID NO: 506334 - DNA, 25 bp, Homo sapien
gtgcccaataggcttgtcgataaca

SEQ ID NO: 506335 - DNA, 25 bp, Homo sapien
aggcttgtcgataacattgatatga

SEQ ID NO: 506336 - DNA, 25 bp, Homo sapien
tgaggtacagtctgcgcattcttat

SEQ ID NO: 506337 - DNA, 25 bp, Homo sapien
gtacagtctgcgcattcttataggg

SEQ ID NO: 506338 - DNA, 25 bp, Homo sapien
tataggggaccctcctcaccatgat

SEQ ID NO: 506339 - DNA, 25 bp, Homo sapien
ggagaaggccccagtgcagaatgaa

SEQ ID NO: 506340 - DNA, 25 bp, Homo sapien
aaggccccagtgcagaatgaagccc

SEQ ID NO: 506341 - DNA, 25 bp, Homo sapien
gtgcagaatgaagcccccgctttag

SEQ ID NO: 506342 - DNA, 25 bp, Homo sapien
ccgctttaggaggtggtgaatacca

SEQ ID NO: 506343 - DNA, 25 bp, Homo sapien
ttaatgatttgtcttgatggaatca

SEQ ID NO: 506344 - DNA, 25 bp, Homo sapien
gatttgtcttgatggaatcattgtt

SEQ ID NO: 506345 - DNA, 25 bp, Homo sapien
atttgtcttgatggaatcattgttt

SEQ ID NO: 506346 - DNA, 25 bp, Homo sapien
ttgtcttgatggaatcattgtttag

SEQ ID NO: 506347 - DNA, 25 bp, Homo sapien
tgtcttgatggaatcattgtttaga

SEQ ID NO: 506348 - DNA, 25 bp, Homo sapien
gtcttgatggaatcattgtttagaa

SEQ ID NO: 506349 - DNA, 25 bp, Homo sapien
gatggaatcattgtttagaatgtaa

SEQ ID NO: 506350 - DNA, 25 bp, Homo sapien
attttattagatacatgttattccc

SEQ ID NO: 506351 - DNA, 25 bp, Homo sapien
tttattagatacatgttattccctt

SEQ ID NO: 506352 - DNA, 25 bp, Homo sapien
ttattagatacatgttattcccttt

SEQ ID NO: 506353 - DNA, 25 bp, Homo sapien
tattagatacatgttattccctttt

SEQ ID NO: 506354 - DNA, 25 bp, Homo sapien
aacttcccctagttcaccattcatt

SEQ ID NO: 506355 - DNA, 25 bp, Homo sapien
ttcccctagttcaccattcattcat

SEQ ID NO: 506356 - DNA, 25 bp, Homo sapien
tcattcatttgaacattaggaggca

SEQ ID NO: 506357 - DNA, 25 bp, Homo sapien
aacattaggaggcaatttagtgacc

SEQ ID NO: 506358 - DNA, 25 bp, Homo sapien
tttagtgacctgttgtacctgacca

SEQ ID NO: 506359 - DNA, 25 bp, Homo sapien
tagtgacctgttgtacctgaccatg

SEQ ID NO: 506360 - DNA, 25 bp, Homo sapien
gtacctgaccatgttcttaaggggg

SEQ ID NO: 506361 - DNA, 25 bp, Homo sapien
ttcccagaaaagtctaccatatata

SEQ ID NO: 506362 - DNA, 25 bp, Homo sapien
aatccttaacctcaattctctgtcc

SEQ ID NO: 506363 - DNA, 25 bp, Homo sapien
tcaattctctgtcctcttcatgtct

SEQ ID NO: 506364 - DNA, 25 bp, Homo sapien
cttcatgtcttacccagatatctca

SEQ ID NO: 506365 - DNA, 25 bp, Homo sapien
tgtttctccagtcagcttttgtcaa

SEQ ID NO: 506366 - DNA, 25 bp, Homo sapien
tttctccagtcagcttttgtcaact

SEQ ID NO: 506367 - DNA, 25 bp, Homo sapien
tccagtcagcttttgtcaactctaa

SEQ ID NO: 506368 - DNA, 25 bp, Homo sapien
gtcagcttttgtcaactctaatagt

SEQ ID NO: 506369 - DNA, 25 bp, Homo sapien
gaaattatcacaactatttagaaac

SEQ ID NO: 506370 - DNA, 25 bp, Homo sapien
aatgttctttttgatataagctata

SEQ ID NO: 506371 - DNA, 25 bp, Homo sapien
acttggaaaaatacattggtatcta

SEQ ID NO: 506372 - DNA, 25 bp, Homo sapien
aatttgaggtgtgttaagactgctt

SEQ ID NO: 506373 - DNA, 25 bp, Homo sapien
gatgataacatttaaggccttcaaa

SEQ ID NO: 506374 - DNA, 25 bp, Homo sapien
gataacatttaaggccttcaaaagt

SEQ ID NO: 506375 - DNA, 25 bp, Homo sapien
tttttccttgtttctccagtcagct

SEQ ID NO: 506376 - DNA, 25 bp, Homo sapien
agatgccttcaaagcagttgtgaat

SEQ ID NO: 506377 - DNA, 25 bp, Homo sapien
agttgtgaatgctcggacagccctc

SEQ ID NO: 506378 - DNA, 25 bp, Homo sapien
ctcggacagccctcctgaaaaacat

SEQ ID NO: 506379 - DNA, 25 bp, Homo sapien
gtgggactcaaatgcaaacagactt

SEQ ID NO: 506380 - DNA, 25 bp, Homo sapien
aacagactttccctagaggtgaaat

SEQ ID NO: 506381 - DNA, 25 bp, Homo sapien
gtatatcagtaattcaggtacccat

SEQ ID NO: 506382 - DNA, 25 bp, Homo sapien
ttcaggtacccatttcatagacatt

SEQ ID NO: 506383 - DNA, 25 bp, Homo sapien
attttactgagaaatgacctgcatt

SEQ ID NO: 506384 - DNA, 25 bp, Homo sapien
gacctgcatttgtatgaagtgaact

SEQ ID NO: 506385 - DNA, 25 bp, Homo sapien
gaagtgaactgagcgtcacaccctg

SEQ ID NO: 506386 - DNA, 25 bp, Homo sapien
ctgagcgtcacaccctgtacttcat

SEQ ID NO: 506387 - DNA, 25 bp, Homo sapien
aataattaaacctactccacagatg

SEQ ID NO: 506388 - DNA, 25 bp, Homo sapien
aattaaacctactccacagatgagg

SEQ ID NO: 506389 - DNA, 25 bp, Homo sapien
cccaaggttataacagcaagaattg

SEQ ID NO: 506390 - DNA, 25 bp, Homo sapien
agaattcaaatccagattggtctta

SEQ ID NO: 506391 - DNA, 25 bp, Homo sapien
gattggtcttaatagtgagctctca

SEQ ID NO: 506392 - DNA, 25 bp, Homo sapien
tagtgagctctcatgtgtgatagaa

SEQ ID NO: 506393 - DNA, 25 bp, Homo sapien
gagctctcatgtgtgatagaaatta

SEQ ID NO: 506394 - DNA, 25 bp, Homo sapien
gaaattagataccactttgaggact

SEQ ID NO: 506395 - DNA, 25 bp, Homo sapien
ggagccagtggtgaatgtacttact

SEQ ID NO: 506396 - DNA, 25 bp, Homo sapien
gaatgtacttactttaggctctaaa

SEQ ID NO: 506397 - DNA, 25 bp, Homo sapien
ttgttcttagagaggtggtgatctt

SEQ ID NO: 506398 - DNA, 25 bp, Homo sapien
tggaattacaggagcgaggaaacat

SEQ ID NO: 506399 - DNA, 25 bp, Homo sapien
attacaggagcgaggaaacattttc

SEQ ID NO: 506400 - DNA, 25 bp, Homo sapien
ggaaacattttctaccaggaatctt

SEQ ID NO: 506401 - DNA, 25 bp, Homo sapien
aacattttctaccaggaatctttat

SEQ ID NO: 506402 - DNA, 25 bp, Homo sapien
aattgttggaaatttctcagcagtt

SEQ ID NO: 506403 - DNA, 25 bp, Homo sapien
ggaaatttctcagcagttagtgcat

SEQ ID NO: 506404 - DNA, 25 bp, Homo sapien
atttctcagcagttagtgcattaaa

SEQ ID NO: 506405 - DNA, 25 bp, Homo sapien
aagtttcaaccagcatgtgtttcct

SEQ ID NO: 506406 - DNA, 25 bp, Homo sapien
tttcctcatcttaaacaataagtag

SEQ ID NO: 506407 - DNA, 25 bp, Homo sapien
aaatgtttgttatactatctctcta

SEQ ID NO: 506408 - DNA, 25 bp, Homo sapien
gtttgttatactatctctctaaata

SEQ ID NO: 506409 - DNA, 25 bp, Homo sapien
ggtctgcggcctgtcaaacaggttc

SEQ ID NO: 506410 - DNA, 25 bp, Homo sapien
tgtcaaacaggttcgggttcagttc

SEQ ID NO: 506411 - DNA, 25 bp, Homo sapien
gttcagttctgtcccttcgagaaaa

SEQ ID NO: 506412 - DNA, 25 bp, Homo sapien
tgtcccttcgagaaaaacgtggaat

SEQ ID NO: 506413 - DNA, 25 bp, Homo sapien
gtggaatcgacgaggaccttcctgc

SEQ ID NO: 506414 - DNA, 25 bp, Homo sapien
agaagcgcagccattcacggcctca

SEQ ID NO: 506415 - DNA, 25 bp, Homo sapien
tgagaaggtccgctccactaatctc

SEQ ID NO: 506416 - DNA, 25 bp, Homo sapien
gctccactaatctcaactgctcagt

SEQ ID NO: 506417 - DNA, 25 bp, Homo sapien
aactgctcagtgattgcggacgtga

SEQ ID NO: 506418 - DNA, 25 bp, Homo sapien
acgtgaggcatgacggctccgagcc

SEQ ID NO: 506419 - DNA, 25 bp, Homo sapien
tgctgttcggagacgggcatcgcct

SEQ ID NO: 506420 - DNA, 25 bp, Homo sapien
ggcagaaagccagcgtccatgcccc

SEQ ID NO: 506421 - DNA, 25 bp, Homo sapien
aaagccagcgtccatgccccagcag

SEQ ID NO: 506422 - DNA, 25 bp, Homo sapien
ttccttttttacacttttcagctca

SEQ ID NO: 506423 - DNA, 25 bp, Homo sapien
tccttttttacacttttcagctcat

SEQ ID NO: 506424 - DNA, 25 bp, Homo sapien
ccttttttacacttttcagctcata

SEQ ID NO: 506425 - DNA, 25 bp, Homo sapien
cttttttacacttttcagctcatat

SEQ ID NO: 506426 - DNA, 25 bp, Homo sapien
ttttttacacttttcagctcatatt

SEQ ID NO: 506427 - DNA, 25 bp, Homo sapien
tttttacacttttcagctcatattt

SEQ ID NO: 506428 - DNA, 25 bp, Homo sapien
tttacacttttcagctcatatttaa

SEQ ID NO: 506429 - DNA, 25 bp, Homo sapien
tacacttttcagctcatatttaacc

SEQ ID NO: 506430 - DNA, 25 bp, Homo sapien
acacttttcagctcatatttaacct

SEQ ID NO: 506431 - DNA, 25 bp, Homo sapien
ggacataatcctagagctttcattc

SEQ ID NO: 506432 - DNA, 25 bp, Homo sapien
agaagttcatgttcatcttagccat

SEQ ID NO: 506433 - DNA, 25 bp, Homo sapien
agccatttggaacttcttcattctc

SEQ ID NO: 506434 - DNA, 25 bp, Homo sapien
tatcttttctccacggtggctgggc

SEQ ID NO: 506435 - DNA, 25 bp, Homo sapien
gggcttgtctgcaaatcattgtgtc

SEQ ID NO: 506436 - DNA, 25 bp, Homo sapien
tattttcaaaacagccctttgcttc

SEQ ID NO: 506437 - DNA, 25 bp, Homo sapien
ggtccatgattctgcagaggtatgg

SEQ ID NO: 506438 - DNA, 25 bp, Homo sapien
gcagaggtatgggacagaatcttca

SEQ ID NO: 506439 - DNA, 25 bp, Homo sapien
gaatcttcagattttaccccttgag

SEQ ID NO: 506440 - DNA, 25 bp, Homo sapien
cagattttaccccttgagtctcttc

SEQ ID NO: 506441 - DNA, 25 bp, Homo sapien
cttgagtctcttcctagtcatatcc

SEQ ID NO: 506442 - DNA, 25 bp, Homo sapien
gaaaagcctgagttcacacgtgcta

SEQ ID NO: 506443 - DNA, 25 bp, Homo sapien
cagtcctcttgctctgggtgcaagg

SEQ ID NO: 506444 - DNA, 25 bp, Homo sapien
aggaggcagagtgcacacaccggct

SEQ ID NO: 506445 - DNA, 25 bp, Homo sapien
cccggcctggctggcaatggtaaaa

SEQ ID NO: 506446 - DNA, 25 bp, Homo sapien
aaaatgggctgcctttcttttgcag

SEQ ID NO: 506447 - DNA, 25 bp, Homo sapien
gcagcttcttctaatcgaaatacca

SEQ ID NO: 506448 - DNA, 25 bp, Homo sapien
aaagggtactgacctctggcctcag

SEQ ID NO: 506449 - DNA, 25 bp, Homo sapien
cagggatgtgacttgcagtgcaaat

SEQ ID NO: 506450 - DNA, 25 bp, Homo sapien
gcagtgcaaattttacctcttcagt

SEQ ID NO: 506451 - DNA, 25 bp, Homo sapien
aattttacctcttcagtgcagagag

SEQ ID NO: 506452 - DNA, 25 bp, Homo sapien
gtgcagagagtggtcttgaaatctt

SEQ ID NO: 506453 - DNA, 25 bp, Homo sapien
ccacacctggcttaaaatactattt

SEQ ID NO: 506454 - DNA, 25 bp, Homo sapien
ctgtccttccactaagcttggtaga

SEQ ID NO: 506455 - DNA, 25 bp, Homo sapien
cttccactaagcttggtagatgtaa

SEQ ID NO: 506456 - DNA, 25 bp, Homo sapien
gtttgcacatcatttaattctcgtt

SEQ ID NO: 506457 - DNA, 25 bp, Homo sapien
tcatttaattctcgtttcacctttg

SEQ ID NO: 506458 - DNA, 25 bp, Homo sapien
ttcacctttgtgaaacatgcacaag

SEQ ID NO: 506459 - DNA, 25 bp, Homo sapien
catgcacaagtctttacagctgtca

SEQ ID NO: 506460 - DNA, 25 bp, Homo sapien
aagtctttacagctgtcattctaga

SEQ ID NO: 506461 - DNA, 25 bp, Homo sapien
tacagctgtcattctagagtttagg

SEQ ID NO: 506462 - DNA, 25 bp, Homo sapien
attctagagtttaggtgagtaacac

SEQ ID NO: 506463 - DNA, 25 bp, Homo sapien
gaaaatactacaaatcccatagttt

SEQ ID NO: 506464 - DNA, 25 bp, Homo sapien
gggtgcatttccgtgtcagaaacag

SEQ ID NO: 506465 - DNA, 25 bp, Homo sapien
tgtcagaaacagtaccgagtcccac

SEQ ID NO: 506466 - DNA, 25 bp, Homo sapien
gaggcacagctgttgcgtcaggcaa

SEQ ID NO: 506467 - DNA, 25 bp, Homo sapien
agctgttgcgtcaggcaaggtcacc

SEQ ID NO: 506468 - DNA, 25 bp, Homo sapien
catttatttattgagcagcagtgct

SEQ ID NO: 506469 - DNA, 25 bp, Homo sapien
tgtgtcaggcccagggaccgagccc

SEQ ID NO: 506470 - DNA, 25 bp, Homo sapien
tgttcccctatggtgtctccgaggc

SEQ ID NO: 506471 - DNA, 25 bp, Homo sapien
ggagggccccacatctggagcagca

SEQ ID NO: 506472 - DNA, 25 bp, Homo sapien
gagcagcacctcagagtggacagaa

SEQ ID NO: 506473 - DNA, 25 bp, Homo sapien
gaaagcattagcgtccacgagctca

SEQ ID NO: 506474 - DNA, 25 bp, Homo sapien
gtgggctgatggtgcccgtctaacc

SEQ ID NO: 506475 - DNA, 25 bp, Homo sapien
tgtgccacatttgcactgcagtcga

SEQ ID NO: 506476 - DNA, 25 bp, Homo sapien
aggctgttcaggctagtttctccct

SEQ ID NO: 506477 - DNA, 25 bp, Homo sapien
gtttctccctatcttaagatgttgc

SEQ ID NO: 506478 - DNA, 25 bp, Homo sapien
aagatgttgcattctcagcatattc

SEQ ID NO: 506479 - DNA, 25 bp, Homo sapien
tgcactgcagtcgagggtcccaaga

SEQ ID NO: 506480 - DNA, 25 bp, Homo sapien
taactgtgtcagtccaaagatacct

SEQ ID NO: 506481 - DNA, 25 bp, Homo sapien
gatacctgaagaattgtcctgtgct

SEQ ID NO: 506482 - DNA, 25 bp, Homo sapien
gaattgtcctgtgctaacagcagaa

SEQ ID NO: 506483 - DNA, 25 bp, Homo sapien
gagggtcccaagaaagcactccacc

SEQ ID NO: 506484 - DNA, 25 bp, Homo sapien
ggttttataccccagcataacatga

SEQ ID NO: 506485 - DNA, 25 bp, Homo sapien
gcataacatgattcactgtgctaat

SEQ ID NO: 506486 - DNA, 25 bp, Homo sapien
gggacgaacagcgtgacaattaaaa

SEQ ID NO: 506487 - DNA, 25 bp, Homo sapien
gatctgggaatcatccaatgtgata

SEQ ID NO: 506488 - DNA, 25 bp, Homo sapien
atctttctgcaaactatacagtatg

SEQ ID NO: 506489 - DNA, 25 bp, Homo sapien
agaagctgatgtgacgtggcaatat

SEQ ID NO: 506490 - DNA, 25 bp, Homo sapien
gtgacgtggcaatatcaaccaggaa

SEQ ID NO: 506491 - DNA, 25 bp, Homo sapien
atatcaaccaggaatacccatctcg

SEQ ID NO: 506492 - DNA, 25 bp, Homo sapien
ggaatacccatctcgagttctggat

SEQ ID NO: 506493 - DNA, 25 bp, Homo sapien
agttctggatatgtgctctgagaag

SEQ ID NO: 506494 - DNA, 25 bp, Homo sapien
gtgctctgagaaggtgcccatgtca

SEQ ID NO: 506495 - DNA, 25 bp, Homo sapien
gagaaggtgcccatgtcaccgacca

SEQ ID NO: 506496 - DNA, 25 bp, Homo sapien
tcaccgaccacactggaggccaatg

SEQ ID NO: 506497 - DNA, 25 bp, Homo sapien
agcacatgggctcccgcctgctgga

SEQ ID NO: 506498 - DNA, 25 bp, Homo sapien
tcaagctgtagagcggcatgtcctt

SEQ ID NO: 506499 - DNA, 25 bp, Homo sapien
ggactttgccgccagccagccaaag

SEQ ID NO: 506500 - DNA, 25 bp, Homo sapien
aaagcacgtcctcaagacgctccag

SEQ ID NO: 506501 - DNA, 25 bp, Homo sapien
gacgctccaggaactcttagactca

SEQ ID NO: 506502 - DNA, 25 bp, Homo sapien
gactcagagtccttgggaggcagcc

SEQ ID NO: 506503 - DNA, 25 bp, Homo sapien
gaggcagccgcaaggccactgacag

SEQ ID NO: 506504 - DNA, 25 bp, Homo sapien
gggtggcccctgacagcaagacaac

SEQ ID NO: 506505 - DNA, 25 bp, Homo sapien
gacagcaagacaactggcagctcat

SEQ ID NO: 506506 - DNA, 25 bp, Homo sapien
aactggcagctcatacccttttcag

SEQ ID NO: 506507 - DNA, 25 bp, Homo sapien
aggaatggcaccctgcctggaccca

SEQ ID NO: 506508 - DNA, 25 bp, Homo sapien
agtatccttggaatgtgctgtttaa

SEQ ID NO: 506509 - DNA, 25 bp, Homo sapien
gaatgtgctgtttaagtgtttctga

SEQ ID NO: 506510 - DNA, 25 bp, Homo sapien
ttctgaattttctacacgccatttt

SEQ ID NO: 506511 - DNA, 25 bp, Homo sapien
tacacgccatttttacaggtccatc

SEQ ID NO: 506512 - DNA, 25 bp, Homo sapien
tcgactggcaacattttgtatcaat

SEQ ID NO: 506513 - DNA, 25 bp, Homo sapien
acaggtccatctgtttatgatgtga

SEQ ID NO: 506514 - DNA, 25 bp, Homo sapien
gatgagataaacaatcacgttgatt

SEQ ID NO: 506515 - DNA, 25 bp, Homo sapien
aatcacgttgattttatgtttcttt

SEQ ID NO: 506516 - DNA, 25 bp, Homo sapien
acttcatggatcatgcccactgata

SEQ ID NO: 506517 - DNA, 25 bp, Homo sapien
caggctgactacaatggcttcaaag

SEQ ID NO: 506518 - DNA, 25 bp, Homo sapien
tcttaaatggactcagtatccttgg

SEQ ID NO: 506519 - DNA, 25 bp, Homo sapien
aaaattactgcctagaactttgaga

SEQ ID NO: 506520 - DNA, 25 bp, Homo sapien
aactgttcatgtccataccagaccg

SEQ ID NO: 506521 - DNA, 25 bp, Homo sapien
gttcatgtccataccagaccggtaa

SEQ ID NO: 506522 - DNA, 25 bp, Homo sapien
gatatgcataagtcatagctctatt

SEQ ID NO: 506523 - DNA, 25 bp, Homo sapien
agaccggtaaattataagatccaga

SEQ ID NO: 506524 - DNA, 25 bp, Homo sapien
aagatccagatgttagtgtctagaa

SEQ ID NO: 506525 - DNA, 25 bp, Homo sapien
gttagtgtctagaattagctgttta

SEQ ID NO: 506526 - DNA, 25 bp, Homo sapien
ggacatatgttttaactttgtcata

SEQ ID NO: 506527 - DNA, 25 bp, Homo sapien
tatattagcaagaattggtctactg

SEQ ID NO: 506528 - DNA, 25 bp, Homo sapien
gtcatagctctattcttagtgtcat

SEQ ID NO: 506529 - DNA, 25 bp, Homo sapien
cagctttatctaatttgagggcatt

SEQ ID NO: 506530 - DNA, 25 bp, Homo sapien
aggagccttttctgaggaaacttca

SEQ ID NO: 506531 - DNA, 25 bp, Homo sapien
aagacttgaactgggatctctaggg

SEQ ID NO: 506532 - DNA, 25 bp, Homo sapien
aggattctctgatttccccaacttt

SEQ ID NO: 506533 - DNA, 25 bp, Homo sapien
gggaacgttggaacatctattgatt

SEQ ID NO: 506534 - DNA, 25 bp, Homo sapien
ttgatgtgtcaaagtccggaatttc

SEQ ID NO: 506535 - DNA, 25 bp, Homo sapien
gtcaaagtccggaatttcactgtaa

SEQ ID NO: 506536 - DNA, 25 bp, Homo sapien
gtgaacgattataacttgtaacttt

SEQ ID NO: 506537 - DNA, 25 bp, Homo sapien
aacttgtaactttgtctgttatgta

SEQ ID NO: 506538 - DNA, 25 bp, Homo sapien
tacattttggtctcttagatccaag

SEQ ID NO: 506539 - DNA, 25 bp, Homo sapien
tggtctcttagatccaagagttctt

SEQ ID NO: 506540 - DNA, 25 bp, Homo sapien
ccaagagttcttgtctgttacgatt

SEQ ID NO: 506541 - DNA, 25 bp, Homo sapien
catctcaatagttactttggtgaag

SEQ ID NO: 506542 - DNA, 25 bp, Homo sapien
gaagatactaactcctgaagttcct

SEQ ID NO: 506543 - DNA, 25 bp, Homo sapien
tgaagttcctactctgtcatcttga

SEQ ID NO: 506544 - DNA, 25 bp, Homo sapien
ctgtcatcttgacctatgtccttaa

SEQ ID NO: 506545 - DNA, 25 bp, Homo sapien
atgtccttaattttcagcaccgatt

SEQ ID NO: 506546 - DNA, 25 bp, Homo sapien
agcaccgatttagttgatccaaccc

SEQ ID NO: 506547 - DNA, 25 bp, Homo sapien
gatccaaccctccttctcagtgtat

SEQ ID NO: 506548 - DNA, 25 bp, Homo sapien
ttctcagtgtatgcgcgcacacaca

SEQ ID NO: 506549 - DNA, 25 bp, Homo sapien
actcatccaatctgttctctacaca

SEQ ID NO: 506550 - DNA, 25 bp, Homo sapien
gaaagaaccctttgtaagtgccagt

SEQ ID NO: 506551 - DNA, 25 bp, Homo sapien
gtaagtgccagtgcctatgtttttt

SEQ ID NO: 506552 - DNA, 25 bp, Homo sapien
aggatttcaagagcaaccaagtaaa

SEQ ID NO: 506553 - DNA, 25 bp, Homo sapien
caaccaagtaaagtcatgcattttc

SEQ ID NO: 506554 - DNA, 25 bp, Homo sapien
catgcattttctaattttgtgtata

SEQ ID NO: 506555 - DNA, 25 bp, Homo sapien
gtgttaatattgctattacctaggt

SEQ ID NO: 506556 - DNA, 25 bp, Homo sapien
tacctaggttaagcactattgtctg

SEQ ID NO: 506557 - DNA, 25 bp, Homo sapien
gcactattgtctgtgctagtaagaa

SEQ ID NO: 506558 - DNA, 25 bp, Homo sapien
tcattgctttatagtagcttatatc

SEQ ID NO: 506559 - DNA, 25 bp, Homo sapien
agatttcatcattactattttgcat

SEQ ID NO: 506560 - DNA, 25 bp, Homo sapien
atcattactattttgcatactggaa

SEQ ID NO: 506561 - DNA, 25 bp, Homo sapien
tactattttgcatactggaatttat

SEQ ID NO: 506562 - DNA, 25 bp, Homo sapien
gtaaattatcattttcttagttttg

SEQ ID NO: 506563 - DNA, 25 bp, Homo sapien
ttctcttccaggaatcagcacttgg

SEQ ID NO: 506564 - DNA, 25 bp, Homo sapien
aggcacgaccccatggtctatgcct

SEQ ID NO: 506565 - DNA, 25 bp, Homo sapien
aatatccatcaattggtcaaccaac

SEQ ID NO: 506566 - DNA, 25 bp, Homo sapien
gagaacccattgtgtgctcagcatt

SEQ ID NO: 506567 - DNA, 25 bp, Homo sapien
gtgtgctcagcatttaactcaaaga

SEQ ID NO: 506568 - DNA, 25 bp, Homo sapien
aacacagacatcaagtatgggtttt

SEQ ID NO: 506569 - DNA, 25 bp, Homo sapien
tcccatcatcccctaaatataagct

SEQ ID NO: 506570 - DNA, 25 bp, Homo sapien
atataagctcactcagcctgtggac

SEQ ID NO: 506571 - DNA, 25 bp, Homo sapien
agctcactcagcctgtggacaaaag

SEQ ID NO: 506572 - DNA, 25 bp, Homo sapien
aagatctgaaagacctatgtccatg

SEQ ID NO: 506573 - DNA, 25 bp, Homo sapien
gacctatgtccatggcagaatcaat

SEQ ID NO: 506574 - DNA, 25 bp, Homo sapien
tattctgagccaaaacttgacagat

SEQ ID NO: 506575 - DNA, 25 bp, Homo sapien
acagatgtgggaaatcttcatatag

SEQ ID NO: 506576 - DNA, 25 bp, Homo sapien
gtgggaaatcttcatatagtgtatg

SEQ ID NO: 506577 - DNA, 25 bp, Homo sapien
gtacagggaaattattttcctctgt

SEQ ID NO: 506578 - DNA, 25 bp, Homo sapien
gggaaattattttcctctgtgtctt

SEQ ID NO: 506579 - DNA, 25 bp, Homo sapien
attattttcctctgtgtcttttctt

SEQ ID NO: 506580 - DNA, 25 bp, Homo sapien
aagtgattcagaattttactgttac

SEQ ID NO: 506581 - DNA, 25 bp, Homo sapien
aagtattgtgacaaaactgcatcaa

SEQ ID NO: 506582 - DNA, 25 bp, Homo sapien
actgcatcaatttgttgactattaa

SEQ ID NO: 506583 - DNA, 25 bp, Homo sapien
ttgactattaaagtgctccttgaac

SEQ ID NO: 506584 - DNA, 25 bp, Homo sapien
actattaaagtgctccttgaacatt

SEQ ID NO: 506585 - DNA, 25 bp, Homo sapien
ttgctggcacctttctgaagtagtg

SEQ ID NO: 506586 - DNA, 25 bp, Homo sapien
tctgaagtagtgttgtcccggtatc

SEQ ID NO: 506587 - DNA, 25 bp, Homo sapien
cccggtatcagcctttgcaatatgt

SEQ ID NO: 506588 - DNA, 25 bp, Homo sapien
gttagagatgtactgtctgccgcat

SEQ ID NO: 506589 - DNA, 25 bp, Homo sapien
actgtctgccgcattttgcactggt

SEQ ID NO: 506590 - DNA, 25 bp, Homo sapien
atgtgtatacgttattcctttttat

SEQ ID NO: 506591 - DNA, 25 bp, Homo sapien
tctctaagtgtattctgggtgcaga

SEQ ID NO: 506592 - DNA, 25 bp, Homo sapien
agatgcatgggctctgtcagtttct

SEQ ID NO: 506593 - DNA, 25 bp, Homo sapien
gtcagtttctgggaaactttctgca

SEQ ID NO: 506594 - DNA, 25 bp, Homo sapien
actttctgcaccctataaacacaat

SEQ ID NO: 506595 - DNA, 25 bp, Homo sapien
ttcacacattcaccattttgctggc

SEQ ID NO: 506596 - DNA, 25 bp, Homo sapien
gtccctggtgtggagcatgaagccc

SEQ ID NO: 506597 - DNA, 25 bp, Homo sapien
ccgtgttcccaagaaaatcctcaag

SEQ ID NO: 506598 - DNA, 25 bp, Homo sapien
aatcctcaagtgcaaggcagtgtct

SEQ ID NO: 506599 - DNA, 25 bp, Homo sapien
gcaaggcagtgtctcgagaacttaa

SEQ ID NO: 506600 - DNA, 25 bp, Homo sapien
gagaacttaatttttcttcgacaga

SEQ ID NO: 506601 - DNA, 25 bp, Homo sapien
gaatggttcttcgagtttggctttg

SEQ ID NO: 506602 - DNA, 25 bp, Homo sapien
ttggctttgtgatccctaactccac

SEQ ID NO: 506603 - DNA, 25 bp, Homo sapien
tgatccctaactccacaaatacctg

SEQ ID NO: 506604 - DNA, 25 bp, Homo sapien
aatacctggcagtccttgatagagg

SEQ ID NO: 506605 - DNA, 25 bp, Homo sapien
ttgatagaggcagcacccgagtccc

SEQ ID NO: 506606 - DNA, 25 bp, Homo sapien
gcaagcgtcttaactgggaacgtta

SEQ ID NO: 506607 - DNA, 25 bp, Homo sapien
attatgatatgttccacagtccaca

SEQ ID NO: 506608 - DNA, 25 bp, Homo sapien
tgttccacagtccacatgaccaaat

SEQ ID NO: 506609 - DNA, 25 bp, Homo sapien
agtccacatgaccaaatccctactg

SEQ ID NO: 506610 - DNA, 25 bp, Homo sapien
tccctactggtagatattttactta

SEQ ID NO: 506611 - DNA, 25 bp, Homo sapien
ataaaaaagtgctgtgctaacctta

SEQ ID NO: 506612 - DNA, 25 bp, Homo sapien
gtgctaaccttatctacttgtgtca

SEQ ID NO: 506613 - DNA, 25 bp, Homo sapien
cttatctacttgtgtcatttttctt

SEQ ID NO: 506614 - DNA, 25 bp, Homo sapien
tttcttcttagctttaattcctaga

SEQ ID NO: 506615 - DNA, 25 bp, Homo sapien
ttcctagatgtgagtttgctagatc

SEQ ID NO: 506616 - DNA, 25 bp, Homo sapien
tttgctagatcaagggcatgcttat

SEQ ID NO: 506617 - DNA, 25 bp, Homo sapien
gatcaagggcatgcttattctttgc

SEQ ID NO: 506618 - DNA, 25 bp, Homo sapien
catgtggtttgggtggcattgtcac

SEQ ID NO: 506619 - DNA, 25 bp, Homo sapien
cctcggctttctagattaacccagt

SEQ ID NO: 506620 - DNA, 25 bp, Homo sapien
taacccagttaccttttagcagtgc

SEQ ID NO: 506621 - DNA, 25 bp, Homo sapien
gttaccttttagcagtgccccactt

SEQ ID NO: 506622 - DNA, 25 bp, Homo sapien
acttccccagtagcaatggttcagg

SEQ ID NO: 506623 - DNA, 25 bp, Homo sapien
gggtaggcacctgacccagaccaga

SEQ ID NO: 506624 - DNA, 25 bp, Homo sapien
gacccagaccagactactgagataa

SEQ ID NO: 506625 - DNA, 25 bp, Homo sapien
gataaagatgtttgcctaggctttt

SEQ ID NO: 506626 - DNA, 25 bp, Homo sapien
gatgtttgcctaggctttttcagga

SEQ ID NO: 506627 - DNA, 25 bp, Homo sapien
tcaggagcaattgaagacatcttgt

SEQ ID NO: 506628 - DNA, 25 bp, Homo sapien
gacatcttgttggagatagtgtgct

SEQ ID NO: 506629 - DNA, 25 bp, Homo sapien
gaggcctcatacatgttcaggtcct

SEQ ID NO: 506630 - DNA, 25 bp, Homo sapien
gttcaggtcctcgatgaatttactc

SEQ ID NO: 506631 - DNA, 25 bp, Homo sapien
gaatttactcgctccaggcccaggt

SEQ ID NO: 506632 - DNA, 25 bp, Homo sapien
aggtcgtcatacttatccatgctgc

SEQ ID NO: 506633 - DNA, 25 bp, Homo sapien
tatccatgctgcagacaggtgtccg

SEQ ID NO: 506634 - DNA, 25 bp, Homo sapien
tcaagtccggcccagtacaactaaa

SEQ ID NO: 506635 - DNA, 25 bp, Homo sapien
gtacaactaaagacttccacctgcc

SEQ ID NO: 506636 - DNA, 25 bp, Homo sapien
acttccacctgcctagcgtgaaggg

SEQ ID NO: 506637 - DNA, 25 bp, Homo sapien
gtgaagggcatgaccccaggattta

SEQ ID NO: 506638 - DNA, 25 bp, Homo sapien
gatttaagagtccagccgaagttga

SEQ ID NO: 506639 - DNA, 25 bp, Homo sapien
agttgagacctcaacgccagctgga

SEQ ID NO: 506640 - DNA, 25 bp, Homo sapien
ttactgatctccacgggttttcaca

SEQ ID NO: 506641 - DNA, 25 bp, Homo sapien
gttttcacatctctgtactgtgcct

SEQ ID NO: 506642 - DNA, 25 bp, Homo sapien
tcaacttcccctaacagatatgcat

SEQ ID NO: 506643 - DNA, 25 bp, Homo sapien
tatgcatattccttccagatgcctc

SEQ ID NO: 506644 - DNA, 25 bp, Homo sapien
agatgcctcagtgctacaccacagt

SEQ ID NO: 506645 - DNA, 25 bp, Homo sapien
gtcccaggacaggaatgcggttcaa

SEQ ID NO: 506646 - DNA, 25 bp, Homo sapien
gtggcttgaaacttcctgagaaact

SEQ ID NO: 506647 - DNA, 25 bp, Homo sapien
tgagaaactgtagcatatccagccc

SEQ ID NO: 506648 - DNA, 25 bp, Homo sapien
gtacaatgtaacttgttcagtccaa

SEQ ID NO: 506649 - DNA, 25 bp, Homo sapien
aacaggttccttatgtttctgcctt

SEQ ID NO: 506650 - DNA, 25 bp, Homo sapien
gtcgctccatcacccaaacaaaaga

SEQ ID NO: 506651 - DNA, 25 bp, Homo sapien
caaatcagtaatctatgtgaactag

SEQ ID NO: 506652 - DNA, 25 bp, Homo sapien
atttcattagcgttttcttgataac

SEQ ID NO: 506653 - DNA, 25 bp, Homo sapien
agcgttttcttgataacaaatagga

SEQ ID NO: 506654 - DNA, 25 bp, Homo sapien
ggaaaatatatgtttacaccctgaa

SEQ ID NO: 506655 - DNA, 25 bp, Homo sapien
atcactcttgattcttaaaatttca

SEQ ID NO: 506656 - DNA, 25 bp, Homo sapien
gaataaattcagctgtgggtggatt

SEQ ID NO: 506657 - DNA, 25 bp, Homo sapien
attcagctgtgggtggatttttgtt

SEQ ID NO: 506658 - DNA, 25 bp, Homo sapien
aaattagctagttcctacatgcatg

SEQ ID NO: 506659 - DNA, 25 bp, Homo sapien
gctagttcctacatgcatgcgtgca

SEQ ID NO: 506660 - DNA, 25 bp, Homo sapien
gcatgcgtgcacaagtatatgcaga

SEQ ID NO: 506661 - DNA, 25 bp, Homo sapien
gcacaagtatatgcagacacacaca

SEQ ID NO: 506662 - DNA, 25 bp, Homo sapien
tggagggtctaatttgtcccaaaat

SEQ ID NO: 506663 - DNA, 25 bp, Homo sapien
gggaggagatcttatccaacctgta

SEQ ID NO: 506664 - DNA, 25 bp, Homo sapien
taacaagtacttgcagtttctctga

SEQ ID NO: 506665 - DNA, 25 bp, Homo sapien
ttctctgaaaagttcagtccctcct

SEQ ID NO: 506666 - DNA, 25 bp, Homo sapien
ttctcccttccctgatagcgaagga

SEQ ID NO: 506667 - DNA, 25 bp, Homo sapien
ttctttaccccttgacagaagtggt

SEQ ID NO: 506668 - DNA, 25 bp, Homo sapien
agaagtggtcctctgccaccttata

SEQ ID NO: 506669 - DNA, 25 bp, Homo sapien
tgccaccttatatttccctgtagtc

SEQ ID NO: 506670 - DNA, 25 bp, Homo sapien
ttatatttccctgtagtcctcctct

SEQ ID NO: 506671 - DNA, 25 bp, Homo sapien
agtcctcctcttctgtggattcata

SEQ ID NO: 506672 - DNA, 25 bp, Homo sapien
tctgtggattcatatgggagcgata

SEQ ID NO: 506673 - DNA, 25 bp, Homo sapien
cctctccacactccatgatgtaaat

SEQ ID NO: 506674 - DNA, 25 bp, Homo sapien
gaaccaggaataaatgtgtcattgt

SEQ ID NO: 506675 - DNA, 25 bp, Homo sapien
gtgtcattgtgataatcccatagca

SEQ ID NO: 506676 - DNA, 25 bp, Homo sapien
agtctcgtggtctgtgtctgtgaac

SEQ ID NO: 506677 - DNA, 25 bp, Homo sapien
tggtctgtgtctgtgaaccagggca

SEQ ID NO: 506678 - DNA, 25 bp, Homo sapien
aaccagggcaggtaattgtgacact

SEQ ID NO: 506679 - DNA, 25 bp, Homo sapien
gcaggtaattgtgacactgcatctc

SEQ ID NO: 506680 - DNA, 25 bp, Homo sapien
actgcatctcatagaactctgcctg

SEQ ID NO: 506681 - DNA, 25 bp, Homo sapien
gcctgcccagatttttgtgtgctca

SEQ ID NO: 506682 - DNA, 25 bp, Homo sapien
gatttttgtgtgctcacctcaatgg

SEQ ID NO: 506683 - DNA, 25 bp, Homo sapien
ttgtgtgctcacctcaatgggtgaa

SEQ ID NO: 506684 - DNA, 25 bp, Homo sapien
aaaatatgtctctcatataccctat

SEQ ID NO: 506685 - DNA, 25 bp, Homo sapien
tatgtctctcatataccctattaat

SEQ ID NO: 506686 - DNA, 25 bp, Homo sapien
gtctctcatataccctattaattgt

SEQ ID NO: 506687 - DNA, 25 bp, Homo sapien
tattgatataatctttttggtttcc

SEQ ID NO: 506688 - DNA, 25 bp, Homo sapien
ggtttccttcagcaattccaaattt

SEQ ID NO: 506689 - DNA, 25 bp, Homo sapien
tttccttcagcaattccaaattttc

SEQ ID NO: 506690 - DNA, 25 bp, Homo sapien
cttggagttaagttagcttgagtaa

SEQ ID NO: 506691 - DNA, 25 bp, Homo sapien
tagagttacgaaatgttagtacttt

SEQ ID NO: 506692 - DNA, 25 bp, Homo sapien
gaaatgttagtactttttctatgtt

SEQ ID NO: 506693 - DNA, 25 bp, Homo sapien
aaattggcagtttgtcagttatgac

SEQ ID NO: 506694 - DNA, 25 bp, Homo sapien
ggcagtttgtcagttatgacatttt

SEQ ID NO: 506695 - DNA, 25 bp, Homo sapien
ggcagaaagccagcgtccatgcccc

SEQ ID NO: 506696 - DNA, 25 bp, Homo sapien
aaagccagcgtccatgccccagcag

SEQ ID NO: 506697 - DNA, 25 bp, Homo sapien
tgttctcattttgcagagttgcaca

SEQ ID NO: 506698 - DNA, 25 bp, Homo sapien
ttccttttttacacttttcagctca

SEQ ID NO: 506699 - DNA, 25 bp, Homo sapien
tccttttttacacttttcagctcat

SEQ ID NO: 506700 - DNA, 25 bp, Homo sapien
ccttttttacacttttcagctcata

SEQ ID NO: 506701 - DNA, 25 bp, Homo sapien
cttttttacacttttcagctcatat

SEQ ID NO: 506702 - DNA, 25 bp, Homo sapien
ttttttacacttttcagctcatatt

SEQ ID NO: 506703 - DNA, 25 bp, Homo sapien
ttttacacttttcagctcatattta

SEQ ID NO: 506704 - DNA, 25 bp, Homo sapien
tacacttttcagctcatatttaacc

SEQ ID NO: 506705 - DNA, 25 bp, Homo sapien
acacttttcagctcatatttaacct

SEQ ID NO: 506706 - DNA, 25 bp, Homo sapien
tgtcatggacagtgctaataataat

SEQ ID NO: 506707 - DNA, 25 bp, Homo sapien
tgctggagatgttagttctcactta

SEQ ID NO: 506708 - DNA, 25 bp, Homo sapien
agatgttagttctcacttatgcatt

SEQ ID NO: 506709 - DNA, 25 bp, Homo sapien
tgttagttctcacttatgcatttta

SEQ ID NO: 506710 - DNA, 25 bp, Homo sapien
taagaccttttgctggaagtgttag

SEQ ID NO: 506711 - DNA, 25 bp, Homo sapien
ggaagtgttagttcttgcttatcta

SEQ ID NO: 506712 - DNA, 25 bp, Homo sapien
gttcttgcttatctaattttaaacg

SEQ ID NO: 506713 - DNA, 25 bp, Homo sapien
aactcctgctctgctgagttttggg

SEQ ID NO: 506714 - DNA, 25 bp, Homo sapien
ttctctaacctgtggcaatgtgctg

SEQ ID NO: 506715 - DNA, 25 bp, Homo sapien
ctaacctgtggcaatgtgctgtagt

SEQ ID NO: 506716 - DNA, 25 bp, Homo sapien
tggcaatgtgctgtagtcagcccga

SEQ ID NO: 506717 - DNA, 25 bp, Homo sapien
ctcactgtggtattttatagaagct

SEQ ID NO: 506718 - DNA, 25 bp, Homo sapien
actgataggctagcttcatggtatt

SEQ ID NO: 506719 - DNA, 25 bp, Homo sapien
gtattgatgatacatggcttaacca

SEQ ID NO: 506720 - DNA, 25 bp, Homo sapien
ttaaccatactaaaagctgctttcc

SEQ ID NO: 506721 - DNA, 25 bp, Homo sapien
gatgaagtttcacttgatggagaca

SEQ ID NO: 506722 - DNA, 25 bp, Homo sapien
gtgtttatcatggaactagtgcatt

SEQ ID NO: 506723 - DNA, 25 bp, Homo sapien
actagtgcattaggccataagctgt

SEQ ID NO: 506724 - DNA, 25 bp, Homo sapien
ttatttttggttcactgcttgcttg

SEQ ID NO: 506725 - DNA, 25 bp, Homo sapien
gcttgcttgagcatagctgggattt

SEQ ID NO: 506726 - DNA, 25 bp, Homo sapien
gctgggatttgtagcccattttcta

SEQ ID NO: 506727 - DNA, 25 bp, Homo sapien
taggcttattgcaatctcactgtgg

SEQ ID NO: 506728 - DNA, 25 bp, Homo sapien
gcctgctgtagaccattccagcaaa

SEQ ID NO: 506729 - DNA, 25 bp, Homo sapien
attccagcaaatgtcagaatgcagg

SEQ ID NO: 506730 - DNA, 25 bp, Homo sapien
gcagggcaagatgtgtgtcgactat

SEQ ID NO: 506731 - DNA, 25 bp, Homo sapien
gatgtgtgtcgactatgttttttat

SEQ ID NO: 506732 - DNA, 25 bp, Homo sapien
gtgtcgactatgttttttatgttta

SEQ ID NO: 506733 - DNA, 25 bp, Homo sapien
taagttacttacttatttcttcagg

SEQ ID NO: 506734 - DNA, 25 bp, Homo sapien
gtaagtgtgtaccaaataacaatac

SEQ ID NO: 506735 - DNA, 25 bp, Homo sapien
taacaatactgaaaagccctcccct

SEQ ID NO: 506736 - DNA, 25 bp, Homo sapien
ttgccaggccgaggaaataaagctt

SEQ ID NO: 506737 - DNA, 25 bp, Homo sapien
gaagggagcattgtagcctgctgta

SEQ ID NO: 506738 - DNA, 25 bp, Homo sapien
ttgtagcctgctgtagaccattcca

SEQ ID NO: 506739 - DNA, 25 bp, Homo sapien
tgaaattaataacacatgcccctat

SEQ ID NO: 506740 - DNA, 25 bp, Homo sapien
taacacatgcccctatttctctttt

SEQ ID NO: 506741 - DNA, 25 bp, Homo sapien
acacatgcccctatttctcttttgg

SEQ ID NO: 506742 - DNA, 25 bp, Homo sapien
tttctcttttggatgatgtgtgggt

SEQ ID NO: 506743 - DNA, 25 bp, Homo sapien
cctggccagctgtaaggcagatttt

SEQ ID NO: 506744 - DNA, 25 bp, Homo sapien
ggccagctgtaaggcagattttgac

SEQ ID NO: 506745 - DNA, 25 bp, Homo sapien
acttccccagtactgaaacatttct

SEQ ID NO: 506746 - DNA, 25 bp, Homo sapien
ctttgaaggtgctctgcagtggtag

SEQ ID NO: 506747 - DNA, 25 bp, Homo sapien
aaggtgctctgcagtggtagacaca

SEQ ID NO: 506748 - DNA, 25 bp, Homo sapien
ggtgctctgcagtggtagacacact

SEQ ID NO: 506749 - DNA, 25 bp, Homo sapien
tctggcctcatttaatgaaattaat

SEQ ID NO: 506750 - DNA, 25 bp, Homo sapien
gaattgaacctgaaacccaaagtga

SEQ ID NO: 506751 - DNA, 25 bp, Homo sapien
aactggattcagtgggatctacaag

SEQ ID NO: 506752 - DNA, 25 bp, Homo sapien
ggaatgtcatttttgtgcatcctac

SEQ ID NO: 506753 - DNA, 25 bp, Homo sapien
catttttgtgcatcctacagtgagg

SEQ ID NO: 506754 - DNA, 25 bp, Homo sapien
gtaactgatcaggtgtctataacat

SEQ ID NO: 506755 - DNA, 25 bp, Homo sapien
ataacatttttcattctctctggaa

SEQ ID NO: 506756 - DNA, 25 bp, Homo sapien
acagactcaggtttctttggaccaa

SEQ ID NO: 506757 - DNA, 25 bp, Homo sapien
gctgtaacacagctgtagttgacta

SEQ ID NO: 506758 - DNA, 25 bp, Homo sapien
gttgactagaatgctctgtatactt

SEQ ID NO: 506759 - DNA, 25 bp, Homo sapien
gaaaatctggatgcctgtgattcga

SEQ ID NO: 506760 - DNA, 25 bp, Homo sapien
tggatgcctgtgattcgagaattga

SEQ ID NO: 506761 - DNA, 25 bp, Homo sapien
aatatgctcttggagccagcactgc

SEQ ID NO: 506762 - DNA, 25 bp, Homo sapien
tggagccagcactgcggtacttaaa

SEQ ID NO: 506763 - DNA, 25 bp, Homo sapien
aggaacgagccagacgcctcattca

SEQ ID NO: 506764 - DNA, 25 bp, Homo sapien
agaacagatgtttcccttatctccc

SEQ ID NO: 506765 - DNA, 25 bp, Homo sapien
tttttacccagacacatgtttctcc

SEQ ID NO: 506766 - DNA, 25 bp, Homo sapien
ttctccccagcctaagtgtagtggc

SEQ ID NO: 506767 - DNA, 25 bp, Homo sapien
cattgtcagagtggaggccgatgca

SEQ ID NO: 506768 - DNA, 25 bp, Homo sapien
gaggccgatgcagctattgtagatg

SEQ ID NO: 506769 - DNA, 25 bp, Homo sapien
gcctcattcacaactacaatctcat

SEQ ID NO: 506770 - DNA, 25 bp, Homo sapien
aatctcatttacaacctgtccctga

SEQ ID NO: 506771 - DNA, 25 bp, Homo sapien
agaaaatcgaccaggccttgcgcag

SEQ ID NO: 506772 - DNA, 25 bp, Homo sapien
gaatacttgaagtccctcggcagac

SEQ ID NO: 506773 - DNA, 25 bp, Homo sapien
tcggcagactcttggatacctccag

SEQ ID NO: 506774 - DNA, 25 bp, Homo sapien
gggagctcaccacctgttttgaagc

SEQ ID NO: 506775 - DNA, 25 bp, Homo sapien
agccaggcaggtttgggctcttctt

SEQ ID NO: 506776 - DNA, 25 bp, Homo sapien
ggctcttcttgtagctgtgtgactc

SEQ ID NO: 506777 - DNA, 25 bp, Homo sapien
gtgactctggattttcccataggtg

SEQ ID NO: 506778 - DNA, 25 bp, Homo sapien
ggtgggagtggatccaccaccttga

SEQ ID NO: 506779 - DNA, 25 bp, Homo sapien
gatccaccaccttgagcttcagttt

SEQ ID NO: 506780 - DNA, 25 bp, Homo sapien
gtgccatgggattagcagcagccct

SEQ ID NO: 506781 - DNA, 25 bp, Homo sapien
tcctgagttggctggtgcagtgcac

SEQ ID NO: 506782 - DNA, 25 bp, Homo sapien
gtgcagtgcacggtacacagagagt

SEQ ID NO: 506783 - DNA, 25 bp, Homo sapien
ccacagtgtaagaccccccaggaag

SEQ ID NO: 506784 - DNA, 25 bp, Homo sapien
attttttgttagcatcaggctctga

SEQ ID NO: 506785 - DNA, 25 bp, Homo sapien
gctctgaaggagttggtatacattt

SEQ ID NO: 506786 - DNA, 25 bp, Homo sapien
gaaaacatcttctggacttacacca

SEQ ID NO: 506787 - DNA, 25 bp, Homo sapien
gacttacaccagagcttagtgtcgt

SEQ ID NO: 506788 - DNA, 25 bp, Homo sapien
accagagcttagtgtcgtctttact

SEQ ID NO: 506789 - DNA, 25 bp, Homo sapien
gcttagtgtcgtctttactatggaa

SEQ ID NO: 506790 - DNA, 25 bp, Homo sapien
gaaatggtttaactgtgtggagttt

SEQ ID NO: 506791 - DNA, 25 bp, Homo sapien
agaccaaaactttcctggtggatca

SEQ ID NO: 506792 - DNA, 25 bp, Homo sapien
aaactttcctggtggatcagctagg

SEQ ID NO: 506793 - DNA, 25 bp, Homo sapien
tggtggatcagctagggcctttgac

SEQ ID NO: 506794 - DNA, 25 bp, Homo sapien
acttgtcattaaagatgtgtgtgca

SEQ ID NO: 506795 - DNA, 25 bp, Homo sapien
atttgtcccttgctttgggattggt

SEQ ID NO: 506796 - DNA, 25 bp, Homo sapien
ttgggattggtttctggacaccact

SEQ ID NO: 506797 - DNA, 25 bp, Homo sapien
acccttgctggccatttgccaagga

SEQ ID NO: 506798 - DNA, 25 bp, Homo sapien
tggccatttgccaaggacaccaaaa

SEQ ID NO: 506799 - DNA, 25 bp, Homo sapien
gacaccaaaacccaaggatgttgaa

SEQ ID NO: 506800 - DNA, 25 bp, Homo sapien
cccttttataaaatggcgctgtatc

SEQ ID NO: 506801 - DNA, 25 bp, Homo sapien
gcgctgtatctgcatacaacttaca

SEQ ID NO: 506802 - DNA, 25 bp, Homo sapien
tctgcatacaacttacacacatcct

SEQ ID NO: 506803 - DNA, 25 bp, Homo sapien
catttccagatttcttatacttcat

SEQ ID NO: 506804 - DNA, 25 bp, Homo sapien
gatttcttatacttcatacaatgtg

SEQ ID NO: 506805 - DNA, 25 bp, Homo sapien
acctagagctacttgtgagtgaatc

SEQ ID NO: 506806 - DNA, 25 bp, Homo sapien
gtgagtgaatcattggcttctagaa

SEQ ID NO: 506807 - DNA, 25 bp, Homo sapien
ggcttctagaaatcagatgcccaga

SEQ ID NO: 506808 - DNA, 25 bp, Homo sapien
tcagatgcccagatgatccaagact

SEQ ID NO: 506809 - DNA, 25 bp, Homo sapien
gcccagatgatccaagactagtttg

SEQ ID NO: 506810 - DNA, 25 bp, Homo sapien
gactagtttgttatctcatctggaa

SEQ ID NO: 506811 - DNA, 25 bp, Homo sapien
tgttatctcatctggaacctacacc

SEQ ID NO: 506812 - DNA, 25 bp, Homo sapien
gaacctacaccaagagatgcagtca

SEQ ID NO: 506813 - DNA, 25 bp, Homo sapien
gatgcagtcagcatcttaaagtaaa

SEQ ID NO: 506814 - DNA, 25 bp, Homo sapien
tccccttaaaacaccagacaaatcg

SEQ ID NO: 506815 - DNA, 25 bp, Homo sapien
accagacaaatcgataacaacttat

SEQ ID NO: 506816 - DNA, 25 bp, Homo sapien
ggtctgaatgccgagtccctgaatt

SEQ ID NO: 506817 - DNA, 25 bp, Homo sapien
tgaatgccgagtccctgaattcacc

SEQ ID NO: 506818 - DNA, 25 bp, Homo sapien
gccgagtccctgaattcacccagga

SEQ ID NO: 506819 - DNA, 25 bp, Homo sapien
gaattcacccaggaccatccaaggg

SEQ ID NO: 506820 - DNA, 25 bp, Homo sapien
gatgaatagaatatacacactgtgc

SEQ ID NO: 506821 - DNA, 25 bp, Homo sapien
gaatatacacactgtgctaggtgta

SEQ ID NO: 506822 - DNA, 25 bp, Homo sapien
cactgtgctaggtgtatatatacat

SEQ ID NO: 506823 - DNA, 25 bp, Homo sapien
gatatggaaatgactgttctgctgt

SEQ ID NO: 506824 - DNA, 25 bp, Homo sapien
gaaatgactgttctgctgttaagat

SEQ ID NO: 506825 - DNA, 25 bp, Homo sapien
gactgttctgctgttaagataatgt

SEQ ID NO: 506826 - DNA, 25 bp, Homo sapien
attttcttcctttcatggttaagat

SEQ ID NO: 506827 - DNA, 25 bp, Homo sapien
acaaattcaatatcctagtcttcat

SEQ ID NO: 506828 - DNA, 25 bp, Homo sapien
aatatcctagtcttcatttgtatga

SEQ ID NO: 506829 - DNA, 25 bp, Homo sapien
gtattgtacatagtttaaccaagtg

SEQ ID NO: 506830 - DNA, 25 bp, Homo sapien
aaccaagtgttatttgagctgctta

SEQ ID NO: 506831 - DNA, 25 bp, Homo sapien
gagctgcttattaatattaacttgt

SEQ ID NO: 506832 - DNA, 25 bp, Homo sapien
aacttgtacttgtctctctgcttgt

SEQ ID NO: 506833 - DNA, 25 bp, Homo sapien
acttgtctctctgcttgttattggt

SEQ ID NO: 506834 - DNA, 25 bp, Homo sapien
ttatcaatgtagctgtgaaggccat

SEQ ID NO: 506835 - DNA, 25 bp, Homo sapien
gtacagagcatttattcagatcaag

SEQ ID NO: 506836 - DNA, 25 bp, Homo sapien
atatacaacattacagtctgtctgt

SEQ ID NO: 506837 - DNA, 25 bp, Homo sapien
acagtctgtctgtatttagatattt

SEQ ID NO: 506838 - DNA, 25 bp, Homo sapien
acattttcgaagtttggatcacagc

SEQ ID NO: 506839 - DNA, 25 bp, Homo sapien
ttggatcacagcctataccagctaa

SEQ ID NO: 506840 - DNA, 25 bp, Homo sapien
taccagctaaaagaccagcttcagg

SEQ ID NO: 506841 - DNA, 25 bp, Homo sapien
ccagcttcaggacaaaactcgattt

SEQ ID NO: 506842 - DNA, 25 bp, Homo sapien
aactcgatttctgttatgcctgctc

SEQ ID NO: 506843 - DNA, 25 bp, Homo sapien
gttatgcctgctcagaaaattacaa

SEQ ID NO: 506844 - DNA, 25 bp, Homo sapien
gaaaattacaaagcctgccgctaaa

SEQ ID NO: 506845 - DNA, 25 bp, Homo sapien
ctgccgctaaatatggaataccttt

SEQ ID NO: 506846 - DNA, 25 bp, Homo sapien
attacacgaaaagaaaccactgcaa

SEQ ID NO: 506847 - DNA, 25 bp, Homo sapien
taaacaggcccatcaaactccagag

SEQ ID NO: 506848 - DNA, 25 bp, Homo sapien
caggcccatcaaactccagagaaga

SEQ ID NO: 506849 - DNA, 25 bp, Homo sapien
cattggctgtacctgaaacttatgg

SEQ ID NO: 506850 - DNA, 25 bp, Homo sapien
ctgaaacttatggtggcctagactc

SEQ ID NO: 506851 - DNA, 25 bp, Homo sapien
ggtggcctagactccccagtatcca

SEQ ID NO: 506852 - DNA, 25 bp, Homo sapien
ccagtatccactcttccttatcttg

SEQ ID NO: 506853 - DNA, 25 bp, Homo sapien
gaagacacttccaaagtaacaaatg

SEQ ID NO: 506854 - DNA, 25 bp, Homo sapien
taacaaatgggaggaagcagccaac

SEQ ID NO: 506855 - DNA, 25 bp, Homo sapien
ggaagcagccaacgcccgaggacaa

SEQ ID NO: 506856 - DNA, 25 bp, Homo sapien
caacgcccgaggacaacatggcaag

SEQ ID NO: 506857 - DNA, 25 bp, Homo sapien
gaaggagcctttggattccggactg

SEQ ID NO: 506858 - DNA, 25 bp, Homo sapien
aagagagttgattgaatcccggaat

SEQ ID NO: 506859 - DNA, 25 bp, Homo sapien
ttggaaaccccagatacggagggcg

SEQ ID NO: 506860 - DNA, 25 bp, Homo sapien
ttggactcccactgctgacaaaatt

SEQ ID NO: 506861 - DNA, 25 bp, Homo sapien
tcaaagttgagatagctaccatggg

SEQ ID NO: 506862 - DNA, 25 bp, Homo sapien
gggaagagcacttagttctatactg

SEQ ID NO: 506863 - DNA, 25 bp, Homo sapien
gagcacttagttctatactgaatgg

SEQ ID NO: 506864 - DNA, 25 bp, Homo sapien
tactgaatggctccaggcattttca

SEQ ID NO: 506865 - DNA, 25 bp, Homo sapien
ggcattttcatgaaagctctttcag

SEQ ID NO: 506866 - DNA, 25 bp, Homo sapien
atattcatccatatctttaccccat

SEQ ID NO: 506867 - DNA, 25 bp, Homo sapien
tctttaccccatcatattagtgtct

SEQ ID NO: 506868 - DNA, 25 bp, Homo sapien
attagtgtctaagccctgcaatcag

SEQ ID NO: 506869 - DNA, 25 bp, Homo sapien
ctgcaatcaggcatgtcagccacgt

SEQ ID NO: 506870 - DNA, 25 bp, Homo sapien
atgtcagccacgtgatggaatggga

SEQ ID NO: 506871 - DNA, 25 bp, Homo sapien
gcatttgtttgttagtatcaatcac

SEQ ID NO: 506872 - DNA, 25 bp, Homo sapien
aaagccttccctaaaaagagagcat

SEQ ID NO: 506873 - DNA, 25 bp, Homo sapien
gagcatgccagtcatagagacacta

SEQ ID NO: 506874 - DNA, 25 bp, Homo sapien
agagacactaatttggcacttttcc

SEQ ID NO: 506875 - DNA, 25 bp, Homo sapien
ctaatttggcacttttcctccttct

SEQ ID NO: 506876 - DNA, 25 bp, Homo sapien
atgttataccaatgcatgtgtttga

SEQ ID NO: 506877 - DNA, 25 bp, Homo sapien
gagtttcttaaatgcgtggattctt

SEQ ID NO: 506878 - DNA, 25 bp, Homo sapien
gtggattcttgttcatttatctctg

SEQ ID NO: 506879 - DNA, 25 bp, Homo sapien
tttatctctgaatatgtctctttta

SEQ ID NO: 506880 - DNA, 25 bp, Homo sapien
gtctcttttatattttggcacaatt

SEQ ID NO: 506881 - DNA, 25 bp, Homo sapien
tacacattggaaagggccaacctat

SEQ ID NO: 506882 - DNA, 25 bp, Homo sapien
ttcccagacttttgccccggctctg

SEQ ID NO: 506883 - DNA, 25 bp, Homo sapien
tggccaagtcgtgggtcctcctctg

SEQ ID NO: 506884 - DNA, 25 bp, Homo sapien
tctgtcccttcattgcatggcacag

SEQ ID NO: 506885 - DNA, 25 bp, Homo sapien
tgtcccttcattgcatggcacagct

SEQ ID NO: 506886 - DNA, 25 bp, Homo sapien
ttcattgcatggcacagctcacttt

SEQ ID NO: 506887 - DNA, 25 bp, Homo sapien
attgcatggcacagctcactttggc

SEQ ID NO: 506888 - DNA, 25 bp, Homo sapien
atggcacagctcactttggcccttc

SEQ ID NO: 506889 - DNA, 25 bp, Homo sapien
tcccaaccccattgctaacaacatg

SEQ ID NO: 506890 - DNA, 25 bp, Homo sapien
gctaacaacatggtacattccggcc

SEQ ID NO: 506891 - DNA, 25 bp, Homo sapien
aacaacatggtacattccggcccca

SEQ ID NO: 506892 - DNA, 25 bp, Homo sapien
accactcagagccttccgaagccaa

SEQ ID NO: 506893 - DNA, 25 bp, Homo sapien
gttaatgttattgtctatgattttt

SEQ ID NO: 506894 - DNA, 25 bp, Homo sapien
gatgacaacaattcctgtagcctgt

SEQ ID NO: 506895 - DNA, 25 bp, Homo sapien
aattcctgtagcctgtttttaccat

SEQ ID NO: 506896 - DNA, 25 bp, Homo sapien
gtagcctgtttttaccattaggatg

SEQ ID NO: 506897 - DNA, 25 bp, Homo sapien
aataaatcatcctgacttgaaagtc

SEQ ID NO: 506898 - DNA, 25 bp, Homo sapien
tttatttttcattccgtagtatcac

SEQ ID NO: 506899 - DNA, 25 bp, Homo sapien
gtagtatcacagaatatgctgcatt

SEQ ID NO: 506900 - DNA, 25 bp, Homo sapien
tgctgcatttagatacaggtttaat

SEQ ID NO: 506901 - DNA, 25 bp, Homo sapien
gatacaggtttaatttgccagattt

SEQ ID NO: 506902 - DNA, 25 bp, Homo sapien
gccagattttctcaaaattctgtat

SEQ ID NO: 506903 - DNA, 25 bp, Homo sapien
gctacaactggtttacttaacatgc

SEQ ID NO: 506904 - DNA, 25 bp, Homo sapien
gctgccaacaccaatgcctaaaact

SEQ ID NO: 506905 - DNA, 25 bp, Homo sapien
caccaatgcctaaaacttgtttcat

SEQ ID NO: 506906 - DNA, 25 bp, Homo sapien
tacgtgattagcctcaactaaacat

SEQ ID NO: 506907 - DNA, 25 bp, Homo sapien
gcctcaactaaacattgctgactat

SEQ ID NO: 506908 - DNA, 25 bp, Homo sapien
agtatattcaccatgtcgctggcaa

SEQ ID NO: 506909 - DNA, 25 bp, Homo sapien
caccatgtcgctggcaatatgtcat

SEQ ID NO: 506910 - DNA, 25 bp, Homo sapien
caatatgtcattgcgtaacaccaaa

SEQ ID NO: 506911 - DNA, 25 bp, Homo sapien
gtcattgcgtaacaccaaataaccc

SEQ ID NO: 506912 - DNA, 25 bp, Homo sapien
cccagaagtagccagaggccagttt

SEQ ID NO: 506913 - DNA, 25 bp, Homo sapien
gtagccagaggccagtttgaacatc

SEQ ID NO: 506914 - DNA, 25 bp, Homo sapien
gtttgaacatcacaattctaagtgt

SEQ ID NO: 506915 - DNA, 25 bp, Homo sapien
gtattctgactcatgaagttctcaa

SEQ ID NO: 506916 - DNA, 25 bp, Homo sapien
agttttgcccttaataccattatat

SEQ ID NO: 506917 - DNA, 25 bp, Homo sapien
taccattatatcttgtagaggccaa

SEQ ID NO: 506918 - DNA, 25 bp, Homo sapien
ggccaagaatgagggacttctgtct

SEQ ID NO: 506919 - DNA, 25 bp, Homo sapien
ggacttctgtctttaaagagcccta

SEQ ID NO: 506920 - DNA, 25 bp, Homo sapien
agccctaaaaatctcgtttgctcac

SEQ ID NO: 506921 - DNA, 25 bp, Homo sapien
aatctcgtttgctcacatgatatga

SEQ ID NO: 506922 - DNA, 25 bp, Homo sapien
gtaaatgcgcaactttgtatacact

SEQ ID NO: 506923 - DNA, 25 bp, Homo sapien
tgtatacactaaaagcactgccaat

SEQ ID NO: 506924 - DNA, 25 bp, Homo sapien
gattttttatcagttgtgcctcagt

SEQ ID NO: 506925 - DNA, 25 bp, Homo sapien
atcagttgtgcctcagttagagata

SEQ ID NO: 506926 - DNA, 25 bp, Homo sapien
cacttcttgctacatttaatcttct

SEQ ID NO: 506927 - DNA, 25 bp, Homo sapien
ttaatcttctaggtgttcagatatc

SEQ ID NO: 506928 - DNA, 25 bp, Homo sapien
ctaggtgttcagatatctttggaga

SEQ ID NO: 506929 - DNA, 25 bp, Homo sapien
atctttggagattataggcagcaat

SEQ ID NO: 506930 - DNA, 25 bp, Homo sapien
ggcagcaataaagctaaggcagcta

SEQ ID NO: 506931 - DNA, 25 bp, Homo sapien
ggcagctaacctttcaacattcttg

SEQ ID NO: 506932 - DNA, 25 bp, Homo sapien
cattcttgtgtcaggctaatatttt

SEQ ID NO: 506933 - DNA, 25 bp, Homo sapien
aggaattcttgtgtttctcaaagaa

SEQ ID NO: 506934 - DNA, 25 bp, Homo sapien
tttaacaaccattctaagcaccata

SEQ ID NO: 506935 - DNA, 25 bp, Homo sapien
gtttcacaaatttggtattcattca

SEQ ID NO: 506936 - DNA, 25 bp, Homo sapien
ataaactgtgtttctcttccacttc

SEQ ID NO: 506937 - DNA, 25 bp, Homo sapien
aggcaagtgattaagagcactgact

SEQ ID NO: 506938 - DNA, 25 bp, Homo sapien
ggcaagtgattaagagcactgactg

SEQ ID NO: 506939 - DNA, 25 bp, Homo sapien
gcaagtgattaagagcactgactgg

SEQ ID NO: 506940 - DNA, 25 bp, Homo sapien
caagtgattaagagcactgactggg

SEQ ID NO: 506941 - DNA, 25 bp, Homo sapien
aagtgattaagagcactgactgggc

SEQ ID NO: 506942 - DNA, 25 bp, Homo sapien
agtgattaagagcactgactgggcc

SEQ ID NO: 506943 - DNA, 25 bp, Homo sapien
gtgattaagagcactgactgggccg

SEQ ID NO: 506944 - DNA, 25 bp, Homo sapien
tgattaagagcactgactgggccgg

SEQ ID NO: 506945 - DNA, 25 bp, Homo sapien
attaagagcactgactgggccgggc

SEQ ID NO: 506946 - DNA, 25 bp, Homo sapien
ttaagagcactgactgggccgggcg

SEQ ID NO: 506947 - DNA, 25 bp, Homo sapien
atggtgtaatcccgggaggtggagg

SEQ ID NO: 506948 - DNA, 25 bp, Homo sapien
tgaaactttttgtaaggtcctctga

SEQ ID NO: 506949 - DNA, 25 bp, Homo sapien
agctggctgcactatggtcaagcca

SEQ ID NO: 506950 - DNA, 25 bp, Homo sapien
gctgcactatggtcaagccacggtg

SEQ ID NO: 506951 - DNA, 25 bp, Homo sapien
tgcactatggtcaagccacggtgac

SEQ ID NO: 506952 - DNA, 25 bp, Homo sapien
cactatggtcaagccacggtgacat

SEQ ID NO: 506953 - DNA, 25 bp, Homo sapien
gatactcctgtccttgtgaatgtac

SEQ ID NO: 506954 - DNA, 25 bp, Homo sapien
atactcctgtccttgtgaatgtact

SEQ ID NO: 506955 - DNA, 25 bp, Homo sapien
ctgcccttgtgacgatacaccctcc

SEQ ID NO: 506956 - DNA, 25 bp, Homo sapien
gaatcccagaaattaaatgtcttat

SEQ ID NO: 506957 - DNA, 25 bp, Homo sapien
aaatgtcttatatttttgccacaag

SEQ ID NO: 506958 - DNA, 25 bp, Homo sapien
atttttgccacaagaaaacacgtgc

SEQ ID NO: 506959 - DNA, 25 bp, Homo sapien
tcttctttcatcaacttagagcaga

SEQ ID NO: 506960 - DNA, 25 bp, Homo sapien
acttagagcagataatccccatgtg

SEQ ID NO: 506961 - DNA, 25 bp, Homo sapien
gaacaggatccctttttgggacaat

SEQ ID NO: 506962 - DNA, 25 bp, Homo sapien
atttgtgactaactccagggaaaag

SEQ ID NO: 506963 - DNA, 25 bp, Homo sapien
gaatatttaggccacttcaggcact

SEQ ID NO: 506964 - DNA, 25 bp, Homo sapien
gccacttcaggcactaccatggagt

SEQ ID NO: 506965 - DNA, 25 bp, Homo sapien
actaccatggagtgaactgaattca

SEQ ID NO: 506966 - DNA, 25 bp, Homo sapien
attcatacggatggcttgggctgac

SEQ ID NO: 506967 - DNA, 25 bp, Homo sapien
atggcttgggctgacacagtttctt

SEQ ID NO: 506968 - DNA, 25 bp, Homo sapien
acagtttcttcccagtggaccaata

SEQ ID NO: 506969 - DNA, 25 bp, Homo sapien
gtggaccaataaatcagactcaccc

SEQ ID NO: 506970 - DNA, 25 bp, Homo sapien
aggttactagaatacacatttgctg

SEQ ID NO: 506971 - DNA, 25 bp, Homo sapien
tgcgtaattcagagagcctagatgc

SEQ ID NO: 506972 - DNA, 25 bp, Homo sapien
gtagctgggacagttacatttccaa

SEQ ID NO: 506973 - DNA, 25 bp, Homo sapien
atgctagcaacaactgtctcccgtc

SEQ ID NO: 506974 - DNA, 25 bp, Homo sapien
gcaagggtaagctaacttcccgtgt

SEQ ID NO: 506975 - DNA, 25 bp, Homo sapien
cttcccgtgtaatttaccacaaatg

SEQ ID NO: 506976 - DNA, 25 bp, Homo sapien
gagcctagatgcagataagctgaat

SEQ ID NO: 506977 - DNA, 25 bp, Homo sapien
aaatgatatggtcacggcgctcact

SEQ ID NO: 506978 - DNA, 25 bp, Homo sapien
gctcactgtgccctcaagtgagaga

SEQ ID NO: 506979 - DNA, 25 bp, Homo sapien
ttttaacttgatcatcttgaacagt

SEQ ID NO: 506980 - DNA, 25 bp, Homo sapien
acagttcaggcatcacaggttacta

SEQ ID NO: 506981 - DNA, 25 bp, Homo sapien
agaggaggagctggcagcattacaa

SEQ ID NO: 506982 - DNA, 25 bp, Homo sapien
agctggcagcattacaactgggccc

SEQ ID NO: 506983 - DNA, 25 bp, Homo sapien
tggcagcattacaactgggccccac

SEQ ID NO: 506984 - DNA, 25 bp, Homo sapien
acccaccacgagtgtgaggccggtc

SEQ ID NO: 506985 - DNA, 25 bp, Homo sapien
tgcgcctcactgcattgcccgacta

SEQ ID NO: 506986 - DNA, 25 bp, Homo sapien
tccccggatgacatcccactcatga

SEQ ID NO: 506987 - DNA, 25 bp, Homo sapien
tatgatccccaactccctggtaggg

SEQ ID NO: 506988 - DNA, 25 bp, Homo sapien
tgatccccaactccctggtagggct

SEQ ID NO: 506989 - DNA, 25 bp, Homo sapien
tgcagacattgcacccctataacac

SEQ ID NO: 506990 - DNA, 25 bp, Homo sapien
acattgcacccctataacacctttg

SEQ ID NO: 506991 - DNA, 25 bp, Homo sapien
tataacacctttgccgcagggttca

SEQ ID NO: 506992 - DNA, 25 bp, Homo sapien
atgcccctatttctcttttggatga

SEQ ID NO: 506993 - DNA, 25 bp, Homo sapien
ggtgggtgggtactgaggtttcctg

SEQ ID NO: 506994 - DNA, 25 bp, Homo sapien
tactgaggtttcctggccagctgta

SEQ ID NO: 506995 - DNA, 25 bp, Homo sapien
gtagtccagttacccagagagctca

SEQ ID NO: 506996 - DNA, 25 bp, Homo sapien
gagctcacttaacattgcctcttta

SEQ ID NO: 506997 - DNA, 25 bp, Homo sapien
tctttacttccccagtactgaaaca

SEQ ID NO: 506998 - DNA, 25 bp, Homo sapien
ctcttctttgtgattgtctgtagta

SEQ ID NO: 506999 - DNA, 25 bp, Homo sapien
ctttgtgattgtctgtagtatgctt

SEQ ID NO: 507000 - DNA, 25 bp, Homo sapien
gtgattgtctgtagtatgctttgaa

SEQ ID NO: 507001 - DNA, 25 bp, Homo sapien
gattgtctgtagtatgctttgaagg

SEQ ID NO: 507002 - DNA, 25 bp, Homo sapien
tgtctgtagtatgctttgaaggtgc

SEQ ID NO: 507003 - DNA, 25 bp, Homo sapien
cactgtgacgcttttgagttatgaa

SEQ ID NO: 507004 - DNA, 25 bp, Homo sapien
ctgtgacgcttttgagttatgaaga

SEQ ID NO: 507005 - DNA, 25 bp, Homo sapien
ttatgaagaagggtagcggcctgat

SEQ ID NO: 507006 - DNA, 25 bp, Homo sapien
gtagcggcctgatgcgaggctcttt

SEQ ID NO: 507007 - DNA, 25 bp, Homo sapien
tagcggcctgatgcgaggctctttg

SEQ ID NO: 507008 - DNA, 25 bp, Homo sapien
ggcctgatgcgaggctctttgtgtc

SEQ ID NO: 507009 - DNA, 25 bp, Homo sapien
ttgtgtcctcattatagcaaagggt

SEQ ID NO: 507010 - DNA, 25 bp, Homo sapien
gtgtcctcattatagcaaagggtta

SEQ ID NO: 507011 - DNA, 25 bp, Homo sapien
tcctcattatagcaaagggttactg

SEQ ID NO: 507012 - DNA, 25 bp, Homo sapien
gcacaacaatacaatttatatggta

SEQ ID NO: 507013 - DNA, 25 bp, Homo sapien
caatttatatggtaaatggaaccaa

SEQ ID NO: 507014 - DNA, 25 bp, Homo sapien
agcagaatgggcaaagacagtgtaa

SEQ ID NO: 507015 - DNA, 25 bp, Homo sapien
aaatgtggagcttcactgttgcaaa

SEQ ID NO: 507016 - DNA, 25 bp, Homo sapien
actgttgcaaagcatgctacacata

SEQ ID NO: 507017 - DNA, 25 bp, Homo sapien
ataaagtatgaatggctgcctgagg

SEQ ID NO: 507018 - DNA, 25 bp, Homo sapien
tgcctgaggagccactgctctagaa

SEQ ID NO: 507019 - DNA, 25 bp, Homo sapien
cactgctctagaaggctggctatta

SEQ ID NO: 507020 - DNA, 25 bp, Homo sapien
ggctggctattactgttatgagaac

SEQ ID NO: 507021 - DNA, 25 bp, Homo sapien
caccttgtgtgtttggtacgtttct

SEQ ID NO: 507022 - DNA, 25 bp, Homo sapien
tgtgtgtttggtacgtttctttctt

SEQ ID NO: 507023 - DNA, 25 bp, Homo sapien
gagttgctgggatgctgctgatgac

SEQ ID NO: 507024 - DNA, 25 bp, Homo sapien
tggaaatgttttaggccgagttcat

SEQ ID NO: 507025 - DNA, 25 bp, Homo sapien
acgacgagcgtcctcatggccaaca

SEQ ID NO: 507026 - DNA, 25 bp, Homo sapien
gacgagcgtcctcatggccaacaaa

SEQ ID NO: 507027 - DNA, 25 bp, Homo sapien
acgagcgtcctcatggccaacaaat

SEQ ID NO: 507028 - DNA, 25 bp, Homo sapien
cgagcgtcctcatggccaacaaatt

SEQ ID NO: 507029 - DNA, 25 bp, Homo sapien
gagcgtcctcatggccaacaaattg

SEQ ID NO: 507030 - DNA, 25 bp, Homo sapien
cgtcctcatggccaacaaattgtct

SEQ ID NO: 507031 - DNA, 25 bp, Homo sapien
gtcctcatggccaacaaattgtctt

SEQ ID NO: 507032 - DNA, 25 bp, Homo sapien
tcctcatggccaacaaattgtcttc

SEQ ID NO: 507033 - DNA, 25 bp, Homo sapien
tcatggccaacaaattgtcttcaag

SEQ ID NO: 507034 - DNA, 25 bp, Homo sapien
atggccaacaaattgtcttcaagga

SEQ ID NO: 507035 - DNA, 25 bp, Homo sapien
ggccaacaaattgtcttcaaggact

SEQ ID NO: 507036 - DNA, 25 bp, Homo sapien
ttaaagctcaggagggtgacgccca

SEQ ID NO: 507037 - DNA, 25 bp, Homo sapien
taggactaccgcaggcccggactca

SEQ ID NO: 507038 - DNA, 25 bp, Homo sapien
ggactcaccaacttgccacatgttc

SEQ ID NO: 507039 - DNA, 25 bp, Homo sapien
cttgccacatgttctaggtttcagc

SEQ ID NO: 507040 - DNA, 25 bp, Homo sapien
ttcagcaacaagactgccaggtggt

SEQ ID NO: 507041 - DNA, 25 bp, Homo sapien
caggtggttgggttctgcctttagc

SEQ ID NO: 507042 - DNA, 25 bp, Homo sapien
gttctgcctttagcctggaccaaag

SEQ ID NO: 507043 - DNA, 25 bp, Homo sapien
tggaccaaagggaagtgaggcccaa

SEQ ID NO: 507044 - DNA, 25 bp, Homo sapien
agtgaggcccaaggagcttacccaa

SEQ ID NO: 507045 - DNA, 25 bp, Homo sapien
aaggagcttacccaagctgtggcag

SEQ ID NO: 507046 - DNA, 25 bp, Homo sapien
agcttacccaagctgtggcagccgt

SEQ ID NO: 507047 - DNA, 25 bp, Homo sapien
cctttgttccatcttgagcagagat

SEQ ID NO: 507048 - DNA, 25 bp, Homo sapien
gatgtgctgcatttcttaacgtttg

SEQ ID NO: 507049 - DNA, 25 bp, Homo sapien
gcatttcttaacgtttggtctctat

SEQ ID NO: 507050 - DNA, 25 bp, Homo sapien
ggtctctatacattataccatctgc

SEQ ID NO: 507051 - DNA, 25 bp, Homo sapien
taccatctgctgaagtttagctttg

SEQ ID NO: 507052 - DNA, 25 bp, Homo sapien
ctgctgaagtttagctttgtgtgtg

SEQ ID NO: 507053 - DNA, 25 bp, Homo sapien
tgtatatgtacccatgtgtgcactt

SEQ ID NO: 507054 - DNA, 25 bp, Homo sapien
caatgtttctggttaatgttgcaaa

SEQ ID NO: 507055 - DNA, 25 bp, Homo sapien
aattgattttctactcctgccctgt

SEQ ID NO: 507056 - DNA, 25 bp, Homo sapien
gccctgtgaattaaggcagagtttt

SEQ ID NO: 507057 - DNA, 25 bp, Homo sapien
tactgtaatatttgcaagtatccaa

SEQ ID NO: 507058 - DNA, 25 bp, Homo sapien
gtgtctgtgtccacttagagcctca

SEQ ID NO: 507059 - DNA, 25 bp, Homo sapien
agagcctcacgacctggctgtgtgt

SEQ ID NO: 507060 - DNA, 25 bp, Homo sapien
gcatgtgtgtgtagtatagtttgta

SEQ ID NO: 507061 - DNA, 25 bp, Homo sapien
atgtgagtgcagaattagtgcccgt

SEQ ID NO: 507062 - DNA, 25 bp, Homo sapien
tgcagaattagtgcccgtggcggtt

SEQ ID NO: 507063 - DNA, 25 bp, Homo sapien
tgcccgtggcggttttctgtatttt

SEQ ID NO: 507064 - DNA, 25 bp, Homo sapien
ggattcttagcaaaatcattctcta

SEQ ID NO: 507065 - DNA, 25 bp, Homo sapien
gcaaaatcattctctaggactatta

SEQ ID NO: 507066 - DNA, 25 bp, Homo sapien
aggactattagtcgcgatctcccag

SEQ ID NO: 507067 - DNA, 25 bp, Homo sapien
tattagtcgcgatctcccagtgagc

SEQ ID NO: 507068 - DNA, 25 bp, Homo sapien
gatctcccagtgagccatcacgatg

SEQ ID NO: 507069 - DNA, 25 bp, Homo sapien
gtctgtgtcaggcagtatgcttgtc

SEQ ID NO: 507070 - DNA, 25 bp, Homo sapien
tctgtgtcaggcagtatgcttgtcc

SEQ ID NO: 507071 - DNA, 25 bp, Homo sapien
ctgtgtcaggcagtatgcttgtcct

SEQ ID NO: 507072 - DNA, 25 bp, Homo sapien
tgtgtcaggcagtatgcttgtcctg

SEQ ID NO: 507073 - DNA, 25 bp, Homo sapien
gtgtcaggcagtatgcttgtcctga

SEQ ID NO: 507074 - DNA, 25 bp, Homo sapien
gtcaggcagtatgcttgtcctgaag

SEQ ID NO: 507075 - DNA, 25 bp, Homo sapien
aggcagtatgcttgtcctgaagaga

SEQ ID NO: 507076 - DNA, 25 bp, Homo sapien
ggcagtatgcttgtcctgaagagag

SEQ ID NO: 507077 - DNA, 25 bp, Homo sapien
cagtatgcttgtcctgaagagaggt

SEQ ID NO: 507078 - DNA, 25 bp, Homo sapien
agtatgcttgtcctgaagagaggtt

SEQ ID NO: 507079 - DNA, 25 bp, Homo sapien
ttttgtttgaaaacacaatcagctc

SEQ ID NO: 507080 - DNA, 25 bp, Homo sapien
ttagaatcagcagcactgtacaaat

SEQ ID NO: 507081 - DNA, 25 bp, Homo sapien
aataaagtgcctgtgcttcacctca

SEQ ID NO: 507082 - DNA, 25 bp, Homo sapien
gcttcacctcacaccaagaatcttg

SEQ ID NO: 507083 - DNA, 25 bp, Homo sapien
aagaatcttgcctaaccctgtcaga

SEQ ID NO: 507084 - DNA, 25 bp, Homo sapien
tgcctaaccctgtcagagtgcctaa

SEQ ID NO: 507085 - DNA, 25 bp, Homo sapien
gagtgcctaatatcctgtggtgatt

SEQ ID NO: 507086 - DNA, 25 bp, Homo sapien
cagtcttattttgtgctctttggtt

SEQ ID NO: 507087 - DNA, 25 bp, Homo sapien
tattttgtgctctttggtttcttaa

SEQ ID NO: 507088 - DNA, 25 bp, Homo sapien
tttctttcctttatcattacagagg

SEQ ID NO: 507089 - DNA, 25 bp, Homo sapien
atcattacagaggtatgtctttggt

SEQ ID NO: 507090 - DNA, 25 bp, Homo sapien
gtctttggttcttaaactatctgtc

SEQ ID NO: 507091 - DNA, 25 bp, Homo sapien
aagcaagctgaatcagtgttagatc

SEQ ID NO: 507092 - DNA, 25 bp, Homo sapien
gtgttagatctccaagaagtgactc

SEQ ID NO: 507093 - DNA, 25 bp, Homo sapien
gaagtgactctagcagaagatttta

SEQ ID NO: 507094 - DNA, 25 bp, Homo sapien
atggtgataagcattccaatcaaga

SEQ ID NO: 507095 - DNA, 25 bp, Homo sapien
atgaaaccagtgttcctgagtgcac

SEQ ID NO: 507096 - DNA, 25 bp, Homo sapien
gtgttcctgagtgcacactgacatg

SEQ ID NO: 507097 - DNA, 25 bp, Homo sapien
gagtgcacactgacatgtctgtgaa

SEQ ID NO: 507098 - DNA, 25 bp, Homo sapien
atgtctgtgaatatgttactgaacc

SEQ ID NO: 507099 - DNA, 25 bp, Homo sapien
gttactgaacctatagtccagtttt

SEQ ID NO: 507100 - DNA, 25 bp, Homo sapien
tagtctgaaattatttgggccctaa

SEQ ID NO: 507101 - DNA, 25 bp, Homo sapien
aagaatggagctgcattgatgaatt

SEQ ID NO: 507102 - DNA, 25 bp, Homo sapien
agtgttgtctgtcatgtgccagaag

SEQ ID NO: 507103 - DNA, 25 bp, Homo sapien
tgtctgtcatgtgccagaagcttct

SEQ ID NO: 507104 - DNA, 25 bp, Homo sapien
gtgagccactggcattgggcaggcg

SEQ ID NO: 507105 - DNA, 25 bp, Homo sapien
agtgtgacccacactccatgggcag

SEQ ID NO: 507106 - DNA, 25 bp, Homo sapien
tccatgggcagccacctgtttatat

SEQ ID NO: 507107 - DNA, 25 bp, Homo sapien
ggcagccacctgtttatatctggtt

SEQ ID NO: 507108 - DNA, 25 bp, Homo sapien
tatctggtttcagttataacccagt

SEQ ID NO: 507109 - DNA, 25 bp, Homo sapien
ttaaacaattcctcttccatcagac

SEQ ID NO: 507110 - DNA, 25 bp, Homo sapien
cttccatcagaccaccagacaaaaa

SEQ ID NO: 507111 - DNA, 25 bp, Homo sapien
ttcccttcctgtacacatctagaaa

SEQ ID NO: 507112 - DNA, 25 bp, Homo sapien
gtacacatctagaaaacttcacctt

SEQ ID NO: 507113 - DNA, 25 bp, Homo sapien
ggtaacagttagatgtttcctaaga

SEQ ID NO: 507114 - DNA, 25 bp, Homo sapien
gttagatgtttcctaagaatgcaaa

SEQ ID NO: 507115 - DNA, 25 bp, Homo sapien
agaatgcaaactgccttttccacac

SEQ ID NO: 507116 - DNA, 25 bp, Homo sapien
ccttttccacacaaaggctgggaat

SEQ ID NO: 507117 - DNA, 25 bp, Homo sapien
aattctgggtattctcgtattctca

SEQ ID NO: 507118 - DNA, 25 bp, Homo sapien
gggtattctcgtattctcatttaaa

SEQ ID NO: 507119 - DNA, 25 bp, Homo sapien
attctcatttaaaggagtttagctt

SEQ ID NO: 507120 - DNA, 25 bp, Homo sapien
gcaggattgcttttgaccttttaga

SEQ ID NO: 507121 - DNA, 25 bp, Homo sapien
ggattgcttttgaccttttagaaga

SEQ ID NO: 507122 - DNA, 25 bp, Homo sapien
ccttttagaagattggtctccagta

SEQ ID NO: 507123 - DNA, 25 bp, Homo sapien
aagattggtctccagtaaaggtgga

SEQ ID NO: 507124 - DNA, 25 bp, Homo sapien
acgacgagcgtcctcatggccaaca

SEQ ID NO: 507125 - DNA, 25 bp, Homo sapien
acgagcgtcctcatggccaacaaat

SEQ ID NO: 507126 - DNA, 25 bp, Homo sapien
gagcgtcctcatggccaacaaattg

SEQ ID NO: 507127 - DNA, 25 bp, Homo sapien
cgtcctcatggccaacaaattgtct

SEQ ID NO: 507128 - DNA, 25 bp, Homo sapien
tcctcatggccaacaaattgtcttc

SEQ ID NO: 507129 - DNA, 25 bp, Homo sapien
catggccaacaaattgtcttcaagg

SEQ ID NO: 507130 - DNA, 25 bp, Homo sapien
ggccaacaaattgtcttcaaggact

SEQ ID NO: 507131 - DNA, 25 bp, Homo sapien
attgtcttcaaggactgacctctga

SEQ ID NO: 507132 - DNA, 25 bp, Homo sapien
tctgctggccaagtcgtgggtcctc

SEQ ID NO: 507133 - DNA, 25 bp, Homo sapien
attgcatggcacagctcactttggc

SEQ ID NO: 507134 - DNA, 25 bp, Homo sapien
taacaacatggtacattccggcccc

SEQ ID NO: 507135 - DNA, 25 bp, Homo sapien
caaagctatttctcaattgtgttat

SEQ ID NO: 507136 - DNA, 25 bp, Homo sapien
gtttcttcaaaagggtacacatgct

SEQ ID NO: 507137 - DNA, 25 bp, Homo sapien
atttttcttcaccattaacttcttg

SEQ ID NO: 507138 - DNA, 25 bp, Homo sapien
taacttcttgttggtagctttttgt

SEQ ID NO: 507139 - DNA, 25 bp, Homo sapien
gatggcaatgcttatctcaaccaga

SEQ ID NO: 507140 - DNA, 25 bp, Homo sapien
cagaattaaggtatgcaactggtaa

SEQ ID NO: 507141 - DNA, 25 bp, Homo sapien
ggtacacatgctttagtgacctaaa

SEQ ID NO: 507142 - DNA, 25 bp, Homo sapien
tcaacctttgagttcttaacctttg

SEQ ID NO: 507143 - DNA, 25 bp, Homo sapien
aattttgtacatttgacatcaggga

SEQ ID NO: 507144 - DNA, 25 bp, Homo sapien
cagggatgttataagtactgcactt

SEQ ID NO: 507145 - DNA, 25 bp, Homo sapien
gtactgcacttaatacaaagctatt

SEQ ID NO: 507146 - DNA, 25 bp, Homo sapien
cactcctaaatttaatccctgaata

SEQ ID NO: 507147 - DNA, 25 bp, Homo sapien
aatccctgaataatgcagtgtacat

SEQ ID NO: 507148 - DNA, 25 bp, Homo sapien
aatgcagtgtacatgatgatagagg

SEQ ID NO: 507149 - DNA, 25 bp, Homo sapien
gtgtgtttttgataagaagtgacta

SEQ ID NO: 507150 - DNA, 25 bp, Homo sapien
gaagtgactaaattttgtgacaatc

SEQ ID NO: 507151 - DNA, 25 bp, Homo sapien
ggcttttcatttagtcttccaataa

SEQ ID NO: 507152 - DNA, 25 bp, Homo sapien
aagacctacatggataagtttgaaa

SEQ ID NO: 507153 - DNA, 25 bp, Homo sapien
cttacatcatatactcaggtgtgta

SEQ ID NO: 507154 - DNA, 25 bp, Homo sapien
tactcaggtgtgtaaaagcctgcta

SEQ ID NO: 507155 - DNA, 25 bp, Homo sapien
aaaagcctgctatttgtaactataa

SEQ ID NO: 507156 - DNA, 25 bp, Homo sapien
gcctgctatttgtaactataatcca

SEQ ID NO: 507157 - DNA, 25 bp, Homo sapien
ggaattatgattgtagtctgttgaa

SEQ ID NO: 507158 - DNA, 25 bp, Homo sapien
gttgaatagtatttaccatggcatt

SEQ ID NO: 507159 - DNA, 25 bp, Homo sapien
ttaccatggcatttcatacccatgg

SEQ ID NO: 507160 - DNA, 25 bp, Homo sapien
tacccatggtattttataccttctg

SEQ ID NO: 507161 - DNA, 25 bp, Homo sapien
gtattttataccttctgactatcaa

SEQ ID NO: 507162 - DNA, 25 bp, Homo sapien
tataccttctgactatcaattttag

SEQ ID NO: 507163 - DNA, 25 bp, Homo sapien
agtattattagatgtttgtgtaacc

SEQ ID NO: 507164 - DNA, 25 bp, Homo sapien
ttgtgtaaccacttgcttatttaaa

SEQ ID NO: 507165 - DNA, 25 bp, Homo sapien
gaattttgagtactgcctaattgtc

SEQ ID NO: 507166 - DNA, 25 bp, Homo sapien
gagtactgcctaattgtcagttata

SEQ ID NO: 507167 - DNA, 25 bp, Homo sapien
ataaattacatgtcattctactgta

SEQ ID NO: 507168 - DNA, 25 bp, Homo sapien
acagatgtgggaaatcttcatatag

SEQ ID NO: 507169 - DNA, 25 bp, Homo sapien
gatgtgggaaatcttcatatagtgt

SEQ ID NO: 507170 - DNA, 25 bp, Homo sapien
gtgggaaatcttcatatagtgtatg

SEQ ID NO: 507171 - DNA, 25 bp, Homo sapien
gtacagggaaattattttcctctgt

SEQ ID NO: 507172 - DNA, 25 bp, Homo sapien
gggaaattattttcctctgtgtctt

SEQ ID NO: 507173 - DNA, 25 bp, Homo sapien
tttactgttactataaaattatgca

SEQ ID NO: 507174 - DNA, 25 bp, Homo sapien
aagtattgtgacaaaactgcatcaa

SEQ ID NO: 507175 - DNA, 25 bp, Homo sapien
actgcatcaatttgttgactattaa

SEQ ID NO: 507176 - DNA, 25 bp, Homo sapien
ttgactattaaagtgctccttgaac

SEQ ID NO: 507177 - DNA, 25 bp, Homo sapien
gactattaaagtgctccttgaacat

SEQ ID NO: 507178 - DNA, 25 bp, Homo sapien
actattaaagtgctccttgaacatt

SEQ ID NO: 507179 - DNA, 25 bp, Homo sapien
ggtcattgtgttgctacccaagaga

SEQ ID NO: 507180 - DNA, 25 bp, Homo sapien
tgtgttgctacccaagagaaaatgc

SEQ ID NO: 507181 - DNA, 25 bp, Homo sapien
tacagttttatagattgcacatcat

SEQ ID NO: 507182 - DNA, 25 bp, Homo sapien
tatagattgcacatcattctttaag

SEQ ID NO: 507183 - DNA, 25 bp, Homo sapien
taaggcatacttttacctcaggaaa

SEQ ID NO: 507184 - DNA, 25 bp, Homo sapien
cctcaggaaacttactctagtatgt

SEQ ID NO: 507185 - DNA, 25 bp, Homo sapien
aacttactctagtatgttctcatat

SEQ ID NO: 507186 - DNA, 25 bp, Homo sapien
gttctcatatattgaattctcaact

SEQ ID NO: 507187 - DNA, 25 bp, Homo sapien
taagtaactatttctttatacctat

SEQ ID NO: 507188 - DNA, 25 bp, Homo sapien
aactagtacctaattcactgttagt

SEQ ID NO: 507189 - DNA, 25 bp, Homo sapien
ctatagataaggcagctaaatttct

SEQ ID NO: 507190 - DNA, 25 bp, Homo sapien
tacctaggtgtgtaagctgaagcct

SEQ ID NO: 507191 - DNA, 25 bp, Homo sapien
gcctttgcacggacctttggtcctg

SEQ ID NO: 507192 - DNA, 25 bp, Homo sapien
cggacctttggtcctgtccatcctg

SEQ ID NO: 507193 - DNA, 25 bp, Homo sapien
aggcccgtgtggcttgctccatcat

SEQ ID NO: 507194 - DNA, 25 bp, Homo sapien
tgtggcttgctccatcattcaggtc

SEQ ID NO: 507195 - DNA, 25 bp, Homo sapien
gctccatcattcaggtcttggctga

SEQ ID NO: 507196 - DNA, 25 bp, Homo sapien
taagctgaagccttacctgtgaggg

SEQ ID NO: 507197 - DNA, 25 bp, Homo sapien
ttttcttactcatatttcccactcc

SEQ ID NO: 507198 - DNA, 25 bp, Homo sapien
acatggtctgatctcccaggagctg

SEQ ID NO: 507199 - DNA, 25 bp, Homo sapien
ggagctgctggatcttaattcctct

SEQ ID NO: 507200 - DNA, 25 bp, Homo sapien
tggatcttaattcctcttacgcttc

SEQ ID NO: 507201 - DNA, 25 bp, Homo sapien
gttacctgcttgaggaaaagcacga

SEQ ID NO: 507202 - DNA, 25 bp, Homo sapien
gaaattggtatcaaagtcttggctt

SEQ ID NO: 507203 - DNA, 25 bp, Homo sapien
tggtatcaaagtcttggctttgttc

SEQ ID NO: 507204 - DNA, 25 bp, Homo sapien
gaaaacaccagagacagtagtaaat

SEQ ID NO: 507205 - DNA, 25 bp, Homo sapien
aaggcagctgccatgagtcatttta

SEQ ID NO: 507206 - DNA, 25 bp, Homo sapien
tacccatttctaccctggtaatcct

SEQ ID NO: 507207 - DNA, 25 bp, Homo sapien
taccctggtaatcctccctgcaaat

SEQ ID NO: 507208 - DNA, 25 bp, Homo sapien
agtcattttaagtctctgagctcca

SEQ ID NO: 507209 - DNA, 25 bp, Homo sapien
taagtctctgagctccagcccagtt

SEQ ID NO: 507210 - DNA, 25 bp, Homo sapien
acaaggctggagtagggatactcct

SEQ ID NO: 507211 - DNA, 25 bp, Homo sapien
agggatactcctagttacctgcttg

SEQ ID NO: 507212 - DNA, 25 bp, Homo sapien
gaagcacttattacactatctaacc

SEQ ID NO: 507213 - DNA, 25 bp, Homo sapien
aattcttgagagttgtatctgtcgt

SEQ ID NO: 507214 - DNA, 25 bp, Homo sapien
gtatctgtcgttatttctgaatgtg

SEQ ID NO: 507215 - DNA, 25 bp, Homo sapien
aaatggctgatcttctatattgtag

SEQ ID NO: 507216 - DNA, 25 bp, Homo sapien
ttccctcttccctgaggaacaaagc

SEQ ID NO: 507217 - DNA, 25 bp, Homo sapien
ggaacaaagcacgtatctttagtct

SEQ ID NO: 507218 - DNA, 25 bp, Homo sapien
ttattctgagaccaagggcttgctt

SEQ ID NO: 507219 - DNA, 25 bp, Homo sapien
gggcttgcttgacctgatgattttc

SEQ ID NO: 507220 - DNA, 25 bp, Homo sapien
gacctgatgattttccttcagctct

SEQ ID NO: 507221 - DNA, 25 bp, Homo sapien
tcagctctctgaaggtgctttttcc

SEQ ID NO: 507222 - DNA, 25 bp, Homo sapien
ctgaaggtgctttttccacaatcca

SEQ ID NO: 507223 - DNA, 25 bp, Homo sapien
tttccaagagagtgattatttgcat

SEQ ID NO: 507224 - DNA, 25 bp, Homo sapien
caagagagtgattatttgcattaca

SEQ ID NO: 507225 - DNA, 25 bp, Homo sapien
gaattcttaataattcctgtaagcc

SEQ ID NO: 507226 - DNA, 25 bp, Homo sapien
attcttaataattcctgtaagccta

SEQ ID NO: 507227 - DNA, 25 bp, Homo sapien
tcctgtaagcctaggaaataggaat

SEQ ID NO: 507228 - DNA, 25 bp, Homo sapien
aagcctaggaaataggaatgccaaa

SEQ ID NO: 507229 - DNA, 25 bp, Homo sapien
ggaatgccaaagtaacatttaatgt

SEQ ID NO: 507230 - DNA, 25 bp, Homo sapien
catttaatgtacttctctataactt

SEQ ID NO: 507231 - DNA, 25 bp, Homo sapien
taatgtacttctctataacttttca

SEQ ID NO: 507232 - DNA, 25 bp, Homo sapien
gtacttctctataacttttcataat

SEQ ID NO: 507233 - DNA, 25 bp, Homo sapien
tctctataacttttcataatcagaa

SEQ ID NO: 507234 - DNA, 25 bp, Homo sapien
gaaggcaagggatcctaagggagat

SEQ ID NO: 507235 - DNA, 25 bp, Homo sapien
taagggagatggtgcaagggctttt

SEQ ID NO: 507236 - DNA, 25 bp, Homo sapien
agggtaacccctaagagatgagaag

SEQ ID NO: 507237 - DNA, 25 bp, Homo sapien
ccaaaatgtagtagagaagagggtt

SEQ ID NO: 507238 - DNA, 25 bp, Homo sapien
gtaacccctaagagatgagaaggat

SEQ ID NO: 507239 - DNA, 25 bp, Homo sapien
cagcagggatgggacatgtgggatt

SEQ ID NO: 507240 - DNA, 25 bp, Homo sapien
atgggacatgtgggatttgtgtaaa

SEQ ID NO: 507241 - DNA, 25 bp, Homo sapien
ttgtgtaaagcagggagcaaactat

SEQ ID NO: 507242 - DNA, 25 bp, Homo sapien
aagcagggagcaaactatggctcaa

SEQ ID NO: 507243 - DNA, 25 bp, Homo sapien
gcaaactatggctcaagggcctgct

SEQ ID NO: 507244 - DNA, 25 bp, Homo sapien
aactatggctcaagggcctgctttg

SEQ ID NO: 507245 - DNA, 25 bp, Homo sapien
aagaggttacatactttctgctcac

SEQ ID NO: 507246 - DNA, 25 bp, Homo sapien
ggttacatactttctgctcacagtt

SEQ ID NO: 507247 - DNA, 25 bp, Homo sapien
ttctgctcacagtttcagttgattg

SEQ ID NO: 507248 - DNA, 25 bp, Homo sapien
cagttgattggatgtgtattctctt

SEQ ID NO: 507249 - DNA, 25 bp, Homo sapien
gttaaaacatttgacacagcaatat

SEQ ID NO: 507250 - DNA, 25 bp, Homo sapien
ttttaaatccatcaactaagtccat

SEQ ID NO: 507251 - DNA, 25 bp, Homo sapien
atcaactaagtccatcagcagagct

SEQ ID NO: 507252 - DNA, 25 bp, Homo sapien
tcagcagagctttatagagctaagg

SEQ ID NO: 507253 - DNA, 25 bp, Homo sapien
ctgtgatgtgtttttgaggagttga

SEQ ID NO: 507254 - DNA, 25 bp, Homo sapien
ggagttgatactcatcagtaagcaa

SEQ ID NO: 507255 - DNA, 25 bp, Homo sapien
ttctaagaactctttactttgaaat

SEQ ID NO: 507256 - DNA, 25 bp, Homo sapien
aaacattctgtgtgcgctagtgcga

SEQ ID NO: 507257 - DNA, 25 bp, Homo sapien
tgcgctagtgcgagaggatcttcta

SEQ ID NO: 507258 - DNA, 25 bp, Homo sapien
gagaggatcttctacagtcacctgc

SEQ ID NO: 507259 - DNA, 25 bp, Homo sapien
agtcacctgccttcatgccattaca

SEQ ID NO: 507260 - DNA, 25 bp, Homo sapien
catgccattacagacagacgggaag

SEQ ID NO: 507261 - DNA, 25 bp, Homo sapien
ggaagtcactgggttctaggacata

SEQ ID NO: 507262 - DNA, 25 bp, Homo sapien
aaagacctacatgttggctagccta

SEQ ID NO: 507263 - DNA, 25 bp, Homo sapien
tggctagcctaaatcgaaccctttt

SEQ ID NO: 507264 - DNA, 25 bp, Homo sapien
tagttgactcaaggcaccctggtgg

SEQ ID NO: 507265 - DNA, 25 bp, Homo sapien
ggacggagaggttttttcgctcagt

SEQ ID NO: 507266 - DNA, 25 bp, Homo sapien
ggcagggcccgggtgcaagaaaaca

SEQ ID NO: 507267 - DNA, 25 bp, Homo sapien
aacatcctgtaggtctccctgttgc

SEQ ID NO: 507268 - DNA, 25 bp, Homo sapien
aggatgtcaggcctcaccgtgctga

SEQ ID NO: 507269 - DNA, 25 bp, Homo sapien
ctgagccttcaggaggctggaaata

SEQ ID NO: 507270 - DNA, 25 bp, Homo sapien
gggctggcttctaagcttgagctct

SEQ ID NO: 507271 - DNA, 25 bp, Homo sapien
ttctaagcttgagctctggagccag

SEQ ID NO: 507272 - DNA, 25 bp, Homo sapien
gagtcaaggccaaaattgcccagat

SEQ ID NO: 507273 - DNA, 25 bp, Homo sapien
tctccctcccattgcttaagtatgg

SEQ ID NO: 507274 - DNA, 25 bp, Homo sapien
ttgcttaagtatggccagaattgtg

SEQ ID NO: 507275 - DNA, 25 bp, Homo sapien
gactcctccattgaggcagcctagg

SEQ ID NO: 507276 - DNA, 25 bp, Homo sapien
agccatctctatcacattctttatt

SEQ ID NO: 507277 - DNA, 25 bp, Homo sapien
tttatttccaaatgacctgccccac

SEQ ID NO: 507278 - DNA, 25 bp, Homo sapien
atcacacagcttaatgagtcacatt

SEQ ID NO: 507279 - DNA, 25 bp, Homo sapien
aattgaactgcaaatcacttttagt

SEQ ID NO: 507280 - DNA, 25 bp, Homo sapien
gcatgtcagtggcatgatgcttgcc

SEQ ID NO: 507281 - DNA, 25 bp, Homo sapien
gatgcttgccaagccagatctaggc

SEQ ID NO: 507282 - DNA, 25 bp, Homo sapien
gccagatctaggcatctaggataat

SEQ ID NO: 507283 - DNA, 25 bp, Homo sapien
gcaatttactgccataatatcaaag

SEQ ID NO: 507284 - DNA, 25 bp, Homo sapien
aggtcagtaacagtgttctttcttt

SEQ ID NO: 507285 - DNA, 25 bp, Homo sapien
ctttcttcaagcttatgtatacctt

SEQ ID NO: 507286 - DNA, 25 bp, Homo sapien
cttgcatgaattactttgattactt

SEQ ID NO: 507287 - DNA, 25 bp, Homo sapien
ggtctcaattatttgtcaccccagt

SEQ ID NO: 507288 - DNA, 25 bp, Homo sapien
atttgtcaccccagttaaacatgaa

SEQ ID NO: 507289 - DNA, 25 bp, Homo sapien
gaagtagaagggacactggagtcca

SEQ ID NO: 507290 - DNA, 25 bp, Homo sapien
aggcagcttcaactcatgcactgag

SEQ ID NO: 507291 - DNA, 25 bp, Homo sapien
aactcatgcactgagccctgaggtt

SEQ ID NO: 507292 - DNA, 25 bp, Homo sapien
agccctgaggttactgggaacggca

SEQ ID NO: 507293 - DNA, 25 bp, Homo sapien
tactgggaacggcaggtgcaaatat

SEQ ID NO: 507294 - DNA, 25 bp, Homo sapien
gaacggcaggtgcaaatatctcatg

SEQ ID NO: 507295 - DNA, 25 bp, Homo sapien
ctcatgaggagatagaaagttggca

SEQ ID NO: 507296 - DNA, 25 bp, Homo sapien
gcataatttggatgagaaaggctac

SEQ ID NO: 507297 - DNA, 25 bp, Homo sapien
gagaaaggctactatggctgcaata

SEQ ID NO: 507298 - DNA, 25 bp, Homo sapien
ggctactatggctgcaatatggtga

SEQ ID NO: 507299 - DNA, 25 bp, Homo sapien
actatggctgcaatatggtgaggga

SEQ ID NO: 507300 - DNA, 25 bp, Homo sapien
gggctcagagattagatcacagctc

SEQ ID NO: 507301 - DNA, 25 bp, Homo sapien
cctggaagagctggactttattttg

SEQ ID NO: 507302 - DNA, 25 bp, Homo sapien
ggactttattttgcttgcacttctg

SEQ ID NO: 507303 - DNA, 25 bp, Homo sapien
ttttgcttgcacttctgtccatgca

SEQ ID NO: 507304 - DNA, 25 bp, Homo sapien
tctgaaatctgcttaagttttctct

SEQ ID NO: 507305 - DNA, 25 bp, Homo sapien
cactctctccagcagttgacatttg

SEQ ID NO: 507306 - DNA, 25 bp, Homo sapien
ttgacatttgccctctttgatggct

SEQ ID NO: 507307 - DNA, 25 bp, Homo sapien
tctttgatggctccacgaccaattt

SEQ ID NO: 507308 - DNA, 25 bp, Homo sapien
cgaccaatttcccttagtcatggca

SEQ ID NO: 507309 - DNA, 25 bp, Homo sapien
aatttcccttagtcatggcatgagt

SEQ ID NO: 507310 - DNA, 25 bp, Homo sapien
agtattttcatcaatcttctgagat

SEQ ID NO: 507311 - DNA, 25 bp, Homo sapien
gccctatctagagtcgagaggaggt

SEQ ID NO: 507312 - DNA, 25 bp, Homo sapien
ccctatctagagtcgagaggaggtc

SEQ ID NO: 507313 - DNA, 25 bp, Homo sapien
cctatctagagtcgagaggaggtct

SEQ ID NO: 507314 - DNA, 25 bp, Homo sapien
ctatctagagtcgagaggaggtctc

SEQ ID NO: 507315 - DNA, 25 bp, Homo sapien
tatctagagtcgagaggaggtctct

SEQ ID NO: 507316 - DNA, 25 bp, Homo sapien
atctagagtcgagaggaggtctcta

SEQ ID NO: 507317 - DNA, 25 bp, Homo sapien
tctagagtcgagaggaggtctctag

SEQ ID NO: 507318 - DNA, 25 bp, Homo sapien
tagagtcgagaggaggtctctaggc

SEQ ID NO: 507319 - DNA, 25 bp, Homo sapien
agagtcgagaggaggtctctaggct

SEQ ID NO: 507320 - DNA, 25 bp, Homo sapien
taggctgagggcaatccctgtgccc

SEQ ID NO: 507321 - DNA, 25 bp, Homo sapien
aggctgagggcaatccctgtgcccc

SEQ ID NO: 507322 - DNA, 25 bp, Homo sapien
tttgcaatctataaatactcctaac

SEQ ID NO: 507323 - DNA, 25 bp, Homo sapien
gggtttcaaagcatggtttggagtt

SEQ ID NO: 507324 - DNA, 25 bp, Homo sapien
ctataaatactcctaacacagtggt

SEQ ID NO: 507325 - DNA, 25 bp, Homo sapien
catggtttggagttaccaggccctt

SEQ ID NO: 507326 - DNA, 25 bp, Homo sapien
tgccttcctacatctttgaaaagta

SEQ ID NO: 507327 - DNA, 25 bp, Homo sapien
agtatattttatccagcttttctaa

SEQ ID NO: 507328 - DNA, 25 bp, Homo sapien
ttggagttaccaggcccttacctct

SEQ ID NO: 507329 - DNA, 25 bp, Homo sapien
gaccctggactctttttgaatcttt

SEQ ID NO: 507330 - DNA, 25 bp, Homo sapien
aatctttagccccttagctctatct

SEQ ID NO: 507331 - DNA, 25 bp, Homo sapien
ttagctctatctactcaacttccca

SEQ ID NO: 507332 - DNA, 25 bp, Homo sapien
tatctactcaacttcccagtggcct

SEQ ID NO: 507333 - DNA, 25 bp, Homo sapien
ggtcacgaaggtctgagctgggtct

SEQ ID NO: 507334 - DNA, 25 bp, Homo sapien
aaggtctgagctgggtctgggtgta

SEQ ID NO: 507335 - DNA, 25 bp, Homo sapien
gggtctgggtgtaggctgggaagca

SEQ ID NO: 507336 - DNA, 25 bp, Homo sapien
actttgcgggcttaccaggaggcct

SEQ ID NO: 507337 - DNA, 25 bp, Homo sapien
ggcgacctcttcgaattctctgcta

SEQ ID NO: 507338 - DNA, 25 bp, Homo sapien
gacctcttcgaattctctgctatct

SEQ ID NO: 507339 - DNA, 25 bp, Homo sapien
cttcgaattctctgctatctctggg

SEQ ID NO: 507340 - DNA, 25 bp, Homo sapien
tgcgggcttaccaggaggcctgtcc

SEQ ID NO: 507341 - DNA, 25 bp, Homo sapien
gaggagacaaggcaggcaagaacca

SEQ ID NO: 507342 - DNA, 25 bp, Homo sapien
gacagagagggatgcccccgaccca

SEQ ID NO: 507343 - DNA, 25 bp, Homo sapien
cccagccagccggagaaagggatgg

SEQ ID NO: 507344 - DNA, 25 bp, Homo sapien
tacaatcagattactcagttgcctt

SEQ ID NO: 507345 - DNA, 25 bp, Homo sapien
agattactcagttgccttacctcat

SEQ ID NO: 507346 - DNA, 25 bp, Homo sapien
tcagttgccttacctcatgggaaga

SEQ ID NO: 507347 - DNA, 25 bp, Homo sapien
tacctcatgggaagagttacttttt

SEQ ID NO: 507348 - DNA, 25 bp, Homo sapien
agcatgttagttacttggtttcaac

SEQ ID NO: 507349 - DNA, 25 bp, Homo sapien
tacttggtttcaacttgagttttct

SEQ ID NO: 507350 - DNA, 25 bp, Homo sapien
gaatggaaagagttgcccttgttgc

SEQ ID NO: 507351 - DNA, 25 bp, Homo sapien
aaagagttgcccttgttgcaagtaa

SEQ ID NO: 507352 - DNA, 25 bp, Homo sapien
gttgcaagtaatgaagcctgatttg

SEQ ID NO: 507353 - DNA, 25 bp, Homo sapien
gcctgatttgattatgaagctgctt

SEQ ID NO: 507354 - DNA, 25 bp, Homo sapien
gaagctgcttaatcactcttcatgt

SEQ ID NO: 507355 - DNA, 25 bp, Homo sapien
cccttcagaacctgttgcatcagaa

SEQ ID NO: 507356 - DNA, 25 bp, Homo sapien
gaaagcgagggctgagaatcccaga

SEQ ID NO: 507357 - DNA, 25 bp, Homo sapien
aatcccagaggaggccgtgaactgt

SEQ ID NO: 507358 - DNA, 25 bp, Homo sapien
aactgttctggaaaagcgagggctt

SEQ ID NO: 507359 - DNA, 25 bp, Homo sapien
ggctttgcagtcagaccttcatatg

SEQ ID NO: 507360 - DNA, 25 bp, Homo sapien
gaccttcatatgcactttgttctat

SEQ ID NO: 507361 - DNA, 25 bp, Homo sapien
ttgttctatctgttgcgctctgcct

SEQ ID NO: 507362 - DNA, 25 bp, Homo sapien
ttgcgctctgcctaaatgaccacgg

SEQ ID NO: 507363 - DNA, 25 bp, Homo sapien
atgaccacgggccagtgactttacc

SEQ ID NO: 507364 - DNA, 25 bp, Homo sapien
tccctgctccttgcctagatagtgg

SEQ ID NO: 507365 - DNA, 25 bp, Homo sapien
gtgtcttaatacatgtctgtcgaga

SEQ ID NO: 507366 - DNA, 25 bp, Homo sapien
atgcagagagaatgtgaggaacctt

SEQ ID NO: 507367 - DNA, 25 bp, Homo sapien
aaactttgatagtcacattatgtga

SEQ ID NO: 507368 - DNA, 25 bp, Homo sapien
gaaattttctgggtgacagtatact

SEQ ID NO: 507369 - DNA, 25 bp, Homo sapien
ttctgggtgacagtatacttattgg

SEQ ID NO: 507370 - DNA, 25 bp, Homo sapien
gtaggttttctggttcatgaaaata

SEQ ID NO: 507371 - DNA, 25 bp, Homo sapien
attgtgaccttgttgtaattgggaa

SEQ ID NO: 507372 - DNA, 25 bp, Homo sapien
gggaaaggccactagttgatcatat

SEQ ID NO: 507373 - DNA, 25 bp, Homo sapien
ggccactagttgatcatatgacctt

SEQ ID NO: 507374 - DNA, 25 bp, Homo sapien
gacctttattgaatatgtcatgctt

SEQ ID NO: 507375 - DNA, 25 bp, Homo sapien
gaatatgtcatgcttgctgtttaaa

SEQ ID NO: 507376 - DNA, 25 bp, Homo sapien
aaattcctaactaatcacatgcaaa

SEQ ID NO: 507377 - DNA, 25 bp, Homo sapien
gaacttttgtaagtctgtgtaacat

SEQ ID NO: 507378 - DNA, 25 bp, Homo sapien
taggtgataatttcccctgtaccct

SEQ ID NO: 507379 - DNA, 25 bp, Homo sapien
ttcccctgtaccctataactgtaat

SEQ ID NO: 507380 - DNA, 25 bp, Homo sapien
ataactgtaatcattcaccttgggt

SEQ ID NO: 507381 - DNA, 25 bp, Homo sapien
aatcattcaccttgggttggccggt

SEQ ID NO: 507382 - DNA, 25 bp, Homo sapien
tggccggtttgtcaagcttggttta

SEQ ID NO: 507383 - DNA, 25 bp, Homo sapien
gaaagagtcttgtcgaatgtggtac

SEQ ID NO: 507384 - DNA, 25 bp, Homo sapien
aatgtggtactgttcttagtgtgta

SEQ ID NO: 507385 - DNA, 25 bp, Homo sapien
aatatttgcgtatggtgttcctctg

SEQ ID NO: 507386 - DNA, 25 bp, Homo sapien
tctgcctcagaggacagttgcacag

SEQ ID NO: 507387 - DNA, 25 bp, Homo sapien
agttgcacagatggctagtgttaaa

SEQ ID NO: 507388 - DNA, 25 bp, Homo sapien
tggtagagaagaccgtggatcacct

SEQ ID NO: 507389 - DNA, 25 bp, Homo sapien
gaccttctcggagatggcttctgag

SEQ ID NO: 507390 - DNA, 25 bp, Homo sapien
tctcggagatggcttctgagccctg

SEQ ID NO: 507391 - DNA, 25 bp, Homo sapien
acttccttccttagcttcatgtgaa

SEQ ID NO: 507392 - DNA, 25 bp, Homo sapien
tccttccttagcttcatgtgaaata

SEQ ID NO: 507393 - DNA, 25 bp, Homo sapien
aaagctattctggtctcctctgtgt

SEQ ID NO: 507394 - DNA, 25 bp, Homo sapien
tattctggtctcctctgtgtctgct

SEQ ID NO: 507395 - DNA, 25 bp, Homo sapien
tgtgtctgctgacagagtaacccgt

SEQ ID NO: 507396 - DNA, 25 bp, Homo sapien
gtctgctgacagagtaacccgttta

SEQ ID NO: 507397 - DNA, 25 bp, Homo sapien
ctgctgacagagtaacccgtttaac

SEQ ID NO: 507398 - DNA, 25 bp, Homo sapien
gctgacagagtaacccgtttaacta

SEQ ID NO: 507399 - DNA, 25 bp, Homo sapien
gagagggttccagaagcattgcctt

SEQ ID NO: 507400 - DNA, 25 bp, Homo sapien
ttgccttttgcctcgtctaatagga

SEQ ID NO: 507401 - DNA, 25 bp, Homo sapien
gacactgtgggctttaggaatgact

SEQ ID NO: 507402 - DNA, 25 bp, Homo sapien
gactatagatgctcacacgtgttta

SEQ ID NO: 507403 - DNA, 25 bp, Homo sapien
tggagatgctctcagtcctgtggca

SEQ ID NO: 507404 - DNA, 25 bp, Homo sapien
gtggcatctggcacgaagtctccaa

SEQ ID NO: 507405 - DNA, 25 bp, Homo sapien
gaagtctccaagaagccactttgcc

SEQ ID NO: 507406 - DNA, 25 bp, Homo sapien
tcttctcccttcaagcacaagcttt

SEQ ID NO: 507407 - DNA, 25 bp, Homo sapien
tgcaaaagggccagtcgcgtttcta

SEQ ID NO: 507408 - DNA, 25 bp, Homo sapien
agtcgcgtttctatttctctcgatc

SEQ ID NO: 507409 - DNA, 25 bp, Homo sapien
ttctgcggaccgacgatacgtttaa

SEQ ID NO: 507410 - DNA, 25 bp, Homo sapien
gttttaaatctggaggcttaagaca

SEQ ID NO: 507411 - DNA, 25 bp, Homo sapien
cagtttttggtagctgagggagaac

SEQ ID NO: 507412 - DNA, 25 bp, Homo sapien
agaaatagctatgttcactgttaat

SEQ ID NO: 507413 - DNA, 25 bp, Homo sapien
ttattctttgcgttcacctttccca

SEQ ID NO: 507414 - DNA, 25 bp, Homo sapien
gtcagataggattagcgcagcacat

SEQ ID NO: 507415 - DNA, 25 bp, Homo sapien
acctttcccacctatattgtagacg

SEQ ID NO: 507416 - DNA, 25 bp, Homo sapien
attgtagacgtcactgatagcttgt

SEQ ID NO: 507417 - DNA, 25 bp, Homo sapien
tgatagcttgtaatacttttctacc

SEQ ID NO: 507418 - DNA, 25 bp, Homo sapien
tagcgcagcacatgactgcctaaga

SEQ ID NO: 507419 - DNA, 25 bp, Homo sapien
actgcctaagagatgctcacaaaaa

SEQ ID NO: 507420 - DNA, 25 bp, Homo sapien
atgagtgaatgaacccagcggtttt

SEQ ID NO: 507421 - DNA, 25 bp, Homo sapien
tatgatgcctgcacgggtttgtgat

SEQ ID NO: 507422 - DNA, 25 bp, Homo sapien
gatactgcagcacttttatggcgtc

SEQ ID NO: 507423 - DNA, 25 bp, Homo sapien
cacttttatggcgtcttctatttta

SEQ ID NO: 507424 - DNA, 25 bp, Homo sapien
ccctcttccttccaatgttaactga

SEQ ID NO: 507425 - DNA, 25 bp, Homo sapien
taactgaatcttcccagtcttccag

SEQ ID NO: 507426 - DNA, 25 bp, Homo sapien
agtcttccagcacttcagtgacaat

SEQ ID NO: 507427 - DNA, 25 bp, Homo sapien
acatagacatacgtcctgtgcttcc

SEQ ID NO: 507428 - DNA, 25 bp, Homo sapien
tcctctcctggttctcaaaaattcc

SEQ ID NO: 507429 - DNA, 25 bp, Homo sapien
aaaattccaactaatcttcccaatg

SEQ ID NO: 507430 - DNA, 25 bp, Homo sapien
tcctcacagacttcacgaactgctg

SEQ ID NO: 507431 - DNA, 25 bp, Homo sapien
ttcacgaactgctgccacacttggc

SEQ ID NO: 507432 - DNA, 25 bp, Homo sapien
tggtagagaagaccgtggatcacct

SEQ ID NO: 507433 - DNA, 25 bp, Homo sapien
gctcccgaccttctcggagatggct

SEQ ID NO: 507434 - DNA, 25 bp, Homo sapien
cgaccttctcggagatggcttctga

SEQ ID NO: 507435 - DNA, 25 bp, Homo sapien
accttctcggagatggcttctgagc

SEQ ID NO: 507436 - DNA, 25 bp, Homo sapien
tctcggagatggcttctgagccctg

SEQ ID NO: 507437 - DNA, 25 bp, Homo sapien
gcagcgcccacagaaccagccctgt

SEQ ID NO: 507438 - DNA, 25 bp, Homo sapien
tcgacttccttccttagcttcatgt

SEQ ID NO: 507439 - DNA, 25 bp, Homo sapien
gacttccttccttagcttcatgtga

SEQ ID NO: 507440 - DNA, 25 bp, Homo sapien
cttccttccttagcttcatgtgaaa

SEQ ID NO: 507441 - DNA, 25 bp, Homo sapien
tccttccttagcttcatgtgaaata

SEQ ID NO: 507442 - DNA, 25 bp, Homo sapien
cttccttagcttcatgtgaaataaa

SEQ ID NO: 507443 - DNA, 25 bp, Homo sapien
atgctttgcatgatagggacagact

SEQ ID NO: 507444 - DNA, 25 bp, Homo sapien
gggacagactaactagcaacttatc

SEQ ID NO: 507445 - DNA, 25 bp, Homo sapien
tagcaacttatctgtccctcagtac

SEQ ID NO: 507446 - DNA, 25 bp, Homo sapien
ccctcagtacctcttagctttgaaa

SEQ ID NO: 507447 - DNA, 25 bp, Homo sapien
aaagcattgtgttgatgtcagaaat

SEQ ID NO: 507448 - DNA, 25 bp, Homo sapien
aatgactgaattttgtgcaccctga

SEQ ID NO: 507449 - DNA, 25 bp, Homo sapien
tgcaccctgatggtagccgtttata

SEQ ID NO: 507450 - DNA, 25 bp, Homo sapien
gccgtttatatcgaattctaactcc

SEQ ID NO: 507451 - DNA, 25 bp, Homo sapien
ttctaactcctacaatagctctcta

SEQ ID NO: 507452 - DNA, 25 bp, Homo sapien
gtttctccccatcttgtcaagtgga

SEQ ID NO: 507453 - DNA, 25 bp, Homo sapien
gtggatagaccactggcaacaagac

SEQ ID NO: 507454 - DNA, 25 bp, Homo sapien
gagacataacttctttcttcgtaag

SEQ ID NO: 507455 - DNA, 25 bp, Homo sapien
cttctttcttcgtaagttatatatg

SEQ ID NO: 507456 - DNA, 25 bp, Homo sapien
gttatatatgtctacttctacctgt

SEQ ID NO: 507457 - DNA, 25 bp, Homo sapien
atatgtctacttctacctgtgttat

SEQ ID NO: 507458 - DNA, 25 bp, Homo sapien
gtctacttctacctgtgttatcata

SEQ ID NO: 507459 - DNA, 25 bp, Homo sapien
acttctacctgtgttatcataataa

SEQ ID NO: 507460 - DNA, 25 bp, Homo sapien
tgtcatgatgatacaggtggaggta

SEQ ID NO: 507461 - DNA, 25 bp, Homo sapien
gaaatatataacttatctcttcata

SEQ ID NO: 507462 - DNA, 25 bp, Homo sapien
tatctcttcataagggctaaaatga

SEQ ID NO: 507463 - DNA, 25 bp, Homo sapien
gaaatacatagtgggctcgattcat

SEQ ID NO: 507464 - DNA, 25 bp, Homo sapien
catagtgggctcgattcatagcccc

SEQ ID NO: 507465 - DNA, 25 bp, Homo sapien
gtaacgtgcctgtgggagtgaccaa

SEQ ID NO: 507466 - DNA, 25 bp, Homo sapien
taacgtgcctgtgggagtgaccaag

SEQ ID NO: 507467 - DNA, 25 bp, Homo sapien
cctgtgggagtgaccaagggccacc

SEQ ID NO: 507468 - DNA, 25 bp, Homo sapien
tgggagtgaccaagggccacccgcc

SEQ ID NO: 507469 - DNA, 25 bp, Homo sapien
agctttgctaattctgctttgaggc

SEQ ID NO: 507470 - DNA, 25 bp, Homo sapien
ctgctttgaggcagtaaaatgcaaa

SEQ ID NO: 507471 - DNA, 25 bp, Homo sapien
aaatgcaaaagaccatagaatttgt

SEQ ID NO: 507472 - DNA, 25 bp, Homo sapien
tattttgtactctttatattagaat

SEQ ID NO: 507473 - DNA, 25 bp, Homo sapien
gaatttgtaactagattgatgtatt

SEQ ID NO: 507474 - DNA, 25 bp, Homo sapien
aattcaatgttttagttgtgtgata

SEQ ID NO: 507475 - DNA, 25 bp, Homo sapien
aacatattcattctattggaatttg

SEQ ID NO: 507476 - DNA, 25 bp, Homo sapien
tctggaagcaagtgactggccctgg

SEQ ID NO: 507477 - DNA, 25 bp, Homo sapien
accttccacgctctgtagtttcatt

SEQ ID NO: 507478 - DNA, 25 bp, Homo sapien
agagccgcgagccactccagcgaga

SEQ ID NO: 507479 - DNA, 25 bp, Homo sapien
agcgagaccccaccttgcatggtgc

SEQ ID NO: 507480 - DNA, 25 bp, Homo sapien
tgccccttcctgcataggactggaa

SEQ ID NO: 507481 - DNA, 25 bp, Homo sapien
cataggactggaagaccgaagtttt

SEQ ID NO: 507482 - DNA, 25 bp, Homo sapien
ttttatggccatattttctactgca

SEQ ID NO: 507483 - DNA, 25 bp, Homo sapien
ggccatattttctactgcaattctg

SEQ ID NO: 507484 - DNA, 25 bp, Homo sapien
aattctgaagtgttcatttctcaca

SEQ ID NO: 507485 - DNA, 25 bp, Homo sapien
caggcccaccactgtgacggcagtg

SEQ ID NO: 507486 - DNA, 25 bp, Homo sapien
actgtgacggcagtgcactctggaa

SEQ ID NO: 507487 - DNA, 25 bp, Homo sapien
agatcaagagggttcagctggcctt

SEQ ID NO: 507488 - DNA, 25 bp, Homo sapien
tcagctggccttgggagatgtttgc

SEQ ID NO: 507489 - DNA, 25 bp, Homo sapien
tgtttgctggagaatgacttcagtt

SEQ ID NO: 507490 - DNA, 25 bp, Homo sapien
cagttttctcctaaggcaatcagat

SEQ ID NO: 507491 - DNA, 25 bp, Homo sapien
gattgcaaccattagcattgtatct

SEQ ID NO: 507492 - DNA, 25 bp, Homo sapien
gcattgtatcttatctgcaaatcag

SEQ ID NO: 507493 - DNA, 25 bp, Homo sapien
ctgcaaatcagtttactccgaggtt

SEQ ID NO: 507494 - DNA, 25 bp, Homo sapien
tactccgaggttccccaaggatagt

SEQ ID NO: 507495 - DNA, 25 bp, Homo sapien
aggatagttttattaggaccacagg

SEQ ID NO: 507496 - DNA, 25 bp, Homo sapien
ggaccacaggactttactaaccact

SEQ ID NO: 507497 - DNA, 25 bp, Homo sapien
gggacaagtttataattccatttat

SEQ ID NO: 507498 - DNA, 25 bp, Homo sapien
atcctcttcctctataacatcattt

SEQ ID NO: 507499 - DNA, 25 bp, Homo sapien
ctataacatcatttccctaggacag

SEQ ID NO: 507500 - DNA, 25 bp, Homo sapien
aaggccctgtgagtctatgaagcgg

SEQ ID NO: 507501 - DNA, 25 bp, Homo sapien
atgagtaaactgattggctgaagac

SEQ ID NO: 507502 - DNA, 25 bp, Homo sapien
gaactaatcatcctactggtatcta

SEQ ID NO: 507503 - DNA, 25 bp, Homo sapien
tggtatctaactccagggcctacgt

SEQ ID NO: 507504 - DNA, 25 bp, Homo sapien
actccagggcctacgttaatagcat

SEQ ID NO: 507505 - DNA, 25 bp, Homo sapien
ctgtgtttaatatgcctcagaggct

SEQ ID NO: 507506 - DNA, 25 bp, Homo sapien
taaaggaccagatcttttaccacct

SEQ ID NO: 507507 - DNA, 25 bp, Homo sapien
tttaccaccttcctgcgtgggtgat

SEQ ID NO: 507508 - DNA, 25 bp, Homo sapien
tgcgtgggtgatccatcctcttcct

SEQ ID NO: 507509 - DNA, 25 bp, Homo sapien
tgtggacggcaaggtcttgttccat

SEQ ID NO: 507510 - DNA, 25 bp, Homo sapien
acggcaaggtcttgttccatgtcaa

SEQ ID NO: 507511 - DNA, 25 bp, Homo sapien
atgtcaacaatggtgctggcaggat

SEQ ID NO: 507512 - DNA, 25 bp, Homo sapien
aaagcaaacaccgtatcactctgat

SEQ ID NO: 507513 - DNA, 25 bp, Homo sapien
aacaccgtatcactctgattgttga

SEQ ID NO: 507514 - DNA, 25 bp, Homo sapien
gcagttggcgctgaaagtccacaca

SEQ ID NO: 507515 - DNA, 25 bp, Homo sapien
agtctacctcagtggacaccaacaa

SEQ ID NO: 507516 - DNA, 25 bp, Homo sapien
gtggacaccaacaatcccatttatg

SEQ ID NO: 507517 - DNA, 25 bp, Homo sapien
ccatttatgttggtggctatcctgc

SEQ ID NO: 507518 - DNA, 25 bp, Homo sapien
aaaatgcctgcgcagccagacctcg

SEQ ID NO: 507519 - DNA, 25 bp, Homo sapien
ccagacctcgttccgcgggtgtttg

SEQ ID NO: 507520 - DNA, 25 bp, Homo sapien
atggagaagcccgtgccacagtgac

SEQ ID NO: 507521 - DNA, 25 bp, Homo sapien
tggagaagcccgtgccacagtgacc

SEQ ID NO: 507522 - DNA, 25 bp, Homo sapien
gagaagcccgtgccacagtgaccct

SEQ ID NO: 507523 - DNA, 25 bp, Homo sapien
tgctctccatcctggatcgtaagga

SEQ ID NO: 507524 - DNA, 25 bp, Homo sapien
gctctccatcctggatcgtaaggag

SEQ ID NO: 507525 - DNA, 25 bp, Homo sapien
tctccatcctggatcgtaaggaggc

SEQ ID NO: 507526 - DNA, 25 bp, Homo sapien
tccatcctggatcgtaaggaggcat

SEQ ID NO: 507527 - DNA, 25 bp, Homo sapien
atcctggatcgtaaggaggcatcat

SEQ ID NO: 507528 - DNA, 25 bp, Homo sapien
cctggatcgtaaggaggcatcatca

SEQ ID NO: 507529 - DNA, 25 bp, Homo sapien
ctggatcgtaaggaggcatcatcag

SEQ ID NO: 507530 - DNA, 25 bp, Homo sapien
ggatcgtaaggaggcatcatcaggc

SEQ ID NO: 507531 - DNA, 25 bp, Homo sapien
gctgttccctggcatgaccctcttt

SEQ ID NO: 507532 - DNA, 25 bp, Homo sapien
atgaccctctttggaagagtggttt

SEQ ID NO: 507533 - DNA, 25 bp, Homo sapien
agagtggtttggagagagccttcta

SEQ ID NO: 507534 - DNA, 25 bp, Homo sapien
gagagagccttctagaatgacagac

SEQ ID NO: 507535 - DNA, 25 bp, Homo sapien
gagccttctagaatgacagactgtg

SEQ ID NO: 507536 - DNA, 25 bp, Homo sapien
aggcgggtccgctcctcttgtctgc

SEQ ID NO: 507537 - DNA, 25 bp, Homo sapien
gctcctcttgtctgcggcatctgtg

SEQ ID NO: 507538 - DNA, 25 bp, Homo sapien
tgcggcatctgtgctctccgagaga

SEQ ID NO: 507539 - DNA, 25 bp, Homo sapien
ggcatctgtgctctccgagagaaaa

SEQ ID NO: 507540 - DNA, 25 bp, Homo sapien
aaaaccaaggtgtgtcaaatgacgt

SEQ ID NO: 507541 - DNA, 25 bp, Homo sapien
gtcaaatgacgtcaagtctctattt

SEQ ID NO: 507542 - DNA, 25 bp, Homo sapien
gcctgttgtcttttgtcttcatgta

SEQ ID NO: 507543 - DNA, 25 bp, Homo sapien
acatccagtccaattgaggtgatct

SEQ ID NO: 507544 - DNA, 25 bp, Homo sapien
atccagtccaattgaggtgatctca

SEQ ID NO: 507545 - DNA, 25 bp, Homo sapien
ctttggcacacacttcagtctttat

SEQ ID NO: 507546 - DNA, 25 bp, Homo sapien
tggcacacacttcagtctttatcct

SEQ ID NO: 507547 - DNA, 25 bp, Homo sapien
acacacttcagtctttatcctctct

SEQ ID NO: 507548 - DNA, 25 bp, Homo sapien
tgaggtgatctcagaggtgcatcag

SEQ ID NO: 507549 - DNA, 25 bp, Homo sapien
atctcagaggtgcatcaggacatct

SEQ ID NO: 507550 - DNA, 25 bp, Homo sapien
gggaggccaccttgcccagatagtt

SEQ ID NO: 507551 - DNA, 25 bp, Homo sapien
ggccaccttgcccagatagttgaaa

SEQ ID NO: 507552 - DNA, 25 bp, Homo sapien
caccttgcccagatagttgaaaaga

SEQ ID NO: 507553 - DNA, 25 bp, Homo sapien
acccagacttccttctgagttgcag

SEQ ID NO: 507554 - DNA, 25 bp, Homo sapien
ttctgagttgcaggtttctccttag

SEQ ID NO: 507555 - DNA, 25 bp, Homo sapien
aggtttctccttagatgtccaacta

SEQ ID NO: 507556 - DNA, 25 bp, Homo sapien
tgggaagtaggagacagcaactccc

SEQ ID NO: 507557 - DNA, 25 bp, Homo sapien
gaaattccatccatctcagaatctg

SEQ ID NO: 507558 - DNA, 25 bp, Homo sapien
atctcagaatctgtgagtcctcctc

SEQ ID NO: 507559 - DNA, 25 bp, Homo sapien
gagtcctcctcacataaatctgagg

SEQ ID NO: 507560 - DNA, 25 bp, Homo sapien
gggaaaaggctgtgtcactgcatct

SEQ ID NO: 507561 - DNA, 25 bp, Homo sapien
aaggctgtgtcactgcatctttgca

SEQ ID NO: 507562 - DNA, 25 bp, Homo sapien
gaagcaagagctagacacacttcag

SEQ ID NO: 507563 - DNA, 25 bp, Homo sapien
tatatcttagtttcccctttcccag

SEQ ID NO: 507564 - DNA, 25 bp, Homo sapien
ttacaagatccatgtcctgtcctta

SEQ ID NO: 507565 - DNA, 25 bp, Homo sapien
tacaagatccatgtcctgtccttac

SEQ ID NO: 507566 - DNA, 25 bp, Homo sapien
acaagatccatgtcctgtccttaca

SEQ ID NO: 507567 - DNA, 25 bp, Homo sapien
tcctgtccttacagcttttaaggta

SEQ ID NO: 507568 - DNA, 25 bp, Homo sapien
cctgtccttacagcttttaaggtat

SEQ ID NO: 507569 - DNA, 25 bp, Homo sapien
gtccttacagcttttaaggtatcct

SEQ ID NO: 507570 - DNA, 25 bp, Homo sapien
tccttacagcttttaaggtatcctt

SEQ ID NO: 507571 - DNA, 25 bp, Homo sapien
tccttttaaaaatctcaactcttgc

SEQ ID NO: 507572 - DNA, 25 bp, Homo sapien
caactcttgcctggtgcagtgctca

SEQ ID NO: 507573 - DNA, 25 bp, Homo sapien
aactcttgcctggtgcagtgctcac

SEQ ID NO: 507574 - DNA, 25 bp, Homo sapien
actcttgcctggtgcagtgctcacg

SEQ ID NO: 507575 - DNA, 25 bp, Homo sapien
tttgtgccaccgtttatatctgtgt

SEQ ID NO: 507576 - DNA, 25 bp, Homo sapien
taggaggctaagttttgttcagtct

SEQ ID NO: 507577 - DNA, 25 bp, Homo sapien
gaggctaagttttgttcagtctcat

SEQ ID NO: 507578 - DNA, 25 bp, Homo sapien
ttcatgtacaataacctaaaaagga

SEQ ID NO: 507579 - DNA, 25 bp, Homo sapien
accgtttatatctgtgttcattttc

SEQ ID NO: 507580 - DNA, 25 bp, Homo sapien
aaaaaggatctcctactgacttcct

SEQ ID NO: 507581 - DNA, 25 bp, Homo sapien
gacttccttcctaattattattgtt

SEQ ID NO: 507582 - DNA, 25 bp, Homo sapien
gaaatacgttttcaattgagttgtt

SEQ ID NO: 507583 - DNA, 25 bp, Homo sapien
tatatgcgtgtgtattcgaatctca

SEQ ID NO: 507584 - DNA, 25 bp, Homo sapien
gcgtgtgtattcgaatctcaatttt

SEQ ID NO: 507585 - DNA, 25 bp, Homo sapien
tctcaatttttcttttactctagtt

SEQ ID NO: 507586 - DNA, 25 bp, Homo sapien
atgcactgctcctcacaggagcttg

SEQ ID NO: 507587 - DNA, 25 bp, Homo sapien
caggagcttgcacttcattcatatt

SEQ ID NO: 507588 - DNA, 25 bp, Homo sapien
attcatatttattctgccctcattt

SEQ ID NO: 507589 - DNA, 25 bp, Homo sapien
tattctgccctcatttaaggtataa

SEQ ID NO: 507590 - DNA, 25 bp, Homo sapien
taaggtataagcttagtgtcctaat

SEQ ID NO: 507591 - DNA, 25 bp, Homo sapien
tttgaggctgcactgttgatatgtc

SEQ ID NO: 507592 - DNA, 25 bp, Homo sapien
tgatatgtcatgcagtggccaccaa

SEQ ID NO: 507593 - DNA, 25 bp, Homo sapien
gtggccaccaagaaagtatatactc

SEQ ID NO: 507594 - DNA, 25 bp, Homo sapien
tatactcgtgttagatactgattac

SEQ ID NO: 507595 - DNA, 25 bp, Homo sapien
agcaagtacatcatctgcatgcact

SEQ ID NO: 507596 - DNA, 25 bp, Homo sapien
agtacatcatctgcatgcactgctc

SEQ ID NO: 507597 - DNA, 25 bp, Homo sapien
tatatatcaaactcggtctccatcc

SEQ ID NO: 507598 - DNA, 25 bp, Homo sapien
gagccagcaatgctctgtgcttcct

SEQ ID NO: 507599 - DNA, 25 bp, Homo sapien
tgcgtcacggcttggcaagagctgc

SEQ ID NO: 507600 - DNA, 25 bp, Homo sapien
ctgaaggccgagtgcttgcaggctt

SEQ ID NO: 507601 - DNA, 25 bp, Homo sapien
caggcttgtgaactgccatcgaaca

SEQ ID NO: 507602 - DNA, 25 bp, Homo sapien
gccatcgaacacaatccaaactctg

SEQ ID NO: 507603 - DNA, 25 bp, Homo sapien
aactctggaaatgttcctgaccacc

SEQ ID NO: 507604 - DNA, 25 bp, Homo sapien
taagccctcaacaacgtaatgcctg

SEQ ID NO: 507605 - DNA, 25 bp, Homo sapien
taatgcctgtatgtgctgtttttca

SEQ ID NO: 507606 - DNA, 25 bp, Homo sapien
gtgctgtttttcagtaaactccttg

SEQ ID NO: 507607 - DNA, 25 bp, Homo sapien
gtaaactccttgttcatgtcaataa

SEQ ID NO: 507608 - DNA, 25 bp, Homo sapien
gcagtagtagaagtttccccaagtt

SEQ ID NO: 507609 - DNA, 25 bp, Homo sapien
gttttttccttcaggataaatcatc

SEQ ID NO: 507610 - DNA, 25 bp, Homo sapien
gaaaactaccaacagcgtactatta

SEQ ID NO: 507611 - DNA, 25 bp, Homo sapien
aacagcgtactattatttatggaat

SEQ ID NO: 507612 - DNA, 25 bp, Homo sapien
tggaatcattataagcaagcaaaga

SEQ ID NO: 507613 - DNA, 25 bp, Homo sapien
tatttccttggctttttaaacaatg

SEQ ID NO: 507614 - DNA, 25 bp, Homo sapien
cacacattacacataccaagtttat

SEQ ID NO: 507615 - DNA, 25 bp, Homo sapien
attttttggtcatccattctcttct

SEQ ID NO: 507616 - DNA, 25 bp, Homo sapien
atccattctcttcttacctattatc

SEQ ID NO: 507617 - DNA, 25 bp, Homo sapien
tctcttcttacctattatcggttgg

SEQ ID NO: 507618 - DNA, 25 bp, Homo sapien
ttatcggttggatattcttttccat

SEQ ID NO: 507619 - DNA, 25 bp, Homo sapien
aactccagagtttgctagcatttcc

SEQ ID NO: 507620 - DNA, 25 bp, Homo sapien
agtttgctagcatttcctgagagaa

SEQ ID NO: 507621 - DNA, 25 bp, Homo sapien
gcacaggaatactgctgggatccct

SEQ ID NO: 507622 - DNA, 25 bp, Homo sapien
aatactgctgggatccctgaaagca

SEQ ID NO: 507623 - DNA, 25 bp, Homo sapien
gtagtggtgccagatttctcgattc

SEQ ID NO: 507624 - DNA, 25 bp, Homo sapien
gatttctcgattctaaaatgcacgt

SEQ ID NO: 507625 - DNA, 25 bp, Homo sapien
taaaatgcacgttttcttttcacat

SEQ ID NO: 507626 - DNA, 25 bp, Homo sapien
attctgacatcaggagacgtcttaa

SEQ ID NO: 507627 - DNA, 25 bp, Homo sapien
gagacgtcttaacgtcagttttgtt

SEQ ID NO: 507628 - DNA, 25 bp, Homo sapien
ttcctttttcactccagaattcatc

SEQ ID NO: 507629 - DNA, 25 bp, Homo sapien
tttataaacaatggcatccgggaat

SEQ ID NO: 507630 - DNA, 25 bp, Homo sapien
gaatcagatccaagtttgactccaa

SEQ ID NO: 507631 - DNA, 25 bp, Homo sapien
tccaagtttgactccaaacccactt

SEQ ID NO: 507632 - DNA, 25 bp, Homo sapien
acccacttttaccacattgcttttg

SEQ ID NO: 507633 - DNA, 25 bp, Homo sapien
acattgcttttgatctaaacttcta

SEQ ID NO: 507634 - DNA, 25 bp, Homo sapien
acttctattttgcttacccctcaca

SEQ ID NO: 507635 - DNA, 25 bp, Homo sapien
ctcacagctagtcatccatatcatt

SEQ ID NO: 507636 - DNA, 25 bp, Homo sapien
gtcatccatatcattgaagcgctca

SEQ ID NO: 507637 - DNA, 25 bp, Homo sapien
gaagcgctcatgatttgatagatta

SEQ ID NO: 507638 - DNA, 25 bp, Homo sapien
gaaagtcttatttcacaatctgatt

SEQ ID NO: 507639 - DNA, 25 bp, Homo sapien
aatctgattgtttctttaacttagg

SEQ ID NO: 507640 - DNA, 25 bp, Homo sapien
taacttaggatccaaacatgtcctt

SEQ ID NO: 507641 - DNA, 25 bp, Homo sapien
gaaaagtagtcctagtgactcagta

SEQ ID NO: 507642 - DNA, 25 bp, Homo sapien
agtcctagtgactcagtagatatag

SEQ ID NO: 507643 - DNA, 25 bp, Homo sapien
ggcaatatttttactcatagttttg

SEQ ID NO: 507644 - DNA, 25 bp, Homo sapien
atataggaagttggctgttggtatc

SEQ ID NO: 507645 - DNA, 25 bp, Homo sapien
gttggctgttggtatcagatactgt

SEQ ID NO: 507646 - DNA, 25 bp, Homo sapien
gatactgttaaggaagaatctctat

SEQ ID NO: 507647 - DNA, 25 bp, Homo sapien
gatgtcgaattttatcaactgatgt

SEQ ID NO: 507648 - DNA, 25 bp, Homo sapien
acattgtataactctgcatttccca

SEQ ID NO: 507649 - DNA, 25 bp, Homo sapien
tctgcatttcccaaaccctgttttc

SEQ ID NO: 507650 - DNA, 25 bp, Homo sapien
ctgttttccttgtcctggcaaaata

SEQ ID NO: 507651 - DNA, 25 bp, Homo sapien
gtcctggcaaaatactgttctagaa

SEQ ID NO: 507652 - DNA, 25 bp, Homo sapien
gagaaataccatttttccttatttg

SEQ ID NO: 507653 - DNA, 25 bp, Homo sapien
ccttatttgattggtgaagaagcac

SEQ ID NO: 507654 - DNA, 25 bp, Homo sapien
gaagcacacagagagggtaagcata

SEQ ID NO: 507655 - DNA, 25 bp, Homo sapien
taagcataatcaaatacaccagcat

SEQ ID NO: 507656 - DNA, 25 bp, Homo sapien
aatacaccagcataaccaaaatcac

SEQ ID NO: 507657 - DNA, 25 bp, Homo sapien
aaaatcacacatttagcgagtggca

SEQ ID NO: 507658 - DNA, 25 bp, Homo sapien
cacatttagcgagtggcagggcctg

SEQ ID NO: 507659 - DNA, 25 bp, Homo sapien
ggcctggatgggagtctgttcaact

SEQ ID NO: 507660 - DNA, 25 bp, Homo sapien
agtctgttcaactctctgctgtatt

SEQ ID NO: 507661 - DNA, 25 bp, Homo sapien
tctctgctgtattgcctcttaaagt

SEQ ID NO: 507662 - DNA, 25 bp, Homo sapien
gtactagcaatgattgtttctgcaa

SEQ ID NO: 507663 - DNA, 25 bp, Homo sapien
tggccatccattctccatctttaaa

SEQ ID NO: 507664 - DNA, 25 bp, Homo sapien
attctccatctttaaaggcaatcac

SEQ ID NO: 507665 - DNA, 25 bp, Homo sapien
aggcaatcaccattgccagtttctt

SEQ ID NO: 507666 - DNA, 25 bp, Homo sapien
cagtttcttctgtatccttctggaa

SEQ ID NO: 507667 - DNA, 25 bp, Homo sapien
acagcattctatattctctcttcta

SEQ ID NO: 507668 - DNA, 25 bp, Homo sapien
atatcttacctatttctgtgaataa

SEQ ID NO: 507669 - DNA, 25 bp, Homo sapien
gaataatttattttggacagcattt

SEQ ID NO: 507670 - DNA, 25 bp, Homo sapien
gacagcattttatgtatgaatattc

SEQ ID NO: 507671 - DNA, 25 bp, Homo sapien
aaataggcagtatatgcacattata

SEQ ID NO: 507672 - DNA, 25 bp, Homo sapien
cagtgtgaagtaagttctcatccaa

SEQ ID NO: 507673 - DNA, 25 bp, Homo sapien
aagtaagttctcatccaacatttct

SEQ ID NO: 507674 - DNA, 25 bp, Homo sapien
gctgccctcctggtgaagggagtga

SEQ ID NO: 507675 - DNA, 25 bp, Homo sapien
tgagactggagttaaatgggtttat

SEQ ID NO: 507676 - DNA, 25 bp, Homo sapien
gggatcaccctttagtggtaaccag

SEQ ID NO: 507677 - DNA, 25 bp, Homo sapien
taaccagggttacctgtatcaacca

SEQ ID NO: 507678 - DNA, 25 bp, Homo sapien
tacctgtatcaaccaaaagctatgc

SEQ ID NO: 507679 - DNA, 25 bp, Homo sapien
aaagctatgcattgtcttagcctga

SEQ ID NO: 507680 - DNA, 25 bp, Homo sapien
tatgcattgtcttagcctgaaaaag

SEQ ID NO: 507681 - DNA, 25 bp, Homo sapien
ttcttctcatacaattatagggcag

SEQ ID NO: 507682 - DNA, 25 bp, Homo sapien
gcagttatttccctattatgtgttt

SEQ ID NO: 507683 - DNA, 25 bp, Homo sapien
tatttccctattatgtgttttccaa

SEQ ID NO: 507684 - DNA, 25 bp, Homo sapien
atgtgttttccaaatatagatatga

SEQ ID NO: 507685 - DNA, 25 bp, Homo sapien
tctgctttgtagaaattatatgttt

SEQ ID NO: 507686 - DNA, 25 bp, Homo sapien
agattgggggttgtgccatactgtt

SEQ ID NO: 507687 - DNA, 25 bp, Homo sapien
taccagtctttaaagcaacatccag

SEQ ID NO: 507688 - DNA, 25 bp, Homo sapien
accagtctttaaagcaacatccaga

SEQ ID NO: 507689 - DNA, 25 bp, Homo sapien
ccagtctttaaagcaacatccagaa

SEQ ID NO: 507690 - DNA, 25 bp, Homo sapien
gtctttaaagcaacatccagaaaaa

SEQ ID NO: 507691 - DNA, 25 bp, Homo sapien
atgatcatctggaatgatacttagt

SEQ ID NO: 507692 - DNA, 25 bp, Homo sapien
gatcatctggaatgatacttagtgt

SEQ ID NO: 507693 - DNA, 25 bp, Homo sapien
tcatctggaatgatacttagtgtat

SEQ ID NO: 507694 - DNA, 25 bp, Homo sapien
catctggaatgatacttagtgtata

SEQ ID NO: 507695 - DNA, 25 bp, Homo sapien
ctggaatgatacttagtgtatatat

SEQ ID NO: 507696 - DNA, 25 bp, Homo sapien
tccttatcttggtaaacaagcccag

SEQ ID NO: 507697 - DNA, 25 bp, Homo sapien
ttatcttggtaaacaagcccagttc

SEQ ID NO: 507698 - DNA, 25 bp, Homo sapien
atcttggtaaacaagcccagttctg

SEQ ID NO: 507699 - DNA, 25 bp, Homo sapien
cttggtaaacaagcccagttctgag

SEQ ID NO: 507700 - DNA, 25 bp, Homo sapien
ggtaaacaagcccagttctgagtca

SEQ ID NO: 507701 - DNA, 25 bp, Homo sapien
gtaaacaagcccagttctgagtcac

SEQ ID NO: 507702 - DNA, 25 bp, Homo sapien
taaacaagcccagttctgagtcaca

SEQ ID NO: 507703 - DNA, 25 bp, Homo sapien
aaacaagcccagttctgagtcacat

SEQ ID NO: 507704 - DNA, 25 bp, Homo sapien
aacaagcccagttctgagtcacatc

SEQ ID NO: 507705 - DNA, 25 bp, Homo sapien
acaagcccagttctgagtcacatcc

SEQ ID NO: 507706 - DNA, 25 bp, Homo sapien
agcccagttctgagtcacatccctg

SEQ ID NO: 507707 - DNA, 25 bp, Homo sapien
agggtaaagcctacaatatcatcag

SEQ ID NO: 507708 - DNA, 25 bp, Homo sapien
gcacattaatttgcagtggctgctt

SEQ ID NO: 507709 - DNA, 25 bp, Homo sapien
ttgcagtggctgcttcatatgagga

SEQ ID NO: 507710 - DNA, 25 bp, Homo sapien
tcaactcctttcaaatttaggatgg

SEQ ID NO: 507711 - DNA, 25 bp, Homo sapien
gggctttatgcaggattctctttga

SEQ ID NO: 507712 - DNA, 25 bp, Homo sapien
gaaaattcttgtatgtccagaacaa

SEQ ID NO: 507713 - DNA, 25 bp, Homo sapien
ttgtattcctcacattcacaatccc

SEQ ID NO: 507714 - DNA, 25 bp, Homo sapien
attcacaatccccattggtctgaag

SEQ ID NO: 507715 - DNA, 25 bp, Homo sapien
atccccattggtctgaagtcacgta

SEQ ID NO: 507716 - DNA, 25 bp, Homo sapien
gaagtcacgtagcacagagcatcta

SEQ ID NO: 507717 - DNA, 25 bp, Homo sapien
gagcatctatagcacatagtgttta

SEQ ID NO: 507718 - DNA, 25 bp, Homo sapien
ttttatttctggactgactcagata

SEQ ID NO: 507719 - DNA, 25 bp, Homo sapien
tagaaagactgagcaccagccgctg

SEQ ID NO: 507720 - DNA, 25 bp, Homo sapien
tcctcaatccgttgccaactttgat

SEQ ID NO: 507721 - DNA, 25 bp, Homo sapien
caactttgattgaatgggtgctgtg

SEQ ID NO: 507722 - DNA, 25 bp, Homo sapien
atgggtgctgtggatgtgattatat

SEQ ID NO: 507723 - DNA, 25 bp, Homo sapien
tgccatttccaagcagtgtttttgg

SEQ ID NO: 507724 - DNA, 25 bp, Homo sapien
gacttttcaaaagacggcaatatag

SEQ ID NO: 507725 - DNA, 25 bp, Homo sapien
gtacccaggctttgacggctgccat

SEQ ID NO: 507726 - DNA, 25 bp, Homo sapien
ggctttgacggctgccattcagggt

SEQ ID NO: 507727 - DNA, 25 bp, Homo sapien
gccattcagggtggacgatgcctaa

SEQ ID NO: 507728 - DNA, 25 bp, Homo sapien
gatgcctaaagattccaccgctaat

SEQ ID NO: 507729 - DNA, 25 bp, Homo sapien
ttcaccacattcaccctcaggtatt

SEQ ID NO: 507730 - DNA, 25 bp, Homo sapien
caggtattcgcgcttcaccaaccgg

SEQ ID NO: 507731 - DNA, 25 bp, Homo sapien
gccagccagatggtggcaaagcagc

SEQ ID NO: 507732 - DNA, 25 bp, Homo sapien
cgctgaagcacgttgggatagtaga

SEQ ID NO: 507733 - DNA, 25 bp, Homo sapien
gatagtagaacattgtccctctggt

SEQ ID NO: 507734 - DNA, 25 bp, Homo sapien
agaacattgtccctctggtctttca

SEQ ID NO: 507735 - DNA, 25 bp, Homo sapien
gattccaccagatccccgttcggat

SEQ ID NO: 507736 - DNA, 25 bp, Homo sapien
tccccgttcggatctgagtcggaat

SEQ ID NO: 507737 - DNA, 25 bp, Homo sapien
atctgagtcggaattctttagggca

SEQ ID NO: 507738 - DNA, 25 bp, Homo sapien
gggttgcactcgtaccagcacgtaa

SEQ ID NO: 507739 - DNA, 25 bp, Homo sapien
ccagcacgtaattgaggatttcctc

SEQ ID NO: 507740 - DNA, 25 bp, Homo sapien
taggtcattaagatgttgatcacac

SEQ ID NO: 507741 - DNA, 25 bp, Homo sapien
gatgttgatcacacagcttcaatca

SEQ ID NO: 507742 - DNA, 25 bp, Homo sapien
acagcttcaatcacaatatgccaag

SEQ ID NO: 507743 - DNA, 25 bp, Homo sapien
tatgccaagtataacctggtttcgt

SEQ ID NO: 507744 - DNA, 25 bp, Homo sapien
cctggtttcgttagaggtgtctaca

SEQ ID NO: 507745 - DNA, 25 bp, Homo sapien
ggtgtctacagtccagatgttcttc

SEQ ID NO: 507746 - DNA, 25 bp, Homo sapien
acagtccagatgttcttcgtaataa

SEQ ID NO: 507747 - DNA, 25 bp, Homo sapien
gaacctctgagtccaaagcaggctg

SEQ ID NO: 507748 - DNA, 25 bp, Homo sapien
agcaggctggttggcataatatgta

SEQ ID NO: 507749 - DNA, 25 bp, Homo sapien
taaaatcttatcttgcagcactatc

SEQ ID NO: 507750 - DNA, 25 bp, Homo sapien
atcttgcagcactatcagtatgttg

SEQ ID NO: 507751 - DNA, 25 bp, Homo sapien
atgttgactacagtgagtctgccaa

SEQ ID NO: 507752 - DNA, 25 bp, Homo sapien
tgagtctgccaaaaaagaggtggtt

SEQ ID NO: 507753 - DNA, 25 bp, Homo sapien
tgaagtggtaaaagccccgcaggta

SEQ ID NO: 507754 - DNA, 25 bp, Homo sapien
aaagccccgcaggtagttgccgaag

SEQ ID NO: 507755 - DNA, 25 bp, Homo sapien
cccgcaggtagttgccgaagcagca

SEQ ID NO: 507756 - DNA, 25 bp, Homo sapien
ggtagttgccgaagcagcaaaaact

SEQ ID NO: 507757 - DNA, 25 bp, Homo sapien
gtgaaagtgacgagactcctccagc

SEQ ID NO: 507758 - DNA, 25 bp, Homo sapien
aagtgacgagactcctccagcagct

SEQ ID NO: 507759 - DNA, 25 bp, Homo sapien
cagcagctcctcagttgatcaagaa

SEQ ID NO: 507760 - DNA, 25 bp, Homo sapien
aagaaggccaaagctggtctggaga

SEQ ID NO: 507761 - DNA, 25 bp, Homo sapien
gggacagtgataccaccaagaagaa

SEQ ID NO: 507762 - DNA, 25 bp, Homo sapien
gaactgggctatgtccctgaggctc

SEQ ID NO: 507763 - DNA, 25 bp, Homo sapien
tgggctatgtccctgaggctcctct

SEQ ID NO: 507764 - DNA, 25 bp, Homo sapien
aggctcctctctaccgtctgactgt

SEQ ID NO: 507765 - DNA, 25 bp, Homo sapien
acaggcatttaaaccaggctgctgc

SEQ ID NO: 507766 - DNA, 25 bp, Homo sapien
agtgcccactggacgccagggtgcc

SEQ ID NO: 507767 - DNA, 25 bp, Homo sapien
gtgccccatagggacagggtcacaa

SEQ ID NO: 507768 - DNA, 25 bp, Homo sapien
cctggtgaggacagtgtggtcacta

SEQ ID NO: 507769 - DNA, 25 bp, Homo sapien
cagtgtggtcactatctcagagaga

SEQ ID NO: 507770 - DNA, 25 bp, Homo sapien
gtggtcactatctcagagagacgaa

SEQ ID NO: 507771 - DNA, 25 bp, Homo sapien
gaatattctgtcatttcagactaaa

SEQ ID NO: 507772 - DNA, 25 bp, Homo sapien
atttcagactaaactactcacccag

SEQ ID NO: 507773 - DNA, 25 bp, Homo sapien
aagaacagctagacagctgtttttt

SEQ ID NO: 507774 - DNA, 25 bp, Homo sapien
atgtttctgtgttgtgtcaaaatga

SEQ ID NO: 507775 - DNA, 25 bp, Homo sapien
ctgtgttgtgtcaaaatgatttctg

SEQ ID NO: 507776 - DNA, 25 bp, Homo sapien
atgatttctggtgatttaaactaac

SEQ ID NO: 507777 - DNA, 25 bp, Homo sapien
tcattacctgtgaagactgtgtctg

SEQ ID NO: 507778 - DNA, 25 bp, Homo sapien
acctgtgaagactgtgtctgtgttt

SEQ ID NO: 507779 - DNA, 25 bp, Homo sapien
gagactggtgccaagtagctgaata

SEQ ID NO: 507780 - DNA, 25 bp, Homo sapien
actggtgccaagtagctgaataatg

SEQ ID NO: 507781 - DNA, 25 bp, Homo sapien
gggatattctgttcgtaaaaatctt

SEQ ID NO: 507782 - DNA, 25 bp, Homo sapien
tattctgttcgtaaaaatcttagca

SEQ ID NO: 507783 - DNA, 25 bp, Homo sapien
aaaaatcttagcagtgttaccaact

SEQ ID NO: 507784 - DNA, 25 bp, Homo sapien
tggccagaaaggcagttattgatct

SEQ ID NO: 507785 - DNA, 25 bp, Homo sapien
tattgatctgggtcacatctccaca

SEQ ID NO: 507786 - DNA, 25 bp, Homo sapien
gggtcacatctccacaagattttat

SEQ ID NO: 507787 - DNA, 25 bp, Homo sapien
gaagaagacattttgccacacactg

SEQ ID NO: 507788 - DNA, 25 bp, Homo sapien
taatcttgatcatgcagactccata

SEQ ID NO: 507789 - DNA, 25 bp, Homo sapien
aatttacattccacatcttagaaca

SEQ ID NO: 507790 - DNA, 25 bp, Homo sapien
tcttagaacacttagactccaccac

SEQ ID NO: 507791 - DNA, 25 bp, Homo sapien
tccaccacctactatggcaggcaga

SEQ ID NO: 507792 - DNA, 25 bp, Homo sapien
atggcaggcagaaaaggttcataac

SEQ ID NO: 507793 - DNA, 25 bp, Homo sapien
gtaagttcactggatacatgcatga

SEQ ID NO: 507794 - DNA, 25 bp, Homo sapien
gcatgagtattttaattggccagaa

SEQ ID NO: 507795 - DNA, 25 bp, Homo sapien
aggcaagtgattaagagcactgact

SEQ ID NO: 507796 - DNA, 25 bp, Homo sapien
ggcaagtgattaagagcactgactg

SEQ ID NO: 507797 - DNA, 25 bp, Homo sapien
gcaagtgattaagagcactgactgg

SEQ ID NO: 507798 - DNA, 25 bp, Homo sapien
caagtgattaagagcactgactggg

SEQ ID NO: 507799 - DNA, 25 bp, Homo sapien
aagtgattaagagcactgactgggc

SEQ ID NO: 507800 - DNA, 25 bp, Homo sapien
agtgattaagagcactgactgggcc

SEQ ID NO: 507801 - DNA, 25 bp, Homo sapien
gtgattaagagcactgactgggccg

SEQ ID NO: 507802 - DNA, 25 bp, Homo sapien
attaagagcactgactgggccgggc

SEQ ID NO: 507803 - DNA, 25 bp, Homo sapien
ttaagagcactgactgggccgggcg

SEQ ID NO: 507804 - DNA, 25 bp, Homo sapien
aagagcactgactgggccgggcgcg

SEQ ID NO: 507805 - DNA, 25 bp, Homo sapien
atggtgtaatcccgggaggtggagg

SEQ ID NO: 507806 - DNA, 25 bp, Homo sapien
agggaaagaatcagtgcctaataaa

SEQ ID NO: 507807 - DNA, 25 bp, Homo sapien
ataaatgtaggcacctaccccacac

SEQ ID NO: 507808 - DNA, 25 bp, Homo sapien
acactccaacttgtgctgtctgaag

SEQ ID NO: 507809 - DNA, 25 bp, Homo sapien
ctgtctgaagccttgggcacaatgg

SEQ ID NO: 507810 - DNA, 25 bp, Homo sapien
gaagccttgggcacaatgggcaatt

SEQ ID NO: 507811 - DNA, 25 bp, Homo sapien
acaatgggcaattcgtgagagtaag

SEQ ID NO: 507812 - DNA, 25 bp, Homo sapien
cagaaaagggcactcctccccgtgg

SEQ ID NO: 507813 - DNA, 25 bp, Homo sapien
aagggcactcctccccgtgggcttg

SEQ ID NO: 507814 - DNA, 25 bp, Homo sapien
gcaggccaccccttcagtgagggaa

SEQ ID NO: 507815 - DNA, 25 bp, Homo sapien
aggccaccccttcagtgagggaaag

SEQ ID NO: 507816 - DNA, 25 bp, Homo sapien
gccaccccttcagtgagggaaagaa

SEQ ID NO: 507817 - DNA, 25 bp, Homo sapien
cagctctgacagttagacatgcaca

SEQ ID NO: 507818 - DNA, 25 bp, Homo sapien
gctctgacagttagacatgcacaca

SEQ ID NO: 507819 - DNA, 25 bp, Homo sapien
gacatgcacacagacgccatagctg

SEQ ID NO: 507820 - DNA, 25 bp, Homo sapien
catgcacacagacgccatagctgga

SEQ ID NO: 507821 - DNA, 25 bp, Homo sapien
gcacacagacgccatagctggattg

SEQ ID NO: 507822 - DNA, 25 bp, Homo sapien
cacagacgccatagctggattggaa

SEQ ID NO: 507823 - DNA, 25 bp, Homo sapien
gacgccatagctggattggaaacat

SEQ ID NO: 507824 - DNA, 25 bp, Homo sapien
gccatagctggattggaaacattga

SEQ ID NO: 507825 - DNA, 25 bp, Homo sapien
gttctatagatttttaactagtcca

SEQ ID NO: 507826 - DNA, 25 bp, Homo sapien
gatttttaactagtccaacacagtc

SEQ ID NO: 507827 - DNA, 25 bp, Homo sapien
tttaactagtccaacacagtcagaa

SEQ ID NO: 507828 - DNA, 25 bp, Homo sapien
agaatgtactcttgttgaaacactt

SEQ ID NO: 507829 - DNA, 25 bp, Homo sapien
gtactcttgttgaaacacttcttgt

SEQ ID NO: 507830 - DNA, 25 bp, Homo sapien
gttgaaacacttcttgtaccatttt

SEQ ID NO: 507831 - DNA, 25 bp, Homo sapien
cacttcttgtaccattttatgttca

SEQ ID NO: 507832 - DNA, 25 bp, Homo sapien
gttcatattatgtttgagagggtaa

SEQ ID NO: 507833 - DNA, 25 bp, Homo sapien
gtaaaaatgtatgagcagcttaact

SEQ ID NO: 507834 - DNA, 25 bp, Homo sapien
gcagcttaactgaagtagaactatt

SEQ ID NO: 507835 - DNA, 25 bp, Homo sapien
gaactattcatgatgcttttcacac

SEQ ID NO: 507836 - DNA, 25 bp, Homo sapien
tcatgatgcttttcacacattgtgg

SEQ ID NO: 507837 - DNA, 25 bp, Homo sapien
gatgcttttcacacattgtggcata

SEQ ID NO: 507838 - DNA, 25 bp, Homo sapien
ttcacacattgtggcataagatgta

SEQ ID NO: 507839 - DNA, 25 bp, Homo sapien
aatggagcaactagtgcttgacaaa

SEQ ID NO: 507840 - DNA, 25 bp, Homo sapien
agacagccgtactggaagaggattc

SEQ ID NO: 507841 - DNA, 25 bp, Homo sapien
aagaggattctgcagattgggaaaa

SEQ ID NO: 507842 - DNA, 25 bp, Homo sapien
actgcagcaggaacttcaagaatat

SEQ ID NO: 507843 - DNA, 25 bp, Homo sapien
atatgaagtggtgacagaatctgaa

SEQ ID NO: 507844 - DNA, 25 bp, Homo sapien
gaggaaaattagctgttcctgaaat

SEQ ID NO: 507845 - DNA, 25 bp, Homo sapien
gaataatccttaacagtctgcaaac

SEQ ID NO: 507846 - DNA, 25 bp, Homo sapien
tctgcaaactgacattaaattctag

SEQ ID NO: 507847 - DNA, 25 bp, Homo sapien
gatgccttcgatgcctgtaacctaa

SEQ ID NO: 507848 - DNA, 25 bp, Homo sapien
tgccttcgatgcctgtaacctaaat

SEQ ID NO: 507849 - DNA, 25 bp, Homo sapien
tcgatgcctgtaacctaaatcagga

SEQ ID NO: 507850 - DNA, 25 bp, Homo sapien
gttatcaaactccatacctgtcaga

SEQ ID NO: 507851 - DNA, 25 bp, Homo sapien
acctgtcagaagaaaccacgtattt

SEQ ID NO: 507852 - DNA, 25 bp, Homo sapien
gaaaccacgtatttggagccaggaa

SEQ ID NO: 507853 - DNA, 25 bp, Homo sapien
gagccaggaaagatcagtgtgaatt

SEQ ID NO: 507854 - DNA, 25 bp, Homo sapien
tgtgaattgtggacacccatctcgt

SEQ ID NO: 507855 - DNA, 25 bp, Homo sapien
cacccatctcgtcataaggctgata

SEQ ID NO: 507856 - DNA, 25 bp, Homo sapien
gagcagtacattaccatcttcagtg

SEQ ID NO: 507857 - DNA, 25 bp, Homo sapien
atcttcagtgtgtcagcagccttca

SEQ ID NO: 507858 - DNA, 25 bp, Homo sapien
aaattaattgttccgctatctagcc

SEQ ID NO: 507859 - DNA, 25 bp, Homo sapien
gttccgctatctagccaacaagata

SEQ ID NO: 507860 - DNA, 25 bp, Homo sapien
gaaatgtcagcgttatcaaactcca

SEQ ID NO: 507861 - DNA, 25 bp, Homo sapien
gcacagtgagagattaatgggcatt

SEQ ID NO: 507862 - DNA, 25 bp, Homo sapien
gtgtacaaattgcttctcaccatcc

SEQ ID NO: 507863 - DNA, 25 bp, Homo sapien
ttagacctacgaataaagcatccgg

SEQ ID NO: 507864 - DNA, 25 bp, Homo sapien
tctggacctgataatgaagcgaatg

SEQ ID NO: 507865 - DNA, 25 bp, Homo sapien
atggaacggtgtgtggacaagtcct

SEQ ID NO: 507866 - DNA, 25 bp, Homo sapien
tgtggacaagtcctggattcctgaa

SEQ ID NO: 507867 - DNA, 25 bp, Homo sapien
gattcctgaaggagtggtgcgatca

SEQ ID NO: 507868 - DNA, 25 bp, Homo sapien
aggagtggtgcgatcaaatggtcat

SEQ ID NO: 507869 - DNA, 25 bp, Homo sapien
atagtagttcaggtggcccatgcct

SEQ ID NO: 507870 - DNA, 25 bp, Homo sapien
atgcctgggatcttctctatgattg

SEQ ID NO: 507871 - DNA, 25 bp, Homo sapien
ctctatgattgatacatggcacagt

SEQ ID NO: 507872 - DNA, 25 bp, Homo sapien
attctaaacttgaacacagagtctt

SEQ ID NO: 507873 - DNA, 25 bp, Homo sapien
acagagtctttgtgagagagattca

SEQ ID NO: 507874 - DNA, 25 bp, Homo sapien
tggtatgaagactaccctggcttcc

SEQ ID NO: 507875 - DNA, 25 bp, Homo sapien
ggcttcctgtcactactgcgtctga

SEQ ID NO: 507876 - DNA, 25 bp, Homo sapien
gtctgacctgagtttatattgctgc

SEQ ID NO: 507877 - DNA, 25 bp, Homo sapien
atattgctgctaccgctgtgtaaaa

SEQ ID NO: 507878 - DNA, 25 bp, Homo sapien
gtacgtgcagtatactgtactcata

SEQ ID NO: 507879 - DNA, 25 bp, Homo sapien
gtatactgtactcatagccatttca

SEQ ID NO: 507880 - DNA, 25 bp, Homo sapien
agccatttcataatataggacctag

SEQ ID NO: 507881 - DNA, 25 bp, Homo sapien
ataggacctagactctcatttgtaa

SEQ ID NO: 507882 - DNA, 25 bp, Homo sapien
tcatttgtaaacgttctaaccctag

SEQ ID NO: 507883 - DNA, 25 bp, Homo sapien
cacaggtttcatgaaaaagttcagc

SEQ ID NO: 507884 - DNA, 25 bp, Homo sapien
gaagtctgcagatgagagttgctca

SEQ ID NO: 507885 - DNA, 25 bp, Homo sapien
gagagttgctcagtgtcaggactca

SEQ ID NO: 507886 - DNA, 25 bp, Homo sapien
gttgctcagtgtcaggactcagaaa

SEQ ID NO: 507887 - DNA, 25 bp, Homo sapien
taccccaagataatgttcaaacctg

SEQ ID NO: 507888 - DNA, 25 bp, Homo sapien
acctgagtgctttgaacaaaggata

SEQ ID NO: 507889 - DNA, 25 bp, Homo sapien
agacctcagaagagggcctcagaac

SEQ ID NO: 507890 - DNA, 25 bp, Homo sapien
agagggcctcagaactcacatgtct

SEQ ID NO: 507891 - DNA, 25 bp, Homo sapien
agaactcacatgtctctctgacctt

SEQ ID NO: 507892 - DNA, 25 bp, Homo sapien
tctccttcacttccaaagcatgatc

SEQ ID NO: 507893 - DNA, 25 bp, Homo sapien
tccaaagcatgatctttggccaggg

SEQ ID NO: 507894 - DNA, 25 bp, Homo sapien
ggaaactagggtttggaatgcccag

SEQ ID NO: 507895 - DNA, 25 bp, Homo sapien
ctagggtttggaatgcccagataac

SEQ ID NO: 507896 - DNA, 25 bp, Homo sapien
agggtttggaatgcccagataacat

SEQ ID NO: 507897 - DNA, 25 bp, Homo sapien
gtttggaatgcccagataacatata

SEQ ID NO: 507898 - DNA, 25 bp, Homo sapien
gaatgcccagataacatatatacat

SEQ ID NO: 507899 - DNA, 25 bp, Homo sapien
atatgaatacttgtagacttttaaa

SEQ ID NO: 507900 - DNA, 25 bp, Homo sapien
aattagaaagctttatttcatcatt

SEQ ID NO: 507901 - DNA, 25 bp, Homo sapien
tcatgtgcaagatatcttgaaggtc

SEQ ID NO: 507902 - DNA, 25 bp, Homo sapien
gtgcaagatatcttgaaggtcttga

SEQ ID NO: 507903 - DNA, 25 bp, Homo sapien
gaagacttgcaaaggtattttcatt

SEQ ID NO: 507904 - DNA, 25 bp, Homo sapien
agacttgcaaaggtattttcatttt

SEQ ID NO: 507905 - DNA, 25 bp, Homo sapien
gttaatttttgtacagtctgtgggc

SEQ ID NO: 507906 - DNA, 25 bp, Homo sapien
gtctgtgggcatttacacattttta

SEQ ID NO: 507907 - DNA, 25 bp, Homo sapien
agttacttctagttatgatttgtga

SEQ ID NO: 507908 - DNA, 25 bp, Homo sapien
gatttgtgaattccctaagaccttg

SEQ ID NO: 507909 - DNA, 25 bp, Homo sapien
tgaattccctaagaccttggatttt

SEQ ID NO: 507910 - DNA, 25 bp, Homo sapien
gaaatgatactgcatctttatattt

SEQ ID NO: 507911 - DNA, 25 bp, Homo sapien
taaaattgtattgctgctcaagaat

SEQ ID NO: 507912 - DNA, 25 bp, Homo sapien
gctgctcaagaatggtaccctcttg

SEQ ID NO: 507913 - DNA, 25 bp, Homo sapien
agaatggtaccctcttgtcaaaaag

SEQ ID NO: 507914 - DNA, 25 bp, Homo sapien
gtcaaaaaggcatacattcataatt

SEQ ID NO: 507915 - DNA, 25 bp, Homo sapien
attcataattgtacattcagcattg

SEQ ID NO: 507916 - DNA, 25 bp, Homo sapien
gctgtatggtatatgcatgctgatt

SEQ ID NO: 507917 - DNA, 25 bp, Homo sapien
atatgcatgctgatttaccacttat

SEQ ID NO: 507918 - DNA, 25 bp, Homo sapien
gctgatttaccacttatgcatagat

SEQ ID NO: 507919 - DNA, 25 bp, Homo sapien
accacttatgcatagatatatcttt

SEQ ID NO: 507920 - DNA, 25 bp, Homo sapien
agaacctaatagcaccaatacaaat

SEQ ID NO: 507921 - DNA, 25 bp, Homo sapien
gcaccaatacaaattgaggacttaa

SEQ ID NO: 507922 - DNA, 25 bp, Homo sapien
aatagctcagctgaccagaatgaat

SEQ ID NO: 507923 - DNA, 25 bp, Homo sapien
tcagctgaccagaatgaatgtattc

SEQ ID NO: 507924 - DNA, 25 bp, Homo sapien
gtattctacttgttgagccatccag

SEQ ID NO: 507925 - DNA, 25 bp, Homo sapien
attctacttgttgagccatccagca

SEQ ID NO: 507926 - DNA, 25 bp, Homo sapien
tctacttgttgagccatccagcatc

SEQ ID NO: 507927 - DNA, 25 bp, Homo sapien
tattgatcgcctggactgtgcagta

SEQ ID NO: 507928 - DNA, 25 bp, Homo sapien
gtatttccagtctgtctcagcaagc

SEQ ID NO: 507929 - DNA, 25 bp, Homo sapien
tgcagatgcctctgaccaagaccag

SEQ ID NO: 507930 - DNA, 25 bp, Homo sapien
caagaccagcccacagtaactaata

SEQ ID NO: 507931 - DNA, 25 bp, Homo sapien
cagtaactaataacccggagccacg

SEQ ID NO: 507932 - DNA, 25 bp, Homo sapien
gagccacgtgggtgaactgtgcact

SEQ ID NO: 507933 - DNA, 25 bp, Homo sapien
cgtgggtgaactgtgcactccagtt

SEQ ID NO: 507934 - DNA, 25 bp, Homo sapien
cactccagttctctccagatgagag

SEQ ID NO: 507935 - DNA, 25 bp, Homo sapien
gagaatcttttcaacagctggtatt

SEQ ID NO: 507936 - DNA, 25 bp, Homo sapien
gggcatgatcctgataaacacctta

SEQ ID NO: 507937 - DNA, 25 bp, Homo sapien
aaacaccttaaatgtcttgtcaact

SEQ ID NO: 507938 - DNA, 25 bp, Homo sapien
attcctaatgaaaaaggctcttaag

SEQ ID NO: 507939 - DNA, 25 bp, Homo sapien
aggctcttaagccagaaaccaattg

SEQ ID NO: 507940 - DNA, 25 bp, Homo sapien
agccagaaaccaattgcctcttatc

SEQ ID NO: 507941 - DNA, 25 bp, Homo sapien
accaattgcctcttatcggttatcc

SEQ ID NO: 507942 - DNA, 25 bp, Homo sapien
tcttatcggttatccccaactgtag

SEQ ID NO: 507943 - DNA, 25 bp, Homo sapien
gttatccccaactgtagatcttcta

SEQ ID NO: 507944 - DNA, 25 bp, Homo sapien
ttattaagtcaaaatttctccagga

SEQ ID NO: 507945 - DNA, 25 bp, Homo sapien
attgttaaactctcacaactgataa

SEQ ID NO: 507946 - DNA, 25 bp, Homo sapien
aattatcccgaaatgacataaccaa

SEQ ID NO: 507947 - DNA, 25 bp, Homo sapien
aaaatgcttctcctctcattagtct

SEQ ID NO: 507948 - DNA, 25 bp, Homo sapien
tctcctctcattagtctaccatgac

SEQ ID NO: 507949 - DNA, 25 bp, Homo sapien
tctaattccagagaatgagacttcc

SEQ ID NO: 507950 - DNA, 25 bp, Homo sapien
gaatgagacttccagtttgaatgca

SEQ ID NO: 507951 - DNA, 25 bp, Homo sapien
gacttccagtttgaatgcaaagtgt

SEQ ID NO: 507952 - DNA, 25 bp, Homo sapien
tgtgtggtcccaaagttgaattctt

SEQ ID NO: 507953 - DNA, 25 bp, Homo sapien
gaattcttttgaacccaagtacatg

SEQ ID NO: 507954 - DNA, 25 bp, Homo sapien
aacccaagtacatgcctgcggttgg

SEQ ID NO: 507955 - DNA, 25 bp, Homo sapien
ctgcggttgggaggaacacttaaag

SEQ ID NO: 507956 - DNA, 25 bp, Homo sapien
gaagcaagttcggaggaaagtgtta

SEQ ID NO: 507957 - DNA, 25 bp, Homo sapien
gaaagtgttaactgaactacagaga

SEQ ID NO: 507958 - DNA, 25 bp, Homo sapien
aactacagagatggtcactgataaa

SEQ ID NO: 507959 - DNA, 25 bp, Homo sapien
ggtcactgataaaacaagttcttag

SEQ ID NO: 507960 - DNA, 25 bp, Homo sapien
aaatggaaggcccacagtcacctgg

SEQ ID NO: 507961 - DNA, 25 bp, Homo sapien
acagtcacctggtcagctcttaaac

SEQ ID NO: 507962 - DNA, 25 bp, Homo sapien
tggtcagctcttaaaccctgcccta

SEQ ID NO: 507963 - DNA, 25 bp, Homo sapien
gccctagcccattctatctctgtgg

SEQ ID NO: 507964 - DNA, 25 bp, Homo sapien
atctctgtggcttcgtgtggtaata

SEQ ID NO: 507965 - DNA, 25 bp, Homo sapien
gtaatatttttagttgtggtgcaga

SEQ ID NO: 507966 - DNA, 25 bp, Homo sapien
gtaaggttcgaatctttcgggtgat

SEQ ID NO: 507967 - DNA, 25 bp, Homo sapien
gaatctttcgggtgatgggagttaa

SEQ ID NO: 507968 - DNA, 25 bp, Homo sapien
actgggatttaagggccacacttca

SEQ ID NO: 507969 - DNA, 25 bp, Homo sapien
caggtctgctttctcccagaatcct

SEQ ID NO: 507970 - DNA, 25 bp, Homo sapien
ttgctgcttactggagggaatgatg

SEQ ID NO: 507971 - DNA, 25 bp, Homo sapien
gagccaatatctaggcattttcttg

SEQ ID NO: 507972 - DNA, 25 bp, Homo sapien
ctaggcattttcttggtagcacaaa

SEQ ID NO: 507973 - DNA, 25 bp, Homo sapien
tgcttagaaaattgtcctccttgtt

SEQ ID NO: 507974 - DNA, 25 bp, Homo sapien
gtcctccttgttatttctgtttgta

SEQ ID NO: 507975 - DNA, 25 bp, Homo sapien
ggaaagcaacgctcctctgaaatgc

SEQ ID NO: 507976 - DNA, 25 bp, Homo sapien
aacgctcctctgaaatgcttgtctt

SEQ ID NO: 507977 - DNA, 25 bp, Homo sapien
tgtcttttttctgttgccgaaatag

SEQ ID NO: 507978 - DNA, 25 bp, Homo sapien
gttgccgaaatagctggtccttttt

SEQ ID NO: 507979 - DNA, 25 bp, Homo sapien
gctggtcctttttcgggagttagat

SEQ ID NO: 507980 - DNA, 25 bp, Homo sapien
acatttcttgtaggcatcaccatga

SEQ ID NO: 507981 - DNA, 25 bp, Homo sapien
gcacttcaagaagtcactgtcagag

SEQ ID NO: 507982 - DNA, 25 bp, Homo sapien
gggtgccacacactcaagactatgc

SEQ ID NO: 507983 - DNA, 25 bp, Homo sapien
acactcaagactatgccggccagac

SEQ ID NO: 507984 - DNA, 25 bp, Homo sapien
ggccagaccggtgagcataacctga

SEQ ID NO: 507985 - DNA, 25 bp, Homo sapien
gcataacctgacactctacggaagt

SEQ ID NO: 507986 - DNA, 25 bp, Homo sapien
tctacggaagtacgcaagcccacgg

SEQ ID NO: 507987 - DNA, 25 bp, Homo sapien
gggagcagagcagcaactcacccag

SEQ ID NO: 507988 - DNA, 25 bp, Homo sapien
ggagcacagacagacggccagcagt

SEQ ID NO: 507989 - DNA, 25 bp, Homo sapien
cagagagtaaatctaccccgaaacg

SEQ ID NO: 507990 - DNA, 25 bp, Homo sapien
ccgaaacggctgcatgtctctaata

SEQ ID NO: 507991 - DNA, 25 bp, Homo sapien
atgtctctaatattcctttccgctt

SEQ ID NO: 507992 - DNA, 25 bp, Homo sapien
ggaccctgacctccggcagatgttt

SEQ ID NO: 507993 - DNA, 25 bp, Homo sapien
agtggtccatacatgaacagctccc

SEQ ID NO: 507994 - DNA, 25 bp, Homo sapien
agctattccaggactcttctccatt

SEQ ID NO: 507995 - DNA, 25 bp, Homo sapien
ccaggactcttctccattgtaagaa

SEQ ID NO: 507996 - DNA, 25 bp, Homo sapien
acaaaaatgtgtctgagatctcatt

SEQ ID NO: 507997 - DNA, 25 bp, Homo sapien
gatcacagcagccactgatataaca

SEQ ID NO: 507998 - DNA, 25 bp, Homo sapien
aagtttaggcatttttctcaacaca

SEQ ID NO: 507999 - DNA, 25 bp, Homo sapien
ttctcaacacaaagactatcgctgg

SEQ ID NO: 508000 - DNA, 25 bp, Homo sapien
aagactatcgctggaagtggcactt

SEQ ID NO: 508001 - DNA, 25 bp, Homo sapien
aagtggcacttgctacctggtgcat

SEQ ID NO: 508002 - DNA, 25 bp, Homo sapien
gctacctggtgcatctttgaaaagt

SEQ ID NO: 508003 - DNA, 25 bp, Homo sapien
gacttacataaagtagctctttcat

SEQ ID NO: 508004 - DNA, 25 bp, Homo sapien
gctctcttactgctcttggtgcatt

SEQ ID NO: 508005 - DNA, 25 bp, Homo sapien
gctcttggtgcattgacagtttctg

SEQ ID NO: 508006 - DNA, 25 bp, Homo sapien
cttggtgcattgacagtttctgtat

SEQ ID NO: 508007 - DNA, 25 bp, Homo sapien
agtttctgtatctcaaccctattca

SEQ ID NO: 508008 - DNA, 25 bp, Homo sapien
gtatctcaaccctattcatctttat

SEQ ID NO: 508009 - DNA, 25 bp, Homo sapien
gaaaaagcattctgaagatctatcc

SEQ ID NO: 508010 - DNA, 25 bp, Homo sapien
actgctgagtgtgcagtcacacttt

SEQ ID NO: 508011 - DNA, 25 bp, Homo sapien
aagggaatcctgattgtgtacagta

SEQ ID NO: 508012 - DNA, 25 bp, Homo sapien
gtaaatagtttgtctcattcaattg

SEQ ID NO: 508013 - DNA, 25 bp, Homo sapien
gtttgtctcattcaattgtatgtga

SEQ ID NO: 508014 - DNA, 25 bp, Homo sapien
ttgaaataaatcctaccatttaggg

SEQ ID NO: 508015 - DNA, 25 bp, Homo sapien
ttatggtggtctttttccagagaaa

SEQ ID NO: 508016 - DNA, 25 bp, Homo sapien
agaaggttctaacaatctctgtaat

SEQ ID NO: 508017 - DNA, 25 bp, Homo sapien
aatacactttataactgacctggaa

SEQ ID NO: 508018 - DNA, 25 bp, Homo sapien
ttataactgacctggaaacttttag

SEQ ID NO: 508019 - DNA, 25 bp, Homo sapien
gtttctggaatgagttgtaactggt

SEQ ID NO: 508020 - DNA, 25 bp, Homo sapien
gtgttttagattagttaaaggccat

SEQ ID NO: 508021 - DNA, 25 bp, Homo sapien
atgagaaagactgagcctataatgc

SEQ ID NO: 508022 - DNA, 25 bp, Homo sapien
gactgagcctataatgctaattgaa

SEQ ID NO: 508023 - DNA, 25 bp, Homo sapien
aatgctaattgaaactacaggactt

SEQ ID NO: 508024 - DNA, 25 bp, Homo sapien
gagttgtaactggtatattttgtgt

SEQ ID NO: 508025 - DNA, 25 bp, Homo sapien
acttggaatgatcaaatggcttttt

SEQ ID NO: 508026 - DNA, 25 bp, Homo sapien
ggccttatacagactcaccactgtg

SEQ ID NO: 508027 - DNA, 25 bp, Homo sapien
tgggcattaacacccaagaccctag

SEQ ID NO: 508028 - DNA, 25 bp, Homo sapien
cactcagcttacagtcctctttctg

SEQ ID NO: 508029 - DNA, 25 bp, Homo sapien
ctgtttcctcttctttgtggattca

SEQ ID NO: 508030 - DNA, 25 bp, Homo sapien
ctcttctttgtggattcaccttttt

SEQ ID NO: 508031 - DNA, 25 bp, Homo sapien
ccctgggtcgtcttcatcactctta

SEQ ID NO: 508032 - DNA, 25 bp, Homo sapien
ttttttgggtgtgagcccagccatg

SEQ ID NO: 508033 - DNA, 25 bp, Homo sapien
gagcccagccatggtttaacctttt

SEQ ID NO: 508034 - DNA, 25 bp, Homo sapien
cactcttactactatctgaaatcaa

SEQ ID NO: 508035 - DNA, 25 bp, Homo sapien
tcctatagaaggtttgtaaaggcct

SEQ ID NO: 508036 - DNA, 25 bp, Homo sapien
gtaaaggccttatacagactcacca

SEQ ID NO: 508037 - DNA, 25 bp, Homo sapien
ttaaggctcttgacacatattgcag

SEQ ID NO: 508038 - DNA, 25 bp, Homo sapien
ggctcttgacacatattgcagatgg

SEQ ID NO: 508039 - DNA, 25 bp, Homo sapien
gacacatattgcagatggcttttaa

SEQ ID NO: 508040 - DNA, 25 bp, Homo sapien
taattccttgagtaagtacttcagt

SEQ ID NO: 508041 - DNA, 25 bp, Homo sapien
agtacttcagtaccaagcatttgat

SEQ ID NO: 508042 - DNA, 25 bp, Homo sapien
cagtaccaagcatttgattctttgt

SEQ ID NO: 508043 - DNA, 25 bp, Homo sapien
attctttgtaattcttggtagtatg

SEQ ID NO: 508044 - DNA, 25 bp, Homo sapien
cttggtagtatggttattattgtga

SEQ ID NO: 508045 - DNA, 25 bp, Homo sapien
gtgggatgtggctagaatacagtat

SEQ ID NO: 508046 - DNA, 25 bp, Homo sapien
taattttgacatgtggtttgtggaa

SEQ ID NO: 508047 - DNA, 25 bp, Homo sapien
attttctgtgttctgggatttagag

SEQ ID NO: 508048 - DNA, 25 bp, Homo sapien
caagcatgttacctattaagagaga

SEQ ID NO: 508049 - DNA, 25 bp, Homo sapien
aagcatgttacctattaagagagag

SEQ ID NO: 508050 - DNA, 25 bp, Homo sapien
agcatgttacctattaagagagaga

SEQ ID NO: 508051 - DNA, 25 bp, Homo sapien
gcatgttacctattaagagagagag

SEQ ID NO: 508052 - DNA, 25 bp, Homo sapien
catgttacctattaagagagagagg

SEQ ID NO: 508053 - DNA, 25 bp, Homo sapien
gagagagagggtatctctgaagact

SEQ ID NO: 508054 - DNA, 25 bp, Homo sapien
atctctgaagactaattaaaatggt

SEQ ID NO: 508055 - DNA, 25 bp, Homo sapien
ctctgaagactaattaaaatggtaa

SEQ ID NO: 508056 - DNA, 25 bp, Homo sapien
gacttttagtatatcatcccaagta

SEQ ID NO: 508057 - DNA, 25 bp, Homo sapien
acttttagtatatcatcccaagtat

SEQ ID NO: 508058 - DNA, 25 bp, Homo sapien
cttttagtatatcatcccaagtatt

SEQ ID NO: 508059 - DNA, 25 bp, Homo sapien
tctattattcaatcatctatccatt

SEQ ID NO: 508060 - DNA, 25 bp, Homo sapien
atatttattaaagtgcctaccatga

SEQ ID NO: 508061 - DNA, 25 bp, Homo sapien
gtgcctaccatgattatgtgctgta

SEQ ID NO: 508062 - DNA, 25 bp, Homo sapien
attgtgggcccaatcggcatcataa

SEQ ID NO: 508063 - DNA, 25 bp, Homo sapien
ggcatcataagcatgtctgaagcaa

SEQ ID NO: 508064 - DNA, 25 bp, Homo sapien
aataatcacatccaacggcaccagt

SEQ ID NO: 508065 - DNA, 25 bp, Homo sapien
ggcaccagttcagctcaactttaga

SEQ ID NO: 508066 - DNA, 25 bp, Homo sapien
gctcaactttagaattcagcagtaa

SEQ ID NO: 508067 - DNA, 25 bp, Homo sapien
gcagtaacagtacagatggcctaaa

SEQ ID NO: 508068 - DNA, 25 bp, Homo sapien
atctgtgtgtatctgtacgtgtgca

SEQ ID NO: 508069 - DNA, 25 bp, Homo sapien
atctgtacgtgtgcacacacccatg

SEQ ID NO: 508070 - DNA, 25 bp, Homo sapien
tgccattcagaatgctatttttgtg

SEQ ID NO: 508071 - DNA, 25 bp, Homo sapien
gaaatcaaaatatcattgggccatg

SEQ ID NO: 508072 - DNA, 25 bp, Homo sapien
atatcattgggccatgagctagtat

SEQ ID NO: 508073 - DNA, 25 bp, Homo sapien
gggccatgagctagtattataatat

SEQ ID NO: 508074 - DNA, 25 bp, Homo sapien
ttcccaaatcctttgtgaacaaggt

SEQ ID NO: 508075 - DNA, 25 bp, Homo sapien
atagttctctaatacactggtttga

SEQ ID NO: 508076 - DNA, 25 bp, Homo sapien
aatacactggtttgaatttctattc

SEQ ID NO: 508077 - DNA, 25 bp, Homo sapien
tgatctgttaggcatgaaagcagtt

SEQ ID NO: 508078 - DNA, 25 bp, Homo sapien
gaaagcagttgcaattactttctgt

SEQ ID NO: 508079 - DNA, 25 bp, Homo sapien
tactttctgttattacagggctatc

SEQ ID NO: 508080 - DNA, 25 bp, Homo sapien
tctgttattacagggctatctataa

SEQ ID NO: 508081 - DNA, 25 bp, Homo sapien
aaggagatggtgacgtcccttccac

SEQ ID NO: 508082 - DNA, 25 bp, Homo sapien
ccttccactgtagttgctgtcacaa

SEQ ID NO: 508083 - DNA, 25 bp, Homo sapien
gctgtcacaaccttgacgtctttaa

SEQ ID NO: 508084 - DNA, 25 bp, Homo sapien
gtctttaagctaatggccgtttgca

SEQ ID NO: 508085 - DNA, 25 bp, Homo sapien
ggccgtttgcatctgtgtcttcaaa

SEQ ID NO: 508086 - DNA, 25 bp, Homo sapien
gtgtcttcaaacagatcctggttac

SEQ ID NO: 508087 - DNA, 25 bp, Homo sapien
gatcctggttacagccattttgtgt

SEQ ID NO: 508088 - DNA, 25 bp, Homo sapien
gattctgcaaacaaggtgtcgccgt

SEQ ID NO: 508089 - DNA, 25 bp, Homo sapien
aggtgtcgccgtccaaatgtactgt

SEQ ID NO: 508090 - DNA, 25 bp, Homo sapien
gtactgtcctggcatagagagcact

SEQ ID NO: 508091 - DNA, 25 bp, Homo sapien
agagcactgctttgttttccactgt

SEQ ID NO: 508092 - DNA, 25 bp, Homo sapien
attggtatcattaaggacccagagc

SEQ ID NO: 508093 - DNA, 25 bp, Homo sapien
tatcattaaggacccagagctgccc

SEQ ID NO: 508094 - DNA, 25 bp, Homo sapien
attaaggacccagagctgcccattt

SEQ ID NO: 508095 - DNA, 25 bp, Homo sapien
ttctctttgttctaatagggaagca

SEQ ID NO: 508096 - DNA, 25 bp, Homo sapien
tagggaagcaattactgatagaaat

SEQ ID NO: 508097 - DNA, 25 bp, Homo sapien
taaaaatagggtcctccctgctgct

SEQ ID NO: 508098 - DNA, 25 bp, Homo sapien
aacaaatgcctaaacacagtatgta

SEQ ID NO: 508099 - DNA, 25 bp, Homo sapien
aacacagtatgtatctcagtcctct

SEQ ID NO: 508100 - DNA, 25 bp, Homo sapien
agtatgtatctcagtcctctgttcc

SEQ ID NO: 508101 - DNA, 25 bp, Homo sapien
atctcagtcctctgttcccagagat

SEQ ID NO: 508102 - DNA, 25 bp, Homo sapien
cagtcctctgttcccagagattcca

SEQ ID NO: 508103 - DNA, 25 bp, Homo sapien
aggacaatttggattcggcctccca

SEQ ID NO: 508104 - DNA, 25 bp, Homo sapien
gcctcccacagcttcatttgtaatg

SEQ ID NO: 508105 - DNA, 25 bp, Homo sapien
ttgtaatgctttcaagacatcttcc

SEQ ID NO: 508106 - DNA, 25 bp, Homo sapien
aagacatcttccatctgtgttagag

SEQ ID NO: 508107 - DNA, 25 bp, Homo sapien
cttccatctgtgttagagacttttc

SEQ ID NO: 508108 - DNA, 25 bp, Homo sapien
aaaagctctttatcttctgacacaa

SEQ ID NO: 508109 - DNA, 25 bp, Homo sapien
acaatttgcttttcagaggacccta

SEQ ID NO: 508110 - DNA, 25 bp, Homo sapien
tcagaggaccctaaaacataacttt

SEQ ID NO: 508111 - DNA, 25 bp, Homo sapien
tttcaatggcttcaacactgaggca

SEQ ID NO: 508112 - DNA, 25 bp, Homo sapien
gaggacacagactagagttcagctt

SEQ ID NO: 508113 - DNA, 25 bp, Homo sapien
gagttcagcttttacaagtggcaaa

SEQ ID NO: 508114 - DNA, 25 bp, Homo sapien
gagcccttcaagaaggtaccagaag

SEQ ID NO: 508115 - DNA, 25 bp, Homo sapien
gaaggtaccagaaggaaccctccag

SEQ ID NO: 508116 - DNA, 25 bp, Homo sapien
agaaggaaccctccagtcctgctct

SEQ ID NO: 508117 - DNA, 25 bp, Homo sapien
gtgcagccctactgtcccttactgg

SEQ ID NO: 508118 - DNA, 25 bp, Homo sapien
ccaccttttagggaggatactgagg

SEQ ID NO: 508119 - DNA, 25 bp, Homo sapien
gaggagtaaaatgctcacggcaaag

SEQ ID NO: 508120 - DNA, 25 bp, Homo sapien
tgctcacggcaaagtcagcagcact

SEQ ID NO: 508121 - DNA, 25 bp, Homo sapien
aagtcagcagcactggtaagccaag

SEQ ID NO: 508122 - DNA, 25 bp, Homo sapien
agcagcactggtaagccaagactga

SEQ ID NO: 508123 - DNA, 25 bp, Homo sapien
actggtaagccaagactgagaaata

SEQ ID NO: 508124 - DNA, 25 bp, Homo sapien
aatacaaggttgcttgtctgacccc

SEQ ID NO: 508125 - DNA, 25 bp, Homo sapien
tcagaatctggcctttttccatggc

SEQ ID NO: 508126 - DNA, 25 bp, Homo sapien
atctggcctttttccatggcaatga

SEQ ID NO: 508127 - DNA, 25 bp, Homo sapien
gcctttttccatggcaatgaggtgg

SEQ ID NO: 508128 - DNA, 25 bp, Homo sapien
cagcctcctctaaagtgactttgtt

SEQ ID NO: 508129 - DNA, 25 bp, Homo sapien
tctgcacagttgtaactgctcttgg

SEQ ID NO: 508130 - DNA, 25 bp, Homo sapien
cagcgtggcctttgatccagactta

SEQ ID NO: 508131 - DNA, 25 bp, Homo sapien
tggcctttgatccagacttagggac

SEQ ID NO: 508132 - DNA, 25 bp, Homo sapien
acttagggacgaggctgtcactggt

SEQ ID NO: 508133 - DNA, 25 bp, Homo sapien
tcactggtgggcaccctctgttcct

SEQ ID NO: 508134 - DNA, 25 bp, Homo sapien
gtttgtgtgtttgaatagtctgaaa

SEQ ID NO: 508135 - DNA, 25 bp, Homo sapien
tgaatagtctgaaatgctgtgactt

SEQ ID NO: 508136 - DNA, 25 bp, Homo sapien
gcccttttggtatgtgcgcatgtaa

SEQ ID NO: 508137 - DNA, 25 bp, Homo sapien
aaagtccagttttgcatacacagaa

SEQ ID NO: 508138 - DNA, 25 bp, Homo sapien
gcatacacagaaatttggtcatttt

SEQ ID NO: 508139 - DNA, 25 bp, Homo sapien
gaagtctcacaacctgaataatttg

SEQ ID NO: 508140 - DNA, 25 bp, Homo sapien
ctattagtcagttttttccttgtct

SEQ ID NO: 508141 - DNA, 25 bp, Homo sapien
ttttccttgtctgtcatattatgtt

SEQ ID NO: 508142 - DNA, 25 bp, Homo sapien
atgttggttaatgtctcttatggcc

SEQ ID NO: 508143 - DNA, 25 bp, Homo sapien
aatgtctcttatggccaatcttagt

SEQ ID NO: 508144 - DNA, 25 bp, Homo sapien
tggccaatcttagtaaacagaccta

SEQ ID NO: 508145 - DNA, 25 bp, Homo sapien
taaacagacctaacactcactgcat

SEQ ID NO: 508146 - DNA, 25 bp, Homo sapien
taacactcactgcatccttttgtgc

SEQ ID NO: 508147 - DNA, 25 bp, Homo sapien
tcatatggcgagagtggaaacgaga

SEQ ID NO: 508148 - DNA, 25 bp, Homo sapien
agagacatctaaactatatcacctt

SEQ ID NO: 508149 - DNA, 25 bp, Homo sapien
tctaaactatatcaccttaacatgt

SEQ ID NO: 508150 - DNA, 25 bp, Homo sapien
tcgtactgtttaggctgttggtgat

SEQ ID NO: 508151 - DNA, 25 bp, Homo sapien
ctgtttaggctgttggtgatactct

SEQ ID NO: 508152 - DNA, 25 bp, Homo sapien
aggctgttggtgatactcttgagaa

SEQ ID NO: 508153 - DNA, 25 bp, Homo sapien
gatactcttgagaagttgtaatgaa

SEQ ID NO: 508154 - DNA, 25 bp, Homo sapien
ggctggagctttcttattcttttcc

SEQ ID NO: 508155 - DNA, 25 bp, Homo sapien
gatctcacgagaacttactgttgtg

SEQ ID NO: 508156 - DNA, 25 bp, Homo sapien
cacgagaacttactgttgtgttgaa

SEQ ID NO: 508157 - DNA, 25 bp, Homo sapien
acttactgttgtgttgaaagcacca

SEQ ID NO: 508158 - DNA, 25 bp, Homo sapien
ttccttccaaaagtagactgtgagt

SEQ ID NO: 508159 - DNA, 25 bp, Homo sapien
gatgtttgtgtggtgtcctttgccc

SEQ ID NO: 508160 - DNA, 25 bp, Homo sapien
ttgcccccatttcttactgtagttt

SEQ ID NO: 508161 - DNA, 25 bp, Homo sapien
tttatggtataaaatcctcagtatt

SEQ ID NO: 508162 - DNA, 25 bp, Homo sapien
cccttttcagttcagcattcagagt

SEQ ID NO: 508163 - DNA, 25 bp, Homo sapien
tcagttcagcattcagagtgaggaa

SEQ ID NO: 508164 - DNA, 25 bp, Homo sapien
gtgagaacggaaccgtagcttccgc

SEQ ID NO: 508165 - DNA, 25 bp, Homo sapien
gaaccgtagcttccgccggcggact

SEQ ID NO: 508166 - DNA, 25 bp, Homo sapien
ccggcggacttgtgagcacgtcaga

SEQ ID NO: 508167 - DNA, 25 bp, Homo sapien
acttgtgagcacgtcagaaagcgaa

SEQ ID NO: 508168 - DNA, 25 bp, Homo sapien
gcacgtcagaaagcgaatgtgcctc

SEQ ID NO: 508169 - DNA, 25 bp, Homo sapien
agaacgtccaccaaccgcggatgca

SEQ ID NO: 508170 - DNA, 25 bp, Homo sapien
accaaccgcggatgcatgagcagca

SEQ ID NO: 508171 - DNA, 25 bp, Homo sapien
gaaactgctgagacatgggcctaca

SEQ ID NO: 508172 - DNA, 25 bp, Homo sapien
atgggcctacatggatgaacctcaa

SEQ ID NO: 508173 - DNA, 25 bp, Homo sapien
tgaacctcaaaaacgctaggccagg

SEQ ID NO: 508174 - DNA, 25 bp, Homo sapien
tctataattcagcatcccctaccat

SEQ ID NO: 508175 - DNA, 25 bp, Homo sapien
gccaggtgaaagatgccagacaaga

SEQ ID NO: 508176 - DNA, 25 bp, Homo sapien
ttccatttatgtgacacttcttaaa

SEQ ID NO: 508177 - DNA, 25 bp, Homo sapien
cccacccaagagaaatacgaccaga

SEQ ID NO: 508178 - DNA, 25 bp, Homo sapien
tacgaccagagagacttgcatgcaa

SEQ ID NO: 508179 - DNA, 25 bp, Homo sapien
gagacttgcatgcaaacattcctaa

SEQ ID NO: 508180 - DNA, 25 bp, Homo sapien
cagctgcttgtggaggatgtaatat

SEQ ID NO: 508181 - DNA, 25 bp, Homo sapien
ggcccacgcatcgacatgtgtgaat

SEQ ID NO: 508182 - DNA, 25 bp, Homo sapien
gtgaatttgcacaccactgcctgaa

SEQ ID NO: 508183 - DNA, 25 bp, Homo sapien
ttgcacaccactgcctgaattggag

SEQ ID NO: 508184 - DNA, 25 bp, Homo sapien
agagtgtccctctacccagagtttt

SEQ ID NO: 508185 - DNA, 25 bp, Homo sapien
aattagtctgagtgttcccagccat

SEQ ID NO: 508186 - DNA, 25 bp, Homo sapien
tgtgggccatttccctttcgcagtt

SEQ ID NO: 508187 - DNA, 25 bp, Homo sapien
gttctttcaataggcccagttcttc

SEQ ID NO: 508188 - DNA, 25 bp, Homo sapien
ataggcccagttcttccaaatggaa

SEQ ID NO: 508189 - DNA, 25 bp, Homo sapien
agaaaggtctggaagaggcccacag

SEQ ID NO: 508190 - DNA, 25 bp, Homo sapien
aggcccacagagttgcacaggcgtg

SEQ ID NO: 508191 - DNA, 25 bp, Homo sapien
aaatccccactgaaacacagctaaa

SEQ ID NO: 508192 - DNA, 25 bp, Homo sapien
acagttgttatgtcattggagggcg

SEQ ID NO: 508193 - DNA, 25 bp, Homo sapien
gttgttatgtcattggagggcgtcc

SEQ ID NO: 508194 - DNA, 25 bp, Homo sapien
tatgtcattggagggcgtccattaa

SEQ ID NO: 508195 - DNA, 25 bp, Homo sapien
tggagggcgtccattaatactgctc

SEQ ID NO: 508196 - DNA, 25 bp, Homo sapien
agggcgtccattaatactgctcgga

SEQ ID NO: 508197 - DNA, 25 bp, Homo sapien
ggcgtccattaatactgctcggaga

SEQ ID NO: 508198 - DNA, 25 bp, Homo sapien
gtccattaatactgctcggagaagc

SEQ ID NO: 508199 - DNA, 25 bp, Homo sapien
gatcttacacgaaaaacacggatgg

SEQ ID NO: 508200 - DNA, 25 bp, Homo sapien
cacggatgggatttcgttttcacct

SEQ ID NO: 508201 - DNA, 25 bp, Homo sapien
ttcaccttaaagcattaaagtgctt

SEQ ID NO: 508202 - DNA, 25 bp, Homo sapien
aggctttcgagaatggccgagcgtt

SEQ ID NO: 508203 - DNA, 25 bp, Homo sapien
tcatgacgtctcgagtgtcctcaag

SEQ ID NO: 508204 - DNA, 25 bp, Homo sapien
gagtgtcctcaagcgatttcttcag

SEQ ID NO: 508205 - DNA, 25 bp, Homo sapien
aagcgatttcttcaggagctcaccg

SEQ ID NO: 508206 - DNA, 25 bp, Homo sapien
ttcaggagctcaccgagcccgtgat

SEQ ID NO: 508207 - DNA, 25 bp, Homo sapien
gacgccttcatctctctggctaaga

SEQ ID NO: 508208 - DNA, 25 bp, Homo sapien
taagaccttgcatgcagaccctggg

SEQ ID NO: 508209 - DNA, 25 bp, Homo sapien
ttatccgctcgctgaagaccctctt

SEQ ID NO: 508210 - DNA, 25 bp, Homo sapien
tacagctgcctgactctaactacaa

SEQ ID NO: 508211 - DNA, 25 bp, Homo sapien
tgactctaactacaacaccctgcgg

SEQ ID NO: 508212 - DNA, 25 bp, Homo sapien
tgcggcacctggtggcccatctgtt

SEQ ID NO: 508213 - DNA, 25 bp, Homo sapien
aagccttggtggactagagcaacat

SEQ ID NO: 508214 - DNA, 25 bp, Homo sapien
tagagcaacatcgtgctgcccaaag

SEQ ID NO: 508215 - DNA, 25 bp, Homo sapien
tgctgcccaaaggactaacctatgc

SEQ ID NO: 508216 - DNA, 25 bp, Homo sapien
taacctatgcaaactagttcacatt

SEQ ID NO: 508217 - DNA, 25 bp, Homo sapien
gttcacattttagtggatgtcgcag

SEQ ID NO: 508218 - DNA, 25 bp, Homo sapien
gtggatgtcgcagttaatgtgtaat

SEQ ID NO: 508219 - DNA, 25 bp, Homo sapien
tttcccctgcataatgtacaacagc

SEQ ID NO: 508220 - DNA, 25 bp, Homo sapien
gaaatgacacattaagcctagcatc

SEQ ID NO: 508221 - DNA, 25 bp, Homo sapien
taagcctagcatcacattgtatagt

SEQ ID NO: 508222 - DNA, 25 bp, Homo sapien
agtcactcacaaacccttcaaggct

SEQ ID NO: 508223 - DNA, 25 bp, Homo sapien
cccttcaaggctaccctaatcatta

SEQ ID NO: 508224 - DNA, 25 bp, Homo sapien
aacagcaggccaagttcaggtccca

SEQ ID NO: 508225 - DNA, 25 bp, Homo sapien
aagttcaggtcccaagacaggccaa

SEQ ID NO: 508226 - DNA, 25 bp, Homo sapien
acaggccaaggccagtgcggtttcc

SEQ ID NO: 508227 - DNA, 25 bp, Homo sapien
ttccactgcctcagtttacctgtat

SEQ ID NO: 508228 - DNA, 25 bp, Homo sapien
gcctcagtttacctgtattcagaag

SEQ ID NO: 508229 - DNA, 25 bp, Homo sapien
ggaagagttgagcagagttccctct

SEQ ID NO: 508230 - DNA, 25 bp, Homo sapien
cagagttccctctaaaagagtaggg

SEQ ID NO: 508231 - DNA, 25 bp, Homo sapien
ggagctgataacagtcccaagccct

SEQ ID NO: 508232 - DNA, 25 bp, Homo sapien
ctcctctttctctatgccaaaatca

SEQ ID NO: 508233 - DNA, 25 bp, Homo sapien
gccaaaatcatttccgttatcctga

SEQ ID NO: 508234 - DNA, 25 bp, Homo sapien
atcatttccgttatcctgagatggg

SEQ ID NO: 508235 - DNA, 25 bp, Homo sapien
ataaaaggcacaccatccattgctg

SEQ ID NO: 508236 - DNA, 25 bp, Homo sapien
agatggcatttagttgtccagcaac

SEQ ID NO: 508237 - DNA, 25 bp, Homo sapien
gtccagcaactgaagatgtcgaaac

SEQ ID NO: 508238 - DNA, 25 bp, Homo sapien
atgaatccgtcactggatggagcca

SEQ ID NO: 508239 - DNA, 25 bp, Homo sapien
gagccaggtgacatccagcacagat

SEQ ID NO: 508240 - DNA, 25 bp, Homo sapien
cacagatgtgctggagctatgaaag

SEQ ID NO: 508241 - DNA, 25 bp, Homo sapien
agctatgaaagaggacaggtcccac

SEQ ID NO: 508242 - DNA, 25 bp, Homo sapien
tgccaggacacacaacctactgaga

SEQ ID NO: 508243 - DNA, 25 bp, Homo sapien
ctgagagaggcaggcgcctcgtcat

SEQ ID NO: 508244 - DNA, 25 bp, Homo sapien
atcccctgagcaccaggcagttgtg

SEQ ID NO: 508245 - DNA, 25 bp, Homo sapien
gagcaccaggcagttgtgtagacaa

SEQ ID NO: 508246 - DNA, 25 bp, Homo sapien
atgtggattgtcacttcatttggaa

SEQ ID NO: 508247 - DNA, 25 bp, Homo sapien
ttggaagcatctcaaatccccagca

SEQ ID NO: 508248 - DNA, 25 bp, Homo sapien
atccccagcattttgaatgcctaca

SEQ ID NO: 508249 - DNA, 25 bp, Homo sapien
gaatgcctacatgttgctcaaagga

SEQ ID NO: 508250 - DNA, 25 bp, Homo sapien
gatgctaaaatggtacgtagaacgc

SEQ ID NO: 508251 - DNA, 25 bp, Homo sapien
gtacgtagaacgcaaatattccaaa

SEQ ID NO: 508252 - DNA, 25 bp, Homo sapien
tccaaaatctgaggtctgaagcaac

SEQ ID NO: 508253 - DNA, 25 bp, Homo sapien
tggtgatcatggtgagttgctatct

SEQ ID NO: 508254 - DNA, 25 bp, Homo sapien
gttgctatctgaactcttctttcac

SEQ ID NO: 508255 - DNA, 25 bp, Homo sapien
tctttcacctcctttgggttcccag

SEQ ID NO: 508256 - DNA, 25 bp, Homo sapien
cagtgtcaaaaagagtggtgtcctt

SEQ ID NO: 508257 - DNA, 25 bp, Homo sapien
aagaggcattcgtaccagttattaa

SEQ ID NO: 508258 - DNA, 25 bp, Homo sapien
gtaccagttattaaactctgttttg

SEQ ID NO: 508259 - DNA, 25 bp, Homo sapien
gattagcactgcagacaattcctga

SEQ ID NO: 508260 - DNA, 25 bp, Homo sapien
aattcctgaagatttggatctacga

SEQ ID NO: 508261 - DNA, 25 bp, Homo sapien
ggatctacgagatgacagtctgcta

SEQ ID NO: 508262 - DNA, 25 bp, Homo sapien
gtcttaacggtatgagaaagcctac

SEQ ID NO: 508263 - DNA, 25 bp, Homo sapien
gagaaagcctacttccttttgtgta

SEQ ID NO: 508264 - DNA, 25 bp, Homo sapien
gcctacttccttttgtgtacttcag

SEQ ID NO: 508265 - DNA, 25 bp, Homo sapien
tgtgtacttcagtttttgtcagata

SEQ ID NO: 508266 - DNA, 25 bp, Homo sapien
tacacaagttttgtattgaagcttt

SEQ ID NO: 508267 - DNA, 25 bp, Homo sapien
agctatattgttaacacagtagtga

SEQ ID NO: 508268 - DNA, 25 bp, Homo sapien
caaagcccggatccaggcgggagca

SEQ ID NO: 508269 - DNA, 25 bp, Homo sapien
agtggcagtgccagcactggtgcca

SEQ ID NO: 508270 - DNA, 25 bp, Homo sapien
agtgccagcactggtgccagtacca

SEQ ID NO: 508271 - DNA, 25 bp, Homo sapien
tggtgccagtaccagtaccaataac

SEQ ID NO: 508272 - DNA, 25 bp, Homo sapien
gtaccaataacagtgccagtgccag

SEQ ID NO: 508273 - DNA, 25 bp, Homo sapien
ataacagtgccagtgccagtgccag

SEQ ID NO: 508274 - DNA, 25 bp, Homo sapien
tgaccgccactctcacatttgggct

SEQ ID NO: 508275 - DNA, 25 bp, Homo sapien
tcacatttgggctcttcgctggcct

SEQ ID NO: 508276 - DNA, 25 bp, Homo sapien
accagtggcagctctggtgcctgtg

SEQ ID NO: 508277 - DNA, 25 bp, Homo sapien
tgcctgtggtttctcctacaagtga

SEQ ID NO: 508278 - DNA, 25 bp, Homo sapien
ctgtggtttctcctacaagtgagat

SEQ ID NO: 508279 - DNA, 25 bp, Homo sapien
tttcctgtctaatgtcttgtatata

SEQ ID NO: 508280 - DNA, 25 bp, Homo sapien
gaagttgtccagaaacttgcgtctc

SEQ ID NO: 508281 - DNA, 25 bp, Homo sapien
gaaacttgcgtctctgattttggta

SEQ ID NO: 508282 - DNA, 25 bp, Homo sapien
aaaatcttcctgtcattcagctgtg

SEQ ID NO: 508283 - DNA, 25 bp, Homo sapien
attcagctgtgtaggaacgaatctc

SEQ ID NO: 508284 - DNA, 25 bp, Homo sapien
tccatctttagcctgcaaaacaaat

SEQ ID NO: 508285 - DNA, 25 bp, Homo sapien
tggtgggtggcctttgttcagtatt

SEQ ID NO: 508286 - DNA, 25 bp, Homo sapien
gttcagtattgatttcctgtgcact

SEQ ID NO: 508287 - DNA, 25 bp, Homo sapien
gtgcactgtaacctggcaactggat

SEQ ID NO: 508288 - DNA, 25 bp, Homo sapien
ttaatttttcttcctgtgttcagtt

SEQ ID NO: 508289 - DNA, 25 bp, Homo sapien
cttcctgtgttcagttagactttaa

SEQ ID NO: 508290 - DNA, 25 bp, Homo sapien
ggtagtgctcaggaccaaaagcgat

SEQ ID NO: 508291 - DNA, 25 bp, Homo sapien
ccacgcgtccggaagttatactttg

SEQ ID NO: 508292 - DNA, 25 bp, Homo sapien
gcatacagagatagcctgactggct

SEQ ID NO: 508293 - DNA, 25 bp, Homo sapien
tgactggctgcagtctggcgtctgc

SEQ ID NO: 508294 - DNA, 25 bp, Homo sapien
tggcgtctgccttctttggacatgt

SEQ ID NO: 508295 - DNA, 25 bp, Homo sapien
tttggacatgttttggcagccttca

SEQ ID NO: 508296 - DNA, 25 bp, Homo sapien
ttggcagccttcagcctatggttgg

SEQ ID NO: 508297 - DNA, 25 bp, Homo sapien
ctatggttggctgagatctgactac

SEQ ID NO: 508298 - DNA, 25 bp, Homo sapien
ggctgagatctgactacttgttaca

SEQ ID NO: 508299 - DNA, 25 bp, Homo sapien
gttatactttggatcctacttctga

SEQ ID NO: 508300 - DNA, 25 bp, Homo sapien
atcctacttctgacaccagtttgtt

SEQ ID NO: 508301 - DNA, 25 bp, Homo sapien
tcccaacccggttctggcaaagaat

SEQ ID NO: 508302 - DNA, 25 bp, Homo sapien
ccttccatgaagacgcacataactc

SEQ ID NO: 508303 - DNA, 25 bp, Homo sapien
gacgcacataactctcttacttggt

SEQ ID NO: 508304 - DNA, 25 bp, Homo sapien
ataactctcttacttggtctttcca

SEQ ID NO: 508305 - DNA, 25 bp, Homo sapien
ttacttggtctttccattagggaca

SEQ ID NO: 508306 - DNA, 25 bp, Homo sapien
ggtctttccattagggacaacataa

SEQ ID NO: 508307 - DNA, 25 bp, Homo sapien
gggacaacataagtcttgttttaca

SEQ ID NO: 508308 - DNA, 25 bp, Homo sapien
ggaagtctactagtttacataccta

SEQ ID NO: 508309 - DNA, 25 bp, Homo sapien
ttacatacctacttcagaggacatg

SEQ ID NO: 508310 - DNA, 25 bp, Homo sapien
atggaaatgaccatgggcctgcatt

SEQ ID NO: 508311 - DNA, 25 bp, Homo sapien
agatgccacattgaacaaactaaat

SEQ ID NO: 508312 - DNA, 25 bp, Homo sapien
tgtgctgggacagaatgggatgcca

SEQ ID NO: 508313 - DNA, 25 bp, Homo sapien
ccttcctatctaagggagggctgaa

SEQ ID NO: 508314 - DNA, 25 bp, Homo sapien
ctatctaagggagggctgaagacaa

SEQ ID NO: 508315 - DNA, 25 bp, Homo sapien
gggccggcattcagtgggcagcaga

SEQ ID NO: 508316 - DNA, 25 bp, Homo sapien
tccttttgccttccgcaggactgaa

SEQ ID NO: 508317 - DNA, 25 bp, Homo sapien
ttttgccttccgcaggactgaagac

SEQ ID NO: 508318 - DNA, 25 bp, Homo sapien
ccttccgcaggactgaagacctgaa

SEQ ID NO: 508319 - DNA, 25 bp, Homo sapien
gcttttggagtgttgaggtgaatat

SEQ ID NO: 508320 - DNA, 25 bp, Homo sapien
tctgggagcagagatcatgaatagc

SEQ ID NO: 508321 - DNA, 25 bp, Homo sapien
tcatgaatagctcagggcagtgaat

SEQ ID NO: 508322 - DNA, 25 bp, Homo sapien
gcagtgaatggcgcaccaagagcag

SEQ ID NO: 508323 - DNA, 25 bp, Homo sapien
atgaaatgtgcccaaaatgaaaagt

SEQ ID NO: 508324 - DNA, 25 bp, Homo sapien
tcttcacactaagaggcagaaagtg

SEQ ID NO: 508325 - DNA, 25 bp, Homo sapien
gcagaaagtggtttcacacaccctt

SEQ ID NO: 508326 - DNA, 25 bp, Homo sapien
tcacacacccttttatttaatcagc

SEQ ID NO: 508327 - DNA, 25 bp, Homo sapien
tttaatcagctaaagtgggtgcggt

SEQ ID NO: 508328 - DNA, 25 bp, Homo sapien
aaagtgggtgcggtgacacacacct

SEQ ID NO: 508329 - DNA, 25 bp, Homo sapien
acacctgtaaactcaaccactaagg

SEQ ID NO: 508330 - DNA, 25 bp, Homo sapien
taaactcaaccactaaggagactga

SEQ ID NO: 508331 - DNA, 25 bp, Homo sapien
gaaaagtaacttgagtatcccaagt

SEQ ID NO: 508332 - DNA, 25 bp, Homo sapien
agttaaacttaatcattagctgcaa

SEQ ID NO: 508333 - DNA, 25 bp, Homo sapien
ttagctgcaaatggacgattttcaa

SEQ ID NO: 508334 - DNA, 25 bp, Homo sapien
gaagaggcattcgtaccagttatta

SEQ ID NO: 508335 - DNA, 25 bp, Homo sapien
gaggcattcgtaccagttattaaac

SEQ ID NO: 508336 - DNA, 25 bp, Homo sapien
ggcattcgtaccagttattaaactc

SEQ ID NO: 508337 - DNA, 25 bp, Homo sapien
gtaccagttattaaactctgttttg

SEQ ID NO: 508338 - DNA, 25 bp, Homo sapien
gattagcactgcagacaattcctga

SEQ ID NO: 508339 - DNA, 25 bp, Homo sapien
ttagcactgcagacaattcctgaag

SEQ ID NO: 508340 - DNA, 25 bp, Homo sapien
gcactgcagacaattcctgaagatt

SEQ ID NO: 508341 - DNA, 25 bp, Homo sapien
attcctgaagatttggatctacgag

SEQ ID NO: 508342 - DNA, 25 bp, Homo sapien
ggatctacgagatgacagtctgcta

SEQ ID NO: 508343 - DNA, 25 bp, Homo sapien
atctacgagatgacagtctgctaaa

SEQ ID NO: 508344 - DNA, 25 bp, Homo sapien
cgagatgacagtctgctaaaaaatt

SEQ ID NO: 508345 - DNA, 25 bp, Homo sapien
gaggaccatatttgcgtgtttccaa

SEQ ID NO: 508346 - DNA, 25 bp, Homo sapien
gggttctgcgtcctatcaaggagat

SEQ ID NO: 508347 - DNA, 25 bp, Homo sapien
taaactactgactacactaccgatg

SEQ ID NO: 508348 - DNA, 25 bp, Homo sapien
acactaccgatgatgctggcttttt

SEQ ID NO: 508349 - DNA, 25 bp, Homo sapien
ggctttttgctccattgccttttca

SEQ ID NO: 508350 - DNA, 25 bp, Homo sapien
attgccttttcaagtcttcaacgta

SEQ ID NO: 508351 - DNA, 25 bp, Homo sapien
aaagagcaatcgcagttcggtttca

SEQ ID NO: 508352 - DNA, 25 bp, Homo sapien
cgcagttcggtttcacatgtattgt

SEQ ID NO: 508353 - DNA, 25 bp, Homo sapien
acatgtattgttctataatccaggc

SEQ ID NO: 508354 - DNA, 25 bp, Homo sapien
ttagtaatgctcaaggatccgacca

SEQ ID NO: 508355 - DNA, 25 bp, Homo sapien
ggatccgaccattcagagtaattat

SEQ ID NO: 508356 - DNA, 25 bp, Homo sapien
ttcctgatcttgtgacattctgtgc

SEQ ID NO: 508357 - DNA, 25 bp, Homo sapien
atcttgtgacattctgtgctgtgct

SEQ ID NO: 508358 - DNA, 25 bp, Homo sapien
ttacatggaacagctctttcctctc

SEQ ID NO: 508359 - DNA, 25 bp, Homo sapien
aatcctgtaacagacacaaccacat

SEQ ID NO: 508360 - DNA, 25 bp, Homo sapien
tacacagtttccacataccacttgg

SEQ ID NO: 508361 - DNA, 25 bp, Homo sapien
cacttggaattgctggttatgctgc

SEQ ID NO: 508362 - DNA, 25 bp, Homo sapien
ttatgctgcaatgagagaatgtctt

SEQ ID NO: 508363 - DNA, 25 bp, Homo sapien
tttaaattgtaagcttcatgagggc

SEQ ID NO: 508364 - DNA, 25 bp, Homo sapien
tctcctcacagtgccttgagcagta

SEQ ID NO: 508365 - DNA, 25 bp, Homo sapien
gccttgagcagtacgttgtctggaa

SEQ ID NO: 508366 - DNA, 25 bp, Homo sapien
cgttgtctggaatgtcagaaccaat

SEQ ID NO: 508367 - DNA, 25 bp, Homo sapien
gtattattcagatggtttgtgagca

SEQ ID NO: 508368 - DNA, 25 bp, Homo sapien
gtttgtgagcatttagagtacctaa

SEQ ID NO: 508369 - DNA, 25 bp, Homo sapien
gtacctaaagagcaaatcatggatt

SEQ ID NO: 508370 - DNA, 25 bp, Homo sapien
gagagactagaagcattctgcagca

SEQ ID NO: 508371 - DNA, 25 bp, Homo sapien
gaagcattctgcagcaataagtgga

SEQ ID NO: 508372 - DNA, 25 bp, Homo sapien
gatcagtgtggaattctgggaagca

SEQ ID NO: 508373 - DNA, 25 bp, Homo sapien
gggcaaatggttgatgaatctaaca

SEQ ID NO: 508374 - DNA, 25 bp, Homo sapien
ggttgatgaatctaacagggtgata

SEQ ID NO: 508375 - DNA, 25 bp, Homo sapien
aattctgggaagcaggagcaagtta

SEQ ID NO: 508376 - DNA, 25 bp, Homo sapien
taaagggaaacgtgtgctgtaaatt

SEQ ID NO: 508377 - DNA, 25 bp, Homo sapien
acgtgtgctgtaaattatagactga

SEQ ID NO: 508378 - DNA, 25 bp, Homo sapien
aatgtactgggcattgtcctggtca

SEQ ID NO: 508379 - DNA, 25 bp, Homo sapien
cattgtcctggtcacccagacacaa

SEQ ID NO: 508380 - DNA, 25 bp, Homo sapien
attgtcctggtcacccagacacaaa

SEQ ID NO: 508381 - DNA, 25 bp, Homo sapien
ttgtcctggtcacccagacacaaag

SEQ ID NO: 508382 - DNA, 25 bp, Homo sapien
gtcctggtcacccagacacaaagat

SEQ ID NO: 508383 - DNA, 25 bp, Homo sapien
tcctggtcacccagacacaaagatg

SEQ ID NO: 508384 - DNA, 25 bp, Homo sapien
cctggtcacccagacacaaagatgg

SEQ ID NO: 508385 - DNA, 25 bp, Homo sapien
ctggtcacccagacacaaagatggg

SEQ ID NO: 508386 - DNA, 25 bp, Homo sapien
tggtcacccagacacaaagatgggt

SEQ ID NO: 508387 - DNA, 25 bp, Homo sapien
ggtcacccagacacaaagatgggta

SEQ ID NO: 508388 - DNA, 25 bp, Homo sapien
gtcacccagacacaaagatgggtaa

SEQ ID NO: 508389 - DNA, 25 bp, Homo sapien
gagctaagacaatttaaggactact

SEQ ID NO: 508390 - DNA, 25 bp, Homo sapien
gaatccactgtgttgaagactcttg

SEQ ID NO: 508391 - DNA, 25 bp, Homo sapien
gaagactcttgatatcatgtgcttg

SEQ ID NO: 508392 - DNA, 25 bp, Homo sapien
gatatcatgtgcttgtctaaccatt

SEQ ID NO: 508393 - DNA, 25 bp, Homo sapien
atgtgcttgtctaaccattttttgt

SEQ ID NO: 508394 - DNA, 25 bp, Homo sapien
tatagttgtgataatggtcatcgaa

SEQ ID NO: 508395 - DNA, 25 bp, Homo sapien
atggtcatcgaatggatttgtttgg

SEQ ID NO: 508396 - DNA, 25 bp, Homo sapien
acttctcatgtctttggtgctttgg

SEQ ID NO: 508397 - DNA, 25 bp, Homo sapien
gctttggccctaatagcactggaca

SEQ ID NO: 508398 - DNA, 25 bp, Homo sapien
ggccctaatagcactggacaacacc

SEQ ID NO: 508399 - DNA, 25 bp, Homo sapien
tggacaacaccacgaccacatggaa

SEQ ID NO: 508400 - DNA, 25 bp, Homo sapien
aaaggttttaagtctgttgcctgat

SEQ ID NO: 508401 - DNA, 25 bp, Homo sapien
taaaattgccaacttttgggagatt

SEQ ID NO: 508402 - DNA, 25 bp, Homo sapien
ttgccaacttttgggagatttcaca

SEQ ID NO: 508403 - DNA, 25 bp, Homo sapien
gatttcacatattttacctctatat

SEQ ID NO: 508404 - DNA, 25 bp, Homo sapien
ttttatttttccaggattggtatgg

SEQ ID NO: 508405 - DNA, 25 bp, Homo sapien
atttttccaggattggtatggagga

SEQ ID NO: 508406 - DNA, 25 bp, Homo sapien
atggaggagtagtaccttctattct

SEQ ID NO: 508407 - DNA, 25 bp, Homo sapien
gaggagtagtaccttctattcttgg

SEQ ID NO: 508408 - DNA, 25 bp, Homo sapien
gagtagtaccttctattcttggttt

SEQ ID NO: 508409 - DNA, 25 bp, Homo sapien
tagtaccttctattcttggtttatt

SEQ ID NO: 508410 - DNA, 25 bp, Homo sapien
tgagggtactggtaggtaacacact

SEQ ID NO: 508411 - DNA, 25 bp, Homo sapien
gaccgaagtccttttcgtcgttgag

SEQ ID NO: 508412 - DNA, 25 bp, Homo sapien
gggctatggactatgactctcaata

SEQ ID NO: 508413 - DNA, 25 bp, Homo sapien
gctatggactatgactctcaataat

SEQ ID NO: 508414 - DNA, 25 bp, Homo sapien
ggactatgactctcaataatttctt

SEQ ID NO: 508415 - DNA, 25 bp, Homo sapien
atgactctcaataatttctttcagc

SEQ ID NO: 508416 - DNA, 25 bp, Homo sapien
ttcagctcttaggaggtcgggctcg

SEQ ID NO: 508417 - DNA, 25 bp, Homo sapien
cgggcgggcggactagcggcgacga

SEQ ID NO: 508418 - DNA, 25 bp, Homo sapien
atcggagggtggttcgtgtcgcgca

SEQ ID NO: 508419 - DNA, 25 bp, Homo sapien
tcgtgtcgcgcaacggcagacggta

SEQ ID NO: 508420 - DNA, 25 bp, Homo sapien
aacggcagacggtatgggctgtcgc

SEQ ID NO: 508421 - DNA, 25 bp, Homo sapien
gacggtatgggctgtcgccggcaga

SEQ ID NO: 508422 - DNA, 25 bp, Homo sapien
ttttgccaatgtgatcacccaaact

SEQ ID NO: 508423 - DNA, 25 bp, Homo sapien
gatcacccaaactattgtcttaaat

SEQ ID NO: 508424 - DNA, 25 bp, Homo sapien
ttaaattgtatctcttttgtttttg

SEQ ID NO: 508425 - DNA, 25 bp, Homo sapien
tttgagtttggtcattttttcatgt

SEQ ID NO: 508426 - DNA, 25 bp, Homo sapien
ttcatgtttattagccatctgtatt

SEQ ID NO: 508427 - DNA, 25 bp, Homo sapien
tttcttctttatgtccaattttgtg

SEQ ID NO: 508428 - DNA, 25 bp, Homo sapien
ttatgtccaattttgtgggtgggag

SEQ ID NO: 508429 - DNA, 25 bp, Homo sapien
gtgggaggaggatttagtctcttcc

SEQ ID NO: 508430 - DNA, 25 bp, Homo sapien
ggaggatttagtctcttcctgattt

SEQ ID NO: 508431 - DNA, 25 bp, Homo sapien
gaatgagattgccagctttcctaca

SEQ ID NO: 508432 - DNA, 25 bp, Homo sapien
gagattgccagctttcctacagcct

SEQ ID NO: 508433 - DNA, 25 bp, Homo sapien
ttgacacatatattttttcccttac

SEQ ID NO: 508434 - DNA, 25 bp, Homo sapien
ggaaactagggtttggaatgcccag

SEQ ID NO: 508435 - DNA, 25 bp, Homo sapien
ctagggtttggaatgcccagataac

SEQ ID NO: 508436 - DNA, 25 bp, Homo sapien
gtttggaatgcccagataacatata

SEQ ID NO: 508437 - DNA, 25 bp, Homo sapien
gaatgcccagataacatatatacat

SEQ ID NO: 508438 - DNA, 25 bp, Homo sapien
caccaactgcacttctgattatgag

SEQ ID NO: 508439 - DNA, 25 bp, Homo sapien
atatgaatacttgtagacttttaaa

SEQ ID NO: 508440 - DNA, 25 bp, Homo sapien
aattagaaagctttatttcatcatt

SEQ ID NO: 508441 - DNA, 25 bp, Homo sapien
gtgcaagatatcttgaaggtcttga

SEQ ID NO: 508442 - DNA, 25 bp, Homo sapien
aactgtgttggatttgattgtagaa

SEQ ID NO: 508443 - DNA, 25 bp, Homo sapien
agacttgcaaaggtattttcatttt

SEQ ID NO: 508444 - DNA, 25 bp, Homo sapien
taagcacagtagcattccaccattg

SEQ ID NO: 508445 - DNA, 25 bp, Homo sapien
gtagcattccaccattgggctatga

SEQ ID NO: 508446 - DNA, 25 bp, Homo sapien
cattgggctatgacctgaggagaat

SEQ ID NO: 508447 - DNA, 25 bp, Homo sapien
aggaatgctctcgtaggagggtaca

SEQ ID NO: 508448 - DNA, 25 bp, Homo sapien
gctctcgtaggagggtacaagaacc

SEQ ID NO: 508449 - DNA, 25 bp, Homo sapien
ggtcaggatgaccataactggagaa

SEQ ID NO: 508450 - DNA, 25 bp, Homo sapien
ggagaagtgagttgtatgcccaaac

SEQ ID NO: 508451 - DNA, 25 bp, Homo sapien
gttgtatgcccaaacagtctctgaa

SEQ ID NO: 508452 - DNA, 25 bp, Homo sapien
agtctctgaacggttacaggcccat

SEQ ID NO: 508453 - DNA, 25 bp, Homo sapien
tgaacggttacaggcccatggaaag

SEQ ID NO: 508454 - DNA, 25 bp, Homo sapien
gatcatctgttaccctgggactggg

SEQ ID NO: 508455 - DNA, 25 bp, Homo sapien
aatatttaacatttttgccaatgtg

SEQ ID NO: 508456 - DNA, 25 bp, Homo sapien
tttttgccaatgtgatcacccaaac

SEQ ID NO: 508457 - DNA, 25 bp, Homo sapien
tttgccaatgtgatcacccaaacta

SEQ ID NO: 508458 - DNA, 25 bp, Homo sapien
tgccaatgtgatcacccaaactatt

SEQ ID NO: 508459 - DNA, 25 bp, Homo sapien
ttaaattgtatctcttttgtttttg

SEQ ID NO: 508460 - DNA, 25 bp, Homo sapien
ctttatcttcaaatggcaatgaatg

SEQ ID NO: 508461 - DNA, 25 bp, Homo sapien
aatgaatgagattgccagctttcct

SEQ ID NO: 508462 - DNA, 25 bp, Homo sapien
gaatgagattgccagctttcctaca

SEQ ID NO: 508463 - DNA, 25 bp, Homo sapien
aatgagattgccagctttcctacag

SEQ ID NO: 508464 - DNA, 25 bp, Homo sapien
tgagattgccagctttcctacagcc

SEQ ID NO: 508465 - DNA, 25 bp, Homo sapien
agattgccagctttcctacagcctc

SEQ ID NO: 508466 - DNA, 25 bp, Homo sapien
ttttcattagcagagaccacgactg

SEQ ID NO: 508467 - DNA, 25 bp, Homo sapien
gagaccacgactgtatcactcattg

SEQ ID NO: 508468 - DNA, 25 bp, Homo sapien
atcactcattgctttgaacactctc

SEQ ID NO: 508469 - DNA, 25 bp, Homo sapien
gatctcattgactcagatgagctgc

SEQ ID NO: 508470 - DNA, 25 bp, Homo sapien
ggcctgtaagaactggtgagtgctg

SEQ ID NO: 508471 - DNA, 25 bp, Homo sapien
gtgactggagcctgccatgctgcct

SEQ ID NO: 508472 - DNA, 25 bp, Homo sapien
atgctgcctccagtggcttcatgct

SEQ ID NO: 508473 - DNA, 25 bp, Homo sapien
tgcctccagtggcttcatgctgaag

SEQ ID NO: 508474 - DNA, 25 bp, Homo sapien
gcggtgctgtactatttttagaaca

SEQ ID NO: 508475 - DNA, 25 bp, Homo sapien
gtgctgtactatttttagaacatac

SEQ ID NO: 508476 - DNA, 25 bp, Homo sapien
aacatacattttccaggctgggcaa

SEQ ID NO: 508477 - DNA, 25 bp, Homo sapien
taatgactggtcttccttacctgga

SEQ ID NO: 508478 - DNA, 25 bp, Homo sapien
gttagttttagaattacaccacaag

SEQ ID NO: 508479 - DNA, 25 bp, Homo sapien
tggaacttacaaagggtctatcttg

SEQ ID NO: 508480 - DNA, 25 bp, Homo sapien
atattgttttgcattgtctgttggc

SEQ ID NO: 508481 - DNA, 25 bp, Homo sapien
ctgttggcaaatttgtgaactgtca

SEQ ID NO: 508482 - DNA, 25 bp, Homo sapien
gaactgtcatgatacgcttaaggtg

SEQ ID NO: 508483 - DNA, 25 bp, Homo sapien
aaggtggaaagtgttcattgcacaa

SEQ ID NO: 508484 - DNA, 25 bp, Homo sapien
atatatttttactgctttctgaatg

SEQ ID NO: 508485 - DNA, 25 bp, Homo sapien
tactgctttctgaatgtagacggaa

SEQ ID NO: 508486 - DNA, 25 bp, Homo sapien
gcttttttaactcatccgtttgcca

SEQ ID NO: 508487 - DNA, 25 bp, Homo sapien
taactcatccgtttgccaatcattg

SEQ ID NO: 508488 - DNA, 25 bp, Homo sapien
tttcctgagttgaaacttctcctgt

SEQ ID NO: 508489 - DNA, 25 bp, Homo sapien
aaacttctcctgtggttactggtat

SEQ ID NO: 508490 - DNA, 25 bp, Homo sapien
gtattgagaaatcagctaccaaagt

SEQ ID NO: 508491 - DNA, 25 bp, Homo sapien
gatcaattcttttctagtcagttct

SEQ ID NO: 508492 - DNA, 25 bp, Homo sapien
tagtcagttctaagactgctagaga

SEQ ID NO: 508493 - DNA, 25 bp, Homo sapien
tgctagagagagataccaggccctt

SEQ ID NO: 508494 - DNA, 25 bp, Homo sapien
agagagataccaggcccttagcctt

SEQ ID NO: 508495 - DNA, 25 bp, Homo sapien
ttagccttgctctcagtagcgtcag

SEQ ID NO: 508496 - DNA, 25 bp, Homo sapien
tccccacattacacttaacaagcag

SEQ ID NO: 508497 - DNA, 25 bp, Homo sapien
gagtgagcactttgggtccttagac

SEQ ID NO: 508498 - DNA, 25 bp, Homo sapien
ttgggtccttagactcatgtctggg

SEQ ID NO: 508499 - DNA, 25 bp, Homo sapien
ttttcattagcagagaccacgactg

SEQ ID NO: 508500 - DNA, 25 bp, Homo sapien
tcattagcagagaccacgactgtat

SEQ ID NO: 508501 - DNA, 25 bp, Homo sapien
attagcagagaccacgactgtatca

SEQ ID NO: 508502 - DNA, 25 bp, Homo sapien
tagcagagaccacgactgtatcact

SEQ ID NO: 508503 - DNA, 25 bp, Homo sapien
gcagagaccacgactgtatcactca

SEQ ID NO: 508504 - DNA, 25 bp, Homo sapien
agagaccacgactgtatcactcatt

SEQ ID NO: 508505 - DNA, 25 bp, Homo sapien
gagaccacgactgtatcactcattg

SEQ ID NO: 508506 - DNA, 25 bp, Homo sapien
agaccacgactgtatcactcattgc

SEQ ID NO: 508507 - DNA, 25 bp, Homo sapien
gaccacgactgtatcactcattgct

SEQ ID NO: 508508 - DNA, 25 bp, Homo sapien
atcactcattgctttgaacactctc

SEQ ID NO: 508509 - DNA, 25 bp, Homo sapien
tcactcattgctttgaacactctcc

SEQ ID NO: 508510 - DNA, 25 bp, Homo sapien
gagccaaggccacccagttgccttt

SEQ ID NO: 508511 - DNA, 25 bp, Homo sapien
ttgcctttttgcctttggtaacata

SEQ ID NO: 508512 - DNA, 25 bp, Homo sapien
ttgcctttggtaacataactctggg

SEQ ID NO: 508513 - DNA, 25 bp, Homo sapien
aactctgggagtcttggtttatcct

SEQ ID NO: 508514 - DNA, 25 bp, Homo sapien
ggagtcttggtttatcctgtgtgtc

SEQ ID NO: 508515 - DNA, 25 bp, Homo sapien
ttatcctgtgtgtcagagagtgggc

SEQ ID NO: 508516 - DNA, 25 bp, Homo sapien
taacggcctgaaggttactgaggaa

SEQ ID NO: 508517 - DNA, 25 bp, Homo sapien
gaagcactggatgggagactgaaat

SEQ ID NO: 508518 - DNA, 25 bp, Homo sapien
gaaatggacagtctcggagcctgtt

SEQ ID NO: 508519 - DNA, 25 bp, Homo sapien
gtctcggagcctgttaatcagctga

SEQ ID NO: 508520 - DNA, 25 bp, Homo sapien
aatcagctgatcaccttacacattt

SEQ ID NO: 508521 - DNA, 25 bp, Homo sapien
tgtgaagaaccggaccctccaaatc

SEQ ID NO: 508522 - DNA, 25 bp, Homo sapien
tgaagaaccggaccctccaaatctt

SEQ ID NO: 508523 - DNA, 25 bp, Homo sapien
agtcaaagcttgaaacgagttttat

SEQ ID NO: 508524 - DNA, 25 bp, Homo sapien
gcttgaaacgagttttatgaccacc

SEQ ID NO: 508525 - DNA, 25 bp, Homo sapien
ttatgaccaccatgaaaaacttgtc

SEQ ID NO: 508526 - DNA, 25 bp, Homo sapien
tttgcaaatggaatctgtaagagga

SEQ ID NO: 508527 - DNA, 25 bp, Homo sapien
atgaaaaacttgtcaccggcatatg

SEQ ID NO: 508528 - DNA, 25 bp, Homo sapien
acttgtcaccggcatatgtgaaaga

SEQ ID NO: 508529 - DNA, 25 bp, Homo sapien
tgtgaaagatcagcctagtccaccc

SEQ ID NO: 508530 - DNA, 25 bp, Homo sapien
ctagtccaccctcaagttttgacaa

SEQ ID NO: 508531 - DNA, 25 bp, Homo sapien
gtccaccctcaagttttgacaagaa

SEQ ID NO: 508532 - DNA, 25 bp, Homo sapien
gaagcatgtctaggcataatatatc

SEQ ID NO: 508533 - DNA, 25 bp, Homo sapien
atcagccttttgagatatttattaa

SEQ ID NO: 508534 - DNA, 25 bp, Homo sapien
tgtttgtgaacaaggtgcccattat

SEQ ID NO: 508535 - DNA, 25 bp, Homo sapien
taaaaacttgttcttatacactatt

SEQ ID NO: 508536 - DNA, 25 bp, Homo sapien
tgtgaacaaggtgcccattattccc

SEQ ID NO: 508537 - DNA, 25 bp, Homo sapien
ctaaagtgacacataccttaattta

SEQ ID NO: 508538 - DNA, 25 bp, Homo sapien
taccttaatttaagtgcctaagatt

SEQ ID NO: 508539 - DNA, 25 bp, Homo sapien
accacatgccatccaaagagatcga

SEQ ID NO: 508540 - DNA, 25 bp, Homo sapien
atgccatccaaagagatcgaggtta

SEQ ID NO: 508541 - DNA, 25 bp, Homo sapien
gaggttaaaagaatcagacacacta

SEQ ID NO: 508542 - DNA, 25 bp, Homo sapien
aacacagtggaagcatgtctaggca

SEQ ID NO: 508543 - DNA, 25 bp, Homo sapien
aaggctgcatggagtccccagggat

SEQ ID NO: 508544 - DNA, 25 bp, Homo sapien
ggtcaccaaggctccctgggaaggt

SEQ ID NO: 508545 - DNA, 25 bp, Homo sapien
cctgggaaggtctcttgtacctggg

SEQ ID NO: 508546 - DNA, 25 bp, Homo sapien
gggcacacagaccaacacttctgaa

SEQ ID NO: 508547 - DNA, 25 bp, Homo sapien
gtatgagcagaacctgtgcagacca

SEQ ID NO: 508548 - DNA, 25 bp, Homo sapien
gcagaccaaggcttagagggctcac

SEQ ID NO: 508549 - DNA, 25 bp, Homo sapien
gagggctcacctcaatgttttgcac

SEQ ID NO: 508550 - DNA, 25 bp, Homo sapien
tgttttgcactgtgtgagaccccag

SEQ ID NO: 508551 - DNA, 25 bp, Homo sapien
gagaccccaggaccttttcgtgatt

SEQ ID NO: 508552 - DNA, 25 bp, Homo sapien
aggaccttttcgtgattctggagag

SEQ ID NO: 508553 - DNA, 25 bp, Homo sapien
gagactcattctcatctattttggt

SEQ ID NO: 508554 - DNA, 25 bp, Homo sapien
aaatgtcagtgtttcaccaaagtat

SEQ ID NO: 508555 - DNA, 25 bp, Homo sapien
ttccattgtattaagagtccagtca

SEQ ID NO: 508556 - DNA, 25 bp, Homo sapien
tgtattaagagtccagtcactgtat

SEQ ID NO: 508557 - DNA, 25 bp, Homo sapien
gagtccagtcactgtatatggaagt

SEQ ID NO: 508558 - DNA, 25 bp, Homo sapien
tttttatatcacttgagtccactag

SEQ ID NO: 508559 - DNA, 25 bp, Homo sapien
gagtccactagtagtacttccttgc

SEQ ID NO: 508560 - DNA, 25 bp, Homo sapien
ctagtagtacttccttgctctgttt

SEQ ID NO: 508561 - DNA, 25 bp, Homo sapien
ccttgctctgtttgacttgtcagat

SEQ ID NO: 508562 - DNA, 25 bp, Homo sapien
aattgtgatacgcatggctgttgat

SEQ ID NO: 508563 - DNA, 25 bp, Homo sapien
catggctgttgatggagtggaacat

SEQ ID NO: 508564 - DNA, 25 bp, Homo sapien
gtaaaccaattactttagcacaaca

SEQ ID NO: 508565 - DNA, 25 bp, Homo sapien
gtagaactagataggcctgctcatt

SEQ ID NO: 508566 - DNA, 25 bp, Homo sapien
ataggcctgctcattagaatatcaa

SEQ ID NO: 508567 - DNA, 25 bp, Homo sapien
tagaatatcaagatggctccagctt

SEQ ID NO: 508568 - DNA, 25 bp, Homo sapien
agatggctccagcttgacttttctt

SEQ ID NO: 508569 - DNA, 25 bp, Homo sapien
tttctttcctaatttatatgtacta

SEQ ID NO: 508570 - DNA, 25 bp, Homo sapien
aatcattttgaccagctattatgtg

SEQ ID NO: 508571 - DNA, 25 bp, Homo sapien
gaaagatttactgggtgtatgatgc

SEQ ID NO: 508572 - DNA, 25 bp, Homo sapien
gtatgatgcggttacttttaagtta

SEQ ID NO: 508573 - DNA, 25 bp, Homo sapien
ttaagttatttctactggccagttg

SEQ ID NO: 508574 - DNA, 25 bp, Homo sapien
atttctactggccagttggagcaat

SEQ ID NO: 508575 - DNA, 25 bp, Homo sapien
actggccagttggagcaatatatat

SEQ ID NO: 508576 - DNA, 25 bp, Homo sapien
ttgggtggtaaaattgtgatacgca

SEQ ID NO: 508577 - DNA, 25 bp, Homo sapien
aattgtgatacgcatggctgttgat

SEQ ID NO: 508578 - DNA, 25 bp, Homo sapien
tgtgatacgcatggctgttgatgga

SEQ ID NO: 508579 - DNA, 25 bp, Homo sapien
catggctgttgatggagtggaacat

SEQ ID NO: 508580 - DNA, 25 bp, Homo sapien
tgatggagtggaacatcttagtgat

SEQ ID NO: 508581 - DNA, 25 bp, Homo sapien
catcttagtgatgtgagaaaggtca

SEQ ID NO: 508582 - DNA, 25 bp, Homo sapien
gtgagaaaggtcattttagttataa

SEQ ID NO: 508583 - DNA, 25 bp, Homo sapien
aatgtaaaccaattactttagcaca

SEQ ID NO: 508584 - DNA, 25 bp, Homo sapien
gtaaaccaattactttagcacaaca

SEQ ID NO: 508585 - DNA, 25 bp, Homo sapien
aaccaattactttagcacaacaata

SEQ ID NO: 508586 - DNA, 25 bp, Homo sapien
ttagcacaacaataaagatgttctg

SEQ ID NO: 508587 - DNA, 25 bp, Homo sapien
ttggattagatgagtccaagctgcc

SEQ ID NO: 508588 - DNA, 25 bp, Homo sapien
ggcatcccaaatgtgatcggcatgt

SEQ ID NO: 508589 - DNA, 25 bp, Homo sapien
ataagcctcgaatgaatgagctgga

SEQ ID NO: 508590 - DNA, 25 bp, Homo sapien
ttgaaagttgtactggctccctgta

SEQ ID NO: 508591 - DNA, 25 bp, Homo sapien
actggctccctgtatagagactttg

SEQ ID NO: 508592 - DNA, 25 bp, Homo sapien
gattcttctggatcgactttgttac

SEQ ID NO: 508593 - DNA, 25 bp, Homo sapien
tctggatcgactttgttacctgaaa

SEQ ID NO: 508594 - DNA, 25 bp, Homo sapien
ggaagatattgcatggtctgctctt

SEQ ID NO: 508595 - DNA, 25 bp, Homo sapien
cttgtgaagttgtttgatcccgtga

SEQ ID NO: 508596 - DNA, 25 bp, Homo sapien
ctggattatgtcagacggtctctaa

SEQ ID NO: 508597 - DNA, 25 bp, Homo sapien
gacggtctctaaagaagcttggatt

SEQ ID NO: 508598 - DNA, 25 bp, Homo sapien
ggccagatgtgctcatgtcggtgtc

SEQ ID NO: 508599 - DNA, 25 bp, Homo sapien
agatgtgctcatgtcggtgtctggt

SEQ ID NO: 508600 - DNA, 25 bp, Homo sapien
tgctcatgtcggtgtctggtgtctg

SEQ ID NO: 508601 - DNA, 25 bp, Homo sapien
cagtatggtgtgttttaagctattt

SEQ ID NO: 508602 - DNA, 25 bp, Homo sapien
taattggtaaggttaaggtagcatt

SEQ ID NO: 508603 - DNA, 25 bp, Homo sapien
aggtagcattaaccacaaagatgtt

SEQ ID NO: 508604 - DNA, 25 bp, Homo sapien
tctctagcaaatattggaatttcca

SEQ ID NO: 508605 - DNA, 25 bp, Homo sapien
aatatatcatttgtacagggttaat

SEQ ID NO: 508606 - DNA, 25 bp, Homo sapien
aatatatcctactttttatcttaag

SEQ ID NO: 508607 - DNA, 25 bp, Homo sapien
tcctactttttatcttaagttgaag

SEQ ID NO: 508608 - DNA, 25 bp, Homo sapien
gatgttatttactaaattgttcttg

SEQ ID NO: 508609 - DNA, 25 bp, Homo sapien
aaatgtcagtgtttcaccaaagtat

SEQ ID NO: 508610 - DNA, 25 bp, Homo sapien
atgtcagtgtttcaccaaagtattt

SEQ ID NO: 508611 - DNA, 25 bp, Homo sapien
ttccattgtattaagagtccagtca

SEQ ID NO: 508612 - DNA, 25 bp, Homo sapien
tgtattaagagtccagtcactgtat

SEQ ID NO: 508613 - DNA, 25 bp, Homo sapien
aagagtccagtcactgtatatggaa

SEQ ID NO: 508614 - DNA, 25 bp, Homo sapien
ccagtcactgtatatggaagtattt

SEQ ID NO: 508615 - DNA, 25 bp, Homo sapien
tttttatatcacttgagtccactag

SEQ ID NO: 508616 - DNA, 25 bp, Homo sapien
atatcacttgagtccactagtagta

SEQ ID NO: 508617 - DNA, 25 bp, Homo sapien
gagtccactagtagtacttccttgc

SEQ ID NO: 508618 - DNA, 25 bp, Homo sapien
cactagtagtacttccttgctctgt

SEQ ID NO: 508619 - DNA, 25 bp, Homo sapien
ctagtagtacttccttgctctgttt

SEQ ID NO: 508620 - DNA, 25 bp, Homo sapien
taaaattgccaacttttgggagatt

SEQ ID NO: 508621 - DNA, 25 bp, Homo sapien
ttgccaacttttgggagatttcaca

SEQ ID NO: 508622 - DNA, 25 bp, Homo sapien
ttttatttttccaggattggtatgg

SEQ ID NO: 508623 - DNA, 25 bp, Homo sapien
atttttccaggattggtatggagga

SEQ ID NO: 508624 - DNA, 25 bp, Homo sapien
atggaggagtagtaccttctattct

SEQ ID NO: 508625 - DNA, 25 bp, Homo sapien
ggaggagtagtaccttctattcttg

SEQ ID NO: 508626 - DNA, 25 bp, Homo sapien
ggagtagtaccttctattcttggtt

SEQ ID NO: 508627 - DNA, 25 bp, Homo sapien
gagtagtaccttctattcttggttt

SEQ ID NO: 508628 - DNA, 25 bp, Homo sapien
gtagtaccttctattcttggtttat

SEQ ID NO: 508629 - DNA, 25 bp, Homo sapien
tagtaccttctattcttggtttatt

SEQ ID NO: 508630 - DNA, 25 bp, Homo sapien
tgagggtactggtaggtaacacact

SEQ ID NO: 508631 - DNA, 25 bp, Homo sapien
tctattacacctttactaagccaca

SEQ ID NO: 508632 - DNA, 25 bp, Homo sapien
ttacacctttactaagccacataaa

SEQ ID NO: 508633 - DNA, 25 bp, Homo sapien
ctaagccacataaaagtaatctgtt

SEQ ID NO: 508634 - DNA, 25 bp, Homo sapien
gtaatctgtttgtgtgtaactgcca

SEQ ID NO: 508635 - DNA, 25 bp, Homo sapien
gtgtaactgccagatataccacctg

SEQ ID NO: 508636 - DNA, 25 bp, Homo sapien
agatataccacctggaattccaagt

SEQ ID NO: 508637 - DNA, 25 bp, Homo sapien
ataccacctggaattccaagtaaga

SEQ ID NO: 508638 - DNA, 25 bp, Homo sapien
cagtgcaaataattttttcgtaaca

SEQ ID NO: 508639 - DNA, 25 bp, Homo sapien
taagcaaaaatactcactgaaatag

SEQ ID NO: 508640 - DNA, 25 bp, Homo sapien
aattcacctacttacaattttatgg

SEQ ID NO: 508641 - DNA, 25 bp, Homo sapien
tacttacaattttatggtttctttg

SEQ ID NO: 508642 - DNA, 25 bp, Homo sapien
ttatcattcagcttgctttgtgttg

SEQ ID NO: 508643 - DNA, 25 bp, Homo sapien
tcattcagcttgctttgtgttgttt

SEQ ID NO: 508644 - DNA, 25 bp, Homo sapien
ggtacagtgggacagttttattttg

SEQ ID NO: 508645 - DNA, 25 bp, Homo sapien
tacagtgggacagttttattttgtt

SEQ ID NO: 508646 - DNA, 25 bp, Homo sapien
gagaagtttcctttgatcaagccat

SEQ ID NO: 508647 - DNA, 25 bp, Homo sapien
gaagtttcctttgatcaagccatat

SEQ ID NO: 508648 - DNA, 25 bp, Homo sapien
agtttagaaaactatctctgctatt

SEQ ID NO: 508649 - DNA, 25 bp, Homo sapien
aacactgtcagtgctaatcatagaa

SEQ ID NO: 508650 - DNA, 25 bp, Homo sapien
gtcagtgctaatcatagaaaatcag

SEQ ID NO: 508651 - DNA, 25 bp, Homo sapien
agaaaatcagactatggcttgaaat

SEQ ID NO: 508652 - DNA, 25 bp, Homo sapien
atcagactatggcttgaaatgacta

SEQ ID NO: 508653 - DNA, 25 bp, Homo sapien
ttcagggaaaccacaaccatcatta

SEQ ID NO: 508654 - DNA, 25 bp, Homo sapien
aaccatcattactcaggccagacag

SEQ ID NO: 508655 - DNA, 25 bp, Homo sapien
actcaggccagacagctgccagaaa

SEQ ID NO: 508656 - DNA, 25 bp, Homo sapien
gccagaaaagcagcctagcctaaga

SEQ ID NO: 508657 - DNA, 25 bp, Homo sapien
aatagaggtgggaggctgtattcca

SEQ ID NO: 508658 - DNA, 25 bp, Homo sapien
taagcgcgggagcactcactcccaa

SEQ ID NO: 508659 - DNA, 25 bp, Homo sapien
actcccaagtttgtccacatttcaa

SEQ ID NO: 508660 - DNA, 25 bp, Homo sapien
aaccctgtggtagaaatccctgatt

SEQ ID NO: 508661 - DNA, 25 bp, Homo sapien
aagcgcaaggcagtttctatcatgg

SEQ ID NO: 508662 - DNA, 25 bp, Homo sapien
ttctatcatgggatgactctccgct

SEQ ID NO: 508663 - DNA, 25 bp, Homo sapien
actctccgctgggaacttcagggaa

SEQ ID NO: 508664 - DNA, 25 bp, Homo sapien
aagggtctcattactaaaacactga

SEQ ID NO: 508665 - DNA, 25 bp, Homo sapien
aaacctaaaaccacttagcaatgtg

SEQ ID NO: 508666 - DNA, 25 bp, Homo sapien
gtaatcgtctaatatttacagtcat

SEQ ID NO: 508667 - DNA, 25 bp, Homo sapien
atttacagtcataaacctgcatgag

SEQ ID NO: 508668 - DNA, 25 bp, Homo sapien
aaacctgcatgagaatactttcaaa

SEQ ID NO: 508669 - DNA, 25 bp, Homo sapien
ttagtattgggtgtgggatgcatca

SEQ ID NO: 508670 - DNA, 25 bp, Homo sapien
catcagggacacaggtttgtaaacc

SEQ ID NO: 508671 - DNA, 25 bp, Homo sapien
aaccatgacaattcagttgtaaaac

SEQ ID NO: 508672 - DNA, 25 bp, Homo sapien
gaaaacatcccagttaccctggtgt

SEQ ID NO: 508673 - DNA, 25 bp, Homo sapien
tattaatggccgataagggtctcat

SEQ ID NO: 508674 - DNA, 25 bp, Homo sapien
ggccgataagggtctcattactaaa

SEQ ID NO: 508675 - DNA, 25 bp, Homo sapien
ttctcaaagggcataccttgtgcat

SEQ ID NO: 508676 - DNA, 25 bp, Homo sapien
gcataccttgtgcattgtggcttat

SEQ ID NO: 508677 - DNA, 25 bp, Homo sapien
gatgagccatattaattgcctgtta

SEQ ID NO: 508678 - DNA, 25 bp, Homo sapien
tgcctgttaaatatacactagcttg

SEQ ID NO: 508679 - DNA, 25 bp, Homo sapien
cactagcttgaacttagatgttaaa

SEQ ID NO: 508680 - DNA, 25 bp, Homo sapien
gttattattaccagcatttgtcctt

SEQ ID NO: 508681 - DNA, 25 bp, Homo sapien
gtatcagaatacttgcactctttaa

SEQ ID NO: 508682 - DNA, 25 bp, Homo sapien
ttgcactctttaacacattctttat

SEQ ID NO: 508683 - DNA, 25 bp, Homo sapien
agaggagtgttattgcatgctgata

SEQ ID NO: 508684 - DNA, 25 bp, Homo sapien
gctgataatcattttgagtttgcct

SEQ ID NO: 508685 - DNA, 25 bp, Homo sapien
tgagtttgcctcagtagatactaaa

SEQ ID NO: 508686 - DNA, 25 bp, Homo sapien
acttgttacaaaacatacttgctaa

SEQ ID NO: 508687 - DNA, 25 bp, Homo sapien
gctaaagtaacttcagtcctcaaat

SEQ ID NO: 508688 - DNA, 25 bp, Homo sapien
acttcagtcctcaaatatagctggg

SEQ ID NO: 508689 - DNA, 25 bp, Homo sapien
tatagctgggaaacaattatgagat

SEQ ID NO: 508690 - DNA, 25 bp, Homo sapien
attatgagatagactcagtctcccc

SEQ ID NO: 508691 - DNA, 25 bp, Homo sapien
cttttcccctgccatatctaattaa

SEQ ID NO: 508692 - DNA, 25 bp, Homo sapien
gccatatctaattaagcactaactg

SEQ ID NO: 508693 - DNA, 25 bp, Homo sapien
tttattgcctttacactgcttattc

SEQ ID NO: 508694 - DNA, 25 bp, Homo sapien
tacactgcttattctttttgactga

SEQ ID NO: 508695 - DNA, 25 bp, Homo sapien
cttactgtatttatcatacctgttt

SEQ ID NO: 508696 - DNA, 25 bp, Homo sapien
ttaaatgcaataaatcccaaatgga

SEQ ID NO: 508697 - DNA, 25 bp, Homo sapien
atgttctcaaacatagtgcctgaaa

SEQ ID NO: 508698 - DNA, 25 bp, Homo sapien
ccacgagggcctaagaataatgttc

SEQ ID NO: 508699 - DNA, 25 bp, Homo sapien
taatgttcaggcatttttgcaggac

SEQ ID NO: 508700 - DNA, 25 bp, Homo sapien
ggcatttttgcaggacacttgtgat

SEQ ID NO: 508701 - DNA, 25 bp, Homo sapien
ttgcaggacacttgtgattgttaaa

SEQ ID NO: 508702 - DNA, 25 bp, Homo sapien
gattgttaaatcctctgaactgacc

SEQ ID NO: 508703 - DNA, 25 bp, Homo sapien
aaatcctctgaactgaccggaacca

SEQ ID NO: 508704 - DNA, 25 bp, Homo sapien
cctctgaactgaccggaaccaggag

SEQ ID NO: 508705 - DNA, 25 bp, Homo sapien
ggaagaaagttctcaatgggttgtt

SEQ ID NO: 508706 - DNA, 25 bp, Homo sapien
gttgttttttggcaatgaagtcaag

SEQ ID NO: 508707 - DNA, 25 bp, Homo sapien
gaagtcaagatattagggtctcaag

SEQ ID NO: 508708 - DNA, 25 bp, Homo sapien
tggtcattgaacttaatctctctgg

SEQ ID NO: 508709 - DNA, 25 bp, Homo sapien
aatgaaactgctgtggtaaaaacca

SEQ ID NO: 508710 - DNA, 25 bp, Homo sapien
gaaactgctgtggtaaaaaccaagt

SEQ ID NO: 508711 - DNA, 25 bp, Homo sapien
aaagtaggcaattatttggctgtta

SEQ ID NO: 508712 - DNA, 25 bp, Homo sapien
tatttgtattgctctgcttgggaac

SEQ ID NO: 508713 - DNA, 25 bp, Homo sapien
gtattgctctgcttgggaactgtat

SEQ ID NO: 508714 - DNA, 25 bp, Homo sapien
attgctctgcttgggaactgtatat

SEQ ID NO: 508715 - DNA, 25 bp, Homo sapien
gctctgcttgggaactgtatatatg

SEQ ID NO: 508716 - DNA, 25 bp, Homo sapien
ggaactgtatatatgcttgtctact

SEQ ID NO: 508717 - DNA, 25 bp, Homo sapien
gtatatatgcttgtctactattttt

SEQ ID NO: 508718 - DNA, 25 bp, Homo sapien
atgcttgtctactatttttaatttt

SEQ ID NO: 508719 - DNA, 25 bp, Homo sapien
acagcttgacccgttgagatactca

SEQ ID NO: 508720 - DNA, 25 bp, Homo sapien
gagatactcaaggacaaccctccag

SEQ ID NO: 508721 - DNA, 25 bp, Homo sapien
gaaatagtatgtttccttcctggga

SEQ ID NO: 508722 - DNA, 25 bp, Homo sapien
ttcctgggaacaagatgctagcgcg

SEQ ID NO: 508723 - DNA, 25 bp, Homo sapien
aacaagatgctagcgcggtgcaccg

SEQ ID NO: 508724 - DNA, 25 bp, Homo sapien
ggaggtatctggtgtcaacaatgcc

SEQ ID NO: 508725 - DNA, 25 bp, Homo sapien
ggtgtcaacaatgccagagcgccct

SEQ ID NO: 508726 - DNA, 25 bp, Homo sapien
gcctcaaagaggcaggacaccagtt

SEQ ID NO: 508727 - DNA, 25 bp, Homo sapien
ggacaccagttacaaaagccagatg

SEQ ID NO: 508728 - DNA, 25 bp, Homo sapien
aagccagatggcacagtggcaataa

SEQ ID NO: 508729 - DNA, 25 bp, Homo sapien
gctcttagaaacgtttaatctgtga

SEQ ID NO: 508730 - DNA, 25 bp, Homo sapien
tggagcaggaggtccctcaagactg

SEQ ID NO: 508731 - DNA, 25 bp, Homo sapien
gtccctcaagactggagaggacact

SEQ ID NO: 508732 - DNA, 25 bp, Homo sapien
tttcaggaagtcaaccaagactgag

SEQ ID NO: 508733 - DNA, 25 bp, Homo sapien
agactgaggatgtgactgacattcc

SEQ ID NO: 508734 - DNA, 25 bp, Homo sapien
aggatgtgactgacattcctggaaa

SEQ ID NO: 508735 - DNA, 25 bp, Homo sapien
gaatttagtatcttccagtgttctt

SEQ ID NO: 508736 - DNA, 25 bp, Homo sapien
gtatcttccagtgttcttacatgga

SEQ ID NO: 508737 - DNA, 25 bp, Homo sapien
catggaatcatttgttcatttctcc

SEQ ID NO: 508738 - DNA, 25 bp, Homo sapien
gattaaaaaactacaaacctcacat

SEQ ID NO: 508739 - DNA, 25 bp, Homo sapien
tctttaccataaaaatctcccattt

SEQ ID NO: 508740 - DNA, 25 bp, Homo sapien
tcttatatttagtcctagatttctg

SEQ ID NO: 508741 - DNA, 25 bp, Homo sapien
gagaaatgctgaaggctggtatgaa

SEQ ID NO: 508742 - DNA, 25 bp, Homo sapien
tgctgaaggctggtatgaatataaa

SEQ ID NO: 508743 - DNA, 25 bp, Homo sapien
gaaaatgttttgcagtcatggacca

SEQ ID NO: 508744 - DNA, 25 bp, Homo sapien
tttgcagtcatggaccaaagaagat

SEQ ID NO: 508745 - DNA, 25 bp, Homo sapien
aactgttctcttttcaacacaattg

SEQ ID NO: 508746 - DNA, 25 bp, Homo sapien
ttttcaacacaattgggagccatca

SEQ ID NO: 508747 - DNA, 25 bp, Homo sapien
caattgggagccatcagtggtttta

SEQ ID NO: 508748 - DNA, 25 bp, Homo sapien
gggagccatcagtggttttagaagt

SEQ ID NO: 508749 - DNA, 25 bp, Homo sapien
tagaagtgttgcaatttgacagaac

SEQ ID NO: 508750 - DNA, 25 bp, Homo sapien
tagattaataagctagcgcctgtta

SEQ ID NO: 508751 - DNA, 25 bp, Homo sapien
aagctagcgcctgttagaaatattt

SEQ ID NO: 508752 - DNA, 25 bp, Homo sapien
ttccgtcctacctggcatgctgcag

SEQ ID NO: 508753 - DNA, 25 bp, Homo sapien
gtggtgtcctctgaatttggaccca

SEQ ID NO: 508754 - DNA, 25 bp, Homo sapien
tgtcctctgaatttggacccaggtt

SEQ ID NO: 508755 - DNA, 25 bp, Homo sapien
gctgtctgtgtttcccaggtggagc

SEQ ID NO: 508756 - DNA, 25 bp, Homo sapien
ggagctcatgtttgtgatcctctat

SEQ ID NO: 508757 - DNA, 25 bp, Homo sapien
gtttgtgatcctctatctggacagc

SEQ ID NO: 508758 - DNA, 25 bp, Homo sapien
gtgatcctctatctggacagctctc

SEQ ID NO: 508759 - DNA, 25 bp, Homo sapien
ttgcccctgttctgcctttctggga

SEQ ID NO: 508760 - DNA, 25 bp, Homo sapien
taccctctctgctaagggcctagca

SEQ ID NO: 508761 - DNA, 25 bp, Homo sapien
taagggcctagcacgctttgatgag

SEQ ID NO: 508762 - DNA, 25 bp, Homo sapien
tagcacgctttgatgaggttcctgg

SEQ ID NO: 508763 - DNA, 25 bp, Homo sapien
acctgactccagttctccgtgtgct

SEQ ID NO: 508764 - DNA, 25 bp, Homo sapien
agttctccgtgtgctccattggctg

SEQ ID NO: 508765 - DNA, 25 bp, Homo sapien
gtgtgctccattggctgcggctgca

SEQ ID NO: 508766 - DNA, 25 bp, Homo sapien
atgccaggggtgtttattgtgttta

SEQ ID NO: 508767 - DNA, 25 bp, Homo sapien
taagaaagggtccttgaagcctcct

SEQ ID NO: 508768 - DNA, 25 bp, Homo sapien
atttgtagcacatattatagatgga

SEQ ID NO: 508769 - DNA, 25 bp, Homo sapien
gatatttatttatacctgtgatgcc

SEQ ID NO: 508770 - DNA, 25 bp, Homo sapien
atttatacctgtgatgccaattgtc

SEQ ID NO: 508771 - DNA, 25 bp, Homo sapien
tacctgtgatgccaattgtcattaa

SEQ ID NO: 508772 - DNA, 25 bp, Homo sapien
ccaattgtcattaaaaggcttttca

SEQ ID NO: 508773 - DNA, 25 bp, Homo sapien
aggcttttcatggcttgacaagtca

SEQ ID NO: 508774 - DNA, 25 bp, Homo sapien
attactagagtatcagaccacccat

SEQ ID NO: 508775 - DNA, 25 bp, Homo sapien
agagtatcagaccacccatttatct

SEQ ID NO: 508776 - DNA, 25 bp, Homo sapien
agaccacccatttatctctcagttc

SEQ ID NO: 508777 - DNA, 25 bp, Homo sapien
gtgagtaaactggagctaacagcag

SEQ ID NO: 508778 - DNA, 25 bp, Homo sapien
aacagcagttggtacttacggcata

SEQ ID NO: 508779 - DNA, 25 bp, Homo sapien
ttacggcatatactggatttggctc

SEQ ID NO: 508780 - DNA, 25 bp, Homo sapien
tatactggatttggctcactcacac

SEQ ID NO: 508781 - DNA, 25 bp, Homo sapien
ggctcactcacacgtggtattccta

SEQ ID NO: 508782 - DNA, 25 bp, Homo sapien
tcatctactgtatcttcctggacta

SEQ ID NO: 508783 - DNA, 25 bp, Homo sapien
ttcctggactacataagctgcaaag

SEQ ID NO: 508784 - DNA, 25 bp, Homo sapien
agattcccttgagctaggttccaga

SEQ ID NO: 508785 - DNA, 25 bp, Homo sapien
aggacatcatttaacgcatcagcaa

SEQ ID NO: 508786 - DNA, 25 bp, Homo sapien
agcagatgccacatacagagtagag

SEQ ID NO: 508787 - DNA, 25 bp, Homo sapien
aaggcatttggtggatcggtcacta

SEQ ID NO: 508788 - DNA, 25 bp, Homo sapien
ggtcactagagatctatcttgcaga

SEQ ID NO: 508789 - DNA, 25 bp, Homo sapien
aaaagtgcctcttaattggccattg

SEQ ID NO: 508790 - DNA, 25 bp, Homo sapien
aattggccattgtaccagccacttg

SEQ ID NO: 508791 - DNA, 25 bp, Homo sapien
acttgtcctagccaaatgtccaaaa

SEQ ID NO: 508792 - DNA, 25 bp, Homo sapien
ccgccacgttacaatccacagattg

SEQ ID NO: 508793 - DNA, 25 bp, Homo sapien
agattgtctgtctgagtcgtttaag

SEQ ID NO: 508794 - DNA, 25 bp, Homo sapien
gtcgtttaaggcatttcctggtgct

SEQ ID NO: 508795 - DNA, 25 bp, Homo sapien
ttcctggtgcttgtgttccatgaat

SEQ ID NO: 508796 - DNA, 25 bp, Homo sapien
cagcagcggtctgggccctgaggac

SEQ ID NO: 508797 - DNA, 25 bp, Homo sapien
gaggttgagagagtggcccccatct

SEQ ID NO: 508798 - DNA, 25 bp, Homo sapien
atctgtggccacactgctgactgca

SEQ ID NO: 508799 - DNA, 25 bp, Homo sapien
tgactgcacacacagtgtggcgtga

SEQ ID NO: 508800 - DNA, 25 bp, Homo sapien
acacagtgtggcgtgagggacatac

SEQ ID NO: 508801 - DNA, 25 bp, Homo sapien
tggcgtgagggacatacagccctct

SEQ ID NO: 508802 - DNA, 25 bp, Homo sapien
tgagggacatacagccctctccctg

SEQ ID NO: 508803 - DNA, 25 bp, Homo sapien
gggaacgggctgtctctgctgtccc

SEQ ID NO: 508804 - DNA, 25 bp, Homo sapien
tagcccagctgatacgtgctgctct

SEQ ID NO: 508805 - DNA, 25 bp, Homo sapien
agctgatacgtgctgctctgtcccc

SEQ ID NO: 508806 - DNA, 25 bp, Homo sapien
cagggaaccagctggcagccagcct

SEQ ID NO: 508807 - DNA, 25 bp, Homo sapien
gagtgggactgtaattggcccctgg

SEQ ID NO: 508808 - DNA, 25 bp, Homo sapien
acgggctgtaggtagatgcaggcac

SEQ ID NO: 508809 - DNA, 25 bp, Homo sapien
atgcaggcactggctggtagacaga

SEQ ID NO: 508810 - DNA, 25 bp, Homo sapien
gctggtagacagaaggccggatgct

SEQ ID NO: 508811 - DNA, 25 bp, Homo sapien
ctcactgtagctggtgtgggtggca

SEQ ID NO: 508812 - DNA, 25 bp, Homo sapien
gcgttggctggagagttgactacca

SEQ ID NO: 508813 - DNA, 25 bp, Homo sapien
ggctggagagttgactaccaccttc

SEQ ID NO: 508814 - DNA, 25 bp, Homo sapien
tggagagttgactaccaccttctgg

SEQ ID NO: 508815 - DNA, 25 bp, Homo sapien
agagttgactaccaccttctggtga

SEQ ID NO: 508816 - DNA, 25 bp, Homo sapien
tgactaccaccttctggtgagggat

SEQ ID NO: 508817 - DNA, 25 bp, Homo sapien
taccaccttctggtgagggatcacc

SEQ ID NO: 508818 - DNA, 25 bp, Homo sapien
ggtgtgattgctataattttgtgaa

SEQ ID NO: 508819 - DNA, 25 bp, Homo sapien
gtgatttcagcaatatgtactaaga

SEQ ID NO: 508820 - DNA, 25 bp, Homo sapien
atatgtactaagattccaaggcaga

SEQ ID NO: 508821 - DNA, 25 bp, Homo sapien
ggatttgagcctgtatgtgtaagaa

SEQ ID NO: 508822 - DNA, 25 bp, Homo sapien
aagaaactctctcttcagtcatatt

SEQ ID NO: 508823 - DNA, 25 bp, Homo sapien
ctctctcttcagtcatatttcctaa

SEQ ID NO: 508824 - DNA, 25 bp, Homo sapien
ctaaattcagtgtaagtacctcgct

SEQ ID NO: 508825 - DNA, 25 bp, Homo sapien
gtacctcgctgatttagcactggag

SEQ ID NO: 508826 - DNA, 25 bp, Homo sapien
agcactggagttattccttgaatgt

SEQ ID NO: 508827 - DNA, 25 bp, Homo sapien
aatgatgttctattctgacctaatg

SEQ ID NO: 508828 - DNA, 25 bp, Homo sapien
acctaatgaattcctgtaatgtgaa

SEQ ID NO: 508829 - DNA, 25 bp, Homo sapien
gaagccagggacatgctcctaactc

SEQ ID NO: 508830 - DNA, 25 bp, Homo sapien
tgctcctaactcctttcccattaaa

SEQ ID NO: 508831 - DNA, 25 bp, Homo sapien
agaatagaccagagggtgtcccttt

SEQ ID NO: 508832 - DNA, 25 bp, Homo sapien
ggtgtcccttttccacagtaatggg

SEQ ID NO: 508833 - DNA, 25 bp, Homo sapien
aatgggatcggctggtgtgccttca

SEQ ID NO: 508834 - DNA, 25 bp, Homo sapien
aactggctttaggatggttctgact

SEQ ID NO: 508835 - DNA, 25 bp, Homo sapien
cctccattctgcagtgttcagagtt

SEQ ID NO: 508836 - DNA, 25 bp, Homo sapien
gaaagggtttgggtgccccagcatc

SEQ ID NO: 508837 - DNA, 25 bp, Homo sapien
ccagcatccaggtgttgtgtggctt

SEQ ID NO: 508838 - DNA, 25 bp, Homo sapien
ccaggtgttgtgtggcttagcgcat

SEQ ID NO: 508839 - DNA, 25 bp, Homo sapien
ttagcgcatgtgaagtgaaaacctt

SEQ ID NO: 508840 - DNA, 25 bp, Homo sapien
cattttttggtgtccgtttgtattg

SEQ ID NO: 508841 - DNA, 25 bp, Homo sapien
tttttggtgtccgtttgtattgaat

SEQ ID NO: 508842 - DNA, 25 bp, Homo sapien
ttttggtgtccgtttgtattgaata

SEQ ID NO: 508843 - DNA, 25 bp, Homo sapien
tttggtgtccgtttgtattgaataa

SEQ ID NO: 508844 - DNA, 25 bp, Homo sapien
ttggtgtccgtttgtattgaataat

SEQ ID NO: 508845 - DNA, 25 bp, Homo sapien
ctctttcccaggaacaaatcaaaag

SEQ ID NO: 508846 - DNA, 25 bp, Homo sapien
tctttcccaggaacaaatcaaaagg

SEQ ID NO: 508847 - DNA, 25 bp, Homo sapien
tttcccaggaacaaatcaaaaggtg

SEQ ID NO: 508848 - DNA, 25 bp, Homo sapien
atcaaaaggtggattatcttctgaa

SEQ ID NO: 508849 - DNA, 25 bp, Homo sapien
tcaaaaggtggattatcttctgaag

SEQ ID NO: 508850 - DNA, 25 bp, Homo sapien
caaaaggtggattatcttctgaaga

SEQ ID NO: 508851 - DNA, 25 bp, Homo sapien
aaagtccactgcacatgacagctgt

SEQ ID NO: 508852 - DNA, 25 bp, Homo sapien
gctgtccatggaaggttcacacggt

SEQ ID NO: 508853 - DNA, 25 bp, Homo sapien
atggaaggttcacacggtcacagac

SEQ ID NO: 508854 - DNA, 25 bp, Homo sapien
ggtcacagaccctcattcagaatgg

SEQ ID NO: 508855 - DNA, 25 bp, Homo sapien
ggataaggacggcaacactcctctc

SEQ ID NO: 508856 - DNA, 25 bp, Homo sapien
tctccatgtggctgcaagatacggt

SEQ ID NO: 508857 - DNA, 25 bp, Homo sapien
ctgcaagatacggtcatgagctttt

SEQ ID NO: 508858 - DNA, 25 bp, Homo sapien
catgagcttttgattaacaccttaa

SEQ ID NO: 508859 - DNA, 25 bp, Homo sapien
aacaccttaataaccagcggagctg

SEQ ID NO: 508860 - DNA, 25 bp, Homo sapien
accagcggagctgacacagccaagt

SEQ ID NO: 508861 - DNA, 25 bp, Homo sapien
cactcatggtgctttgtgtcttgaa

SEQ ID NO: 508862 - DNA, 25 bp, Homo sapien
gtaaactcccagaacagctgatgat

SEQ ID NO: 508863 - DNA, 25 bp, Homo sapien
aatcagggacatttgctctttttac

SEQ ID NO: 508864 - DNA, 25 bp, Homo sapien
gggacatttgctctttttacctcca

SEQ ID NO: 508865 - DNA, 25 bp, Homo sapien
tttacctccacctcaaaaactgatg

SEQ ID NO: 508866 - DNA, 25 bp, Homo sapien
aggcacatggctgcaaattccccgt

SEQ ID NO: 508867 - DNA, 25 bp, Homo sapien
aaattccccgtgtgctgtttggctt

SEQ ID NO: 508868 - DNA, 25 bp, Homo sapien
tgccctgggatgagcagacagccct

SEQ ID NO: 508869 - DNA, 25 bp, Homo sapien
tgggatgagcagacagccctcggcc

SEQ ID NO: 508870 - DNA, 25 bp, Homo sapien
ggcccgatggagcacgacttattta

SEQ ID NO: 508871 - DNA, 25 bp, Homo sapien
gcacgacttatttattacggtccac

SEQ ID NO: 508872 - DNA, 25 bp, Homo sapien
ttatttattacggtccacacaggga

SEQ ID NO: 508873 - DNA, 25 bp, Homo sapien
ttggatgaaagctgacagggtccat

SEQ ID NO: 508874 - DNA, 25 bp, Homo sapien
gacagggtccatccaggagcaagtt

SEQ ID NO: 508875 - DNA, 25 bp, Homo sapien
ccatccaggagcaagtttgagcctt

SEQ ID NO: 508876 - DNA, 25 bp, Homo sapien
ttccattttgggtgctgagtggagt

SEQ ID NO: 508877 - DNA, 25 bp, Homo sapien
gtggagtggcgactatagcaaacct

SEQ ID NO: 508878 - DNA, 25 bp, Homo sapien
tagcaaacctgtgatctctggctgc

SEQ ID NO: 508879 - DNA, 25 bp, Homo sapien
atattctaattctgagcctctattg

SEQ ID NO: 508880 - DNA, 25 bp, Homo sapien
tctgagcctctattggaatcagcta

SEQ ID NO: 508881 - DNA, 25 bp, Homo sapien
ggcgatcatcttgcccagaaacatc

SEQ ID NO: 508882 - DNA, 25 bp, Homo sapien
catcttgcccagaaacatcatgttg

SEQ ID NO: 508883 - DNA, 25 bp, Homo sapien
catcatgttgaaactcttggtcaga

SEQ ID NO: 508884 - DNA, 25 bp, Homo sapien
tttccctctatttttctggctggtt

SEQ ID NO: 508885 - DNA, 25 bp, Homo sapien
ttttctggctggttttttgctcttt

SEQ ID NO: 508886 - DNA, 25 bp, Homo sapien
ccccttgagaccctaatatcttgac

SEQ ID NO: 508887 - DNA, 25 bp, Homo sapien
gacttcattgccaaaaaacaaccca

SEQ ID NO: 508888 - DNA, 25 bp, Homo sapien
acaacccattgagaactttcttcct

SEQ ID NO: 508889 - DNA, 25 bp, Homo sapien
ttgagaactttcttcctactgatcc

SEQ ID NO: 508890 - DNA, 25 bp, Homo sapien
tcttcctactgatcccatctctttt

SEQ ID NO: 508891 - DNA, 25 bp, Homo sapien
tcctggttccggtcagttcagagga

SEQ ID NO: 508892 - DNA, 25 bp, Homo sapien
ccggtcagttcagaggatttaacaa

SEQ ID NO: 508893 - DNA, 25 bp, Homo sapien
gatttaacaatcacaagtgtcctgc

SEQ ID NO: 508894 - DNA, 25 bp, Homo sapien
gtgtcctgcaaaaatgcctgaacat

SEQ ID NO: 508895 - DNA, 25 bp, Homo sapien
aactccagagaagcatcccagggct

SEQ ID NO: 508896 - DNA, 25 bp, Homo sapien
tttgtgacagtctctaattcccttc

SEQ ID NO: 508897 - DNA, 25 bp, Homo sapien
ccttcccttctcgttaagaatcata

SEQ ID NO: 508898 - DNA, 25 bp, Homo sapien
attgtatagtagctttcagaccata

SEQ ID NO: 508899 - DNA, 25 bp, Homo sapien
gtattcattgggttactcctattat

SEQ ID NO: 508900 - DNA, 25 bp, Homo sapien
ggtcggagtagttagatctttagct

SEQ ID NO: 508901 - DNA, 25 bp, Homo sapien
agatctttagcttttattccttatt

SEQ ID NO: 508902 - DNA, 25 bp, Homo sapien
ttgtattactctccatgtgtataaa

SEQ ID NO: 508903 - DNA, 25 bp, Homo sapien
ttattgatcatgttgctggctttta

SEQ ID NO: 508904 - DNA, 25 bp, Homo sapien
aaggaggagcactgcctcagccttt

SEQ ID NO: 508905 - DNA, 25 bp, Homo sapien
gcctcagcctttgcacatggtaatg

SEQ ID NO: 508906 - DNA, 25 bp, Homo sapien
gccggacaccattctttttcaatga

SEQ ID NO: 508907 - DNA, 25 bp, Homo sapien
gaatgagacttccagtttgaatgca

SEQ ID NO: 508908 - DNA, 25 bp, Homo sapien
tttgaatgcaaagtgtgtggtccca

SEQ ID NO: 508909 - DNA, 25 bp, Homo sapien
tgtgtggtcccaaagttgaattctt

SEQ ID NO: 508910 - DNA, 25 bp, Homo sapien
gaattcttttgaacccaagtacatg

SEQ ID NO: 508911 - DNA, 25 bp, Homo sapien
aacccaagtacatgcctgcggttgg

SEQ ID NO: 508912 - DNA, 25 bp, Homo sapien
ctgcggttgggaggaacacttaaag

SEQ ID NO: 508913 - DNA, 25 bp, Homo sapien
gaagcaagttcggaggaaagtgtta

SEQ ID NO: 508914 - DNA, 25 bp, Homo sapien
gaaagtgttaactgaactacagaga

SEQ ID NO: 508915 - DNA, 25 bp, Homo sapien
aactacagagatggtcactgataaa

SEQ ID NO: 508916 - DNA, 25 bp, Homo sapien
ggtcactgataaaacaagttcttag

SEQ ID NO: 508917 - DNA, 25 bp, Homo sapien
gcttcctctttggatgtgaacgcgg

SEQ ID NO: 508918 - DNA, 25 bp, Homo sapien
cctctttggatgtgaacgcgggaat

SEQ ID NO: 508919 - DNA, 25 bp, Homo sapien
aacgcgggaatgaacagtggctgtt

SEQ ID NO: 508920 - DNA, 25 bp, Homo sapien
ttctcctttccattttgcagccggg

SEQ ID NO: 508921 - DNA, 25 bp, Homo sapien
ttccttcgaagggtagtgccttggg

SEQ ID NO: 508922 - DNA, 25 bp, Homo sapien
agcagcagacctgctctgagtccag

SEQ ID NO: 508923 - DNA, 25 bp, Homo sapien
tgctctgagtccagcttagctttcc

SEQ ID NO: 508924 - DNA, 25 bp, Homo sapien
aaattctgtgtggaacttactggag

SEQ ID NO: 508925 - DNA, 25 bp, Homo sapien
gtggaacttactggagatgttttta

SEQ ID NO: 508926 - DNA, 25 bp, Homo sapien
ataatggcctgtatttctcacgcta

SEQ ID NO: 508927 - DNA, 25 bp, Homo sapien
gcctgtatttctcacgctatactta

SEQ ID NO: 508928 - DNA, 25 bp, Homo sapien
taatcaagacttgctctgcagccac

SEQ ID NO: 508929 - DNA, 25 bp, Homo sapien
tcaagacttgctctgcagccactca

SEQ ID NO: 508930 - DNA, 25 bp, Homo sapien
tttgaacacatccaatagaaacatt

SEQ ID NO: 508931 - DNA, 25 bp, Homo sapien
gcatgtttaattgcataccattctc

SEQ ID NO: 508932 - DNA, 25 bp, Homo sapien
aattgcataccattctcttcacagt

SEQ ID NO: 508933 - DNA, 25 bp, Homo sapien
tctcttcacagtagcaggcttacca

SEQ ID NO: 508934 - DNA, 25 bp, Homo sapien
gtagcaggcttaccaatttccatag

SEQ ID NO: 508935 - DNA, 25 bp, Homo sapien
ggcttaccaatttccatagtctcat

SEQ ID NO: 508936 - DNA, 25 bp, Homo sapien
atttccatagtctcatgaggccgaa

SEQ ID NO: 508937 - DNA, 25 bp, Homo sapien
atgaggccgaaatgaattacaatgt

SEQ ID NO: 508938 - DNA, 25 bp, Homo sapien
attacaatgtaaagtgttccaggaa

SEQ ID NO: 508939 - DNA, 25 bp, Homo sapien
gggcggcagccgctgtgcaggaggc

SEQ ID NO: 508940 - DNA, 25 bp, Homo sapien
agccgctgtgcaggaggcgcctggc

SEQ ID NO: 508941 - DNA, 25 bp, Homo sapien
ggaagctcgctcactgctggccggc

SEQ ID NO: 508942 - DNA, 25 bp, Homo sapien
tccgggcgtccgtgggaggctggct

SEQ ID NO: 508943 - DNA, 25 bp, Homo sapien
gacagcatgcgcggcgggtctggaa

SEQ ID NO: 508944 - DNA, 25 bp, Homo sapien
ggtctggaagccgagttgcgctctc

SEQ ID NO: 508945 - DNA, 25 bp, Homo sapien
tctggaagccgagttgcgctctccg

SEQ ID NO: 508946 - DNA, 25 bp, Homo sapien
tggaagccgagttgcgctctccggc

SEQ ID NO: 508947 - DNA, 25 bp, Homo sapien
gctgcagcgcgaaagcgtcacggcc

SEQ ID NO: 508948 - DNA, 25 bp, Homo sapien
ctgcagcgcgaaagcgtcacggccg

SEQ ID NO: 508949 - DNA, 25 bp, Homo sapien
aaagcgtcacggccgctccgtctgg

SEQ ID NO: 508950 - DNA, 25 bp, Homo sapien
cattaagcagtctctgttgctgatt

SEQ ID NO: 508951 - DNA, 25 bp, Homo sapien
agtctctgttgctgattatatgaag

SEQ ID NO: 508952 - DNA, 25 bp, Homo sapien
gttgtatatgctgatctgtatgtta

SEQ ID NO: 508953 - DNA, 25 bp, Homo sapien
tatgctgatctgtatgttatgtaca

SEQ ID NO: 508954 - DNA, 25 bp, Homo sapien
gttatgtacattttcacagtgattg

SEQ ID NO: 508955 - DNA, 25 bp, Homo sapien
gaatcaccactgtctattttatgaa

SEQ ID NO: 508956 - DNA, 25 bp, Homo sapien
caccactgtctattttatgaagatg

SEQ ID NO: 508957 - DNA, 25 bp, Homo sapien
cagttatgtttcaaatggtgttatc

SEQ ID NO: 508958 - DNA, 25 bp, Homo sapien
atggtgttatctgccacattgtttc

SEQ ID NO: 508959 - DNA, 25 bp, Homo sapien
atctgccacattgtttccttttatc

SEQ ID NO: 508960 - DNA, 25 bp, Homo sapien
gttttctctgcttcaaaaatttaat

SEQ ID NO: 508961 - DNA, 25 bp, Homo sapien
gaaggatccacgtgtgtggccatat

SEQ ID NO: 508962 - DNA, 25 bp, Homo sapien
gtgtggccatattgtaacacatttt

SEQ ID NO: 508963 - DNA, 25 bp, Homo sapien
acctctttcatttaacagcccttat

SEQ ID NO: 508964 - DNA, 25 bp, Homo sapien
cagcccttattcaatggcctttttc

SEQ ID NO: 508965 - DNA, 25 bp, Homo sapien
tcagtagtacatacacatctgtgtc

SEQ ID NO: 508966 - DNA, 25 bp, Homo sapien
tacacatctgtgtcatttgttgaat

SEQ ID NO: 508967 - DNA, 25 bp, Homo sapien
tgttttaagcatttctcactcatag

SEQ ID NO: 508968 - DNA, 25 bp, Homo sapien
atttatgttagcaccaaatttctgt

SEQ ID NO: 508969 - DNA, 25 bp, Homo sapien
aatttctgtgcaatgaacctcccta

SEQ ID NO: 508970 - DNA, 25 bp, Homo sapien
ctgtgcaatgaacctccctatatat

SEQ ID NO: 508971 - DNA, 25 bp, Homo sapien
gaacctccctatatatcagtaattt

SEQ ID NO: 508972 - DNA, 25 bp, Homo sapien
taaaggcaccttctgagaataaaac

SEQ ID NO: 508973 - DNA, 25 bp, Homo sapien
tgaagcacattaggtccaggtcctt

SEQ ID NO: 508974 - DNA, 25 bp, Homo sapien
taggtccaggtccttccctctggga

SEQ ID NO: 508975 - DNA, 25 bp, Homo sapien
tccctctgggagtctgactgtgaaa

SEQ ID NO: 508976 - DNA, 25 bp, Homo sapien
tgactgtgaaactctttaacccaac

SEQ ID NO: 508977 - DNA, 25 bp, Homo sapien
caacaactcaattagcccctgtaga

SEQ ID NO: 508978 - DNA, 25 bp, Homo sapien
attagcccctgtagataagacatgc

SEQ ID NO: 508979 - DNA, 25 bp, Homo sapien
agataagacatgcttcccagagtga

SEQ ID NO: 508980 - DNA, 25 bp, Homo sapien
cagagtgagatttttgaaatcccct

SEQ ID NO: 508981 - DNA, 25 bp, Homo sapien
catccagaactatatttacccacct

SEQ ID NO: 508982 - DNA, 25 bp, Homo sapien
atatttacccacctattgtaactat

SEQ ID NO: 508983 - DNA, 25 bp, Homo sapien
ttaatagtataatttcgctgtcccc

SEQ ID NO: 508984 - DNA, 25 bp, Homo sapien
gtaccaatcgaaagctcagggatgc

SEQ ID NO: 508985 - DNA, 25 bp, Homo sapien
atgctactgttgacgcatcagcaag

SEQ ID NO: 508986 - DNA, 25 bp, Homo sapien
aagagttcttgagcagttttacctg

SEQ ID NO: 508987 - DNA, 25 bp, Homo sapien
gagcagttttacctgtccatcaata

SEQ ID NO: 508988 - DNA, 25 bp, Homo sapien
atacaaagagttcccacaacagtag

SEQ ID NO: 508989 - DNA, 25 bp, Homo sapien
aacagtagtgggattcctctgcctc

SEQ ID NO: 508990 - DNA, 25 bp, Homo sapien
ttcctctgcctctctgaagatatga

SEQ ID NO: 508991 - DNA, 25 bp, Homo sapien
gagagctataggagggattcccatg

SEQ ID NO: 508992 - DNA, 25 bp, Homo sapien
tagaagagctgacctccaatgtccc

SEQ ID NO: 508993 - DNA, 25 bp, Homo sapien
caatgtcccgtctaattccaagatt

SEQ ID NO: 508994 - DNA, 25 bp, Homo sapien
cactactttgtgtctgtgactgctg

SEQ ID NO: 508995 - DNA, 25 bp, Homo sapien
gctccaccttctgtcgtaagagatc

SEQ ID NO: 508996 - DNA, 25 bp, Homo sapien
gagatccattttgtgtgctgggtga

SEQ ID NO: 508997 - DNA, 25 bp, Homo sapien
tgctgggtgagttgctgctctgctc

SEQ ID NO: 508998 - DNA, 25 bp, Homo sapien
gcttgcgtacttccgtagagtgtca

SEQ ID NO: 508999 - DNA, 25 bp, Homo sapien
gagtgtcaggttatgctcaccggtc

SEQ ID NO: 509000 - DNA, 25 bp, Homo sapien
gtctggccggcatagtcttgagtgt

SEQ ID NO: 509001 - DNA, 25 bp, Homo sapien
gattttgccaaactgcccaaacatc

SEQ ID NO: 509002 - DNA, 25 bp, Homo sapien
catagtcttgagtgtgtggcacccc

SEQ ID NO: 509003 - DNA, 25 bp, Homo sapien
aaacatctgccggaggtcagggtcc

SEQ ID NO: 509004 - DNA, 25 bp, Homo sapien
attagagacatgcagccgtttcggg

SEQ ID NO: 509005 - DNA, 25 bp, Homo sapien
acatcctgctggtctgcagcgtggt

SEQ ID NO: 509006 - DNA, 25 bp, Homo sapien
agcctgtctacaccgtgtgagctga

SEQ ID NO: 509007 - DNA, 25 bp, Homo sapien
tgtctacaccgtgtgagctgaatcg

SEQ ID NO: 509008 - DNA, 25 bp, Homo sapien
agctgaatcgtgacttgcttcccac

SEQ ID NO: 509009 - DNA, 25 bp, Homo sapien
ggactcatggttcctaaataaccac

SEQ ID NO: 509010 - DNA, 25 bp, Homo sapien
gttcctaaataaccacgctcagaag

SEQ ID NO: 509011 - DNA, 25 bp, Homo sapien
aataaccacgctcagaagctctgct

SEQ ID NO: 509012 - DNA, 25 bp, Homo sapien
agaagctctgctaggacttacccca

SEQ ID NO: 509013 - DNA, 25 bp, Homo sapien
ccactgagtggcaggcgcatgagat

SEQ ID NO: 509014 - DNA, 25 bp, Homo sapien
gcgcatgagatttgtggctgttcct

SEQ ID NO: 509015 - DNA, 25 bp, Homo sapien
atttgtggctgttcctgatgctagt

SEQ ID NO: 509016 - DNA, 25 bp, Homo sapien
gcattgttgcattaagctttttcaa

SEQ ID NO: 509017 - DNA, 25 bp, Homo sapien
ataggcaacaccagcaaattatatg

SEQ ID NO: 509018 - DNA, 25 bp, Homo sapien
agcaaattatatgtggacaggttct

SEQ ID NO: 509019 - DNA, 25 bp, Homo sapien
gacaggttctaaactctatatatac

SEQ ID NO: 509020 - DNA, 25 bp, Homo sapien
tacgtaatcatctagttctgtcatc

SEQ ID NO: 509021 - DNA, 25 bp, Homo sapien
catctagttctgtcatcttactgaa

SEQ ID NO: 509022 - DNA, 25 bp, Homo sapien
gttctgtcatcttactgaaaggaat

SEQ ID NO: 509023 - DNA, 25 bp, Homo sapien
acttctaaagatcaccatttctgag

SEQ ID NO: 509024 - DNA, 25 bp, Homo sapien
agttcttggaaatctttatgtctaa

SEQ ID NO: 509025 - DNA, 25 bp, Homo sapien
ctaagtgattgtattagatcagcaa

SEQ ID NO: 509026 - DNA, 25 bp, Homo sapien
tcagcaataatgactatgtaatctc

SEQ ID NO: 509027 - DNA, 25 bp, Homo sapien
gctgaggttccggagtgaaacactg

SEQ ID NO: 509028 - DNA, 25 bp, Homo sapien
gaggttccggagtgaaacactgcct

SEQ ID NO: 509029 - DNA, 25 bp, Homo sapien
gtgaaacactgcctttcatggaagc

SEQ ID NO: 509030 - DNA, 25 bp, Homo sapien
ttcatggaagcacgtcttcctgtca

SEQ ID NO: 509031 - DNA, 25 bp, Homo sapien
gtcacccatcggcttcattttaaag

SEQ ID NO: 509032 - DNA, 25 bp, Homo sapien
cacccatcggcttcattttaaagga

SEQ ID NO: 509033 - DNA, 25 bp, Homo sapien
ggagagctgcatcacataaaagaaa

SEQ ID NO: 509034 - DNA, 25 bp, Homo sapien
cacagggaatctgagatgggagcca

SEQ ID NO: 509035 - DNA, 25 bp, Homo sapien
gagaaatgtgaatgactccaatcat

SEQ ID NO: 509036 - DNA, 25 bp, Homo sapien
gtgaatgactccaatcattccaatc

SEQ ID NO: 509037 - DNA, 25 bp, Homo sapien
atgctgtggatctggatccagcgtg

SEQ ID NO: 509038 - DNA, 25 bp, Homo sapien
gcagtgtgtatggtttattcactca

SEQ ID NO: 509039 - DNA, 25 bp, Homo sapien
ttattcactcagtaattcctttagc

SEQ ID NO: 509040 - DNA, 25 bp, Homo sapien
ttattgaggatctactaggtgccag

SEQ ID NO: 509041 - DNA, 25 bp, Homo sapien
actaggtgccaggtatcatgatact

SEQ ID NO: 509042 - DNA, 25 bp, Homo sapien
aaacagacctgttctccgctcttga

SEQ ID NO: 509043 - DNA, 25 bp, Homo sapien
gttctccgctcttgaggaaatcaaa

SEQ ID NO: 509044 - DNA, 25 bp, Homo sapien
aaatgtgttaagtaccacgaggaga

SEQ ID NO: 509045 - DNA, 25 bp, Homo sapien
gtaccacgaggagaaatatcagggc

SEQ ID NO: 509046 - DNA, 25 bp, Homo sapien
tttgaagaagggtgtgacctgccac

SEQ ID NO: 509047 - DNA, 25 bp, Homo sapien
agggtgtgacctgccaccattttaa

SEQ ID NO: 509048 - DNA, 25 bp, Homo sapien
aatctagttatttcactcctgagct

SEQ ID NO: 509049 - DNA, 25 bp, Homo sapien
attggtatcattaaggacccagagc

SEQ ID NO: 509050 - DNA, 25 bp, Homo sapien
tatcattaaggacccagagctgccc

SEQ ID NO: 509051 - DNA, 25 bp, Homo sapien
ttctctttgttctaatagggaagca

SEQ ID NO: 509052 - DNA, 25 bp, Homo sapien
tagggaagcaattactgatagaaat

SEQ ID NO: 509053 - DNA, 25 bp, Homo sapien
aacaaatgcctaaacacagtatgta

SEQ ID NO: 509054 - DNA, 25 bp, Homo sapien
aacacagtatgtatctcagtcctct

SEQ ID NO: 509055 - DNA, 25 bp, Homo sapien
cagtatgtatctcagtcctctgttc

SEQ ID NO: 509056 - DNA, 25 bp, Homo sapien
tatgtatctcagtcctctgttccca

SEQ ID NO: 509057 - DNA, 25 bp, Homo sapien
atctcagtcctctgttcccagagat

SEQ ID NO: 509058 - DNA, 25 bp, Homo sapien
cagtcctctgttcccagagattcca

SEQ ID NO: 509059 - DNA, 25 bp, Homo sapien
tctgttcccagagattccaccctag

SEQ ID NO: 509060 - DNA, 25 bp, Homo sapien
gtcctatgactaatgttactggcag

SEQ ID NO: 509061 - DNA, 25 bp, Homo sapien
gttactggcagagcaaataatctaa

SEQ ID NO: 509062 - DNA, 25 bp, Homo sapien
tggattaccatctccgtgctgtgca

SEQ ID NO: 509063 - DNA, 25 bp, Homo sapien
cagtgctgtgctggcaggaaaatag

SEQ ID NO: 509064 - DNA, 25 bp, Homo sapien
gagaaaaagcagatcctatactata

SEQ ID NO: 509065 - DNA, 25 bp, Homo sapien
tagggactgtagtatctatgacgta

SEQ ID NO: 509066 - DNA, 25 bp, Homo sapien
gtatctatgacgtagccagccattc

SEQ ID NO: 509067 - DNA, 25 bp, Homo sapien
atgacgtagccagccattctttgct

SEQ ID NO: 509068 - DNA, 25 bp, Homo sapien
ccattctttgctcccaaggcaagaa

SEQ ID NO: 509069 - DNA, 25 bp, Homo sapien
tgacagagtcaatatagggttgcca

SEQ ID NO: 509070 - DNA, 25 bp, Homo sapien
atagggttgccaaatcggattttct

SEQ ID NO: 509071 - DNA, 25 bp, Homo sapien
aaagctctataaatgttcagttgac

SEQ ID NO: 509072 - DNA, 25 bp, Homo sapien
gatgggtacttttagaggatgaaac

SEQ ID NO: 509073 - DNA, 25 bp, Homo sapien
attttacaagaactaggtgccgatg

SEQ ID NO: 509074 - DNA, 25 bp, Homo sapien
ggtgccgatgagactgctgtagcca

SEQ ID NO: 509075 - DNA, 25 bp, Homo sapien
gactgctgtagccagtattttggaa

SEQ ID NO: 509076 - DNA, 25 bp, Homo sapien
agtattttggaacgctgcccggaag

SEQ ID NO: 509077 - DNA, 25 bp, Homo sapien
tgcccggaagcaattgtctgtagtc

SEQ ID NO: 509078 - DNA, 25 bp, Homo sapien
ttgtctgtagtccaaccgctgttaa

SEQ ID NO: 509079 - DNA, 25 bp, Homo sapien
caaccgctgttaacacccagagaaa

SEQ ID NO: 509080 - DNA, 25 bp, Homo sapien
aaactctggcagttggtctgcaaaa

SEQ ID NO: 509081 - DNA, 25 bp, Homo sapien
agttaatagagcagtttccagaatc

SEQ ID NO: 509082 - DNA, 25 bp, Homo sapien
gagagacgccaatggttcttgaatt

SEQ ID NO: 509083 - DNA, 25 bp, Homo sapien
gacgccaatggttcttgaattaaca

SEQ ID NO: 509084 - DNA, 25 bp, Homo sapien
atggttcttgaattaacaccacaga

SEQ ID NO: 509085 - DNA, 25 bp, Homo sapien
aacaccacagatagtacagtacagg

SEQ ID NO: 509086 - DNA, 25 bp, Homo sapien
aaggatggacatctagcaaatctaa

SEQ ID NO: 509087 - DNA, 25 bp, Homo sapien
ggacatctagcaaatctaaatggat

SEQ ID NO: 509088 - DNA, 25 bp, Homo sapien
aaagagtttgaagctaattttggca

SEQ ID NO: 509089 - DNA, 25 bp, Homo sapien
ttcaggccaaaaaagtaaggccatt

SEQ ID NO: 509090 - DNA, 25 bp, Homo sapien
gtaaggccattatttaaccctgtgg

SEQ ID NO: 509091 - DNA, 25 bp, Homo sapien
cattatttaaccctgtggcaccatt

SEQ ID NO: 509092 - DNA, 25 bp, Homo sapien
gtggcaccattaaatgttgaagaat

SEQ ID NO: 509093 - DNA, 25 bp, Homo sapien
caaatgtgaaaacaggtttcccctg

SEQ ID NO: 509094 - DNA, 25 bp, Homo sapien
aggtttcccctgtgttgcccgtcat

SEQ ID NO: 509095 - DNA, 25 bp, Homo sapien
ctttggcccgttcacaggaatggag

SEQ ID NO: 509096 - DNA, 25 bp, Homo sapien
ttaggctttcattcccagcagtgtt

SEQ ID NO: 509097 - DNA, 25 bp, Homo sapien
tcccagcagtgtttactgaggacct

SEQ ID NO: 509098 - DNA, 25 bp, Homo sapien
actgaggacctggttttctagaaca

SEQ ID NO: 509099 - DNA, 25 bp, Homo sapien
aacaggtgtgtcctgtcctcttcca

SEQ ID NO: 509100 - DNA, 25 bp, Homo sapien
tgaactgactagagacccatctgga

SEQ ID NO: 509101 - DNA, 25 bp, Homo sapien
gacccatctggaggcaaatattaag

SEQ ID NO: 509102 - DNA, 25 bp, Homo sapien
ttaagttgccaggactgctttcact

SEQ ID NO: 509103 - DNA, 25 bp, Homo sapien
actgctttcacttcagggtgattga

SEQ ID NO: 509104 - DNA, 25 bp, Homo sapien
gagatgcttttgcttatgttcaaga

SEQ ID NO: 509105 - DNA, 25 bp, Homo sapien
gctggatttgtccatcaacttcagg

SEQ ID NO: 509106 - DNA, 25 bp, Homo sapien
gaatatgaagccatctacctagcaa

SEQ ID NO: 509107 - DNA, 25 bp, Homo sapien
aatacagatgatgtcaccactccag

SEQ ID NO: 509108 - DNA, 25 bp, Homo sapien
gatgatgtcaccactccagatagaa

SEQ ID NO: 509109 - DNA, 25 bp, Homo sapien
cattatctgttcattctggtaccac

SEQ ID NO: 509110 - DNA, 25 bp, Homo sapien
attctggtaccacaggcagtttgaa

SEQ ID NO: 509111 - DNA, 25 bp, Homo sapien
agaggatgattttggaaccatgcaa

SEQ ID NO: 509112 - DNA, 25 bp, Homo sapien
gaaccatgcaagtggcgactgcaca

SEQ ID NO: 509113 - DNA, 25 bp, Homo sapien
ggcgactgcacagaatggctgactt

SEQ ID NO: 509114 - DNA, 25 bp, Homo sapien
aatggctgacttgaagagcaacatc

SEQ ID NO: 509115 - DNA, 25 bp, Homo sapien
tgctggagttaaccgaatttcatac

SEQ ID NO: 509116 - DNA, 25 bp, Homo sapien
ttcatactggcctgctgatccagaa

SEQ ID NO: 509117 - DNA, 25 bp, Homo sapien
tgcttacggaggcttctagttctga

SEQ ID NO: 509118 - DNA, 25 bp, Homo sapien
gaagtcaaacagtcgggcccatgtg

SEQ ID NO: 509119 - DNA, 25 bp, Homo sapien
ggcccatgtgtgtgtcttacttcaa

SEQ ID NO: 509120 - DNA, 25 bp, Homo sapien
gtgtcttacttcaacctttggtgtg

SEQ ID NO: 509121 - DNA, 25 bp, Homo sapien
cctttggtgtgttatatggtgcagt

SEQ ID NO: 509122 - DNA, 25 bp, Homo sapien
tggtgcagtttgtagaggagacctc

SEQ ID NO: 509123 - DNA, 25 bp, Homo sapien
gaggagacctcttacaaatgtgact

SEQ ID NO: 509124 - DNA, 25 bp, Homo sapien
aaacattgccggatgctaacactga

SEQ ID NO: 509125 - DNA, 25 bp, Homo sapien
gctaacactgacttttattatgaat

SEQ ID NO: 509126 - DNA, 25 bp, Homo sapien
ttatcattcagcttgctttgtgttg

SEQ ID NO: 509127 - DNA, 25 bp, Homo sapien
tcattcagcttgctttgtgttgttt

SEQ ID NO: 509128 - DNA, 25 bp, Homo sapien
ggtacagtgggacagttttattttg

SEQ ID NO: 509129 - DNA, 25 bp, Homo sapien
gagaagtttcctttgatcaagccat

SEQ ID NO: 509130 - DNA, 25 bp, Homo sapien
gaagtttcctttgatcaagccatat

SEQ ID NO: 509131 - DNA, 25 bp, Homo sapien
agtttagaaaactatctctgctatt

SEQ ID NO: 509132 - DNA, 25 bp, Homo sapien
tctctgctattttattctgctttta

SEQ ID NO: 509133 - DNA, 25 bp, Homo sapien
tatttctgtcccttagactttaaca

SEQ ID NO: 509134 - DNA, 25 bp, Homo sapien
aacactgtcagtgctaatcatagaa

SEQ ID NO: 509135 - DNA, 25 bp, Homo sapien
gtcagtgctaatcatagaaaatcag

SEQ ID NO: 509136 - DNA, 25 bp, Homo sapien
aaatcagactatggcttgaaatgac

SEQ ID NO: 509137 - DNA, 25 bp, Homo sapien
aacatactacagcattagccaccac

SEQ ID NO: 509138 - DNA, 25 bp, Homo sapien
ccaccacaccttaagatgcatttca

SEQ ID NO: 509139 - DNA, 25 bp, Homo sapien
tttcacagccaaaataagtctcatt

SEQ ID NO: 509140 - DNA, 25 bp, Homo sapien
tttcttttcatgacacatttctctt

SEQ ID NO: 509141 - DNA, 25 bp, Homo sapien
acatgttaacaccttgctactacca

SEQ ID NO: 509142 - DNA, 25 bp, Homo sapien
tgctactaccaaggcataattactt

SEQ ID NO: 509143 - DNA, 25 bp, Homo sapien
taattacttaacatgcttcgaggct

SEQ ID NO: 509144 - DNA, 25 bp, Homo sapien
gcttcgaggctgtagattccaagta

SEQ ID NO: 509145 - DNA, 25 bp, Homo sapien
ggaactataaacattgcactgaaaa

SEQ ID NO: 509146 - DNA, 25 bp, Homo sapien
ctttaaagctttacctgacctgtca

SEQ ID NO: 509147 - DNA, 25 bp, Homo sapien
acctgacctgtcagtttgtagacaa

SEQ ID NO: 509148 - DNA, 25 bp, Homo sapien
gctctgtaaagcaggattcacaata

SEQ ID NO: 509149 - DNA, 25 bp, Homo sapien
gattcacaatagtgaccttgtcctt

SEQ ID NO: 509150 - DNA, 25 bp, Homo sapien
atagtgaccttgtcctttggaggaa

SEQ ID NO: 509151 - DNA, 25 bp, Homo sapien
acagcaaactcccatcaggcctgat

SEQ ID NO: 509152 - DNA, 25 bp, Homo sapien
tcaggcctgatcaccctggtgtgaa

SEQ ID NO: 509153 - DNA, 25 bp, Homo sapien
tcaccctggtgtgaacattaaccca

SEQ ID NO: 509154 - DNA, 25 bp, Homo sapien
taacccagaactagcttacttactt

SEQ ID NO: 509155 - DNA, 25 bp, Homo sapien
atctgggcttcagtccctgttcggc

SEQ ID NO: 509156 - DNA, 25 bp, Homo sapien
tctgggttggtctgaactactcttt

SEQ ID NO: 509157 - DNA, 25 bp, Homo sapien
tggtctgaactactctttggaaaaa

SEQ ID NO: 509158 - DNA, 25 bp, Homo sapien
tccctgttcggccacatactagctg

SEQ ID NO: 509159 - DNA, 25 bp, Homo sapien
tgattctaagtcaagtctctctctg

SEQ ID NO: 509160 - DNA, 25 bp, Homo sapien
ctctgttgccttcctccgggcagga

SEQ ID NO: 509161 - DNA, 25 bp, Homo sapien
ggctgtgatgtatcctggcgagcct

SEQ ID NO: 509162 - DNA, 25 bp, Homo sapien
agagcagaggtgaatgggcctccca

SEQ ID NO: 509163 - DNA, 25 bp, Homo sapien
aatgggcctcccaggttgagcttgt

SEQ ID NO: 509164 - DNA, 25 bp, Homo sapien
gcctcccaggttgagcttgtgatgg

SEQ ID NO: 509165 - DNA, 25 bp, Homo sapien
caagtagactggcacgggatgaggt

SEQ ID NO: 509166 - DNA, 25 bp, Homo sapien
atcagtgtcatcattcccctttaac

SEQ ID NO: 509167 - DNA, 25 bp, Homo sapien
tcatcattcccctttaaccgttgga

SEQ ID NO: 509168 - DNA, 25 bp, Homo sapien
tcccctttaaccgttggaagacatg

SEQ ID NO: 509169 - DNA, 25 bp, Homo sapien
ttaaccgttggaagacatgagtctg

SEQ ID NO: 509170 - DNA, 25 bp, Homo sapien
tggaatcagtgcaacagtgggaact

SEQ ID NO: 509171 - DNA, 25 bp, Homo sapien
gcaacagtgggaactaccttttaca

SEQ ID NO: 509172 - DNA, 25 bp, Homo sapien
ggaactaccttttacaagtatccat

SEQ ID NO: 509173 - DNA, 25 bp, Homo sapien
gtatccattgcttcataaactccat

SEQ ID NO: 509174 - DNA, 25 bp, Homo sapien
actccatttgtttggaccaatccct

SEQ ID NO: 509175 - DNA, 25 bp, Homo sapien
tggaccaatcccttaaacaaaagca

SEQ ID NO: 509176 - DNA, 25 bp, Homo sapien
aattttacatggatttagagcctag

SEQ ID NO: 509177 - DNA, 25 bp, Homo sapien
gatttagagcctaggtcaggttatt

SEQ ID NO: 509178 - DNA, 25 bp, Homo sapien
ggattataaattttccactggtatg

SEQ ID NO: 509179 - DNA, 25 bp, Homo sapien
ggtatgtcattgtgattatctttgt

SEQ ID NO: 509180 - DNA, 25 bp, Homo sapien
tggattttctataacaccttgtgta

SEQ ID NO: 509181 - DNA, 25 bp, Homo sapien
tgtgctcagccatgaggactgggaa

SEQ ID NO: 509182 - DNA, 25 bp, Homo sapien
catgaggactgggaagagtcctgcc

SEQ ID NO: 509183 - DNA, 25 bp, Homo sapien
cagctcaagtgtctacaccgcactg

SEQ ID NO: 509184 - DNA, 25 bp, Homo sapien
tcaagtgtctacaccgcactgccat

SEQ ID NO: 509185 - DNA, 25 bp, Homo sapien
accgcactgccatccaggctgtgag

SEQ ID NO: 509186 - DNA, 25 bp, Homo sapien
tggctgctgcagagacgttatgaaa

SEQ ID NO: 509187 - DNA, 25 bp, Homo sapien
gctgctgcagagacgttatgaaaca

SEQ ID NO: 509188 - DNA, 25 bp, Homo sapien
gcagagacgttatgaaacacttcta

SEQ ID NO: 509189 - DNA, 25 bp, Homo sapien
gacgttatgaaacacttctaaaaga

SEQ ID NO: 509190 - DNA, 25 bp, Homo sapien
tttgagtacctgttaaaatgatagt

SEQ ID NO: 509191 - DNA, 25 bp, Homo sapien
atagtaattttggatctagtagatt

SEQ ID NO: 509192 - DNA, 25 bp, Homo sapien
atttggtatagcctgttggtcctgg

SEQ ID NO: 509193 - DNA, 25 bp, Homo sapien
tttggtatagcctgttggtcctggg

SEQ ID NO: 509194 - DNA, 25 bp, Homo sapien
tagcctgttggtcctggggtacaaa

SEQ ID NO: 509195 - DNA, 25 bp, Homo sapien
gggtacaaatctgtacaacatgtta

SEQ ID NO: 509196 - DNA, 25 bp, Homo sapien
gtacaaatctgtacaacatgttact

SEQ ID NO: 509197 - DNA, 25 bp, Homo sapien
gttttataatcttctgggaccacca

SEQ ID NO: 509198 - DNA, 25 bp, Homo sapien
attgaccaaaacatcgttatccagc

SEQ ID NO: 509199 - DNA, 25 bp, Homo sapien
gaccaaaacatcgttatccagcata

SEQ ID NO: 509200 - DNA, 25 bp, Homo sapien
aaaacatcgttatccagcatatgac

SEQ ID NO: 509201 - DNA, 25 bp, Homo sapien
aaacatcatagcatgtacttccaca

SEQ ID NO: 509202 - DNA, 25 bp, Homo sapien
catcatagcatgtacttccacaaac

SEQ ID NO: 509203 - DNA, 25 bp, Homo sapien
cagcagcggtctgggccctgaggac

SEQ ID NO: 509204 - DNA, 25 bp, Homo sapien
gaggttgagagagtggcccccatct

SEQ ID NO: 509205 - DNA, 25 bp, Homo sapien
tgactgcacacacagtgtggcgtga

SEQ ID NO: 509206 - DNA, 25 bp, Homo sapien
cacacacagtgtggcgtgagggaca

SEQ ID NO: 509207 - DNA, 25 bp, Homo sapien
cacagtgtggcgtgagggacataca

SEQ ID NO: 509208 - DNA, 25 bp, Homo sapien
tgtggcgtgagggacatacagccct

SEQ ID NO: 509209 - DNA, 25 bp, Homo sapien
tggcgtgagggacatacagccctct

SEQ ID NO: 509210 - DNA, 25 bp, Homo sapien
tgagggacatacagccctctccctg

SEQ ID NO: 509211 - DNA, 25 bp, Homo sapien
tagcccagctgatacgtgctgctct

SEQ ID NO: 509212 - DNA, 25 bp, Homo sapien
agcccagctgatacgtgctgctctg

SEQ ID NO: 509213 - DNA, 25 bp, Homo sapien
agctgatacgtgctgctctgtcccc

SEQ ID NO: 509214 - DNA, 25 bp, Homo sapien
caacatgataaccagagtcttcctt

SEQ ID NO: 509215 - DNA, 25 bp, Homo sapien
agagtcttccttcacattgtactgc

SEQ ID NO: 509216 - DNA, 25 bp, Homo sapien
cttggttttattacctccttgcagt

SEQ ID NO: 509217 - DNA, 25 bp, Homo sapien
ttacctccttgcagtccattttcag

SEQ ID NO: 509218 - DNA, 25 bp, Homo sapien
cattgatctccacccgcacaatgat

SEQ ID NO: 509219 - DNA, 25 bp, Homo sapien
actcccgccggatgggtgtatacca

SEQ ID NO: 509220 - DNA, 25 bp, Homo sapien
accagagactgcctgtgtacagcga

SEQ ID NO: 509221 - DNA, 25 bp, Homo sapien
gtacagcgagtggtcgatacctcca

SEQ ID NO: 509222 - DNA, 25 bp, Homo sapien
gtggtcgatacctccaatgatctag

SEQ ID NO: 509223 - DNA, 25 bp, Homo sapien
gactgttctaggctcaacttccaac

SEQ ID NO: 509224 - DNA, 25 bp, Homo sapien
caaccctttctgcaggtcctattac

SEQ ID NO: 509225 - DNA, 25 bp, Homo sapien
gggctggactgtctagtctaactag

SEQ ID NO: 509226 - DNA, 25 bp, Homo sapien
taactaggcagtgaaccctgtcctg

SEQ ID NO: 509227 - DNA, 25 bp, Homo sapien
aaccctgtcctgaacagagcttgtt

SEQ ID NO: 509228 - DNA, 25 bp, Homo sapien
gcttgtttgttcataaagcactcta

SEQ ID NO: 509229 - DNA, 25 bp, Homo sapien
aagcactctaaagcagtgactttta

SEQ ID NO: 509230 - DNA, 25 bp, Homo sapien
gtgacttttaaatcttgatctgtgc

SEQ ID NO: 509231 - DNA, 25 bp, Homo sapien
tgatctgtgcataatctcactcctc

SEQ ID NO: 509232 - DNA, 25 bp, Homo sapien
ccaaagagtcatcaagggagagcaa

SEQ ID NO: 509233 - DNA, 25 bp, Homo sapien
ggagagcaaacacccaagggtaacg

SEQ ID NO: 509234 - DNA, 25 bp, Homo sapien
aagggtaacgttggctcacgttcat

SEQ ID NO: 509235 - DNA, 25 bp, Homo sapien
tggctcacgttcattttgttgttgt

SEQ ID NO: 509236 - DNA, 25 bp, Homo sapien
tgagattttaggtatctgccttggt

SEQ ID NO: 509237 - DNA, 25 bp, Homo sapien
gagattttaggtatctgccttggtt

SEQ ID NO: 509238 - DNA, 25 bp, Homo sapien
agattttaggtatctgccttggttt

SEQ ID NO: 509239 - DNA, 25 bp, Homo sapien
gattttaggtatctgccttggtttc

SEQ ID NO: 509240 - DNA, 25 bp, Homo sapien
attttaggtatctgccttggtttca

SEQ ID NO: 509241 - DNA, 25 bp, Homo sapien
ttttaggtatctgccttggtttcag

SEQ ID NO: 509242 - DNA, 25 bp, Homo sapien
tttcagtggggacatctggggctta

SEQ ID NO: 509243 - DNA, 25 bp, Homo sapien
ttcagtggggacatctggggcttat

SEQ ID NO: 509244 - DNA, 25 bp, Homo sapien
tcagtggggacatctggggcttatg

SEQ ID NO: 509245 - DNA, 25 bp, Homo sapien
cagtggggacatctggggcttatgg

SEQ ID NO: 509246 - DNA, 25 bp, Homo sapien
agtggggacatctggggcttatggg

SEQ ID NO: 509247 - DNA, 25 bp, Homo sapien
tacaagactctaccacgtcatgtct

SEQ ID NO: 509248 - DNA, 25 bp, Homo sapien
taccacgtcatgtctccagttacat

SEQ ID NO: 509249 - DNA, 25 bp, Homo sapien
gtcatgtctccagttacatctctta

SEQ ID NO: 509250 - DNA, 25 bp, Homo sapien
atgtctccagttacatctcttaacc

SEQ ID NO: 509251 - DNA, 25 bp, Homo sapien
agttacatctcttaacccctcttct

SEQ ID NO: 509252 - DNA, 25 bp, Homo sapien
ctcttaacccctcttcttgagaaga

SEQ ID NO: 509253 - DNA, 25 bp, Homo sapien
tcttcttgagaagagtggacccctc

SEQ ID NO: 509254 - DNA, 25 bp, Homo sapien
tgaaggttcgcaggtatggtggtgt

SEQ ID NO: 509255 - DNA, 25 bp, Homo sapien
aagagtggacccctcacatatgctt

SEQ ID NO: 509256 - DNA, 25 bp, Homo sapien
acccctcacatatgcttctatgtta

SEQ ID NO: 509257 - DNA, 25 bp, Homo sapien
atgcttctatgttaggagatttaca

SEQ ID NO: 509258 - DNA, 25 bp, Homo sapien
caaagtaataggcttcttgtccctt

SEQ ID NO: 509259 - DNA, 25 bp, Homo sapien
ttttctggcatgttatggaatgatc

SEQ ID NO: 509260 - DNA, 25 bp, Homo sapien
gaagttcaactcaggaaggtgcaat

SEQ ID NO: 509261 - DNA, 25 bp, Homo sapien
gatcattgtaaatcaggaccattta

SEQ ID NO: 509262 - DNA, 25 bp, Homo sapien
atcaagcagtacaccaactcataag

SEQ ID NO: 509263 - DNA, 25 bp, Homo sapien
ggtttgaggttgtagctctataaat

SEQ ID NO: 509264 - DNA, 25 bp, Homo sapien
atagtagtttttaacatgcctgtag

SEQ ID NO: 509265 - DNA, 25 bp, Homo sapien
atgcctgtagtattgctaactgcaa

SEQ ID NO: 509266 - DNA, 25 bp, Homo sapien
tgctaactgcaaaaacatactcttt

SEQ ID NO: 509267 - DNA, 25 bp, Homo sapien
atactctttgtacaagaagtgcttc

SEQ ID NO: 509268 - DNA, 25 bp, Homo sapien
ggtactaccgttccagattttctgt

SEQ ID NO: 509269 - DNA, 25 bp, Homo sapien
gaggcctcaagtttcgggctgaagc

SEQ ID NO: 509270 - DNA, 25 bp, Homo sapien
gtttcgggctgaagcaacagagtcc

SEQ ID NO: 509271 - DNA, 25 bp, Homo sapien
aacagagtcccaaccagtgggcgta

SEQ ID NO: 509272 - DNA, 25 bp, Homo sapien
aaccagtgggcgtatcccaagatga

SEQ ID NO: 509273 - DNA, 25 bp, Homo sapien
gagggtctgcaagaacagctcagca

SEQ ID NO: 509274 - DNA, 25 bp, Homo sapien
gaacagctcagcaggaatactcata

SEQ ID NO: 509275 - DNA, 25 bp, Homo sapien
ttctcctgggagctgtgataatagt

SEQ ID NO: 509276 - DNA, 25 bp, Homo sapien
taatagtttattcacccaaaatgtc

SEQ ID NO: 509277 - DNA, 25 bp, Homo sapien
tttttgaataccctgctctgtggat

SEQ ID NO: 509278 - DNA, 25 bp, Homo sapien
tgtggatttgtaaaaccagccttga

SEQ ID NO: 509279 - DNA, 25 bp, Homo sapien
tcttgggagaaacagcagaggcctc

SEQ ID NO: 509280 - DNA, 25 bp, Homo sapien
agcctacagatatgcacagcctgct

SEQ ID NO: 509281 - DNA, 25 bp, Homo sapien
tgcagccgcttacagtgacggttat

SEQ ID NO: 509282 - DNA, 25 bp, Homo sapien
tatggcagggtgtacacagccgacc

SEQ ID NO: 509283 - DNA, 25 bp, Homo sapien
ttgcccctgccgctagctatggagt

SEQ ID NO: 509284 - DNA, 25 bp, Homo sapien
ccgctagctatggagttggcgctgt

SEQ ID NO: 509285 - DNA, 25 bp, Homo sapien
tggcgctgtggcgagtttataccga

SEQ ID NO: 509286 - DNA, 25 bp, Homo sapien
tttataccgaggtggctacagccga

SEQ ID NO: 509287 - DNA, 25 bp, Homo sapien
tactgaagtgacgtgagacccctgc

SEQ ID NO: 509288 - DNA, 25 bp, Homo sapien
acgtgagacccctgcaaatgggaca

SEQ ID NO: 509289 - DNA, 25 bp, Homo sapien
cccagttcatgaggcctggctattg

SEQ ID NO: 509290 - DNA, 25 bp, Homo sapien
gaggcctggctattgcaatatttac

SEQ ID NO: 509291 - DNA, 25 bp, Homo sapien
gctttactcttttgtttataggtga

SEQ ID NO: 509292 - DNA, 25 bp, Homo sapien
tctgtagttcaatagccatggctgt

SEQ ID NO: 509293 - DNA, 25 bp, Homo sapien
aggcctaaacatgagcttcacttcc

SEQ ID NO: 509294 - DNA, 25 bp, Homo sapien
ttcacttccccactaactaattagc

SEQ ID NO: 509295 - DNA, 25 bp, Homo sapien
ttagcatctgttatttcttaaccgt

SEQ ID NO: 509296 - DNA, 25 bp, Homo sapien
ttcttaaccgtaatgcctaggccta

SEQ ID NO: 509297 - DNA, 25 bp, Homo sapien
aatgcctaggcctaacctcaaccaa

SEQ ID NO: 509298 - DNA, 25 bp, Homo sapien
gaaacataacaactatatcagctag

SEQ ID NO: 509299 - DNA, 25 bp, Homo sapien
ttttctatgctttacctgctatgga

SEQ ID NO: 509300 - DNA, 25 bp, Homo sapien
ttacctgctatggaaaatttgacac

SEQ ID NO: 509301 - DNA, 25 bp, Homo sapien
aatttgacacattctgctttactct

SEQ ID NO: 509302 - DNA, 25 bp, Homo sapien
tgaggtagcatgtgtgccgcttcca

SEQ ID NO: 509303 - DNA, 25 bp, Homo sapien
agacagcagttcgaggaatgccctt

SEQ ID NO: 509304 - DNA, 25 bp, Homo sapien
tcgaggaatgcccttggaatgccct

SEQ ID NO: 509305 - DNA, 25 bp, Homo sapien
ttggaatgccctcctaggccggagc

SEQ ID NO: 509306 - DNA, 25 bp, Homo sapien
tcaatgcctacgagcgcgaagtgat

SEQ ID NO: 509307 - DNA, 25 bp, Homo sapien
acatgctgaactcactgtcgcggaa

SEQ ID NO: 509308 - DNA, 25 bp, Homo sapien
ggaaccagcagctgccgcggatcac

SEQ ID NO: 509309 - DNA, 25 bp, Homo sapien
gcccttccatggttacgaaagtgct

SEQ ID NO: 509310 - DNA, 25 bp, Homo sapien
ttacgaaagtgcttgctcgggccgc

SEQ ID NO: 509311 - DNA, 25 bp, Homo sapien
ccactactgtctgcgcgggatggac

SEQ ID NO: 509312 - DNA, 25 bp, Homo sapien
tgcgcgggatggactactacgccag

SEQ ID NO: 509313 - DNA, 25 bp, Homo sapien
agaccaaaacaggtgaatataccaa

SEQ ID NO: 509314 - DNA, 25 bp, Homo sapien
aacactctgataagcaacaccctgg

SEQ ID NO: 509315 - DNA, 25 bp, Homo sapien
actctgataagcaacaccctggaaa

SEQ ID NO: 509316 - DNA, 25 bp, Homo sapien
aacaccctggaaaggacctgcattc

SEQ ID NO: 509317 - DNA, 25 bp, Homo sapien
accctggaaaggacctgcattcctg

SEQ ID NO: 509318 - DNA, 25 bp, Homo sapien
ggaaaggacctgcattcctgatctg

SEQ ID NO: 509319 - DNA, 25 bp, Homo sapien
aaaggacctgcattcctgatctgac

SEQ ID NO: 509320 - DNA, 25 bp, Homo sapien
aggacctgcattcctgatctgactg

SEQ ID NO: 509321 - DNA, 25 bp, Homo sapien
tgcattcctgatctgactgtcctga

SEQ ID NO: 509322 - DNA, 25 bp, Homo sapien
cattcctgatctgactgtcctgaaa

SEQ ID NO: 509323 - DNA, 25 bp, Homo sapien
ttcctgatctgactgtcctgaaaac

SEQ ID NO: 509324 - DNA, 25 bp, Homo sapien
gagatgtggatctgtctcgcacaag

SEQ ID NO: 509325 - DNA, 25 bp, Homo sapien
agcctgggactctggtggtaatcta

SEQ ID NO: 509326 - DNA, 25 bp, Homo sapien
tatcccacatttcagcactcaaagt

SEQ ID NO: 509327 - DNA, 25 bp, Homo sapien
tcaaagtctgtgtggtccgtgtagg

SEQ ID NO: 509328 - DNA, 25 bp, Homo sapien
gtccgtgtagggtcggatccataca

SEQ ID NO: 509329 - DNA, 25 bp, Homo sapien
ggtcggatccatacatgtagagctc

SEQ ID NO: 509330 - DNA, 25 bp, Homo sapien
atgtagagctcaagggtaagcccaa

SEQ ID NO: 509331 - DNA, 25 bp, Homo sapien
gtaagcccaagagttcatgagcaac

SEQ ID NO: 509332 - DNA, 25 bp, Homo sapien
gataatcaccccaaatgggttcaga

SEQ ID NO: 509333 - DNA, 25 bp, Homo sapien
agaccacaaattccaagttcctgca

SEQ ID NO: 509334 - DNA, 25 bp, Homo sapien
aagttcctgcaagacttgtgtggat

SEQ ID NO: 509335 - DNA, 25 bp, Homo sapien
atccaatgcatgtttgttctctctc

SEQ ID NO: 509336 - DNA, 25 bp, Homo sapien
tttgttctctctcctgatatattga

SEQ ID NO: 509337 - DNA, 25 bp, Homo sapien
tctcctgatatattgaacaccacac

SEQ ID NO: 509338 - DNA, 25 bp, Homo sapien
ccacacagttgtgaagccgtgcagt

SEQ ID NO: 509339 - DNA, 25 bp, Homo sapien
gcatctacccctgtgtataaggaaa

SEQ ID NO: 509340 - DNA, 25 bp, Homo sapien
gaaagacattttcctttgctgtact

SEQ ID NO: 509341 - DNA, 25 bp, Homo sapien
ttcctttgctgtacttgcttgagca

SEQ ID NO: 509342 - DNA, 25 bp, Homo sapien
gcttgagcagttttattgtctgtac

SEQ ID NO: 509343 - DNA, 25 bp, Homo sapien
gtctgtacatgtgagctgtgtgaga

SEQ ID NO: 509344 - DNA, 25 bp, Homo sapien
tttcctgccccatgtatacagattg

SEQ ID NO: 509345 - DNA, 25 bp, Homo sapien
ttgtcatctgtacaaggaactgtat

SEQ ID NO: 509346 - DNA, 25 bp, Homo sapien
catggagttggcaaactttcttcaa

SEQ ID NO: 509347 - DNA, 25 bp, Homo sapien
caagtattgagttctgttcaatgca

SEQ ID NO: 509348 - DNA, 25 bp, Homo sapien
gttcaatgcattggacatgtgattt

SEQ ID NO: 509349 - DNA, 25 bp, Homo sapien
gaatgcttatagatgatgaaaacct

SEQ ID NO: 509350 - DNA, 25 bp, Homo sapien
ggctgcagagcccagtttagaagaa

SEQ ID NO: 509351 - DNA, 25 bp, Homo sapien
tggtggtggtatttcccaactgttt

SEQ ID NO: 509352 - DNA, 25 bp, Homo sapien
caactgtttcctcccctaaattcag

SEQ ID NO: 509353 - DNA, 25 bp, Homo sapien
aagggatgaaaccagctgctgttgc

SEQ ID NO: 509354 - DNA, 25 bp, Homo sapien
tgaaaccagctgctgttgcaaaggc

SEQ ID NO: 509355 - DNA, 25 bp, Homo sapien
gcttgtcattgatagaaggactcac

SEQ ID NO: 509356 - DNA, 25 bp, Homo sapien
ggactcacgggcttggattgattaa

SEQ ID NO: 509357 - DNA, 25 bp, Homo sapien
atttggtatagcctgttggtcctgg

SEQ ID NO: 509358 - DNA, 25 bp, Homo sapien
tagcctgttggtcctggggtacaaa

SEQ ID NO: 509359 - DNA, 25 bp, Homo sapien
gggtacaaatctgtacaacatgtta

SEQ ID NO: 509360 - DNA, 25 bp, Homo sapien
gttttataatcttctgggaccacca

SEQ ID NO: 509361 - DNA, 25 bp, Homo sapien
gggaccaccattgtatatgcggtac

SEQ ID NO: 509362 - DNA, 25 bp, Homo sapien
gtatatgcggtacatcattgaccaa

SEQ ID NO: 509363 - DNA, 25 bp, Homo sapien
attgaccaaaacatcgttatccagc

SEQ ID NO: 509364 - DNA, 25 bp, Homo sapien
aaaacatcgttatccagcatatgac

SEQ ID NO: 509365 - DNA, 25 bp, Homo sapien
tcgttatccagcatatgactgtatt

SEQ ID NO: 509366 - DNA, 25 bp, Homo sapien
aaacatcatagcatgtacttccaca

SEQ ID NO: 509367 - DNA, 25 bp, Homo sapien
catcatagcatgtacttccacaaac

SEQ ID NO: 509368 - DNA, 25 bp, Homo sapien
tggcctcatcccctcctagaatgag

SEQ ID NO: 509369 - DNA, 25 bp, Homo sapien
cctcctagaatgagtcacccgtaga

SEQ ID NO: 509370 - DNA, 25 bp, Homo sapien
gagtcacccgtagatcagggtctgg

SEQ ID NO: 509371 - DNA, 25 bp, Homo sapien
agggcagcccggaatagggctcttt

SEQ ID NO: 509372 - DNA, 25 bp, Homo sapien
tttgaagaggaagtagaagccccag

SEQ ID NO: 509373 - DNA, 25 bp, Homo sapien
agaagccccagggtaatgaggcaga

SEQ ID NO: 509374 - DNA, 25 bp, Homo sapien
atgcaccctcctttctgtaccgtgt

SEQ ID NO: 509375 - DNA, 25 bp, Homo sapien
tgtaccgtgtgtgctggctccatag

SEQ ID NO: 509376 - DNA, 25 bp, Homo sapien
tgtgctggctccatagttctctctt

SEQ ID NO: 509377 - DNA, 25 bp, Homo sapien
tctctcttctgtacatataagcatg

SEQ ID NO: 509378 - DNA, 25 bp, Homo sapien
tataagcatgcttgttctgaaataa

SEQ ID NO: 509379 - DNA, 25 bp, Homo sapien
atactcctagatcccgtcagtgatt

SEQ ID NO: 509380 - DNA, 25 bp, Homo sapien
tagatcccgtcagtgatttttatat

SEQ ID NO: 509381 - DNA, 25 bp, Homo sapien
aaaaacctaatttctgcattgcatt

SEQ ID NO: 509382 - DNA, 25 bp, Homo sapien
gttattttgcctttatccaattcag

SEQ ID NO: 509383 - DNA, 25 bp, Homo sapien
gcctttatccaattcagttgattag

SEQ ID NO: 509384 - DNA, 25 bp, Homo sapien
gttactgtggtcatttttggtgcat

SEQ ID NO: 509385 - DNA, 25 bp, Homo sapien
ggtgcatgatgccaagtttatcttt

SEQ ID NO: 509386 - DNA, 25 bp, Homo sapien
tatctttagttagccattgccacct

SEQ ID NO: 509387 - DNA, 25 bp, Homo sapien
agccattgccacctgatatgtaatg

SEQ ID NO: 509388 - DNA, 25 bp, Homo sapien
ccagtgtgagcttgaaatactccta

SEQ ID NO: 509389 - DNA, 25 bp, Homo sapien
ttgaaatactcctagatcccgtcag

SEQ ID NO: 509390 - DNA, 25 bp, Homo sapien
tgatgccctcatgattttccaccct

SEQ ID NO: 509391 - DNA, 25 bp, Homo sapien
tctcttcccataaagcatcttccta

SEQ ID NO: 509392 - DNA, 25 bp, Homo sapien
tcttcctaaggaaatgaccatggcc

SEQ ID NO: 509393 - DNA, 25 bp, Homo sapien
ggaaatgaccatggcctgatactca

SEQ ID NO: 509394 - DNA, 25 bp, Homo sapien
tggcctgatactcattttgtcactt

SEQ ID NO: 509395 - DNA, 25 bp, Homo sapien
ttttgtcacttgtacagagccctaa

SEQ ID NO: 509396 - DNA, 25 bp, Homo sapien
gtcacttgtacagagccctaaggat

SEQ ID NO: 509397 - DNA, 25 bp, Homo sapien
ttgtacagagccctaaggatgttct

SEQ ID NO: 509398 - DNA, 25 bp, Homo sapien
acagagccctaaggatgttctgaat

SEQ ID NO: 509399 - DNA, 25 bp, Homo sapien
atgttctgaattcagtggtgccaaa

SEQ ID NO: 509400 - DNA, 25 bp, Homo sapien
attcctgtctttcacttgaatggcc

SEQ ID NO: 509401 - DNA, 25 bp, Homo sapien
gcagcttcggcaaaaggagtctgta

SEQ ID NO: 509402 - DNA, 25 bp, Homo sapien
aaggagtctgtaccaagctgcttct

SEQ ID NO: 509403 - DNA, 25 bp, Homo sapien
ggagtctgtaccaagctgcttctgg

SEQ ID NO: 509404 - DNA, 25 bp, Homo sapien
ttctcaacacttttgtgtttctaac

SEQ ID NO: 509405 - DNA, 25 bp, Homo sapien
gtttctaacactgtatcttgactgt

SEQ ID NO: 509406 - DNA, 25 bp, Homo sapien
gactgtgtaaataccaacaaggctg

SEQ ID NO: 509407 - DNA, 25 bp, Homo sapien
aatgcagatgtagataccttctaga

SEQ ID NO: 509408 - DNA, 25 bp, Homo sapien
accagaagtgatcccgtgtagcctt

SEQ ID NO: 509409 - DNA, 25 bp, Homo sapien
aagtgatcccgtgtagccttcgttg

SEQ ID NO: 509410 - DNA, 25 bp, Homo sapien
cccgtgtagccttcgttgacaaata

SEQ ID NO: 509411 - DNA, 25 bp, Homo sapien
gtagccttcgttgacaaataaagac

SEQ ID NO: 509412 - DNA, 25 bp, Homo sapien
atagttgctttggtatcaaacttaa

SEQ ID NO: 509413 - DNA, 25 bp, Homo sapien
atacctaacccatataagatcctta

SEQ ID NO: 509414 - DNA, 25 bp, Homo sapien
gtgatcttaaaaatatgacctggtc

SEQ ID NO: 509415 - DNA, 25 bp, Homo sapien
tgacctggtcattgcacaacgtttg

SEQ ID NO: 509416 - DNA, 25 bp, Homo sapien
gcacaacgtttgcatttgaaatgaa

SEQ ID NO: 509417 - DNA, 25 bp, Homo sapien
gtggatatggagttattcagtgcaa

SEQ ID NO: 509418 - DNA, 25 bp, Homo sapien
gttattcagtgcaagtgtgtgctta

SEQ ID NO: 509419 - DNA, 25 bp, Homo sapien
gtgtgcttaatatcaaaccctatgc

SEQ ID NO: 509420 - DNA, 25 bp, Homo sapien
accctatgcaaggagctatgtctag

SEQ ID NO: 509421 - DNA, 25 bp, Homo sapien
aatttgcctccttcaagcctactag

SEQ ID NO: 509422 - DNA, 25 bp, Homo sapien
caagcctactagtgtgagatggaaa

SEQ ID NO: 509423 - DNA, 25 bp, Homo sapien
ttaatattctatcacatgtctaaaa

SEQ ID NO: 509424 - DNA, 25 bp, Homo sapien
tatgaagcattacagtttaggtctc

SEQ ID NO: 509425 - DNA, 25 bp, Homo sapien
acactgcttacaataaccttccatg

SEQ ID NO: 509426 - DNA, 25 bp, Homo sapien
gcttacaataaccttccatgatcta

SEQ ID NO: 509427 - DNA, 25 bp, Homo sapien
ccatgatctaaaaaggactcgggtt

SEQ ID NO: 509428 - DNA, 25 bp, Homo sapien
aaggactcgggttgttgacatcaaa

SEQ ID NO: 509429 - DNA, 25 bp, Homo sapien
gagtcagatgtaggacgcccagcac

SEQ ID NO: 509430 - DNA, 25 bp, Homo sapien
gttttaataaaatccatgcaatcag

SEQ ID NO: 509431 - DNA, 25 bp, Homo sapien
gcccagcaccagagcatgagtggat

SEQ ID NO: 509432 - DNA, 25 bp, Homo sapien
gcatgagtggatgtcagcatacggt

SEQ ID NO: 509433 - DNA, 25 bp, Homo sapien
cagcatacggtatgcaaggtcagct

SEQ ID NO: 509434 - DNA, 25 bp, Homo sapien
agccaaaaggagctggccatccagg

SEQ ID NO: 509435 - DNA, 25 bp, Homo sapien
agggcctagggagaccagccttcct

SEQ ID NO: 509436 - DNA, 25 bp, Homo sapien
cttcctcagctatgcttgccgaaac

SEQ ID NO: 509437 - DNA, 25 bp, Homo sapien
ttgccgaaaccagcatgatgcttca

SEQ ID NO: 509438 - DNA, 25 bp, Homo sapien
gatgcttcaaagagccctgctccac

SEQ ID NO: 509439 - DNA, 25 bp, Homo sapien
tcatggcatggatccttttcctggt

SEQ ID NO: 509440 - DNA, 25 bp, Homo sapien
tgtggactctgaagggtcagtcttc

SEQ ID NO: 509441 - DNA, 25 bp, Homo sapien
gggctactagcatcccaatttagaa

SEQ ID NO: 509442 - DNA, 25 bp, Homo sapien
ttgtagccagcagcctgtaaactgg

SEQ ID NO: 509443 - DNA, 25 bp, Homo sapien
aactggaaacactggtctcagccaa

SEQ ID NO: 509444 - DNA, 25 bp, Homo sapien
tggaaacactggtctcagccaacct

SEQ ID NO: 509445 - DNA, 25 bp, Homo sapien
agtctctgccactgtatttgtgagt

SEQ ID NO: 509446 - DNA, 25 bp, Homo sapien
gtgagtaatccaggcgcgtactatc

SEQ ID NO: 509447 - DNA, 25 bp, Homo sapien
aggcgcgtactatcactgcagatac

SEQ ID NO: 509448 - DNA, 25 bp, Homo sapien
gaaataatcatctctgtaaaccata

SEQ ID NO: 509449 - DNA, 25 bp, Homo sapien
cacatgtactatttgtgtcctgctg

SEQ ID NO: 509450 - DNA, 25 bp, Homo sapien
cctgctggtgtgaagatgtttctca

SEQ ID NO: 509451 - DNA, 25 bp, Homo sapien
aagatgtttctcattcttccacctt

SEQ ID NO: 509452 - DNA, 25 bp, Homo sapien
ttttgtacacgggaatgctacttct

SEQ ID NO: 509453 - DNA, 25 bp, Homo sapien
gagggtataattctttgctacagca

SEQ ID NO: 509454 - DNA, 25 bp, Homo sapien
agcatggagcaagttttcctcccat

SEQ ID NO: 509455 - DNA, 25 bp, Homo sapien
ttcctcccatttaacattccagtct

SEQ ID NO: 509456 - DNA, 25 bp, Homo sapien
agagagagacaagcacctgtgggtt

SEQ ID NO: 509457 - DNA, 25 bp, Homo sapien
acctgtgggttgactacagtccctt

SEQ ID NO: 509458 - DNA, 25 bp, Homo sapien
tacagtccctttgcgtgagtctttt

SEQ ID NO: 509459 - DNA, 25 bp, Homo sapien
tttgcgtgagtcttttgtcatcggg

SEQ ID NO: 509460 - DNA, 25 bp, Homo sapien
gtcttcttttaaacacaatgtacaa

SEQ ID NO: 509461 - DNA, 25 bp, Homo sapien
acaaaaatagagcttcttccttatt

SEQ ID NO: 509462 - DNA, 25 bp, Homo sapien
tctcaaagtgttggtttcctcattc

SEQ ID NO: 509463 - DNA, 25 bp, Homo sapien
aagtgttggtttcctcattcaagtc

SEQ ID NO: 509464 - DNA, 25 bp, Homo sapien
tttcctcattcaagtcctcctctgg

SEQ ID NO: 509465 - DNA, 25 bp, Homo sapien
acgagtttagagttgtctgttccta

SEQ ID NO: 509466 - DNA, 25 bp, Homo sapien
agagttgtctgttcctagagagaga

SEQ ID NO: 509467 - DNA, 25 bp, Homo sapien
caaaacacaccatgactgtaattgt

SEQ ID NO: 509468 - DNA, 25 bp, Homo sapien
acaccatgactgtaattgttaaggc

SEQ ID NO: 509469 - DNA, 25 bp, Homo sapien
cttctcagcctgtgcccagaaacaa

SEQ ID NO: 509470 - DNA, 25 bp, Homo sapien
cattctgcagacttaacatctgtca

SEQ ID NO: 509471 - DNA, 25 bp, Homo sapien
acatctgtcaaataaccttcctgaa

SEQ ID NO: 509472 - DNA, 25 bp, Homo sapien
aagttattggaggaatccaggccaa

SEQ ID NO: 509473 - DNA, 25 bp, Homo sapien
gaatccaggccaaacaacaagtaga

SEQ ID NO: 509474 - DNA, 25 bp, Homo sapien
aacaacaagtagaatagagccatct

SEQ ID NO: 509475 - DNA, 25 bp, Homo sapien
tagagccatctaaagttattaataa

SEQ ID NO: 509476 - DNA, 25 bp, Homo sapien
agatgaattttttcctggcatagtc

SEQ ID NO: 509477 - DNA, 25 bp, Homo sapien
tatttatatctcacaacaagtcaaa

SEQ ID NO: 509478 - DNA, 25 bp, Homo sapien
agggctggtctactgtggacactta

SEQ ID NO: 509479 - DNA, 25 bp, Homo sapien
ggacacttagttgtggaccccaaca

SEQ ID NO: 509480 - DNA, 25 bp, Homo sapien
aggaggcctcacacattcatccggc

SEQ ID NO: 509481 - DNA, 25 bp, Homo sapien
tcggtgagcatgtggccagtagcca

SEQ ID NO: 509482 - DNA, 25 bp, Homo sapien
ggccagtagccagagtcttcaacat

SEQ ID NO: 509483 - DNA, 25 bp, Homo sapien
agtcttcaacataggtgggaggtct

SEQ ID NO: 509484 - DNA, 25 bp, Homo sapien
cataggtgggaggtctgaaattcgt

SEQ ID NO: 509485 - DNA, 25 bp, Homo sapien
gggagaccctttgcctaatgttgag

SEQ ID NO: 509486 - DNA, 25 bp, Homo sapien
gaccctttgcctaatgttgagagaa

SEQ ID NO: 509487 - DNA, 25 bp, Homo sapien
gcctaatgttgagagaatccaagcc

SEQ ID NO: 509488 - DNA, 25 bp, Homo sapien
aatccaagcctgagcagggctggtc

SEQ ID NO: 509489 - DNA, 25 bp, Homo sapien
gctgaggttccggagtgaaacactg

SEQ ID NO: 509490 - DNA, 25 bp, Homo sapien
gaggttccggagtgaaacactgcct

SEQ ID NO: 509491 - DNA, 25 bp, Homo sapien
tttcatggaagcacgtcttcctgtc

SEQ ID NO: 509492 - DNA, 25 bp, Homo sapien
atggaagcacgtcttcctgtcaccc

SEQ ID NO: 509493 - DNA, 25 bp, Homo sapien
gtcacccatcggcttcattttaaag

SEQ ID NO: 509494 - DNA, 25 bp, Homo sapien
cacccatcggcttcattttaaagga

SEQ ID NO: 509495 - DNA, 25 bp, Homo sapien
ggagagctgcatcacataaaagaaa

SEQ ID NO: 509496 - DNA, 25 bp, Homo sapien
gctgcatcacataaaagaaagacca

SEQ ID NO: 509497 - DNA, 25 bp, Homo sapien
gagaaatgtgaatgactccaatcat

SEQ ID NO: 509498 - DNA, 25 bp, Homo sapien
gtgaatgactccaatcattccaatc

SEQ ID NO: 509499 - DNA, 25 bp, Homo sapien
gggaatctgagatgggagccagtga

SEQ ID NO: 509500 - DNA, 25 bp, Homo sapien
gggagaacttcaacggggaactgca

SEQ ID NO: 509501 - DNA, 25 bp, Homo sapien
gggaactgcaatttctgatccacca

SEQ ID NO: 509502 - DNA, 25 bp, Homo sapien
ggaactgcaatttctgatccaccag

SEQ ID NO: 509503 - DNA, 25 bp, Homo sapien
gaactgcaatttctgatccaccaga

SEQ ID NO: 509504 - DNA, 25 bp, Homo sapien
aactgcaatttctgatccaccagag

SEQ ID NO: 509505 - DNA, 25 bp, Homo sapien
actgcaatttctgatccaccagagc

SEQ ID NO: 509506 - DNA, 25 bp, Homo sapien
ctgcaatttctgatccaccagagct

SEQ ID NO: 509507 - DNA, 25 bp, Homo sapien
tgcaatttctgatccaccagagctg

SEQ ID NO: 509508 - DNA, 25 bp, Homo sapien
gcaatttctgatccaccagagctga

SEQ ID NO: 509509 - DNA, 25 bp, Homo sapien
caatttctgatccaccagagctgaa

SEQ ID NO: 509510 - DNA, 25 bp, Homo sapien
aatttctgatccaccagagctgaag

SEQ ID NO: 509511 - DNA, 25 bp, Homo sapien
ggaaagtaggtagcccccgaatgag

SEQ ID NO: 509512 - DNA, 25 bp, Homo sapien
aagcattgagtgagagctggccctc

SEQ ID NO: 509513 - DNA, 25 bp, Homo sapien
ctggccctctgacccttctaaaaga

SEQ ID NO: 509514 - DNA, 25 bp, Homo sapien
ccttctaaaagaacacagccaactt

SEQ ID NO: 509515 - DNA, 25 bp, Homo sapien
gagatggaaaacttcgaagcccctt

SEQ ID NO: 509516 - DNA, 25 bp, Homo sapien
tttccactgccttgccaagcagttc

SEQ ID NO: 509517 - DNA, 25 bp, Homo sapien
agttccaccagctgtaccgggagaa

SEQ ID NO: 509518 - DNA, 25 bp, Homo sapien
ttttccgggccctggcatgacgagc

SEQ ID NO: 509519 - DNA, 25 bp, Homo sapien
gagctggagcagatcgtgctgcaca

SEQ ID NO: 509520 - DNA, 25 bp, Homo sapien
atcgtgctgcacaaccggagaagac

SEQ ID NO: 509521 - DNA, 25 bp, Homo sapien
aaccggagaagacagaattacctct

SEQ ID NO: 509522 - DNA, 25 bp, Homo sapien
acctgactccagttctccgtgtgct

SEQ ID NO: 509523 - DNA, 25 bp, Homo sapien
agttctccgtgtgctccattggctg

SEQ ID NO: 509524 - DNA, 25 bp, Homo sapien
gtgtgctccattggctgcggctgca

SEQ ID NO: 509525 - DNA, 25 bp, Homo sapien
ggaagatgcctgacagccctcatgc

SEQ ID NO: 509526 - DNA, 25 bp, Homo sapien
taagaaagggtccttgaagcctcct

SEQ ID NO: 509527 - DNA, 25 bp, Homo sapien
tgaagcctcctaacctgggttggac

SEQ ID NO: 509528 - DNA, 25 bp, Homo sapien
atttgtagcacatattatagatgga

SEQ ID NO: 509529 - DNA, 25 bp, Homo sapien
gatatttatttatacctgtgatgcc

SEQ ID NO: 509530 - DNA, 25 bp, Homo sapien
tatacctgtgatgccaattgtcatt

SEQ ID NO: 509531 - DNA, 25 bp, Homo sapien
ccaattgtcattaaaaggcttttca

SEQ ID NO: 509532 - DNA, 25 bp, Homo sapien
aaggcttttcatggcttgacaagtc

SEQ ID NO: 509533 - DNA, 25 bp, Homo sapien
ctgacacagccaagtaggttaccgc

SEQ ID NO: 509534 - DNA, 25 bp, Homo sapien
tgacacagccaagtaggttaccgca

SEQ ID NO: 509535 - DNA, 25 bp, Homo sapien
gacacagccaagtaggttaccgcaa

SEQ ID NO: 509536 - DNA, 25 bp, Homo sapien
acacagccaagtaggttaccgcaaa

SEQ ID NO: 509537 - DNA, 25 bp, Homo sapien
cacagccaagtaggttaccgcaaaa

SEQ ID NO: 509538 - DNA, 25 bp, Homo sapien
cagccaagtaggttaccgcaaaaat

SEQ ID NO: 509539 - DNA, 25 bp, Homo sapien
aaatacggtggaataattgcctcaa

SEQ ID NO: 509540 - DNA, 25 bp, Homo sapien
aatacggtggaataattgcctcaag

SEQ ID NO: 509541 - DNA, 25 bp, Homo sapien
atacggtggaataattgcctcaagt

SEQ ID NO: 509542 - DNA, 25 bp, Homo sapien
tacggtggaataattgcctcaagtg

SEQ ID NO: 509543 - DNA, 25 bp, Homo sapien
ggtggaataattgcctcaagtggga

SEQ ID NO: 509544 - DNA, 25 bp, Homo sapien
gggcaagagtatgtctgcaatccaa

SEQ ID NO: 509545 - DNA, 25 bp, Homo sapien
attttggcagctatcctcaccattt

SEQ ID NO: 509546 - DNA, 25 bp, Homo sapien
gcagctatcctcaccatttagtaaa

SEQ ID NO: 509547 - DNA, 25 bp, Homo sapien
gtatactaacaatacccaactttat

SEQ ID NO: 509548 - DNA, 25 bp, Homo sapien
caaagttttgtaagcatacctaagt

SEQ ID NO: 509549 - DNA, 25 bp, Homo sapien
aagtagtaacttgatatgctgaaaa

SEQ ID NO: 509550 - DNA, 25 bp, Homo sapien
aatctgacctgtcacttcgcttcac

SEQ ID NO: 509551 - DNA, 25 bp, Homo sapien
ttcgcttcactctgaccagtaattg

SEQ ID NO: 509552 - DNA, 25 bp, Homo sapien
agtaattgcagattgtcgtcaccat

SEQ ID NO: 509553 - DNA, 25 bp, Homo sapien
ttgtcgtcaccatcctagcctatga

SEQ ID NO: 509554 - DNA, 25 bp, Homo sapien
cctagcctatgactacattaggatt

SEQ ID NO: 509555 - DNA, 25 bp, Homo sapien
tactgtgacatggagcatttgatga

SEQ ID NO: 509556 - DNA, 25 bp, Homo sapien
tatgaagtgagtagcatcgccccag

SEQ ID NO: 509557 - DNA, 25 bp, Homo sapien
agtgagtagcatcgccccaggagca

SEQ ID NO: 509558 - DNA, 25 bp, Homo sapien
caggagcaccatgacagatgcacag

SEQ ID NO: 509559 - DNA, 25 bp, Homo sapien
gcaccatgacagatgcacaggacat

SEQ ID NO: 509560 - DNA, 25 bp, Homo sapien
acagatgcacaggacatggagggaa

SEQ ID NO: 509561 - DNA, 25 bp, Homo sapien
agggaaggaaatggcatcctgcaca

SEQ ID NO: 509562 - DNA, 25 bp, Homo sapien
ggaaaaatcatctaaaacaaggtat

SEQ ID NO: 509563 - DNA, 25 bp, Homo sapien
taaagaaatggctcacgtgtgaccc

SEQ ID NO: 509564 - DNA, 25 bp, Homo sapien
aaatggctcacgtgtgacccttatt

SEQ ID NO: 509565 - DNA, 25 bp, Homo sapien
ggctcacgtgtgacccttattttac

SEQ ID NO: 509566 - DNA, 25 bp, Homo sapien
gcacttttcatctataaaaagggtg

SEQ ID NO: 509567 - DNA, 25 bp, Homo sapien
aaaagagtcagtgtaagcattgaaa

SEQ ID NO: 509568 - DNA, 25 bp, Homo sapien
gtctcttttaatcttatatagtgcc

SEQ ID NO: 509569 - DNA, 25 bp, Homo sapien
ctacattctaccaagctgctctttt

SEQ ID NO: 509570 - DNA, 25 bp, Homo sapien
attctaccaagctgctcttttaaaa

SEQ ID NO: 509571 - DNA, 25 bp, Homo sapien
aagtcactaatgactgccattcacc

SEQ ID NO: 509572 - DNA, 25 bp, Homo sapien
gccattcaccaaataaagcagcttt

SEQ ID NO: 509573 - DNA, 25 bp, Homo sapien
aaagcagctttgtcttattcctcac

SEQ ID NO: 509574 - DNA, 25 bp, Homo sapien
ttgtcttattcctcacatctctgag

SEQ ID NO: 509575 - DNA, 25 bp, Homo sapien
atctctgagcccctccatagtatta

SEQ ID NO: 509576 - DNA, 25 bp, Homo sapien
gagcccctccatagtattagcaata

SEQ ID NO: 509577 - DNA, 25 bp, Homo sapien
aaaactgaatcatggactgtgtgta

SEQ ID NO: 509578 - DNA, 25 bp, Homo sapien
aatcatggactgtgtgtattctaca

SEQ ID NO: 509579 - DNA, 25 bp, Homo sapien
ggactgtgtgtattctacactctta

SEQ ID NO: 509580 - DNA, 25 bp, Homo sapien
gtgtattctacactcttaacatgaa

SEQ ID NO: 509581 - DNA, 25 bp, Homo sapien
tacactcttaacatgaactctgaga

SEQ ID NO: 509582 - DNA, 25 bp, Homo sapien
gaactctgagactaagcttttataa

SEQ ID NO: 509583 - DNA, 25 bp, Homo sapien
cagaatcaagcagttttgcattgaa

SEQ ID NO: 509584 - DNA, 25 bp, Homo sapien
cccgttgtatttcccacttgagaat

SEQ ID NO: 509585 - DNA, 25 bp, Homo sapien
cgttgtatttcccacttgagaattt

SEQ ID NO: 509586 - DNA, 25 bp, Homo sapien
ccacttgagaatttccagcggaagg

SEQ ID NO: 509587 - DNA, 25 bp, Homo sapien
tgagaatttccagcggaaggcaggt

SEQ ID NO: 509588 - DNA, 25 bp, Homo sapien
gctgccacaccactgattggccttt

SEQ ID NO: 509589 - DNA, 25 bp, Homo sapien
attggccttttctttcacgtgattc

SEQ ID NO: 509590 - DNA, 25 bp, Homo sapien
cttttctttcacgtgattcatcctt

SEQ ID NO: 509591 - DNA, 25 bp, Homo sapien
attcatccttcctcattgtggcaag

SEQ ID NO: 509592 - DNA, 25 bp, Homo sapien
attgtggcaaggagtttctttctct

SEQ ID NO: 509593 - DNA, 25 bp, Homo sapien
ttcctcctttgggatcattgtgtat

SEQ ID NO: 509594 - DNA, 25 bp, Homo sapien
aatgacaaacccagactccaggtgc

SEQ ID NO: 509595 - DNA, 25 bp, Homo sapien
gactccaggtgccttgcaaaggttg

SEQ ID NO: 509596 - DNA, 25 bp, Homo sapien
aaggccagccaggattgctgctgct

SEQ ID NO: 509597 - DNA, 25 bp, Homo sapien
aacacccctttcattggcatgacgg

SEQ ID NO: 509598 - DNA, 25 bp, Homo sapien
gaaaggatgcatgtctccacttcct

SEQ ID NO: 509599 - DNA, 25 bp, Homo sapien
agctcccatcccagttgtgggttaa

SEQ ID NO: 509600 - DNA, 25 bp, Homo sapien
cccagttgtgggttaagaataggct

SEQ ID NO: 509601 - DNA, 25 bp, Homo sapien
gaataggctagagcagacattgggt

SEQ ID NO: 509602 - DNA, 25 bp, Homo sapien
gggtgtttccatgctgtaggctggt

SEQ ID NO: 509603 - DNA, 25 bp, Homo sapien
gaccatgtgcctctaggcagtgact

SEQ ID NO: 509604 - DNA, 25 bp, Homo sapien
acccctcaggaagaacacaggtggg

SEQ ID NO: 509605 - DNA, 25 bp, Homo sapien
acacaggtgggctcctagcagctga

SEQ ID NO: 509606 - DNA, 25 bp, Homo sapien
ctagcagctgatccccaatgcctgg

SEQ ID NO: 509607 - DNA, 25 bp, Homo sapien
aatgcctggccttaaagccgagctc

SEQ ID NO: 509608 - DNA, 25 bp, Homo sapien
ggaagtctggttgtagagcctgaat

SEQ ID NO: 509609 - DNA, 25 bp, Homo sapien
ctgaataggctcctggccccatgac

SEQ ID NO: 509610 - DNA, 25 bp, Homo sapien
gataacctcaactataattgtcctc

SEQ ID NO: 509611 - DNA, 25 bp, Homo sapien
attgtcctcaactataattgatgtg

SEQ ID NO: 509612 - DNA, 25 bp, Homo sapien
gagaagcataattatgtaccctgta

SEQ ID NO: 509613 - DNA, 25 bp, Homo sapien
gtaccctgtaaaccacatttaattg

SEQ ID NO: 509614 - DNA, 25 bp, Homo sapien
gaactaccttgtaagtcaaagttgt

SEQ ID NO: 509615 - DNA, 25 bp, Homo sapien
agttgtgtgggcatttgtgctttaa

SEQ ID NO: 509616 - DNA, 25 bp, Homo sapien
attcacactgtgcaataacaagtaa

SEQ ID NO: 509617 - DNA, 25 bp, Homo sapien
aatcatctgcataaactccagggag

SEQ ID NO: 509618 - DNA, 25 bp, Homo sapien
aactccagggagacttccagccttt

SEQ ID NO: 509619 - DNA, 25 bp, Homo sapien
gaatggtcatgtccgtattacactt

SEQ ID NO: 509620 - DNA, 25 bp, Homo sapien
gtccgtattacactttcttttagat

SEQ ID NO: 509621 - DNA, 25 bp, Homo sapien
ggctgaagttgtggacaccgatctt

SEQ ID NO: 509622 - DNA, 25 bp, Homo sapien
tggacaccgatcttctcttggatga

SEQ ID NO: 509623 - DNA, 25 bp, Homo sapien
accgatcttctcttggatgatcaag

SEQ ID NO: 509624 - DNA, 25 bp, Homo sapien
aagattcagtcttgcttcagggtga

SEQ ID NO: 509625 - DNA, 25 bp, Homo sapien
tcttgcttcagggtgacgcagaact

SEQ ID NO: 509626 - DNA, 25 bp, Homo sapien
cagggtgacgcagaactataaagcc

SEQ ID NO: 509627 - DNA, 25 bp, Homo sapien
gccctgtgtgtcacttagagacagt

SEQ ID NO: 509628 - DNA, 25 bp, Homo sapien
agagacagtgaaaacccacggcctc

SEQ ID NO: 509629 - DNA, 25 bp, Homo sapien
agtgaaaacccacggcctccatctt

SEQ ID NO: 509630 - DNA, 25 bp, Homo sapien
acctggactgcctgcttgttttgta

SEQ ID NO: 509631 - DNA, 25 bp, Homo sapien
aagtggtcattttattcaggtttag

SEQ ID NO: 509632 - DNA, 25 bp, Homo sapien
gggccctgacccaaggccttcaggg

SEQ ID NO: 509633 - DNA, 25 bp, Homo sapien
ggagaagaccctgcgtgacagtgag

SEQ ID NO: 509634 - DNA, 25 bp, Homo sapien
agatccgggacagcaagaagttcct

SEQ ID NO: 509635 - DNA, 25 bp, Homo sapien
tccgggacagcaagaagttcctgtg

SEQ ID NO: 509636 - DNA, 25 bp, Homo sapien
tggtgcgggaggaggtgaccttcat

SEQ ID NO: 509637 - DNA, 25 bp, Homo sapien
gaggtgaccttcatctatcagaagc

SEQ ID NO: 509638 - DNA, 25 bp, Homo sapien
gaccttcatctatcagaagctccaa

SEQ ID NO: 509639 - DNA, 25 bp, Homo sapien
gagatctcagagaacttggtgaaca

SEQ ID NO: 509640 - DNA, 25 bp, Homo sapien
tcagagaacttggtgaacattcaga

SEQ ID NO: 509641 - DNA, 25 bp, Homo sapien
gaaaatgcagaaaacgcaggtgaaa

SEQ ID NO: 509642 - DNA, 25 bp, Homo sapien
aggtgaaatgccgcaaaatcctgac

SEQ ID NO: 509643 - DNA, 25 bp, Homo sapien
gtcccagtttctactccagagggct

SEQ ID NO: 509644 - DNA, 25 bp, Homo sapien
gtttctactccagagggcttaggaa

SEQ ID NO: 509645 - DNA, 25 bp, Homo sapien
gagggcttaggaacttccagcaaca

SEQ ID NO: 509646 - DNA, 25 bp, Homo sapien
tccagcaacaacctaggagtcccag

SEQ ID NO: 509647 - DNA, 25 bp, Homo sapien
acaacctaggagtcccagctactga

SEQ ID NO: 509648 - DNA, 25 bp, Homo sapien
tgagcagcggcaggagtcttttgaa

SEQ ID NO: 509649 - DNA, 25 bp, Homo sapien
cagcggcaggagtcttttgaaggat

SEQ ID NO: 509650 - DNA, 25 bp, Homo sapien
gagtcttttgaaggattcattgcta

SEQ ID NO: 509651 - DNA, 25 bp, Homo sapien
gaatgtgttctccttcaccagatgc

SEQ ID NO: 509652 - DNA, 25 bp, Homo sapien
accagatgcgacttctggaactgga

SEQ ID NO: 509653 - DNA, 25 bp, Homo sapien
gtccagaaatagcagatcttcttca

SEQ ID NO: 509654 - DNA, 25 bp, Homo sapien
gaaagggtctgaatgctctggcaat

SEQ ID NO: 509655 - DNA, 25 bp, Homo sapien
aatgctctggcaatggcgagaagaa

SEQ ID NO: 509656 - DNA, 25 bp, Homo sapien
gagaagaagcgatcgccacactgcc

SEQ ID NO: 509657 - DNA, 25 bp, Homo sapien
agccaccaggatttctgcctggagc

SEQ ID NO: 509658 - DNA, 25 bp, Homo sapien
ctgctgcctgaggtggcgtagagca

SEQ ID NO: 509659 - DNA, 25 bp, Homo sapien
tccaggccaggagcacaaatcgttg

SEQ ID NO: 509660 - DNA, 25 bp, Homo sapien
gccaggagcacaaatcgttgttcaa

SEQ ID NO: 509661 - DNA, 25 bp, Homo sapien
cgttgttcaatgaatttctctccaa

SEQ ID NO: 509662 - DNA, 25 bp, Homo sapien
ttctctccaactcgaccttggtaaa

SEQ ID NO: 509663 - DNA, 25 bp, Homo sapien
tcgaccttggtaaacggaaatgttg

SEQ ID NO: 509664 - DNA, 25 bp, Homo sapien
gggtgaagagaaacaatcactattt

SEQ ID NO: 509665 - DNA, 25 bp, Homo sapien
aatgtaaaatacctgcatgccacta

SEQ ID NO: 509666 - DNA, 25 bp, Homo sapien
atacctgcatgccactaatctgtaa

SEQ ID NO: 509667 - DNA, 25 bp, Homo sapien
gcatgccactaatctgtaacatttt

SEQ ID NO: 509668 - DNA, 25 bp, Homo sapien
atctgtaacattttaccagttcaga

SEQ ID NO: 509669 - DNA, 25 bp, Homo sapien
taccagttcagatgcctgtaatgtg

SEQ ID NO: 509670 - DNA, 25 bp, Homo sapien
cagatgcctgtaatgtgtgacttta

SEQ ID NO: 509671 - DNA, 25 bp, Homo sapien
gtaatgtgtgactttatgtgtgtct

SEQ ID NO: 509672 - DNA, 25 bp, Homo sapien
atactttgcaaactgtttaaacaag

SEQ ID NO: 509673 - DNA, 25 bp, Homo sapien
gtttaaacttctattggcaacattt

SEQ ID NO: 509674 - DNA, 25 bp, Homo sapien
cagttattgaaaactccgcatagtt

SEQ ID NO: 509675 - DNA, 25 bp, Homo sapien
gaaacttcaatcaaatcaagactat

SEQ ID NO: 509676 - DNA, 25 bp, Homo sapien
gcaacagagctgcaaaaagtcagtc

SEQ ID NO: 509677 - DNA, 25 bp, Homo sapien
aacaaaggtgtctggactacagcac

SEQ ID NO: 509678 - DNA, 25 bp, Homo sapien
caaaggtgtctggactacagcacag

SEQ ID NO: 509679 - DNA, 25 bp, Homo sapien
ggacatgccatccatactggcctgt

SEQ ID NO: 509680 - DNA, 25 bp, Homo sapien
acatgccatccatactggcctgtgc

SEQ ID NO: 509681 - DNA, 25 bp, Homo sapien
atccatactggcctgtgccccgtta

SEQ ID NO: 509682 - DNA, 25 bp, Homo sapien
catactggcctgtgccccgttatca

SEQ ID NO: 509683 - DNA, 25 bp, Homo sapien
ccgttatcaatcactgggcacaaca

SEQ ID NO: 509684 - DNA, 25 bp, Homo sapien
gttatcaatcactgggcacaacagt

SEQ ID NO: 509685 - DNA, 25 bp, Homo sapien
aatcactgggcacaacagtgaagaa

SEQ ID NO: 509686 - DNA, 25 bp, Homo sapien
aagaagtgcaaatcaagtggtgttt

SEQ ID NO: 509687 - DNA, 25 bp, Homo sapien
atggatgagtatgtggccagcctac

SEQ ID NO: 509688 - DNA, 25 bp, Homo sapien
tgagtatgtggccagcctacacctg

SEQ ID NO: 509689 - DNA, 25 bp, Homo sapien
acctttgatgcccacttgacagagc

SEQ ID NO: 509690 - DNA, 25 bp, Homo sapien
gagctgacagatgaacaggccaagt

SEQ ID NO: 509691 - DNA, 25 bp, Homo sapien
actcaacaagaatgggcccttcaag

SEQ ID NO: 509692 - DNA, 25 bp, Homo sapien
atgggcccttcaagcctaattacta

SEQ ID NO: 509693 - DNA, 25 bp, Homo sapien
caagcctaattactacaggtattaa

SEQ ID NO: 509694 - DNA, 25 bp, Homo sapien
taagttcctgtaactcaaaccagaa

SEQ ID NO: 509695 - DNA, 25 bp, Homo sapien
taaggaatagaactccaagcctttt

SEQ ID NO: 509696 - DNA, 25 bp, Homo sapien
aagccttttctccactactatacaa

SEQ ID NO: 509697 - DNA, 25 bp, Homo sapien
ctcaccctgtgtgttaggttattta

SEQ ID NO: 509698 - DNA, 25 bp, Homo sapien
gaccatcctggttcacccagaattg

SEQ ID NO: 509699 - DNA, 25 bp, Homo sapien
gttcacccagaattgacaccaaaga

SEQ ID NO: 509700 - DNA, 25 bp, Homo sapien
acttcacagtaaatcatttctcctg

SEQ ID NO: 509701 - DNA, 25 bp, Homo sapien
aatcatttctcctgaaatagaggaa

SEQ ID NO: 509702 - DNA, 25 bp, Homo sapien
ggaagattctttacgttgttgtgct

SEQ ID NO: 509703 - DNA, 25 bp, Homo sapien
tctttacgttgttgtgcttgttttt

SEQ ID NO: 509704 - DNA, 25 bp, Homo sapien
aaatcatcagtatagtttaacacat

SEQ ID NO: 509705 - DNA, 25 bp, Homo sapien
agtttaacacattctttctaagcag

SEQ ID NO: 509706 - DNA, 25 bp, Homo sapien
ctttctaagcagttttgtgtgggat

SEQ ID NO: 509707 - DNA, 25 bp, Homo sapien
gcagttttgtgtgggataatttgaa

SEQ ID NO: 509708 - DNA, 25 bp, Homo sapien
ccaaaggctcaatggattatgtttc

SEQ ID NO: 509709 - DNA, 25 bp, Homo sapien
aatgtactgggcattgtcctggtca

SEQ ID NO: 509710 - DNA, 25 bp, Homo sapien
attgtcctggtcacccagacacaaa

SEQ ID NO: 509711 - DNA, 25 bp, Homo sapien
ttgtcctggtcacccagacacaaag

SEQ ID NO: 509712 - DNA, 25 bp, Homo sapien
gtcctggtcacccagacacaaagat

SEQ ID NO: 509713 - DNA, 25 bp, Homo sapien
cctggtcacccagacacaaagatgg

SEQ ID NO: 509714 - DNA, 25 bp, Homo sapien
ggtcacccagacacaaagatgggta

SEQ ID NO: 509715 - DNA, 25 bp, Homo sapien
gggaactgcaatttctgatccacca

SEQ ID NO: 509716 - DNA, 25 bp, Homo sapien
gcaatttctgatccaccagagctga

SEQ ID NO: 509717 - DNA, 25 bp, Homo sapien
accagagctgaagagggcaaaagaa

SEQ ID NO: 509718 - DNA, 25 bp, Homo sapien
acatcagcaatgtttattacagagg

SEQ ID NO: 509719 - DNA, 25 bp, Homo sapien
gctgggaagagctaccactttaagt

SEQ ID NO: 509720 - DNA, 25 bp, Homo sapien
gacatttgtgattctcattttctca

SEQ ID NO: 509721 - DNA, 25 bp, Homo sapien
tcaccattaaattaccttggagggt

SEQ ID NO: 509722 - DNA, 25 bp, Homo sapien
agggctgtggtttactcctgtctaa

SEQ ID NO: 509723 - DNA, 25 bp, Homo sapien
tgtctaaacccctgaagcctaacac

SEQ ID NO: 509724 - DNA, 25 bp, Homo sapien
gaagcctaacacagttcctggcaca

SEQ ID NO: 509725 - DNA, 25 bp, Homo sapien
gttcctggcacacaacaggtgttca

SEQ ID NO: 509726 - DNA, 25 bp, Homo sapien
ggtgttcaacagatattgtgctcat

SEQ ID NO: 509727 - DNA, 25 bp, Homo sapien
atatttactcgctttgtttaatgga

SEQ ID NO: 509728 - DNA, 25 bp, Homo sapien
ccctgccttcctaggtgaccttgga

SEQ ID NO: 509729 - DNA, 25 bp, Homo sapien
tggacaaattctcgaacccattcac

SEQ ID NO: 509730 - DNA, 25 bp, Homo sapien
ccattcaccaaccacacaagtttgt

SEQ ID NO: 509731 - DNA, 25 bp, Homo sapien
gagagcagtcacgtaggtttcttct

SEQ ID NO: 509732 - DNA, 25 bp, Homo sapien
ggtttcttctgcttggcacataaca

SEQ ID NO: 509733 - DNA, 25 bp, Homo sapien
ggaaagcaggcattcagagtaaact

SEQ ID NO: 509734 - DNA, 25 bp, Homo sapien
gtttgtatatccagtctaggcacag

SEQ ID NO: 509735 - DNA, 25 bp, Homo sapien
gtctaggcacagtaaactactcttc

SEQ ID NO: 509736 - DNA, 25 bp, Homo sapien
aaactactcttctcagttgtgggaa

SEQ ID NO: 509737 - DNA, 25 bp, Homo sapien
tagaaattagtcaagggtcaacctt

SEQ ID NO: 509738 - DNA, 25 bp, Homo sapien
ggtcaaccttgtaagtagacttttg

SEQ ID NO: 509739 - DNA, 25 bp, Homo sapien
atatatgaaatgtcgtctcccaggg

SEQ ID NO: 509740 - DNA, 25 bp, Homo sapien
ccagggaagcttgttaggcgcactt

SEQ ID NO: 509741 - DNA, 25 bp, Homo sapien
gggtttttattgagagcagtcacgt

SEQ ID NO: 509742 - DNA, 25 bp, Homo sapien
atggacttggacatcactaatgcaa

SEQ ID NO: 509743 - DNA, 25 bp, Homo sapien
agtttatttagtgccttgcctcaat

SEQ ID NO: 509744 - DNA, 25 bp, Homo sapien
cttgcctcaatggagcttaaagcat

SEQ ID NO: 509745 - DNA, 25 bp, Homo sapien
tcttatttagccctggagcatcact

SEQ ID NO: 509746 - DNA, 25 bp, Homo sapien
agattatgcttgtgccagagaagtg

SEQ ID NO: 509747 - DNA, 25 bp, Homo sapien
agcctgaaatcccttgtcaagtatt

SEQ ID NO: 509748 - DNA, 25 bp, Homo sapien
atcccttgtcaagtattccacagga

SEQ ID NO: 509749 - DNA, 25 bp, Homo sapien
tagtctttgggctttggtctactga

SEQ ID NO: 509750 - DNA, 25 bp, Homo sapien
ggtctactgacctgtggattaaact

SEQ ID NO: 509751 - DNA, 25 bp, Homo sapien
gtggattaaactctatcccttagat

SEQ ID NO: 509752 - DNA, 25 bp, Homo sapien
ctatcccttagattatcccatttct

SEQ ID NO: 509753 - DNA, 25 bp, Homo sapien
aaagggtaccggcatgacagctcaa

SEQ ID NO: 509754 - DNA, 25 bp, Homo sapien
gggtaccggcatgacagctcaacag

SEQ ID NO: 509755 - DNA, 25 bp, Homo sapien
taccggcatgacagctcaacagcag

SEQ ID NO: 509756 - DNA, 25 bp, Homo sapien
catgacagctcaacagcagtggccg

SEQ ID NO: 509757 - DNA, 25 bp, Homo sapien
cagctcaacagcagtggccggcagc

SEQ ID NO: 509758 - DNA, 25 bp, Homo sapien
agccaacaaggcgacaagagccaac

SEQ ID NO: 509759 - DNA, 25 bp, Homo sapien
acaagagccaaccacaaccggagaa

SEQ ID NO: 509760 - DNA, 25 bp, Homo sapien
agccaaccacaaccggagaaccatg

SEQ ID NO: 509761 - DNA, 25 bp, Homo sapien
aaccggagaaccatggccgaccgca

SEQ ID NO: 509762 - DNA, 25 bp, Homo sapien
catggccgaccgcaagaggagcaaa

SEQ ID NO: 509763 - DNA, 25 bp, Homo sapien
gaggagcaaaggcatgatcccatcc

SEQ ID NO: 509764 - DNA, 25 bp, Homo sapien
gggtcaccagtgaaaagttgtgcag

SEQ ID NO: 509765 - DNA, 25 bp, Homo sapien
gtgcagagcccaacatgagcttcat

SEQ ID NO: 509766 - DNA, 25 bp, Homo sapien
atgagcttcatttccaagctgccac

SEQ ID NO: 509767 - DNA, 25 bp, Homo sapien
ctgcctcctgcgtagcatccggaaa

SEQ ID NO: 509768 - DNA, 25 bp, Homo sapien
gtagcatccggaaacatgtggccct

SEQ ID NO: 509769 - DNA, 25 bp, Homo sapien
aaacatgtggccctacatcaggaat

SEQ ID NO: 509770 - DNA, 25 bp, Homo sapien
gtggccctacatcaggaatttcatg

SEQ ID NO: 509771 - DNA, 25 bp, Homo sapien
aatttcatggcaagggtgagcgctc

SEQ ID NO: 509772 - DNA, 25 bp, Homo sapien
gcttggtgggtctcaagttgcccca

SEQ ID NO: 509773 - DNA, 25 bp, Homo sapien
ggagaatatccttggatgctgcatt

SEQ ID NO: 509774 - DNA, 25 bp, Homo sapien
ttggatgctgcattcataggagaat

SEQ ID NO: 509775 - DNA, 25 bp, Homo sapien
tgtggttactagtgccaaaaatgct

SEQ ID NO: 509776 - DNA, 25 bp, Homo sapien
agctgttcttttttcgatcggggag

SEQ ID NO: 509777 - DNA, 25 bp, Homo sapien
gccacacagacacactaggcctgtg

SEQ ID NO: 509778 - DNA, 25 bp, Homo sapien
gacacactaggcctgtgtatttatt

SEQ ID NO: 509779 - DNA, 25 bp, Homo sapien
cgaggttctcttggcatcactttct

SEQ ID NO: 509780 - DNA, 25 bp, Homo sapien
aggttctcttggcatcactttctcc

SEQ ID NO: 509781 - DNA, 25 bp, Homo sapien
atcactttctccctggctgcagaac

SEQ ID NO: 509782 - DNA, 25 bp, Homo sapien
tggctgcagaactagacacccttga

SEQ ID NO: 509783 - DNA, 25 bp, Homo sapien
gctgcagaactagacacccttgaag

SEQ ID NO: 509784 - DNA, 25 bp, Homo sapien
gcagaactagacacccttgaagatt

SEQ ID NO: 509785 - DNA, 25 bp, Homo sapien
aactagacacccttgaagatttggc

SEQ ID NO: 509786 - DNA, 25 bp, Homo sapien
tgatgccctcatgattttccaccct

SEQ ID NO: 509787 - DNA, 25 bp, Homo sapien
ctctcttcccataaagcatcttcct

SEQ ID NO: 509788 - DNA, 25 bp, Homo sapien
tcttcctaaggaaatgaccatggcc

SEQ ID NO: 509789 - DNA, 25 bp, Homo sapien
ggaaatgaccatggcctgatactca

SEQ ID NO: 509790 - DNA, 25 bp, Homo sapien
tggcctgatactcattttgtcactt

SEQ ID NO: 509791 - DNA, 25 bp, Homo sapien
ttttgtcacttgtacagagccctaa

SEQ ID NO: 509792 - DNA, 25 bp, Homo sapien
ttgtcacttgtacagagccctaagg

SEQ ID NO: 509793 - DNA, 25 bp, Homo sapien
gtcacttgtacagagccctaaggat

SEQ ID NO: 509794 - DNA, 25 bp, Homo sapien
ttgtacagagccctaaggatgttct

SEQ ID NO: 509795 - DNA, 25 bp, Homo sapien
acagagccctaaggatgttctgaat

SEQ ID NO: 509796 - DNA, 25 bp, Homo sapien
atgttctgaattcagtggtgccaaa

SEQ ID NO: 509797 - DNA, 25 bp, Homo sapien
attttttccaagcacgaagccacca

SEQ ID NO: 509798 - DNA, 25 bp, Homo sapien
gaagggacatggatgtgctcctgcc

SEQ ID NO: 509799 - DNA, 25 bp, Homo sapien
gaaggtgaatacaaagcagcaggca

SEQ ID NO: 509800 - DNA, 25 bp, Homo sapien
gtaaaatctgctgggactgcctgga

SEQ ID NO: 509801 - DNA, 25 bp, Homo sapien
gctgggactgcctggagatttgtca

SEQ ID NO: 509802 - DNA, 25 bp, Homo sapien
gagctgcagacaagtaccttggagc

SEQ ID NO: 509803 - DNA, 25 bp, Homo sapien
agtaccttggagcattctgttattt

SEQ ID NO: 509804 - DNA, 25 bp, Homo sapien
ggaaagttcaaatatgcagggacaa

SEQ ID NO: 509805 - DNA, 25 bp, Homo sapien
aaggaggttgctgactgtactgaca

SEQ ID NO: 509806 - DNA, 25 bp, Homo sapien
ttgctgactgtactgacaggctcta

SEQ ID NO: 509807 - DNA, 25 bp, Homo sapien
acaggctctaagtcattttctccaa

SEQ ID NO: 509808 - DNA, 25 bp, Homo sapien
gcaggtgttaattccaattcaatgc

SEQ ID NO: 509809 - DNA, 25 bp, Homo sapien
ggtgttaattccaattcaatgcaaa

SEQ ID NO: 509810 - DNA, 25 bp, Homo sapien
gcaaatatccttttcaatccggtcc

SEQ ID NO: 509811 - DNA, 25 bp, Homo sapien
aatatccttttcaatccggtccatt

SEQ ID NO: 509812 - DNA, 25 bp, Homo sapien
ttttcaatccggtccattcttggag

SEQ ID NO: 509813 - DNA, 25 bp, Homo sapien
caatccggtccattcttggagaaga

SEQ ID NO: 509814 - DNA, 25 bp, Homo sapien
tccggtccattcttggagaagaaac

SEQ ID NO: 509815 - DNA, 25 bp, Homo sapien
tcttctgtggttgggatattacttt

SEQ ID NO: 509816 - DNA, 25 bp, Homo sapien
ctgtggttgggatattactttgtaa

SEQ ID NO: 509817 - DNA, 25 bp, Homo sapien
aatatgtagtaaatcttgctttcat

SEQ ID NO: 509818 - DNA, 25 bp, Homo sapien
ggaaaacactgaggcaaaagtaggt

SEQ ID NO: 509819 - DNA, 25 bp, Homo sapien
tttctgacctcaaaagtgcctcact

SEQ ID NO: 509820 - DNA, 25 bp, Homo sapien
caaaagtgcctcacttgtatattat

SEQ ID NO: 509821 - DNA, 25 bp, Homo sapien
atttccattaaaagcttgactgcat

SEQ ID NO: 509822 - DNA, 25 bp, Homo sapien
ttgactgcattctttctaatgaaca

SEQ ID NO: 509823 - DNA, 25 bp, Homo sapien
gaaaaactgtttaactcatgtcata

SEQ ID NO: 509824 - DNA, 25 bp, Homo sapien
catgtcataatgtgtctcctcagat

SEQ ID NO: 509825 - DNA, 25 bp, Homo sapien
gtgtctcctcagatatagttaacta

SEQ ID NO: 509826 - DNA, 25 bp, Homo sapien
ctagcttgatagttttgagtatata

SEQ ID NO: 509827 - DNA, 25 bp, Homo sapien
cataataagtttgtaaccatttctg

SEQ ID NO: 509828 - DNA, 25 bp, Homo sapien
ttctgttacttcatacccgtgtaat

SEQ ID NO: 509829 - DNA, 25 bp, Homo sapien
tcatacccgtgtaattggacatagc

SEQ ID NO: 509830 - DNA, 25 bp, Homo sapien
tactgtgacatggagcatttgatga

SEQ ID NO: 509831 - DNA, 25 bp, Homo sapien
gggagcctgcttaactatgaagtga

SEQ ID NO: 509832 - DNA, 25 bp, Homo sapien
tatgaagtgagtagcatcgccccag

SEQ ID NO: 509833 - DNA, 25 bp, Homo sapien
agtgagtagcatcgccccaggagca

SEQ ID NO: 509834 - DNA, 25 bp, Homo sapien
caggagcaccatgacagatgcacag

SEQ ID NO: 509835 - DNA, 25 bp, Homo sapien
gcaccatgacagatgcacaggacat

SEQ ID NO: 509836 - DNA, 25 bp, Homo sapien
acagatgcacaggacatggagggaa

SEQ ID NO: 509837 - DNA, 25 bp, Homo sapien
agggaaggaaatggcatcctgcaca

SEQ ID NO: 509838 - DNA, 25 bp, Homo sapien
aaggctgctctagttttctactttt

SEQ ID NO: 509839 - DNA, 25 bp, Homo sapien
taaagaaatggctcacgtgtgaccc

SEQ ID NO: 509840 - DNA, 25 bp, Homo sapien
ggctcacgtgtgacccttattttac

SEQ ID NO: 509841 - DNA, 25 bp, Homo sapien
ggacataacatcagatgtctagatg

SEQ ID NO: 509842 - DNA, 25 bp, Homo sapien
gtctagatgaattatagctatggct

SEQ ID NO: 509843 - DNA, 25 bp, Homo sapien
atagctatggcttaattacacaata

SEQ ID NO: 509844 - DNA, 25 bp, Homo sapien
attacacaataatctgccttcttag

SEQ ID NO: 509845 - DNA, 25 bp, Homo sapien
caataatctgccttcttagtagaaa

SEQ ID NO: 509846 - DNA, 25 bp, Homo sapien
agtagaaattgcttatttccagcat

SEQ ID NO: 509847 - DNA, 25 bp, Homo sapien
aaagacagtcagtttacaaaaatat

SEQ ID NO: 509848 - DNA, 25 bp, Homo sapien
ttggtgcgtgataatagcaagttat

SEQ ID NO: 509849 - DNA, 25 bp, Homo sapien
gaatattaaatcttttgtgcccaag

SEQ ID NO: 509850 - DNA, 25 bp, Homo sapien
atcttttgtgcccaagtgccttaat

SEQ ID NO: 509851 - DNA, 25 bp, Homo sapien
gtgcccaagtgccttaataaataag

SEQ ID NO: 509852 - DNA, 25 bp, Homo sapien
taaacctatttcctagcatgccttc

SEQ ID NO: 509853 - DNA, 25 bp, Homo sapien
gcatgccttcaggaagttgtgccag

SEQ ID NO: 509854 - DNA, 25 bp, Homo sapien
agttgtgccagaccctagattgtga

SEQ ID NO: 509855 - DNA, 25 bp, Homo sapien
ccactgttcttctgttgtacgagct

SEQ ID NO: 509856 - DNA, 25 bp, Homo sapien
tgtacgagctccctgaaccattgtt

SEQ ID NO: 509857 - DNA, 25 bp, Homo sapien
attgttcagaggaccaatgtcacat

SEQ ID NO: 509858 - DNA, 25 bp, Homo sapien
aatgtcacatcgcttcatgggcatg

SEQ ID NO: 509859 - DNA, 25 bp, Homo sapien
gagcatctgggtgatatctgtctac

SEQ ID NO: 509860 - DNA, 25 bp, Homo sapien
atctgtctacagtattggctcttct

SEQ ID NO: 509861 - DNA, 25 bp, Homo sapien
attggctcttctgcgaggctgatac

SEQ ID NO: 509862 - DNA, 25 bp, Homo sapien
aggctgatacacaaggcctctcttc

SEQ ID NO: 509863 - DNA, 25 bp, Homo sapien
gtaccagctgccatgaatatgccag

SEQ ID NO: 509864 - DNA, 25 bp, Homo sapien
tgccatgaatatgccagagctgctg

SEQ ID NO: 509865 - DNA, 25 bp, Homo sapien
gagctgctggctagtgataaataac

SEQ ID NO: 509866 - DNA, 25 bp, Homo sapien
gctggctagtgataaataactgaaa

SEQ ID NO: 509867 - DNA, 25 bp, Homo sapien
tttttatccagcttagacaaagatg

SEQ ID NO: 509868 - DNA, 25 bp, Homo sapien
ccagcttagacaaagatgggcaaag

SEQ ID NO: 509869 - DNA, 25 bp, Homo sapien
aaatggtagagatgggcacagagaa

SEQ ID NO: 509870 - DNA, 25 bp, Homo sapien
gaaagggcacggagggaggcacaaa

SEQ ID NO: 509871 - DNA, 25 bp, Homo sapien
gcagacattggagaaatgcctttac

SEQ ID NO: 509872 - DNA, 25 bp, Homo sapien
tggagaaatgcctttacaagccggg

SEQ ID NO: 509873 - DNA, 25 bp, Homo sapien
gccaaggatgctggcaaccctggga

SEQ ID NO: 509874 - DNA, 25 bp, Homo sapien
tccccgctcctaatggtacgtgggt

SEQ ID NO: 509875 - DNA, 25 bp, Homo sapien
acgtgggtacccaggctggttcttg

SEQ ID NO: 509876 - DNA, 25 bp, Homo sapien
aagttcattacctccctatcagttc

SEQ ID NO: 509877 - DNA, 25 bp, Homo sapien
acctccctatcagttctagcatagt

SEQ ID NO: 509878 - DNA, 25 bp, Homo sapien
gcatagtaaactacggtaccagtgt

SEQ ID NO: 509879 - DNA, 25 bp, Homo sapien
gaagagctgggttttcctagtatac

SEQ ID NO: 509880 - DNA, 25 bp, Homo sapien
ggttttcctagtatacccactgcat

SEQ ID NO: 509881 - DNA, 25 bp, Homo sapien
tggtcaacccgctgcttccaggtat

SEQ ID NO: 509882 - DNA, 25 bp, Homo sapien
ctgcttccaggtatgggacctgcta

SEQ ID NO: 509883 - DNA, 25 bp, Homo sapien
ggacctgctaagtgtggaattacct

SEQ ID NO: 509884 - DNA, 25 bp, Homo sapien
tacaaggagggcctctggtgttcct

SEQ ID NO: 509885 - DNA, 25 bp, Homo sapien
taataaaggctttggacttaccact

SEQ ID NO: 509886 - DNA, 25 bp, Homo sapien
cttctttgaaatcccaactggtcgc

SEQ ID NO: 509887 - DNA, 25 bp, Homo sapien
actggtcgcatcttaggttggtttg

SEQ ID NO: 509888 - DNA, 25 bp, Homo sapien
cttgtgggaactctcctgctattct

SEQ ID NO: 509889 - DNA, 25 bp, Homo sapien
tattctgtctggttttgggccttac

SEQ ID NO: 509890 - DNA, 25 bp, Homo sapien
gggccttactgcagttgtggttttg

SEQ ID NO: 509891 - DNA, 25 bp, Homo sapien
ggtggttggaacaagcatatatttc

SEQ ID NO: 509892 - DNA, 25 bp, Homo sapien
acaacatgacacaactgcgggtcga

SEQ ID NO: 509893 - DNA, 25 bp, Homo sapien
ctgcgggtcgagagccagttttagt

SEQ ID NO: 509894 - DNA, 25 bp, Homo sapien
gaggactaatgcagcacacaatgta

SEQ ID NO: 509895 - DNA, 25 bp, Homo sapien
gcagcacacaatgtatacagtacta

SEQ ID NO: 509896 - DNA, 25 bp, Homo sapien
tgcagctcccttttttacagttctg

SEQ ID NO: 509897 - DNA, 25 bp, Homo sapien
gtgggagctgaattgcatactgatt

SEQ ID NO: 509898 - DNA, 25 bp, Homo sapien
gcatactgatttcatcttgctgaag

SEQ ID NO: 509899 - DNA, 25 bp, Homo sapien
ttgctgaagtgcacattccccttcc

SEQ ID NO: 509900 - DNA, 25 bp, Homo sapien
tgtctgtgttctctagccctgaatt

SEQ ID NO: 509901 - DNA, 25 bp, Homo sapien
gaattcagatgtcccagactggtca

SEQ ID NO: 509902 - DNA, 25 bp, Homo sapien
tattctacttccctgtcacaaatgg

SEQ ID NO: 509903 - DNA, 25 bp, Homo sapien
caaatggccatcatgtccagagctt

SEQ ID NO: 509904 - DNA, 25 bp, Homo sapien
ccagagcttttgtccaaagtgctag

SEQ ID NO: 509905 - DNA, 25 bp, Homo sapien
gtgctagggaataagacactctttt

SEQ ID NO: 509906 - DNA, 25 bp, Homo sapien
acactcttttttctgttccagtcaa

SEQ ID NO: 509907 - DNA, 25 bp, Homo sapien
ccaatgtcacattcgagtcttactg

SEQ ID NO: 509908 - DNA, 25 bp, Homo sapien
attcgagtcttactgaactacttga

SEQ ID NO: 509909 - DNA, 25 bp, Homo sapien
gaactacttgactgcatttcccgag

SEQ ID NO: 509910 - DNA, 25 bp, Homo sapien
gagatctcacctcttctcgcctgta

SEQ ID NO: 509911 - DNA, 25 bp, Homo sapien
gcctgtaccctgtgcgcggaaagtc

SEQ ID NO: 509912 - DNA, 25 bp, Homo sapien
ctgtgcgcggaaagtcagccctcca

SEQ ID NO: 509913 - DNA, 25 bp, Homo sapien
aaaatacttcgtggttttgcagctc

SEQ ID NO: 509914 - DNA, 25 bp, Homo sapien
gcagctctggagtatttaccgtgtt

SEQ ID NO: 509915 - DNA, 25 bp, Homo sapien
gagtatttaccgtgttggctgttta

SEQ ID NO: 509916 - DNA, 25 bp, Homo sapien
atttctgcctccatcagaaggcaga

SEQ ID NO: 509917 - DNA, 25 bp, Homo sapien
aatatacctaagtgactgcccacct

SEQ ID NO: 509918 - DNA, 25 bp, Homo sapien
gacttttaattttcatagagtgaaa

SEQ ID NO: 509919 - DNA, 25 bp, Homo sapien
tgaagtgagtgtttggtaaatatgc

SEQ ID NO: 509920 - DNA, 25 bp, Homo sapien
atggaaaactaaacaccttgaatat

SEQ ID NO: 509921 - DNA, 25 bp, Homo sapien
ggaaaactaaacaccttgaatatgc

SEQ ID NO: 509922 - DNA, 25 bp, Homo sapien
aaactaaacaccttgaatatgctga

SEQ ID NO: 509923 - DNA, 25 bp, Homo sapien
actaaacaccttgaatatgctgaaa

SEQ ID NO: 509924 - DNA, 25 bp, Homo sapien
aaacaccttgaatatgctgaaagca

SEQ ID NO: 509925 - DNA, 25 bp, Homo sapien
tatttgttatatagtttctttgaac

SEQ ID NO: 509926 - DNA, 25 bp, Homo sapien
tctttgaacatgtggtcactctgcc

SEQ ID NO: 509927 - DNA, 25 bp, Homo sapien
tgtggtcactctgcctgcaaacgta

SEQ ID NO: 509928 - DNA, 25 bp, Homo sapien
tggtcactctgcctgcaaacgtaaa

SEQ ID NO: 509929 - DNA, 25 bp, Homo sapien
gtacttaactgtagtcttctccatg

SEQ ID NO: 509930 - DNA, 25 bp, Homo sapien
gtcttctccatgaattacacgttag

SEQ ID NO: 509931 - DNA, 25 bp, Homo sapien
acacgttagaatagactggcagcaa

SEQ ID NO: 509932 - DNA, 25 bp, Homo sapien
cagcaagtaagcctctagcttatag

SEQ ID NO: 509933 - DNA, 25 bp, Homo sapien
agcctctagcttatagtttcatccc

SEQ ID NO: 509934 - DNA, 25 bp, Homo sapien
tagcttatagtttcatccctacccc

SEQ ID NO: 509935 - DNA, 25 bp, Homo sapien
ctgcgtgagtctgtacagggatatg

SEQ ID NO: 509936 - DNA, 25 bp, Homo sapien
aatgtctgtatactacatgctgcta

SEQ ID NO: 509937 - DNA, 25 bp, Homo sapien
ctgtatactacatgctgctaaggta

SEQ ID NO: 509938 - DNA, 25 bp, Homo sapien
attgtgggtccaaactactctttgc

SEQ ID NO: 509939 - DNA, 25 bp, Homo sapien
gtccaaactactctttgcactactt

SEQ ID NO: 509940 - DNA, 25 bp, Homo sapien
ccatttcttttggatatgctttacc

SEQ ID NO: 509941 - DNA, 25 bp, Homo sapien
ggatatgctttaccattcttaggtt

SEQ ID NO: 509942 - DNA, 25 bp, Homo sapien
accattcttaggtttctgtggaaca

SEQ ID NO: 509943 - DNA, 25 bp, Homo sapien
ttttttccaattgctattgcccaag

SEQ ID NO: 509944 - DNA, 25 bp, Homo sapien
attgcccaagaattgctttccatgc

SEQ ID NO: 509945 - DNA, 25 bp, Homo sapien
ttgctttccatgcacatattgtaaa

SEQ ID NO: 509946 - DNA, 25 bp, Homo sapien
gtaaaaattccgctttgtgccacag

SEQ ID NO: 509947 - DNA, 25 bp, Homo sapien
gctttgtgccacaggtcatgattgt

SEQ ID NO: 509948 - DNA, 25 bp, Homo sapien
gtcatgattgtggatgagtttactc

SEQ ID NO: 509949 - DNA, 25 bp, Homo sapien
tgagtttactcttaacttcaaaggg

SEQ ID NO: 509950 - DNA, 25 bp, Homo sapien
agggactatttgtattgtatgttgc

SEQ ID NO: 509951 - DNA, 25 bp, Homo sapien
gacaattatgccatcagacaatgtt

SEQ ID NO: 509952 - DNA, 25 bp, Homo sapien
agaacgatccttggagatcccgtaa

SEQ ID NO: 509953 - DNA, 25 bp, Homo sapien
ttggagatcccgtaatcccactacc

SEQ ID NO: 509954 - DNA, 25 bp, Homo sapien
actacccttctttggctcagagagg

SEQ ID NO: 509955 - DNA, 25 bp, Homo sapien
gctcagagaggataatttgcctaat

SEQ ID NO: 509956 - DNA, 25 bp, Homo sapien
ggcaaaacttaatttggagcctgat

SEQ ID NO: 509957 - DNA, 25 bp, Homo sapien
atttggagcctgatttcctactgac

SEQ ID NO: 509958 - DNA, 25 bp, Homo sapien
gatttcctactgacttccaatttag

SEQ ID NO: 509959 - DNA, 25 bp, Homo sapien
tagtgctcccccagtatgctaaata

SEQ ID NO: 509960 - DNA, 25 bp, Homo sapien
gtatgctaaatagaaagccctctgc

SEQ ID NO: 509961 - DNA, 25 bp, Homo sapien
agaaagccctctgcaatatattaaa

SEQ ID NO: 509962 - DNA, 25 bp, Homo sapien
taaagtcaaccttttcactctgctc

SEQ ID NO: 509963 - DNA, 25 bp, Homo sapien
cctctggatggagctctttccagca

SEQ ID NO: 509964 - DNA, 25 bp, Homo sapien
agatgcaaaatctggagagcgcgag

SEQ ID NO: 509965 - DNA, 25 bp, Homo sapien
gggaaagcatggacccttaggagat

SEQ ID NO: 509966 - DNA, 25 bp, Homo sapien
gcatggacccttaggagataatgaa

SEQ ID NO: 509967 - DNA, 25 bp, Homo sapien
gaggaccagagtatctactgacaaa

SEQ ID NO: 509968 - DNA, 25 bp, Homo sapien
gggcggtcagtcagcacccagactg

SEQ ID NO: 509969 - DNA, 25 bp, Homo sapien
ggtcagtcagcacccagactggcag

SEQ ID NO: 509970 - DNA, 25 bp, Homo sapien
agactggcagcatgaccggtcagat

SEQ ID NO: 509971 - DNA, 25 bp, Homo sapien
gaccggtcagataccaaggctttct

SEQ ID NO: 509972 - DNA, 25 bp, Homo sapien
gataccaaggctttctaaagtcaac

SEQ ID NO: 509973 - DNA, 25 bp, Homo sapien
gctatggactatgactctcaataat

SEQ ID NO: 509974 - DNA, 25 bp, Homo sapien
ggactatgactctcaataatttctt

SEQ ID NO: 509975 - DNA, 25 bp, Homo sapien
atgactctcaataatttctttcagc

SEQ ID NO: 509976 - DNA, 25 bp, Homo sapien
ttcagctcttaggaggtcgggctcg

SEQ ID NO: 509977 - DNA, 25 bp, Homo sapien
gctcttaggaggtcgggctcggcag

SEQ ID NO: 509978 - DNA, 25 bp, Homo sapien
cgggcgggcggactagcggcgacga

SEQ ID NO: 509979 - DNA, 25 bp, Homo sapien
atcggagggtggttcgtgtcgcgca

SEQ ID NO: 509980 - DNA, 25 bp, Homo sapien
tcgtgtcgcgcaacggcagacggta

SEQ ID NO: 509981 - DNA, 25 bp, Homo sapien
aacggcagacggtatgggctgtcgc

SEQ ID NO: 509982 - DNA, 25 bp, Homo sapien
gacggtatgggctgtcgccggcaga

SEQ ID NO: 509983 - DNA, 25 bp, Homo sapien
ggctgtcgccggcagacggtcctgc

SEQ ID NO: 509984 - DNA, 25 bp, Homo sapien
gctggagatactaagtcccaaccta

SEQ ID NO: 509985 - DNA, 25 bp, Homo sapien
gagatactaagtcccaacctaaatg

SEQ ID NO: 509986 - DNA, 25 bp, Homo sapien
atactaagtcccaacctaaatgatg

SEQ ID NO: 509987 - DNA, 25 bp, Homo sapien
aagtcccaacctaaatgatggaagg

SEQ ID NO: 509988 - DNA, 25 bp, Homo sapien
gtctgtggaagatatcacatgaact

SEQ ID NO: 509989 - DNA, 25 bp, Homo sapien
gaactacctaattttcaagcatgga

SEQ ID NO: 509990 - DNA, 25 bp, Homo sapien
ctaattttcaagcatggatctccat

SEQ ID NO: 509991 - DNA, 25 bp, Homo sapien
agcatggatctccatatttcaaagg

SEQ ID NO: 509992 - DNA, 25 bp, Homo sapien
aaacttcaaatatctcaccacagtg

SEQ ID NO: 509993 - DNA, 25 bp, Homo sapien
atctcaccacagtgaattatgggta

SEQ ID NO: 509994 - DNA, 25 bp, Homo sapien
acactgtatacatatgccaaaatat

SEQ ID NO: 509995 - DNA, 25 bp, Homo sapien
ggtatgtaaaactcatactcatatg

SEQ ID NO: 509996 - DNA, 25 bp, Homo sapien
tcatatgtaagcctcatactcccta

SEQ ID NO: 509997 - DNA, 25 bp, Homo sapien
gtaagcctcatactccctatggtag

SEQ ID NO: 509998 - DNA, 25 bp, Homo sapien
gcctcatactccctatggtagtaaa

SEQ ID NO: 509999 - DNA, 25 bp, Homo sapien
gtagtaaaacttaaggccagcaggt

SEQ ID NO: 510000 - DNA, 25 bp, Homo sapien
aggccagcaggtaaagattatttct

SEQ ID NO: 510001 - DNA, 25 bp, Homo sapien
gcatatagatgggattctgtttctt

SEQ ID NO: 510002 - DNA, 25 bp, Homo sapien
cataaatatagagtaggattgccca

SEQ ID NO: 510003 - DNA, 25 bp, Homo sapien
ggattgcccaggtatgaaccccaat

SEQ ID NO: 510004 - DNA, 25 bp, Homo sapien
tgcccaggtatgaaccccaatttca

SEQ ID NO: 510005 - DNA, 25 bp, Homo sapien
gtatgaaccccaatttcactaaaat

SEQ ID NO: 510006 - DNA, 25 bp, Homo sapien
aagatcaggggtccggctgtccttc

SEQ ID NO: 510007 - DNA, 25 bp, Homo sapien
tgtcctgctgcagactaaaggtctg

SEQ ID NO: 510008 - DNA, 25 bp, Homo sapien
gactaaaggtctggccaatgtcttg

SEQ ID NO: 510009 - DNA, 25 bp, Homo sapien
taaaggtctggccaatgtcttgccc

SEQ ID NO: 510010 - DNA, 25 bp, Homo sapien
aaggtctggccaatgtcttgcccca

SEQ ID NO: 510011 - DNA, 25 bp, Homo sapien
cgcgatacggcgcagttcctatatt

SEQ ID NO: 510012 - DNA, 25 bp, Homo sapien
gatacggcgcagttcctatattcat

SEQ ID NO: 510013 - DNA, 25 bp, Homo sapien
gttatttattgtgtactgactccat

SEQ ID NO: 510014 - DNA, 25 bp, Homo sapien
tttattgtgtactgactccatctgc

SEQ ID NO: 510015 - DNA, 25 bp, Homo sapien
tattgtgtactgactccatctgccc

SEQ ID NO: 510016 - DNA, 25 bp, Homo sapien
tccatctgccccgtcaaataaaaaa

SEQ ID NO: 510017 - DNA, 25 bp, Homo sapien
gggccctgacccaaggccttcaggg

SEQ ID NO: 510018 - DNA, 25 bp, Homo sapien
tggagaagaccctgcgtgacagtga

SEQ ID NO: 510019 - DNA, 25 bp, Homo sapien
agaccctgcgtgacagtgaggagat

SEQ ID NO: 510020 - DNA, 25 bp, Homo sapien
gatccgggacagcaagaagttcctg

SEQ ID NO: 510021 - DNA, 25 bp, Homo sapien
gaggtgaccttcatctatcagaagc

SEQ ID NO: 510022 - DNA, 25 bp, Homo sapien
gaccttcatctatcagaagctccaa

SEQ ID NO: 510023 - DNA, 25 bp, Homo sapien
atctatcagaagctccaagcgcagg

SEQ ID NO: 510024 - DNA, 25 bp, Homo sapien
tccaagcgcaggaggatgagatctc

SEQ ID NO: 510025 - DNA, 25 bp, Homo sapien
gagatctcagagaacttggtgaaca

SEQ ID NO: 510026 - DNA, 25 bp, Homo sapien
tcagagaacttggtgaacattcaga

SEQ ID NO: 510027 - DNA, 25 bp, Homo sapien
aggtgaaatgccgcaaaatcctgac

SEQ ID NO: 510028 - DNA, 25 bp, Homo sapien
taaggaggagataggcactgaagac

SEQ ID NO: 510029 - DNA, 25 bp, Homo sapien
gacagagagggtgcctttgagcccc

SEQ ID NO: 510030 - DNA, 25 bp, Homo sapien
agcacttctcctgagctattcgaaa

SEQ ID NO: 510031 - DNA, 25 bp, Homo sapien
tctcctgagctattcgaaaaattct

SEQ ID NO: 510032 - DNA, 25 bp, Homo sapien
aaaaattctacgactgtgaggagga

SEQ ID NO: 510033 - DNA, 25 bp, Homo sapien
ttgctgcctatgaaggcgccttcac

SEQ ID NO: 510034 - DNA, 25 bp, Homo sapien
aaggcgccttcactgcttgccagag

SEQ ID NO: 510035 - DNA, 25 bp, Homo sapien
cttcctctcttgtttcccatggaaa

SEQ ID NO: 510036 - DNA, 25 bp, Homo sapien
ttcccatggaaacggcctcttcaga

SEQ ID NO: 510037 - DNA, 25 bp, Homo sapien
gaaacggcctcttcagaaggcagat

SEQ ID NO: 510038 - DNA, 25 bp, Homo sapien
tcagaaggcagatcgggctgtctct

SEQ ID NO: 510039 - DNA, 25 bp, Homo sapien
ggcctgaattatccagaggagatag

SEQ ID NO: 510040 - DNA, 25 bp, Homo sapien
ataggtggatctagcttcagaggaa

SEQ ID NO: 510041 - DNA, 25 bp, Homo sapien
ttcagaggaagtctacaccccattc

SEQ ID NO: 510042 - DNA, 25 bp, Homo sapien
attcccttctgcttacaatgtaccc

SEQ ID NO: 510043 - DNA, 25 bp, Homo sapien
gcttacaatgtacccatgatatgtg

SEQ ID NO: 510044 - DNA, 25 bp, Homo sapien
gtacccatgatatgtgtttagcaca

SEQ ID NO: 510045 - DNA, 25 bp, Homo sapien
atactgtaacaggacatcacatgga

SEQ ID NO: 510046 - DNA, 25 bp, Homo sapien
aaatcaaagcagctggctcactgta

SEQ ID NO: 510047 - DNA, 25 bp, Homo sapien
agcagctggctcactgtatttaact

SEQ ID NO: 510048 - DNA, 25 bp, Homo sapien
aagaatgcctacagattggatattt

SEQ ID NO: 510049 - DNA, 25 bp, Homo sapien
aacttcattatgtgaaacttgttga

SEQ ID NO: 510050 - DNA, 25 bp, Homo sapien
atcccctgaaagttggacaccaact

SEQ ID NO: 510051 - DNA, 25 bp, Homo sapien
gttggacaccaactgtataccctag

SEQ ID NO: 510052 - DNA, 25 bp, Homo sapien
accaactgtataccctaggttgctt

SEQ ID NO: 510053 - DNA, 25 bp, Homo sapien
caactgtataccctaggttgcttaa

SEQ ID NO: 510054 - DNA, 25 bp, Homo sapien
ctgtataccctaggttgcttaaagg

SEQ ID NO: 510055 - DNA, 25 bp, Homo sapien
gttgcttaaagggatttcactatta

SEQ ID NO: 510056 - DNA, 25 bp, Homo sapien
gggatttcactattatataaagtca

SEQ ID NO: 510057 - DNA, 25 bp, Homo sapien
gaaacattctcgtcttcctttacct

SEQ ID NO: 510058 - DNA, 25 bp, Homo sapien
taatcccctaatacctagtctactt

SEQ ID NO: 510059 - DNA, 25 bp, Homo sapien
aattttcagacttcactgctttttg

SEQ ID NO: 510060 - DNA, 25 bp, Homo sapien
aattcataattctaattttcacatt

SEQ ID NO: 510061 - DNA, 25 bp, Homo sapien
tccctcttttttcatagcaagtggt

SEQ ID NO: 510062 - DNA, 25 bp, Homo sapien
gagtttcatgtagagtccacaagca

SEQ ID NO: 510063 - DNA, 25 bp, Homo sapien
agtccacaagcattgcacacgggtt

SEQ ID NO: 510064 - DNA, 25 bp, Homo sapien
gtttctgcgccataaggtggtagtt

SEQ ID NO: 510065 - DNA, 25 bp, Homo sapien
gtgacagttggcacaggacaatcca

SEQ ID NO: 510066 - DNA, 25 bp, Homo sapien
aggacaatccaagccgccgtgatga

SEQ ID NO: 510067 - DNA, 25 bp, Homo sapien
aaggcacgcgcttctgcggcttgat

SEQ ID NO: 510068 - DNA, 25 bp, Homo sapien
gctgaggccgttcatcttgctgtag

SEQ ID NO: 510069 - DNA, 25 bp, Homo sapien
attaccagagcaagtctttgattta

SEQ ID NO: 510070 - DNA, 25 bp, Homo sapien
tatgttcttaggttttcgtttcctg

SEQ ID NO: 510071 - DNA, 25 bp, Homo sapien
tcgtttcctggtttgaattccctct

SEQ ID NO: 510072 - DNA, 25 bp, Homo sapien
gagaatatcaagtccccaggtctgg

SEQ ID NO: 510073 - DNA, 25 bp, Homo sapien
aagagtagtactattgtccaatgtc

SEQ ID NO: 510074 - DNA, 25 bp, Homo sapien
actattgtccaatgtcatgaaagtg

SEQ ID NO: 510075 - DNA, 25 bp, Homo sapien
gtgggaaccagtgtgctttgaaacc

SEQ ID NO: 510076 - DNA, 25 bp, Homo sapien
gaaccagtgtgctttgaaaccaaat

SEQ ID NO: 510077 - DNA, 25 bp, Homo sapien
aattagaaacacattccttgggaag

SEQ ID NO: 510078 - DNA, 25 bp, Homo sapien
gttttctgggacttgatcatacatt

SEQ ID NO: 510079 - DNA, 25 bp, Homo sapien
tacattttatatggttgggacttct

SEQ ID NO: 510080 - DNA, 25 bp, Homo sapien
gttcatcagatatttgagtgcccac

SEQ ID NO: 510081 - DNA, 25 bp, Homo sapien
agatatttgagtgcccactctgtgc

SEQ ID NO: 510082 - DNA, 25 bp, Homo sapien
tgcccactctgtgcccaaataaata

SEQ ID NO: 510083 - DNA, 25 bp, Homo sapien
agaggctgccataattcatctccac

SEQ ID NO: 510084 - DNA, 25 bp, Homo sapien
gtgtacttctgtcatgcttatttca

SEQ ID NO: 510085 - DNA, 25 bp, Homo sapien
aaactccctgagtgatgggtacgac

SEQ ID NO: 510086 - DNA, 25 bp, Homo sapien
gggtacgacatcaaaacatggctca

SEQ ID NO: 510087 - DNA, 25 bp, Homo sapien
aaaacatggctcagtggtatcacga

SEQ ID NO: 510088 - DNA, 25 bp, Homo sapien
acatggctcagtggtatcacgagaa

SEQ ID NO: 510089 - DNA, 25 bp, Homo sapien
tatcacgagaactttggttggtggt

SEQ ID NO: 510090 - DNA, 25 bp, Homo sapien
tttggttggtggtttcttcagaatc

SEQ ID NO: 510091 - DNA, 25 bp, Homo sapien
ataaaggataggtcggaatggtact

SEQ ID NO: 510092 - DNA, 25 bp, Homo sapien
ggtcggaatggtacttaaaatgcta

SEQ ID NO: 510093 - DNA, 25 bp, Homo sapien
ggaatggtacttaaaatgctagcat

SEQ ID NO: 510094 - DNA, 25 bp, Homo sapien
tttccgccggcgcagggtcccaagc

SEQ ID NO: 510095 - DNA, 25 bp, Homo sapien
cagtcctgcggtgtgcgtctgggca

SEQ ID NO: 510096 - DNA, 25 bp, Homo sapien
gtcctgcacacacaatgcaagtcct

SEQ ID NO: 510097 - DNA, 25 bp, Homo sapien
gcacacacaatgcaagtcctggcct

SEQ ID NO: 510098 - DNA, 25 bp, Homo sapien
gccaactctgttatttatggtgtga

SEQ ID NO: 510099 - DNA, 25 bp, Homo sapien
atttatggtgtgaccccctggaggt

SEQ ID NO: 510100 - DNA, 25 bp, Homo sapien
atttgttgaggttatttcctctgag

SEQ ID NO: 510101 - DNA, 25 bp, Homo sapien
gttgaggttatttcctctgagcagt

SEQ ID NO: 510102 - DNA, 25 bp, Homo sapien
aggttatttcctctgagcagtctgc

SEQ ID NO: 510103 - DNA, 25 bp, Homo sapien
gttatttcctctgagcagtctgcct

SEQ ID NO: 510104 - DNA, 25 bp, Homo sapien
tatttcctctgagcagtctgcctct

SEQ ID NO: 510105 - DNA, 25 bp, Homo sapien
gtcaagacctttgcactaggatagt

SEQ ID NO: 510106 - DNA, 25 bp, Homo sapien
gaaccatggcaactgatcacaacaa

SEQ ID NO: 510107 - DNA, 25 bp, Homo sapien
atcagatccattttatcctccttgt

SEQ ID NO: 510108 - DNA, 25 bp, Homo sapien
taattacctatgttacctttccctg

SEQ ID NO: 510109 - DNA, 25 bp, Homo sapien
ctttccctgggactatgaatgtgca

SEQ ID NO: 510110 - DNA, 25 bp, Homo sapien
aattccaatgttcatggtctctccc

SEQ ID NO: 510111 - DNA, 25 bp, Homo sapien
gtctctccctttaaacctatattct

SEQ ID NO: 510112 - DNA, 25 bp, Homo sapien
atattctaccccttttacattatag

SEQ ID NO: 510113 - DNA, 25 bp, Homo sapien
gaaacccagagtccttctcttggga

SEQ ID NO: 510114 - DNA, 25 bp, Homo sapien
ccttctcttgggactcttaatgtgt

SEQ ID NO: 510115 - DNA, 25 bp, Homo sapien
gtatttctaattatccatgactctt

SEQ ID NO: 510116 - DNA, 25 bp, Homo sapien
tgtggttactagtgccaaaaatgct

SEQ ID NO: 510117 - DNA, 25 bp, Homo sapien
agctgttcttttttcgatcggggag

SEQ ID NO: 510118 - DNA, 25 bp, Homo sapien
tgtgccacacagacacactaggcct

SEQ ID NO: 510119 - DNA, 25 bp, Homo sapien
gacacactaggcctgtgtatttatt

SEQ ID NO: 510120 - DNA, 25 bp, Homo sapien
tatttccccttcaaagcagactgag

SEQ ID NO: 510121 - DNA, 25 bp, Homo sapien
cgaggttctcttggcatcactttct

SEQ ID NO: 510122 - DNA, 25 bp, Homo sapien
aggttctcttggcatcactttctcc

SEQ ID NO: 510123 - DNA, 25 bp, Homo sapien
atcactttctccctggctgcagaac

SEQ ID NO: 510124 - DNA, 25 bp, Homo sapien
tggctgcagaactagacacccttga

SEQ ID NO: 510125 - DNA, 25 bp, Homo sapien
gcagaactagacacccttgaagatt

SEQ ID NO: 510126 - DNA, 25 bp, Homo sapien
aactagacacccttgaagatttggc

SEQ ID NO: 510127 - DNA, 25 bp, Homo sapien
acccctggtttgtgcaaagatactg

SEQ ID NO: 510128 - DNA, 25 bp, Homo sapien
gtttgtgcaaagatactgggtatat

SEQ ID NO: 510129 - DNA, 25 bp, Homo sapien
gatactgggtatatgtaaacatgaa

SEQ ID NO: 510130 - DNA, 25 bp, Homo sapien
catgaagaggtaggaggtgcgagtt

SEQ ID NO: 510131 - DNA, 25 bp, Homo sapien
aggaggtgcgagttcaggtcctggc

SEQ ID NO: 510132 - DNA, 25 bp, Homo sapien
tccagatacagttaagctgctacaa

SEQ ID NO: 510133 - DNA, 25 bp, Homo sapien
agttaagctgctacaacaaccaggg

SEQ ID NO: 510134 - DNA, 25 bp, Homo sapien
gctacaacaaccagggggacccaga

SEQ ID NO: 510135 - DNA, 25 bp, Homo sapien
gaggaccccctcaagaggtgagaag

SEQ ID NO: 510136 - DNA, 25 bp, Homo sapien
tataaaataggattctgcacagcag

SEQ ID NO: 510137 - DNA, 25 bp, Homo sapien
ataggattctgcacagcagaaaaat

SEQ ID NO: 510138 - DNA, 25 bp, Homo sapien
gatgttgatcatcctctaccaataa

SEQ ID NO: 510139 - DNA, 25 bp, Homo sapien
tgatcatcctctaccaataagcaat

SEQ ID NO: 510140 - DNA, 25 bp, Homo sapien
taagcaatccactaacaagcagtca

SEQ ID NO: 510141 - DNA, 25 bp, Homo sapien
caagcagtcaaccaatagatgatga

SEQ ID NO: 510142 - DNA, 25 bp, Homo sapien
gattatgctaatttttaccagggat

SEQ ID NO: 510143 - DNA, 25 bp, Homo sapien
ttaccagggattgtgggattgtact

SEQ ID NO: 510144 - DNA, 25 bp, Homo sapien
gggattgtactggagctttttctga

SEQ ID NO: 510145 - DNA, 25 bp, Homo sapien
gtactggagctttttctgatgagtt

SEQ ID NO: 510146 - DNA, 25 bp, Homo sapien
atgagttgtcatttaagcgtggtga

SEQ ID NO: 510147 - DNA, 25 bp, Homo sapien
atgtgatttacattcttagcaagga

SEQ ID NO: 510148 - DNA, 25 bp, Homo sapien
aagggagccattggcttggtgccta

SEQ ID NO: 510149 - DNA, 25 bp, Homo sapien
actaagttttgttaacagagactgc

SEQ ID NO: 510150 - DNA, 25 bp, Homo sapien
aacagagactgcatgctttgcttat

SEQ ID NO: 510151 - DNA, 25 bp, Homo sapien
gcatgctttgcttatagttcttaat

SEQ ID NO: 510152 - DNA, 25 bp, Homo sapien
tcttaattttggttttgacattcat

SEQ ID NO: 510153 - DNA, 25 bp, Homo sapien
attgttcatgcttttaggcctttgg

SEQ ID NO: 510154 - DNA, 25 bp, Homo sapien
ttttatccacaggtagaaaatggtc

SEQ ID NO: 510155 - DNA, 25 bp, Homo sapien
gaaaatggtctttgcacacactaca

SEQ ID NO: 510156 - DNA, 25 bp, Homo sapien
gtctttgcacacactacacttattt

SEQ ID NO: 510157 - DNA, 25 bp, Homo sapien
atatacaatgtgctcccgaactttc

SEQ ID NO: 510158 - DNA, 25 bp, Homo sapien
atgtgctcccgaactttcgcattag

SEQ ID NO: 510159 - DNA, 25 bp, Homo sapien
gaactttcgcattagtctttaaaat

SEQ ID NO: 510160 - DNA, 25 bp, Homo sapien
aattgacattccagacaagcggtgc

SEQ ID NO: 510161 - DNA, 25 bp, Homo sapien
gacattccagacaagcggtgcctga

SEQ ID NO: 510162 - DNA, 25 bp, Homo sapien
cagacaagcggtgcctgagcccgtg

SEQ ID NO: 510163 - DNA, 25 bp, Homo sapien
tgagcccgtgcctgtcttcagatct

SEQ ID NO: 510164 - DNA, 25 bp, Homo sapien
gtcttcagatcttcacagcacagtt

SEQ ID NO: 510165 - DNA, 25 bp, Homo sapien
ttcagatcttcacagcacagttcct

SEQ ID NO: 510166 - DNA, 25 bp, Homo sapien
atcttcacagcacagttcctgggaa

SEQ ID NO: 510167 - DNA, 25 bp, Homo sapien
ataaatgactggatggtcgctgctt

SEQ ID NO: 510168 - DNA, 25 bp, Homo sapien
tgactggatggtcgctgctttttaa

SEQ ID NO: 510169 - DNA, 25 bp, Homo sapien
ggatggtcgctgctttttaagtttc

SEQ ID NO: 510170 - DNA, 25 bp, Homo sapien
tggtcgctgctttttaagtttcaaa

SEQ ID NO: 510171 - DNA, 25 bp, Homo sapien
cttttacattattgtgttccagaac

SEQ ID NO: 510172 - DNA, 25 bp, Homo sapien
aagtgactgtaggtactgggtatta

SEQ ID NO: 510173 - DNA, 25 bp, Homo sapien
gatggtaaactttgtgttgctcttt

SEQ ID NO: 510174 - DNA, 25 bp, Homo sapien
gtgttgctctttatgaaatgatcca

SEQ ID NO: 510175 - DNA, 25 bp, Homo sapien
gatccatataactgttgggtgcatc

SEQ ID NO: 510176 - DNA, 25 bp, Homo sapien
gttgggtgcatcagtgcttttcaaa

SEQ ID NO: 510177 - DNA, 25 bp, Homo sapien
gggctgcttactatagggttaacta

SEQ ID NO: 510178 - DNA, 25 bp, Homo sapien
gggttaactatgtatattcattgtt

SEQ ID NO: 510179 - DNA, 25 bp, Homo sapien
agagttaacttgtggtttggctgtt

SEQ ID NO: 510180 - DNA, 25 bp, Homo sapien
ggtttggctgtttcctggattttat

SEQ ID NO: 510181 - DNA, 25 bp, Homo sapien
cctggattttataacatacatgtgc

SEQ ID NO: 510182 - DNA, 25 bp, Homo sapien
tgctgctgtggagactgcattgtcg

SEQ ID NO: 510183 - DNA, 25 bp, Homo sapien
tgctgtggagactgcattgtcggct

SEQ ID NO: 510184 - DNA, 25 bp, Homo sapien
tgtggagactgcattgtcggctgcc

SEQ ID NO: 510185 - DNA, 25 bp, Homo sapien
tggagactgcattgtcggctgccac

SEQ ID NO: 510186 - DNA, 25 bp, Homo sapien
agactgcattgtcggctgccacctg

SEQ ID NO: 510187 - DNA, 25 bp, Homo sapien
attgtcggctgccacctggttgtgt

SEQ ID NO: 510188 - DNA, 25 bp, Homo sapien
tcggctgccacctggttgtgtgcta

SEQ ID NO: 510189 - DNA, 25 bp, Homo sapien
ctgccacctggttgtgtgctaccat

SEQ ID NO: 510190 - DNA, 25 bp, Homo sapien
cacctggttgtgtgctaccatccta

SEQ ID NO: 510191 - DNA, 25 bp, Homo sapien
ggttgtgtgctaccatcctacagaa

SEQ ID NO: 510192 - DNA, 25 bp, Homo sapien
tgtgtgctaccatcctacagaaggg

SEQ ID NO: 510193 - DNA, 25 bp, Homo sapien
cctctttctcaatctataacctttg

SEQ ID NO: 510194 - DNA, 25 bp, Homo sapien
ataacctttgtaggcatgcatttat

SEQ ID NO: 510195 - DNA, 25 bp, Homo sapien
tttgtaggcatgcatttataccagc

SEQ ID NO: 510196 - DNA, 25 bp, Homo sapien
tgcatttataccagcatgttttata

SEQ ID NO: 510197 - DNA, 25 bp, Homo sapien
aattatgagtttctatctgtgtcca

SEQ ID NO: 510198 - DNA, 25 bp, Homo sapien
tttctatctgtgtccatgaagtctt

SEQ ID NO: 510199 - DNA, 25 bp, Homo sapien
atctgtgtccatgaagtcttactag

SEQ ID NO: 510200 - DNA, 25 bp, Homo sapien
gtgtccatgaagtcttactagtttt

SEQ ID NO: 510201 - DNA, 25 bp, Homo sapien
tccatgaagtcttactagttttcac

SEQ ID NO: 510202 - DNA, 25 bp, Homo sapien
agtgattcataacttcacgcttgaa

SEQ ID NO: 510203 - DNA, 25 bp, Homo sapien
cataacttcacgcttgaacctggga

SEQ ID NO: 510204 - DNA, 25 bp, Homo sapien
tttgttttcctgttgcatgacagat

SEQ ID NO: 510205 - DNA, 25 bp, Homo sapien
gacagatttaactattctttccagc

SEQ ID NO: 510206 - DNA, 25 bp, Homo sapien
tattctttccagcagtggaggtgct

SEQ ID NO: 510207 - DNA, 25 bp, Homo sapien
gaggtgctgtcagagtccagtgttc

SEQ ID NO: 510208 - DNA, 25 bp, Homo sapien
gctgtcagagtccagtgttctagaa

SEQ ID NO: 510209 - DNA, 25 bp, Homo sapien
gaggcagtgtctaaagcctaatttt

SEQ ID NO: 510210 - DNA, 25 bp, Homo sapien
cttttctaattctggtagctattac

SEQ ID NO: 510211 - DNA, 25 bp, Homo sapien
gtagctattaccaggaatttttgaa

SEQ ID NO: 510212 - DNA, 25 bp, Homo sapien
atttttgtaacctaacagtgaatca

SEQ ID NO: 510213 - DNA, 25 bp, Homo sapien
caagggcttcctgtagttctattca

SEQ ID NO: 510214 - DNA, 25 bp, Homo sapien
gcttcctgtagttctattcaagtgt

SEQ ID NO: 510215 - DNA, 25 bp, Homo sapien
agccagagcgaggacatgctcaccg

SEQ ID NO: 510216 - DNA, 25 bp, Homo sapien
atgctcaccgtgcagtcctacaaca

SEQ ID NO: 510217 - DNA, 25 bp, Homo sapien
ggagaacacgtccaaatcgggtctt

SEQ ID NO: 510218 - DNA, 25 bp, Homo sapien
ttaacttgacttgtgcgctccataa

SEQ ID NO: 510219 - DNA, 25 bp, Homo sapien
aacgacggcatctacatcatgagca

SEQ ID NO: 510220 - DNA, 25 bp, Homo sapien
atgagcagagacgtcaccctgtcga

SEQ ID NO: 510221 - DNA, 25 bp, Homo sapien
tgtcgaccagcttggaacaccgagt

SEQ ID NO: 510222 - DNA, 25 bp, Homo sapien
acaccgagtgttcctcaagtacaac

SEQ ID NO: 510223 - DNA, 25 bp, Homo sapien
tagttgggaagcatttcggcgtttt

SEQ ID NO: 510224 - DNA, 25 bp, Homo sapien
cggcgttttccagcttttggacata

SEQ ID NO: 510225 - DNA, 25 bp, Homo sapien
gacataacttgctggtttcttctct

SEQ ID NO: 510226 - DNA, 25 bp, Homo sapien
ggagacaagtataactgccagggaa

SEQ ID NO: 510227 - DNA, 25 bp, Homo sapien
ggaaagagagaccaaaccagactgc

SEQ ID NO: 510228 - DNA, 25 bp, Homo sapien
gaagcctgggccacagtataacatc

SEQ ID NO: 510229 - DNA, 25 bp, Homo sapien
agtataacatcctgccatggccggc

SEQ ID NO: 510230 - DNA, 25 bp, Homo sapien
gcaaagggcctagggtccaaatact

SEQ ID NO: 510231 - DNA, 25 bp, Homo sapien
gtaccataaaccatttctcagggag

SEQ ID NO: 510232 - DNA, 25 bp, Homo sapien
gaaaggttgacccacatcttagatg

SEQ ID NO: 510233 - DNA, 25 bp, Homo sapien
gaacagttaggtggccttctaccct

SEQ ID NO: 510234 - DNA, 25 bp, Homo sapien
tctcagggagctggaatgcattcat

SEQ ID NO: 510235 - DNA, 25 bp, Homo sapien
ggaatgcattcatacttgacttcaa

SEQ ID NO: 510236 - DNA, 25 bp, Homo sapien
catacttgacttcaacttgctggaa

SEQ ID NO: 510237 - DNA, 25 bp, Homo sapien
gagtctgtgactgagatttctggag

SEQ ID NO: 510238 - DNA, 25 bp, Homo sapien
tttctggagttatataacccctgcg

SEQ ID NO: 510239 - DNA, 25 bp, Homo sapien
tggagttatataacccctgcgccac

SEQ ID NO: 510240 - DNA, 25 bp, Homo sapien
caacttgccagaattcaccccttaa

SEQ ID NO: 510241 - DNA, 25 bp, Homo sapien
agaattcaccccttaacctgcaatg

SEQ ID NO: 510242 - DNA, 25 bp, Homo sapien
accccttaacctgcaatgtgattgt

SEQ ID NO: 510243 - DNA, 25 bp, Homo sapien
tatttggacatagggcaatgaggac

SEQ ID NO: 510244 - DNA, 25 bp, Homo sapien
taggataggatattgcagtctcatc

SEQ ID NO: 510245 - DNA, 25 bp, Homo sapien
gatattgcagtctcatcctgttttc

SEQ ID NO: 510246 - DNA, 25 bp, Homo sapien
tgcagtctcatcctgttttctgctg

SEQ ID NO: 510247 - DNA, 25 bp, Homo sapien
tgtcctgcaccattaaattttatat

SEQ ID NO: 510248 - DNA, 25 bp, Homo sapien
tgaaattgtgccacatgactttttc

SEQ ID NO: 510249 - DNA, 25 bp, Homo sapien
tttcctctaaaaactggatcctagt

SEQ ID NO: 510250 - DNA, 25 bp, Homo sapien
agtgttttaattacctgtgtgcagc

SEQ ID NO: 510251 - DNA, 25 bp, Homo sapien
tttaattacctgtgtgcagctattt

SEQ ID NO: 510252 - DNA, 25 bp, Homo sapien
ttgtcattgtttcatgctatacttt

SEQ ID NO: 510253 - DNA, 25 bp, Homo sapien
gtttcatgctatactttgtgggata

SEQ ID NO: 510254 - DNA, 25 bp, Homo sapien
ctttgtgggataaaacttgggaatg

SEQ ID NO: 510255 - DNA, 25 bp, Homo sapien
tgcttttaaaacgtggacataactc

SEQ ID NO: 510256 - DNA, 25 bp, Homo sapien
taaaacgtggacataactcattttt

SEQ ID NO: 510257 - DNA, 25 bp, Homo sapien
caattgtgtgttttagtgtctagtc

SEQ ID NO: 510258 - DNA, 25 bp, Homo sapien
gcagagagctgtgtgattaataaac

SEQ ID NO: 510259 - DNA, 25 bp, Homo sapien
agtatgcctttagcgcacatgtaaa

SEQ ID NO: 510260 - DNA, 25 bp, Homo sapien
atgtaaatagcctgcacttcctaaa

SEQ ID NO: 510261 - DNA, 25 bp, Homo sapien
gcacttcctaaatctcgtgtggcct

SEQ ID NO: 510262 - DNA, 25 bp, Homo sapien
tgtggcctcccatggttacattctt

SEQ ID NO: 510263 - DNA, 25 bp, Homo sapien
gggaaacacttttagagcacttgag

SEQ ID NO: 510264 - DNA, 25 bp, Homo sapien
tgactggttcagcattttgtgtggt

SEQ ID NO: 510265 - DNA, 25 bp, Homo sapien
gagaaaaataggaccccagacagtt

SEQ ID NO: 510266 - DNA, 25 bp, Homo sapien
taggaccccagacagtttatacctt

SEQ ID NO: 510267 - DNA, 25 bp, Homo sapien
gtttataccttccatttgctgtttt

SEQ ID NO: 510268 - DNA, 25 bp, Homo sapien
aagtgtgagcctgccaagtcaacaa

SEQ ID NO: 510269 - DNA, 25 bp, Homo sapien
gcctgccaagtcaacaagtatgcct

SEQ ID NO: 510270 - DNA, 25 bp, Homo sapien
gtagtattactgtctgaaactggtc

SEQ ID NO: 510271 - DNA, 25 bp, Homo sapien
ttactgtctgaaactggtcagtttt

SEQ ID NO: 510272 - DNA, 25 bp, Homo sapien
aatacctgccaagattaatacccaa

SEQ ID NO: 510273 - DNA, 25 bp, Homo sapien
taatacccaatcaaatgccatgact

SEQ ID NO: 510274 - DNA, 25 bp, Homo sapien
atcaaatgccatgacttggaaataa

SEQ ID NO: 510275 - DNA, 25 bp, Homo sapien
aatcctttcaacttgtgtaaatagg

SEQ ID NO: 510276 - DNA, 25 bp, Homo sapien
ggatataacagaataacaccaatag

SEQ ID NO: 510277 - DNA, 25 bp, Homo sapien
gaataacaccaatagttgttttaag

SEQ ID NO: 510278 - DNA, 25 bp, Homo sapien
gactgaaaaacccaaaatgcccata

SEQ ID NO: 510279 - DNA, 25 bp, Homo sapien
aactctgacagtagtgtgtttctga

SEQ ID NO: 510280 - DNA, 25 bp, Homo sapien
gacagtagtgtgtttctgagaaaaa

SEQ ID NO: 510281 - DNA, 25 bp, Homo sapien
ccttcctcccaatatttcttcattt

SEQ ID NO: 510282 - DNA, 25 bp, Homo sapien
ttcttcatttctatgctcaattttc

SEQ ID NO: 510283 - DNA, 25 bp, Homo sapien
ctatgctcaattttctaatactttt

SEQ ID NO: 510284 - DNA, 25 bp, Homo sapien
ttaatcatttactctttcatcgcct

SEQ ID NO: 510285 - DNA, 25 bp, Homo sapien
tctttcatcgccttccctcaaaaaa

SEQ ID NO: 510286 - DNA, 25 bp, Homo sapien
acctgctccgttgaagtaaactaag

SEQ ID NO: 510287 - DNA, 25 bp, Homo sapien
tattttggtttggaacctgtctcaa

SEQ ID NO: 510288 - DNA, 25 bp, Homo sapien
gtttggaacctgtctcaattttttg

SEQ ID NO: 510289 - DNA, 25 bp, Homo sapien
gggtaacacaaccatgagattagta

SEQ ID NO: 510290 - DNA, 25 bp, Homo sapien
gtaaataatacatatggctagcaca

SEQ ID NO: 510291 - DNA, 25 bp, Homo sapien
ggctagcacataatttgacacctta

SEQ ID NO: 510292 - DNA, 25 bp, Homo sapien
tcgtttcaagggtccttctacattg

SEQ ID NO: 510293 - DNA, 25 bp, Homo sapien
tctacattgttaatactctggtata

SEQ ID NO: 510294 - DNA, 25 bp, Homo sapien
aatactctggtataaatacgttcca

SEQ ID NO: 510295 - DNA, 25 bp, Homo sapien
tactctggtataaatacgttccatt

SEQ ID NO: 510296 - DNA, 25 bp, Homo sapien
gtataaatacgttccattattccct

SEQ ID NO: 510297 - DNA, 25 bp, Homo sapien
taaatacgttccattattccctata

SEQ ID NO: 510298 - DNA, 25 bp, Homo sapien
attattccctataacatgactgaaa

SEQ ID NO: 510299 - DNA, 25 bp, Homo sapien
tattccctataacatgactgaaacc

SEQ ID NO: 510300 - DNA, 25 bp, Homo sapien
tccctataacatgactgaaaccaat

SEQ ID NO: 510301 - DNA, 25 bp, Homo sapien
taacatgactgaaaccaatctaaag

SEQ ID NO: 510302 - DNA, 25 bp, Homo sapien
gactgaaaccaatctaaagtattaa

SEQ ID NO: 510303 - DNA, 25 bp, Homo sapien
gggtaggcagcttgcacccagttct

SEQ ID NO: 510304 - DNA, 25 bp, Homo sapien
ccagttctcctttatctcaacttat

SEQ ID NO: 510305 - DNA, 25 bp, Homo sapien
ctttatctcaacttattttcctggg

SEQ ID NO: 510306 - DNA, 25 bp, Homo sapien
tgcctagagggattgaggtaacttc

SEQ ID NO: 510307 - DNA, 25 bp, Homo sapien
gaggtaacttcaactgggaattcca

SEQ ID NO: 510308 - DNA, 25 bp, Homo sapien
aggtgggcaagtagccttggctctc

SEQ ID NO: 510309 - DNA, 25 bp, Homo sapien
gtccatcaggattgagagtgtgtct

SEQ ID NO: 510310 - DNA, 25 bp, Homo sapien
agagtgtgtctagctcccgaccact

SEQ ID NO: 510311 - DNA, 25 bp, Homo sapien
gaccactttgtcttgacctactgaa

SEQ ID NO: 510312 - DNA, 25 bp, Homo sapien
actttctccagctcaacttgggact

SEQ ID NO: 510313 - DNA, 25 bp, Homo sapien
tctccagctcaacttgggacttggg

SEQ ID NO: 510314 - DNA, 25 bp, Homo sapien
attatccaggccttgtggcatgggc

SEQ ID NO: 510315 - DNA, 25 bp, Homo sapien
ttatccaggccttgtggcatgggcc

SEQ ID NO: 510316 - DNA, 25 bp, Homo sapien
tatccaggccttgtggcatgggcct

SEQ ID NO: 510317 - DNA, 25 bp, Homo sapien
atccaggccttgtggcatgggcctg

SEQ ID NO: 510318 - DNA, 25 bp, Homo sapien
tccaggccttgtggcatgggcctgt

SEQ ID NO: 510319 - DNA, 25 bp, Homo sapien
ggcatgggcctgtgttcccatgact

SEQ ID NO: 510320 - DNA, 25 bp, Homo sapien
gcatgggcctgtgttcccatgactc

SEQ ID NO: 510321 - DNA, 25 bp, Homo sapien
catgggcctgtgttcccatgactca

SEQ ID NO: 510322 - DNA, 25 bp, Homo sapien
atgggcctgtgttcccatgactcag

SEQ ID NO: 510323 - DNA, 25 bp, Homo sapien
tgggcctgtgttcccatgactcagg

SEQ ID NO: 510324 - DNA, 25 bp, Homo sapien
aatttttaactattggccaggcatg

SEQ ID NO: 510325 - DNA, 25 bp, Homo sapien
agaggtattcatctgttacggccct

SEQ ID NO: 510326 - DNA, 25 bp, Homo sapien
ttacggccctcacgataatcaacgg

SEQ ID NO: 510327 - DNA, 25 bp, Homo sapien
aatcaacggctgttcctggaatacg

SEQ ID NO: 510328 - DNA, 25 bp, Homo sapien
cctggaatacggatttgtttctgtc

SEQ ID NO: 510329 - DNA, 25 bp, Homo sapien
ttgtttctgtccataatcctcatgc

SEQ ID NO: 510330 - DNA, 25 bp, Homo sapien
gtccataatcctcatgcttgtgttt

SEQ ID NO: 510331 - DNA, 25 bp, Homo sapien
cctcatgcttgtgtttatgtctcaa

SEQ ID NO: 510332 - DNA, 25 bp, Homo sapien
ctgctgaatcatagcccacatgtcc

SEQ ID NO: 510333 - DNA, 25 bp, Homo sapien
agcagcgtttaatgaagaaactcat

SEQ ID NO: 510334 - DNA, 25 bp, Homo sapien
gaaactcattcttacgaaattagaa

SEQ ID NO: 510335 - DNA, 25 bp, Homo sapien
aattagaacgacttcacgttggaga

SEQ ID NO: 510336 - DNA, 25 bp, Homo sapien
ctttctgatcaaacaggttcaaagt

SEQ ID NO: 510337 - DNA, 25 bp, Homo sapien
gtgtaacagttacgccatacttcat

SEQ ID NO: 510338 - DNA, 25 bp, Homo sapien
acagttacgccatacttcataagtg

SEQ ID NO: 510339 - DNA, 25 bp, Homo sapien
gttacgccatacttcataagtggta

SEQ ID NO: 510340 - DNA, 25 bp, Homo sapien
acgccatacttcataagtggtaaag

SEQ ID NO: 510341 - DNA, 25 bp, Homo sapien
aaatgagaatgtgctgtaattggaa

SEQ ID NO: 510342 - DNA, 25 bp, Homo sapien
ctgtaattggaagtagggagctaaa

SEQ ID NO: 510343 - DNA, 25 bp, Homo sapien
agggagctaaaggatgtttctttca

SEQ ID NO: 510344 - DNA, 25 bp, Homo sapien
gagctaaaggatgtttctttcagtt

SEQ ID NO: 510345 - DNA, 25 bp, Homo sapien
tagtagaactggaacgttttactat

SEQ ID NO: 510346 - DNA, 25 bp, Homo sapien
gaacgttttactattaaacatggct

SEQ ID NO: 510347 - DNA, 25 bp, Homo sapien
gaaaacttgctagcgatggatcatc

SEQ ID NO: 510348 - DNA, 25 bp, Homo sapien
gcgatggatcatcattcccctaaaa

SEQ ID NO: 510349 - DNA, 25 bp, Homo sapien
tcatcattcccctaaaacgcacatt

SEQ ID NO: 510350 - DNA, 25 bp, Homo sapien
accgcacattcccacaatttcagga

SEQ ID NO: 510351 - DNA, 25 bp, Homo sapien
tccaatccaaggttcccaggttcaa

SEQ ID NO: 510352 - DNA, 25 bp, Homo sapien
tcccaggttcaaaacccaaggattg

SEQ ID NO: 510353 - DNA, 25 bp, Homo sapien
ggaactgctaagttttcttacaact

SEQ ID NO: 510354 - DNA, 25 bp, Homo sapien
tttacgtacacccacgctttatagt

SEQ ID NO: 510355 - DNA, 25 bp, Homo sapien
tacacccacgctttatagtttacaa

SEQ ID NO: 510356 - DNA, 25 bp, Homo sapien
tttacaaagcgatttcaaccccaca

SEQ ID NO: 510357 - DNA, 25 bp, Homo sapien
aaccccacacacattgataggcaga

SEQ ID NO: 510358 - DNA, 25 bp, Homo sapien
cttaagctttgatagtggcactgga

SEQ ID NO: 510359 - DNA, 25 bp, Homo sapien
tgatagtggcactggagccacccgt

SEQ ID NO: 510360 - DNA, 25 bp, Homo sapien
tggagccacccgttttaatttatat

SEQ ID NO: 510361 - DNA, 25 bp, Homo sapien
gatgtttaaagccactgtacctgaa

SEQ ID NO: 510362 - DNA, 25 bp, Homo sapien
gccactgtacctgaatcatgctgtt

SEQ ID NO: 510363 - DNA, 25 bp, Homo sapien
gtacctgaatcatgctgttcatcta

SEQ ID NO: 510364 - DNA, 25 bp, Homo sapien
attactataagtagccttcagaaga

SEQ ID NO: 510365 - DNA, 25 bp, Homo sapien
tcttttgtgtccttaagcttgtctc

SEQ ID NO: 510366 - DNA, 25 bp, Homo sapien
gtgtccttaagcttgtctcacaaga

SEQ ID NO: 510367 - DNA, 25 bp, Homo sapien
gtctcacaagaaagatgccaggcct

SEQ ID NO: 510368 - DNA, 25 bp, Homo sapien
gatgccaggcctctaaatgtaataa

SEQ ID NO: 510369 - DNA, 25 bp, Homo sapien
gggtctggaatcttctaagagaaat

SEQ ID NO: 510370 - DNA, 25 bp, Homo sapien
gagaaatagaatcaggcatccaagg

SEQ ID NO: 510371 - DNA, 25 bp, Homo sapien
gccctcaatcctggtctttggaagc

SEQ ID NO: 510372 - DNA, 25 bp, Homo sapien
aatcctggtctttggaagcttccaa

SEQ ID NO: 510373 - DNA, 25 bp, Homo sapien
tttggaagcttccaagcctcttcca

SEQ ID NO: 510374 - DNA, 25 bp, Homo sapien
ccggtgtgacgtgccataaaagtgg

SEQ ID NO: 510375 - DNA, 25 bp, Homo sapien
tgaagcagcactatgcgttcagaga

SEQ ID NO: 510376 - DNA, 25 bp, Homo sapien
tatgcgttcagagagtttttgttca

SEQ ID NO: 510377 - DNA, 25 bp, Homo sapien
gttcaaccatggtgagttcaacctc

SEQ ID NO: 510378 - DNA, 25 bp, Homo sapien
agttcaacctctagcttatgtcaca

SEQ ID NO: 510379 - DNA, 25 bp, Homo sapien
tctagcttatgtcacatgatctcct

SEQ ID NO: 510380 - DNA, 25 bp, Homo sapien
tggaccacagagagtgccatcagct

SEQ ID NO: 510381 - DNA, 25 bp, Homo sapien
ggaagagaagccttttgcctgccca

SEQ ID NO: 510382 - DNA, 25 bp, Homo sapien
gaatggcataaagtatcacgctaag

SEQ ID NO: 510383 - DNA, 25 bp, Homo sapien
gtatcacgctaagaatggtcacaga

SEQ ID NO: 510384 - DNA, 25 bp, Homo sapien
acagaacacagattcgtgtccgcaa

SEQ ID NO: 510385 - DNA, 25 bp, Homo sapien
gtgtccgcaaaccattcaagtgtcg

SEQ ID NO: 510386 - DNA, 25 bp, Homo sapien
aaccattcaagtgtcgctgtgggaa

SEQ ID NO: 510387 - DNA, 25 bp, Homo sapien
caagtgtcgctgtgggaagagttac

SEQ ID NO: 510388 - DNA, 25 bp, Homo sapien
agggcctgcggcaccacacaatcaa

SEQ ID NO: 510389 - DNA, 25 bp, Homo sapien
ccccggtgtcggctgagattatcag

SEQ ID NO: 510390 - DNA, 25 bp, Homo sapien
gagattatcaggaagatgcagcaat

SEQ ID NO: 510391 - DNA, 25 bp, Homo sapien
atttttaggtgatttgtctgtttct

SEQ ID NO: 510392 - DNA, 25 bp, Homo sapien
taggtgatttgtctgtttcttggat

SEQ ID NO: 510393 - DNA, 25 bp, Homo sapien
gtgatttgtctgtttcttggatgaa

SEQ ID NO: 510394 - DNA, 25 bp, Homo sapien
ttgtctgtttcttggatgaaatata

SEQ ID NO: 510395 - DNA, 25 bp, Homo sapien
gctttaatgttctgacttgttcatt

SEQ ID NO: 510396 - DNA, 25 bp, Homo sapien
taatgttctgacttgttcatttgaa

SEQ ID NO: 510397 - DNA, 25 bp, Homo sapien
tgttctgacttgttcatttgaaata

SEQ ID NO: 510398 - DNA, 25 bp, Homo sapien
gaggaaattgtatggacatgccttt

SEQ ID NO: 510399 - DNA, 25 bp, Homo sapien
aattgtatggacatgcctttgtgaa

SEQ ID NO: 510400 - DNA, 25 bp, Homo sapien
tatggacatgcctttgtgaaaccag

SEQ ID NO: 510401 - DNA, 25 bp, Homo sapien
gtgttttaatggagccccattttag

SEQ ID NO: 510402 - DNA, 25 bp, Homo sapien
ttcatgcacacctgacagcgactta

SEQ ID NO: 510403 - DNA, 25 bp, Homo sapien
acctgacagcgacttattatttttt

SEQ ID NO: 510404 - DNA, 25 bp, Homo sapien
taattccccagctttcacagttgat

SEQ ID NO: 510405 - DNA, 25 bp, Homo sapien
ccccagctttcacagttgatggaat

SEQ ID NO: 510406 - DNA, 25 bp, Homo sapien
gagagaaatccagccgtgaggacat

SEQ ID NO: 510407 - DNA, 25 bp, Homo sapien
aaatccagccgtgaggacatggagg

SEQ ID NO: 510408 - DNA, 25 bp, Homo sapien
cagtggtttggctgtgaacggctat

SEQ ID NO: 510409 - DNA, 25 bp, Homo sapien
gctgtgaacggctatggcgatcgca

SEQ ID NO: 510410 - DNA, 25 bp, Homo sapien
tatggcgatcgcaggaccttcacaa

SEQ ID NO: 510411 - DNA, 25 bp, Homo sapien
gcaggaccttcacaaacagtgcatc

SEQ ID NO: 510412 - DNA, 25 bp, Homo sapien
agtgtcttttcttcatgcacacctg

SEQ ID NO: 510413 - DNA, 25 bp, Homo sapien
ctcagccaagagtgaaagattcttc

SEQ ID NO: 510414 - DNA, 25 bp, Homo sapien
gtcccagagcagagaacgagaaagt

SEQ ID NO: 510415 - DNA, 25 bp, Homo sapien
accagaaagtggtctaggtccagat

SEQ ID NO: 510416 - DNA, 25 bp, Homo sapien
agtggtctaggtccagatctcattc

SEQ ID NO: 510417 - DNA, 25 bp, Homo sapien
taggtccagatctcattctaggtcc

SEQ ID NO: 510418 - DNA, 25 bp, Homo sapien
taggtccccctcaagatgtagaaca

SEQ ID NO: 510419 - DNA, 25 bp, Homo sapien
aagtaagagttcatcatttggtaga

SEQ ID NO: 510420 - DNA, 25 bp, Homo sapien
gacagagatagttactctccccggt

SEQ ID NO: 510421 - DNA, 25 bp, Homo sapien
gatagttactctccccggtggaagg

SEQ ID NO: 510422 - DNA, 25 bp, Homo sapien
gcaaatgatggttggagatgtccac

SEQ ID NO: 510423 - DNA, 25 bp, Homo sapien
gatgtccacgaggaaatgatcggta

SEQ ID NO: 510424 - DNA, 25 bp, Homo sapien
tcctcagatctgaagtatggtcttg

SEQ ID NO: 510425 - DNA, 25 bp, Homo sapien
tatggtcttggtcctgaatatacag

SEQ ID NO: 510426 - DNA, 25 bp, Homo sapien
gaatatacagtgttatcctatgttt

SEQ ID NO: 510427 - DNA, 25 bp, Homo sapien
ggtgatccagacatgagacgcaact

SEQ ID NO: 510428 - DNA, 25 bp, Homo sapien
gttggtgcataagaaggccccactt

SEQ ID NO: 510429 - DNA, 25 bp, Homo sapien
gaaggccccacttggctatttcata

SEQ ID NO: 510430 - DNA, 25 bp, Homo sapien
ggctatttcatatctacctacaatt

SEQ ID NO: 510431 - DNA, 25 bp, Homo sapien
tttaggccagcaattattatttagc

SEQ ID NO: 510432 - DNA, 25 bp, Homo sapien
ttagcttcgctctttctagtgcaag

SEQ ID NO: 510433 - DNA, 25 bp, Homo sapien
ctgcaggctggatcagtagttcaac

SEQ ID NO: 510434 - DNA, 25 bp, Homo sapien
gtcattgtgcatgttaaatttcttt

SEQ ID NO: 510435 - DNA, 25 bp, Homo sapien
aaaatgtgcaaataatgccaattat

SEQ ID NO: 510436 - DNA, 25 bp, Homo sapien
tttgaatgtaacaaggaattcacct

SEQ ID NO: 510437 - DNA, 25 bp, Homo sapien
attcacctgaaatcctgataagttt

SEQ ID NO: 510438 - DNA, 25 bp, Homo sapien
tcctgataagttttaaccaaagtca

SEQ ID NO: 510439 - DNA, 25 bp, Homo sapien
atgtttatacaggatctttcagatc

SEQ ID NO: 510440 - DNA, 25 bp, Homo sapien
gatctttcagatcatgtgcaatttt

SEQ ID NO: 510441 - DNA, 25 bp, Homo sapien
gatcatgtgcaatttttatctaacc

SEQ ID NO: 510442 - DNA, 25 bp, Homo sapien
gtgcaatttttatctaaccaatcag

SEQ ID NO: 510443 - DNA, 25 bp, Homo sapien
atctaaccaatcagaaatactagtt

SEQ ID NO: 510444 - DNA, 25 bp, Homo sapien
ttctatatgaatatggatctgccat

SEQ ID NO: 510445 - DNA, 25 bp, Homo sapien
atgaatatggatctgccataagaaa

SEQ ID NO: 510446 - DNA, 25 bp, Homo sapien
gatttttacatctgtcacccgatgc

SEQ ID NO: 510447 - DNA, 25 bp, Homo sapien
tcacccgatgcctatctccagttag

SEQ ID NO: 510448 - DNA, 25 bp, Homo sapien
tctccagttagttttctgcagctga

SEQ ID NO: 510449 - DNA, 25 bp, Homo sapien
ggagcagcagatccttaaaagtaaa

SEQ ID NO: 510450 - DNA, 25 bp, Homo sapien
aagtaaagccacagagcatgcaact

SEQ ID NO: 510451 - DNA, 25 bp, Homo sapien
ttaaatgtttctttgagggctcgca

SEQ ID NO: 510452 - DNA, 25 bp, Homo sapien
agggctcgcatccaaaagaatataa

SEQ ID NO: 510453 - DNA, 25 bp, Homo sapien
agaatataacactccaagcatgaaa

SEQ ID NO: 510454 - DNA, 25 bp, Homo sapien
gaaccagaaatttgtccttgaataa

SEQ ID NO: 510455 - DNA, 25 bp, Homo sapien
cccgtgttgggctggatcttgatag

SEQ ID NO: 510456 - DNA, 25 bp, Homo sapien
ggctggatcttgatagcagttgtta

SEQ ID NO: 510457 - DNA, 25 bp, Homo sapien
ggagacaccattgtctcatccaagt

SEQ ID NO: 510458 - DNA, 25 bp, Homo sapien
gtctcatccaagtccagtgcattag

SEQ ID NO: 510459 - DNA, 25 bp, Homo sapien
aagtccagtgcattagctgcagctc

SEQ ID NO: 510460 - DNA, 25 bp, Homo sapien
gtgcattagctgcagctcgtagagc

SEQ ID NO: 510461 - DNA, 25 bp, Homo sapien
agagacttttattggctggagtgga

SEQ ID NO: 510462 - DNA, 25 bp, Homo sapien
ggagattccagaacctgttttcttc

SEQ ID NO: 510463 - DNA, 25 bp, Homo sapien
ccatcactgtctaagcagccagatt

SEQ ID NO: 510464 - DNA, 25 bp, Homo sapien
aatagttgcaatataccctcaagag

SEQ ID NO: 510465 - DNA, 25 bp, Homo sapien
agttgcaatataccctcaagagatt

SEQ ID NO: 510466 - DNA, 25 bp, Homo sapien
ataccctcaagagatttcttatgtg

SEQ ID NO: 510467 - DNA, 25 bp, Homo sapien
gagatttcttatgtgattgaggtaa

SEQ ID NO: 510468 - DNA, 25 bp, Homo sapien
gttgcatgtgtgaaaactctgaatt

SEQ ID NO: 510469 - DNA, 25 bp, Homo sapien
gtgaaaactctgaatttactttggt

SEQ ID NO: 510470 - DNA, 25 bp, Homo sapien
aatttactttggttgatacatcttc

SEQ ID NO: 510471 - DNA, 25 bp, Homo sapien
aaattgctaacttatctgttcttaa

SEQ ID NO: 510472 - DNA, 25 bp, Homo sapien
ttgctaacttatctgttcttaaaga

SEQ ID NO: 510473 - DNA, 25 bp, Homo sapien
gaatccacctgaaaagtgtcttttt

SEQ ID NO: 510474 - DNA, 25 bp, Homo sapien
tttatttcttctgccaccctgtttt

SEQ ID NO: 510475 - DNA, 25 bp, Homo sapien
tctgccaccctgttttatgaatgct

SEQ ID NO: 510476 - DNA, 25 bp, Homo sapien
tgccaccctgttttatgaatgctgt

SEQ ID NO: 510477 - DNA, 25 bp, Homo sapien
accctgttttatgaatgctgtggac

SEQ ID NO: 510478 - DNA, 25 bp, Homo sapien
ttaagcgaagagaatgcaggtgttg

SEQ ID NO: 510479 - DNA, 25 bp, Homo sapien
ctacaaagaaagcagttgagtgttt

SEQ ID NO: 510480 - DNA, 25 bp, Homo sapien
agcagttgagtgtttatgtaataca

SEQ ID NO: 510481 - DNA, 25 bp, Homo sapien
tgaaagcttgtggaaaacttttctt

SEQ ID NO: 510482 - DNA, 25 bp, Homo sapien
cttggccaggcgcattggttcacgc

SEQ ID NO: 510483 - DNA, 25 bp, Homo sapien
caatgaggcacaactaaatgaaaat

SEQ ID NO: 510484 - DNA, 25 bp, Homo sapien
tgaggcacaactaaatgaaaattat

SEQ ID NO: 510485 - DNA, 25 bp, Homo sapien
ctcattgcatacaacctcaatttca

SEQ ID NO: 510486 - DNA, 25 bp, Homo sapien
tcattgcatacaacctcaatttcaa

SEQ ID NO: 510487 - DNA, 25 bp, Homo sapien
tgcatacaacctcaatttcaaccat

SEQ ID NO: 510488 - DNA, 25 bp, Homo sapien
gcatacaacctcaatttcaaccatt

SEQ ID NO: 510489 - DNA, 25 bp, Homo sapien
catacaacctcaatttcaaccatta

SEQ ID NO: 510490 - DNA, 25 bp, Homo sapien
atccaagtccagtgcattagctgca

SEQ ID NO: 510491 - DNA, 25 bp, Homo sapien
aagtccagtgcattagctgcagctc

SEQ ID NO: 510492 - DNA, 25 bp, Homo sapien
tccagtgcattagctgcagctcgta

SEQ ID NO: 510493 - DNA, 25 bp, Homo sapien
cagtgcattagctgcagctcgtaga

SEQ ID NO: 510494 - DNA, 25 bp, Homo sapien
gtgcattagctgcagctcgtagagc

SEQ ID NO: 510495 - DNA, 25 bp, Homo sapien
aacaatgaagcagagagacttttat

SEQ ID NO: 510496 - DNA, 25 bp, Homo sapien
gtggagattccagaacctgttttct

SEQ ID NO: 510497 - DNA, 25 bp, Homo sapien
gagattccagaacctgttttcttct

SEQ ID NO: 510498 - DNA, 25 bp, Homo sapien
tttcttctgtaccatagaaccccca

SEQ ID NO: 510499 - DNA, 25 bp, Homo sapien
tgtaccatagaacccccatcactgt

SEQ ID NO: 510500 - DNA, 25 bp, Homo sapien
ccatcactgtctaagcagccagatt

SEQ ID NO: 510501 - DNA, 25 bp, Homo sapien
aggcactggtgcatctgctctcttt

SEQ ID NO: 510502 - DNA, 25 bp, Homo sapien
tggtgcatctgctctctttgtccag

SEQ ID NO: 510503 - DNA, 25 bp, Homo sapien
tctttgtccagtcacacttgggatg

SEQ ID NO: 510504 - DNA, 25 bp, Homo sapien
gtccagtcacacttgggatgcttaa

SEQ ID NO: 510505 - DNA, 25 bp, Homo sapien
gggatgcttaattttcctgatatta

SEQ ID NO: 510506 - DNA, 25 bp, Homo sapien
atgcaaatcacttacttttcataga

SEQ ID NO: 510507 - DNA, 25 bp, Homo sapien
gaatttaccattcatcaaatgactt

SEQ ID NO: 510508 - DNA, 25 bp, Homo sapien
aacaatggtctgacattctttcatg

SEQ ID NO: 510509 - DNA, 25 bp, Homo sapien
tctttcatgtcgtactgagatttca

SEQ ID NO: 510510 - DNA, 25 bp, Homo sapien
agttcctctgaatagttggtataac

SEQ ID NO: 510511 - DNA, 25 bp, Homo sapien
tttaccatgatcaaagctagagttc

SEQ ID NO: 510512 - DNA, 25 bp, Homo sapien
tgtcttgactttctcccctgtcatt

SEQ ID NO: 510513 - DNA, 25 bp, Homo sapien
cccaccgtgaattcgttttggatca

SEQ ID NO: 510514 - DNA, 25 bp, Homo sapien
tcgttttggatcactttggacccag

SEQ ID NO: 510515 - DNA, 25 bp, Homo sapien
gacccagcggtgatggtgaacttga

SEQ ID NO: 510516 - DNA, 25 bp, Homo sapien
gaacttgaagtgcttcccattctgc

SEQ ID NO: 510517 - DNA, 25 bp, Homo sapien
ttcccattctgcacgatttccgaca

SEQ ID NO: 510518 - DNA, 25 bp, Homo sapien
ggcagaccgattgccttcatgaagg

SEQ ID NO: 510519 - DNA, 25 bp, Homo sapien
aattctcttgctgattctcttgaag

SEQ ID NO: 510520 - DNA, 25 bp, Homo sapien
gaagacaatgtcacccaatgtgaaa

SEQ ID NO: 510521 - DNA, 25 bp, Homo sapien
tgtcaccagtttattgtcaccttcc

SEQ ID NO: 510522 - DNA, 25 bp, Homo sapien
ttattgtcaccttccaactgaacca

SEQ ID NO: 510523 - DNA, 25 bp, Homo sapien
accgaagattctgtagtttatgact

SEQ ID NO: 510524 - DNA, 25 bp, Homo sapien
ttatgacttaaacaggcccagaatt

SEQ ID NO: 510525 - DNA, 25 bp, Homo sapien
agtttttcaaatcctagtagtgtgt

SEQ ID NO: 510526 - DNA, 25 bp, Homo sapien
atcctagtagtgtgttttttctgtc

SEQ ID NO: 510527 - DNA, 25 bp, Homo sapien
gttttttctgtcttgccaaaaagca

SEQ ID NO: 510528 - DNA, 25 bp, Homo sapien
caaaaagcagcacacctcaaagaag

SEQ ID NO: 510529 - DNA, 25 bp, Homo sapien
tagggttattagtgcttccgaggga

SEQ ID NO: 510530 - DNA, 25 bp, Homo sapien
cttccgagggaagataggcatcact

SEQ ID NO: 510531 - DNA, 25 bp, Homo sapien
ataggcatcactacttcccagagat

SEQ ID NO: 510532 - DNA, 25 bp, Homo sapien
tacttcccagagatgcccctggaaa

SEQ ID NO: 510533 - DNA, 25 bp, Homo sapien
gagatgcccctggaaatgatataga

SEQ ID NO: 510534 - DNA, 25 bp, Homo sapien
tatatttcccattggtttcccctat

SEQ ID NO: 510535 - DNA, 25 bp, Homo sapien
ttttgtcctttctttgtgtgcttga

SEQ ID NO: 510536 - DNA, 25 bp, Homo sapien
atttttcagtttgtcctcataggga

SEQ ID NO: 510537 - DNA, 25 bp, Homo sapien
caagctcaaattatagttggtcaca

SEQ ID NO: 510538 - DNA, 25 bp, Homo sapien
ttttagctaggtgatgtcttgcaag

SEQ ID NO: 510539 - DNA, 25 bp, Homo sapien
gatgtcttgcaagtacgttccactt

SEQ ID NO: 510540 - DNA, 25 bp, Homo sapien
gtacgttccactttgttacaatcta

SEQ ID NO: 510541 - DNA, 25 bp, Homo sapien
gttggtcacaggattctaaagtctt

SEQ ID NO: 510542 - DNA, 25 bp, Homo sapien
gtctttatttgacttctcctttttg

SEQ ID NO: 510543 - DNA, 25 bp, Homo sapien
acttctcctttttgaactggctcaa

SEQ ID NO: 510544 - DNA, 25 bp, Homo sapien
ctggctcaaatggaaaagtgtagtt

SEQ ID NO: 510545 - DNA, 25 bp, Homo sapien
aagtgtgtacctacgtgtcaggccc

SEQ ID NO: 510546 - DNA, 25 bp, Homo sapien
tgcaggcctttgtcttggtgtcacc

SEQ ID NO: 510547 - DNA, 25 bp, Homo sapien
gagctggccccaaccacagtagcaa

SEQ ID NO: 510548 - DNA, 25 bp, Homo sapien
accacagtagcaacagtgatgctga

SEQ ID NO: 510549 - DNA, 25 bp, Homo sapien
tgatgctgatgtgtgactgctgcca

SEQ ID NO: 510550 - DNA, 25 bp, Homo sapien
gagcctgctcacatgaccgtgtgga

SEQ ID NO: 510551 - DNA, 25 bp, Homo sapien
tgaccgtgtggagaaagttctttcc

SEQ ID NO: 510552 - DNA, 25 bp, Homo sapien
tctttccctgaggaccatctggagt

SEQ ID NO: 510553 - DNA, 25 bp, Homo sapien
gaccatctggagtggacgcgtgcac

SEQ ID NO: 510554 - DNA, 25 bp, Homo sapien
tggagtggacgcgtgcactacccct

SEQ ID NO: 510555 - DNA, 25 bp, Homo sapien
ggagcatcctgtagagccagcccct

SEQ ID NO: 510556 - DNA, 25 bp, Homo sapien
attaaacaacaacatttgaaggcct

SEQ ID NO: 510557 - DNA, 25 bp, Homo sapien
acatttgaaggcctacagtgtgtat

SEQ ID NO: 510558 - DNA, 25 bp, Homo sapien
gaaggcctacagtgtgtatagagaa

SEQ ID NO: 510559 - DNA, 25 bp, Homo sapien
cagttttagggaatcaagatattct

SEQ ID NO: 510560 - DNA, 25 bp, Homo sapien
cagggaaagattgttatatttgtct

SEQ ID NO: 510561 - DNA, 25 bp, Homo sapien
gaaattgggatggaatttgctatgc

SEQ ID NO: 510562 - DNA, 25 bp, Homo sapien
ttgctatgcagaattgaggtttgtg

SEQ ID NO: 510563 - DNA, 25 bp, Homo sapien
attgaggtttgtggctttgctgttc

SEQ ID NO: 510564 - DNA, 25 bp, Homo sapien
gtttgtggctttgctgttcctgtag

SEQ ID NO: 510565 - DNA, 25 bp, Homo sapien
tggctttgctgttcctgtagggtgc

SEQ ID NO: 510566 - DNA, 25 bp, Homo sapien
tttgctgttcctgtagggtgcatga

SEQ ID NO: 510567 - DNA, 25 bp, Homo sapien
actaattttagattttcagcttgat

SEQ ID NO: 510568 - DNA, 25 bp, Homo sapien
tcagcttgatggattttcagttttt

SEQ ID NO: 510569 - DNA, 25 bp, Homo sapien
gaagaattttctttaccattagtct

SEQ ID NO: 510570 - DNA, 25 bp, Homo sapien
ttaccattagtcttcaaattggata

SEQ ID NO: 510571 - DNA, 25 bp, Homo sapien
ggatactgttgtgcagtggtgtact

SEQ ID NO: 510572 - DNA, 25 bp, Homo sapien
gtggtgtactgttatacttcagaga

SEQ ID NO: 510573 - DNA, 25 bp, Homo sapien
gagtacatctagttcagttcctatg

SEQ ID NO: 510574 - DNA, 25 bp, Homo sapien
gttcctatgaggtagctgtaaccct

SEQ ID NO: 510575 - DNA, 25 bp, Homo sapien
gaggtagctgtaacccttaaaaatg

SEQ ID NO: 510576 - DNA, 25 bp, Homo sapien
aattacttattctgatgatgcactt

SEQ ID NO: 510577 - DNA, 25 bp, Homo sapien
tattctgatgatgcacttttatgta

SEQ ID NO: 510578 - DNA, 25 bp, Homo sapien
atcccctgaaagttggacaccaact

SEQ ID NO: 510579 - DNA, 25 bp, Homo sapien
cctgaaagttggacaccaactgtat

SEQ ID NO: 510580 - DNA, 25 bp, Homo sapien
accaactgtataccctaggttgctt

SEQ ID NO: 510581 - DNA, 25 bp, Homo sapien
caactgtataccctaggttgcttaa

SEQ ID NO: 510582 - DNA, 25 bp, Homo sapien
ctgtataccctaggttgcttaaagg

SEQ ID NO: 510583 - DNA, 25 bp, Homo sapien
aggttgcttaaagggatttcactat

SEQ ID NO: 510584 - DNA, 25 bp, Homo sapien
gttgcttaaagggatttcactatta

SEQ ID NO: 510585 - DNA, 25 bp, Homo sapien
gcttaaagggatttcactattatat

SEQ ID NO: 510586 - DNA, 25 bp, Homo sapien
gggatttcactattatataaagtca

SEQ ID NO: 510587 - DNA, 25 bp, Homo sapien
atgaagtagttgtatatatgcaaca

SEQ ID NO: 510588 - DNA, 25 bp, Homo sapien
aattcataattctaattttcacatt

SEQ ID NO: 510589 - DNA, 25 bp, Homo sapien
ggactttaggtgtcacttaatctct

SEQ ID NO: 510590 - DNA, 25 bp, Homo sapien
gcaaaagccccatctttgaattcag

SEQ ID NO: 510591 - DNA, 25 bp, Homo sapien
taactacacctatctgcataggagg

SEQ ID NO: 510592 - DNA, 25 bp, Homo sapien
aagccccatctttgaattcagaatg

SEQ ID NO: 510593 - DNA, 25 bp, Homo sapien
tgcataggaggctccccacatcagt

SEQ ID NO: 510594 - DNA, 25 bp, Homo sapien
catcagtccaggcaacttttttctt

SEQ ID NO: 510595 - DNA, 25 bp, Homo sapien
gggccatttcttctaaatggaagga

SEQ ID NO: 510596 - DNA, 25 bp, Homo sapien
atggaaggagaaaagtctgagcatt

SEQ ID NO: 510597 - DNA, 25 bp, Homo sapien
ctgagcattagaaattgtggcatta

SEQ ID NO: 510598 - DNA, 25 bp, Homo sapien
tggcattaatgtctgcaagggctaa

SEQ ID NO: 510599 - DNA, 25 bp, Homo sapien
aattcagaatgctgaccccagggcc

SEQ ID NO: 510600 - DNA, 25 bp, Homo sapien
tataaagagctctgttgaatgtcat

SEQ ID NO: 510601 - DNA, 25 bp, Homo sapien
aacctgcatatgttgtttactagca

SEQ ID NO: 510602 - DNA, 25 bp, Homo sapien
atatgttgtttactagcagatgaca

SEQ ID NO: 510603 - DNA, 25 bp, Homo sapien
ggaatctgaagaacacgtaaaactt

SEQ ID NO: 510604 - DNA, 25 bp, Homo sapien
ttttggtagattaactagcaggcct

SEQ ID NO: 510605 - DNA, 25 bp, Homo sapien
gattaactagcaggcctattttaaa

SEQ ID NO: 510606 - DNA, 25 bp, Homo sapien
aaaggtaattcagctaaagggcaat

SEQ ID NO: 510607 - DNA, 25 bp, Homo sapien
aattcagctaaagggcaatttactt

SEQ ID NO: 510608 - DNA, 25 bp, Homo sapien
tacttttttgtacttcagactatct

SEQ ID NO: 510609 - DNA, 25 bp, Homo sapien
gtacttcagactatcttgattgtca

SEQ ID NO: 510610 - DNA, 25 bp, Homo sapien
gattgtcaaagtgtacgaactgtaa

SEQ ID NO: 510611 - DNA, 25 bp, Homo sapien
ccccttaggctatgcattaatcgaa

SEQ ID NO: 510612 - DNA, 25 bp, Homo sapien
ggctatgcattaatcgaagctttct

SEQ ID NO: 510613 - DNA, 25 bp, Homo sapien
gaagctttcttttcaccatgacttt

SEQ ID NO: 510614 - DNA, 25 bp, Homo sapien
ttcaccatgactttataatgtctag

SEQ ID NO: 510615 - DNA, 25 bp, Homo sapien
aaacaatatttctacttcccacatc

SEQ ID NO: 510616 - DNA, 25 bp, Homo sapien
ttcccacatctttgctttacacagt

SEQ ID NO: 510617 - DNA, 25 bp, Homo sapien
cacatctttgctttacacagtcacc

SEQ ID NO: 510618 - DNA, 25 bp, Homo sapien
aaagatggtcatactaacaggtgaa

SEQ ID NO: 510619 - DNA, 25 bp, Homo sapien
gtacaaggtgtctgtgtgttttgtg

SEQ ID NO: 510620 - DNA, 25 bp, Homo sapien
gtgtgttttgtgtagcttcagagtt

SEQ ID NO: 510621 - DNA, 25 bp, Homo sapien
aaattaccaggcacagatttagtct

SEQ ID NO: 510622 - DNA, 25 bp, Homo sapien
tagtgacacactgtattaagatagt

SEQ ID NO: 510623 - DNA, 25 bp, Homo sapien
gatagtgactgctatactcaactct

SEQ ID NO: 510624 - DNA, 25 bp, Homo sapien
atgagtggcaaaaccacagcccttg

SEQ ID NO: 510625 - DNA, 25 bp, Homo sapien
aaaaccacagcccttgggccatatg

SEQ ID NO: 510626 - DNA, 25 bp, Homo sapien
cttgggccatatgctgctattcagt

SEQ ID NO: 510627 - DNA, 25 bp, Homo sapien
atatgctgctattcagtcccagatg

SEQ ID NO: 510628 - DNA, 25 bp, Homo sapien
tattcagtcccagatgtagcccctg

SEQ ID NO: 510629 - DNA, 25 bp, Homo sapien
gatgtagcccctgaagcaagcataa

SEQ ID NO: 510630 - DNA, 25 bp, Homo sapien
gtatgactaaaccatgtctttggca

SEQ ID NO: 510631 - DNA, 25 bp, Homo sapien
gtctttggcaaagatctaacacaat

SEQ ID NO: 510632 - DNA, 25 bp, Homo sapien
aataggtagtctctgtttgtaaaat

SEQ ID NO: 510633 - DNA, 25 bp, Homo sapien
aaccattaagcgcaggaaaacagta

SEQ ID NO: 510634 - DNA, 25 bp, Homo sapien
agtgactgaagcattggtatgataa

SEQ ID NO: 510635 - DNA, 25 bp, Homo sapien
ggtatgataatttctaacacttgta

SEQ ID NO: 510636 - DNA, 25 bp, Homo sapien
acttgtagaaggtccatgactgtaa

SEQ ID NO: 510637 - DNA, 25 bp, Homo sapien
aaggtccatgactgtaattttacca

SEQ ID NO: 510638 - DNA, 25 bp, Homo sapien
agcatttaactgttttggattccaa

SEQ ID NO: 510639 - DNA, 25 bp, Homo sapien
ggattccaaactagcagcactacaa

SEQ ID NO: 510640 - DNA, 25 bp, Homo sapien
agcagcactacaatgctttgctaga

SEQ ID NO: 510641 - DNA, 25 bp, Homo sapien
acaatgctttgctagagctggtaaa

SEQ ID NO: 510642 - DNA, 25 bp, Homo sapien
tttgctagagctggtaaaatggaac

SEQ ID NO: 510643 - DNA, 25 bp, Homo sapien
agacgtacattgatcattccttaat

SEQ ID NO: 510644 - DNA, 25 bp, Homo sapien
ggtgctcaaatattaatttcctcct

SEQ ID NO: 510645 - DNA, 25 bp, Homo sapien
ttgccttccttatctaccctgtgtc

SEQ ID NO: 510646 - DNA, 25 bp, Homo sapien
tgtgtcctccatttccccgtatgat

SEQ ID NO: 510647 - DNA, 25 bp, Homo sapien
tttccccgtatgattccaacccaat

SEQ ID NO: 510648 - DNA, 25 bp, Homo sapien
gattccaacccaatatagcaaatga

SEQ ID NO: 510649 - DNA, 25 bp, Homo sapien
gaaaacatctattgggtaaaatcag

SEQ ID NO: 510650 - DNA, 25 bp, Homo sapien
ttatataagcttttggtagacagaa

SEQ ID NO: 510651 - DNA, 25 bp, Homo sapien
gaaagctggaataatactacgtaac

SEQ ID NO: 510652 - DNA, 25 bp, Homo sapien
taatactacgtaactttgtccaggt

SEQ ID NO: 510653 - DNA, 25 bp, Homo sapien
actttgtccaggttactttgactga

SEQ ID NO: 510654 - DNA, 25 bp, Homo sapien
ttactttgactgaaacacgtttttg

SEQ ID NO: 510655 - DNA, 25 bp, Homo sapien
gagcctgctctcagaaggacaatga

SEQ ID NO: 510656 - DNA, 25 bp, Homo sapien
gaaggacaatgattcagcatgtgat

SEQ ID NO: 510657 - DNA, 25 bp, Homo sapien
tcgctcccaattcctagtcgtgact

SEQ ID NO: 510658 - DNA, 25 bp, Homo sapien
cccaattcctagtcgtgacttcatt

SEQ ID NO: 510659 - DNA, 25 bp, Homo sapien
ttcatttctaaaacagagcctgacc

SEQ ID NO: 510660 - DNA, 25 bp, Homo sapien
tgaccaaccttccatgtatctccat

SEQ ID NO: 510661 - DNA, 25 bp, Homo sapien
aggactgagggagtgccccgagacc

SEQ ID NO: 510662 - DNA, 25 bp, Homo sapien
gggcttctgggccaagagtactttt

SEQ ID NO: 510663 - DNA, 25 bp, Homo sapien
cttctgggccaagagtactttttat

SEQ ID NO: 510664 - DNA, 25 bp, Homo sapien
gctcaaggaatagacagtgttctgt

SEQ ID NO: 510665 - DNA, 25 bp, Homo sapien
ttggtttgaaggagttacccaccat

SEQ ID NO: 510666 - DNA, 25 bp, Homo sapien
gtgctgggcactttccgggagtcct

SEQ ID NO: 510667 - DNA, 25 bp, Homo sapien
agaagccctatcgtgccagttgtga

SEQ ID NO: 510668 - DNA, 25 bp, Homo sapien
ccgggagtcctgtgttgggtcaatc

SEQ ID NO: 510669 - DNA, 25 bp, Homo sapien
gttgggtcaatcctggcatgacacc

SEQ ID NO: 510670 - DNA, 25 bp, Homo sapien
ggcggcagtgctaacacgaaagctt

SEQ ID NO: 510671 - DNA, 25 bp, Homo sapien
aagcttacgcgttttacaaggcgct

SEQ ID NO: 510672 - DNA, 25 bp, Homo sapien
acaaggcgcttttttgcacacatct

SEQ ID NO: 510673 - DNA, 25 bp, Homo sapien
atcctttctgaggttggtgccagtc

SEQ ID NO: 510674 - DNA, 25 bp, Homo sapien
cagtcccgctttacaaacatgcagg

SEQ ID NO: 510675 - DNA, 25 bp, Homo sapien
gttccccgcaggacacgtgctgaag

SEQ ID NO: 510676 - DNA, 25 bp, Homo sapien
gctgaaggaatccaccactgcaggt

SEQ ID NO: 510677 - DNA, 25 bp, Homo sapien
aggagggcgaaagcccagcccaatc

SEQ ID NO: 510678 - DNA, 25 bp, Homo sapien
gaagctgctcatcaatttgtagcct

SEQ ID NO: 510679 - DNA, 25 bp, Homo sapien
tttgtagcctctccaagcgaagctg

SEQ ID NO: 510680 - DNA, 25 bp, Homo sapien
gagaggtgatactccagcaaagcct

SEQ ID NO: 510681 - DNA, 25 bp, Homo sapien
aaagcctgggcattgctgatgttct

SEQ ID NO: 510682 - DNA, 25 bp, Homo sapien
attgctgatgttctctcgggtgcca

SEQ ID NO: 510683 - DNA, 25 bp, Homo sapien
gttctctcgggtgccaacaaaaatg

SEQ ID NO: 510684 - DNA, 25 bp, Homo sapien
atggaaggattaacgccgcccagtc

SEQ ID NO: 510685 - DNA, 25 bp, Homo sapien
ggagcctgcccagtgggatcattct

SEQ ID NO: 510686 - DNA, 25 bp, Homo sapien
agtgggatcattctgggctctaaat

SEQ ID NO: 510687 - DNA, 25 bp, Homo sapien
ctgggctctaaatctactagtgtta

SEQ ID NO: 510688 - DNA, 25 bp, Homo sapien
acatgtttaacaggccaggtcgtag

SEQ ID NO: 510689 - DNA, 25 bp, Homo sapien
caggccaggtcgtagagattatttt

SEQ ID NO: 510690 - DNA, 25 bp, Homo sapien
gtgctgctttcagaacagagggctg

SEQ ID NO: 510691 - DNA, 25 bp, Homo sapien
aacagagggctggattggatagatt

SEQ ID NO: 510692 - DNA, 25 bp, Homo sapien
tctatcctggagattcatttcttgc

SEQ ID NO: 510693 - DNA, 25 bp, Homo sapien
tcatttcttgcattaagagcttatt

SEQ ID NO: 510694 - DNA, 25 bp, Homo sapien
tatttataatccctgactatgtcaa

SEQ ID NO: 510695 - DNA, 25 bp, Homo sapien
gaagttcttacctacatatcagagg

SEQ ID NO: 510696 - DNA, 25 bp, Homo sapien
gtcctccactgaatagcccattaca

SEQ ID NO: 510697 - DNA, 25 bp, Homo sapien
agcccattacagctagcacctaata

SEQ ID NO: 510698 - DNA, 25 bp, Homo sapien
acagctagcacctaatagttactca

SEQ ID NO: 510699 - DNA, 25 bp, Homo sapien
gccttaccaatatggtgaagcccca

SEQ ID NO: 510700 - DNA, 25 bp, Homo sapien
ccttaccaatatggtgaagccccat

SEQ ID NO: 510701 - DNA, 25 bp, Homo sapien
cttaccaatatggtgaagccccatc

SEQ ID NO: 510702 - DNA, 25 bp, Homo sapien
aaaaattagccctgcatggtggcag

SEQ ID NO: 510703 - DNA, 25 bp, Homo sapien
aaaattagccctgcatggtggcagg

SEQ ID NO: 510704 - DNA, 25 bp, Homo sapien
aaattagccctgcatggtggcaggt

SEQ ID NO: 510705 - DNA, 25 bp, Homo sapien
aaagttgccgggggtggtggctcat

SEQ ID NO: 510706 - DNA, 25 bp, Homo sapien
aagttgccgggggtggtggctcatg

SEQ ID NO: 510707 - DNA, 25 bp, Homo sapien
agttgccgggggtggtggctcatgc

SEQ ID NO: 510708 - DNA, 25 bp, Homo sapien
gttgccgggggtggtggctcatgcc

SEQ ID NO: 510709 - DNA, 25 bp, Homo sapien
cttgggcaatagcaagactccatct

SEQ ID NO: 510710 - DNA, 25 bp, Homo sapien
gtgcacttccctaaggtcctccagt

SEQ ID NO: 510711 - DNA, 25 bp, Homo sapien
aggtcctccagtgcttgaatatcag

SEQ ID NO: 510712 - DNA, 25 bp, Homo sapien
gaatatcagcgtgctaagtcagaaa

SEQ ID NO: 510713 - DNA, 25 bp, Homo sapien
gtgcgaggatgcttacccgagacag

SEQ ID NO: 510714 - DNA, 25 bp, Homo sapien
acccgagacagatagatgacaccat

SEQ ID NO: 510715 - DNA, 25 bp, Homo sapien
gttctgcgccggtgacaaagcaggt

SEQ ID NO: 510716 - DNA, 25 bp, Homo sapien
caaagcaggtagagactcctgccag

SEQ ID NO: 510717 - DNA, 25 bp, Homo sapien
ggagattacccttgtgcccggccca

SEQ ID NO: 510718 - DNA, 25 bp, Homo sapien
ccaacagaccgggtgtctacacgaa

SEQ ID NO: 510719 - DNA, 25 bp, Homo sapien
gggtgtctacacgaacctctgcaag

SEQ ID NO: 510720 - DNA, 25 bp, Homo sapien
cacgaacctctgcaagttcaccaag

SEQ ID NO: 510721 - DNA, 25 bp, Homo sapien
ggtctgcaatataacttaaaattcc

SEQ ID NO: 510722 - DNA, 25 bp, Homo sapien
acttaaaattcctgtacatactgca

SEQ ID NO: 510723 - DNA, 25 bp, Homo sapien
ctgtacatactgcaaatatttcttt

SEQ ID NO: 510724 - DNA, 25 bp, Homo sapien
tgcacaggaaaatgagcgaactttt

SEQ ID NO: 510725 - DNA, 25 bp, Homo sapien
gaaaatgagcgaactttttatttct

SEQ ID NO: 510726 - DNA, 25 bp, Homo sapien
taaccctgagggatcatcaaagata

SEQ ID NO: 510727 - DNA, 25 bp, Homo sapien
caaagatactatcctgattcctggt

SEQ ID NO: 510728 - DNA, 25 bp, Homo sapien
agatactatcctgattcctggtaag

SEQ ID NO: 510729 - DNA, 25 bp, Homo sapien
tactatcctgattcctggtaaggaa

SEQ ID NO: 510730 - DNA, 25 bp, Homo sapien
attatttccttataacaaggcaagg

SEQ ID NO: 510731 - DNA, 25 bp, Homo sapien
taacaaggcaaggagaaatgctatt

SEQ ID NO: 510732 - DNA, 25 bp, Homo sapien
tgaaagttatcaattgcttttgttt

SEQ ID NO: 510733 - DNA, 25 bp, Homo sapien
agtatgtcaagttcttactagtttc

SEQ ID NO: 510734 - DNA, 25 bp, Homo sapien
ttcttactagtttcctgtactgaag

SEQ ID NO: 510735 - DNA, 25 bp, Homo sapien
actagtttcctgtactgaaggttca

SEQ ID NO: 510736 - DNA, 25 bp, Homo sapien
gtttcctgtactgaaggttcaattt

SEQ ID NO: 510737 - DNA, 25 bp, Homo sapien
tcctgtactgaaggttcaatttttt

SEQ ID NO: 510738 - DNA, 25 bp, Homo sapien
ataagtttacttttcacctgctcta

SEQ ID NO: 510739 - DNA, 25 bp, Homo sapien
aagtttacttttcacctgctctatt

SEQ ID NO: 510740 - DNA, 25 bp, Homo sapien
agtttacttttcacctgctctattc

SEQ ID NO: 510741 - DNA, 25 bp, Homo sapien
tgaaagttagtaacgtccattattt

SEQ ID NO: 510742 - DNA, 25 bp, Homo sapien
tagtaacgtccattatttaataaag

SEQ ID NO: 510743 - DNA, 25 bp, Homo sapien
aggaaaaataatgagtaccaggctt

SEQ ID NO: 510744 - DNA, 25 bp, Homo sapien
taccaggcttaatacatgggcgatg

SEQ ID NO: 510745 - DNA, 25 bp, Homo sapien
ataatctgtatgacaagcctctctg

SEQ ID NO: 510746 - DNA, 25 bp, Homo sapien
atctgtatgacaagcctctctgaca

SEQ ID NO: 510747 - DNA, 25 bp, Homo sapien
atgacaagcctctctgacacagttt

SEQ ID NO: 510748 - DNA, 25 bp, Homo sapien
aagcctctctgacacagtttaccta

SEQ ID NO: 510749 - DNA, 25 bp, Homo sapien
tctctgacacagtttacctatgtaa

SEQ ID NO: 510750 - DNA, 25 bp, Homo sapien
tatgttctatcaaaacctgcctctc

SEQ ID NO: 510751 - DNA, 25 bp, Homo sapien
tcaaaacctgcctctcatttatgta

SEQ ID NO: 510752 - DNA, 25 bp, Homo sapien
gtattaggaatcttgtgacaacgga

SEQ ID NO: 510753 - DNA, 25 bp, Homo sapien
ggaatcttgtgacaacggaacagtt

SEQ ID NO: 510754 - DNA, 25 bp, Homo sapien
attaggcaaacaccactccttgctt

SEQ ID NO: 510755 - DNA, 25 bp, Homo sapien
cttccttcatgtgacctatcactga

SEQ ID NO: 510756 - DNA, 25 bp, Homo sapien
gatctgaggaccctgtactggttac

SEQ ID NO: 510757 - DNA, 25 bp, Homo sapien
tatcactgagctcaccagctgaggt

SEQ ID NO: 510758 - DNA, 25 bp, Homo sapien
gctgaggtcaattacattcttccca

SEQ ID NO: 510759 - DNA, 25 bp, Homo sapien
acattcttcccaacctggagaacag

SEQ ID NO: 510760 - DNA, 25 bp, Homo sapien
atttgggtctgctcagaggcatgat

SEQ ID NO: 510761 - DNA, 25 bp, Homo sapien
gtctgggataaaagctttgttctat

SEQ ID NO: 510762 - DNA, 25 bp, Homo sapien
gttctattgacagcaaacctttttg

SEQ ID NO: 510763 - DNA, 25 bp, Homo sapien
tggttactcctgtacacgttcacaa

SEQ ID NO: 510764 - DNA, 25 bp, Homo sapien
tactgagcagtccaggagcagccat

SEQ ID NO: 510765 - DNA, 25 bp, Homo sapien
ttagcttatgggtcaaggttcagtt

SEQ ID NO: 510766 - DNA, 25 bp, Homo sapien
aaaatatggctatctaattgttcta

SEQ ID NO: 510767 - DNA, 25 bp, Homo sapien
attgcattgcttttgcacttctgtc

SEQ ID NO: 510768 - DNA, 25 bp, Homo sapien
ttgggtctaattctgggctgcctat

SEQ ID NO: 510769 - DNA, 25 bp, Homo sapien
ctaattctgggctgcctattctgtt

SEQ ID NO: 510770 - DNA, 25 bp, Homo sapien
tctgttccattgttatccattcaca

SEQ ID NO: 510771 - DNA, 25 bp, Homo sapien
atccattcacaaataccacactttc

SEQ ID NO: 510772 - DNA, 25 bp, Homo sapien
aataccacactttcctaatcatagg

SEQ ID NO: 510773 - DNA, 25 bp, Homo sapien
gatagtgtgtacaacttcgtccgtc

SEQ ID NO: 510774 - DNA, 25 bp, Homo sapien
gtacaacttcgtccgtctcaaaaat

SEQ ID NO: 510775 - DNA, 25 bp, Homo sapien
gtctcaaaaatcgtgttgattacta

SEQ ID NO: 510776 - DNA, 25 bp, Homo sapien
ttgactctctgacctgtgggatgca

SEQ ID NO: 510777 - DNA, 25 bp, Homo sapien
ttcctcagcgctttttccttgttgt

SEQ ID NO: 510778 - DNA, 25 bp, Homo sapien
tttttccttgttgtggtgacgtaca

SEQ ID NO: 510779 - DNA, 25 bp, Homo sapien
ggtgacgtacattcactatctgaga

SEQ ID NO: 510780 - DNA, 25 bp, Homo sapien
agagtgaaagaccacacacacccct

SEQ ID NO: 510781 - DNA, 25 bp, Homo sapien
tttaaaattattgtatctcttcctt

SEQ ID NO: 510782 - DNA, 25 bp, Homo sapien
aaagatagtgtcaccttgttccgtg

SEQ ID NO: 510783 - DNA, 25 bp, Homo sapien
gtgtcaccttgttccgtgaaaaaga

SEQ ID NO: 510784 - DNA, 25 bp, Homo sapien
tgatagcttatgatgtgtgtcaatc

SEQ ID NO: 510785 - DNA, 25 bp, Homo sapien
gtgtgtcaatcagttctctgaatct

SEQ ID NO: 510786 - DNA, 25 bp, Homo sapien
tctctgaatcttttactgaaactga

SEQ ID NO: 510787 - DNA, 25 bp, Homo sapien
acctggtgactttgtggtgcactca

SEQ ID NO: 510788 - DNA, 25 bp, Homo sapien
ggtgcactcacctctgatagtgact

SEQ ID NO: 510789 - DNA, 25 bp, Homo sapien
gatagtgacttgaattcggtatgta

SEQ ID NO: 510790 - DNA, 25 bp, Homo sapien
gctgctaaaaatgacaactccctct

SEQ ID NO: 510791 - DNA, 25 bp, Homo sapien
tttttcttaaagctgtcagtgtaca

SEQ ID NO: 510792 - DNA, 25 bp, Homo sapien
gctgtcagtgtacaagtgggtattt

SEQ ID NO: 510793 - DNA, 25 bp, Homo sapien
tttgaataccagaccttactgtaaa

SEQ ID NO: 510794 - DNA, 25 bp, Homo sapien
aaaggtggtatctagagcatgtaaa

SEQ ID NO: 510795 - DNA, 25 bp, Homo sapien
aattggatataaagttctgctctta

SEQ ID NO: 510796 - DNA, 25 bp, Homo sapien
gatctaagagtatggctaaacatct

SEQ ID NO: 510797 - DNA, 25 bp, Homo sapien
ggctaaacatctatatatgcaatct

SEQ ID NO: 510798 - DNA, 25 bp, Homo sapien
gaggaaacctctacagatgctgcac

SEQ ID NO: 510799 - DNA, 25 bp, Homo sapien
aacctctacagatgctgcactgtgt

SEQ ID NO: 510800 - DNA, 25 bp, Homo sapien
ctgcactgtgtggtatggaaggcac

SEQ ID NO: 510801 - DNA, 25 bp, Homo sapien
tatggaaggcactggccacgcgtga

SEQ ID NO: 510802 - DNA, 25 bp, Homo sapien
ggccacgcgtgactactgagtatgt

SEQ ID NO: 510803 - DNA, 25 bp, Homo sapien
gagtatgtgaaatgcatctggtcca

SEQ ID NO: 510804 - DNA, 25 bp, Homo sapien
aatgcatctggtccacactgagaag

SEQ ID NO: 510805 - DNA, 25 bp, Homo sapien
cactgagaagtgttccaagtacaaa

SEQ ID NO: 510806 - DNA, 25 bp, Homo sapien
cacacatcagattttaaagacgtag

SEQ ID NO: 510807 - DNA, 25 bp, Homo sapien
attaaggtccctacttcaaggagca

SEQ ID NO: 510808 - DNA, 25 bp, Homo sapien
tacttcaaggagcagattcttcagg

SEQ ID NO: 510809 - DNA, 25 bp, Homo sapien
tacgaatacgaggtccgaatgcgga

SEQ ID NO: 510810 - DNA, 25 bp, Homo sapien
tgcggaccaactgataccattttct

SEQ ID NO: 510811 - DNA, 25 bp, Homo sapien
gataccattttctgttgctcagcgc

SEQ ID NO: 510812 - DNA, 25 bp, Homo sapien
agcgccctctaagctttggtgtttc

SEQ ID NO: 510813 - DNA, 25 bp, Homo sapien
gacagtgttcatcacaggctagaga

SEQ ID NO: 510814 - DNA, 25 bp, Homo sapien
gcactgtagtttgtcagagactcca

SEQ ID NO: 510815 - DNA, 25 bp, Homo sapien
gagactccagtttacatccagaaag

SEQ ID NO: 510816 - DNA, 25 bp, Homo sapien
cataggacacgcttctgtctgtaga

SEQ ID NO: 510817 - DNA, 25 bp, Homo sapien
gaggcttcatatgagacccagaaag

SEQ ID NO: 510818 - DNA, 25 bp, Homo sapien
tctatcctatggcaagtctgacctc

SEQ ID NO: 510819 - DNA, 25 bp, Homo sapien
tcctggcaatgctcagttctgattt

SEQ ID NO: 510820 - DNA, 25 bp, Homo sapien
aagttggagcattctggttaattga

SEQ ID NO: 510821 - DNA, 25 bp, Homo sapien
ttgagattttgctctgtattgacac

SEQ ID NO: 510822 - DNA, 25 bp, Homo sapien
tgtattgacacagctcgcaccagtt

SEQ ID NO: 510823 - DNA, 25 bp, Homo sapien
acagctcgcaccagtttggttcagg

SEQ ID NO: 510824 - DNA, 25 bp, Homo sapien
accagtttggttcaggagctacctc

SEQ ID NO: 510825 - DNA, 25 bp, Homo sapien
agctacctccttgtcattgaattga

SEQ ID NO: 510826 - DNA, 25 bp, Homo sapien
gttacaatgtttggtattcggatac

SEQ ID NO: 510827 - DNA, 25 bp, Homo sapien
ggtattcggatacattcagcaagaa

SEQ ID NO: 510828 - DNA, 25 bp, Homo sapien
ggatacattcagcaagaacacttga

SEQ ID NO: 510829 - DNA, 25 bp, Homo sapien
agaacacttgaaaactcctcaccaa

SEQ ID NO: 510830 - DNA, 25 bp, Homo sapien
tgaaaactcctcaccaactattttt

SEQ ID NO: 510831 - DNA, 25 bp, Homo sapien
aaattcaccctacattcctctcctc

SEQ ID NO: 510832 - DNA, 25 bp, Homo sapien
aattcaccctacattcctctcctct

SEQ ID NO: 510833 - DNA, 25 bp, Homo sapien
attcaccctacattcctctcctctt

SEQ ID NO: 510834 - DNA, 25 bp, Homo sapien
ttcaccctacattcctctcctcttc

SEQ ID NO: 510835 - DNA, 25 bp, Homo sapien
tcaccctacattcctctcctcttca

SEQ ID NO: 510836 - DNA, 25 bp, Homo sapien
tctcctcttcactagcctctctgaa

SEQ ID NO: 510837 - DNA, 25 bp, Homo sapien
ctcctcttcactagcctctctgaag

SEQ ID NO: 510838 - DNA, 25 bp, Homo sapien
tggagaagcactggtgtctgcagca

SEQ ID NO: 510839 - DNA, 25 bp, Homo sapien
ggagaagcactggtgtctgcagcac

SEQ ID NO: 510840 - DNA, 25 bp, Homo sapien
gagaagcactggtgtctgcagcacc

SEQ ID NO: 510841 - DNA, 25 bp, Homo sapien
aaccactattgataccactacaaaa

SEQ ID NO: 510842 - DNA, 25 bp, Homo sapien
aaacaagccagcaaaaagatactgt

SEQ ID NO: 510843 - DNA, 25 bp, Homo sapien
tagagaggttggcttgcttccctct

SEQ ID NO: 510844 - DNA, 25 bp, Homo sapien
agaggttggcttgcttccctctctt

SEQ ID NO: 510845 - DNA, 25 bp, Homo sapien
cctctcttcctaactgcatgttgaa

SEQ ID NO: 510846 - DNA, 25 bp, Homo sapien
ctcttcctaactgcatgttgaaaaa

SEQ ID NO: 510847 - DNA, 25 bp, Homo sapien
aagccgttattgatcttaaacatcg

SEQ ID NO: 510848 - DNA, 25 bp, Homo sapien
gttattgatcttaaacatcggtcag

SEQ ID NO: 510849 - DNA, 25 bp, Homo sapien
aacatcggtcagatgagtcatacat

SEQ ID NO: 510850 - DNA, 25 bp, Homo sapien
tgagtcatacattgggttatttttt

SEQ ID NO: 510851 - DNA, 25 bp, Homo sapien
actattacaagctgttgtctaaaac

SEQ ID NO: 510852 - DNA, 25 bp, Homo sapien
gattttcgaggtgatctcaaagcaa

SEQ ID NO: 510853 - DNA, 25 bp, Homo sapien
agaaaaagttgctctgtcaggatta

SEQ ID NO: 510854 - DNA, 25 bp, Homo sapien
aacagtcccggaattacagagtaag

SEQ ID NO: 510855 - DNA, 25 bp, Homo sapien
gagtaaggttcgtgatcctcgggcc

SEQ ID NO: 510856 - DNA, 25 bp, Homo sapien
atcctcgggccaattttgatcagtc

SEQ ID NO: 510857 - DNA, 25 bp, Homo sapien
caattttgatcagtccctacgtgta

SEQ ID NO: 510858 - DNA, 25 bp, Homo sapien
gtccctacgtgtactgaaacatgcc

SEQ ID NO: 510859 - DNA, 25 bp, Homo sapien
ggttcagcctgatgttatttctaaa

SEQ ID NO: 510860 - DNA, 25 bp, Homo sapien
aagcacttcgtgaggcagatgtaga

SEQ ID NO: 510861 - DNA, 25 bp, Homo sapien
gatgtagactgcttgactttaggac

SEQ ID NO: 510862 - DNA, 25 bp, Homo sapien
taggacaatatatgcagccaacaag

SEQ ID NO: 510863 - DNA, 25 bp, Homo sapien
aaaatatttagcgtctggcccttcg

SEQ ID NO: 510864 - DNA, 25 bp, Homo sapien
ctggcccttcgagaaaatgttagct

SEQ ID NO: 510865 - DNA, 25 bp, Homo sapien
gagaaaatgttagctgcccctggtc

SEQ ID NO: 510866 - DNA, 25 bp, Homo sapien
tagctgcccctggtctagagtaggt

SEQ ID NO: 510867 - DNA, 25 bp, Homo sapien
tggaagctgcttgttcaaattctgt

SEQ ID NO: 510868 - DNA, 25 bp, Homo sapien
gattggaaccgaatgatgtggctca

SEQ ID NO: 510869 - DNA, 25 bp, Homo sapien
gtggctcattgtacagctcatggtg

SEQ ID NO: 510870 - DNA, 25 bp, Homo sapien
gtacagctcatggtgaattgcttca

SEQ ID NO: 510871 - DNA, 25 bp, Homo sapien
gaattgcttcagtaccatggttttg

SEQ ID NO: 510872 - DNA, 25 bp, Homo sapien
ctgtgttgtctgtggctgctcgtgt

SEQ ID NO: 510873 - DNA, 25 bp, Homo sapien
tgctcgtgtgctacaatggcagagt

SEQ ID NO: 510874 - DNA, 25 bp, Homo sapien
aggctccccgagatctcccagaggg

SEQ ID NO: 510875 - DNA, 25 bp, Homo sapien
gcacagccctgccaagttattggtt

SEQ ID NO: 510876 - DNA, 25 bp, Homo sapien
ggttttggacttccggcttccagag

SEQ ID NO: 510877 - DNA, 25 bp, Homo sapien
agagctctttggaggtgttcaccga

SEQ ID NO: 510878 - DNA, 25 bp, Homo sapien
ttaagtcaccaggtttgtggcgatt

SEQ ID NO: 510879 - DNA, 25 bp, Homo sapien
gtggcgattgttacggcagcctcag

SEQ ID NO: 510880 - DNA, 25 bp, Homo sapien
gcctcaggaaactcctacaaggaag

SEQ ID NO: 510881 - DNA, 25 bp, Homo sapien
tcctacaaggaagtgagttacgctc

SEQ ID NO: 510882 - DNA, 25 bp, Homo sapien
ttacgctcacggcagaaagtgctac

SEQ ID NO: 510883 - DNA, 25 bp, Homo sapien
ggtgttcaccgaatgcacgggctgc

SEQ ID NO: 510884 - DNA, 25 bp, Homo sapien
aagtccccagaagcggaacatgtag

SEQ ID NO: 510885 - DNA, 25 bp, Homo sapien
aaaagtaaacatgggcactgattgt

SEQ ID NO: 510886 - DNA, 25 bp, Homo sapien
agtaaacatgggcactgattgtttt

SEQ ID NO: 510887 - DNA, 25 bp, Homo sapien
aatgggaaacagactaaatggctat

SEQ ID NO: 510888 - DNA, 25 bp, Homo sapien
atgggaaacagactaaatggctatt

SEQ ID NO: 510889 - DNA, 25 bp, Homo sapien
aaacagactaaatggctattcacag

SEQ ID NO: 510890 - DNA, 25 bp, Homo sapien
aacagactaaatggctattcacagg

SEQ ID NO: 510891 - DNA, 25 bp, Homo sapien
cagactaaatggctattcacaggaa

SEQ ID NO: 510892 - DNA, 25 bp, Homo sapien
agactaaatggctattcacaggaaa

SEQ ID NO: 510893 - DNA, 25 bp, Homo sapien
gactaaatggctattcacaggaaac

SEQ ID NO: 510894 - DNA, 25 bp, Homo sapien
ctaaatggctattcacaggaaactg

SEQ ID NO: 510895 - DNA, 25 bp, Homo sapien
taaatggctattcacaggaaactga

SEQ ID NO: 510896 - DNA, 25 bp, Homo sapien
tatttttgacccatgcctttttaag

SEQ ID NO: 510897 - DNA, 25 bp, Homo sapien
aagctgtttcatattgaaaggtgga

SEQ ID NO: 510898 - DNA, 25 bp, Homo sapien
tttgtcaaagatgtactgtagtgct

SEQ ID NO: 510899 - DNA, 25 bp, Homo sapien
actgtagtgctatttgaagtacctg

SEQ ID NO: 510900 - DNA, 25 bp, Homo sapien
gtgctatttgaagtacctgtaacaa

SEQ ID NO: 510901 - DNA, 25 bp, Homo sapien
ccctctgtatccatgtactctgcat

SEQ ID NO: 510902 - DNA, 25 bp, Homo sapien
gtatccatgtactctgcatctgtgg

SEQ ID NO: 510903 - DNA, 25 bp, Homo sapien
atccatgtactctgcatctgtggat

SEQ ID NO: 510904 - DNA, 25 bp, Homo sapien
acattgcattaggtattagtctagg

SEQ ID NO: 510905 - DNA, 25 bp, Homo sapien
tatacaggcggatgtgcgttggtta

SEQ ID NO: 510906 - DNA, 25 bp, Homo sapien
ggcggatgtgcgttggttatataca

SEQ ID NO: 510907 - DNA, 25 bp, Homo sapien
aatggagtaggctgtccttggcact

SEQ ID NO: 510908 - DNA, 25 bp, Homo sapien
gtccttggcacttgcatgtgtgaaa

SEQ ID NO: 510909 - DNA, 25 bp, Homo sapien
ttgcctcttcttgagcatggcttga

SEQ ID NO: 510910 - DNA, 25 bp, Homo sapien
aaagctgtaactcacgaagccctga

SEQ ID NO: 510911 - DNA, 25 bp, Homo sapien
tgctacccctaagatcgagcttgtt

SEQ ID NO: 510912 - DNA, 25 bp, Homo sapien
atcgagcttgttttcagtgactggc

SEQ ID NO: 510913 - DNA, 25 bp, Homo sapien
cagggccatctgaagcggtagcatt

SEQ ID NO: 510914 - DNA, 25 bp, Homo sapien
tgaagcggtagcattgccaccatct

SEQ ID NO: 510915 - DNA, 25 bp, Homo sapien
atctccctctcatctagagcagttt

SEQ ID NO: 510916 - DNA, 25 bp, Homo sapien
agagcagttttcttatgccttggtt

SEQ ID NO: 510917 - DNA, 25 bp, Homo sapien
atgccttggtttgagctgaatttga

SEQ ID NO: 510918 - DNA, 25 bp, Homo sapien
actcgccatttctgcccgtgaattt

SEQ ID NO: 510919 - DNA, 25 bp, Homo sapien
gcccgtgaatttgtgtctgatcgct

SEQ ID NO: 510920 - DNA, 25 bp, Homo sapien
gtgtctgatcgctttgtacagattt

SEQ ID NO: 510921 - DNA, 25 bp, Homo sapien
aggactttatgcaactgtctccaca

SEQ ID NO: 510922 - DNA, 25 bp, Homo sapien
tgtctccacaggaactgatctcagt

SEQ ID NO: 510923 - DNA, 25 bp, Homo sapien
ggaactgatctcagtcatttcaaat

SEQ ID NO: 510924 - DNA, 25 bp, Homo sapien
atttcaaatgacagcctaaatgtag

SEQ ID NO: 510925 - DNA, 25 bp, Homo sapien
atgggtgcgaacagacaaggaaaac

SEQ ID NO: 510926 - DNA, 25 bp, Homo sapien
gtgtttgattgtatccgttttcgcc

SEQ ID NO: 510927 - DNA, 25 bp, Homo sapien
atccgttttcgccttatgacagaaa

SEQ ID NO: 510928 - DNA, 25 bp, Homo sapien
taattaaaagcaacccagacctcca

SEQ ID NO: 510929 - DNA, 25 bp, Homo sapien
tcgtttcaagggtccttctacattg

SEQ ID NO: 510930 - DNA, 25 bp, Homo sapien
tctacattgttaatactctggtata

SEQ ID NO: 510931 - DNA, 25 bp, Homo sapien
tactctggtataaatacgttccatt

SEQ ID NO: 510932 - DNA, 25 bp, Homo sapien
gtataaatacgttccattattccct

SEQ ID NO: 510933 - DNA, 25 bp, Homo sapien
taaatacgttccattattccctata

SEQ ID NO: 510934 - DNA, 25 bp, Homo sapien
attattccctataacatgactgaaa

SEQ ID NO: 510935 - DNA, 25 bp, Homo sapien
tccctataacatgactgaaaccaat

SEQ ID NO: 510936 - DNA, 25 bp, Homo sapien
taacatgactgaaaccaatctaaag

SEQ ID NO: 510937 - DNA, 25 bp, Homo sapien
gactgaaaccaatctaaagtattaa

SEQ ID NO: 510938 - DNA, 25 bp, Homo sapien
aatatgtttttgggccaagtgcagt

SEQ ID NO: 510939 - DNA, 25 bp, Homo sapien
tggctcttatctgtgatcccagcta

SEQ ID NO: 510940 - DNA, 25 bp, Homo sapien
gcagaattgattcctacacgaaaaa

SEQ ID NO: 510941 - DNA, 25 bp, Homo sapien
aaaagcacacgaatgccaaaccttt

SEQ ID NO: 510942 - DNA, 25 bp, Homo sapien
gaatgccaaacctttcctttggtgg

SEQ ID NO: 510943 - DNA, 25 bp, Homo sapien
gccaaacctttcctttggtggactg

SEQ ID NO: 510944 - DNA, 25 bp, Homo sapien
ttggtggactggacactaaccagat

SEQ ID NO: 510945 - DNA, 25 bp, Homo sapien
ggacactaaccagatgagagtaaat

SEQ ID NO: 510946 - DNA, 25 bp, Homo sapien
gagtaaatttcttatccgtggacgt

SEQ ID NO: 510947 - DNA, 25 bp, Homo sapien
tatccgtggacgtatgtaagctact

SEQ ID NO: 510948 - DNA, 25 bp, Homo sapien
atgtaagctactgctgctgtgtgct

SEQ ID NO: 510949 - DNA, 25 bp, Homo sapien
tgtgtgctctccacagccatattta

SEQ ID NO: 510950 - DNA, 25 bp, Homo sapien
gctctccacagccatatttattgta

SEQ ID NO: 510951 - DNA, 25 bp, Homo sapien
ttaactcatgtggtagtgatattta

SEQ ID NO: 510952 - DNA, 25 bp, Homo sapien
gtagtgatatttaatactttctgat

SEQ ID NO: 510953 - DNA, 25 bp, Homo sapien
tagtgatatttaatactttctgatc

SEQ ID NO: 510954 - DNA, 25 bp, Homo sapien
agtgatatttaatactttctgatca

SEQ ID NO: 510955 - DNA, 25 bp, Homo sapien
gtgatatttaatactttctgatcaa

SEQ ID NO: 510956 - DNA, 25 bp, Homo sapien
tgatatttaatactttctgatcaaa

SEQ ID NO: 510957 - DNA, 25 bp, Homo sapien
gatatttaatactttctgatcaaac

SEQ ID NO: 510958 - DNA, 25 bp, Homo sapien
atatttaatactttctgatcaaaca

SEQ ID NO: 510959 - DNA, 25 bp, Homo sapien
atcatgcctctgagcagacccaaat

SEQ ID NO: 510960 - DNA, 25 bp, Homo sapien
tctgagcagacccaaattctgttct

SEQ ID NO: 510961 - DNA, 25 bp, Homo sapien
aattgacctcagctggtgagctcag

SEQ ID NO: 510962 - DNA, 25 bp, Homo sapien
tggtgagctcagtgataggtcacat

SEQ ID NO: 510963 - DNA, 25 bp, Homo sapien
gaagcaaggagtggtgtttgcctaa

SEQ ID NO: 510964 - DNA, 25 bp, Homo sapien
agtggtgtttgcctaatggctgctc

SEQ ID NO: 510965 - DNA, 25 bp, Homo sapien
aatggctgctcctggactgctcagt

SEQ ID NO: 510966 - DNA, 25 bp, Homo sapien
gctcctggactgctcagtatattaa

SEQ ID NO: 510967 - DNA, 25 bp, Homo sapien
aaaaggtttgctgtcaatagaacaa

SEQ ID NO: 510968 - DNA, 25 bp, Homo sapien
gaacaaagcttttatcccagacatg

SEQ ID NO: 510969 - DNA, 25 bp, Homo sapien
gacatgtttcacatcatgcctctga

SEQ ID NO: 510970 - DNA, 25 bp, Homo sapien
tgcgagccctcaaagaaacatttaa

SEQ ID NO: 510971 - DNA, 25 bp, Homo sapien
ttaatattctcttttgccaattcag

SEQ ID NO: 510972 - DNA, 25 bp, Homo sapien
ttgccaattcagttgcatgctctgt

SEQ ID NO: 510973 - DNA, 25 bp, Homo sapien
catgctctgtggctttacttttaag

SEQ ID NO: 510974 - DNA, 25 bp, Homo sapien
ttacttttaaggatctgctgctcct

SEQ ID NO: 510975 - DNA, 25 bp, Homo sapien
gattttccagaatttcagctgcaga

SEQ ID NO: 510976 - DNA, 25 bp, Homo sapien
gtactggcccttcggattgaaagta

SEQ ID NO: 510977 - DNA, 25 bp, Homo sapien
taactggagataggcatcgggtgac

SEQ ID NO: 510978 - DNA, 25 bp, Homo sapien
acaactgctatcaagatccagccca

SEQ ID NO: 510979 - DNA, 25 bp, Homo sapien
aaatttgctgccactctttcatgct

SEQ ID NO: 510980 - DNA, 25 bp, Homo sapien
ttatattcttttggatgcgagccct

SEQ ID NO: 510981 - DNA, 25 bp, Homo sapien
gagaagatcttgctccttcagactc

SEQ ID NO: 510982 - DNA, 25 bp, Homo sapien
cttcagactctgacctgagtggaga

SEQ ID NO: 510983 - DNA, 25 bp, Homo sapien
tgagtggagacctttccaccagaca

SEQ ID NO: 510984 - DNA, 25 bp, Homo sapien
acagctcgggcctgtgtaattgtag

SEQ ID NO: 510985 - DNA, 25 bp, Homo sapien
acactcagcagtgattgccatggca

SEQ ID NO: 510986 - DNA, 25 bp, Homo sapien
agtgattgccatggcacagagccgt

SEQ ID NO: 510987 - DNA, 25 bp, Homo sapien
ggcacagagccgtggtcattgttgc

SEQ ID NO: 510988 - DNA, 25 bp, Homo sapien
gtggtcattgttgctgttacaaaga

SEQ ID NO: 510989 - DNA, 25 bp, Homo sapien
gaagaaaaccatctgagttctaact

SEQ ID NO: 510990 - DNA, 25 bp, Homo sapien
gagttctaactccttggttgcttaa

SEQ ID NO: 510991 - DNA, 25 bp, Homo sapien
aaaagtagttcccaagagtctgaga

SEQ ID NO: 510992 - DNA, 25 bp, Homo sapien
tcacactggcctctttaggatcagg

SEQ ID NO: 510993 - DNA, 25 bp, Homo sapien
ggcccaggtgctgaatcgcaatggt

SEQ ID NO: 510994 - DNA, 25 bp, Homo sapien
tgttgtaggccccttcaggatgcgc

SEQ ID NO: 510995 - DNA, 25 bp, Homo sapien
cctccaggcctagatgttacgtgat

SEQ ID NO: 510996 - DNA, 25 bp, Homo sapien
atgttacgtgatcatggcctctgca

SEQ ID NO: 510997 - DNA, 25 bp, Homo sapien
atggcctctgcaggtcaagaattta

SEQ ID NO: 510998 - DNA, 25 bp, Homo sapien
ttaaattttcgcagcctctataggc

SEQ ID NO: 510999 - DNA, 25 bp, Homo sapien
tggtctgtttaggtccatctcatgc

SEQ ID NO: 511000 - DNA, 25 bp, Homo sapien
tttctcagactctccaagcgacgat

SEQ ID NO: 511001 - DNA, 25 bp, Homo sapien
aagcgacgatctggcctgacacttg

SEQ ID NO: 511002 - DNA, 25 bp, Homo sapien
acacttgcttctgtgggccatgtga

SEQ ID NO: 511003 - DNA, 25 bp, Homo sapien
gttttgaatgtgatgagccagccag

SEQ ID NO: 511004 - DNA, 25 bp, Homo sapien
tgatgagccagccaggagatagaat

SEQ ID NO: 511005 - DNA, 25 bp, Homo sapien
gagatagaatactacctgcccttag

SEQ ID NO: 511006 - DNA, 25 bp, Homo sapien
agaatactacctgcccttagggttg

SEQ ID NO: 511007 - DNA, 25 bp, Homo sapien
gacttgatacttcagaaaccctttt

SEQ ID NO: 511008 - DNA, 25 bp, Homo sapien
accctttttattgacccacaagcag

SEQ ID NO: 511009 - DNA, 25 bp, Homo sapien
attacttcttactttattgctccag

SEQ ID NO: 511010 - DNA, 25 bp, Homo sapien
tcttactttattgctccaggattct

SEQ ID NO: 511011 - DNA, 25 bp, Homo sapien
gatgggctgcatttactgtgtgaag

SEQ ID NO: 511012 - DNA, 25 bp, Homo sapien
aatcattagcctggattctgatttc

SEQ ID NO: 511013 - DNA, 25 bp, Homo sapien
ttcccctaagaactgaaatgtgctc

SEQ ID NO: 511014 - DNA, 25 bp, Homo sapien
ttgggtggtcagattctactttgaa

SEQ ID NO: 511015 - DNA, 25 bp, Homo sapien
tctactttgaatctgaagtttgcag

SEQ ID NO: 511016 - DNA, 25 bp, Homo sapien
tgaatctgaagtttgcagatatgcc

SEQ ID NO: 511017 - DNA, 25 bp, Homo sapien
gcagatatgcctatagatttttgga

SEQ ID NO: 511018 - DNA, 25 bp, Homo sapien
tgcctatagatttttggagtttacc

SEQ ID NO: 511019 - DNA, 25 bp, Homo sapien
ggagtttaccactttcttattctgt

SEQ ID NO: 511020 - DNA, 25 bp, Homo sapien
gtttaccactttcttattctgtatc

SEQ ID NO: 511021 - DNA, 25 bp, Homo sapien
actatatatgttaccatttttctgg

SEQ ID NO: 511022 - DNA, 25 bp, Homo sapien
atatatgttaccatttttctggatt

SEQ ID NO: 511023 - DNA, 25 bp, Homo sapien
tagtaagaaatttgcagttttggtt

SEQ ID NO: 511024 - DNA, 25 bp, Homo sapien
ttgcagttttggtttgatgtaacaa

SEQ ID NO: 511025 - DNA, 25 bp, Homo sapien
atgagtttatggtgcctccagcttc

SEQ ID NO: 511026 - DNA, 25 bp, Homo sapien
tctcatggccccacttgggaaattc

SEQ ID NO: 511027 - DNA, 25 bp, Homo sapien
tgggaaattcctccagtaacattac

SEQ ID NO: 511028 - DNA, 25 bp, Homo sapien
tccagtaacattacactcactcact

SEQ ID NO: 511029 - DNA, 25 bp, Homo sapien
tcctcatttccctgttaccaaaact

SEQ ID NO: 511030 - DNA, 25 bp, Homo sapien
ttaccaaaactatgtgccctaccca

SEQ ID NO: 511031 - DNA, 25 bp, Homo sapien
tacccagggacttctgggcagctct

SEQ ID NO: 511032 - DNA, 25 bp, Homo sapien
actaacttagcctttcatactgaat

SEQ ID NO: 511033 - DNA, 25 bp, Homo sapien
catactgaatcacattttccttaaa

SEQ ID NO: 511034 - DNA, 25 bp, Homo sapien
aacagctgctgacagaagatgctac

SEQ ID NO: 511035 - DNA, 25 bp, Homo sapien
gctacattttgtttcagggcctggt

SEQ ID NO: 511036 - DNA, 25 bp, Homo sapien
gagcaagacttgtcaggggccagac

SEQ ID NO: 511037 - DNA, 25 bp, Homo sapien
ggccagacctgggtaggaggattgt

SEQ ID NO: 511038 - DNA, 25 bp, Homo sapien
gaggctcaggttgtacctgcaggcc

SEQ ID NO: 511039 - DNA, 25 bp, Homo sapien
aggctcaggttgtacctgcaggcca

SEQ ID NO: 511040 - DNA, 25 bp, Homo sapien
ggctcaggttgtacctgcaggccac

SEQ ID NO: 511041 - DNA, 25 bp, Homo sapien
tgcaggccacagtctcctcgacaga

SEQ ID NO: 511042 - DNA, 25 bp, Homo sapien
agtctcctcgacagacctcggacga

SEQ ID NO: 511043 - DNA, 25 bp, Homo sapien
tcctcgacagacctcggacgaggtt

SEQ ID NO: 511044 - DNA, 25 bp, Homo sapien
ctcgacagacctcggacgaggttgt

SEQ ID NO: 511045 - DNA, 25 bp, Homo sapien
cgacagacctcggacgaggttgtaa

SEQ ID NO: 511046 - DNA, 25 bp, Homo sapien
gacctcggacgaggttgtaagtgtt

SEQ ID NO: 511047 - DNA, 25 bp, Homo sapien
aagaatgaatcctgtgctacccacc

SEQ ID NO: 511048 - DNA, 25 bp, Homo sapien
tacccaccttgccatgttgtgtttc

SEQ ID NO: 511049 - DNA, 25 bp, Homo sapien
gccatgttgtgtttcagtgagacga

SEQ ID NO: 511050 - DNA, 25 bp, Homo sapien
acactaccaaaaagtcattccacag

SEQ ID NO: 511051 - DNA, 25 bp, Homo sapien
aggacagaaagtgccctcactcaag

SEQ ID NO: 511052 - DNA, 25 bp, Homo sapien
actcaagcttctcttgtaaccacag

SEQ ID NO: 511053 - DNA, 25 bp, Homo sapien
accacagagaaggtgtctggatatt

SEQ ID NO: 511054 - DNA, 25 bp, Homo sapien
gatattaacatagagcagaggccac

SEQ ID NO: 511055 - DNA, 25 bp, Homo sapien
atcaaaaatcctgcatgtgaaggca

SEQ ID NO: 511056 - DNA, 25 bp, Homo sapien
gcatgtgaaggcagtaattgtatct

SEQ ID NO: 511057 - DNA, 25 bp, Homo sapien
aacatctgtgggtgtgaaatttttc

SEQ ID NO: 511058 - DNA, 25 bp, Homo sapien
aggagtcaaaattcatcgtcttcaa

SEQ ID NO: 511059 - DNA, 25 bp, Homo sapien
gagtcaaaattcatcgtcttcaagc

SEQ ID NO: 511060 - DNA, 25 bp, Homo sapien
gtcaaaattcatcgtcttcaagccc

SEQ ID NO: 511061 - DNA, 25 bp, Homo sapien
caaaattcatcgtcttcaagcccct

SEQ ID NO: 511062 - DNA, 25 bp, Homo sapien
aaattcatcgtcttcaagcccctct

SEQ ID NO: 511063 - DNA, 25 bp, Homo sapien
attcatcgtcttcaagcccctcttt

SEQ ID NO: 511064 - DNA, 25 bp, Homo sapien
tcagccgaatttttttataccactc

SEQ ID NO: 511065 - DNA, 25 bp, Homo sapien
ttttttataccactctgatgtcagc

SEQ ID NO: 511066 - DNA, 25 bp, Homo sapien
ttttataccactctgatgtcagcat

SEQ ID NO: 511067 - DNA, 25 bp, Homo sapien
tataccactctgatgtcagcatttt

SEQ ID NO: 511068 - DNA, 25 bp, Homo sapien
taccactctgatgtcagcatttttt

SEQ ID NO: 511069 - DNA, 25 bp, Homo sapien
ggagattacttgaagagttgctgaa

SEQ ID NO: 511070 - DNA, 25 bp, Homo sapien
gttgctgaagatgttcatggactca

SEQ ID NO: 511071 - DNA, 25 bp, Homo sapien
aagatgttcatggactcagaatcct

SEQ ID NO: 511072 - DNA, 25 bp, Homo sapien
gactcagaatccttttattatagct

SEQ ID NO: 511073 - DNA, 25 bp, Homo sapien
gaatccttttattatagcttgacct

SEQ ID NO: 511074 - DNA, 25 bp, Homo sapien
agcttgacctatgacctgaccaatt

SEQ ID NO: 511075 - DNA, 25 bp, Homo sapien
tatgacctgaccaattccgtgcaga

SEQ ID NO: 511076 - DNA, 25 bp, Homo sapien
ctgaccaattccgtgcagaggcaga

SEQ ID NO: 511077 - DNA, 25 bp, Homo sapien
aattccgtgcagaggcagagcactg

SEQ ID NO: 511078 - DNA, 25 bp, Homo sapien
acggtcggcccctctggcagaaggt

SEQ ID NO: 511079 - DNA, 25 bp, Homo sapien
ggttgatgaccgatttttttggaat

SEQ ID NO: 511080 - DNA, 25 bp, Homo sapien
gaggcccttgccatggggcttttta

SEQ ID NO: 511081 - DNA, 25 bp, Homo sapien
aggataaagcaacaagcctggactt

SEQ ID NO: 511082 - DNA, 25 bp, Homo sapien
aacaagcctggactttgctctacaa

SEQ ID NO: 511083 - DNA, 25 bp, Homo sapien
aagcctggactttgctctacaacag

SEQ ID NO: 511084 - DNA, 25 bp, Homo sapien
tggactttgctctacaacagggttt

SEQ ID NO: 511085 - DNA, 25 bp, Homo sapien
gactttgctctacaacagggttttg

SEQ ID NO: 511086 - DNA, 25 bp, Homo sapien
tgctctacaacagggttttgcatag

SEQ ID NO: 511087 - DNA, 25 bp, Homo sapien
acaacagggttttgcatagggagtg

SEQ ID NO: 511088 - DNA, 25 bp, Homo sapien
ggagtggtatgaccagatccctcaa

SEQ ID NO: 511089 - DNA, 25 bp, Homo sapien
gtggtatgaccagatccctcaagaa

SEQ ID NO: 511090 - DNA, 25 bp, Homo sapien
tggtatgaccagatccctcaagaaa

SEQ ID NO: 511091 - DNA, 25 bp, Homo sapien
acagcagacaaagctaaatgcatct

SEQ ID NO: 511092 - DNA, 25 bp, Homo sapien
gacaaagctaaatgcatctggagag

SEQ ID NO: 511093 - DNA, 25 bp, Homo sapien
agttcagagaggcagtctataggta

SEQ ID NO: 511094 - DNA, 25 bp, Homo sapien
gtctataggtagaatctctccccac

SEQ ID NO: 511095 - DNA, 25 bp, Homo sapien
cacccctatcgtggttattgtgttt

SEQ ID NO: 511096 - DNA, 25 bp, Homo sapien
ggttattgtgtttttggactgaatt

SEQ ID NO: 511097 - DNA, 25 bp, Homo sapien
tttagtgtcgatgtgaaatgccccg

SEQ ID NO: 511098 - DNA, 25 bp, Homo sapien
gtgtcgatgtgaaatgccccgtgat

SEQ ID NO: 511099 - DNA, 25 bp, Homo sapien
gtcgatgtgaaatgccccgtgatca

SEQ ID NO: 511100 - DNA, 25 bp, Homo sapien
gaaatgccccgtgatcaataataaa

SEQ ID NO: 511101 - DNA, 25 bp, Homo sapien
gccccgtgatcaataataaaccagt

SEQ ID NO: 511102 - DNA, 25 bp, Homo sapien
agaggaggaaggttctggccgccgt

SEQ ID NO: 511103 - DNA, 25 bp, Homo sapien
gaggaggaaggttctggccgccgtc

SEQ ID NO: 511104 - DNA, 25 bp, Homo sapien
aggaggaaggttctggccgccgtcg

SEQ ID NO: 511105 - DNA, 25 bp, Homo sapien
ggaggaaggttctggccgccgtcgg

SEQ ID NO: 511106 - DNA, 25 bp, Homo sapien
gaggaaggttctggccgccgtcggg

SEQ ID NO: 511107 - DNA, 25 bp, Homo sapien
gaaggttctggccgccgtcggggct

SEQ ID NO: 511108 - DNA, 25 bp, Homo sapien
ttctggccgccgtcggggctctgct

SEQ ID NO: 511109 - DNA, 25 bp, Homo sapien
tctggccgccgtcggggctctgctg

SEQ ID NO: 511110 - DNA, 25 bp, Homo sapien
ggaagtgcgtgtcgccgggggccgg

SEQ ID NO: 511111 - DNA, 25 bp, Homo sapien
gaagtgcgtgtcgccgggggccggg

SEQ ID NO: 511112 - DNA, 25 bp, Homo sapien
ttgtgacaaattgttctcggccggg

SEQ ID NO: 511113 - DNA, 25 bp, Homo sapien
tgtgacaaattgttctcggccgggc

SEQ ID NO: 511114 - DNA, 25 bp, Homo sapien
gtgacaaattgttctcggccgggca

SEQ ID NO: 511115 - DNA, 25 bp, Homo sapien
tgacaaattgttctcggccgggcac

SEQ ID NO: 511116 - DNA, 25 bp, Homo sapien
gacaaattgttctcggccgggcaca

SEQ ID NO: 511117 - DNA, 25 bp, Homo sapien
acaaattgttctcggccgggcacag

SEQ ID NO: 511118 - DNA, 25 bp, Homo sapien
caaattgttctcggccgggcacagt

SEQ ID NO: 511119 - DNA, 25 bp, Homo sapien
aaattgttctcggccgggcacagtg

SEQ ID NO: 511120 - DNA, 25 bp, Homo sapien
gcgcacgcctataatccctgtactt

SEQ ID NO: 511121 - DNA, 25 bp, Homo sapien
cgcacgcctataatccctgtacttt

SEQ ID NO: 511122 - DNA, 25 bp, Homo sapien
cgtggtgatgcgcacctgcagtccc

SEQ ID NO: 511123 - DNA, 25 bp, Homo sapien
gaccctgatcagagagattaggatt

SEQ ID NO: 511124 - DNA, 25 bp, Homo sapien
ttgacataggatttggaacccatct

SEQ ID NO: 511125 - DNA, 25 bp, Homo sapien
ggatttggaacccatctaaatgttg

SEQ ID NO: 511126 - DNA, 25 bp, Homo sapien
cccatctaaatgttgaagttccctg

SEQ ID NO: 511127 - DNA, 25 bp, Homo sapien
aatgttgaagttccctgagacagct

SEQ ID NO: 511128 - DNA, 25 bp, Homo sapien
aagcagcccctaatgagaggctctg

SEQ ID NO: 511129 - DNA, 25 bp, Homo sapien
ttcccacctcgccaatgttgttgtt

SEQ ID NO: 511130 - DNA, 25 bp, Homo sapien
gatttgtatcctctgttatagacat

SEQ ID NO: 511131 - DNA, 25 bp, Homo sapien
tctttcattgtgcacaagtgctgag

SEQ ID NO: 511132 - DNA, 25 bp, Homo sapien
ttgtgcacaagtgctgagagtctga

SEQ ID NO: 511133 - DNA, 25 bp, Homo sapien
gctgtgtatatatatcctgactcgg

SEQ ID NO: 511134 - DNA, 25 bp, Homo sapien
aggctaaccctgatccatagtgcta

SEQ ID NO: 511135 - DNA, 25 bp, Homo sapien
atagtgctacctgcacctctggatt

SEQ ID NO: 511136 - DNA, 25 bp, Homo sapien
tgcacctctggattctggattcaca

SEQ ID NO: 511137 - DNA, 25 bp, Homo sapien
ggattcacagaccaagtccaagccc

SEQ ID NO: 511138 - DNA, 25 bp, Homo sapien
agcccgttcttacgtcgccataaag

SEQ ID NO: 511139 - DNA, 25 bp, Homo sapien
cgaacggcattctcggtacttctgt

SEQ ID NO: 511140 - DNA, 25 bp, Homo sapien
ggcattctcggtacttctgtttgtt

SEQ ID NO: 511141 - DNA, 25 bp, Homo sapien
aatagccacttagacactttacctc

SEQ ID NO: 511142 - DNA, 25 bp, Homo sapien
agacactttacctcttcagtatgca

SEQ ID NO: 511143 - DNA, 25 bp, Homo sapien
taatataagaatgagcctgtccaat

SEQ ID NO: 511144 - DNA, 25 bp, Homo sapien
agcctgtccaatttctgctgtacat

SEQ ID NO: 511145 - DNA, 25 bp, Homo sapien
aggtgtagaggaagctgccccttgc

SEQ ID NO: 511146 - DNA, 25 bp, Homo sapien
tgccccttgcagaactgtactgtaa

SEQ ID NO: 511147 - DNA, 25 bp, Homo sapien
tttcacaggactgattgtacacagg

SEQ ID NO: 511148 - DNA, 25 bp, Homo sapien
gactgattgtacacagggcttgtaa

SEQ ID NO: 511149 - DNA, 25 bp, Homo sapien
aacactgtgctgtgaaacaactatg

SEQ ID NO: 511150 - DNA, 25 bp, Homo sapien
atctccattgaaggctacttcatgg

SEQ ID NO: 511151 - DNA, 25 bp, Homo sapien
cttcatgggcacctgaaagtggagt

SEQ ID NO: 511152 - DNA, 25 bp, Homo sapien
ggagtgttatagctatgactttcta

SEQ ID NO: 511153 - DNA, 25 bp, Homo sapien
tctatttcttgtttcctaagtaaat

SEQ ID NO: 511154 - DNA, 25 bp, Homo sapien
acctaattttcaccctttcattctg

SEQ ID NO: 511155 - DNA, 25 bp, Homo sapien
ttttcaccctttcattctgtttcag

SEQ ID NO: 511156 - DNA, 25 bp, Homo sapien
attctttctgggtttaatgaagcca

SEQ ID NO: 511157 - DNA, 25 bp, Homo sapien
gaatagtagttgcacgttcctcttc

SEQ ID NO: 511158 - DNA, 25 bp, Homo sapien
tagttgcacgttcctcttccatgac

SEQ ID NO: 511159 - DNA, 25 bp, Homo sapien
tgacattctagaaatgggctggctc

SEQ ID NO: 511160 - DNA, 25 bp, Homo sapien
aaatgggctggctcggaattcttcc

SEQ ID NO: 511161 - DNA, 25 bp, Homo sapien
tggctcggaattcttccaggcagga

SEQ ID NO: 511162 - DNA, 25 bp, Homo sapien
ggaattcttccaggcaggagccagg

SEQ ID NO: 511163 - DNA, 25 bp, Homo sapien
gaggccagtgcttgcccggtgccct

SEQ ID NO: 511164 - DNA, 25 bp, Homo sapien
tgccctcagaacctgcacttgtgaa

SEQ ID NO: 511165 - DNA, 25 bp, Homo sapien
gaacctgcacttgtgaacatgatga

SEQ ID NO: 511166 - DNA, 25 bp, Homo sapien
ggctttctgaacattctttctgggt

SEQ ID NO: 511167 - DNA, 25 bp, Homo sapien
catatgtccatttatagggaggtaa

SEQ ID NO: 511168 - DNA, 25 bp, Homo sapien
gttttcctacacattttcataaagc

SEQ ID NO: 511169 - DNA, 25 bp, Homo sapien
aatgtatcttacatccaaagtaggg

SEQ ID NO: 511170 - DNA, 25 bp, Homo sapien
atccaaagtagggagggcatccaac

SEQ ID NO: 511171 - DNA, 25 bp, Homo sapien
ggagggcatccaacatattatagat

SEQ ID NO: 511172 - DNA, 25 bp, Homo sapien
atagctttgtattgcatagtttgtc

SEQ ID NO: 511173 - DNA, 25 bp, Homo sapien
gcatagtttgtctttaagagttcaa

SEQ ID NO: 511174 - DNA, 25 bp, Homo sapien
ataattttgatgttcactggtttta

SEQ ID NO: 511175 - DNA, 25 bp, Homo sapien
tttgatgttcactggttttatttta

SEQ ID NO: 511176 - DNA, 25 bp, Homo sapien
aaattgccttcttatttgttagcaa

SEQ ID NO: 511177 - DNA, 25 bp, Homo sapien
tatttgttagcaaaatgcctttttt

SEQ ID NO: 511178 - DNA, 25 bp, Homo sapien
gaagcaaagcaaacaaccagacatg

SEQ ID NO: 511179 - DNA, 25 bp, Homo sapien
agacatgactcatctgacggagctg

SEQ ID NO: 511180 - DNA, 25 bp, Homo sapien
atctgacggagctggccctcagact

SEQ ID NO: 511181 - DNA, 25 bp, Homo sapien
aggctcagggactctggtgccaaat

SEQ ID NO: 511182 - DNA, 25 bp, Homo sapien
agggactctggtgccaaatccagaa

SEQ ID NO: 511183 - DNA, 25 bp, Homo sapien
aatccagaaagatctgctctgctgc

SEQ ID NO: 511184 - DNA, 25 bp, Homo sapien
cttacggcaatttaggtttctcatt

SEQ ID NO: 511185 - DNA, 25 bp, Homo sapien
aattgttttaagctttggcctctat

SEQ ID NO: 511186 - DNA, 25 bp, Homo sapien
taagctttggcctctatccaggtta

SEQ ID NO: 511187 - DNA, 25 bp, Homo sapien
ggcctctatccaggttattctgaca

SEQ ID NO: 511188 - DNA, 25 bp, Homo sapien
gaaatgggagttgtcagagcattaa

SEQ ID NO: 511189 - DNA, 25 bp, Homo sapien
taggattacagacaggtgccaccac

SEQ ID NO: 511190 - DNA, 25 bp, Homo sapien
aggattacagacaggtgccaccacg

SEQ ID NO: 511191 - DNA, 25 bp, Homo sapien
ggctgatctcaaactggctggtctc

SEQ ID NO: 511192 - DNA, 25 bp, Homo sapien
gctgatctcaaactggctggtctca

SEQ ID NO: 511193 - DNA, 25 bp, Homo sapien
ctgatctcaaactggctggtctcaa

SEQ ID NO: 511194 - DNA, 25 bp, Homo sapien
tgatctcaaactggctggtctcaaa

SEQ ID NO: 511195 - DNA, 25 bp, Homo sapien
gatctcaaactggctggtctcaaac

SEQ ID NO: 511196 - DNA, 25 bp, Homo sapien
atctcaaactggctggtctcaaact

SEQ ID NO: 511197 - DNA, 25 bp, Homo sapien
aatacgggaacatcaatattgcttt

SEQ ID NO: 511198 - DNA, 25 bp, Homo sapien
gggaacatcaatattgcttttttaa

SEQ ID NO: 511199 - DNA, 25 bp, Homo sapien
tattttctttcggttcaactgtatt

SEQ ID NO: 511200 - DNA, 25 bp, Homo sapien
taaaagtggaaactcttcgtcaggt

SEQ ID NO: 511201 - DNA, 25 bp, Homo sapien
agtggaaactcttcgtcaggtgctc

SEQ ID NO: 511202 - DNA, 25 bp, Homo sapien
ggaaactcttcgtcaggtgctccga

SEQ ID NO: 511203 - DNA, 25 bp, Homo sapien
aactcttcgtcaggtgctccgagaa

SEQ ID NO: 511204 - DNA, 25 bp, Homo sapien
tcttcgtcaggtgctccgagaacag

SEQ ID NO: 511205 - DNA, 25 bp, Homo sapien
tcgtcaggtgctccgagaacagtga

SEQ ID NO: 511206 - DNA, 25 bp, Homo sapien
aggtgctccgagaacagtgaacaaa

SEQ ID NO: 511207 - DNA, 25 bp, Homo sapien
tgctccgagaacagtgaacaaacac

SEQ ID NO: 511208 - DNA, 25 bp, Homo sapien
atttgaaggactctcttctgcgttt

SEQ ID NO: 511209 - DNA, 25 bp, Homo sapien
ctcttctgcgtttcctaacagttat

SEQ ID NO: 511210 - DNA, 25 bp, Homo sapien
tcctaacagttatttggtggtctca

SEQ ID NO: 511211 - DNA, 25 bp, Homo sapien
gttatttggtggtctcaagagttga

SEQ ID NO: 511212 - DNA, 25 bp, Homo sapien
aactgaagttctatacatttccata

SEQ ID NO: 511213 - DNA, 25 bp, Homo sapien
gagtttacatcctgcagttaaaagg

SEQ ID NO: 511214 - DNA, 25 bp, Homo sapien
ttttctctagccgaatctttttcga

SEQ ID NO: 511215 - DNA, 25 bp, Homo sapien
gccgaatctttttcgaacagcccgg

SEQ ID NO: 511216 - DNA, 25 bp, Homo sapien
aggaaaacggattcacttgctgatt

SEQ ID NO: 511217 - DNA, 25 bp, Homo sapien
acttgctgattttgttcacggcgga

SEQ ID NO: 511218 - DNA, 25 bp, Homo sapien
tgttcacggcggaagcaccatgttc

SEQ ID NO: 511219 - DNA, 25 bp, Homo sapien
acagaggagaactgctcccttttct

SEQ ID NO: 511220 - DNA, 25 bp, Homo sapien
tggttatggctttataaacttttat

SEQ ID NO: 511221 - DNA, 25 bp, Homo sapien
cttttatttggtgaaagccccagat

SEQ ID NO: 511222 - DNA, 25 bp, Homo sapien
aagccccagatacccaaatgtcatt

SEQ ID NO: 511223 - DNA, 25 bp, Homo sapien
atgtcattggcaaaacttatttttt

SEQ ID NO: 511224 - DNA, 25 bp, Homo sapien
ttttttctggacagatcagatttct

SEQ ID NO: 511225 - DNA, 25 bp, Homo sapien
tcagatttctagagagagcagattt

SEQ ID NO: 511226 - DNA, 25 bp, Homo sapien
gagcagatttctagagagattagca

SEQ ID NO: 511227 - DNA, 25 bp, Homo sapien
gagagattagcattcatagtaagtg

SEQ ID NO: 511228 - DNA, 25 bp, Homo sapien
tttaatccatgctattactgggcag

SEQ ID NO: 511229 - DNA, 25 bp, Homo sapien
tactgggcagtaggtctaatttttt

SEQ ID NO: 511230 - DNA, 25 bp, Homo sapien
gggtttccagctcactgggactctc

SEQ ID NO: 511231 - DNA, 25 bp, Homo sapien
actgggactctcagaccttaccttt

SEQ ID NO: 511232 - DNA, 25 bp, Homo sapien
ctttccagctcaaacaccattagtt

SEQ ID NO: 511233 - DNA, 25 bp, Homo sapien
agttaaattccttcattctcattag

SEQ ID NO: 511234 - DNA, 25 bp, Homo sapien
tgcagcctgctgagtatgtgggttt

SEQ ID NO: 511235 - DNA, 25 bp, Homo sapien
atgtgggtttcactgccggagtcca

SEQ ID NO: 511236 - DNA, 25 bp, Homo sapien
ggagtccatcatttagccagtatac

SEQ ID NO: 511237 - DNA, 25 bp, Homo sapien
tagaggaactgcttcgaatcaaggc

SEQ ID NO: 511238 - DNA, 25 bp, Homo sapien
aatcaaggcaactggtgaagggctt

SEQ ID NO: 511239 - DNA, 25 bp, Homo sapien
gaagggcttagcatgttggcagcaa

SEQ ID NO: 511240 - DNA, 25 bp, Homo sapien
gttggcagcaatatcccagagattg

SEQ ID NO: 511241 - DNA, 25 bp, Homo sapien
gatgttataccaactattcagagga

SEQ ID NO: 511242 - DNA, 25 bp, Homo sapien
tattcagaggaactcatacttcaaa

SEQ ID NO: 511243 - DNA, 25 bp, Homo sapien
aaaatctgtcttatagtttctctaa

SEQ ID NO: 511244 - DNA, 25 bp, Homo sapien
tgaaatctcagtacgacatgaaaga

SEQ ID NO: 511245 - DNA, 25 bp, Homo sapien
atgtcagaccattgttattgttgaa

SEQ ID NO: 511246 - DNA, 25 bp, Homo sapien
gatttgcatgtataatatcaggaaa

SEQ ID NO: 511247 - DNA, 25 bp, Homo sapien
aaaattaagcatcccaagtgtgact

SEQ ID NO: 511248 - DNA, 25 bp, Homo sapien
ggacaaagagagcagatgcaccagt

SEQ ID NO: 511249 - DNA, 25 bp, Homo sapien
cagtgcctgtgccataaagttccga

SEQ ID NO: 511250 - DNA, 25 bp, Homo sapien
gcctgtgccataaagttccgaatcc

SEQ ID NO: 511251 - DNA, 25 bp, Homo sapien
aatcccccatgtgtctctttcagag

SEQ ID NO: 511252 - DNA, 25 bp, Homo sapien
caggaagaaggctcgcaaagtaata

SEQ ID NO: 511253 - DNA, 25 bp, Homo sapien
aagaaggctcgcaaagtaatataaa

SEQ ID NO: 511254 - DNA, 25 bp, Homo sapien
aaatatatcttatggtttatggaaa

SEQ ID NO: 511255 - DNA, 25 bp, Homo sapien
atcttatggtttatggaaaattctt

SEQ ID NO: 511256 - DNA, 25 bp, Homo sapien
ccaatgaatgagttttaagtaggaa

SEQ ID NO: 511257 - DNA, 25 bp, Homo sapien
gtttcttttggagttcaaatcttcg

SEQ ID NO: 511258 - DNA, 25 bp, Homo sapien
tttggagttcaaatcttcggatatt

SEQ ID NO: 511259 - DNA, 25 bp, Homo sapien
ggagttcaaatcttcggatatttta

SEQ ID NO: 511260 - DNA, 25 bp, Homo sapien
tcaaatcttcggatattttaccctt

SEQ ID NO: 511261 - DNA, 25 bp, Homo sapien
agtcaagacaggaagaaggctcgca

SEQ ID NO: 511262 - DNA, 25 bp, Homo sapien
aagacaggaagaaggctcgcaaagt

SEQ ID NO: 511263 - DNA, 25 bp, Homo sapien
aggcaggttgctgggtaagccatcc

SEQ ID NO: 511264 - DNA, 25 bp, Homo sapien
aggttgctgggtaagccatcctgct

SEQ ID NO: 511265 - DNA, 25 bp, Homo sapien
taagccatcctgctcctacctggtg

SEQ ID NO: 511266 - DNA, 25 bp, Homo sapien
gctgagtgctgtgcgccagtgcctt

SEQ ID NO: 511267 - DNA, 25 bp, Homo sapien
agtgctgtgcgccagtgcctttcct

SEQ ID NO: 511268 - DNA, 25 bp, Homo sapien
tctgcagatggagcccatctctttc

SEQ ID NO: 511269 - DNA, 25 bp, Homo sapien
aggtgtcttgaagagcccaaaggac

SEQ ID NO: 511270 - DNA, 25 bp, Homo sapien
gagcccaaaggacactcacgtgcta

SEQ ID NO: 511271 - DNA, 25 bp, Homo sapien
cactcacgtgctaaggtgtccattt

SEQ ID NO: 511272 - DNA, 25 bp, Homo sapien
cgtgctaaggtgtccattttatgca

SEQ ID NO: 511273 - DNA, 25 bp, Homo sapien
tgccctgtcttagtgccactaacgg

SEQ ID NO: 511274 - DNA, 25 bp, Homo sapien
gagaacattgttcgtattcatctgt

SEQ ID NO: 511275 - DNA, 25 bp, Homo sapien
attgttcgtattcatctgttaggga

SEQ ID NO: 511276 - DNA, 25 bp, Homo sapien
gaagttagggttgtatgtgattata

SEQ ID NO: 511277 - DNA, 25 bp, Homo sapien
taagactagtggaagggatacgttt

SEQ ID NO: 511278 - DNA, 25 bp, Homo sapien
tttttaatgatggatgagttctgca

SEQ ID NO: 511279 - DNA, 25 bp, Homo sapien
gatgagttctgcattctgattcatg

SEQ ID NO: 511280 - DNA, 25 bp, Homo sapien
cattctgattcatgcagtggttaca

SEQ ID NO: 511281 - DNA, 25 bp, Homo sapien
tgattcatgcagtggttacaaaaat

SEQ ID NO: 511282 - DNA, 25 bp, Homo sapien
atgtgcacatttcaccaatgacaat

SEQ ID NO: 511283 - DNA, 25 bp, Homo sapien
ccaatgacaatgtgctggttgtgat

SEQ ID NO: 511284 - DNA, 25 bp, Homo sapien
tgttaatggaaaatatcaccactgg

SEQ ID NO: 511285 - DNA, 25 bp, Homo sapien
tgccagggcaatctctaacttcaat

SEQ ID NO: 511286 - DNA, 25 bp, Homo sapien
tcaatcccgccttcgacagtgaaaa

SEQ ID NO: 511287 - DNA, 25 bp, Homo sapien
gaaaaagctctacttctacgctgac

SEQ ID NO: 511288 - DNA, 25 bp, Homo sapien
tacttctacgctgacccagggagga

SEQ ID NO: 511289 - DNA, 25 bp, Homo sapien
gggaggaaacactaggaccctgttg

SEQ ID NO: 511290 - DNA, 25 bp, Homo sapien
taggaccctgttgtatcctcaactg

SEQ ID NO: 511291 - DNA, 25 bp, Homo sapien
ctgttgggccccacatcatgggaaa

SEQ ID NO: 511292 - DNA, 25 bp, Homo sapien
cccacatcatgggaaaggctgtcaa

SEQ ID NO: 511293 - DNA, 25 bp, Homo sapien
aggctgtcaaataatctttcccaag

SEQ ID NO: 511294 - DNA, 25 bp, Homo sapien
ctgagagggacctagcagaatgaga

SEQ ID NO: 511295 - DNA, 25 bp, Homo sapien
agaagacattcatgtaccacctcct

SEQ ID NO: 511296 - DNA, 25 bp, Homo sapien
gctgttaggagggactctgagcttc

SEQ ID NO: 511297 - DNA, 25 bp, Homo sapien
cacctgtctgctgccatgggtgcag

SEQ ID NO: 511298 - DNA, 25 bp, Homo sapien
ggtgcagagccctagtcctgatggc

SEQ ID NO: 511299 - DNA, 25 bp, Homo sapien
atggcccctggtggcacatatcgaa

SEQ ID NO: 511300 - DNA, 25 bp, Homo sapien
gcacatatcgaatgcctagggcaga

SEQ ID NO: 511301 - DNA, 25 bp, Homo sapien
gaagatgtgacattcctcggtgtta

SEQ ID NO: 511302 - DNA, 25 bp, Homo sapien
ctcggtgttagatcctgttttttct

SEQ ID NO: 511303 - DNA, 25 bp, Homo sapien
tttcttaacaagttgaggcgtgggt

SEQ ID NO: 511304 - DNA, 25 bp, Homo sapien
agagcaggaattggttttccagcat

SEQ ID NO: 511305 - DNA, 25 bp, Homo sapien
ttggttttccagcattgtgtccgta

SEQ ID NO: 511306 - DNA, 25 bp, Homo sapien
taagatgtaacggaagccacgataa

SEQ ID NO: 511307 - DNA, 25 bp, Homo sapien
cattcatcatgttcacaagtgcagg

SEQ ID NO: 511308 - DNA, 25 bp, Homo sapien
agggcaccgggcaagcactggcctc

SEQ ID NO: 511309 - DNA, 25 bp, Homo sapien
tggctcctgcctggaagaattccga

SEQ ID NO: 511310 - DNA, 25 bp, Homo sapien
tggaagaattccgagccagcccatt

SEQ ID NO: 511311 - DNA, 25 bp, Homo sapien
agccagcccatttctagaatgtcat

SEQ ID NO: 511312 - DNA, 25 bp, Homo sapien
tcatggaagaggaacgtgcaactac

SEQ ID NO: 511313 - DNA, 25 bp, Homo sapien
gtgcaactactattcaaattcctac

SEQ ID NO: 511314 - DNA, 25 bp, Homo sapien
aaattcctacagtttctggctggct

SEQ ID NO: 511315 - DNA, 25 bp, Homo sapien
tcctacagtttctggctggcttcat

SEQ ID NO: 511316 - DNA, 25 bp, Homo sapien
tggcttcattaaacccagaaagaat

SEQ ID NO: 511317 - DNA, 25 bp, Homo sapien
agaatgttcagaaagcctattccat

SEQ ID NO: 511318 - DNA, 25 bp, Homo sapien
tgagtgatgggtacgacatcaaaac

SEQ ID NO: 511319 - DNA, 25 bp, Homo sapien
atgggtacgacatcaaaacatggct

SEQ ID NO: 511320 - DNA, 25 bp, Homo sapien
gggtacgacatcaaaacatggctca

SEQ ID NO: 511321 - DNA, 25 bp, Homo sapien
gtacgacatcaaaacatggctcagt

SEQ ID NO: 511322 - DNA, 25 bp, Homo sapien
tcaaaacatggctcagtggtatcac

SEQ ID NO: 511323 - DNA, 25 bp, Homo sapien
aaaacatggctcagtggtatcacga

SEQ ID NO: 511324 - DNA, 25 bp, Homo sapien
acatggctcagtggtatcacgagaa

SEQ ID NO: 511325 - DNA, 25 bp, Homo sapien
tatcacgagaactttggttggtggt

SEQ ID NO: 511326 - DNA, 25 bp, Homo sapien
ataaaggataggtcggaatggtact

SEQ ID NO: 511327 - DNA, 25 bp, Homo sapien
ggtcggaatggtacttaaaatgcta

SEQ ID NO: 511328 - DNA, 25 bp, Homo sapien
ggaatggtacttaaaatgctagcat

SEQ ID NO: 511329 - DNA, 25 bp, Homo sapien
taaggcagaattgaggagcatgacc

SEQ ID NO: 511330 - DNA, 25 bp, Homo sapien
ggagcatgacctttggcatatcatc

SEQ ID NO: 511331 - DNA, 25 bp, Homo sapien
gacctttggcatatcatcagagtaa

SEQ ID NO: 511332 - DNA, 25 bp, Homo sapien
ggcatatcatcagagtaatagcagt

SEQ ID NO: 511333 - DNA, 25 bp, Homo sapien
atgttgatggcaaaagtggcttgtc

SEQ ID NO: 511334 - DNA, 25 bp, Homo sapien
gatggcaaaagtggcttgtcagaac

SEQ ID NO: 511335 - DNA, 25 bp, Homo sapien
gtggcttgtcagaactttaaactct

SEQ ID NO: 511336 - DNA, 25 bp, Homo sapien
gaactttaaactcttagccaggctt

SEQ ID NO: 511337 - DNA, 25 bp, Homo sapien
actttaaactcttagccaggcttgg

SEQ ID NO: 511338 - DNA, 25 bp, Homo sapien
gtaatcctagctacaagtaagactg

SEQ ID NO: 511339 - DNA, 25 bp, Homo sapien
gagatgagaggatcccctgagggaa

SEQ ID NO: 511340 - DNA, 25 bp, Homo sapien
aacttcataaataatagctgtgctt

SEQ ID NO: 511341 - DNA, 25 bp, Homo sapien
gctgtgctttagataccagataaca

SEQ ID NO: 511342 - DNA, 25 bp, Homo sapien
gtttcccctgaagatatgacctact

SEQ ID NO: 511343 - DNA, 25 bp, Homo sapien
gatatgacctactagaactactcac

SEQ ID NO: 511344 - DNA, 25 bp, Homo sapien
gaactactcacatatatagtccaat

SEQ ID NO: 511345 - DNA, 25 bp, Homo sapien
gtccaataattactgacttaatagg

SEQ ID NO: 511346 - DNA, 25 bp, Homo sapien
gactctcaagagtttctgtaccttg

SEQ ID NO: 511347 - DNA, 25 bp, Homo sapien
gagtttctgtaccttgattattgac

SEQ ID NO: 511348 - DNA, 25 bp, Homo sapien
gtaccttgattattgacaaattcat

SEQ ID NO: 511349 - DNA, 25 bp, Homo sapien
atcctactaaagaacatgtgtgtgg

SEQ ID NO: 511350 - DNA, 25 bp, Homo sapien
gggaactggttcacaacataatctg

SEQ ID NO: 511351 - DNA, 25 bp, Homo sapien
gtgggaagcacaactgagaggactt

SEQ ID NO: 511352 - DNA, 25 bp, Homo sapien
gggaagcacaactgagaggacttga

SEQ ID NO: 511353 - DNA, 25 bp, Homo sapien
ggaagcacaactgagaggacttgaa

SEQ ID NO: 511354 - DNA, 25 bp, Homo sapien
aagcacaactgagaggacttgaagg

SEQ ID NO: 511355 - DNA, 25 bp, Homo sapien
agcttgcagtgagtccagaattgcc

SEQ ID NO: 511356 - DNA, 25 bp, Homo sapien
gcttgcagtgagtccagaattgcca

SEQ ID NO: 511357 - DNA, 25 bp, Homo sapien
cttgcagtgagtccagaattgccac

SEQ ID NO: 511358 - DNA, 25 bp, Homo sapien
ttgcagtgagtccagaattgccact

SEQ ID NO: 511359 - DNA, 25 bp, Homo sapien
agtgagtccagaattgccactgcgc

SEQ ID NO: 511360 - DNA, 25 bp, Homo sapien
gtgagtccagaattgccactgcgct

SEQ ID NO: 511361 - DNA, 25 bp, Homo sapien
tgagtccagaattgccactgcgctc

SEQ ID NO: 511362 - DNA, 25 bp, Homo sapien
attttatacttggtccttgcaatgg

SEQ ID NO: 511363 - DNA, 25 bp, Homo sapien
ggtccttgcaatggtgtgagtttta

SEQ ID NO: 511364 - DNA, 25 bp, Homo sapien
gattgcattatcgtgattggtggtt

SEQ ID NO: 511365 - DNA, 25 bp, Homo sapien
atcgtgattggtggttatgagtttc

SEQ ID NO: 511366 - DNA, 25 bp, Homo sapien
cagaaatctatacttggcatccaac

SEQ ID NO: 511367 - DNA, 25 bp, Homo sapien
gcatccaactcatgagtggatttta

SEQ ID NO: 511368 - DNA, 25 bp, Homo sapien
ggaaggtatgtcctgtcagtatctt

SEQ ID NO: 511369 - DNA, 25 bp, Homo sapien
ctgtcagtatcttaaccctttcaac

SEQ ID NO: 511370 - DNA, 25 bp, Homo sapien
cctttcaacaagacatttacctatt

SEQ ID NO: 511371 - DNA, 25 bp, Homo sapien
ctatttgtctttccttacgttctca

SEQ ID NO: 511372 - DNA, 25 bp, Homo sapien
gtctttccttacgttctcaaaatat

SEQ ID NO: 511373 - DNA, 25 bp, Homo sapien
aaaaggtgcacagcgccagcagagg

SEQ ID NO: 511374 - DNA, 25 bp, Homo sapien
cgggctccaaacaaacagggcaggt

SEQ ID NO: 511375 - DNA, 25 bp, Homo sapien
gaggaggcttccacttagtaatgta

SEQ ID NO: 511376 - DNA, 25 bp, Homo sapien
aatgtatgcccctaagtagcttcga

SEQ ID NO: 511377 - DNA, 25 bp, Homo sapien
agtagcttcgaatcactgtgtccgt

SEQ ID NO: 511378 - DNA, 25 bp, Homo sapien
caacgaaataatcatctgtccctcc

SEQ ID NO: 511379 - DNA, 25 bp, Homo sapien
gggatgtttgactcatcagccctct

SEQ ID NO: 511380 - DNA, 25 bp, Homo sapien
cagggcaggtatacgccttgggtaa

SEQ ID NO: 511381 - DNA, 25 bp, Homo sapien
caagcaggcgctaagtttgaatctt

SEQ ID NO: 511382 - DNA, 25 bp, Homo sapien
aaatctccaggtaaggcttccaaag

SEQ ID NO: 511383 - DNA, 25 bp, Homo sapien
aaagagatcggtgcccagcatgctt

SEQ ID NO: 511384 - DNA, 25 bp, Homo sapien
tagcattctaatctagagttcgttt

SEQ ID NO: 511385 - DNA, 25 bp, Homo sapien
atgtggtatgagtatacttcctggg

SEQ ID NO: 511386 - DNA, 25 bp, Homo sapien
ctgtttacatattgacttgtttttc

SEQ ID NO: 511387 - DNA, 25 bp, Homo sapien
aatttgtttcgtcatccaaggtgca

SEQ ID NO: 511388 - DNA, 25 bp, Homo sapien
gtttcgtcatccaaggtgcaaataa

SEQ ID NO: 511389 - DNA, 25 bp, Homo sapien
gtgcaaataaaagtcctgagagttt

SEQ ID NO: 511390 - DNA, 25 bp, Homo sapien
tacttcctgggtaatgagaatggca

SEQ ID NO: 511391 - DNA, 25 bp, Homo sapien
ggcaaacacttgtgattacctagtt

SEQ ID NO: 511392 - DNA, 25 bp, Homo sapien
gattacctagttgtcaagatgatta

SEQ ID NO: 511393 - DNA, 25 bp, Homo sapien
gatgattactaattctaacctagca

SEQ ID NO: 511394 - DNA, 25 bp, Homo sapien
aattctaacctagcattctaatcta

SEQ ID NO: 511395 - DNA, 25 bp, Homo sapien
tttttctgaaactcacacaactagg

SEQ ID NO: 511396 - DNA, 25 bp, Homo sapien
gtggctgagtcaggacttgaaccca

SEQ ID NO: 511397 - DNA, 25 bp, Homo sapien
aggtctccctggatcagaacaggag

SEQ ID NO: 511398 - DNA, 25 bp, Homo sapien
ggagctcttaactacagtggctgaa

SEQ ID NO: 511399 - DNA, 25 bp, Homo sapien
gtggctgaatagcttctccaaaggc

SEQ ID NO: 511400 - DNA, 25 bp, Homo sapien
tgtgttctcaccgtgatcaagttga

SEQ ID NO: 511401 - DNA, 25 bp, Homo sapien
agcctcagaaaccagactcgttctt

SEQ ID NO: 511402 - DNA, 25 bp, Homo sapien
agactcgttcttctgggaaccctgc

SEQ ID NO: 511403 - DNA, 25 bp, Homo sapien
aggaccaagattggcctgaggctgc

SEQ ID NO: 511404 - DNA, 25 bp, Homo sapien
gcctgaggctgcactaaaattcact

SEQ ID NO: 511405 - DNA, 25 bp, Homo sapien
attcacttagggtcgagcatcctgt

SEQ ID NO: 511406 - DNA, 25 bp, Homo sapien
aagatctcttgaaggttgctccgaa

SEQ ID NO: 511407 - DNA, 25 bp, Homo sapien
gaaggttgctccgaagcccatggga

SEQ ID NO: 511408 - DNA, 25 bp, Homo sapien
agcccatgggagtgaatgttccggt

SEQ ID NO: 511409 - DNA, 25 bp, Homo sapien
ctctgtaccactcgttagtagtctg

SEQ ID NO: 511410 - DNA, 25 bp, Homo sapien
ttagtagtctggttggtggccgcca

SEQ ID NO: 511411 - DNA, 25 bp, Homo sapien
ggtggccgccagatacaggacaaac

SEQ ID NO: 511412 - DNA, 25 bp, Homo sapien
aaacaacaggtagccacccaggagg

SEQ ID NO: 511413 - DNA, 25 bp, Homo sapien
gaggaagctcagaaccacgacaaag

SEQ ID NO: 511414 - DNA, 25 bp, Homo sapien
tcagaaccacgacaaagcccagcat

SEQ ID NO: 511415 - DNA, 25 bp, Homo sapien
aagcccagcatgaagacaatccgtg

SEQ ID NO: 511416 - DNA, 25 bp, Homo sapien
gtcaggaacaggtactaggagcaga

SEQ ID NO: 511417 - DNA, 25 bp, Homo sapien
actgttcctctttcacagctggaat

SEQ ID NO: 511418 - DNA, 25 bp, Homo sapien
tcacagctggaatatgtcacatgat

SEQ ID NO: 511419 - DNA, 25 bp, Homo sapien
atggccaggattgccgtggtcccta

SEQ ID NO: 511420 - DNA, 25 bp, Homo sapien
gattgccgtggtccctagctagatc

SEQ ID NO: 511421 - DNA, 25 bp, Homo sapien
tagctagatccccttcctatcaatc

SEQ ID NO: 511422 - DNA, 25 bp, Homo sapien
tatcaatcacctgatagcaacaggg

SEQ ID NO: 511423 - DNA, 25 bp, Homo sapien
agggacagctgccaataccctgctc

SEQ ID NO: 511424 - DNA, 25 bp, Homo sapien
aataccctgctctttactcaatggt

SEQ ID NO: 511425 - DNA, 25 bp, Homo sapien
gctctttactcaatggtacccaggg

SEQ ID NO: 511426 - DNA, 25 bp, Homo sapien
acagccactgggtgagctgttcacg

SEQ ID NO: 511427 - DNA, 25 bp, Homo sapien
gagctgttcacggtcttatactatt

SEQ ID NO: 511428 - DNA, 25 bp, Homo sapien
tcggccctccagcagcaacatgaag

SEQ ID NO: 511429 - DNA, 25 bp, Homo sapien
gccctccagcagcaacatgaagcga

SEQ ID NO: 511430 - DNA, 25 bp, Homo sapien
aacatgaagcgagcagcctccttga

SEQ ID NO: 511431 - DNA, 25 bp, Homo sapien
gaagcgagcagcctccttgaactat

SEQ ID NO: 511432 - DNA, 25 bp, Homo sapien
gagcagcctccttgaactatctgaa

SEQ ID NO: 511433 - DNA, 25 bp, Homo sapien
agcctccttgaactatctgaaccaa

SEQ ID NO: 511434 - DNA, 25 bp, Homo sapien
gaactatctgaaccaacctagtgca

SEQ ID NO: 511435 - DNA, 25 bp, Homo sapien
atctgaaccaacctagtgcagcacc

SEQ ID NO: 511436 - DNA, 25 bp, Homo sapien
catggacctctcttcaagcagctga

SEQ ID NO: 511437 - DNA, 25 bp, Homo sapien
gacctctcttcaagcagctgacatt

SEQ ID NO: 511438 - DNA, 25 bp, Homo sapien
aagcagctgacattcaacccggccc

SEQ ID NO: 511439 - DNA, 25 bp, Homo sapien
tgcttgcctgggtctttgtgcttcc

SEQ ID NO: 511440 - DNA, 25 bp, Homo sapien
gtgatgccaccattcctaggagagg

SEQ ID NO: 511441 - DNA, 25 bp, Homo sapien
aaaactgtgtgaacggtgaactttg

SEQ ID NO: 511442 - DNA, 25 bp, Homo sapien
tgaagatcaatcttgcacttggtga

SEQ ID NO: 511443 - DNA, 25 bp, Homo sapien
agtgcacattggacctcaaggcgaa

SEQ ID NO: 511444 - DNA, 25 bp, Homo sapien
acctcaaggcgaaagccagtggttt

SEQ ID NO: 511445 - DNA, 25 bp, Homo sapien
aaaatgttcccgcatgaggccacag

SEQ ID NO: 511446 - DNA, 25 bp, Homo sapien
ccgcatgaggccacaggactgagga

SEQ ID NO: 511447 - DNA, 25 bp, Homo sapien
agaagatggtctgacttccaggctt

SEQ ID NO: 511448 - DNA, 25 bp, Homo sapien
caggcttcctggtcaaagagagcta

SEQ ID NO: 511449 - DNA, 25 bp, Homo sapien
gagagctacgtttgggcagttctgc

SEQ ID NO: 511450 - DNA, 25 bp, Homo sapien
ttgactttacagagcagtgtgtgag

SEQ ID NO: 511451 - DNA, 25 bp, Homo sapien
aatgaaaacaacaacctccactctt

SEQ ID NO: 511452 - DNA, 25 bp, Homo sapien
caacaacctccactctttagtttat

SEQ ID NO: 511453 - DNA, 25 bp, Homo sapien
aaagatctacacttgagttgggaac

SEQ ID NO: 511454 - DNA, 25 bp, Homo sapien
aatggacttccatctgttttactgg

SEQ ID NO: 511455 - DNA, 25 bp, Homo sapien
aggaaatcctctgatggacaggtca

SEQ ID NO: 511456 - DNA, 25 bp, Homo sapien
gttgtgctggtaagacatctctgac

SEQ ID NO: 511457 - DNA, 25 bp, Homo sapien
aagacatctctgacgaagagccatg

SEQ ID NO: 511458 - DNA, 25 bp, Homo sapien
gaagagccatggatgctttccacaa

SEQ ID NO: 511459 - DNA, 25 bp, Homo sapien
atgctttccacaaaatgtcacctcg

SEQ ID NO: 511460 - DNA, 25 bp, Homo sapien
atgtcacctcgctgcactaaaggat

SEQ ID NO: 511461 - DNA, 25 bp, Homo sapien
gctggccccttctgtaggatggtag

SEQ ID NO: 511462 - DNA, 25 bp, Homo sapien
tggccccttctgtaggatggtagca

SEQ ID NO: 511463 - DNA, 25 bp, Homo sapien
gccccttctgtaggatggtagcaca

SEQ ID NO: 511464 - DNA, 25 bp, Homo sapien
ccttctgtaggatggtagcacacaa

SEQ ID NO: 511465 - DNA, 25 bp, Homo sapien
gtaggatggtagcacacaaccaggt

SEQ ID NO: 511466 - DNA, 25 bp, Homo sapien
gatggtagcacacaaccaggtggca

SEQ ID NO: 511467 - DNA, 25 bp, Homo sapien
caggtggcagccgacaatgcagtct

SEQ ID NO: 511468 - DNA, 25 bp, Homo sapien
gtggcagccgacaatgcagtctcca

SEQ ID NO: 511469 - DNA, 25 bp, Homo sapien
tggcagccgacaatgcagtctccac

SEQ ID NO: 511470 - DNA, 25 bp, Homo sapien
agcagagccccgacggcggccagaa

SEQ ID NO: 511471 - DNA, 25 bp, Homo sapien
gcacattccgttcgcacgccgatta

SEQ ID NO: 511472 - DNA, 25 bp, Homo sapien
tatttttcactacctttggagaaca

SEQ ID NO: 511473 - DNA, 25 bp, Homo sapien
tttcactacctttggagaacagatg

SEQ ID NO: 511474 - DNA, 25 bp, Homo sapien
tacctttggagaacagatgaacatt

SEQ ID NO: 511475 - DNA, 25 bp, Homo sapien
attattcaccatgaatggatctata

SEQ ID NO: 511476 - DNA, 25 bp, Homo sapien
gaatggatctatactgtgtggtcat

SEQ ID NO: 511477 - DNA, 25 bp, Homo sapien
ctatactgtgtggtcatgagttgtg

SEQ ID NO: 511478 - DNA, 25 bp, Homo sapien
gttgtgtatacttccataacactgt

SEQ ID NO: 511479 - DNA, 25 bp, Homo sapien
tacttccataacactgtatttttct

SEQ ID NO: 511480 - DNA, 25 bp, Homo sapien
acaccttaaggtctgatgttatggc

SEQ ID NO: 511481 - DNA, 25 bp, Homo sapien
ccttaaggtctgatgttatggcaac

SEQ ID NO: 511482 - DNA, 25 bp, Homo sapien
tgttatggcaacaaactactttttc

SEQ ID NO: 511483 - DNA, 25 bp, Homo sapien
gaagccaagggtcaagaatgcagaa

SEQ ID NO: 511484 - DNA, 25 bp, Homo sapien
ggactaaaaagcctccacggacatc

SEQ ID NO: 511485 - DNA, 25 bp, Homo sapien
agcctccacggacatcgataatcaa

SEQ ID NO: 511486 - DNA, 25 bp, Homo sapien
agatctttgctagaagagttccttt

SEQ ID NO: 511487 - DNA, 25 bp, Homo sapien
tagaagagttcctttacctgtactt

SEQ ID NO: 511488 - DNA, 25 bp, Homo sapien
gaatgacttctgcaactgtagtccc

SEQ ID NO: 511489 - DNA, 25 bp, Homo sapien
agctgccctgcaggatccagttttt

SEQ ID NO: 511490 - DNA, 25 bp, Homo sapien
tttcttgggaggttgtatctggtca

SEQ ID NO: 511491 - DNA, 25 bp, Homo sapien
gtatctggtcataaggtaaacattc

SEQ ID NO: 511492 - DNA, 25 bp, Homo sapien
ttctatatattctatgcctgctcta

SEQ ID NO: 511493 - DNA, 25 bp, Homo sapien
atgcctgctctagaattgaaagact

SEQ ID NO: 511494 - DNA, 25 bp, Homo sapien
attagggccactatctaaagcatag

SEQ ID NO: 511495 - DNA, 25 bp, Homo sapien
ggctggcacatcacctcaatagagg

SEQ ID NO: 511496 - DNA, 25 bp, Homo sapien
agaggttacctattcttgttgccac

SEQ ID NO: 511497 - DNA, 25 bp, Homo sapien
tgttgccacttagcctcatatgtac

SEQ ID NO: 511498 - DNA, 25 bp, Homo sapien
tagcctcatatgtaccatgttttac

SEQ ID NO: 511499 - DNA, 25 bp, Homo sapien
tacttaataccttcattgtccttta

SEQ ID NO: 511500 - DNA, 25 bp, Homo sapien
gaattacagtgcttcattcagcata

SEQ ID NO: 511501 - DNA, 25 bp, Homo sapien
gcataagacttttgttcatgctgtt

SEQ ID NO: 511502 - DNA, 25 bp, Homo sapien
ttggcctgaaatatctatcccttcc

SEQ ID NO: 511503 - DNA, 25 bp, Homo sapien
tatcccttcccaattgcctaattaa

SEQ ID NO: 511504 - DNA, 25 bp, Homo sapien
gtctttcagatcttagctagttcat

SEQ ID NO: 511505 - DNA, 25 bp, Homo sapien
gataccatgcagacattttgcttgt

SEQ ID NO: 511506 - DNA, 25 bp, Homo sapien
gacattttgcttgttcaaaccaaca

SEQ ID NO: 511507 - DNA, 25 bp, Homo sapien
tgttcaaaccaacaagacccagcac

SEQ ID NO: 511508 - DNA, 25 bp, Homo sapien
cattattatgcagccagcggttctc

SEQ ID NO: 511509 - DNA, 25 bp, Homo sapien
tgcagccagcggttctcttgtggag

SEQ ID NO: 511510 - DNA, 25 bp, Homo sapien
gggcaggtgacgtttcagaagacac

SEQ ID NO: 511511 - DNA, 25 bp, Homo sapien
gacgtttcagaagacaccgagctgg

SEQ ID NO: 511512 - DNA, 25 bp, Homo sapien
gacaccgagctggatgggactacct

SEQ ID NO: 511513 - DNA, 25 bp, Homo sapien
atgggactacctttctgttcatcac

SEQ ID NO: 511514 - DNA, 25 bp, Homo sapien
gttcatcaccacacagcagaatttc

SEQ ID NO: 511515 - DNA, 25 bp, Homo sapien
agaatgcattgacaggttctttgcg

SEQ ID NO: 511516 - DNA, 25 bp, Homo sapien
gaaatttgtttggacttccacttga

SEQ ID NO: 511517 - DNA, 25 bp, Homo sapien
tccaatttacatccacattttaggt

SEQ ID NO: 511518 - DNA, 25 bp, Homo sapien
tacatccacattttaggtccaacag

SEQ ID NO: 511519 - DNA, 25 bp, Homo sapien
aggtccaacagcaagaagttcagag

SEQ ID NO: 511520 - DNA, 25 bp, Homo sapien
ttcagagagagatttcccaaccaga

SEQ ID NO: 511521 - DNA, 25 bp, Homo sapien
gagagatttcccaaccagacattgg

SEQ ID NO: 511522 - DNA, 25 bp, Homo sapien
agacattgggtcactcactggtcac

SEQ ID NO: 511523 - DNA, 25 bp, Homo sapien
caccttgccagtgcattttattaga

SEQ ID NO: 511524 - DNA, 25 bp, Homo sapien
agaagggaatctgttgtagcaaatg

SEQ ID NO: 511525 - DNA, 25 bp, Homo sapien
tagcaaatgggaataaacctgggtt

SEQ ID NO: 511526 - DNA, 25 bp, Homo sapien
taaacctgggtttctatagacccag

SEQ ID NO: 511527 - DNA, 25 bp, Homo sapien
gaggtgattctgttgcactcttgac

SEQ ID NO: 511528 - DNA, 25 bp, Homo sapien
tgattctgttgcactcttgactttc

SEQ ID NO: 511529 - DNA, 25 bp, Homo sapien
actcttgactttcagaaccactcag

SEQ ID NO: 511530 - DNA, 25 bp, Homo sapien
gactttcagaaccactcaggagatt

SEQ ID NO: 511531 - DNA, 25 bp, Homo sapien
caggagattacacactttggaaaaa

SEQ ID NO: 511532 - DNA, 25 bp, Homo sapien
attgtttttctgataggactttctt

SEQ ID NO: 511533 - DNA, 25 bp, Homo sapien
ggactttcttaaatagcagacccta

SEQ ID NO: 511534 - DNA, 25 bp, Homo sapien
gaccctatgagtctgtttacatttg

SEQ ID NO: 511535 - DNA, 25 bp, Homo sapien
aggattcaggttatatatatcactt

SEQ ID NO: 511536 - DNA, 25 bp, Homo sapien
cttgtcagtcatcgcgaggtgattc

SEQ ID NO: 511537 - DNA, 25 bp, Homo sapien
gtcatcgcgaggtgattctgttgca

SEQ ID NO: 511538 - DNA, 25 bp, Homo sapien
gatatcaatggcaaactgtttcttc

SEQ ID NO: 511539 - DNA, 25 bp, Homo sapien
tgtttcttcccaaatatgctctgtc

SEQ ID NO: 511540 - DNA, 25 bp, Homo sapien
ctctgtcccaggatgtttgcacata

SEQ ID NO: 511541 - DNA, 25 bp, Homo sapien
tagagacttcatctacaggactgta

SEQ ID NO: 511542 - DNA, 25 bp, Homo sapien
gaaataccaggatgcccactccatg

SEQ ID NO: 511543 - DNA, 25 bp, Homo sapien
catgttgctccctatttttcctatc

SEQ ID NO: 511544 - DNA, 25 bp, Homo sapien
ttttcctatcctgttgctttaagct

SEQ ID NO: 511545 - DNA, 25 bp, Homo sapien
gtggcaagtgcaatactgactatag

SEQ ID NO: 511546 - DNA, 25 bp, Homo sapien
gtgactgcatacatgaagccatcaa

SEQ ID NO: 511547 - DNA, 25 bp, Homo sapien
tgtaccaaacctcagaagtcttatc

SEQ ID NO: 511548 - DNA, 25 bp, Homo sapien
gtcttatctggtaggattttctgtc

SEQ ID NO: 511549 - DNA, 25 bp, Homo sapien
tggtaataatttccctcttttgtag

SEQ ID NO: 511550 - DNA, 25 bp, Homo sapien
aatttccctcttttgtagtctgcac

SEQ ID NO: 511551 - DNA, 25 bp, Homo sapien
tcttttgtagtctgcacaagatcca

SEQ ID NO: 511552 - DNA, 25 bp, Homo sapien
gattaaatttagtctgcacagtgag

SEQ ID NO: 511553 - DNA, 25 bp, Homo sapien
tagtctgcacagtgagcaagggttc

SEQ ID NO: 511554 - DNA, 25 bp, Homo sapien
gagcaagggttcacatgcattcttt

SEQ ID NO: 511555 - DNA, 25 bp, Homo sapien
ggttcacatgcattcttttatactg

SEQ ID NO: 511556 - DNA, 25 bp, Homo sapien
attttgttgtgcatcatttaaaaca

SEQ ID NO: 511557 - DNA, 25 bp, Homo sapien
tgtatgtttcttcttatctgtgtat

SEQ ID NO: 511558 - DNA, 25 bp, Homo sapien
ctgtgtatacagtatgttcttgaat

SEQ ID NO: 511559 - DNA, 25 bp, Homo sapien
gatgttcatttgtcaggagaactgt

SEQ ID NO: 511560 - DNA, 25 bp, Homo sapien
aaatattgttttgtgtgactgaatg

SEQ ID NO: 511561 - DNA, 25 bp, Homo sapien
tattgttttgtgtgactgaatgtgt

SEQ ID NO: 511562 - DNA, 25 bp, Homo sapien
tgactgaatgtgttagctcatgcct

SEQ ID NO: 511563 - DNA, 25 bp, Homo sapien
gactgaatgtgttagctcatgcctg

SEQ ID NO: 511564 - DNA, 25 bp, Homo sapien
tcccgttgatcaccagggttgaatt

SEQ ID NO: 511565 - DNA, 25 bp, Homo sapien
cccgttgatcaccagggttgaattt

SEQ ID NO: 511566 - DNA, 25 bp, Homo sapien
cgttgatcaccagggttgaatttat

SEQ ID NO: 511567 - DNA, 25 bp, Homo sapien
gatcaccagggttgaatttattaaa

SEQ ID NO: 511568 - DNA, 25 bp, Homo sapien
tcaccagggttgaatttattaaatt

SEQ ID NO: 511569 - DNA, 25 bp, Homo sapien
ttaggcatattaattcattgaagtt

SEQ ID NO: 511570 - DNA, 25 bp, Homo sapien
ggcatattaattcattgaagttgac

SEQ ID NO: 511571 - DNA, 25 bp, Homo sapien
aatggatagttaagggaggttgtct

SEQ ID NO: 511572 - DNA, 25 bp, Homo sapien
ggaggttgtctgaacagggattata

SEQ ID NO: 511573 - DNA, 25 bp, Homo sapien
ggttgtctgaacagggattataatt

SEQ ID NO: 511574 - DNA, 25 bp, Homo sapien
cagggattataattagtttacatac

SEQ ID NO: 511575 - DNA, 25 bp, Homo sapien
gggattataattagtttacatacat

SEQ ID NO: 511576 - DNA, 25 bp, Homo sapien
ttacatacatactccttaaacagat

SEQ ID NO: 511577 - DNA, 25 bp, Homo sapien
acatacatactccttaaacagataa

SEQ ID NO: 511578 - DNA, 25 bp, Homo sapien
atacatactccttaaacagataaat

SEQ ID NO: 511579 - DNA, 25 bp, Homo sapien
catactccttaaacagataaataca

SEQ ID NO: 511580 - DNA, 25 bp, Homo sapien
gataaatacattacacctttcaaag

SEQ ID NO: 511581 - DNA, 25 bp, Homo sapien
ataaatacattacacctttcaaaga

SEQ ID NO: 511582 - DNA, 25 bp, Homo sapien
attagagaactgacatgagaaaaga

SEQ ID NO: 511583 - DNA, 25 bp, Homo sapien
gaaaagaggagctgttttggtatta

SEQ ID NO: 511584 - DNA, 25 bp, Homo sapien
ggagctgttttggtattaaacgaat

SEQ ID NO: 511585 - DNA, 25 bp, Homo sapien
agcagatacagtttatccacatttg

SEQ ID NO: 511586 - DNA, 25 bp, Homo sapien
gatacagtttatccacatttgtaaa

SEQ ID NO: 511587 - DNA, 25 bp, Homo sapien
aaaagttccaagtctcattgcaatc

SEQ ID NO: 511588 - DNA, 25 bp, Homo sapien
gttccaagtctcattgcaatcattc

SEQ ID NO: 511589 - DNA, 25 bp, Homo sapien
agtctcattgcaatcattctttgta

SEQ ID NO: 511590 - DNA, 25 bp, Homo sapien
gcaatcattctttgtaaaggctgac

SEQ ID NO: 511591 - DNA, 25 bp, Homo sapien
aaaggctgacttgtaatgaatatgt

SEQ ID NO: 511592 - DNA, 25 bp, Homo sapien
catcttgttctagaagagtttaaag

SEQ ID NO: 511593 - DNA, 25 bp, Homo sapien
taaaatcctttctattctgagacta

SEQ ID NO: 511594 - DNA, 25 bp, Homo sapien
aaatcctttctattctgagactaat

SEQ ID NO: 511595 - DNA, 25 bp, Homo sapien
gctcattcttctgaatctaatatca

SEQ ID NO: 511596 - DNA, 25 bp, Homo sapien
tctgaatctaatatcactaactcct

SEQ ID NO: 511597 - DNA, 25 bp, Homo sapien
ttttctttggatacactttaagtag

SEQ ID NO: 511598 - DNA, 25 bp, Homo sapien
acactttaagtaggaatttatcaga

SEQ ID NO: 511599 - DNA, 25 bp, Homo sapien
atcagaattttcattcaactcgttc

SEQ ID NO: 511600 - DNA, 25 bp, Homo sapien
gaattttcattcaactcgttcttta

SEQ ID NO: 511601 - DNA, 25 bp, Homo sapien
cattcaactcgttctttaatgcaga

SEQ ID NO: 511602 - DNA, 25 bp, Homo sapien
gttctttaatgcagatatttactag

SEQ ID NO: 511603 - DNA, 25 bp, Homo sapien
gttataagaccttaaggctgggtgc

SEQ ID NO: 511604 - DNA, 25 bp, Homo sapien
cccggaccacaggagccagtatatg

SEQ ID NO: 511605 - DNA, 25 bp, Homo sapien
aggagccagtatatgtgttgagaca

SEQ ID NO: 511606 - DNA, 25 bp, Homo sapien
ggcgggaggacctacacatgtctac

SEQ ID NO: 511607 - DNA, 25 bp, Homo sapien
tacacatgtctacagccatgcacat

SEQ ID NO: 511608 - DNA, 25 bp, Homo sapien
tgtctacagccatgcacatgctcct

SEQ ID NO: 511609 - DNA, 25 bp, Homo sapien
agtctgggccatgccaaaaggtcca

SEQ ID NO: 511610 - DNA, 25 bp, Homo sapien
aaaggtccagggttcatgcccagga

SEQ ID NO: 511611 - DNA, 25 bp, Homo sapien
gttcatgcccaggaagagtacttcc

SEQ ID NO: 511612 - DNA, 25 bp, Homo sapien
ggccctggcagtagcgagtcacgta

SEQ ID NO: 511613 - DNA, 25 bp, Homo sapien
gtagcgagtcacgtagttgcgatgt

SEQ ID NO: 511614 - DNA, 25 bp, Homo sapien
tagttgcgatgtggctaccatgcat

SEQ ID NO: 511615 - DNA, 25 bp, Homo sapien
cagtggaaattttcggcgcacccga

SEQ ID NO: 511616 - DNA, 25 bp, Homo sapien
aattttcggcgcacccgatatttgc

SEQ ID NO: 511617 - DNA, 25 bp, Homo sapien
ggattgtgcgcgtaccactcccgca

SEQ ID NO: 511618 - DNA, 25 bp, Homo sapien
agcttctcggcctccacgtaatgcg

SEQ ID NO: 511619 - DNA, 25 bp, Homo sapien
cacgtaatgcgccttcagccacagt

SEQ ID NO: 511620 - DNA, 25 bp, Homo sapien
tgaggcgagaactggtggctctcca

SEQ ID NO: 511621 - DNA, 25 bp, Homo sapien
ggtggctctccaggatcttgtagag

SEQ ID NO: 511622 - DNA, 25 bp, Homo sapien
ccaggatcttgtagagctcacggaa

SEQ ID NO: 511623 - DNA, 25 bp, Homo sapien
tagagctcacggaagttgccgcggt

SEQ ID NO: 511624 - DNA, 25 bp, Homo sapien
tccttgaagcagtagctggtctcct

SEQ ID NO: 511625 - DNA, 25 bp, Homo sapien
atggtgcgcggcagtggaaattttc

SEQ ID NO: 511626 - DNA, 25 bp, Homo sapien
ttcagagaggcccagtaagaggtat

SEQ ID NO: 511627 - DNA, 25 bp, Homo sapien
cagagaggcccagtaagaggtatct

SEQ ID NO: 511628 - DNA, 25 bp, Homo sapien
gagaggcccagtaagaggtatctcc

SEQ ID NO: 511629 - DNA, 25 bp, Homo sapien
agaggcccagtaagaggtatctcca

SEQ ID NO: 511630 - DNA, 25 bp, Homo sapien
gaggcccagtaagaggtatctccat

SEQ ID NO: 511631 - DNA, 25 bp, Homo sapien
aggcccagtaagaggtatctccatc

SEQ ID NO: 511632 - DNA, 25 bp, Homo sapien
ggcccagtaagaggtatctccatca

SEQ ID NO: 511633 - DNA, 25 bp, Homo sapien
gcccagtaagaggtatctccatcaa

SEQ ID NO: 511634 - DNA, 25 bp, Homo sapien
cccagtaagaggtatctccatcaag

SEQ ID NO: 511635 - DNA, 25 bp, Homo sapien
cagtaagaggtatctccatcaagct

SEQ ID NO: 511636 - DNA, 25 bp, Homo sapien
agtaagaggtatctccatcaagctg

SEQ ID NO: 511637 - DNA, 25 bp, Homo sapien
agtgtcttttcttcatgcacacctg

SEQ ID NO: 511638 - DNA, 25 bp, Homo sapien
tcttttcttcatgcacacctgacag

SEQ ID NO: 511639 - DNA, 25 bp, Homo sapien
tttcttcatgcacacctgacagcga

SEQ ID NO: 511640 - DNA, 25 bp, Homo sapien
ttcatgcacacctgacagcgactta

SEQ ID NO: 511641 - DNA, 25 bp, Homo sapien
tgcacacctgacagcgacttattat

SEQ ID NO: 511642 - DNA, 25 bp, Homo sapien
acacctgacagcgacttattatttt

SEQ ID NO: 511643 - DNA, 25 bp, Homo sapien
cctgacagcgacttattattttttc

SEQ ID NO: 511644 - DNA, 25 bp, Homo sapien
tttctaattccccagctttcacagt

SEQ ID NO: 511645 - DNA, 25 bp, Homo sapien
taattccccagctttcacagttgat

SEQ ID NO: 511646 - DNA, 25 bp, Homo sapien
ttccccagctttcacagttgatgga

SEQ ID NO: 511647 - DNA, 25 bp, Homo sapien
cccagctttcacagttgatggaata

SEQ ID NO: 511648 - DNA, 25 bp, Homo sapien
atggctttgcttgatctgttgatgc

SEQ ID NO: 511649 - DNA, 25 bp, Homo sapien
ttgatgctttctctcatcaagactt

SEQ ID NO: 511650 - DNA, 25 bp, Homo sapien
tgctttctctcatcaagactttgct

SEQ ID NO: 511651 - DNA, 25 bp, Homo sapien
ctttgctgcattttagccaggcagt

SEQ ID NO: 511652 - DNA, 25 bp, Homo sapien
ttttagccaggcagtatttactcat

SEQ ID NO: 511653 - DNA, 25 bp, Homo sapien
agccaggcagtatttactcattatt

SEQ ID NO: 511654 - DNA, 25 bp, Homo sapien
ggcagtatttactcattattaggaa

SEQ ID NO: 511655 - DNA, 25 bp, Homo sapien
gaggctcagttagcaacctgtgttg

SEQ ID NO: 511656 - DNA, 25 bp, Homo sapien
tcagtccattgattgtctttagaga

SEQ ID NO: 511657 - DNA, 25 bp, Homo sapien
gtctttagagagttaatgttacaaa

SEQ ID NO: 511658 - DNA, 25 bp, Homo sapien
gacaaacatgatctgctgaggacac

SEQ ID NO: 511659 - DNA, 25 bp, Homo sapien
aaatcggtgacatttcctttgatac

SEQ ID NO: 511660 - DNA, 25 bp, Homo sapien
ggaatgatttggcaacctccgagaa

SEQ ID NO: 511661 - DNA, 25 bp, Homo sapien
gcaacctccgagaatcttggtcaaa

SEQ ID NO: 511662 - DNA, 25 bp, Homo sapien
aatcttggtcaaattcttctgtgtg

SEQ ID NO: 511663 - DNA, 25 bp, Homo sapien
aattcttctgtgtgtcataaggatg

SEQ ID NO: 511664 - DNA, 25 bp, Homo sapien
gatgagaaatcattactctttaaga

SEQ ID NO: 511665 - DNA, 25 bp, Homo sapien
tttaagagtgatttgagcctgggca

SEQ ID NO: 511666 - DNA, 25 bp, Homo sapien
tttttcaggccttagttccctccat

SEQ ID NO: 511667 - DNA, 25 bp, Homo sapien
ccttagttccctccatttataactg

SEQ ID NO: 511668 - DNA, 25 bp, Homo sapien
ccatttataactgatgcctgtgtat

SEQ ID NO: 511669 - DNA, 25 bp, Homo sapien
tgatgcctgtgtatctttcttctgt

SEQ ID NO: 511670 - DNA, 25 bp, Homo sapien
tttccctttcctgaatgaaaaatca

SEQ ID NO: 511671 - DNA, 25 bp, Homo sapien
taaacacaatacattgcctcagcat

SEQ ID NO: 511672 - DNA, 25 bp, Homo sapien
aatacattgcctcagcataaataaa

SEQ ID NO: 511673 - DNA, 25 bp, Homo sapien
atgaacatggatttctaactggacc

SEQ ID NO: 511674 - DNA, 25 bp, Homo sapien
ggatttctaactggaccaacactaa

SEQ ID NO: 511675 - DNA, 25 bp, Homo sapien
ggaccaacactaatgttgcaacctg

SEQ ID NO: 511676 - DNA, 25 bp, Homo sapien
atgttgcaacctgataaaatttgag

SEQ ID NO: 511677 - DNA, 25 bp, Homo sapien
gtaaattcatttcacagactcataa

SEQ ID NO: 511678 - DNA, 25 bp, Homo sapien
agactcataaacacactctctttaa

SEQ ID NO: 511679 - DNA, 25 bp, Homo sapien
acacactctctttaagactcttctt

SEQ ID NO: 511680 - DNA, 25 bp, Homo sapien
gactcttctttaaatggatccttac

SEQ ID NO: 511681 - DNA, 25 bp, Homo sapien
atgaagaaatctctcccaataccca

SEQ ID NO: 511682 - DNA, 25 bp, Homo sapien
ctcccaatacccatttatcctattt

SEQ ID NO: 511683 - DNA, 25 bp, Homo sapien
taatgattccacttgattttcagaa

SEQ ID NO: 511684 - DNA, 25 bp, Homo sapien
tttcagaatattgtcctggttgatt

SEQ ID NO: 511685 - DNA, 25 bp, Homo sapien
ggttgattttgatttgacagcatac

SEQ ID NO: 511686 - DNA, 25 bp, Homo sapien
agtaggttaccattttgaggcagtt

SEQ ID NO: 511687 - DNA, 25 bp, Homo sapien
aatggcataacatgagtgtactaac

SEQ ID NO: 511688 - DNA, 25 bp, Homo sapien
gtgtactaactaccttctatgctgg

SEQ ID NO: 511689 - DNA, 25 bp, Homo sapien
ttctatgctggccatgctacagatt

SEQ ID NO: 511690 - DNA, 25 bp, Homo sapien
gctggccatgctacagattttctgg

SEQ ID NO: 511691 - DNA, 25 bp, Homo sapien
acagattttctggaggtatgacaat

SEQ ID NO: 511692 - DNA, 25 bp, Homo sapien
agttttcagtttgcttggaggtagc

SEQ ID NO: 511693 - DNA, 25 bp, Homo sapien
tgcttggaggtagctgggtaatcaa

SEQ ID NO: 511694 - DNA, 25 bp, Homo sapien
caatgtgaacgattacggtctttat

SEQ ID NO: 511695 - DNA, 25 bp, Homo sapien
acggtctttatgaccaagagtctga

SEQ ID NO: 511696 - DNA, 25 bp, Homo sapien
aaaatctttttgttatgctgtttag

SEQ ID NO: 511697 - DNA, 25 bp, Homo sapien
atgctgtttagtattcgtttgatat

SEQ ID NO: 511698 - DNA, 25 bp, Homo sapien
gatattgttacttttcacctgttga

SEQ ID NO: 511699 - DNA, 25 bp, Homo sapien
acttttcacctgttgagcccaaatt

SEQ ID NO: 511700 - DNA, 25 bp, Homo sapien
attcaggattggttcagtggcagca

SEQ ID NO: 511701 - DNA, 25 bp, Homo sapien
tttgttcatagcctacatcaccaag

SEQ ID NO: 511702 - DNA, 25 bp, Homo sapien
ggccactctatatgcactttgttta

SEQ ID NO: 511703 - DNA, 25 bp, Homo sapien
gcattttagccaggcagtatttact

SEQ ID NO: 511704 - DNA, 25 bp, Homo sapien
attttagccaggcagtatttactca

SEQ ID NO: 511705 - DNA, 25 bp, Homo sapien
ttttagccaggcagtatttactcat

SEQ ID NO: 511706 - DNA, 25 bp, Homo sapien
tttagccaggcagtatttactcatt

SEQ ID NO: 511707 - DNA, 25 bp, Homo sapien
gtatttactcattattaggaaaatc

SEQ ID NO: 511708 - DNA, 25 bp, Homo sapien
gattgtctttagagagttaatgtta

SEQ ID NO: 511709 - DNA, 25 bp, Homo sapien
attgtctttagagagttaatgttac

SEQ ID NO: 511710 - DNA, 25 bp, Homo sapien
gtctttagagagttaatgttacaaa

SEQ ID NO: 511711 - DNA, 25 bp, Homo sapien
tctttagagagttaatgttacaaaa

SEQ ID NO: 511712 - DNA, 25 bp, Homo sapien
gaattcttaataatcagacaaacat

SEQ ID NO: 511713 - DNA, 25 bp, Homo sapien
attcttaataatcagacaaacatga

SEQ ID NO: 511714 - DNA, 25 bp, Homo sapien
gactcagggaggctaaatcagtgtt

SEQ ID NO: 511715 - DNA, 25 bp, Homo sapien
aaatcagtgtttgattccccgccga

SEQ ID NO: 511716 - DNA, 25 bp, Homo sapien
gccgaacccttcctgaaacttcaag

SEQ ID NO: 511717 - DNA, 25 bp, Homo sapien
ctgaaacttcaagacctggtaggga

SEQ ID NO: 511718 - DNA, 25 bp, Homo sapien
ggtatcctggagcattgtgtataga

SEQ ID NO: 511719 - DNA, 25 bp, Homo sapien
agaactggattttcagacctgctga

SEQ ID NO: 511720 - DNA, 25 bp, Homo sapien
agacctgctgaggaccgtaaggcct

SEQ ID NO: 511721 - DNA, 25 bp, Homo sapien
ggaccgtaaggcctgatggaacaca

SEQ ID NO: 511722 - DNA, 25 bp, Homo sapien
tggaacacagaactgaactgaggtt

SEQ ID NO: 511723 - DNA, 25 bp, Homo sapien
tggattttccaggactgtttcaaac

SEQ ID NO: 511724 - DNA, 25 bp, Homo sapien
actgtttcaaacatgcccattacta

SEQ ID NO: 511725 - DNA, 25 bp, Homo sapien
ggcctcaccattttgcgttttttag

SEQ ID NO: 511726 - DNA, 25 bp, Homo sapien
agatatctttgatcctggcatgcct

SEQ ID NO: 511727 - DNA, 25 bp, Homo sapien
ttcctaacctcctcttgtagtaatt

SEQ ID NO: 511728 - DNA, 25 bp, Homo sapien
gtagtaattctcaactcaactcaaa

SEQ ID NO: 511729 - DNA, 25 bp, Homo sapien
actcaactcaaagtcccaagaattt

SEQ ID NO: 511730 - DNA, 25 bp, Homo sapien
aatttggaatggtaggatgctgtgc

SEQ ID NO: 511731 - DNA, 25 bp, Homo sapien
gaggcataatcactgcttcggttct

SEQ ID NO: 511732 - DNA, 25 bp, Homo sapien
actgcttcggttctgctcatcaggg

SEQ ID NO: 511733 - DNA, 25 bp, Homo sapien
gctcccttactcatggcagccatgt

SEQ ID NO: 511734 - DNA, 25 bp, Homo sapien
catggcagccatgtttgattgtcac

SEQ ID NO: 511735 - DNA, 25 bp, Homo sapien
ccatgtttgattgtcacagagcccc

SEQ ID NO: 511736 - DNA, 25 bp, Homo sapien
ggccaaagatgtttggtttgcccat

SEQ ID NO: 511737 - DNA, 25 bp, Homo sapien
gatgtttggtttgcccatggagttt

SEQ ID NO: 511738 - DNA, 25 bp, Homo sapien
tggtttgcccatggagttttaatta

SEQ ID NO: 511739 - DNA, 25 bp, Homo sapien
aatagagagacatacctggctccaa

SEQ ID NO: 511740 - DNA, 25 bp, Homo sapien
gagagacatacctggctccaaaaca

SEQ ID NO: 511741 - DNA, 25 bp, Homo sapien
atacctggctccaaaacaaggctgt

SEQ ID NO: 511742 - DNA, 25 bp, Homo sapien
tggctccaaaacaaggctgtatctt

SEQ ID NO: 511743 - DNA, 25 bp, Homo sapien
gctgtatcttctgccactgtaataa

SEQ ID NO: 511744 - DNA, 25 bp, Homo sapien
aaatagatgcaattgaggttcataa

SEQ ID NO: 511745 - DNA, 25 bp, Homo sapien
agattgcaaataaatacatgggcca

SEQ ID NO: 511746 - DNA, 25 bp, Homo sapien
gcaaataaatacatgggccaaagat

SEQ ID NO: 511747 - DNA, 25 bp, Homo sapien
aaacctgaattaagtctgctgggag

SEQ ID NO: 511748 - DNA, 25 bp, Homo sapien
gagaccattagccaatcacaggaga

SEQ ID NO: 511749 - DNA, 25 bp, Homo sapien
ggagacccaaatctgcttgttatct

SEQ ID NO: 511750 - DNA, 25 bp, Homo sapien
gcttgttatctacagaactcaaagt

SEQ ID NO: 511751 - DNA, 25 bp, Homo sapien
tagaggtacgcttttttcctcaggc

SEQ ID NO: 511752 - DNA, 25 bp, Homo sapien
ctcaggcttaaacctttgccactga

SEQ ID NO: 511753 - DNA, 25 bp, Homo sapien
gatggactacatttgtctccaaagg

SEQ ID NO: 511754 - DNA, 25 bp, Homo sapien
gaatgaatttttgttctcgcatctc

SEQ ID NO: 511755 - DNA, 25 bp, Homo sapien
tctcgcatctctggcctttgataga

SEQ ID NO: 511756 - DNA, 25 bp, Homo sapien
aaggtctcttctctacctttgctgc

SEQ ID NO: 511757 - DNA, 25 bp, Homo sapien
gctgcttccttactggcgggatgta

SEQ ID NO: 511758 - DNA, 25 bp, Homo sapien
gttgtatgtatatatctaatgggaa

SEQ ID NO: 511759 - DNA, 25 bp, Homo sapien
agagatgtcagtataattgttttcc

SEQ ID NO: 511760 - DNA, 25 bp, Homo sapien
attgttttcctattaaatgatctca

SEQ ID NO: 511761 - DNA, 25 bp, Homo sapien
gttttcctattaaatgatctcataa

SEQ ID NO: 511762 - DNA, 25 bp, Homo sapien
gggtgtttgtggcataaaaatcata

SEQ ID NO: 511763 - DNA, 25 bp, Homo sapien
tatcagtatcttttttacattttcc

SEQ ID NO: 511764 - DNA, 25 bp, Homo sapien
acattttcctgatgagaatataaat

SEQ ID NO: 511765 - DNA, 25 bp, Homo sapien
aagtacaatacataaacccaaatca

SEQ ID NO: 511766 - DNA, 25 bp, Homo sapien
gtttcttcagttatgtctgtgctgt

SEQ ID NO: 511767 - DNA, 25 bp, Homo sapien
ttcagttatgtctgtgctgtataga

SEQ ID NO: 511768 - DNA, 25 bp, Homo sapien
tatgtctgtgctgtatagaactgtc

SEQ ID NO: 511769 - DNA, 25 bp, Homo sapien
ttactcccactttcttgacaacagg

SEQ ID NO: 511770 - DNA, 25 bp, Homo sapien
gggtgctcagtactttacgccaagc

SEQ ID NO: 511771 - DNA, 25 bp, Homo sapien
ttacgccaagctgattttgaggccc

SEQ ID NO: 511772 - DNA, 25 bp, Homo sapien
tttgaggcccataacattctcaggg

SEQ ID NO: 511773 - DNA, 25 bp, Homo sapien
cattctcagggagtctgggtatgct

SEQ ID NO: 511774 - DNA, 25 bp, Homo sapien
gatgccggtgattttgacaccatta

SEQ ID NO: 511775 - DNA, 25 bp, Homo sapien
gacaccattacattttgatcgggac

SEQ ID NO: 511776 - DNA, 25 bp, Homo sapien
tgatcgggacccacttcaaaagcag

SEQ ID NO: 511777 - DNA, 25 bp, Homo sapien
aaagcagccttcatgccagagatct

SEQ ID NO: 511778 - DNA, 25 bp, Homo sapien
gagatctgtggttattcgaaccttt

SEQ ID NO: 511779 - DNA, 25 bp, Homo sapien
gtgacttcatgactggtatacctgc

SEQ ID NO: 511780 - DNA, 25 bp, Homo sapien
ggagcaagtccggagctttcaggtc

SEQ ID NO: 511781 - DNA, 25 bp, Homo sapien
caggtcccaacctgcgttcaatgtg

SEQ ID NO: 511782 - DNA, 25 bp, Homo sapien
gaaaccagatgtcgttttcttcggg

SEQ ID NO: 511783 - DNA, 25 bp, Homo sapien
gggacacagtgaaccctgacaaggt

SEQ ID NO: 511784 - DNA, 25 bp, Homo sapien
gcgtgtaaaagaagccgactccctc

SEQ ID NO: 511785 - DNA, 25 bp, Homo sapien
gggatcatccttgcaggtatactct

SEQ ID NO: 511786 - DNA, 25 bp, Homo sapien
tggttacaggtttatcctcactgcc

SEQ ID NO: 511787 - DNA, 25 bp, Homo sapien
gaagctcccgattgcaatactgaac

SEQ ID NO: 511788 - DNA, 25 bp, Homo sapien
atactgaacattgggcccacacggt

SEQ ID NO: 511789 - DNA, 25 bp, Homo sapien
gtcggatgacttggcgtgtctgaaa

SEQ ID NO: 511790 - DNA, 25 bp, Homo sapien
gcgtgtctgaaactgaattctcgtt

SEQ ID NO: 511791 - DNA, 25 bp, Homo sapien
caatagtgtctagcttttcagaatc

SEQ ID NO: 511792 - DNA, 25 bp, Homo sapien
agcttttcagaatcttctgattgtt

SEQ ID NO: 511793 - DNA, 25 bp, Homo sapien
aaacatagcatctatttgctaacaa

SEQ ID NO: 511794 - DNA, 25 bp, Homo sapien
gataatcatttcatctccttccaag

SEQ ID NO: 511795 - DNA, 25 bp, Homo sapien
atttcatctccttccaagaagtggt

SEQ ID NO: 511796 - DNA, 25 bp, Homo sapien
gaaccaggtgacattaatttaactt

SEQ ID NO: 511797 - DNA, 25 bp, Homo sapien
ggtgacattaatttaacttctgttt

SEQ ID NO: 511798 - DNA, 25 bp, Homo sapien
cacctcaggaaaaggcccactgtgt

SEQ ID NO: 511799 - DNA, 25 bp, Homo sapien
caggaaaaggcccactgtgtccagg

SEQ ID NO: 511800 - DNA, 25 bp, Homo sapien
gggcgtcagtccagctcaatagtgt

SEQ ID NO: 511801 - DNA, 25 bp, Homo sapien
gtcagtccagctcaatagtgtctag

SEQ ID NO: 511802 - DNA, 25 bp, Homo sapien
tgttgctccttcacacagacctgga

SEQ ID NO: 511803 - DNA, 25 bp, Homo sapien
tctgggcactgacttaacggcacct

SEQ ID NO: 511804 - DNA, 25 bp, Homo sapien
ctgacttaacggcacctccctagaa

SEQ ID NO: 511805 - DNA, 25 bp, Homo sapien
aaggcgagaaacatgccaaatctaa

SEQ ID NO: 511806 - DNA, 25 bp, Homo sapien
aggactcccatccatcgccttgaga

SEQ ID NO: 511807 - DNA, 25 bp, Homo sapien
catcgccttgagactgaccgtaaac

SEQ ID NO: 511808 - DNA, 25 bp, Homo sapien
agactgaccgtaaaccacagacgct

SEQ ID NO: 511809 - DNA, 25 bp, Homo sapien
tcaagagttatcctgccttccagat

SEQ ID NO: 511810 - DNA, 25 bp, Homo sapien
agttatcctgccttccagattcctg

SEQ ID NO: 511811 - DNA, 25 bp, Homo sapien
tctattgcctcttgaatacaaatgc

SEQ ID NO: 511812 - DNA, 25 bp, Homo sapien
ttgaatacaaatgcactcccaaagt

SEQ ID NO: 511813 - DNA, 25 bp, Homo sapien
ttccacttaaactgatgagtcccct

SEQ ID NO: 511814 - DNA, 25 bp, Homo sapien
ttaaactgatgagtcccctgggtct

SEQ ID NO: 511815 - DNA, 25 bp, Homo sapien
agtcccctgggtctgtcaaaatgag

SEQ ID NO: 511816 - DNA, 25 bp, Homo sapien
tcccctgggtctgtcaaaatgagaa

SEQ ID NO: 511817 - DNA, 25 bp, Homo sapien
gtcaaaatgagaaggtcactgctgc

SEQ ID NO: 511818 - DNA, 25 bp, Homo sapien
gtcactgctgccacgcttgggagga

SEQ ID NO: 511819 - DNA, 25 bp, Homo sapien
tgctgccacgcttgggaggactcag

SEQ ID NO: 511820 - DNA, 25 bp, Homo sapien
ggactcagggctatagcatggccct

SEQ ID NO: 511821 - DNA, 25 bp, Homo sapien
gggtgggacctgttctcccatccct

SEQ ID NO: 511822 - DNA, 25 bp, Homo sapien
tgcctcacgtccctgtttttgtttg

SEQ ID NO: 511823 - DNA, 25 bp, Homo sapien
gtttgtgacggagccttggtctgtt

SEQ ID NO: 511824 - DNA, 25 bp, Homo sapien
ttggccttgatattcagtatttgga

SEQ ID NO: 511825 - DNA, 25 bp, Homo sapien
agattagtttataccttccacctca

SEQ ID NO: 511826 - DNA, 25 bp, Homo sapien
cacctcaggcagtcatcagctgctt

SEQ ID NO: 511827 - DNA, 25 bp, Homo sapien
ttagagaatggaatccaccctgccc

SEQ ID NO: 511828 - DNA, 25 bp, Homo sapien
tgcccctccattttttggttcctgg

SEQ ID NO: 511829 - DNA, 25 bp, Homo sapien
agtctggtcaagtctccctggctgg

SEQ ID NO: 511830 - DNA, 25 bp, Homo sapien
ctgtcctgggaacagatactcagtt

SEQ ID NO: 511831 - DNA, 25 bp, Homo sapien
gatactcagttgtagtctcatgtgt

SEQ ID NO: 511832 - DNA, 25 bp, Homo sapien
tgtagtctcatgtgtctgcactcac

SEQ ID NO: 511833 - DNA, 25 bp, Homo sapien
ctgcactcacccaagactctatata

SEQ ID NO: 511834 - DNA, 25 bp, Homo sapien
gactctatatacttgcttgctcaga

SEQ ID NO: 511835 - DNA, 25 bp, Homo sapien
ttcacataacttaaaacatggctat

SEQ ID NO: 511836 - DNA, 25 bp, Homo sapien
aacatggctatttcaataaaggact

SEQ ID NO: 511837 - DNA, 25 bp, Homo sapien
ggactaaagtttctcctggatccca

SEQ ID NO: 511838 - DNA, 25 bp, Homo sapien
cctggatcccagaattcaacctgta

SEQ ID NO: 511839 - DNA, 25 bp, Homo sapien
cccagaattcaacctgtatttataa

SEQ ID NO: 511840 - DNA, 25 bp, Homo sapien
taatgtatttagctactttttggtt

SEQ ID NO: 511841 - DNA, 25 bp, Homo sapien
tgaacttgttgggttagcttggtaa

SEQ ID NO: 511842 - DNA, 25 bp, Homo sapien
taatttaagttggagctatctgtgc

SEQ ID NO: 511843 - DNA, 25 bp, Homo sapien
gagctatctgtgcagcagtttctct

SEQ ID NO: 511844 - DNA, 25 bp, Homo sapien
gcagtttctctacagttgtgcataa

SEQ ID NO: 511845 - DNA, 25 bp, Homo sapien
aatactgctgtataccataataaag

SEQ ID NO: 511846 - DNA, 25 bp, Homo sapien
aggagtcaaaattcatcgtcttcaa

SEQ ID NO: 511847 - DNA, 25 bp, Homo sapien
gagtcaaaattcatcgtcttcaagc

SEQ ID NO: 511848 - DNA, 25 bp, Homo sapien
gtcaaaattcatcgtcttcaagccc

SEQ ID NO: 511849 - DNA, 25 bp, Homo sapien
aaaattcatcgtcttcaagcccctc

SEQ ID NO: 511850 - DNA, 25 bp, Homo sapien
attcatcgtcttcaagcccctcttt

SEQ ID NO: 511851 - DNA, 25 bp, Homo sapien
tactactctctgcttggtcaaggtt

SEQ ID NO: 511852 - DNA, 25 bp, Homo sapien
tcagccgaatttttttataccactc

SEQ ID NO: 511853 - DNA, 25 bp, Homo sapien
tttttataccactctgatgtcagca

SEQ ID NO: 511854 - DNA, 25 bp, Homo sapien
tataccactctgatgtcagcatttt

SEQ ID NO: 511855 - DNA, 25 bp, Homo sapien
taccactctgatgtcagcatttttt

SEQ ID NO: 511856 - DNA, 25 bp, Homo sapien
tgatgtcagcattttttccatctgt

SEQ ID NO: 511857 - DNA, 25 bp, Homo sapien
aagatagcaggttatgtcacgcatc

SEQ ID NO: 511858 - DNA, 25 bp, Homo sapien
gtcacgcatctgatgaagcgaattc

SEQ ID NO: 511859 - DNA, 25 bp, Homo sapien
tcacgcatctgatgaagcgaattca

SEQ ID NO: 511860 - DNA, 25 bp, Homo sapien
cacgcatctgatgaagcgaattcag

SEQ ID NO: 511861 - DNA, 25 bp, Homo sapien
acgcatctgatgaagcgaattcaga

SEQ ID NO: 511862 - DNA, 25 bp, Homo sapien
aagcgaattcagagaggcccagtaa

SEQ ID NO: 511863 - DNA, 25 bp, Homo sapien
gaggcccagtaagaggtatctccat

SEQ ID NO: 511864 - DNA, 25 bp, Homo sapien
gaggtatctccatcaagctgcagga

SEQ ID NO: 511865 - DNA, 25 bp, Homo sapien
ttatgttcctgaggtctcagccttg

SEQ ID NO: 511866 - DNA, 25 bp, Homo sapien
aagcttttggacttcggcagtctgt

SEQ ID NO: 511867 - DNA, 25 bp, Homo sapien
ggcagtctgtccaaccttcaggtca

SEQ ID NO: 511868 - DNA, 25 bp, Homo sapien
gggtgttacaaaggactagctgttc

SEQ ID NO: 511869 - DNA, 25 bp, Homo sapien
ggactagctgttcaaatatcttttg

SEQ ID NO: 511870 - DNA, 25 bp, Homo sapien
tgtattgtattgattcccctattga

SEQ ID NO: 511871 - DNA, 25 bp, Homo sapien
gtattgattcccctattgaatataa

SEQ ID NO: 511872 - DNA, 25 bp, Homo sapien
aactatactgtaggtgggcttatga

SEQ ID NO: 511873 - DNA, 25 bp, Homo sapien
ctgtaggtgggcttatgagtgttct

SEQ ID NO: 511874 - DNA, 25 bp, Homo sapien
gtgggcttatgagtgttctaaatat

SEQ ID NO: 511875 - DNA, 25 bp, Homo sapien
acactggccctgtatatggactctg

SEQ ID NO: 511876 - DNA, 25 bp, Homo sapien
tggccctgtatatggactctggtaa

SEQ ID NO: 511877 - DNA, 25 bp, Homo sapien
gccctgtatatggactctggtaaaa

SEQ ID NO: 511878 - DNA, 25 bp, Homo sapien
gtatatggactctggtaaaatgtga

SEQ ID NO: 511879 - DNA, 25 bp, Homo sapien
tggactcttctttagctttacagag

SEQ ID NO: 511880 - DNA, 25 bp, Homo sapien
agagatccttggtgtttggctagca

SEQ ID NO: 511881 - DNA, 25 bp, Homo sapien
tggctagcaatgagatttcggaatc

SEQ ID NO: 511882 - DNA, 25 bp, Homo sapien
agaaggatcctagagccaaccccag

SEQ ID NO: 511883 - DNA, 25 bp, Homo sapien
cccagtgcctttctatgagactttg

SEQ ID NO: 511884 - DNA, 25 bp, Homo sapien
tttggatccttctgacttttcttct

SEQ ID NO: 511885 - DNA, 25 bp, Homo sapien
ttctgctctctctaagctttctctt

SEQ ID NO: 511886 - DNA, 25 bp, Homo sapien
ttctcttcctcccttagggaatatc

SEQ ID NO: 511887 - DNA, 25 bp, Homo sapien
gaatatctagggtctgtaaccgttt

SEQ ID NO: 511888 - DNA, 25 bp, Homo sapien
aaggaaaggccccttgtcacatcct

SEQ ID NO: 511889 - DNA, 25 bp, Homo sapien
gccttgacatattttagtgggagcc

SEQ ID NO: 511890 - DNA, 25 bp, Homo sapien
gaaacattttagcttcttaatcaag

SEQ ID NO: 511891 - DNA, 25 bp, Homo sapien
gcttcttaatcaaggagtgctataa

SEQ ID NO: 511892 - DNA, 25 bp, Homo sapien
aatcaaggagtgctataatttcaag

SEQ ID NO: 511893 - DNA, 25 bp, Homo sapien
atataattcacttaccctaaagcaa

SEQ ID NO: 511894 - DNA, 25 bp, Homo sapien
tcacttaccctaaagcaattgtgca

SEQ ID NO: 511895 - DNA, 25 bp, Homo sapien
gttaactttctacaggggccaatag

SEQ ID NO: 511896 - DNA, 25 bp, Homo sapien
ggagcacagcaattaaccttcacat

SEQ ID NO: 511897 - DNA, 25 bp, Homo sapien
ttaaccttcacatactggagtcttg

SEQ ID NO: 511898 - DNA, 25 bp, Homo sapien
accttcacatactggagtcttgttt

SEQ ID NO: 511899 - DNA, 25 bp, Homo sapien
ggagtcttgtttaaaaggccatcaa

SEQ ID NO: 511900 - DNA, 25 bp, Homo sapien
gaaaatcacaaatgtcaccaacaaa

SEQ ID NO: 511901 - DNA, 25 bp, Homo sapien
accttttacatgtacttctctcttg

SEQ ID NO: 511902 - DNA, 25 bp, Homo sapien
gatcaaatatgtctttaactgtaca

SEQ ID NO: 511903 - DNA, 25 bp, Homo sapien
ttaactgtacatctcagtggctgga

SEQ ID NO: 511904 - DNA, 25 bp, Homo sapien
gaacatacacatagttattttagta

SEQ ID NO: 511905 - DNA, 25 bp, Homo sapien
accaaattctgctataagtcttgat

SEQ ID NO: 511906 - DNA, 25 bp, Homo sapien
ctgctataagtcttgatcttcaatg

SEQ ID NO: 511907 - DNA, 25 bp, Homo sapien
gtcttgatcttcaatgaacttttaa

SEQ ID NO: 511908 - DNA, 25 bp, Homo sapien
tgcatttagctggaaaacaagactt

SEQ ID NO: 511909 - DNA, 25 bp, Homo sapien
tagaagcgtgaatgtataggatacc

SEQ ID NO: 511910 - DNA, 25 bp, Homo sapien
taggatacctgactactaagactat

SEQ ID NO: 511911 - DNA, 25 bp, Homo sapien
actaagactatattctcagccctgc

SEQ ID NO: 511912 - DNA, 25 bp, Homo sapien
gtgaggaattcatattgcacatttt

SEQ ID NO: 511913 - DNA, 25 bp, Homo sapien
aaactctttttatagaatgcttgga

SEQ ID NO: 511914 - DNA, 25 bp, Homo sapien
ggtttatccattggttggtggaagt

SEQ ID NO: 511915 - DNA, 25 bp, Homo sapien
gtggaagtatagcatagccgcagtt

SEQ ID NO: 511916 - DNA, 25 bp, Homo sapien
atagcatagccgcagttactgtggt

SEQ ID NO: 511917 - DNA, 25 bp, Homo sapien
gccgcagttactgtggtgatgcatc

SEQ ID NO: 511918 - DNA, 25 bp, Homo sapien
tactgtggtgatgcatcattaagca

SEQ ID NO: 511919 - DNA, 25 bp, Homo sapien
gcatttttggaacctaatacagccc

SEQ ID NO: 511920 - DNA, 25 bp, Homo sapien
taatacagccctaaggttaagagga

SEQ ID NO: 511921 - DNA, 25 bp, Homo sapien
gctggtatgccaaactcttaagatc

SEQ ID NO: 511922 - DNA, 25 bp, Homo sapien
ctcttaagatccttgtatagtgtga

SEQ ID NO: 511923 - DNA, 25 bp, Homo sapien
ggcaaatgtacttctcacccagtct

SEQ ID NO: 511924 - DNA, 25 bp, Homo sapien
tcacccagtcttctacacagatgga

SEQ ID NO: 511925 - DNA, 25 bp, Homo sapien
tattctatattgcttacctgatctc

SEQ ID NO: 511926 - DNA, 25 bp, Homo sapien
acctgatctcatgttaggcctaaga

SEQ ID NO: 511927 - DNA, 25 bp, Homo sapien
aggcctaagaggctttctccaggag

SEQ ID NO: 511928 - DNA, 25 bp, Homo sapien
gaggattagcttggagttctctata

SEQ ID NO: 511929 - DNA, 25 bp, Homo sapien
agttctctatactcaggtacctctt

SEQ ID NO: 511930 - DNA, 25 bp, Homo sapien
ggttttctaaccctgacacggactg

SEQ ID NO: 511931 - DNA, 25 bp, Homo sapien
gacacggactgtgcatactttccct

SEQ ID NO: 511932 - DNA, 25 bp, Homo sapien
ttccctcatccatgctgtgctgtgt

SEQ ID NO: 511933 - DNA, 25 bp, Homo sapien
ggctaagatcatgtctgaattatgt

SEQ ID NO: 511934 - DNA, 25 bp, Homo sapien
ggcgctaaggaaagcaggaaccagt

SEQ ID NO: 511935 - DNA, 25 bp, Homo sapien
gaaccagtaatcctcttctgtggtg

SEQ ID NO: 511936 - DNA, 25 bp, Homo sapien
aaacaggctattgttggccagccct

SEQ ID NO: 511937 - DNA, 25 bp, Homo sapien
gggcggagggttcgcctctaggaag

SEQ ID NO: 511938 - DNA, 25 bp, Homo sapien
ggaaatagttcatagcttcgtgcag

SEQ ID NO: 511939 - DNA, 25 bp, Homo sapien
atagcttcgtgcaggtgatccctat

SEQ ID NO: 511940 - DNA, 25 bp, Homo sapien
aggtgatccctattctgcgtgtatg

SEQ ID NO: 511941 - DNA, 25 bp, Homo sapien
tccctattctgcgtgtatgtgtttg

SEQ ID NO: 511942 - DNA, 25 bp, Homo sapien
attctgcgtgtatgtgtttgcacat

SEQ ID NO: 511943 - DNA, 25 bp, Homo sapien
gtttgcacatgagtgtttgtagacc

SEQ ID NO: 511944 - DNA, 25 bp, Homo sapien
gtgtttgtagaccatagaccattaa

SEQ ID NO: 511945 - DNA, 25 bp, Homo sapien
gccctctttaaaatctcaaaactga

SEQ ID NO: 511946 - DNA, 25 bp, Homo sapien
ttgcaaagcctttatcatacagaaa

SEQ ID NO: 511947 - DNA, 25 bp, Homo sapien
aggtgtacctaaaagaacacatgtt

SEQ ID NO: 511948 - DNA, 25 bp, Homo sapien
gaacacatgttctcatatgtttcca

SEQ ID NO: 511949 - DNA, 25 bp, Homo sapien
atgttctcatatgtttccaaaatac

SEQ ID NO: 511950 - DNA, 25 bp, Homo sapien
gaagatcttgcttttatagtcttgt

SEQ ID NO: 511951 - DNA, 25 bp, Homo sapien
taatattcatactgtgagcctgtgt

SEQ ID NO: 511952 - DNA, 25 bp, Homo sapien
catactgtgagcctgtgtttttgaa

SEQ ID NO: 511953 - DNA, 25 bp, Homo sapien
ttctaatctccctccttcttacttt

SEQ ID NO: 511954 - DNA, 25 bp, Homo sapien
ccttcttactttcccttgatagcaa

SEQ ID NO: 511955 - DNA, 25 bp, Homo sapien
tgatcatctgatttgaaaatccagt

SEQ ID NO: 511956 - DNA, 25 bp, Homo sapien
tttagttcttagtatatggcctata

SEQ ID NO: 511957 - DNA, 25 bp, Homo sapien
atatggcctataatctaactttaat

SEQ ID NO: 511958 - DNA, 25 bp, Homo sapien
atttatcccttttatattagcttat

SEQ ID NO: 511959 - DNA, 25 bp, Homo sapien
aacaacaaggatatctcttctggag

SEQ ID NO: 511960 - DNA, 25 bp, Homo sapien
ggatatctcttctggagtatctcaa

SEQ ID NO: 511961 - DNA, 25 bp, Homo sapien
atctcttctggagtatctcaagtca

SEQ ID NO: 511962 - DNA, 25 bp, Homo sapien
ggagtatctcaagtcaaggtagaaa

SEQ ID NO: 511963 - DNA, 25 bp, Homo sapien
cagaacagttttggatatgtatgag

SEQ ID NO: 511964 - DNA, 25 bp, Homo sapien
gagaaattgtaactcaggaaatatt

SEQ ID NO: 511965 - DNA, 25 bp, Homo sapien
ttggcacattctatcaaaattttgt

SEQ ID NO: 511966 - DNA, 25 bp, Homo sapien
aaacattcacaattcaattaggagt

SEQ ID NO: 511967 - DNA, 25 bp, Homo sapien
cactcttcttcggaggcaactgaga

SEQ ID NO: 511968 - DNA, 25 bp, Homo sapien
tgcctacctcactgcattgcactgg

SEQ ID NO: 511969 - DNA, 25 bp, Homo sapien
attgcactggacctgggatgcctat

SEQ ID NO: 511970 - DNA, 25 bp, Homo sapien
ggcagaagacactcaccaggttatc

SEQ ID NO: 511971 - DNA, 25 bp, Homo sapien
gtgaagagactctgggatcccatca

SEQ ID NO: 511972 - DNA, 25 bp, Homo sapien
gagggtccccaagtcaccgctgaga

SEQ ID NO: 511973 - DNA, 25 bp, Homo sapien
accgctgagagcacttgagcctcaa

SEQ ID NO: 511974 - DNA, 25 bp, Homo sapien
gagcctcaaggatgtaagcctgacc

SEQ ID NO: 511975 - DNA, 25 bp, Homo sapien
aagcctgaccataggatcttgactc

SEQ ID NO: 511976 - DNA, 25 bp, Homo sapien
aggatcttgactccaacagcggcaa

SEQ ID NO: 511977 - DNA, 25 bp, Homo sapien
cattgtggtccgtccttaacccatc

SEQ ID NO: 511978 - DNA, 25 bp, Homo sapien
ctctcagcccatgataaagttcctt

SEQ ID NO: 511979 - DNA, 25 bp, Homo sapien
aagttccttaagctggtgattccta

SEQ ID NO: 511980 - DNA, 25 bp, Homo sapien
gctggtgattcctaatcaaggacaa

SEQ ID NO: 511981 - DNA, 25 bp, Homo sapien
tcaaggacaagccaccctagtgtct

SEQ ID NO: 511982 - DNA, 25 bp, Homo sapien
ccaccctagtgtctcatgtttgtat

SEQ ID NO: 511983 - DNA, 25 bp, Homo sapien
tagtgtctcatgtttgtatttggtc

SEQ ID NO: 511984 - DNA, 25 bp, Homo sapien
gtatttggtcccagttgggtacatt

SEQ ID NO: 511985 - DNA, 25 bp, Homo sapien
atgggtaacatgactcttgttggat

SEQ ID NO: 511986 - DNA, 25 bp, Homo sapien
gaagcatcaagtctctttcttacca

SEQ ID NO: 511987 - DNA, 25 bp, Homo sapien
gtctctttcttaccaaagtcttgtt

SEQ ID NO: 511988 - DNA, 25 bp, Homo sapien
taggtggtttatagttcttttggct

SEQ ID NO: 511989 - DNA, 25 bp, Homo sapien
gagacattcggctgctgtggaggtt

SEQ ID NO: 511990 - DNA, 25 bp, Homo sapien
tgggataattgatcattgcttgaaa

SEQ ID NO: 511991 - DNA, 25 bp, Homo sapien
gattttaacagtgcattttctcgtt

SEQ ID NO: 511992 - DNA, 25 bp, Homo sapien
cagtgcattttctcgttcaagtaaa

SEQ ID NO: 511993 - DNA, 25 bp, Homo sapien
acttccacttcttctcttactgcat

SEQ ID NO: 511994 - DNA, 25 bp, Homo sapien
cttcttctcttactgcatacatcaa

SEQ ID NO: 511995 - DNA, 25 bp, Homo sapien
ttactgcatacatcaaatggctttt

SEQ ID NO: 511996 - DNA, 25 bp, Homo sapien
atcaaatggcttttcaccagatcca

SEQ ID NO: 511997 - DNA, 25 bp, Homo sapien
tcaccagatccattgcttgttctat

SEQ ID NO: 511998 - DNA, 25 bp, Homo sapien
gcttgttctattttgttgtcaatgg

SEQ ID NO: 511999 - DNA, 25 bp, Homo sapien
gttgtcaatggctacaacacctccc

SEQ ID NO: 512000 - DNA, 25 bp, Homo sapien
caatgtattttatttgctagacttt

SEQ ID NO: 512001 - DNA, 25 bp, Homo sapien
tttgaagtttcatgttattcatgcc

SEQ ID NO: 512002 - DNA, 25 bp, Homo sapien
gttattcatgccaggattgtttgat

SEQ ID NO: 512003 - DNA, 25 bp, Homo sapien
tcatgccaggattgtttgatagagc

SEQ ID NO: 512004 - DNA, 25 bp, Homo sapien
aaaagtattagaggcagcgtttctc

SEQ ID NO: 512005 - DNA, 25 bp, Homo sapien
gtccacaagaagcatgggcacccag

SEQ ID NO: 512006 - DNA, 25 bp, Homo sapien
gcacccagccaaacttgaacctgga

SEQ ID NO: 512007 - DNA, 25 bp, Homo sapien
ggttcccggcctgcaggtgctcttt

SEQ ID NO: 512008 - DNA, 25 bp, Homo sapien
tcttggtcccaagcatctgtgcagg

SEQ ID NO: 512009 - DNA, 25 bp, Homo sapien
cccaagcatctgtgcagggtcgtgg

SEQ ID NO: 512010 - DNA, 25 bp, Homo sapien
cagggtcgtgggagccacactgaga

SEQ ID NO: 512011 - DNA, 25 bp, Homo sapien
gtatttggtcccagttgggtacatt

SEQ ID NO: 512012 - DNA, 25 bp, Homo sapien
tcctgattttggagacttaaaacca

SEQ ID NO: 512013 - DNA, 25 bp, Homo sapien
taaaaccaggttaatggctaagaat

SEQ ID NO: 512014 - DNA, 25 bp, Homo sapien
ggctaagaatgggtaacatgactct

SEQ ID NO: 512015 - DNA, 25 bp, Homo sapien
atgggtaacatgactcttgttggat

SEQ ID NO: 512016 - DNA, 25 bp, Homo sapien
catgactcttgttggattgttattt

SEQ ID NO: 512017 - DNA, 25 bp, Homo sapien
gaagcatcaagtctctttcttacca

SEQ ID NO: 512018 - DNA, 25 bp, Homo sapien
agcatcaagtctctttcttaccaaa

SEQ ID NO: 512019 - DNA, 25 bp, Homo sapien
ttcttaccaaagtcttgttaggtgg

SEQ ID NO: 512020 - DNA, 25 bp, Homo sapien
taggtggtttatagttcttttggct

SEQ ID NO: 512021 - DNA, 25 bp, Homo sapien
gttcttttggctaacaaatcatttt

SEQ ID NO: 512022 - DNA, 25 bp, Homo sapien
tacaagcaaacctgggtgaccctct

SEQ ID NO: 512023 - DNA, 25 bp, Homo sapien
ttccattcagggttccctggcaggg

SEQ ID NO: 512024 - DNA, 25 bp, Homo sapien
agagccatggctgaactatcaggga

SEQ ID NO: 512025 - DNA, 25 bp, Homo sapien
gaactatcagggacaaaggcccatg

SEQ ID NO: 512026 - DNA, 25 bp, Homo sapien
gggacaaaggcccatgtccccacat

SEQ ID NO: 512027 - DNA, 25 bp, Homo sapien
atccagcaccaaatctttgcttatg

SEQ ID NO: 512028 - DNA, 25 bp, Homo sapien
gggacaaggagcttccgtctggcaa

SEQ ID NO: 512029 - DNA, 25 bp, Homo sapien
aaggagcttccgtctggcaaggccg

SEQ ID NO: 512030 - DNA, 25 bp, Homo sapien
acaatttgcactcccctcagctaga

SEQ ID NO: 512031 - DNA, 25 bp, Homo sapien
tcagctagacgcacagactcagcaa

SEQ ID NO: 512032 - DNA, 25 bp, Homo sapien
gactcagcaataaacctttgcatca

SEQ ID NO: 512033 - DNA, 25 bp, Homo sapien
ttggtggcctgcgtgacagtttcct

SEQ ID NO: 512034 - DNA, 25 bp, Homo sapien
tttcctcccgtcgacatcgaaagga

SEQ ID NO: 512035 - DNA, 25 bp, Homo sapien
tcgacatcgaaaggaagccggacgt

SEQ ID NO: 512036 - DNA, 25 bp, Homo sapien
cgggcagagagcttcatcgcagtag

SEQ ID NO: 512037 - DNA, 25 bp, Homo sapien
atcgcagtaggaatggcagccccat

SEQ ID NO: 512038 - DNA, 25 bp, Homo sapien
atggcagccccatctatgaaggaaa

SEQ ID NO: 512039 - DNA, 25 bp, Homo sapien
cccgggatgagtactggaagtgttt

SEQ ID NO: 512040 - DNA, 25 bp, Homo sapien
acttagaggatgcttctcaatgcaa

SEQ ID NO: 512041 - DNA, 25 bp, Homo sapien
gcaagaagttaagaagctctttcga

SEQ ID NO: 512042 - DNA, 25 bp, Homo sapien
agctctttcgaatcaagttgtcccc

SEQ ID NO: 512043 - DNA, 25 bp, Homo sapien
cgaatcaagttgtccccaacagtgg

SEQ ID NO: 512044 - DNA, 25 bp, Homo sapien
gagaatgacagcatcgcaggtacca

SEQ ID NO: 512045 - DNA, 25 bp, Homo sapien
gacagcatcgcaggtaccatcaaaa

SEQ ID NO: 512046 - DNA, 25 bp, Homo sapien
gtaccatcaaaacggaaggcgagca

SEQ ID NO: 512047 - DNA, 25 bp, Homo sapien
aaggcgagcatgaccctgtgacgga

SEQ ID NO: 512048 - DNA, 25 bp, Homo sapien
acttcatcatggtgaactaatttag

SEQ ID NO: 512049 - DNA, 25 bp, Homo sapien
aactaatttagagcatcctccagag

SEQ ID NO: 512050 - DNA, 25 bp, Homo sapien
gcagaacattccagaacccgttgtg

SEQ ID NO: 512051 - DNA, 25 bp, Homo sapien
ccctttcaagaagctgttttaagag

SEQ ID NO: 512052 - DNA, 25 bp, Homo sapien
ggcagcgtcttgaaaatgggcaccg

SEQ ID NO: 512053 - DNA, 25 bp, Homo sapien
cgtcttgaaaatgggcaccgctggg

SEQ ID NO: 512054 - DNA, 25 bp, Homo sapien
ggtggatgacttctttacaaaggaa

SEQ ID NO: 512055 - DNA, 25 bp, Homo sapien
tccactcagcacagttcatgttcag

SEQ ID NO: 512056 - DNA, 25 bp, Homo sapien
gacaggcatgtctttgaccccagga

SEQ ID NO: 512057 - DNA, 25 bp, Homo sapien
gaccccaggaatgatcatttgctga

SEQ ID NO: 512058 - DNA, 25 bp, Homo sapien
gtgaacctagattaacagccctcca

SEQ ID NO: 512059 - DNA, 25 bp, Homo sapien
cctccactccagatggatatccagt

SEQ ID NO: 512060 - DNA, 25 bp, Homo sapien
gatatccagtgattcctagaatggg

SEQ ID NO: 512061 - DNA, 25 bp, Homo sapien
gagaacaattctatgcaccctacac

SEQ ID NO: 512062 - DNA, 25 bp, Homo sapien
tacactgacagactcccttaagcaa

SEQ ID NO: 512063 - DNA, 25 bp, Homo sapien
agactcccttaagcaacaccagatg

SEQ ID NO: 512064 - DNA, 25 bp, Homo sapien
gcaacaccagatgctctactggtac

SEQ ID NO: 512065 - DNA, 25 bp, Homo sapien
tgactttgaagtcttgaccctccat

SEQ ID NO: 512066 - DNA, 25 bp, Homo sapien
gggacaaggagcttccgtctggcaa

SEQ ID NO: 512067 - DNA, 25 bp, Homo sapien
ggacaaggagcttccgtctggcaag

SEQ ID NO: 512068 - DNA, 25 bp, Homo sapien
caaggagcttccgtctggcaaggcc

SEQ ID NO: 512069 - DNA, 25 bp, Homo sapien
aaggagcttccgtctggcaaggccg

SEQ ID NO: 512070 - DNA, 25 bp, Homo sapien
ggagcttccgtctggcaaggccggg

SEQ ID NO: 512071 - DNA, 25 bp, Homo sapien
aaggccggggcacaatttgcactcc

SEQ ID NO: 512072 - DNA, 25 bp, Homo sapien
acaatttgcactcccctcagctaga

SEQ ID NO: 512073 - DNA, 25 bp, Homo sapien
tttgcactcccctcagctagacgca

SEQ ID NO: 512074 - DNA, 25 bp, Homo sapien
cagactcagcaataaacctttgcat

SEQ ID NO: 512075 - DNA, 25 bp, Homo sapien
gactcagcaataaacctttgcatca

SEQ ID NO: 512076 - DNA, 25 bp, Homo sapien
ctcagcaataaacctttgcatcagg

SEQ ID NO: 512077 - DNA, 25 bp, Homo sapien
aaagtacaggtatatctcggagata

SEQ ID NO: 512078 - DNA, 25 bp, Homo sapien
atctcggagatattgtgggttcagt

SEQ ID NO: 512079 - DNA, 25 bp, Homo sapien
ttccagaccacctcggtaaagccaa

SEQ ID NO: 512080 - DNA, 25 bp, Homo sapien
ctcggtaaagccaacatcacaataa

SEQ ID NO: 512081 - DNA, 25 bp, Homo sapien
ggaagcgcattgttttagtttccca

SEQ ID NO: 512082 - DNA, 25 bp, Homo sapien
tagtttcccagtgcatctaagtcat

SEQ ID NO: 512083 - DNA, 25 bp, Homo sapien
gcatctaagtcatgtttactgcata

SEQ ID NO: 512084 - DNA, 25 bp, Homo sapien
ctgcatattgcagtccactaaatgt

SEQ ID NO: 512085 - DNA, 25 bp, Homo sapien
tatttactgttcaaaatgctgacac

SEQ ID NO: 512086 - DNA, 25 bp, Homo sapien
aatggtgccaaatagacttgcctga

SEQ ID NO: 512087 - DNA, 25 bp, Homo sapien
agacttgcctgatgccaggctgcta

SEQ ID NO: 512088 - DNA, 25 bp, Homo sapien
ataattcatctccacatggagccaa

SEQ ID NO: 512089 - DNA, 25 bp, Homo sapien
attcatctccacatggagccaagtt

SEQ ID NO: 512090 - DNA, 25 bp, Homo sapien
tctccacatggagccaagtttaatg

SEQ ID NO: 512091 - DNA, 25 bp, Homo sapien
ggagccaagtttaatgtttctagtt

SEQ ID NO: 512092 - DNA, 25 bp, Homo sapien
gccaagtttaatgtttctagttcac

SEQ ID NO: 512093 - DNA, 25 bp, Homo sapien
gtacttctgtcatgcttatttcaaa

SEQ ID NO: 512094 - DNA, 25 bp, Homo sapien
atgcttatttcaaactccctgagtg

SEQ ID NO: 512095 - DNA, 25 bp, Homo sapien
gcttatttcaaactccctgagtgat

SEQ ID NO: 512096 - DNA, 25 bp, Homo sapien
tttcaaactccctgagtgatgggta

SEQ ID NO: 512097 - DNA, 25 bp, Homo sapien
ggtggtttcttcagaatcatgaagt

SEQ ID NO: 512098 - DNA, 25 bp, Homo sapien
atcatgaagttcttttgccagataa

SEQ ID NO: 512099 - DNA, 25 bp, Homo sapien
aattatctgctcttttggattatca

SEQ ID NO: 512100 - DNA, 25 bp, Homo sapien
ggattatcactactgctactagccg

SEQ ID NO: 512101 - DNA, 25 bp, Homo sapien
ctgctactagccgttagaatattgg

SEQ ID NO: 512102 - DNA, 25 bp, Homo sapien
gactagagctacaaaatctgtttca

SEQ ID NO: 512103 - DNA, 25 bp, Homo sapien
gatctgctcaaacaagaatgtgatg

SEQ ID NO: 512104 - DNA, 25 bp, Homo sapien
gtgatgatcacttgctgtattgtac

SEQ ID NO: 512105 - DNA, 25 bp, Homo sapien
aaactgctgttagactcaggtgaca

SEQ ID NO: 512106 - DNA, 25 bp, Homo sapien
aggtgacagtcaaatgttggaggct

SEQ ID NO: 512107 - DNA, 25 bp, Homo sapien
gctgtgttgggatgagttgttacaa

SEQ ID NO: 512108 - DNA, 25 bp, Homo sapien
gagttgttacaaagcctctttcatt

SEQ ID NO: 512109 - DNA, 25 bp, Homo sapien
ttcattcttcccatgccatgtccag

SEQ ID NO: 512110 - DNA, 25 bp, Homo sapien
acagaactattaagtccccttattg

SEQ ID NO: 512111 - DNA, 25 bp, Homo sapien
tccccttattgtactttttatggca

SEQ ID NO: 512112 - DNA, 25 bp, Homo sapien
actttttatggcatgcccatgaaaa

SEQ ID NO: 512113 - DNA, 25 bp, Homo sapien
aaaagcactttcttaagcctacagt

SEQ ID NO: 512114 - DNA, 25 bp, Homo sapien
aagcctacagtatcagatcaatggg

SEQ ID NO: 512115 - DNA, 25 bp, Homo sapien
gtataagtctaattgcccattgcca

SEQ ID NO: 512116 - DNA, 25 bp, Homo sapien
gtctaattgcccattgccataaatt

SEQ ID NO: 512117 - DNA, 25 bp, Homo sapien
gccataaattttgtcttgtactcag

SEQ ID NO: 512118 - DNA, 25 bp, Homo sapien
tgtcttgtactcagagaagcaacat

SEQ ID NO: 512119 - DNA, 25 bp, Homo sapien
tatactttcagctaacatatgccag

SEQ ID NO: 512120 - DNA, 25 bp, Homo sapien
acatatgccagtttcacagaactat

SEQ ID NO: 512121 - DNA, 25 bp, Homo sapien
gcttccagcttaagggtagagaaat

SEQ ID NO: 512122 - DNA, 25 bp, Homo sapien
aggatggaaactatgtcctcagttt

SEQ ID NO: 512123 - DNA, 25 bp, Homo sapien
atgtcctcagttttacttctaccaa

SEQ ID NO: 512124 - DNA, 25 bp, Homo sapien
ttctaccaaaacatccctgtatgtg

SEQ ID NO: 512125 - DNA, 25 bp, Homo sapien
caaaacatccctgtatgtgtgtgca

SEQ ID NO: 512126 - DNA, 25 bp, Homo sapien
gtgtgcatgcatattagtaaatgtg

SEQ ID NO: 512127 - DNA, 25 bp, Homo sapien
gtgtatgtgatctgggtgtttgttt

SEQ ID NO: 512128 - DNA, 25 bp, Homo sapien
gtttatctctgttattattcccctt

SEQ ID NO: 512129 - DNA, 25 bp, Homo sapien
tctgttattattcccctttagcttt

SEQ ID NO: 512130 - DNA, 25 bp, Homo sapien
ctttagctttattttagtcaactct

SEQ ID NO: 512131 - DNA, 25 bp, Homo sapien
tattttagtcaactctacattatga

SEQ ID NO: 512132 - DNA, 25 bp, Homo sapien
gatgcactgtttgtgaaggtcctgc

SEQ ID NO: 512133 - DNA, 25 bp, Homo sapien
ttgtgaaggtcctgcgatcgccata

SEQ ID NO: 512134 - DNA, 25 bp, Homo sapien
aaggtcctgcgatcgccatagccgt

SEQ ID NO: 512135 - DNA, 25 bp, Homo sapien
tgcgatcgccatagccgttcacagc

SEQ ID NO: 512136 - DNA, 25 bp, Homo sapien
atagccgttcacagccaaaccactg

SEQ ID NO: 512137 - DNA, 25 bp, Homo sapien
attcctccatgtcctcacggctgga

SEQ ID NO: 512138 - DNA, 25 bp, Homo sapien
tcctcacggctggatttctctctgg

SEQ ID NO: 512139 - DNA, 25 bp, Homo sapien
gaaagcctattccatcaactgtgaa

SEQ ID NO: 512140 - DNA, 25 bp, Homo sapien
tattccatcaactgtgaaagctggg

SEQ ID NO: 512141 - DNA, 25 bp, Homo sapien
aaaataataagtcgctgtcaggtgt

SEQ ID NO: 512142 - DNA, 25 bp, Homo sapien
aagtcgctgtcaggtgtgcatgaag

SEQ ID NO: 512143 - DNA, 25 bp, Homo sapien
tttttatagggctgtacctagtata

SEQ ID NO: 512144 - DNA, 25 bp, Homo sapien
gggctgtacctagtatatattttat

SEQ ID NO: 512145 - DNA, 25 bp, Homo sapien
gtattgtaagtactttcccatgttt

SEQ ID NO: 512146 - DNA, 25 bp, Homo sapien
gtagtcattaagaacttgaggtctg

SEQ ID NO: 512147 - DNA, 25 bp, Homo sapien
gttttgaatactaccttcaccacct

SEQ ID NO: 512148 - DNA, 25 bp, Homo sapien
tttgaatactaccttcaccacctgt

SEQ ID NO: 512149 - DNA, 25 bp, Homo sapien
gggcaagttactaacacatttcctt

SEQ ID NO: 512150 - DNA, 25 bp, Homo sapien
gttactaacacatttccttgtctat

SEQ ID NO: 512151 - DNA, 25 bp, Homo sapien
ctagctaccttattagatattaaat

SEQ ID NO: 512152 - DNA, 25 bp, Homo sapien
gattatttcatgtaaagctcttagc

SEQ ID NO: 512153 - DNA, 25 bp, Homo sapien
ttcatgtaaagctcttagccctgtg

SEQ ID NO: 512154 - DNA, 25 bp, Homo sapien
caccctacatgtctgaaaaactgtt

SEQ ID NO: 512155 - DNA, 25 bp, Homo sapien
tgaaaaactgttgcttctcctctga

SEQ ID NO: 512156 - DNA, 25 bp, Homo sapien
tgcttctcctctgaaacttcaaact

SEQ ID NO: 512157 - DNA, 25 bp, Homo sapien
cttcaaactccaacgatttccaaat

SEQ ID NO: 512158 - DNA, 25 bp, Homo sapien
gttttctttagttctgtaatggata

SEQ ID NO: 512159 - DNA, 25 bp, Homo sapien
ggaaaactttacaccaggcttctgg

SEQ ID NO: 512160 - DNA, 25 bp, Homo sapien
acaccaggcttctggttacactaga

SEQ ID NO: 512161 - DNA, 25 bp, Homo sapien
ggttacactagaagtcaagcccatt

SEQ ID NO: 512162 - DNA, 25 bp, Homo sapien
atcagttttcaagctgtggtctttc

SEQ ID NO: 512163 - DNA, 25 bp, Homo sapien
tggtctttcaaacacatctgcacat

SEQ ID NO: 512164 - DNA, 25 bp, Homo sapien
atctgcacataagtcacacatttca

SEQ ID NO: 512165 - DNA, 25 bp, Homo sapien
acagtgtgatggtccttagcgcaac

SEQ ID NO: 512166 - DNA, 25 bp, Homo sapien
ttagcgcaacccatcgctacaagaa

SEQ ID NO: 512167 - DNA, 25 bp, Homo sapien
gaagaagtatgttactactctgcta

SEQ ID NO: 512168 - DNA, 25 bp, Homo sapien
actactctgctatacaagcccattt

SEQ ID NO: 512169 - DNA, 25 bp, Homo sapien
caagcccatttgaagggatcccttc

SEQ ID NO: 512170 - DNA, 25 bp, Homo sapien
ttcttgcctctaaggattcaggaga

SEQ ID NO: 512171 - DNA, 25 bp, Homo sapien
atctcccttgcatttctggactgaa

SEQ ID NO: 512172 - DNA, 25 bp, Homo sapien
ggactgaaccagtcttacctgagac

SEQ ID NO: 512173 - DNA, 25 bp, Homo sapien
gaaggctgatttgctttgaggctga

SEQ ID NO: 512174 - DNA, 25 bp, Homo sapien
ttcagagcctctgagtaggatgctc

SEQ ID NO: 512175 - DNA, 25 bp, Homo sapien
gagagctttatgagttcacggaatt

SEQ ID NO: 512176 - DNA, 25 bp, Homo sapien
gaaaaactaactgcagtctctaaat

SEQ ID NO: 512177 - DNA, 25 bp, Homo sapien
aactgcagtctctaaatatgtaggc

SEQ ID NO: 512178 - DNA, 25 bp, Homo sapien
gcagtctctaaatatgtaggctcaa

SEQ ID NO: 512179 - DNA, 25 bp, Homo sapien
gtaggctcaatcattaccttccttt

SEQ ID NO: 512180 - DNA, 25 bp, Homo sapien
aggctcaatcattaccttccttttc

SEQ ID NO: 512181 - DNA, 25 bp, Homo sapien
tcaatcattaccttccttttccaaa

SEQ ID NO: 512182 - DNA, 25 bp, Homo sapien
aatcattaccttccttttccaaatg

SEQ ID NO: 512183 - DNA, 25 bp, Homo sapien
tcatgcctggcattgtacaatattc

SEQ ID NO: 512184 - DNA, 25 bp, Homo sapien
gcctggcattgtacaatattccctt

SEQ ID NO: 512185 - DNA, 25 bp, Homo sapien
tggcattgtacaatattcccttccg

SEQ ID NO: 512186 - DNA, 25 bp, Homo sapien
caaatgcttgttgaaaggtcaagac

SEQ ID NO: 512187 - DNA, 25 bp, Homo sapien
gaaattcattttgtgtatatttaac

SEQ ID NO: 512188 - DNA, 25 bp, Homo sapien
tagcttttaaactattttacattag

SEQ ID NO: 512189 - DNA, 25 bp, Homo sapien
ttttacattagctacttcattatgg

SEQ ID NO: 512190 - DNA, 25 bp, Homo sapien
acattagctacttcattatggtttc

SEQ ID NO: 512191 - DNA, 25 bp, Homo sapien
gctacttcattatggtttcttgaac

SEQ ID NO: 512192 - DNA, 25 bp, Homo sapien
cttcattatggtttcttgaacttct

SEQ ID NO: 512193 - DNA, 25 bp, Homo sapien
tttgtttcacctaacgaatactgcg

SEQ ID NO: 512194 - DNA, 25 bp, Homo sapien
gtttcacctaacgaatactgcgttt

SEQ ID NO: 512195 - DNA, 25 bp, Homo sapien
cacctaacgaatactgcgtttgtaa

SEQ ID NO: 512196 - DNA, 25 bp, Homo sapien
agaaagaagcaaattatcactgaac

SEQ ID NO: 512197 - DNA, 25 bp, Homo sapien
tatcactgaacatatttcttattat

SEQ ID NO: 512198 - DNA, 25 bp, Homo sapien
gatctcaaaacagttggcccacaca

SEQ ID NO: 512199 - DNA, 25 bp, Homo sapien
gttggcccacacataattgtaatct

SEQ ID NO: 512200 - DNA, 25 bp, Homo sapien
attgtaatcttgcataccaccttcc

SEQ ID NO: 512201 - DNA, 25 bp, Homo sapien
acatcataccaatgtgcgccgtttg

SEQ ID NO: 512202 - DNA, 25 bp, Homo sapien
gcgccgtttgtgattccatctttga

SEQ ID NO: 512203 - DNA, 25 bp, Homo sapien
aaagtctcgtcttcatctcctggac

SEQ ID NO: 512204 - DNA, 25 bp, Homo sapien
gacaatgaggctcaccagttttcat

SEQ ID NO: 512205 - DNA, 25 bp, Homo sapien
gaagcataagcttttgccaagtatt

SEQ ID NO: 512206 - DNA, 25 bp, Homo sapien
aaagactcacgattgttctcccatt

SEQ ID NO: 512207 - DNA, 25 bp, Homo sapien
ttctcccattcctgtcgaagctgtg

SEQ ID NO: 512208 - DNA, 25 bp, Homo sapien
aagcaggtgggtacttgcaacaaga

SEQ ID NO: 512209 - DNA, 25 bp, Homo sapien
ccctggacactgacgggtttgtgat

SEQ ID NO: 512210 - DNA, 25 bp, Homo sapien
gacgggtttgtgatcttgacctccg

SEQ ID NO: 512211 - DNA, 25 bp, Homo sapien
ttgacctccgtggttactttctggg

SEQ ID NO: 512212 - DNA, 25 bp, Homo sapien
gacatctcttttcctggttgaagga

SEQ ID NO: 512213 - DNA, 25 bp, Homo sapien
aatgggtgattatttcttcctgaga

SEQ ID NO: 512214 - DNA, 25 bp, Homo sapien
ttcctgagagtgacagtaaccccag

SEQ ID NO: 512215 - DNA, 25 bp, Homo sapien
tggatgtagtattttcaggccccac

SEQ ID NO: 512216 - DNA, 25 bp, Homo sapien
aggccccacccttattgattctgat

SEQ ID NO: 512217 - DNA, 25 bp, Homo sapien
tattgattctgatcagctctggagc

SEQ ID NO: 512218 - DNA, 25 bp, Homo sapien
ttgcaatgtgatgcactgccaacat

SEQ ID NO: 512219 - DNA, 25 bp, Homo sapien
agaattagtgaactgatccctttgc

SEQ ID NO: 512220 - DNA, 25 bp, Homo sapien
gtgcgtctactttcagtctgagggt

SEQ ID NO: 512221 - DNA, 25 bp, Homo sapien
gagggtgccttgatgctggctcatc

SEQ ID NO: 512222 - DNA, 25 bp, Homo sapien
tcacacattgagtatcttgggcatt

SEQ ID NO: 512223 - DNA, 25 bp, Homo sapien
tgggcattatcatggcccttgtgct

SEQ ID NO: 512224 - DNA, 25 bp, Homo sapien
aggtcaatgcagtcctctttggaag

SEQ ID NO: 512225 - DNA, 25 bp, Homo sapien
tggaagtgagcttaccaaccccttg

SEQ ID NO: 512226 - DNA, 25 bp, Homo sapien
tacagatgcgctggtttctccggga

SEQ ID NO: 512227 - DNA, 25 bp, Homo sapien
tttctccgggaaacagggcactatc

SEQ ID NO: 512228 - DNA, 25 bp, Homo sapien
gagatgtagtggacttcctctttgt

SEQ ID NO: 512229 - DNA, 25 bp, Homo sapien
ttgtggctctgttcacaggagtgag

SEQ ID NO: 512230 - DNA, 25 bp, Homo sapien
gattggtgtgggagcttgcctcctt

SEQ ID NO: 512231 - DNA, 25 bp, Homo sapien
aagattttggttattctgggctgcc

SEQ ID NO: 512232 - DNA, 25 bp, Homo sapien
ttattctgggctgccagcagtacgt

SEQ ID NO: 512233 - DNA, 25 bp, Homo sapien
ctgtgcattttgtgacatcgtcctt

SEQ ID NO: 512234 - DNA, 25 bp, Homo sapien
ttgtgacatcgtccttcctgctgtg

SEQ ID NO: 512235 - DNA, 25 bp, Homo sapien
tcctgctgtgcacatcagctgtgat

SEQ ID NO: 512236 - DNA, 25 bp, Homo sapien
tcagctgtgatgacattttgagggt

SEQ ID NO: 512237 - DNA, 25 bp, Homo sapien
taatttagctcggttctcttgttgg

SEQ ID NO: 512238 - DNA, 25 bp, Homo sapien
ggttctcttgttggtgccagtatta

SEQ ID NO: 512239 - DNA, 25 bp, Homo sapien
gccagtattacattgaagactacct

SEQ ID NO: 512240 - DNA, 25 bp, Homo sapien
gactacctatgatagaggcaatgtt

SEQ ID NO: 512241 - DNA, 25 bp, Homo sapien
gaaaatctcccttcaggcggaggtt

SEQ ID NO: 512242 - DNA, 25 bp, Homo sapien
acttgcattcaaaaaacaggatctc

SEQ ID NO: 512243 - DNA, 25 bp, Homo sapien
aaacaggatctcagttctcctttct

SEQ ID NO: 512244 - DNA, 25 bp, Homo sapien
agttaacttaccttgcctcaacaga

SEQ ID NO: 512245 - DNA, 25 bp, Homo sapien
acttaccttgcctcaacagaagaaa

SEQ ID NO: 512246 - DNA, 25 bp, Homo sapien
cattttatttgtccttattcctgtg

SEQ ID NO: 512247 - DNA, 25 bp, Homo sapien
tatttgtccttattcctgtggaagc

SEQ ID NO: 512248 - DNA, 25 bp, Homo sapien
tgtccttattcctgtggaagcagta

SEQ ID NO: 512249 - DNA, 25 bp, Homo sapien
aagcagtatatgttttcttcctgaa

SEQ ID NO: 512250 - DNA, 25 bp, Homo sapien
tgttttcttcctgaatgctcattag

SEQ ID NO: 512251 - DNA, 25 bp, Homo sapien
gaatgctcattaggacttcttaaaa

SEQ ID NO: 512252 - DNA, 25 bp, Homo sapien
gtaagtttatccaataaagcagtat

SEQ ID NO: 512253 - DNA, 25 bp, Homo sapien
tatggcaagccctttgagccaagaa

SEQ ID NO: 512254 - DNA, 25 bp, Homo sapien
agccctttgagccaagaagtgtgaa

SEQ ID NO: 512255 - DNA, 25 bp, Homo sapien
aaaaacatacactctactcctgctt

SEQ ID NO: 512256 - DNA, 25 bp, Homo sapien
gaatcagaaactccatgttgccaat

SEQ ID NO: 512257 - DNA, 25 bp, Homo sapien
aaactccatgttgccaatgtgctgg

SEQ ID NO: 512258 - DNA, 25 bp, Homo sapien
tgctggaagatgaccccggctacct

SEQ ID NO: 512259 - DNA, 25 bp, Homo sapien
ctacctcacgtctacagcgaggaag

SEQ ID NO: 512260 - DNA, 25 bp, Homo sapien
ccagcttggaacaggagttgcaacc

SEQ ID NO: 512261 - DNA, 25 bp, Homo sapien
aggagttgcaacctgatttgctgga

SEQ ID NO: 512262 - DNA, 25 bp, Homo sapien
gatttgctggactctttgggttcaa

SEQ ID NO: 512263 - DNA, 25 bp, Homo sapien
ttgggttcaaaagcgactccgtttg

SEQ ID NO: 512264 - DNA, 25 bp, Homo sapien
gggcaccacgcagagcatcttgtac

SEQ ID NO: 512265 - DNA, 25 bp, Homo sapien
agagcatcttgtacctcgcgcacac

SEQ ID NO: 512266 - DNA, 25 bp, Homo sapien
tcgcgcacacctgctggtactggag

SEQ ID NO: 512267 - DNA, 25 bp, Homo sapien
tactggagctggcttgcgtttccct

SEQ ID NO: 512268 - DNA, 25 bp, Homo sapien
gcagatcctgcactgtactgtccag

SEQ ID NO: 512269 - DNA, 25 bp, Homo sapien
gtactgtccagtcaactgacttcag

SEQ ID NO: 512270 - DNA, 25 bp, Homo sapien
ttcagcaaagatgtctgggttcagc

SEQ ID NO: 512271 - DNA, 25 bp, Homo sapien
atgtctgggttcagcagcgagttgc

SEQ ID NO: 512272 - DNA, 25 bp, Homo sapien
gagttgctgtgtgaggccaccagaa

SEQ ID NO: 512273 - DNA, 25 bp, Homo sapien
tgatatcggcctcagtgctcatcct

SEQ ID NO: 512274 - DNA, 25 bp, Homo sapien
ggagacattcagaatcgaggcgaaa

SEQ ID NO: 512275 - DNA, 25 bp, Homo sapien
tggacaagacctctggccgacctgg

SEQ ID NO: 512276 - DNA, 25 bp, Homo sapien
acttgcccggtgctctcagaaacct

SEQ ID NO: 512277 - DNA, 25 bp, Homo sapien
gcccggtgctctcagaaacctcaga

SEQ ID NO: 512278 - DNA, 25 bp, Homo sapien
ggtgctctcagaaacctcagagctg

SEQ ID NO: 512279 - DNA, 25 bp, Homo sapien
ctctcagaaacctcagagctggtgg

SEQ ID NO: 512280 - DNA, 25 bp, Homo sapien
agagggtgggcgcagggcaccaact

SEQ ID NO: 512281 - DNA, 25 bp, Homo sapien
tctcctgggcgacgtcagtggacct

SEQ ID NO: 512282 - DNA, 25 bp, Homo sapien
tcctgggcgacgtcagtggaccttc

SEQ ID NO: 512283 - DNA, 25 bp, Homo sapien
ggcgacgtcagtggaccttcctgca

SEQ ID NO: 512284 - DNA, 25 bp, Homo sapien
tgtaaatcagctgtgtggtgcccgc

SEQ ID NO: 512285 - DNA, 25 bp, Homo sapien
tgtggtgcccgcgtggctggaagga

SEQ ID NO: 512286 - DNA, 25 bp, Homo sapien
atcttgtctccaaaagtccttgaag

SEQ ID NO: 512287 - DNA, 25 bp, Homo sapien
tgtctccaaaagtccttgaaggatt

SEQ ID NO: 512288 - DNA, 25 bp, Homo sapien
gtccttgaaggattttaggaagttg

SEQ ID NO: 512289 - DNA, 25 bp, Homo sapien
taaaagtcttgaaacgatgtttggg

SEQ ID NO: 512290 - DNA, 25 bp, Homo sapien
gggcatgttagggttcttgaatgtt

SEQ ID NO: 512291 - DNA, 25 bp, Homo sapien
gcatgttagggttcttgaatgttta

SEQ ID NO: 512292 - DNA, 25 bp, Homo sapien
gtttaattcctctaataactgctta

SEQ ID NO: 512293 - DNA, 25 bp, Homo sapien
aattcctctaataactgcttattca

SEQ ID NO: 512294 - DNA, 25 bp, Homo sapien
taataactgcttattcaagagaagc

SEQ ID NO: 512295 - DNA, 25 bp, Homo sapien
agagaagcatttctgactgggtgca

SEQ ID NO: 512296 - DNA, 25 bp, Homo sapien
agaagcatttctgactgggtgcagg

SEQ ID NO: 512297 - DNA, 25 bp, Homo sapien
actagttccgtaagataaatatgag

SEQ ID NO: 512298 - DNA, 25 bp, Homo sapien
tccatttgacttctgatgtctggtt

SEQ ID NO: 512299 - DNA, 25 bp, Homo sapien
acttctgatgtctggtttagcatta

SEQ ID NO: 512300 - DNA, 25 bp, Homo sapien
gatgtctggtttagcattacataat

SEQ ID NO: 512301 - DNA, 25 bp, Homo sapien
aatatgttgatcttacactctgctt

SEQ ID NO: 512302 - DNA, 25 bp, Homo sapien
tacactctgcttttgtccaaataaa

SEQ ID NO: 512303 - DNA, 25 bp, Homo sapien
ggactgaatatgcttttttggtgat

SEQ ID NO: 512304 - DNA, 25 bp, Homo sapien
tatgcttttttggtgatgaaatctc

SEQ ID NO: 512305 - DNA, 25 bp, Homo sapien
gatgaaatctcatgtacgatattta

SEQ ID NO: 512306 - DNA, 25 bp, Homo sapien
acgatatttatagtgatgtgctttt

SEQ ID NO: 512307 - DNA, 25 bp, Homo sapien
gcttttattttctcatgagatacta

SEQ ID NO: 512308 - DNA, 25 bp, Homo sapien
agacacaacatatatgcccctcatg

SEQ ID NO: 512309 - DNA, 25 bp, Homo sapien
gcccctcatgcataattgtgcttat

SEQ ID NO: 512310 - DNA, 25 bp, Homo sapien
ctcatgcataattgtgcttattttg

SEQ ID NO: 512311 - DNA, 25 bp, Homo sapien
tattttgccctaattgaggaatttg

SEQ ID NO: 512312 - DNA, 25 bp, Homo sapien
ttctccctctcagatactatggtgg

SEQ ID NO: 512313 - DNA, 25 bp, Homo sapien
tccctctcagatactatggtgggta

SEQ ID NO: 512314 - DNA, 25 bp, Homo sapien
atggtgggtaaaacccacagcctga

SEQ ID NO: 512315 - DNA, 25 bp, Homo sapien
ttccataaatgccactgagtgtaca

SEQ ID NO: 512316 - DNA, 25 bp, Homo sapien
atacacacacaatattgcctttagt

SEQ ID NO: 512317 - DNA, 25 bp, Homo sapien
acaatattgcctttagtgctaatgc

SEQ ID NO: 512318 - DNA, 25 bp, Homo sapien
gcctttagtgctaatgcaagttgga

SEQ ID NO: 512319 - DNA, 25 bp, Homo sapien
aatacaccagcagggcaattagcag

SEQ ID NO: 512320 - DNA, 25 bp, Homo sapien
aagttggaagtctcgatgttgtgat

SEQ ID NO: 512321 - DNA, 25 bp, Homo sapien
agaccacggaggtgacagcagccat

SEQ ID NO: 512322 - DNA, 25 bp, Homo sapien
ggtgacagcagccatgaacgccatc

SEQ ID NO: 512323 - DNA, 25 bp, Homo sapien
atcccggctggcatgtacaggtgca

SEQ ID NO: 512324 - DNA, 25 bp, Homo sapien
agatggtgggattcggtcaccccat

SEQ ID NO: 512325 - DNA, 25 bp, Homo sapien
ttcggtcaccccatcagacaggatg

SEQ ID NO: 512326 - DNA, 25 bp, Homo sapien
agacaggatgccctctgcaatctca

SEQ ID NO: 512327 - DNA, 25 bp, Homo sapien
tgcaatctcacacaccaggacgaag

SEQ ID NO: 512328 - DNA, 25 bp, Homo sapien
tgaaggtcaggatccaccgcaggtt

SEQ ID NO: 512329 - DNA, 25 bp, Homo sapien
aatgaagccatgtgctgtggtggat

SEQ ID NO: 512330 - DNA, 25 bp, Homo sapien
actaatcccagtcagccattcaggt

SEQ ID NO: 512331 - DNA, 25 bp, Homo sapien
cagccattcaggtctttaggagttc

SEQ ID NO: 512332 - DNA, 25 bp, Homo sapien
caggtctttaggagttccagatgat

SEQ ID NO: 512333 - DNA, 25 bp, Homo sapien
gatggatcagcacaagtctgtcgtc

SEQ ID NO: 512334 - DNA, 25 bp, Homo sapien
agcacaagtctgtcgtcaccgaaaa

SEQ ID NO: 512335 - DNA, 25 bp, Homo sapien
gtcgtcaccgaaaattagtcctctt

SEQ ID NO: 512336 - DNA, 25 bp, Homo sapien
caccgaaaattagtcctcttgttct

SEQ ID NO: 512337 - DNA, 25 bp, Homo sapien
attccactcttttctgagctgatca

SEQ ID NO: 512338 - DNA, 25 bp, Homo sapien
ttttctgagctgatcagacttctca

SEQ ID NO: 512339 - DNA, 25 bp, Homo sapien
agacttctcagctacactgtttttt

SEQ ID NO: 512340 - DNA, 25 bp, Homo sapien
tgaatcagcaagtcaataaacattt

SEQ ID NO: 512341 - DNA, 25 bp, Homo sapien
gtaaaccaaaacactcacatgtctc

SEQ ID NO: 512342 - DNA, 25 bp, Homo sapien
ggtcgatggaagtttctggcatcca

SEQ ID NO: 512343 - DNA, 25 bp, Homo sapien
tttagttctctataaaacactgtca

SEQ ID NO: 512344 - DNA, 25 bp, Homo sapien
aacactgtcatttttgaaagaacca

SEQ ID NO: 512345 - DNA, 25 bp, Homo sapien
atggaagtttctggcatccatgttg

SEQ ID NO: 512346 - DNA, 25 bp, Homo sapien
aaagcaggatttttgtggacacaga

SEQ ID NO: 512347 - DNA, 25 bp, Homo sapien
ggacacagacactcttttcttgccc

SEQ ID NO: 512348 - DNA, 25 bp, Homo sapien
agacactcttttcttgcccaggtat

SEQ ID NO: 512349 - DNA, 25 bp, Homo sapien
tttcttgcccaggtatgttttccac

SEQ ID NO: 512350 - DNA, 25 bp, Homo sapien
gttttccacataatatcagttcttt

SEQ ID NO: 512351 - DNA, 25 bp, Homo sapien
tagaggagaccgcaggtgccttttt

SEQ ID NO: 512352 - DNA, 25 bp, Homo sapien
agcctcctcatattctttagataag

SEQ ID NO: 512353 - DNA, 25 bp, Homo sapien
aagtgagcctggcatctcttttgga

SEQ ID NO: 512354 - DNA, 25 bp, Homo sapien
caccccaactgatttgcacgaactg

SEQ ID NO: 512355 - DNA, 25 bp, Homo sapien
gcacgaactgcaacttcttggttaa

SEQ ID NO: 512356 - DNA, 25 bp, Homo sapien
aacttcttggttaagatgcctggca

SEQ ID NO: 512357 - DNA, 25 bp, Homo sapien
gatgcctggcaatagtttttatttc

SEQ ID NO: 512358 - DNA, 25 bp, Homo sapien
aaaggcagcgtgacagcaccccgta

SEQ ID NO: 512359 - DNA, 25 bp, Homo sapien
gaatccaaaccaacacagtggcttt

SEQ ID NO: 512360 - DNA, 25 bp, Homo sapien
aaagggtggcagttatctcgcacat

SEQ ID NO: 512361 - DNA, 25 bp, Homo sapien
gttatctcgcacatatagctctgaa

SEQ ID NO: 512362 - DNA, 25 bp, Homo sapien
ctgaaattagcctcctcatattctt

SEQ ID NO: 512363 - DNA, 25 bp, Homo sapien
ggacatgcagagttttccaactagg

SEQ ID NO: 512364 - DNA, 25 bp, Homo sapien
ttccaactaggaagactgaatctgt

SEQ ID NO: 512365 - DNA, 25 bp, Homo sapien
actagaattctgtcttcctgcccaa

SEQ ID NO: 512366 - DNA, 25 bp, Homo sapien
ccacctacggatgcaatctgtaatg

SEQ ID NO: 512367 - DNA, 25 bp, Homo sapien
tgcaatctgtaatgcatgtgcatga

SEQ ID NO: 512368 - DNA, 25 bp, Homo sapien
gcatgtgcatgagaagtctgttatt

SEQ ID NO: 512369 - DNA, 25 bp, Homo sapien
tcttcctgcccaacttcaatataag

SEQ ID NO: 512370 - DNA, 25 bp, Homo sapien
ggttatggtaataggaacagctttt

SEQ ID NO: 512371 - DNA, 25 bp, Homo sapien
ctaaaatgcgagaaaggtgtcctgt

SEQ ID NO: 512372 - DNA, 25 bp, Homo sapien
gaaaggtgtcctgtggtctatgcaa

SEQ ID NO: 512373 - DNA, 25 bp, Homo sapien
ggtgtcctgtggtctatgcaaatta

SEQ ID NO: 512374 - DNA, 25 bp, Homo sapien
acttgataacccctagaaagaagag

SEQ ID NO: 512375 - DNA, 25 bp, Homo sapien
cttgataacccctagaaagaagagg

SEQ ID NO: 512376 - DNA, 25 bp, Homo sapien
ttgataacccctagaaagaagagga

SEQ ID NO: 512377 - DNA, 25 bp, Homo sapien
tgataacccctagaaagaagaggac

SEQ ID NO: 512378 - DNA, 25 bp, Homo sapien
gataacccctagaaagaagaggaca

SEQ ID NO: 512379 - DNA, 25 bp, Homo sapien
ataacccctagaaagaagaggacat

SEQ ID NO: 512380 - DNA, 25 bp, Homo sapien
taacccctagaaagaagaggacatg

SEQ ID NO: 512381 - DNA, 25 bp, Homo sapien
aacccctagaaagaagaggacatga

SEQ ID NO: 512382 - DNA, 25 bp, Homo sapien
agtctctagtttaccaatcccaatg

SEQ ID NO: 512383 - DNA, 25 bp, Homo sapien
tagtttaccaatcccaatgcagatg

SEQ ID NO: 512384 - DNA, 25 bp, Homo sapien
gatggctctgggagagataattcca

SEQ ID NO: 512385 - DNA, 25 bp, Homo sapien
ataattccagttggcctggttaggc

SEQ ID NO: 512386 - DNA, 25 bp, Homo sapien
aggatggtgattcttcccaggcgca

SEQ ID NO: 512387 - DNA, 25 bp, Homo sapien
gcgcacacctgtgcacaaagctttg

SEQ ID NO: 512388 - DNA, 25 bp, Homo sapien
aatgggagttgagtgggtcccactc

SEQ ID NO: 512389 - DNA, 25 bp, Homo sapien
ggtcccactcaaacttcatcaaatg

SEQ ID NO: 512390 - DNA, 25 bp, Homo sapien
tcatcaaatgtagggcttctgggac

SEQ ID NO: 512391 - DNA, 25 bp, Homo sapien
agtgaggctttgaaaactggacaga

SEQ ID NO: 512392 - DNA, 25 bp, Homo sapien
gaaagttacacgattctcaaaccat

SEQ ID NO: 512393 - DNA, 25 bp, Homo sapien
aacaagtggctttccttgcctactt

SEQ ID NO: 512394 - DNA, 25 bp, Homo sapien
ttgcctactttagtcacccagcaga

SEQ ID NO: 512395 - DNA, 25 bp, Homo sapien
ggtgcatgactcttccataagggat

SEQ ID NO: 512396 - DNA, 25 bp, Homo sapien
tcacccttccactttcatgcaagaa

SEQ ID NO: 512397 - DNA, 25 bp, Homo sapien
ggcccagttgccacagattatacaa

SEQ ID NO: 512398 - DNA, 25 bp, Homo sapien
ttatacaaccattacccaaaccact

SEQ ID NO: 512399 - DNA, 25 bp, Homo sapien
ctccagttccagcaatgcctagaga

SEQ ID NO: 512400 - DNA, 25 bp, Homo sapien
gcaatgcctagagacatgctccctg

SEQ ID NO: 512401 - DNA, 25 bp, Homo sapien
cacacctagcctttgttctggaaac

SEQ ID NO: 512402 - DNA, 25 bp, Homo sapien
agagggctgggcttgactcatctca

SEQ ID NO: 512403 - DNA, 25 bp, Homo sapien
tgggcttgactcatctcagggaatg

SEQ ID NO: 512404 - DNA, 25 bp, Homo sapien
gtccttgaaggattttaggaagttg

SEQ ID NO: 512405 - DNA, 25 bp, Homo sapien
taaaagtcttgaaacgatgtttggg

SEQ ID NO: 512406 - DNA, 25 bp, Homo sapien
gggcatgttagggttcttgaatgtt

SEQ ID NO: 512407 - DNA, 25 bp, Homo sapien
gcatgttagggttcttgaatgttta

SEQ ID NO: 512408 - DNA, 25 bp, Homo sapien
gtttaattcctctaataactgctta

SEQ ID NO: 512409 - DNA, 25 bp, Homo sapien
aattcctctaataactgcttattca

SEQ ID NO: 512410 - DNA, 25 bp, Homo sapien
ttcctctaataactgcttattcaag

SEQ ID NO: 512411 - DNA, 25 bp, Homo sapien
taataactgcttattcaagagaagc

SEQ ID NO: 512412 - DNA, 25 bp, Homo sapien
tcaagagaagcatttctgactgggt

SEQ ID NO: 512413 - DNA, 25 bp, Homo sapien
agagaagcatttctgactgggtgca

SEQ ID NO: 512414 - DNA, 25 bp, Homo sapien
agaagcatttctgactgggtgcagg

SEQ ID NO: 512415 - DNA, 25 bp, Homo sapien
gaagtgaacaggcatgtccccgcag

SEQ ID NO: 512416 - DNA, 25 bp, Homo sapien
gcatgtccccgcagaaacaatgctt

SEQ ID NO: 512417 - DNA, 25 bp, Homo sapien
acaatgcttccctctgaaaaataga

SEQ ID NO: 512418 - DNA, 25 bp, Homo sapien
aggctaggaacctgtaccctcttgg

SEQ ID NO: 512419 - DNA, 25 bp, Homo sapien
taccctcttggtagaagcactttgg

SEQ ID NO: 512420 - DNA, 25 bp, Homo sapien
actttggtcttcactctcttgggtg

SEQ ID NO: 512421 - DNA, 25 bp, Homo sapien
tcactctcttgggtgggtgcagttg

SEQ ID NO: 512422 - DNA, 25 bp, Homo sapien
ggtgtcagggtctggcaaatctttt

SEQ ID NO: 512423 - DNA, 25 bp, Homo sapien
caaatcttttgccaatgccctagca

SEQ ID NO: 512424 - DNA, 25 bp, Homo sapien
atgccctagcaatggagtttctctc

SEQ ID NO: 512425 - DNA, 25 bp, Homo sapien
atggagtttctctccgggcattgtc

SEQ ID NO: 512426 - DNA, 25 bp, Homo sapien
gtagatcacttttctgaagagcttt

SEQ ID NO: 512427 - DNA, 25 bp, Homo sapien
atacagctaatcaaggagtttgcga

SEQ ID NO: 512428 - DNA, 25 bp, Homo sapien
ggagtttgcgatttctcttactttc

SEQ ID NO: 512429 - DNA, 25 bp, Homo sapien
ctcttactttctacagctcagcagt

SEQ ID NO: 512430 - DNA, 25 bp, Homo sapien
agctcagcagtgactaatgatgtgt

SEQ ID NO: 512431 - DNA, 25 bp, Homo sapien
gactaatgatgtgtgactatgcgaa

SEQ ID NO: 512432 - DNA, 25 bp, Homo sapien
tgaattcgtaaaaactaagcgctta

SEQ ID NO: 512433 - DNA, 25 bp, Homo sapien
aacatggatatttagaagcctttct

SEQ ID NO: 512434 - DNA, 25 bp, Homo sapien
gaagcctttctatatacacagtgca

SEQ ID NO: 512435 - DNA, 25 bp, Homo sapien
acacagtgcagttgagatggtttac

SEQ ID NO: 512436 - DNA, 25 bp, Homo sapien
gatggtttacagcaaatttcgtttt

SEQ ID NO: 512437 - DNA, 25 bp, Homo sapien
aaggagtacatacctggtcagcccc

SEQ ID NO: 512438 - DNA, 25 bp, Homo sapien
ccccattatctcaaagttcggattc

SEQ ID NO: 512439 - DNA, 25 bp, Homo sapien
aaagttcggattcaagcccaaccag

SEQ ID NO: 512440 - DNA, 25 bp, Homo sapien
gaaattctgaacctgctggtttaga

SEQ ID NO: 512441 - DNA, 25 bp, Homo sapien
gaaacaccagaagcgaaagtacttt

SEQ ID NO: 512442 - DNA, 25 bp, Homo sapien
ttttgacaaagtagcttctcaaggg

SEQ ID NO: 512443 - DNA, 25 bp, Homo sapien
aagcccctaaggatcaagtagatat

SEQ ID NO: 512444 - DNA, 25 bp, Homo sapien
gtagatatagctgttcaagaactcc

SEQ ID NO: 512445 - DNA, 25 bp, Homo sapien
gaactccttcagctaaaggcacagt

SEQ ID NO: 512446 - DNA, 25 bp, Homo sapien
aaggcacagtacaagtctttgatag

SEQ ID NO: 512447 - DNA, 25 bp, Homo sapien
gtataagcctgtgtcggccactgga

SEQ ID NO: 512448 - DNA, 25 bp, Homo sapien
caaaaaggtgtcaactctgcccgct

SEQ ID NO: 512449 - DNA, 25 bp, Homo sapien
aggtgtcaactctgcccgctcagtt

SEQ ID NO: 512450 - DNA, 25 bp, Homo sapien
gcaggacccgttaaaccacggccag

SEQ ID NO: 512451 - DNA, 25 bp, Homo sapien
gacggcatcgctcagtcgcaggtct

SEQ ID NO: 512452 - DNA, 25 bp, Homo sapien
gcatcgctcagtcgcaggtctttga

SEQ ID NO: 512453 - DNA, 25 bp, Homo sapien
gtcgcaggtctttgagttcaccgaa

SEQ ID NO: 512454 - DNA, 25 bp, Homo sapien
ttgagttcaccgaacccaagcgcag

SEQ ID NO: 512455 - DNA, 25 bp, Homo sapien
aagcgcagccagtcaccattctggc

SEQ ID NO: 512456 - DNA, 25 bp, Homo sapien
agtcaccattctggcaaaacttcag

SEQ ID NO: 512457 - DNA, 25 bp, Homo sapien
aaatgatacctacagggaggcagat

SEQ ID NO: 512458 - DNA, 25 bp, Homo sapien
cctacagggaggcagataattttaa

SEQ ID NO: 512459 - DNA, 25 bp, Homo sapien
atatattttcttagtcccctgggat

SEQ ID NO: 512460 - DNA, 25 bp, Homo sapien
aaagtgtgtgaagctccataaatat

SEQ ID NO: 512461 - DNA, 25 bp, Homo sapien
tgggatcctccattctgtgccccaa

SEQ ID NO: 512462 - DNA, 25 bp, Homo sapien
aatccctaacccttcattagtaatg

SEQ ID NO: 512463 - DNA, 25 bp, Homo sapien
tagtaatgcctagatgtctccacat

SEQ ID NO: 512464 - DNA, 25 bp, Homo sapien
tagatgtctccacatatttcaaggg

SEQ ID NO: 512465 - DNA, 25 bp, Homo sapien
gggtgccagaaagtctccagacaaa

SEQ ID NO: 512466 - DNA, 25 bp, Homo sapien
aactctagacaccttgttctccatg

SEQ ID NO: 512467 - DNA, 25 bp, Homo sapien
aatgtttgtagtcccagccttgcta

SEQ ID NO: 512468 - DNA, 25 bp, Homo sapien
gccttgctagctcaaatccaagtta

SEQ ID NO: 512469 - DNA, 25 bp, Homo sapien
gggtagttcttctctcagccccaat

SEQ ID NO: 512470 - DNA, 25 bp, Homo sapien
tgatgctcaagaaatcactaacagc

SEQ ID NO: 512471 - DNA, 25 bp, Homo sapien
taacagctactgacttctacaatgg

SEQ ID NO: 512472 - DNA, 25 bp, Homo sapien
tacaatggatatttgcacccctggt

SEQ ID NO: 512473 - DNA, 25 bp, Homo sapien
atatttgcacccctggtaccagaaa

SEQ ID NO: 512474 - DNA, 25 bp, Homo sapien
agaaaaattcccaagctcaaccaag

SEQ ID NO: 512475 - DNA, 25 bp, Homo sapien
aagctcaaccaagccaatgcagatt

SEQ ID NO: 512476 - DNA, 25 bp, Homo sapien
aatgcagatttcagactctcagact

SEQ ID NO: 512477 - DNA, 25 bp, Homo sapien
gttgctatgcaacaatgcattgagt

SEQ ID NO: 512478 - DNA, 25 bp, Homo sapien
gtaatataccacaaacagtcacaaa

SEQ ID NO: 512479 - DNA, 25 bp, Homo sapien
aatactattggtttattgcaaggat

SEQ ID NO: 512480 - DNA, 25 bp, Homo sapien
gattggtgttcgatcagtgatgctc

SEQ ID NO: 512481 - DNA, 25 bp, Homo sapien
atcactttggttcagagctctaaaa

SEQ ID NO: 512482 - DNA, 25 bp, Homo sapien
gccattctaaaaaggactccctaca

SEQ ID NO: 512483 - DNA, 25 bp, Homo sapien
attctaaaaaggactccctacatga

SEQ ID NO: 512484 - DNA, 25 bp, Homo sapien
ctaaaaaggactccctacatgacct

SEQ ID NO: 512485 - DNA, 25 bp, Homo sapien
aaaaaggactccctacatgacctgc

SEQ ID NO: 512486 - DNA, 25 bp, Homo sapien
aaaaggactccctacatgacctgca

SEQ ID NO: 512487 - DNA, 25 bp, Homo sapien
aaaggactccctacatgacctgcaa

SEQ ID NO: 512488 - DNA, 25 bp, Homo sapien
aaggactccctacatgacctgcaac

SEQ ID NO: 512489 - DNA, 25 bp, Homo sapien
ggactccctacatgacctgcaactt

SEQ ID NO: 512490 - DNA, 25 bp, Homo sapien
actccctacatgacctgcaacttga

SEQ ID NO: 512491 - DNA, 25 bp, Homo sapien
tccctacatgacctgcaacttgaaa

SEQ ID NO: 512492 - DNA, 25 bp, Homo sapien
ttttgtttcttgagtagcctagaac

SEQ ID NO: 512493 - DNA, 25 bp, Homo sapien
agcctagaactatgctactcactga

SEQ ID NO: 512494 - DNA, 25 bp, Homo sapien
gctactcactgatgtgcatgttcaa

SEQ ID NO: 512495 - DNA, 25 bp, Homo sapien
gcgagatgtgcttttcgttggttga

SEQ ID NO: 512496 - DNA, 25 bp, Homo sapien
tcgttggttgaatttgtccctcctt

SEQ ID NO: 512497 - DNA, 25 bp, Homo sapien
gtccctccttgcctaagaaatacta

SEQ ID NO: 512498 - DNA, 25 bp, Homo sapien
ggtcatccttttataaggacaaact

SEQ ID NO: 512499 - DNA, 25 bp, Homo sapien
aactgcttttgaacagtgtcttcaa

SEQ ID NO: 512500 - DNA, 25 bp, Homo sapien
atcaagcacaaataactctttcttc

SEQ ID NO: 512501 - DNA, 25 bp, Homo sapien
gaatcataagtctctttttaccagc

SEQ ID NO: 512502 - DNA, 25 bp, Homo sapien
cataagtctctttttaccagcttaa

SEQ ID NO: 512503 - DNA, 25 bp, Homo sapien
agacacagggaactccatctctcat

SEQ ID NO: 512504 - DNA, 25 bp, Homo sapien
catctctcattctcactagcaattt

SEQ ID NO: 512505 - DNA, 25 bp, Homo sapien
ctagcaatttgctgtggcaactcaa

SEQ ID NO: 512506 - DNA, 25 bp, Homo sapien
cagacgtgatgtgtttgccttccag

SEQ ID NO: 512507 - DNA, 25 bp, Homo sapien
tgtttgccttccaggtctaacccat

SEQ ID NO: 512508 - DNA, 25 bp, Homo sapien
taacccatgcaaagcctcctgggaa

SEQ ID NO: 512509 - DNA, 25 bp, Homo sapien
tgggaacacacctcacgctattttc

SEQ ID NO: 512510 - DNA, 25 bp, Homo sapien
cgctattttctattccatcaggtgg

SEQ ID NO: 512511 - DNA, 25 bp, Homo sapien
tggagccagaaaacacaaggagcct

SEQ ID NO: 512512 - DNA, 25 bp, Homo sapien
atccctgaatgaccacatggacata

SEQ ID NO: 512513 - DNA, 25 bp, Homo sapien
ggacatacacatgctgaagactgcc

SEQ ID NO: 512514 - DNA, 25 bp, Homo sapien
ttgatacaacctacagacctcacat

SEQ ID NO: 512515 - DNA, 25 bp, Homo sapien
gacctcacattccaatcagcaaatt

SEQ ID NO: 512516 - DNA, 25 bp, Homo sapien
agttgtttcagaatcctatgatact

SEQ ID NO: 512517 - DNA, 25 bp, Homo sapien
ttatcgatcatgtctattgctcccc

SEQ ID NO: 512518 - DNA, 25 bp, Homo sapien
gctgcgttcagactgcacacaatat

SEQ ID NO: 512519 - DNA, 25 bp, Homo sapien
tgaagatccgtgtagagcccggctt

SEQ ID NO: 512520 - DNA, 25 bp, Homo sapien
gagcccggcttatttgagtggacaa

SEQ ID NO: 512521 - DNA, 25 bp, Homo sapien
gttgctgggagcacattacctgcat

SEQ ID NO: 512522 - DNA, 25 bp, Homo sapien
agcacattacctgcatggatacctc

SEQ ID NO: 512523 - DNA, 25 bp, Homo sapien
tacctccatcagagttagctgcagc

SEQ ID NO: 512524 - DNA, 25 bp, Homo sapien
tagctgcagccaacctgagtgttga

SEQ ID NO: 512525 - DNA, 25 bp, Homo sapien
tcaaggaggagcaccgcgcctacga

SEQ ID NO: 512526 - DNA, 25 bp, Homo sapien
agaactcgcaggacgcgctccgcgt

SEQ ID NO: 512527 - DNA, 25 bp, Homo sapien
tgtacaagtgcgaacactgccgggt

SEQ ID NO: 512528 - DNA, 25 bp, Homo sapien
aagtgcgaacactgccgggtgctct

SEQ ID NO: 512529 - DNA, 25 bp, Homo sapien
aacactgccgggtgctcttcctgga

SEQ ID NO: 512530 - DNA, 25 bp, Homo sapien
tgctcttcctggatcacgtcatgta

SEQ ID NO: 512531 - DNA, 25 bp, Homo sapien
gcttccgtgatccttttgagtgcaa

SEQ ID NO: 512532 - DNA, 25 bp, Homo sapien
ttgagtgcaacatgtgcggctacca

SEQ ID NO: 512533 - DNA, 25 bp, Homo sapien
acatgtgcggctaccacagccagga

SEQ ID NO: 512534 - DNA, 25 bp, Homo sapien
ccaggaccggtacgagttctcgtcg

SEQ ID NO: 512535 - DNA, 25 bp, Homo sapien
gtacgagttctcgtcgcacataacg

SEQ ID NO: 512536 - DNA, 25 bp, Homo sapien
gatgctctaaaacctcaaatcagtg

SEQ ID NO: 512537 - DNA, 25 bp, Homo sapien
gagagtgaggaacccccaaggcacc

SEQ ID NO: 512538 - DNA, 25 bp, Homo sapien
aaggcaccaagccagtgactccgaa

SEQ ID NO: 512539 - DNA, 25 bp, Homo sapien
gactccgaaaatgaggagcctccca

SEQ ID NO: 512540 - DNA, 25 bp, Homo sapien
agcctcccaaacctcgaatgagtga

SEQ ID NO: 512541 - DNA, 25 bp, Homo sapien
ccaaacctcgaatgagtgattctga

SEQ ID NO: 512542 - DNA, 25 bp, Homo sapien
taaacctcaggtcagtgattcagaa

SEQ ID NO: 512543 - DNA, 25 bp, Homo sapien
aaggcaccaggccagtgactctgaa

SEQ ID NO: 512544 - DNA, 25 bp, Homo sapien
gaggagcttcccaaacctcgtatca

SEQ ID NO: 512545 - DNA, 25 bp, Homo sapien
tcccaaacctcgtatcagtgactca

SEQ ID NO: 512546 - DNA, 25 bp, Homo sapien
aagtgaggaccctccgaggcaccag

SEQ ID NO: 512547 - DNA, 25 bp, Homo sapien
cagtattgcattttcacataggtga

SEQ ID NO: 512548 - DNA, 25 bp, Homo sapien
aatgactttggaactttatctgtgt

SEQ ID NO: 512549 - DNA, 25 bp, Homo sapien
atagttatgagttgctttgggagac

SEQ ID NO: 512550 - DNA, 25 bp, Homo sapien
ggagctctctgtagctattgttcat

SEQ ID NO: 512551 - DNA, 25 bp, Homo sapien
ataacactttgctccataaccctga

SEQ ID NO: 512552 - DNA, 25 bp, Homo sapien
ataaccctgatgtccgcagtatcta

SEQ ID NO: 512553 - DNA, 25 bp, Homo sapien
tatctaagtatctcagccttcatcc

SEQ ID NO: 512554 - DNA, 25 bp, Homo sapien
agccttcatccattaactctactag

SEQ ID NO: 512555 - DNA, 25 bp, Homo sapien
attaactctactagggagcccacag

SEQ ID NO: 512556 - DNA, 25 bp, Homo sapien
agccaccatttccactaggaggtat

SEQ ID NO: 512557 - DNA, 25 bp, Homo sapien
tggtatgacataaggctcccttgaa

SEQ ID NO: 512558 - DNA, 25 bp, Homo sapien
aagtcctcatatgacactcctatgg

SEQ ID NO: 512559 - DNA, 25 bp, Homo sapien
ggcatctctgtgtctaccgccgtta

SEQ ID NO: 512560 - DNA, 25 bp, Homo sapien
cgccgttactcattctgtgcatata

SEQ ID NO: 512561 - DNA, 25 bp, Homo sapien
catatatgtttgcttaggtccttgg

SEQ ID NO: 512562 - DNA, 25 bp, Homo sapien
tgcttaggtccttggtataaattcc

SEQ ID NO: 512563 - DNA, 25 bp, Homo sapien
aactttttatatttattgcccagtg

SEQ ID NO: 512564 - DNA, 25 bp, Homo sapien
tgcccagtgacctcccagaaagatt

SEQ ID NO: 512565 - DNA, 25 bp, Homo sapien
gacctcccagaaagattgtacccct

SEQ ID NO: 512566 - DNA, 25 bp, Homo sapien
cctttctcccatcaagagttcatca

SEQ ID NO: 512567 - DNA, 25 bp, Homo sapien
gagttcatcagtaatgcatcaatac

SEQ ID NO: 512568 - DNA, 25 bp, Homo sapien
gaaaggtatctcaaattcctttgaa

SEQ ID NO: 512569 - DNA, 25 bp, Homo sapien
aagagtagaggagcgtctactggtc

SEQ ID NO: 512570 - DNA, 25 bp, Homo sapien
gagtagaggagcgtctactggtctt

SEQ ID NO: 512571 - DNA, 25 bp, Homo sapien
agtagaggagcgtctactggtcttt

SEQ ID NO: 512572 - DNA, 25 bp, Homo sapien
gtagaggagcgtctactggtctttc

SEQ ID NO: 512573 - DNA, 25 bp, Homo sapien
tagaggagcgtctactggtctttca

SEQ ID NO: 512574 - DNA, 25 bp, Homo sapien
agaggagcgtctactggtctttcaa

SEQ ID NO: 512575 - DNA, 25 bp, Homo sapien
gaggagcgtctactggtctttcaac

SEQ ID NO: 512576 - DNA, 25 bp, Homo sapien
cccatttattataggccagtgatgt

SEQ ID NO: 512577 - DNA, 25 bp, Homo sapien
ccatttattataggccagtgatgtc

SEQ ID NO: 512578 - DNA, 25 bp, Homo sapien
catttattataggccagtgatgtct

SEQ ID NO: 512579 - DNA, 25 bp, Homo sapien
tttattataggccagtgatgtctca

SEQ ID NO: 512580 - DNA, 25 bp, Homo sapien
cagatcgtttcccaagtttggcgat

SEQ ID NO: 512581 - DNA, 25 bp, Homo sapien
aagtttggcgatttgctgtcggtgc

SEQ ID NO: 512582 - DNA, 25 bp, Homo sapien
gcctcagccacatatgaccaatggt

SEQ ID NO: 512583 - DNA, 25 bp, Homo sapien
aatggttacaactcagggctccaga

SEQ ID NO: 512584 - DNA, 25 bp, Homo sapien
agggctccagacctcagctaaaaag

SEQ ID NO: 512585 - DNA, 25 bp, Homo sapien
aaagagaagacgctgccctcctggg

SEQ ID NO: 512586 - DNA, 25 bp, Homo sapien
cctcctgggcacgaacgtttagaat

SEQ ID NO: 512587 - DNA, 25 bp, Homo sapien
agaatgctcaactcctctattgtga

SEQ ID NO: 512588 - DNA, 25 bp, Homo sapien
tggccctgaagatgcaccgaagaca

SEQ ID NO: 512589 - DNA, 25 bp, Homo sapien
gaggtgactgctgtactgtcagcct

SEQ ID NO: 512590 - DNA, 25 bp, Homo sapien
gaggcattcgtgcagtgccagctaa

SEQ ID NO: 512591 - DNA, 25 bp, Homo sapien
gtttgtcaggataaaaaacatatta

SEQ ID NO: 512592 - DNA, 25 bp, Homo sapien
aacatattattattttggccgggcg

SEQ ID NO: 512593 - DNA, 25 bp, Homo sapien
acatattattattttggccgggcgc

SEQ ID NO: 512594 - DNA, 25 bp, Homo sapien
catattattattttggccgggcgcg

SEQ ID NO: 512595 - DNA, 25 bp, Homo sapien
atattattattttggccgggcgcgg

SEQ ID NO: 512596 - DNA, 25 bp, Homo sapien
tattattattttggccgggcgcggt

SEQ ID NO: 512597 - DNA, 25 bp, Homo sapien
attattattttggccgggcgcggtg

SEQ ID NO: 512598 - DNA, 25 bp, Homo sapien
catgcctgtagttcctactctggag

SEQ ID NO: 512599 - DNA, 25 bp, Homo sapien
gcaccagaatcacttgaaccaggag

SEQ ID NO: 512600 - DNA, 25 bp, Homo sapien
agctgagatggtgcccgctgcactc

SEQ ID NO: 512601 - DNA, 25 bp, Homo sapien
gctgagatggtgcccgctgcactcc

SEQ ID NO: 512602 - DNA, 25 bp, Homo sapien
tagtttctgttctcctccccttact

SEQ ID NO: 512603 - DNA, 25 bp, Homo sapien
ttgtgtctttcccacgcggattctt

SEQ ID NO: 512604 - DNA, 25 bp, Homo sapien
tttcccacgcggattctttctcttt

SEQ ID NO: 512605 - DNA, 25 bp, Homo sapien
tctgagtggacaatactgtaggcct

SEQ ID NO: 512606 - DNA, 25 bp, Homo sapien
tggacaatactgtaggcctgacccg

SEQ ID NO: 512607 - DNA, 25 bp, Homo sapien
aatactgtaggcctgacccgcttag

SEQ ID NO: 512608 - DNA, 25 bp, Homo sapien
tgacccgcttagacaaactctgacc

SEQ ID NO: 512609 - DNA, 25 bp, Homo sapien
tagacaaactctgacctcctgtggt

SEQ ID NO: 512610 - DNA, 25 bp, Homo sapien
tgtggtcacccaggaagctgactgc

SEQ ID NO: 512611 - DNA, 25 bp, Homo sapien
aagctgactgctaggccttggatga

SEQ ID NO: 512612 - DNA, 25 bp, Homo sapien
accaggtgataccagaatggctccc

SEQ ID NO: 512613 - DNA, 25 bp, Homo sapien
acagagaacgttggtggcgtcgtaa

SEQ ID NO: 512614 - DNA, 25 bp, Homo sapien
acagcgggaacaggatttgagagcc

SEQ ID NO: 512615 - DNA, 25 bp, Homo sapien
gaacaggatttgagagccgggaacc

SEQ ID NO: 512616 - DNA, 25 bp, Homo sapien
ttattttactgtgaatctctggcct

SEQ ID NO: 512617 - DNA, 25 bp, Homo sapien
tttactgtgaatctctggccttata

SEQ ID NO: 512618 - DNA, 25 bp, Homo sapien
tactgtgaatctctggccttatatc

SEQ ID NO: 512619 - DNA, 25 bp, Homo sapien
ctgtgaatctctggccttatatcag

SEQ ID NO: 512620 - DNA, 25 bp, Homo sapien
gaatctctggccttatatcagaaaa

SEQ ID NO: 512621 - DNA, 25 bp, Homo sapien
aaaaaattgtgccaccctcggcaca

SEQ ID NO: 512622 - DNA, 25 bp, Homo sapien
attgtgccaccctcggcacagagaa

SEQ ID NO: 512623 - DNA, 25 bp, Homo sapien
accctcggcacagagaacgttggtg

SEQ ID NO: 512624 - DNA, 25 bp, Homo sapien
atctctccatttggtctcttcttac

SEQ ID NO: 512625 - DNA, 25 bp, Homo sapien
atttggtctcttcttacactccaac

SEQ ID NO: 512626 - DNA, 25 bp, Homo sapien
tccaacccagcaggaacagttaata

SEQ ID NO: 512627 - DNA, 25 bp, Homo sapien
gtttactgtgatggatcctggctat

SEQ ID NO: 512628 - DNA, 25 bp, Homo sapien
tcctggctatccctctaggaggaga

SEQ ID NO: 512629 - DNA, 25 bp, Homo sapien
aggaggagacctttgcttcagcaat

SEQ ID NO: 512630 - DNA, 25 bp, Homo sapien
agacctttgcttcagcaatggtgtc

SEQ ID NO: 512631 - DNA, 25 bp, Homo sapien
agctgcttcatttccttaggtctgt

SEQ ID NO: 512632 - DNA, 25 bp, Homo sapien
ccttaggtctgttgtgttttctgta

SEQ ID NO: 512633 - DNA, 25 bp, Homo sapien
ctgtaaagtgttaggaattctggat

SEQ ID NO: 512634 - DNA, 25 bp, Homo sapien
gttgtttacagatcttttaatgaat

SEQ ID NO: 512635 - DNA, 25 bp, Homo sapien
ttcaccttattacatgctattttat

SEQ ID NO: 512636 - DNA, 25 bp, Homo sapien
aactcaggacattaactaattttag

SEQ ID NO: 512637 - DNA, 25 bp, Homo sapien
taggttttcctttatcatggctttc

SEQ ID NO: 512638 - DNA, 25 bp, Homo sapien
ggttttcctttatcatggctttcta

SEQ ID NO: 512639 - DNA, 25 bp, Homo sapien
ttttcctttatcatggctttctaca

SEQ ID NO: 512640 - DNA, 25 bp, Homo sapien
atcatggctttctacagtatttcta

SEQ ID NO: 512641 - DNA, 25 bp, Homo sapien
ctttcttccaagtgcatgtgtgtcc

SEQ ID NO: 512642 - DNA, 25 bp, Homo sapien
tgtccttgtcttcttaagtctgaga

SEQ ID NO: 512643 - DNA, 25 bp, Homo sapien
tgtcttcttaagtctgagaggttgc

SEQ ID NO: 512644 - DNA, 25 bp, Homo sapien
gaaaggactgttttcttgtacttgt

SEQ ID NO: 512645 - DNA, 25 bp, Homo sapien
tcttgtacttgttcatttgtgcctc

SEQ ID NO: 512646 - DNA, 25 bp, Homo sapien
aaaagatagtttagctacttgaatt

SEQ ID NO: 512647 - DNA, 25 bp, Homo sapien
ttttgcacctgccttgtaaatttaa

SEQ ID NO: 512648 - DNA, 25 bp, Homo sapien
gcacctgccttgtaaatttaatagt

SEQ ID NO: 512649 - DNA, 25 bp, Homo sapien
tttaatagttaagtgacctctgcct

SEQ ID NO: 512650 - DNA, 25 bp, Homo sapien
atagttaagtgacctctgcctagag

SEQ ID NO: 512651 - DNA, 25 bp, Homo sapien
gtgacctctgcctagaggatgatat

SEQ ID NO: 512652 - DNA, 25 bp, Homo sapien
tttcctgtgggaataagacgattca

SEQ ID NO: 512653 - DNA, 25 bp, Homo sapien
gaataagacgattcacaggtgagag

SEQ ID NO: 512654 - DNA, 25 bp, Homo sapien
gaaggttttcactgacttcacctaa

SEQ ID NO: 512655 - DNA, 25 bp, Homo sapien
ggttttcactgacttcacctaaaag

SEQ ID NO: 512656 - DNA, 25 bp, Homo sapien
ttcactgacttcacctaaaagatag

SEQ ID NO: 512657 - DNA, 25 bp, Homo sapien
gtcatctgacttggaaggtacacct

SEQ ID NO: 512658 - DNA, 25 bp, Homo sapien
aaagctcactgcaaggagtctccct

SEQ ID NO: 512659 - DNA, 25 bp, Homo sapien
ctccctgcagattccaaggctggaa

SEQ ID NO: 512660 - DNA, 25 bp, Homo sapien
ttttcttctggctccaggcagcaca

SEQ ID NO: 512661 - DNA, 25 bp, Homo sapien
ggacaagatgtcctctcagggtctt

SEQ ID NO: 512662 - DNA, 25 bp, Homo sapien
ctctcagggtcttcaatggccaagt

SEQ ID NO: 512663 - DNA, 25 bp, Homo sapien
agaatctttctgtctacccgtaagt

SEQ ID NO: 512664 - DNA, 25 bp, Homo sapien
ttctgtctacccgtaagtatccttt

SEQ ID NO: 512665 - DNA, 25 bp, Homo sapien
gtaagtatcctttcctgagttccag

SEQ ID NO: 512666 - DNA, 25 bp, Homo sapien
tttcctgagttccaggcaaagctgg

SEQ ID NO: 512667 - DNA, 25 bp, Homo sapien
gttagcctatgactgtcatctgact

SEQ ID NO: 512668 - DNA, 25 bp, Homo sapien
gcccaggccatgaaactcaatgtgc

SEQ ID NO: 512669 - DNA, 25 bp, Homo sapien
gccatgaaactcaatgtgccccgaa

SEQ ID NO: 512670 - DNA, 25 bp, Homo sapien
tgaaactcaatgtgccccgaaagac

SEQ ID NO: 512671 - DNA, 25 bp, Homo sapien
caatgtgccccgaaagacccggctt

SEQ ID NO: 512672 - DNA, 25 bp, Homo sapien
aagacccggctttacgtggatcaga

SEQ ID NO: 512673 - DNA, 25 bp, Homo sapien
tacgtggatcagacactgcgagagc

SEQ ID NO: 512674 - DNA, 25 bp, Homo sapien
accgggccttccagacagacctata

SEQ ID NO: 512675 - DNA, 25 bp, Homo sapien
gacctatacctgctgcgcctacgtg

SEQ ID NO: 512676 - DNA, 25 bp, Homo sapien
tgcaggccctcgagtccagcctgag

SEQ ID NO: 512677 - DNA, 25 bp, Homo sapien
gagagccactcaagctgcacgccgt

SEQ ID NO: 512678 - DNA, 25 bp, Homo sapien
cactcaagctgcacgccgtggttca

SEQ ID NO: 512679 - DNA, 25 bp, Homo sapien
ggagacctgtgtaaaagcagactat

SEQ ID NO: 512680 - DNA, 25 bp, Homo sapien
gtgtaaaagcagactattatcttcc

SEQ ID NO: 512681 - DNA, 25 bp, Homo sapien
ttcctactgtgagagtactaaaatt

SEQ ID NO: 512682 - DNA, 25 bp, Homo sapien
aagcattgaagtaaatgtttctttt

SEQ ID NO: 512683 - DNA, 25 bp, Homo sapien
tgttgcagatacatagttgctctag

SEQ ID NO: 512684 - DNA, 25 bp, Homo sapien
gcagatacatagttgctctagagat

SEQ ID NO: 512685 - DNA, 25 bp, Homo sapien
catagttgctctagagatcaccttt

SEQ ID NO: 512686 - DNA, 25 bp, Homo sapien
agagatcacctttttctttatgcat

SEQ ID NO: 512687 - DNA, 25 bp, Homo sapien
gatcacctttttctttatgcattgt

SEQ ID NO: 512688 - DNA, 25 bp, Homo sapien
gcattgtgaatagcagtctgcatcc

SEQ ID NO: 512689 - DNA, 25 bp, Homo sapien
atagcagtctgcatcctaagtttaa

SEQ ID NO: 512690 - DNA, 25 bp, Homo sapien
atcattttcacttgtctgtattgag

SEQ ID NO: 512691 - DNA, 25 bp, Homo sapien
tttcacttgtctgtattgagatatt

SEQ ID NO: 512692 - DNA, 25 bp, Homo sapien
gttctctgtaaacttgagttgattt

SEQ ID NO: 512693 - DNA, 25 bp, Homo sapien
tgtccttctctcttgtaacgtgtta

SEQ ID NO: 512694 - DNA, 25 bp, Homo sapien
gtaacgtgttatacaatgactcttg

SEQ ID NO: 512695 - DNA, 25 bp, Homo sapien
acaatgactcttgggcttgcttaaa

SEQ ID NO: 512696 - DNA, 25 bp, Homo sapien
taaaaagacagatatagccacagat

SEQ ID NO: 512697 - DNA, 25 bp, Homo sapien
atatagccacagatgcagggagttt

SEQ ID NO: 512698 - DNA, 25 bp, Homo sapien
acagatgcagggagtttgggcacaa

SEQ ID NO: 512699 - DNA, 25 bp, Homo sapien
tttgggcacaaaacacgtgcagttt

SEQ ID NO: 512700 - DNA, 25 bp, Homo sapien
gcagtttaaagttggtgtgcgttaa

SEQ ID NO: 512701 - DNA, 25 bp, Homo sapien
ttctttcttccaagtgcatgtgtgt

SEQ ID NO: 512702 - DNA, 25 bp, Homo sapien
tctttcttccaagtgcatgtgtgtc

SEQ ID NO: 512703 - DNA, 25 bp, Homo sapien
ctttcttccaagtgcatgtgtgtcc

SEQ ID NO: 512704 - DNA, 25 bp, Homo sapien
tgtcttcttaagtctgagaggttgc

SEQ ID NO: 512705 - DNA, 25 bp, Homo sapien
gtctgagaggttgctggaaaggact

SEQ ID NO: 512706 - DNA, 25 bp, Homo sapien
tctgagaggttgctggaaaggactg

SEQ ID NO: 512707 - DNA, 25 bp, Homo sapien
ctgagaggttgctggaaaggactgt

SEQ ID NO: 512708 - DNA, 25 bp, Homo sapien
tgagaggttgctggaaaggactgtt

SEQ ID NO: 512709 - DNA, 25 bp, Homo sapien
gagaggttgctggaaaggactgttt

SEQ ID NO: 512710 - DNA, 25 bp, Homo sapien
gaaaggactgttttcttgtacttgt

SEQ ID NO: 512711 - DNA, 25 bp, Homo sapien
tcttgtacttgttcatttgtgcctc

SEQ ID NO: 512712 - DNA, 25 bp, Homo sapien
cccaccgttttagagagctaggcct

SEQ ID NO: 512713 - DNA, 25 bp, Homo sapien
caccgttttagagagctaggcctca

SEQ ID NO: 512714 - DNA, 25 bp, Homo sapien
gttttagagagctaggcctcagcca

SEQ ID NO: 512715 - DNA, 25 bp, Homo sapien
ttttagagagctaggcctcagccag

SEQ ID NO: 512716 - DNA, 25 bp, Homo sapien
taggcctcagccagtcttgccactc

SEQ ID NO: 512717 - DNA, 25 bp, Homo sapien
cccatctcagtgcttcctgaagagg

SEQ ID NO: 512718 - DNA, 25 bp, Homo sapien
gctgttttgagtgttgatgaaaagc

SEQ ID NO: 512719 - DNA, 25 bp, Homo sapien
tgagtgttgatgaaaagcaatgcaa

SEQ ID NO: 512720 - DNA, 25 bp, Homo sapien
caatgcaattatgccaaacagtatt

SEQ ID NO: 512721 - DNA, 25 bp, Homo sapien
attatgccaaacagtattgagcaga

SEQ ID NO: 512722 - DNA, 25 bp, Homo sapien
gccaaacagtattgagcagaataat

SEQ ID NO: 512723 - DNA, 25 bp, Homo sapien
acctcacacaatggccagctatgaa

SEQ ID NO: 512724 - DNA, 25 bp, Homo sapien
aggtactatctcctttagccatggt

SEQ ID NO: 512725 - DNA, 25 bp, Homo sapien
tagccatggtcctttaggcactgga

SEQ ID NO: 512726 - DNA, 25 bp, Homo sapien
tttaggcactggaaccggcattggc

SEQ ID NO: 512727 - DNA, 25 bp, Homo sapien
ggaaccggcattggcgtcattcttt

SEQ ID NO: 512728 - DNA, 25 bp, Homo sapien
gtcattcttttcctccagcatggag

SEQ ID NO: 512729 - DNA, 25 bp, Homo sapien
tccagcatggagtgcaacccttcac

SEQ ID NO: 512730 - DNA, 25 bp, Homo sapien
agcatctcctgtcatccctggtgag

SEQ ID NO: 512731 - DNA, 25 bp, Homo sapien
tgtcatccctggtgagcctatgaaa

SEQ ID NO: 512732 - DNA, 25 bp, Homo sapien
tccctggtgagcctatgaaactatc

SEQ ID NO: 512733 - DNA, 25 bp, Homo sapien
atgaaactatctggagagggtcctc

SEQ ID NO: 512734 - DNA, 25 bp, Homo sapien
tgtcttcctgacctgagtgttatct

SEQ ID NO: 512735 - DNA, 25 bp, Homo sapien
tcctgacctgagtgttatctccatg

SEQ ID NO: 512736 - DNA, 25 bp, Homo sapien
agcaaaggagagatccccggaatct

SEQ ID NO: 512737 - DNA, 25 bp, Homo sapien
attacgtggagtgacggtcatgctg

SEQ ID NO: 512738 - DNA, 25 bp, Homo sapien
gagagatccccggaatctgcagagt

SEQ ID NO: 512739 - DNA, 25 bp, Homo sapien
agatccccggaatctgcagagtgaa

SEQ ID NO: 512740 - DNA, 25 bp, Homo sapien
aaaatagcaaacaatccagggtctt

SEQ ID NO: 512741 - DNA, 25 bp, Homo sapien
agcaaacaatccagggtcttgctct

SEQ ID NO: 512742 - DNA, 25 bp, Homo sapien
tcatgctgcggcgtggacacttggc

SEQ ID NO: 512743 - DNA, 25 bp, Homo sapien
gctgcggcgtggacacttggcattc

SEQ ID NO: 512744 - DNA, 25 bp, Homo sapien
gcgtggacacttggcattcagggac

SEQ ID NO: 512745 - DNA, 25 bp, Homo sapien
cccggctttacgtggatcagacact

SEQ ID NO: 512746 - DNA, 25 bp, Homo sapien
gctttacgtggatcagacactgcga

SEQ ID NO: 512747 - DNA, 25 bp, Homo sapien
tacgtggatcagacactgcgagagc

SEQ ID NO: 512748 - DNA, 25 bp, Homo sapien
tcagacactgcgagagcgggaggct

SEQ ID NO: 512749 - DNA, 25 bp, Homo sapien
agagcgggaggctggcaccgccatg

SEQ ID NO: 512750 - DNA, 25 bp, Homo sapien
accgggccttccagacagacctata

SEQ ID NO: 512751 - DNA, 25 bp, Homo sapien
gacctatacctgctgcgcctacgtg

SEQ ID NO: 512752 - DNA, 25 bp, Homo sapien
tgcaggccctcgagtccagcctgag

SEQ ID NO: 512753 - DNA, 25 bp, Homo sapien
ctgtccacgacagcccgagagccac

SEQ ID NO: 512754 - DNA, 25 bp, Homo sapien
gagagccactcaagctgcacgccgt

SEQ ID NO: 512755 - DNA, 25 bp, Homo sapien
cactcaagctgcacgccgtggttca

SEQ ID NO: 512756 - DNA, 25 bp, Homo sapien
gagatctgccgaggataacaacctc

SEQ ID NO: 512757 - DNA, 25 bp, Homo sapien
atctgccgaggataacaacctccct

SEQ ID NO: 512758 - DNA, 25 bp, Homo sapien
tgccgaggataacaacctcccttgt

SEQ ID NO: 512759 - DNA, 25 bp, Homo sapien
gaggataacaacctcccttgtggcc

SEQ ID NO: 512760 - DNA, 25 bp, Homo sapien
ggataacaacctcccttgtggccga

SEQ ID NO: 512761 - DNA, 25 bp, Homo sapien
taacaacctcccttgtggccgaagg

SEQ ID NO: 512762 - DNA, 25 bp, Homo sapien
tccgcttcgagagacggcgacaaag

SEQ ID NO: 512763 - DNA, 25 bp, Homo sapien
cgagagacggcgacaaaggaaagtt

SEQ ID NO: 512764 - DNA, 25 bp, Homo sapien
gacaaaggaaagttcgtagcgcgtt

SEQ ID NO: 512765 - DNA, 25 bp, Homo sapien
gcccggccacctctgagaagggaga

SEQ ID NO: 512766 - DNA, 25 bp, Homo sapien
gacgctgctgggtccgctgagcggg

SEQ ID NO: 512767 - DNA, 25 bp, Homo sapien
aaagctgcatcctgggagagccagc

SEQ ID NO: 512768 - DNA, 25 bp, Homo sapien
agcgggcaagggacaccctgcctca

SEQ ID NO: 512769 - DNA, 25 bp, Homo sapien
tcagaatcccaccaggaggagtcct

SEQ ID NO: 512770 - DNA, 25 bp, Homo sapien
aggagtcctggctttctgtgggtcc

SEQ ID NO: 512771 - DNA, 25 bp, Homo sapien
gtgaaattacagaactaccagcatc

SEQ ID NO: 512772 - DNA, 25 bp, Homo sapien
ggaatatgagacactggccatgcct

SEQ ID NO: 512773 - DNA, 25 bp, Homo sapien
ggccatgcctgaaggatcgcaagca

SEQ ID NO: 512774 - DNA, 25 bp, Homo sapien
ggactgatatgcaggaatcccagcc

SEQ ID NO: 512775 - DNA, 25 bp, Homo sapien
aatcccagcctactgtgggcttgga

SEQ ID NO: 512776 - DNA, 25 bp, Homo sapien
actgtgggcttggatgatgaaactc

SEQ ID NO: 512777 - DNA, 25 bp, Homo sapien
gaaactccacaactactaggaccta

SEQ ID NO: 512778 - DNA, 25 bp, Homo sapien
gtttattgagctgtacatgcatatg

SEQ ID NO: 512779 - DNA, 25 bp, Homo sapien
attgagctgtacatgcatatgagaa

SEQ ID NO: 512780 - DNA, 25 bp, Homo sapien
gagctgtacatgcatatgagaaata

SEQ ID NO: 512781 - DNA, 25 bp, Homo sapien
ttttttcctactatcatctcttaaa

SEQ ID NO: 512782 - DNA, 25 bp, Homo sapien
tcctactatcatctcttaaattttg

SEQ ID NO: 512783 - DNA, 25 bp, Homo sapien
tatcatgcacaactataacctatgg

SEQ ID NO: 512784 - DNA, 25 bp, Homo sapien
atgcacaactataacctatgggaat

SEQ ID NO: 512785 - DNA, 25 bp, Homo sapien
cctatgggaatgatgtagtaacaca

SEQ ID NO: 512786 - DNA, 25 bp, Homo sapien
tgatgtagtaacacagattattcat

SEQ ID NO: 512787 - DNA, 25 bp, Homo sapien
gattattcatcttgttagagttgta

SEQ ID NO: 512788 - DNA, 25 bp, Homo sapien
attcatcttgttagagttgtattaa

SEQ ID NO: 512789 - DNA, 25 bp, Homo sapien
tggaaagaacactccatccccagtg

SEQ ID NO: 512790 - DNA, 25 bp, Homo sapien
gggaactgtaacaatggcccagtca

SEQ ID NO: 512791 - DNA, 25 bp, Homo sapien
agcgcattcaccacatggctgccag

SEQ ID NO: 512792 - DNA, 25 bp, Homo sapien
agccacgtcaacatcactagcaatg

SEQ ID NO: 512793 - DNA, 25 bp, Homo sapien
aacatcactagcaatgtgttacggg

SEQ ID NO: 512794 - DNA, 25 bp, Homo sapien
gaacactgggatatggccgacaaac

SEQ ID NO: 512795 - DNA, 25 bp, Homo sapien
gatatggccgacaaactgacaagag

SEQ ID NO: 512796 - DNA, 25 bp, Homo sapien
aattctttggtgatctggacacgct

SEQ ID NO: 512797 - DNA, 25 bp, Homo sapien
agcacagcagcatgaccaatcttgt

SEQ ID NO: 512798 - DNA, 25 bp, Homo sapien
agcatgaccaatcttgtccgctacg

SEQ ID NO: 512799 - DNA, 25 bp, Homo sapien
gtccgctacgttcgccaaggactgt

SEQ ID NO: 512800 - DNA, 25 bp, Homo sapien
acgcgcgccgaggacagcatagcag

SEQ ID NO: 512801 - DNA, 25 bp, Homo sapien
ggacagcatagcagctaagatctta

SEQ ID NO: 512802 - DNA, 25 bp, Homo sapien
taagatcttatcctacaaccgagcc

SEQ ID NO: 512803 - DNA, 25 bp, Homo sapien
tacaaccgagccaaccgagtcgtgg

SEQ ID NO: 512804 - DNA, 25 bp, Homo sapien
gagtcgtggccattctctgcaacca

SEQ ID NO: 512805 - DNA, 25 bp, Homo sapien
attctctgcaaccatcagcgagcaa

SEQ ID NO: 512806 - DNA, 25 bp, Homo sapien
cagtacgttcgagaagtcgatgcag

SEQ ID NO: 512807 - DNA, 25 bp, Homo sapien
aagtcgatgcagaatctccagacga

SEQ ID NO: 512808 - DNA, 25 bp, Homo sapien
tctccagacgaagatccaggcaaag

SEQ ID NO: 512809 - DNA, 25 bp, Homo sapien
ggcgagggctgagcacaaagcccaa

SEQ ID NO: 512810 - DNA, 25 bp, Homo sapien
ggatggcaagtccaggagtgtcctg

SEQ ID NO: 512811 - DNA, 25 bp, Homo sapien
ttgtttttgtaagttatctcaactt

SEQ ID NO: 512812 - DNA, 25 bp, Homo sapien
tgtttttgtaagttatctcaacttt

SEQ ID NO: 512813 - DNA, 25 bp, Homo sapien
tatctcaactttattcttgtgaaat

SEQ ID NO: 512814 - DNA, 25 bp, Homo sapien
atctcaactttattcttgtgaaatt

SEQ ID NO: 512815 - DNA, 25 bp, Homo sapien
tctcaactttattcttgtgaaattg

SEQ ID NO: 512816 - DNA, 25 bp, Homo sapien
ctcaactttattcttgtgaaattgc

SEQ ID NO: 512817 - DNA, 25 bp, Homo sapien
tcaactttattcttgtgaaattgca

SEQ ID NO: 512818 - DNA, 25 bp, Homo sapien
caactttattcttgtgaaattgcaa

SEQ ID NO: 512819 - DNA, 25 bp, Homo sapien
aactttattcttgtgaaattgcaaa

SEQ ID NO: 512820 - DNA, 25 bp, Homo sapien
actttattcttgtgaaattgcaaag

SEQ ID NO: 512821 - DNA, 25 bp, Homo sapien
ctttattcttgtgaaattgcaaagg

SEQ ID NO: 512822 - DNA, 25 bp, Homo sapien
gagatcactgtttgtgttcagttgt

SEQ ID NO: 512823 - DNA, 25 bp, Homo sapien
ttacccattcctccatgttgcaaaa

SEQ ID NO: 512824 - DNA, 25 bp, Homo sapien
tagcacaatatcaccgccacggtag

SEQ ID NO: 512825 - DNA, 25 bp, Homo sapien
ccacggtagacgcagtgaggccata

SEQ ID NO: 512826 - DNA, 25 bp, Homo sapien
gaggccataagacatttccgtcagc

SEQ ID NO: 512827 - DNA, 25 bp, Homo sapien
tttccgtcagcaaaagggtcacttc

SEQ ID NO: 512828 - DNA, 25 bp, Homo sapien
gggtcacttcttgtgcccctttaga

SEQ ID NO: 512829 - DNA, 25 bp, Homo sapien
ccctgccttccaactattaatgctg

SEQ ID NO: 512830 - DNA, 25 bp, Homo sapien
actattaatgctggcaggacttagc

SEQ ID NO: 512831 - DNA, 25 bp, Homo sapien
aggacttagccagaccgcaagggcg

SEQ ID NO: 512832 - DNA, 25 bp, Homo sapien
agggcgcctactccgaacaaggaag

SEQ ID NO: 512833 - DNA, 25 bp, Homo sapien
ctaagattgagctgagtgcgtggct

SEQ ID NO: 512834 - DNA, 25 bp, Homo sapien
gtgcgtggctggagacaccacacaa

SEQ ID NO: 512835 - DNA, 25 bp, Homo sapien
acaacacggacccttgctaaggcat

SEQ ID NO: 512836 - DNA, 25 bp, Homo sapien
cttgctaaggcatctagtccacccg

SEQ ID NO: 512837 - DNA, 25 bp, Homo sapien
agtccacccgcttgttatgtagagg

SEQ ID NO: 512838 - DNA, 25 bp, Homo sapien
gaagcccaaaacagtcaatcgtgaa

SEQ ID NO: 512839 - DNA, 25 bp, Homo sapien
tcgtgaactctaagccgatcaggtg

SEQ ID NO: 512840 - DNA, 25 bp, Homo sapien
ggaggctttttattgaacacaagaa

SEQ ID NO: 512841 - DNA, 25 bp, Homo sapien
atcaggtgggaaagccggcatctct

SEQ ID NO: 512842 - DNA, 25 bp, Homo sapien
gaaagccggcatctctagaatgaaa

SEQ ID NO: 512843 - DNA, 25 bp, Homo sapien
atgaaaacctaaggctgcttctccc

SEQ ID NO: 512844 - DNA, 25 bp, Homo sapien
ctgagcaaactatagtgtggtattc

SEQ ID NO: 512845 - DNA, 25 bp, Homo sapien
tggtattctgcagtgactatgggaa

SEQ ID NO: 512846 - DNA, 25 bp, Homo sapien
gaaagccttgaatgttctatcggtt

SEQ ID NO: 512847 - DNA, 25 bp, Homo sapien
aattctggagagaatgccccattga

SEQ ID NO: 512848 - DNA, 25 bp, Homo sapien
tcatcaatattggagagctttctgt

SEQ ID NO: 512849 - DNA, 25 bp, Homo sapien
aaacttgtgagcattcacactacag

SEQ ID NO: 512850 - DNA, 25 bp, Homo sapien
gcattcacactacagagaaacttga

SEQ ID NO: 512851 - DNA, 25 bp, Homo sapien
agccttcagtgatgcctctgtgtta

SEQ ID NO: 512852 - DNA, 25 bp, Homo sapien
gtgatgcctctgtgttagggaaaat

SEQ ID NO: 512853 - DNA, 25 bp, Homo sapien
atatggaacttctccctggatgcaa

SEQ ID NO: 512854 - DNA, 25 bp, Homo sapien
ccctggatgcaaaacctatgagtat

SEQ ID NO: 512855 - DNA, 25 bp, Homo sapien
tgccacacccctaacagacaggaga

SEQ ID NO: 512856 - DNA, 25 bp, Homo sapien
gggaggctttagaagccctattgta

SEQ ID NO: 512857 - DNA, 25 bp, Homo sapien
gaagccctattgtaatatttcttaa

SEQ ID NO: 512858 - DNA, 25 bp, Homo sapien
aaatatatttagtgtgagccatgta

SEQ ID NO: 512859 - DNA, 25 bp, Homo sapien
gtgagccatgtaaaaattgccattt

SEQ ID NO: 512860 - DNA, 25 bp, Homo sapien
ttggaggtcaaaaaccgttgaatat

SEQ ID NO: 512861 - DNA, 25 bp, Homo sapien
atatcagcaatttagtatggttcaa

SEQ ID NO: 512862 - DNA, 25 bp, Homo sapien
tcaatttatgtggtttctaatcaaa

SEQ ID NO: 512863 - DNA, 25 bp, Homo sapien
aaactacaagttgcctgtgttatgt

SEQ ID NO: 512864 - DNA, 25 bp, Homo sapien
acaagttgcctgtgttatgtaggag

SEQ ID NO: 512865 - DNA, 25 bp, Homo sapien
gttgcctgtgttatgtaggagagat

SEQ ID NO: 512866 - DNA, 25 bp, Homo sapien
cacatggttgtgctgtcgaggacct

SEQ ID NO: 512867 - DNA, 25 bp, Homo sapien
aaaattcttcccactgtcattccta

SEQ ID NO: 512868 - DNA, 25 bp, Homo sapien
ggatttctagacacatcctgctgtg

SEQ ID NO: 512869 - DNA, 25 bp, Homo sapien
tagacacatcctgctgtgatgtaaa

SEQ ID NO: 512870 - DNA, 25 bp, Homo sapien
gaaatcacgaattcgctcactggat

SEQ ID NO: 512871 - DNA, 25 bp, Homo sapien
gaattcgctcactggatcaagttgt

SEQ ID NO: 512872 - DNA, 25 bp, Homo sapien
ggatcaagttgttccactggtgtct

SEQ ID NO: 512873 - DNA, 25 bp, Homo sapien
cactggtgtctaatacgctattgtt

SEQ ID NO: 512874 - DNA, 25 bp, Homo sapien
aatacgctattgttgccggaggtgg

SEQ ID NO: 512875 - DNA, 25 bp, Homo sapien
gtgggttctgtgacgtgaagccatt

SEQ ID NO: 512876 - DNA, 25 bp, Homo sapien
cccatcattcaacagccagttacaa

SEQ ID NO: 512877 - DNA, 25 bp, Homo sapien
cttggagtggagaggaaaagcatca

SEQ ID NO: 512878 - DNA, 25 bp, Homo sapien
catccaccaggcctttgagaaaggg

SEQ ID NO: 512879 - DNA, 25 bp, Homo sapien
aaagggtagaattctggctggtaga

SEQ ID NO: 512880 - DNA, 25 bp, Homo sapien
tagaattctggctggtagagcaggt

SEQ ID NO: 512881 - DNA, 25 bp, Homo sapien
gagcaggtgagatgggacattccaa

SEQ ID NO: 512882 - DNA, 25 bp, Homo sapien
gggacattccaaagaacagcctgag

SEQ ID NO: 512883 - DNA, 25 bp, Homo sapien
acattccaaagaacagcctgagcca

SEQ ID NO: 512884 - DNA, 25 bp, Homo sapien
ggcctcgtggtagtaagaatctagc

SEQ ID NO: 512885 - DNA, 25 bp, Homo sapien
gagagagggcctgctggagagcata

SEQ ID NO: 512886 - DNA, 25 bp, Homo sapien
gctgggcttccagaaaatgaacaca

SEQ ID NO: 512887 - DNA, 25 bp, Homo sapien
cttccagaaaatgaacacagcagtt

SEQ ID NO: 512888 - DNA, 25 bp, Homo sapien
gaacacgggctttccttatagtggt

SEQ ID NO: 512889 - DNA, 25 bp, Homo sapien
cgggctttccttatagtggtcatat

SEQ ID NO: 512890 - DNA, 25 bp, Homo sapien
tatagtggtcatatctctgcttttg

SEQ ID NO: 512891 - DNA, 25 bp, Homo sapien
gtggtcatatctctgcttttgaact

SEQ ID NO: 512892 - DNA, 25 bp, Homo sapien
gaactagcaaaatcagcatgagtgt

SEQ ID NO: 512893 - DNA, 25 bp, Homo sapien
cagcatgagtgtgatttttgaatag

SEQ ID NO: 512894 - DNA, 25 bp, Homo sapien
gcagcaaatcccatataagaaatct

SEQ ID NO: 512895 - DNA, 25 bp, Homo sapien
aagcagttatgtctaaatatgcagc

SEQ ID NO: 512896 - DNA, 25 bp, Homo sapien
aatatgcagcccaaagtttttctta

SEQ ID NO: 512897 - DNA, 25 bp, Homo sapien
atgcagcccaaagtttttcttaata

SEQ ID NO: 512898 - DNA, 25 bp, Homo sapien
atatctgtagatacaggccaggcac

SEQ ID NO: 512899 - DNA, 25 bp, Homo sapien
tgggttttttatactttgacagctt

SEQ ID NO: 512900 - DNA, 25 bp, Homo sapien
gcatacatgagactgtgttgacttt

SEQ ID NO: 512901 - DNA, 25 bp, Homo sapien
ggcaggaaatgctccagcagtggct

SEQ ID NO: 512902 - DNA, 25 bp, Homo sapien
agtggctcagtgctccctggtgtct

SEQ ID NO: 512903 - DNA, 25 bp, Homo sapien
agtgctccctggtgtctgctgcatg

SEQ ID NO: 512904 - DNA, 25 bp, Homo sapien
ggcatcctggatgcttagcatgcaa

SEQ ID NO: 512905 - DNA, 25 bp, Homo sapien
gatgcttagcatgcaagttccctcc

SEQ ID NO: 512906 - DNA, 25 bp, Homo sapien
tccatcattgccaccttggtagaga

SEQ ID NO: 512907 - DNA, 25 bp, Homo sapien
tggtagagagggatggctccccacc

SEQ ID NO: 512908 - DNA, 25 bp, Homo sapien
agcctccttcttggttgtcatagtg

SEQ ID NO: 512909 - DNA, 25 bp, Homo sapien
ctccttcttggttgtcatagtgata

SEQ ID NO: 512910 - DNA, 25 bp, Homo sapien
gccattctaaaaaggactccctaca

SEQ ID NO: 512911 - DNA, 25 bp, Homo sapien
attctaaaaaggactccctacatga

SEQ ID NO: 512912 - DNA, 25 bp, Homo sapien
ctaaaaaggactccctacatgacct

SEQ ID NO: 512913 - DNA, 25 bp, Homo sapien
aaaaaggactccctacatgacctgc

SEQ ID NO: 512914 - DNA, 25 bp, Homo sapien
aaaaggactccctacatgacctgca

SEQ ID NO: 512915 - DNA, 25 bp, Homo sapien
aaaggactccctacatgacctgcaa

SEQ ID NO: 512916 - DNA, 25 bp, Homo sapien
aaggactccctacatgacctgcaac

SEQ ID NO: 512917 - DNA, 25 bp, Homo sapien
aggactccctacatgacctgcaact

SEQ ID NO: 512918 - DNA, 25 bp, Homo sapien
ggactccctacatgacctgcaactt

SEQ ID NO: 512919 - DNA, 25 bp, Homo sapien
actccctacatgacctgcaacttga

SEQ ID NO: 512920 - DNA, 25 bp, Homo sapien
tccctacatgacctgcaacttgaaa

SEQ ID NO: 512921 - DNA, 25 bp, Homo sapien
gtaagaactgggacaaagttggctt

SEQ ID NO: 512922 - DNA, 25 bp, Homo sapien
tgatgtgtaactgatagcctcagaa

SEQ ID NO: 512923 - DNA, 25 bp, Homo sapien
gtaactgatagcctcagaaggtgta

SEQ ID NO: 512924 - DNA, 25 bp, Homo sapien
gatagcctcagaaggtgtaaggtta

SEQ ID NO: 512925 - DNA, 25 bp, Homo sapien
tcatcagtataacaggagctggaca

SEQ ID NO: 512926 - DNA, 25 bp, Homo sapien
agtataacaggagctggacagtatt

SEQ ID NO: 512927 - DNA, 25 bp, Homo sapien
gacagtattaatcagtggtccaatt

SEQ ID NO: 512928 - DNA, 25 bp, Homo sapien
cttattgtgacctggggctccttaa

SEQ ID NO: 512929 - DNA, 25 bp, Homo sapien
tggggctccttaatgacacagattt

SEQ ID NO: 512930 - DNA, 25 bp, Homo sapien
acagatttgattcccacttaatggg

SEQ ID NO: 512931 - DNA, 25 bp, Homo sapien
gattcccacttaatgggcaactgaa

SEQ ID NO: 512932 - DNA, 25 bp, Homo sapien
gaggttccaccatatcaccatatgt

SEQ ID NO: 512933 - DNA, 25 bp, Homo sapien
gtgtctaccatctgatcattttctt

SEQ ID NO: 512934 - DNA, 25 bp, Homo sapien
cagggtgaccattacctacagattg

SEQ ID NO: 512935 - DNA, 25 bp, Homo sapien
gtgagccttataaatgcccctttag

SEQ ID NO: 512936 - DNA, 25 bp, Homo sapien
gggaccaatcaatagtgactccata

SEQ ID NO: 512937 - DNA, 25 bp, Homo sapien
tagtgactccatatgaatcattaca

SEQ ID NO: 512938 - DNA, 25 bp, Homo sapien
atcattacacaacacctttgcttgc

SEQ ID NO: 512939 - DNA, 25 bp, Homo sapien
ttgcttgccctgcaatacaatcttc

SEQ ID NO: 512940 - DNA, 25 bp, Homo sapien
caatcttcccaagtaaatatcttca

SEQ ID NO: 512941 - DNA, 25 bp, Homo sapien
ttttttctgaacatgtccaatccac

SEQ ID NO: 512942 - DNA, 25 bp, Homo sapien
atgtccaatccactatacagatagg

SEQ ID NO: 512943 - DNA, 25 bp, Homo sapien
ctgtgtgaagtcaagaggccagaga

SEQ ID NO: 512944 - DNA, 25 bp, Homo sapien
tgtgtgaagtcaagaggccagagaa

SEQ ID NO: 512945 - DNA, 25 bp, Homo sapien
gagaaaatgcacaaactgtaggaaa

SEQ ID NO: 512946 - DNA, 25 bp, Homo sapien
aactgtaggaaactataggaaagca

SEQ ID NO: 512947 - DNA, 25 bp, Homo sapien
ctgtaggaaactataggaaagcatt

SEQ ID NO: 512948 - DNA, 25 bp, Homo sapien
tgtaggaaactataggaaagcattt

SEQ ID NO: 512949 - DNA, 25 bp, Homo sapien
taggaaactataggaaagcatttac

SEQ ID NO: 512950 - DNA, 25 bp, Homo sapien
aggaaactataggaaagcatttact

SEQ ID NO: 512951 - DNA, 25 bp, Homo sapien
ggaaactataggaaagcatttacta

SEQ ID NO: 512952 - DNA, 25 bp, Homo sapien
gaaactataggaaagcatttactat

SEQ ID NO: 512953 - DNA, 25 bp, Homo sapien
aactataggaaagcatttactatga

SEQ ID NO: 512954 - DNA, 25 bp, Homo sapien
gggtacacccacatctattgtatta

SEQ ID NO: 512955 - DNA, 25 bp, Homo sapien
gtattagacaaatcacagagggatt

SEQ ID NO: 512956 - DNA, 25 bp, Homo sapien
agagggattgcaacagaacacagat

SEQ ID NO: 512957 - DNA, 25 bp, Homo sapien
ttttctctggttgatcgggatgcat

SEQ ID NO: 512958 - DNA, 25 bp, Homo sapien
gatcgggatgcattatccaccagaa

SEQ ID NO: 512959 - DNA, 25 bp, Homo sapien
gatgcattatccaccagaaaacact

SEQ ID NO: 512960 - DNA, 25 bp, Homo sapien
aaaacactgtagacgactcactcac

SEQ ID NO: 512961 - DNA, 25 bp, Homo sapien
actcactcaccaggaaaagagcata

SEQ ID NO: 512962 - DNA, 25 bp, Homo sapien
aagagcatatgccagttggaataaa

SEQ ID NO: 512963 - DNA, 25 bp, Homo sapien
ggaagaggctgtagaattattttat

SEQ ID NO: 512964 - DNA, 25 bp, Homo sapien
atcaagtcttatgagccaggtgcag

SEQ ID NO: 512965 - DNA, 25 bp, Homo sapien
tatggatctggaaatgtgggaagtc

SEQ ID NO: 512966 - DNA, 25 bp, Homo sapien
ggaagtcaagtcaaagacccagcca

SEQ ID NO: 512967 - DNA, 25 bp, Homo sapien
agccatagtggttaagaaagttctt

SEQ ID NO: 512968 - DNA, 25 bp, Homo sapien
aagttcttgaggaggtagaccaacg

SEQ ID NO: 512969 - DNA, 25 bp, Homo sapien
tgaggaggtagaccaacgcagcaaa

SEQ ID NO: 512970 - DNA, 25 bp, Homo sapien
agcaaaatacttaccaccaggctcc

SEQ ID NO: 512971 - DNA, 25 bp, Homo sapien
aaaatacttaccaccaggctccact

SEQ ID NO: 512972 - DNA, 25 bp, Homo sapien
gatgcaacagagaacgtatgccaca

SEQ ID NO: 512973 - DNA, 25 bp, Homo sapien
ttgagacctactgtctccttatagg

SEQ ID NO: 512974 - DNA, 25 bp, Homo sapien
gacctactgtctccttataggagga

SEQ ID NO: 512975 - DNA, 25 bp, Homo sapien
agatgatggagcctgtaagtctggg

SEQ ID NO: 512976 - DNA, 25 bp, Homo sapien
gcagaaacaaccacggttaccctag

SEQ ID NO: 512977 - DNA, 25 bp, Homo sapien
agaagtaaatccagagctgcgggac

SEQ ID NO: 512978 - DNA, 25 bp, Homo sapien
agagctaaagacttcctgaaattta

SEQ ID NO: 512979 - DNA, 25 bp, Homo sapien
caaccttccagggaagccgaggaga

SEQ ID NO: 512980 - DNA, 25 bp, Homo sapien
agccgaggagaagtcatgccttcaa

SEQ ID NO: 512981 - DNA, 25 bp, Homo sapien
atgccttcaaaaggtgtctgccttt

SEQ ID NO: 512982 - DNA, 25 bp, Homo sapien
tctcctctaacctgtttgtaactgg

SEQ ID NO: 512983 - DNA, 25 bp, Homo sapien
agttttggtttgcaagctgtcgcca

SEQ ID NO: 512984 - DNA, 25 bp, Homo sapien
tatttgcttgtcctgctaagaccgt

SEQ ID NO: 512985 - DNA, 25 bp, Homo sapien
gcttgtcctgctaagaccgtagcaa

SEQ ID NO: 512986 - DNA, 25 bp, Homo sapien
atcctcctcccattgacagtttaga

SEQ ID NO: 512987 - DNA, 25 bp, Homo sapien
tgtatcgatgaggccacagcaagtg

SEQ ID NO: 512988 - DNA, 25 bp, Homo sapien
tgctccagcagaccatctgcaaacg

SEQ ID NO: 512989 - DNA, 25 bp, Homo sapien
agaccatctgcaaacgctttgccaa

SEQ ID NO: 512990 - DNA, 25 bp, Homo sapien
aaacgctttgccaacaagacagtgc

SEQ ID NO: 512991 - DNA, 25 bp, Homo sapien
tttgccaacaagacagtgctgacca

SEQ ID NO: 512992 - DNA, 25 bp, Homo sapien
aacaagacagtgctgaccattgccc

SEQ ID NO: 512993 - DNA, 25 bp, Homo sapien
tgaccattgcccataggctcaacac

SEQ ID NO: 512994 - DNA, 25 bp, Homo sapien
ataggctcaacacgatcctgaactc

SEQ ID NO: 512995 - DNA, 25 bp, Homo sapien
ggctcaacacgatcctgaactcaga

SEQ ID NO: 512996 - DNA, 25 bp, Homo sapien
gatcctgaactcagaccgggtgctg

SEQ ID NO: 512997 - DNA, 25 bp, Homo sapien
ctcagaccgggtgctggtgctacaa

SEQ ID NO: 512998 - DNA, 25 bp, Homo sapien
tctgggagcatccatgtcccggaga

SEQ ID NO: 512999 - DNA, 25 bp, Homo sapien
agaggggtccctcaacagtcagcct

SEQ ID NO: 513000 - DNA, 25 bp, Homo sapien
ggttctcccggatctggatggcgcc

SEQ ID NO: 513001 - DNA, 25 bp, Homo sapien
gggccgcagagcatgtgctggatct

SEQ ID NO: 513002 - DNA, 25 bp, Homo sapien
gagggaagtcttgtgaaaccgctga

SEQ ID NO: 513003 - DNA, 25 bp, Homo sapien
agtcttgtgaaaccgctgattgctg

SEQ ID NO: 513004 - DNA, 25 bp, Homo sapien
gaaaccgctgattgctgacttttgt

SEQ ID NO: 513005 - DNA, 25 bp, Homo sapien
cgctgattgctgacttttgtgtgaa

SEQ ID NO: 513006 - DNA, 25 bp, Homo sapien
gacttttgtgtgaagaatcgtgttc

SEQ ID NO: 513007 - DNA, 25 bp, Homo sapien
tgaagaatcgtgttcttggagcagg

SEQ ID NO: 513008 - DNA, 25 bp, Homo sapien
gagcaggaaataaagcttgccccgg

SEQ ID NO: 513009 - DNA, 25 bp, Homo sapien
atttgaggaatatcagtcacgtgtt

SEQ ID NO: 513010 - DNA, 25 bp, Homo sapien
aatatcagtcacgtgttgtgggctt

SEQ ID NO: 513011 - DNA, 25 bp, Homo sapien
ttctttaaggttggagtggctggca

SEQ ID NO: 513012 - DNA, 25 bp, Homo sapien
agagcagagccttaatttgacttta

SEQ ID NO: 513013 - DNA, 25 bp, Homo sapien
ttaatttgactttagctctggctgg

SEQ ID NO: 513014 - DNA, 25 bp, Homo sapien
gactttagctctggctggtctggaa

SEQ ID NO: 513015 - DNA, 25 bp, Homo sapien
gctggtctggaagcttttacttttt

SEQ ID NO: 513016 - DNA, 25 bp, Homo sapien
ttttgttaatcccacttcctcactc

SEQ ID NO: 513017 - DNA, 25 bp, Homo sapien
tcactctgtcattcagcattatcat

SEQ ID NO: 513018 - DNA, 25 bp, Homo sapien
cagcattatcatgatcgtgaacaaa

SEQ ID NO: 513019 - DNA, 25 bp, Homo sapien
cggtattgtattgaacatccattaa

SEQ ID NO: 513020 - DNA, 25 bp, Homo sapien
gaggctattgtgtaactcttactat

SEQ ID NO: 513021 - DNA, 25 bp, Homo sapien
atccaatagcttttatgctcatcat

SEQ ID NO: 513022 - DNA, 25 bp, Homo sapien
atcatcatgtcattcgattctgctc

SEQ ID NO: 513023 - DNA, 25 bp, Homo sapien
ttcgattctgctcattaacgctcat

SEQ ID NO: 513024 - DNA, 25 bp, Homo sapien
taacgctcatcctgcaaacattcga

SEQ ID NO: 513025 - DNA, 25 bp, Homo sapien
aaacattcgagcaagaccagccact

SEQ ID NO: 513026 - DNA, 25 bp, Homo sapien
accagccactttctagtacctcagg

SEQ ID NO: 513027 - DNA, 25 bp, Homo sapien
ctcaggccatcctttgtcagctgat

SEQ ID NO: 513028 - DNA, 25 bp, Homo sapien
tgagacaacacttcaatccttcctc

SEQ ID NO: 513029 - DNA, 25 bp, Homo sapien
cttcaatccttcctctaagtcactg

SEQ ID NO: 513030 - DNA, 25 bp, Homo sapien
aggtgcatctcctatcctggaaata

SEQ ID NO: 513031 - DNA, 25 bp, Homo sapien
gttccagcccggaagggcttggaat

SEQ ID NO: 513032 - DNA, 25 bp, Homo sapien
ggagcgcgtgaaagccaaaccttgg

SEQ ID NO: 513033 - DNA, 25 bp, Homo sapien
gggcttgatcagaaagaagagctca

SEQ ID NO: 513034 - DNA, 25 bp, Homo sapien
agagtaatttgactgcgaaggcacc

SEQ ID NO: 513035 - DNA, 25 bp, Homo sapien
atttgactgcgaaggcaccgtcatc

SEQ ID NO: 513036 - DNA, 25 bp, Homo sapien
gaaggcaccgtcatcgtcgggcacc

SEQ ID NO: 513037 - DNA, 25 bp, Homo sapien
tagacgggcgcataatagctacatc

SEQ ID NO: 513038 - DNA, 25 bp, Homo sapien
gggcgcataatagctacatctctgg

SEQ ID NO: 513039 - DNA, 25 bp, Homo sapien
gcataatagctacatctctggagat

SEQ ID NO: 513040 - DNA, 25 bp, Homo sapien
aacaccaacaccagggcgtacgata

SEQ ID NO: 513041 - DNA, 25 bp, Homo sapien
agggcgtacgatacacccgaggctc

SEQ ID NO: 513042 - DNA, 25 bp, Homo sapien
aggctcaaaggctgacctgataatt

SEQ ID NO: 513043 - DNA, 25 bp, Homo sapien
aaggatgcctagttcaaggcctccc

SEQ ID NO: 513044 - DNA, 25 bp, Homo sapien
cctggtcaggtggtcccaagggaca

SEQ ID NO: 513045 - DNA, 25 bp, Homo sapien
agggacaagctaggtcctcctgaac

SEQ ID NO: 513046 - DNA, 25 bp, Homo sapien
gaagatatagctgggtcctcatcct

SEQ ID NO: 513047 - DNA, 25 bp, Homo sapien
tcctcatcctgggtctgtaatttat

SEQ ID NO: 513048 - DNA, 25 bp, Homo sapien
aatttattagacgtgtggctttgga

SEQ ID NO: 513049 - DNA, 25 bp, Homo sapien
aatgacataatttcccagagcctcc

SEQ ID NO: 513050 - DNA, 25 bp, Homo sapien
atttcccagagcctccttagataaa

SEQ ID NO: 513051 - DNA, 25 bp, Homo sapien
aactagggctttgcttaccttggcg

SEQ ID NO: 513052 - DNA, 25 bp, Homo sapien
gcttaccttggcgtattgttaggaa

SEQ ID NO: 513053 - DNA, 25 bp, Homo sapien
gaggcagcatctggctgattttcta

SEQ ID NO: 513054 - DNA, 25 bp, Homo sapien
ttttctacaacatctggtcttctct

SEQ ID NO: 513055 - DNA, 25 bp, Homo sapien
ttctctctgctgcacaatgtactat

SEQ ID NO: 513056 - DNA, 25 bp, Homo sapien
gaactgcattagaatccaacagatt

SEQ ID NO: 513057 - DNA, 25 bp, Homo sapien
aaattttggtcttgctcttctgaaa

SEQ ID NO: 513058 - DNA, 25 bp, Homo sapien
cacagccaactgcatgccaattatt

SEQ ID NO: 513059 - DNA, 25 bp, Homo sapien
attattctgctgaaattctttgtgt

SEQ ID NO: 513060 - DNA, 25 bp, Homo sapien
aattctttgtgtacagctctgccaa

SEQ ID NO: 513061 - DNA, 25 bp, Homo sapien
agcccagtggcaccagtaaccagaa

SEQ ID NO: 513062 - DNA, 25 bp, Homo sapien
cagtaaccagaaccctcctattagg

SEQ ID NO: 513063 - DNA, 25 bp, Homo sapien
ttagggatgttaacttcctcctcca

SEQ ID NO: 513064 - DNA, 25 bp, Homo sapien
ctttctgcccattgtttcttactag

SEQ ID NO: 513065 - DNA, 25 bp, Homo sapien
gaattgttcttgtggacttttcctc

SEQ ID NO: 513066 - DNA, 25 bp, Homo sapien
gtggacttttcctcagggatacatt

SEQ ID NO: 513067 - DNA, 25 bp, Homo sapien
ggatacattggcctgcaggtcccag

SEQ ID NO: 513068 - DNA, 25 bp, Homo sapien
tgcaggtcccagttcacatgtagtc

SEQ ID NO: 513069 - DNA, 25 bp, Homo sapien
agtcccctgctcaccattggagaat

SEQ ID NO: 513070 - DNA, 25 bp, Homo sapien
actgctctctagaaacgtggcgttg

SEQ ID NO: 513071 - DNA, 25 bp, Homo sapien
gttggtgaacggaccatgcttccgt

SEQ ID NO: 513072 - DNA, 25 bp, Homo sapien
atgcttccgtagctctgacctgggc

SEQ ID NO: 513073 - DNA, 25 bp, Homo sapien
gcagcttggacctggtcatcctcta

SEQ ID NO: 513074 - DNA, 25 bp, Homo sapien
ggagatggacaaccacttcaaagaa

SEQ ID NO: 513075 - DNA, 25 bp, Homo sapien
ccccaaatcacgagtgcagctggag

SEQ ID NO: 513076 - DNA, 25 bp, Homo sapien
cccttgttcggaagctggacgttca

SEQ ID NO: 513077 - DNA, 25 bp, Homo sapien
gaagctggacgttcacttggtgact

SEQ ID NO: 513078 - DNA, 25 bp, Homo sapien
acttggtgactggtgcctctgcact

SEQ ID NO: 513079 - DNA, 25 bp, Homo sapien
actggtgcctctgcactgacggagg

SEQ ID NO: 513080 - DNA, 25 bp, Homo sapien
gggtccttcttaccggctctgacct

SEQ ID NO: 513081 - DNA, 25 bp, Homo sapien
tctcttcgtgcctggtctgggactg

SEQ ID NO: 513082 - DNA, 25 bp, Homo sapien
ctgtgtacagcgagggtgggcagcc

SEQ ID NO: 513083 - DNA, 25 bp, Homo sapien
gcttccacaaagtcggctcccgaga

SEQ ID NO: 513084 - DNA, 25 bp, Homo sapien
acaaagtcggctcccgagagctcga

SEQ ID NO: 513085 - DNA, 25 bp, Homo sapien
ccgagagctcgaggctgcttctgtt

SEQ ID NO: 513086 - DNA, 25 bp, Homo sapien
ctgcttccaggtacaaaggttcatt

SEQ ID NO: 513087 - DNA, 25 bp, Homo sapien
agaaagtatcttctagagccagccg

SEQ ID NO: 513088 - DNA, 25 bp, Homo sapien
gagccagccgcaagagctgtgagct

SEQ ID NO: 513089 - DNA, 25 bp, Homo sapien
tgtgagctgcttccaagttaggcga

SEQ ID NO: 513090 - DNA, 25 bp, Homo sapien
gtggtggtaccctggacataatgca

SEQ ID NO: 513091 - DNA, 25 bp, Homo sapien
ggacataatgcaattctgtagtcag

SEQ ID NO: 513092 - DNA, 25 bp, Homo sapien
gtagtcagagcaatatccctggcga

SEQ ID NO: 513093 - DNA, 25 bp, Homo sapien
aatatccctggcgagagcctgacat

SEQ ID NO: 513094 - DNA, 25 bp, Homo sapien
gagagcctgacatcgcctgttaaag

SEQ ID NO: 513095 - DNA, 25 bp, Homo sapien
cctgttaaaggtggctgcctctgaa

SEQ ID NO: 513096 - DNA, 25 bp, Homo sapien
aaggtggctgcctctgaataaagga

SEQ ID NO: 513097 - DNA, 25 bp, Homo sapien
ggccaagctcatcacagtcctgatc

SEQ ID NO: 513098 - DNA, 25 bp, Homo sapien
tgatccccaggagtgtgtttgacaa

SEQ ID NO: 513099 - DNA, 25 bp, Homo sapien
aggactgcaaaaggtttctccaggt

SEQ ID NO: 513100 - DNA, 25 bp, Homo sapien
tttctccaggtggatgattttccca

SEQ ID NO: 513101 - DNA, 25 bp, Homo sapien
atacaggatatgatgccccacgatc

SEQ ID NO: 513102 - DNA, 25 bp, Homo sapien
gatcagcacagggattccctcagtg

SEQ ID NO: 513103 - DNA, 25 bp, Homo sapien
ctcagtggtgtaatgtaggtctccc

SEQ ID NO: 513104 - DNA, 25 bp, Homo sapien
ggaggtttccagctaatccagtgct

SEQ ID NO: 513105 - DNA, 25 bp, Homo sapien
aatccagtgctgtagcgagcctcga

SEQ ID NO: 513106 - DNA, 25 bp, Homo sapien
agccctcgcactggaaataacaatt

SEQ ID NO: 513107 - DNA, 25 bp, Homo sapien
aatttgcaccatgagctttctgtct

SEQ ID NO: 513108 - DNA, 25 bp, Homo sapien
agctcaacgagctggcggagtttgc

SEQ ID NO: 513109 - DNA, 25 bp, Homo sapien
ggagtttgcccgcttacaggaccag

SEQ ID NO: 513110 - DNA, 25 bp, Homo sapien
ttgcccgcttacaggaccagctgga

SEQ ID NO: 513111 - DNA, 25 bp, Homo sapien
agccactatgcctaggcccatgtgg

SEQ ID NO: 513112 - DNA, 25 bp, Homo sapien
gcccatgtggtctgggcccttccag

SEQ ID NO: 513113 - DNA, 25 bp, Homo sapien
gcccttccagtgctttggccttacg

SEQ ID NO: 513114 - DNA, 25 bp, Homo sapien
tgcccttcggcctgatctttatcgt

SEQ ID NO: 513115 - DNA, 25 bp, Homo sapien
ttcggcctgatctttatcgtcttcg

SEQ ID NO: 513116 - DNA, 25 bp, Homo sapien
tgatctttatcgtcttcgccgtcca

SEQ ID NO: 513117 - DNA, 25 bp, Homo sapien
ttctaccgctcactggttagccata

SEQ ID NO: 513118 - DNA, 25 bp, Homo sapien
accgctcactggttagccataagac

SEQ ID NO: 513119 - DNA, 25 bp, Homo sapien
tgaagatccgcagtcgcagggagaa

SEQ ID NO: 513120 - DNA, 25 bp, Homo sapien
gcgctaggcggctcgaactctccag

SEQ ID NO: 513121 - DNA, 25 bp, Homo sapien
aactctccagcgacggccgcggtgg

SEQ ID NO: 513122 - DNA, 25 bp, Homo sapien
agaccgttccttcttcgcaggcggc

SEQ ID NO: 513123 - DNA, 25 bp, Homo sapien
tggttcagaaagtctcccaggcgcc

SEQ ID NO: 513124 - DNA, 25 bp, Homo sapien
accaagcccgcgtggctcaggtcgg

SEQ ID NO: 513125 - DNA, 25 bp, Homo sapien
agaaagtctcccaggcgcctcatgc

SEQ ID NO: 513126 - DNA, 25 bp, Homo sapien
ggtcggcccggtgcttgctcaagta

SEQ ID NO: 513127 - DNA, 25 bp, Homo sapien
tgcttgctcaagtacggaatgcccc

SEQ ID NO: 513128 - DNA, 25 bp, Homo sapien
tcaagtacggaatgccccagcagtt

SEQ ID NO: 513129 - DNA, 25 bp, Homo sapien
ttgaggttgaagatccgcagtcgca

SEQ ID NO: 513130 - DNA, 25 bp, Homo sapien
acttgcccggtgctctcagaaacct

SEQ ID NO: 513131 - DNA, 25 bp, Homo sapien
tgcccggtgctctcagaaacctcag

SEQ ID NO: 513132 - DNA, 25 bp, Homo sapien
cccggtgctctcagaaacctcagag

SEQ ID NO: 513133 - DNA, 25 bp, Homo sapien
ggtgctctcagaaacctcagagctg

SEQ ID NO: 513134 - DNA, 25 bp, Homo sapien
ctctcagaaacctcagagctggtgg

SEQ ID NO: 513135 - DNA, 25 bp, Homo sapien
agagggtgggcgcagggcaccaact

SEQ ID NO: 513136 - DNA, 25 bp, Homo sapien
tctcctgggcgacgtcagtggacct

SEQ ID NO: 513137 - DNA, 25 bp, Homo sapien
tcctgggcgacgtcagtggaccttc

SEQ ID NO: 513138 - DNA, 25 bp, Homo sapien
ggcgacgtcagtggaccttcctgca

SEQ ID NO: 513139 - DNA, 25 bp, Homo sapien
atcagctgtgtggtgcccgcgtggc

SEQ ID NO: 513140 - DNA, 25 bp, Homo sapien
tgtggtgcccgcgtggctggaagga

SEQ ID NO: 513141 - DNA, 25 bp, Homo sapien
aaaacctttcatcagaagtcagctc

SEQ ID NO: 513142 - DNA, 25 bp, Homo sapien
acctttcatcagaagtcagctctaa

SEQ ID NO: 513143 - DNA, 25 bp, Homo sapien
gtcagctctaattgttcaccacaga

SEQ ID NO: 513144 - DNA, 25 bp, Homo sapien
agctctaattgttcaccacagaact

SEQ ID NO: 513145 - DNA, 25 bp, Homo sapien
gaaagtagcttctcagtggacatca

SEQ ID NO: 513146 - DNA, 25 bp, Homo sapien
gcttctcagtggacatcagatagta

SEQ ID NO: 513147 - DNA, 25 bp, Homo sapien
gaaaggatttttaactggattcaat

SEQ ID NO: 513148 - DNA, 25 bp, Homo sapien
gatttttaactggattcaatgtgtg

SEQ ID NO: 513149 - DNA, 25 bp, Homo sapien
taactggattcaatgtgtggatggt

SEQ ID NO: 513150 - DNA, 25 bp, Homo sapien
ctggattcaatgtgtggatggttta

SEQ ID NO: 513151 - DNA, 25 bp, Homo sapien
gattcaatgtgtggatggtttaagt

SEQ ID NO: 513152 - DNA, 25 bp, Homo sapien
agcaaaggagagatccccggaatct

SEQ ID NO: 513153 - DNA, 25 bp, Homo sapien
attacgtggagtgacggtcatgctg

SEQ ID NO: 513154 - DNA, 25 bp, Homo sapien
caaaggagagatccccggaatctgc

SEQ ID NO: 513155 - DNA, 25 bp, Homo sapien
gagagatccccggaatctgcagagt

SEQ ID NO: 513156 - DNA, 25 bp, Homo sapien
agagatccccggaatctgcagagtg

SEQ ID NO: 513157 - DNA, 25 bp, Homo sapien
agatccccggaatctgcagagtgaa

SEQ ID NO: 513158 - DNA, 25 bp, Homo sapien
aaaatagcaaacaatccagggtctt

SEQ ID NO: 513159 - DNA, 25 bp, Homo sapien
agcaaacaatccagggtcttgctct

SEQ ID NO: 513160 - DNA, 25 bp, Homo sapien
tcatgctgcggcgtggacacttggc

SEQ ID NO: 513161 - DNA, 25 bp, Homo sapien
atgctgcggcgtggacacttggcat

SEQ ID NO: 513162 - DNA, 25 bp, Homo sapien
gctgcggcgtggacacttggcattc

SEQ ID NO: 513163 - DNA, 25 bp, Homo sapien
acttgataacccctagaaagaagag

SEQ ID NO: 513164 - DNA, 25 bp, Homo sapien
cttgataacccctagaaagaagagg

SEQ ID NO: 513165 - DNA, 25 bp, Homo sapien
gataacccctagaaagaagaggaca

SEQ ID NO: 513166 - DNA, 25 bp, Homo sapien
taacccctagaaagaagaggacatg

SEQ ID NO: 513167 - DNA, 25 bp, Homo sapien
aacccctagaaagaagaggacatga

SEQ ID NO: 513168 - DNA, 25 bp, Homo sapien
cagggtctcactataatgcttagac

SEQ ID NO: 513169 - DNA, 25 bp, Homo sapien
gggtctcactataatgcttagactg

SEQ ID NO: 513170 - DNA, 25 bp, Homo sapien
ctcactataatgcttagactggtct

SEQ ID NO: 513171 - DNA, 25 bp, Homo sapien
actataatgcttagactggtcttga

SEQ ID NO: 513172 - DNA, 25 bp, Homo sapien
cacacctggcccatagttgtatttt

SEQ ID NO: 513173 - DNA, 25 bp, Homo sapien
cacctggcccatagttgtatttttt

SEQ ID NO: 513174 - DNA, 25 bp, Homo sapien
aagggatgtgagtcttgatttacat

SEQ ID NO: 513175 - DNA, 25 bp, Homo sapien
acatataaaatcatcagtctgcaca

SEQ ID NO: 513176 - DNA, 25 bp, Homo sapien
agacatagggacaatccttggtgca

SEQ ID NO: 513177 - DNA, 25 bp, Homo sapien
gggacaatccttggtgcaggtttct

SEQ ID NO: 513178 - DNA, 25 bp, Homo sapien
aatccttggtgcaggtttctgctac

SEQ ID NO: 513179 - DNA, 25 bp, Homo sapien
tggtgcaggtttctgctacccctcg

SEQ ID NO: 513180 - DNA, 25 bp, Homo sapien
tacccctcgctagtttttgccaaag

SEQ ID NO: 513181 - DNA, 25 bp, Homo sapien
tgccaaagtagcaaaagctgagtta

SEQ ID NO: 513182 - DNA, 25 bp, Homo sapien
gctacagaacatggagcccattggt

SEQ ID NO: 513183 - DNA, 25 bp, Homo sapien
gaacatggagcccattggtctgcaa

SEQ ID NO: 513184 - DNA, 25 bp, Homo sapien
atggagcccattggtctgcaaggca

SEQ ID NO: 513185 - DNA, 25 bp, Homo sapien
gaatattttttgcttaactactcaa

SEQ ID NO: 513186 - DNA, 25 bp, Homo sapien
aattagaatattgtacacctgatca

SEQ ID NO: 513187 - DNA, 25 bp, Homo sapien
attgtacacctgatcaatgtgtgtt

SEQ ID NO: 513188 - DNA, 25 bp, Homo sapien
atgtgtgttcagcacagatggccat

SEQ ID NO: 513189 - DNA, 25 bp, Homo sapien
acagatggccatgaattgtcattta

SEQ ID NO: 513190 - DNA, 25 bp, Homo sapien
gtcatttatagtccaattttttatc

SEQ ID NO: 513191 - DNA, 25 bp, Homo sapien
gaacaaaacgtttagcagggttgat

SEQ ID NO: 513192 - DNA, 25 bp, Homo sapien
cagggttgattgatattatttttac

SEQ ID NO: 513193 - DNA, 25 bp, Homo sapien
tttacattgttctggcaatccacag

SEQ ID NO: 513194 - DNA, 25 bp, Homo sapien
tggcaatccacagaaagagaagagc

SEQ ID NO: 513195 - DNA, 25 bp, Homo sapien
aacccattttagtcattttatgaca

SEQ ID NO: 513196 - DNA, 25 bp, Homo sapien
aggcctcccactcagagtctgggtc

SEQ ID NO: 513197 - DNA, 25 bp, Homo sapien
agtctgggtctcactggccccaagt

SEQ ID NO: 513198 - DNA, 25 bp, Homo sapien
tctgggtctcactggccccaagtct

SEQ ID NO: 513199 - DNA, 25 bp, Homo sapien
gaactctggccaaaaatggctctct

SEQ ID NO: 513200 - DNA, 25 bp, Homo sapien
actctggccaaaaatggctctctag

SEQ ID NO: 513201 - DNA, 25 bp, Homo sapien
tctggccaaaaatggctctctaggt

SEQ ID NO: 513202 - DNA, 25 bp, Homo sapien
ctggccaaaaatggctctctaggtg

SEQ ID NO: 513203 - DNA, 25 bp, Homo sapien
acccacgctctgacgagaggctttt

SEQ ID NO: 513204 - DNA, 25 bp, Homo sapien
cacgctctgacgagaggcttttcca

SEQ ID NO: 513205 - DNA, 25 bp, Homo sapien
acgctctgacgagaggcttttccac

SEQ ID NO: 513206 - DNA, 25 bp, Homo sapien
gtgtgtaataaaccacaagtgcgtg

SEQ ID NO: 513207 - DNA, 25 bp, Homo sapien
gctcatcactttctctcaaagttag

SEQ ID NO: 513208 - DNA, 25 bp, Homo sapien
gaaaacctttttagaatggcaatga

SEQ ID NO: 513209 - DNA, 25 bp, Homo sapien
gaatggcaatgaccacttggatcta

SEQ ID NO: 513210 - DNA, 25 bp, Homo sapien
accacttggatctaggtcaacatat

SEQ ID NO: 513211 - DNA, 25 bp, Homo sapien
acatattccaaaatgtgtgaccttg

SEQ ID NO: 513212 - DNA, 25 bp, Homo sapien
tagaaaattctggacctgattcatt

SEQ ID NO: 513213 - DNA, 25 bp, Homo sapien
tggacctgattcattaaccccgctt

SEQ ID NO: 513214 - DNA, 25 bp, Homo sapien
taaccccgcttttcttctctaatgt

SEQ ID NO: 513215 - DNA, 25 bp, Homo sapien
gcttttcttctctaatgtgtcctga

SEQ ID NO: 513216 - DNA, 25 bp, Homo sapien
ttctctaatgtgtcctgaagctgag

SEQ ID NO: 513217 - DNA, 25 bp, Homo sapien
gaagctgagctagatgatgagtaaa

SEQ ID NO: 513218 - DNA, 25 bp, Homo sapien
agagtggtagagctggactccccgg

SEQ ID NO: 513219 - DNA, 25 bp, Homo sapien
gccaccctgcgcaaccagccccact

SEQ ID NO: 513220 - DNA, 25 bp, Homo sapien
ccaccctgcgcaaccagccccactc

SEQ ID NO: 513221 - DNA, 25 bp, Homo sapien
ccctgcgcaaccagccccactccct

SEQ ID NO: 513222 - DNA, 25 bp, Homo sapien
agagcagccagcagggagtccctgc

SEQ ID NO: 513223 - DNA, 25 bp, Homo sapien
gagcagccagcagggagtccctgcc

SEQ ID NO: 513224 - DNA, 25 bp, Homo sapien
cagccagcagggagtccctgcctca

SEQ ID NO: 513225 - DNA, 25 bp, Homo sapien
agccagcagggagtccctgcctcac

SEQ ID NO: 513226 - DNA, 25 bp, Homo sapien
gaacaccctagcctagagatttaat

SEQ ID NO: 513227 - DNA, 25 bp, Homo sapien
cctagcctagagatttaatttagtg

SEQ ID NO: 513228 - DNA, 25 bp, Homo sapien
ggtacagagagagtctttcaagaaa

SEQ ID NO: 513229 - DNA, 25 bp, Homo sapien
aagaaaggacctagtctgctcgcgt

SEQ ID NO: 513230 - DNA, 25 bp, Homo sapien
gtgtgtgtacatatggaccacttca

SEQ ID NO: 513231 - DNA, 25 bp, Homo sapien
gtgtacatatggaccacttcaagct

SEQ ID NO: 513232 - DNA, 25 bp, Homo sapien
acacacatatacacgtgtatgaata

SEQ ID NO: 513233 - DNA, 25 bp, Homo sapien
aaaaatgcctcagttttgttaagag

SEQ ID NO: 513234 - DNA, 25 bp, Homo sapien
aaaagcaaatcctaagttacagtgg

SEQ ID NO: 513235 - DNA, 25 bp, Homo sapien
gttacagtggaacttatgaacaccc

SEQ ID NO: 513236 - DNA, 25 bp, Homo sapien
atgaacaccctagcctagagattta

SEQ ID NO: 513237 - DNA, 25 bp, Homo sapien
tcggaggcccgagtgcaggtttggt

SEQ ID NO: 513238 - DNA, 25 bp, Homo sapien
aatcaactccataaaggtgttctca

SEQ ID NO: 513239 - DNA, 25 bp, Homo sapien
actccataaaggtgttctcataggg

SEQ ID NO: 513240 - DNA, 25 bp, Homo sapien
aaaggtgttctcataggggccgcca

SEQ ID NO: 513241 - DNA, 25 bp, Homo sapien
ccagccagtttgaagcttgtagagt

SEQ ID NO: 513242 - DNA, 25 bp, Homo sapien
tttgaagcttgtagagtcgcacctt

SEQ ID NO: 513243 - DNA, 25 bp, Homo sapien
agcttgtagagtcgcaccttatgtc

SEQ ID NO: 513244 - DNA, 25 bp, Homo sapien
agagtcgcaccttatgtcaacgtag

SEQ ID NO: 513245 - DNA, 25 bp, Homo sapien
ccttatgtcaacgtaggtgctttaa

SEQ ID NO: 513246 - DNA, 25 bp, Homo sapien
acgtaggtgctttaaggatgccatt

SEQ ID NO: 513247 - DNA, 25 bp, Homo sapien
gcgccctacatgatgttcccagcac

SEQ ID NO: 513248 - DNA, 25 bp, Homo sapien
taagatcggccacctgaactccaag

SEQ ID NO: 513249 - DNA, 25 bp, Homo sapien
tgaactccaagctcttcctgaacga

SEQ ID NO: 513250 - DNA, 25 bp, Homo sapien
agctcttcctgaacgaagtggccaa

SEQ ID NO: 513251 - DNA, 25 bp, Homo sapien
gctgcggaaaatgctagaaggcccc

SEQ ID NO: 513252 - DNA, 25 bp, Homo sapien
ggcccaggccaagttctgcagcgag

SEQ ID NO: 513253 - DNA, 25 bp, Homo sapien
aagttctgcagcgagaacgcagcgc

SEQ ID NO: 513254 - DNA, 25 bp, Homo sapien
tgcagctgctctttgataagacgga

SEQ ID NO: 513255 - DNA, 25 bp, Homo sapien
agacggaggatgtcagcttcatgaa

SEQ ID NO: 513256 - DNA, 25 bp, Homo sapien
gcttcatgaagaacaccaagtctgt

SEQ ID NO: 513257 - DNA, 25 bp, Homo sapien
acaccaagtctgtgaaaatcctgat

SEQ ID NO: 513258 - DNA, 25 bp, Homo sapien
atggacaggacccagacctgcacga

SEQ ID NO: 513259 - DNA, 25 bp, Homo sapien
agcctccggaactccagggagcaac

SEQ ID NO: 513260 - DNA, 25 bp, Homo sapien
tcagctcactttgaccgcttcggag

SEQ ID NO: 513261 - DNA, 25 bp, Homo sapien
tgaccgcttcggagctctgatctga

SEQ ID NO: 513262 - DNA, 25 bp, Homo sapien
ggagctctgatctgagcccagtatg

SEQ ID NO: 513263 - DNA, 25 bp, Homo sapien
ctgagcccagtatggtttctggaaa

SEQ ID NO: 513264 - DNA, 25 bp, Homo sapien
agtaggacttcagtgggaccatgct

SEQ ID NO: 513265 - DNA, 25 bp, Homo sapien
aacaggaggctcaatctcacccaag

SEQ ID NO: 513266 - DNA, 25 bp, Homo sapien
tctcacccaagaagagcttctgatt

SEQ ID NO: 513267 - DNA, 25 bp, Homo sapien
tctgatttccctggccaggactagc

SEQ ID NO: 513268 - DNA, 25 bp, Homo sapien
aggactagcccaattttggccttgg

SEQ ID NO: 513269 - DNA, 25 bp, Homo sapien
tagcccaattttggccttggcctgc

SEQ ID NO: 513270 - DNA, 25 bp, Homo sapien
ttgggacttcttcccagctaggtca

SEQ ID NO: 513271 - DNA, 25 bp, Homo sapien
agctaggtcaccttgagcatgtcta

SEQ ID NO: 513272 - DNA, 25 bp, Homo sapien
ggtcaccttgagcatgtctactctg

SEQ ID NO: 513273 - DNA, 25 bp, Homo sapien
aagcctgtgctggacatttgtcgtt

SEQ ID NO: 513274 - DNA, 25 bp, Homo sapien
atttgtcgttttggcctcccagaat

SEQ ID NO: 513275 - DNA, 25 bp, Homo sapien
tggtaatagtacactccagtgaaat

SEQ ID NO: 513276 - DNA, 25 bp, Homo sapien
aaatgtactgagtggattccgtctt

SEQ ID NO: 513277 - DNA, 25 bp, Homo sapien
agtggattccgtcttctactcagga

SEQ ID NO: 513278 - DNA, 25 bp, Homo sapien
tccgtcttctactcaggaatggaat

SEQ ID NO: 513279 - DNA, 25 bp, Homo sapien
catccctcaagccacagttaatgat

SEQ ID NO: 513280 - DNA, 25 bp, Homo sapien
caagccacagttaatgattcagatg

SEQ ID NO: 513281 - DNA, 25 bp, Homo sapien
gaatttcttctcacattaagacctc

SEQ ID NO: 513282 - DNA, 25 bp, Homo sapien
ttaagacctccaatgtccagagcca

SEQ ID NO: 513283 - DNA, 25 bp, Homo sapien
gaggtaatcatgcaagcttttagaa

SEQ ID NO: 513284 - DNA, 25 bp, Homo sapien
caagactggagatggtgttataaca

SEQ ID NO: 513285 - DNA, 25 bp, Homo sapien
gtgttataacaatcgaagaccttcg

SEQ ID NO: 513286 - DNA, 25 bp, Homo sapien
gtatataatgcaaaacaccacccaa

SEQ ID NO: 513287 - DNA, 25 bp, Homo sapien
ggataactttgattcaccctatgac

SEQ ID NO: 513288 - DNA, 25 bp, Homo sapien
gattcaccctatgacaaagatggat

SEQ ID NO: 513289 - DNA, 25 bp, Homo sapien
gattggtgacccctgaggagttcat

SEQ ID NO: 513290 - DNA, 25 bp, Homo sapien
gagttcatgaactactatgcaggtg

SEQ ID NO: 513291 - DNA, 25 bp, Homo sapien
atgcaggtgtgagcgcatccattga

SEQ ID NO: 513292 - DNA, 25 bp, Homo sapien
ggctgtatcacagtaaataatcttg

SEQ ID NO: 513293 - DNA, 25 bp, Homo sapien
aatcttgattgtttctagaacaggg

SEQ ID NO: 513294 - DNA, 25 bp, Homo sapien
gggtagaaaagtcccaagatcttca

SEQ ID NO: 513295 - DNA, 25 bp, Homo sapien
aagtcccaagatcttcagaagggct

SEQ ID NO: 513296 - DNA, 25 bp, Homo sapien
gttttttcctcccaggattcttgct

SEQ ID NO: 513297 - DNA, 25 bp, Homo sapien
ggattcttgctcagtgatgagttga

SEQ ID NO: 513298 - DNA, 25 bp, Homo sapien
agcacaggataagcttctaagggag

SEQ ID NO: 513299 - DNA, 25 bp, Homo sapien
tgatggtcctcctcagggtctcagt

SEQ ID NO: 513300 - DNA, 25 bp, Homo sapien
aatattcctgcctctagagaaataa

SEQ ID NO: 513301 - DNA, 25 bp, Homo sapien
taatgtagcatatctggtcgacgtt

SEQ ID NO: 513302 - DNA, 25 bp, Homo sapien
ggtcgacgttgtatttgtatctatt

SEQ ID NO: 513303 - DNA, 25 bp, Homo sapien
aatgataattcatcctctctctcag

SEQ ID NO: 513304 - DNA, 25 bp, Homo sapien
ctctctctcagccatgtagttaaat

SEQ ID NO: 513305 - DNA, 25 bp, Homo sapien
agggaaccatccaacttgtccattg

SEQ ID NO: 513306 - DNA, 25 bp, Homo sapien
tgaggtcatagagacgttcccctgg

SEQ ID NO: 513307 - DNA, 25 bp, Homo sapien
ttcccctgggtcaacaaaactatca

SEQ ID NO: 513308 - DNA, 25 bp, Homo sapien
ggcacactaggttttcttttcactt

SEQ ID NO: 513309 - DNA, 25 bp, Homo sapien
tttcacttttccaatgcctaaggta

SEQ ID NO: 513310 - DNA, 25 bp, Homo sapien
aacttgtccattgtagctaccacgc

SEQ ID NO: 513311 - DNA, 25 bp, Homo sapien
gtatcctttaggtttttcacaatag

SEQ ID NO: 513312 - DNA, 25 bp, Homo sapien
agatgctttccgagcactgtttttc

SEQ ID NO: 513313 - DNA, 25 bp, Homo sapien
atttctccatgacgatcacctttgt

SEQ ID NO: 513314 - DNA, 25 bp, Homo sapien
aggcaccaccttcgcataaactttt

SEQ ID NO: 513315 - DNA, 25 bp, Homo sapien
gcataaactttttccagacaaggct

SEQ ID NO: 513316 - DNA, 25 bp, Homo sapien
gacaaggctaaatgtgcatgcttca

SEQ ID NO: 513317 - DNA, 25 bp, Homo sapien
gtgcatgcttcataaccataattct

SEQ ID NO: 513318 - DNA, 25 bp, Homo sapien
atttttctacttgtaacactgtgca

SEQ ID NO: 513319 - DNA, 25 bp, Homo sapien
gtaacactgtgcattatttcaaact

SEQ ID NO: 513320 - DNA, 25 bp, Homo sapien
tacctgtttgtaaagcttgtctctt

SEQ ID NO: 513321 - DNA, 25 bp, Homo sapien
gcttgtctcttaatcaaatttgtct

SEQ ID NO: 513322 - DNA, 25 bp, Homo sapien
gtcttgaccaaataagtttcctgag

SEQ ID NO: 513323 - DNA, 25 bp, Homo sapien
tcctgagggctggaattatgcctta

SEQ ID NO: 513324 - DNA, 25 bp, Homo sapien
ggaattatgccttaactatatctat

SEQ ID NO: 513325 - DNA, 25 bp, Homo sapien
attacatatttcaggtttgttctct

SEQ ID NO: 513326 - DNA, 25 bp, Homo sapien
catatttcaggtttgttctctttcc

SEQ ID NO: 513327 - DNA, 25 bp, Homo sapien
attttccaatccatttatccctggg

SEQ ID NO: 513328 - DNA, 25 bp, Homo sapien
gaaggattcatttgttgcgagtgcc

SEQ ID NO: 513329 - DNA, 25 bp, Homo sapien
aggattcatttgttgcgagtgccag

SEQ ID NO: 513330 - DNA, 25 bp, Homo sapien
gattcatttgttgcgagtgccagta

SEQ ID NO: 513331 - DNA, 25 bp, Homo sapien
tcatttgttgcgagtgccagtatac

SEQ ID NO: 513332 - DNA, 25 bp, Homo sapien
tttgttgcgagtgccagtatactta

SEQ ID NO: 513333 - DNA, 25 bp, Homo sapien
gttgcgagtgccagtatacttaaat

SEQ ID NO: 513334 - DNA, 25 bp, Homo sapien
gcgagtgccagtatacttaaatgta

SEQ ID NO: 513335 - DNA, 25 bp, Homo sapien
agcagaaatttaaaatgtggtcttt

SEQ ID NO: 513336 - DNA, 25 bp, Homo sapien
gcaagggaaatagtggccccttaat

SEQ ID NO: 513337 - DNA, 25 bp, Homo sapien
tagtggccccttaatgagtattttt

SEQ ID NO: 513338 - DNA, 25 bp, Homo sapien
gaatgatcttagtgtctttaccttt

SEQ ID NO: 513339 - DNA, 25 bp, Homo sapien
agtgtctttacctttctcatattaa

SEQ ID NO: 513340 - DNA, 25 bp, Homo sapien
ctttctcatattaactcacctcttt

SEQ ID NO: 513341 - DNA, 25 bp, Homo sapien
ttctgaatagaaatgtatgccctag

SEQ ID NO: 513342 - DNA, 25 bp, Homo sapien
tatgccctaggaagaaatcatgctg

SEQ ID NO: 513343 - DNA, 25 bp, Homo sapien
aggtggtggatttattttgcctgca

SEQ ID NO: 513344 - DNA, 25 bp, Homo sapien
attttgcctgcagtaaagattctca

SEQ ID NO: 513345 - DNA, 25 bp, Homo sapien
gattctcagggtgtcagagcagcat

SEQ ID NO: 513346 - DNA, 25 bp, Homo sapien
gtgtcagagcagcatattgtcaaat

SEQ ID NO: 513347 - DNA, 25 bp, Homo sapien
aatcagccctggattccacaagtga

SEQ ID NO: 513348 - DNA, 25 bp, Homo sapien
cacaagtgaagcagcggaggaacca

SEQ ID NO: 513349 - DNA, 25 bp, Homo sapien
aaccaggaggtcagcggtgtcactc

SEQ ID NO: 513350 - DNA, 25 bp, Homo sapien
gcggtgtcactcaaatctgtggcaa

SEQ ID NO: 513351 - DNA, 25 bp, Homo sapien
aaatctgtggcaatcaagtgggagt

SEQ ID NO: 513352 - DNA, 25 bp, Homo sapien
gtgggagttctcaaaaggctatcaa

SEQ ID NO: 513353 - DNA, 25 bp, Homo sapien
gataaggaaaggctcaagacctgcc

SEQ ID NO: 513354 - DNA, 25 bp, Homo sapien
ggaagagcaggactgactccactca

SEQ ID NO: 513355 - DNA, 25 bp, Homo sapien
gagaagttatgtcatcttccactgc

SEQ ID NO: 513356 - DNA, 25 bp, Homo sapien
actgcagcagataccccttttttag

SEQ ID NO: 513357 - DNA, 25 bp, Homo sapien
atcacagcatttctaaatcagccct

SEQ ID NO: 513358 - DNA, 25 bp, Homo sapien
aagtaatccatgtttgtgtcaaatg

SEQ ID NO: 513359 - DNA, 25 bp, Homo sapien
atccatgtttgtgtcaaatgatcat

SEQ ID NO: 513360 - DNA, 25 bp, Homo sapien
atagaagagacagtgaagcaagtaa

SEQ ID NO: 513361 - DNA, 25 bp, Homo sapien
aaaatgcttcttttgttgccacagt

SEQ ID NO: 513362 - DNA, 25 bp, Homo sapien
aatgcttcttttgttgccacagtaa

SEQ ID NO: 513363 - DNA, 25 bp, Homo sapien
atgcttcttttgttgccacagtaaa

SEQ ID NO: 513364 - DNA, 25 bp, Homo sapien
gcttcttttgttgccacagtaaaga

SEQ ID NO: 513365 - DNA, 25 bp, Homo sapien
gttgccacagtaaagaacagttttt

SEQ ID NO: 513366 - DNA, 25 bp, Homo sapien
aattacgtagctgattttgtatgta

SEQ ID NO: 513367 - DNA, 25 bp, Homo sapien
aaattattgtatgtttactgtgatc

SEQ ID NO: 513368 - DNA, 25 bp, Homo sapien
tatgtttactgtgatcttaatgggc

SEQ ID NO: 513369 - DNA, 25 bp, Homo sapien
aaattctcagaaatctgcaggactc

SEQ ID NO: 513370 - DNA, 25 bp, Homo sapien
gaaatctgcaggactcactctaatt

SEQ ID NO: 513371 - DNA, 25 bp, Homo sapien
caaatatgtgtcaatgtgcagctta

SEQ ID NO: 513372 - DNA, 25 bp, Homo sapien
gtgtcaatgtgcagcttaacagagg

SEQ ID NO: 513373 - DNA, 25 bp, Homo sapien
ttatctagagctacccagtactggg

SEQ ID NO: 513374 - DNA, 25 bp, Homo sapien
cagtactgggcttgaatttaatcat

SEQ ID NO: 513375 - DNA, 25 bp, Homo sapien
tagtcaaatgtttcctctggcagca

SEQ ID NO: 513376 - DNA, 25 bp, Homo sapien
aaatgtttcctctggcagcataata

SEQ ID NO: 513377 - DNA, 25 bp, Homo sapien
ggcagcataatattaccatacacca

SEQ ID NO: 513378 - DNA, 25 bp, Homo sapien
accatattaccttataattgccatt

SEQ ID NO: 513379 - DNA, 25 bp, Homo sapien
taattgccattacagttccttatca

SEQ ID NO: 513380 - DNA, 25 bp, Homo sapien
gaggccgaagctgtgccccactggt

SEQ ID NO: 513381 - DNA, 25 bp, Homo sapien
agctgtgccccactggtttggatgc

SEQ ID NO: 513382 - DNA, 25 bp, Homo sapien
gggtgacctgcaccctgtagtccta

SEQ ID NO: 513383 - DNA, 25 bp, Homo sapien
tgtagtcctacagttcacacgctat

SEQ ID NO: 513384 - DNA, 25 bp, Homo sapien
gtcctacagttcacacgctatggat

SEQ ID NO: 513385 - DNA, 25 bp, Homo sapien
cagttcacacgctatggatgcctga

SEQ ID NO: 513386 - DNA, 25 bp, Homo sapien
tcacacgctatggatgcctgaaggg

SEQ ID NO: 513387 - DNA, 25 bp, Homo sapien
cacgctatggatgcctgaagggatg

SEQ ID NO: 513388 - DNA, 25 bp, Homo sapien
gctgtggttgatggcgtgtccagga

SEQ ID NO: 513389 - DNA, 25 bp, Homo sapien
gggtctggcaacagcctcaccacga

SEQ ID NO: 513390 - DNA, 25 bp, Homo sapien
agcctcaccacgatggcatggcggt

SEQ ID NO: 513391 - DNA, 25 bp, Homo sapien
agactgctccggactcttctaggaa

SEQ ID NO: 513392 - DNA, 25 bp, Homo sapien
cttctaggaaattcctctgtctcat

SEQ ID NO: 513393 - DNA, 25 bp, Homo sapien
tctctgcctcagtctttgttaatgt

SEQ ID NO: 513394 - DNA, 25 bp, Homo sapien
tcaggatttgagagctggagcccat

SEQ ID NO: 513395 - DNA, 25 bp, Homo sapien
ttgagagctggagcccatctttctg

SEQ ID NO: 513396 - DNA, 25 bp, Homo sapien
ttctgcctccatccaaagaggcctt

SEQ ID NO: 513397 - DNA, 25 bp, Homo sapien
ggaagaagacttggccttttctctg

SEQ ID NO: 513398 - DNA, 25 bp, Homo sapien
tctctgcctgcatgtccctgtgcag

SEQ ID NO: 513399 - DNA, 25 bp, Homo sapien
ctgtgcagaggaaggctgtctctca

SEQ ID NO: 513400 - DNA, 25 bp, Homo sapien
ggctgtctctcaagggtaaccccaa

SEQ ID NO: 513401 - DNA, 25 bp, Homo sapien
aagggtaaccccaatctgcctgtgc

SEQ ID NO: 513402 - DNA, 25 bp, Homo sapien
atatttttctttatctgccctgtga

SEQ ID NO: 513403 - DNA, 25 bp, Homo sapien
tgccctgtgatttcgcttcgtgtcc

SEQ ID NO: 513404 - DNA, 25 bp, Homo sapien
tgatttcgcttcgtgtccttcaaag

SEQ ID NO: 513405 - DNA, 25 bp, Homo sapien
tcgcttcgtgtccttcaaagttttt

SEQ ID NO: 513406 - DNA, 25 bp, Homo sapien
ggcaaaatcatttgccattttttat

SEQ ID NO: 513407 - DNA, 25 bp, Homo sapien
atttatttttctatctcatacaatg

SEQ ID NO: 513408 - DNA, 25 bp, Homo sapien
tctcatacaatgatcagttttactt

SEQ ID NO: 513409 - DNA, 25 bp, Homo sapien
catgtacttcatccagttatttatt

SEQ ID NO: 513410 - DNA, 25 bp, Homo sapien
aatgttaactggagatactgcattc

SEQ ID NO: 513411 - DNA, 25 bp, Homo sapien
agtcggaccacttaacacttaccag

SEQ ID NO: 513412 - DNA, 25 bp, Homo sapien
ggaccacttaacacttaccaggaat

SEQ ID NO: 513413 - DNA, 25 bp, Homo sapien
aacagcaacattttgtggtgtctac

SEQ ID NO: 513414 - DNA, 25 bp, Homo sapien
cattttgtggtgtctacaggcgtgg

SEQ ID NO: 513415 - DNA, 25 bp, Homo sapien
ctgcagcgtcaccatgggaacaaaa

SEQ ID NO: 513416 - DNA, 25 bp, Homo sapien
gggaacaaaagtctcccacgcatct

SEQ ID NO: 513417 - DNA, 25 bp, Homo sapien
acaaaagtctcccacgcatctcagg

SEQ ID NO: 513418 - DNA, 25 bp, Homo sapien
catctcaggcccgaggaatctttaa

SEQ ID NO: 513419 - DNA, 25 bp, Homo sapien
caggcccgaggaatctttaaagagg

SEQ ID NO: 513420 - DNA, 25 bp, Homo sapien
gggatgaagtcattctacttgtacc

SEQ ID NO: 513421 - DNA, 25 bp, Homo sapien
tgaagtcattctacttgtaccaact

SEQ ID NO: 513422 - DNA, 25 bp, Homo sapien
gagtgcctcctaaaagtgtaacctt

SEQ ID NO: 513423 - DNA, 25 bp, Homo sapien
tgcctcctaaaagtgtaaccttggg

SEQ ID NO: 513424 - DNA, 25 bp, Homo sapien
tagcggacagacacgagcctcttgg

SEQ ID NO: 513425 - DNA, 25 bp, Homo sapien
agcctcttgggaataccttgtccat

SEQ ID NO: 513426 - DNA, 25 bp, Homo sapien
atcttttggagcagctttgtcggtg

SEQ ID NO: 513427 - DNA, 25 bp, Homo sapien
gggtgtcttaacactactggtggaa

SEQ ID NO: 513428 - DNA, 25 bp, Homo sapien
tactggtggaagtcagcaacatctt

SEQ ID NO: 513429 - DNA, 25 bp, Homo sapien
acatcttcctcaccattcgcatgat

SEQ ID NO: 513430 - DNA, 25 bp, Homo sapien
atcagtaatgcccaggatcatctcc

SEQ ID NO: 513431 - DNA, 25 bp, Homo sapien
tcatctcctctaccgggttaacaag

SEQ ID NO: 513432 - DNA, 25 bp, Homo sapien
gtgaacctggtcatgtactttctct

SEQ ID NO: 513433 - DNA, 25 bp, Homo sapien
tcacccatttcttcttgcgttatgt

SEQ ID NO: 513434 - DNA, 25 bp, Homo sapien
cttgcgttatgtgaaccagaggacc

SEQ ID NO: 513435 - DNA, 25 bp, Homo sapien
gttttgcatatcttttgttatgcca

SEQ ID NO: 513436 - DNA, 25 bp, Homo sapien
tgttatgccatgtaaattccctttt

SEQ ID NO: 513437 - DNA, 25 bp, Homo sapien
gttcatttacattcacttgtagcaa

SEQ ID NO: 513438 - DNA, 25 bp, Homo sapien
gaatttgaattttgtcgtgtttggg

SEQ ID NO: 513439 - DNA, 25 bp, Homo sapien
gtcgtgtttgggtttgttcattcct

SEQ ID NO: 513440 - DNA, 25 bp, Homo sapien
ttgggtttgttcattcctgtgaatg

SEQ ID NO: 513441 - DNA, 25 bp, Homo sapien
gatggtacagttaggtgagattttc

SEQ ID NO: 513442 - DNA, 25 bp, Homo sapien
gagattttctgttatggtacccaaa

SEQ ID NO: 513443 - DNA, 25 bp, Homo sapien
tatggtacccaaactcaccatttgg

SEQ ID NO: 513444 - DNA, 25 bp, Homo sapien
caaactcaccatttggtcctcttta

SEQ ID NO: 513445 - DNA, 25 bp, Homo sapien
tctttaatctttgagggtttcaata

SEQ ID NO: 513446 - DNA, 25 bp, Homo sapien
gatccacaaaagcatgtatgtactt

SEQ ID NO: 513447 - DNA, 25 bp, Homo sapien
gtatgtacttacaaaccaagctgta

SEQ ID NO: 513448 - DNA, 25 bp, Homo sapien
aagaacttaagtgttgatctcaaga

SEQ ID NO: 513449 - DNA, 25 bp, Homo sapien
aagtgttgatctcaagatttctaaa

SEQ ID NO: 513450 - DNA, 25 bp, Homo sapien
tggcattgtggtggaactagttaac

SEQ ID NO: 513451 - DNA, 25 bp, Homo sapien
gttaacacttagagcttttggtatg

SEQ ID NO: 513452 - DNA, 25 bp, Homo sapien
gagcttttggtatgtaataactatt

SEQ ID NO: 513453 - DNA, 25 bp, Homo sapien
ttgctatggactgattaaatgtttc

SEQ ID NO: 513454 - DNA, 25 bp, Homo sapien
tcaaaagattgtgttcttcaatttt

SEQ ID NO: 513455 - DNA, 25 bp, Homo sapien
ttttttaactgcctctcagattata

SEQ ID NO: 513456 - DNA, 25 bp, Homo sapien
aactgcctctcagattatatttact

SEQ ID NO: 513457 - DNA, 25 bp, Homo sapien
acatgttttgcttggttctatagta

SEQ ID NO: 513458 - DNA, 25 bp, Homo sapien
tgcttggttctatagtatgttactt

SEQ ID NO: 513459 - DNA, 25 bp, Homo sapien
gtatgttacttaggatctatttacc

SEQ ID NO: 513460 - DNA, 25 bp, Homo sapien
taggatctatttaccatatatttgt

SEQ ID NO: 513461 - DNA, 25 bp, Homo sapien
gtatgagaaatcctcacccaagcat

SEQ ID NO: 513462 - DNA, 25 bp, Homo sapien
tcacccaagcattcaacctaaatct

SEQ ID NO: 513463 - DNA, 25 bp, Homo sapien
atctttgaaaagttgggtgctgtct

SEQ ID NO: 513464 - DNA, 25 bp, Homo sapien
tgggtgctgtctttagtaactttta

SEQ ID NO: 513465 - DNA, 25 bp, Homo sapien
gtttaaatctcccattttaatagtg

SEQ ID NO: 513466 - DNA, 25 bp, Homo sapien
gaaacctgttaaaatcatggctatt

SEQ ID NO: 513467 - DNA, 25 bp, Homo sapien
gttgaactttatgaacccatacttt

SEQ ID NO: 513468 - DNA, 25 bp, Homo sapien
aggcctcccactcagagtctgggtc

SEQ ID NO: 513469 - DNA, 25 bp, Homo sapien
agtctgggtctcactggccccaagt

SEQ ID NO: 513470 - DNA, 25 bp, Homo sapien
tctgggtctcactggccccaagtct

SEQ ID NO: 513471 - DNA, 25 bp, Homo sapien
gaactctggccaaaaatggctctct

SEQ ID NO: 513472 - DNA, 25 bp, Homo sapien
tctggccaaaaatggctctctaggt

SEQ ID NO: 513473 - DNA, 25 bp, Homo sapien
aatggctctctaggtgggctgtgca

SEQ ID NO: 513474 - DNA, 25 bp, Homo sapien
aaagcaaagctcagggctggttccc

SEQ ID NO: 513475 - DNA, 25 bp, Homo sapien
ctggttcccagctggcctgagcagg

SEQ ID NO: 513476 - DNA, 25 bp, Homo sapien
acccacgctctgacgagaggctttt

SEQ ID NO: 513477 - DNA, 25 bp, Homo sapien
acgctctgacgagaggcttttccac

SEQ ID NO: 513478 - DNA, 25 bp, Homo sapien
gtgtgtaataaaccacaagtgcgtg

SEQ ID NO: 513479 - DNA, 25 bp, Homo sapien
gtacagttgctgcagcaatgtgcat

SEQ ID NO: 513480 - DNA, 25 bp, Homo sapien
gtgcatggttgtcacacgaacagaa

SEQ ID NO: 513481 - DNA, 25 bp, Homo sapien
tatgtagttgctttttccgatgaaa

SEQ ID NO: 513482 - DNA, 25 bp, Homo sapien
aatggtaccatgtccagtgactaca

SEQ ID NO: 513483 - DNA, 25 bp, Homo sapien
gtgactacagatatgaccttacaac

SEQ ID NO: 513484 - DNA, 25 bp, Homo sapien
aatggctatgagtcagatcccagca

SEQ ID NO: 513485 - DNA, 25 bp, Homo sapien
ggtggaactgattgctctcttccaa

SEQ ID NO: 513486 - DNA, 25 bp, Homo sapien
attgctctcttccaatgatctgggc

SEQ ID NO: 513487 - DNA, 25 bp, Homo sapien
gctgatgtcttcattgtattcactg

SEQ ID NO: 513488 - DNA, 25 bp, Homo sapien
gagacctttgctggaggtgtccatc

SEQ ID NO: 513489 - DNA, 25 bp, Homo sapien
catcctgctattgctctgagggagt

SEQ ID NO: 513490 - DNA, 25 bp, Homo sapien
gtggctcccagcttggaagaccagg

SEQ ID NO: 513491 - DNA, 25 bp, Homo sapien
tggaagaccagggtgggtacatact

SEQ ID NO: 513492 - DNA, 25 bp, Homo sapien
gtgggtacatactggagacagccaa

SEQ ID NO: 513493 - DNA, 25 bp, Homo sapien
gagacagccaagagctgagtatata

SEQ ID NO: 513494 - DNA, 25 bp, Homo sapien
aatgtgcaggaacagaggcgtcttc

SEQ ID NO: 513495 - DNA, 25 bp, Homo sapien
gaggcgtcttcctgggtttggctcc

SEQ ID NO: 513496 - DNA, 25 bp, Homo sapien
ccctagactttgattttacggatat

SEQ ID NO: 513497 - DNA, 25 bp, Homo sapien
ttacggatatcttgcttctgttccc

SEQ ID NO: 513498 - DNA, 25 bp, Homo sapien
ttctgttccccatggagctccgaat

SEQ ID NO: 513499 - DNA, 25 bp, Homo sapien
atggagctccgaattcttgcgtgtg

SEQ ID NO: 513500 - DNA, 25 bp, Homo sapien
aattcttgcgtgtgtgtagatgagg

SEQ ID NO: 513501 - DNA, 25 bp, Homo sapien
gaaatttgggctctgggaataagaa

SEQ ID NO: 513502 - DNA, 25 bp, Homo sapien
tgatatgtacccattccttcaaggc

SEQ ID NO: 513503 - DNA, 25 bp, Homo sapien
attccttcaaggcaactggtatcag

SEQ ID NO: 513504 - DNA, 25 bp, Homo sapien
aagtgtgatttacctgagatatttt

SEQ ID NO: 513505 - DNA, 25 bp, Homo sapien
gagatatttttgttcagcaaagctc

SEQ ID NO: 513506 - DNA, 25 bp, Homo sapien
gttcagcaaagctcatagcaccctc

SEQ ID NO: 513507 - DNA, 25 bp, Homo sapien
gcttctgatgttgttcacgttttta

SEQ ID NO: 513508 - DNA, 25 bp, Homo sapien
gatgttgttcacgtttttaaccctg

SEQ ID NO: 513509 - DNA, 25 bp, Homo sapien
acgtttttaaccctgtcaagcattg

SEQ ID NO: 513510 - DNA, 25 bp, Homo sapien
aaccctgtcaagcattgaactgaat

SEQ ID NO: 513511 - DNA, 25 bp, Homo sapien
tgaactgaatatattagctactttt

SEQ ID NO: 513512 - DNA, 25 bp, Homo sapien
attgtatgtcgcttttattcttgta

SEQ ID NO: 513513 - DNA, 25 bp, Homo sapien
tcgcttttattcttgtatcggtctc

SEQ ID NO: 513514 - DNA, 25 bp, Homo sapien
ttttattcttgtatcggtctcgttt

SEQ ID NO: 513515 - DNA, 25 bp, Homo sapien
gtatcggtctcgttttagactgcac

SEQ ID NO: 513516 - DNA, 25 bp, Homo sapien
tctcgttttagactgcactgtgagt

SEQ ID NO: 513517 - DNA, 25 bp, Homo sapien
gtatttgtactttaacgatgaacca

SEQ ID NO: 513518 - DNA, 25 bp, Homo sapien
agacttatttccgatgtccaggcat

SEQ ID NO: 513519 - DNA, 25 bp, Homo sapien
atttccgatgtccaggcatcagaca

SEQ ID NO: 513520 - DNA, 25 bp, Homo sapien
gtccaggcatcagacatcaagaagc

SEQ ID NO: 513521 - DNA, 25 bp, Homo sapien
atcaagaagccccatatgctttcgg

SEQ ID NO: 513522 - DNA, 25 bp, Homo sapien
aagaagccccatatgctttcggcgc

SEQ ID NO: 513523 - DNA, 25 bp, Homo sapien
aagtcaggaatcttgctgctagcca

SEQ ID NO: 513524 - DNA, 25 bp, Homo sapien
tgctagccacgccttgcagtgactt

SEQ ID NO: 513525 - DNA, 25 bp, Homo sapien
cttgcagtgacttctcgtctgggag

SEQ ID NO: 513526 - DNA, 25 bp, Homo sapien
gacttctcgtctgggagtgggcact

SEQ ID NO: 513527 - DNA, 25 bp, Homo sapien
agtgggcactgagtcctctcagtaa

SEQ ID NO: 513528 - DNA, 25 bp, Homo sapien
gagtcctctcagtaaactaataaga

SEQ ID NO: 513529 - DNA, 25 bp, Homo sapien
taataagacttgcacctgacaaagg

SEQ ID NO: 513530 - DNA, 25 bp, Homo sapien
cacagtgtatgctaggctgagacct

SEQ ID NO: 513531 - DNA, 25 bp, Homo sapien
tgttgagcctgaacttccagtactc

SEQ ID NO: 513532 - DNA, 25 bp, Homo sapien
ttccttctgtttacctggcttggcc

SEQ ID NO: 513533 - DNA, 25 bp, Homo sapien
gcacccctggtcttgatgcctcaag

SEQ ID NO: 513534 - DNA, 25 bp, Homo sapien
ataggccagtgatgtctcaaagagt

SEQ ID NO: 513535 - DNA, 25 bp, Homo sapien
gagtagaggagcgtctactggtctt

SEQ ID NO: 513536 - DNA, 25 bp, Homo sapien
agtagaggagcgtctactggtcttt

SEQ ID NO: 513537 - DNA, 25 bp, Homo sapien
gtagaggagcgtctactggtctttc

SEQ ID NO: 513538 - DNA, 25 bp, Homo sapien
tagaggagcgtctactggtctttca

SEQ ID NO: 513539 - DNA, 25 bp, Homo sapien
agaggagcgtctactggtctttcaa

SEQ ID NO: 513540 - DNA, 25 bp, Homo sapien
gaggagcgtctactggtctttcaac

SEQ ID NO: 513541 - DNA, 25 bp, Homo sapien
cccatttattataggccagtgatgt

SEQ ID NO: 513542 - DNA, 25 bp, Homo sapien
ccatttattataggccagtgatgtc

SEQ ID NO: 513543 - DNA, 25 bp, Homo sapien
tttattataggccagtgatgtctca

SEQ ID NO: 513544 - DNA, 25 bp, Homo sapien
tattataggccagtgatgtctcaaa

SEQ ID NO: 513545 - DNA, 25 bp, Homo sapien
aacacatttggccttaaaatagcat

SEQ ID NO: 513546 - DNA, 25 bp, Homo sapien
aaaatagcatgcattctcccagaag

SEQ ID NO: 513547 - DNA, 25 bp, Homo sapien
cccagaagcccatagtaaagaaaat

SEQ ID NO: 513548 - DNA, 25 bp, Homo sapien
gacagatcgtggtcagcagactctt

SEQ ID NO: 513549 - DNA, 25 bp, Homo sapien
ggtcagcagactcttatcaaattgg

SEQ ID NO: 513550 - DNA, 25 bp, Homo sapien
gatttcttcaagctccattttgcag

SEQ ID NO: 513551 - DNA, 25 bp, Homo sapien
aagctccattttgcagagaccacca

SEQ ID NO: 513552 - DNA, 25 bp, Homo sapien
cattttgcagagaccaccacttaga

SEQ ID NO: 513553 - DNA, 25 bp, Homo sapien
aaattcctgttttgatacttctaag

SEQ ID NO: 513554 - DNA, 25 bp, Homo sapien
gttacagtttatctggtacttcatt

SEQ ID NO: 513555 - DNA, 25 bp, Homo sapien
gtttatctggtacttcatttttctt

SEQ ID NO: 513556 - DNA, 25 bp, Homo sapien
agcctcccaaagtagcctacattgc

SEQ ID NO: 513557 - DNA, 25 bp, Homo sapien
agtagcctacattgcctctactttg

SEQ ID NO: 513558 - DNA, 25 bp, Homo sapien
ttgcctctactttgaagggacaaag

SEQ ID NO: 513559 - DNA, 25 bp, Homo sapien
taaaacttacatacattgcctatgt

SEQ ID NO: 513560 - DNA, 25 bp, Homo sapien
acatacattgcctatgtttggcatt

SEQ ID NO: 513561 - DNA, 25 bp, Homo sapien
ttgcctatgtttggcattccataac

SEQ ID NO: 513562 - DNA, 25 bp, Homo sapien
tttggcattccataacataataatt

SEQ ID NO: 513563 - DNA, 25 bp, Homo sapien
taattataataatcccccaatgtca

SEQ ID NO: 513564 - DNA, 25 bp, Homo sapien
aatgtatgtgtgagttcccatgttt

SEQ ID NO: 513565 - DNA, 25 bp, Homo sapien
gtatgtgtgagttcccatgtttatt

SEQ ID NO: 513566 - DNA, 25 bp, Homo sapien
gagttcccatgtttattggcaattt

SEQ ID NO: 513567 - DNA, 25 bp, Homo sapien
taccggccggactggaaccgtctga

SEQ ID NO: 513568 - DNA, 25 bp, Homo sapien
tggaaccgtctgagcggcctaaccc

SEQ ID NO: 513569 - DNA, 25 bp, Homo sapien
gggatgacagctgaaccgcctaaag

SEQ ID NO: 513570 - DNA, 25 bp, Homo sapien
tgaaggctttcgtcacgcaggacat

SEQ ID NO: 513571 - DNA, 25 bp, Homo sapien
gcaggacattccattctatcacaac

SEQ ID NO: 513572 - DNA, 25 bp, Homo sapien
cattccattctatcacaacctggtg

SEQ ID NO: 513573 - DNA, 25 bp, Homo sapien
tgggccgccgctacgaggaactaga

SEQ ID NO: 513574 - DNA, 25 bp, Homo sapien
acgaggaactagagcgcatcccact

SEQ ID NO: 513575 - DNA, 25 bp, Homo sapien
gagcgcatcccactcagtgaaatga

SEQ ID NO: 513576 - DNA, 25 bp, Homo sapien
aaatgacccgcgaagagatcaatgc

SEQ ID NO: 513577 - DNA, 25 bp, Homo sapien
agatcaatgcgctagtgcaggagct

SEQ ID NO: 513578 - DNA, 25 bp, Homo sapien
gaaagaggcagaccatccaccaggc

SEQ ID NO: 513579 - DNA, 25 bp, Homo sapien
catccaccaggcctttgagaaaggg

SEQ ID NO: 513580 - DNA, 25 bp, Homo sapien
aaagggtagaattctggctggtaga

SEQ ID NO: 513581 - DNA, 25 bp, Homo sapien
tagaattctggctggtagagcaggt

SEQ ID NO: 513582 - DNA, 25 bp, Homo sapien
gagcaggtgagatgggacattccaa

SEQ ID NO: 513583 - DNA, 25 bp, Homo sapien
gggacattccaaagaacagcctgag

SEQ ID NO: 513584 - DNA, 25 bp, Homo sapien
acattccaaagaacagcctgagcca

SEQ ID NO: 513585 - DNA, 25 bp, Homo sapien
ggcctcgtggtagtaagaatctagc

SEQ ID NO: 513586 - DNA, 25 bp, Homo sapien
gagagagggcctgctggagagcata

SEQ ID NO: 513587 - DNA, 25 bp, Homo sapien
ccaggctgaggtcctgatcagcttc

SEQ ID NO: 513588 - DNA, 25 bp, Homo sapien
gctgggcttccagaaaatgaacaca

SEQ ID NO: 513589 - DNA, 25 bp, Homo sapien
gaaactgatcgcaggattttctgat

SEQ ID NO: 513590 - DNA, 25 bp, Homo sapien
gattttctgatccatagctattaat

SEQ ID NO: 513591 - DNA, 25 bp, Homo sapien
aaacttctgatagtgctgtaggctc

SEQ ID NO: 513592 - DNA, 25 bp, Homo sapien
gctgtaggctctatagtaggcttaa

SEQ ID NO: 513593 - DNA, 25 bp, Homo sapien
gtcttatactatgaagccagccaca

SEQ ID NO: 513594 - DNA, 25 bp, Homo sapien
gccagccacaagatactaacaaatg

SEQ ID NO: 513595 - DNA, 25 bp, Homo sapien
aagtaccaatactttttgcacatag

SEQ ID NO: 513596 - DNA, 25 bp, Homo sapien
gggctccaaaaatcaggttagtagg

SEQ ID NO: 513597 - DNA, 25 bp, Homo sapien
aatcaggttagtaggctcatttcca

SEQ ID NO: 513598 - DNA, 25 bp, Homo sapien
gtaggctcatttccatgtgcttaaa

SEQ ID NO: 513599 - DNA, 25 bp, Homo sapien
gttgttatgcattgattaagggcta

SEQ ID NO: 513600 - DNA, 25 bp, Homo sapien
gcttccggggccttttcacctggag

SEQ ID NO: 513601 - DNA, 25 bp, Homo sapien
ctattttatcaattgtcagtcccgt

SEQ ID NO: 513602 - DNA, 25 bp, Homo sapien
ttttatcaattgtcagtcccgttcc

SEQ ID NO: 513603 - DNA, 25 bp, Homo sapien
tttatcaattgtcagtcccgttcct

SEQ ID NO: 513604 - DNA, 25 bp, Homo sapien
ttatcaattgtcagtcccgttcctt

SEQ ID NO: 513605 - DNA, 25 bp, Homo sapien
atcaattgtcagtcccgttccttta

SEQ ID NO: 513606 - DNA, 25 bp, Homo sapien
tcaattgtcagtcccgttcctttac

SEQ ID NO: 513607 - DNA, 25 bp, Homo sapien
ttgtcagtcccgttcctttaccata

SEQ ID NO: 513608 - DNA, 25 bp, Homo sapien
tcagtcccgttcctttaccatagga

SEQ ID NO: 513609 - DNA, 25 bp, Homo sapien
cagtcccgttcctttaccataggat

SEQ ID NO: 513610 - DNA, 25 bp, Homo sapien
tcccgttcctttaccataggattct

SEQ ID NO: 513611 - DNA, 25 bp, Homo sapien
ggaggccccaccatggcttgtcgag

SEQ ID NO: 513612 - DNA, 25 bp, Homo sapien
ccaccatggcttgtcgagggcacgg

SEQ ID NO: 513613 - DNA, 25 bp, Homo sapien
cttgtcgagggcacgggcacctgca

SEQ ID NO: 513614 - DNA, 25 bp, Homo sapien
acgggcacctgcatggcggcgctct

SEQ ID NO: 513615 - DNA, 25 bp, Homo sapien
ctgccgggctgcaagcctgaggtct

SEQ ID NO: 513616 - DNA, 25 bp, Homo sapien
ggctgcaagcctgaggtctgtgctg

SEQ ID NO: 513617 - DNA, 25 bp, Homo sapien
aggcctgggacgcacgtgtcctctc

SEQ ID NO: 513618 - DNA, 25 bp, Homo sapien
gttgtaatgtgaacacaggcatcct

SEQ ID NO: 513619 - DNA, 25 bp, Homo sapien
gcacgtgtcctctcacagcgtcgtg

SEQ ID NO: 513620 - DNA, 25 bp, Homo sapien
cctctcacagcgtcgtgcctgtgaa

SEQ ID NO: 513621 - DNA, 25 bp, Homo sapien
tgtaatgtgaacacaggcatccttg

SEQ ID NO: 513622 - DNA, 25 bp, Homo sapien
gggtcagcaatctaggtctgtgagt

SEQ ID NO: 513623 - DNA, 25 bp, Homo sapien
taggtctgtgagtctagttccactt

SEQ ID NO: 513624 - DNA, 25 bp, Homo sapien
gtgagtctagttccacttgggactg

SEQ ID NO: 513625 - DNA, 25 bp, Homo sapien
gagctcacaaagtggcagatggccc

SEQ ID NO: 513626 - DNA, 25 bp, Homo sapien
ggcagatggcccagctgtgaccagc

SEQ ID NO: 513627 - DNA, 25 bp, Homo sapien
gtgaccagcaacgtagcacagtgct

SEQ ID NO: 513628 - DNA, 25 bp, Homo sapien
gtagcacagtgctggccaagtgctg

SEQ ID NO: 513629 - DNA, 25 bp, Homo sapien
attggccatctcaggtgctaggcaa

SEQ ID NO: 513630 - DNA, 25 bp, Homo sapien
gaagtaggaattcagtcatcttgat

SEQ ID NO: 513631 - DNA, 25 bp, Homo sapien
gtcatcttgatgaggctgccagagc

SEQ ID NO: 513632 - DNA, 25 bp, Homo sapien
gtctgagactcagcaggcacatgga

SEQ ID NO: 513633 - DNA, 25 bp, Homo sapien
gacgattccacataacaggaaaagg

SEQ ID NO: 513634 - DNA, 25 bp, Homo sapien
gattccacataacaggaaaaggacc

SEQ ID NO: 513635 - DNA, 25 bp, Homo sapien
gaaaaggaccaggaacatcttaaat

SEQ ID NO: 513636 - DNA, 25 bp, Homo sapien
aggaccaggaacatcttaaatactt

SEQ ID NO: 513637 - DNA, 25 bp, Homo sapien
gaccaggaacatcttaaatacttca

SEQ ID NO: 513638 - DNA, 25 bp, Homo sapien
aggaacatcttaaatacttcacgat

SEQ ID NO: 513639 - DNA, 25 bp, Homo sapien
gaacatcttaaatacttcacgatgg

SEQ ID NO: 513640 - DNA, 25 bp, Homo sapien
catcttaaatacttcacgatggaag

SEQ ID NO: 513641 - DNA, 25 bp, Homo sapien
gacttcagtaagaagcttatttact

SEQ ID NO: 513642 - DNA, 25 bp, Homo sapien
tttactctggtaaatagtttctagt

SEQ ID NO: 513643 - DNA, 25 bp, Homo sapien
actctggtaaatagtttctagtaag

SEQ ID NO: 513644 - DNA, 25 bp, Homo sapien
gactcgtcagacacatcagaaggat

SEQ ID NO: 513645 - DNA, 25 bp, Homo sapien
gaaggattccgcctccacttggaac

SEQ ID NO: 513646 - DNA, 25 bp, Homo sapien
ttggaacctggctccatttttatgc

SEQ ID NO: 513647 - DNA, 25 bp, Homo sapien
atttttatgccgctgtctgagcctc

SEQ ID NO: 513648 - DNA, 25 bp, Homo sapien
tgagcctccgtctgatttcttgaca

SEQ ID NO: 513649 - DNA, 25 bp, Homo sapien
catcatcaccagaccacagggaatt

SEQ ID NO: 513650 - DNA, 25 bp, Homo sapien
acctgtgagtgcttctcagcatcag

SEQ ID NO: 513651 - DNA, 25 bp, Homo sapien
ttctcagcatcagtctgtggacaga

SEQ ID NO: 513652 - DNA, 25 bp, Homo sapien
cgccatgagcctgtctgggagatga

SEQ ID NO: 513653 - DNA, 25 bp, Homo sapien
gatgacaggattcttcttgcccgac

SEQ ID NO: 513654 - DNA, 25 bp, Homo sapien
acgtgcttttgtcggactcgtcaga

SEQ ID NO: 513655 - DNA, 25 bp, Homo sapien
gctcggcctgctgggttcttaacct

SEQ ID NO: 513656 - DNA, 25 bp, Homo sapien
tgctgggttcttaacctccagtgtc

SEQ ID NO: 513657 - DNA, 25 bp, Homo sapien
taacctccagtgtcctcttcatctt

SEQ ID NO: 513658 - DNA, 25 bp, Homo sapien
tcttcatcttttccacccgtaggga

SEQ ID NO: 513659 - DNA, 25 bp, Homo sapien
cacccgtagggaaaccttgagccat

SEQ ID NO: 513660 - DNA, 25 bp, Homo sapien
agggaaaccttgagccatgtgttca

SEQ ID NO: 513661 - DNA, 25 bp, Homo sapien
accttgagccatgtgttcaaacaag

SEQ ID NO: 513662 - DNA, 25 bp, Homo sapien
gagagcagcagctctaagcccacac

SEQ ID NO: 513663 - DNA, 25 bp, Homo sapien
agctctaagcccacactcagaaagt

SEQ ID NO: 513664 - DNA, 25 bp, Homo sapien
acactcagaaagtggcgccctcctg

SEQ ID NO: 513665 - DNA, 25 bp, Homo sapien
ggcctctgtttcaggttatcctgga

SEQ ID NO: 513666 - DNA, 25 bp, Homo sapien
cggcctctagcgcagtcgctaacta

SEQ ID NO: 513667 - DNA, 25 bp, Homo sapien
agtcgctaactactctgctgggctc

SEQ ID NO: 513668 - DNA, 25 bp, Homo sapien
accaagcttggtgaaattcctccct

SEQ ID NO: 513669 - DNA, 25 bp, Homo sapien
gggcctagcatagttcctgcctatg

SEQ ID NO: 513670 - DNA, 25 bp, Homo sapien
atagttcctgcctatgccaggagct

SEQ ID NO: 513671 - DNA, 25 bp, Homo sapien
tgcctatgccaggagctggctctgt

SEQ ID NO: 513672 - DNA, 25 bp, Homo sapien
ggactgaaggacaaacaaccaagag

SEQ ID NO: 513673 - DNA, 25 bp, Homo sapien
gacaaacaaccaagagtggcccagt

SEQ ID NO: 513674 - DNA, 25 bp, Homo sapien
tgtacacaccctattaactccttgg

SEQ ID NO: 513675 - DNA, 25 bp, Homo sapien
accctattaactccttggctgtggt

SEQ ID NO: 513676 - DNA, 25 bp, Homo sapien
tattaactccttggctgtggtcccc

SEQ ID NO: 513677 - DNA, 25 bp, Homo sapien
gtaatataaaaaactgcttctcatg

SEQ ID NO: 513678 - DNA, 25 bp, Homo sapien
aaaaaactgcttctcatgaaagctt

SEQ ID NO: 513679 - DNA, 25 bp, Homo sapien
gaaagctttggtataatcttacgag

SEQ ID NO: 513680 - DNA, 25 bp, Homo sapien
taatcttacgaggtaacatcattgt

SEQ ID NO: 513681 - DNA, 25 bp, Homo sapien
acatcattgttttgcaactacggta

SEQ ID NO: 513682 - DNA, 25 bp, Homo sapien
gttttgcaactacggtatgtgttca

SEQ ID NO: 513683 - DNA, 25 bp, Homo sapien
cggtatgtgttcaaaatgttcttct

SEQ ID NO: 513684 - DNA, 25 bp, Homo sapien
aaatgttcttctttgaccccacatt

SEQ ID NO: 513685 - DNA, 25 bp, Homo sapien
ttctttgaccccacatttcattaga

SEQ ID NO: 513686 - DNA, 25 bp, Homo sapien
ctttgaccccacatttcattagata

SEQ ID NO: 513687 - DNA, 25 bp, Homo sapien
agatcctgcaactgcactctggctg

SEQ ID NO: 513688 - DNA, 25 bp, Homo sapien
tttgcagtctctgaagcagctttgt

SEQ ID NO: 513689 - DNA, 25 bp, Homo sapien
aaaactgccttttctctctcgtgaa

SEQ ID NO: 513690 - DNA, 25 bp, Homo sapien
ttttctctctcgtgaagcttctttc

SEQ ID NO: 513691 - DNA, 25 bp, Homo sapien
cctggtctcctaaaagcctttgata

SEQ ID NO: 513692 - DNA, 25 bp, Homo sapien
aacttcaatggatgcctcaggagac

SEQ ID NO: 513693 - DNA, 25 bp, Homo sapien
atggatgcctcaggagactttccct

SEQ ID NO: 513694 - DNA, 25 bp, Homo sapien
aggcaaggttaatacaatgttctct

SEQ ID NO: 513695 - DNA, 25 bp, Homo sapien
acaatgttctcttaatccctttgcc

SEQ ID NO: 513696 - DNA, 25 bp, Homo sapien
aatccctttgccttctgagtcaaaa

SEQ ID NO: 513697 - DNA, 25 bp, Homo sapien
gcatgtgattgtacatcctgccatt

SEQ ID NO: 513698 - DNA, 25 bp, Homo sapien
acatcctgccatttggctatggcta

SEQ ID NO: 513699 - DNA, 25 bp, Homo sapien
gtaatataaaaaactgcttctcatg

SEQ ID NO: 513700 - DNA, 25 bp, Homo sapien
aaaaaactgcttctcatgaaagctt

SEQ ID NO: 513701 - DNA, 25 bp, Homo sapien
tctcatgaaagctttggtataatct

SEQ ID NO: 513702 - DNA, 25 bp, Homo sapien
aagctttggtataatcttacgaggt

SEQ ID NO: 513703 - DNA, 25 bp, Homo sapien
taatcttacgaggtaacatcattgt

SEQ ID NO: 513704 - DNA, 25 bp, Homo sapien
acatcattgttttgcaactacggta

SEQ ID NO: 513705 - DNA, 25 bp, Homo sapien
gttttgcaactacggtatgtgttca

SEQ ID NO: 513706 - DNA, 25 bp, Homo sapien
gcaactacggtatgtgttcaaaatg

SEQ ID NO: 513707 - DNA, 25 bp, Homo sapien
ggtatgtgttcaaaatgttcttctt

SEQ ID NO: 513708 - DNA, 25 bp, Homo sapien
cttctttgaccccacatttcattag

SEQ ID NO: 513709 - DNA, 25 bp, Homo sapien
ctttgaccccacatttcattagata

SEQ ID NO: 513710 - DNA, 25 bp, Homo sapien
ttttgctatgctctgattgttcctt

SEQ ID NO: 513711 - DNA, 25 bp, Homo sapien
atgctctgattgttccttagaccac

SEQ ID NO: 513712 - DNA, 25 bp, Homo sapien
gttccttagaccacatatgttctta

SEQ ID NO: 513713 - DNA, 25 bp, Homo sapien
atgttcttatgaagcagcattatgc

SEQ ID NO: 513714 - DNA, 25 bp, Homo sapien
gtatattttaacaaacctgtccttg

SEQ ID NO: 513715 - DNA, 25 bp, Homo sapien
aaacctgtccttgatattagttaag

SEQ ID NO: 513716 - DNA, 25 bp, Homo sapien
aggtgacacataagggtgacacaga

SEQ ID NO: 513717 - DNA, 25 bp, Homo sapien
acacagaatgtgtaatgcaaatttc

SEQ ID NO: 513718 - DNA, 25 bp, Homo sapien
taaacctttctaaatagatcctgaa

SEQ ID NO: 513719 - DNA, 25 bp, Homo sapien
agatcctgaaactgtctctcacatt

SEQ ID NO: 513720 - DNA, 25 bp, Homo sapien
gaaactgtctctcacattatatagt

SEQ ID NO: 513721 - DNA, 25 bp, Homo sapien
gacgattccacataacaggaaaagg

SEQ ID NO: 513722 - DNA, 25 bp, Homo sapien
gaaaaggaccaggaacatcttaaat

SEQ ID NO: 513723 - DNA, 25 bp, Homo sapien
aggaccaggaacatcttaaatactt

SEQ ID NO: 513724 - DNA, 25 bp, Homo sapien
aggaacatcttaaatacttcacgat

SEQ ID NO: 513725 - DNA, 25 bp, Homo sapien
gagtaacgtgttcagttttacatca

SEQ ID NO: 513726 - DNA, 25 bp, Homo sapien
catcttaaatacttcacgatggaag

SEQ ID NO: 513727 - DNA, 25 bp, Homo sapien
ttccagaaagtcttttgacttcagt

SEQ ID NO: 513728 - DNA, 25 bp, Homo sapien
gacttcagtaagaagcttatttact

SEQ ID NO: 513729 - DNA, 25 bp, Homo sapien
tttactctggtaaatagtttctagt

SEQ ID NO: 513730 - DNA, 25 bp, Homo sapien
actctggtaaatagtttctagtaag

SEQ ID NO: 513731 - DNA, 25 bp, Homo sapien
agagtgtgtccatctctgttgaagg

SEQ ID NO: 513732 - DNA, 25 bp, Homo sapien
ggcagccgggcccatagccagcctc

SEQ ID NO: 513733 - DNA, 25 bp, Homo sapien
cagagcaacaggtaggctggtgagg

SEQ ID NO: 513734 - DNA, 25 bp, Homo sapien
gaaggctgcgggtgaacgggagggt

SEQ ID NO: 513735 - DNA, 25 bp, Homo sapien
tgaacgggagggtcgagggcacacg

SEQ ID NO: 513736 - DNA, 25 bp, Homo sapien
tcgagggcacacgtgagtgacagca

SEQ ID NO: 513737 - DNA, 25 bp, Homo sapien
agggcacacgtgagtgacagcacct

SEQ ID NO: 513738 - DNA, 25 bp, Homo sapien
ggcacacgtgagtgacagcaccttg

SEQ ID NO: 513739 - DNA, 25 bp, Homo sapien
acacgtgagtgacagcaccttgcac

SEQ ID NO: 513740 - DNA, 25 bp, Homo sapien
acgtgagtgacagcaccttgcactg

SEQ ID NO: 513741 - DNA, 25 bp, Homo sapien
gtgagtgacagcaccttgcactgaa

SEQ ID NO: 513742 - DNA, 25 bp, Homo sapien
ctgtccggagttcggcccgggagca

SEQ ID NO: 513743 - DNA, 25 bp, Homo sapien
agcagggtagggaacacctggccca

SEQ ID NO: 513744 - DNA, 25 bp, Homo sapien
ccacctggagcggaaaactgctcaa

SEQ ID NO: 513745 - DNA, 25 bp, Homo sapien
gaaaactgctcaaaccacaaacaac

SEQ ID NO: 513746 - DNA, 25 bp, Homo sapien
gtggcctgagccttaacaacatgtt

SEQ ID NO: 513747 - DNA, 25 bp, Homo sapien
gtttttgctgcagataatcggccag

SEQ ID NO: 513748 - DNA, 25 bp, Homo sapien
agataatcggccagagactgtttct

SEQ ID NO: 513749 - DNA, 25 bp, Homo sapien
tctctactcctctctaagtatgctt

SEQ ID NO: 513750 - DNA, 25 bp, Homo sapien
aatgcttttagctaatctgtaacct

SEQ ID NO: 513751 - DNA, 25 bp, Homo sapien
aacatgtgggtcaaactctgtttgt

SEQ ID NO: 513752 - DNA, 25 bp, Homo sapien
caaactctgtttgtggctctcagct

SEQ ID NO: 513753 - DNA, 25 bp, Homo sapien
tctcagctctcaaggctgttttccc

SEQ ID NO: 513754 - DNA, 25 bp, Homo sapien
tgtcatctatgtatcacaagttgct

SEQ ID NO: 513755 - DNA, 25 bp, Homo sapien
gtatcacaagttgctagaccaaaat

SEQ ID NO: 513756 - DNA, 25 bp, Homo sapien
tggccaggccacagtccaaatggga

SEQ ID NO: 513757 - DNA, 25 bp, Homo sapien
gggaagacaccagtcagtcacaaaa

SEQ ID NO: 513758 - DNA, 25 bp, Homo sapien
ccagtcagtcacaaaagtcgggagc

SEQ ID NO: 513759 - DNA, 25 bp, Homo sapien
agtcgggagcgccacacaaacctgg

SEQ ID NO: 513760 - DNA, 25 bp, Homo sapien
gagcgccacacaaacctggctataa

SEQ ID NO: 513761 - DNA, 25 bp, Homo sapien
gccacacaaacctggctataaggcc

SEQ ID NO: 513762 - DNA, 25 bp, Homo sapien
ataaggcccaggaaccatataggag

SEQ ID NO: 513763 - DNA, 25 bp, Homo sapien
ggcccaggaaccatataggagcctg

SEQ ID NO: 513764 - DNA, 25 bp, Homo sapien
tcattaaactatacaggatgaggct

SEQ ID NO: 513765 - DNA, 25 bp, Homo sapien
cacgacacccatgagccgaaaggat

SEQ ID NO: 513766 - DNA, 25 bp, Homo sapien
gagccgaaaggatgtcactaaggat

SEQ ID NO: 513767 - DNA, 25 bp, Homo sapien
actaaggatggctgattccccaagg

SEQ ID NO: 513768 - DNA, 25 bp, Homo sapien
tccctgctggaggaacacgtcatat

SEQ ID NO: 513769 - DNA, 25 bp, Homo sapien
gaggaacacgtcatatcagatgaga

SEQ ID NO: 513770 - DNA, 25 bp, Homo sapien
aggaagatggcctctgatggacaga

SEQ ID NO: 513771 - DNA, 25 bp, Homo sapien
tcttaactcagcttttgctactttg

SEQ ID NO: 513772 - DNA, 25 bp, Homo sapien
gaaacctgcaccaaggattgtccct

SEQ ID NO: 513773 - DNA, 25 bp, Homo sapien
caaggattgtccctatgtcttggcc

SEQ ID NO: 513774 - DNA, 25 bp, Homo sapien
tggcccctcctagagcgtgtgcaga

SEQ ID NO: 513775 - DNA, 25 bp, Homo sapien
gtgtgcagactgatgattttatatg

SEQ ID NO: 513776 - DNA, 25 bp, Homo sapien
attcaaaagtagacccacgtgtata

SEQ ID NO: 513777 - DNA, 25 bp, Homo sapien
aagtagacccacgtgtataccatca

SEQ ID NO: 513778 - DNA, 25 bp, Homo sapien
ccacgtgtataccatcacctgagtt

SEQ ID NO: 513779 - DNA, 25 bp, Homo sapien
gtataccatcacctgagttttgaga

SEQ ID NO: 513780 - DNA, 25 bp, Homo sapien
taccatcacctgagttttgagaaag

SEQ ID NO: 513781 - DNA, 25 bp, Homo sapien
gggtgttctttccagtaaatgtact

SEQ ID NO: 513782 - DNA, 25 bp, Homo sapien
attgcagatctgaatatgaaatgtg

SEQ ID NO: 513783 - DNA, 25 bp, Homo sapien
atcttaggacagttgtaatcttgga

SEQ ID NO: 513784 - DNA, 25 bp, Homo sapien
ggacagttgtaatcttggagtaagc

SEQ ID NO: 513785 - DNA, 25 bp, Homo sapien
caaaggtttatgagaccaaaaagca

SEQ ID NO: 513786 - DNA, 25 bp, Homo sapien
ggagaacttctatttatcaggacag

SEQ ID NO: 513787 - DNA, 25 bp, Homo sapien
caaaatccgctgctgtgaaggagct

SEQ ID NO: 513788 - DNA, 25 bp, Homo sapien
gtaggcggacgctctgtagataaga

SEQ ID NO: 513789 - DNA, 25 bp, Homo sapien
gagaatccctgatctgcctgggcat

SEQ ID NO: 513790 - DNA, 25 bp, Homo sapien
atcatcttgctctttatgacctgct

SEQ ID NO: 513791 - DNA, 25 bp, Homo sapien
tttatgacctgcttggctgccactg

SEQ ID NO: 513792 - DNA, 25 bp, Homo sapien
gctgccactgtgtagggcctgctta

SEQ ID NO: 513793 - DNA, 25 bp, Homo sapien
tagggcctgcttaaagtcctttgca

SEQ ID NO: 513794 - DNA, 25 bp, Homo sapien
taaagtcctttgcactctcagcatt

SEQ ID NO: 513795 - DNA, 25 bp, Homo sapien
gacaagcttctcattatggcaggca

SEQ ID NO: 513796 - DNA, 25 bp, Homo sapien
aactctttataattcgtcctccact

SEQ ID NO: 513797 - DNA, 25 bp, Homo sapien
tgttgtctcacacttccttgaagtt

SEQ ID NO: 513798 - DNA, 25 bp, Homo sapien
agcaccacttgtcctggaggctgga

SEQ ID NO: 513799 - DNA, 25 bp, Homo sapien
gaggacatctggttataggtactgt

SEQ ID NO: 513800 - DNA, 25 bp, Homo sapien
tactgtagcagggataggtgccaca

SEQ ID NO: 513801 - DNA, 25 bp, Homo sapien
agcagatcgctgtttccagaacggg

SEQ ID NO: 513802 - DNA, 25 bp, Homo sapien
gtatctcattgtgaaacagactcta

SEQ ID NO: 513803 - DNA, 25 bp, Homo sapien
gagtggttctatttggtcttcagtg

SEQ ID NO: 513804 - DNA, 25 bp, Homo sapien
agtgttttagcctcattagttcata

SEQ ID NO: 513805 - DNA, 25 bp, Homo sapien
ttagttcatatttggcatgcagctt

SEQ ID NO: 513806 - DNA, 25 bp, Homo sapien
tggcatgcagcttgtggtgagtact

SEQ ID NO: 513807 - DNA, 25 bp, Homo sapien
gagtactgttctaggactggccaaa

SEQ ID NO: 513808 - DNA, 25 bp, Homo sapien
cactccaaacactactgattcagca

SEQ ID NO: 513809 - DNA, 25 bp, Homo sapien
tgtgtggtccgtatcatgaatgccc

SEQ ID NO: 513810 - DNA, 25 bp, Homo sapien
gtggtccgtatcatgaatgcccatc

SEQ ID NO: 513811 - DNA, 25 bp, Homo sapien
cgtatcatgaatgcccatcacgagg

SEQ ID NO: 513812 - DNA, 25 bp, Homo sapien
gaatgcccatcacgaggcaggatct

SEQ ID NO: 513813 - DNA, 25 bp, Homo sapien
tcacgaggcaggatctcgggcacat

SEQ ID NO: 513814 - DNA, 25 bp, Homo sapien
aggatctcgggcacatacctgtact

SEQ ID NO: 513815 - DNA, 25 bp, Homo sapien
atacctgtacttctgctccagagtg

SEQ ID NO: 513816 - DNA, 25 bp, Homo sapien
gtacttctgctccagagtgtgcgct

SEQ ID NO: 513817 - DNA, 25 bp, Homo sapien
tgctccagagtgtgcgctccccaaa

SEQ ID NO: 513818 - DNA, 25 bp, Homo sapien
aaatcccctgagtaaacctctctgg

SEQ ID NO: 513819 - DNA, 25 bp, Homo sapien
ctgagtaaacctctctggactgtgc

SEQ ID NO: 513820 - DNA, 25 bp, Homo sapien
agtcgatgaactcgccctcagaggg

SEQ ID NO: 513821 - DNA, 25 bp, Homo sapien
gtgcccgcagtgtgaggacgccctc

SEQ ID NO: 513822 - DNA, 25 bp, Homo sapien
tttccgctggttcagctgcttgaaa

SEQ ID NO: 513823 - DNA, 25 bp, Homo sapien
ggttcagctgcttgaaagcctcggc

SEQ ID NO: 513824 - DNA, 25 bp, Homo sapien
tgaaagcctcggctgccttctgcag

SEQ ID NO: 513825 - DNA, 25 bp, Homo sapien
gggccacaaaccactcgatgtcgtc

SEQ ID NO: 513826 - DNA, 25 bp, Homo sapien
tcgatgtcgtccagggcgcagttga

SEQ ID NO: 513827 - DNA, 25 bp, Homo sapien
atttgcgtctccttctctatcttct

SEQ ID NO: 513828 - DNA, 25 bp, Homo sapien
gctttgccagcaagttaatcgccag

SEQ ID NO: 513829 - DNA, 25 bp, Homo sapien
taatcgccagcttgattttctggaa

SEQ ID NO: 513830 - DNA, 25 bp, Homo sapien
ttctggaagcagtcgatgaactcgc

SEQ ID NO: 513831 - DNA, 25 bp, Homo sapien
gtattcaaaagtgcccatacgccag

SEQ ID NO: 513832 - DNA, 25 bp, Homo sapien
aaagtgcccatacgccagtcatcat

SEQ ID NO: 513833 - DNA, 25 bp, Homo sapien
gctaaacagcagtaacatccttggg

SEQ ID NO: 513834 - DNA, 25 bp, Homo sapien
aacatccttgggagtctggaatctt

SEQ ID NO: 513835 - DNA, 25 bp, Homo sapien
gatgaaattccccatcatgaatctt

SEQ ID NO: 513836 - DNA, 25 bp, Homo sapien
gaatcttcaattaagtgacttctat

SEQ ID NO: 513837 - DNA, 25 bp, Homo sapien
tatacagaagacaccaaagagcaat

SEQ ID NO: 513838 - DNA, 25 bp, Homo sapien
agagcaatcagatgtcaccacatct

SEQ ID NO: 513839 - DNA, 25 bp, Homo sapien
atctgagagaaccagaagtcctcca

SEQ ID NO: 513840 - DNA, 25 bp, Homo sapien
gatgtactaaaaactgaggattcca

SEQ ID NO: 513841 - DNA, 25 bp, Homo sapien
caaaaatcccacaaagtcagcagca

SEQ ID NO: 513842 - DNA, 25 bp, Homo sapien
tacatggccacagtacagtctggtc

SEQ ID NO: 513843 - DNA, 25 bp, Homo sapien
acagtacagtctggtccttttcctt

SEQ ID NO: 513844 - DNA, 25 bp, Homo sapien
tccccatctcttgtacacattttaa

SEQ ID NO: 513845 - DNA, 25 bp, Homo sapien
agaccatatacaaaacctctccact

SEQ ID NO: 513846 - DNA, 25 bp, Homo sapien
tggtcttccccaactttcagttata

SEQ ID NO: 513847 - DNA, 25 bp, Homo sapien
tttcagttatacgaatgccatcagc

SEQ ID NO: 513848 - DNA, 25 bp, Homo sapien
catcagcttgaccagggaagatctg

SEQ ID NO: 513849 - DNA, 25 bp, Homo sapien
agatctgggcttcatgaggcccctt

SEQ ID NO: 513850 - DNA, 25 bp, Homo sapien
atgaggccccttttgaggctctcaa

SEQ ID NO: 513851 - DNA, 25 bp, Homo sapien
ccttttgaggctctcaagttctaga

SEQ ID NO: 513852 - DNA, 25 bp, Homo sapien
aagttctagagagctgcctgtggga

SEQ ID NO: 513853 - DNA, 25 bp, Homo sapien
tctctctgatccaggccgggcctat

SEQ ID NO: 513854 - DNA, 25 bp, Homo sapien
caggccgggcctatacagaggtgct

SEQ ID NO: 513855 - DNA, 25 bp, Homo sapien
gcctatacagaggtgctggctgctt

SEQ ID NO: 513856 - DNA, 25 bp, Homo sapien
ggctgcttgtttacattctcctctg

SEQ ID NO: 513857 - DNA, 25 bp, Homo sapien
ctgcttgtttacattctcctctggg

SEQ ID NO: 513858 - DNA, 25 bp, Homo sapien
aaagggcaccctggattactctttg

SEQ ID NO: 513859 - DNA, 25 bp, Homo sapien
gcaccctggattactctttggaaat

SEQ ID NO: 513860 - DNA, 25 bp, Homo sapien
ttactctttggaaatcactccttgg

SEQ ID NO: 513861 - DNA, 25 bp, Homo sapien
tttggaaatcactccttggtgggca

SEQ ID NO: 513862 - DNA, 25 bp, Homo sapien
gaaatcactccttggtgggcagcat

SEQ ID NO: 513863 - DNA, 25 bp, Homo sapien
tcactccttggtgggcagcatcctg

SEQ ID NO: 513864 - DNA, 25 bp, Homo sapien
gaagccatcacgtctgtggacgacg

SEQ ID NO: 513865 - DNA, 25 bp, Homo sapien
tggacgacgccatccggaagctggt

SEQ ID NO: 513866 - DNA, 25 bp, Homo sapien
gatctggacccaggagatgctgctg

SEQ ID NO: 513867 - DNA, 25 bp, Homo sapien
gctgctgcaggtgaacgaccagtcg

SEQ ID NO: 513868 - DNA, 25 bp, Homo sapien
tgcggctgctggacatcgagtcaca

SEQ ID NO: 513869 - DNA, 25 bp, Homo sapien
gagctggaagacttcccgctgccca

SEQ ID NO: 513870 - DNA, 25 bp, Homo sapien
tgcagcgcagccagacggtcctcaa

SEQ ID NO: 513871 - DNA, 25 bp, Homo sapien
tacccgtctgtgctgctgctcgtgt

SEQ ID NO: 513872 - DNA, 25 bp, Homo sapien
ctcgtgtgccaggactcggagcaga

SEQ ID NO: 513873 - DNA, 25 bp, Homo sapien
agagcaagccggatgtccacttctt

SEQ ID NO: 513874 - DNA, 25 bp, Homo sapien
tccacttcttccactgcgatgaggt

SEQ ID NO: 513875 - DNA, 25 bp, Homo sapien
cttgcagccgtcacagctcgaggca

SEQ ID NO: 513876 - DNA, 25 bp, Homo sapien
acagctcgaggcaccgtagtgtttg

SEQ ID NO: 513877 - DNA, 25 bp, Homo sapien
aggcaccgtagtgtttgcccgtggc

SEQ ID NO: 513878 - DNA, 25 bp, Homo sapien
agatggcacacagggcgctgacacc

SEQ ID NO: 513879 - DNA, 25 bp, Homo sapien
cgcgttgaggttggtgccttctgat

SEQ ID NO: 513880 - DNA, 25 bp, Homo sapien
gggacgtgtcattgcccatcgtcaa

SEQ ID NO: 513881 - DNA, 25 bp, Homo sapien
cattctcaaattccagggtggtgta

SEQ ID NO: 513882 - DNA, 25 bp, Homo sapien
agtgcagcactgtagtcggccatgt

SEQ ID NO: 513883 - DNA, 25 bp, Homo sapien
actgtagtcggccatgtccatgtcg

SEQ ID NO: 513884 - DNA, 25 bp, Homo sapien
catgtccatgtcgacggagggtttt

SEQ ID NO: 513885 - DNA, 25 bp, Homo sapien
tttggagagtgcattctccctgcct

SEQ ID NO: 513886 - DNA, 25 bp, Homo sapien
ggagccacttcttgactgagcttgt

SEQ ID NO: 513887 - DNA, 25 bp, Homo sapien
gaatctggagagatacttgtggcaa

SEQ ID NO: 513888 - DNA, 25 bp, Homo sapien
tacttgtggcaagtacccggtgttc

SEQ ID NO: 513889 - DNA, 25 bp, Homo sapien
aagtacccggtgttcctgcagtcat

SEQ ID NO: 513890 - DNA, 25 bp, Homo sapien
gtgttcctgcagtcatccacaagcg

SEQ ID NO: 513891 - DNA, 25 bp, Homo sapien
agtgtaaagtttgcatcctccaatt

SEQ ID NO: 513892 - DNA, 25 bp, Homo sapien
ttgcatcctccaattatcacggttg

SEQ ID NO: 513893 - DNA, 25 bp, Homo sapien
ttatcacggttgcaagacagaactt

SEQ ID NO: 513894 - DNA, 25 bp, Homo sapien
tgaaactagatacacctgattttgg

SEQ ID NO: 513895 - DNA, 25 bp, Homo sapien
ctgattttggttatctctggatgcc

SEQ ID NO: 513896 - DNA, 25 bp, Homo sapien
ctggatgccattcaccgagaatgaa

SEQ ID NO: 513897 - DNA, 25 bp, Homo sapien
gaaagctccagttcatgtaaaacgt

SEQ ID NO: 513898 - DNA, 25 bp, Homo sapien
ggtttggctttcttgaagcccagca

SEQ ID NO: 513899 - DNA, 25 bp, Homo sapien
ggccttccagtcagtaggtaccaag

SEQ ID NO: 513900 - DNA, 25 bp, Homo sapien
taggtaccaagtgggatgtttcaac

SEQ ID NO: 513901 - DNA, 25 bp, Homo sapien
accaaagctcgagtggcacctgaga

SEQ ID NO: 513902 - DNA, 25 bp, Homo sapien
aaggttaccgtcagatttcctccag

SEQ ID NO: 513903 - DNA, 25 bp, Homo sapien
tccagaggccagtggttacttacac

SEQ ID NO: 513904 - DNA, 25 bp, Homo sapien
ggttacttacacattgggcatgcaa

SEQ ID NO: 513905 - DNA, 25 bp, Homo sapien
gggcatgcaaaagctgctcttctga

SEQ ID NO: 513906 - DNA, 25 bp, Homo sapien
tcttctgaaccagcactaccaggtt

SEQ ID NO: 513907 - DNA, 25 bp, Homo sapien
cagcactaccaggttaactttaaag

SEQ ID NO: 513908 - DNA, 25 bp, Homo sapien
catctcaactcgtgccctcttttgg

SEQ ID NO: 513909 - DNA, 25 bp, Homo sapien
cccgtctcttggagggagcccagac

SEQ ID NO: 513910 - DNA, 25 bp, Homo sapien
gagcccagaccctgtagggagtttt

SEQ ID NO: 513911 - DNA, 25 bp, Homo sapien
ctttcttctcttgggtgtggtgtct

SEQ ID NO: 513912 - DNA, 25 bp, Homo sapien
ggtgtggtgtcttgtgtttctgaat

SEQ ID NO: 513913 - DNA, 25 bp, Homo sapien
tctgaatgtgaacccaaagacccta

SEQ ID NO: 513914 - DNA, 25 bp, Homo sapien
gaggaagcaccttcctctttgtgtt

SEQ ID NO: 513915 - DNA, 25 bp, Homo sapien
tgcccttttctctagagtgttgtgt

SEQ ID NO: 513916 - DNA, 25 bp, Homo sapien
agtgttgtgttcttgctcttggtac

SEQ ID NO: 513917 - DNA, 25 bp, Homo sapien
aggagctagtctggtgccttgagca

SEQ ID NO: 513918 - DNA, 25 bp, Homo sapien
gtctggtgccttgagcaagcttgaa

SEQ ID NO: 513919 - DNA, 25 bp, Homo sapien
acccatattgccatgtccaaggcag

SEQ ID NO: 513920 - DNA, 25 bp, Homo sapien
tctccaccagaggaggcatcatctg

SEQ ID NO: 513921 - DNA, 25 bp, Homo sapien
atctgcccgcagactgggactgtgg

SEQ ID NO: 513922 - DNA, 25 bp, Homo sapien
gggtcatgattacatgcgattgtat

SEQ ID NO: 513923 - DNA, 25 bp, Homo sapien
cgattgtatcggcatgctcagttct

SEQ ID NO: 513924 - DNA, 25 bp, Homo sapien
atcggcatgctcagttctgtccttt

SEQ ID NO: 513925 - DNA, 25 bp, Homo sapien
ggctggccatctgagtgaggaccga

SEQ ID NO: 513926 - DNA, 25 bp, Homo sapien
tgaggaccgaggtggccacagcttc

SEQ ID NO: 513927 - DNA, 25 bp, Homo sapien
gaggtggccacagcttcagctgcag

SEQ ID NO: 513928 - DNA, 25 bp, Homo sapien
ttcagctgcagagcgaacactgagg

SEQ ID NO: 513929 - DNA, 25 bp, Homo sapien
gagcgaacactgaggccattgctag

SEQ ID NO: 513930 - DNA, 25 bp, Homo sapien
ccgttggtaaataataattggctat

SEQ ID NO: 513931 - DNA, 25 bp, Homo sapien
atatttggtaaatgtctctctccta

SEQ ID NO: 513932 - DNA, 25 bp, Homo sapien
tggtaaatgtctctctcctactgta

SEQ ID NO: 513933 - DNA, 25 bp, Homo sapien
tctcctactgtattgtcattttcaa

SEQ ID NO: 513934 - DNA, 25 bp, Homo sapien
gtgtttgttttctggcgcgtgctgc

SEQ ID NO: 513935 - DNA, 25 bp, Homo sapien
gttttctggcgcgtgctgcaaagaa

SEQ ID NO: 513936 - DNA, 25 bp, Homo sapien
gcgcgtgctgcaaagaagctatttc

SEQ ID NO: 513937 - DNA, 25 bp, Homo sapien
ataaatcactaagacatatttcctt

SEQ ID NO: 513938 - DNA, 25 bp, Homo sapien
ggcaggattcctttcaaaatggatc

SEQ ID NO: 513939 - DNA, 25 bp, Homo sapien
ggatctggagttattagacactagt

SEQ ID NO: 513940 - DNA, 25 bp, Homo sapien
ttataaagtactattgttccaaaag

SEQ ID NO: 513941 - DNA, 25 bp, Homo sapien
agacatgtgaccaaattcagctcaa

SEQ ID NO: 513942 - DNA, 25 bp, Homo sapien
tctagaaaaagtgtcctcttcccta

SEQ ID NO: 513943 - DNA, 25 bp, Homo sapien
atgtctcagaacattgtcctgccta

SEQ ID NO: 513944 - DNA, 25 bp, Homo sapien
attgtcctgcctaaacatgatgcct

SEQ ID NO: 513945 - DNA, 25 bp, Homo sapien
aaacatgatgcctcggacattctgc

SEQ ID NO: 513946 - DNA, 25 bp, Homo sapien
cctcggacattctgcttctgtcttg

SEQ ID NO: 513947 - DNA, 25 bp, Homo sapien
gtcttgctacctgcagcacaaggaa

SEQ ID NO: 513948 - DNA, 25 bp, Homo sapien
ttagaccccatgttgggcctgagta

SEQ ID NO: 513949 - DNA, 25 bp, Homo sapien
ccatgttgggcctgagtagtccaaa

SEQ ID NO: 513950 - DNA, 25 bp, Homo sapien
gtagtccaaaggcatatcccattcc

SEQ ID NO: 513951 - DNA, 25 bp, Homo sapien
cattcccctggccagggattagttt

SEQ ID NO: 513952 - DNA, 25 bp, Homo sapien
gaagatgctctaaaacctcaaatca

SEQ ID NO: 513953 - DNA, 25 bp, Homo sapien
gatgctctaaaacctcaaatcagtg

SEQ ID NO: 513954 - DNA, 25 bp, Homo sapien
gctctaaaacctcaaatcagtgact

SEQ ID NO: 513955 - DNA, 25 bp, Homo sapien
gagagtgaggaacccccaaggcacc

SEQ ID NO: 513956 - DNA, 25 bp, Homo sapien
agcctcccaaacctcgaatgagtga

SEQ ID NO: 513957 - DNA, 25 bp, Homo sapien
gcctcccaaacctcgaatgagtgat

SEQ ID NO: 513958 - DNA, 25 bp, Homo sapien
ccaaacctcgaatgagtgattctga

SEQ ID NO: 513959 - DNA, 25 bp, Homo sapien
gaggagcttcccaaacctcgtatca

SEQ ID NO: 513960 - DNA, 25 bp, Homo sapien
ggagcttcccaaacctcgtatcagt

SEQ ID NO: 513961 - DNA, 25 bp, Homo sapien
tcccaaacctcgtatcagtgactca

SEQ ID NO: 513962 - DNA, 25 bp, Homo sapien
aagtgaggaccctccgaggcaccag

SEQ ID NO: 513963 - DNA, 25 bp, Homo sapien
ttgggccgctgcagtcacatctgtc

SEQ ID NO: 513964 - DNA, 25 bp, Homo sapien
acatctgtccagagaaattcctttt

SEQ ID NO: 513965 - DNA, 25 bp, Homo sapien
aattccttttgggactggaggcaga

SEQ ID NO: 513966 - DNA, 25 bp, Homo sapien
actggaggcagaaaagcggccagaa

SEQ ID NO: 513967 - DNA, 25 bp, Homo sapien
ttgcccccagccttaggatttcagg

SEQ ID NO: 513968 - DNA, 25 bp, Homo sapien
gggaggaacctcaataaccttgaag

SEQ ID NO: 513969 - DNA, 25 bp, Homo sapien
gtggaatccagttatttcctgcgct

SEQ ID NO: 513970 - DNA, 25 bp, Homo sapien
tccagttatttcctgcgctgcgagg

SEQ ID NO: 513971 - DNA, 25 bp, Homo sapien
cgctgcgagggtttctttatttcac

SEQ ID NO: 513972 - DNA, 25 bp, Homo sapien
tcttttctgaatgtcaaggcagtga

SEQ ID NO: 513973 - DNA, 25 bp, Homo sapien
aaggcagtgaggtgcctctcactgt

SEQ ID NO: 513974 - DNA, 25 bp, Homo sapien
ccccatccctgataaaggagccgta

SEQ ID NO: 513975 - DNA, 25 bp, Homo sapien
aaaggagccgtaaggctgcaccctt

SEQ ID NO: 513976 - DNA, 25 bp, Homo sapien
ggctgcacccttgtgataacagaaa

SEQ ID NO: 513977 - DNA, 25 bp, Homo sapien
aacaaagggctaaaatggctgcata

SEQ ID NO: 513978 - DNA, 25 bp, Homo sapien
tggctgcataaatcaacatcagtct

SEQ ID NO: 513979 - DNA, 25 bp, Homo sapien
caacatcagtctttcatccagaact

SEQ ID NO: 513980 - DNA, 25 bp, Homo sapien
catccagaactggtgaatcacattg

SEQ ID NO: 513981 - DNA, 25 bp, Homo sapien
tcctgaaagtagctgcctgtgaccc

SEQ ID NO: 513982 - DNA, 25 bp, Homo sapien
tgcctgtgacccagtgaagccatat

SEQ ID NO: 513983 - DNA, 25 bp, Homo sapien
gtgacccagtgaagccatatcaaaa

SEQ ID NO: 513984 - DNA, 25 bp, Homo sapien
gaagcctgaagtgtaactgatgttt

SEQ ID NO: 513985 - DNA, 25 bp, Homo sapien
ttttgtttgttcagacagtctgttc

SEQ ID NO: 513986 - DNA, 25 bp, Homo sapien
gtttgttcagacagtctgttctttt

SEQ ID NO: 513987 - DNA, 25 bp, Homo sapien
ttccccatcctctacgttttagaga

SEQ ID NO: 513988 - DNA, 25 bp, Homo sapien
ctacgttttagagaggaatcttgtt

SEQ ID NO: 513989 - DNA, 25 bp, Homo sapien
gccaaaaaacctttgagattgcatt

SEQ ID NO: 513990 - DNA, 25 bp, Homo sapien
agagaagggataaaggaccagcaat

SEQ ID NO: 513991 - DNA, 25 bp, Homo sapien
ggaccagcaataataccttgtaagt

SEQ ID NO: 513992 - DNA, 25 bp, Homo sapien
taataccttgtaagttgcttttgtt

SEQ ID NO: 513993 - DNA, 25 bp, Homo sapien
ttgtttgtaaaatctgagcttatag

SEQ ID NO: 513994 - DNA, 25 bp, Homo sapien
aatctgagcttatagttttccttag

SEQ ID NO: 513995 - DNA, 25 bp, Homo sapien
tagttttccttagtgagtaaattca

SEQ ID NO: 513996 - DNA, 25 bp, Homo sapien
gagagatctagaacagatgcctcaa

SEQ ID NO: 513997 - DNA, 25 bp, Homo sapien
aacagatgcctcaacgacgaagaat

SEQ ID NO: 513998 - DNA, 25 bp, Homo sapien
aagaatgaacagcactggtggtcag

SEQ ID NO: 513999 - DNA, 25 bp, Homo sapien
gaaggctcttagacctggagatcct

SEQ ID NO: 514000 - DNA, 25 bp, Homo sapien
gagatcctggattctgtgcccgtgc

SEQ ID NO: 514001 - DNA, 25 bp, Homo sapien
cctggattctgtgcccgtgcaaggg

SEQ ID NO: 514002 - DNA, 25 bp, Homo sapien
gtgcaagggtcccaatgccttcaaa

SEQ ID NO: 514003 - DNA, 25 bp, Homo sapien
acaaggactatgttgtcaggcccaa

SEQ ID NO: 514004 - DNA, 25 bp, Homo sapien
gactatgttgtcaggcccaaatgga

SEQ ID NO: 514005 - DNA, 25 bp, Homo sapien
ttgtcaggcccaaatggaatgtgga

SEQ ID NO: 514006 - DNA, 25 bp, Homo sapien
gtggaaatggagtcatccaggtttc

SEQ ID NO: 514007 - DNA, 25 bp, Homo sapien
aaaagactccactgaaattctaagt

SEQ ID NO: 514008 - DNA, 25 bp, Homo sapien
aattctaagtttgccaagtagtgta

SEQ ID NO: 514009 - DNA, 25 bp, Homo sapien
agtagtgtaattgaagtccttgtct

SEQ ID NO: 514010 - DNA, 25 bp, Homo sapien
gaagtccttgtctggtcacacagtt

SEQ ID NO: 514011 - DNA, 25 bp, Homo sapien
gtccttgtctggtcacacagtttaa

SEQ ID NO: 514012 - DNA, 25 bp, Homo sapien
ggtcacacagtttaattctattttt

SEQ ID NO: 514013 - DNA, 25 bp, Homo sapien
gaacataatgggactgcataacaga

SEQ ID NO: 514014 - DNA, 25 bp, Homo sapien
gggactgcataacagagttctatat

SEQ ID NO: 514015 - DNA, 25 bp, Homo sapien
tagtacagagtacagctatgctgtg

SEQ ID NO: 514016 - DNA, 25 bp, Homo sapien
ctatgctgtgactgttttggaaagc

SEQ ID NO: 514017 - DNA, 25 bp, Homo sapien
ggaaagccagttttaacactatgtt

SEQ ID NO: 514018 - DNA, 25 bp, Homo sapien
gggtatttattcaacatctgctttc

SEQ ID NO: 514019 - DNA, 25 bp, Homo sapien
aacatctgctttctgctaagctcca

SEQ ID NO: 514020 - DNA, 25 bp, Homo sapien
ttctgctaagctccatggaaggcac

SEQ ID NO: 514021 - DNA, 25 bp, Homo sapien
gagtggtatcaggacaatgctattt

SEQ ID NO: 514022 - DNA, 25 bp, Homo sapien
tttaatgtttgatccatcccttctc

SEQ ID NO: 514023 - DNA, 25 bp, Homo sapien
tgatccatcccttctctaagcacat

SEQ ID NO: 514024 - DNA, 25 bp, Homo sapien
tttctgtgctacctgatttaaccct

SEQ ID NO: 514025 - DNA, 25 bp, Homo sapien
gtgctacctgatttaaccctttcag

SEQ ID NO: 514026 - DNA, 25 bp, Homo sapien
aaccctttcagttcatagaacccag

SEQ ID NO: 514027 - DNA, 25 bp, Homo sapien
tggccaagagtagcttccacttcaa

SEQ ID NO: 514028 - DNA, 25 bp, Homo sapien
gagtagcttccacttcaaagttcct

SEQ ID NO: 514029 - DNA, 25 bp, Homo sapien
tggtaggaacccaggagggacccag

SEQ ID NO: 514030 - DNA, 25 bp, Homo sapien
ggacccaggaaactaagatttgaga

SEQ ID NO: 514031 - DNA, 25 bp, Homo sapien
aagatttgagattcagtgcctctga

SEQ ID NO: 514032 - DNA, 25 bp, Homo sapien
gcctctgaaagactaccaaaatcta

SEQ ID NO: 514033 - DNA, 25 bp, Homo sapien
agctgctgtagatttattctgccca

SEQ ID NO: 514034 - DNA, 25 bp, Homo sapien
gtagatttattctgcccacaacttg

SEQ ID NO: 514035 - DNA, 25 bp, Homo sapien
gggtcctttctggatctcggcttct

SEQ ID NO: 514036 - DNA, 25 bp, Homo sapien
aaaatggacacacaatcctcctcca

SEQ ID NO: 514037 - DNA, 25 bp, Homo sapien
cagggactgctgtgaaatcaagaaa

SEQ ID NO: 514038 - DNA, 25 bp, Homo sapien
gaaatcggaaaatactttcagaagt

SEQ ID NO: 514039 - DNA, 25 bp, Homo sapien
tgctagaaaaacaaccccaataaat

SEQ ID NO: 514040 - DNA, 25 bp, Homo sapien
ctgtaaatgaaacccagttttgtgt

SEQ ID NO: 514041 - DNA, 25 bp, Homo sapien
gttttgtgttaatattcctgctgtg

SEQ ID NO: 514042 - DNA, 25 bp, Homo sapien
agacaggcggtgagaagttacaact

SEQ ID NO: 514043 - DNA, 25 bp, Homo sapien
tacaactctgaagtgaagctgtcct

SEQ ID NO: 514044 - DNA, 25 bp, Homo sapien
gacctttgcagtgatgtccagggct

SEQ ID NO: 514045 - DNA, 25 bp, Homo sapien
ccagggctgccgtccttgtgaggat

SEQ ID NO: 514046 - DNA, 25 bp, Homo sapien
gccgtccttgtgaggatggagcttc

SEQ ID NO: 514047 - DNA, 25 bp, Homo sapien
ggatggagcttcaggctcccatcat

SEQ ID NO: 514048 - DNA, 25 bp, Homo sapien
ttattttctgtttcaagcttctgta

SEQ ID NO: 514049 - DNA, 25 bp, Homo sapien
tcaagcttctgtactttatggaact

SEQ ID NO: 514050 - DNA, 25 bp, Homo sapien
tgtactttatggaactttggctgtg

SEQ ID NO: 514051 - DNA, 25 bp, Homo sapien
acaaggcagtgcttctggtccagat

SEQ ID NO: 514052 - DNA, 25 bp, Homo sapien
cttctggtccagattgatgataaat

SEQ ID NO: 514053 - DNA, 25 bp, Homo sapien
atatgtgactgtaattgaaactggg

SEQ ID NO: 514054 - DNA, 25 bp, Homo sapien
gaagtgtgagccagtgtttattata

SEQ ID NO: 514055 - DNA, 25 bp, Homo sapien
tttttccctctcaattccaaggcat

SEQ ID NO: 514056 - DNA, 25 bp, Homo sapien
ttccctctcaattccaaggcattgg

SEQ ID NO: 514057 - DNA, 25 bp, Homo sapien
atgcctgcaggtatcactttgatcc

SEQ ID NO: 514058 - DNA, 25 bp, Homo sapien
gcaggtatcactttgatcctatgtg

SEQ ID NO: 514059 - DNA, 25 bp, Homo sapien
tttgatcctatgtgggagcgactga

SEQ ID NO: 514060 - DNA, 25 bp, Homo sapien
tcctatgtgggagcgactgaaaata

SEQ ID NO: 514061 - DNA, 25 bp, Homo sapien
tcactgtctccatccccaaataaag

SEQ ID NO: 514062 - DNA, 25 bp, Homo sapien
tttcctgtaatttatagtgtgtagc

SEQ ID NO: 514063 - DNA, 25 bp, Homo sapien
gtgtgtagctgtaaattgaaatatt

SEQ ID NO: 514064 - DNA, 25 bp, Homo sapien
attcatatgttgtctcataacttta

SEQ ID NO: 514065 - DNA, 25 bp, Homo sapien
atatgttgtctcataactttatttt

SEQ ID NO: 514066 - DNA, 25 bp, Homo sapien
attactcatatttacaattgggcga

SEQ ID NO: 514067 - DNA, 25 bp, Homo sapien
acaattgggcgatataggaacttca

SEQ ID NO: 514068 - DNA, 25 bp, Homo sapien
gggcgatataggaacttcaatttag

SEQ ID NO: 514069 - DNA, 25 bp, Homo sapien
gatttaatttgcaactcttagcatt

SEQ ID NO: 514070 - DNA, 25 bp, Homo sapien
gaaaattgtacatctcctctgagca

SEQ ID NO: 514071 - DNA, 25 bp, Homo sapien
aaattgtacatctcctctgagcatt

SEQ ID NO: 514072 - DNA, 25 bp, Homo sapien
tctgagcatttaggagcagccatct

SEQ ID NO: 514073 - DNA, 25 bp, Homo sapien
tggactagacgcaactacagtgaaa

SEQ ID NO: 514074 - DNA, 25 bp, Homo sapien
aacaagagcactttctaaaatcact

SEQ ID NO: 514075 - DNA, 25 bp, Homo sapien
tcacttaagactgtaaaaccgtcgt

SEQ ID NO: 514076 - DNA, 25 bp, Homo sapien
accgtcgttaagttgcaaggacttg

SEQ ID NO: 514077 - DNA, 25 bp, Homo sapien
gcaaggacttggctttatatgaaaa

SEQ ID NO: 514078 - DNA, 25 bp, Homo sapien
aaatcaccttaaactcttgttcagt

SEQ ID NO: 514079 - DNA, 25 bp, Homo sapien
accttaaactcttgttcagttcaca

SEQ ID NO: 514080 - DNA, 25 bp, Homo sapien
aattgaaatgtgaacttgcctgtcg

SEQ ID NO: 514081 - DNA, 25 bp, Homo sapien
tgaacttgcctgtcgtttgcaactt

SEQ ID NO: 514082 - DNA, 25 bp, Homo sapien
gtcgtttgcaacttcacacttttag

SEQ ID NO: 514083 - DNA, 25 bp, Homo sapien
tgcaacttcacacttttagaatttg

SEQ ID NO: 514084 - DNA, 25 bp, Homo sapien
gcttctgtcttagaattgagctagc

SEQ ID NO: 514085 - DNA, 25 bp, Homo sapien
tcttagaattgagctagcttgagtc

SEQ ID NO: 514086 - DNA, 25 bp, Homo sapien
agcttgagtcaatttctgtgcctgc

SEQ ID NO: 514087 - DNA, 25 bp, Homo sapien
tgagtcaatttctgtgcctgcaacc

SEQ ID NO: 514088 - DNA, 25 bp, Homo sapien
caatttctgtgcctgcaaccaaatg

SEQ ID NO: 514089 - DNA, 25 bp, Homo sapien
ctgtgcctgcaaccaaatgaaaatt

SEQ ID NO: 514090 - DNA, 25 bp, Homo sapien
atagtgagttctttcaggagctttc

SEQ ID NO: 514091 - DNA, 25 bp, Homo sapien
agttctttcaggagctttctctgtt

SEQ ID NO: 514092 - DNA, 25 bp, Homo sapien
aggagctttctctgtttttctattg

SEQ ID NO: 514093 - DNA, 25 bp, Homo sapien
tttctattgatacctctatatattt

SEQ ID NO: 514094 - DNA, 25 bp, Homo sapien
tttaaggcaatgtcactttgttttg

SEQ ID NO: 514095 - DNA, 25 bp, Homo sapien
gggtgagtgaccacaaggccgaggt

SEQ ID NO: 514096 - DNA, 25 bp, Homo sapien
gccgaggtggataagtcaacccagg

SEQ ID NO: 514097 - DNA, 25 bp, Homo sapien
aagtcaacccaggtggacatcgaca

SEQ ID NO: 514098 - DNA, 25 bp, Homo sapien
caacccaggtggacatcgacaagat

SEQ ID NO: 514099 - DNA, 25 bp, Homo sapien
caggtggacatcgacaagatgctga

SEQ ID NO: 514100 - DNA, 25 bp, Homo sapien
aagatgctgagtgtctgcactgctc

SEQ ID NO: 514101 - DNA, 25 bp, Homo sapien
gctctctcctcagtacaagtgactg

SEQ ID NO: 514102 - DNA, 25 bp, Homo sapien
ctcctcagtacaagtgactgtcccg

SEQ ID NO: 514103 - DNA, 25 bp, Homo sapien
cttccacgcctgaatttggcttcag

SEQ ID NO: 514104 - DNA, 25 bp, Homo sapien
cctgaatttggcttcaggcttcctg

SEQ ID NO: 514105 - DNA, 25 bp, Homo sapien
ccccacttgggactttggtcttgct

SEQ ID NO: 514106 - DNA, 25 bp, Homo sapien
ggccggcctatacaaagtttcttat

SEQ ID NO: 514107 - DNA, 25 bp, Homo sapien
gtggttccaatcatgttttttgccc

SEQ ID NO: 514108 - DNA, 25 bp, Homo sapien
ctttagctgctatctcttgaacaga

SEQ ID NO: 514109 - DNA, 25 bp, Homo sapien
aagttgctgactaggaccttaccca

SEQ ID NO: 514110 - DNA, 25 bp, Homo sapien
aggaccttacccacagggtggcact

SEQ ID NO: 514111 - DNA, 25 bp, Homo sapien
ggtggcactctgtccttgggaaata

SEQ ID NO: 514112 - DNA, 25 bp, Homo sapien
caggtttgaacttcttaacttccag

SEQ ID NO: 514113 - DNA, 25 bp, Homo sapien
gatgggacctgtgatactgtgctgc

SEQ ID NO: 514114 - DNA, 25 bp, Homo sapien
acctgtgatactgtgctgctggtgg

SEQ ID NO: 514115 - DNA, 25 bp, Homo sapien
tgctggtgggaggacccttccacat

SEQ ID NO: 514116 - DNA, 25 bp, Homo sapien
cacatcaacatttgtgtgtatcctt

SEQ ID NO: 514117 - DNA, 25 bp, Homo sapien
tagccccggtcatggtgtccagaca

SEQ ID NO: 514118 - DNA, 25 bp, Homo sapien
gtcatggtgtccagacagagccctg

SEQ ID NO: 514119 - DNA, 25 bp, Homo sapien
gccctgtgaggctgggtccaattgt

SEQ ID NO: 514120 - DNA, 25 bp, Homo sapien
aggctgggtccaattgtggcacttg

SEQ ID NO: 514121 - DNA, 25 bp, Homo sapien
aacaccacctctacagaggccaagg

SEQ ID NO: 514122 - DNA, 25 bp, Homo sapien
gaggccttggaaacgattcccccag

SEQ ID NO: 514123 - DNA, 25 bp, Homo sapien
cattctgggaacatgttgtaagcac

SEQ ID NO: 514124 - DNA, 25 bp, Homo sapien
ggaacatgttgtaagcactgactgg

SEQ ID NO: 514125 - DNA, 25 bp, Homo sapien
tgtaagcactgactgggaccaggca

SEQ ID NO: 514126 - DNA, 25 bp, Homo sapien
agcactgactgggaccaggcaccag

SEQ ID NO: 514127 - DNA, 25 bp, Homo sapien
caccaggcagggtctagaaggctgt

SEQ ID NO: 514128 - DNA, 25 bp, Homo sapien
tagaagggcaggtctctggatgcat

SEQ ID NO: 514129 - DNA, 25 bp, Homo sapien
aggtctctggatgcataactcccga

SEQ ID NO: 514130 - DNA, 25 bp, Homo sapien
tggatgcataactcccgagcccggg

SEQ ID NO: 514131 - DNA, 25 bp, Homo sapien
gggaggaagattccccagcgccccg

SEQ ID NO: 514132 - DNA, 25 bp, Homo sapien
ctgcgtggcgttagctcgtcacgta

SEQ ID NO: 514133 - DNA, 25 bp, Homo sapien
ggcgttagctcgtcacgtagtgttt

SEQ ID NO: 514134 - DNA, 25 bp, Homo sapien
tagctcgtcacgtagtgtttggtgg

SEQ ID NO: 514135 - DNA, 25 bp, Homo sapien
agtgtttggtggacggctgcccata

SEQ ID NO: 514136 - DNA, 25 bp, Homo sapien
ggctgcccatacaccctgtagaaat

SEQ ID NO: 514137 - DNA, 25 bp, Homo sapien
accctgtagaaatcctggtggccgg

SEQ ID NO: 514138 - DNA, 25 bp, Homo sapien
ctgcgtccaggagattcataataaa

SEQ ID NO: 514139 - DNA, 25 bp, Homo sapien
gccctgtgaggctgggtccaattgt

SEQ ID NO: 514140 - DNA, 25 bp, Homo sapien
ccctgtgaggctgggtccaattgtg

SEQ ID NO: 514141 - DNA, 25 bp, Homo sapien
gaggctgggtccaattgtggcactt

SEQ ID NO: 514142 - DNA, 25 bp, Homo sapien
aggctgggtccaattgtggcacttg

SEQ ID NO: 514143 - DNA, 25 bp, Homo sapien
aattgtggcacttggggcaccttgc

SEQ ID NO: 514144 - DNA, 25 bp, Homo sapien
tgctgtcaccttgctcagccatccc

SEQ ID NO: 514145 - DNA, 25 bp, Homo sapien
gccaaggaggccttggaaacgattc

SEQ ID NO: 514146 - DNA, 25 bp, Homo sapien
gaggccttggaaacgattcccccag

SEQ ID NO: 514147 - DNA, 25 bp, Homo sapien
ttggaaacgattcccccagtcattc

SEQ ID NO: 514148 - DNA, 25 bp, Homo sapien
acgattcccccagtcattctgggaa

SEQ ID NO: 514149 - DNA, 25 bp, Homo sapien
caccaggcagggtctagaaggctgt

SEQ ID NO: 514150 - DNA, 25 bp, Homo sapien
tatatacatgagtttatttctgata

SEQ ID NO: 514151 - DNA, 25 bp, Homo sapien
gtgagcatatcagagaggcaaattc

SEQ ID NO: 514152 - DNA, 25 bp, Homo sapien
ctctaggaagagctcaagatcaatt

SEQ ID NO: 514153 - DNA, 25 bp, Homo sapien
tcatagaacagcatttgacgcctag

SEQ ID NO: 514154 - DNA, 25 bp, Homo sapien
aacagcatttgacgcctagaactat

SEQ ID NO: 514155 - DNA, 25 bp, Homo sapien
ttgacgcctagaactatgaccacct

SEQ ID NO: 514156 - DNA, 25 bp, Homo sapien
cctagaactatgaccacctcatggt

SEQ ID NO: 514157 - DNA, 25 bp, Homo sapien
gaccacctcatggtcagagatgaga

SEQ ID NO: 514158 - DNA, 25 bp, Homo sapien
gagaatgtagcctttgtgaccagat

SEQ ID NO: 514159 - DNA, 25 bp, Homo sapien
gtagcctttgtgaccagattatatt

SEQ ID NO: 514160 - DNA, 25 bp, Homo sapien
gaagaagcactcattaaataaaaca

SEQ ID NO: 514161 - DNA, 25 bp, Homo sapien
tgctctggccctcttgcatctggaa

SEQ ID NO: 514162 - DNA, 25 bp, Homo sapien
cctcttgcatctggaacgccaggtg

SEQ ID NO: 514163 - DNA, 25 bp, Homo sapien
aacgccaggtgggtttttctggcat

SEQ ID NO: 514164 - DNA, 25 bp, Homo sapien
ggtttttctggcataggagcccact

SEQ ID NO: 514165 - DNA, 25 bp, Homo sapien
tttctggcataggagcccacttgca

SEQ ID NO: 514166 - DNA, 25 bp, Homo sapien
ggcataggagcccacttgcattttc

SEQ ID NO: 514167 - DNA, 25 bp, Homo sapien
ataggagcccacttgcattttcata

SEQ ID NO: 514168 - DNA, 25 bp, Homo sapien
ggagcccacttgcattttcatagtt

SEQ ID NO: 514169 - DNA, 25 bp, Homo sapien
gcccacttgcattttcatagtttta

SEQ ID NO: 514170 - DNA, 25 bp, Homo sapien
gataaaattccatcttacattctgt

SEQ ID NO: 514171 - DNA, 25 bp, Homo sapien
taaaattccatcttacattctgtgt

SEQ ID NO: 514172 - DNA, 25 bp, Homo sapien
gagtctctgggttctagatgatttt

SEQ ID NO: 514173 - DNA, 25 bp, Homo sapien
agatgattttggtggcatgcttgct

SEQ ID NO: 514174 - DNA, 25 bp, Homo sapien
ggtggcatgcttgctgagccataat

SEQ ID NO: 514175 - DNA, 25 bp, Homo sapien
tgcttgctgagccataattactaaa

SEQ ID NO: 514176 - DNA, 25 bp, Homo sapien
gaatgtaagtggacgggttccctga

SEQ ID NO: 514177 - DNA, 25 bp, Homo sapien
gagagccatcgaggagaatgtgcaa

SEQ ID NO: 514178 - DNA, 25 bp, Homo sapien
atgtgcaattggactgaagctccct

SEQ ID NO: 514179 - DNA, 25 bp, Homo sapien
gaagctccctggctgaagatacatg

SEQ ID NO: 514180 - DNA, 25 bp, Homo sapien
aagatacatgccgagtcagcacatg

SEQ ID NO: 514181 - DNA, 25 bp, Homo sapien
tgccgagtcagcacatgggtagaga

SEQ ID NO: 514182 - DNA, 25 bp, Homo sapien
gatgatgtaaaagcagccaatctgg

SEQ ID NO: 514183 - DNA, 25 bp, Homo sapien
gtgttattcttagcttccactggca

SEQ ID NO: 514184 - DNA, 25 bp, Homo sapien
attcttagcttccactggcagccta

SEQ ID NO: 514185 - DNA, 25 bp, Homo sapien
cactggcagcctagctttgagggta

SEQ ID NO: 514186 - DNA, 25 bp, Homo sapien
gcagcctagctttgagggtaaatga

SEQ ID NO: 514187 - DNA, 25 bp, Homo sapien
atataacccatagattacccagcca

SEQ ID NO: 514188 - DNA, 25 bp, Homo sapien
aacccatagattacccagccacttg

SEQ ID NO: 514189 - DNA, 25 bp, Homo sapien
ccagccacttgggaacagcaggtaa

SEQ ID NO: 514190 - DNA, 25 bp, Homo sapien
ccacttgggaacagcaggtaatact

SEQ ID NO: 514191 - DNA, 25 bp, Homo sapien
gattatgattctgttccatttaagg

SEQ ID NO: 514192 - DNA, 25 bp, Homo sapien
atgattctgttccatttaagggaaa

SEQ ID NO: 514193 - DNA, 25 bp, Homo sapien
ttttctataacattgtgtagtcagt

SEQ ID NO: 514194 - DNA, 25 bp, Homo sapien
tctcgaattcccaaacacccgaaag

SEQ ID NO: 514195 - DNA, 25 bp, Homo sapien
acaaaccagaattgagccctactcc

SEQ ID NO: 514196 - DNA, 25 bp, Homo sapien
attgagccctactccccaaaatgta

SEQ ID NO: 514197 - DNA, 25 bp, Homo sapien
gatacgcttaactttttggacacct

SEQ ID NO: 514198 - DNA, 25 bp, Homo sapien
actttttggacacctgtgatttgca

SEQ ID NO: 514199 - DNA, 25 bp, Homo sapien
tttgcatactgagcatataaagcca

SEQ ID NO: 514200 - DNA, 25 bp, Homo sapien
tataaagccatctttacgcacgtcc

SEQ ID NO: 514201 - DNA, 25 bp, Homo sapien
tttacgcacgtccatcggtgaaaga

SEQ ID NO: 514202 - DNA, 25 bp, Homo sapien
gaaaacggtctctttcaccactaat

SEQ ID NO: 514203 - DNA, 25 bp, Homo sapien
tcaccactaattaagttttctccag

SEQ ID NO: 514204 - DNA, 25 bp, Homo sapien
gaaccacaatagcatgtagtcttgg

SEQ ID NO: 514205 - DNA, 25 bp, Homo sapien
ttgtttttgtaagttatctcaactt

SEQ ID NO: 514206 - DNA, 25 bp, Homo sapien
tgtttttgtaagttatctcaacttt

SEQ ID NO: 514207 - DNA, 25 bp, Homo sapien
tatctcaactttattcttgtgaaat

SEQ ID NO: 514208 - DNA, 25 bp, Homo sapien
atctcaactttattcttgtgaaatt

SEQ ID NO: 514209 - DNA, 25 bp, Homo sapien
tctcaactttattcttgtgaaattg

SEQ ID NO: 514210 - DNA, 25 bp, Homo sapien
ctcaactttattcttgtgaaattgc

SEQ ID NO: 514211 - DNA, 25 bp, Homo sapien
tcaactttattcttgtgaaattgca

SEQ ID NO: 514212 - DNA, 25 bp, Homo sapien
caactttattcttgtgaaattgcaa

SEQ ID NO: 514213 - DNA, 25 bp, Homo sapien
aactttattcttgtgaaattgcaaa

SEQ ID NO: 514214 - DNA, 25 bp, Homo sapien
ctttattcttgtgaaattgcaaagg

SEQ ID NO: 514215 - DNA, 25 bp, Homo sapien
ttattcttgtgaaattgcaaaggaa

SEQ ID NO: 514216 - DNA, 25 bp, Homo sapien
aaatctgtagtcatgctgctccaag

SEQ ID NO: 514217 - DNA, 25 bp, Homo sapien
gctgctccaagctaaggaatacctg

SEQ ID NO: 514218 - DNA, 25 bp, Homo sapien
gggctaccagaagctcgaagaagca

SEQ ID NO: 514219 - DNA, 25 bp, Homo sapien
aggagaagttcctccctagaggctt

SEQ ID NO: 514220 - DNA, 25 bp, Homo sapien
gagaacatgacatctgacacattga

SEQ ID NO: 514221 - DNA, 25 bp, Homo sapien
gacacattgatttcagttggctgac

SEQ ID NO: 514222 - DNA, 25 bp, Homo sapien
agttggctgaccttcaaagcgatga

SEQ ID NO: 514223 - DNA, 25 bp, Homo sapien
taagccacccagagacagccctaag

SEQ ID NO: 514224 - DNA, 25 bp, Homo sapien
gccctaagaaattaatgcacatgct

SEQ ID NO: 514225 - DNA, 25 bp, Homo sapien
ggtgtccatataagaagatagccct

SEQ ID NO: 514226 - DNA, 25 bp, Homo sapien
aagaagatagccctgtgaagacaca

SEQ ID NO: 514227 - DNA, 25 bp, Homo sapien
agttacttgcctttcatcatacaat

SEQ ID NO: 514228 - DNA, 25 bp, Homo sapien
catacaatttcttcggtagttgaga

SEQ ID NO: 514229 - DNA, 25 bp, Homo sapien
gttgagaatttggtctacatttatc

SEQ ID NO: 514230 - DNA, 25 bp, Homo sapien
agtgtcacaaactctaaaaagctga

SEQ ID NO: 514231 - DNA, 25 bp, Homo sapien
aaggagaccccacagatcttctcac

SEQ ID NO: 514232 - DNA, 25 bp, Homo sapien
atcttctcactgtcagcagccctta

SEQ ID NO: 514233 - DNA, 25 bp, Homo sapien
agcccttacttctgcaaaatgttga

SEQ ID NO: 514234 - DNA, 25 bp, Homo sapien
taatgttgctctgtttgcaaagaag

SEQ ID NO: 514235 - DNA, 25 bp, Homo sapien
ttgcaaagaagatgcctctggctag

SEQ ID NO: 514236 - DNA, 25 bp, Homo sapien
gatgcctctggctagaatgtttgtg

SEQ ID NO: 514237 - DNA, 25 bp, Homo sapien
aagcaagggactgcttgtttttgta

SEQ ID NO: 514238 - DNA, 25 bp, Homo sapien
aaaagtatacatgtcaatggcctct

SEQ ID NO: 514239 - DNA, 25 bp, Homo sapien
aaagtatacatgtcaatggcctctt

SEQ ID NO: 514240 - DNA, 25 bp, Homo sapien
agtagcatattaccagctagccagt

SEQ ID NO: 514241 - DNA, 25 bp, Homo sapien
gtagcatattaccagctagccagtc

SEQ ID NO: 514242 - DNA, 25 bp, Homo sapien
gcatattaccagctagccagtcact

SEQ ID NO: 514243 - DNA, 25 bp, Homo sapien
catattaccagctagccagtcacta

SEQ ID NO: 514244 - DNA, 25 bp, Homo sapien
tattaccagctagccagtcactagg

SEQ ID NO: 514245 - DNA, 25 bp, Homo sapien
ttaccagctagccagtcactaggaa

SEQ ID NO: 514246 - DNA, 25 bp, Homo sapien
taccagctagccagtcactaggaat

SEQ ID NO: 514247 - DNA, 25 bp, Homo sapien
ccagctagccagtcactaggaattt

SEQ ID NO: 514248 - DNA, 25 bp, Homo sapien
cagctagccagtcactaggaatttt

SEQ ID NO: 514249 - DNA, 25 bp, Homo sapien
acgcatcccaggcagaatgttgtgc

SEQ ID NO: 514250 - DNA, 25 bp, Homo sapien
atcccaggcagaatgttgtgcaaaa

SEQ ID NO: 514251 - DNA, 25 bp, Homo sapien
gttgtgcaaaaaccacaccaggatt

SEQ ID NO: 514252 - DNA, 25 bp, Homo sapien
acaccaggattcgtacatgccagag

SEQ ID NO: 514253 - DNA, 25 bp, Homo sapien
aggattcgtacatgccagaggactg

SEQ ID NO: 514254 - DNA, 25 bp, Homo sapien
gtacatgccagaggactgaacttct

SEQ ID NO: 514255 - DNA, 25 bp, Homo sapien
gaggactgaacttctgcgtgttgca

SEQ ID NO: 514256 - DNA, 25 bp, Homo sapien
gcgtgttgcagataattcatcttcc

SEQ ID NO: 514257 - DNA, 25 bp, Homo sapien
agataattcatcttcctgaatcact

SEQ ID NO: 514258 - DNA, 25 bp, Homo sapien
cagaaacttatgcttcttccgttac

SEQ ID NO: 514259 - DNA, 25 bp, Homo sapien
tcgcaggcctcccagatgaatgaag

SEQ ID NO: 514260 - DNA, 25 bp, Homo sapien
aggagaaggccgatgtgctggcccg

SEQ ID NO: 514261 - DNA, 25 bp, Homo sapien
gggacccctgaaccagacggcgctg

SEQ ID NO: 514262 - DNA, 25 bp, Homo sapien
cccacgggcactcggaggtggtgga

SEQ ID NO: 514263 - DNA, 25 bp, Homo sapien
aggagttggtcagcgccgatgtcat

SEQ ID NO: 514264 - DNA, 25 bp, Homo sapien
gtcagcgccgatgtcattgacctgt

SEQ ID NO: 514265 - DNA, 25 bp, Homo sapien
gatgtcattgacctgttcgacgagc

SEQ ID NO: 514266 - DNA, 25 bp, Homo sapien
tcattgacctgttcgacgagcaggg

SEQ ID NO: 514267 - DNA, 25 bp, Homo sapien
ccggcacgcacagacggtggagact

SEQ ID NO: 514268 - DNA, 25 bp, Homo sapien
acatcaacctgcagagcctcaagtt

SEQ ID NO: 514269 - DNA, 25 bp, Homo sapien
agagcctcaagttccagggcggcca

SEQ ID NO: 514270 - DNA, 25 bp, Homo sapien
gcctcaagttccagggcggccatgg

SEQ ID NO: 514271 - DNA, 25 bp, Homo sapien
gaaaatcacctgttatctactccca

SEQ ID NO: 514272 - DNA, 25 bp, Homo sapien
tcacctgttatctactcccagaaat

SEQ ID NO: 514273 - DNA, 25 bp, Homo sapien
cattttggtatatgtttttccaggc

SEQ ID NO: 514274 - DNA, 25 bp, Homo sapien
ttttccaggcttctttgggttgatc

SEQ ID NO: 514275 - DNA, 25 bp, Homo sapien
ttgggttgatcccacctatgagatc

SEQ ID NO: 514276 - DNA, 25 bp, Homo sapien
gatcccacctatgagatcagaatat

SEQ ID NO: 514277 - DNA, 25 bp, Homo sapien
cagaatatgtatgcagttctttctt

SEQ ID NO: 514278 - DNA, 25 bp, Homo sapien
tttttctcctatgtactgtgaacat

SEQ ID NO: 514279 - DNA, 25 bp, Homo sapien
tattctttggaaacttagcttttag

SEQ ID NO: 514280 - DNA, 25 bp, Homo sapien
tagcttttagtaactacttggttgt

SEQ ID NO: 514281 - DNA, 25 bp, Homo sapien
gtaactacttggttgtatcataatt

SEQ ID NO: 514282 - DNA, 25 bp, Homo sapien
gcctggcccaggtaacatgtttatt

SEQ ID NO: 514283 - DNA, 25 bp, Homo sapien
gtttattgagctgtacatgcatatg

SEQ ID NO: 514284 - DNA, 25 bp, Homo sapien
tgagctgtacatgcatatgagaaat

SEQ ID NO: 514285 - DNA, 25 bp, Homo sapien
ttttttcctactatcatctcttaaa

SEQ ID NO: 514286 - DNA, 25 bp, Homo sapien
tcctactatcatctcttaaattttg

SEQ ID NO: 514287 - DNA, 25 bp, Homo sapien
tatcatgcacaactataacctatgg

SEQ ID NO: 514288 - DNA, 25 bp, Homo sapien
atgcacaactataacctatgggaat

SEQ ID NO: 514289 - DNA, 25 bp, Homo sapien
cctatgggaatgatgtagtaacaca

SEQ ID NO: 514290 - DNA, 25 bp, Homo sapien
tgatgtagtaacacagattattcat

SEQ ID NO: 514291 - DNA, 25 bp, Homo sapien
gattattcatcttgttagagttgta

SEQ ID NO: 514292 - DNA, 25 bp, Homo sapien
attcatcttgttagagttgtattaa

SEQ ID NO: 514293 - DNA, 25 bp, Homo sapien
tgcttttaaactggcaaatgcactc

SEQ ID NO: 514294 - DNA, 25 bp, Homo sapien
aaatgcactcttcagaaatcctttt

SEQ ID NO: 514295 - DNA, 25 bp, Homo sapien
gaaatccttttctatctgatccaca

SEQ ID NO: 514296 - DNA, 25 bp, Homo sapien
cttttctatctgatccacatggaga

SEQ ID NO: 514297 - DNA, 25 bp, Homo sapien
atccacatggagaggttaaaggttc

SEQ ID NO: 514298 - DNA, 25 bp, Homo sapien
gttcaatttcatgacctctatgcag

SEQ ID NO: 514299 - DNA, 25 bp, Homo sapien
tttcatgacctctatgcaggcagcg

SEQ ID NO: 514300 - DNA, 25 bp, Homo sapien
caggcagcgctctcattggatgtaa

SEQ ID NO: 514301 - DNA, 25 bp, Homo sapien
gtaagaatattacctgcaaggatag

SEQ ID NO: 514302 - DNA, 25 bp, Homo sapien
tgcagttgtgcaacagagacacatt

SEQ ID NO: 514303 - DNA, 25 bp, Homo sapien
gttgacatatttcctctatctcata

SEQ ID NO: 514304 - DNA, 25 bp, Homo sapien
cccaccgttttagagagctaggcct

SEQ ID NO: 514305 - DNA, 25 bp, Homo sapien
accgttttagagagctaggcctcag

SEQ ID NO: 514306 - DNA, 25 bp, Homo sapien
ttttagagagctaggcctcagccag

SEQ ID NO: 514307 - DNA, 25 bp, Homo sapien
taggcctcagccagtcttgccactc

SEQ ID NO: 514308 - DNA, 25 bp, Homo sapien
cccatctcagtgcttcctgaagagg

SEQ ID NO: 514309 - DNA, 25 bp, Homo sapien
tcagtgcttcctgaagaggctgttt

SEQ ID NO: 514310 - DNA, 25 bp, Homo sapien
ttcctgaagaggctgttttgagtgt

SEQ ID NO: 514311 - DNA, 25 bp, Homo sapien
gctgttttgagtgttgatgaaaagc

SEQ ID NO: 514312 - DNA, 25 bp, Homo sapien
caatgcaattatgccaaacagtatt

SEQ ID NO: 514313 - DNA, 25 bp, Homo sapien
atgccaaacagtattgagcagaata

SEQ ID NO: 514314 - DNA, 25 bp, Homo sapien
taaatcatgaatcccgccaggtacg

SEQ ID NO: 514315 - DNA, 25 bp, Homo sapien
ttcaaaccctgcctcttaaggaatt

SEQ ID NO: 514316 - DNA, 25 bp, Homo sapien
ttttagacttaagttcactgtgata

SEQ ID NO: 514317 - DNA, 25 bp, Homo sapien
gttcactgtgatatccctagtacct

SEQ ID NO: 514318 - DNA, 25 bp, Homo sapien
atccctagtacctagaagagtacct

SEQ ID NO: 514319 - DNA, 25 bp, Homo sapien
agagtacctagcacaaagtagacat

SEQ ID NO: 514320 - DNA, 25 bp, Homo sapien
gtgttgtttttgtcacttgccccag

SEQ ID NO: 514321 - DNA, 25 bp, Homo sapien
gtttttgtcacttgccccagcagag

SEQ ID NO: 514322 - DNA, 25 bp, Homo sapien
ggagaggtctttaatagctttgaaa

SEQ ID NO: 514323 - DNA, 25 bp, Homo sapien
gaaatgctttgagatcattggtcaa

SEQ ID NO: 514324 - DNA, 25 bp, Homo sapien
tggtcaaattgcattttctatgtag

SEQ ID NO: 514325 - DNA, 25 bp, Homo sapien
tagagaatattctgctaggtggaaa

SEQ ID NO: 514326 - DNA, 25 bp, Homo sapien
gatttttaactggattcaatgtgtg

SEQ ID NO: 514327 - DNA, 25 bp, Homo sapien
ttaactggattcaatgtgtggatgg

SEQ ID NO: 514328 - DNA, 25 bp, Homo sapien
taactggattcaatgtgtggatggt

SEQ ID NO: 514329 - DNA, 25 bp, Homo sapien
aactggattcaatgtgtggatggtt

SEQ ID NO: 514330 - DNA, 25 bp, Homo sapien
actggattcaatgtgtggatggttt

SEQ ID NO: 514331 - DNA, 25 bp, Homo sapien
ctggattcaatgtgtggatggttta

SEQ ID NO: 514332 - DNA, 25 bp, Homo sapien
tggattcaatgtgtggatggtttaa

SEQ ID NO: 514333 - DNA, 25 bp, Homo sapien
ggattcaatgtgtggatggtttaag

SEQ ID NO: 514334 - DNA, 25 bp, Homo sapien
gattcaatgtgtggatggtttaagt

SEQ ID NO: 514335 - DNA, 25 bp, Homo sapien
agcagtgtttgcgttagtgattata

SEQ ID NO: 514336 - DNA, 25 bp, Homo sapien
gattataaactgcagcatggtgctg

SEQ ID NO: 514337 - DNA, 25 bp, Homo sapien
gcatggtgctgacattgataactga

SEQ ID NO: 514338 - DNA, 25 bp, Homo sapien
acctgctgcctttcttagggcctta

SEQ ID NO: 514339 - DNA, 25 bp, Homo sapien
acttctgaagtacacttagttgcta

SEQ ID NO: 514340 - DNA, 25 bp, Homo sapien
acttagttgctagtgtctccctttt

SEQ ID NO: 514341 - DNA, 25 bp, Homo sapien
gtctcccttttggtgtcactggaaa

SEQ ID NO: 514342 - DNA, 25 bp, Homo sapien
cttagggccttattattcaccgata

SEQ ID NO: 514343 - DNA, 25 bp, Homo sapien
tattcaccgataacctgtttccttg

SEQ ID NO: 514344 - DNA, 25 bp, Homo sapien
ttgctttggtgtaagcagagttctt

SEQ ID NO: 514345 - DNA, 25 bp, Homo sapien
gcagagttctttctgtaggtttttt

SEQ ID NO: 514346 - DNA, 25 bp, Homo sapien
ccagatgatgaacaatggcctcctc

SEQ ID NO: 514347 - DNA, 25 bp, Homo sapien
agttcttacttctgtggcccttaat

SEQ ID NO: 514348 - DNA, 25 bp, Homo sapien
cttaatgccaactttgtgtcctgga

SEQ ID NO: 514349 - DNA, 25 bp, Homo sapien
gtgtcctggaagagtcgtaccaagt

SEQ ID NO: 514350 - DNA, 25 bp, Homo sapien
gtaccaagtacaccattacaccagt

SEQ ID NO: 514351 - DNA, 25 bp, Homo sapien
ccgagaccacacaggtgggaacaag

SEQ ID NO: 514352 - DNA, 25 bp, Homo sapien
gaaaaacatgttaagaccctagact

SEQ ID NO: 514353 - DNA, 25 bp, Homo sapien
catgttaagaccctagacttgtata

SEQ ID NO: 514354 - DNA, 25 bp, Homo sapien
gacttgtatattgacacacttgtac

SEQ ID NO: 514355 - DNA, 25 bp, Homo sapien
ttgacacacttgtaccttgtaaggc

SEQ ID NO: 514356 - DNA, 25 bp, Homo sapien
acttgtaccttgtaaggcagaggaa

SEQ ID NO: 514357 - DNA, 25 bp, Homo sapien
gcctcagactcccataatggtatga

SEQ ID NO: 514358 - DNA, 25 bp, Homo sapien
ataatggtatgagtaccctcctcct

SEQ ID NO: 514359 - DNA, 25 bp, Homo sapien
atggtatgagtaccctcctccttct

SEQ ID NO: 514360 - DNA, 25 bp, Homo sapien
aatggaaggtgctaatctttgctgt

SEQ ID NO: 514361 - DNA, 25 bp, Homo sapien
tggatccctcacctcagaagtaagt

SEQ ID NO: 514362 - DNA, 25 bp, Homo sapien
gatccctcacctcagaagtaagtca

SEQ ID NO: 514363 - DNA, 25 bp, Homo sapien
ccctcacctcagaagtaagtcaact

SEQ ID NO: 514364 - DNA, 25 bp, Homo sapien
cacctcagaagtaagtcaacttttt

SEQ ID NO: 514365 - DNA, 25 bp, Homo sapien
tagatagttggacaaaaggactttg

SEQ ID NO: 514366 - DNA, 25 bp, Homo sapien
aattagccagatgtagaatccctgt

SEQ ID NO: 514367 - DNA, 25 bp, Homo sapien
atgtagaatccctgttgttttgccc

SEQ ID NO: 514368 - DNA, 25 bp, Homo sapien
cgcccagatgatgaacaatggcctc

SEQ ID NO: 514369 - DNA, 25 bp, Homo sapien
ccagatgatgaacaatggcctcctc

SEQ ID NO: 514370 - DNA, 25 bp, Homo sapien
agttcttacttctgtggcccttaat

SEQ ID NO: 514371 - DNA, 25 bp, Homo sapien
ttcttacttctgtggcccttaatgc

SEQ ID NO: 514372 - DNA, 25 bp, Homo sapien
ccaactttgtgtcctggaagagtcg

SEQ ID NO: 514373 - DNA, 25 bp, Homo sapien
ctttgtgtcctggaagagtcgtacc

SEQ ID NO: 514374 - DNA, 25 bp, Homo sapien
gtgtcctggaagagtcgtaccaagt

SEQ ID NO: 514375 - DNA, 25 bp, Homo sapien
ggaagagtcgtaccaagtacaccat

SEQ ID NO: 514376 - DNA, 25 bp, Homo sapien
gagtcgtaccaagtacaccattaca

SEQ ID NO: 514377 - DNA, 25 bp, Homo sapien
gtaccaagtacaccattacaccagt

SEQ ID NO: 514378 - DNA, 25 bp, Homo sapien
aagtacaccattacaccagtgaaga

SEQ ID NO: 514379 - DNA, 25 bp, Homo sapien
gaaatacaccgaaggcgtggatgaa

SEQ ID NO: 514380 - DNA, 25 bp, Homo sapien
gtggatgaagccgatccggccaagt

SEQ ID NO: 514381 - DNA, 25 bp, Homo sapien
aagtggaaggccaacctgcgctgtg

SEQ ID NO: 514382 - DNA, 25 bp, Homo sapien
tgcgctgtgcccttaacaagagccg

SEQ ID NO: 514383 - DNA, 25 bp, Homo sapien
acaagagccgggacttccgcctcat

SEQ ID NO: 514384 - DNA, 25 bp, Homo sapien
ggacttccgcctcatctacgacggg

SEQ ID NO: 514385 - DNA, 25 bp, Homo sapien
acctcagccctacaagatctacgag

SEQ ID NO: 514386 - DNA, 25 bp, Homo sapien
aagatctacgaggtctgctccaatg

SEQ ID NO: 514387 - DNA, 25 bp, Homo sapien
tacgaggtctgctccaatggccctg

SEQ ID NO: 514388 - DNA, 25 bp, Homo sapien
tgaggattactcttttggtgcagga

SEQ ID NO: 514389 - DNA, 25 bp, Homo sapien
gcagaggatgttgccaagcctgagc

SEQ ID NO: 514390 - DNA, 25 bp, Homo sapien
tggtaactatcttcctgctggtgac

SEQ ID NO: 514391 - DNA, 25 bp, Homo sapien
gaccatcagcctttgtagttactct

SEQ ID NO: 514392 - DNA, 25 bp, Homo sapien
tttgtagttactctgctactgcctt

SEQ ID NO: 514393 - DNA, 25 bp, Homo sapien
tactgccttcctcatcaacaaagtg

SEQ ID NO: 514394 - DNA, 25 bp, Homo sapien
agtgccccttcctgttgacaagttg

SEQ ID NO: 514395 - DNA, 25 bp, Homo sapien
ttgacaagttggcacctttacctct

SEQ ID NO: 514396 - DNA, 25 bp, Homo sapien
acctttacctctggacaacattctt

SEQ ID NO: 514397 - DNA, 25 bp, Homo sapien
attcttccctttatggatccattaa

SEQ ID NO: 514398 - DNA, 25 bp, Homo sapien
agcttcttctgaaaactctgggcat

SEQ ID NO: 514399 - DNA, 25 bp, Homo sapien
atttctgttgagcaccttgtggagg

SEQ ID NO: 514400 - DNA, 25 bp, Homo sapien
aagtggaaccactggcttggtggat

SEQ ID NO: 514401 - DNA, 25 bp, Homo sapien
caccaactggactgctggccggtag

SEQ ID NO: 514402 - DNA, 25 bp, Homo sapien
aactggactgctggccggtagcaaa

SEQ ID NO: 514403 - DNA, 25 bp, Homo sapien
actgctggccggtagcaaaagacca

SEQ ID NO: 514404 - DNA, 25 bp, Homo sapien
aagaccagctggaaatttcataaaa

SEQ ID NO: 514405 - DNA, 25 bp, Homo sapien
ggttagacaatccacagttactcag

SEQ ID NO: 514406 - DNA, 25 bp, Homo sapien
atccacagttactcagtgttacgca

SEQ ID NO: 514407 - DNA, 25 bp, Homo sapien
agtgttacgcaacaggtctctgcag

SEQ ID NO: 514408 - DNA, 25 bp, Homo sapien
acgcaacaggtctctgcagcacaga

SEQ ID NO: 514409 - DNA, 25 bp, Homo sapien
tctgcagcacagagcacgaactggg

SEQ ID NO: 514410 - DNA, 25 bp, Homo sapien
agtcaggatgctggagtccagccct

SEQ ID NO: 514411 - DNA, 25 bp, Homo sapien
cggattccctgcctgaccttgggaa

SEQ ID NO: 514412 - DNA, 25 bp, Homo sapien
ataatgtatttacctgtcctgatat

SEQ ID NO: 514413 - DNA, 25 bp, Homo sapien
gtatttacctgtcctgatatatagc

SEQ ID NO: 514414 - DNA, 25 bp, Homo sapien
gtcctgatatatagctataacccaa

SEQ ID NO: 514415 - DNA, 25 bp, Homo sapien
agacatcatcatacagaaggcagga

SEQ ID NO: 514416 - DNA, 25 bp, Homo sapien
aggcaggattccttaaactgagatc

SEQ ID NO: 514417 - DNA, 25 bp, Homo sapien
aactgagatccctgatccatcttta

SEQ ID NO: 514418 - DNA, 25 bp, Homo sapien
gatccctgatccatctttaatattt

SEQ ID NO: 514419 - DNA, 25 bp, Homo sapien
gcccttttgtgtacattcaggcata

SEQ ID NO: 514420 - DNA, 25 bp, Homo sapien
tgtgtacattcaggcatacccattt

SEQ ID NO: 514421 - DNA, 25 bp, Homo sapien
aggcatacccattttaatcaatttg

SEQ ID NO: 514422 - DNA, 25 bp, Homo sapien
aacctctagaggtgaatgagaaaca

SEQ ID NO: 514423 - DNA, 25 bp, Homo sapien
aagaagctaatatgagtttctcatc

SEQ ID NO: 514424 - DNA, 25 bp, Homo sapien
gtttctcatcatcccttagctcttc

SEQ ID NO: 514425 - DNA, 25 bp, Homo sapien
caaccccagaccctgtgtaatagga

SEQ ID NO: 514426 - DNA, 25 bp, Homo sapien
ttaaagacccacagatcaatagcca

SEQ ID NO: 514427 - DNA, 25 bp, Homo sapien
agatcaatagccacactcttccact

SEQ ID NO: 514428 - DNA, 25 bp, Homo sapien
attgacaccaagttatcatcccaga

SEQ ID NO: 514429 - DNA, 25 bp, Homo sapien
atcccagaactaatgaagcaagtcc

SEQ ID NO: 514430 - DNA, 25 bp, Homo sapien
aagtccagatgctagacgtggcccc

SEQ ID NO: 514431 - DNA, 25 bp, Homo sapien
agacgtggccccttaatattgagca

SEQ ID NO: 514432 - DNA, 25 bp, Homo sapien
gtggccccttaatattgagcaattt

SEQ ID NO: 514433 - DNA, 25 bp, Homo sapien
gcaatttgattgcaatcctgcttgt

SEQ ID NO: 514434 - DNA, 25 bp, Homo sapien
ccagggacctgtggtaagctaatga

SEQ ID NO: 514435 - DNA, 25 bp, Homo sapien
acctgtggtaagctaatgagatcaa

SEQ ID NO: 514436 - DNA, 25 bp, Homo sapien
gagatcaagaactggctccataagg

SEQ ID NO: 514437 - DNA, 25 bp, Homo sapien
agtgattgcaaagctctggagagtt

SEQ ID NO: 514438 - DNA, 25 bp, Homo sapien
gtgcccaattccaagagggaaaaga

SEQ ID NO: 514439 - DNA, 25 bp, Homo sapien
agagatgtaaaccatcgacgtttga

SEQ ID NO: 514440 - DNA, 25 bp, Homo sapien
tcgacgtttgagaggcgtgatcgcc

SEQ ID NO: 514441 - DNA, 25 bp, Homo sapien
tgagaggcgtgatcgcctgattcct

SEQ ID NO: 514442 - DNA, 25 bp, Homo sapien
ccaccagtttcttcccaggttgaca

SEQ ID NO: 514443 - DNA, 25 bp, Homo sapien
cgctgccctcgatgtggtcatgaag

SEQ ID NO: 514444 - DNA, 25 bp, Homo sapien
ggtcatgaaggaatggcataccaca

SEQ ID NO: 514445 - DNA, 25 bp, Homo sapien
atccagaagtcatacaaattgtcag

SEQ ID NO: 514446 - DNA, 25 bp, Homo sapien
caggattggttgatacagtggctta

SEQ ID NO: 514447 - DNA, 25 bp, Homo sapien
cagtggcttaatgctatcaccaagg

SEQ ID NO: 514448 - DNA, 25 bp, Homo sapien
atgctatcaccaaggaccaactctc

SEQ ID NO: 514449 - DNA, 25 bp, Homo sapien
cctttgatgttggtggcatcttcag

SEQ ID NO: 514450 - DNA, 25 bp, Homo sapien
cttgctgcaaaggtgactgtagcag

SEQ ID NO: 514451 - DNA, 25 bp, Homo sapien
gactgtagcagtttgaggtgtcact

SEQ ID NO: 514452 - DNA, 25 bp, Homo sapien
ttgaggtgtcactgtctgaggaaga

SEQ ID NO: 514453 - DNA, 25 bp, Homo sapien
ttttcctccatcatttttaggattg

SEQ ID NO: 514454 - DNA, 25 bp, Homo sapien
ggaacctaactcaaattggcttaag

SEQ ID NO: 514455 - DNA, 25 bp, Homo sapien
attgttgtaatgtggctggaaatcc

SEQ ID NO: 514456 - DNA, 25 bp, Homo sapien
tcctggtggactcaaccctgttcaa

SEQ ID NO: 514457 - DNA, 25 bp, Homo sapien
gactcaaccctgttcaactcagaga

SEQ ID NO: 514458 - DNA, 25 bp, Homo sapien
ttcaactcagagacgggcctcctct

SEQ ID NO: 514459 - DNA, 25 bp, Homo sapien
gcctcctctcactgatgcaaagctt

SEQ ID NO: 514460 - DNA, 25 bp, Homo sapien
agctttaaggcttctctgactgttc

SEQ ID NO: 514461 - DNA, 25 bp, Homo sapien
gttctgaaactcttcgtattcttgt

SEQ ID NO: 514462 - DNA, 25 bp, Homo sapien
taatttctgtaggttctgctggagg

SEQ ID NO: 514463 - DNA, 25 bp, Homo sapien
atgtggaattagcacagatccttcc

SEQ ID NO: 514464 - DNA, 25 bp, Homo sapien
gctttctgtttcacttgatcattta

SEQ ID NO: 514465 - DNA, 25 bp, Homo sapien
acttgatcatttagcccagaccacc

SEQ ID NO: 514466 - DNA, 25 bp, Homo sapien
ttagcccagaccacccaggatgttt

SEQ ID NO: 514467 - DNA, 25 bp, Homo sapien
gggcatagcttagtccaaactgcta

SEQ ID NO: 514468 - DNA, 25 bp, Homo sapien
gtccaaactgctaatttcattttac

SEQ ID NO: 514469 - DNA, 25 bp, Homo sapien
acagtgtatgtaacgcttagtctca

SEQ ID NO: 514470 - DNA, 25 bp, Homo sapien
taacgcttagtctcacagtgtcttt

SEQ ID NO: 514471 - DNA, 25 bp, Homo sapien
acagtgtctttaactcatctttgca

SEQ ID NO: 514472 - DNA, 25 bp, Homo sapien
acaactttactagtgactttctgga

SEQ ID NO: 514473 - DNA, 25 bp, Homo sapien
tttctggaacaatttcctttcagga

SEQ ID NO: 514474 - DNA, 25 bp, Homo sapien
gaatacatattcactgcttagaggt

SEQ ID NO: 514475 - DNA, 25 bp, Homo sapien
tgcttagaggtgaccttgccttaat

SEQ ID NO: 514476 - DNA, 25 bp, Homo sapien
gatagctcatgaaacttttgcttaa

SEQ ID NO: 514477 - DNA, 25 bp, Homo sapien
gaaaacctcgaattgaaatgtgtga

SEQ ID NO: 514478 - DNA, 25 bp, Homo sapien
gcgctgccctcgatgtggtcatgaa

SEQ ID NO: 514479 - DNA, 25 bp, Homo sapien
cgctgccctcgatgtggtcatgaag

SEQ ID NO: 514480 - DNA, 25 bp, Homo sapien
gctgccctcgatgtggtcatgaagg

SEQ ID NO: 514481 - DNA, 25 bp, Homo sapien
ctgccctcgatgtggtcatgaagga

SEQ ID NO: 514482 - DNA, 25 bp, Homo sapien
tgccctcgatgtggtcatgaaggaa

SEQ ID NO: 514483 - DNA, 25 bp, Homo sapien
gccctcgatgtggtcatgaaggaat

SEQ ID NO: 514484 - DNA, 25 bp, Homo sapien
ccctcgatgtggtcatgaaggaatg

SEQ ID NO: 514485 - DNA, 25 bp, Homo sapien
ctcgatgtggtcatgaaggaatggc

SEQ ID NO: 514486 - DNA, 25 bp, Homo sapien
tgtggtcatgaaggaatggcatacc

SEQ ID NO: 514487 - DNA, 25 bp, Homo sapien
ggtcatgaaggaatggcataccaca

SEQ ID NO: 514488 - DNA, 25 bp, Homo sapien
tcatgaaggaatggcataccacacc

SEQ ID NO: 514489 - DNA, 25 bp, Homo sapien
gactgagctcttaacctgctgggga

SEQ ID NO: 514490 - DNA, 25 bp, Homo sapien
gggatctgcacttaatgccgattaa

SEQ ID NO: 514491 - DNA, 25 bp, Homo sapien
aatgccgattaatgccagaattgaa

SEQ ID NO: 514492 - DNA, 25 bp, Homo sapien
ccagaattgaattgtatgatatcca

SEQ ID NO: 514493 - DNA, 25 bp, Homo sapien
ccagttggtattggagaattggcca

SEQ ID NO: 514494 - DNA, 25 bp, Homo sapien
gaaaacccacacagttggtggcaag

SEQ ID NO: 514495 - DNA, 25 bp, Homo sapien
cacacagttggtggcaaggagtgtt

SEQ ID NO: 514496 - DNA, 25 bp, Homo sapien
gttcagtgttgagtgtgaatgtcaa

SEQ ID NO: 514497 - DNA, 25 bp, Homo sapien
gttttttctacgtacaatatctttg

SEQ ID NO: 514498 - DNA, 25 bp, Homo sapien
gtacaatatctttgggaacttggag

SEQ ID NO: 514499 - DNA, 25 bp, Homo sapien
cagggtcagacgtctgtgtgtgtat

SEQ ID NO: 514500 - DNA, 25 bp, Homo sapien
atagtttgtctatgcatgtataatg

SEQ ID NO: 514501 - DNA, 25 bp, Homo sapien
gtataatgctgagaagggtctgcag

SEQ ID NO: 514502 - DNA, 25 bp, Homo sapien
agataagatagacttctccagcaca

SEQ ID NO: 514503 - DNA, 25 bp, Homo sapien
cttctccagcacaactattactcat

SEQ ID NO: 514504 - DNA, 25 bp, Homo sapien
gcacaactattactcatttgataat

SEQ ID NO: 514505 - DNA, 25 bp, Homo sapien
taattcagtttcatttttgctcaca

SEQ ID NO: 514506 - DNA, 25 bp, Homo sapien
aagccatatcagaaaccaagttttt

SEQ ID NO: 514507 - DNA, 25 bp, Homo sapien
ggtgtctgcttctgtattctaaact

SEQ ID NO: 514508 - DNA, 25 bp, Homo sapien
ggaagtagacatcatatcccagcta

SEQ ID NO: 514509 - DNA, 25 bp, Homo sapien
gacatcatatcccagctaaacaggg

SEQ ID NO: 514510 - DNA, 25 bp, Homo sapien
aactttgggaatagtttgtctatgc

SEQ ID NO: 514511 - DNA, 25 bp, Homo sapien
aatttcatagtcgttggagtgccat

SEQ ID NO: 514512 - DNA, 25 bp, Homo sapien
gattgcggtagtttacactttttct

SEQ ID NO: 514513 - DNA, 25 bp, Homo sapien
gtatgtttcaaatcaggtgtgtacc

SEQ ID NO: 514514 - DNA, 25 bp, Homo sapien
tatgtttcaaatcaggtgtgtacca

SEQ ID NO: 514515 - DNA, 25 bp, Homo sapien
atgtttcaaatcaggtgtgtaccat

SEQ ID NO: 514516 - DNA, 25 bp, Homo sapien
gtttcaaatcaggtgtgtaccattt

SEQ ID NO: 514517 - DNA, 25 bp, Homo sapien
tttcaaatcaggtgtgtaccatttg

SEQ ID NO: 514518 - DNA, 25 bp, Homo sapien
gtaccatttgtactgagaacaccac

SEQ ID NO: 514519 - DNA, 25 bp, Homo sapien
tgattttaatacgtgttttggtttg

SEQ ID NO: 514520 - DNA, 25 bp, Homo sapien
tagtaatttcttgcacatttttgga

SEQ ID NO: 514521 - DNA, 25 bp, Homo sapien
atctgcttctagatacagtgtgtaa

SEQ ID NO: 514522 - DNA, 25 bp, Homo sapien
tgtggacgctgtgctggttctgttt

SEQ ID NO: 514523 - DNA, 25 bp, Homo sapien
gctgtgctggttctgttttctaaag

SEQ ID NO: 514524 - DNA, 25 bp, Homo sapien
gcagaaggacaggtctctgagacag

SEQ ID NO: 514525 - DNA, 25 bp, Homo sapien
tctctgagacaggatcgttgtccct

SEQ ID NO: 514526 - DNA, 25 bp, Homo sapien
gagacaggatcgttgtccctacagg

SEQ ID NO: 514527 - DNA, 25 bp, Homo sapien
caggatcgttgtccctacaggagga

SEQ ID NO: 514528 - DNA, 25 bp, Homo sapien
atcgttgtccctacaggaggaacag

SEQ ID NO: 514529 - DNA, 25 bp, Homo sapien
gtggccttgcttcttagacggtctt

SEQ ID NO: 514530 - DNA, 25 bp, Homo sapien
cttgcttcttagacggtcttcactg

SEQ ID NO: 514531 - DNA, 25 bp, Homo sapien
ttttgacctgtaacttaaagatcat

SEQ ID NO: 514532 - DNA, 25 bp, Homo sapien
atcataaacttcaggcaataatatt

SEQ ID NO: 514533 - DNA, 25 bp, Homo sapien
gaagaggtatctccagaccctctca

SEQ ID NO: 514534 - DNA, 25 bp, Homo sapien
accctctcaacctcatgtggtttga

SEQ ID NO: 514535 - DNA, 25 bp, Homo sapien
tggtttgaaggcagagctacctctg

SEQ ID NO: 514536 - DNA, 25 bp, Homo sapien
tgagtatgcccctgagtagttttct

SEQ ID NO: 514537 - DNA, 25 bp, Homo sapien
tcaggacgggctcttaactggcaga

SEQ ID NO: 514538 - DNA, 25 bp, Homo sapien
ggaagactctaagacgcagcccata

SEQ ID NO: 514539 - DNA, 25 bp, Homo sapien
gcagcccatagcagctcctgtgagc

SEQ ID NO: 514540 - DNA, 25 bp, Homo sapien
aggcccttgagagcactctgttagc

SEQ ID NO: 514541 - DNA, 25 bp, Homo sapien
agaggcaacctcaaagcctttattc

SEQ ID NO: 514542 - DNA, 25 bp, Homo sapien
gcctttattcaggaacctggctcag

SEQ ID NO: 514543 - DNA, 25 bp, Homo sapien
gccactgggtattgagagagcttta

SEQ ID NO: 514544 - DNA, 25 bp, Homo sapien
atctcttcattgtttggctgaagtt

SEQ ID NO: 514545 - DNA, 25 bp, Homo sapien
tggctgaagtttgcctcttgtgaga

SEQ ID NO: 514546 - DNA, 25 bp, Homo sapien
gaagtttgcctcttgtgagaaaaca

SEQ ID NO: 514547 - DNA, 25 bp, Homo sapien
tttttccagcccagattaataggta

SEQ ID NO: 514548 - DNA, 25 bp, Homo sapien
cagattaataggtatcccctaccct

SEQ ID NO: 514549 - DNA, 25 bp, Homo sapien
taccctaatcccaactctatgatct

SEQ ID NO: 514550 - DNA, 25 bp, Homo sapien
aactctatgatctaatacctttttt

SEQ ID NO: 514551 - DNA, 25 bp, Homo sapien
gaggaaccacttctttttaatattg

SEQ ID NO: 514552 - DNA, 25 bp, Homo sapien
taatattgaaatctgctggttactt

SEQ ID NO: 514553 - DNA, 25 bp, Homo sapien
gctggttactttatgttttctcaag

SEQ ID NO: 514554 - DNA, 25 bp, Homo sapien
aattgacttgtagagagctgctaaa

SEQ ID NO: 514555 - DNA, 25 bp, Homo sapien
tgcggccgctactggtgtctgccct

SEQ ID NO: 514556 - DNA, 25 bp, Homo sapien
ggtgtctgccctgcggcccgtggtg

SEQ ID NO: 514557 - DNA, 25 bp, Homo sapien
ccgtggtgctgttgcctgagtgcct

SEQ ID NO: 514558 - DNA, 25 bp, Homo sapien
tgctgttgcctgagtgcctggcgcc

SEQ ID NO: 514559 - DNA, 25 bp, Homo sapien
ggctcatccgtaacctgctagacct

SEQ ID NO: 514560 - DNA, 25 bp, Homo sapien
gtaacctgctagacctgcccagctc

SEQ ID NO: 514561 - DNA, 25 bp, Homo sapien
agctcccggctggacttccaagtgt

SEQ ID NO: 514562 - DNA, 25 bp, Homo sapien
cggctggacttccaagtgtgcccag

SEQ ID NO: 514563 - DNA, 25 bp, Homo sapien
caagtgtgcccagcggaaagcctct

SEQ ID NO: 514564 - DNA, 25 bp, Homo sapien
tgtgcccagcggaaagcctctctgg

SEQ ID NO: 514565 - DNA, 25 bp, Homo sapien
ggggaggaactgtgcccatcctcag

SEQ ID NO: 514566 - DNA, 25 bp, Homo sapien
agcagcgagtgaatctttaaaacag

SEQ ID NO: 514567 - DNA, 25 bp, Homo sapien
aaaacagacttgatcacgcacacac

SEQ ID NO: 514568 - DNA, 25 bp, Homo sapien
gatcacgcacacacaataagtcttt

SEQ ID NO: 514569 - DNA, 25 bp, Homo sapien
caataagtctttctctccgaaaccg

SEQ ID NO: 514570 - DNA, 25 bp, Homo sapien
gaaaccggaagtaaatctatatctg

SEQ ID NO: 514571 - DNA, 25 bp, Homo sapien
atatctgttagaaataatgtagcca

SEQ ID NO: 514572 - DNA, 25 bp, Homo sapien
gaacaaaatttgcactctaccagat

SEQ ID NO: 514573 - DNA, 25 bp, Homo sapien
gcactctaccagatttgaacatcta

SEQ ID NO: 514574 - DNA, 25 bp, Homo sapien
gaacatctagtgaggttcacattca

SEQ ID NO: 514575 - DNA, 25 bp, Homo sapien
tctagtgaggttcacattcatacta

SEQ ID NO: 514576 - DNA, 25 bp, Homo sapien
tcatactaagttttcaacattgtgt

SEQ ID NO: 514577 - DNA, 25 bp, Homo sapien
aaagcatgtccacagtgatttgaaa

SEQ ID NO: 514578 - DNA, 25 bp, Homo sapien
aagcatgtccacagtgatttgaaaa

SEQ ID NO: 514579 - DNA, 25 bp, Homo sapien
agcatgtccacagtgatttgaaaac

SEQ ID NO: 514580 - DNA, 25 bp, Homo sapien
gcatgtccacagtgatttgaaaacc

SEQ ID NO: 514581 - DNA, 25 bp, Homo sapien
atgtccacagtgatttgaaaaccca

SEQ ID NO: 514582 - DNA, 25 bp, Homo sapien
tgtccacagtgatttgaaaacccaa

SEQ ID NO: 514583 - DNA, 25 bp, Homo sapien
gtccacagtgatttgaaaacccaag

SEQ ID NO: 514584 - DNA, 25 bp, Homo sapien
agtgatttgaaaacccaagctggaa

SEQ ID NO: 514585 - DNA, 25 bp, Homo sapien
ttgaaaacccaagctggaaggccag

SEQ ID NO: 514586 - DNA, 25 bp, Homo sapien
aaaattcaaaagttagccagttatg

SEQ ID NO: 514587 - DNA, 25 bp, Homo sapien
aaattcaaaagttagccagttatgg

SEQ ID NO: 514588 - DNA, 25 bp, Homo sapien
atatgtaactaacgcctgtttgtga

SEQ ID NO: 514589 - DNA, 25 bp, Homo sapien
aacgcctgtttgtgaaattagctta

SEQ ID NO: 514590 - DNA, 25 bp, Homo sapien
gaaattagcttatcaggctgaaatt

SEQ ID NO: 514591 - DNA, 25 bp, Homo sapien
gcaaaagaaggtctaggtccatcaa

SEQ ID NO: 514592 - DNA, 25 bp, Homo sapien
ggtccatcaaggaaattcccctccg

SEQ ID NO: 514593 - DNA, 25 bp, Homo sapien
tcccctccgttttcctttgtcatgg

SEQ ID NO: 514594 - DNA, 25 bp, Homo sapien
tttgtgtgacttagaaattccagga

SEQ ID NO: 514595 - DNA, 25 bp, Homo sapien
cacaattaggatattttcatacaca

SEQ ID NO: 514596 - DNA, 25 bp, Homo sapien
acacatagggtatcttgttcactgc

SEQ ID NO: 514597 - DNA, 25 bp, Homo sapien
ttgttcactgctgtgctactttaca

SEQ ID NO: 514598 - DNA, 25 bp, Homo sapien
cactgctgtgctactttacatgagt

SEQ ID NO: 514599 - DNA, 25 bp, Homo sapien
tgctgtggctattccaacatctctg

SEQ ID NO: 514600 - DNA, 25 bp, Homo sapien
tctggtcagggcctggaagtacctt

SEQ ID NO: 514601 - DNA, 25 bp, Homo sapien
gtcagggcctggaagtaccttagga

SEQ ID NO: 514602 - DNA, 25 bp, Homo sapien
gggcctggaagtaccttaggacaca

SEQ ID NO: 514603 - DNA, 25 bp, Homo sapien
ctggaagtaccttaggacacatggg

SEQ ID NO: 514604 - DNA, 25 bp, Homo sapien
gtcaggactgcattctcagggacca

SEQ ID NO: 514605 - DNA, 25 bp, Homo sapien
ccctggaccagatgaactggagtct

SEQ ID NO: 514606 - DNA, 25 bp, Homo sapien
gatgaactggagtctaggcctctct

SEQ ID NO: 514607 - DNA, 25 bp, Homo sapien
aactggagtctaggcctctctcgtg

SEQ ID NO: 514608 - DNA, 25 bp, Homo sapien
taggcctctctcgtgactgggactt

SEQ ID NO: 514609 - DNA, 25 bp, Homo sapien
tctctcgtgactgggacttgtggga

SEQ ID NO: 514610 - DNA, 25 bp, Homo sapien
aaatctgactgtggattatgacaaa

SEQ ID NO: 514611 - DNA, 25 bp, Homo sapien
aatctatttagatcgggctgactgt

SEQ ID NO: 514612 - DNA, 25 bp, Homo sapien
tttagatcgggctgactgtacaaat

SEQ ID NO: 514613 - DNA, 25 bp, Homo sapien
gggctgactgtacaaatgactcctg

SEQ ID NO: 514614 - DNA, 25 bp, Homo sapien
gactgtacaaatgactcctggaaaa

SEQ ID NO: 514615 - DNA, 25 bp, Homo sapien
gtggagaatgatgacttaccctgaa

SEQ ID NO: 514616 - DNA, 25 bp, Homo sapien
gatgacttaccctgaagtcttccct

SEQ ID NO: 514617 - DNA, 25 bp, Homo sapien
tctgtgccctggagcattctgccca

SEQ ID NO: 514618 - DNA, 25 bp, Homo sapien
cttcccaagtattcgatttcattca

SEQ ID NO: 514619 - DNA, 25 bp, Homo sapien
gtattcgatttcattcatgtgatta

SEQ ID NO: 514620 - DNA, 25 bp, Homo sapien
catgtgattaaaacaagttgccata

SEQ ID NO: 514621 - DNA, 25 bp, Homo sapien
gtcagttgagtccttctgggaaccg

SEQ ID NO: 514622 - DNA, 25 bp, Homo sapien
gggctatgaaaactttcgtctttgg

SEQ ID NO: 514623 - DNA, 25 bp, Homo sapien
gtacccatgaaggaaaactttcctg

SEQ ID NO: 514624 - DNA, 25 bp, Homo sapien
gaggaccaaagaatcaagatccttt

SEQ ID NO: 514625 - DNA, 25 bp, Homo sapien
agatccttttcaggcctgatagcca

SEQ ID NO: 514626 - DNA, 25 bp, Homo sapien
tttcaggcctgatagccaagatgat

SEQ ID NO: 514627 - DNA, 25 bp, Homo sapien
gagtccctggccttttgagcatcct

SEQ ID NO: 514628 - DNA, 25 bp, Homo sapien
tgagcatcctgcttgggcacacggg

SEQ ID NO: 514629 - DNA, 25 bp, Homo sapien
ggaataacctttctccagcttccag

SEQ ID NO: 514630 - DNA, 25 bp, Homo sapien
cagcttccagtgtgaactgagaaag

SEQ ID NO: 514631 - DNA, 25 bp, Homo sapien
tgggatcttcccagcaccagaaact

SEQ ID NO: 514632 - DNA, 25 bp, Homo sapien
aaatatgtaactaacgcctgtttgt

SEQ ID NO: 514633 - DNA, 25 bp, Homo sapien
atatgtaactaacgcctgtttgtga

SEQ ID NO: 514634 - DNA, 25 bp, Homo sapien
gtaactaacgcctgtttgtgaaatt

SEQ ID NO: 514635 - DNA, 25 bp, Homo sapien
taacgcctgtttgtgaaattagctt

SEQ ID NO: 514636 - DNA, 25 bp, Homo sapien
cgcctgtttgtgaaattagcttatc

SEQ ID NO: 514637 - DNA, 25 bp, Homo sapien
gaaattagcttatcaggctgaaatt

SEQ ID NO: 514638 - DNA, 25 bp, Homo sapien
atcaggctgaaattaaagccatgca

SEQ ID NO: 514639 - DNA, 25 bp, Homo sapien
aagccatgcaaaagaaggtctaggt

SEQ ID NO: 514640 - DNA, 25 bp, Homo sapien
gcaaaagaaggtctaggtccatcaa

SEQ ID NO: 514641 - DNA, 25 bp, Homo sapien
aaagaaggtctaggtccatcaagga

SEQ ID NO: 514642 - DNA, 25 bp, Homo sapien
agaaggtctaggtccatcaaggaaa

SEQ ID NO: 514643 - DNA, 25 bp, Homo sapien
ggctggccattgaagtagttgaacc

SEQ ID NO: 514644 - DNA, 25 bp, Homo sapien
ggactgtccagaatcattagccaga

SEQ ID NO: 514645 - DNA, 25 bp, Homo sapien
gagttcactgtgagtggacgtcttt

SEQ ID NO: 514646 - DNA, 25 bp, Homo sapien
ggacgtcttttagttctgcttcaac

SEQ ID NO: 514647 - DNA, 25 bp, Homo sapien
tgcttcaacgctataaccaaccttt

SEQ ID NO: 514648 - DNA, 25 bp, Homo sapien
gttctgttcacaaaggatggctcct

SEQ ID NO: 514649 - DNA, 25 bp, Homo sapien
aggatggctcctcatgtcatcacac

SEQ ID NO: 514650 - DNA, 25 bp, Homo sapien
tcatcacaccggcaaggaatggacg

SEQ ID NO: 514651 - DNA, 25 bp, Homo sapien
aatggacgagcctctgatttttctc

SEQ ID NO: 514652 - DNA, 25 bp, Homo sapien
tctcttcttggctgactttacaagg

SEQ ID NO: 514653 - DNA, 25 bp, Homo sapien
actttacaaggttggatgcagtcca

SEQ ID NO: 514654 - DNA, 25 bp, Homo sapien
agatgtgagtagaagccccctggac

SEQ ID NO: 514655 - DNA, 25 bp, Homo sapien
gtgagaaaaggttcttcaatcctaa

SEQ ID NO: 514656 - DNA, 25 bp, Homo sapien
agtgacacctcaaactgctacagtc

SEQ ID NO: 514657 - DNA, 25 bp, Homo sapien
actgctacagtcacctttgcagcaa

SEQ ID NO: 514658 - DNA, 25 bp, Homo sapien
tgaagatgccaccaacatcaaaggg

SEQ ID NO: 514659 - DNA, 25 bp, Homo sapien
gagagttggtccttggtgatagcat

SEQ ID NO: 514660 - DNA, 25 bp, Homo sapien
tggtgatagcattaagccactgtat

SEQ ID NO: 514661 - DNA, 25 bp, Homo sapien
taagccactgtatcaaccaatcctg

SEQ ID NO: 514662 - DNA, 25 bp, Homo sapien
gtatcaaccaatcctgacaatttgt

SEQ ID NO: 514663 - DNA, 25 bp, Homo sapien
ctgacaatttgtatgacttctggat

SEQ ID NO: 514664 - DNA, 25 bp, Homo sapien
atgacttctggatttccagccacat

SEQ ID NO: 514665 - DNA, 25 bp, Homo sapien
ggactttgattaagatacaggctca

SEQ ID NO: 514666 - DNA, 25 bp, Homo sapien
gactttgattaagatacaggctcac

SEQ ID NO: 514667 - DNA, 25 bp, Homo sapien
actttgattaagatacaggctcaca

SEQ ID NO: 514668 - DNA, 25 bp, Homo sapien
ctttgattaagatacaggctcacag

SEQ ID NO: 514669 - DNA, 25 bp, Homo sapien
tttgattaagatacaggctcacagc

SEQ ID NO: 514670 - DNA, 25 bp, Homo sapien
ttgattaagatacaggctcacagct

SEQ ID NO: 514671 - DNA, 25 bp, Homo sapien
tgattaagatacaggctcacagctg

SEQ ID NO: 514672 - DNA, 25 bp, Homo sapien
gattaagatacaggctcacagctgg

SEQ ID NO: 514673 - DNA, 25 bp, Homo sapien
atggggacgggcatctatgatccca

SEQ ID NO: 514674 - DNA, 25 bp, Homo sapien
gggacgggcatctatgatcccagct

SEQ ID NO: 514675 - DNA, 25 bp, Homo sapien
ggacgggcatctatgatcccagcta

SEQ ID NO: 514676 - DNA, 25 bp, Homo sapien
ttgaccaggtggttttgccttcttt

SEQ ID NO: 514677 - DNA, 25 bp, Homo sapien
tgccttcttttatttgggagtttat

SEQ ID NO: 514678 - DNA, 25 bp, Homo sapien
cttccctcctttaagtgttgaggat

SEQ ID NO: 514679 - DNA, 25 bp, Homo sapien
ttttctgtttagtgattccctgacc

SEQ ID NO: 514680 - DNA, 25 bp, Homo sapien
ttccctgacccagtttcaaacagag

SEQ ID NO: 514681 - DNA, 25 bp, Homo sapien
aacagagccatcttttacagattat

SEQ ID NO: 514682 - DNA, 25 bp, Homo sapien
acctaactcaacaaccctttatgtg

SEQ ID NO: 514683 - DNA, 25 bp, Homo sapien
aaccctttatgtgattcctgagagc

SEQ ID NO: 514684 - DNA, 25 bp, Homo sapien
cctgagagcagtatgaggcctgcaa

SEQ ID NO: 514685 - DNA, 25 bp, Homo sapien
catataattgtatcttcactttctt

SEQ ID NO: 514686 - DNA, 25 bp, Homo sapien
attacattgggatgcattgtcatgc

SEQ ID NO: 514687 - DNA, 25 bp, Homo sapien
catttccaggaaatgtccttggttc

SEQ ID NO: 514688 - DNA, 25 bp, Homo sapien
caggaaatgtccttggttcgcgaac

SEQ ID NO: 514689 - DNA, 25 bp, Homo sapien
gaaatgtccttggttcgcgaactac

SEQ ID NO: 514690 - DNA, 25 bp, Homo sapien
ttggttcgcgaactacagctggcac

SEQ ID NO: 514691 - DNA, 25 bp, Homo sapien
gttcgcgaactacagctggcacaat

SEQ ID NO: 514692 - DNA, 25 bp, Homo sapien
ctggcacaatccagcccagggcgtt

SEQ ID NO: 514693 - DNA, 25 bp, Homo sapien
ccagggcgttctgtgagctgtagtc

SEQ ID NO: 514694 - DNA, 25 bp, Homo sapien
gcgttctgtgagctgtagtctccag

SEQ ID NO: 514695 - DNA, 25 bp, Homo sapien
tgtagtctccagcaagtgaattcca

SEQ ID NO: 514696 - DNA, 25 bp, Homo sapien
aagacctcaaagaccatacagggtg

SEQ ID NO: 514697 - DNA, 25 bp, Homo sapien
gaccatacagggtggacagcgtagt

SEQ ID NO: 514698 - DNA, 25 bp, Homo sapien
tcgcgaggtgcagtgcgcccctggg

SEQ ID NO: 514699 - DNA, 25 bp, Homo sapien
gccaggtcggcttggcgcccaggga

SEQ ID NO: 514700 - DNA, 25 bp, Homo sapien
ttggcgcccagggactggccggacg

SEQ ID NO: 514701 - DNA, 25 bp, Homo sapien
tggaagaggaggttgccgcgccctg

SEQ ID NO: 514702 - DNA, 25 bp, Homo sapien
gcagcgggagattcccggccggact

SEQ ID NO: 514703 - DNA, 25 bp, Homo sapien
attcccggccggactggcggacgag

SEQ ID NO: 514704 - DNA, 25 bp, Homo sapien
actggcggacgagcgtcgagagaca

SEQ ID NO: 514705 - DNA, 25 bp, Homo sapien
agcgcactgagcaggcaaagtcgca

SEQ ID NO: 514706 - DNA, 25 bp, Homo sapien
cactgagcaggcaaagtcgcagggc

SEQ ID NO: 514707 - DNA, 25 bp, Homo sapien
ggcaaagtcgcagggccgccagcat

SEQ ID NO: 514708 - DNA, 25 bp, Homo sapien
aagtcgcagggccgccagcatgttc

SEQ ID NO: 514709 - DNA, 25 bp, Homo sapien
gcagctgctatctagatagacagca

SEQ ID NO: 514710 - DNA, 25 bp, Homo sapien
gatagacagcaaaaaccaaccacta

SEQ ID NO: 514711 - DNA, 25 bp, Homo sapien
aaaccaaccactaattcagcaaaca

SEQ ID NO: 514712 - DNA, 25 bp, Homo sapien
ttaaatggccttcggtgtgtgcgca

SEQ ID NO: 514713 - DNA, 25 bp, Homo sapien
ggagaaccatacttattcccctgtt

SEQ ID NO: 514714 - DNA, 25 bp, Homo sapien
tgtctcctctgctttgtttcttatc

SEQ ID NO: 514715 - DNA, 25 bp, Homo sapien
tttgtttcttatcactgctgctggt

SEQ ID NO: 514716 - DNA, 25 bp, Homo sapien
tatcactgctgctggtgtctagagc

SEQ ID NO: 514717 - DNA, 25 bp, Homo sapien
gctggtgtctagagccagccagcag

SEQ ID NO: 514718 - DNA, 25 bp, Homo sapien
gaccctgcgggcagcgcttaggact

SEQ ID NO: 514719 - DNA, 25 bp, Homo sapien
gcgcttaggactgcacatttacatt

SEQ ID NO: 514720 - DNA, 25 bp, Homo sapien
ggtttgcctgtgacccaatgcccac

SEQ ID NO: 514721 - DNA, 25 bp, Homo sapien
gacccaatgcccactgggactgaat

SEQ ID NO: 514722 - DNA, 25 bp, Homo sapien
gactgaatgccaaaggactcccttt

SEQ ID NO: 514723 - DNA, 25 bp, Homo sapien
aaaggactccctttaggcatccagg

SEQ ID NO: 514724 - DNA, 25 bp, Homo sapien
cctttaggcatccaggttgtggctg

SEQ ID NO: 514725 - DNA, 25 bp, Homo sapien
gttgtggctggaccctttaatgatc

SEQ ID NO: 514726 - DNA, 25 bp, Homo sapien
tttaatgatcatctgaccctggctg

SEQ ID NO: 514727 - DNA, 25 bp, Homo sapien
gctgtggcccagtacttggagaaaa

SEQ ID NO: 514728 - DNA, 25 bp, Homo sapien
aagttttaggaggaccttctgcaag

SEQ ID NO: 514729 - DNA, 25 bp, Homo sapien
ccttctgcaaggttaatgtgtgtgt

SEQ ID NO: 514730 - DNA, 25 bp, Homo sapien
aggtgtcttcagtgccctgggtttg

SEQ ID NO: 514731 - DNA, 25 bp, Homo sapien
acagctctggcattgtttttgcact

SEQ ID NO: 514732 - DNA, 25 bp, Homo sapien
ttgcactgacaaaatgctgtgtttt

SEQ ID NO: 514733 - DNA, 25 bp, Homo sapien
gtgttttgaagccatttttcttatc

SEQ ID NO: 514734 - DNA, 25 bp, Homo sapien
gtatagtccatagcggatgttcctc

SEQ ID NO: 514735 - DNA, 25 bp, Homo sapien
ggatgttcctcttccggagagctgt

SEQ ID NO: 514736 - DNA, 25 bp, Homo sapien
cggagagctgttcccaattcaccaa

SEQ ID NO: 514737 - DNA, 25 bp, Homo sapien
aattcaccaaccaaatcccgatgag

SEQ ID NO: 514738 - DNA, 25 bp, Homo sapien
atgaggccccacgtctttggagttc

SEQ ID NO: 514739 - DNA, 25 bp, Homo sapien
gtaagtatcaggacattcccactcc

SEQ ID NO: 514740 - DNA, 25 bp, Homo sapien
tccccatcagaccagatcagatcag

SEQ ID NO: 514741 - DNA, 25 bp, Homo sapien
taacaaggtcgtacagctctggcat

SEQ ID NO: 514742 - DNA, 25 bp, Homo sapien
aaccaacgagatgagaagactgtga

SEQ ID NO: 514743 - DNA, 25 bp, Homo sapien
aacgagatgagaagactgtgatcct

SEQ ID NO: 514744 - DNA, 25 bp, Homo sapien
cgagatgagaagactgtgatcctca

SEQ ID NO: 514745 - DNA, 25 bp, Homo sapien
agatgagaagactgtgatcctcatg

SEQ ID NO: 514746 - DNA, 25 bp, Homo sapien
aggcttgtgactcaacaaagggctt

SEQ ID NO: 514747 - DNA, 25 bp, Homo sapien
ggcttgtgactcaacaaagggcttt

SEQ ID NO: 514748 - DNA, 25 bp, Homo sapien
gcttgtgactcaacaaagggctttt

SEQ ID NO: 514749 - DNA, 25 bp, Homo sapien
gatagaagcagtttgggatttgtag

SEQ ID NO: 514750 - DNA, 25 bp, Homo sapien
gataaagaagatgctaccaatgaaa

SEQ ID NO: 514751 - DNA, 25 bp, Homo sapien
aagaagatgctaccaatgaaataga

SEQ ID NO: 514752 - DNA, 25 bp, Homo sapien
gatgctaccaatgaaatagaaaacc

SEQ ID NO: 514753 - DNA, 25 bp, Homo sapien
agagacgccaatggcagggctgcac

SEQ ID NO: 514754 - DNA, 25 bp, Homo sapien
agacgccaatggcagggctgcacca

SEQ ID NO: 514755 - DNA, 25 bp, Homo sapien
gacgccaatggcagggctgcaccag

SEQ ID NO: 514756 - DNA, 25 bp, Homo sapien
acgccaatggcagggctgcaccagt

SEQ ID NO: 514757 - DNA, 25 bp, Homo sapien
caatggcagggctgcaccagtggaa

SEQ ID NO: 514758 - DNA, 25 bp, Homo sapien
atggcagggctgcaccagtggaaga

SEQ ID NO: 514759 - DNA, 25 bp, Homo sapien
ggcagggctgcaccagtggaagaca

SEQ ID NO: 514760 - DNA, 25 bp, Homo sapien
gggctgcaccagtggaagacaactg

SEQ ID NO: 514761 - DNA, 25 bp, Homo sapien
ggctgcaccagtggaagacaactgt

SEQ ID NO: 514762 - DNA, 25 bp, Homo sapien
gctgcaccagtggaagacaactgtt

SEQ ID NO: 514763 - DNA, 25 bp, Homo sapien
ctgcaccagtggaagacaactgtta

SEQ ID NO: 514764 - DNA, 25 bp, Homo sapien
tcctttctccagctttagaaaaatc

SEQ ID NO: 514765 - DNA, 25 bp, Homo sapien
atggcccagccctgaaggactgaag

SEQ ID NO: 514766 - DNA, 25 bp, Homo sapien
gagcttgtgcgggatcccgtcatcc

SEQ ID NO: 514767 - DNA, 25 bp, Homo sapien
gtgcgggatcccgtcatcctggact

SEQ ID NO: 514768 - DNA, 25 bp, Homo sapien
tccacacagcgtccacgcatggatg

SEQ ID NO: 514769 - DNA, 25 bp, Homo sapien
gcatgagtctctggatctccctgag

SEQ ID NO: 514770 - DNA, 25 bp, Homo sapien
ataaaccagtagaaaggctcctatt

SEQ ID NO: 514771 - DNA, 25 bp, Homo sapien
aaggctcctatttacatccaggttg

SEQ ID NO: 514772 - DNA, 25 bp, Homo sapien
catccaggttgtcagtttaagctca

SEQ ID NO: 514773 - DNA, 25 bp, Homo sapien
ttaagctcaagtaatatgcaaggca

SEQ ID NO: 514774 - DNA, 25 bp, Homo sapien
atgcaaggcacaattcttcctttct

SEQ ID NO: 514775 - DNA, 25 bp, Homo sapien
gcagctctgcttgagttcacagatg

SEQ ID NO: 514776 - DNA, 25 bp, Homo sapien
ttcacagatgactgccaagcttcag

SEQ ID NO: 514777 - DNA, 25 bp, Homo sapien
tgactgccaagcttcagacacccta

SEQ ID NO: 514778 - DNA, 25 bp, Homo sapien
tgtggccatgccagctaattggacc

SEQ ID NO: 514779 - DNA, 25 bp, Homo sapien
agctaattggacctcacctcagaaa

SEQ ID NO: 514780 - DNA, 25 bp, Homo sapien
tggacctcacctcagaaatcctcag

SEQ ID NO: 514781 - DNA, 25 bp, Homo sapien
gccctggctccagaggatcatggca

SEQ ID NO: 514782 - DNA, 25 bp, Homo sapien
agaggatcatggcagctcctatgag

SEQ ID NO: 514783 - DNA, 25 bp, Homo sapien
tttttgccgctggtgtcaggagtat

SEQ ID NO: 514784 - DNA, 25 bp, Homo sapien
ttccaataccgataaatctttgagg

SEQ ID NO: 514785 - DNA, 25 bp, Homo sapien
atctttgaggtttctgggtgtctct

SEQ ID NO: 514786 - DNA, 25 bp, Homo sapien
acagtgttgttttgaccgggagatc

SEQ ID NO: 514787 - DNA, 25 bp, Homo sapien
gtgctcagaattagggcctggcatt

SEQ ID NO: 514788 - DNA, 25 bp, Homo sapien
gcctggcatttggaatcacaggatt

SEQ ID NO: 514789 - DNA, 25 bp, Homo sapien
ggatttatcatcacagaaacaactg

SEQ ID NO: 514790 - DNA, 25 bp, Homo sapien
aagattagttccatcactctcatcc

SEQ ID NO: 514791 - DNA, 25 bp, Homo sapien
ccatcactctcatcctgtattttta

SEQ ID NO: 514792 - DNA, 25 bp, Homo sapien
aacacaagagtgcataccagaattg

SEQ ID NO: 514793 - DNA, 25 bp, Homo sapien
gctggagactacttttgtgctttac

SEQ ID NO: 514794 - DNA, 25 bp, Homo sapien
aactgtgaaggattgtggtcacctg

SEQ ID NO: 514795 - DNA, 25 bp, Homo sapien
gtggtcacctggaacaggtctccaa

SEQ ID NO: 514796 - DNA, 25 bp, Homo sapien
aggtctccaatctatgttagcacta

SEQ ID NO: 514797 - DNA, 25 bp, Homo sapien
tagtctctcctctgtgatgcaaaat

SEQ ID NO: 514798 - DNA, 25 bp, Homo sapien
tggaatattcaatggcagatctgcc

SEQ ID NO: 514799 - DNA, 25 bp, Homo sapien
agatctgcccttctgagatgctgac

SEQ ID NO: 514800 - DNA, 25 bp, Homo sapien
gatgctgaccatccaaaacaccttg

SEQ ID NO: 514801 - DNA, 25 bp, Homo sapien
tatggtgcaccatgattagctcaca

SEQ ID NO: 514802 - DNA, 25 bp, Homo sapien
gattagctcacacacaatgccaagg

SEQ ID NO: 514803 - DNA, 25 bp, Homo sapien
agaccctccctactgattggctagg

SEQ ID NO: 514804 - DNA, 25 bp, Homo sapien
attggctaggatgcctgtcaggaac

SEQ ID NO: 514805 - DNA, 25 bp, Homo sapien
ggaactcattatgctactggttgtt

SEQ ID NO: 514806 - DNA, 25 bp, Homo sapien
ggatccccatagtggactactttca

SEQ ID NO: 514807 - DNA, 25 bp, Homo sapien
attgtaaccaactgagtgctgcccc

SEQ ID NO: 514808 - DNA, 25 bp, Homo sapien
catagaatttagttgaccattttca

SEQ ID NO: 514809 - DNA, 25 bp, Homo sapien
tagttgaccattttcattgtcttca

SEQ ID NO: 514810 - DNA, 25 bp, Homo sapien
ttcattgtcttcacttgtgggttaa

SEQ ID NO: 514811 - DNA, 25 bp, Homo sapien
tggctgagcagggaataacctcttg

SEQ ID NO: 514812 - DNA, 25 bp, Homo sapien
taacctcttggaggaaggaaaacat

SEQ ID NO: 514813 - DNA, 25 bp, Homo sapien
gaaaacattcccctttatatgtcag

SEQ ID NO: 514814 - DNA, 25 bp, Homo sapien
attcccctttatatgtcagcaactt

SEQ ID NO: 514815 - DNA, 25 bp, Homo sapien
tcagcaactttgaccctagagggaa

SEQ ID NO: 514816 - DNA, 25 bp, Homo sapien
gagggaatcagaacccatgcctttg

SEQ ID NO: 514817 - DNA, 25 bp, Homo sapien
acatgaactgacttagttatctcaa

SEQ ID NO: 514818 - DNA, 25 bp, Homo sapien
gacttagttatctcaatgttcaaac

SEQ ID NO: 514819 - DNA, 25 bp, Homo sapien
ggctgcgtggcaatcaggaactcat

SEQ ID NO: 514820 - DNA, 25 bp, Homo sapien
aggaactcataagccactgactata

SEQ ID NO: 514821 - DNA, 25 bp, Homo sapien
aacacagcaaagttggcagtcggca

SEQ ID NO: 514822 - DNA, 25 bp, Homo sapien
atgaaaagtgatccctgtttgcccc

SEQ ID NO: 514823 - DNA, 25 bp, Homo sapien
tgtttgcccctaaacgtagagaaat

SEQ ID NO: 514824 - DNA, 25 bp, Homo sapien
aaatctgcgttattttccagcacac

SEQ ID NO: 514825 - DNA, 25 bp, Homo sapien
attttccagcacacatggagcacaa

SEQ ID NO: 514826 - DNA, 25 bp, Homo sapien
ggaagatcattgaaacactgtttgg

SEQ ID NO: 514827 - DNA, 25 bp, Homo sapien
taaaagcttgtttctaactcacggg

SEQ ID NO: 514828 - DNA, 25 bp, Homo sapien
taactcacgggatgcgggcagtctg

SEQ ID NO: 514829 - DNA, 25 bp, Homo sapien
ggcagtctgctctctagaactggac

SEQ ID NO: 514830 - DNA, 25 bp, Homo sapien
agaggtgccagagcccagtgatcgt

SEQ ID NO: 514831 - DNA, 25 bp, Homo sapien
ccagtgatcgttctgaggagcctga

SEQ ID NO: 514832 - DNA, 25 bp, Homo sapien
gagactccagctgcctacagagcga

SEQ ID NO: 514833 - DNA, 25 bp, Homo sapien
aggaagggagccgacagccgccctt

SEQ ID NO: 514834 - DNA, 25 bp, Homo sapien
gcccttcggatttgatgtcacgttt

SEQ ID NO: 514835 - DNA, 25 bp, Homo sapien
cgtgactgtcctggctatgcgtgcg

SEQ ID NO: 514836 - DNA, 25 bp, Homo sapien
tatgcgtgcgtcctcagcactgaag

SEQ ID NO: 514837 - DNA, 25 bp, Homo sapien
acttggctatgctgattcgcgtgaa

SEQ ID NO: 514838 - DNA, 25 bp, Homo sapien
cgcgtgaaggcggagcagaatctca

SEQ ID NO: 514839 - DNA, 25 bp, Homo sapien
agatcggaaactgctcctcgcctgg

SEQ ID NO: 514840 - DNA, 25 bp, Homo sapien
ctcgcctggctcttgatgtccaagg

SEQ ID NO: 514841 - DNA, 25 bp, Homo sapien
agagcatcaagtaccacgtttttga

SEQ ID NO: 514842 - DNA, 25 bp, Homo sapien
cacgtttttgaagaccatggcctat

SEQ ID NO: 514843 - DNA, 25 bp, Homo sapien
gaccatggcctatcatcattatgca

SEQ ID NO: 514844 - DNA, 25 bp, Homo sapien
gaagcttcaagtctcatctgcatta

SEQ ID NO: 514845 - DNA, 25 bp, Homo sapien
gcattaaagctctccattgaaccct

SEQ ID NO: 514846 - DNA, 25 bp, Homo sapien
ccattgaaccctctcacaaaagtac

SEQ ID NO: 514847 - DNA, 25 bp, Homo sapien
ttccattttatatcccttcctctga

SEQ ID NO: 514848 - DNA, 25 bp, Homo sapien
tctgacttctcttcaatttccttgg

SEQ ID NO: 514849 - DNA, 25 bp, Homo sapien
ttcaatttccttggcctctagggtc

SEQ ID NO: 514850 - DNA, 25 bp, Homo sapien
cctctagggtccttcatattgctta

SEQ ID NO: 514851 - DNA, 25 bp, Homo sapien
tattgcttacgttcctttagactag

SEQ ID NO: 514852 - DNA, 25 bp, Homo sapien
ttggtcataaagtgaaacccgtatt

SEQ ID NO: 514853 - DNA, 25 bp, Homo sapien
agtgaaacccgtattagcaagtacg

SEQ ID NO: 514854 - DNA, 25 bp, Homo sapien
attccaatcagatgcagctttctcc

SEQ ID NO: 514855 - DNA, 25 bp, Homo sapien
gtctggtctcctgtttgcaattgct

SEQ ID NO: 514856 - DNA, 25 bp, Homo sapien
tcctgtttgcaattgcttccctcat

SEQ ID NO: 514857 - DNA, 25 bp, Homo sapien
attgcttccctcatctcagtaggga

SEQ ID NO: 514858 - DNA, 25 bp, Homo sapien
gaatgaggttagaagactgcagctt

SEQ ID NO: 514859 - DNA, 25 bp, Homo sapien
aagactgcagcttggagtctctcta

SEQ ID NO: 514860 - DNA, 25 bp, Homo sapien
ggagtctctctaggttttcaactat

SEQ ID NO: 514861 - DNA, 25 bp, Homo sapien
ttcacaatttgaacacttgacggtt

SEQ ID NO: 514862 - DNA, 25 bp, Homo sapien
ttgaacacttgacggttgtcccttt

SEQ ID NO: 514863 - DNA, 25 bp, Homo sapien
gatttcctctaggacgtatagctag

SEQ ID NO: 514864 - DNA, 25 bp, Homo sapien
ggacgtatagctaggaagtgttact

SEQ ID NO: 514865 - DNA, 25 bp, Homo sapien
gaagtgttactatcttgatttgaac

SEQ ID NO: 514866 - DNA, 25 bp, Homo sapien
gaacaaattttctggtgctaagtct

SEQ ID NO: 514867 - DNA, 25 bp, Homo sapien
gtgctaagtctgatgttctttccat

SEQ ID NO: 514868 - DNA, 25 bp, Homo sapien
gatgttctttccatgaatcattgtg

SEQ ID NO: 514869 - DNA, 25 bp, Homo sapien
gagatggagctttgtaatgggaata

SEQ ID NO: 514870 - DNA, 25 bp, Homo sapien
ctttctgaaaaggaggtatctagca

SEQ ID NO: 514871 - DNA, 25 bp, Homo sapien
ggataaatagataccactgaatgaa

SEQ ID NO: 514872 - DNA, 25 bp, Homo sapien
aatcctttaaggtcaacattgttat

SEQ ID NO: 514873 - DNA, 25 bp, Homo sapien
aaacattttgatttcctctaggacg

SEQ ID NO: 514874 - DNA, 25 bp, Homo sapien
tccctttgcctcttgcattagacag

SEQ ID NO: 514875 - DNA, 25 bp, Homo sapien
gcctcttgcattagacagggccaat

SEQ ID NO: 514876 - DNA, 25 bp, Homo sapien
attagacagggccaatattttgtcc

SEQ ID NO: 514877 - DNA, 25 bp, Homo sapien
tttgtcctacaaaatttcctcttgg

SEQ ID NO: 514878 - DNA, 25 bp, Homo sapien
tacaaaatttcctcttggtctcttt

SEQ ID NO: 514879 - DNA, 25 bp, Homo sapien
taaaaatcagttattgtcgtgcttg

SEQ ID NO: 514880 - DNA, 25 bp, Homo sapien
agttattgtcgtgcttgctgaagat

SEQ ID NO: 514881 - DNA, 25 bp, Homo sapien
ttgtcgtgcttgctgaagattttca

SEQ ID NO: 514882 - DNA, 25 bp, Homo sapien
aacagattttcattatctttgtaag

SEQ ID NO: 514883 - DNA, 25 bp, Homo sapien
gatttcaactatatttatttgccct

SEQ ID NO: 514884 - DNA, 25 bp, Homo sapien
ctatatttatttgccctttcttctc

SEQ ID NO: 514885 - DNA, 25 bp, Homo sapien
ttgtaaattgcccaggtatgtcttt

SEQ ID NO: 514886 - DNA, 25 bp, Homo sapien
gtaaattgcccaggtatgtctttat

SEQ ID NO: 514887 - DNA, 25 bp, Homo sapien
tgaaaatggactcatacaatgatcc

SEQ ID NO: 514888 - DNA, 25 bp, Homo sapien
agcctcccgtgtagcaggcattgtc

SEQ ID NO: 514889 - DNA, 25 bp, Homo sapien
ctcccgtgtagcaggcattgtcaca

SEQ ID NO: 514890 - DNA, 25 bp, Homo sapien
tcccgtgtagcaggcattgtcacag

SEQ ID NO: 514891 - DNA, 25 bp, Homo sapien
ccgtgtagcaggcattgtcacaggc

SEQ ID NO: 514892 - DNA, 25 bp, Homo sapien
gtgtagcaggcattgtcacaggcgc

SEQ ID NO: 514893 - DNA, 25 bp, Homo sapien
gtagcaggcattgtcacaggcgcct

SEQ ID NO: 514894 - DNA, 25 bp, Homo sapien
tagcaggcattgtcacaggcgcctg

SEQ ID NO: 514895 - DNA, 25 bp, Homo sapien
agcaggcattgtcacaggcgcctgc

SEQ ID NO: 514896 - DNA, 25 bp, Homo sapien
atcagcaatagctaccatcatttgt

SEQ ID NO: 514897 - DNA, 25 bp, Homo sapien
tcatttgtcaagcacctactagatg

SEQ ID NO: 514898 - DNA, 25 bp, Homo sapien
acattgcctcctattctcatccatt

SEQ ID NO: 514899 - DNA, 25 bp, Homo sapien
attctcatccattcctgcaaagaag

SEQ ID NO: 514900 - DNA, 25 bp, Homo sapien
gcaatgagcatccttggaacagact

SEQ ID NO: 514901 - DNA, 25 bp, Homo sapien
catccttggaacagactgggagcct

SEQ ID NO: 514902 - DNA, 25 bp, Homo sapien
gaggctgctgaactggccccagtca

SEQ ID NO: 514903 - DNA, 25 bp, Homo sapien
cacctatgtgccagagtcaggcctg

SEQ ID NO: 514904 - DNA, 25 bp, Homo sapien
aggcctggccgacacaaggatctat

SEQ ID NO: 514905 - DNA, 25 bp, Homo sapien
gacacaaggatctatgctttttctg

SEQ ID NO: 514906 - DNA, 25 bp, Homo sapien
ctgtggtgtgtcactgcctttttaa

SEQ ID NO: 514907 - DNA, 25 bp, Homo sapien
tgtatgtaagacaattctatccagc

SEQ ID NO: 514908 - DNA, 25 bp, Homo sapien
gtatgtaagacaattctatccagcc

SEQ ID NO: 514909 - DNA, 25 bp, Homo sapien
tatgtaagacaattctatccagccc

SEQ ID NO: 514910 - DNA, 25 bp, Homo sapien
atgtaagacaattctatccagcccg

SEQ ID NO: 514911 - DNA, 25 bp, Homo sapien
tgtaagacaattctatccagcccgc

SEQ ID NO: 514912 - DNA, 25 bp, Homo sapien
gtaagacaattctatccagcccgcc

SEQ ID NO: 514913 - DNA, 25 bp, Homo sapien
taagacaattctatccagcccgcca

SEQ ID NO: 514914 - DNA, 25 bp, Homo sapien
aagacaattctatccagcccgccac

SEQ ID NO: 514915 - DNA, 25 bp, Homo sapien
gacaattctatccagcccgccacct

SEQ ID NO: 514916 - DNA, 25 bp, Homo sapien
tctggactccctcccctgtatgtaa

SEQ ID NO: 514917 - DNA, 25 bp, Homo sapien
cctcccctgtatgtaagccctcaat

SEQ ID NO: 514918 - DNA, 25 bp, Homo sapien
aagtctcttaactgcaccttgtgaa

SEQ ID NO: 514919 - DNA, 25 bp, Homo sapien
gtcttcatacagttcagcctctaga

SEQ ID NO: 514920 - DNA, 25 bp, Homo sapien
aaatcagccaattggattcgaaaca

SEQ ID NO: 514921 - DNA, 25 bp, Homo sapien
gaagactatgtaaaactcacccatc

SEQ ID NO: 514922 - DNA, 25 bp, Homo sapien
tcacccatcacactttgagactact

SEQ ID NO: 514923 - DNA, 25 bp, Homo sapien
gagactactcactggttggaagaat

SEQ ID NO: 514924 - DNA, 25 bp, Homo sapien
agagatgtgggcttcctttttgagt

SEQ ID NO: 514925 - DNA, 25 bp, Homo sapien
ttttgagtcttgtgttaggtgctga

SEQ ID NO: 514926 - DNA, 25 bp, Homo sapien
ggtgctgagaccttttacatgggct

SEQ ID NO: 514927 - DNA, 25 bp, Homo sapien
agaccttttacatgggcttatacag

SEQ ID NO: 514928 - DNA, 25 bp, Homo sapien
ggcttatacagggagagagtcttca

SEQ ID NO: 514929 - DNA, 25 bp, Homo sapien
atccccacggtactaagagcaggcg

SEQ ID NO: 514930 - DNA, 25 bp, Homo sapien
acggtactaagagcaggcgccgtcg

SEQ ID NO: 514931 - DNA, 25 bp, Homo sapien
ttcggttttacctgtatggaaagct

SEQ ID NO: 514932 - DNA, 25 bp, Homo sapien
tatggaaagctatccccggcgggcg

SEQ ID NO: 514933 - DNA, 25 bp, Homo sapien
gcgcggtgagtttgctcgaccagct

SEQ ID NO: 514934 - DNA, 25 bp, Homo sapien
gagtttgctcgaccagcttaggtgt

SEQ ID NO: 514935 - DNA, 25 bp, Homo sapien
gctcgaccagcttaggtgtgcgcga

SEQ ID NO: 514936 - DNA, 25 bp, Homo sapien
cagagtccaggattgggcagcggga

SEQ ID NO: 514937 - DNA, 25 bp, Homo sapien
gaccgggcttgggacagggcgcgca

SEQ ID NO: 514938 - DNA, 25 bp, Homo sapien
cgcgcagcctggaggtgcatttgtt

SEQ ID NO: 514939 - DNA, 25 bp, Homo sapien
aggtgcatttgttgctcgaggccgc

SEQ ID NO: 514940 - DNA, 25 bp, Homo sapien
ggtggcctgcccttttgtagtgcag

SEQ ID NO: 514941 - DNA, 25 bp, Homo sapien
gcctgcccttttgtagtgcagttga

SEQ ID NO: 514942 - DNA, 25 bp, Homo sapien
ttgtagtgcagttgaggagagctca

SEQ ID NO: 514943 - DNA, 25 bp, Homo sapien
ttttctcttccctacctcgtatgta

SEQ ID NO: 514944 - DNA, 25 bp, Homo sapien
ctcgtatgtactcccactcaggaaa

SEQ ID NO: 514945 - DNA, 25 bp, Homo sapien
gtactcccactcaggaaaagatcct

SEQ ID NO: 514946 - DNA, 25 bp, Homo sapien
ggaaaagatcctgagacctctctgt

SEQ ID NO: 514947 - DNA, 25 bp, Homo sapien
atcctgagacctctctgtaccagat

SEQ ID NO: 514948 - DNA, 25 bp, Homo sapien
tgtaccagatcctcttatacccagg

SEQ ID NO: 514949 - DNA, 25 bp, Homo sapien
tcttatacccaggttctccttaatc

SEQ ID NO: 514950 - DNA, 25 bp, Homo sapien
gttctccttaatcccaatcaacttt

SEQ ID NO: 514951 - DNA, 25 bp, Homo sapien
agcagttgtttgtgtcaggcatgac

SEQ ID NO: 514952 - DNA, 25 bp, Homo sapien
ggatgttaccttaactactgagctg

SEQ ID NO: 514953 - DNA, 25 bp, Homo sapien
aactactgagctgtcttactggaaa

SEQ ID NO: 514954 - DNA, 25 bp, Homo sapien
tagttaagatggactatacaatgta

SEQ ID NO: 514955 - DNA, 25 bp, Homo sapien
ataagtctaaaagtggtggatcata

SEQ ID NO: 514956 - DNA, 25 bp, Homo sapien
aaagtggtggatcatatgttaaaac

SEQ ID NO: 514957 - DNA, 25 bp, Homo sapien
atatgttaaaacctgatctagatgt

SEQ ID NO: 514958 - DNA, 25 bp, Homo sapien
aacctgatctagatgtttctttaac

SEQ ID NO: 514959 - DNA, 25 bp, Homo sapien
gatctagatgtttctttaaccaaga

SEQ ID NO: 514960 - DNA, 25 bp, Homo sapien
gatgtttctttaaccaagatgaatt

SEQ ID NO: 514961 - DNA, 25 bp, Homo sapien
taaaatatagtagagttccactgtg

SEQ ID NO: 514962 - DNA, 25 bp, Homo sapien
tcttcaaggttattctcaggacttt

SEQ ID NO: 514963 - DNA, 25 bp, Homo sapien
caaggttattctcaggactttgatt

SEQ ID NO: 514964 - DNA, 25 bp, Homo sapien
ggactttgattaagatacaggctca

SEQ ID NO: 514965 - DNA, 25 bp, Homo sapien
actttgattaagatacaggctcaca

SEQ ID NO: 514966 - DNA, 25 bp, Homo sapien
tttgattaagatacaggctcacagc

SEQ ID NO: 514967 - DNA, 25 bp, Homo sapien
ttgattaagatacaggctcacagct

SEQ ID NO: 514968 - DNA, 25 bp, Homo sapien
tgattaagatacaggctcacagctg

SEQ ID NO: 514969 - DNA, 25 bp, Homo sapien
gattaagatacaggctcacagctgg

SEQ ID NO: 514970 - DNA, 25 bp, Homo sapien
agatacaggctcacagctgggcatg

SEQ ID NO: 514971 - DNA, 25 bp, Homo sapien
gggacgggcatctatgatcccagct

SEQ ID NO: 514972 - DNA, 25 bp, Homo sapien
ggacgggcatctatgatcccagcta

SEQ ID NO: 514973 - DNA, 25 bp, Homo sapien
tttcctatcccctagcttgttgagt

SEQ ID NO: 514974 - DNA, 25 bp, Homo sapien
tatcccctagcttgttgagtgttcc

SEQ ID NO: 514975 - DNA, 25 bp, Homo sapien
agcttgttgagtgttcccttagaga

SEQ ID NO: 514976 - DNA, 25 bp, Homo sapien
ggatctccttgcttgagacagcaat

SEQ ID NO: 514977 - DNA, 25 bp, Homo sapien
agcaatccatgctgtgactgtggaa

SEQ ID NO: 514978 - DNA, 25 bp, Homo sapien
tgctgtgactgtggaaggcttctct

SEQ ID NO: 514979 - DNA, 25 bp, Homo sapien
gtggaaggcttctcttggcgagaat

SEQ ID NO: 514980 - DNA, 25 bp, Homo sapien
ttctcttggcgagaattgtgtgtgc

SEQ ID NO: 514981 - DNA, 25 bp, Homo sapien
gggctagcatctctgaacctgcagc

SEQ ID NO: 514982 - DNA, 25 bp, Homo sapien
atctctgaacctgcagctgcaaagg

SEQ ID NO: 514983 - DNA, 25 bp, Homo sapien
cctgcagctgcaaagggataatttt

SEQ ID NO: 514984 - DNA, 25 bp, Homo sapien
gcaaattgcatttattcactacatt

SEQ ID NO: 514985 - DNA, 25 bp, Homo sapien
ttcactacattacaaaccatcactg

SEQ ID NO: 514986 - DNA, 25 bp, Homo sapien
accatcactgatgtatccaaaatag

SEQ ID NO: 514987 - DNA, 25 bp, Homo sapien
gtatccaaaatagcacacatagttc

SEQ ID NO: 514988 - DNA, 25 bp, Homo sapien
atagcacacatagttcagtatgaaa

SEQ ID NO: 514989 - DNA, 25 bp, Homo sapien
gtgtttatgcattatctgactatat

SEQ ID NO: 514990 - DNA, 25 bp, Homo sapien
tgtttttctatttaccttctatcag

SEQ ID NO: 514991 - DNA, 25 bp, Homo sapien
tttaccttctatcagttttctctac

SEQ ID NO: 514992 - DNA, 25 bp, Homo sapien
tttctctaccaattatgttttttca

SEQ ID NO: 514993 - DNA, 25 bp, Homo sapien
atgttttttcaatgctctataagaa

SEQ ID NO: 514994 - DNA, 25 bp, Homo sapien
tttctgtaaaagagttgcaactact

SEQ ID NO: 514995 - DNA, 25 bp, Homo sapien
tgtacttgaaccctccaggtggtgc

SEQ ID NO: 514996 - DNA, 25 bp, Homo sapien
gggctggttagaccacttctgagaa

SEQ ID NO: 514997 - DNA, 25 bp, Homo sapien
gaccacttctgagaactggactatt

SEQ ID NO: 514998 - DNA, 25 bp, Homo sapien
tggactatttcctgcgtaaaccggg

SEQ ID NO: 514999 - DNA, 25 bp, Homo sapien
atttcctgcgtaaaccgggcgctca

SEQ ID NO: 515000 - DNA, 25 bp, Homo sapien
taaaccgggcgctcaggcgcttgga

SEQ ID NO: 515001 - DNA, 25 bp, Homo sapien
ttggacccggcccaagatttgactc

SEQ ID NO: 515002 - DNA, 25 bp, Homo sapien
gcccaagatttgactccggttctca

SEQ ID NO: 515003 - DNA, 25 bp, Homo sapien
ctttctccataccagggcctaagtc

SEQ ID NO: 515004 - DNA, 25 bp, Homo sapien
taccagggcctaagtccgccttact

SEQ ID NO: 515005 - DNA, 25 bp, Homo sapien
tactcctctcctccatgtacttgaa

SEQ ID NO: 515006 - DNA, 25 bp, Homo sapien
tgtcctgtccaatgcgggggcactg

SEQ ID NO: 515007 - DNA, 25 bp, Homo sapien
gggcactgcagaactctctagaaat

SEQ ID NO: 515008 - DNA, 25 bp, Homo sapien
gcagaactctctagaaatgtcatga

SEQ ID NO: 515009 - DNA, 25 bp, Homo sapien
aatgtcatgattgagcttcagagct

SEQ ID NO: 515010 - DNA, 25 bp, Homo sapien
gagcttcagagctaaaatgccttca

SEQ ID NO: 515011 - DNA, 25 bp, Homo sapien
tcagagctaaaatgccttcaccctt

SEQ ID NO: 515012 - DNA, 25 bp, Homo sapien
ctgttagttttgtggcttactgctg

SEQ ID NO: 515013 - DNA, 25 bp, Homo sapien
ttagttttgtggcttactgctgctc

SEQ ID NO: 515014 - DNA, 25 bp, Homo sapien
agttttgtggcttactgctgctcca

SEQ ID NO: 515015 - DNA, 25 bp, Homo sapien
tgctgctccacccagtgtctgcaga

SEQ ID NO: 515016 - DNA, 25 bp, Homo sapien
acccagtgtctgcagacttttgacc

SEQ ID NO: 515017 - DNA, 25 bp, Homo sapien
tgtgggagggccgctgaccttccct

SEQ ID NO: 515018 - DNA, 25 bp, Homo sapien
tgagcacggtccctcggcagatgtt

SEQ ID NO: 515019 - DNA, 25 bp, Homo sapien
ggtccctcggcagatgttcagcgat

SEQ ID NO: 515020 - DNA, 25 bp, Homo sapien
cctcggcagatgttcagcgatgcag

SEQ ID NO: 515021 - DNA, 25 bp, Homo sapien
cagatgttcagcgatgcaggtagcg

SEQ ID NO: 515022 - DNA, 25 bp, Homo sapien
ccttggatggagacgatgacctggt

SEQ ID NO: 515023 - DNA, 25 bp, Homo sapien
atgacctggtgatcgacatcccgga

SEQ ID NO: 515024 - DNA, 25 bp, Homo sapien
ctggtgatcgacatcccggagtgac

SEQ ID NO: 515025 - DNA, 25 bp, Homo sapien
gacatcccggagtgaccgtgacatc

SEQ ID NO: 515026 - DNA, 25 bp, Homo sapien
ggagtgaccgtgacatcacgccatg

SEQ ID NO: 515027 - DNA, 25 bp, Homo sapien
gtgccagcacacacgagtccagctt

SEQ ID NO: 515028 - DNA, 25 bp, Homo sapien
gatctgggatttggaagacctggct

SEQ ID NO: 515029 - DNA, 25 bp, Homo sapien
aagacctggcttctagctgctacta

SEQ ID NO: 515030 - DNA, 25 bp, Homo sapien
ctagctgctactaaccaactctgtg

SEQ ID NO: 515031 - DNA, 25 bp, Homo sapien
tctgtaacatgaggacaccggacta

SEQ ID NO: 515032 - DNA, 25 bp, Homo sapien
ggacaccggactatttgaattcaga

SEQ ID NO: 515033 - DNA, 25 bp, Homo sapien
gaccttaaagccctctaagaaagag

SEQ ID NO: 515034 - DNA, 25 bp, Homo sapien
aaagagttcgggaatgttctccatt

SEQ ID NO: 515035 - DNA, 25 bp, Homo sapien
tgttctccattgctgtcagttttcc

SEQ ID NO: 515036 - DNA, 25 bp, Homo sapien
tcctccaaaaataacctggcttgga

SEQ ID NO: 515037 - DNA, 25 bp, Homo sapien
acctggcttggaagttattggtcca

SEQ ID NO: 515038 - DNA, 25 bp, Homo sapien
ggtccagtgggaatttgattcccca

SEQ ID NO: 515039 - DNA, 25 bp, Homo sapien
tttaaaagaggaatgcggagaggac

SEQ ID NO: 515040 - DNA, 25 bp, Homo sapien
gtcagggtctctgggcaacgtccat

SEQ ID NO: 515041 - DNA, 25 bp, Homo sapien
tctgggcaacgtccattcagggtgc

SEQ ID NO: 515042 - DNA, 25 bp, Homo sapien
caacgtccattcagggtgcggcatg

SEQ ID NO: 515043 - DNA, 25 bp, Homo sapien
tccattcagggtgcggcatggctgt

SEQ ID NO: 515044 - DNA, 25 bp, Homo sapien
ggctgtcacaaagctttatttgagc

SEQ ID NO: 515045 - DNA, 25 bp, Homo sapien
ttttcactttaggagacttctacaa

SEQ ID NO: 515046 - DNA, 25 bp, Homo sapien
ttaggagacttctacaagtttgttt

SEQ ID NO: 515047 - DNA, 25 bp, Homo sapien
gtgtgtgtgatgtgctgtttattta

SEQ ID NO: 515048 - DNA, 25 bp, Homo sapien
gtttatttatcagcttgaggtccat

SEQ ID NO: 515049 - DNA, 25 bp, Homo sapien
tatttatcagcttgaggtccatggg

SEQ ID NO: 515050 - DNA, 25 bp, Homo sapien
ccagggacctgtggtaagctaatga

SEQ ID NO: 515051 - DNA, 25 bp, Homo sapien
acctgtggtaagctaatgagatcaa

SEQ ID NO: 515052 - DNA, 25 bp, Homo sapien
gagatcaagaactggctccataagg

SEQ ID NO: 515053 - DNA, 25 bp, Homo sapien
atcaagaactggctccataaggtgg

SEQ ID NO: 515054 - DNA, 25 bp, Homo sapien
aatggaggagtgattgcaaagctct

SEQ ID NO: 515055 - DNA, 25 bp, Homo sapien
gtgattgcaaagctctggagagttt

SEQ ID NO: 515056 - DNA, 25 bp, Homo sapien
gtgcccaattccaagagggaaaaga

SEQ ID NO: 515057 - DNA, 25 bp, Homo sapien
agagatgtaaaccatcgacgtttga

SEQ ID NO: 515058 - DNA, 25 bp, Homo sapien
tcgacgtttgagaggcgtgatcgcc

SEQ ID NO: 515059 - DNA, 25 bp, Homo sapien
tgagaggcgtgatcgcctgattcct

SEQ ID NO: 515060 - DNA, 25 bp, Homo sapien
ccaccagtttcttcccaggttgaca

SEQ ID NO: 515061 - DNA, 25 bp, Homo sapien
tattgcatttatgattcagtggctg

SEQ ID NO: 515062 - DNA, 25 bp, Homo sapien
tcagtggctgggaattgagaattta

SEQ ID NO: 515063 - DNA, 25 bp, Homo sapien
gcgtactatagaaaatgcactcagc

SEQ ID NO: 515064 - DNA, 25 bp, Homo sapien
aaatgcactcagctcaactgctgtg

SEQ ID NO: 515065 - DNA, 25 bp, Homo sapien
gcactcagctcaactgctgtgttta

SEQ ID NO: 515066 - DNA, 25 bp, Homo sapien
agctcaactgctgtgtttaaaatac

SEQ ID NO: 515067 - DNA, 25 bp, Homo sapien
cattttaaatccctctttacagaca

SEQ ID NO: 515068 - DNA, 25 bp, Homo sapien
aaatccctctttacagacactaaca

SEQ ID NO: 515069 - DNA, 25 bp, Homo sapien
gacactaacataaaagtacatcttt

SEQ ID NO: 515070 - DNA, 25 bp, Homo sapien
ggttgtaaacatgtggtagtaccag

SEQ ID NO: 515071 - DNA, 25 bp, Homo sapien
gtagtaccagagtattgtatagtca

SEQ ID NO: 515072 - DNA, 25 bp, Homo sapien
ctggatacggcgctgtctatagcaa

SEQ ID NO: 515073 - DNA, 25 bp, Homo sapien
gatacggcgctgtctatagcaagtt

SEQ ID NO: 515074 - DNA, 25 bp, Homo sapien
gcgctgtctatagcaagttggccag

SEQ ID NO: 515075 - DNA, 25 bp, Homo sapien
tctatagcaagttggccagtctggc

SEQ ID NO: 515076 - DNA, 25 bp, Homo sapien
aagttggccagtctggcctcctgtt

SEQ ID NO: 515077 - DNA, 25 bp, Homo sapien
ctcctgttcctctgctggacctggg

SEQ ID NO: 515078 - DNA, 25 bp, Homo sapien
ggcagaagcccctcttaaattgtgg

SEQ ID NO: 515079 - DNA, 25 bp, Homo sapien
ccctcttaaattgtggttgccatgg

SEQ ID NO: 515080 - DNA, 25 bp, Homo sapien
taaattgtggttgccatggtaccga

SEQ ID NO: 515081 - DNA, 25 bp, Homo sapien
gttgccatggtaccgagggactcat

SEQ ID NO: 515082 - DNA, 25 bp, Homo sapien
tgtgactcccacatcaaccattaaa

SEQ ID NO: 515083 - DNA, 25 bp, Homo sapien
gtaggctcagagaaattaagcagct

SEQ ID NO: 515084 - DNA, 25 bp, Homo sapien
aattaagcagctttcccaacttcac

SEQ ID NO: 515085 - DNA, 25 bp, Homo sapien
gcagctttcccaacttcacacagtg

SEQ ID NO: 515086 - DNA, 25 bp, Homo sapien
agtaagtacatctatctgaccccag

SEQ ID NO: 515087 - DNA, 25 bp, Homo sapien
agtacatctatctgaccccagagtt

SEQ ID NO: 515088 - DNA, 25 bp, Homo sapien
tgaccccagagttacccttttctat

SEQ ID NO: 515089 - DNA, 25 bp, Homo sapien
agagttacccttttctatcatgccc

SEQ ID NO: 515090 - DNA, 25 bp, Homo sapien
atcatgcccccgtaggatattgcct

SEQ ID NO: 515091 - DNA, 25 bp, Homo sapien
gggacacctgacaacagaaagtcta

SEQ ID NO: 515092 - DNA, 25 bp, Homo sapien
gtctaaggttttcatctaggattgg

SEQ ID NO: 515093 - DNA, 25 bp, Homo sapien
ttcatctaggattgggagttacccc

SEQ ID NO: 515094 - DNA, 25 bp, Homo sapien
ctggatacggcgctgtctatagcaa

SEQ ID NO: 515095 - DNA, 25 bp, Homo sapien
gatacggcgctgtctatagcaagtt

SEQ ID NO: 515096 - DNA, 25 bp, Homo sapien
acggcgctgtctatagcaagttggc

SEQ ID NO: 515097 - DNA, 25 bp, Homo sapien
gcgctgtctatagcaagttggccag

SEQ ID NO: 515098 - DNA, 25 bp, Homo sapien
gctgtctatagcaagttggccagtc

SEQ ID NO: 515099 - DNA, 25 bp, Homo sapien
gtctatagcaagttggccagtctgg

SEQ ID NO: 515100 - DNA, 25 bp, Homo sapien
ctatagcaagttggccagtctggcc

SEQ ID NO: 515101 - DNA, 25 bp, Homo sapien
tcctgttcctctgctggacctgggg

SEQ ID NO: 515102 - DNA, 25 bp, Homo sapien
ccctcttaaattgtggttgccatgg

SEQ ID NO: 515103 - DNA, 25 bp, Homo sapien
taaattgtggttgccatggtaccga

SEQ ID NO: 515104 - DNA, 25 bp, Homo sapien
attgtggttgccatggtaccgaggg

SEQ ID NO: 515105 - DNA, 25 bp, Homo sapien
aagtggtagacatgaagggcaggta

SEQ ID NO: 515106 - DNA, 25 bp, Homo sapien
gggaacagaaaatgtctccttgcag

SEQ ID NO: 515107 - DNA, 25 bp, Homo sapien
tatatattttaaacgaactgtgtaa

SEQ ID NO: 515108 - DNA, 25 bp, Homo sapien
gtaataagtatgagctaaggagaca

SEQ ID NO: 515109 - DNA, 25 bp, Homo sapien
gggcaaaatgaatgcaatccttcat

SEQ ID NO: 515110 - DNA, 25 bp, Homo sapien
atgcaatccttcatttgataagaga

SEQ ID NO: 515111 - DNA, 25 bp, Homo sapien
aatccttcatttgataagagagaac

SEQ ID NO: 515112 - DNA, 25 bp, Homo sapien
ctgttctctgtatcttaaatcaact

SEQ ID NO: 515113 - DNA, 25 bp, Homo sapien
ctctgtatcttaaatcaactctgtg

SEQ ID NO: 515114 - DNA, 25 bp, Homo sapien
tgtgccaaagcagttctgtcccctg

SEQ ID NO: 515115 - DNA, 25 bp, Homo sapien
gccaaagcagttctgtcccctgact

SEQ ID NO: 515116 - DNA, 25 bp, Homo sapien
ttgccagatcccgtagatgagggac

SEQ ID NO: 515117 - DNA, 25 bp, Homo sapien
cgtagatgagggactgttttgctga

SEQ ID NO: 515118 - DNA, 25 bp, Homo sapien
aaacaaaagtgaagcagaggccagc

SEQ ID NO: 515119 - DNA, 25 bp, Homo sapien
gctgctctgggtcaagccgaggttt

SEQ ID NO: 515120 - DNA, 25 bp, Homo sapien
agcatcactgacatgagggttggca

SEQ ID NO: 515121 - DNA, 25 bp, Homo sapien
gcagcactgccatctaaaccataga

SEQ ID NO: 515122 - DNA, 25 bp, Homo sapien
caaagtaatcactaattttatgtcc

SEQ ID NO: 515123 - DNA, 25 bp, Homo sapien
taggagtgcctttcccttggctagt

SEQ ID NO: 515124 - DNA, 25 bp, Homo sapien
ctttcccttggctagtttcatatgg

SEQ ID NO: 515125 - DNA, 25 bp, Homo sapien
gtttcatatggttcagcttttcttt

SEQ ID NO: 515126 - DNA, 25 bp, Homo sapien
cagcttttcttttccgatttcgctg

SEQ ID NO: 515127 - DNA, 25 bp, Homo sapien
gtaaaacgtataggtcaacagaaat

SEQ ID NO: 515128 - DNA, 25 bp, Homo sapien
tcttttttgaaagcagacagaagca

SEQ ID NO: 515129 - DNA, 25 bp, Homo sapien
agacagaagcaaggctagtatagta

SEQ ID NO: 515130 - DNA, 25 bp, Homo sapien
aggctagtatagtatgaatggtcag

SEQ ID NO: 515131 - DNA, 25 bp, Homo sapien
atagtatgaatggtcaggtagttta

SEQ ID NO: 515132 - DNA, 25 bp, Homo sapien
caggtagtttaaatgcgttgtccca

SEQ ID NO: 515133 - DNA, 25 bp, Homo sapien
ggtagtttaaatgcgttgtcccacg

SEQ ID NO: 515134 - DNA, 25 bp, Homo sapien
tagtttaaatgcgttgtcccacgtg

SEQ ID NO: 515135 - DNA, 25 bp, Homo sapien
agtttaaatgcgttgtcccacgtgg

SEQ ID NO: 515136 - DNA, 25 bp, Homo sapien
ctgtaattttcttcacagttaaaat

SEQ ID NO: 515137 - DNA, 25 bp, Homo sapien
ttcttcacagttaaaatatcctaat

SEQ ID NO: 515138 - DNA, 25 bp, Homo sapien
tgtgtcctctcagtgctcactcaag

SEQ ID NO: 515139 - DNA, 25 bp, Homo sapien
tgtcctctcagtgctcactcaagtt

SEQ ID NO: 515140 - DNA, 25 bp, Homo sapien
tgctcactcaagttccgtatttcca

SEQ ID NO: 515141 - DNA, 25 bp, Homo sapien
ctcactcaagttccgtatttccaag

SEQ ID NO: 515142 - DNA, 25 bp, Homo sapien
cactcaagttccgtatttccaagtc

SEQ ID NO: 515143 - DNA, 25 bp, Homo sapien
ggcgtaacgcacgtgagaactgcca

SEQ ID NO: 515144 - DNA, 25 bp, Homo sapien
gtaacgcacgtgagaactgccattt

SEQ ID NO: 515145 - DNA, 25 bp, Homo sapien
acgcacgtgagaactgccatttctg

SEQ ID NO: 515146 - DNA, 25 bp, Homo sapien
gaactgccatttctgtcacagatac

SEQ ID NO: 515147 - DNA, 25 bp, Homo sapien
catttctgtcacagatacgtggccg

SEQ ID NO: 515148 - DNA, 25 bp, Homo sapien
atggctgcgggaggagtgactcctc

SEQ ID NO: 515149 - DNA, 25 bp, Homo sapien
gatgaaatagcctcctttaacgttt

SEQ ID NO: 515150 - DNA, 25 bp, Homo sapien
ttctgggtgccaagggaggcccatt

SEQ ID NO: 515151 - DNA, 25 bp, Homo sapien
aagggaggcccattcctctaacatt

SEQ ID NO: 515152 - DNA, 25 bp, Homo sapien
cccattcctctaacattctcataat

SEQ ID NO: 515153 - DNA, 25 bp, Homo sapien
tttctcaaaggcctatgatctaaac

SEQ ID NO: 515154 - DNA, 25 bp, Homo sapien
tgatctaaacatttcaccacggcat

SEQ ID NO: 515155 - DNA, 25 bp, Homo sapien
acggcatccactcagctgtgaggct

SEQ ID NO: 515156 - DNA, 25 bp, Homo sapien
tgtgaggctgcgtacacagtctcca

SEQ ID NO: 515157 - DNA, 25 bp, Homo sapien
ctccacctctgaaatctgaacttcg

SEQ ID NO: 515158 - DNA, 25 bp, Homo sapien
tgaacttcgtttaccagtggtgctg

SEQ ID NO: 515159 - DNA, 25 bp, Homo sapien
gtggtgctgtttgaacttcataatg

SEQ ID NO: 515160 - DNA, 25 bp, Homo sapien
tgaaatagcccagttgttcagggtc

SEQ ID NO: 515161 - DNA, 25 bp, Homo sapien
tagcccagttgttcagggtcacttc

SEQ ID NO: 515162 - DNA, 25 bp, Homo sapien
cccagttgttcagggtcacttctat

SEQ ID NO: 515163 - DNA, 25 bp, Homo sapien
gactgcatgcccagggtcagtagtc

SEQ ID NO: 515164 - DNA, 25 bp, Homo sapien
gcatgcccagggtcagtagtcagca

SEQ ID NO: 515165 - DNA, 25 bp, Homo sapien
tgcccagggtcagtagtcagcagag

SEQ ID NO: 515166 - DNA, 25 bp, Homo sapien
gattcttcagaggtcagccaagtcg

SEQ ID NO: 515167 - DNA, 25 bp, Homo sapien
tcttcagaggtcagccaagtcggta

SEQ ID NO: 515168 - DNA, 25 bp, Homo sapien
aggtcagccaagtcggtaacattct

SEQ ID NO: 515169 - DNA, 25 bp, Homo sapien
agccaagtcggtaacattctgtgaa

SEQ ID NO: 515170 - DNA, 25 bp, Homo sapien
agtcggtaacattctgtgaagcaga

SEQ ID NO: 515171 - DNA, 25 bp, Homo sapien
agcgctacgggaagctgaagcccca

SEQ ID NO: 515172 - DNA, 25 bp, Homo sapien
gctacgggaagctgaagccccaggt

SEQ ID NO: 515173 - DNA, 25 bp, Homo sapien
tacgggaagctgaagccccaggtcc

SEQ ID NO: 515174 - DNA, 25 bp, Homo sapien
agccaggacaacgtgtcgctgacca

SEQ ID NO: 515175 - DNA, 25 bp, Homo sapien
aggacaacgtgtcgctgaccagcac

SEQ ID NO: 515176 - DNA, 25 bp, Homo sapien
aacgtgtcgctgaccagcaccgaga

SEQ ID NO: 515177 - DNA, 25 bp, Homo sapien
gtgtcgctgaccagcaccgagacgc

SEQ ID NO: 515178 - DNA, 25 bp, Homo sapien
agctgggcatgcagaagatcataga

SEQ ID NO: 515179 - DNA, 25 bp, Homo sapien
tgggcatgcagaagatcatagaccc

SEQ ID NO: 515180 - DNA, 25 bp, Homo sapien
tgcagaagatcatagaccccctggc

SEQ ID NO: 515181 - DNA, 25 bp, Homo sapien
gcagatgacactgcggaaggcctga

SEQ ID NO: 515182 - DNA, 25 bp, Homo sapien
gggagccagcgtcccagcctaatca

SEQ ID NO: 515183 - DNA, 25 bp, Homo sapien
tcccagcctaatcacggatctgctg

SEQ ID NO: 515184 - DNA, 25 bp, Homo sapien
taatcacggatctgctgcctcccag

SEQ ID NO: 515185 - DNA, 25 bp, Homo sapien
tgctcagccttgtgccagccagact

SEQ ID NO: 515186 - DNA, 25 bp, Homo sapien
ttgtgccagccagactcgtatgagg

SEQ ID NO: 515187 - DNA, 25 bp, Homo sapien
tgccagccagactcgtatgaggctc

SEQ ID NO: 515188 - DNA, 25 bp, Homo sapien
catcctaagctccaagcatgtctgg

SEQ ID NO: 515189 - DNA, 25 bp, Homo sapien
taagctccaagcatgtctgggccag

SEQ ID NO: 515190 - DNA, 25 bp, Homo sapien
aagctccaagcatgtctgggccagg

SEQ ID NO: 515191 - DNA, 25 bp, Homo sapien
cagaggtgctcctcatccatgacac

SEQ ID NO: 515192 - DNA, 25 bp, Homo sapien
caccaccagtctgaatggtcctggg

SEQ ID NO: 515193 - DNA, 25 bp, Homo sapien
aggtataaatttcagctgctctcag

SEQ ID NO: 515194 - DNA, 25 bp, Homo sapien
tccaaagccttccaacagcaacatg

SEQ ID NO: 515195 - DNA, 25 bp, Homo sapien
gcaacatgaagttggcagccttcct

SEQ ID NO: 515196 - DNA, 25 bp, Homo sapien
ctcctgtgatcctcatcatcttcag

SEQ ID NO: 515197 - DNA, 25 bp, Homo sapien
tacacagggtgggtggctattctcc

SEQ ID NO: 515198 - DNA, 25 bp, Homo sapien
gagaccggcttttgggtacctgcgt

SEQ ID NO: 515199 - DNA, 25 bp, Homo sapien
ttttgggtacctgcgtcgagctctg

SEQ ID NO: 515200 - DNA, 25 bp, Homo sapien
ctgcgtcgagctctgcacaggtgac

SEQ ID NO: 515201 - DNA, 25 bp, Homo sapien
gggtgggtggctattctccagaaat

SEQ ID NO: 515202 - DNA, 25 bp, Homo sapien
aatgtcagtttctgggcagggctta

SEQ ID NO: 515203 - DNA, 25 bp, Homo sapien
agggcttaggtgtctgcagtcccta

SEQ ID NO: 515204 - DNA, 25 bp, Homo sapien
cattcatccctgtttccgtggctat

SEQ ID NO: 515205 - DNA, 25 bp, Homo sapien
gtttccgtggctatcttgactttcg

SEQ ID NO: 515206 - DNA, 25 bp, Homo sapien
tgaaaagtgaggttaggccctgttt

SEQ ID NO: 515207 - DNA, 25 bp, Homo sapien
gcgccatcacactctagtggcctgg

SEQ ID NO: 515208 - DNA, 25 bp, Homo sapien
cagccccagaggtcggccgctgtag

SEQ ID NO: 515209 - DNA, 25 bp, Homo sapien
attcatattggctcaccttgtcggt

SEQ ID NO: 515210 - DNA, 25 bp, Homo sapien
tcaccttgtcggtgcccggttcggt

SEQ ID NO: 515211 - DNA, 25 bp, Homo sapien
ggttcggtcctcttggagctcacac

SEQ ID NO: 515212 - DNA, 25 bp, Homo sapien
ggagctcacactccagttgaggaaa

SEQ ID NO: 515213 - DNA, 25 bp, Homo sapien
atggacacaggaactactgggtaac

SEQ ID NO: 515214 - DNA, 25 bp, Homo sapien
gggctgcgattgtgtgagtttctac

SEQ ID NO: 515215 - DNA, 25 bp, Homo sapien
cgtcctgcaagactctttggcagtt

SEQ ID NO: 515216 - DNA, 25 bp, Homo sapien
tctttggcagttgcactgggtactg

SEQ ID NO: 515217 - DNA, 25 bp, Homo sapien
gttgcactgggtactggctgagttc

SEQ ID NO: 515218 - DNA, 25 bp, Homo sapien
actggctgagttctggaaaacagga

SEQ ID NO: 515219 - DNA, 25 bp, Homo sapien
gtgagcagagtgctgcagatctcct

SEQ ID NO: 515220 - DNA, 25 bp, Homo sapien
agcagagtgctgcagatctccttgt

SEQ ID NO: 515221 - DNA, 25 bp, Homo sapien
agtgctgcagatctccttgtcagga

SEQ ID NO: 515222 - DNA, 25 bp, Homo sapien
gatctccttgtcaggagcacctaag

SEQ ID NO: 515223 - DNA, 25 bp, Homo sapien
gtcaggagcacctaagaactggcat

SEQ ID NO: 515224 - DNA, 25 bp, Homo sapien
gcacctaagaactggcatgactcta

SEQ ID NO: 515225 - DNA, 25 bp, Homo sapien
aagaactggcatgactctacaccct

SEQ ID NO: 515226 - DNA, 25 bp, Homo sapien
tgatcacatggagggcctagagcat

SEQ ID NO: 515227 - DNA, 25 bp, Homo sapien
ggagggcctagagcatgttgaaaaa

SEQ ID NO: 515228 - DNA, 25 bp, Homo sapien
aaaaaataaggctgtgcaagtgtca

SEQ ID NO: 515229 - DNA, 25 bp, Homo sapien
gtgcaagtgtcattatatcgaggat

SEQ ID NO: 515230 - DNA, 25 bp, Homo sapien
atcgaggatgactgtttgctgagac

SEQ ID NO: 515231 - DNA, 25 bp, Homo sapien
ggatgactgtttgctgagacttagt

SEQ ID NO: 515232 - DNA, 25 bp, Homo sapien
atggaaataatatcctgtgggaata

SEQ ID NO: 515233 - DNA, 25 bp, Homo sapien
gggaatatcacagacaaaggcatca

SEQ ID NO: 515234 - DNA, 25 bp, Homo sapien
aaaggcatcattgctttgcgtcatt

SEQ ID NO: 515235 - DNA, 25 bp, Homo sapien
ggcatcattgctttgcgtcatttaa

SEQ ID NO: 515236 - DNA, 25 bp, Homo sapien
gctttgcgtcatttaagaaacctca

SEQ ID NO: 515237 - DNA, 25 bp, Homo sapien
acactggtggttctactgacccaac

SEQ ID NO: 515238 - DNA, 25 bp, Homo sapien
cactggtggttctactgacccaact

SEQ ID NO: 515239 - DNA, 25 bp, Homo sapien
actggtggttctactgacccaactg

SEQ ID NO: 515240 - DNA, 25 bp, Homo sapien
ctggtggttctactgacccaactgg

SEQ ID NO: 515241 - DNA, 25 bp, Homo sapien
tggtggttctactgacccaactggg

SEQ ID NO: 515242 - DNA, 25 bp, Homo sapien
cttgaggaagcccaggctcggagga

SEQ ID NO: 515243 - DNA, 25 bp, Homo sapien
accctggaaaacagacgggtctgag

SEQ ID NO: 515244 - DNA, 25 bp, Homo sapien
aacagacgggtctgagactgaaaat

SEQ ID NO: 515245 - DNA, 25 bp, Homo sapien
cgggtctgagactgaaaatggttta

SEQ ID NO: 515246 - DNA, 25 bp, Homo sapien
gggtctgagactgaaaatggtttac

SEQ ID NO: 515247 - DNA, 25 bp, Homo sapien
ggtctgagactgaaaatggtttacc

SEQ ID NO: 515248 - DNA, 25 bp, Homo sapien
gtcagagcagaattataaggcattt

SEQ ID NO: 515249 - DNA, 25 bp, Homo sapien
ctttatattctttgtccgcacgtat

SEQ ID NO: 515250 - DNA, 25 bp, Homo sapien
tctttgtccgcacgtatatagatgt

SEQ ID NO: 515251 - DNA, 25 bp, Homo sapien
atgggaatcccatctatctcagaga

SEQ ID NO: 515252 - DNA, 25 bp, Homo sapien
gatacataacatttaacacggttgc

SEQ ID NO: 515253 - DNA, 25 bp, Homo sapien
gatttgttaacttaatgtcacatca

SEQ ID NO: 515254 - DNA, 25 bp, Homo sapien
tatctcagagaaatcaccgcacagt

SEQ ID NO: 515255 - DNA, 25 bp, Homo sapien
aaatcaccgcacagtgtctgagcta

SEQ ID NO: 515256 - DNA, 25 bp, Homo sapien
gcacagtgtctgagctatttatttt

SEQ ID NO: 515257 - DNA, 25 bp, Homo sapien
tgagctatttattttcaaccagata

SEQ ID NO: 515258 - DNA, 25 bp, Homo sapien
ccttgaaaagcagtgtcagagcaga

SEQ ID NO: 515259 - DNA, 25 bp, Homo sapien
aggctatagagattaattcagtgtc

SEQ ID NO: 515260 - DNA, 25 bp, Homo sapien
attcagtgtctaacatttgtattta

SEQ ID NO: 515261 - DNA, 25 bp, Homo sapien
attgacctatgatgactttctagtc

SEQ ID NO: 515262 - DNA, 25 bp, Homo sapien
gtggttcttaataggttcactgaat

SEQ ID NO: 515263 - DNA, 25 bp, Homo sapien
aatgcacagttgaggcacttcttgt

SEQ ID NO: 515264 - DNA, 25 bp, Homo sapien
tgaggcacttcttgtgacaccagtt

SEQ ID NO: 515265 - DNA, 25 bp, Homo sapien
acaccagttcccaagtagcgttaat

SEQ ID NO: 515266 - DNA, 25 bp, Homo sapien
agcgttaataattgggcctgtgtca

SEQ ID NO: 515267 - DNA, 25 bp, Homo sapien
gtgtcataaaatgcacggatcatta

SEQ ID NO: 515268 - DNA, 25 bp, Homo sapien
attaataactaaatgtccctgacac

SEQ ID NO: 515269 - DNA, 25 bp, Homo sapien
atgtccctgacacttttcactacag

SEQ ID NO: 515270 - DNA, 25 bp, Homo sapien
tgtgctggcccggaagaaacaccgt

SEQ ID NO: 515271 - DNA, 25 bp, Homo sapien
ggaagaaacaccgtcggcggccatc

SEQ ID NO: 515272 - DNA, 25 bp, Homo sapien
cgtcggcggccatcgaagcgcaaaa

SEQ ID NO: 515273 - DNA, 25 bp, Homo sapien
aagcgcaaaaggcactggcgaccct

SEQ ID NO: 515274 - DNA, 25 bp, Homo sapien
cactggcgaccctacctggagctga

SEQ ID NO: 515275 - DNA, 25 bp, Homo sapien
gggaacgcttccacaccgagagcct

SEQ ID NO: 515276 - DNA, 25 bp, Homo sapien
acaccgagagcctgcagggccgcag

SEQ ID NO: 515277 - DNA, 25 bp, Homo sapien
agctggtgcgagactacctggagct

SEQ ID NO: 515278 - DNA, 25 bp, Homo sapien
ctgcaggcgtgcaccggccagcagt

SEQ ID NO: 515279 - DNA, 25 bp, Homo sapien
ctgccgaggtccagaggctccggac

SEQ ID NO: 515280 - DNA, 25 bp, Homo sapien
aaccagcggcttcgtcaggagaacc

SEQ ID NO: 515281 - DNA, 25 bp, Homo sapien
gcccagaagccgcaatatgacattt

SEQ ID NO: 515282 - DNA, 25 bp, Homo sapien
ccagccgcatggagagtacaggagt

SEQ ID NO: 515283 - DNA, 25 bp, Homo sapien
ggagtccttggcaaaatccaagtga

SEQ ID NO: 515284 - DNA, 25 bp, Homo sapien
atccaagtgactgaggagacagcat

SEQ ID NO: 515285 - DNA, 25 bp, Homo sapien
gtgaaaggcaaagggcagctctgca

SEQ ID NO: 515286 - DNA, 25 bp, Homo sapien
acctacttcctgaacacagacttga

SEQ ID NO: 515287 - DNA, 25 bp, Homo sapien
agacttgacacgaactggacctcct

SEQ ID NO: 515288 - DNA, 25 bp, Homo sapien
acacgaactggacctccttcagcta

SEQ ID NO: 515289 - DNA, 25 bp, Homo sapien
agctaccctaggctgagattgcact

SEQ ID NO: 515290 - DNA, 25 bp, Homo sapien
tgagattgcactcgccttctaagaa

SEQ ID NO: 515291 - DNA, 25 bp, Homo sapien
actcgccttctaagaacctcaataa

SEQ ID NO: 515292 - DNA, 25 bp, Homo sapien
tgggcggcttctttaaatccagccc

SEQ ID NO: 515293 - DNA, 25 bp, Homo sapien
gaagcagtgaaaccccttggctagt

SEQ ID NO: 515294 - DNA, 25 bp, Homo sapien
aaaccccttggctagtccagctgga

SEQ ID NO: 515295 - DNA, 25 bp, Homo sapien
tcggccttcgctccacagtggagag

SEQ ID NO: 515296 - DNA, 25 bp, Homo sapien
ctccacagtggagagtgggagccta

SEQ ID NO: 515297 - DNA, 25 bp, Homo sapien
ggagcctagctgtgcttgatgctga

SEQ ID NO: 515298 - DNA, 25 bp, Homo sapien
tgctgaatgcctgttttgagagtgt

SEQ ID NO: 515299 - DNA, 25 bp, Homo sapien
gtgagtgggatcatctacagtaaat

SEQ ID NO: 515300 - DNA, 25 bp, Homo sapien
tacttgcaaagcatggcactgtggc

SEQ ID NO: 515301 - DNA, 25 bp, Homo sapien
acgcctgtgctgtaaccatggtact

SEQ ID NO: 515302 - DNA, 25 bp, Homo sapien
atggtactcagtccttccaaagtgt

SEQ ID NO: 515303 - DNA, 25 bp, Homo sapien
gaatgtgtttctccaggaagttttc

SEQ ID NO: 515304 - DNA, 25 bp, Homo sapien
tccaggaagttttcccggcgatatc

SEQ ID NO: 515305 - DNA, 25 bp, Homo sapien
ttcccggcgatatcatagctgctga

SEQ ID NO: 515306 - DNA, 25 bp, Homo sapien
ttcttgctttgccatcaacactttg

SEQ ID NO: 515307 - DNA, 25 bp, Homo sapien
accatcctgccatctaaaaatgtga

SEQ ID NO: 515308 - DNA, 25 bp, Homo sapien
gaacacatcgtcaataaatcacctg

SEQ ID NO: 515309 - DNA, 25 bp, Homo sapien
atctcaggcgctacttctggcaagg

SEQ ID NO: 515310 - DNA, 25 bp, Homo sapien
tctggcaaggcatatcatgaggcta

SEQ ID NO: 515311 - DNA, 25 bp, Homo sapien
atgaggctagtgaagcacctacaag

SEQ ID NO: 515312 - DNA, 25 bp, Homo sapien
aaatggcatggtgactcttacaatc

SEQ ID NO: 515313 - DNA, 25 bp, Homo sapien
tcttacaatcatatcacagtgggcc

SEQ ID NO: 515314 - DNA, 25 bp, Homo sapien
tcaccggacgttcggttgagaaaga

SEQ ID NO: 515315 - DNA, 25 bp, Homo sapien
gcaaggcactgaggaaagttctgga

SEQ ID NO: 515316 - DNA, 25 bp, Homo sapien
gaaagttctggagcagaaaagcctt

SEQ ID NO: 515317 - DNA, 25 bp, Homo sapien
aaataacttgggaacctgctagagg

SEQ ID NO: 515318 - DNA, 25 bp, Homo sapien
taacttgggaacctgctagaggaaa

SEQ ID NO: 515319 - DNA, 25 bp, Homo sapien
gtatgacttgaaatcacattactta

SEQ ID NO: 515320 - DNA, 25 bp, Homo sapien
ttataaactggattttaatctgcca

SEQ ID NO: 515321 - DNA, 25 bp, Homo sapien
tggattttaatctgccagtaagttt

SEQ ID NO: 515322 - DNA, 25 bp, Homo sapien
tgctttaatccaccatcctgttcac

SEQ ID NO: 515323 - DNA, 25 bp, Homo sapien
ttaatccaccatcctgttcaccgga

SEQ ID NO: 515324 - DNA, 25 bp, Homo sapien
ctgttcaccggacgttcggttgaga

SEQ ID NO: 515325 - DNA, 25 bp, Homo sapien
aaaaatctgcttgttctattctgag

SEQ ID NO: 515326 - DNA, 25 bp, Homo sapien
gagttctctgagatatcccttcact

SEQ ID NO: 515327 - DNA, 25 bp, Homo sapien
atatcccttcactctgcttggcatt

SEQ ID NO: 515328 - DNA, 25 bp, Homo sapien
tggcatttggccattgatattcaac

SEQ ID NO: 515329 - DNA, 25 bp, Homo sapien
aggtcactgaccaagcttttctaaa

SEQ ID NO: 515330 - DNA, 25 bp, Homo sapien
gttacttaccaataaggtctgttct

SEQ ID NO: 515331 - DNA, 25 bp, Homo sapien
tgttcttaaacctacctagttgatt

SEQ ID NO: 515332 - DNA, 25 bp, Homo sapien
gtgtcatgattctatcatagaccct

SEQ ID NO: 515333 - DNA, 25 bp, Homo sapien
catagaccctgacttaacattgtaa

SEQ ID NO: 515334 - DNA, 25 bp, Homo sapien
tagcaaattaggacttcggcaggtt

SEQ ID NO: 515335 - DNA, 25 bp, Homo sapien
tcggcaggttttcctctcctaaact

SEQ ID NO: 515336 - DNA, 25 bp, Homo sapien
aagcccagggcttcagatctaagtt

SEQ ID NO: 515337 - DNA, 25 bp, Homo sapien
gatctaagttagtccaaaagctaaa

SEQ ID NO: 515338 - DNA, 25 bp, Homo sapien
aaagtcaagttgtaatgctaggcat

SEQ ID NO: 515339 - DNA, 25 bp, Homo sapien
gtaatgctaggcataagcactctat

SEQ ID NO: 515340 - DNA, 25 bp, Homo sapien
ggcataagcactctataatacatta

SEQ ID NO: 515341 - DNA, 25 bp, Homo sapien
atacattaaattataggccgagcaa

SEQ ID NO: 515342 - DNA, 25 bp, Homo sapien
ggccgagcaattagggaatgtttct

SEQ ID NO: 515343 - DNA, 25 bp, Homo sapien
attaaacttgtatttatgtcactaa

SEQ ID NO: 515344 - DNA, 25 bp, Homo sapien
aatgtgtctcatacatatgctgtac

SEQ ID NO: 515345 - DNA, 25 bp, Homo sapien
tatgctgtactaggcttcatcatgc

SEQ ID NO: 515346 - DNA, 25 bp, Homo sapien
ctaggcttcatcatgcatttctaaa

SEQ ID NO: 515347 - DNA, 25 bp, Homo sapien
tactcccaggttccctttatatgtt

SEQ ID NO: 515348 - DNA, 25 bp, Homo sapien
gggagtttcctgtagtgctgtttca

SEQ ID NO: 515349 - DNA, 25 bp, Homo sapien
gtttcctgtagtgctgtttcattag

SEQ ID NO: 515350 - DNA, 25 bp, Homo sapien
agtgctgtttcattagaggatttca

SEQ ID NO: 515351 - DNA, 25 bp, Homo sapien
attaaattccacagctaattcaata

SEQ ID NO: 515352 - DNA, 25 bp, Homo sapien
ataatggtacatttaagtgttctga

SEQ ID NO: 515353 - DNA, 25 bp, Homo sapien
atatatttcacatttatccacacag

SEQ ID NO: 515354 - DNA, 25 bp, Homo sapien
tcacatttatccacacagtaacaat

SEQ ID NO: 515355 - DNA, 25 bp, Homo sapien
ctggatgttccaatttagaactaaa

SEQ ID NO: 515356 - DNA, 25 bp, Homo sapien
aaagatattaatccctctactccca

SEQ ID NO: 515357 - DNA, 25 bp, Homo sapien
atattaatccctctactcccaggtt

SEQ ID NO: 515358 - DNA, 25 bp, Homo sapien
gaatgtcagacagtattattaccag

SEQ ID NO: 515359 - DNA, 25 bp, Homo sapien
ttacatacatgttcctaccaaggtg

SEQ ID NO: 515360 - DNA, 25 bp, Homo sapien
gaaagaaattcaaacctcatggtaa

SEQ ID NO: 515361 - DNA, 25 bp, Homo sapien
ctcatggtaaaacttaagcacgatt

SEQ ID NO: 515362 - DNA, 25 bp, Homo sapien
catagtatttcttcagtgtagactt

SEQ ID NO: 515363 - DNA, 25 bp, Homo sapien
tattaagtgccttattgaacaggat

SEQ ID NO: 515364 - DNA, 25 bp, Homo sapien
gaacaggatcttaacctgctttttc

SEQ ID NO: 515365 - DNA, 25 bp, Homo sapien
gcaattgttgaagcttctaaccaag

SEQ ID NO: 515366 - DNA, 25 bp, Homo sapien
gaattgggagacttggtcccctcgt

SEQ ID NO: 515367 - DNA, 25 bp, Homo sapien
ctcgttgtcagggttctggctataa

SEQ ID NO: 515368 - DNA, 25 bp, Homo sapien
ggttctggctataagtacctcccca

SEQ ID NO: 515369 - DNA, 25 bp, Homo sapien
gacattactgtaaattatctcatgg

SEQ ID NO: 515370 - DNA, 25 bp, Homo sapien
tttgctaaaattcagagatacggga

SEQ ID NO: 515371 - DNA, 25 bp, Homo sapien
gatacgggaagttcacaatctacct

SEQ ID NO: 515372 - DNA, 25 bp, Homo sapien
gggaagttcacaatctaccttattg

SEQ ID NO: 515373 - DNA, 25 bp, Homo sapien
gacatgaaatgcgaacacttactta

SEQ ID NO: 515374 - DNA, 25 bp, Homo sapien
gcgaacacttacttacatattaatg

SEQ ID NO: 515375 - DNA, 25 bp, Homo sapien
atgttaactcaaccttagggacctg

SEQ ID NO: 515376 - DNA, 25 bp, Homo sapien
aactcaaccttagggacctggaatg

SEQ ID NO: 515377 - DNA, 25 bp, Homo sapien
gacctggaatggttgcattaatgct

SEQ ID NO: 515378 - DNA, 25 bp, Homo sapien
aatgctataatcgttggatcgccac

SEQ ID NO: 515379 - DNA, 25 bp, Homo sapien
tcgttggatcgccacatttcccaaa

SEQ ID NO: 515380 - DNA, 25 bp, Homo sapien
ttccccgactcccaggcataatgag

SEQ ID NO: 515381 - DNA, 25 bp, Homo sapien
tcccaggcataatgaggcatgtctt

SEQ ID NO: 515382 - DNA, 25 bp, Homo sapien
gaggcatgtcttactcaatgttatg

SEQ ID NO: 515383 - DNA, 25 bp, Homo sapien
gtcttactcaatgttatgcaatgga

SEQ ID NO: 515384 - DNA, 25 bp, Homo sapien
ggatttaggcaaaaattcattctta

SEQ ID NO: 515385 - DNA, 25 bp, Homo sapien
ttcattcttagtgtcagccacacaa

SEQ ID NO: 515386 - DNA, 25 bp, Homo sapien
cttagtgtcagccacacaatttttt

SEQ ID NO: 515387 - DNA, 25 bp, Homo sapien
aatgcagtatattcacctgtaaata

SEQ ID NO: 515388 - DNA, 25 bp, Homo sapien
tattcacctgtaaatagtttgtgta

SEQ ID NO: 515389 - DNA, 25 bp, Homo sapien
gtaaagcagttagttgctgcacatg

SEQ ID NO: 515390 - DNA, 25 bp, Homo sapien
gttagttgctgcacatggataacaa

SEQ ID NO: 515391 - DNA, 25 bp, Homo sapien
gatactaatgtactcaacagccagg

SEQ ID NO: 515392 - DNA, 25 bp, Homo sapien
taatgtactcaacagccaggtataa

SEQ ID NO: 515393 - DNA, 25 bp, Homo sapien
gccaggtataaactatatctcctag

SEQ ID NO: 515394 - DNA, 25 bp, Homo sapien
aatacttgcttatgaaggatttcag

SEQ ID NO: 515395 - DNA, 25 bp, Homo sapien
aatgtcagcttttgatagcatagca

SEQ ID NO: 515396 - DNA, 25 bp, Homo sapien
ttgatagcatagcagtaattgacat

SEQ ID NO: 515397 - DNA, 25 bp, Homo sapien
ttctgtgtttggttgggtgtaatga

SEQ ID NO: 515398 - DNA, 25 bp, Homo sapien
gtctgaagacactttctaatgttat

SEQ ID NO: 515399 - DNA, 25 bp, Homo sapien
ctttctaatgttatcttggtgcata

SEQ ID NO: 515400 - DNA, 25 bp, Homo sapien
atcttggtgcataagctgtaatttt

SEQ ID NO: 515401 - DNA, 25 bp, Homo sapien
tcaaatgtttgcagttttggctaaa

SEQ ID NO: 515402 - DNA, 25 bp, Homo sapien
gagagaaggaccatggagcccctgc

SEQ ID NO: 515403 - DNA, 25 bp, Homo sapien
gaaggaccatggagcccctgcaaag

SEQ ID NO: 515404 - DNA, 25 bp, Homo sapien
agagaaggaaagtccccactgtcca

SEQ ID NO: 515405 - DNA, 25 bp, Homo sapien
aaggaaagtccccactgtccatcag

SEQ ID NO: 515406 - DNA, 25 bp, Homo sapien
agcaggccgatgtgggaggcatcac

SEQ ID NO: 515407 - DNA, 25 bp, Homo sapien
gaggcatcaccacacgtgggttcca

SEQ ID NO: 515408 - DNA, 25 bp, Homo sapien
gtgggttccaactgcttctccaaac

SEQ ID NO: 515409 - DNA, 25 bp, Homo sapien
ttctccaaaccctgtggtctcacat

SEQ ID NO: 515410 - DNA, 25 bp, Homo sapien
aaccctgtggtctcacatgaggcag

SEQ ID NO: 515411 - DNA, 25 bp, Homo sapien
tcacatgaggcagggaggaaatttg

SEQ ID NO: 515412 - DNA, 25 bp, Homo sapien
tgcaaaaacccatcacagagagaag

SEQ ID NO: 515413 - DNA, 25 bp, Homo sapien
tgttgtttaccctatcctcaacaac

SEQ ID NO: 515414 - DNA, 25 bp, Homo sapien
tttaccctatcctcaacaacatttt

SEQ ID NO: 515415 - DNA, 25 bp, Homo sapien
aactgttgctctgtcaaaacagcta

SEQ ID NO: 515416 - DNA, 25 bp, Homo sapien
tctgtcaaaacagctatgcagtgga

SEQ ID NO: 515417 - DNA, 25 bp, Homo sapien
gtggagttgcatttgatgttctaga

SEQ ID NO: 515418 - DNA, 25 bp, Homo sapien
ctagagtttgattacatgcagagtt

SEQ ID NO: 515419 - DNA, 25 bp, Homo sapien
acatgcagagttgtatatagccaaa

SEQ ID NO: 515420 - DNA, 25 bp, Homo sapien
gtatatagccaaaacttctcttatc

SEQ ID NO: 515421 - DNA, 25 bp, Homo sapien
acttctcttatcaaactctgttatg

SEQ ID NO: 515422 - DNA, 25 bp, Homo sapien
atcaaactctgttatgtaggcatat

SEQ ID NO: 515423 - DNA, 25 bp, Homo sapien
ttaaagactgttgtactgtgtctca

SEQ ID NO: 515424 - DNA, 25 bp, Homo sapien
ctgactatgtgccaaggcctcactt

SEQ ID NO: 515425 - DNA, 25 bp, Homo sapien
tgactatgtgccaaggcctcacttc

SEQ ID NO: 515426 - DNA, 25 bp, Homo sapien
gactatgtgccaaggcctcacttca

SEQ ID NO: 515427 - DNA, 25 bp, Homo sapien
actatgtgccaaggcctcacttcag

SEQ ID NO: 515428 - DNA, 25 bp, Homo sapien
atgtgccaaggcctcacttcaggct

SEQ ID NO: 515429 - DNA, 25 bp, Homo sapien
tgtgccaaggcctcacttcaggctt

SEQ ID NO: 515430 - DNA, 25 bp, Homo sapien
gtgccaaggcctcacttcaggcttg

SEQ ID NO: 515431 - DNA, 25 bp, Homo sapien
tgccaaggcctcacttcaggcttgt

SEQ ID NO: 515432 - DNA, 25 bp, Homo sapien
ccaaggcctcacttcaggcttgtga

SEQ ID NO: 515433 - DNA, 25 bp, Homo sapien
caaggcctcacttcaggcttgtgac

SEQ ID NO: 515434 - DNA, 25 bp, Homo sapien
aaggcctcacttcaggcttgtgact

SEQ ID NO: 515435 - DNA, 25 bp, Homo sapien
tctgtgttcagagtcctttgcttct

SEQ ID NO: 515436 - DNA, 25 bp, Homo sapien
ttcagagtcctttgcttcttagtga

SEQ ID NO: 515437 - DNA, 25 bp, Homo sapien
gtcctttgcttcttagtgactatgt

SEQ ID NO: 515438 - DNA, 25 bp, Homo sapien
cttagtgactatgtgaccttgagaa

SEQ ID NO: 515439 - DNA, 25 bp, Homo sapien
agataacttgagctccctttttcct

SEQ ID NO: 515440 - DNA, 25 bp, Homo sapien
ggtagaggtaagattgatgtgcata

SEQ ID NO: 515441 - DNA, 25 bp, Homo sapien
gatgtgcatattgatattgtactta

SEQ ID NO: 515442 - DNA, 25 bp, Homo sapien
gtaaaacctaatgctatgctttgaa

SEQ ID NO: 515443 - DNA, 25 bp, Homo sapien
atgctttgaatgtagtgggttccaa

SEQ ID NO: 515444 - DNA, 25 bp, Homo sapien
cctgcatctgccagtaaacctgtta

SEQ ID NO: 515445 - DNA, 25 bp, Homo sapien
atctgccagtaaacctgttaacaca

SEQ ID NO: 515446 - DNA, 25 bp, Homo sapien
cagtttttgtgttgtgaagttctac

SEQ ID NO: 515447 - DNA, 25 bp, Homo sapien
gtggtttgacccaagaccacaacca

SEQ ID NO: 515448 - DNA, 25 bp, Homo sapien
gaccacaaccatgagaccctgaagt

SEQ ID NO: 515449 - DNA, 25 bp, Homo sapien
ttatttgagtaactgtttccttggg

SEQ ID NO: 515450 - DNA, 25 bp, Homo sapien
gggccaatctgtgtatgcttttaga

SEQ ID NO: 515451 - DNA, 25 bp, Homo sapien
tgtctataacaaacagtctgtcatt

SEQ ID NO: 515452 - DNA, 25 bp, Homo sapien
atttctgttgataaaccatttggac

SEQ ID NO: 515453 - DNA, 25 bp, Homo sapien
cagagtgaggacgtttgccctgtta

SEQ ID NO: 515454 - DNA, 25 bp, Homo sapien
ttgccctgttatctcctagtgctaa

SEQ ID NO: 515455 - DNA, 25 bp, Homo sapien
acaatacactccagtcatgagccgg

SEQ ID NO: 515456 - DNA, 25 bp, Homo sapien
catgagccgggctttacaaataaag

SEQ ID NO: 515457 - DNA, 25 bp, Homo sapien
gaatcgcatgtgtgagtgcccctag

SEQ ID NO: 515458 - DNA, 25 bp, Homo sapien
gaaactcagagagctgtgcagagaa

SEQ ID NO: 515459 - DNA, 25 bp, Homo sapien
gaaaacttttcgatatacatctttg

SEQ ID NO: 515460 - DNA, 25 bp, Homo sapien
taatccattggacttacccgaaaga

SEQ ID NO: 515461 - DNA, 25 bp, Homo sapien
ttacccgaaagaattgctgcacata

SEQ ID NO: 515462 - DNA, 25 bp, Homo sapien
gctgcacatagttttgacatcgtaa

SEQ ID NO: 515463 - DNA, 25 bp, Homo sapien
gacatcgtaatagcagatcctccct

SEQ ID NO: 515464 - DNA, 25 bp, Homo sapien
agatcctccctatctttcggaggaa

SEQ ID NO: 515465 - DNA, 25 bp, Homo sapien
atctttcggaggaatgtctcagaaa

SEQ ID NO: 515466 - DNA, 25 bp, Homo sapien
gaaaccgtcaagtacctgacgcggg

SEQ ID NO: 515467 - DNA, 25 bp, Homo sapien
ttctgctgtgcacaggtgccatcat

SEQ ID NO: 515468 - DNA, 25 bp, Homo sapien
catgatgtttgcaggcagttgtggt

SEQ ID NO: 515469 - DNA, 25 bp, Homo sapien
gtatgtaagacaattctatccagcc

SEQ ID NO: 515470 - DNA, 25 bp, Homo sapien
tatgtaagacaattctatccagccc

SEQ ID NO: 515471 - DNA, 25 bp, Homo sapien
atgtaagacaattctatccagcccg

SEQ ID NO: 515472 - DNA, 25 bp, Homo sapien
tgtaagacaattctatccagcccgc

SEQ ID NO: 515473 - DNA, 25 bp, Homo sapien
gtaagacaattctatccagcccgcc

SEQ ID NO: 515474 - DNA, 25 bp, Homo sapien
taagacaattctatccagcccgcca

SEQ ID NO: 515475 - DNA, 25 bp, Homo sapien
tctggactccctcccctgtatgtaa

SEQ ID NO: 515476 - DNA, 25 bp, Homo sapien
cctcccctgtatgtaagccctcaat

SEQ ID NO: 515477 - DNA, 25 bp, Homo sapien
tcaataaaaccccacgtctcttttg

SEQ ID NO: 515478 - DNA, 25 bp, Homo sapien
ccccacgtctcttttgctggcaaaa

SEQ ID NO: 515479 - DNA, 25 bp, Homo sapien
ggccggcggggccgcaggctcgcgc

SEQ ID NO: 515480 - DNA, 25 bp, Homo sapien
gccggcggggccgcaggctcgcgcc

SEQ ID NO: 515481 - DNA, 25 bp, Homo sapien
ccggcggggccgcaggctcgcgccc

SEQ ID NO: 515482 - DNA, 25 bp, Homo sapien
ggcggggccgcaggctcgcgcccgg

SEQ ID NO: 515483 - DNA, 25 bp, Homo sapien
gcggggccgcaggctcgcgcccggg

SEQ ID NO: 515484 - DNA, 25 bp, Homo sapien
gggccgcaggctcgcgcccgggctc

SEQ ID NO: 515485 - DNA, 25 bp, Homo sapien
ggccgcaggctcgcgcccgggctcg

SEQ ID NO: 515486 - DNA, 25 bp, Homo sapien
gccgcaggctcgcgcccgggctcgc

SEQ ID NO: 515487 - DNA, 25 bp, Homo sapien
ccgcaggctcgcgcccgggctcgcc

SEQ ID NO: 515488 - DNA, 25 bp, Homo sapien
cgcaggctcgcgcccgggctcgccc

SEQ ID NO: 515489 - DNA, 25 bp, Homo sapien
gcaggctcgcgcccgggctcgcccc

SEQ ID NO: 515490 - DNA, 25 bp, Homo sapien
gtgtggcttttcaatgtctgaagtg

SEQ ID NO: 515491 - DNA, 25 bp, Homo sapien
aatcttggctttactgtagtttaag

SEQ ID NO: 515492 - DNA, 25 bp, Homo sapien
gatgatgcttattagtccacctgaa

SEQ ID NO: 515493 - DNA, 25 bp, Homo sapien
ctgaaagagtccttccaggtttttg

SEQ ID NO: 515494 - DNA, 25 bp, Homo sapien
ggtttttggaagctttattcctgct

SEQ ID NO: 515495 - DNA, 25 bp, Homo sapien
gctttattcctgcttattaccttgc

SEQ ID NO: 515496 - DNA, 25 bp, Homo sapien
tgcttattaccttgcccttgagaag

SEQ ID NO: 515497 - DNA, 25 bp, Homo sapien
atgtctgaagtggattaagtggccc

SEQ ID NO: 515498 - DNA, 25 bp, Homo sapien
gcccttgagaagtccttcatggaaa

SEQ ID NO: 515499 - DNA, 25 bp, Homo sapien
ttaagtggcccacagtcagttctgt

SEQ ID NO: 515500 - DNA, 25 bp, Homo sapien
tcagttctgtgacttgagtttcaaa

SEQ ID NO: 515501 - DNA, 25 bp, Homo sapien
ttaaaccggtcttttggggctgcag

SEQ ID NO: 515502 - DNA, 25 bp, Homo sapien
ttcttggacaagaaatcccctgaaa

SEQ ID NO: 515503 - DNA, 25 bp, Homo sapien
gaaatcccctgaaattcagctgtta

SEQ ID NO: 515504 - DNA, 25 bp, Homo sapien
aattcagctgttatagtgcttcact

SEQ ID NO: 515505 - DNA, 25 bp, Homo sapien
tgttatagtgcttcactgtttttgc

SEQ ID NO: 515506 - DNA, 25 bp, Homo sapien
tgcactgatttttctataccttagg

SEQ ID NO: 515507 - DNA, 25 bp, Homo sapien
ctataccttaggtggtcagaagaca

SEQ ID NO: 515508 - DNA, 25 bp, Homo sapien
gaagacaaccttgaatgcactcata

SEQ ID NO: 515509 - DNA, 25 bp, Homo sapien
gcactcatagagaaaactgttactt

SEQ ID NO: 515510 - DNA, 25 bp, Homo sapien
gaaaactgttactttctgacgtaat

SEQ ID NO: 515511 - DNA, 25 bp, Homo sapien
aattcaggaagacagacgctgcaat

SEQ ID NO: 515512 - DNA, 25 bp, Homo sapien
ggtttctctcctggctgccggcgga

SEQ ID NO: 515513 - DNA, 25 bp, Homo sapien
ctgccggcggaggtaggctgggaaa

SEQ ID NO: 515514 - DNA, 25 bp, Homo sapien
gtaggctgggaaagcttccccctca

SEQ ID NO: 515515 - DNA, 25 bp, Homo sapien
gcccctgctgtgtccgtggtgctgt

SEQ ID NO: 515516 - DNA, 25 bp, Homo sapien
ctgctgtgtccgtggtgctgttgta

SEQ ID NO: 515517 - DNA, 25 bp, Homo sapien
gctgtgtccgtggtgctgttgtatt

SEQ ID NO: 515518 - DNA, 25 bp, Homo sapien
actgcagccctggtgctctggggaa

SEQ ID NO: 515519 - DNA, 25 bp, Homo sapien
acaggtggtttgactgttcacccag

SEQ ID NO: 515520 - DNA, 25 bp, Homo sapien
aggtggtttgactgttcacccagca

SEQ ID NO: 515521 - DNA, 25 bp, Homo sapien
gtggtttgactgttcacccagcagc

SEQ ID NO: 515522 - DNA, 25 bp, Homo sapien
ggtttgactgttcacccagcagccc

SEQ ID NO: 515523 - DNA, 25 bp, Homo sapien
gcaccctgactgcagagcagttgga

SEQ ID NO: 515524 - DNA, 25 bp, Homo sapien
cagagcagttggagcgcgagttaca

SEQ ID NO: 515525 - DNA, 25 bp, Homo sapien
gcgagttacagttgagacccctggc

SEQ ID NO: 515526 - DNA, 25 bp, Homo sapien
acccagctgtgctgtcatgcagcta

SEQ ID NO: 515527 - DNA, 25 bp, Homo sapien
catgcagctaacctctgatgtggtc

SEQ ID NO: 515528 - DNA, 25 bp, Homo sapien
taagggcagcttgcgggttagctct

SEQ ID NO: 515529 - DNA, 25 bp, Homo sapien
cttgcgggttagctctgtgactgca

SEQ ID NO: 515530 - DNA, 25 bp, Homo sapien
gtgactgcatagtttttctaccttc

SEQ ID NO: 515531 - DNA, 25 bp, Homo sapien
taccttctttccctgatcttttgct

SEQ ID NO: 515532 - DNA, 25 bp, Homo sapien
aatacattcactgtgggtccgacgc

SEQ ID NO: 515533 - DNA, 25 bp, Homo sapien
tgggtccgacgcaatttataaaaat

SEQ ID NO: 515534 - DNA, 25 bp, Homo sapien
gttgaatctgattctttcattaata

SEQ ID NO: 515535 - DNA, 25 bp, Homo sapien
ttagtggatcacaaacatgctattt

SEQ ID NO: 515536 - DNA, 25 bp, Homo sapien
tttgaaggctgctttcttagctgct

SEQ ID NO: 515537 - DNA, 25 bp, Homo sapien
aaggctgctttcttagctgctgact

SEQ ID NO: 515538 - DNA, 25 bp, Homo sapien
agctgctgactgttggctagttcat

SEQ ID NO: 515539 - DNA, 25 bp, Homo sapien
agttcattcaatgccagggagcctg

SEQ ID NO: 515540 - DNA, 25 bp, Homo sapien
caatgccagggagcctgctcaggct

SEQ ID NO: 515541 - DNA, 25 bp, Homo sapien
gtggtggttctaatttatcaactct

SEQ ID NO: 515542 - DNA, 25 bp, Homo sapien
tcaactcttttattcatactgacag

SEQ ID NO: 515543 - DNA, 25 bp, Homo sapien
gcaaaattgtaacatgccttgtaga

SEQ ID NO: 515544 - DNA, 25 bp, Homo sapien
gccttgtagaagttatagttacgct

SEQ ID NO: 515545 - DNA, 25 bp, Homo sapien
gagaatcaatcatcagtaagttact

SEQ ID NO: 515546 - DNA, 25 bp, Homo sapien
gtgactttagatacttttatgccaa

SEQ ID NO: 515547 - DNA, 25 bp, Homo sapien
aactcacatgagcacatgacagtct

SEQ ID NO: 515548 - DNA, 25 bp, Homo sapien
agcacatgacagtctgagctctata

SEQ ID NO: 515549 - DNA, 25 bp, Homo sapien
tgacagtctgagctctataatcagt

SEQ ID NO: 515550 - DNA, 25 bp, Homo sapien
ataatcagtgtgcttctgctgtgca

SEQ ID NO: 515551 - DNA, 25 bp, Homo sapien
atcagtgtgcttctgctgtgcagaa

SEQ ID NO: 515552 - DNA, 25 bp, Homo sapien
attaattcagttggttactcagtgt

SEQ ID NO: 515553 - DNA, 25 bp, Homo sapien
ggttactcagtgtttgttacagaaa

SEQ ID NO: 515554 - DNA, 25 bp, Homo sapien
gagtccagaaaagtattcaccctaa

SEQ ID NO: 515555 - DNA, 25 bp, Homo sapien
aagtattcaccctaagagaatgtca

SEQ ID NO: 515556 - DNA, 25 bp, Homo sapien
aaattcattcccctgtattcaagac

SEQ ID NO: 515557 - DNA, 25 bp, Homo sapien
cctgtattcaagaccaaagcacata

SEQ ID NO: 515558 - DNA, 25 bp, Homo sapien
taaatgctaatgtagggctcagagg

SEQ ID NO: 515559 - DNA, 25 bp, Homo sapien
atacagttctcctgcatatttgaga

SEQ ID NO: 515560 - DNA, 25 bp, Homo sapien
gaaaatgtgaagtcctttcaagaaa

SEQ ID NO: 515561 - DNA, 25 bp, Homo sapien
ataataatcatagcctgctgacact

SEQ ID NO: 515562 - DNA, 25 bp, Homo sapien
aaaaggacctcattcactctttctt

SEQ ID NO: 515563 - DNA, 25 bp, Homo sapien
tcattcactctttcttttatgcagt

SEQ ID NO: 515564 - DNA, 25 bp, Homo sapien
gcagtgatttactggtccctactga

SEQ ID NO: 515565 - DNA, 25 bp, Homo sapien
ggtccctactgatttccaaattgga

SEQ ID NO: 515566 - DNA, 25 bp, Homo sapien
gatcacgatagtaaattatccatgc

SEQ ID NO: 515567 - DNA, 25 bp, Homo sapien
atccatgaccacaccaaacttggtt

SEQ ID NO: 515568 - DNA, 25 bp, Homo sapien
gaccacaccaaacttggttattcat

SEQ ID NO: 515569 - DNA, 25 bp, Homo sapien
tggttattcataatttttcctgtta

SEQ ID NO: 515570 - DNA, 25 bp, Homo sapien
gttaaaaacagtaatgccaacattg

SEQ ID NO: 515571 - DNA, 25 bp, Homo sapien
ggtcaaagaaccagttgttctcttt

SEQ ID NO: 515572 - DNA, 25 bp, Homo sapien
ccagttgttctctttatatttagat

SEQ ID NO: 515573 - DNA, 25 bp, Homo sapien
gaggatgattgagtccatatactat

SEQ ID NO: 515574 - DNA, 25 bp, Homo sapien
gagtccatatactatgtatgtttac

SEQ ID NO: 515575 - DNA, 25 bp, Homo sapien
tatactatacatgcacattaggtgt

SEQ ID NO: 515576 - DNA, 25 bp, Homo sapien
atgcacattaggtgttttcatttgt

SEQ ID NO: 515577 - DNA, 25 bp, Homo sapien
aaagttcacttcttgagcatcaata

SEQ ID NO: 515578 - DNA, 25 bp, Homo sapien
tggtgggattatgggcaggagcctc

SEQ ID NO: 515579 - DNA, 25 bp, Homo sapien
gctgctgccattttcaaatttcctc

SEQ ID NO: 515580 - DNA, 25 bp, Homo sapien
tgccattttcaaatttcctccctgc

SEQ ID NO: 515581 - DNA, 25 bp, Homo sapien
ctgcctcatgtgagaccacagggtt

SEQ ID NO: 515582 - DNA, 25 bp, Homo sapien
ctcatgtgagaccacagggtttgga

SEQ ID NO: 515583 - DNA, 25 bp, Homo sapien
tattttctctgtaatgctgtttatt

SEQ ID NO: 515584 - DNA, 25 bp, Homo sapien
ttggagaagcagttggaacccacgt

SEQ ID NO: 515585 - DNA, 25 bp, Homo sapien
gaagcagttggaacccacgtgtggt

SEQ ID NO: 515586 - DNA, 25 bp, Homo sapien
ttggaacccacgtgtggtgatgcct

SEQ ID NO: 515587 - DNA, 25 bp, Homo sapien
ggaacccacgtgtggtgatgcctcc

SEQ ID NO: 515588 - DNA, 25 bp, Homo sapien
cacgtgtggtgatgcctcccacatc

SEQ ID NO: 515589 - DNA, 25 bp, Homo sapien
atgcatggctgaatccacgaggagc

SEQ ID NO: 515590 - DNA, 25 bp, Homo sapien
aatccacgaggagcgcgactgggat

SEQ ID NO: 515591 - DNA, 25 bp, Homo sapien
agtcacgcggtaacgggctcaggtc

SEQ ID NO: 515592 - DNA, 25 bp, Homo sapien
gcggtaacgggctcaggtctcctag

SEQ ID NO: 515593 - DNA, 25 bp, Homo sapien
gtctcctaggagcagaacaggccca

SEQ ID NO: 515594 - DNA, 25 bp, Homo sapien
tcaggagacctcgtgcccagggcag

SEQ ID NO: 515595 - DNA, 25 bp, Homo sapien
gcccatgagaacttgagtgtgcaaa

SEQ ID NO: 515596 - DNA, 25 bp, Homo sapien
agtgtgcaaacctgcgcacaggtgt

SEQ ID NO: 515597 - DNA, 25 bp, Homo sapien
gaacagactccagggcgagtgttta

SEQ ID NO: 515598 - DNA, 25 bp, Homo sapien
gacacagacacacataagacccact

SEQ ID NO: 515599 - DNA, 25 bp, Homo sapien
agggaacaccccagtccatgcatgg

SEQ ID NO: 515600 - DNA, 25 bp, Homo sapien
aggagtggtgttcccttttccacag

SEQ ID NO: 515601 - DNA, 25 bp, Homo sapien
acaggtctggaccacagtgtctcta

SEQ ID NO: 515602 - DNA, 25 bp, Homo sapien
ccgctcctggatacttggttactgt

SEQ ID NO: 515603 - DNA, 25 bp, Homo sapien
atacttggttactgtgtgtttcggt

SEQ ID NO: 515604 - DNA, 25 bp, Homo sapien
gcatccacaacatgaatatccacta

SEQ ID NO: 515605 - DNA, 25 bp, Homo sapien
tatccactaagctataacagggcct

SEQ ID NO: 515606 - DNA, 25 bp, Homo sapien
gggcctgctgcaactatagtatttc

SEQ ID NO: 515607 - DNA, 25 bp, Homo sapien
aaaagtatcaactgccacaagggcc

SEQ ID NO: 515608 - DNA, 25 bp, Homo sapien
gattcagatcatcggtgggatttca

SEQ ID NO: 515609 - DNA, 25 bp, Homo sapien
gatttcactgggaaatctcccactg

SEQ ID NO: 515610 - DNA, 25 bp, Homo sapien
ctcccactgggcaagagtagatgat

SEQ ID NO: 515611 - DNA, 25 bp, Homo sapien
aagcacctggaaaacatgcaatggg

SEQ ID NO: 515612 - DNA, 25 bp, Homo sapien
atgcaatgggaaccttcaccctgag

SEQ ID NO: 515613 - DNA, 25 bp, Homo sapien
tcccatgctacccaacagtagacag

SEQ ID NO: 515614 - DNA, 25 bp, Homo sapien
acaggacaccctgtgttgttggctg

SEQ ID NO: 515615 - DNA, 25 bp, Homo sapien
tggaagccactctcagcacatacag

SEQ ID NO: 515616 - DNA, 25 bp, Homo sapien
agcacatacagccactgtgttccga

SEQ ID NO: 515617 - DNA, 25 bp, Homo sapien
ctgtgttccgaggtccagtcagctg

SEQ ID NO: 515618 - DNA, 25 bp, Homo sapien
gaaggaattcaacacagccaaggac

SEQ ID NO: 515619 - DNA, 25 bp, Homo sapien
gacagaggtccatatgatgacgggt

SEQ ID NO: 515620 - DNA, 25 bp, Homo sapien
tggatgctcgtgtgactttgctgac

SEQ ID NO: 515621 - DNA, 25 bp, Homo sapien
gtgactttgctgaccttttatgttt

SEQ ID NO: 515622 - DNA, 25 bp, Homo sapien
tgacatgttcatttgactactattg

SEQ ID NO: 515623 - DNA, 25 bp, Homo sapien
actactattgtagccgattttcgat

SEQ ID NO: 515624 - DNA, 25 bp, Homo sapien
tagccgattttcgattgtttaacca

SEQ ID NO: 515625 - DNA, 25 bp, Homo sapien
ttgtttaaccaaacccagttgcatt

SEQ ID NO: 515626 - DNA, 25 bp, Homo sapien
tacagatccacgtgtactggcacct

SEQ ID NO: 515627 - DNA, 25 bp, Homo sapien
ggcacctcagaagaccaaatcatgg

SEQ ID NO: 515628 - DNA, 25 bp, Homo sapien
ggactgtacaagtctctatacaatg

SEQ ID NO: 515629 - DNA, 25 bp, Homo sapien
atacaatgtctttatccctgtgggc

SEQ ID NO: 515630 - DNA, 25 bp, Homo sapien
atgtctttatccctgtgggcagcaa

SEQ ID NO: 515631 - DNA, 25 bp, Homo sapien
gggctactgttgttacagtctcata

SEQ ID NO: 515632 - DNA, 25 bp, Homo sapien
acagtctcatatgtatcccagcaca

SEQ ID NO: 515633 - DNA, 25 bp, Homo sapien
ctgctccacagctttcagggtgtgt

SEQ ID NO: 515634 - DNA, 25 bp, Homo sapien
cagggtgtgtttatgagtgactcca

SEQ ID NO: 515635 - DNA, 25 bp, Homo sapien
tgagtgactccacccaagcttgtag

SEQ ID NO: 515636 - DNA, 25 bp, Homo sapien
caagcttgtagctgttctctcccat

SEQ ID NO: 515637 - DNA, 25 bp, Homo sapien
tctcccatctaacctcaggcaagat

SEQ ID NO: 515638 - DNA, 25 bp, Homo sapien
aacctcaggcaagatcctggtgaaa

SEQ ID NO: 515639 - DNA, 25 bp, Homo sapien
agagatgaactctatccagcccctt

SEQ ID NO: 515640 - DNA, 25 bp, Homo sapien
ccagccccttaattggcaggtgtat

SEQ ID NO: 515641 - DNA, 25 bp, Homo sapien
gctgacagtactgaaagctttcctc

SEQ ID NO: 515642 - DNA, 25 bp, Homo sapien
cacccaaaagtcagcagtggcactg

SEQ ID NO: 515643 - DNA, 25 bp, Homo sapien
tggagagccctctaaagcctgcact

SEQ ID NO: 515644 - DNA, 25 bp, Homo sapien
ttgggctggattaagtcctgcttcc

SEQ ID NO: 515645 - DNA, 25 bp, Homo sapien
tgcttccagcatttcagggtctctg

SEQ ID NO: 515646 - DNA, 25 bp, Homo sapien
gtctaggatttctagcccttggact

SEQ ID NO: 515647 - DNA, 25 bp, Homo sapien
gatggcctgttgtggaacttctcaa

SEQ ID NO: 515648 - DNA, 25 bp, Homo sapien
aacttctcaacctccattatcagat

SEQ ID NO: 515649 - DNA, 25 bp, Homo sapien
tatcagatgcattaattcctccaat

SEQ ID NO: 515650 - DNA, 25 bp, Homo sapien
tcctccaataagtcccatttcatat

SEQ ID NO: 515651 - DNA, 25 bp, Homo sapien
tatagtcatttaccccacaacattt

SEQ ID NO: 515652 - DNA, 25 bp, Homo sapien
ttaccccacaacatttcagtcaagg

SEQ ID NO: 515653 - DNA, 25 bp, Homo sapien
ggactccagggcatacaccagtggc

SEQ ID NO: 515654 - DNA, 25 bp, Homo sapien
gtggcctcccgaaggatctaaggat

SEQ ID NO: 515655 - DNA, 25 bp, Homo sapien
aactgttctttagtgtaaggctgca

SEQ ID NO: 515656 - DNA, 25 bp, Homo sapien
tagtgtaaggctgcattgtgggttt

SEQ ID NO: 515657 - DNA, 25 bp, Homo sapien
aaattcataggatctgatttgctca

SEQ ID NO: 515658 - DNA, 25 bp, Homo sapien
gatttgctcagagtattattcaaga

SEQ ID NO: 515659 - DNA, 25 bp, Homo sapien
gaatgtattaataaggcattgcccc

SEQ ID NO: 515660 - DNA, 25 bp, Homo sapien
tgtttgcactcagggttaatatgtc

SEQ ID NO: 515661 - DNA, 25 bp, Homo sapien
attcaggtacattaattgcatatta

SEQ ID NO: 515662 - DNA, 25 bp, Homo sapien
gaaagatgagtcctatacgtggcaa

SEQ ID NO: 515663 - DNA, 25 bp, Homo sapien
tacgtggcaatttttcaatgtcatc

SEQ ID NO: 515664 - DNA, 25 bp, Homo sapien
ttttcaatgtcatctgaagccagca

SEQ ID NO: 515665 - DNA, 25 bp, Homo sapien
aagccagcattatcttccaaagaaa

SEQ ID NO: 515666 - DNA, 25 bp, Homo sapien
ggcaggctttttggtgctaggccct

SEQ ID NO: 515667 - DNA, 25 bp, Homo sapien
ctaggccctgggactggaagtcgcc

SEQ ID NO: 515668 - DNA, 25 bp, Homo sapien
ctggaagtcgcccagcccgtattta

SEQ ID NO: 515669 - DNA, 25 bp, Homo sapien
ccagcccgtatttatgtaaaggtat

SEQ ID NO: 515670 - DNA, 25 bp, Homo sapien
gtaaaggtatttatgggccactgca

SEQ ID NO: 515671 - DNA, 25 bp, Homo sapien
gtatttatgggccactgcacatgcc

SEQ ID NO: 515672 - DNA, 25 bp, Homo sapien
gaaaccctgattcaggtctgcaggc

SEQ ID NO: 515673 - DNA, 25 bp, Homo sapien
aggtctgcaggctcctgcgggctca

SEQ ID NO: 515674 - DNA, 25 bp, Homo sapien
aggctgctggctccggtaccatgta

SEQ ID NO: 515675 - DNA, 25 bp, Homo sapien
ctggctccggtaccatgtaaaccta

SEQ ID NO: 515676 - DNA, 25 bp, Homo sapien
cactgtcctccaggcaggctttttg

SEQ ID NO: 515677 - DNA, 25 bp, Homo sapien
ggttgtgaatacactagtaccactt

SEQ ID NO: 515678 - DNA, 25 bp, Homo sapien
tacactagtaccacttaaagttcag

SEQ ID NO: 515679 - DNA, 25 bp, Homo sapien
tacagttcagaaatagggtccttaa

SEQ ID NO: 515680 - DNA, 25 bp, Homo sapien
agagtttactcttcagtcagcttag

SEQ ID NO: 515681 - DNA, 25 bp, Homo sapien
gtcagcttagatgagagctctctcc

SEQ ID NO: 515682 - DNA, 25 bp, Homo sapien
ttagatgagagctctctccctgctc

SEQ ID NO: 515683 - DNA, 25 bp, Homo sapien
ccctctaccctctcaaaagttgaga

SEQ ID NO: 515684 - DNA, 25 bp, Homo sapien
gaataggacttttatactttccaat

SEQ ID NO: 515685 - DNA, 25 bp, Homo sapien
gtttgtgatatatatgggtccagca

SEQ ID NO: 515686 - DNA, 25 bp, Homo sapien
tatgggtccagcaaacctatcgaga

SEQ ID NO: 515687 - DNA, 25 bp, Homo sapien
gtccagcaaacctatcgagataatg

SEQ ID NO: 515688 - DNA, 25 bp, Homo sapien
tgggacatcccacgtgtgatccctt

SEQ ID NO: 515689 - DNA, 25 bp, Homo sapien
tgtgatccctttcactccatcagga

SEQ ID NO: 515690 - DNA, 25 bp, Homo sapien
tttcactccatcaggacaccaggac

SEQ ID NO: 515691 - DNA, 25 bp, Homo sapien
ggacaccaggactgtccttaggaaa

SEQ ID NO: 515692 - DNA, 25 bp, Homo sapien
gactgtccttaggaaaatgtccttg

SEQ ID NO: 515693 - DNA, 25 bp, Homo sapien
ccttgagatggcagcaggagtcata

SEQ ID NO: 515694 - DNA, 25 bp, Homo sapien
caggagtcatattttctgtgtgtgt

SEQ ID NO: 515695 - DNA, 25 bp, Homo sapien
ttcggaaagccgctgtgtcctgcct

SEQ ID NO: 515696 - DNA, 25 bp, Homo sapien
aaagacccagtgtcatttgctcctc

SEQ ID NO: 515697 - DNA, 25 bp, Homo sapien
gagccaccgcctgccagtgtgagag

SEQ ID NO: 515698 - DNA, 25 bp, Homo sapien
tgagaggcggccactttcatggcag

SEQ ID NO: 515699 - DNA, 25 bp, Homo sapien
ttcggaaagccgctgtgtcctgcct

SEQ ID NO: 515700 - DNA, 25 bp, Homo sapien
ctgcctcagcacaaagacccagtgt

SEQ ID NO: 515701 - DNA, 25 bp, Homo sapien
ctcagcacaaagacccagtgtcatt

SEQ ID NO: 515702 - DNA, 25 bp, Homo sapien
aaagacccagtgtcatttgctcctc

SEQ ID NO: 515703 - DNA, 25 bp, Homo sapien
agacccagtgtcatttgctcctcct

SEQ ID NO: 515704 - DNA, 25 bp, Homo sapien
gtgccactccagaacctcagcagat

SEQ ID NO: 515705 - DNA, 25 bp, Homo sapien
cactccagaacctcagcagatctga

SEQ ID NO: 515706 - DNA, 25 bp, Homo sapien
ccagaacctcagcagatctgagcca

SEQ ID NO: 515707 - DNA, 25 bp, Homo sapien
tgccagtgtgagaggcggccacttt

SEQ ID NO: 515708 - DNA, 25 bp, Homo sapien
tgagaggcggccactttcatggcag

SEQ ID NO: 515709 - DNA, 25 bp, Homo sapien
agaggcggccactttcatggcagct

SEQ ID NO: 515710 - DNA, 25 bp, Homo sapien
gatacttgcacacagtcaaaagcgc

SEQ ID NO: 515711 - DNA, 25 bp, Homo sapien
aaaagcgcagactggatggatggtc

SEQ ID NO: 515712 - DNA, 25 bp, Homo sapien
taaggcatttaagggtacactactg

SEQ ID NO: 515713 - DNA, 25 bp, Homo sapien
tacactactgtgtttcactgaccat

SEQ ID NO: 515714 - DNA, 25 bp, Homo sapien
gtttcactgaccatacatttttctt

SEQ ID NO: 515715 - DNA, 25 bp, Homo sapien
tttcttagcccctcaagtaatatag

SEQ ID NO: 515716 - DNA, 25 bp, Homo sapien
atgaatgacaattcccctaaccatt

SEQ ID NO: 515717 - DNA, 25 bp, Homo sapien
taaccattcctcttcatatctgcct

SEQ ID NO: 515718 - DNA, 25 bp, Homo sapien
aaactggtcataaaggcactctgtg

SEQ ID NO: 515719 - DNA, 25 bp, Homo sapien
gggactgacatcttaagctctcacc

SEQ ID NO: 515720 - DNA, 25 bp, Homo sapien
tcttaagctctcacctggctgcagt

SEQ ID NO: 515721 - DNA, 25 bp, Homo sapien
atactcttccctcaaaggaaactat

SEQ ID NO: 515722 - DNA, 25 bp, Homo sapien
gaaagagtgtgttcaaacatcataa

SEQ ID NO: 515723 - DNA, 25 bp, Homo sapien
gggatctcctccaaagagcagattt

SEQ ID NO: 515724 - DNA, 25 bp, Homo sapien
tcctccaaagagcagatttcagcat

SEQ ID NO: 515725 - DNA, 25 bp, Homo sapien
aaagagcagatttcagcattgcctg

SEQ ID NO: 515726 - DNA, 25 bp, Homo sapien
gagcagatttcagcattgcctgaca

SEQ ID NO: 515727 - DNA, 25 bp, Homo sapien
gcagatttcagcattgcctgacagt

SEQ ID NO: 515728 - DNA, 25 bp, Homo sapien
gatttcagcattgcctgacagtctt

SEQ ID NO: 515729 - DNA, 25 bp, Homo sapien
gcctgacagtcttggttttaggctt

SEQ ID NO: 515730 - DNA, 25 bp, Homo sapien
aacctgtgtgtttgtagagatttca

SEQ ID NO: 515731 - DNA, 25 bp, Homo sapien
tttcagacatcttctgatttcttct

SEQ ID NO: 515732 - DNA, 25 bp, Homo sapien
catctccacttctgattcatgctgc

SEQ ID NO: 515733 - DNA, 25 bp, Homo sapien
gcccctccttggtggccacaattta

SEQ ID NO: 515734 - DNA, 25 bp, Homo sapien
gtgtgccatcacagcaaaggtaggg

SEQ ID NO: 515735 - DNA, 25 bp, Homo sapien
ggccacaatttagccatgtcatctg

SEQ ID NO: 515736 - DNA, 25 bp, Homo sapien
atgtcatctggtggtgaccagctcc

SEQ ID NO: 515737 - DNA, 25 bp, Homo sapien
tttctgagcccttcctcttgactac

SEQ ID NO: 515738 - DNA, 25 bp, Homo sapien
tcttgactaccaggatcaccagaat

SEQ ID NO: 515739 - DNA, 25 bp, Homo sapien
ggatcaccagaatctaataagttag

SEQ ID NO: 515740 - DNA, 25 bp, Homo sapien
agttagccattctctattgcattcc

SEQ ID NO: 515741 - DNA, 25 bp, Homo sapien
tagccattctctattgcattccaga

SEQ ID NO: 515742 - DNA, 25 bp, Homo sapien
ttgcattccagattagggttagggt

SEQ ID NO: 515743 - DNA, 25 bp, Homo sapien
gggatctcctccaaagagcagattt

SEQ ID NO: 515744 - DNA, 25 bp, Homo sapien
ggatctcctccaaagagcagatttc

SEQ ID NO: 515745 - DNA, 25 bp, Homo sapien
atctcctccaaagagcagatttcag

SEQ ID NO: 515746 - DNA, 25 bp, Homo sapien
tcctccaaagagcagatttcagcat

SEQ ID NO: 515747 - DNA, 25 bp, Homo sapien
cctccaaagagcagatttcagcatt

SEQ ID NO: 515748 - DNA, 25 bp, Homo sapien
aaagagcagatttcagcattgcctg

SEQ ID NO: 515749 - DNA, 25 bp, Homo sapien
agagcagatttcagcattgcctgac

SEQ ID NO: 515750 - DNA, 25 bp, Homo sapien
gagcagatttcagcattgcctgaca

SEQ ID NO: 515751 - DNA, 25 bp, Homo sapien
gcagatttcagcattgcctgacagt

SEQ ID NO: 515752 - DNA, 25 bp, Homo sapien
gatttcagcattgcctgacagtctt

SEQ ID NO: 515753 - DNA, 25 bp, Homo sapien
gcctgacagtcttggttttaggctt

SEQ ID NO: 515754 - DNA, 25 bp, Homo sapien
gaggaggagcggtctaagcataaga

SEQ ID NO: 515755 - DNA, 25 bp, Homo sapien
tagacaaacacaagagcatccaaag

SEQ ID NO: 515756 - DNA, 25 bp, Homo sapien
gaaatagaaaccgtacatgtcagta

SEQ ID NO: 515757 - DNA, 25 bp, Homo sapien
gaaaccgtacatgtcagtacagaaa

SEQ ID NO: 515758 - DNA, 25 bp, Homo sapien
aaagccgagatgtagtctctaagaa

SEQ ID NO: 515759 - DNA, 25 bp, Homo sapien
agagtttacaagcacttctcctcag

SEQ ID NO: 515760 - DNA, 25 bp, Homo sapien
gtttacaagcacttctcctcagata

SEQ ID NO: 515761 - DNA, 25 bp, Homo sapien
gcacttctcctcagataacagtacc

SEQ ID NO: 515762 - DNA, 25 bp, Homo sapien
aacagtaccagtactcatcaagcca

SEQ ID NO: 515763 - DNA, 25 bp, Homo sapien
tactcatcaagccagtcacaaacag

SEQ ID NO: 515764 - DNA, 25 bp, Homo sapien
gccagtcacaaacagatacatcaga

SEQ ID NO: 515765 - DNA, 25 bp, Homo sapien
tgataacacaacagcaatcctctcc

SEQ ID NO: 515766 - DNA, 25 bp, Homo sapien
aatcctctcctctacgtggacttac

SEQ ID NO: 515767 - DNA, 25 bp, Homo sapien
ctctacgtggacttactgttgtttt

SEQ ID NO: 515768 - DNA, 25 bp, Homo sapien
gaatctgctctttctctgaatactg

SEQ ID NO: 515769 - DNA, 25 bp, Homo sapien
tctgctctttctctgaatactgttt

SEQ ID NO: 515770 - DNA, 25 bp, Homo sapien
ttctctgaatactgttttgacccca

SEQ ID NO: 515771 - DNA, 25 bp, Homo sapien
ctgaatactgttttgaccccaggca

SEQ ID NO: 515772 - DNA, 25 bp, Homo sapien
gaaaggccaaaacattaacagtagt

SEQ ID NO: 515773 - DNA, 25 bp, Homo sapien
acagtagtacttctgttcactgaag

SEQ ID NO: 515774 - DNA, 25 bp, Homo sapien
gttcactgaagagttatgttacatg

SEQ ID NO: 515775 - DNA, 25 bp, Homo sapien
gataaaatggttttgtcgtgtttat

SEQ ID NO: 515776 - DNA, 25 bp, Homo sapien
aagtggtagacatgaagggcaggta

SEQ ID NO: 515777 - DNA, 25 bp, Homo sapien
tatatattttaaacgaactgtgtaa

SEQ ID NO: 515778 - DNA, 25 bp, Homo sapien
gtaataagtatgagctaaggagaca

SEQ ID NO: 515779 - DNA, 25 bp, Homo sapien
gcaaaatgaatgcaatccttcattt

SEQ ID NO: 515780 - DNA, 25 bp, Homo sapien
atgcaatccttcatttgataagaga

SEQ ID NO: 515781 - DNA, 25 bp, Homo sapien
aatccttcatttgataagagagaac

SEQ ID NO: 515782 - DNA, 25 bp, Homo sapien
ctgttctctgtatcttaaatcaact

SEQ ID NO: 515783 - DNA, 25 bp, Homo sapien
ttctctgtatcttaaatcaactctg

SEQ ID NO: 515784 - DNA, 25 bp, Homo sapien
ctctgtatcttaaatcaactctgtg

SEQ ID NO: 515785 - DNA, 25 bp, Homo sapien
tgtgccaaagcagttctgtcccctg

SEQ ID NO: 515786 - DNA, 25 bp, Homo sapien
gccaaagcagttctgtcccctgact

SEQ ID NO: 515787 - DNA, 25 bp, Homo sapien
gatgggagggaaattctttgtatat

SEQ ID NO: 515788 - DNA, 25 bp, Homo sapien
acaaattccgtagatttagagctct

SEQ ID NO: 515789 - DNA, 25 bp, Homo sapien
aaattccgtagatttagagctctga

SEQ ID NO: 515790 - DNA, 25 bp, Homo sapien
attccgtagatttagagctctgaac

SEQ ID NO: 515791 - DNA, 25 bp, Homo sapien
ccgtagatttagagctctgaacttt

SEQ ID NO: 515792 - DNA, 25 bp, Homo sapien
agaatgtatagagacgttgggagat

SEQ ID NO: 515793 - DNA, 25 bp, Homo sapien
gtatagagacgttgggagattttaa

SEQ ID NO: 515794 - DNA, 25 bp, Homo sapien
gcaaaaagtgtcattctattataaa

SEQ ID NO: 515795 - DNA, 25 bp, Homo sapien
atatatggtattctaaatgttattc

SEQ ID NO: 515796 - DNA, 25 bp, Homo sapien
tctaaatgttattccatcgtgttgt

SEQ ID NO: 515797 - DNA, 25 bp, Homo sapien
taaatgttattccatcgtgttgtac

SEQ ID NO: 515798 - DNA, 25 bp, Homo sapien
aatgtattaccatctgacccacttc

SEQ ID NO: 515799 - DNA, 25 bp, Homo sapien
tggccagcctgttcacctgtctgct

SEQ ID NO: 515800 - DNA, 25 bp, Homo sapien
acctgtctgctgttcttcattgaac

SEQ ID NO: 515801 - DNA, 25 bp, Homo sapien
gaaggaatcacaattggtccatgac

SEQ ID NO: 515802 - DNA, 25 bp, Homo sapien
aattggtccatgacagtcacggtca

SEQ ID NO: 515803 - DNA, 25 bp, Homo sapien
tgacagtcacggtcatctcattcct

SEQ ID NO: 515804 - DNA, 25 bp, Homo sapien
atctcattcctcttgccagtggcag

SEQ ID NO: 515805 - DNA, 25 bp, Homo sapien
caggtgtatgtgtgagtttgcagct

SEQ ID NO: 515806 - DNA, 25 bp, Homo sapien
tttgcagctcaatcctggccaaggg

SEQ ID NO: 515807 - DNA, 25 bp, Homo sapien
caaggactgctgaagaggcatgtct

SEQ ID NO: 515808 - DNA, 25 bp, Homo sapien
agagctctgagagcccgagaaagat

SEQ ID NO: 515809 - DNA, 25 bp, Homo sapien
cccagcctgtagaggactttcttca

SEQ ID NO: 515810 - DNA, 25 bp, Homo sapien
aggactttcttcagggcccgtagct

SEQ ID NO: 515811 - DNA, 25 bp, Homo sapien
tagctgctgggcgtacccctggcag

SEQ ID NO: 515812 - DNA, 25 bp, Homo sapien
cgcgggcacatttgccttttgtgaa

SEQ ID NO: 515813 - DNA, 25 bp, Homo sapien
tttgtgaaggccgaactcgagctgt

SEQ ID NO: 515814 - DNA, 25 bp, Homo sapien
gaactcgagctgtatcctcatagga

SEQ ID NO: 515815 - DNA, 25 bp, Homo sapien
gagctgtatcctcataggaaacagt

SEQ ID NO: 515816 - DNA, 25 bp, Homo sapien
gaaacagtgatcaccccggacgggc

SEQ ID NO: 515817 - DNA, 25 bp, Homo sapien
gcatttaagcaagtgacttctggga

SEQ ID NO: 515818 - DNA, 25 bp, Homo sapien
gtgacttctgggaagtccccggccg

SEQ ID NO: 515819 - DNA, 25 bp, Homo sapien
gttctatgatatttgtagtgccggg

SEQ ID NO: 515820 - DNA, 25 bp, Homo sapien
aggtacaggctcagtctgcggccaa

SEQ ID NO: 515821 - DNA, 25 bp, Homo sapien
acaggctcagtctgcggccaagact

SEQ ID NO: 515822 - DNA, 25 bp, Homo sapien
cctgcaaggatattgtggctggaga

SEQ ID NO: 515823 - DNA, 25 bp, Homo sapien
atattgtggctggagacatgagcaa

SEQ ID NO: 515824 - DNA, 25 bp, Homo sapien
acatgagcaagaaaagcctctggga

SEQ ID NO: 515825 - DNA, 25 bp, Homo sapien
gcaagaaaagcctctgggagcagaa

SEQ ID NO: 515826 - DNA, 25 bp, Homo sapien
gaagggaggctccaagacctcatca

SEQ ID NO: 515827 - DNA, 25 bp, Homo sapien
ggctccaagacctcatcaacaatta

SEQ ID NO: 515828 - DNA, 25 bp, Homo sapien
atcaacaattaagatggactctgtg

SEQ ID NO: 515829 - DNA, 25 bp, Homo sapien
gatggactctgtgactacatgacta

SEQ ID NO: 515830 - DNA, 25 bp, Homo sapien
gactctgtgactacatgactaataa

SEQ ID NO: 515831 - DNA, 25 bp, Homo sapien
aaacaggcccttgagttgggagcct

SEQ ID NO: 515832 - DNA, 25 bp, Homo sapien
ttgggagcctgcttcactttgactt

SEQ ID NO: 515833 - DNA, 25 bp, Homo sapien
gttgctggagacaaagacatcgtga

SEQ ID NO: 515834 - DNA, 25 bp, Homo sapien
gaaagttcgcacaatctagtcggta

SEQ ID NO: 515835 - DNA, 25 bp, Homo sapien
aatctagtcggtaacagccactttc

SEQ ID NO: 515836 - DNA, 25 bp, Homo sapien
acagccactttccttgagaccaaga

SEQ ID NO: 515837 - DNA, 25 bp, Homo sapien
ggagagcacgggtccccgtctgaca

SEQ ID NO: 515838 - DNA, 25 bp, Homo sapien
tggccgctgccatattcaggtgtag

SEQ ID NO: 515839 - DNA, 25 bp, Homo sapien
caggtgtagctaattgctctggtgt

SEQ ID NO: 515840 - DNA, 25 bp, Homo sapien
ctctggtgtgggaatgcaggcctaa

SEQ ID NO: 515841 - DNA, 25 bp, Homo sapien
aatgcaggcctaatgacagaaatct

SEQ ID NO: 515842 - DNA, 25 bp, Homo sapien
cctgcaaggatattgtggctggaga

SEQ ID NO: 515843 - DNA, 25 bp, Homo sapien
gcaaggatattgtggctggagacat

SEQ ID NO: 515844 - DNA, 25 bp, Homo sapien
atattgtggctggagacatgagcaa

SEQ ID NO: 515845 - DNA, 25 bp, Homo sapien
ttgtggctggagacatgagcaagaa

SEQ ID NO: 515846 - DNA, 25 bp, Homo sapien
ggagacatgagcaagaaaagcctct

SEQ ID NO: 515847 - DNA, 25 bp, Homo sapien
acatgagcaagaaaagcctctggga

SEQ ID NO: 515848 - DNA, 25 bp, Homo sapien
agaagggaggctccaagacctcatc

SEQ ID NO: 515849 - DNA, 25 bp, Homo sapien
aagggaggctccaagacctcatcaa

SEQ ID NO: 515850 - DNA, 25 bp, Homo sapien
gaggctccaagacctcatcaacaat

SEQ ID NO: 515851 - DNA, 25 bp, Homo sapien
ggctccaagacctcatcaacaatta

SEQ ID NO: 515852 - DNA, 25 bp, Homo sapien
tccaagacctcatcaacaattaaga

SEQ ID NO: 515853 - DNA, 25 bp, Homo sapien
atagtttgtctatgcatgtataatg

SEQ ID NO: 515854 - DNA, 25 bp, Homo sapien
atgtataatgctgagaagggtctgc

SEQ ID NO: 515855 - DNA, 25 bp, Homo sapien
gaagggtctgcagtgaagaagataa

SEQ ID NO: 515856 - DNA, 25 bp, Homo sapien
aagaagataagatagacttctccag

SEQ ID NO: 515857 - DNA, 25 bp, Homo sapien
acttctccagcacaactattactca

SEQ ID NO: 515858 - DNA, 25 bp, Homo sapien
gcacaactattactcatttgataat

SEQ ID NO: 515859 - DNA, 25 bp, Homo sapien
tttgataattcagtttcatttttgc

SEQ ID NO: 515860 - DNA, 25 bp, Homo sapien
aagccatatcagaaaccaagttttt

SEQ ID NO: 515861 - DNA, 25 bp, Homo sapien
ggaagtagacatcatatcccagcta

SEQ ID NO: 515862 - DNA, 25 bp, Homo sapien
gacatcatatcccagctaaacaggg

SEQ ID NO: 515863 - DNA, 25 bp, Homo sapien
aactttgggaatagtttgtctatgc

SEQ ID NO: 515864 - DNA, 25 bp, Homo sapien
ggatgcccttgtgatggcccatgta

SEQ ID NO: 515865 - DNA, 25 bp, Homo sapien
tgatggcccatgtactcagtatgtg

SEQ ID NO: 515866 - DNA, 25 bp, Homo sapien
gtatgtgtacgagtgcttttctctc

SEQ ID NO: 515867 - DNA, 25 bp, Homo sapien
cttttctctctggagaatgagctgc

SEQ ID NO: 515868 - DNA, 25 bp, Homo sapien
tagttcttactctctacatcttcag

SEQ ID NO: 515869 - DNA, 25 bp, Homo sapien
ggtaagatagttgccacccacattt

SEQ ID NO: 515870 - DNA, 25 bp, Homo sapien
gccacccacatttttctacctaagt

SEQ ID NO: 515871 - DNA, 25 bp, Homo sapien
ctacctaagtttccttctagcaaag

SEQ ID NO: 515872 - DNA, 25 bp, Homo sapien
ggataccattcataaactcctggga

SEQ ID NO: 515873 - DNA, 25 bp, Homo sapien
actcctgggatacctaagggaatag

SEQ ID NO: 515874 - DNA, 25 bp, Homo sapien
aagggaatagtctcaagcagcagaa

SEQ ID NO: 515875 - DNA, 25 bp, Homo sapien
taaactccaaactgaagtggctctg

SEQ ID NO: 515876 - DNA, 25 bp, Homo sapien
gaaggtgaccaatgtcactgcttct

SEQ ID NO: 515877 - DNA, 25 bp, Homo sapien
gaccaatgtcactgcttctaaaata

SEQ ID NO: 515878 - DNA, 25 bp, Homo sapien
cactgcttctaaaatactgtcctaa

SEQ ID NO: 515879 - DNA, 25 bp, Homo sapien
aatactgtcctaaacaacccagaag

SEQ ID NO: 515880 - DNA, 25 bp, Homo sapien
tgtcctaaacaacccagaagatttt

SEQ ID NO: 515881 - DNA, 25 bp, Homo sapien
agaagattttatttcagctcatgaa

SEQ ID NO: 515882 - DNA, 25 bp, Homo sapien
agctcatgaatagctgttctaaatc

SEQ ID NO: 515883 - DNA, 25 bp, Homo sapien
ctaaatctgttgtatgttagacata

SEQ ID NO: 515884 - DNA, 25 bp, Homo sapien
tagacatactatgaactacctcttc

SEQ ID NO: 515885 - DNA, 25 bp, Homo sapien
gaactacctcttcacttattatggg

SEQ ID NO: 515886 - DNA, 25 bp, Homo sapien
gtgggcatccggtggtggtctgagc

SEQ ID NO: 515887 - DNA, 25 bp, Homo sapien
gtggtctgagccttggagtttccta

SEQ ID NO: 515888 - DNA, 25 bp, Homo sapien
ggtctgagccttggagtttcctaga

SEQ ID NO: 515889 - DNA, 25 bp, Homo sapien
tcctagatggttacctttctggaac

SEQ ID NO: 515890 - DNA, 25 bp, Homo sapien
atttgtttccgtaattctgtcctgt

SEQ ID NO: 515891 - DNA, 25 bp, Homo sapien
gtttccgtaattctgtcctgtcgac

SEQ ID NO: 515892 - DNA, 25 bp, Homo sapien
gtaattctgtcctgtcgacttctaa

SEQ ID NO: 515893 - DNA, 25 bp, Homo sapien
attctgtcctgtcgacttctaaaac

SEQ ID NO: 515894 - DNA, 25 bp, Homo sapien
gggaccatcggctctgacgctagta

SEQ ID NO: 515895 - DNA, 25 bp, Homo sapien
catcggctctgacgctagtaaatct

SEQ ID NO: 515896 - DNA, 25 bp, Homo sapien
tgacgctagtaaatctgcgcctgcg

SEQ ID NO: 515897 - DNA, 25 bp, Homo sapien
atcctctctgctcaaaattattgac

SEQ ID NO: 515898 - DNA, 25 bp, Homo sapien
ctgttcattatgtcaggcctcatgg

SEQ ID NO: 515899 - DNA, 25 bp, Homo sapien
attatgtcaggcctcatgggagcct

SEQ ID NO: 515900 - DNA, 25 bp, Homo sapien
gtcaggcctcatgggagcctggcct

SEQ ID NO: 515901 - DNA, 25 bp, Homo sapien
gggtcccgtgtgcacgcccaatcag

SEQ ID NO: 515902 - DNA, 25 bp, Homo sapien
gtgtgcacgcccaatcagaccgagc

SEQ ID NO: 515903 - DNA, 25 bp, Homo sapien
caatcagaccgagcacttgtgacac

SEQ ID NO: 515904 - DNA, 25 bp, Homo sapien
tcagaccgagcacttgtgacactac

SEQ ID NO: 515905 - DNA, 25 bp, Homo sapien
gagcacttgtgacactaccccaaca

SEQ ID NO: 515906 - DNA, 25 bp, Homo sapien
aacacctctcccagggctgaatgag

SEQ ID NO: 515907 - DNA, 25 bp, Homo sapien
ctgaatgaggaacgcgccactggac

SEQ ID NO: 515908 - DNA, 25 bp, Homo sapien
ttgggttcaacaaatgggaagcacc

SEQ ID NO: 515909 - DNA, 25 bp, Homo sapien
aagcaccagtgggagattagaagtt

SEQ ID NO: 515910 - DNA, 25 bp, Homo sapien
gaaatgatgttatttatttccctgg

SEQ ID NO: 515911 - DNA, 25 bp, Homo sapien
tcagttggctgtgttcctctactaa

SEQ ID NO: 515912 - DNA, 25 bp, Homo sapien
ggctgtgttcctctactaaatagta

SEQ ID NO: 515913 - DNA, 25 bp, Homo sapien
atcaggaatcctatctcttctgttc

SEQ ID NO: 515914 - DNA, 25 bp, Homo sapien
tgttcccaagcagttaccccagtta

SEQ ID NO: 515915 - DNA, 25 bp, Homo sapien
tacctcactaggtttagttcctgct

SEQ ID NO: 515916 - DNA, 25 bp, Homo sapien
agcttacagttattactagccccag

SEQ ID NO: 515917 - DNA, 25 bp, Homo sapien
actagccccagtatagttcactaca

SEQ ID NO: 515918 - DNA, 25 bp, Homo sapien
agttcactacaacttgttgctttac

SEQ ID NO: 515919 - DNA, 25 bp, Homo sapien
aatgactttgtcacaccagagcccc

SEQ ID NO: 515920 - DNA, 25 bp, Homo sapien
acccagcagcgagcttccaaaaaga

SEQ ID NO: 515921 - DNA, 25 bp, Homo sapien
cccaaagttgtcttctcaagtgatg

SEQ ID NO: 515922 - DNA, 25 bp, Homo sapien
gtgaggaagatctttcagcagagat

SEQ ID NO: 515923 - DNA, 25 bp, Homo sapien
gacagaagacgagacacccaagaaa

SEQ ID NO: 515924 - DNA, 25 bp, Homo sapien
aaaacaactcccattctcagagcat

SEQ ID NO: 515925 - DNA, 25 bp, Homo sapien
tcagagcatcggctcgcaggcacag

SEQ ID NO: 515926 - DNA, 25 bp, Homo sapien
caggcacagatcctaggaagtctgt

SEQ ID NO: 515927 - DNA, 25 bp, Homo sapien
tatcctgtagggtgacctggaattc

SEQ ID NO: 515928 - DNA, 25 bp, Homo sapien
gaattcgaattctgtttcccttgta

SEQ ID NO: 515929 - DNA, 25 bp, Homo sapien
ttcccttgtaaaatatttgtctgtc

SEQ ID NO: 515930 - DNA, 25 bp, Homo sapien
gggcagttttgccaaccagcctctg

SEQ ID NO: 515931 - DNA, 25 bp, Homo sapien
agcctctgctcatggtcaccatatg

SEQ ID NO: 515932 - DNA, 25 bp, Homo sapien
tcaccatatgtgtatgacaaggcct

SEQ ID NO: 515933 - DNA, 25 bp, Homo sapien
acaaggcctgagtgagttcctgcat

SEQ ID NO: 515934 - DNA, 25 bp, Homo sapien
agtgagttcctgcataaactgggta

SEQ ID NO: 515935 - DNA, 25 bp, Homo sapien
gataattgctttggttagaaggact

SEQ ID NO: 515936 - DNA, 25 bp, Homo sapien
agaaggactttacatttcctgattt

SEQ ID NO: 515937 - DNA, 25 bp, Homo sapien
atttcaagtccagcaccaatttaga

SEQ ID NO: 515938 - DNA, 25 bp, Homo sapien
agatgaaaccacctgtctttacctg

SEQ ID NO: 515939 - DNA, 25 bp, Homo sapien
cctgacagagtcataacggtttgtg

SEQ ID NO: 515940 - DNA, 25 bp, Homo sapien
tcagggaccttttttgttctttctg

SEQ ID NO: 515941 - DNA, 25 bp, Homo sapien
ggcagctcctatgagtgttaacctt

SEQ ID NO: 515942 - DNA, 25 bp, Homo sapien
gcagctcctatgagtgttaaccttg

SEQ ID NO: 515943 - DNA, 25 bp, Homo sapien
agctcctatgagtgttaaccttgat

SEQ ID NO: 515944 - DNA, 25 bp, Homo sapien
gctcctatgagtgttaaccttgatg

SEQ ID NO: 515945 - DNA, 25 bp, Homo sapien
tcctatgagtgttaaccttgatgcc

SEQ ID NO: 515946 - DNA, 25 bp, Homo sapien
ctatgagtgttaaccttgatgcctg

SEQ ID NO: 515947 - DNA, 25 bp, Homo sapien
tatgagtgttaaccttgatgcctga

SEQ ID NO: 515948 - DNA, 25 bp, Homo sapien
atgagtgttaaccttgatgcctgaa

SEQ ID NO: 515949 - DNA, 25 bp, Homo sapien
tgagtgttaaccttgatgcctgaaa

SEQ ID NO: 515950 - DNA, 25 bp, Homo sapien
gagtgttaaccttgatgcctgaaag

SEQ ID NO: 515951 - DNA, 25 bp, Homo sapien
agtgttaaccttgatgcctgaaaga

SEQ ID NO: 515952 - DNA, 25 bp, Homo sapien
tagttaagatggactatacaatgta

SEQ ID NO: 515953 - DNA, 25 bp, Homo sapien
ataagtctaaaagtggtggatcata

SEQ ID NO: 515954 - DNA, 25 bp, Homo sapien
gtctaaaagtggtggatcatatgtt

SEQ ID NO: 515955 - DNA, 25 bp, Homo sapien
aaagtggtggatcatatgttaaaac

SEQ ID NO: 515956 - DNA, 25 bp, Homo sapien
atatgttaaaacctgatctagatgt

SEQ ID NO: 515957 - DNA, 25 bp, Homo sapien
aacctgatctagatgtttctttaac

SEQ ID NO: 515958 - DNA, 25 bp, Homo sapien
cctgatctagatgtttctttaacca

SEQ ID NO: 515959 - DNA, 25 bp, Homo sapien
gatctagatgtttctttaaccaaga

SEQ ID NO: 515960 - DNA, 25 bp, Homo sapien
ctagatgtttctttaaccaagatga

SEQ ID NO: 515961 - DNA, 25 bp, Homo sapien
gatgtttctttaaccaagatgaatt

SEQ ID NO: 515962 - DNA, 25 bp, Homo sapien
taaaatatagtagagttccactgtg

SEQ ID NO: 515963 - DNA, 25 bp, Homo sapien
aatctgacagccaggataacgtgtc

SEQ ID NO: 515964 - DNA, 25 bp, Homo sapien
tctgacagccaggataacgtgtcca

SEQ ID NO: 515965 - DNA, 25 bp, Homo sapien
gacagccaggataacgtgtccagga

SEQ ID NO: 515966 - DNA, 25 bp, Homo sapien
cagccaggataacgtgtccaggaga

SEQ ID NO: 515967 - DNA, 25 bp, Homo sapien
caggataacgtgtccaggagagaca

SEQ ID NO: 515968 - DNA, 25 bp, Homo sapien
ctcgttatctatggcagatctatcc

SEQ ID NO: 515969 - DNA, 25 bp, Homo sapien
gttatctatggcagatctatccaat

SEQ ID NO: 515970 - DNA, 25 bp, Homo sapien
tatctatggcagatctatccaataa

SEQ ID NO: 515971 - DNA, 25 bp, Homo sapien
gagaaaggaccgcatacgcctggtt

SEQ ID NO: 515972 - DNA, 25 bp, Homo sapien
gaaaggaccgcatacgcctggttct

SEQ ID NO: 515973 - DNA, 25 bp, Homo sapien
aaggaccgcatacgcctggttctca

SEQ ID NO: 515974 - DNA, 25 bp, Homo sapien
tccagacctacgagcacaacgactg

SEQ ID NO: 515975 - DNA, 25 bp, Homo sapien
cagacctacgagcacaacgactgga

SEQ ID NO: 515976 - DNA, 25 bp, Homo sapien
agacctacgagcacaacgactggat

SEQ ID NO: 515977 - DNA, 25 bp, Homo sapien
gacctacgagcacaacgactggatc

SEQ ID NO: 515978 - DNA, 25 bp, Homo sapien
acctacgagcacaacgactggatca

SEQ ID NO: 515979 - DNA, 25 bp, Homo sapien
cctacgagcacaacgactggatcat

SEQ ID NO: 515980 - DNA, 25 bp, Homo sapien
ctacgagcacaacgactggatcatc

SEQ ID NO: 515981 - DNA, 25 bp, Homo sapien
tacgagcacaacgactggatcatcc

SEQ ID NO: 515982 - DNA, 25 bp, Homo sapien
tggctggcagcaagggcctaggaaa

SEQ ID NO: 515983 - DNA, 25 bp, Homo sapien
gtagtggttagcttttgagcttgaa

SEQ ID NO: 515984 - DNA, 25 bp, Homo sapien
gaccttgcagggtgatggcagggca

SEQ ID NO: 515985 - DNA, 25 bp, Homo sapien
ggcgcccagtgtagtgtgcttagta

SEQ ID NO: 515986 - DNA, 25 bp, Homo sapien
cgcccagtgtagtgtgcttagtaat

SEQ ID NO: 515987 - DNA, 25 bp, Homo sapien
cccagtgtagtgtgcttagtaattg

SEQ ID NO: 515988 - DNA, 25 bp, Homo sapien
tcaccagctgtcatccttggcttct

SEQ ID NO: 515989 - DNA, 25 bp, Homo sapien
tgtatctttgttacaagccctccgc

SEQ ID NO: 515990 - DNA, 25 bp, Homo sapien
atctttgttacaagccctccgcaat

SEQ ID NO: 515991 - DNA, 25 bp, Homo sapien
ttttgagcttgaaccccgcgttgaa

SEQ ID NO: 515992 - DNA, 25 bp, Homo sapien
gagcttgaaccccgcgttgaacaga

SEQ ID NO: 515993 - DNA, 25 bp, Homo sapien
tgtggacgctgtgctggttctgttt

SEQ ID NO: 515994 - DNA, 25 bp, Homo sapien
gctgtgctggttctgttttctaaag

SEQ ID NO: 515995 - DNA, 25 bp, Homo sapien
gcagaaggacaggtctctgagacag

SEQ ID NO: 515996 - DNA, 25 bp, Homo sapien
tctgagacaggatcgttgtccctac

SEQ ID NO: 515997 - DNA, 25 bp, Homo sapien
acaggatcgttgtccctacaggagg

SEQ ID NO: 515998 - DNA, 25 bp, Homo sapien
atcgttgtccctacaggaggaacag

SEQ ID NO: 515999 - DNA, 25 bp, Homo sapien
aggaacagtggccttgcttcttaga

SEQ ID NO: 516000 - DNA, 25 bp, Homo sapien
ggccttgcttcttagacggtcttca

SEQ ID NO: 516001 - DNA, 25 bp, Homo sapien
cttagacggtcttcactgtgtgttt

SEQ ID NO: 516002 - DNA, 25 bp, Homo sapien
ttttgacctgtaacttaaagatcat

SEQ ID NO: 516003 - DNA, 25 bp, Homo sapien
ggcaataatattttctgtgtaagct

SEQ ID NO: 516004 - DNA, 25 bp, Homo sapien
gtagtgtgggctcaacagtgccaaa

SEQ ID NO: 516005 - DNA, 25 bp, Homo sapien
agttggtgaaacatgccagctagca

SEQ ID NO: 516006 - DNA, 25 bp, Homo sapien
acatgccagctagcaggaccagtaa

SEQ ID NO: 516007 - DNA, 25 bp, Homo sapien
gaccagtaaaggcataatcaggcat

SEQ ID NO: 516008 - DNA, 25 bp, Homo sapien
aatcaggcatttggcaaagcttgct

SEQ ID NO: 516009 - DNA, 25 bp, Homo sapien
aaagcttgcttttctaattcaatga

SEQ ID NO: 516010 - DNA, 25 bp, Homo sapien
atgttatagtggcacttccccagta

SEQ ID NO: 516011 - DNA, 25 bp, Homo sapien
gtggcacttccccagtatggaataa

SEQ ID NO: 516012 - DNA, 25 bp, Homo sapien
atatactgtcatattcagatgtcat

SEQ ID NO: 516013 - DNA, 25 bp, Homo sapien
atggatgagtcacagaggagctatc

SEQ ID NO: 516014 - DNA, 25 bp, Homo sapien
ggagctatcagatgctctcatgact

SEQ ID NO: 516015 - DNA, 25 bp, Homo sapien
attattctgcattgatacttatctc

SEQ ID NO: 516016 - DNA, 25 bp, Homo sapien
gatacttatctcttactcttaaaat

SEQ ID NO: 516017 - DNA, 25 bp, Homo sapien
tctcttactcttaaaattcgctatg

SEQ ID NO: 516018 - DNA, 25 bp, Homo sapien
tactcttaaaattcgctatgtatta

SEQ ID NO: 516019 - DNA, 25 bp, Homo sapien
atatctgctacaacactgagttcat

SEQ ID NO: 516020 - DNA, 25 bp, Homo sapien
aggaatgatcactattttaataaga

SEQ ID NO: 516021 - DNA, 25 bp, Homo sapien
ctgctacaacactgagttcatggct

SEQ ID NO: 516022 - DNA, 25 bp, Homo sapien
aataagatgttctttaccatatatt

SEQ ID NO: 516023 - DNA, 25 bp, Homo sapien
tggcttttcacacataattgctcaa

SEQ ID NO: 516024 - DNA, 25 bp, Homo sapien
aattgctcaacagagcaggtgccat

SEQ ID NO: 516025 - DNA, 25 bp, Homo sapien
aacagagcaggtgccatggaaagtc

SEQ ID NO: 516026 - DNA, 25 bp, Homo sapien
gatgggcactatccttgagggactt

SEQ ID NO: 516027 - DNA, 25 bp, Homo sapien
tgggcactatccttgagggacttac

SEQ ID NO: 516028 - DNA, 25 bp, Homo sapien
gcactatccttgagggacttaccct

SEQ ID NO: 516029 - DNA, 25 bp, Homo sapien
tatccttgagggacttaccctttct

SEQ ID NO: 516030 - DNA, 25 bp, Homo sapien
agggacttaccctttctaatcagct

SEQ ID NO: 516031 - DNA, 25 bp, Homo sapien
gacttaccctttctaatcagctttg

SEQ ID NO: 516032 - DNA, 25 bp, Homo sapien
ttaccctttctaatcagctttgcat

SEQ ID NO: 516033 - DNA, 25 bp, Homo sapien
accctttctaatcagctttgcatgg

SEQ ID NO: 516034 - DNA, 25 bp, Homo sapien
tctaatcagctttgcatggtttgtt

SEQ ID NO: 516035 - DNA, 25 bp, Homo sapien
tcaaactcctggattatctccctgg

SEQ ID NO: 516036 - DNA, 25 bp, Homo sapien
aaactcctggattatctccctggcc

SEQ ID NO: 516037 - DNA, 25 bp, Homo sapien
cccagatacgtctgcggttccggct

SEQ ID NO: 516038 - DNA, 25 bp, Homo sapien
ccagatacgtctgcggttccggctc

SEQ ID NO: 516039 - DNA, 25 bp, Homo sapien
agatacgtctgcggttccggctccg

SEQ ID NO: 516040 - DNA, 25 bp, Homo sapien
gatacgtctgcggttccggctccgc

SEQ ID NO: 516041 - DNA, 25 bp, Homo sapien
atacgtctgcggttccggctccgcc

SEQ ID NO: 516042 - DNA, 25 bp, Homo sapien
tacgtctgcggttccggctccgcca

SEQ ID NO: 516043 - DNA, 25 bp, Homo sapien
acgtctgcggttccggctccgccac

SEQ ID NO: 516044 - DNA, 25 bp, Homo sapien
tgcggttccggctccgccaccctca

SEQ ID NO: 516045 - DNA, 25 bp, Homo sapien
tccggctccgccaccctcagcttct

SEQ ID NO: 516046 - DNA, 25 bp, Homo sapien
ctgggagccgagtgcggaaggaggg

SEQ ID NO: 516047 - DNA, 25 bp, Homo sapien
ctttgggaagccagaggacacccct

SEQ ID NO: 516048 - DNA, 25 bp, Homo sapien
agtgttgaaagaacggttggtgtct

SEQ ID NO: 516049 - DNA, 25 bp, Homo sapien
agaacggttggtgtctgtgtgattt

SEQ ID NO: 516050 - DNA, 25 bp, Homo sapien
gtctgtgtgattttccttgagtctg

SEQ ID NO: 516051 - DNA, 25 bp, Homo sapien
tcttctgcagcttgccatgactgcc

SEQ ID NO: 516052 - DNA, 25 bp, Homo sapien
cagcttgccatgactgcctgggaaa

SEQ ID NO: 516053 - DNA, 25 bp, Homo sapien
gcttgccatgactgcctgggaaaga

SEQ ID NO: 516054 - DNA, 25 bp, Homo sapien
gccatgactgcctgggaaagagtag

SEQ ID NO: 516055 - DNA, 25 bp, Homo sapien
gagtaacaagaaaccaaccgtgtgt

SEQ ID NO: 516056 - DNA, 25 bp, Homo sapien
gagtagggaaatacccagagccaaa

SEQ ID NO: 516057 - DNA, 25 bp, Homo sapien
cagagccaaaacctcctttcagtcc

SEQ ID NO: 516058 - DNA, 25 bp, Homo sapien
aagaaaccaaccgtgtgtgagaggg

SEQ ID NO: 516059 - DNA, 25 bp, Homo sapien
gacctgcataaggattgcgtctcat

SEQ ID NO: 516060 - DNA, 25 bp, Homo sapien
taaggattgcgtctcattttattgt

SEQ ID NO: 516061 - DNA, 25 bp, Homo sapien
tttattgtgtagtgctttttcgaaa

SEQ ID NO: 516062 - DNA, 25 bp, Homo sapien
ggttcccatgttcatgtattctgga

SEQ ID NO: 516063 - DNA, 25 bp, Homo sapien
tttcttgattactgggcagacccta

SEQ ID NO: 516064 - DNA, 25 bp, Homo sapien
aacatgtagttagctgtctgctcat

SEQ ID NO: 516065 - DNA, 25 bp, Homo sapien
gctgtctgctcatggtttgttcaaa

SEQ ID NO: 516066 - DNA, 25 bp, Homo sapien
gtttgttcaaatctaagctaacctt

SEQ ID NO: 516067 - DNA, 25 bp, Homo sapien
aaccttaatggtgctgtgtccgctg

SEQ ID NO: 516068 - DNA, 25 bp, Homo sapien
tgtgtccgctgtccacagaaaacgc

SEQ ID NO: 516069 - DNA, 25 bp, Homo sapien
ctaccttactccttagagcttattt

SEQ ID NO: 516070 - DNA, 25 bp, Homo sapien
tttccccagtgcaaaacctcgatat

SEQ ID NO: 516071 - DNA, 25 bp, Homo sapien
atggttgtttgactttactgcgctt

SEQ ID NO: 516072 - DNA, 25 bp, Homo sapien
tttactgcgcttgggccagcagaat

SEQ ID NO: 516073 - DNA, 25 bp, Homo sapien
gcagaatccagttaagtccactaat

SEQ ID NO: 516074 - DNA, 25 bp, Homo sapien
cactaataagctcttggcctgtctt

SEQ ID NO: 516075 - DNA, 25 bp, Homo sapien
aaaatagactgaccctatcaccctg

SEQ ID NO: 516076 - DNA, 25 bp, Homo sapien
accctgctaacttggccagtcagta

SEQ ID NO: 516077 - DNA, 25 bp, Homo sapien
agaggcttcattcaagagatttact

SEQ ID NO: 516078 - DNA, 25 bp, Homo sapien
gttgtaactattggaacccagggat

SEQ ID NO: 516079 - DNA, 25 bp, Homo sapien
aacccagggatgatttcaggatttt

SEQ ID NO: 516080 - DNA, 25 bp, Homo sapien
gggcctgagccttatctagtaaaaa

SEQ ID NO: 516081 - DNA, 25 bp, Homo sapien
cagagaggcgccttcagagacccag

SEQ ID NO: 516082 - DNA, 25 bp, Homo sapien
agagaggcgccttcagagacccagc

SEQ ID NO: 516083 - DNA, 25 bp, Homo sapien
ttcagagacccagcgcttacacaat

SEQ ID NO: 516084 - DNA, 25 bp, Homo sapien
agagacccagcgcttacacaatacc

SEQ ID NO: 516085 - DNA, 25 bp, Homo sapien
agcgcttacacaatacccaccatgt

SEQ ID NO: 516086 - DNA, 25 bp, Homo sapien
tatcaagaagaagcgcccccctgtg

SEQ ID NO: 516087 - DNA, 25 bp, Homo sapien
ccgaggaaacctgaccaagaaccag

SEQ ID NO: 516088 - DNA, 25 bp, Homo sapien
ccaagacctaccaggtcatgcgaga

SEQ ID NO: 516089 - DNA, 25 bp, Homo sapien
gacctaccaggtcatgcgagagtgt

SEQ ID NO: 516090 - DNA, 25 bp, Homo sapien
cctaccaggtcatgcgagagtgtga

SEQ ID NO: 516091 - DNA, 25 bp, Homo sapien
ccaggtcatgcgagagtgtgagcaa

SEQ ID NO: 516092 - DNA, 25 bp, Homo sapien
gcagcacaatgagtagttcttgacc

SEQ ID NO: 516093 - DNA, 25 bp, Homo sapien
agcacaatgagtagttcttgacccg

SEQ ID NO: 516094 - DNA, 25 bp, Homo sapien
ggtcgccctgaaggtgtcgcatgaa

SEQ ID NO: 516095 - DNA, 25 bp, Homo sapien
gtcgccctgaaggtgtcgcatgaag

SEQ ID NO: 516096 - DNA, 25 bp, Homo sapien
tggattcgccttggctaggtgccag

SEQ ID NO: 516097 - DNA, 25 bp, Homo sapien
attcgccttggctaggtgccaggca

SEQ ID NO: 516098 - DNA, 25 bp, Homo sapien
tagcttatgtcacagcccgaaccag

SEQ ID NO: 516099 - DNA, 25 bp, Homo sapien
gcttatgtcacagcccgaaccagat

SEQ ID NO: 516100 - DNA, 25 bp, Homo sapien
gtcacagcccgaaccagatcgactg

SEQ ID NO: 516101 - DNA, 25 bp, Homo sapien
acagcccgaaccagatcgactggtc

SEQ ID NO: 516102 - DNA, 25 bp, Homo sapien
tccaccccagacttccgcaaactga

SEQ ID NO: 516103 - DNA, 25 bp, Homo sapien
tccacaagacaccagaattcacacg

SEQ ID NO: 516104 - DNA, 25 bp, Homo sapien
aattcacacggtactcagaggcact

SEQ ID NO: 516105 - DNA, 25 bp, Homo sapien
agagacctgtccataatacccaaca

SEQ ID NO: 516106 - DNA, 25 bp, Homo sapien
atgtctgtggtgtacaagtcgtttt

SEQ ID NO: 516107 - DNA, 25 bp, Homo sapien
tttggtataacttctttcctgctgc

SEQ ID NO: 516108 - DNA, 25 bp, Homo sapien
gctgcttcccggcaaacatagtttt

SEQ ID NO: 516109 - DNA, 25 bp, Homo sapien
agttttcctatttcaggcagagtgc

SEQ ID NO: 516110 - DNA, 25 bp, Homo sapien
ggcagagtgcggtatattccaggaa

SEQ ID NO: 516111 - DNA, 25 bp, Homo sapien
gaaacactgtttcctactcacttag

SEQ ID NO: 516112 - DNA, 25 bp, Homo sapien
actcacttagcttacttctttgttg

SEQ ID NO: 516113 - DNA, 25 bp, Homo sapien
tttgttgaatgcctcactaatggca

SEQ ID NO: 516114 - DNA, 25 bp, Homo sapien
gtggagattggatcaactgagttgt

SEQ ID NO: 516115 - DNA, 25 bp, Homo sapien
ttttgttttaagtcaccttgtgcga

SEQ ID NO: 516116 - DNA, 25 bp, Homo sapien
aagtcaccttgtgcgagaacctcaa

SEQ ID NO: 516117 - DNA, 25 bp, Homo sapien
cgcacctatcttgggaaccgggtat

SEQ ID NO: 516118 - DNA, 25 bp, Homo sapien
gggtatacccttttctttagcactg

SEQ ID NO: 516119 - DNA, 25 bp, Homo sapien
ctttagcactgctatcctttttgtc

SEQ ID NO: 516120 - DNA, 25 bp, Homo sapien
gctatcctttttgtcttcagcacaa

SEQ ID NO: 516121 - DNA, 25 bp, Homo sapien
agatgttcaagtgagccagaagcaa

SEQ ID NO: 516122 - DNA, 25 bp, Homo sapien
cagaagcaagaagagccattttagt

SEQ ID NO: 516123 - DNA, 25 bp, Homo sapien
gagccattttagtcttcatagctat

SEQ ID NO: 516124 - DNA, 25 bp, Homo sapien
gctgatggtctattttaaccttgaa

SEQ ID NO: 516125 - DNA, 25 bp, Homo sapien
ggagaacctgacaccggagagctca

SEQ ID NO: 516126 - DNA, 25 bp, Homo sapien
tgacaccggagagctcaagaagttc

SEQ ID NO: 516127 - DNA, 25 bp, Homo sapien
cgccatcagggcagctagatatcgt

SEQ ID NO: 516128 - DNA, 25 bp, Homo sapien
ggcagctagatatcgtggacctcac

SEQ ID NO: 516129 - DNA, 25 bp, Homo sapien
ctagatatcgtggacctcaccgaca

SEQ ID NO: 516130 - DNA, 25 bp, Homo sapien
aggtaggacctgatggctccaggcc

SEQ ID NO: 516131 - DNA, 25 bp, Homo sapien
aagctggtcgcctcctactacgagg

SEQ ID NO: 516132 - DNA, 25 bp, Homo sapien
tactacgaggactacgcagccgagc

SEQ ID NO: 516133 - DNA, 25 bp, Homo sapien
gactacgcagccgagctcgtcgtgg

SEQ ID NO: 516134 - DNA, 25 bp, Homo sapien
tcgtcgtggccgtgctgcgcgacat

SEQ ID NO: 516135 - DNA, 25 bp, Homo sapien
catgggaacgaagcgcgaggccatc

SEQ ID NO: 516136 - DNA, 25 bp, Homo sapien
gtctaaacgttgtgatggccccaat

SEQ ID NO: 516137 - DNA, 25 bp, Homo sapien
atggccccaatggtcactatagctg

SEQ ID NO: 516138 - DNA, 25 bp, Homo sapien
tggtcactatagctgctgcccagaa

SEQ ID NO: 516139 - DNA, 25 bp, Homo sapien
gcagatccaagcaagacagtcaggc

SEQ ID NO: 516140 - DNA, 25 bp, Homo sapien
ttggccttcactgggtggcatttag

SEQ ID NO: 516141 - DNA, 25 bp, Homo sapien
gcatatgagttcttaaccgctccac

SEQ ID NO: 516142 - DNA, 25 bp, Homo sapien
aagcttggaaacttggcccctggat

SEQ ID NO: 516143 - DNA, 25 bp, Homo sapien
tggcccctggatcctaggtctgaga

SEQ ID NO: 516144 - DNA, 25 bp, Homo sapien
ggtctgagaccacaacctaagttca

SEQ ID NO: 516145 - DNA, 25 bp, Homo sapien
ggaaatctggtgcacatccagtcaa

SEQ ID NO: 516146 - DNA, 25 bp, Homo sapien
gtgctgctgcacaaacctgtctaaa

SEQ ID NO: 516147 - DNA, 25 bp, Homo sapien
ctgtgaccagaagggaaaggcggct

SEQ ID NO: 516148 - DNA, 25 bp, Homo sapien
gaaaggcggctgtttggctctttct

SEQ ID NO: 516149 - DNA, 25 bp, Homo sapien
aaggacccgctgacccgctggatgg

SEQ ID NO: 516150 - DNA, 25 bp, Homo sapien
gctgacccgctggatggagagcaaa

SEQ ID NO: 516151 - DNA, 25 bp, Homo sapien
gagagcaaaggagacccctcccgag

SEQ ID NO: 516152 - DNA, 25 bp, Homo sapien
gagccgctcacagtcctgtatttgg

SEQ ID NO: 516153 - DNA, 25 bp, Homo sapien
ctcacagtcctgtatttggcaggtt

SEQ ID NO: 516154 - DNA, 25 bp, Homo sapien
catccgtgctcctggtaaaggggga

SEQ ID NO: 516155 - DNA, 25 bp, Homo sapien
agagagcctcaccttgccacatatt

SEQ ID NO: 516156 - DNA, 25 bp, Homo sapien
gagcctcaccttgccacatatttga

SEQ ID NO: 516157 - DNA, 25 bp, Homo sapien
gccacatatttgaacagtgatgagt

SEQ ID NO: 516158 - DNA, 25 bp, Homo sapien
aaagcatgtccacagtgatttgaaa

SEQ ID NO: 516159 - DNA, 25 bp, Homo sapien
aagcatgtccacagtgatttgaaaa

SEQ ID NO: 516160 - DNA, 25 bp, Homo sapien
agcatgtccacagtgatttgaaaac

SEQ ID NO: 516161 - DNA, 25 bp, Homo sapien
gcatgtccacagtgatttgaaaacc

SEQ ID NO: 516162 - DNA, 25 bp, Homo sapien
catgtccacagtgatttgaaaaccc

SEQ ID NO: 516163 - DNA, 25 bp, Homo sapien
atgtccacagtgatttgaaaaccca

SEQ ID NO: 516164 - DNA, 25 bp, Homo sapien
tgtccacagtgatttgaaaacccaa

SEQ ID NO: 516165 - DNA, 25 bp, Homo sapien
gtccacagtgatttgaaaacccaag

SEQ ID NO: 516166 - DNA, 25 bp, Homo sapien
aaaattcaaaagttagccagttatg

SEQ ID NO: 516167 - DNA, 25 bp, Homo sapien
aaattcaaaagttagccagttatgg

SEQ ID NO: 516168 - DNA, 25 bp, Homo sapien
tggctggcaagctcctggccagcga

SEQ ID NO: 516169 - DNA, 25 bp, Homo sapien
ggctggcaagctcctggccagcgac

SEQ ID NO: 516170 - DNA, 25 bp, Homo sapien
gctggcaagctcctggccagcgacg

SEQ ID NO: 516171 - DNA, 25 bp, Homo sapien
ctggcaagctcctggccagcgacgc

SEQ ID NO: 516172 - DNA, 25 bp, Homo sapien
tggcaagctcctggccagcgacgcc

SEQ ID NO: 516173 - DNA, 25 bp, Homo sapien
ggcaagctcctggccagcgacgccg

SEQ ID NO: 516174 - DNA, 25 bp, Homo sapien
gcaagctcctggccagcgacgccga

SEQ ID NO: 516175 - DNA, 25 bp, Homo sapien
caagctcctggccagcgacgccgag

SEQ ID NO: 516176 - DNA, 25 bp, Homo sapien
ctggccagcgacgccgaggccttgt

SEQ ID NO: 516177 - DNA, 25 bp, Homo sapien
tggccagcgacgccgaggccttgtc

SEQ ID NO: 516178 - DNA, 25 bp, Homo sapien
gccagcgacgccgaggccttgtccc

SEQ ID NO: 516179 - DNA, 25 bp, Homo sapien
atcttctgggacagggttgtaactc

SEQ ID NO: 516180 - DNA, 25 bp, Homo sapien
acagggttgtaactcagccttccaa

SEQ ID NO: 516181 - DNA, 25 bp, Homo sapien
ttctttattggctgttattctgtat

SEQ ID NO: 516182 - DNA, 25 bp, Homo sapien
gtataacactcatatctttgccaaa

SEQ ID NO: 516183 - DNA, 25 bp, Homo sapien
atttaggcaactgatggtccttttg

SEQ ID NO: 516184 - DNA, 25 bp, Homo sapien
gatggtccttttgcatttaggattt

SEQ ID NO: 516185 - DNA, 25 bp, Homo sapien
ttcgttgttgttaccttatacctca

SEQ ID NO: 516186 - DNA, 25 bp, Homo sapien
gttgttaccttatacctcatgatat

SEQ ID NO: 516187 - DNA, 25 bp, Homo sapien
aggaatgggctcatgtgtcttccgt

SEQ ID NO: 516188 - DNA, 25 bp, Homo sapien
ctcatgtgtcttccgtcttttggaa

SEQ ID NO: 516189 - DNA, 25 bp, Homo sapien
tccgtcttttggaaggaggttgaca

SEQ ID NO: 516190 - DNA, 25 bp, Homo sapien
accaccacccgagcctgggagccag

SEQ ID NO: 516191 - DNA, 25 bp, Homo sapien
tcccagcctaatcacggatctgctg

SEQ ID NO: 516192 - DNA, 25 bp, Homo sapien
tgctcagccttgtgccagccagact

SEQ ID NO: 516193 - DNA, 25 bp, Homo sapien
agccttgtgccagccagactcgtat

SEQ ID NO: 516194 - DNA, 25 bp, Homo sapien
ttgtgccagccagactcgtatgagg

SEQ ID NO: 516195 - DNA, 25 bp, Homo sapien
gtgccagccagactcgtatgaggct

SEQ ID NO: 516196 - DNA, 25 bp, Homo sapien
gccagccagactcgtatgaggctcc

SEQ ID NO: 516197 - DNA, 25 bp, Homo sapien
catcctaagctccaagcatgtctgg

SEQ ID NO: 516198 - DNA, 25 bp, Homo sapien
taagctccaagcatgtctgggccag

SEQ ID NO: 516199 - DNA, 25 bp, Homo sapien
aagctccaagcatgtctgggccagg

SEQ ID NO: 516200 - DNA, 25 bp, Homo sapien
caccaccagtctgaatggtcctggg

SEQ ID NO: 516201 - DNA, 25 bp, Homo sapien
aacactccagtattgatgcagtcaa

SEQ ID NO: 516202 - DNA, 25 bp, Homo sapien
gatgcagtcaatcttgtataacatt

SEQ ID NO: 516203 - DNA, 25 bp, Homo sapien
gtgcaaagcacgatgttggaaatta

SEQ ID NO: 516204 - DNA, 25 bp, Homo sapien
gacaaaaactcttgctctcaaagat

SEQ ID NO: 516205 - DNA, 25 bp, Homo sapien
actcttgctctcaaagatgtcagtc

SEQ ID NO: 516206 - DNA, 25 bp, Homo sapien
gctctcaaagatgtcagtctttttc

SEQ ID NO: 516207 - DNA, 25 bp, Homo sapien
tttctttgcaaggataacacatgta

SEQ ID NO: 516208 - DNA, 25 bp, Homo sapien
tgtatgttaacacccatgtcaccac

SEQ ID NO: 516209 - DNA, 25 bp, Homo sapien
acccatgtcaccaccatgtttagga

SEQ ID NO: 516210 - DNA, 25 bp, Homo sapien
gtcaccaccatgtttaggacatttc

SEQ ID NO: 516211 - DNA, 25 bp, Homo sapien
caccatgtttaggacatttccagca

SEQ ID NO: 516212 - DNA, 25 bp, Homo sapien
gaatacactttgttctggcaagagc

SEQ ID NO: 516213 - DNA, 25 bp, Homo sapien
tgagaagccgtgttacctaccacta

SEQ ID NO: 516214 - DNA, 25 bp, Homo sapien
ctaccactacctgggattaattcag

SEQ ID NO: 516215 - DNA, 25 bp, Homo sapien
ttaattcagggagcgggataattct

SEQ ID NO: 516216 - DNA, 25 bp, Homo sapien
ataattctggatatgactggtaaaa

SEQ ID NO: 516217 - DNA, 25 bp, Homo sapien
gatattaatttctactactactccc

SEQ ID NO: 516218 - DNA, 25 bp, Homo sapien
actactactcccaaaagtctagaag

SEQ ID NO: 516219 - DNA, 25 bp, Homo sapien
gttatctttgttgacttaatttcta

SEQ ID NO: 516220 - DNA, 25 bp, Homo sapien
taacttcttagaaagctgacttcct

SEQ ID NO: 516221 - DNA, 25 bp, Homo sapien
aaagctgacttcctttccatgtaca

SEQ ID NO: 516222 - DNA, 25 bp, Homo sapien
ctttccatgtacatttcaaactgaa

SEQ ID NO: 516223 - DNA, 25 bp, Homo sapien
ctgtggaagctcaggcgctgcgcgt

SEQ ID NO: 516224 - DNA, 25 bp, Homo sapien
cgctgcgcgtgagaggtcccagata

SEQ ID NO: 516225 - DNA, 25 bp, Homo sapien
gctgcgcgtgagaggtcccagatac

SEQ ID NO: 516226 - DNA, 25 bp, Homo sapien
tgcgcgtgagaggtcccagatacgt

SEQ ID NO: 516227 - DNA, 25 bp, Homo sapien
cgcgtgagaggtcccagatacgtct

SEQ ID NO: 516228 - DNA, 25 bp, Homo sapien
agaggtcccagatacgtctgcggtt

SEQ ID NO: 516229 - DNA, 25 bp, Homo sapien
ggtcccagatacgtctgcggttccg

SEQ ID NO: 516230 - DNA, 25 bp, Homo sapien
gaacggccctagctttgggaagcca

SEQ ID NO: 516231 - DNA, 25 bp, Homo sapien
ctttgggaagccagaggacacccct

SEQ ID NO: 516232 - DNA, 25 bp, Homo sapien
cagaggctcgcgcactcagcaggtt

SEQ ID NO: 516233 - DNA, 25 bp, Homo sapien
agaggctcgcgcactcagcaggttg

SEQ ID NO: 516234 - DNA, 25 bp, Homo sapien
tggctgatgctggcctgtaattttt

SEQ ID NO: 516235 - DNA, 25 bp, Homo sapien
ttgtgtgttgtttgatttgtttata

SEQ ID NO: 516236 - DNA, 25 bp, Homo sapien
ttgtgagatattggatgtgtggcta

SEQ ID NO: 516237 - DNA, 25 bp, Homo sapien
tggatgtgtggctatttttcctttc

SEQ ID NO: 516238 - DNA, 25 bp, Homo sapien
gtattattcatacagctttggtttg

SEQ ID NO: 516239 - DNA, 25 bp, Homo sapien
cagctttggtttgtatattctgtat

SEQ ID NO: 516240 - DNA, 25 bp, Homo sapien
atattctgtatagcctaactacaca

SEQ ID NO: 516241 - DNA, 25 bp, Homo sapien
gtatagcctaactacacacatcaaa

SEQ ID NO: 516242 - DNA, 25 bp, Homo sapien
tagcctaactacacacatcaaaatg

SEQ ID NO: 516243 - DNA, 25 bp, Homo sapien
caaaatgtatgtcaaccaagtgttt

SEQ ID NO: 516244 - DNA, 25 bp, Homo sapien
gtcaaccaagtgtttagaatgaaat

SEQ ID NO: 516245 - DNA, 25 bp, Homo sapien
gaagctgctgcttatcaattagtaa

SEQ ID NO: 516246 - DNA, 25 bp, Homo sapien
gctgctgcttatcaattagtaatta

SEQ ID NO: 516247 - DNA, 25 bp, Homo sapien
agaggtgcaaagaaacaaggcattt

SEQ ID NO: 516248 - DNA, 25 bp, Homo sapien
gaatacactgtattattacctgcaa

SEQ ID NO: 516249 - DNA, 25 bp, Homo sapien
attacctgcaatactcatggaaaca

SEQ ID NO: 516250 - DNA, 25 bp, Homo sapien
gcaatactcatggaaacaacgaagg

SEQ ID NO: 516251 - DNA, 25 bp, Homo sapien
gaaacaacgaaggaacatcctgaaa

SEQ ID NO: 516252 - DNA, 25 bp, Homo sapien
aatgaagggactggctttatcaaca

SEQ ID NO: 516253 - DNA, 25 bp, Homo sapien
ggactggctttatcaacaatgccaa

SEQ ID NO: 516254 - DNA, 25 bp, Homo sapien
taactccttggatgttcagctttgt

SEQ ID NO: 516255 - DNA, 25 bp, Homo sapien
cttggatgttcagctttgtaagatt

SEQ ID NO: 516256 - DNA, 25 bp, Homo sapien
caccacttacaagctggctgttgaa

SEQ ID NO: 516257 - DNA, 25 bp, Homo sapien
atgagagcggtttcttacagtctac

SEQ ID NO: 516258 - DNA, 25 bp, Homo sapien
tttcttacagtctacccggcgttgt

SEQ ID NO: 516259 - DNA, 25 bp, Homo sapien
gcagtggctgtcagccttcaattaa

SEQ ID NO: 516260 - DNA, 25 bp, Homo sapien
ggctgtcagccttcaattaatacct

SEQ ID NO: 516261 - DNA, 25 bp, Homo sapien
tccagcctagacaatggagcaaggt

SEQ ID NO: 516262 - DNA, 25 bp, Homo sapien
ggagcaaggtggacggatctcaaaa

SEQ ID NO: 516263 - DNA, 25 bp, Homo sapien
ttaatctgaccagttttcaaatgtc

SEQ ID NO: 516264 - DNA, 25 bp, Homo sapien
gttttcaaatgtctggagccttatc

SEQ ID NO: 516265 - DNA, 25 bp, Homo sapien
tggagccttatcaccagctgtttct

SEQ ID NO: 516266 - DNA, 25 bp, Homo sapien
cttatcaccagctgtttcttcctca

SEQ ID NO: 516267 - DNA, 25 bp, Homo sapien
gctgtggaagctcaggcgctgcgcg

SEQ ID NO: 516268 - DNA, 25 bp, Homo sapien
ctgtggaagctcaggcgctgcgcgt

SEQ ID NO: 516269 - DNA, 25 bp, Homo sapien
tgtggaagctcaggcgctgcgcgtg

SEQ ID NO: 516270 - DNA, 25 bp, Homo sapien
gaagctcaggcgctgcgcgtgagag

SEQ ID NO: 516271 - DNA, 25 bp, Homo sapien
aagctcaggcgctgcgcgtgagagg

SEQ ID NO: 516272 - DNA, 25 bp, Homo sapien
cgctgcgcgtgagaggtcccagata

SEQ ID NO: 516273 - DNA, 25 bp, Homo sapien
gctgcgcgtgagaggtcccagatac

SEQ ID NO: 516274 - DNA, 25 bp, Homo sapien
ctgcgcgtgagaggtcccagatacg

SEQ ID NO: 516275 - DNA, 25 bp, Homo sapien
tgcgcgtgagaggtcccagatacgt

SEQ ID NO: 516276 - DNA, 25 bp, Homo sapien
gcgcgtgagaggtcccagatacgtc

SEQ ID NO: 516277 - DNA, 25 bp, Homo sapien
cgcgtgagaggtcccagatacgtct

SEQ ID NO: 516278 - DNA, 25 bp, Homo sapien
cagaggtcatcccacagcatcgttc

SEQ ID NO: 516279 - DNA, 25 bp, Homo sapien
gcccccagactactgtgacttaaaa

SEQ ID NO: 516280 - DNA, 25 bp, Homo sapien
gccactggcggctggaggtccccat

SEQ ID NO: 516281 - DNA, 25 bp, Homo sapien
tggaggtccccattcagttgcacta

SEQ ID NO: 516282 - DNA, 25 bp, Homo sapien
ggtccccattcagttgcactacaaa

SEQ ID NO: 516283 - DNA, 25 bp, Homo sapien
gttgcactacaaacactgaccaaat

SEQ ID NO: 516284 - DNA, 25 bp, Homo sapien
tacaaacactgaccaaatatgcaag

SEQ ID NO: 516285 - DNA, 25 bp, Homo sapien
aatatgcaaggaaggagctgtgttt

SEQ ID NO: 516286 - DNA, 25 bp, Homo sapien
gtgtttgtttgttgtcgtcccagac

SEQ ID NO: 516287 - DNA, 25 bp, Homo sapien
gttgtcgtcccagacagtgttgtga

SEQ ID NO: 516288 - DNA, 25 bp, Homo sapien
ccagacagtgttgtgagggacctga

SEQ ID NO: 516289 - DNA, 25 bp, Homo sapien
ggcatcactagatggacaatccaag

SEQ ID NO: 516290 - DNA, 25 bp, Homo sapien
cagctgactttctggtggcacaaag

SEQ ID NO: 516291 - DNA, 25 bp, Homo sapien
ggtatactttgtgcaaatctgccat

SEQ ID NO: 516292 - DNA, 25 bp, Homo sapien
gtgcaaatctgccataagctcaagg

SEQ ID NO: 516293 - DNA, 25 bp, Homo sapien
gattgagcttagttttcatgtctag

SEQ ID NO: 516294 - DNA, 25 bp, Homo sapien
gagcttagttttcatgtctaggaaa

SEQ ID NO: 516295 - DNA, 25 bp, Homo sapien
agcaaaacaacttaatctgaaacag

SEQ ID NO: 516296 - DNA, 25 bp, Homo sapien
tctggtggcacaaagcattcataaa

SEQ ID NO: 516297 - DNA, 25 bp, Homo sapien
tggaattagccaaccatctcttcta

SEQ ID NO: 516298 - DNA, 25 bp, Homo sapien
cttctacctgtgatggcatgaacta

SEQ ID NO: 516299 - DNA, 25 bp, Homo sapien
ggcatgaactactggcatcactaga

SEQ ID NO: 516300 - DNA, 25 bp, Homo sapien
gacaattaagtcatggtacgtttcc

SEQ ID NO: 516301 - DNA, 25 bp, Homo sapien
gtcatggtacgtttcctaaagatag

SEQ ID NO: 516302 - DNA, 25 bp, Homo sapien
aagagaactgtttaatatgctgatt

SEQ ID NO: 516303 - DNA, 25 bp, Homo sapien
gtctattttagaccttgagtaaact

SEQ ID NO: 516304 - DNA, 25 bp, Homo sapien
aactaatttagcttctaggatccaa

SEQ ID NO: 516305 - DNA, 25 bp, Homo sapien
tagcttctaggatccaagtttcctt

SEQ ID NO: 516306 - DNA, 25 bp, Homo sapien
ctaggatccaagtttccttatttgt

SEQ ID NO: 516307 - DNA, 25 bp, Homo sapien
gacagtgagggttcgatccaatttt

SEQ ID NO: 516308 - DNA, 25 bp, Homo sapien
gtaggtattactgtttgtgtgtttg

SEQ ID NO: 516309 - DNA, 25 bp, Homo sapien
gtgagggttcgatccaattttaggg

SEQ ID NO: 516310 - DNA, 25 bp, Homo sapien
gaatgagtctactttggagacaatt

SEQ ID NO: 516311 - DNA, 25 bp, Homo sapien
aaggtgtgattatctttccctgtcc

SEQ ID NO: 516312 - DNA, 25 bp, Homo sapien
tgtgattatctttccctgtccatgt

SEQ ID NO: 516313 - DNA, 25 bp, Homo sapien
ctttccctgtccatgtgcttattga

SEQ ID NO: 516314 - DNA, 25 bp, Homo sapien
atgtgaaatccacacttggaacttt

SEQ ID NO: 516315 - DNA, 25 bp, Homo sapien
ggaactttttagatctgtctgttgc

SEQ ID NO: 516316 - DNA, 25 bp, Homo sapien
agatctgtctgttgcttgtttaata

SEQ ID NO: 516317 - DNA, 25 bp, Homo sapien
agggttttctatccactgtcaattt

SEQ ID NO: 516318 - DNA, 25 bp, Homo sapien
gttttctatccactgtcaatttcaa

SEQ ID NO: 516319 - DNA, 25 bp, Homo sapien
attatttgatgctagctggaattca

SEQ ID NO: 516320 - DNA, 25 bp, Homo sapien
gatgctagctggaattcaagaaatg

SEQ ID NO: 516321 - DNA, 25 bp, Homo sapien
gaaatggcattgaccttattcaaat

SEQ ID NO: 516322 - DNA, 25 bp, Homo sapien
aagagagacaacgttcttccttgcc

SEQ ID NO: 516323 - DNA, 25 bp, Homo sapien
caacgttcttccttgcccagaaagg

SEQ ID NO: 516324 - DNA, 25 bp, Homo sapien
aataggcaagacaacgaggcagtga

SEQ ID NO: 516325 - DNA, 25 bp, Homo sapien
gtgagcggtaggagctcatcacctc

SEQ ID NO: 516326 - DNA, 25 bp, Homo sapien
aaataacctcgccaagccaatcttt

SEQ ID NO: 516327 - DNA, 25 bp, Homo sapien
agccaatctttgacactggcacctt

SEQ ID NO: 516328 - DNA, 25 bp, Homo sapien
tggcaccttctcctcacaattttct

SEQ ID NO: 516329 - DNA, 25 bp, Homo sapien
aattttgccttcctaagattgctgg

SEQ ID NO: 516330 - DNA, 25 bp, Homo sapien
agattgctggtattctagctcttac

SEQ ID NO: 516331 - DNA, 25 bp, Homo sapien
tagctcttacctctatgttctttct

SEQ ID NO: 516332 - DNA, 25 bp, Homo sapien
tgttctttctcacgtctcctaaaga

SEQ ID NO: 516333 - DNA, 25 bp, Homo sapien
taaggcatgtttgtgaccgaagctc

SEQ ID NO: 516334 - DNA, 25 bp, Homo sapien
tgaccgaagctcaatttgccatcac

SEQ ID NO: 516335 - DNA, 25 bp, Homo sapien
aatttgccatcacagtgtggccaca

SEQ ID NO: 516336 - DNA, 25 bp, Homo sapien
cacacctacctcactaatattctaa

SEQ ID NO: 516337 - DNA, 25 bp, Homo sapien
gataaagcctggattttcctcttat

SEQ ID NO: 516338 - DNA, 25 bp, Homo sapien
tcttattctctcttagtgcttacat

SEQ ID NO: 516339 - DNA, 25 bp, Homo sapien
gtgcttacattcttggcatgatatc

SEQ ID NO: 516340 - DNA, 25 bp, Homo sapien
gcatgatatcgatgtgccatagaca

SEQ ID NO: 516341 - DNA, 25 bp, Homo sapien
tgagtgtactctatctgaataaagt

SEQ ID NO: 516342 - DNA, 25 bp, Homo sapien
cttttgtgcatctaccgctatgtaa

SEQ ID NO: 516343 - DNA, 25 bp, Homo sapien
gtgcatctaccgctatgtaaaggaa

SEQ ID NO: 516344 - DNA, 25 bp, Homo sapien
ataaagtttaggtaacatctcctga

SEQ ID NO: 516345 - DNA, 25 bp, Homo sapien
cagcatcgattctcattgaggagaa

SEQ ID NO: 516346 - DNA, 25 bp, Homo sapien
attgaggagaaaccttgggcagctc

SEQ ID NO: 516347 - DNA, 25 bp, Homo sapien
ctccggccaggccttgtaggaaaag

SEQ ID NO: 516348 - DNA, 25 bp, Homo sapien
gaggttccagcgtcaacggccactg

SEQ ID NO: 516349 - DNA, 25 bp, Homo sapien
caacggccactgtgtgtggctgctc

SEQ ID NO: 516350 - DNA, 25 bp, Homo sapien
gaaaaactggttccatgtactgtga

SEQ ID NO: 516351 - DNA, 25 bp, Homo sapien
actgtgaacttgaaaacttgcagac

SEQ ID NO: 516352 - DNA, 25 bp, Homo sapien
gggtccctgatgcagtgcttcagat

SEQ ID NO: 516353 - DNA, 25 bp, Homo sapien
ggacttgaaaatacagactgggcta

SEQ ID NO: 516354 - DNA, 25 bp, Homo sapien
gggctagtccagtgtctatatttaa

SEQ ID NO: 516355 - DNA, 25 bp, Homo sapien
gccaaccgcgagagaccacagcata

SEQ ID NO: 516356 - DNA, 25 bp, Homo sapien
cccggaacggacagggcagctctgc

SEQ ID NO: 516357 - DNA, 25 bp, Homo sapien
attatattttaaccgtgctaacttg

SEQ ID NO: 516358 - DNA, 25 bp, Homo sapien
attttaaccgtgctaacttgtcaag

SEQ ID NO: 516359 - DNA, 25 bp, Homo sapien
ttaaccgtgctaacttgtcaagtgc

SEQ ID NO: 516360 - DNA, 25 bp, Homo sapien
gtgctaacttgtcaagtgctgactc

SEQ ID NO: 516361 - DNA, 25 bp, Homo sapien
aagtgctgactctactcccgtttgt

SEQ ID NO: 516362 - DNA, 25 bp, Homo sapien
gactctactcccgtttgtacgtggt

SEQ ID NO: 516363 - DNA, 25 bp, Homo sapien
tactcccgtttgtacgtggtgttat

SEQ ID NO: 516364 - DNA, 25 bp, Homo sapien
ccgtttgtacgtggtgttattattg

SEQ ID NO: 516365 - DNA, 25 bp, Homo sapien
gtacgtggtgttattattgaaatgt

SEQ ID NO: 516366 - DNA, 25 bp, Homo sapien
atctgtgacagaaatggcagttctc

SEQ ID NO: 516367 - DNA, 25 bp, Homo sapien
aaatggcagttctcacgtgcgttac

SEQ ID NO: 516368 - DNA, 25 bp, Homo sapien
aatacggaacttgagtgagcactga

SEQ ID NO: 516369 - DNA, 25 bp, Homo sapien
tgagaggacacagaccctcatcctg

SEQ ID NO: 516370 - DNA, 25 bp, Homo sapien
agccatcagagcctgacaaccgctt

SEQ ID NO: 516371 - DNA, 25 bp, Homo sapien
tgacaaccgcttctcaccagaggcg

SEQ ID NO: 516372 - DNA, 25 bp, Homo sapien
accagaggcgcttcttagaccctga

SEQ ID NO: 516373 - DNA, 25 bp, Homo sapien
aggcgcttcttagaccctgaccttg

SEQ ID NO: 516374 - DNA, 25 bp, Homo sapien
cttctttgtatgcaagccagacagt

SEQ ID NO: 516375 - DNA, 25 bp, Homo sapien
ttgtatgcaagccagacagtctact

SEQ ID NO: 516376 - DNA, 25 bp, Homo sapien
gacagtctactgttgtatatttgaa

SEQ ID NO: 516377 - DNA, 25 bp, Homo sapien
agtgcttttttcaaacctgattaat

SEQ ID NO: 516378 - DNA, 25 bp, Homo sapien
ttctctcctcataccaacagaggat

SEQ ID NO: 516379 - DNA, 25 bp, Homo sapien
ctttctgtttagttcctttgcaatc

SEQ ID NO: 516380 - DNA, 25 bp, Homo sapien
tgtttagttcctttgcaatcctgta

SEQ ID NO: 516381 - DNA, 25 bp, Homo sapien
tagttcctttgcaatcctgtagaga

SEQ ID NO: 516382 - DNA, 25 bp, Homo sapien
gttcctttgcaatcctgtagagaca

SEQ ID NO: 516383 - DNA, 25 bp, Homo sapien
tttgcaatcctgtagagacatgtac

SEQ ID NO: 516384 - DNA, 25 bp, Homo sapien
gagacatgtacagcttactttggtg

SEQ ID NO: 516385 - DNA, 25 bp, Homo sapien
acatgtacagcttactttggtgctt

SEQ ID NO: 516386 - DNA, 25 bp, Homo sapien
gtgcttttagcactgagagtctgct

SEQ ID NO: 516387 - DNA, 25 bp, Homo sapien
gcttttagcactgagagtctgctgt

SEQ ID NO: 516388 - DNA, 25 bp, Homo sapien
cgggcatctggttgaccccagcctg

SEQ ID NO: 516389 - DNA, 25 bp, Homo sapien
tggtctccgctcctcaggggcttag

SEQ ID NO: 516390 - DNA, 25 bp, Homo sapien
aggcccctcagctgtcagctggttt

SEQ ID NO: 516391 - DNA, 25 bp, Homo sapien
agctggttttgatggcctcccactg

SEQ ID NO: 516392 - DNA, 25 bp, Homo sapien
gctggttttgatggcctcccactgc

SEQ ID NO: 516393 - DNA, 25 bp, Homo sapien
tccaggggcgactctagtggcctga

SEQ ID NO: 516394 - DNA, 25 bp, Homo sapien
agtggcctgaggagatgtatttata

SEQ ID NO: 516395 - DNA, 25 bp, Homo sapien
ctgaggagatgtatttataggcccc

SEQ ID NO: 516396 - DNA, 25 bp, Homo sapien
gagatgtatttataggcccccagca

SEQ ID NO: 516397 - DNA, 25 bp, Homo sapien
gatgtatttataggcccccagcagg

SEQ ID NO: 516398 - DNA, 25 bp, Homo sapien
tttataggcccccagcagggctgct

SEQ ID NO: 516399 - DNA, 25 bp, Homo sapien
gagcagatgtaaccaggcgaccaca

SEQ ID NO: 516400 - DNA, 25 bp, Homo sapien
ggcgaccacattggataatcagaat

SEQ ID NO: 516401 - DNA, 25 bp, Homo sapien
aaggcaattgaggttcaaattcaga

SEQ ID NO: 516402 - DNA, 25 bp, Homo sapien
accccaagagggacgatctacagca

SEQ ID NO: 516403 - DNA, 25 bp, Homo sapien
gacgatctacagcatgtcaaagaca

SEQ ID NO: 516404 - DNA, 25 bp, Homo sapien
gtattttgtgatgaagagttgctaa

SEQ ID NO: 516405 - DNA, 25 bp, Homo sapien
tgtgtttttattggatgccacaaaa

SEQ ID NO: 516406 - DNA, 25 bp, Homo sapien
aagaaggaaatgtcggccgcttcct

SEQ ID NO: 516407 - DNA, 25 bp, Homo sapien
ggccgcttccttaatcatagttgtt

SEQ ID NO: 516408 - DNA, 25 bp, Homo sapien
atcatagttgttgcccaaatctctt

SEQ ID NO: 516409 - DNA, 25 bp, Homo sapien
gttgcccaaatctcttggtacagaa

SEQ ID NO: 516410 - DNA, 25 bp, Homo sapien
ggaaggcgctttccgctgttcctca

SEQ ID NO: 516411 - DNA, 25 bp, Homo sapien
ttctcgccgtcttgcagttgaagag

SEQ ID NO: 516412 - DNA, 25 bp, Homo sapien
gctacatacgtagtcagtttcgatt

SEQ ID NO: 516413 - DNA, 25 bp, Homo sapien
cagtttcgatttgttacagacgtta

SEQ ID NO: 516414 - DNA, 25 bp, Homo sapien
attcctttacccaaggttatgctat

SEQ ID NO: 516415 - DNA, 25 bp, Homo sapien
tatgctatgacctttccgcagttta

SEQ ID NO: 516416 - DNA, 25 bp, Homo sapien
ccgcagtttactttgattttctatg

SEQ ID NO: 516417 - DNA, 25 bp, Homo sapien
agccgaatttaactggcactttatt

SEQ ID NO: 516418 - DNA, 25 bp, Homo sapien
tggcactttattttacttctaacct

SEQ ID NO: 516419 - DNA, 25 bp, Homo sapien
ttacttctaaccttgtttcctgacg

SEQ ID NO: 516420 - DNA, 25 bp, Homo sapien
gtttcctgacggtgtacagaatcaa

SEQ ID NO: 516421 - DNA, 25 bp, Homo sapien
cagtcagttgcatctagtgagcact

SEQ ID NO: 516422 - DNA, 25 bp, Homo sapien
agtgagcactgataatgcattcttc

SEQ ID NO: 516423 - DNA, 25 bp, Homo sapien
tgataatgcattcttcaggcagaat

SEQ ID NO: 516424 - DNA, 25 bp, Homo sapien
gtatttccctttgattgtaagttca

SEQ ID NO: 516425 - DNA, 25 bp, Homo sapien
gtaagttcatggtctttcctgagaa

SEQ ID NO: 516426 - DNA, 25 bp, Homo sapien
gagaaaattccaactgtgtctgatg

SEQ ID NO: 516427 - DNA, 25 bp, Homo sapien
gtttgaaaacccctgtaatagagat

SEQ ID NO: 516428 - DNA, 25 bp, Homo sapien
ctggagaataccactgctggaattg

SEQ ID NO: 516429 - DNA, 25 bp, Homo sapien
aattggtgtctttcagaggctggca

SEQ ID NO: 516430 - DNA, 25 bp, Homo sapien
gcaacagcatggattgtgtgcagca

SEQ ID NO: 516431 - DNA, 25 bp, Homo sapien
cttacgagagtagggacagtcagtt

SEQ ID NO: 516432 - DNA, 25 bp, Homo sapien
ctatattgcaacgtaagggtgaaca

SEQ ID NO: 516433 - DNA, 25 bp, Homo sapien
atctttgctggttttcccacagtgg

SEQ ID NO: 516434 - DNA, 25 bp, Homo sapien
aaagagaagtaagcagttttcctgg

SEQ ID NO: 516435 - DNA, 25 bp, Homo sapien
agttttcctggacatattggccgag

SEQ ID NO: 516436 - DNA, 25 bp, Homo sapien
gacatattggccgaggtgaaaaatg

SEQ ID NO: 516437 - DNA, 25 bp, Homo sapien
tcccacagtgggagatgtagatacc

SEQ ID NO: 516438 - DNA, 25 bp, Homo sapien
ggagatgtagataccattgccccaa

SEQ ID NO: 516439 - DNA, 25 bp, Homo sapien
tgtagataccattgccccaaactat

SEQ ID NO: 516440 - DNA, 25 bp, Homo sapien
tgccccaaactatgcacttttcagg

SEQ ID NO: 516441 - DNA, 25 bp, Homo sapien
tgcacttttcaggtaagctttactt

SEQ ID NO: 516442 - DNA, 25 bp, Homo sapien
gtagcattaattcctatattgcaac

SEQ ID NO: 516443 - DNA, 25 bp, Homo sapien
ctggcactgttacttgcctctgcgc

SEQ ID NO: 516444 - DNA, 25 bp, Homo sapien
tgttacttgcctctgcgcctcaggg

SEQ ID NO: 516445 - DNA, 25 bp, Homo sapien
gtggaccagggtctgcaagttcaac

SEQ ID NO: 516446 - DNA, 25 bp, Homo sapien
ccagggtctgcaagttcaacggtca

SEQ ID NO: 516447 - DNA, 25 bp, Homo sapien
gggtctgcaagttcaacggtcatag

SEQ ID NO: 516448 - DNA, 25 bp, Homo sapien
aagttcaacggtcatagctgtccct

SEQ ID NO: 516449 - DNA, 25 bp, Homo sapien
gctcagaccccaacctagtcaaggg

SEQ ID NO: 516450 - DNA, 25 bp, Homo sapien
gattctcctgctcttaactcgatga

SEQ ID NO: 516451 - DNA, 25 bp, Homo sapien
cctgctcttaactcgatgacttggg

SEQ ID NO: 516452 - DNA, 25 bp, Homo sapien
ccgaggaagatgctctgcaggaaaa

SEQ ID NO: 516453 - DNA, 25 bp, Homo sapien
tgcaggaaaataaaagtcagccttt

SEQ ID NO: 516454 - DNA, 25 bp, Homo sapien
gacaagttaggaaagtacctagcag

SEQ ID NO: 516455 - DNA, 25 bp, Homo sapien
gtacctagcagagtacctgggacat

SEQ ID NO: 516456 - DNA, 25 bp, Homo sapien
cctgggacataagtaggttttctgt

SEQ ID NO: 516457 - DNA, 25 bp, Homo sapien
gagactgagcatacattactccacg

SEQ ID NO: 516458 - DNA, 25 bp, Homo sapien
catacattactccacgctacaaata

SEQ ID NO: 516459 - DNA, 25 bp, Homo sapien
tactccacgctacaaataattaact

SEQ ID NO: 516460 - DNA, 25 bp, Homo sapien
gatttgactttcagtgtggagtgca

SEQ ID NO: 516461 - DNA, 25 bp, Homo sapien
tcagtgtggagtgcagagctttttt

SEQ ID NO: 516462 - DNA, 25 bp, Homo sapien
aagtgctaataaagccagtcctcat

SEQ ID NO: 516463 - DNA, 25 bp, Homo sapien
aaaatatagtcagatgagtcagcaa

SEQ ID NO: 516464 - DNA, 25 bp, Homo sapien
gagtcagcaaagcaagttatttcaa

SEQ ID NO: 516465 - DNA, 25 bp, Homo sapien
tgcagcatattcttctctttggccc

SEQ ID NO: 516466 - DNA, 25 bp, Homo sapien
ttctctttggcccagaggtgggtta

SEQ ID NO: 516467 - DNA, 25 bp, Homo sapien
attgagtgtcagtattgctaagcgt

SEQ ID NO: 516468 - DNA, 25 bp, Homo sapien
gtattgctaagcgtggcattcacaa

SEQ ID NO: 516469 - DNA, 25 bp, Homo sapien
ggcattcacaatactggcactataa

SEQ ID NO: 516470 - DNA, 25 bp, Homo sapien
aggacagtttttctactgccattca

SEQ ID NO: 516471 - DNA, 25 bp, Homo sapien
agtttttctactgccattcaatttg

SEQ ID NO: 516472 - DNA, 25 bp, Homo sapien
ccattcaatttgatgtgagtgcctt

SEQ ID NO: 516473 - DNA, 25 bp, Homo sapien
gtgagtgccttgaaaactgatcttc

SEQ ID NO: 516474 - DNA, 25 bp, Homo sapien
aaaactgatcttcctatttgagtct

SEQ ID NO: 516475 - DNA, 25 bp, Homo sapien
tcttcctatttgagtctcttgagac

SEQ ID NO: 516476 - DNA, 25 bp, Homo sapien
cgggcatctggttgaccccagcctg

SEQ ID NO: 516477 - DNA, 25 bp, Homo sapien
tggtctccgctcctcaggggcttag

SEQ ID NO: 516478 - DNA, 25 bp, Homo sapien
agctggttttgatggcctcccactg

SEQ ID NO: 516479 - DNA, 25 bp, Homo sapien
gctggttttgatggcctcccactgc

SEQ ID NO: 516480 - DNA, 25 bp, Homo sapien
tggttttgatggcctcccactgccc

SEQ ID NO: 516481 - DNA, 25 bp, Homo sapien
tccaggggcgactctagtggcctga

SEQ ID NO: 516482 - DNA, 25 bp, Homo sapien
aggagatgtatttataggcccccag

SEQ ID NO: 516483 - DNA, 25 bp, Homo sapien
gagatgtatttataggcccccagca

SEQ ID NO: 516484 - DNA, 25 bp, Homo sapien
gatgtatttataggcccccagcagg

SEQ ID NO: 516485 - DNA, 25 bp, Homo sapien
atttataggcccccagcagggctgc

SEQ ID NO: 516486 - DNA, 25 bp, Homo sapien
tcccggcgggggcttggccaaagct

SEQ ID NO: 516487 - DNA, 25 bp, Homo sapien
gggcaaggtttgaagcacagctccg

SEQ ID NO: 516488 - DNA, 25 bp, Homo sapien
aaggtttgaagcacagctccggcag

SEQ ID NO: 516489 - DNA, 25 bp, Homo sapien
aggacgcgtttgtgcatactgccct

SEQ ID NO: 516490 - DNA, 25 bp, Homo sapien
tttgtgcatactgccctgctctata

SEQ ID NO: 516491 - DNA, 25 bp, Homo sapien
actgccctgctctatacacggaaga

SEQ ID NO: 516492 - DNA, 25 bp, Homo sapien
tatacacggaagacctggatctcta

SEQ ID NO: 516493 - DNA, 25 bp, Homo sapien
ggaagacctggatctctagtgagtg

SEQ ID NO: 516494 - DNA, 25 bp, Homo sapien
atctctagtgagtgtgactgccgga

SEQ ID NO: 516495 - DNA, 25 bp, Homo sapien
ctagtgagtgtgactgccggatctg

SEQ ID NO: 516496 - DNA, 25 bp, Homo sapien
ggatctggctgtggtccttggccac

SEQ ID NO: 516497 - DNA, 25 bp, Homo sapien
tccttggccacgcttcttgaggaag

SEQ ID NO: 516498 - DNA, 25 bp, Homo sapien
ttgacctgacctcacaagatgataa

SEQ ID NO: 516499 - DNA, 25 bp, Homo sapien
attgcattgctgctacaggcccgag

SEQ ID NO: 516500 - DNA, 25 bp, Homo sapien
gtcacttctatcacaggtccgttta

SEQ ID NO: 516501 - DNA, 25 bp, Homo sapien
aggtccgtttagtcgtccgcagagc

SEQ ID NO: 516502 - DNA, 25 bp, Homo sapien
gatattcctcccatgttgattagct

SEQ ID NO: 516503 - DNA, 25 bp, Homo sapien
attagctacctaaaacaccaactgt

SEQ ID NO: 516504 - DNA, 25 bp, Homo sapien
accaactgtaatcttgcagtctccc

SEQ ID NO: 516505 - DNA, 25 bp, Homo sapien
gcagtctccccaggaacttatgatg

SEQ ID NO: 516506 - DNA, 25 bp, Homo sapien
ggaacttatgatgcctccgaaaacc

SEQ ID NO: 516507 - DNA, 25 bp, Homo sapien
gggactcacgtagctggagagcatt

SEQ ID NO: 516508 - DNA, 25 bp, Homo sapien
tggagagcattacagcctcatccac

SEQ ID NO: 516509 - DNA, 25 bp, Homo sapien
actttagctgtagaaccttgggcaa

SEQ ID NO: 516510 - DNA, 25 bp, Homo sapien
tagctgtagaaccttgggcaaataa

SEQ ID NO: 516511 - DNA, 25 bp, Homo sapien
gggcaaataacttcatctttttggg

SEQ ID NO: 516512 - DNA, 25 bp, Homo sapien
tcctgtctaactggagggactgtga

SEQ ID NO: 516513 - DNA, 25 bp, Homo sapien
aactggagggactgtgatccttcca

SEQ ID NO: 516514 - DNA, 25 bp, Homo sapien
ggaagaggcttacctgacagccagc

SEQ ID NO: 516515 - DNA, 25 bp, Homo sapien
gagtcagctcattaaatcttgaaga

SEQ ID NO: 516516 - DNA, 25 bp, Homo sapien
tcattaaatcttgaagaaccgctgt

SEQ ID NO: 516517 - DNA, 25 bp, Homo sapien
gctcggccagagctctgggttttaa

SEQ ID NO: 516518 - DNA, 25 bp, Homo sapien
gagctctgggttttaatcctacttt

SEQ ID NO: 516519 - DNA, 25 bp, Homo sapien
ctgggttttaatcctactttagctg

SEQ ID NO: 516520 - DNA, 25 bp, Homo sapien
gccaccctaaatacaacagggacac

SEQ ID NO: 516521 - DNA, 25 bp, Homo sapien
aatacaacagggacactctggacaa

SEQ ID NO: 516522 - DNA, 25 bp, Homo sapien
caacagggacactctggacaatgac

SEQ ID NO: 516523 - DNA, 25 bp, Homo sapien
gggcaacactctgagctttggtgct

SEQ ID NO: 516524 - DNA, 25 bp, Homo sapien
gcaacactctgagctttggtgctga

SEQ ID NO: 516525 - DNA, 25 bp, Homo sapien
aacactctgagctttggtgctgact

SEQ ID NO: 516526 - DNA, 25 bp, Homo sapien
acactctgagctttggtgctgacta

SEQ ID NO: 516527 - DNA, 25 bp, Homo sapien
cactctgagctttggtgctgactac

SEQ ID NO: 516528 - DNA, 25 bp, Homo sapien
gagctttggtgctgactacccagac

SEQ ID NO: 516529 - DNA, 25 bp, Homo sapien
gctttggtgctgactacccagacga

SEQ ID NO: 516530 - DNA, 25 bp, Homo sapien
ctttggtgctgactacccagacgag

SEQ ID NO: 516531 - DNA, 25 bp, Homo sapien
tgtatgtttcaaatcaggtgtgtac

SEQ ID NO: 516532 - DNA, 25 bp, Homo sapien
gtatgtttcaaatcaggtgtgtacc

SEQ ID NO: 516533 - DNA, 25 bp, Homo sapien
tatgtttcaaatcaggtgtgtacca

SEQ ID NO: 516534 - DNA, 25 bp, Homo sapien
atgtttcaaatcaggtgtgtaccat

SEQ ID NO: 516535 - DNA, 25 bp, Homo sapien
tgtttcaaatcaggtgtgtaccatt

SEQ ID NO: 516536 - DNA, 25 bp, Homo sapien
gtttcaaatcaggtgtgtaccattt

SEQ ID NO: 516537 - DNA, 25 bp, Homo sapien
tttcaaatcaggtgtgtaccatttg

SEQ ID NO: 516538 - DNA, 25 bp, Homo sapien
tgattttaatacgtgttttggtttg

SEQ ID NO: 516539 - DNA, 25 bp, Homo sapien
gaaatttcatagtcgttggagtgcc

SEQ ID NO: 516540 - DNA, 25 bp, Homo sapien
aatttcatagtcgttggagtgccat

SEQ ID NO: 516541 - DNA, 25 bp, Homo sapien
tcatagtcgttggagtgccatgaaa

SEQ ID NO: 516542 - DNA, 25 bp, Homo sapien
agtcgttggagtgccatgaaattaa

SEQ ID NO: 516543 - DNA, 25 bp, Homo sapien
ggagtgccatgaaattaatacttgc

SEQ ID NO: 516544 - DNA, 25 bp, Homo sapien
gtgccatgaaattaatacttgcaat

SEQ ID NO: 516545 - DNA, 25 bp, Homo sapien
attcagattgcggtagtttacactt

SEQ ID NO: 516546 - DNA, 25 bp, Homo sapien
cagattgcggtagtttacacttttt

SEQ ID NO: 516547 - DNA, 25 bp, Homo sapien
ccatttgtactgagaacaccacaga

SEQ ID NO: 516548 - DNA, 25 bp, Homo sapien
ttgtactgagaacaccacagaatga

SEQ ID NO: 516549 - DNA, 25 bp, Homo sapien
gagaacaccacagaatgaattatcc

SEQ ID NO: 516550 - DNA, 25 bp, Homo sapien
ttcttcctctgacatggggaccata

SEQ ID NO: 516551 - DNA, 25 bp, Homo sapien
gggaccataacaggtgatcactgat

SEQ ID NO: 516552 - DNA, 25 bp, Homo sapien
gtgatcactgatacctggcaaagac

SEQ ID NO: 516553 - DNA, 25 bp, Homo sapien
gatcactgatacctggcaaagactg

SEQ ID NO: 516554 - DNA, 25 bp, Homo sapien
tcactgatacctggcaaagactggg

SEQ ID NO: 516555 - DNA, 25 bp, Homo sapien
aagactggggccctctcctttctat

SEQ ID NO: 516556 - DNA, 25 bp, Homo sapien
tttctatgtcctcaatcctgcctga

SEQ ID NO: 516557 - DNA, 25 bp, Homo sapien
tgtcctcaatcctgcctgactcttg

SEQ ID NO: 516558 - DNA, 25 bp, Homo sapien
tgcctgactcttggtccttctggca

SEQ ID NO: 516559 - DNA, 25 bp, Homo sapien
atatatctggggtcttgtctaccac

SEQ ID NO: 516560 - DNA, 25 bp, Homo sapien
tgtctaccacctcccctggtcagag

SEQ ID NO: 516561 - DNA, 25 bp, Homo sapien
gaagttggaatggacaagcctgccc

SEQ ID NO: 516562 - DNA, 25 bp, Homo sapien
ttggaatggacaagcctgccctctc

SEQ ID NO: 516563 - DNA, 25 bp, Homo sapien
tctgtcctcaggctgtttctgcaat

SEQ ID NO: 516564 - DNA, 25 bp, Homo sapien
gtcctcaggctgtttctgcaatttg

SEQ ID NO: 516565 - DNA, 25 bp, Homo sapien
tcaggctgtttctgcaatttgacat

SEQ ID NO: 516566 - DNA, 25 bp, Homo sapien
aggctgtttctgcaatttgacatga

SEQ ID NO: 516567 - DNA, 25 bp, Homo sapien
gtttctgcaatttgacatgaggcct

SEQ ID NO: 516568 - DNA, 25 bp, Homo sapien
ctgcaatttgacatgaggcctggcc

SEQ ID NO: 516569 - DNA, 25 bp, Homo sapien
tggagccttctcagggtcagtccag

SEQ ID NO: 516570 - DNA, 25 bp, Homo sapien
tctcagggtcagtccagctctggag

SEQ ID NO: 516571 - DNA, 25 bp, Homo sapien
gggtcagtccagctctggagcccct

SEQ ID NO: 516572 - DNA, 25 bp, Homo sapien
cagctcctgattctggatctgagat

SEQ ID NO: 516573 - DNA, 25 bp, Homo sapien
tcctgattctggatctgagattctc

SEQ ID NO: 516574 - DNA, 25 bp, Homo sapien
tgagattctcagatcacaggcccct

SEQ ID NO: 516575 - DNA, 25 bp, Homo sapien
gagactcatgcccatggccatccat

SEQ ID NO: 516576 - DNA, 25 bp, Homo sapien
atggccatccatgcgtggacgctgt

SEQ ID NO: 516577 - DNA, 25 bp, Homo sapien
catccatgcgtggacgctgtgtgga

SEQ ID NO: 516578 - DNA, 25 bp, Homo sapien
gagtccaggatgacgggatcccgca

SEQ ID NO: 516579 - DNA, 25 bp, Homo sapien
aggatgacgggatcccgcacaagct

SEQ ID NO: 516580 - DNA, 25 bp, Homo sapien
tgccttgcatattacttgagcttaa

SEQ ID NO: 516581 - DNA, 25 bp, Homo sapien
tgagcttaaactgacaacctggatg

SEQ ID NO: 516582 - DNA, 25 bp, Homo sapien
taaataggagcctttctactggttt

SEQ ID NO: 516583 - DNA, 25 bp, Homo sapien
tgctgctttaaaatctctttccaca

SEQ ID NO: 516584 - DNA, 25 bp, Homo sapien
tctctttccacagaaaagttgtgtt

SEQ ID NO: 516585 - DNA, 25 bp, Homo sapien
tgtttttctgtttcaccatagaaac

SEQ ID NO: 516586 - DNA, 25 bp, Homo sapien
ttcaccatagaaacatcctccacag

SEQ ID NO: 516587 - DNA, 25 bp, Homo sapien
atcctccacagcaactctttataaa

SEQ ID NO: 516588 - DNA, 25 bp, Homo sapien
ctctttataaattctgttgccatta

SEQ ID NO: 516589 - DNA, 25 bp, Homo sapien
gttgccattacattcaatttccaat

SEQ ID NO: 516590 - DNA, 25 bp, Homo sapien
attcaatttccaatatccagcaaaa

SEQ ID NO: 516591 - DNA, 25 bp, Homo sapien
aaacttccaatcttaatattaatct

SEQ ID NO: 516592 - DNA, 25 bp, Homo sapien
acagccctgagcgagctgccaggtg

SEQ ID NO: 516593 - DNA, 25 bp, Homo sapien
tgggagaagcgcacctgagccaagc

SEQ ID NO: 516594 - DNA, 25 bp, Homo sapien
agctccgggcgctgcgtcccgaggg

SEQ ID NO: 516595 - DNA, 25 bp, Homo sapien
agtctccatttcagcgtcttgcatg

SEQ ID NO: 516596 - DNA, 25 bp, Homo sapien
atttcagcgtcttgcatggcctggc

SEQ ID NO: 516597 - DNA, 25 bp, Homo sapien
agcgtcttgcatggcctggcaccgg

SEQ ID NO: 516598 - DNA, 25 bp, Homo sapien
gccccaggacccttgtttgtgtcaa

SEQ ID NO: 516599 - DNA, 25 bp, Homo sapien
aggacccttgtttgtgtcaaaaatg

SEQ ID NO: 516600 - DNA, 25 bp, Homo sapien
aaatgactttccctgcccttgccgt

SEQ ID NO: 516601 - DNA, 25 bp, Homo sapien
atcacagtgggcagccggcacccgg

SEQ ID NO: 516602 - DNA, 25 bp, Homo sapien
accactttggcgagcgtcctgcttc

SEQ ID NO: 516603 - DNA, 25 bp, Homo sapien
tcagacccctttttgccgtgcaaag

SEQ ID NO: 516604 - DNA, 25 bp, Homo sapien
ttgccgtgcaaagggaattcttgac

SEQ ID NO: 516605 - DNA, 25 bp, Homo sapien
tccgacgtggaggaggacctccgca

SEQ ID NO: 516606 - DNA, 25 bp, Homo sapien
ctgctgcctgccagagaggcgcctt

SEQ ID NO: 516607 - DNA, 25 bp, Homo sapien
agagaggcgccttcagagacccagc

SEQ ID NO: 516608 - DNA, 25 bp, Homo sapien
ttcagagacccagcgcttacacaat

SEQ ID NO: 516609 - DNA, 25 bp, Homo sapien
agcgcttacacaatacccaccatgt

SEQ ID NO: 516610 - DNA, 25 bp, Homo sapien
catgtcccaggctggtgctcaggaa

SEQ ID NO: 516611 - DNA, 25 bp, Homo sapien
tatcaagaagaagcgcccccctgtg

SEQ ID NO: 516612 - DNA, 25 bp, Homo sapien
ccgaggaaacctgaccaagaaccag

SEQ ID NO: 516613 - DNA, 25 bp, Homo sapien
gaaatcaagtccaagacctaccagg

SEQ ID NO: 516614 - DNA, 25 bp, Homo sapien
acctaccaggtcatgcgagagtgtg

SEQ ID NO: 516615 - DNA, 25 bp, Homo sapien
ccaggtcatgcgagagtgtgagcaa

SEQ ID NO: 516616 - DNA, 25 bp, Homo sapien
aaagtgtttagcatgcttgctctcc

SEQ ID NO: 516617 - DNA, 25 bp, Homo sapien
tagcatgcttgctctccaacacaga

SEQ ID NO: 516618 - DNA, 25 bp, Homo sapien
gcttgctctccaacacagaaattgc

SEQ ID NO: 516619 - DNA, 25 bp, Homo sapien
ttgctctccaacacagaaattgctt

SEQ ID NO: 516620 - DNA, 25 bp, Homo sapien
gaacatatagtgtaatttcctttaa

SEQ ID NO: 516621 - DNA, 25 bp, Homo sapien
taatttcctttaatgaaagtgactc

SEQ ID NO: 516622 - DNA, 25 bp, Homo sapien
tagacaaacacaagagcatccaaag

SEQ ID NO: 516623 - DNA, 25 bp, Homo sapien
gaaatagaaaccgtacatgtcagta

SEQ ID NO: 516624 - DNA, 25 bp, Homo sapien
gaaaccgtacatgtcagtacagaaa

SEQ ID NO: 516625 - DNA, 25 bp, Homo sapien
acatgtcagtacagaaaagcttaag

SEQ ID NO: 516626 - DNA, 25 bp, Homo sapien
aaagccgagatgtagtctctaagaa

SEQ ID NO: 516627 - DNA, 25 bp, Homo sapien
gtctaatcttgacccaaatagctgt

SEQ ID NO: 516628 - DNA, 25 bp, Homo sapien
caaatagctgtttcttctaaatatc

SEQ ID NO: 516629 - DNA, 25 bp, Homo sapien
aaatatctcttgtcagatggtcatc

SEQ ID NO: 516630 - DNA, 25 bp, Homo sapien
ggtcgtgaactactgggctcctcct

SEQ ID NO: 516631 - DNA, 25 bp, Homo sapien
ttggcctcccaaaacttcgatagct

SEQ ID NO: 516632 - DNA, 25 bp, Homo sapien
aaacttcgatagctcctcctgcctt

SEQ ID NO: 516633 - DNA, 25 bp, Homo sapien
acagcacctggcctacattccgttt

SEQ ID NO: 516634 - DNA, 25 bp, Homo sapien
gcctacattccgtttctagtgttaa

SEQ ID NO: 516635 - DNA, 25 bp, Homo sapien
tagtgttaatacttatgtctgcatt

SEQ ID NO: 516636 - DNA, 25 bp, Homo sapien
gaaattatagtgagcttgcctacca

SEQ ID NO: 516637 - DNA, 25 bp, Homo sapien
ttatagtgagcttgcctaccaaatt

SEQ ID NO: 516638 - DNA, 25 bp, Homo sapien
aagagtgccagggaatgccataatg

SEQ ID NO: 516639 - DNA, 25 bp, Homo sapien
aatggaggcttttggatctgaattt

SEQ ID NO: 516640 - DNA, 25 bp, Homo sapien
gaatttggaccatttcactaaagag

SEQ ID NO: 516641 - DNA, 25 bp, Homo sapien
gagaacatgagtttgctcagccctt

SEQ ID NO: 516642 - DNA, 25 bp, Homo sapien
tcagccctttcctcacaagagggag

SEQ ID NO: 516643 - DNA, 25 bp, Homo sapien
ttctccacgcgctggctccataaag

SEQ ID NO: 516644 - DNA, 25 bp, Homo sapien
tggctccataaaggccagctttggc

SEQ ID NO: 516645 - DNA, 25 bp, Homo sapien
ttgtttctttgcctgcttatactgg

SEQ ID NO: 516646 - DNA, 25 bp, Homo sapien
tttgcctgcttatactggccataaa

SEQ ID NO: 516647 - DNA, 25 bp, Homo sapien
atactggccataaaagagggagctg

SEQ ID NO: 516648 - DNA, 25 bp, Homo sapien
gagggagctgccttcaatgtataaa

SEQ ID NO: 516649 - DNA, 25 bp, Homo sapien
ctaactagccatgtggattgtgaac

SEQ ID NO: 516650 - DNA, 25 bp, Homo sapien
gattgtgaacagtcacctcatcctt

SEQ ID NO: 516651 - DNA, 25 bp, Homo sapien
acctcatccttcatggcctcagttt

SEQ ID NO: 516652 - DNA, 25 bp, Homo sapien
tcagtttccacatctatgaaataag

SEQ ID NO: 516653 - DNA, 25 bp, Homo sapien
ggtcaggagacacataacagcattc

SEQ ID NO: 516654 - DNA, 25 bp, Homo sapien
gggtaattaacccaattgcctctag

SEQ ID NO: 516655 - DNA, 25 bp, Homo sapien
aacccaattgcctctagagggcaaa

SEQ ID NO: 516656 - DNA, 25 bp, Homo sapien
taattaacagaattgcctccagttt

SEQ ID NO: 516657 - DNA, 25 bp, Homo sapien
tccagtttctccatggctttctaaa

SEQ ID NO: 516658 - DNA, 25 bp, Homo sapien
tggatgccagatgttttccagggat

SEQ ID NO: 516659 - DNA, 25 bp, Homo sapien
ggccaggctctggacactaactagc

SEQ ID NO: 516660 - DNA, 25 bp, Homo sapien
atcccagttccatatgctggtaact

SEQ ID NO: 516661 - DNA, 25 bp, Homo sapien
agatacagctgtaaccaaggtgatg

SEQ ID NO: 516662 - DNA, 25 bp, Homo sapien
caattgtctctgctgtgtggttcaa

SEQ ID NO: 516663 - DNA, 25 bp, Homo sapien
gaacattcccttaggtgttgacatc

SEQ ID NO: 516664 - DNA, 25 bp, Homo sapien
ggtgttgacatcagtgaactcagtt

SEQ ID NO: 516665 - DNA, 25 bp, Homo sapien
gaactcagttcttggatgtaaacat

SEQ ID NO: 516666 - DNA, 25 bp, Homo sapien
ataaaggcttcatcctgacagtaag

SEQ ID NO: 516667 - DNA, 25 bp, Homo sapien
gtttcatcaactgtattccatcatt

SEQ ID NO: 516668 - DNA, 25 bp, Homo sapien
gtattccatcattctgctttagctt

SEQ ID NO: 516669 - DNA, 25 bp, Homo sapien
gctttagctttcatctctaccaata

SEQ ID NO: 516670 - DNA, 25 bp, Homo sapien
tcatctctaccaatagctacttgtg

SEQ ID NO: 516671 - DNA, 25 bp, Homo sapien
ccacagatggttaacctggactggg

SEQ ID NO: 516672 - DNA, 25 bp, Homo sapien
tgatgatcgtatgttgctgtctcca

SEQ ID NO: 516673 - DNA, 25 bp, Homo sapien
ttgctgtctccatccgtctttaatg

SEQ ID NO: 516674 - DNA, 25 bp, Homo sapien
tccgtctttaatgggtcagggcttt

SEQ ID NO: 516675 - DNA, 25 bp, Homo sapien
ttccaagggtcttcaggtgatgagt

SEQ ID NO: 516676 - DNA, 25 bp, Homo sapien
gggtacccacaagtcagaaggtctg

SEQ ID NO: 516677 - DNA, 25 bp, Homo sapien
aagtcagaaggtctgcgttctccta

SEQ ID NO: 516678 - DNA, 25 bp, Homo sapien
gttctcctagtttgtttgctgccat

SEQ ID NO: 516679 - DNA, 25 bp, Homo sapien
gtttgctgccatttgaactcatgta

SEQ ID NO: 516680 - DNA, 25 bp, Homo sapien
gaaagctgcaattatccgccaactg

SEQ ID NO: 516681 - DNA, 25 bp, Homo sapien
gcaattatccgccaactgcatttaa

SEQ ID NO: 516682 - DNA, 25 bp, Homo sapien
ccgaggaagatgctcatctgagcca

SEQ ID NO: 516683 - DNA, 25 bp, Homo sapien
ctggcgggtggctgcaagcccacct

SEQ ID NO: 516684 - DNA, 25 bp, Homo sapien
gcagtccctgcttatgatgggctcc

SEQ ID NO: 516685 - DNA, 25 bp, Homo sapien
cctgcttatgatgggctccccagga

SEQ ID NO: 516686 - DNA, 25 bp, Homo sapien
tcctgtctcgccagaagactcctag

SEQ ID NO: 516687 - DNA, 25 bp, Homo sapien
gccagaagactcctaggcccttggg

SEQ ID NO: 516688 - DNA, 25 bp, Homo sapien
gggtggcgcgcctgccttttctagt

SEQ ID NO: 516689 - DNA, 25 bp, Homo sapien
gcgcctgccttttctagttttatac

SEQ ID NO: 516690 - DNA, 25 bp, Homo sapien
gcctgccttttctagttttatacaa

SEQ ID NO: 516691 - DNA, 25 bp, Homo sapien
aaagacagccacttttagctactgc

SEQ ID NO: 516692 - DNA, 25 bp, Homo sapien
gacagccacttttagctactgctaa

SEQ ID NO: 516693 - DNA, 25 bp, Homo sapien
aggactgttttccagcatggttgct

SEQ ID NO: 516694 - DNA, 25 bp, Homo sapien
catggttgctcttggttggtgtaca

SEQ ID NO: 516695 - DNA, 25 bp, Homo sapien
agtcttaccattcacactctggtga

SEQ ID NO: 516696 - DNA, 25 bp, Homo sapien
actctggtgaacagtgtcctctgtt

SEQ ID NO: 516697 - DNA, 25 bp, Homo sapien
tagtgatacttggatgtttctctga

SEQ ID NO: 516698 - DNA, 25 bp, Homo sapien
tgacttctttttaaatcttgcccac

SEQ ID NO: 516699 - DNA, 25 bp, Homo sapien
taaatcttgcccaccagtgtcactg

SEQ ID NO: 516700 - DNA, 25 bp, Homo sapien
tttcacccagcattcctgcatttta

SEQ ID NO: 516701 - DNA, 25 bp, Homo sapien
aagagcctggttttcacttgaagtt

SEQ ID NO: 516702 - DNA, 25 bp, Homo sapien
aagtttctctgccttagctgcacgt

SEQ ID NO: 516703 - DNA, 25 bp, Homo sapien
ctgcacgttgcaattttctgagata

SEQ ID NO: 516704 - DNA, 25 bp, Homo sapien
atgggtttcccacacttccatcaac

SEQ ID NO: 516705 - DNA, 25 bp, Homo sapien
acacttcacaacaccttggaggcat

SEQ ID NO: 516706 - DNA, 25 bp, Homo sapien
acaacaccttggaggcattgtgaaa

SEQ ID NO: 516707 - DNA, 25 bp, Homo sapien
agagtcctgaagatgttgggtgaca

SEQ ID NO: 516708 - DNA, 25 bp, Homo sapien
tgttgggtgacattgtacagtgaat

SEQ ID NO: 516709 - DNA, 25 bp, Homo sapien
tgtacagtgaatggaggctgcctgc

SEQ ID NO: 516710 - DNA, 25 bp, Homo sapien
ggaggctgcctgcttggcacacttt

SEQ ID NO: 516711 - DNA, 25 bp, Homo sapien
acactttccatcacacatcacattt

SEQ ID NO: 516712 - DNA, 25 bp, Homo sapien
ttaagatgcagccagaacagtgact

SEQ ID NO: 516713 - DNA, 25 bp, Homo sapien
acagtgactggagtggtttcatacc

SEQ ID NO: 516714 - DNA, 25 bp, Homo sapien
gtggtttcatacctcatgggtttcc

SEQ ID NO: 516715 - DNA, 25 bp, Homo sapien
cccgaccatgctgggaatccagaaa

SEQ ID NO: 516716 - DNA, 25 bp, Homo sapien
ggaatccagaaacagggaccccatt

SEQ ID NO: 516717 - DNA, 25 bp, Homo sapien
agggaccccatttgtcttcccatat

SEQ ID NO: 516718 - DNA, 25 bp, Homo sapien
catttgtcttcccatatctggtgga

SEQ ID NO: 516719 - DNA, 25 bp, Homo sapien
ttgtcttcccatatctggtggaggt

SEQ ID NO: 516720 - DNA, 25 bp, Homo sapien
tcttcccatatctggtggaggtgag

SEQ ID NO: 516721 - DNA, 25 bp, Homo sapien
aagggaactgagaggctgctcttag

SEQ ID NO: 516722 - DNA, 25 bp, Homo sapien
agaggctgctcttagggagggcaaa

SEQ ID NO: 516723 - DNA, 25 bp, Homo sapien
gtgtctcccatcagtgcctttttta

SEQ ID NO: 516724 - DNA, 25 bp, Homo sapien
agtggcctcaaagcaaccatggcct

SEQ ID NO: 516725 - DNA, 25 bp, Homo sapien
gcctcaaagcaaccatggcctactt

SEQ ID NO: 516726 - DNA, 25 bp, Homo sapien
gaaagtcagatcttatccaggatga

SEQ ID NO: 516727 - DNA, 25 bp, Homo sapien
tcttatccaggatgaagcacttaga

SEQ ID NO: 516728 - DNA, 25 bp, Homo sapien
agaagggcaattgagaaccataaca

SEQ ID NO: 516729 - DNA, 25 bp, Homo sapien
gaaaagacatcgtcattccgagtag

SEQ ID NO: 516730 - DNA, 25 bp, Homo sapien
attccgagtaggaaaagccacctgc

SEQ ID NO: 516731 - DNA, 25 bp, Homo sapien
gaaaagccacctgcctgcagggaca

SEQ ID NO: 516732 - DNA, 25 bp, Homo sapien
ctgttgagagcagtgctgaccccag

SEQ ID NO: 516733 - DNA, 25 bp, Homo sapien
agtgctgaccccagcagttagggac

SEQ ID NO: 516734 - DNA, 25 bp, Homo sapien
gaccccagcagttagggactggctg

SEQ ID NO: 516735 - DNA, 25 bp, Homo sapien
tagggactggctgcatagcatactt

SEQ ID NO: 516736 - DNA, 25 bp, Homo sapien
actggctgcatagcatacttgttgg

SEQ ID NO: 516737 - DNA, 25 bp, Homo sapien
tccgtgccagccctttgaaggagat

SEQ ID NO: 516738 - DNA, 25 bp, Homo sapien
aggagatggccacatctgtaggcct

SEQ ID NO: 516739 - DNA, 25 bp, Homo sapien
ccttgtgcagaacccaggcaggagt

SEQ ID NO: 516740 - DNA, 25 bp, Homo sapien
gccactggagtgtgtcgtagatctt

SEQ ID NO: 516741 - DNA, 25 bp, Homo sapien
agatcttagattccactgtgctgcc

SEQ ID NO: 516742 - DNA, 25 bp, Homo sapien
catggctttgctcttcagggtgtta

SEQ ID NO: 516743 - DNA, 25 bp, Homo sapien
aaaccaagtcgcgtttcctgaacat

SEQ ID NO: 516744 - DNA, 25 bp, Homo sapien
gcgtttcctgaacatggtctcggat

SEQ ID NO: 516745 - DNA, 25 bp, Homo sapien
atggtctcggatgacaggcagcagc

SEQ ID NO: 516746 - DNA, 25 bp, Homo sapien
gcagcagccagctccgtgggaaatc

SEQ ID NO: 516747 - DNA, 25 bp, Homo sapien
gtgggaaatccagagtctcctcaga

SEQ ID NO: 516748 - DNA, 25 bp, Homo sapien
ggacctctgccagtggcccagggtg

SEQ ID NO: 516749 - DNA, 25 bp, Homo sapien
cagggtgtgtgcagggcagctccaa

SEQ ID NO: 516750 - DNA, 25 bp, Homo sapien
gggcagctccaaggatgaacctggt

SEQ ID NO: 516751 - DNA, 25 bp, Homo sapien
cagctccaaggatgaacctggtggg

SEQ ID NO: 516752 - DNA, 25 bp, Homo sapien
aggctggatgtaaccttgttcccaa

SEQ ID NO: 516753 - DNA, 25 bp, Homo sapien
gctggatgtaaccttgttcccaaga

SEQ ID NO: 516754 - DNA, 25 bp, Homo sapien
tgtaaccttgttcccaagaagtgtt

SEQ ID NO: 516755 - DNA, 25 bp, Homo sapien
atgtgctgtaagaatggaggaagtc

SEQ ID NO: 516756 - DNA, 25 bp, Homo sapien
ggaggaagtcgtttccactgtcagc

SEQ ID NO: 516757 - DNA, 25 bp, Homo sapien
aagtcgtttccactgtcagcatcct

SEQ ID NO: 516758 - DNA, 25 bp, Homo sapien
agactctggagagaggacctctgcc

SEQ ID NO: 516759 - DNA, 25 bp, Homo sapien
ataatagtaaaatgttacatgtgca

SEQ ID NO: 516760 - DNA, 25 bp, Homo sapien
taatagtaaaatgttacatgtgcat

SEQ ID NO: 516761 - DNA, 25 bp, Homo sapien
aatagtaaaatgttacatgtgcatg

SEQ ID NO: 516762 - DNA, 25 bp, Homo sapien
atagtaaaatgttacatgtgcatga

SEQ ID NO: 516763 - DNA, 25 bp, Homo sapien
tagtaaaatgttacatgtgcatgaa

SEQ ID NO: 516764 - DNA, 25 bp, Homo sapien
agtaaaatgttacatgtgcatgaag

SEQ ID NO: 516765 - DNA, 25 bp, Homo sapien
gtaaaatgttacatgtgcatgaagt

SEQ ID NO: 516766 - DNA, 25 bp, Homo sapien
taaaatgttacatgtgcatgaagtt

SEQ ID NO: 516767 - DNA, 25 bp, Homo sapien
aaaatgttacatgtgcatgaagttt

SEQ ID NO: 516768 - DNA, 25 bp, Homo sapien
aaatgttacatgtgcatgaagtttt

SEQ ID NO: 516769 - DNA, 25 bp, Homo sapien
tcagcctcagggcaggagtcccact

SEQ ID NO: 516770 - DNA, 25 bp, Homo sapien
tcctggaggaggacactcccatcag

SEQ ID NO: 516771 - DNA, 25 bp, Homo sapien
ggaggacactcccatcagaacttgg

SEQ ID NO: 516772 - DNA, 25 bp, Homo sapien
tcccatcagaacttggcagccttga

SEQ ID NO: 516773 - DNA, 25 bp, Homo sapien
cagaacttggcagccttgaagttgg

SEQ ID NO: 516774 - DNA, 25 bp, Homo sapien
acctgtaccaccatgtgggactcca

SEQ ID NO: 516775 - DNA, 25 bp, Homo sapien
gtaccaccatgtgggactccaggca

SEQ ID NO: 516776 - DNA, 25 bp, Homo sapien
gggactccaggcaccatctgttctc

SEQ ID NO: 516777 - DNA, 25 bp, Homo sapien
aggcaccatctgttctccccaggga

SEQ ID NO: 516778 - DNA, 25 bp, Homo sapien
tgacttgaatgccagcccttgctcc

SEQ ID NO: 516779 - DNA, 25 bp, Homo sapien
agcccttgctcctctgtgttgcttt

SEQ ID NO: 516780 - DNA, 25 bp, Homo sapien
gttactcattagtacagcaggaagt

SEQ ID NO: 516781 - DNA, 25 bp, Homo sapien
gggagtttgtcccacactatgggaa

SEQ ID NO: 516782 - DNA, 25 bp, Homo sapien
gagcaggattgatgagagccaagtt

SEQ ID NO: 516783 - DNA, 25 bp, Homo sapien
tcactgtctctcatctagacttctg

SEQ ID NO: 516784 - DNA, 25 bp, Homo sapien
agacttctgctaatgtcaatgccta

SEQ ID NO: 516785 - DNA, 25 bp, Homo sapien
gtcaatgcctaatatgtaccaacca

SEQ ID NO: 516786 - DNA, 25 bp, Homo sapien
aggcaacagataccttgttatcccc

SEQ ID NO: 516787 - DNA, 25 bp, Homo sapien
caggcatcaaggcaggcatcaatct

SEQ ID NO: 516788 - DNA, 25 bp, Homo sapien
aaggcaggcatcaatctctcacttt

SEQ ID NO: 516789 - DNA, 25 bp, Homo sapien
taaaaagtcatgttctattcactgc

SEQ ID NO: 516790 - DNA, 25 bp, Homo sapien
cactgctatgtaaatcttgccttaa

SEQ ID NO: 516791 - DNA, 25 bp, Homo sapien
tgacctcatgagcaataccccagat

SEQ ID NO: 516792 - DNA, 25 bp, Homo sapien
tcatgagcaataccccagattctgt

SEQ ID NO: 516793 - DNA, 25 bp, Homo sapien
gattctgtccctcctgaggaactga

SEQ ID NO: 516794 - DNA, 25 bp, Homo sapien
gaactgaagccctatcatatccgag

SEQ ID NO: 516795 - DNA, 25 bp, Homo sapien
atatccgagtctccaagccaacaga

SEQ ID NO: 516796 - DNA, 25 bp, Homo sapien
aagccaacagactccaaagcagaaa

SEQ ID NO: 516797 - DNA, 25 bp, Homo sapien
gagctcattgaatcatgcataccat

SEQ ID NO: 516798 - DNA, 25 bp, Homo sapien
cataccatgcagaaagttgagcttt

SEQ ID NO: 516799 - DNA, 25 bp, Homo sapien
tttgcttccccaaggctaaagtcag

SEQ ID NO: 516800 - DNA, 25 bp, Homo sapien
ttctgccacaggtctaacaatcaag

SEQ ID NO: 516801 - DNA, 25 bp, Homo sapien
aggaatccaggcaacattcttcacc

SEQ ID NO: 516802 - DNA, 25 bp, Homo sapien
accagctccaggtgctcaagattct

SEQ ID NO: 516803 - DNA, 25 bp, Homo sapien
atgacttggaactagggcttggctc

SEQ ID NO: 516804 - DNA, 25 bp, Homo sapien
gaactagggcttggctctcagaagt

SEQ ID NO: 516805 - DNA, 25 bp, Homo sapien
gaagtcctggattttggaaactcca

SEQ ID NO: 516806 - DNA, 25 bp, Homo sapien
aatggaatcacccttcagagacatc

SEQ ID NO: 516807 - DNA, 25 bp, Homo sapien
tcagagacatccctggtgcctggag

SEQ ID NO: 516808 - DNA, 25 bp, Homo sapien
tcagtgcctctgagtaggtgccatg

SEQ ID NO: 516809 - DNA, 25 bp, Homo sapien
gcacctttgctttctgcccagagtg

SEQ ID NO: 516810 - DNA, 25 bp, Homo sapien
agaacagatgatctccatttccgcc

SEQ ID NO: 516811 - DNA, 25 bp, Homo sapien
tagccacgtggcatcctgcctgtgg

SEQ ID NO: 516812 - DNA, 25 bp, Homo sapien
ctgcctgtggtctgggtgagattta

SEQ ID NO: 516813 - DNA, 25 bp, Homo sapien
gggaaaagcatgtaagagctccttt

SEQ ID NO: 516814 - DNA, 25 bp, Homo sapien
agagctccttttgtgatggtccatc

SEQ ID NO: 516815 - DNA, 25 bp, Homo sapien
gatggtccatctacccaaaagagat

SEQ ID NO: 516816 - DNA, 25 bp, Homo sapien
agagatctgctttagtgaacgatac

SEQ ID NO: 516817 - DNA, 25 bp, Homo sapien
ttagtgaacgatactctttcatttt

SEQ ID NO: 516818 - DNA, 25 bp, Homo sapien
tgattttagatgacttgtatgcaaa

SEQ ID NO: 516819 - DNA, 25 bp, Homo sapien
ttaaagctgattgggaactacaaac

SEQ ID NO: 516820 - DNA, 25 bp, Homo sapien
tggaatctactgacacagctaattg

SEQ ID NO: 516821 - DNA, 25 bp, Homo sapien
cagctaattggaaaacagatgtctt

SEQ ID NO: 516822 - DNA, 25 bp, Homo sapien
agatgtcttcttctgtcctattgat

SEQ ID NO: 516823 - DNA, 25 bp, Homo sapien
tcttctgtcctattgatgctggtgt

SEQ ID NO: 516824 - DNA, 25 bp, Homo sapien
ggtgtggaggcctatgttctgcccc

SEQ ID NO: 516825 - DNA, 25 bp, Homo sapien
gtgtggaggcctatgttctgcccca

SEQ ID NO: 516826 - DNA, 25 bp, Homo sapien
tgtggaggcctatgttctgccccat

SEQ ID NO: 516827 - DNA, 25 bp, Homo sapien
gtggaggcctatgttctgccccata

SEQ ID NO: 516828 - DNA, 25 bp, Homo sapien
ggaggcctatgttctgccccataca

SEQ ID NO: 516829 - DNA, 25 bp, Homo sapien
gaggcctatgttctgccccatacac

SEQ ID NO: 516830 - DNA, 25 bp, Homo sapien
agaggactgtgccgccctgttcttg

SEQ ID NO: 516831 - DNA, 25 bp, Homo sapien
gacagagaggacttgtacaaaggct

SEQ ID NO: 516832 - DNA, 25 bp, Homo sapien
acagagaggacttgtacaaaggctt

SEQ ID NO: 516833 - DNA, 25 bp, Homo sapien
taacatcattggaactagctattag

SEQ ID NO: 516834 - DNA, 25 bp, Homo sapien
catcattggaactagctattaggaa

SEQ ID NO: 516835 - DNA, 25 bp, Homo sapien
gaatttatgtttacttgatatggaa

SEQ ID NO: 516836 - DNA, 25 bp, Homo sapien
cttgatatggaaaattacgctttat

SEQ ID NO: 516837 - DNA, 25 bp, Homo sapien
tggaaaattacgctttataggtgga

SEQ ID NO: 516838 - DNA, 25 bp, Homo sapien
tacgctttataggtggaaaagtagc

SEQ ID NO: 516839 - DNA, 25 bp, Homo sapien
gctagttaaaacaataagtatcatc

SEQ ID NO: 516840 - DNA, 25 bp, Homo sapien
aagtatcatctaatttgggtgttta

SEQ ID NO: 516841 - DNA, 25 bp, Homo sapien
gaaaacagacctagaaccgtggcat

SEQ ID NO: 516842 - DNA, 25 bp, Homo sapien
aaacagacctagaaccgtggcatgt

SEQ ID NO: 516843 - DNA, 25 bp, Homo sapien
acagacctagaaccgtggcatgttt

SEQ ID NO: 516844 - DNA, 25 bp, Homo sapien
gacctagaaccgtggcatgttttgc

SEQ ID NO: 516845 - DNA, 25 bp, Homo sapien
tagaaccgtggcatgttttgcctga

SEQ ID NO: 516846 - DNA, 25 bp, Homo sapien
aagacctgctctcccctcggaaagg

SEQ ID NO: 516847 - DNA, 25 bp, Homo sapien
aattggcaccttggaaagacatacc

SEQ ID NO: 516848 - DNA, 25 bp, Homo sapien
aacaggattcgagaaaacaagtgcc

SEQ ID NO: 516849 - DNA, 25 bp, Homo sapien
acaagtgccattgcaaatgttgcca

SEQ ID NO: 516850 - DNA, 25 bp, Homo sapien
aaatgttgccaaaatacagacactg

SEQ ID NO: 516851 - DNA, 25 bp, Homo sapien
aatacagacactggatgccctgaat

SEQ ID NO: 516852 - DNA, 25 bp, Homo sapien
ggatgccctgaatgacgcactggag

SEQ ID NO: 516853 - DNA, 25 bp, Homo sapien
gacgcactggagaagctcaactata

SEQ ID NO: 516854 - DNA, 25 bp, Homo sapien
tggcactggcacacgctatggcaaa

SEQ ID NO: 516855 - DNA, 25 bp, Homo sapien
tggcacacgctatggcaaatgaagt

SEQ ID NO: 516856 - DNA, 25 bp, Homo sapien
aatgaagtgcaagacctgctctccc

SEQ ID NO: 516857 - DNA, 25 bp, Homo sapien
tggcaggtgtttccaaccctgatga

SEQ ID NO: 516858 - DNA, 25 bp, Homo sapien
gttttctgcattctggaggcaaatg

SEQ ID NO: 516859 - DNA, 25 bp, Homo sapien
aattcagcagtgtctctcttcccag

SEQ ID NO: 516860 - DNA, 25 bp, Homo sapien
gttcatttaaaccttgactttggca

SEQ ID NO: 516861 - DNA, 25 bp, Homo sapien
tcttcccaggaagcagatttacagg

SEQ ID NO: 516862 - DNA, 25 bp, Homo sapien
cagatttacaggcttttccttccaa

SEQ ID NO: 516863 - DNA, 25 bp, Homo sapien
actgaaaatggcagcatgccccacc

SEQ ID NO: 516864 - DNA, 25 bp, Homo sapien
ggtggctgatcagagaactacctca

SEQ ID NO: 516865 - DNA, 25 bp, Homo sapien
agagaactacctcagcagggcagag

SEQ ID NO: 516866 - DNA, 25 bp, Homo sapien
atcaatgccaagatgcaccatgtta

SEQ ID NO: 516867 - DNA, 25 bp, Homo sapien
gcaccatgttaattgcaaccgagaa

SEQ ID NO: 516868 - DNA, 25 bp, Homo sapien
aaattcaatacatactgctcctttg

SEQ ID NO: 516869 - DNA, 25 bp, Homo sapien
atacatactgctcctttgaaatttg

SEQ ID NO: 516870 - DNA, 25 bp, Homo sapien
gtacaaccgtatatatagtcatttt

SEQ ID NO: 516871 - DNA, 25 bp, Homo sapien
aataaggagtccagagactacgctt

SEQ ID NO: 516872 - DNA, 25 bp, Homo sapien
gagtccagagactacgcttaacttt

SEQ ID NO: 516873 - DNA, 25 bp, Homo sapien
gagactacgcttaactttctatgca

SEQ ID NO: 516874 - DNA, 25 bp, Homo sapien
acgcttaactttctatgcatgcatt

SEQ ID NO: 516875 - DNA, 25 bp, Homo sapien
gaaagctgtttttacctgataatgt

SEQ ID NO: 516876 - DNA, 25 bp, Homo sapien
gctgtttttacctgataatgtagta

SEQ ID NO: 516877 - DNA, 25 bp, Homo sapien
aatactgatctgtgttgcatttcaa

SEQ ID NO: 516878 - DNA, 25 bp, Homo sapien
actgatctgtgttgcatttcaaaat

SEQ ID NO: 516879 - DNA, 25 bp, Homo sapien
cagctcttcagttccttgacctgag

SEQ ID NO: 516880 - DNA, 25 bp, Homo sapien
ttcagttccttgacctgagcttttc

SEQ ID NO: 516881 - DNA, 25 bp, Homo sapien
cctgagcttttctggccaaaagaag

SEQ ID NO: 516882 - DNA, 25 bp, Homo sapien
gtgtgtttaacggttgctggcccca

SEQ ID NO: 516883 - DNA, 25 bp, Homo sapien
gattaggtttcccacctggatcctg

SEQ ID NO: 516884 - DNA, 25 bp, Homo sapien
ttctgtgaactgtccggcttatcga

SEQ ID NO: 516885 - DNA, 25 bp, Homo sapien
gtccggcttatcgaagaagacccat

SEQ ID NO: 516886 - DNA, 25 bp, Homo sapien
tatcgaagaagacccatttttcctt

SEQ ID NO: 516887 - DNA, 25 bp, Homo sapien
ttttccttcttacagttgctgtttc

SEQ ID NO: 516888 - DNA, 25 bp, Homo sapien
cagccctatggaatgtgctctgtct

SEQ ID NO: 516889 - DNA, 25 bp, Homo sapien
tgccagtcatcaaggcagttactgt

SEQ ID NO: 516890 - DNA, 25 bp, Homo sapien
tactgttgtccctgttttcctttgg

SEQ ID NO: 516891 - DNA, 25 bp, Homo sapien
ggaatttactcagttagcagcccct

SEQ ID NO: 516892 - DNA, 25 bp, Homo sapien
ggaaggccatgtcccagttttctgt

SEQ ID NO: 516893 - DNA, 25 bp, Homo sapien
tgttcctctgcactatgtctctgat

SEQ ID NO: 516894 - DNA, 25 bp, Homo sapien
tgtctctgattttccctgccaggga

SEQ ID NO: 516895 - DNA, 25 bp, Homo sapien
cacgcacctgtgctcatgagtgttt

SEQ ID NO: 516896 - DNA, 25 bp, Homo sapien
gctcatgagtgtttccgcaggataa

SEQ ID NO: 516897 - DNA, 25 bp, Homo sapien
aattcgttctgagcatgataccaca

SEQ ID NO: 516898 - DNA, 25 bp, Homo sapien
accacagtgtggattgtctgtctgt

SEQ ID NO: 516899 - DNA, 25 bp, Homo sapien
gtctgtctgtaaggagatgccatct

SEQ ID NO: 516900 - DNA, 25 bp, Homo sapien
gagatgccatctactaaccaatttg

SEQ ID NO: 516901 - DNA, 25 bp, Homo sapien
gtcatgcactgacacagcattcatg

SEQ ID NO: 516902 - DNA, 25 bp, Homo sapien
gaaggatttttctcatgctcttata

SEQ ID NO: 516903 - DNA, 25 bp, Homo sapien
ctcatgctcttatattagggattct

SEQ ID NO: 516904 - DNA, 25 bp, Homo sapien
gggattctatttgagttgcgtttat

SEQ ID NO: 516905 - DNA, 25 bp, Homo sapien
gagttgcgtttatctgttggcaaaa

SEQ ID NO: 516906 - DNA, 25 bp, Homo sapien
tatctttttcaaggcatcagctctg

SEQ ID NO: 516907 - DNA, 25 bp, Homo sapien
aaggcatcagctctgaacctagctt

SEQ ID NO: 516908 - DNA, 25 bp, Homo sapien
gagcagtgaggtttacaacaagccc

SEQ ID NO: 516909 - DNA, 25 bp, Homo sapien
ggtttacaacaagccctacaattag

SEQ ID NO: 516910 - DNA, 25 bp, Homo sapien
attagagattgctgaactgctgcta

SEQ ID NO: 516911 - DNA, 25 bp, Homo sapien
gctgaactgctgctaaagtgatttt

SEQ ID NO: 516912 - DNA, 25 bp, Homo sapien
cccattccagatccggtgtttttga

SEQ ID NO: 516913 - DNA, 25 bp, Homo sapien
gatccggtgtttttgagaactgtgt

SEQ ID NO: 516914 - DNA, 25 bp, Homo sapien
gagaactgtgttacggtcaggtgat

SEQ ID NO: 516915 - DNA, 25 bp, Homo sapien
tgaactcttggaacctcagctttcc

SEQ ID NO: 516916 - DNA, 25 bp, Homo sapien
ggcatgtctgctgccctgaataaat

SEQ ID NO: 516917 - DNA, 25 bp, Homo sapien
agcttatctttctatctcgagtcca

SEQ ID NO: 516918 - DNA, 25 bp, Homo sapien
tctcgagtccactctaagtggtcag

SEQ ID NO: 516919 - DNA, 25 bp, Homo sapien
gtggtcagaacttgagtagcactaa

SEQ ID NO: 516920 - DNA, 25 bp, Homo sapien
gtagcactaaacatatacctgttga

SEQ ID NO: 516921 - DNA, 25 bp, Homo sapien
gaacctcagctttccataacagatg

SEQ ID NO: 516922 - DNA, 25 bp, Homo sapien
aaagcttagcattgggcctgacata

SEQ ID NO: 516923 - DNA, 25 bp, Homo sapien
aactcgaacttgaagacacatactt

SEQ ID NO: 516924 - DNA, 25 bp, Homo sapien
gaagacacatacttcaactgtcctt

SEQ ID NO: 516925 - DNA, 25 bp, Homo sapien
catacttcaactgtccttattgtcc

SEQ ID NO: 516926 - DNA, 25 bp, Homo sapien
tcaactgtccttattgtccattaaa

SEQ ID NO: 516927 - DNA, 25 bp, Homo sapien
gtccttattgtccattaaactgata

SEQ ID NO: 516928 - DNA, 25 bp, Homo sapien
taaaaatagtgtaccaatgcttcat

SEQ ID NO: 516929 - DNA, 25 bp, Homo sapien
ccaatgcttcatatacgttagttat

SEQ ID NO: 516930 - DNA, 25 bp, Homo sapien
gcttcatatacgttagttatttgct

SEQ ID NO: 516931 - DNA, 25 bp, Homo sapien
agttatttgctattatgtagggaag

SEQ ID NO: 516932 - DNA, 25 bp, Homo sapien
ggaagaggattgttatttcaaagat

SEQ ID NO: 516933 - DNA, 25 bp, Homo sapien
gaacagttgcatctgaatataatca

SEQ ID NO: 516934 - DNA, 25 bp, Homo sapien
accctaccagtgtctttgtggactt

SEQ ID NO: 516935 - DNA, 25 bp, Homo sapien
gtctttgtggacttgagttgattca

SEQ ID NO: 516936 - DNA, 25 bp, Homo sapien
ttgccctcgctctacttttacagta

SEQ ID NO: 516937 - DNA, 25 bp, Homo sapien
attcactattcatatgcaactctga

SEQ ID NO: 516938 - DNA, 25 bp, Homo sapien
gcaactctgataaactaaccgtgta

SEQ ID NO: 516939 - DNA, 25 bp, Homo sapien
attggcctggaatctcaacactttg

SEQ ID NO: 516940 - DNA, 25 bp, Homo sapien
ttttacagtaactagctccaagtat

SEQ ID NO: 516941 - DNA, 25 bp, Homo sapien
tagctccaagtataggacaagtcca

SEQ ID NO: 516942 - DNA, 25 bp, Homo sapien
gacaagtccaagtccgtctgtgctt

SEQ ID NO: 516943 - DNA, 25 bp, Homo sapien
aagtccgtctgtgcttgctccagtc

SEQ ID NO: 516944 - DNA, 25 bp, Homo sapien
agctactttttctaccctaccagtg

SEQ ID NO: 516945 - DNA, 25 bp, Homo sapien
accaatggaagttggcagttatcca

SEQ ID NO: 516946 - DNA, 25 bp, Homo sapien
cagttatccaaatatgccccatcct

SEQ ID NO: 516947 - DNA, 25 bp, Homo sapien
atcggacagaggaatatgggcccca

SEQ ID NO: 516948 - DNA, 25 bp, Homo sapien
tgggccccagaaacatgcagcagtc

SEQ ID NO: 516949 - DNA, 25 bp, Homo sapien
cagcagtctcgtccatttataggca

SEQ ID NO: 516950 - DNA, 25 bp, Homo sapien
tttataggcatgtcctcggcaccaa

SEQ ID NO: 516951 - DNA, 25 bp, Homo sapien
gtcctcggcaccaagggaattgact

SEQ ID NO: 516952 - DNA, 25 bp, Homo sapien
aattgactgggcacatgaggccaaa

SEQ ID NO: 516953 - DNA, 25 bp, Homo sapien
aggccaaatggttgtcctggtgttg

SEQ ID NO: 516954 - DNA, 25 bp, Homo sapien
tggtgttggccttggagacccacaa

SEQ ID NO: 516955 - DNA, 25 bp, Homo sapien
ggaacgactgatacctggccaacaa

SEQ ID NO: 516956 - DNA, 25 bp, Homo sapien
gtattttctgtatgaaactgccaat

SEQ ID NO: 516957 - DNA, 25 bp, Homo sapien
gaaactgccaatatcatgaatagaa

SEQ ID NO: 516958 - DNA, 25 bp, Homo sapien
gttctgttatgttcatgtaaaccta

SEQ ID NO: 516959 - DNA, 25 bp, Homo sapien
gaggcaggcgcgatcagccgaactc

SEQ ID NO: 516960 - DNA, 25 bp, Homo sapien
atcagccgaactctagggacttggt

SEQ ID NO: 516961 - DNA, 25 bp, Homo sapien
tctagggacttggtgttgcttggaa

SEQ ID NO: 516962 - DNA, 25 bp, Homo sapien
tggaaggcatccatacctgcatttt

SEQ ID NO: 516963 - DNA, 25 bp, Homo sapien
cctgcattttgcattcttcgtatgt

SEQ ID NO: 516964 - DNA, 25 bp, Homo sapien
gtatgtaatcatattgccaaagaca

SEQ ID NO: 516965 - DNA, 25 bp, Homo sapien
gccaaagacaaactatttcatcatt

SEQ ID NO: 516966 - DNA, 25 bp, Homo sapien
tccccagacctaccataaagtttct

SEQ ID NO: 516967 - DNA, 25 bp, Homo sapien
atgctgtgctgttaatcagtgtcct

SEQ ID NO: 516968 - DNA, 25 bp, Homo sapien
ggttgcttggaaatcttggcgcccc

SEQ ID NO: 516969 - DNA, 25 bp, Homo sapien
cctcagtagtaacagccttggttta

SEQ ID NO: 516970 - DNA, 25 bp, Homo sapien
aacagccttggtttaagggcgcaga

SEQ ID NO: 516971 - DNA, 25 bp, Homo sapien
gggctataacaagggcattcatgct

SEQ ID NO: 516972 - DNA, 25 bp, Homo sapien
gcattcatgctgtgggttaagatcc

SEQ ID NO: 516973 - DNA, 25 bp, Homo sapien
gggttaagatccacaaatcgctagg

SEQ ID NO: 516974 - DNA, 25 bp, Homo sapien
atcgctaggaatgtgtatactctgg

SEQ ID NO: 516975 - DNA, 25 bp, Homo sapien
ctctgggtagtaagtttgtagtatt

SEQ ID NO: 516976 - DNA, 25 bp, Homo sapien
tgaagttaagtgttgggaggccatc

SEQ ID NO: 516977 - DNA, 25 bp, Homo sapien
gcaggtcaactgtttttgcaagcat

SEQ ID NO: 516978 - DNA, 25 bp, Homo sapien
gagtgctccttgacagagaccgaga

SEQ ID NO: 516979 - DNA, 25 bp, Homo sapien
gagtaactactgtgcacagctggca

SEQ ID NO: 516980 - DNA, 25 bp, Homo sapien
agctggcacagatccaggctcagat

SEQ ID NO: 516981 - DNA, 25 bp, Homo sapien
agatccaggctcagatcgggtccct

SEQ ID NO: 516982 - DNA, 25 bp, Homo sapien
agctgcaccaggtcagaaccgagac

SEQ ID NO: 516983 - DNA, 25 bp, Homo sapien
gaaccgagaccgagggccagaagct

SEQ ID NO: 516984 - DNA, 25 bp, Homo sapien
tactgcctcctgatagatggagaag

SEQ ID NO: 516985 - DNA, 25 bp, Homo sapien
atggctcctgttctaaatcaaaagg

SEQ ID NO: 516986 - DNA, 25 bp, Homo sapien
tcaaaaggctatggaggcccaggaa

SEQ ID NO: 516987 - DNA, 25 bp, Homo sapien
aagattcatctaaaaccaccattgt

SEQ ID NO: 516988 - DNA, 25 bp, Homo sapien
accaccattgtcaaaacagttgttg

SEQ ID NO: 516989 - DNA, 25 bp, Homo sapien
ccagcatccagtcagacctagtaaa

SEQ ID NO: 516990 - DNA, 25 bp, Homo sapien
ttggattcttaacccaagataggct

SEQ ID NO: 516991 - DNA, 25 bp, Homo sapien
acccaagataggctgtaaatcacta

SEQ ID NO: 516992 - DNA, 25 bp, Homo sapien
ttcctctcttttccatattccagct

SEQ ID NO: 516993 - DNA, 25 bp, Homo sapien
atattccagctgaactccgtttcca

SEQ ID NO: 516994 - DNA, 25 bp, Homo sapien
tgaactccgtttccaaaggcacaaa

SEQ ID NO: 516995 - DNA, 25 bp, Homo sapien
aagagtgtgcttattcagattttga

SEQ ID NO: 516996 - DNA, 25 bp, Homo sapien
tttggtaccttttggttaatgacat

SEQ ID NO: 516997 - DNA, 25 bp, Homo sapien
ggttaatgacatagcctcctgaaat

SEQ ID NO: 516998 - DNA, 25 bp, Homo sapien
agcctcctgaaattctggatgtctt

SEQ ID NO: 516999 - DNA, 25 bp, Homo sapien
gttttgcttctttatcctgaaaatc

SEQ ID NO: 517000 - DNA, 25 bp, Homo sapien
gagaagatgcggtcactgcaagaaa

SEQ ID NO: 517001 - DNA, 25 bp, Homo sapien
agatgcggtcactgcaagaaagaag

SEQ ID NO: 517002 - DNA, 25 bp, Homo sapien
gggctaatggcataggctatcagag

SEQ ID NO: 517003 - DNA, 25 bp, Homo sapien
tggcataggctatcagagcaacaaa

SEQ ID NO: 517004 - DNA, 25 bp, Homo sapien
gagcaacaaagagcaagcacctagt

SEQ ID NO: 517005 - DNA, 25 bp, Homo sapien
gagcaagcacctagtgatcttttag

SEQ ID NO: 517006 - DNA, 25 bp, Homo sapien
gcacctagtgatcttttagagtttc

SEQ ID NO: 517007 - DNA, 25 bp, Homo sapien
gatcttttagagtttcttcattccc

SEQ ID NO: 517008 - DNA, 25 bp, Homo sapien
agagtttcttcattcccaaattgac

SEQ ID NO: 517009 - DNA, 25 bp, Homo sapien
attcccaaattgacaaagctgaagt

SEQ ID NO: 517010 - DNA, 25 bp, Homo sapien
ggccaaactacccagtgagtatggg

SEQ ID NO: 517011 - DNA, 25 bp, Homo sapien
gggtttagcatttccagtgcagcat

SEQ ID NO: 517012 - DNA, 25 bp, Homo sapien
gcatttccagtgcagcattatcagt

SEQ ID NO: 517013 - DNA, 25 bp, Homo sapien
agtgcagcattatcagtgggccttt

SEQ ID NO: 517014 - DNA, 25 bp, Homo sapien
cagcattatcagtgggcctttaaaa

SEQ ID NO: 517015 - DNA, 25 bp, Homo sapien
tacttcgtaagtacattagctttca

SEQ ID NO: 517016 - DNA, 25 bp, Homo sapien
cgtaagtacattagctttcactttg

SEQ ID NO: 517017 - DNA, 25 bp, Homo sapien
tatagcagactcattatagagaaca

SEQ ID NO: 517018 - DNA, 25 bp, Homo sapien
tgctaagcacccagaagataaaatt

SEQ ID NO: 517019 - DNA, 25 bp, Homo sapien
tttgtacattgtgttcattcttgaa

SEQ ID NO: 517020 - DNA, 25 bp, Homo sapien
aaatgagttctgtgttggcttgtag

SEQ ID NO: 517021 - DNA, 25 bp, Homo sapien
gttctgtgttggcttgtagatacta

SEQ ID NO: 517022 - DNA, 25 bp, Homo sapien
atcatggaggagtgcatttccttgg

SEQ ID NO: 517023 - DNA, 25 bp, Homo sapien
atggaggagtgcatttccttggcta

SEQ ID NO: 517024 - DNA, 25 bp, Homo sapien
ggaggagtgcatttccttggctatt

SEQ ID NO: 517025 - DNA, 25 bp, Homo sapien
agaagtcctacctcccttctgagat

SEQ ID NO: 517026 - DNA, 25 bp, Homo sapien
ctcccttctgagattttataatggt

SEQ ID NO: 517027 - DNA, 25 bp, Homo sapien
cccttctgagattttataatggtat

SEQ ID NO: 517028 - DNA, 25 bp, Homo sapien
ggtatttcttatggttatcccaaat

SEQ ID NO: 517029 - DNA, 25 bp, Homo sapien
atttcttatggttatcccaaatata

SEQ ID NO: 517030 - DNA, 25 bp, Homo sapien
ggttatcccaaatatacttggcaag

SEQ ID NO: 517031 - DNA, 25 bp, Homo sapien
atcccaaatatacttggcaagtcgt

SEQ ID NO: 517032 - DNA, 25 bp, Homo sapien
cccaaatatacttggcaagtcgtct

SEQ ID NO: 517033 - DNA, 25 bp, Homo sapien
gattctcttcctagggctgtgggaa

SEQ ID NO: 517034 - DNA, 25 bp, Homo sapien
tgggaagccccttgagatgttggaa

SEQ ID NO: 517035 - DNA, 25 bp, Homo sapien
aagccccttgagatgttggaagcag

SEQ ID NO: 517036 - DNA, 25 bp, Homo sapien
ggcacagagctgtggacgagggctg

SEQ ID NO: 517037 - DNA, 25 bp, Homo sapien
acgagggctgggaaagccatcccgc

SEQ ID NO: 517038 - DNA, 25 bp, Homo sapien
gagggctgggaaagccatcccgcct

SEQ ID NO: 517039 - DNA, 25 bp, Homo sapien
tccgaggagtgctgctgtggccaaa

SEQ ID NO: 517040 - DNA, 25 bp, Homo sapien
ttgtgctttctgtttaggtgatggg

SEQ ID NO: 517041 - DNA, 25 bp, Homo sapien
taggtgatgggatgcttctatctcc

SEQ ID NO: 517042 - DNA, 25 bp, Homo sapien
tcttttgaaaatgctggcctgctgc

SEQ ID NO: 517043 - DNA, 25 bp, Homo sapien
tttgaaaatgctggcctgctgcacc

SEQ ID NO: 517044 - DNA, 25 bp, Homo sapien
gaaagcaccgataaggtcttcacct

SEQ ID NO: 517045 - DNA, 25 bp, Homo sapien
gcaccgataaggtcttcacctttga

SEQ ID NO: 517046 - DNA, 25 bp, Homo sapien
ataaggtcttcacctttgaccccag

SEQ ID NO: 517047 - DNA, 25 bp, Homo sapien
aggtggaggtccagccatccctgca

SEQ ID NO: 517048 - DNA, 25 bp, Homo sapien
tcaccatcatccagagcttgggcag

SEQ ID NO: 517049 - DNA, 25 bp, Homo sapien
ccatcatccagagcttgggcaggtg

SEQ ID NO: 517050 - DNA, 25 bp, Homo sapien
gcaggtgattcagatttggacagcc

SEQ ID NO: 517051 - DNA, 25 bp, Homo sapien
ttcagatttggacagcctgagccag

SEQ ID NO: 517052 - DNA, 25 bp, Homo sapien
ggcaggcggagctcagatgcacact

SEQ ID NO: 517053 - DNA, 25 bp, Homo sapien
agatgcacactctgctccctcatgg

SEQ ID NO: 517054 - DNA, 25 bp, Homo sapien
taatggtcccttttcttgtataaat

SEQ ID NO: 517055 - DNA, 25 bp, Homo sapien
gtggagaaaccacccctgcaggttg

SEQ ID NO: 517056 - DNA, 25 bp, Homo sapien
agctctccatcccaggtatttgttt

SEQ ID NO: 517057 - DNA, 25 bp, Homo sapien
aataatttgaaactggacctgctgg

SEQ ID NO: 517058 - DNA, 25 bp, Homo sapien
aagaattaacacatccttcctaggg

SEQ ID NO: 517059 - DNA, 25 bp, Homo sapien
atccttcctagggaggccaaatgtt

SEQ ID NO: 517060 - DNA, 25 bp, Homo sapien
tgttagatcaatcatgtcttccagc

SEQ ID NO: 517061 - DNA, 25 bp, Homo sapien
atgtcttccagccactacagtgatt

SEQ ID NO: 517062 - DNA, 25 bp, Homo sapien
gggttcctgatgctgttgagttcac

SEQ ID NO: 517063 - DNA, 25 bp, Homo sapien
ctgatgctgttgagttcactgccta

SEQ ID NO: 517064 - DNA, 25 bp, Homo sapien
accttgccttttcagttaagtgttg

SEQ ID NO: 517065 - DNA, 25 bp, Homo sapien
agttaagtgttgctgtacggacaga

SEQ ID NO: 517066 - DNA, 25 bp, Homo sapien
gttggactgtacttctctgagtgag

SEQ ID NO: 517067 - DNA, 25 bp, Homo sapien
tacttctctgagtgaggtgctgtga

SEQ ID NO: 517068 - DNA, 25 bp, Homo sapien
gtgaggacccctggaaggacacaag

SEQ ID NO: 517069 - DNA, 25 bp, Homo sapien
atagtgaaggccgacgctgacttcc

SEQ ID NO: 517070 - DNA, 25 bp, Homo sapien
gacgctgacttccagaagcaatgag

SEQ ID NO: 517071 - DNA, 25 bp, Homo sapien
tatgccgtttcctcaagttttacct

SEQ ID NO: 517072 - DNA, 25 bp, Homo sapien
tagtagcttctagactttttccgaa

SEQ ID NO: 517073 - DNA, 25 bp, Homo sapien
gactttttccgaattctcatcacat

SEQ ID NO: 517074 - DNA, 25 bp, Homo sapien
gcagcaactttttggtaaactgtca

SEQ ID NO: 517075 - DNA, 25 bp, Homo sapien
taaactgtcaactagtggcttgctg

SEQ ID NO: 517076 - DNA, 25 bp, Homo sapien
tagtggcttgctgttggactgtact

SEQ ID NO: 517077 - DNA, 25 bp, Homo sapien
aaagcaaggttcagtcatttttagc

SEQ ID NO: 517078 - DNA, 25 bp, Homo sapien
gcatcacttgatggagagaagctgg

SEQ ID NO: 517079 - DNA, 25 bp, Homo sapien
gacctaatttccattaaagacatct

SEQ ID NO: 517080 - DNA, 25 bp, Homo sapien
gagaagaatttgctcgcatgcttac

SEQ ID NO: 517081 - DNA, 25 bp, Homo sapien
tcgcatgcttacagagcttctcttt

SEQ ID NO: 517082 - DNA, 25 bp, Homo sapien
gagcttctctttgaattacatgtgg

SEQ ID NO: 517083 - DNA, 25 bp, Homo sapien
ctttgaattacatgtggcggccaca

SEQ ID NO: 517084 - DNA, 25 bp, Homo sapien
ggccacacctgacaaactcaataag

SEQ ID NO: 517085 - DNA, 25 bp, Homo sapien
aaggccatgaagagggctcatgact

SEQ ID NO: 517086 - DNA, 25 bp, Homo sapien
aagaggatcaaaccgtggtgtcagt

SEQ ID NO: 517087 - DNA, 25 bp, Homo sapien
accgtggtgtcagtagatgtggcaa

SEQ ID NO: 517088 - DNA, 25 bp, Homo sapien
aataggaattcctcgacatcactcc

SEQ ID NO: 517089 - DNA, 25 bp, Homo sapien
actttccttgcctgtgttgttgcta

SEQ ID NO: 517090 - DNA, 25 bp, Homo sapien
aagtaatatctgcattccttttaag

SEQ ID NO: 517091 - DNA, 25 bp, Homo sapien
gatgttctgtaagtcatatttgtca

SEQ ID NO: 517092 - DNA, 25 bp, Homo sapien
tatacagagtagtcttccttttccc

SEQ ID NO: 517093 - DNA, 25 bp, Homo sapien
ttttccccacgttcagtgtaatctc

SEQ ID NO: 517094 - DNA, 25 bp, Homo sapien
agctaacaacatctgcacagcacct

SEQ ID NO: 517095 - DNA, 25 bp, Homo sapien
gcacagcaccttacagtttgcaaag

SEQ ID NO: 517096 - DNA, 25 bp, Homo sapien
gcaaagaacgttcacacattctcat

SEQ ID NO: 517097 - DNA, 25 bp, Homo sapien
gtgaacctgttacgagatgtctctt

SEQ ID NO: 517098 - DNA, 25 bp, Homo sapien
tacgagatgtctcttgacgtcgatg

SEQ ID NO: 517099 - DNA, 25 bp, Homo sapien
gcgtcatggtccttttagccagaag

SEQ ID NO: 517100 - DNA, 25 bp, Homo sapien
ggttttcttttgcatagttggtgag

SEQ ID NO: 517101 - DNA, 25 bp, Homo sapien
gttggtgagcatcaagaatccttta

SEQ ID NO: 517102 - DNA, 25 bp, Homo sapien
ggtgctgacttctccccattgagag

SEQ ID NO: 517103 - DNA, 25 bp, Homo sapien
ttctccccattgagagtcagcctca

SEQ ID NO: 517104 - DNA, 25 bp, Homo sapien
ccaaaccttggtgttagagtcacaa

SEQ ID NO: 517105 - DNA, 25 bp, Homo sapien
gaacaggcagtgatatacattttct

SEQ ID NO: 517106 - DNA, 25 bp, Homo sapien
ttctgctgttgaaagatgtccgctt

SEQ ID NO: 517107 - DNA, 25 bp, Homo sapien
aaagatgtccgcttatccttctctt

SEQ ID NO: 517108 - DNA, 25 bp, Homo sapien
gacaataacttgtctttctgggcat

SEQ ID NO: 517109 - DNA, 25 bp, Homo sapien
tttctgggcattcgcgtcatggtcc

SEQ ID NO: 517110 - DNA, 25 bp, Homo sapien
gagagcaacactcagggaaccagag

SEQ ID NO: 517111 - DNA, 25 bp, Homo sapien
gagacaggaacacagctgggaacta

SEQ ID NO: 517112 - DNA, 25 bp, Homo sapien
gtggccaggtcagaaaagcctcatg

SEQ ID NO: 517113 - DNA, 25 bp, Homo sapien
aaccagaagtcatggagtggagcca

SEQ ID NO: 517114 - DNA, 25 bp, Homo sapien
aagcctcatggaatcctggttaact

SEQ ID NO: 517115 - DNA, 25 bp, Homo sapien
gaatcctggttaactgaatgtttct

SEQ ID NO: 517116 - DNA, 25 bp, Homo sapien
gaatgtttctattgactgaggccac

SEQ ID NO: 517117 - DNA, 25 bp, Homo sapien
tgaggccactgcttaagccctgtat

SEQ ID NO: 517118 - DNA, 25 bp, Homo sapien
gcttaagccctgtattcttttttat

SEQ ID NO: 517119 - DNA, 25 bp, Homo sapien
tcaatccccatggttagaaaaatag

SEQ ID NO: 517120 - DNA, 25 bp, Homo sapien
gaaccaccaggataaaggtgccaag

SEQ ID NO: 517121 - DNA, 25 bp, Homo sapien
ggtccctggaggacaggtcacatct

SEQ ID NO: 517122 - DNA, 25 bp, Homo sapien
ggaggacaggtcacatctgatccct

SEQ ID NO: 517123 - DNA, 25 bp, Homo sapien
acatctgatccctttggggtgcggg

SEQ ID NO: 517124 - DNA, 25 bp, Homo sapien
gcactgagtgaatgccccctggctg

SEQ ID NO: 517125 - DNA, 25 bp, Homo sapien
atgaggttttcctccccaggcaggc

SEQ ID NO: 517126 - DNA, 25 bp, Homo sapien
gcacgtggaaagttggctgctgcct

SEQ ID NO: 517127 - DNA, 25 bp, Homo sapien
cacgtggaaagttggctgctgcctg

SEQ ID NO: 517128 - DNA, 25 bp, Homo sapien
tctgccctaggacttaccaagctgt

SEQ ID NO: 517129 - DNA, 25 bp, Homo sapien
tgccctaggacttaccaagctgtag

SEQ ID NO: 517130 - DNA, 25 bp, Homo sapien
ctaggacttaccaagctgtagggcc

SEQ ID NO: 517131 - DNA, 25 bp, Homo sapien
aggacttaccaagctgtagggccag

SEQ ID NO: 517132 - DNA, 25 bp, Homo sapien
agacacattgcaggtcagcttcttc

SEQ ID NO: 517133 - DNA, 25 bp, Homo sapien
acattgcaggtcagcttcttcctct

SEQ ID NO: 517134 - DNA, 25 bp, Homo sapien
ttttctgtctcgttgtctgtccaga

SEQ ID NO: 517135 - DNA, 25 bp, Homo sapien
ctgtctcgttgtctgtccagataat

SEQ ID NO: 517136 - DNA, 25 bp, Homo sapien
gtctgtccagataattgattctaag

SEQ ID NO: 517137 - DNA, 25 bp, Homo sapien
ggagtgtagataaggcttcagccat

SEQ ID NO: 517138 - DNA, 25 bp, Homo sapien
taaggcttcagccatgagtcacccc

SEQ ID NO: 517139 - DNA, 25 bp, Homo sapien
gccccagagtatattgaatagaaat

SEQ ID NO: 517140 - DNA, 25 bp, Homo sapien
taggaaaaagtcctcatcaaagaac

SEQ ID NO: 517141 - DNA, 25 bp, Homo sapien
agaacagcttttttgggacaagctt

SEQ ID NO: 517142 - DNA, 25 bp, Homo sapien
tttgggacaagctttacatgggtgg

SEQ ID NO: 517143 - DNA, 25 bp, Homo sapien
tatgttcttaagttattaccatgaa

SEQ ID NO: 517144 - DNA, 25 bp, Homo sapien
attgcagggttagtatttgattgtc

SEQ ID NO: 517145 - DNA, 25 bp, Homo sapien
atttgattgtctagtgatgtacgat

SEQ ID NO: 517146 - DNA, 25 bp, Homo sapien
gatgtacgataacagccaccagctt

SEQ ID NO: 517147 - DNA, 25 bp, Homo sapien
gataacagccaccagctttcctgag

SEQ ID NO: 517148 - DNA, 25 bp, Homo sapien
accagctttcctgagcatcactggg

SEQ ID NO: 517149 - DNA, 25 bp, Homo sapien
gggaagcctgctgtttatgtacaag

SEQ ID NO: 517150 - DNA, 25 bp, Homo sapien
agcctgctgtttatgtacaagtaca

SEQ ID NO: 517151 - DNA, 25 bp, Homo sapien
gtacagccataaaatccagacacag

SEQ ID NO: 517152 - DNA, 25 bp, Homo sapien
gaaactattatgcaagccagtggta

SEQ ID NO: 517153 - DNA, 25 bp, Homo sapien
tatgcaagccagtggtactagaaag

SEQ ID NO: 517154 - DNA, 25 bp, Homo sapien
gaaaatgactcaagctgaggacata

SEQ ID NO: 517155 - DNA, 25 bp, Homo sapien
acataaggtcttgagtcacgagcac

SEQ ID NO: 517156 - DNA, 25 bp, Homo sapien
ttgagtcacgagcaccttgtgttag

SEQ ID NO: 517157 - DNA, 25 bp, Homo sapien
accttgtgttagatgctgggctaca

SEQ ID NO: 517158 - DNA, 25 bp, Homo sapien
gatcaaaacagaaggcctgcccact

SEQ ID NO: 517159 - DNA, 25 bp, Homo sapien
agaaggcctgcccactgagagtaca

SEQ ID NO: 517160 - DNA, 25 bp, Homo sapien
tgagagtacacacttccctgggcca

SEQ ID NO: 517161 - DNA, 25 bp, Homo sapien
ctccaaagtaatcccaccataacag

SEQ ID NO: 517162 - DNA, 25 bp, Homo sapien
ataacagggcagctgtcatcatgga

SEQ ID NO: 517163 - DNA, 25 bp, Homo sapien
gtcatcatggaaggactgcccacgt

SEQ ID NO: 517164 - DNA, 25 bp, Homo sapien
catggaaggactgcccacgtgcaga

SEQ ID NO: 517165 - DNA, 25 bp, Homo sapien
ccacgatgccttgattttcactcat

SEQ ID NO: 517166 - DNA, 25 bp, Homo sapien
actcatcatttggacatgtgactgg

SEQ ID NO: 517167 - DNA, 25 bp, Homo sapien
atgtgactggcttttcctacctctg

SEQ ID NO: 517168 - DNA, 25 bp, Homo sapien
tcctacctctgccatggtgtagaaa

SEQ ID NO: 517169 - DNA, 25 bp, Homo sapien
gggttttctctaaatctgactaaag

SEQ ID NO: 517170 - DNA, 25 bp, Homo sapien
aaagtgggcccatctgagtcaggtt

SEQ ID NO: 517171 - DNA, 25 bp, Homo sapien
ctctcaagtgggtggtggcttttca

SEQ ID NO: 517172 - DNA, 25 bp, Homo sapien
tggtggcttttcagtggccctgatt

SEQ ID NO: 517173 - DNA, 25 bp, Homo sapien
ctgatttctgttccacacgtgttca

SEQ ID NO: 517174 - DNA, 25 bp, Homo sapien
cacacgtgttcactggagccaggtg

SEQ ID NO: 517175 - DNA, 25 bp, Homo sapien
gtgacttcctccttgcgtgagtgag

SEQ ID NO: 517176 - DNA, 25 bp, Homo sapien
gacaaatactttgctctagtgagga

SEQ ID NO: 517177 - DNA, 25 bp, Homo sapien
ttccattagcccctttcattttagg

SEQ ID NO: 517178 - DNA, 25 bp, Homo sapien
gagtagaatttgctgttcccacatt

SEQ ID NO: 517179 - DNA, 25 bp, Homo sapien
gggaaacattgagcgcaccctgcat

SEQ ID NO: 517180 - DNA, 25 bp, Homo sapien
gttcccacattaggaatcgattcca

SEQ ID NO: 517181 - DNA, 25 bp, Homo sapien
attccattctctccaagatcttaag

SEQ ID NO: 517182 - DNA, 25 bp, Homo sapien
aagagctaccaattggctgtttcca

SEQ ID NO: 517183 - DNA, 25 bp, Homo sapien
gtttccaatgcctagttgtagctta

SEQ ID NO: 517184 - DNA, 25 bp, Homo sapien
agcttaatcctacatcagtatctcc

SEQ ID NO: 517185 - DNA, 25 bp, Homo sapien
gagcgcaccctgcatagtgatttct

SEQ ID NO: 517186 - DNA, 25 bp, Homo sapien
tgggatatcttgatgctgtcatgca

SEQ ID NO: 517187 - DNA, 25 bp, Homo sapien
tgtgcaggtcatcatacaggtcctc

SEQ ID NO: 517188 - DNA, 25 bp, Homo sapien
acttcgtcagcgcagacagctgtgt

SEQ ID NO: 517189 - DNA, 25 bp, Homo sapien
agacagctgtgtccagagctccatc

SEQ ID NO: 517190 - DNA, 25 bp, Homo sapien
agagctccatcaggcatggcagtgc

SEQ ID NO: 517191 - DNA, 25 bp, Homo sapien
agcccatgtggttcagtcccgttgg

SEQ ID NO: 517192 - DNA, 25 bp, Homo sapien
agtcccgttggagcactctgggaga

SEQ ID NO: 517193 - DNA, 25 bp, Homo sapien
actctgggagagtggatggcttctt

SEQ ID NO: 517194 - DNA, 25 bp, Homo sapien
gatggcttcttctagggagattcaa

SEQ ID NO: 517195 - DNA, 25 bp, Homo sapien
aggtaatgatcgtctttctccagca

SEQ ID NO: 517196 - DNA, 25 bp, Homo sapien
acttgactccatctttgtgcactgc

SEQ ID NO: 517197 - DNA, 25 bp, Homo sapien
tatgtgcagcctcctttcgacgtgg

SEQ ID NO: 517198 - DNA, 25 bp, Homo sapien
aattctctctctaaagtcgagagct

SEQ ID NO: 517199 - DNA, 25 bp, Homo sapien
attctctctctaaagtcgagagctc

SEQ ID NO: 517200 - DNA, 25 bp, Homo sapien
ttctctctctaaagtcgagagctca

SEQ ID NO: 517201 - DNA, 25 bp, Homo sapien
tctctctctaaagtcgagagctcac

SEQ ID NO: 517202 - DNA, 25 bp, Homo sapien
ctctctctaaagtcgagagctcacc

SEQ ID NO: 517203 - DNA, 25 bp, Homo sapien
tctctctaaagtcgagagctcacca

SEQ ID NO: 517204 - DNA, 25 bp, Homo sapien
tctctaaagtcgagagctcaccacc

SEQ ID NO: 517205 - DNA, 25 bp, Homo sapien
taaagtcgagagctcaccaccccgg

SEQ ID NO: 517206 - DNA, 25 bp, Homo sapien
aaagtcgagagctcaccaccccggg

SEQ ID NO: 517207 - DNA, 25 bp, Homo sapien
agtcgagagctcaccaccccgggcg

SEQ ID NO: 517208 - DNA, 25 bp, Homo sapien
tcgagagctcaccaccccgggcgtt

SEQ ID NO: 517209 - DNA, 25 bp, Homo sapien
tcgttttggccatggttttctccaa

SEQ ID NO: 517210 - DNA, 25 bp, Homo sapien
ttttggccatggttttctccaacca

SEQ ID NO: 517211 - DNA, 25 bp, Homo sapien
ccatggttttctccaaccaccagtg

SEQ ID NO: 517212 - DNA, 25 bp, Homo sapien
ccagtgaaatatgggtttggttcat

SEQ ID NO: 517213 - DNA, 25 bp, Homo sapien
tggttcattttagtttcagatagat

SEQ ID NO: 517214 - DNA, 25 bp, Homo sapien
agtttcagatagatggcttcaccaa

SEQ ID NO: 517215 - DNA, 25 bp, Homo sapien
gatggcttcaccaaagaactcttga

SEQ ID NO: 517216 - DNA, 25 bp, Homo sapien
cagggaagtaggagcttatggtata

SEQ ID NO: 517217 - DNA, 25 bp, Homo sapien
aatctatgatgcaaaccctttccac

SEQ ID NO: 517218 - DNA, 25 bp, Homo sapien
tgatgcaaaccctttccacatagta

SEQ ID NO: 517219 - DNA, 25 bp, Homo sapien
aaccctttccacatagtactagata

SEQ ID NO: 517220 - DNA, 25 bp, Homo sapien
acctcattttaagaagcatgtgaaa

SEQ ID NO: 517221 - DNA, 25 bp, Homo sapien
aaatgggatactatagactactgag

SEQ ID NO: 517222 - DNA, 25 bp, Homo sapien
gatactatagactactgagaatttc

SEQ ID NO: 517223 - DNA, 25 bp, Homo sapien
aacaggaaaatacatttgacacttt

SEQ ID NO: 517224 - DNA, 25 bp, Homo sapien
gacactttatggaattttatgagac

SEQ ID NO: 517225 - DNA, 25 bp, Homo sapien
tttatgagactttttgtgggaacag

SEQ ID NO: 517226 - DNA, 25 bp, Homo sapien
acagaaggtcttcaaattgtaaaat

SEQ ID NO: 517227 - DNA, 25 bp, Homo sapien
aagtctttaacagggatgtatttca

SEQ ID NO: 517228 - DNA, 25 bp, Homo sapien
cagggatgtatttcattgtatgttt

SEQ ID NO: 517229 - DNA, 25 bp, Homo sapien
gtatgttttgggtatggctttggaa

SEQ ID NO: 517230 - DNA, 25 bp, Homo sapien
tgttttgggtatggctttggaataa

SEQ ID NO: 517231 - DNA, 25 bp, Homo sapien
gcctcaagcgctggagcttgtcggt

SEQ ID NO: 517232 - DNA, 25 bp, Homo sapien
gtggccggtaatgggcagtgcacgt

SEQ ID NO: 517233 - DNA, 25 bp, Homo sapien
gtgagttaactcaagggtgcctttt

SEQ ID NO: 517234 - DNA, 25 bp, Homo sapien
tggctcccctgggtcaaaagtggat

SEQ ID NO: 517235 - DNA, 25 bp, Homo sapien
tcaaaagtggatgtcggaggcctca

SEQ ID NO: 517236 - DNA, 25 bp, Homo sapien
gatgtcggaggcctcaggctcttac

SEQ ID NO: 517237 - DNA, 25 bp, Homo sapien
acggaagtggtcgtccagcctggat

SEQ ID NO: 517238 - DNA, 25 bp, Homo sapien
aagtggtcgtccagcctggatattt

SEQ ID NO: 517239 - DNA, 25 bp, Homo sapien
ctggatatttctacaggttgctgac

SEQ ID NO: 517240 - DNA, 25 bp, Homo sapien
cgggagctgactgagtggaataaat

SEQ ID NO: 517241 - DNA, 25 bp, Homo sapien
gactgagtggaataaatgttctctc

SEQ ID NO: 517242 - DNA, 25 bp, Homo sapien
tcaccctggcatagctcagaaaatt

SEQ ID NO: 517243 - DNA, 25 bp, Homo sapien
tagggacatagacgtgatcactaca

SEQ ID NO: 517244 - DNA, 25 bp, Homo sapien
gatcactacaccataatttactaag

SEQ ID NO: 517245 - DNA, 25 bp, Homo sapien
atttactaagctgtgagaactggag

SEQ ID NO: 517246 - DNA, 25 bp, Homo sapien
agaactggaggtgcatcagtgacca

SEQ ID NO: 517247 - DNA, 25 bp, Homo sapien
tgaccagagtgcatttgagccagag

SEQ ID NO: 517248 - DNA, 25 bp, Homo sapien
aaggaacaacatgcgctctaggctg

SEQ ID NO: 517249 - DNA, 25 bp, Homo sapien
gcgctctaggctgtatcattaggta

SEQ ID NO: 517250 - DNA, 25 bp, Homo sapien
tcattaggtacaattttctgtcctt

SEQ ID NO: 517251 - DNA, 25 bp, Homo sapien
aagaggccacggttcatctttgcaa

SEQ ID NO: 517252 - DNA, 25 bp, Homo sapien
gccacggttcatctttgcaattctt

SEQ ID NO: 517253 - DNA, 25 bp, Homo sapien
attcactactaatatgcacagtttc

SEQ ID NO: 517254 - DNA, 25 bp, Homo sapien
gcacagtttctctaatcatggtcaa

SEQ ID NO: 517255 - DNA, 25 bp, Homo sapien
agatctgacagtgcattgtccctaa

SEQ ID NO: 517256 - DNA, 25 bp, Homo sapien
attgtccctaaacgacccatacttg

SEQ ID NO: 517257 - DNA, 25 bp, Homo sapien
atacttgcctcactgacaccatgtg

SEQ ID NO: 517258 - DNA, 25 bp, Homo sapien
ccacttcccatctataatctatgtc

SEQ ID NO: 517259 - DNA, 25 bp, Homo sapien
atctatgtctgggtgtgaagccctt

SEQ ID NO: 517260 - DNA, 25 bp, Homo sapien
ggtgtgaagcccttcccatatgatc

SEQ ID NO: 517261 - DNA, 25 bp, Homo sapien
aagttcgaattcactgggtcacagt

SEQ ID NO: 517262 - DNA, 25 bp, Homo sapien
atgtgttaggcagggtcagagatta

SEQ ID NO: 517263 - DNA, 25 bp, Homo sapien
gggtcagagattaccacatcctaaa

SEQ ID NO: 517264 - DNA, 25 bp, Homo sapien
attgctctttctttatgtccatcac

SEQ ID NO: 517265 - DNA, 25 bp, Homo sapien
gtccatcacagtctgggaaccagta

SEQ ID NO: 517266 - DNA, 25 bp, Homo sapien
tctgggaaccagtaccttgaagcac

SEQ ID NO: 517267 - DNA, 25 bp, Homo sapien
gtaccttgaagcactatccttgatt

SEQ ID NO: 517268 - DNA, 25 bp, Homo sapien
gaagcactatccttgattaatttat

SEQ ID NO: 517269 - DNA, 25 bp, Homo sapien
tgccctatactgactgcctaggaaa

SEQ ID NO: 517270 - DNA, 25 bp, Homo sapien
gagagggtgaaaatactgttcttaa

SEQ ID NO: 517271 - DNA, 25 bp, Homo sapien
aaacctatatctgttctgtgtatcc

SEQ ID NO: 517272 - DNA, 25 bp, Homo sapien
atctgttctgtgtatccatggataa

SEQ ID NO: 517273 - DNA, 25 bp, Homo sapien
agtgggcaggacatctccattctgg

SEQ ID NO: 517274 - DNA, 25 bp, Homo sapien
aagacgcaaggctttggcaaatact

SEQ ID NO: 517275 - DNA, 25 bp, Homo sapien
gtgagaagaggcttttaaggaccat

SEQ ID NO: 517276 - DNA, 25 bp, Homo sapien
gaggcttttaaggaccatgtgaaga

SEQ ID NO: 517277 - DNA, 25 bp, Homo sapien
taaggaccatgtgaagaggctttta

SEQ ID NO: 517278 - DNA, 25 bp, Homo sapien
aaacagtgtttccagattgcccaca

SEQ ID NO: 517279 - DNA, 25 bp, Homo sapien
acagtgtttccagattgcccacaga

SEQ ID NO: 517280 - DNA, 25 bp, Homo sapien
agtgtttccagattgcccacagata

SEQ ID NO: 517281 - DNA, 25 bp, Homo sapien
tgtttccagattgcccacagataga

SEQ ID NO: 517282 - DNA, 25 bp, Homo sapien
tccagattgcccacagatagaaata

SEQ ID NO: 517283 - DNA, 25 bp, Homo sapien
aatagtcaggatttggtaacaagaa

SEQ ID NO: 517284 - DNA, 25 bp, Homo sapien
gaaatcagaattcttggtatagtca

SEQ ID NO: 517285 - DNA, 25 bp, Homo sapien
tcttggtatagtcaagatttcctga

SEQ ID NO: 517286 - DNA, 25 bp, Homo sapien
ggatcatgcttccttaatatctttg

SEQ ID NO: 517287 - DNA, 25 bp, Homo sapien
atctttgaacctgtttacttctcca

SEQ ID NO: 517288 - DNA, 25 bp, Homo sapien
tgtttacttctccatatctcattgt

SEQ ID NO: 517289 - DNA, 25 bp, Homo sapien
tacttgacttagatttctgtccact

SEQ ID NO: 517290 - DNA, 25 bp, Homo sapien
ggttttaatagccagccagtcataa

SEQ ID NO: 517291 - DNA, 25 bp, Homo sapien
atagccagccagtcataatagtaga

SEQ ID NO: 517292 - DNA, 25 bp, Homo sapien
agatatccgtacagagagttccagt

SEQ ID NO: 517293 - DNA, 25 bp, Homo sapien
tatgagtccacgaccccttttctaa

SEQ ID NO: 517294 - DNA, 25 bp, Homo sapien
agcagtctggtccatgttggtctca

SEQ ID NO: 517295 - DNA, 25 bp, Homo sapien
gttggtctcatacctcatatgcagg

SEQ ID NO: 517296 - DNA, 25 bp, Homo sapien
cctcatatgcaggattcattcattc

SEQ ID NO: 517297 - DNA, 25 bp, Homo sapien
agccaaaacaatatgccagccaatg

SEQ ID NO: 517298 - DNA, 25 bp, Homo sapien
aatggcatggccagccaaccagtgt

SEQ ID NO: 517299 - DNA, 25 bp, Homo sapien
ggcagacttttcctacaaagagcca

SEQ ID NO: 517300 - DNA, 25 bp, Homo sapien
ggatttgacccactggctgtcgttg

SEQ ID NO: 517301 - DNA, 25 bp, Homo sapien
gctgtcgttggctgactcctgtgtt

SEQ ID NO: 517302 - DNA, 25 bp, Homo sapien
gtgttagaccctccatggtcttata

SEQ ID NO: 517303 - DNA, 25 bp, Homo sapien
accctccatggtcttatatgcgtta

SEQ ID NO: 517304 - DNA, 25 bp, Homo sapien
ttatgtgcagttattctcccatctc

SEQ ID NO: 517305 - DNA, 25 bp, Homo sapien
atctctctcaaaagggaaacgtcag

SEQ ID NO: 517306 - DNA, 25 bp, Homo sapien
acactggaggccctgtggtctctgt

SEQ ID NO: 517307 - DNA, 25 bp, Homo sapien
aggccctgtggtctctgtagcagct

SEQ ID NO: 517308 - DNA, 25 bp, Homo sapien
tgacattcttcagtgcataggcgat

SEQ ID NO: 517309 - DNA, 25 bp, Homo sapien
gatgctggcattctccacaaagaag

SEQ ID NO: 517310 - DNA, 25 bp, Homo sapien
aaagaagctggcatgcatgttttca

SEQ ID NO: 517311 - DNA, 25 bp, Homo sapien
gtgaaactcaactgggacgaagggt

SEQ ID NO: 517312 - DNA, 25 bp, Homo sapien
gacgaagggtacactgcattcattc

SEQ ID NO: 517313 - DNA, 25 bp, Homo sapien
agcagccacttctcattgtatttta

SEQ ID NO: 517314 - DNA, 25 bp, Homo sapien
gaactgtgatcttgaaccagctccc

SEQ ID NO: 517315 - DNA, 25 bp, Homo sapien
tctctggaggtttttgctctctctc

SEQ ID NO: 517316 - DNA, 25 bp, Homo sapien
gctctctctccatgttaacgtgggt

SEQ ID NO: 517317 - DNA, 25 bp, Homo sapien
ttggtcttgtttacgaaaactgcct

SEQ ID NO: 517318 - DNA, 25 bp, Homo sapien
gaaaactgcctttccgattataggg

SEQ ID NO: 517319 - DNA, 25 bp, Homo sapien
aaaaacactcacacaatagactctg

SEQ ID NO: 517320 - DNA, 25 bp, Homo sapien
tagactctgaggtcagctcaccaca

SEQ ID NO: 517321 - DNA, 25 bp, Homo sapien
gactcttaaaagacatacttctgaa

SEQ ID NO: 517322 - DNA, 25 bp, Homo sapien
ttctgaatcatctttcttgaccctc

SEQ ID NO: 517323 - DNA, 25 bp, Homo sapien
caaactgtagcaagacaggcttcct

SEQ ID NO: 517324 - DNA, 25 bp, Homo sapien
acattagcattagtcaagagtgaaa

SEQ ID NO: 517325 - DNA, 25 bp, Homo sapien
gtcattgtactcaaacatctgccaa

SEQ ID NO: 517326 - DNA, 25 bp, Homo sapien
gtactcaaacatctgccaacagtct

SEQ ID NO: 517327 - DNA, 25 bp, Homo sapien
gccaacagtctgtgatttcatagta

SEQ ID NO: 517328 - DNA, 25 bp, Homo sapien
tgatttcatagtacccacctctgaa

SEQ ID NO: 517329 - DNA, 25 bp, Homo sapien
cacctctgaaataagactctgtcta

SEQ ID NO: 517330 - DNA, 25 bp, Homo sapien
gctgaagtgcagattgaaatacttt

SEQ ID NO: 517331 - DNA, 25 bp, Homo sapien
tactttttaaacaactgaagttctg

SEQ ID NO: 517332 - DNA, 25 bp, Homo sapien
ttatagggaatttcatgtaacaaga

SEQ ID NO: 517333 - DNA, 25 bp, Homo sapien
tttagaaacgtaaagttgcgcagtc

SEQ ID NO: 517334 - DNA, 25 bp, Homo sapien
gtaaagttgcgcagtcaacataaat

SEQ ID NO: 517335 - DNA, 25 bp, Homo sapien
cttctaagtaaagacagtgggcagc

SEQ ID NO: 517336 - DNA, 25 bp, Homo sapien
ttctgtttctccttctatcaaggct

SEQ ID NO: 517337 - DNA, 25 bp, Homo sapien
tgtttctccttctatcaaggcttca

SEQ ID NO: 517338 - DNA, 25 bp, Homo sapien
atcaaggcttcaccctatcttaaag

SEQ ID NO: 517339 - DNA, 25 bp, Homo sapien
ggcttcaccctatcttaaaggtctg

SEQ ID NO: 517340 - DNA, 25 bp, Homo sapien
accctatcttaaaggtctgtggtgc

SEQ ID NO: 517341 - DNA, 25 bp, Homo sapien
ccccatctcgaagtgttctggaatt

SEQ ID NO: 517342 - DNA, 25 bp, Homo sapien
agcccagccatcaagaacttctgat

SEQ ID NO: 517343 - DNA, 25 bp, Homo sapien
gccatcaagaacttctgatctcctg

SEQ ID NO: 517344 - DNA, 25 bp, Homo sapien
gggacttagccatggacttggccag

SEQ ID NO: 517345 - DNA, 25 bp, Homo sapien
agccatggacttggccagtaggcct

SEQ ID NO: 517346 - DNA, 25 bp, Homo sapien
tttggcagccaaagtccactggccc

SEQ ID NO: 517347 - DNA, 25 bp, Homo sapien
tgccgtgcccctgagtaggaaactg

SEQ ID NO: 517348 - DNA, 25 bp, Homo sapien
ctgagtaggaaactgtcccctaggg

SEQ ID NO: 517349 - DNA, 25 bp, Homo sapien
gggtggccccactgatatatgcaaa

SEQ ID NO: 517350 - DNA, 25 bp, Homo sapien
cactgatatatgcaaacccgccggt

SEQ ID NO: 517351 - DNA, 25 bp, Homo sapien
gatatatgcaaacccgccggtccga

SEQ ID NO: 517352 - DNA, 25 bp, Homo sapien
gtgcacccagacctgtcctagcatg

SEQ ID NO: 517353 - DNA, 25 bp, Homo sapien
tagcatgctcctttccctaatgacc

SEQ ID NO: 517354 - DNA, 25 bp, Homo sapien
aatgaccgagtctttcctgttgaat

SEQ ID NO: 517355 - DNA, 25 bp, Homo sapien
gagtctttcctgttgaattatccca

SEQ ID NO: 517356 - DNA, 25 bp, Homo sapien
gaattatcccattctccatgggtgc

SEQ ID NO: 517357 - DNA, 25 bp, Homo sapien
cattctccatgggtgcctttgactt

SEQ ID NO: 517358 - DNA, 25 bp, Homo sapien
tttgactttggcctccttactggaa

SEQ ID NO: 517359 - DNA, 25 bp, Homo sapien
ggcctccttactggaaattagcgga

SEQ ID NO: 517360 - DNA, 25 bp, Homo sapien
attagcggagctgctgtttgcacac

SEQ ID NO: 517361 - DNA, 25 bp, Homo sapien
gtttgcacacactgagctgtgaggt

SEQ ID NO: 517362 - DNA, 25 bp, Homo sapien
tggaagtggatgatagtgtcctctt

SEQ ID NO: 517363 - DNA, 25 bp, Homo sapien
tgttcttatagaggttcagcagctt

SEQ ID NO: 517364 - DNA, 25 bp, Homo sapien
gttcttatagaggttcagcagcttt

SEQ ID NO: 517365 - DNA, 25 bp, Homo sapien
tcttatagaggttcagcagcttttc

SEQ ID NO: 517366 - DNA, 25 bp, Homo sapien
ttatagaggttcagcagcttttctt

SEQ ID NO: 517367 - DNA, 25 bp, Homo sapien
atagaggttcagcagcttttcttga

SEQ ID NO: 517368 - DNA, 25 bp, Homo sapien
tagaggttcagcagcttttcttgaa

SEQ ID NO: 517369 - DNA, 25 bp, Homo sapien
agaggttcagcagcttttcttgaat

SEQ ID NO: 517370 - DNA, 25 bp, Homo sapien
gaggttcagcagcttttcttgaatt

SEQ ID NO: 517371 - DNA, 25 bp, Homo sapien
aggttcagcagcttttcttgaatta

SEQ ID NO: 517372 - DNA, 25 bp, Homo sapien
ggttcagcagcttttcttgaattaa

SEQ ID NO: 517373 - DNA, 25 bp, Homo sapien
gttcagcagcttttcttgaattaat

SEQ ID NO: 517374 - DNA, 25 bp, Homo sapien
ggtgtggaggcctatgttctgcccc

SEQ ID NO: 517375 - DNA, 25 bp, Homo sapien
gtggaggcctatgttctgccccata

SEQ ID NO: 517376 - DNA, 25 bp, Homo sapien
gaggcctatgttctgccccatacac

SEQ ID NO: 517377 - DNA, 25 bp, Homo sapien
accccacaggccctgcttatgggaa

SEQ ID NO: 517378 - DNA, 25 bp, Homo sapien
atgggaaggaacacaggcctccagc

SEQ ID NO: 517379 - DNA, 25 bp, Homo sapien
agaggactgtgccgccctgttcttg

SEQ ID NO: 517380 - DNA, 25 bp, Homo sapien
gacagagaggacttgtacaaaggct

SEQ ID NO: 517381 - DNA, 25 bp, Homo sapien
gaggctagcttctatctttgtctac

SEQ ID NO: 517382 - DNA, 25 bp, Homo sapien
tgttatttcagctcagggcgggtaa

SEQ ID NO: 517383 - DNA, 25 bp, Homo sapien
taacatcattggaactagctattag

SEQ ID NO: 517384 - DNA, 25 bp, Homo sapien
catcattggaactagctattaggaa

SEQ ID NO: 517385 - DNA, 25 bp, Homo sapien
ttcccagagcccctttcagcttgaa

SEQ ID NO: 517386 - DNA, 25 bp, Homo sapien
gcccctttcagcttgaattccaaat

SEQ ID NO: 517387 - DNA, 25 bp, Homo sapien
attccaaatgtgacttagcttcctc

SEQ ID NO: 517388 - DNA, 25 bp, Homo sapien
aatgtgacttagcttcctctatgca

SEQ ID NO: 517389 - DNA, 25 bp, Homo sapien
agcttcctctatgcagatgtaccta

SEQ ID NO: 517390 - DNA, 25 bp, Homo sapien
gcagatgtacctacttgaaactggg

SEQ ID NO: 517391 - DNA, 25 bp, Homo sapien
agaggtaatgtttctgccaacaaac

SEQ ID NO: 517392 - DNA, 25 bp, Homo sapien
gagcaataacagagaccccagggtg

SEQ ID NO: 517393 - DNA, 25 bp, Homo sapien
ggattgtggctaaaataatgtggct

SEQ ID NO: 517394 - DNA, 25 bp, Homo sapien
tggagccagcaatgggcagcatctt

SEQ ID NO: 517395 - DNA, 25 bp, Homo sapien
gcaatgggcagcatcttcatgactt

SEQ ID NO: 517396 - DNA, 25 bp, Homo sapien
aatgatgaaatagtttgtctttggc

SEQ ID NO: 517397 - DNA, 25 bp, Homo sapien
gtttgtctttggcaatatgattaca

SEQ ID NO: 517398 - DNA, 25 bp, Homo sapien
ctttggcaatatgattacatacgaa

SEQ ID NO: 517399 - DNA, 25 bp, Homo sapien
tacatacgaagaatgcaaaatgcag

SEQ ID NO: 517400 - DNA, 25 bp, Homo sapien
caaaatgcaggtatggatgccttcc

SEQ ID NO: 517401 - DNA, 25 bp, Homo sapien
aaatgcaggtatggatgccttccaa

SEQ ID NO: 517402 - DNA, 25 bp, Homo sapien
tggatgccttccaagcaacaccaag

SEQ ID NO: 517403 - DNA, 25 bp, Homo sapien
ggatgccttccaagcaacaccaagt

SEQ ID NO: 517404 - DNA, 25 bp, Homo sapien
attgatgcaactcagtaatttttat

SEQ ID NO: 517405 - DNA, 25 bp, Homo sapien
tgcaactggaagacaatacatcaca

SEQ ID NO: 517406 - DNA, 25 bp, Homo sapien
tcacagaaactttatggtaggtctg

SEQ ID NO: 517407 - DNA, 25 bp, Homo sapien
agctctttggagacacgaagccctt

SEQ ID NO: 517408 - DNA, 25 bp, Homo sapien
ttggagacacgaagcccttggaaaa

SEQ ID NO: 517409 - DNA, 25 bp, Homo sapien
gaaaatctgatgaaggttacggacc

SEQ ID NO: 517410 - DNA, 25 bp, Homo sapien
tgatgaaggttacggaccttcccta

SEQ ID NO: 517411 - DNA, 25 bp, Homo sapien
aacagataactgacgtagactcaaa

SEQ ID NO: 517412 - DNA, 25 bp, Homo sapien
gtagactcaaaaaccccaagcaatt

SEQ ID NO: 517413 - DNA, 25 bp, Homo sapien
ccccaagcaatttcaggagccactg

SEQ ID NO: 517414 - DNA, 25 bp, Homo sapien
actggactccctgaatgaaacccat

SEQ ID NO: 517415 - DNA, 25 bp, Homo sapien
tgaatgaaacccatccctggactcc

SEQ ID NO: 517416 - DNA, 25 bp, Homo sapien
ctggactccaggctaagaacctcag

SEQ ID NO: 517417 - DNA, 25 bp, Homo sapien
tttccttacctgtcacacattgagc

SEQ ID NO: 517418 - DNA, 25 bp, Homo sapien
gcttggaaagggtcaatctgaggcc

SEQ ID NO: 517419 - DNA, 25 bp, Homo sapien
atctgaggcccttgctttcatgaaa

SEQ ID NO: 517420 - DNA, 25 bp, Homo sapien
gctttcatgaaaggccttgaggccc

SEQ ID NO: 517421 - DNA, 25 bp, Homo sapien
agaaatctagaattgaccctggttt

SEQ ID NO: 517422 - DNA, 25 bp, Homo sapien
ttgaccctggtttccagaatgacca

SEQ ID NO: 517423 - DNA, 25 bp, Homo sapien
gaatgaccagtttgcatttccttta

SEQ ID NO: 517424 - DNA, 25 bp, Homo sapien
gcatttcctttatctgcacaaagaa

SEQ ID NO: 517425 - DNA, 25 bp, Homo sapien
agtggtgccacgtgccagcctagag

SEQ ID NO: 517426 - DNA, 25 bp, Homo sapien
gtgccagcctagaggtttcggttta

SEQ ID NO: 517427 - DNA, 25 bp, Homo sapien
ggtttcggtttacctgcatgcacca

SEQ ID NO: 517428 - DNA, 25 bp, Homo sapien
accacggtcccttgagaatctgtgc

SEQ ID NO: 517429 - DNA, 25 bp, Homo sapien
tcgcccgacgcgtagaggtccagca

SEQ ID NO: 517430 - DNA, 25 bp, Homo sapien
gagtaggtgccctcgtcggcgacct

SEQ ID NO: 517431 - DNA, 25 bp, Homo sapien
tgttgagcctcctccacgtgccggt

SEQ ID NO: 517432 - DNA, 25 bp, Homo sapien
tgcccgcggttcacgcaggtcagaa

SEQ ID NO: 517433 - DNA, 25 bp, Homo sapien
cgcggttcacgcaggtcagaagcgc

SEQ ID NO: 517434 - DNA, 25 bp, Homo sapien
gtcggcgacctccagcggctcgata

SEQ ID NO: 517435 - DNA, 25 bp, Homo sapien
tccagcggctcgatacgcagtgaga

SEQ ID NO: 517436 - DNA, 25 bp, Homo sapien
ggctcgatacgcagtgagaagtcac

SEQ ID NO: 517437 - DNA, 25 bp, Homo sapien
cagtgagaagtcaccgcgctcaaag

SEQ ID NO: 517438 - DNA, 25 bp, Homo sapien
aagtcaccgcgctcaaaggcatccg

SEQ ID NO: 517439 - DNA, 25 bp, Homo sapien
cagccacgcggtcgcgcagaaaaag

SEQ ID NO: 517440 - DNA, 25 bp, Homo sapien
acaactgattttctttcaaggataa

SEQ ID NO: 517441 - DNA, 25 bp, Homo sapien
tctttcaaggataaactgtgctatt

SEQ ID NO: 517442 - DNA, 25 bp, Homo sapien
ttaaaaaaccacactgttgcaattt

SEQ ID NO: 517443 - DNA, 25 bp, Homo sapien
accttcataatcttaattgtaacct

SEQ ID NO: 517444 - DNA, 25 bp, Homo sapien
atcttaattgtaacctaaggacagt

SEQ ID NO: 517445 - DNA, 25 bp, Homo sapien
ggacagtaatacctagcccacttaa

SEQ ID NO: 517446 - DNA, 25 bp, Homo sapien
tagcccacttaaatctccggttatt

SEQ ID NO: 517447 - DNA, 25 bp, Homo sapien
ccacttaaatctccggttattatgg

SEQ ID NO: 517448 - DNA, 25 bp, Homo sapien
gaaacatgtgtaaataatctgataa

SEQ ID NO: 517449 - DNA, 25 bp, Homo sapien
ataaatgctcattcttggatgtaag

SEQ ID NO: 517450 - DNA, 25 bp, Homo sapien
gttcctggatattaacaactgattt

SEQ ID NO: 517451 - DNA, 25 bp, Homo sapien
aggctgggcatttcctgacagaggt

SEQ ID NO: 517452 - DNA, 25 bp, Homo sapien
tgggcatttcctgacagaggtccag

SEQ ID NO: 517453 - DNA, 25 bp, Homo sapien
catttcctgacagaggtccaggtcc

SEQ ID NO: 517454 - DNA, 25 bp, Homo sapien
tccaggtccggcagacagcaaggca

SEQ ID NO: 517455 - DNA, 25 bp, Homo sapien
caggtccggcagacagcaaggcaca

SEQ ID NO: 517456 - DNA, 25 bp, Homo sapien
ctgtgctcactgactgcgtgggctg

SEQ ID NO: 517457 - DNA, 25 bp, Homo sapien
gggctgcaaatatccatgtcggacc

SEQ ID NO: 517458 - DNA, 25 bp, Homo sapien
atatccatgtcggacctgagcagtc

SEQ ID NO: 517459 - DNA, 25 bp, Homo sapien
tccatgtcggacctgagcagtctca

SEQ ID NO: 517460 - DNA, 25 bp, Homo sapien
tcggacctgagcagtctcaggcttg

SEQ ID NO: 517461 - DNA, 25 bp, Homo sapien
cagggaggctgagaactggctttca

SEQ ID NO: 517462 - DNA, 25 bp, Homo sapien
tattcttttcaaacagggctccctc

SEQ ID NO: 517463 - DNA, 25 bp, Homo sapien
agggctccctctcagtggtcatgag

SEQ ID NO: 517464 - DNA, 25 bp, Homo sapien
aactgtgagctttggaatcgtaact

SEQ ID NO: 517465 - DNA, 25 bp, Homo sapien
gaatcgtaacttgctgtgagtccag

SEQ ID NO: 517466 - DNA, 25 bp, Homo sapien
tgtgagtccagcttctgtctactgc

SEQ ID NO: 517467 - DNA, 25 bp, Homo sapien
gtctactgccataagatggacccca

SEQ ID NO: 517468 - DNA, 25 bp, Homo sapien
atggaccccacgtcagcataatgag

SEQ ID NO: 517469 - DNA, 25 bp, Homo sapien
gtggtatatatgctcgcacctagac

SEQ ID NO: 517470 - DNA, 25 bp, Homo sapien
acatgcgcatatgtacctgtcgtac

SEQ ID NO: 517471 - DNA, 25 bp, Homo sapien
gtacctgtcgtaccttcacggaagg

SEQ ID NO: 517472 - DNA, 25 bp, Homo sapien
aacaggctactgacgtttcggagga

SEQ ID NO: 517473 - DNA, 25 bp, Homo sapien
gggcactgggtgatactcagtttct

SEQ ID NO: 517474 - DNA, 25 bp, Homo sapien
gggtgatactcagtttcttgttcct

SEQ ID NO: 517475 - DNA, 25 bp, Homo sapien
gatactcagtttcttgttcctggcc

SEQ ID NO: 517476 - DNA, 25 bp, Homo sapien
tcagtttcttgttcctggccgtgga

SEQ ID NO: 517477 - DNA, 25 bp, Homo sapien
aaatccgctctggagcatgaggctg

SEQ ID NO: 517478 - DNA, 25 bp, Homo sapien
tttgttttgcgctctcctgtcacaa

SEQ ID NO: 517479 - DNA, 25 bp, Homo sapien
ttgcgctctcctgtcacaaatgctg

SEQ ID NO: 517480 - DNA, 25 bp, Homo sapien
ctcctgtcacaaatgctgcactatt

SEQ ID NO: 517481 - DNA, 25 bp, Homo sapien
aaatgctgcactattggttcttaag

SEQ ID NO: 517482 - DNA, 25 bp, Homo sapien
gctgcactattggttcttaagtttt

SEQ ID NO: 517483 - DNA, 25 bp, Homo sapien
tcttaagttttttatctccagatcc

SEQ ID NO: 517484 - DNA, 25 bp, Homo sapien
gcagttttaagtggatgctaatttt

SEQ ID NO: 517485 - DNA, 25 bp, Homo sapien
gggcataagccttttatggccctct

SEQ ID NO: 517486 - DNA, 25 bp, Homo sapien
atggccctcttgcagatcttctgaa

SEQ ID NO: 517487 - DNA, 25 bp, Homo sapien
gatcttctgaactatgcacatttgt

SEQ ID NO: 517488 - DNA, 25 bp, Homo sapien
gaactatgcacatttgtgctttttt

SEQ ID NO: 517489 - DNA, 25 bp, Homo sapien
tgtaagtttggaccaacttttatgt

SEQ ID NO: 517490 - DNA, 25 bp, Homo sapien
gttttacaacaatcagaaagggcac

SEQ ID NO: 517491 - DNA, 25 bp, Homo sapien
tttagtcaaaggtcactgtcagtct

SEQ ID NO: 517492 - DNA, 25 bp, Homo sapien
aaggtcactgtcagtctttgcacct

SEQ ID NO: 517493 - DNA, 25 bp, Homo sapien
tctttgcacctgctttcagtgttat

SEQ ID NO: 517494 - DNA, 25 bp, Homo sapien
aggtgtactttgtgctcatttcaga

SEQ ID NO: 517495 - DNA, 25 bp, Homo sapien
tcctgaccttgagtaatccacccgc

SEQ ID NO: 517496 - DNA, 25 bp, Homo sapien
gaccttgagtaatccacccgcctcg

SEQ ID NO: 517497 - DNA, 25 bp, Homo sapien
accttgagtaatccacccgcctcgg

SEQ ID NO: 517498 - DNA, 25 bp, Homo sapien
actgagcccggccacagtgcagtat

SEQ ID NO: 517499 - DNA, 25 bp, Homo sapien
ctgagcccggccacagtgcagtatt

SEQ ID NO: 517500 - DNA, 25 bp, Homo sapien
tgagcccggccacagtgcagtattt

SEQ ID NO: 517501 - DNA, 25 bp, Homo sapien
gagcccggccacagtgcagtatttc

SEQ ID NO: 517502 - DNA, 25 bp, Homo sapien
agcccggccacagtgcagtatttct

SEQ ID NO: 517503 - DNA, 25 bp, Homo sapien
gcccggccacagtgcagtatttcta

SEQ ID NO: 517504 - DNA, 25 bp, Homo sapien
cccggccacagtgcagtatttctaa

SEQ ID NO: 517505 - DNA, 25 bp, Homo sapien
ccggccacagtgcagtatttctaac

SEQ ID NO: 517506 - DNA, 25 bp, Homo sapien
gacactgactagcacgctggagcac

SEQ ID NO: 517507 - DNA, 25 bp, Homo sapien
gcacgctggagcacattgtgggcca

SEQ ID NO: 517508 - DNA, 25 bp, Homo sapien
atgtcctcactcagacagtctccat

SEQ ID NO: 517509 - DNA, 25 bp, Homo sapien
cactcagacagtctccattctggag

SEQ ID NO: 517510 - DNA, 25 bp, Homo sapien
ctccattctggagcagcggttgaca

SEQ ID NO: 517511 - DNA, 25 bp, Homo sapien
ggagcagcggttgacactgacagaa

SEQ ID NO: 517512 - DNA, 25 bp, Homo sapien
ctgaagcagtgtctggagaaccagc

SEQ ID NO: 517513 - DNA, 25 bp, Homo sapien
accagcagctaatcatgcagagagc

SEQ ID NO: 517514 - DNA, 25 bp, Homo sapien
tgcagagagcaacaccatgatcagg

SEQ ID NO: 517515 - DNA, 25 bp, Homo sapien
caggaatcaggagctcggtggattt

SEQ ID NO: 517516 - DNA, 25 bp, Homo sapien
gccagggatttgtaccatgggactt

SEQ ID NO: 517517 - DNA, 25 bp, Homo sapien
gtcaataacagtataaaacagccct

SEQ ID NO: 517518 - DNA, 25 bp, Homo sapien
aaatgactgtctcttgcggatgctt

SEQ ID NO: 517519 - DNA, 25 bp, Homo sapien
tctcttgcggatgcttggtactgta

SEQ ID NO: 517520 - DNA, 25 bp, Homo sapien
tgcggatgcttggtactgtaatgtt

SEQ ID NO: 517521 - DNA, 25 bp, Homo sapien
gttaataatagtcacctgctgttgg

SEQ ID NO: 517522 - DNA, 25 bp, Homo sapien
gtcacctgctgttggatgcagcaat

SEQ ID NO: 517523 - DNA, 25 bp, Homo sapien
caataatttctgtatggtccatagc

SEQ ID NO: 517524 - DNA, 25 bp, Homo sapien
atagcactgtatattatggatcgat

SEQ ID NO: 517525 - DNA, 25 bp, Homo sapien
gtatccaatgaaataatcgacttgt

SEQ ID NO: 517526 - DNA, 25 bp, Homo sapien
atcgacttgttcttgatagcctcat

SEQ ID NO: 517527 - DNA, 25 bp, Homo sapien
gttcttgatagcctcattaaagcat

SEQ ID NO: 517528 - DNA, 25 bp, Homo sapien
gtatttgccaaagccttgcgtcttc

SEQ ID NO: 517529 - DNA, 25 bp, Homo sapien
atgtcctgcccactgaaaaaatgat

SEQ ID NO: 517530 - DNA, 25 bp, Homo sapien
tttcctaggcagtcagtatagggca

SEQ ID NO: 517531 - DNA, 25 bp, Homo sapien
aatgatgggcctcctgttgccagct

SEQ ID NO: 517532 - DNA, 25 bp, Homo sapien
tgcagtgatctcaatccctttgcct

SEQ ID NO: 517533 - DNA, 25 bp, Homo sapien
aatccctttgcctcacaagagcatc

SEQ ID NO: 517534 - DNA, 25 bp, Homo sapien
aagagcatcagaaaggtcccctgcc

SEQ ID NO: 517535 - DNA, 25 bp, Homo sapien
tgcccttccagctttagattccttt

SEQ ID NO: 517536 - DNA, 25 bp, Homo sapien
gctttagattcctttcattggctac

SEQ ID NO: 517537 - DNA, 25 bp, Homo sapien
aattactcaaggatagtgcttcaag

SEQ ID NO: 517538 - DNA, 25 bp, Homo sapien
gtgcttcaaggtactggttcccaga

SEQ ID NO: 517539 - DNA, 25 bp, Homo sapien
gactgatcacagttatttttgtatc

SEQ ID NO: 517540 - DNA, 25 bp, Homo sapien
gttatttttgtatcagtctatgtta

SEQ ID NO: 517541 - DNA, 25 bp, Homo sapien
tttctcccctgattaatggtgatat

SEQ ID NO: 517542 - DNA, 25 bp, Homo sapien
gaattgtaccaccaaatatttttgt

SEQ ID NO: 517543 - DNA, 25 bp, Homo sapien
gaggtctgctgttttccatattcat

SEQ ID NO: 517544 - DNA, 25 bp, Homo sapien
gtctgctgttttccatattcatttt

SEQ ID NO: 517545 - DNA, 25 bp, Homo sapien
ttatgctactgcctttaagaaagaa

SEQ ID NO: 517546 - DNA, 25 bp, Homo sapien
gaaagaactagtgtatccttgaaat

SEQ ID NO: 517547 - DNA, 25 bp, Homo sapien
tagtgtatccttgaaatagcacaaa

SEQ ID NO: 517548 - DNA, 25 bp, Homo sapien
aaatctgtgactaacttaatgtctt

SEQ ID NO: 517549 - DNA, 25 bp, Homo sapien
acttaatgtcttcagatctaaaggg

SEQ ID NO: 517550 - DNA, 25 bp, Homo sapien
taagcagcagatgtggatagcagca

SEQ ID NO: 517551 - DNA, 25 bp, Homo sapien
tgtggatagcagcaagccgtcttct

SEQ ID NO: 517552 - DNA, 25 bp, Homo sapien
cagcaagccgtcttctgcttctgat

SEQ ID NO: 517553 - DNA, 25 bp, Homo sapien
cttctgcttctgatctttcgggtca

SEQ ID NO: 517554 - DNA, 25 bp, Homo sapien
gcttctgatctttcgggtcagcatt

SEQ ID NO: 517555 - DNA, 25 bp, Homo sapien
tgatctttcgggtcagcattatttt

SEQ ID NO: 517556 - DNA, 25 bp, Homo sapien
tatcgagccaagcaatgggtctgga

SEQ ID NO: 517557 - DNA, 25 bp, Homo sapien
gcaaagtgaaggtgagtgctgttca

SEQ ID NO: 517558 - DNA, 25 bp, Homo sapien
ccagaggaggtggtctgcttctcat

SEQ ID NO: 517559 - DNA, 25 bp, Homo sapien
aggaggtggtctgcttctcattttt

SEQ ID NO: 517560 - DNA, 25 bp, Homo sapien
ctgcacccttcactgagtctcagtg

SEQ ID NO: 517561 - DNA, 25 bp, Homo sapien
tgttgttgtttggtctgagaatgta

SEQ ID NO: 517562 - DNA, 25 bp, Homo sapien
gtctgagaatgtactgccaacccct

SEQ ID NO: 517563 - DNA, 25 bp, Homo sapien
ctgagaatgtactgccaacccctct

SEQ ID NO: 517564 - DNA, 25 bp, Homo sapien
tgccaacccctcttttataagagag

SEQ ID NO: 517565 - DNA, 25 bp, Homo sapien
acccctcttttataagagagaactg

SEQ ID NO: 517566 - DNA, 25 bp, Homo sapien
gagagaactgattttgatacatatt

SEQ ID NO: 517567 - DNA, 25 bp, Homo sapien
atcgagaatcatataatcagtacat

SEQ ID NO: 517568 - DNA, 25 bp, Homo sapien
aatactggacacaaccatttgccat

SEQ ID NO: 517569 - DNA, 25 bp, Homo sapien
ctggacacaaccatttgccatcttt

SEQ ID NO: 517570 - DNA, 25 bp, Homo sapien
tgccatcttttcctgttatcatccc

SEQ ID NO: 517571 - DNA, 25 bp, Homo sapien
gttatcatcccatagagtgggtggg

SEQ ID NO: 517572 - DNA, 25 bp, Homo sapien
aaatctgtcttcacctgcagtatta

SEQ ID NO: 517573 - DNA, 25 bp, Homo sapien
aagtgagtcatgtgctgctacaggt

SEQ ID NO: 517574 - DNA, 25 bp, Homo sapien
tgctacaggttacaccaaactccca

SEQ ID NO: 517575 - DNA, 25 bp, Homo sapien
tccctctgttactcactgctgttgt

SEQ ID NO: 517576 - DNA, 25 bp, Homo sapien
actgctgttgtcaaagccaaacttt

SEQ ID NO: 517577 - DNA, 25 bp, Homo sapien
aactttatcttgctaatttctcaca

SEQ ID NO: 517578 - DNA, 25 bp, Homo sapien
taatttctcacagcttggcacctaa

SEQ ID NO: 517579 - DNA, 25 bp, Homo sapien
gtttgtggactgcatgatattcctt

SEQ ID NO: 517580 - DNA, 25 bp, Homo sapien
gatattccttgaacatcagggatgg

SEQ ID NO: 517581 - DNA, 25 bp, Homo sapien
acagggatacccatagtctggcctc

SEQ ID NO: 517582 - DNA, 25 bp, Homo sapien
atagtctggcctccaagacaggaga

SEQ ID NO: 517583 - DNA, 25 bp, Homo sapien
ttttccttccttggagcgtccctga

SEQ ID NO: 517584 - DNA, 25 bp, Homo sapien
ttggagcgtccctgacggacaagtg

SEQ ID NO: 517585 - DNA, 25 bp, Homo sapien
cctgacggacaagtggaggcctctt

SEQ ID NO: 517586 - DNA, 25 bp, Homo sapien
caagtggaggcctcttgctgcggct

SEQ ID NO: 517587 - DNA, 25 bp, Homo sapien
aggcctcttgctgcggctgcaatgg

SEQ ID NO: 517588 - DNA, 25 bp, Homo sapien
agcccaggtgcactgtgtgatgatg

SEQ ID NO: 517589 - DNA, 25 bp, Homo sapien
gggctccgtcctgcaggctggaggt

SEQ ID NO: 517590 - DNA, 25 bp, Homo sapien
gagtgagggtaacatttccatttcc

SEQ ID NO: 517591 - DNA, 25 bp, Homo sapien
ttcatgttttgtttcttacgttctt

SEQ ID NO: 517592 - DNA, 25 bp, Homo sapien
ttacgttctttcagcatgctcctta

SEQ ID NO: 517593 - DNA, 25 bp, Homo sapien
cgttctttcagcatgctccttaaaa

SEQ ID NO: 517594 - DNA, 25 bp, Homo sapien
ggattgattcccatggtctaagagg

SEQ ID NO: 517595 - DNA, 25 bp, Homo sapien
gggtctttttgactaaggccagcct

SEQ ID NO: 517596 - DNA, 25 bp, Homo sapien
ctaaggccagcctgtggtgatccca

SEQ ID NO: 517597 - DNA, 25 bp, Homo sapien
tgcagccacacactgactgatacat

SEQ ID NO: 517598 - DNA, 25 bp, Homo sapien
atggtatgttacagggacttgtcac

SEQ ID NO: 517599 - DNA, 25 bp, Homo sapien
gacttgtcactttggatcaggctgg

SEQ ID NO: 517600 - DNA, 25 bp, Homo sapien
actacagggcctgatgggccaactt

SEQ ID NO: 517601 - DNA, 25 bp, Homo sapien
gggccaacttgggtaatcactggga

SEQ ID NO: 517602 - DNA, 25 bp, Homo sapien
aggcccgaggcagatacctgggttt

SEQ ID NO: 517603 - DNA, 25 bp, Homo sapien
ttagcccggttctctgaactacata

SEQ ID NO: 517604 - DNA, 25 bp, Homo sapien
cagctgtgaagccttcctcttgagg

SEQ ID NO: 517605 - DNA, 25 bp, Homo sapien
ctgagcttggcttttatggagagtg

SEQ ID NO: 517606 - DNA, 25 bp, Homo sapien
ttggcttttatggagagtgttctta

SEQ ID NO: 517607 - DNA, 25 bp, Homo sapien
aaccacattcagtccaggaccaagg

SEQ ID NO: 517608 - DNA, 25 bp, Homo sapien
gtccaggaccaaggctcagggatga

SEQ ID NO: 517609 - DNA, 25 bp, Homo sapien
gggttatactgtccctggagcttca

SEQ ID NO: 517610 - DNA, 25 bp, Homo sapien
ggagcttcatcatgattgcctgaga

SEQ ID NO: 517611 - DNA, 25 bp, Homo sapien
ttcatcatgattgcctgagaagaca

SEQ ID NO: 517612 - DNA, 25 bp, Homo sapien
acagatgctcatcatggctggaatg

SEQ ID NO: 517613 - DNA, 25 bp, Homo sapien
ggctggaatgaaggtatccttcagt

SEQ ID NO: 517614 - DNA, 25 bp, Homo sapien
cttcagtttctgataagtcatccct

SEQ ID NO: 517615 - DNA, 25 bp, Homo sapien
ttatcttgatcaaggctttctacag

SEQ ID NO: 517616 - DNA, 25 bp, Homo sapien
gctcaggagctctacttgttggaag

SEQ ID NO: 517617 - DNA, 25 bp, Homo sapien
tggaagcctgtctgctttacctgta

SEQ ID NO: 517618 - DNA, 25 bp, Homo sapien
tttacctgtagtccagtgacctttt

SEQ ID NO: 517619 - DNA, 25 bp, Homo sapien
tttctcttgcatagcctcttagttc

SEQ ID NO: 517620 - DNA, 25 bp, Homo sapien
atagcctcttagttctggcttgctc

SEQ ID NO: 517621 - DNA, 25 bp, Homo sapien
ggcttgctcgttttctagtactatc

SEQ ID NO: 517622 - DNA, 25 bp, Homo sapien
tgtttccacctcttatttcatgttc

SEQ ID NO: 517623 - DNA, 25 bp, Homo sapien
catgttcctgacattatcctttttt

SEQ ID NO: 517624 - DNA, 25 bp, Homo sapien
cttttgctccttttcagaatttcgc

SEQ ID NO: 517625 - DNA, 25 bp, Homo sapien
agaatttcgcagtacttgtggccca

SEQ ID NO: 517626 - DNA, 25 bp, Homo sapien
aaagagcctctcagactcggtcata

SEQ ID NO: 517627 - DNA, 25 bp, Homo sapien
taccgcccatcatactatggaggat

SEQ ID NO: 517628 - DNA, 25 bp, Homo sapien
cccatcatactatggaggatatgga

SEQ ID NO: 517629 - DNA, 25 bp, Homo sapien
aggatatggattctctggattctat

SEQ ID NO: 517630 - DNA, 25 bp, Homo sapien
gatatggattctctggattctatta

SEQ ID NO: 517631 - DNA, 25 bp, Homo sapien
ggattctctggattctattaaacta

SEQ ID NO: 517632 - DNA, 25 bp, Homo sapien
ggattctattaaactactgccccag

SEQ ID NO: 517633 - DNA, 25 bp, Homo sapien
ttctattaaactactgccccagcaa

SEQ ID NO: 517634 - DNA, 25 bp, Homo sapien
actgccccagcaacacaatgtgtga

SEQ ID NO: 517635 - DNA, 25 bp, Homo sapien
tgccccagcaacacaatgtgtgaaa

SEQ ID NO: 517636 - DNA, 25 bp, Homo sapien
ttataagaggactttcccagagctg

SEQ ID NO: 517637 - DNA, 25 bp, Homo sapien
ctatggctgtggaggctttggtggc

SEQ ID NO: 517638 - DNA, 25 bp, Homo sapien
tccgaagcccgcgagaccttaaaat

SEQ ID NO: 517639 - DNA, 25 bp, Homo sapien
cgagaccttaaaatgaacctgcctt

SEQ ID NO: 517640 - DNA, 25 bp, Homo sapien
ttaaaatgaacctgccttccagctg

SEQ ID NO: 517641 - DNA, 25 bp, Homo sapien
acagtccccagggaaacttcatggg

SEQ ID NO: 517642 - DNA, 25 bp, Homo sapien
ttggtcatcctctgttagccgacta

SEQ ID NO: 517643 - DNA, 25 bp, Homo sapien
tagccgactacagaaagagtaccca

SEQ ID NO: 517644 - DNA, 25 bp, Homo sapien
gagtacccagagagcaaaacacaca

SEQ ID NO: 517645 - DNA, 25 bp, Homo sapien
agagcaaaacacacaccgaaagaat

SEQ ID NO: 517646 - DNA, 25 bp, Homo sapien
ctctggcttcagaagaacgacaaaa

SEQ ID NO: 517647 - DNA, 25 bp, Homo sapien
agaacgacaaaagccggtttctcag

SEQ ID NO: 517648 - DNA, 25 bp, Homo sapien
caaaagccggtttctcagtgaggga

SEQ ID NO: 517649 - DNA, 25 bp, Homo sapien
gccgggcgtaagctaagccccttca

SEQ ID NO: 517650 - DNA, 25 bp, Homo sapien
tcaccaggatcgctctagatgctgt

SEQ ID NO: 517651 - DNA, 25 bp, Homo sapien
atcgctctagatgctgtgttaacca

SEQ ID NO: 517652 - DNA, 25 bp, Homo sapien
gtgttaaccatagcagggccaggtg

SEQ ID NO: 517653 - DNA, 25 bp, Homo sapien
ctcctggccaggatgatcgtggaca

SEQ ID NO: 517654 - DNA, 25 bp, Homo sapien
atcgtggacaggatgcgtagcctcc

SEQ ID NO: 517655 - DNA, 25 bp, Homo sapien
gtagcctccctgttgatggttcttc

SEQ ID NO: 517656 - DNA, 25 bp, Homo sapien
ccaggtttttatattcagtgctcac

SEQ ID NO: 517657 - DNA, 25 bp, Homo sapien
tattcagtgctcacacatctctgag

SEQ ID NO: 517658 - DNA, 25 bp, Homo sapien
tctctgagcacataaataagcactt

SEQ ID NO: 517659 - DNA, 25 bp, Homo sapien
cacttctctgcaatggattcctgga

SEQ ID NO: 517660 - DNA, 25 bp, Homo sapien
tgtgactgattggagcgacacttca

SEQ ID NO: 517661 - DNA, 25 bp, Homo sapien
tcagatgtctaattccacatgtcag

SEQ ID NO: 517662 - DNA, 25 bp, Homo sapien
cagaagattattccagaagccagca

SEQ ID NO: 517663 - DNA, 25 bp, Homo sapien
aagccagcagtatttcagtatcaca

SEQ ID NO: 517664 - DNA, 25 bp, Homo sapien
gtatcacagtgtttcagtaatttgc

SEQ ID NO: 517665 - DNA, 25 bp, Homo sapien
gtaatttgcctccatgattctagtg

SEQ ID NO: 517666 - DNA, 25 bp, Homo sapien
atgattctagtgcttctgccttacc

SEQ ID NO: 517667 - DNA, 25 bp, Homo sapien
aatggtctctttaatggcacccaat

SEQ ID NO: 517668 - DNA, 25 bp, Homo sapien
gatcatcaacagtatttcgaagcat

SEQ ID NO: 517669 - DNA, 25 bp, Homo sapien
aaaggtgtttaagacttccgctgct

SEQ ID NO: 517670 - DNA, 25 bp, Homo sapien
aagacttccgctgctgcttaaaaat

SEQ ID NO: 517671 - DNA, 25 bp, Homo sapien
gttctcaggaatcccctgcagatgc

SEQ ID NO: 517672 - DNA, 25 bp, Homo sapien
actcagcaggcagcgaggccctgga

SEQ ID NO: 517673 - DNA, 25 bp, Homo sapien
ctgcaacgcctgtgggatcaggtac

SEQ ID NO: 517674 - DNA, 25 bp, Homo sapien
acgcctgtgggatcaggtacaagaa

SEQ ID NO: 517675 - DNA, 25 bp, Homo sapien
ggtacaagaaatacggcactcgctg

SEQ ID NO: 517676 - DNA, 25 bp, Homo sapien
agaaatacggcactcgctgctccag

SEQ ID NO: 517677 - DNA, 25 bp, Homo sapien
ggaaaaatgtccagcccaagaggct

SEQ ID NO: 517678 - DNA, 25 bp, Homo sapien
gtccagcccaagaggctatgtggca

SEQ ID NO: 517679 - DNA, 25 bp, Homo sapien
tatgtggcagatgtggagtgtccct

SEQ ID NO: 517680 - DNA, 25 bp, Homo sapien
gcagatgtggagtgtccctggaccc

SEQ ID NO: 517681 - DNA, 25 bp, Homo sapien
gatgtggagtgtccctggaccccat

SEQ ID NO: 517682 - DNA, 25 bp, Homo sapien
tggatatttgtgatcctgaaatgtt

SEQ ID NO: 517683 - DNA, 25 bp, Homo sapien
tttgtgatcctgaaatgtttactaa

SEQ ID NO: 517684 - DNA, 25 bp, Homo sapien
aatttatttataactgccatctcca

SEQ ID NO: 517685 - DNA, 25 bp, Homo sapien
atttataactgccatctccaactac

SEQ ID NO: 517686 - DNA, 25 bp, Homo sapien
ttataactgccatctccaactacat

SEQ ID NO: 517687 - DNA, 25 bp, Homo sapien
ccatctccaactacatccttatgat

SEQ ID NO: 517688 - DNA, 25 bp, Homo sapien
actacatccttatgatgtttttaac

SEQ ID NO: 517689 - DNA, 25 bp, Homo sapien
ccagtacttgatctctgagctacaa

SEQ ID NO: 517690 - DNA, 25 bp, Homo sapien
acttgatctctgagctacaatactc

SEQ ID NO: 517691 - DNA, 25 bp, Homo sapien
gtgattatagtgtccacttgccacc

SEQ ID NO: 517692 - DNA, 25 bp, Homo sapien
atagtgtccacttgccaccattttt

SEQ ID NO: 517693 - DNA, 25 bp, Homo sapien
ttatgtcagcatcacaagatcttga

SEQ ID NO: 517694 - DNA, 25 bp, Homo sapien
atcacaagatcttgaacccaagccc

SEQ ID NO: 517695 - DNA, 25 bp, Homo sapien
cagaagccgcccctaagtaccgaga

SEQ ID NO: 517696 - DNA, 25 bp, Homo sapien
taagtaccgagaactcccatgaaga

SEQ ID NO: 517697 - DNA, 25 bp, Homo sapien
gagaactcccatgaagacgaaagcc

SEQ ID NO: 517698 - DNA, 25 bp, Homo sapien
ccatgaagacgaaagccccatgaag

SEQ ID NO: 517699 - DNA, 25 bp, Homo sapien
gtgtcttcatcaaaagggtccccag

SEQ ID NO: 517700 - DNA, 25 bp, Homo sapien
gtcttcatcaaaagggtccccagct

SEQ ID NO: 517701 - DNA, 25 bp, Homo sapien
ctgggagtcaggtccaaaagcggcc

SEQ ID NO: 517702 - DNA, 25 bp, Homo sapien
gagtcaggtccaaaagcggcccttt

SEQ ID NO: 517703 - DNA, 25 bp, Homo sapien
tggttttgaaacctgctgcgagcag

SEQ ID NO: 517704 - DNA, 25 bp, Homo sapien
actgcccttacctattgcttttgta

SEQ ID NO: 517705 - DNA, 25 bp, Homo sapien
acctattgcttttgtacttttgctt

SEQ ID NO: 517706 - DNA, 25 bp, Homo sapien
ttgctttactttagccacaccatgt

SEQ ID NO: 517707 - DNA, 25 bp, Homo sapien
ggcagtcagacgaggtaagcacatg

SEQ ID NO: 517708 - DNA, 25 bp, Homo sapien
gtaagcacatgagactcagcgtgtg

SEQ ID NO: 517709 - DNA, 25 bp, Homo sapien
gtgtggatcgtctgtggcatgactt

SEQ ID NO: 517710 - DNA, 25 bp, Homo sapien
tctgtggcatgactttgacctcttg

SEQ ID NO: 517711 - DNA, 25 bp, Homo sapien
tgacctcttgtccttgtaaacctga

SEQ ID NO: 517712 - DNA, 25 bp, Homo sapien
gtccttgtaaacctgatctatgtct

SEQ ID NO: 517713 - DNA, 25 bp, Homo sapien
acctgatctatgtctctcagataaa

SEQ ID NO: 517714 - DNA, 25 bp, Homo sapien
gattgaaatctgttctattacaagc

SEQ ID NO: 517715 - DNA, 25 bp, Homo sapien
gatcaaccatattaatagcaattaa

SEQ ID NO: 517716 - DNA, 25 bp, Homo sapien
gaatgtggccacttatttcactatc

SEQ ID NO: 517717 - DNA, 25 bp, Homo sapien
atgtggccacttatttcactatctt

SEQ ID NO: 517718 - DNA, 25 bp, Homo sapien
tggccacttatttcactatcttctt

SEQ ID NO: 517719 - DNA, 25 bp, Homo sapien
ccacttatttcactatcttcttcaa

SEQ ID NO: 517720 - DNA, 25 bp, Homo sapien
ttcactatcttcttcaaatacaaag

SEQ ID NO: 517721 - DNA, 25 bp, Homo sapien
aagactgttgtgatcttgcattcat

SEQ ID NO: 517722 - DNA, 25 bp, Homo sapien
actgttgtgatcttgcattcatttt

SEQ ID NO: 517723 - DNA, 25 bp, Homo sapien
cattcattttctgacatgcattgtt

SEQ ID NO: 517724 - DNA, 25 bp, Homo sapien
gcaaatctacagatcctttttccat

SEQ ID NO: 517725 - DNA, 25 bp, Homo sapien
atctacagatcctttttccatcatt

SEQ ID NO: 517726 - DNA, 25 bp, Homo sapien
tggctggcgtctttcccgactgtaa

SEQ ID NO: 517727 - DNA, 25 bp, Homo sapien
gcgtctttcccgactgtaacgtggg

SEQ ID NO: 517728 - DNA, 25 bp, Homo sapien
gtgggttacggcaggcagaaaaaca

SEQ ID NO: 517729 - DNA, 25 bp, Homo sapien
gaaaaacatctggtgataattctga

SEQ ID NO: 517730 - DNA, 25 bp, Homo sapien
ttctgaaaaaagtgctgtggcgttt

SEQ ID NO: 517731 - DNA, 25 bp, Homo sapien
gtaaagcacgttttgcgggcgggat

SEQ ID NO: 517732 - DNA, 25 bp, Homo sapien
gtttaacaaatgagtgcggccggga

SEQ ID NO: 517733 - DNA, 25 bp, Homo sapien
gtgcggccgggaaattctcaggaaa

SEQ ID NO: 517734 - DNA, 25 bp, Homo sapien
gaagttcttcgatttcggcgccatt

SEQ ID NO: 517735 - DNA, 25 bp, Homo sapien
cgccattttcgagtggagccagagg

SEQ ID NO: 517736 - DNA, 25 bp, Homo sapien
ggagccagaggtgacatgcgatttt

SEQ ID NO: 517737 - DNA, 25 bp, Homo sapien
tcccctaatatgttatggaagatgg

SEQ ID NO: 517738 - DNA, 25 bp, Homo sapien
atggaagatgggataaacgtagtta

SEQ ID NO: 517739 - DNA, 25 bp, Homo sapien
gtagttaacatagactgttccgact

SEQ ID NO: 517740 - DNA, 25 bp, Homo sapien
aacatagactgttccgactataaac

SEQ ID NO: 517741 - DNA, 25 bp, Homo sapien
ttccgactataaacaaagccaattt

SEQ ID NO: 517742 - DNA, 25 bp, Homo sapien
ttgaatactttgacttacaggaaaa

SEQ ID NO: 517743 - DNA, 25 bp, Homo sapien
acaggaatatcatatctgaattttt

SEQ ID NO: 517744 - DNA, 25 bp, Homo sapien
atgagtatacttgacaacacttagt

SEQ ID NO: 517745 - DNA, 25 bp, Homo sapien
gacaacacttagtctgctttttccc

SEQ ID NO: 517746 - DNA, 25 bp, Homo sapien
caacacttagtctgctttttcccct

SEQ ID NO: 517747 - DNA, 25 bp, Homo sapien
gctttttcccctaatatgttatgga

SEQ ID NO: 517748 - DNA, 25 bp, Homo sapien
tcttctgtcatgaccctatctaggg

SEQ ID NO: 517749 - DNA, 25 bp, Homo sapien
ccctatctagggtggtgaaatgcct

SEQ ID NO: 517750 - DNA, 25 bp, Homo sapien
gggtggtgaaatgcctgaaatctct

SEQ ID NO: 517751 - DNA, 25 bp, Homo sapien
ggaaaccatccatcaaggtctctag

SEQ ID NO: 517752 - DNA, 25 bp, Homo sapien
aaggtctctagtagttctggcccac

SEQ ID NO: 517753 - DNA, 25 bp, Homo sapien
tctagtagttctggcccacctcttt

SEQ ID NO: 517754 - DNA, 25 bp, Homo sapien
aacaggccttgggaatcaggagctg

SEQ ID NO: 517755 - DNA, 25 bp, Homo sapien
gagccaggatgcgaagcagctgtaa

SEQ ID NO: 517756 - DNA, 25 bp, Homo sapien
gcagctgtaatggtctgagcggatt

SEQ ID NO: 517757 - DNA, 25 bp, Homo sapien
ctgagcggatttattgacaatgaat

SEQ ID NO: 517758 - DNA, 25 bp, Homo sapien
agggcctgggcctcttgtgctaaga

SEQ ID NO: 517759 - DNA, 25 bp, Homo sapien
cctcttcctccatactaggttggaa

SEQ ID NO: 517760 - DNA, 25 bp, Homo sapien
tctggtttagcccactttttgcaac

SEQ ID NO: 517761 - DNA, 25 bp, Homo sapien
actttttgcaacactcctgccaagt

SEQ ID NO: 517762 - DNA, 25 bp, Homo sapien
tggtcttctacccattgcttgaaaa

SEQ ID NO: 517763 - DNA, 25 bp, Homo sapien
aaatctctcttgacagggagctcac

SEQ ID NO: 517764 - DNA, 25 bp, Homo sapien
aggcaggtcatttcattgtgggatc

SEQ ID NO: 517765 - DNA, 25 bp, Homo sapien
gttaagtaccacattctcctctaaa

SEQ ID NO: 517766 - DNA, 25 bp, Homo sapien
aaccttgcctacgacatgtttaata

SEQ ID NO: 517767 - DNA, 25 bp, Homo sapien
gtttaatacttcatctacatagcag

SEQ ID NO: 517768 - DNA, 25 bp, Homo sapien
agtctgtccacacagggattacctg

SEQ ID NO: 517769 - DNA, 25 bp, Homo sapien
ggattacctgtcatcttgcatgcaa

SEQ ID NO: 517770 - DNA, 25 bp, Homo sapien
ggagtcagcctgcttcacactggga

SEQ ID NO: 517771 - DNA, 25 bp, Homo sapien
gcttctagagaatccagctgcaggg

SEQ ID NO: 517772 - DNA, 25 bp, Homo sapien
gagagacaagaaaccaaagcttgct

SEQ ID NO: 517773 - DNA, 25 bp, Homo sapien
aaagcttgctaaaatgtttctgaga

SEQ ID NO: 517774 - DNA, 25 bp, Homo sapien
gggtgtggttatattctgtatcaaa

SEQ ID NO: 517775 - DNA, 25 bp, Homo sapien
ctgtatcaaaattggaagtgccttc

SEQ ID NO: 517776 - DNA, 25 bp, Homo sapien
ttggaagtgccttccttccacatta

SEQ ID NO: 517777 - DNA, 25 bp, Homo sapien
ttccacattacctaagaaccagtta

SEQ ID NO: 517778 - DNA, 25 bp, Homo sapien
gaaccagttaggactctgaagacac

SEQ ID NO: 517779 - DNA, 25 bp, Homo sapien
gttaggactctgaagacaccacaag

SEQ ID NO: 517780 - DNA, 25 bp, Homo sapien
tctggaggcagagacgggatcaaat

SEQ ID NO: 517781 - DNA, 25 bp, Homo sapien
aagggatgacaccaaacctggcagg

SEQ ID NO: 517782 - DNA, 25 bp, Homo sapien
cctggcaggaacttttcacgcaatc

SEQ ID NO: 517783 - DNA, 25 bp, Homo sapien
gaacttttcacgcaatcaagggaag

SEQ ID NO: 517784 - DNA, 25 bp, Homo sapien
gaacagcatgccaagcgtgagaagg

SEQ ID NO: 517785 - DNA, 25 bp, Homo sapien
gcccaagtattggagcctacagttt

SEQ ID NO: 517786 - DNA, 25 bp, Homo sapien
attggagcctacagttttgcccctt

SEQ ID NO: 517787 - DNA, 25 bp, Homo sapien
gttctgtcccctgcaaaatggtcag

SEQ ID NO: 517788 - DNA, 25 bp, Homo sapien
aaaatggtcagagcttaccccttgg

SEQ ID NO: 517789 - DNA, 25 bp, Homo sapien
agagcttaccccttggctgtgcagg

SEQ ID NO: 517790 - DNA, 25 bp, Homo sapien
gctgtgcagggtcaactttctgact

SEQ ID NO: 517791 - DNA, 25 bp, Homo sapien
ctttctgactggtgagagggattct

SEQ ID NO: 517792 - DNA, 25 bp, Homo sapien
ggttgggagttgtctttgtatatca

SEQ ID NO: 517793 - DNA, 25 bp, Homo sapien
gtatatcaaccgtggaagggctgtt

SEQ ID NO: 517794 - DNA, 25 bp, Homo sapien
ggttcatcattctgtggtctacctg

SEQ ID NO: 517795 - DNA, 25 bp, Homo sapien
atcattctgtggtctacctgggtag

SEQ ID NO: 517796 - DNA, 25 bp, Homo sapien
tctacctgggtagacctgatgcagc

SEQ ID NO: 517797 - DNA, 25 bp, Homo sapien
agacctgatgcagccgtgtttctga

SEQ ID NO: 517798 - DNA, 25 bp, Homo sapien
ggtagatgtagtgccatggaatgat

SEQ ID NO: 517799 - DNA, 25 bp, Homo sapien
gatgcagatttcattcagatattct

SEQ ID NO: 517800 - DNA, 25 bp, Homo sapien
tattcttggatcttggccccaggac

SEQ ID NO: 517801 - DNA, 25 bp, Homo sapien
tgacagcaggtatatgaggcatgga

SEQ ID NO: 517802 - DNA, 25 bp, Homo sapien
aaatatgcagtcctttctatccacc

SEQ ID NO: 517803 - DNA, 25 bp, Homo sapien
attttatggcatttggaggccctcc

SEQ ID NO: 517804 - DNA, 25 bp, Homo sapien
ttatggcatttggaggccctccagt

SEQ ID NO: 517805 - DNA, 25 bp, Homo sapien
gaggccctccagtggacaaatacta

SEQ ID NO: 517806 - DNA, 25 bp, Homo sapien
gtggacaaatactatacctgaaaaa

SEQ ID NO: 517807 - DNA, 25 bp, Homo sapien
atccttttgctgtgctaaagtgttc

SEQ ID NO: 517808 - DNA, 25 bp, Homo sapien
ctgtgctaaagtgttcaggtgtgaa

SEQ ID NO: 517809 - DNA, 25 bp, Homo sapien
gatttcagattgagtctcttgccct

SEQ ID NO: 517810 - DNA, 25 bp, Homo sapien
agattgagtctcttgccctaattga

SEQ ID NO: 517811 - DNA, 25 bp, Homo sapien
gagtctcttgccctaattgatgcaa

SEQ ID NO: 517812 - DNA, 25 bp, Homo sapien
aattgatgcaatttacactccatgc

SEQ ID NO: 517813 - DNA, 25 bp, Homo sapien
aatttacactccatgcatctccttc

SEQ ID NO: 517814 - DNA, 25 bp, Homo sapien
gacgatgccacatgatgaatacata

SEQ ID NO: 517815 - DNA, 25 bp, Homo sapien
gcaccaaggagggaaacccagttct

SEQ ID NO: 517816 - DNA, 25 bp, Homo sapien
acaagcccagtgtctgctccctttg

SEQ ID NO: 517817 - DNA, 25 bp, Homo sapien
cctttgtgggagacgtgttgtttca

SEQ ID NO: 517818 - DNA, 25 bp, Homo sapien
aagtgcttgaatttccttttcatgg

SEQ ID NO: 517819 - DNA, 25 bp, Homo sapien
tgaatttccttttcatggaaccacc

SEQ ID NO: 517820 - DNA, 25 bp, Homo sapien
catccatgcattctattcccagtat

SEQ ID NO: 517821 - DNA, 25 bp, Homo sapien
atgcattctattcccagtatcaggg

SEQ ID NO: 517822 - DNA, 25 bp, Homo sapien
gacaagtgacttcaggcttggccaa

SEQ ID NO: 517823 - DNA, 25 bp, Homo sapien
gcttggccaattagggttctgactc

SEQ ID NO: 517824 - DNA, 25 bp, Homo sapien
attagggttctgactcttggtcaaa

SEQ ID NO: 517825 - DNA, 25 bp, Homo sapien
atttattatacatggcctacaacgg

SEQ ID NO: 517826 - DNA, 25 bp, Homo sapien
atacatggcctacaacggttctgtc

SEQ ID NO: 517827 - DNA, 25 bp, Homo sapien
tacaacggttctgtctgcgctgtta

SEQ ID NO: 517828 - DNA, 25 bp, Homo sapien
tgtctgcgctgttacgtattaccta

SEQ ID NO: 517829 - DNA, 25 bp, Homo sapien
gttacgtattacctacacttctggg

SEQ ID NO: 517830 - DNA, 25 bp, Homo sapien
tttgttcttgttctcagcctctctt

SEQ ID NO: 517831 - DNA, 25 bp, Homo sapien
tctttaagagttcttgggccttcct

SEQ ID NO: 517832 - DNA, 25 bp, Homo sapien
ttagaaccatttacattccagtagg

SEQ ID NO: 517833 - DNA, 25 bp, Homo sapien
agtaggtaattcactatgcgcttta

SEQ ID NO: 517834 - DNA, 25 bp, Homo sapien
ctatgcgctttatatgccttagggc

SEQ ID NO: 517835 - DNA, 25 bp, Homo sapien
tgccttagggcatccaaataaaaaa

SEQ ID NO: 517836 - DNA, 25 bp, Homo sapien
tgcaggccctaaccaacggatagtt

SEQ ID NO: 517837 - DNA, 25 bp, Homo sapien
gggcctagacgccaatggaaagaaa

SEQ ID NO: 517838 - DNA, 25 bp, Homo sapien
tgggactttaagctttgtttgaaca

SEQ ID NO: 517839 - DNA, 25 bp, Homo sapien
gttgtaacagatttggatcgcgctt

SEQ ID NO: 517840 - DNA, 25 bp, Homo sapien
tttggatcgcgcttagaaaaacagg

SEQ ID NO: 517841 - DNA, 25 bp, Homo sapien
gttcaacttaatgtcttgcatttca

SEQ ID NO: 517842 - DNA, 25 bp, Homo sapien
cttgcatttcagacgattatcgaat

SEQ ID NO: 517843 - DNA, 25 bp, Homo sapien
aaacgatgttacagatagccctcta

SEQ ID NO: 517844 - DNA, 25 bp, Homo sapien
gatagccctctaagtgtggatagta

SEQ ID NO: 517845 - DNA, 25 bp, Homo sapien
gatttacaattaagcctaccttgag

SEQ ID NO: 517846 - DNA, 25 bp, Homo sapien
aagcctaccttgaggtgcaggccct

SEQ ID NO: 517847 - DNA, 25 bp, Homo sapien
tgagcgcctcgggagccccgaatag

SEQ ID NO: 517848 - DNA, 25 bp, Homo sapien
gggagccccgaatagcagctgggag

SEQ ID NO: 517849 - DNA, 25 bp, Homo sapien
cgggctagagatacgggcgtgcccc

SEQ ID NO: 517850 - DNA, 25 bp, Homo sapien
agatacgggcgtgccccccattgtg

SEQ ID NO: 517851 - DNA, 25 bp, Homo sapien
tgcccgtgcacgtagccgctgcgag

SEQ ID NO: 517852 - DNA, 25 bp, Homo sapien
tagccgctgcgagcggaggcctgct

SEQ ID NO: 517853 - DNA, 25 bp, Homo sapien
gagcggaggcctgctcacctggtgc

SEQ ID NO: 517854 - DNA, 25 bp, Homo sapien
tgctcacctggtgcctgctactcac

SEQ ID NO: 517855 - DNA, 25 bp, Homo sapien
ccgtgtgtggcgtcttagctggccc

SEQ ID NO: 517856 - DNA, 25 bp, Homo sapien
tgtgtggcgtcttagctggcccctg

SEQ ID NO: 517857 - DNA, 25 bp, Homo sapien
tggcgtcttagctggcccctgggtt

SEQ ID NO: 517858 - DNA, 25 bp, Homo sapien
tctccttccctggaataaggcttca

SEQ ID NO: 517859 - DNA, 25 bp, Homo sapien
cttccctggaataaggcttcagctt

SEQ ID NO: 517860 - DNA, 25 bp, Homo sapien
gtgaagacaccatttgtaagcactt

SEQ ID NO: 517861 - DNA, 25 bp, Homo sapien
gacaccatttgtaagcactttgaac

SEQ ID NO: 517862 - DNA, 25 bp, Homo sapien
ccccataataatgagttttgtttgg

SEQ ID NO: 517863 - DNA, 25 bp, Homo sapien
atgagttttgtttggaattgtaata

SEQ ID NO: 517864 - DNA, 25 bp, Homo sapien
agtaatgaactgcatggtttagaaa

SEQ ID NO: 517865 - DNA, 25 bp, Homo sapien
tctctgaaaaaaattgcaccccttt

SEQ ID NO: 517866 - DNA, 25 bp, Homo sapien
aaaattttgttgcatcttcgtagta

SEQ ID NO: 517867 - DNA, 25 bp, Homo sapien
aattttgttgcatcttcgtagtaat

SEQ ID NO: 517868 - DNA, 25 bp, Homo sapien
tttgttgcatcttcgtagtaatgta

SEQ ID NO: 517869 - DNA, 25 bp, Homo sapien
gggatgatacattacttatacattt

SEQ ID NO: 517870 - DNA, 25 bp, Homo sapien
gtgggtgtgtgtctaattactttgt

SEQ ID NO: 517871 - DNA, 25 bp, Homo sapien
attactttgttggacagattcctgt

SEQ ID NO: 517872 - DNA, 25 bp, Homo sapien
ttgttggacagattcctgtggtttg

SEQ ID NO: 517873 - DNA, 25 bp, Homo sapien
ggccaagtttatacaaaaatctaca

SEQ ID NO: 517874 - DNA, 25 bp, Homo sapien
ttttgagtaaactccccatgactct

SEQ ID NO: 517875 - DNA, 25 bp, Homo sapien
tccccatgactctagtaagtttcca

SEQ ID NO: 517876 - DNA, 25 bp, Homo sapien
gactctagtaagtttccacagtatt

SEQ ID NO: 517877 - DNA, 25 bp, Homo sapien
gtaagtttccacagtatttgagtat

SEQ ID NO: 517878 - DNA, 25 bp, Homo sapien
gagtattctttatttcctaaagctg

SEQ ID NO: 517879 - DNA, 25 bp, Homo sapien
tatttcctaaagctgtacaaacatc

SEQ ID NO: 517880 - DNA, 25 bp, Homo sapien
tttcatttttcatttctacctctta

SEQ ID NO: 517881 - DNA, 25 bp, Homo sapien
ttcatttctacctcttaaagtcaat

SEQ ID NO: 517882 - DNA, 25 bp, Homo sapien
gtcaatgataaactcacaagtgtaa

SEQ ID NO: 517883 - DNA, 25 bp, Homo sapien
aaatctactgtacactttgccacgg

SEQ ID NO: 517884 - DNA, 25 bp, Homo sapien
tactgtacactttgccacggtcaaa

SEQ ID NO: 517885 - DNA, 25 bp, Homo sapien
ttgccacggtcaaagaatgaaggac

SEQ ID NO: 517886 - DNA, 25 bp, Homo sapien
ggacaatatggaaaagccaatcttc

SEQ ID NO: 517887 - DNA, 25 bp, Homo sapien
gccaatcttcaaatatatccttaac

SEQ ID NO: 517888 - DNA, 25 bp, Homo sapien
aacaaaaactctctcctgcatagta

SEQ ID NO: 517889 - DNA, 25 bp, Homo sapien
aaactctctcctgcatagtaaaagc

SEQ ID NO: 517890 - DNA, 25 bp, Homo sapien
gcatcatctaaacagcagctccaac

SEQ ID NO: 517891 - DNA, 25 bp, Homo sapien
atcaatctcagcgaggtagcctctt

SEQ ID NO: 517892 - DNA, 25 bp, Homo sapien
ttgaacaatcctctaatggccttcc

SEQ ID NO: 517893 - DNA, 25 bp, Homo sapien
atggccttcctatttgtctctggat

SEQ ID NO: 517894 - DNA, 25 bp, Homo sapien
gtctctggattgtcaagcatgcgca

SEQ ID NO: 517895 - DNA, 25 bp, Homo sapien
aatcaaccgtgatattgcccagcta

SEQ ID NO: 517896 - DNA, 25 bp, Homo sapien
tgatattgcccagctactgactcat

SEQ ID NO: 517897 - DNA, 25 bp, Homo sapien
agctactgactcattcacgttcaat

SEQ ID NO: 517898 - DNA, 25 bp, Homo sapien
cattcacgttcaatagatcaggcat

SEQ ID NO: 517899 - DNA, 25 bp, Homo sapien
gagatgaatttcttcgcttgctcct

SEQ ID NO: 517900 - DNA, 25 bp, Homo sapien
cgcttgctcctcacaagatttatct

SEQ ID NO: 517901 - DNA, 25 bp, Homo sapien
ttatcttttgttcagccaccatgag

SEQ ID NO: 517902 - DNA, 25 bp, Homo sapien
aggtgctgactgacagtgaaagtgc

SEQ ID NO: 517903 - DNA, 25 bp, Homo sapien
acagtgaaagtgctgaggaccagac

SEQ ID NO: 517904 - DNA, 25 bp, Homo sapien
gaccaaggctgctgagcaaaagcct

SEQ ID NO: 517905 - DNA, 25 bp, Homo sapien
gcaaaagccttccagtaagagtaga

SEQ ID NO: 517906 - DNA, 25 bp, Homo sapien
gaatccagagaagcatattagccat

SEQ ID NO: 517907 - DNA, 25 bp, Homo sapien
gaacaacaagatgacatgcttctgt

SEQ ID NO: 517908 - DNA, 25 bp, Homo sapien
catgcttctgtctgataaattggta

SEQ ID NO: 517909 - DNA, 25 bp, Homo sapien
gcttctgtctgataaattggtatta

SEQ ID NO: 517910 - DNA, 25 bp, Homo sapien
gtattaaggaggcttcggaccataa

SEQ ID NO: 517911 - DNA, 25 bp, Homo sapien
aggaggcttcggaccataataagaa

SEQ ID NO: 517912 - DNA, 25 bp, Homo sapien
ttaataaggctcttaagtatttcag

SEQ ID NO: 517913 - DNA, 25 bp, Homo sapien
aaaagccactgtaagctcttcacag

SEQ ID NO: 517914 - DNA, 25 bp, Homo sapien
ctcttcacagatggcgatgctgctt

SEQ ID NO: 517915 - DNA, 25 bp, Homo sapien
atggcgatgctgctttggaatttgc

SEQ ID NO: 517916 - DNA, 25 bp, Homo sapien
ggagtagctatccagatcacaagga

SEQ ID NO: 517917 - DNA, 25 bp, Homo sapien
aggaccccaataaggctgaggagtt

SEQ ID NO: 517918 - DNA, 25 bp, Homo sapien
tggaattgattctgccttctggtgc

SEQ ID NO: 517919 - DNA, 25 bp, Homo sapien
ttctggtgccagagtgggtcatcgc

SEQ ID NO: 517920 - DNA, 25 bp, Homo sapien
cagagtgggtcatcgctccttgatg

SEQ ID NO: 517921 - DNA, 25 bp, Homo sapien
atcgctccttgatgagatactacaa

SEQ ID NO: 517922 - DNA, 25 bp, Homo sapien
acagcgatttggcttgtcaagagct

SEQ ID NO: 517923 - DNA, 25 bp, Homo sapien
gccgtgggccgagtacttcagcagt

SEQ ID NO: 517924 - DNA, 25 bp, Homo sapien
actgcactgggtcctgctggcacta

SEQ ID NO: 517925 - DNA, 25 bp, Homo sapien
tggcactagctctggtgaacctgct

SEQ ID NO: 517926 - DNA, 25 bp, Homo sapien
tggtgaacctgctcttgtccgttgc

SEQ ID NO: 517927 - DNA, 25 bp, Homo sapien
acccaggactgctggatcctctggt

SEQ ID NO: 517928 - DNA, 25 bp, Homo sapien
ggatcctctggtaccactggatgag

SEQ ID NO: 517929 - DNA, 25 bp, Homo sapien
gggacatactgactgcccctttgac

SEQ ID NO: 517930 - DNA, 25 bp, Homo sapien
cctttgaccccacaagaatctatga

SEQ ID NO: 517931 - DNA, 25 bp, Homo sapien
gaatctatgatacagccttggctct

SEQ ID NO: 517932 - DNA, 25 bp, Homo sapien
tggatcccttctttgctcatgtctg

SEQ ID NO: 517933 - DNA, 25 bp, Homo sapien
gggaggctgctctatctggttactg

SEQ ID NO: 517934 - DNA, 25 bp, Homo sapien
tctggttactgctgtgtggctgcac

SEQ ID NO: 517935 - DNA, 25 bp, Homo sapien
aggcacttgtacaaattcccggaat

SEQ ID NO: 517936 - DNA, 25 bp, Homo sapien
attcccggaatgctttcttgtgttt

SEQ ID NO: 517937 - DNA, 25 bp, Homo sapien
aattccagagatcctgaccaggcat

SEQ ID NO: 517938 - DNA, 25 bp, Homo sapien
gaccaggcatcgaatcaagctgcta

SEQ ID NO: 517939 - DNA, 25 bp, Homo sapien
aatcaagctgctatggatacacgaa

SEQ ID NO: 517940 - DNA, 25 bp, Homo sapien
tggatacacgaagcaggtttcaact

SEQ ID NO: 517941 - DNA, 25 bp, Homo sapien
actgcccacagctgagttaataatc

SEQ ID NO: 517942 - DNA, 25 bp, Homo sapien
aagacctcggcttccaagcctggga

SEQ ID NO: 517943 - DNA, 25 bp, Homo sapien
agcctgggatgaaccattttccctt

SEQ ID NO: 517944 - DNA, 25 bp, Homo sapien
attttcccttggtagcgtgctgtta

SEQ ID NO: 517945 - DNA, 25 bp, Homo sapien
agcgtgctgttaccagagcaactcc

SEQ ID NO: 517946 - DNA, 25 bp, Homo sapien
gcagttaagtaattcatcacttcat

SEQ ID NO: 517947 - DNA, 25 bp, Homo sapien
ttcatcacttcatatttttaccaaa

SEQ ID NO: 517948 - DNA, 25 bp, Homo sapien
tacaagtctgtttatctggatctgg

SEQ ID NO: 517949 - DNA, 25 bp, Homo sapien
tttatctggatctggcaaactggaa

SEQ ID NO: 517950 - DNA, 25 bp, Homo sapien
atgtttgaagggatactcaggcttt

SEQ ID NO: 517951 - DNA, 25 bp, Homo sapien
tactcaggctttgatccatgccaac

SEQ ID NO: 517952 - DNA, 25 bp, Homo sapien
ccatgccaacatgaaaggactccaa

SEQ ID NO: 517953 - DNA, 25 bp, Homo sapien
gaaaggactccaagcacatttaagt

SEQ ID NO: 517954 - DNA, 25 bp, Homo sapien
gcacatttaagtaggctggtctttt

SEQ ID NO: 517955 - DNA, 25 bp, Homo sapien
ctggtcttttcatcatgcatgattt

SEQ ID NO: 517956 - DNA, 25 bp, Homo sapien
gaacagtatacagtatcctttgtaa

SEQ ID NO: 517957 - DNA, 25 bp, Homo sapien
gcaatggctttatctgaaacatgaa

SEQ ID NO: 517958 - DNA, 25 bp, Homo sapien
caatggctttatctgaaacatgaaa

SEQ ID NO: 517959 - DNA, 25 bp, Homo sapien
aatggctttatctgaaacatgaaag

SEQ ID NO: 517960 - DNA, 25 bp, Homo sapien
atggctttatctgaaacatgaaaga

SEQ ID NO: 517961 - DNA, 25 bp, Homo sapien
tggctttatctgaaacatgaaagat

SEQ ID NO: 517962 - DNA, 25 bp, Homo sapien
ggctttatctgaaacatgaaagata

SEQ ID NO: 517963 - DNA, 25 bp, Homo sapien
gctttatctgaaacatgaaagataa

SEQ ID NO: 517964 - DNA, 25 bp, Homo sapien
agataaacttttttggctgggtgca

SEQ ID NO: 517965 - DNA, 25 bp, Homo sapien
ttgggaggcgggtggattgcctgac

SEQ ID NO: 517966 - DNA, 25 bp, Homo sapien
gggtgaggtaggagaattgcttgag

SEQ ID NO: 517967 - DNA, 25 bp, Homo sapien
ggtgaggtaggagaattgcttgagc

SEQ ID NO: 517968 - DNA, 25 bp, Homo sapien
atggttgcaacatttaacttctcgc

SEQ ID NO: 517969 - DNA, 25 bp, Homo sapien
ttaacttctcgcacatggttcccgt

SEQ ID NO: 517970 - DNA, 25 bp, Homo sapien
tcctctggagctctgtcttgtcggg

SEQ ID NO: 517971 - DNA, 25 bp, Homo sapien
ggagatgggcatgttgtataccaaa

SEQ ID NO: 517972 - DNA, 25 bp, Homo sapien
gtacaaagtgttgcagggctgtgac

SEQ ID NO: 517973 - DNA, 25 bp, Homo sapien
ggctgtgacacaatagggactctat

SEQ ID NO: 517974 - DNA, 25 bp, Homo sapien
gggcagtctgtaaatcagtcacctg

SEQ ID NO: 517975 - DNA, 25 bp, Homo sapien
tgtaaatcagtcacctgtgttgctg

SEQ ID NO: 517976 - DNA, 25 bp, Homo sapien
tgcaggccaaggtagaaacgccctc

SEQ ID NO: 517977 - DNA, 25 bp, Homo sapien
aaacgccctccgtgtgtgcatattt

SEQ ID NO: 517978 - DNA, 25 bp, Homo sapien
gtgcatatttgttggttctctgatt

SEQ ID NO: 517979 - DNA, 25 bp, Homo sapien
atccaggagagggagtcctttgcca

SEQ ID NO: 517980 - DNA, 25 bp, Homo sapien
gagtcctttgccaactgatgaccaa

SEQ ID NO: 517981 - DNA, 25 bp, Homo sapien
tgatgaccaacagttccaagccaga

SEQ ID NO: 517982 - DNA, 25 bp, Homo sapien
acagttccaagccagatagtctcgt

SEQ ID NO: 517983 - DNA, 25 bp, Homo sapien
agccagatagtctcgtgaacagtga

SEQ ID NO: 517984 - DNA, 25 bp, Homo sapien
gtctcgtgaacagtgacaatacaga

SEQ ID NO: 517985 - DNA, 25 bp, Homo sapien
aaacttgaatataggtgggagacat

SEQ ID NO: 517986 - DNA, 25 bp, Homo sapien
gtgacaggacaaataatcattactt

SEQ ID NO: 517987 - DNA, 25 bp, Homo sapien
attactttcaattcatgactgcttt

SEQ ID NO: 517988 - DNA, 25 bp, Homo sapien
aatcatttgtatacaaaccagggag

SEQ ID NO: 517989 - DNA, 25 bp, Homo sapien
gagagttttctttacacccttgaca

SEQ ID NO: 517990 - DNA, 25 bp, Homo sapien
aaatttgtgcatggctttttgttgt

SEQ ID NO: 517991 - DNA, 25 bp, Homo sapien
ttgttgcttagtaactggtagagga

SEQ ID NO: 517992 - DNA, 25 bp, Homo sapien
tcctcacagtcttttcaaaggtaca

SEQ ID NO: 517993 - DNA, 25 bp, Homo sapien
aatctgactggcctaatcgatggaa

SEQ ID NO: 517994 - DNA, 25 bp, Homo sapien
atcgatggaaaagaccctgtccttt

SEQ ID NO: 517995 - DNA, 25 bp, Homo sapien
atcctgcaatcctccgtgcagagga

SEQ ID NO: 517996 - DNA, 25 bp, Homo sapien
gcagaggaactacactgttgtattc

SEQ ID NO: 517997 - DNA, 25 bp, Homo sapien
acactgttgtattctagtaattcac

SEQ ID NO: 517998 - DNA, 25 bp, Homo sapien
ctgtgatttataacaaaccggtgat

SEQ ID NO: 517999 - DNA, 25 bp, Homo sapien
accggtgatgtcattctattgtgca

SEQ ID NO: 518000 - DNA, 25 bp, Homo sapien
ctattgtgcacttttgtcaaaccat

SEQ ID NO: 518001 - DNA, 25 bp, Homo sapien
caggacaaacttaccctgatgttgt

SEQ ID NO: 518002 - DNA, 25 bp, Homo sapien
ttagatgaccagttgctttgatttc

SEQ ID NO: 518003 - DNA, 25 bp, Homo sapien
tggtttgctgtgtggcatgcctaca

SEQ ID NO: 518004 - DNA, 25 bp, Homo sapien
gcatgcctacatggagggaacacac

SEQ ID NO: 518005 - DNA, 25 bp, Homo sapien
agggaacacactgagccaatgattt

SEQ ID NO: 518006 - DNA, 25 bp, Homo sapien
aatgatttcatcatctgggtccctt

SEQ ID NO: 518007 - DNA, 25 bp, Homo sapien
tgggtccctttggtttatatcagtt

SEQ ID NO: 518008 - DNA, 25 bp, Homo sapien
atatcagtttccaacatgacttgtt

SEQ ID NO: 518009 - DNA, 25 bp, Homo sapien
atacatcggccccaggattctaaca

SEQ ID NO: 518010 - DNA, 25 bp, Homo sapien
gattctaacatctcctggtctctga

SEQ ID NO: 518011 - DNA, 25 bp, Homo sapien
catctcctggtctctgaggttataa

SEQ ID NO: 518012 - DNA, 25 bp, Homo sapien
atgggcactgtctggccgggcttca

SEQ ID NO: 518013 - DNA, 25 bp, Homo sapien
gtctggccgggcttcatggctgaca

SEQ ID NO: 518014 - DNA, 25 bp, Homo sapien
gggcttcatggctgacattccaggt

SEQ ID NO: 518015 - DNA, 25 bp, Homo sapien
gtaattaccacttaccctggtcaat

SEQ ID NO: 518016 - DNA, 25 bp, Homo sapien
atggctgacattccaggtcctccca

SEQ ID NO: 518017 - DNA, 25 bp, Homo sapien
tgctgctcatctctgctggcacaga

SEQ ID NO: 518018 - DNA, 25 bp, Homo sapien
ggcacagaagtctcttccctggtct

SEQ ID NO: 518019 - DNA, 25 bp, Homo sapien
cctggtcaatgggtccgagagattc

SEQ ID NO: 518020 - DNA, 25 bp, Homo sapien
gtccgagagattccccttgtaggca

SEQ ID NO: 518021 - DNA, 25 bp, Homo sapien
agattccccttgtaggcagggctgt

SEQ ID NO: 518022 - DNA, 25 bp, Homo sapien
caggaggtcccatgggcactgtctg

SEQ ID NO: 518023 - DNA, 25 bp, Homo sapien
aactactgtgtgcaaattatacctt

SEQ ID NO: 518024 - DNA, 25 bp, Homo sapien
gtgcaaattataccttggaccatat

SEQ ID NO: 518025 - DNA, 25 bp, Homo sapien
tataccttggaccatataggcattg

SEQ ID NO: 518026 - DNA, 25 bp, Homo sapien
ataggcattgattaacttctttaag

SEQ ID NO: 518027 - DNA, 25 bp, Homo sapien
agagacccatctagataacagcaat

SEQ ID NO: 518028 - DNA, 25 bp, Homo sapien
gcaatcaacctgcttaattctgaat

SEQ ID NO: 518029 - DNA, 25 bp, Homo sapien
tcaacctgcttaattctgaatgaca

SEQ ID NO: 518030 - DNA, 25 bp, Homo sapien
aaaacttctacatgtatttttcaca

SEQ ID NO: 518031 - DNA, 25 bp, Homo sapien
tttttcacatgaagatctccttaac

SEQ ID NO: 518032 - DNA, 25 bp, Homo sapien
agatctccttaacaggttgccaacc

SEQ ID NO: 518033 - DNA, 25 bp, Homo sapien
acatttaaaatatggacgtctgaaa

SEQ ID NO: 518034 - DNA, 25 bp, Homo sapien
tccagagcccagcacctgtagtcct

SEQ ID NO: 518035 - DNA, 25 bp, Homo sapien
ctgtagtcctaactattcagattcc

SEQ ID NO: 518036 - DNA, 25 bp, Homo sapien
tgtagtcctaactattcagattcct

SEQ ID NO: 518037 - DNA, 25 bp, Homo sapien
gtagtcctaactattcagattcctt

SEQ ID NO: 518038 - DNA, 25 bp, Homo sapien
tagtcctaactattcagattccttg

SEQ ID NO: 518039 - DNA, 25 bp, Homo sapien
agtcctaactattcagattccttga

SEQ ID NO: 518040 - DNA, 25 bp, Homo sapien
gtcctaactattcagattccttgag

SEQ ID NO: 518041 - DNA, 25 bp, Homo sapien
tcctaactattcagattccttgagc

SEQ ID NO: 518042 - DNA, 25 bp, Homo sapien
cctaactattcagattccttgagcc

SEQ ID NO: 518043 - DNA, 25 bp, Homo sapien
ctaactattcagattccttgagccc

SEQ ID NO: 518044 - DNA, 25 bp, Homo sapien
taactattcagattccttgagccca

SEQ ID NO: 518045 - DNA, 25 bp, Homo sapien
gtggataacttttcactgatttagt

SEQ ID NO: 518046 - DNA, 25 bp, Homo sapien
cactgatttagttacttgactgtag

SEQ ID NO: 518047 - DNA, 25 bp, Homo sapien
taggaaacactgttgctttgcacgc

SEQ ID NO: 518048 - DNA, 25 bp, Homo sapien
ttgctttgcacgctgtgagaggttt

SEQ ID NO: 518049 - DNA, 25 bp, Homo sapien
tgagaggtttgcactgttacagatg

SEQ ID NO: 518050 - DNA, 25 bp, Homo sapien
tcaaaaataacatcggctctttggg

SEQ ID NO: 518051 - DNA, 25 bp, Homo sapien
gtgtctgtttccttggttgtctcac

SEQ ID NO: 518052 - DNA, 25 bp, Homo sapien
ttgtctcacgccactggaacattga

SEQ ID NO: 518053 - DNA, 25 bp, Homo sapien
caagtaactctaatcagcgtgcaaa

SEQ ID NO: 518054 - DNA, 25 bp, Homo sapien
aatcagcgtgcaaaggcgtgcatat

SEQ ID NO: 518055 - DNA, 25 bp, Homo sapien
ggcgtgcatatatatctgctatgta

SEQ ID NO: 518056 - DNA, 25 bp, Homo sapien
tttgcatttaatttcctgtggtttg

SEQ ID NO: 518057 - DNA, 25 bp, Homo sapien
aagtgcaactgctactgaccatctg

SEQ ID NO: 518058 - DNA, 25 bp, Homo sapien
taagctggcctcctagggttagtat

SEQ ID NO: 518059 - DNA, 25 bp, Homo sapien
tgaccatctgcactggcatctagtc

SEQ ID NO: 518060 - DNA, 25 bp, Homo sapien
ggcatctagtcaagcgattgtctga

SEQ ID NO: 518061 - DNA, 25 bp, Homo sapien
aaggattttggagattcccatctga

SEQ ID NO: 518062 - DNA, 25 bp, Homo sapien
gattcccatctgatattcttctatt

SEQ ID NO: 518063 - DNA, 25 bp, Homo sapien
tattcttctatttggtctcttgtac

SEQ ID NO: 518064 - DNA, 25 bp, Homo sapien
ttgtacccattgtcatcctgtacca

SEQ ID NO: 518065 - DNA, 25 bp, Homo sapien
ttaattcctctttccctcatttttg

SEQ ID NO: 518066 - DNA, 25 bp, Homo sapien
tccctcatttttgtcatgtttgcaa

SEQ ID NO: 518067 - DNA, 25 bp, Homo sapien
cagccagaaacacagccgcagaact

SEQ ID NO: 518068 - DNA, 25 bp, Homo sapien
acagccgcagaactgagcccaagct

SEQ ID NO: 518069 - DNA, 25 bp, Homo sapien
cagaccaaaaactgagcccaagctc

SEQ ID NO: 518070 - DNA, 25 bp, Homo sapien
actggcccaggcaaagtgaccactg

SEQ ID NO: 518071 - DNA, 25 bp, Homo sapien
aatgtggaaccatggacgctatgtg

SEQ ID NO: 518072 - DNA, 25 bp, Homo sapien
aaccatggacgctatgtgagccagt

SEQ ID NO: 518073 - DNA, 25 bp, Homo sapien
tggacgctatgtgagccagtgtgct

SEQ ID NO: 518074 - DNA, 25 bp, Homo sapien
tatgtgagccagtgtgctccctagc

SEQ ID NO: 518075 - DNA, 25 bp, Homo sapien
ctccctagccgtccagaaaaacaag

SEQ ID NO: 518076 - DNA, 25 bp, Homo sapien
aacaaggcccacttgtacattctgc

SEQ ID NO: 518077 - DNA, 25 bp, Homo sapien
cgggtatcctgatgcagaccatccc

SEQ ID NO: 518078 - DNA, 25 bp, Homo sapien
ttcctcagcttcaccttgatactgg

SEQ ID NO: 518079 - DNA, 25 bp, Homo sapien
ttgatactgggcctcttccttgtca

SEQ ID NO: 518080 - DNA, 25 bp, Homo sapien
ttccttgtcatgtctgaagctgtgg

SEQ ID NO: 518081 - DNA, 25 bp, Homo sapien
agacctggacttttgtctgcttaag

SEQ ID NO: 518082 - DNA, 25 bp, Homo sapien
ggacttttgtctgcttaagggaaat

SEQ ID NO: 518083 - DNA, 25 bp, Homo sapien
gcacagtggacagggagacctcaca

SEQ ID NO: 518084 - DNA, 25 bp, Homo sapien
aaggcctggaaggtgatttcccgtg

SEQ ID NO: 518085 - DNA, 25 bp, Homo sapien
gatttcccgtgtgactcatggatag

SEQ ID NO: 518086 - DNA, 25 bp, Homo sapien
tgtgttccatgtaccattaatcttg

SEQ ID NO: 518087 - DNA, 25 bp, Homo sapien
attaatcttgacatatgccatgcat

SEQ ID NO: 518088 - DNA, 25 bp, Homo sapien
tatgccatgcataaagacttcctat

SEQ ID NO: 518089 - DNA, 25 bp, Homo sapien
gccgggctgtgctggaaaccatcag

SEQ ID NO: 518090 - DNA, 25 bp, Homo sapien
aaaccatcagaacttacctcaccat

SEQ ID NO: 518091 - DNA, 25 bp, Homo sapien
gacactcagttggtgaacagtctcc

SEQ ID NO: 518092 - DNA, 25 bp, Homo sapien
gtgaacagtctcctggaaaaagcca

SEQ ID NO: 518093 - DNA, 25 bp, Homo sapien
agtgagaaggtgctcgaccctgcca

SEQ ID NO: 518094 - DNA, 25 bp, Homo sapien
actttaccagattgtctgtcctgga

SEQ ID NO: 518095 - DNA, 25 bp, Homo sapien
ctggacctggtcgtggccttggctc

SEQ ID NO: 518096 - DNA, 25 bp, Homo sapien
ttggctccgtgtgctgacgaagctg

SEQ ID NO: 518097 - DNA, 25 bp, Homo sapien
gacgaagctgccatcagtaagctat

SEQ ID NO: 518098 - DNA, 25 bp, Homo sapien
agtaagctatactccaccatccggc

SEQ ID NO: 518099 - DNA, 25 bp, Homo sapien
cggccctacctagattgctaacaaa

SEQ ID NO: 518100 - DNA, 25 bp, Homo sapien
agcagagtgtgcatctgagctccgc

SEQ ID NO: 518101 - DNA, 25 bp, Homo sapien
agagtgtgcatctgagctccgcctg

SEQ ID NO: 518102 - DNA, 25 bp, Homo sapien
ctggctcaggctgtccaaatctgaa

SEQ ID NO: 518103 - DNA, 25 bp, Homo sapien
ggctgtccaaatctgaatcacctgc

SEQ ID NO: 518104 - DNA, 25 bp, Homo sapien
aaatctgaatcacctgcccaagctc

SEQ ID NO: 518105 - DNA, 25 bp, Homo sapien
acacagccgtgggagctggtgcagc

SEQ ID NO: 518106 - DNA, 25 bp, Homo sapien
tgcagggatggctggacctccacct

SEQ ID NO: 518107 - DNA, 25 bp, Homo sapien
ggtgaagaccttatcggtgctttct

SEQ ID NO: 518108 - DNA, 25 bp, Homo sapien
ttatcggtgctttctccgcgatcat

SEQ ID NO: 518109 - DNA, 25 bp, Homo sapien
gccaaggatgtggaccttcccgtca

SEQ ID NO: 518110 - DNA, 25 bp, Homo sapien
tggaccttcccgtcacacacagtga

SEQ ID NO: 518111 - DNA, 25 bp, Homo sapien
ctggatccagatacagctcatcacg

SEQ ID NO: 518112 - DNA, 25 bp, Homo sapien
gctcatcacgaactaattctctctg

SEQ ID NO: 518113 - DNA, 25 bp, Homo sapien
aattctctctgaggatcggagacaa

SEQ ID NO: 518114 - DNA, 25 bp, Homo sapien
aagtgactcgtggatacacccagga

SEQ ID NO: 518115 - DNA, 25 bp, Homo sapien
gagaatcaggacacatcttccagga

SEQ ID NO: 518116 - DNA, 25 bp, Homo sapien
tcttccaggagatttactgccttcc

SEQ ID NO: 518117 - DNA, 25 bp, Homo sapien
ttcccctgtgtcttgggttgtgaag

SEQ ID NO: 518118 - DNA, 25 bp, Homo sapien
tgtgaaggcttcacctcaggaagac

SEQ ID NO: 518119 - DNA, 25 bp, Homo sapien
cacctcaggaagacgttactttgaa

SEQ ID NO: 518120 - DNA, 25 bp, Homo sapien
tggcatgaagcaagagcctcagtct

SEQ ID NO: 518121 - DNA, 25 bp, Homo sapien
tcagtctggattctggaccctcagg

SEQ ID NO: 518122 - DNA, 25 bp, Homo sapien
agaagccttactcctgtaatgtgtg

SEQ ID NO: 518123 - DNA, 25 bp, Homo sapien
atctcaaccagcacctgagagttca

SEQ ID NO: 518124 - DNA, 25 bp, Homo sapien
gagttcacacccaggagacacttta

SEQ ID NO: 518125 - DNA, 25 bp, Homo sapien
actttatcagtgtcaacgttgccag

SEQ ID NO: 518126 - DNA, 25 bp, Homo sapien
agtgtcaacgttgccagaaagcctt

SEQ ID NO: 518127 - DNA, 25 bp, Homo sapien
cagaaagcctttcggtgccactcga

SEQ ID NO: 518128 - DNA, 25 bp, Homo sapien
ccgccatcagcgtgtacacaacaag

SEQ ID NO: 518129 - DNA, 25 bp, Homo sapien
gcaatactgcctgtagccattgggt

SEQ ID NO: 518130 - DNA, 25 bp, Homo sapien
gcagagtcccagaatatgagaccgt

SEQ ID NO: 518131 - DNA, 25 bp, Homo sapien
atgagaccgttactcggatgttgaa

SEQ ID NO: 518132 - DNA, 25 bp, Homo sapien
gttggaaactatcccattgcaagtt

SEQ ID NO: 518133 - DNA, 25 bp, Homo sapien
aaggctggaagggaccatgatacca

SEQ ID NO: 518134 - DNA, 25 bp, Homo sapien
gggaccatgataccaaagcggatta

SEQ ID NO: 518135 - DNA, 25 bp, Homo sapien
gcggattaaagtgcattgacttcac

SEQ ID NO: 518136 - DNA, 25 bp, Homo sapien
tatgtacaaaaaagccctccttagg

SEQ ID NO: 518137 - DNA, 25 bp, Homo sapien
gtgtaagtaaactctccttgttcct

SEQ ID NO: 518138 - DNA, 25 bp, Homo sapien
tttctctgaagctgtcttccttgca

SEQ ID NO: 518139 - DNA, 25 bp, Homo sapien
tcttccttgcagtctaagaatcctg

SEQ ID NO: 518140 - DNA, 25 bp, Homo sapien
agtctaagaatcctgtgctgtattt

SEQ ID NO: 518141 - DNA, 25 bp, Homo sapien
atttggtcacaaatttccagtctat

SEQ ID NO: 518142 - DNA, 25 bp, Homo sapien
gtctataattttgttgtagcccttt

SEQ ID NO: 518143 - DNA, 25 bp, Homo sapien
tttaatttttgcagccagagtggga

SEQ ID NO: 518144 - DNA, 25 bp, Homo sapien
ttatcgttcagtacaacaggcccat

SEQ ID NO: 518145 - DNA, 25 bp, Homo sapien
gtacaacaggcccatcagtgatttt

SEQ ID NO: 518146 - DNA, 25 bp, Homo sapien
cagtgattttttgaccttgcactcc

SEQ ID NO: 518147 - DNA, 25 bp, Homo sapien
ttgcactccatcatcattagcctag

SEQ ID NO: 518148 - DNA, 25 bp, Homo sapien
catcattagcctagttgaagccgga

SEQ ID NO: 518149 - DNA, 25 bp, Homo sapien
cggagctcacactgacatgacgaat

SEQ ID NO: 518150 - DNA, 25 bp, Homo sapien
cagaataagactccgctagacaaaa

SEQ ID NO: 518151 - DNA, 25 bp, Homo sapien
agatgagtctcaagtgcctggctgc

SEQ ID NO: 518152 - DNA, 25 bp, Homo sapien
agcagttcgggctaatgacattaac

SEQ ID NO: 518153 - DNA, 25 bp, Homo sapien
ttaactaccaagaccagatccccag

SEQ ID NO: 518154 - DNA, 25 bp, Homo sapien
cagatccccagaactcttgaagagt

SEQ ID NO: 518155 - DNA, 25 bp, Homo sapien
ccgggctgtgctggaaaccatcaga

SEQ ID NO: 518156 - DNA, 25 bp, Homo sapien
ggctgtgctggaaaccatcagaact

SEQ ID NO: 518157 - DNA, 25 bp, Homo sapien
tggaaaccatcagaacttacctcac

SEQ ID NO: 518158 - DNA, 25 bp, Homo sapien
aaaccatcagaacttacctcaccat

SEQ ID NO: 518159 - DNA, 25 bp, Homo sapien
gacactcagttggtgaacagtctcc

SEQ ID NO: 518160 - DNA, 25 bp, Homo sapien
cagttggtgaacagtctcctggaaa

SEQ ID NO: 518161 - DNA, 25 bp, Homo sapien
gtgaacagtctcctggaaaaagcca

SEQ ID NO: 518162 - DNA, 25 bp, Homo sapien
acagtctcctggaaaaagccagtga

SEQ ID NO: 518163 - DNA, 25 bp, Homo sapien
gccagtgagaaggtgctcgaccctg

SEQ ID NO: 518164 - DNA, 25 bp, Homo sapien
agtgagaaggtgctcgaccctgcca

SEQ ID NO: 518165 - DNA, 25 bp, Homo sapien
tgagaaggtgctcgaccctgccagc

SEQ ID NO: 518166 - DNA, 25 bp, Homo sapien
gcccaggctctagatcacatggcat

SEQ ID NO: 518167 - DNA, 25 bp, Homo sapien
tctagatcacatggcatcaggctgg

SEQ ID NO: 518168 - DNA, 25 bp, Homo sapien
aggcatagctattgtctcgggcatc

SEQ ID NO: 518169 - DNA, 25 bp, Homo sapien
attgtctcgggcatccttcccaggg

SEQ ID NO: 518170 - DNA, 25 bp, Homo sapien
tcccagggttgggtcttacacaaat

SEQ ID NO: 518171 - DNA, 25 bp, Homo sapien
acacaaatagaaggctcttgctctg

SEQ ID NO: 518172 - DNA, 25 bp, Homo sapien
tcttgctctgagttatgtgacatgc

SEQ ID NO: 518173 - DNA, 25 bp, Homo sapien
gagttatgtgacatgcctcagcccc

SEQ ID NO: 518174 - DNA, 25 bp, Homo sapien
gcctcagccccatggactaagcagg

SEQ ID NO: 518175 - DNA, 25 bp, Homo sapien
ggtctggtataaaaacactcctgga

SEQ ID NO: 518176 - DNA, 25 bp, Homo sapien
aacgcctttgccctgatccaaatgt

SEQ ID NO: 518177 - DNA, 25 bp, Homo sapien
ttaggagtgcagaaatttgacctgg

SEQ ID NO: 518178 - DNA, 25 bp, Homo sapien
gggatcatctgtgttgacaacaaga

SEQ ID NO: 518179 - DNA, 25 bp, Homo sapien
gagatagaaatgtcccaaccgatgt

SEQ ID NO: 518180 - DNA, 25 bp, Homo sapien
tgtcccaaccgatgtgctttctttt

SEQ ID NO: 518181 - DNA, 25 bp, Homo sapien
ttttccatttcatgagcatctgaaa

SEQ ID NO: 518182 - DNA, 25 bp, Homo sapien
gagcatctgaaagcaggtgaatttc

SEQ ID NO: 518183 - DNA, 25 bp, Homo sapien
ggtgaatttccccagcctgattttc

SEQ ID NO: 518184 - DNA, 25 bp, Homo sapien
gattttccagatgactacaatttgg

SEQ ID NO: 518185 - DNA, 25 bp, Homo sapien
acaatttgggagacattttcctagg

SEQ ID NO: 518186 - DNA, 25 bp, Homo sapien
gacattttcctaggagtggagtata

SEQ ID NO: 518187 - DNA, 25 bp, Homo sapien
gagtatatcttccatcagtgtaaag

SEQ ID NO: 518188 - DNA, 25 bp, Homo sapien
gagtagggtatcagggtgtcttttc

SEQ ID NO: 518189 - DNA, 25 bp, Homo sapien
tagggtatcagggtgtcttttctgc

SEQ ID NO: 518190 - DNA, 25 bp, Homo sapien
gaaaataagctttgtgcatctgtat

SEQ ID NO: 518191 - DNA, 25 bp, Homo sapien
aagctttgtgcatctgtatttgaga

SEQ ID NO: 518192 - DNA, 25 bp, Homo sapien
gagatatgttaatgacgtggagtaa

SEQ ID NO: 518193 - DNA, 25 bp, Homo sapien
gtcagctgtaagactctggaggcaa

SEQ ID NO: 518194 - DNA, 25 bp, Homo sapien
gactctggaggcaaacaagttgtat

SEQ ID NO: 518195 - DNA, 25 bp, Homo sapien
tatatggttcatatggctctatggg

SEQ ID NO: 518196 - DNA, 25 bp, Homo sapien
tttaagtaatggtgaaatggtccca

SEQ ID NO: 518197 - DNA, 25 bp, Homo sapien
aatggtcccattggagagtctccta

SEQ ID NO: 518198 - DNA, 25 bp, Homo sapien
gagagtctcctaaatagaccttcca

SEQ ID NO: 518199 - DNA, 25 bp, Homo sapien
gagagacaagaaaccaaagcttgct

SEQ ID NO: 518200 - DNA, 25 bp, Homo sapien
gaaaccaaagcttgctaaaatgttt

SEQ ID NO: 518201 - DNA, 25 bp, Homo sapien
gggtgtggttatattctgtatcaaa

SEQ ID NO: 518202 - DNA, 25 bp, Homo sapien
ctgtatcaaaattggaagtgccttc

SEQ ID NO: 518203 - DNA, 25 bp, Homo sapien
ttggaagtgccttccttccacatta

SEQ ID NO: 518204 - DNA, 25 bp, Homo sapien
ttccacattacctaagaaccagtta

SEQ ID NO: 518205 - DNA, 25 bp, Homo sapien
gaaccagttaggactctgaagacac

SEQ ID NO: 518206 - DNA, 25 bp, Homo sapien
gttaggactctgaagacaccacaag

SEQ ID NO: 518207 - DNA, 25 bp, Homo sapien
gactctgaagacaccacaagagtga

SEQ ID NO: 518208 - DNA, 25 bp, Homo sapien
tctggaggcagagacgggatcaaat

SEQ ID NO: 518209 - DNA, 25 bp, Homo sapien
gcagagacgggatcaaatgagcccc

SEQ ID NO: 518210 - DNA, 25 bp, Homo sapien
gtgcagatgaaaagtccctttgact

SEQ ID NO: 518211 - DNA, 25 bp, Homo sapien
cctttgactttcacacaaccggatg

SEQ ID NO: 518212 - DNA, 25 bp, Homo sapien
acaaccggatgtggaggatggcaat

SEQ ID NO: 518213 - DNA, 25 bp, Homo sapien
atatcctttatgtgcagacatcccc

SEQ ID NO: 518214 - DNA, 25 bp, Homo sapien
ttccttcagaggcagtgttcatagt

SEQ ID NO: 518215 - DNA, 25 bp, Homo sapien
aggactgtttttccctggatgtgat

SEQ ID NO: 518216 - DNA, 25 bp, Homo sapien
gtttccaagttgtgagcagagtcga

SEQ ID NO: 518217 - DNA, 25 bp, Homo sapien
gagtcgaaatcttggtggacaccac

SEQ ID NO: 518218 - DNA, 25 bp, Homo sapien
tggtggacaccacgcctaagtggat

SEQ ID NO: 518219 - DNA, 25 bp, Homo sapien
ctaagtggatttttctgcaggtaca

SEQ ID NO: 518220 - DNA, 25 bp, Homo sapien
aggtacagaatttcacagttcaaga

SEQ ID NO: 518221 - DNA, 25 bp, Homo sapien
aatgacattctattttgagaaggga

SEQ ID NO: 518222 - DNA, 25 bp, Homo sapien
tgagaagggaagacaatgctgaaga

SEQ ID NO: 518223 - DNA, 25 bp, Homo sapien
ctgttgattgaaatgctgacagggt

SEQ ID NO: 518224 - DNA, 25 bp, Homo sapien
ggtggagaacgaatttgaagacagt

SEQ ID NO: 518225 - DNA, 25 bp, Homo sapien
aaactatgaactatgctaatggtaa

SEQ ID NO: 518226 - DNA, 25 bp, Homo sapien
aaattgtgtagtatcttgctgagaa

SEQ ID NO: 518227 - DNA, 25 bp, Homo sapien
agtatcttgctgagaatctaattct

SEQ ID NO: 518228 - DNA, 25 bp, Homo sapien
gaatctaattctatcttgtaaaatc

SEQ ID NO: 518229 - DNA, 25 bp, Homo sapien
tgtaaaatcaatccaaatgtgtatt

SEQ ID NO: 518230 - DNA, 25 bp, Homo sapien
aatgtgtattgtgaaacacctgtat

SEQ ID NO: 518231 - DNA, 25 bp, Homo sapien
tgtgaaacacctgtataaaatcatt

SEQ ID NO: 518232 - DNA, 25 bp, Homo sapien
caaggaccactgaggttttgtggtt

SEQ ID NO: 518233 - DNA, 25 bp, Homo sapien
aagcagaggagcatgatccacccca

SEQ ID NO: 518234 - DNA, 25 bp, Homo sapien
cacaacccagagatgaagctgggag

SEQ ID NO: 518235 - DNA, 25 bp, Homo sapien
ctttcttttcctcacagtgacagag

SEQ ID NO: 518236 - DNA, 25 bp, Homo sapien
ccaccacacttgacctgtctggagg

SEQ ID NO: 518237 - DNA, 25 bp, Homo sapien
ttgacctgtctggaggccacatgaa

SEQ ID NO: 518238 - DNA, 25 bp, Homo sapien
gtctggaggccacatgaagccttga

SEQ ID NO: 518239 - DNA, 25 bp, Homo sapien
atgaagccttgatgcgctggcatct

SEQ ID NO: 518240 - DNA, 25 bp, Homo sapien
ccttgatgcgctggcatctgacctg

SEQ ID NO: 518241 - DNA, 25 bp, Homo sapien
aaaggacatggcaaggaccactgag

SEQ ID NO: 518242 - DNA, 25 bp, Homo sapien
acatggcaaggaccactgaggtttt

SEQ ID NO: 518243 - DNA, 25 bp, Homo sapien
ttctcatctgtattggaggtagcag

SEQ ID NO: 518244 - DNA, 25 bp, Homo sapien
tagctctgccttcaggcatgcaata

SEQ ID NO: 518245 - DNA, 25 bp, Homo sapien
atgcaatatgccagaactacagaca

SEQ ID NO: 518246 - DNA, 25 bp, Homo sapien
agacaacagcccacaggatgcaaaa

SEQ ID NO: 518247 - DNA, 25 bp, Homo sapien
aagtgctttgccatcttaaaaatgc

SEQ ID NO: 518248 - DNA, 25 bp, Homo sapien
aaatgccagatcactcagagcctat

SEQ ID NO: 518249 - DNA, 25 bp, Homo sapien
gtggatatcaacaccaggtctctag

SEQ ID NO: 518250 - DNA, 25 bp, Homo sapien
aggtctctagcaccgctggatgaaa

SEQ ID NO: 518251 - DNA, 25 bp, Homo sapien
aaggcagtagctcatcacttgggta

SEQ ID NO: 518252 - DNA, 25 bp, Homo sapien
agctcatcacttgggtagcaggtac

SEQ ID NO: 518253 - DNA, 25 bp, Homo sapien
ttttaggaccctacactcaaatgtg

SEQ ID NO: 518254 - DNA, 25 bp, Homo sapien
gtacttaatcttaaatacgctgagt

SEQ ID NO: 518255 - DNA, 25 bp, Homo sapien
atttcagtaagtgcggtaagttcta

SEQ ID NO: 518256 - DNA, 25 bp, Homo sapien
agtgcggtaagttctattgagtaca

SEQ ID NO: 518257 - DNA, 25 bp, Homo sapien
aggatggagaggacctttaccactg

SEQ ID NO: 518258 - DNA, 25 bp, Homo sapien
tttaccactgtatctcttaagctgt

SEQ ID NO: 518259 - DNA, 25 bp, Homo sapien
tcttaagctgtatgatttttctcca

SEQ ID NO: 518260 - DNA, 25 bp, Homo sapien
tttttctccagtttgttttatacag

SEQ ID NO: 518261 - DNA, 25 bp, Homo sapien
gtgtgtactgaatactgcatatgta

SEQ ID NO: 518262 - DNA, 25 bp, Homo sapien
gtattattctgattgtttgctctag

SEQ ID NO: 518263 - DNA, 25 bp, Homo sapien
gattgtttgctctagtttactacca

SEQ ID NO: 518264 - DNA, 25 bp, Homo sapien
ctaccaataaaagtcctgttaatca

SEQ ID NO: 518265 - DNA, 25 bp, Homo sapien
gttcattttgtgattaaacctgcaa

SEQ ID NO: 518266 - DNA, 25 bp, Homo sapien
gattaaacctgcaaccatttttcca

SEQ ID NO: 518267 - DNA, 25 bp, Homo sapien
cctgcaaccatttttccattacttt

SEQ ID NO: 518268 - DNA, 25 bp, Homo sapien
ttttctatagttaatggttattgcc

SEQ ID NO: 518269 - DNA, 25 bp, Homo sapien
ggttattgccatgatttcttctgtt

SEQ ID NO: 518270 - DNA, 25 bp, Homo sapien
cttctgtttggttctactaagctag

SEQ ID NO: 518271 - DNA, 25 bp, Homo sapien
tctactaagctagaaagccagggtg

SEQ ID NO: 518272 - DNA, 25 bp, Homo sapien
gggtgaagttaatgataattcccat

SEQ ID NO: 518273 - DNA, 25 bp, Homo sapien
tttctgtaccatgagattgctgttg

SEQ ID NO: 518274 - DNA, 25 bp, Homo sapien
gattgctgttgatgactgaaatacc

SEQ ID NO: 518275 - DNA, 25 bp, Homo sapien
gatgactgaaataccaggtgcaaaa

SEQ ID NO: 518276 - DNA, 25 bp, Homo sapien
tgagccgtttgacaacactacctac

SEQ ID NO: 518277 - DNA, 25 bp, Homo sapien
acctacaagaacctgcagcatcatg

SEQ ID NO: 518278 - DNA, 25 bp, Homo sapien
gcagcatcatgactacagcacgtac

SEQ ID NO: 518279 - DNA, 25 bp, Homo sapien
actacagcacgtacaccttcttaga

SEQ ID NO: 518280 - DNA, 25 bp, Homo sapien
ttcttagacctcaacctcgaactct

SEQ ID NO: 518281 - DNA, 25 bp, Homo sapien
ctcaacctcgaactctcaaaattca

SEQ ID NO: 518282 - DNA, 25 bp, Homo sapien
tcaaaattcaggatgcctcagccct

SEQ ID NO: 518283 - DNA, 25 bp, Homo sapien
aggccgggagtcacctcgacactga

SEQ ID NO: 518284 - DNA, 25 bp, Homo sapien
gggccctcggtgtgaagatgaacct

SEQ ID NO: 518285 - DNA, 25 bp, Homo sapien
gtgaagatgaaccttccaccgtctt

SEQ ID NO: 518286 - DNA, 25 bp, Homo sapien
tcactgcatcctggagtgcaaaaat

SEQ ID NO: 518287 - DNA, 25 bp, Homo sapien
cgggacctccagtaagatactactt

SEQ ID NO: 518288 - DNA, 25 bp, Homo sapien
aagatactacttcagtcatgacact

SEQ ID NO: 518289 - DNA, 25 bp, Homo sapien
caagttgtcttaacgttactccagg

SEQ ID NO: 518290 - DNA, 25 bp, Homo sapien
gttactccaggaccacttgattttg

SEQ ID NO: 518291 - DNA, 25 bp, Homo sapien
aagagtgcacttaattcagaagcta

SEQ ID NO: 518292 - DNA, 25 bp, Homo sapien
cataatactatggatttctctttca

SEQ ID NO: 518293 - DNA, 25 bp, Homo sapien
ggatttctctttcattaagccttaa

SEQ ID NO: 518294 - DNA, 25 bp, Homo sapien
gggcatagcatacacttgtctaacg

SEQ ID NO: 518295 - DNA, 25 bp, Homo sapien
ttgtctaacggttcacacgtggcta

SEQ ID NO: 518296 - DNA, 25 bp, Homo sapien
acgtggctatgatcacaagcaactt

SEQ ID NO: 518297 - DNA, 25 bp, Homo sapien
aactttgaactggaatgctatttac

SEQ ID NO: 518298 - DNA, 25 bp, Homo sapien
ggaaccaggctggagaatgcttaca

SEQ ID NO: 518299 - DNA, 25 bp, Homo sapien
tctcctcaagaatccggagccttgg

SEQ ID NO: 518300 - DNA, 25 bp, Homo sapien
ggagccttggctgcttgttgcactg

SEQ ID NO: 518301 - DNA, 25 bp, Homo sapien
gcttgttgcactgcgcatacaatgt

SEQ ID NO: 518302 - DNA, 25 bp, Homo sapien
catacaatgtgatgccctggagagg

SEQ ID NO: 518303 - DNA, 25 bp, Homo sapien
gaggagacgaattcagatgcttaaa

SEQ ID NO: 518304 - DNA, 25 bp, Homo sapien
gatgcttttcctgatgaagcccaat

SEQ ID NO: 518305 - DNA, 25 bp, Homo sapien
gaagcccaatcatgcagagtatgcc

SEQ ID NO: 518306 - DNA, 25 bp, Homo sapien
gagtatgccagcaaataccttacag

SEQ ID NO: 518307 - DNA, 25 bp, Homo sapien
aataccttacagctcgaagcaccta

SEQ ID NO: 518308 - DNA, 25 bp, Homo sapien
tacagctcgaagcacctactacgtt

SEQ ID NO: 518309 - DNA, 25 bp, Homo sapien
ctataggtggaagtcaaggttctta

SEQ ID NO: 518310 - DNA, 25 bp, Homo sapien
gtcaaggttcttaaagcatcatgtt

SEQ ID NO: 518311 - DNA, 25 bp, Homo sapien
gcatcatgttgctgctattactgta

SEQ ID NO: 518312 - DNA, 25 bp, Homo sapien
gttgctgctattactgtaaacatta

SEQ ID NO: 518313 - DNA, 25 bp, Homo sapien
gtaattttatgcttaacactgtggg

SEQ ID NO: 518314 - DNA, 25 bp, Homo sapien
attgttaggattccagccctacact

SEQ ID NO: 518315 - DNA, 25 bp, Homo sapien
gccctacactgacaatcatctttta

SEQ ID NO: 518316 - DNA, 25 bp, Homo sapien
aagaatgtttgatgtttgttcccaa

SEQ ID NO: 518317 - DNA, 25 bp, Homo sapien
atgtttgttcccaatggttccttca

SEQ ID NO: 518318 - DNA, 25 bp, Homo sapien
ggttccttcatttgtgattacttca

SEQ ID NO: 518319 - DNA, 25 bp, Homo sapien
gtgattacttcaattctataggtgg

SEQ ID NO: 518320 - DNA, 25 bp, Homo sapien
agacctagcagtgtgaagccaaact

SEQ ID NO: 518321 - DNA, 25 bp, Homo sapien
ccccagccccggtgacatgaggaaa

SEQ ID NO: 518322 - DNA, 25 bp, Homo sapien
atgaggaaaccgtgaggcgctcagc

SEQ ID NO: 518323 - DNA, 25 bp, Homo sapien
tgaggttcatcgttcatctccttcc

SEQ ID NO: 518324 - DNA, 25 bp, Homo sapien
ctccttcctgcttggaatcagaatg

SEQ ID NO: 518325 - DNA, 25 bp, Homo sapien
gcttggaatcagaatgtcctcactg

SEQ ID NO: 518326 - DNA, 25 bp, Homo sapien
actgctgagtttctccgttttatgg

SEQ ID NO: 518327 - DNA, 25 bp, Homo sapien
ggaggaagtcccagccggaaacaca

SEQ ID NO: 518328 - DNA, 25 bp, Homo sapien
agtcccagccggaaacacagaaagg

SEQ ID NO: 518329 - DNA, 25 bp, Homo sapien
gagaaggatcaatcacagctgactc

SEQ ID NO: 518330 - DNA, 25 bp, Homo sapien
atcacagctgactcctcagaggtga

SEQ ID NO: 518331 - DNA, 25 bp, Homo sapien
aaagctagcgcctaggcctttgtca

SEQ ID NO: 518332 - DNA, 25 bp, Homo sapien
tgtcagcgctttggctgtgcaccaa

SEQ ID NO: 518333 - DNA, 25 bp, Homo sapien
ctgtgcaccaagttcttctgagatc

SEQ ID NO: 518334 - DNA, 25 bp, Homo sapien
ttctgagatctctgaactttcctag

SEQ ID NO: 518335 - DNA, 25 bp, Homo sapien
gaagctctttattaagggtcgtcct

SEQ ID NO: 518336 - DNA, 25 bp, Homo sapien
taagggtcgtccttcaagcttgtct

SEQ ID NO: 518337 - DNA, 25 bp, Homo sapien
ttcctcctaggcacttgactatggc

SEQ ID NO: 518338 - DNA, 25 bp, Homo sapien
actatggctccacatcagatgcagg

SEQ ID NO: 518339 - DNA, 25 bp, Homo sapien
gactggtagggcttctgatttctta

SEQ ID NO: 518340 - DNA, 25 bp, Homo sapien
agtaattaactttctgtgacgcaaa

SEQ ID NO: 518341 - DNA, 25 bp, Homo sapien
gcagctgtggctattttccagttgt

SEQ ID NO: 518342 - DNA, 25 bp, Homo sapien
gaggagttgtagtgaaaacttccag

SEQ ID NO: 518343 - DNA, 25 bp, Homo sapien
aaacttccagaatgtcagtaactct

SEQ ID NO: 518344 - DNA, 25 bp, Homo sapien
gtcagtaactctaaatatcctcaat

SEQ ID NO: 518345 - DNA, 25 bp, Homo sapien
tggtggtttgtttgaaaatacttca

SEQ ID NO: 518346 - DNA, 25 bp, Homo sapien
aatacttcaggaacctagaaggtag

SEQ ID NO: 518347 - DNA, 25 bp, Homo sapien
aaatgtgatttgaatttcagtggcc

SEQ ID NO: 518348 - DNA, 25 bp, Homo sapien
ggacataatgaccaaagacaacctt

SEQ ID NO: 518349 - DNA, 25 bp, Homo sapien
agacaacctttaacttccttctgct

SEQ ID NO: 518350 - DNA, 25 bp, Homo sapien
actgtcatggccaggaaagatacca

SEQ ID NO: 518351 - DNA, 25 bp, Homo sapien
aaagataccatctgttggccaagaa

SEQ ID NO: 518352 - DNA, 25 bp, Homo sapien
ggccaagaaggataccatgtgtgaa

SEQ ID NO: 518353 - DNA, 25 bp, Homo sapien
gagcacacagcaatggtatcaccta

SEQ ID NO: 518354 - DNA, 25 bp, Homo sapien
ggtatcacctagagaagttcacgca

SEQ ID NO: 518355 - DNA, 25 bp, Homo sapien
gaagttcacgcaactttgttgaatg

SEQ ID NO: 518356 - DNA, 25 bp, Homo sapien
gttgaatgtagttgacttttccaaa

SEQ ID NO: 518357 - DNA, 25 bp, Homo sapien
atttgccaacaacgaatatcctttt

SEQ ID NO: 518358 - DNA, 25 bp, Homo sapien
aacgaatatcctttttctaaatcag

SEQ ID NO: 518359 - DNA, 25 bp, Homo sapien
taaatcagatcattccttttttgtt

SEQ ID NO: 518360 - DNA, 25 bp, Homo sapien
tccttttttgttagtggcagtttat

SEQ ID NO: 518361 - DNA, 25 bp, Homo sapien
gttagtggcagtttatcctgtaatt

SEQ ID NO: 518362 - DNA, 25 bp, Homo sapien
tatcctgtaatttcaaatgacgtta

SEQ ID NO: 518363 - DNA, 25 bp, Homo sapien
gtttacagatgatctcatttgctga

SEQ ID NO: 518364 - DNA, 25 bp, Homo sapien
ggaagagagttcatcagggactgat

SEQ ID NO: 518365 - DNA, 25 bp, Homo sapien
cagggactgattacgtaggagagac

SEQ ID NO: 518366 - DNA, 25 bp, Homo sapien
ggaaatggtggccaccgtctccatt

SEQ ID NO: 518367 - DNA, 25 bp, Homo sapien
gccaccgtctccattgaatagcaat

SEQ ID NO: 518368 - DNA, 25 bp, Homo sapien
gtctccattgaatagcaatagctgc

SEQ ID NO: 518369 - DNA, 25 bp, Homo sapien
atagcaatagctgctgtttagcaaa

SEQ ID NO: 518370 - DNA, 25 bp, Homo sapien
gactgattaaaaagtactctgattt

SEQ ID NO: 518371 - DNA, 25 bp, Homo sapien
gagtttaatcaaaactaccagtgga

SEQ ID NO: 518372 - DNA, 25 bp, Homo sapien
ctaccagtggaacatgttcttgagt

SEQ ID NO: 518373 - DNA, 25 bp, Homo sapien
taactgctggcataatttgcaactg

SEQ ID NO: 518374 - DNA, 25 bp, Homo sapien
tttgcaactgttggattttctcatg

SEQ ID NO: 518375 - DNA, 25 bp, Homo sapien
atccacctgcctgacaagaactggg

SEQ ID NO: 518376 - DNA, 25 bp, Homo sapien
aaactgctatcaaggcatgtccctg

SEQ ID NO: 518377 - DNA, 25 bp, Homo sapien
atgtccctgttacatgtcagacccc

SEQ ID NO: 518378 - DNA, 25 bp, Homo sapien
acttggcacctgctgcagcaagaaa

SEQ ID NO: 518379 - DNA, 25 bp, Homo sapien
atgcccaaaagccaactaaacaagc

SEQ ID NO: 518380 - DNA, 25 bp, Homo sapien
gccaactaaacaagcagtagcattt

SEQ ID NO: 518381 - DNA, 25 bp, Homo sapien
ccaatggctgggaaactgctgatgt

SEQ ID NO: 518382 - DNA, 25 bp, Homo sapien
agaaagaccgcacagttacactcac

SEQ ID NO: 518383 - DNA, 25 bp, Homo sapien
agttacactcacatttgcagcaggt

SEQ ID NO: 518384 - DNA, 25 bp, Homo sapien
tgcagcaggtagtagagcgccatga

SEQ ID NO: 518385 - DNA, 25 bp, Homo sapien
agcgccatgagcagcttaataatga

SEQ ID NO: 518386 - DNA, 25 bp, Homo sapien
aaatagggcatcttcttgtacctgc

SEQ ID NO: 518387 - DNA, 25 bp, Homo sapien
ttgtacctgccacatgtcgggccgg

SEQ ID NO: 518388 - DNA, 25 bp, Homo sapien
atgtcgggccggtcagcacaggttt

SEQ ID NO: 518389 - DNA, 25 bp, Homo sapien
ggccggtcagcacaggttttctgca

SEQ ID NO: 518390 - DNA, 25 bp, Homo sapien
ttctggctgggctggcaaaaagcag

SEQ ID NO: 518391 - DNA, 25 bp, Homo sapien
ggccctattcccagttgctccagag

SEQ ID NO: 518392 - DNA, 25 bp, Homo sapien
cagagccactatttaggatccaggt

SEQ ID NO: 518393 - DNA, 25 bp, Homo sapien
ttaggatccaggttgtgccaccaag

SEQ ID NO: 518394 - DNA, 25 bp, Homo sapien
gatccaggttgtgccaccaagttca

SEQ ID NO: 518395 - DNA, 25 bp, Homo sapien
gtgatggtgagaacagctgctttca

SEQ ID NO: 518396 - DNA, 25 bp, Homo sapien
gaaaaatcatcatgtcctagcacag

SEQ ID NO: 518397 - DNA, 25 bp, Homo sapien
gatctagacaatctgtgcctgctac

SEQ ID NO: 518398 - DNA, 25 bp, Homo sapien
tagacaatctgtgcctgctacgaga

SEQ ID NO: 518399 - DNA, 25 bp, Homo sapien
ctgtgcctgctacgagatcttgaat

SEQ ID NO: 518400 - DNA, 25 bp, Homo sapien
gcctgctacgagatcttgaatgcct

SEQ ID NO: 518401 - DNA, 25 bp, Homo sapien
gctacgagatcttgaatgcctagat

SEQ ID NO: 518402 - DNA, 25 bp, Homo sapien
atgcctagatgaatacgggcttctg

SEQ ID NO: 518403 - DNA, 25 bp, Homo sapien
atgaatacgggcttctgcttcggga

SEQ ID NO: 518404 - DNA, 25 bp, Homo sapien
aatacgggcttctgcttcgggattt

SEQ ID NO: 518405 - DNA, 25 bp, Homo sapien
ttctgcttcgggattttccagaccg

SEQ ID NO: 518406 - DNA, 25 bp, Homo sapien
ttcgggattttccagaccgtctgag

SEQ ID NO: 518407 - DNA, 25 bp, Homo sapien
tccagaccgtctgagcacagggctg

SEQ ID NO: 518408 - DNA, 25 bp, Homo sapien
tttgtgcataccaactacccacaga

SEQ ID NO: 518409 - DNA, 25 bp, Homo sapien
tacccacagacatttctattaccca

SEQ ID NO: 518410 - DNA, 25 bp, Homo sapien
atttctattacccaccctctggatg

SEQ ID NO: 518411 - DNA, 25 bp, Homo sapien
gatgccagtgcattaatgattctag

SEQ ID NO: 518412 - DNA, 25 bp, Homo sapien
accagtgtcgtcgtgttcctagaaa

SEQ ID NO: 518413 - DNA, 25 bp, Homo sapien
gagtagaaacccctctatctgggtt

SEQ ID NO: 518414 - DNA, 25 bp, Homo sapien
tgccttctgtaactgtgcatgaggt

SEQ ID NO: 518415 - DNA, 25 bp, Homo sapien
acctgtgcgctcagattcctaccag

SEQ ID NO: 518416 - DNA, 25 bp, Homo sapien
agattcctaccagcttgatgagtta

SEQ ID NO: 518417 - DNA, 25 bp, Homo sapien
gatgagttagctgatgggccatttg

SEQ ID NO: 518418 - DNA, 25 bp, Homo sapien
gatgggccatttgtgcataccaact

SEQ ID NO: 518419 - DNA, 25 bp, Homo sapien
aatcctttatttgggactctagcag

SEQ ID NO: 518420 - DNA, 25 bp, Homo sapien
tatttgggactctagcagaggcctt

SEQ ID NO: 518421 - DNA, 25 bp, Homo sapien
ttgggactctagcagaggccttatt

SEQ ID NO: 518422 - DNA, 25 bp, Homo sapien
gactctagcagaggccttattcttc

SEQ ID NO: 518423 - DNA, 25 bp, Homo sapien
agaggccttattcttctctgggaag

SEQ ID NO: 518424 - DNA, 25 bp, Homo sapien
aggccttattcttctctgggaagaa

SEQ ID NO: 518425 - DNA, 25 bp, Homo sapien
tctctgggaagaagttttgcataac

SEQ ID NO: 518426 - DNA, 25 bp, Homo sapien
gcataacagatgcatactacttata

SEQ ID NO: 518427 - DNA, 25 bp, Homo sapien
gatgcatactacttatactaacaat

SEQ ID NO: 518428 - DNA, 25 bp, Homo sapien
cttaatttggtttcagctatttgga

SEQ ID NO: 518429 - DNA, 25 bp, Homo sapien
aatttggtttcagctatttggatgg

SEQ ID NO: 518430 - DNA, 25 bp, Homo sapien
cactgagcccggccacagtgcagta

SEQ ID NO: 518431 - DNA, 25 bp, Homo sapien
actgagcccggccacagtgcagtat

SEQ ID NO: 518432 - DNA, 25 bp, Homo sapien
ctgagcccggccacagtgcagtatt

SEQ ID NO: 518433 - DNA, 25 bp, Homo sapien
tgagcccggccacagtgcagtattt

SEQ ID NO: 518434 - DNA, 25 bp, Homo sapien
gagcccggccacagtgcagtatttc

SEQ ID NO: 518435 - DNA, 25 bp, Homo sapien
agcccggccacagtgcagtatttct

SEQ ID NO: 518436 - DNA, 25 bp, Homo sapien
gcccggccacagtgcagtatttcta

SEQ ID NO: 518437 - DNA, 25 bp, Homo sapien
cccggccacagtgcagtatttctaa

SEQ ID NO: 518438 - DNA, 25 bp, Homo sapien
ccggccacagtgcagtatttctaac

SEQ ID NO: 518439 - DNA, 25 bp, Homo sapien
cagagtctcagtaggtggttgattg

SEQ ID NO: 518440 - DNA, 25 bp, Homo sapien
ggttgattgttgttactgatggctc

SEQ ID NO: 518441 - DNA, 25 bp, Homo sapien
tactgatggctcttcctgagcatgt

SEQ ID NO: 518442 - DNA, 25 bp, Homo sapien
gctcttcctgagcatgtgaaccatg

SEQ ID NO: 518443 - DNA, 25 bp, Homo sapien
gagcatgtgaaccatggtcctcttc

SEQ ID NO: 518444 - DNA, 25 bp, Homo sapien
atgtgaaccatggtcctcttctgcc

SEQ ID NO: 518445 - DNA, 25 bp, Homo sapien
ttgttcctcgggtcttatcccagag

SEQ ID NO: 518446 - DNA, 25 bp, Homo sapien
ttcctcgggtcttatcccagagttc

SEQ ID NO: 518447 - DNA, 25 bp, Homo sapien
tcccagagttctggctgcatttgac

SEQ ID NO: 518448 - DNA, 25 bp, Homo sapien
gttctggctgcatttgacattcagg

SEQ ID NO: 518449 - DNA, 25 bp, Homo sapien
gctgcatttgacattcaggtattct

SEQ ID NO: 518450 - DNA, 25 bp, Homo sapien
aaagatgaacaacatgaccgggaag

SEQ ID NO: 518451 - DNA, 25 bp, Homo sapien
atgaccgggaagatttcctaatctc

SEQ ID NO: 518452 - DNA, 25 bp, Homo sapien
cctggctctaccttaagtctttaat

SEQ ID NO: 518453 - DNA, 25 bp, Homo sapien
ataaaagcttgactgaaggtaccaa

SEQ ID NO: 518454 - DNA, 25 bp, Homo sapien
actgaaggtaccaaggtgtgctgaa

SEQ ID NO: 518455 - DNA, 25 bp, Homo sapien
gaagcaaagttctccaaagtccagc

SEQ ID NO: 518456 - DNA, 25 bp, Homo sapien
agttctccaaagtccagcatggtag

SEQ ID NO: 518457 - DNA, 25 bp, Homo sapien
gcatggtagacatcagtggtggtaa

SEQ ID NO: 518458 - DNA, 25 bp, Homo sapien
ccaaggcaaggtgaacctcaaaaat

SEQ ID NO: 518459 - DNA, 25 bp, Homo sapien
aaatggaacctcaagtctatgcagt

SEQ ID NO: 518460 - DNA, 25 bp, Homo sapien
acctcaagtctatgcagtccagctg

SEQ ID NO: 518461 - DNA, 25 bp, Homo sapien
aatcctttatttgggactctagcag

SEQ ID NO: 518462 - DNA, 25 bp, Homo sapien
tttgggactctagcagaggccttat

SEQ ID NO: 518463 - DNA, 25 bp, Homo sapien
gactctagcagaggccttattcttc

SEQ ID NO: 518464 - DNA, 25 bp, Homo sapien
agaggccttattcttctctgggaag

SEQ ID NO: 518465 - DNA, 25 bp, Homo sapien
tctctgggaagaagttttgcataac

SEQ ID NO: 518466 - DNA, 25 bp, Homo sapien
gcataacagatgcatactacttata

SEQ ID NO: 518467 - DNA, 25 bp, Homo sapien
gatgcatactacttatactaacaat

SEQ ID NO: 518468 - DNA, 25 bp, Homo sapien
aatttggtttcagctatttggatgg

SEQ ID NO: 518469 - DNA, 25 bp, Homo sapien
tggatggctcttttgcaaagtacat

SEQ ID NO: 518470 - DNA, 25 bp, Homo sapien
aaagtacatcctgttgctattgtgt

SEQ ID NO: 518471 - DNA, 25 bp, Homo sapien
gggagttcagcaatttgccccaaga

SEQ ID NO: 518472 - DNA, 25 bp, Homo sapien
gcatctcactatttattgacaggtt

SEQ ID NO: 518473 - DNA, 25 bp, Homo sapien
cactatttattgacaggttgggctg

SEQ ID NO: 518474 - DNA, 25 bp, Homo sapien
tgtgtatacatttccaggcgtgcct

SEQ ID NO: 518475 - DNA, 25 bp, Homo sapien
atttccaggcgtgcctgtgtcctgt

SEQ ID NO: 518476 - DNA, 25 bp, Homo sapien
catcccactatgaatctggcatctt

SEQ ID NO: 518477 - DNA, 25 bp, Homo sapien
tgaatctggcatcttcttatgcttc

SEQ ID NO: 518478 - DNA, 25 bp, Homo sapien
atgcttctagtgttttggccataca

SEQ ID NO: 518479 - DNA, 25 bp, Homo sapien
gttttggccatacatcaaccaaggg

SEQ ID NO: 518480 - DNA, 25 bp, Homo sapien
gggtttaatttatccaatgcttgac

SEQ ID NO: 518481 - DNA, 25 bp, Homo sapien
atccaatgcttgacgacatgttcag

SEQ ID NO: 518482 - DNA, 25 bp, Homo sapien
atgcttgacgacatgttcaggaggg

SEQ ID NO: 518483 - DNA, 25 bp, Homo sapien
tccctcttgtaaaagtaccatcaag

SEQ ID NO: 518484 - DNA, 25 bp, Homo sapien
gtggagagtgaatttgtatgactaa

SEQ ID NO: 518485 - DNA, 25 bp, Homo sapien
gactaaaggataatctgtacatggg

SEQ ID NO: 518486 - DNA, 25 bp, Homo sapien
atatcctaccctttcccattgtgca

SEQ ID NO: 518487 - DNA, 25 bp, Homo sapien
tcccattgtgcatatcccaagtgtc

SEQ ID NO: 518488 - DNA, 25 bp, Homo sapien
cattgtgcatatcccaagtgtcata

SEQ ID NO: 518489 - DNA, 25 bp, Homo sapien
gtgcatatcccaagtgtcatattta

SEQ ID NO: 518490 - DNA, 25 bp, Homo sapien
cagaatccaggaatatcaaggctct

SEQ ID NO: 518491 - DNA, 25 bp, Homo sapien
caggaatatcaaggctctgtggctt

SEQ ID NO: 518492 - DNA, 25 bp, Homo sapien
gaatatcaaggctctgtggcttgga

SEQ ID NO: 518493 - DNA, 25 bp, Homo sapien
ggcttggaattttagaggataggac

SEQ ID NO: 518494 - DNA, 25 bp, Homo sapien
tctccttccctggaataaggcttca

SEQ ID NO: 518495 - DNA, 25 bp, Homo sapien
cttccctggaataaggcttcagctt

SEQ ID NO: 518496 - DNA, 25 bp, Homo sapien
gtgaagacaccatttgtaagcactt

SEQ ID NO: 518497 - DNA, 25 bp, Homo sapien
gacaccatttgtaagcactttgaac

SEQ ID NO: 518498 - DNA, 25 bp, Homo sapien
gcactttgaacataagcactgtgtg

SEQ ID NO: 518499 - DNA, 25 bp, Homo sapien
atgagttttgtttggaattgtaata

SEQ ID NO: 518500 - DNA, 25 bp, Homo sapien
agtaatgaactgcatggtttagaaa

SEQ ID NO: 518501 - DNA, 25 bp, Homo sapien
atttgatcagctgtcctctctgaaa

SEQ ID NO: 518502 - DNA, 25 bp, Homo sapien
tctctgaaaaaaattgcaccccttt

SEQ ID NO: 518503 - DNA, 25 bp, Homo sapien
aaattttgttgcatcttcgtagtaa

SEQ ID NO: 518504 - DNA, 25 bp, Homo sapien
tttgttgcatcttcgtagtaatgta

SEQ ID NO: 518505 - DNA, 25 bp, Homo sapien
aggttgcaactagtcattaaaatga

SEQ ID NO: 518506 - DNA, 25 bp, Homo sapien
gggcctcctgaaagcttaacctctt

SEQ ID NO: 518507 - DNA, 25 bp, Homo sapien
ctgaaagcttaacctcttggctcca

SEQ ID NO: 518508 - DNA, 25 bp, Homo sapien
ggtggagaggtgttcatctcctcca

SEQ ID NO: 518509 - DNA, 25 bp, Homo sapien
atctcctccactcctttaaatatgg

SEQ ID NO: 518510 - DNA, 25 bp, Homo sapien
aatatggagctcattcctggaaggg

SEQ ID NO: 518511 - DNA, 25 bp, Homo sapien
atagaggaatttggccgcaccacga

SEQ ID NO: 518512 - DNA, 25 bp, Homo sapien
gaaaccccgtcagtggcgtgagagt

SEQ ID NO: 518513 - DNA, 25 bp, Homo sapien
ggtttgaggatcacgaccttcaatt

SEQ ID NO: 518514 - DNA, 25 bp, Homo sapien
cgaccttcaattaaagtccagagaa

SEQ ID NO: 518515 - DNA, 25 bp, Homo sapien
ggcagagggacagcttcaatccttc

SEQ ID NO: 518516 - DNA, 25 bp, Homo sapien
ggtggcccattactcgagatgatca

SEQ ID NO: 518517 - DNA, 25 bp, Homo sapien
ggcccattactcgagatgatcatca

SEQ ID NO: 518518 - DNA, 25 bp, Homo sapien
tcgagatgatcatcacaaccagatg

SEQ ID NO: 518519 - DNA, 25 bp, Homo sapien
cacaaccagatgatgctaacctata

SEQ ID NO: 518520 - DNA, 25 bp, Homo sapien
atgatgctaacctatatcctctacc

SEQ ID NO: 518521 - DNA, 25 bp, Homo sapien
tctacccttcgcgtgctttgtctgg

SEQ ID NO: 518522 - DNA, 25 bp, Homo sapien
aagagcccctggtcagtcaggcttc

SEQ ID NO: 518523 - DNA, 25 bp, Homo sapien
tggtcagtcaggcttccatttagca

SEQ ID NO: 518524 - DNA, 25 bp, Homo sapien
caggcttccatttagcatggcgttt

SEQ ID NO: 518525 - DNA, 25 bp, Homo sapien
gcatggcgtttgcaaggtttaccca

SEQ ID NO: 518526 - DNA, 25 bp, Homo sapien
cgtttgcaaggtttacccatgttgt

SEQ ID NO: 518527 - DNA, 25 bp, Homo sapien
ctctttttctctgagtacgtttcag

SEQ ID NO: 518528 - DNA, 25 bp, Homo sapien
gtacgtttcagtgtttaattgacca

SEQ ID NO: 518529 - DNA, 25 bp, Homo sapien
actgaatcatcatgcactgaccgaa

SEQ ID NO: 518530 - DNA, 25 bp, Homo sapien
actgaccgaaatgccacctgtatga

SEQ ID NO: 518531 - DNA, 25 bp, Homo sapien
aaatgccacctgtatgagtgctaaa

SEQ ID NO: 518532 - DNA, 25 bp, Homo sapien
tgctaaaatcattgtcgctggacct

SEQ ID NO: 518533 - DNA, 25 bp, Homo sapien
gctggacctgtgtctgcactgttta

SEQ ID NO: 518534 - DNA, 25 bp, Homo sapien
tgttgtttctcacatcagcttctgt

SEQ ID NO: 518535 - DNA, 25 bp, Homo sapien
catggttgtggttctcatactttta

SEQ ID NO: 518536 - DNA, 25 bp, Homo sapien
catacttttaatatctgttggagca

SEQ ID NO: 518537 - DNA, 25 bp, Homo sapien
ggagcaaataaagcctcgtttctca

SEQ ID NO: 518538 - DNA, 25 bp, Homo sapien
agttcttattattggttcttgggat

SEQ ID NO: 518539 - DNA, 25 bp, Homo sapien
ttcttattattggttcttgggattc

SEQ ID NO: 518540 - DNA, 25 bp, Homo sapien
cttattattggttcttgggattcat

SEQ ID NO: 518541 - DNA, 25 bp, Homo sapien
ttgttcagaagaagtccatttctct

SEQ ID NO: 518542 - DNA, 25 bp, Homo sapien
gttcagaagaagtccatttctctat

SEQ ID NO: 518543 - DNA, 25 bp, Homo sapien
tcagaagaagtccatttctctatct

SEQ ID NO: 518544 - DNA, 25 bp, Homo sapien
cagaagaagtccatttctctatctg

SEQ ID NO: 518545 - DNA, 25 bp, Homo sapien
tctgcagttttctgatgtgaaataa

SEQ ID NO: 518546 - DNA, 25 bp, Homo sapien
atttgacttattagatatgacccat

SEQ ID NO: 518547 - DNA, 25 bp, Homo sapien
tgacttattagatatgacccatttt

SEQ ID NO: 518548 - DNA, 25 bp, Homo sapien
tcagttattaacaaagctatgcata

SEQ ID NO: 518549 - DNA, 25 bp, Homo sapien
ttgcctattctttctaggattcaaa

SEQ ID NO: 518550 - DNA, 25 bp, Homo sapien
ctaggattcaaatattgtgacattt

SEQ ID NO: 518551 - DNA, 25 bp, Homo sapien
tgaacccccactatcataatccata

SEQ ID NO: 518552 - DNA, 25 bp, Homo sapien
aatccatacattcatttccatgttg

SEQ ID NO: 518553 - DNA, 25 bp, Homo sapien
catttccatgttgtttgactagcag

SEQ ID NO: 518554 - DNA, 25 bp, Homo sapien
ccatgttgtttgactagcagtgcat

SEQ ID NO: 518555 - DNA, 25 bp, Homo sapien
gtttgactagcagtgcatatatgaa

SEQ ID NO: 518556 - DNA, 25 bp, Homo sapien
aataccttgaatatattcagtggat

SEQ ID NO: 518557 - DNA, 25 bp, Homo sapien
gtggattgaatgtgacttcataact

SEQ ID NO: 518558 - DNA, 25 bp, Homo sapien
gtgacttcataactgtactacgatt

SEQ ID NO: 518559 - DNA, 25 bp, Homo sapien
tcataactgtactacgattgtatta

SEQ ID NO: 518560 - DNA, 25 bp, Homo sapien
caggaggatgcaattctctctctaa

SEQ ID NO: 518561 - DNA, 25 bp, Homo sapien
aattctctctctaaagtcgagagct

SEQ ID NO: 518562 - DNA, 25 bp, Homo sapien
tctctaaagtcgagagctcaccacc

SEQ ID NO: 518563 - DNA, 25 bp, Homo sapien
aaagtcgagagctcaccaccccggg

SEQ ID NO: 518564 - DNA, 25 bp, Homo sapien
ggcgttcgtcactgcagacatcact

SEQ ID NO: 518565 - DNA, 25 bp, Homo sapien
gttcgtcactgcagacatcactgca

SEQ ID NO: 518566 - DNA, 25 bp, Homo sapien
tcgtcactgcagacatcactgcaga

SEQ ID NO: 518567 - DNA, 25 bp, Homo sapien
ctgcagacacagagacggccattag

SEQ ID NO: 518568 - DNA, 25 bp, Homo sapien
agagacggccattagagctcaccac

SEQ ID NO: 518569 - DNA, 25 bp, Homo sapien
attagagctcaccaccccgggcgtt

SEQ ID NO: 518570 - DNA, 25 bp, Homo sapien
ggtcggtcctaactccaccaaagca

SEQ ID NO: 518571 - DNA, 25 bp, Homo sapien
agaaggtacagctgaccccttctca

SEQ ID NO: 518572 - DNA, 25 bp, Homo sapien
accccttctcaccatgttgtaaata

SEQ ID NO: 518573 - DNA, 25 bp, Homo sapien
actgggtgcagtactgagggataat

SEQ ID NO: 518574 - DNA, 25 bp, Homo sapien
gatttatcaaatcctgactgtctag

SEQ ID NO: 518575 - DNA, 25 bp, Homo sapien
atcctgactgtctagagcaaattgt

SEQ ID NO: 518576 - DNA, 25 bp, Homo sapien
agcaaattgtacactctctttgtga

SEQ ID NO: 518577 - DNA, 25 bp, Homo sapien
actctctttgtgaatggtcctgtaa

SEQ ID NO: 518578 - DNA, 25 bp, Homo sapien
gaatggtcctgtaacgtgtatgaac

SEQ ID NO: 518579 - DNA, 25 bp, Homo sapien
gtatgaacacatttctgggtgcctt

SEQ ID NO: 518580 - DNA, 25 bp, Homo sapien
ctgggtgccttagaagttgtatttt

SEQ ID NO: 518581 - DNA, 25 bp, Homo sapien
tatacattgtgagaagctgctttga

SEQ ID NO: 518582 - DNA, 25 bp, Homo sapien
tctctgttagtgtcctgagctcttt

SEQ ID NO: 518583 - DNA, 25 bp, Homo sapien
tgttagtgtcctgagctcttttgca

SEQ ID NO: 518584 - DNA, 25 bp, Homo sapien
tgtaggtacagaccaatccctgtcc

SEQ ID NO: 518585 - DNA, 25 bp, Homo sapien
tgagttgtttggttttccagaagct

SEQ ID NO: 518586 - DNA, 25 bp, Homo sapien
gtttggttttccagaagctgccagt

SEQ ID NO: 518587 - DNA, 25 bp, Homo sapien
agaagctgccagtgggttcccgtga

SEQ ID NO: 518588 - DNA, 25 bp, Homo sapien
cagtgggttcccgtgaattgcgtta

SEQ ID NO: 518589 - DNA, 25 bp, Homo sapien
gggttcccgtgaattgcgttaagat

SEQ ID NO: 518590 - DNA, 25 bp, Homo sapien
gaattgcgttaagatatcgatgatt

SEQ ID NO: 518591 - DNA, 25 bp, Homo sapien
aaggcagtatcttttgtactgtgaa

SEQ ID NO: 518592 - DNA, 25 bp, Homo sapien
ctgttggtgtgtattgtatatagtg

SEQ ID NO: 518593 - DNA, 25 bp, Homo sapien
tcagctcttcgttcccagaaaccca

SEQ ID NO: 518594 - DNA, 25 bp, Homo sapien
cagaaacccagatgtaatcccccta

SEQ ID NO: 518595 - DNA, 25 bp, Homo sapien
gatgtaatccccctacgtggtgctt

SEQ ID NO: 518596 - DNA, 25 bp, Homo sapien
gtaatccccctacgtggtgcttggg

SEQ ID NO: 518597 - DNA, 25 bp, Homo sapien
tacgtggtgcttggggcatcccgat

SEQ ID NO: 518598 - DNA, 25 bp, Homo sapien
gggcatcccgataccatctcagtaa

SEQ ID NO: 518599 - DNA, 25 bp, Homo sapien
ggcatcccgataccatctcagtaaa

SEQ ID NO: 518600 - DNA, 25 bp, Homo sapien
gcatcccgataccatctcagtaaat

SEQ ID NO: 518601 - DNA, 25 bp, Homo sapien
catcccgataccatctcagtaaatc

SEQ ID NO: 518602 - DNA, 25 bp, Homo sapien
atcccgataccatctcagtaaatct

SEQ ID NO: 518603 - DNA, 25 bp, Homo sapien
tcccgataccatctcagtaaatctc

SEQ ID NO: 518604 - DNA, 25 bp, Homo sapien
tgtttgacctgtggctgtctttgca

SEQ ID NO: 518605 - DNA, 25 bp, Homo sapien
ttgacctgtggctgtctttgcacta

SEQ ID NO: 518606 - DNA, 25 bp, Homo sapien
tttgcactaccccagcagagttgag

SEQ ID NO: 518607 - DNA, 25 bp, Homo sapien
tgagtagttgtagcagacaccacat

SEQ ID NO: 518608 - DNA, 25 bp, Homo sapien
gtagcagacaccacatgcccttgag

SEQ ID NO: 518609 - DNA, 25 bp, Homo sapien
acatgcccttgagcctaagatctag

SEQ ID NO: 518610 - DNA, 25 bp, Homo sapien
gcccttgagcctaagatctagcact

SEQ ID NO: 518611 - DNA, 25 bp, Homo sapien
gagcctaagatctagcactttacaa

SEQ ID NO: 518612 - DNA, 25 bp, Homo sapien
gcaatgtagagttacgcttttataa

SEQ ID NO: 518613 - DNA, 25 bp, Homo sapien
cgcttttataagtatttcatgtttc

SEQ ID NO: 518614 - DNA, 25 bp, Homo sapien
tacagcaatttgtaggtgggtggtt

SEQ ID NO: 518615 - DNA, 25 bp, Homo sapien
ttaaatagtcacagggaggtagagt

SEQ ID NO: 518616 - DNA, 25 bp, Homo sapien
gtgagaagaggcttttaaggaccat

SEQ ID NO: 518617 - DNA, 25 bp, Homo sapien
gaggcttttaaggaccatgtgaaga

SEQ ID NO: 518618 - DNA, 25 bp, Homo sapien
taaggaccatgtgaagaggctttta

SEQ ID NO: 518619 - DNA, 25 bp, Homo sapien
aaacagtgtttccagattgcccaca

SEQ ID NO: 518620 - DNA, 25 bp, Homo sapien
gtgtttccagattgcccacagatag

SEQ ID NO: 518621 - DNA, 25 bp, Homo sapien
tccagattgcccacagatagaaata

SEQ ID NO: 518622 - DNA, 25 bp, Homo sapien
aatagtcaggatttggtaacaagaa

SEQ ID NO: 518623 - DNA, 25 bp, Homo sapien
gaaatcagaattcttggtatagtca

SEQ ID NO: 518624 - DNA, 25 bp, Homo sapien
ggtatagtcaagatttcctgaaatc

SEQ ID NO: 518625 - DNA, 25 bp, Homo sapien
tttttcctctgttctcataaggtgc

SEQ ID NO: 518626 - DNA, 25 bp, Homo sapien
tatttccgggaagttaggaggcctg

SEQ ID NO: 518627 - DNA, 25 bp, Homo sapien
aggcctggttgagtcttggatcttc

SEQ ID NO: 518628 - DNA, 25 bp, Homo sapien
cttcagtgactgatgctgtgaccat

SEQ ID NO: 518629 - DNA, 25 bp, Homo sapien
gatgctgtgaccatgagatactcaa

SEQ ID NO: 518630 - DNA, 25 bp, Homo sapien
tgtaatcataatcctgagctgtcag

SEQ ID NO: 518631 - DNA, 25 bp, Homo sapien
agagggacacagtgctctctccggc

SEQ ID NO: 518632 - DNA, 25 bp, Homo sapien
gctgtcaggtctctaaatctattac

SEQ ID NO: 518633 - DNA, 25 bp, Homo sapien
aatcctgagctgtcagcagggcagt

SEQ ID NO: 518634 - DNA, 25 bp, Homo sapien
tattactgtgccaccgtgaggagat

SEQ ID NO: 518635 - DNA, 25 bp, Homo sapien
gcagggcagtgattggtttccagat

SEQ ID NO: 518636 - DNA, 25 bp, Homo sapien
gtccatgaaacaggtagccagggtt

SEQ ID NO: 518637 - DNA, 25 bp, Homo sapien
ctgtagtcctaactattcagattcc

SEQ ID NO: 518638 - DNA, 25 bp, Homo sapien
tgtagtcctaactattcagattcct

SEQ ID NO: 518639 - DNA, 25 bp, Homo sapien
gtagtcctaactattcagattcctt

SEQ ID NO: 518640 - DNA, 25 bp, Homo sapien
tagtcctaactattcagattccttg

SEQ ID NO: 518641 - DNA, 25 bp, Homo sapien
agtcctaactattcagattccttga

SEQ ID NO: 518642 - DNA, 25 bp, Homo sapien
gtcctaactattcagattccttgag

SEQ ID NO: 518643 - DNA, 25 bp, Homo sapien
tcctaactattcagattccttgagc

SEQ ID NO: 518644 - DNA, 25 bp, Homo sapien
cctaactattcagattccttgagcc

SEQ ID NO: 518645 - DNA, 25 bp, Homo sapien
ctaactattcagattccttgagccc

SEQ ID NO: 518646 - DNA, 25 bp, Homo sapien
tgggaactgccaaaagtgtgcattt

SEQ ID NO: 518647 - DNA, 25 bp, Homo sapien
catttggctacagtggactcgactg

SEQ ID NO: 518648 - DNA, 25 bp, Homo sapien
ggactcgactgtaaggacaaatttc

SEQ ID NO: 518649 - DNA, 25 bp, Homo sapien
gacaaatttcagctgatcctcacta

SEQ ID NO: 518650 - DNA, 25 bp, Homo sapien
tgatcctcactattgtgggcaccat

SEQ ID NO: 518651 - DNA, 25 bp, Homo sapien
tgggcaccatcgctggcattgtcat

SEQ ID NO: 518652 - DNA, 25 bp, Homo sapien
gcattgtcattctcagcatgataat

SEQ ID NO: 518653 - DNA, 25 bp, Homo sapien
taaaactgcggtcgacaggcttcac

SEQ ID NO: 518654 - DNA, 25 bp, Homo sapien
tcgacaggcttcaccaatcttggag

SEQ ID NO: 518655 - DNA, 25 bp, Homo sapien
atcttggagcagaagggagcgtctt

SEQ ID NO: 518656 - DNA, 25 bp, Homo sapien
agggagcgtctttcctaaggtcagg

SEQ ID NO: 518657 - DNA, 25 bp, Homo sapien
gaacatttcatgtttggcgggcatg

SEQ ID NO: 518658 - DNA, 25 bp, Homo sapien
agtgcacaagatggaaagagcgatt

SEQ ID NO: 518659 - DNA, 25 bp, Homo sapien
tggaaagagcgattggagcatcctg

SEQ ID NO: 518660 - DNA, 25 bp, Homo sapien
tggagcatcctggtataattacccc

SEQ ID NO: 518661 - DNA, 25 bp, Homo sapien
ataattacccccattgtgctcttaa

SEQ ID NO: 518662 - DNA, 25 bp, Homo sapien
attgtgctcttaatggaaatttcaa

SEQ ID NO: 518663 - DNA, 25 bp, Homo sapien
caaaggacgggagtattctgttggt

SEQ ID NO: 518664 - DNA, 25 bp, Homo sapien
attctgttggttggtgtccaggttt

SEQ ID NO: 518665 - DNA, 25 bp, Homo sapien
gtccaggtttgtggcactgttccaa

SEQ ID NO: 518666 - DNA, 25 bp, Homo sapien
actgttccaagaggccttacacaca

SEQ ID NO: 518667 - DNA, 25 bp, Homo sapien
ttccaagaggccttacacacacaca

SEQ ID NO: 518668 - DNA, 25 bp, Homo sapien
ggtgcagggaaaacacagtccactc

SEQ ID NO: 518669 - DNA, 25 bp, Homo sapien
gactgctcagaaaaccctgtccttt

SEQ ID NO: 518670 - DNA, 25 bp, Homo sapien
tttcctctcttcaaaggcaggcatg

SEQ ID NO: 518671 - DNA, 25 bp, Homo sapien
caaaggcaggcatgtgattgaggat

SEQ ID NO: 518672 - DNA, 25 bp, Homo sapien
attgaggatgtgatggtgacttctg

SEQ ID NO: 518673 - DNA, 25 bp, Homo sapien
tggcctgttttattttgtggtaact

SEQ ID NO: 518674 - DNA, 25 bp, Homo sapien
tgtggtaacttcactttagtcaggg

SEQ ID NO: 518675 - DNA, 25 bp, Homo sapien
gtaacttcactttagtcagggaaat

SEQ ID NO: 518676 - DNA, 25 bp, Homo sapien
aattggaatatctttaatctgatgt

SEQ ID NO: 518677 - DNA, 25 bp, Homo sapien
taatctgatgtagtttgacctttag

SEQ ID NO: 518678 - DNA, 25 bp, Homo sapien
aacagctattgttgataattcacaa

SEQ ID NO: 518679 - DNA, 25 bp, Homo sapien
tacccgggacataacacgctgctca

SEQ ID NO: 518680 - DNA, 25 bp, Homo sapien
gagagccacggagtgagggaccctt

SEQ ID NO: 518681 - DNA, 25 bp, Homo sapien
agggacccttggatgatagtgcttc

SEQ ID NO: 518682 - DNA, 25 bp, Homo sapien
tggatgatagtgcttcccaaagacc

SEQ ID NO: 518683 - DNA, 25 bp, Homo sapien
cccgacacagccaacacagaaagaa

SEQ ID NO: 518684 - DNA, 25 bp, Homo sapien
aaagattccagagacgttccagcat

SEQ ID NO: 518685 - DNA, 25 bp, Homo sapien
gattccagagacgttccagcataag

SEQ ID NO: 518686 - DNA, 25 bp, Homo sapien
agagacgttccagcataaggccatg

SEQ ID NO: 518687 - DNA, 25 bp, Homo sapien
agcataaggccatgcagggccggct

SEQ ID NO: 518688 - DNA, 25 bp, Homo sapien
gggtgccggccacagaggaaggtcc

SEQ ID NO: 518689 - DNA, 25 bp, Homo sapien
ccctgaggacacagtaccgaagtct

SEQ ID NO: 518690 - DNA, 25 bp, Homo sapien
aaggcccactgataatgctgcactg

SEQ ID NO: 518691 - DNA, 25 bp, Homo sapien
gctgcactggaaatgctaaacccaa

SEQ ID NO: 518692 - DNA, 25 bp, Homo sapien
tggcaccacttcatgcctacatcat

SEQ ID NO: 518693 - DNA, 25 bp, Homo sapien
tgcctacatcatgggaaagtacctc

SEQ ID NO: 518694 - DNA, 25 bp, Homo sapien
aaagtacctcttttacagaatgcag

SEQ ID NO: 518695 - DNA, 25 bp, Homo sapien
gcagatcactgctaacaatccacat

SEQ ID NO: 518696 - DNA, 25 bp, Homo sapien
taacaatccacatgactaagtcttc

SEQ ID NO: 518697 - DNA, 25 bp, Homo sapien
taagtcttcagtttcccttgcttaa

SEQ ID NO: 518698 - DNA, 25 bp, Homo sapien
tcagtttcccttgcttaacatttgt

SEQ ID NO: 518699 - DNA, 25 bp, Homo sapien
gttagcatatatttcagcaaagatt

SEQ ID NO: 518700 - DNA, 25 bp, Homo sapien
aaaatcctatttaattcgcttcaat

SEQ ID NO: 518701 - DNA, 25 bp, Homo sapien
ggcccctttaagactcaggtgagct

SEQ ID NO: 518702 - DNA, 25 bp, Homo sapien
tcccgctgcgccaggcttgaatcaa

SEQ ID NO: 518703 - DNA, 25 bp, Homo sapien
aggcttgaatcaaaggtgtcagcaa

SEQ ID NO: 518704 - DNA, 25 bp, Homo sapien
aggtgtcagcaagctagatgtcaaa

SEQ ID NO: 518705 - DNA, 25 bp, Homo sapien
catttcgagagagaggcagcttgca

SEQ ID NO: 518706 - DNA, 25 bp, Homo sapien
gaggcagcttgcagaaaagcagaaa

SEQ ID NO: 518707 - DNA, 25 bp, Homo sapien
agcaaactatggcatgtggccccgt

SEQ ID NO: 518708 - DNA, 25 bp, Homo sapien
catgtggccccgtgagctaggaatg

SEQ ID NO: 518709 - DNA, 25 bp, Homo sapien
gagctaggaatggtttttcctcttt

SEQ ID NO: 518710 - DNA, 25 bp, Homo sapien
ctggctcaagcgatggcttttacct

SEQ ID NO: 518711 - DNA, 25 bp, Homo sapien
tcaagcgatggcttttaccttttta

SEQ ID NO: 518712 - DNA, 25 bp, Homo sapien
tcaaagctaaccgaggctgtgcctt

SEQ ID NO: 518713 - DNA, 25 bp, Homo sapien
taaccgaggctgtgccttccgagac

SEQ ID NO: 518714 - DNA, 25 bp, Homo sapien
agtcactgtggccacggagaaccgc

SEQ ID NO: 518715 - DNA, 25 bp, Homo sapien
cacggagaaccgcagctgagcttta

SEQ ID NO: 518716 - DNA, 25 bp, Homo sapien
gagctttatgaagccacgtggccac

SEQ ID NO: 518717 - DNA, 25 bp, Homo sapien
cccaagcaaacacagatcgctcaga

SEQ ID NO: 518718 - DNA, 25 bp, Homo sapien
gatcgctcagaaaatgggaacccag

SEQ ID NO: 518719 - DNA, 25 bp, Homo sapien
ggaacccagggcaaattgtatgtgc

SEQ ID NO: 518720 - DNA, 25 bp, Homo sapien
aattgtatgtgctccttactgggtt

SEQ ID NO: 518721 - DNA, 25 bp, Homo sapien
gtatgtgctccttactgggtttatt

SEQ ID NO: 518722 - DNA, 25 bp, Homo sapien
gggtttattataagtgtcacatgtt

SEQ ID NO: 518723 - DNA, 25 bp, Homo sapien
aagctggtatgagcaatcctgcatt

SEQ ID NO: 518724 - DNA, 25 bp, Homo sapien
gagcaatcctgcattaaccatggaa

SEQ ID NO: 518725 - DNA, 25 bp, Homo sapien
aaaatgagacttaactcttcaagca

SEQ ID NO: 518726 - DNA, 25 bp, Homo sapien
gatggaagaggcttcccacaggaag

SEQ ID NO: 518727 - DNA, 25 bp, Homo sapien
gaaggtgccaccagtcagttgtgcc

SEQ ID NO: 518728 - DNA, 25 bp, Homo sapien
agtcagttgtgcctatgtccctttg

SEQ ID NO: 518729 - DNA, 25 bp, Homo sapien
ctatgtccctttggctggaaatgca

SEQ ID NO: 518730 - DNA, 25 bp, Homo sapien
gaattgattagttctctccaagcca

SEQ ID NO: 518731 - DNA, 25 bp, Homo sapien
ctctccaagccattgcttaaaatat

SEQ ID NO: 518732 - DNA, 25 bp, Homo sapien
gttttggatccaatacacacattgt

SEQ ID NO: 518733 - DNA, 25 bp, Homo sapien
gttacaactaacacaaattcctatt

SEQ ID NO: 518734 - DNA, 25 bp, Homo sapien
ttcttcctctgactctctgagtggt

SEQ ID NO: 518735 - DNA, 25 bp, Homo sapien
cttcctctgactctctgagtggtgt

SEQ ID NO: 518736 - DNA, 25 bp, Homo sapien
gtcggctaggccacgggacagatgg

SEQ ID NO: 518737 - DNA, 25 bp, Homo sapien
aggaagggccctggcctctaaactg

SEQ ID NO: 518738 - DNA, 25 bp, Homo sapien
aagggccctggcctctaaactggct

SEQ ID NO: 518739 - DNA, 25 bp, Homo sapien
cctggcctctaaactggctcgagag

SEQ ID NO: 518740 - DNA, 25 bp, Homo sapien
ggcctctaaactggctcgagagcat

SEQ ID NO: 518741 - DNA, 25 bp, Homo sapien
ctctaaactggctcgagagcatctt

SEQ ID NO: 518742 - DNA, 25 bp, Homo sapien
aaactggctcgagagcatcttggcc

SEQ ID NO: 518743 - DNA, 25 bp, Homo sapien
tggctcgagagcatcttggccccgg

SEQ ID NO: 518744 - DNA, 25 bp, Homo sapien
ggctcgagagcatcttggccccggc

SEQ ID NO: 518745 - DNA, 25 bp, Homo sapien
tattactaccatactctgttggtca

SEQ ID NO: 518746 - DNA, 25 bp, Homo sapien
accatactctgttggtcaaagcagt

SEQ ID NO: 518747 - DNA, 25 bp, Homo sapien
ggacttctcacatggtaactatatt

SEQ ID NO: 518748 - DNA, 25 bp, Homo sapien
caaagcagtcatgaatctgcccaga

SEQ ID NO: 518749 - DNA, 25 bp, Homo sapien
gaatagactctaccatttgataagg

SEQ ID NO: 518750 - DNA, 25 bp, Homo sapien
ggagtggcatggtaactttggcaaa

SEQ ID NO: 518751 - DNA, 25 bp, Homo sapien
attgttggaaaatacgatctggatt

SEQ ID NO: 518752 - DNA, 25 bp, Homo sapien
tctgccagtttataagctatattaa

SEQ ID NO: 518753 - DNA, 25 bp, Homo sapien
ccaggcagaggcttatgtctttgtt

SEQ ID NO: 518754 - DNA, 25 bp, Homo sapien
cttatgtctttgttgcctggtctca

SEQ ID NO: 518755 - DNA, 25 bp, Homo sapien
tctttgttgcctggtctcagaattc

SEQ ID NO: 518756 - DNA, 25 bp, Homo sapien
taggatggtccttccaccaagaagc

SEQ ID NO: 518757 - DNA, 25 bp, Homo sapien
ggatggtccttccaccaagaagcct

SEQ ID NO: 518758 - DNA, 25 bp, Homo sapien
tcctcaccagactgtggctccagga

SEQ ID NO: 518759 - DNA, 25 bp, Homo sapien
tgacagggcagagttggactcacct

SEQ ID NO: 518760 - DNA, 25 bp, Homo sapien
gagttggactcacctgtgtctgcca

SEQ ID NO: 518761 - DNA, 25 bp, Homo sapien
caagaggcctctggatttggaccaa

SEQ ID NO: 518762 - DNA, 25 bp, Homo sapien
aggcctctggatttggaccaacttc

SEQ ID NO: 518763 - DNA, 25 bp, Homo sapien
tttggaccaacttccagtgtgacct

SEQ ID NO: 518764 - DNA, 25 bp, Homo sapien
gtgaccttgaacaaggccttcgcct

SEQ ID NO: 518765 - DNA, 25 bp, Homo sapien
aactgatctcatccctcagggcttg

SEQ ID NO: 518766 - DNA, 25 bp, Homo sapien
tgatctcatccctcagggcttggca

SEQ ID NO: 518767 - DNA, 25 bp, Homo sapien
cctggctgggtctgggttcagaaac

SEQ ID NO: 518768 - DNA, 25 bp, Homo sapien
aagtgaaccttctagatcctgctga

SEQ ID NO: 518769 - DNA, 25 bp, Homo sapien
tagatcctgctgactcatacaatga

SEQ ID NO: 518770 - DNA, 25 bp, Homo sapien
gagttttgtgtggaccatcagacaa

SEQ ID NO: 518771 - DNA, 25 bp, Homo sapien
ccagctctcctctaattatgtcata

SEQ ID NO: 518772 - DNA, 25 bp, Homo sapien
atgtcataaggactggaggcccctt

SEQ ID NO: 518773 - DNA, 25 bp, Homo sapien
gcctgcttgtgataacacgcaagga

SEQ ID NO: 518774 - DNA, 25 bp, Homo sapien
acgcaaggaaatatgggccaactct

SEQ ID NO: 518775 - DNA, 25 bp, Homo sapien
gggccaactcttcacatgaacacaa

SEQ ID NO: 518776 - DNA, 25 bp, Homo sapien
acacaagatatttccatgctagcct

SEQ ID NO: 518777 - DNA, 25 bp, Homo sapien
atttccatgctagccttttgcaagt

SEQ ID NO: 518778 - DNA, 25 bp, Homo sapien
acatatatatcctctagcttgaaac

SEQ ID NO: 518779 - DNA, 25 bp, Homo sapien
tatatcctctagcttgaaacttttg

SEQ ID NO: 518780 - DNA, 25 bp, Homo sapien
tcctctagcttgaaacttttgctca

SEQ ID NO: 518781 - DNA, 25 bp, Homo sapien
gcttgaaacttttgctcaagtttat

SEQ ID NO: 518782 - DNA, 25 bp, Homo sapien
gtttatttatgtcactggctggctg

SEQ ID NO: 518783 - DNA, 25 bp, Homo sapien
ttatttatgtcactggctggctgga

SEQ ID NO: 518784 - DNA, 25 bp, Homo sapien
atttatgtcactggctggctggatc

SEQ ID NO: 518785 - DNA, 25 bp, Homo sapien
actggctggctggatccaaagtcat

SEQ ID NO: 518786 - DNA, 25 bp, Homo sapien
tggctggctggatccaaagtcatgt

SEQ ID NO: 518787 - DNA, 25 bp, Homo sapien
tggctggatccaaagtcatgtgtcc

SEQ ID NO: 518788 - DNA, 25 bp, Homo sapien
gatccaaagtcatgtgtccacacat

SEQ ID NO: 518789 - DNA, 25 bp, Homo sapien
ttaaagcaagccactagcccctgaa

SEQ ID NO: 518790 - DNA, 25 bp, Homo sapien
aagcaagccactagcccctgaatgg

SEQ ID NO: 518791 - DNA, 25 bp, Homo sapien
tatataaatgtatagtttgcctgtg

SEQ ID NO: 518792 - DNA, 25 bp, Homo sapien
agtttgcctgtgttggtttattgtt

SEQ ID NO: 518793 - DNA, 25 bp, Homo sapien
gcctgtgttggtttattgttttcaa

SEQ ID NO: 518794 - DNA, 25 bp, Homo sapien
tgttggtttattgttttcaatgatc

SEQ ID NO: 518795 - DNA, 25 bp, Homo sapien
gtcacacttttataacaggtaggat

SEQ ID NO: 518796 - DNA, 25 bp, Homo sapien
cacttttataacaggtaggatggac

SEQ ID NO: 518797 - DNA, 25 bp, Homo sapien
gtaggatggactaggaaagcccaat

SEQ ID NO: 518798 - DNA, 25 bp, Homo sapien
ggatggactaggaaagcccaattat

SEQ ID NO: 518799 - DNA, 25 bp, Homo sapien
atggactaggaaagcccaattatga

SEQ ID NO: 518800 - DNA, 25 bp, Homo sapien
aacatttggtgctaagagttgcagc

SEQ ID NO: 518801 - DNA, 25 bp, Homo sapien
agcactgatgcctttccctaagtta

SEQ ID NO: 518802 - DNA, 25 bp, Homo sapien
gatgcctttccctaagttaattcta

SEQ ID NO: 518803 - DNA, 25 bp, Homo sapien
atatttccttcccaatgagatgcag

SEQ ID NO: 518804 - DNA, 25 bp, Homo sapien
ccttcccaatgagatgcagagtaaa

SEQ ID NO: 518805 - DNA, 25 bp, Homo sapien
gtaaaatttgagaccctccattgac

SEQ ID NO: 518806 - DNA, 25 bp, Homo sapien
ccattgactagggagcagcatctgt

SEQ ID NO: 518807 - DNA, 25 bp, Homo sapien
gagcagcatctgtcatctatggtta

SEQ ID NO: 518808 - DNA, 25 bp, Homo sapien
gcatctgtcatctatggttaattac

SEQ ID NO: 518809 - DNA, 25 bp, Homo sapien
ccccatgtatttcagattgttagag

SEQ ID NO: 518810 - DNA, 25 bp, Homo sapien
gaagtagtttgcttatatttccctt

SEQ ID NO: 518811 - DNA, 25 bp, Homo sapien
cgggaggccccgagtgggagtcata

SEQ ID NO: 518812 - DNA, 25 bp, Homo sapien
ggagtcatagcagggacccgtagcc

SEQ ID NO: 518813 - DNA, 25 bp, Homo sapien
acatcgacgggctgtaccgcatcag

SEQ ID NO: 518814 - DNA, 25 bp, Homo sapien
ggctgtaccgcatcagtggaaacct

SEQ ID NO: 518815 - DNA, 25 bp, Homo sapien
tcagtggaaacctggccaccatcca

SEQ ID NO: 518816 - DNA, 25 bp, Homo sapien
gccaccatccagaagctacgctata

SEQ ID NO: 518817 - DNA, 25 bp, Homo sapien
gaagctacgctataaggtggaccac

SEQ ID NO: 518818 - DNA, 25 bp, Homo sapien
ggtggaccacgatgagcgccttgac

SEQ ID NO: 518819 - DNA, 25 bp, Homo sapien
gctgggaggacgtccacgttatcac

SEQ ID NO: 518820 - DNA, 25 bp, Homo sapien
gtccacgttatcaccggagccctga

SEQ ID NO: 518821 - DNA, 25 bp, Homo sapien
tcgcacttccgccagttcattgcgg

SEQ ID NO: 518822 - DNA, 25 bp, Homo sapien
gattattacttgagtgttcactgat

SEQ ID NO: 518823 - DNA, 25 bp, Homo sapien
gagtgttcactgatggtttttcctt

SEQ ID NO: 518824 - DNA, 25 bp, Homo sapien
agtgttcactgatggtttttccttc

SEQ ID NO: 518825 - DNA, 25 bp, Homo sapien
tttccttcttgttaacaggaaatag

SEQ ID NO: 518826 - DNA, 25 bp, Homo sapien
tatttggtgaatatcttagttttgc

SEQ ID NO: 518827 - DNA, 25 bp, Homo sapien
ggtgaatatcttagttttgcattta

SEQ ID NO: 518828 - DNA, 25 bp, Homo sapien
tgctaagcagaatcaatgcaatcac

SEQ ID NO: 518829 - DNA, 25 bp, Homo sapien
gcagaatcaatgcaatcactatcat

SEQ ID NO: 518830 - DNA, 25 bp, Homo sapien
aatgcaatcactatcatattctata

SEQ ID NO: 518831 - DNA, 25 bp, Homo sapien
catattctatagtttttcctaacag

SEQ ID NO: 518832 - DNA, 25 bp, Homo sapien
gtttttcctaacagattgatagagt

SEQ ID NO: 518833 - DNA, 25 bp, Homo sapien
atagtttgttaatattgctgtaaag

SEQ ID NO: 518834 - DNA, 25 bp, Homo sapien
gtatgatttgaagacagactatatg

SEQ ID NO: 518835 - DNA, 25 bp, Homo sapien
gaagacagactatatgtcattttat

SEQ ID NO: 518836 - DNA, 25 bp, Homo sapien
gtcattttattatactccatcaatc

SEQ ID NO: 518837 - DNA, 25 bp, Homo sapien
atactccatcaatctataatatatt

SEQ ID NO: 518838 - DNA, 25 bp, Homo sapien
taatatattagactgatgctttatc

SEQ ID NO: 518839 - DNA, 25 bp, Homo sapien
gactgatgctttatctaaaatgctt

SEQ ID NO: 518840 - DNA, 25 bp, Homo sapien
gatgctttatctaaaatgctttgag

SEQ ID NO: 518841 - DNA, 25 bp, Homo sapien
aatgctttgagtttgtataatatat

SEQ ID NO: 518842 - DNA, 25 bp, Homo sapien
atatcttgacaaattttactaccat

SEQ ID NO: 518843 - DNA, 25 bp, Homo sapien
caaattttactaccatatgttatgt

SEQ ID NO: 518844 - DNA, 25 bp, Homo sapien
ggagatggctgggtttatcataaac

SEQ ID NO: 518845 - DNA, 25 bp, Homo sapien
ataattccaacaacacaaccagcag

SEQ ID NO: 518846 - DNA, 25 bp, Homo sapien
gtgacacatactatctaaaactcga

SEQ ID NO: 518847 - DNA, 25 bp, Homo sapien
cgaccaaatgaggttcttctctgtt

SEQ ID NO: 518848 - DNA, 25 bp, Homo sapien
tttaccctaaatcctcccagaatgg

SEQ ID NO: 518849 - DNA, 25 bp, Homo sapien
gagtcattgcactgagtgacctgct

SEQ ID NO: 518850 - DNA, 25 bp, Homo sapien
gtgacctgcttcctgattgcgcaga

SEQ ID NO: 518851 - DNA, 25 bp, Homo sapien
aacctgaatgtacctactagggcac

SEQ ID NO: 518852 - DNA, 25 bp, Homo sapien
actagggcaccataatactgcagca

SEQ ID NO: 518853 - DNA, 25 bp, Homo sapien
atactgcagcaagaccaaagtggta

SEQ ID NO: 518854 - DNA, 25 bp, Homo sapien
gaccttttaccaacctgttcatgtg

SEQ ID NO: 518855 - DNA, 25 bp, Homo sapien
agcctgctacacttacaacaactag

SEQ ID NO: 518856 - DNA, 25 bp, Homo sapien
accagtaagttgatccatccagatg

SEQ ID NO: 518857 - DNA, 25 bp, Homo sapien
gggcacagttacctaagtatcaacg

SEQ ID NO: 518858 - DNA, 25 bp, Homo sapien
agtatcaacgtaatcttcctcggcc

SEQ ID NO: 518859 - DNA, 25 bp, Homo sapien
atcggtaatccaccagttggaccaa

SEQ ID NO: 518860 - DNA, 25 bp, Homo sapien
gaccaattggaggtatgatgccacc

SEQ ID NO: 518861 - DNA, 25 bp, Homo sapien
caggcatcccacagcaacaaggaat

SEQ ID NO: 518862 - DNA, 25 bp, Homo sapien
aatgccacctcatggtcagtatggt

SEQ ID NO: 518863 - DNA, 25 bp, Homo sapien
atggtggtcatcatcaaggcatgcc

SEQ ID NO: 518864 - DNA, 25 bp, Homo sapien
tcaaggcatgccaggataccttcct

SEQ ID NO: 518865 - DNA, 25 bp, Homo sapien
aggataccttcctggtgctatgccc

SEQ ID NO: 518866 - DNA, 25 bp, Homo sapien
tataactttttacttctgccattta

SEQ ID NO: 518867 - DNA, 25 bp, Homo sapien
gccatttaaaatgctctcctgcaat

SEQ ID NO: 518868 - DNA, 25 bp, Homo sapien
taaaatgctctcctgcaataccacc

SEQ ID NO: 518869 - DNA, 25 bp, Homo sapien
gcaataccaccccttcatttaacat

SEQ ID NO: 518870 - DNA, 25 bp, Homo sapien
ttcatttaacatccttcctgtacca

SEQ ID NO: 518871 - DNA, 25 bp, Homo sapien
ttcctgtaccatcacatattgaaga

SEQ ID NO: 518872 - DNA, 25 bp, Homo sapien
gaaaacagtattacagcaaagctta

SEQ ID NO: 518873 - DNA, 25 bp, Homo sapien
tacagcaaagcttagatagtttaac

SEQ ID NO: 518874 - DNA, 25 bp, Homo sapien
tgattcttaaaaaatctttggcctt

SEQ ID NO: 518875 - DNA, 25 bp, Homo sapien
gccttagtggccttttttcttcact

SEQ ID NO: 518876 - DNA, 25 bp, Homo sapien
caattttgccattctagaaactatt

SEQ ID NO: 518877 - DNA, 25 bp, Homo sapien
gaccatgggtctctgtagaaattcc

SEQ ID NO: 518878 - DNA, 25 bp, Homo sapien
aaatttgactgcatggagtcttcag

SEQ ID NO: 518879 - DNA, 25 bp, Homo sapien
ggagtcttcaggtagaaatgtttct

SEQ ID NO: 518880 - DNA, 25 bp, Homo sapien
aatgtttctcttgcctaaattcagg

SEQ ID NO: 518881 - DNA, 25 bp, Homo sapien
tctcttgcctaaattcaggtgctaa

SEQ ID NO: 518882 - DNA, 25 bp, Homo sapien
aatggtaacctctactatgaagtgt

SEQ ID NO: 518883 - DNA, 25 bp, Homo sapien
acctctactatgaagtgtttccaat

SEQ ID NO: 518884 - DNA, 25 bp, Homo sapien
ttccaatgatgggatatctgaggcc

SEQ ID NO: 518885 - DNA, 25 bp, Homo sapien
tgaggccattacattcctgggaata

SEQ ID NO: 518886 - DNA, 25 bp, Homo sapien
ggtgaaacatacgacagaccactgt

SEQ ID NO: 518887 - DNA, 25 bp, Homo sapien
gcccaacccacaccaaataagaaat

SEQ ID NO: 518888 - DNA, 25 bp, Homo sapien
tgttctctgtagctgtgagcccttt

SEQ ID NO: 518889 - DNA, 25 bp, Homo sapien
tgaggatctgacttgggtcttggaa

SEQ ID NO: 518890 - DNA, 25 bp, Homo sapien
agctgtgagccctttgtgagaatat

SEQ ID NO: 518891 - DNA, 25 bp, Homo sapien
gccctttgtgagaatatgactctta

SEQ ID NO: 518892 - DNA, 25 bp, Homo sapien
gaggaaagtatcaggccttgagaga

SEQ ID NO: 518893 - DNA, 25 bp, Homo sapien
atgtagctttgcttctatgatctgg

SEQ ID NO: 518894 - DNA, 25 bp, Homo sapien
ggagtcaccttcacttgctagctga

SEQ ID NO: 518895 - DNA, 25 bp, Homo sapien
acttgctagctgagtcctaacacaa

SEQ ID NO: 518896 - DNA, 25 bp, Homo sapien
ttccaaccccaagtcagtcaggaag

SEQ ID NO: 518897 - DNA, 25 bp, Homo sapien
caagtcagtcaggaagctgcccatt

SEQ ID NO: 518898 - DNA, 25 bp, Homo sapien
ttgcaaggcattttaatgccctttc

SEQ ID NO: 518899 - DNA, 25 bp, Homo sapien
ttgaaagtgaggcacttcctccgtg

SEQ ID NO: 518900 - DNA, 25 bp, Homo sapien
tgaggcacttcctccgtggagccct

SEQ ID NO: 518901 - DNA, 25 bp, Homo sapien
tggagccctccaagcagaactgtgt

SEQ ID NO: 518902 - DNA, 25 bp, Homo sapien
agccctccaagcagaactgtgttcg

SEQ ID NO: 518903 - DNA, 25 bp, Homo sapien
tgtgttcgcaaaagtgttttgataa

SEQ ID NO: 518904 - DNA, 25 bp, Homo sapien
gtgttttgataattctagttcttac

SEQ ID NO: 518905 - DNA, 25 bp, Homo sapien
attctagttcttacattatttggtt

SEQ ID NO: 518906 - DNA, 25 bp, Homo sapien
tatttggttatttatcggtttgcca

SEQ ID NO: 518907 - DNA, 25 bp, Homo sapien
ggttatttatcggtttgccaatatt

SEQ ID NO: 518908 - DNA, 25 bp, Homo sapien
atcggtttgccaatattagccatag

SEQ ID NO: 518909 - DNA, 25 bp, Homo sapien
ttagccatagatttaaaaccattca

SEQ ID NO: 518910 - DNA, 25 bp, Homo sapien
agacatggcagcatctctgagttac

SEQ ID NO: 518911 - DNA, 25 bp, Homo sapien
cagattgcaatgtgttgccctgcat

SEQ ID NO: 518912 - DNA, 25 bp, Homo sapien
gttgccctgcatggttgaactgctt

SEQ ID NO: 518913 - DNA, 25 bp, Homo sapien
tgaactgcttcggacatctgctagg

SEQ ID NO: 518914 - DNA, 25 bp, Homo sapien
ggacatctgctaggcatcccatgtg

SEQ ID NO: 518915 - DNA, 25 bp, Homo sapien
tcttcaatgccagtgagtcacaatg

SEQ ID NO: 518916 - DNA, 25 bp, Homo sapien
gtcacaatggcctatgcttattcac

SEQ ID NO: 518917 - DNA, 25 bp, Homo sapien
gcaataatacctagggagtccccat

SEQ ID NO: 518918 - DNA, 25 bp, Homo sapien
atgaagcccttttgtcctggtccct

SEQ ID NO: 518919 - DNA, 25 bp, Homo sapien
gggtcagttcatgagaacctgcatt

SEQ ID NO: 518920 - DNA, 25 bp, Homo sapien
acctgcatttatgaagccctgggct

SEQ ID NO: 518921 - DNA, 25 bp, Homo sapien
attccttacaaaatcttcatttaag

SEQ ID NO: 518922 - DNA, 25 bp, Homo sapien
ttccttacaaaatcttcatttaagg

SEQ ID NO: 518923 - DNA, 25 bp, Homo sapien
cttacaaaatcttcatttaaggctg

SEQ ID NO: 518924 - DNA, 25 bp, Homo sapien
ttacaaaatcttcatttaaggctga

SEQ ID NO: 518925 - DNA, 25 bp, Homo sapien
tacaaaatcttcatttaaggctgag

SEQ ID NO: 518926 - DNA, 25 bp, Homo sapien
acaaaatcttcatttaaggctgagt

SEQ ID NO: 518927 - DNA, 25 bp, Homo sapien
caaaatcttcatttaaggctgagtg

SEQ ID NO: 518928 - DNA, 25 bp, Homo sapien
aaaatcttcatttaaggctgagtgt

SEQ ID NO: 518929 - DNA, 25 bp, Homo sapien
atcttcatttaaggctgagtgtggt

SEQ ID NO: 518930 - DNA, 25 bp, Homo sapien
tcttcatttaaggctgagtgtggtg

SEQ ID NO: 518931 - DNA, 25 bp, Homo sapien
gtctctacatagaaattttattata

SEQ ID NO: 518932 - DNA, 25 bp, Homo sapien
aatcacattgtaagcttgaatttgg

SEQ ID NO: 518933 - DNA, 25 bp, Homo sapien
atttgggcttgtacctgcatctttt

SEQ ID NO: 518934 - DNA, 25 bp, Homo sapien
gcttgtacctgcatcttttgtattc

SEQ ID NO: 518935 - DNA, 25 bp, Homo sapien
tacctgcatcttttgtattctgtac

SEQ ID NO: 518936 - DNA, 25 bp, Homo sapien
tctgtacatctggttacttagactt

SEQ ID NO: 518937 - DNA, 25 bp, Homo sapien
acatctggttacttagactttggga

SEQ ID NO: 518938 - DNA, 25 bp, Homo sapien
tagactttgggagtccaatttggtt

SEQ ID NO: 518939 - DNA, 25 bp, Homo sapien
agtccaatttggtttcagtcatgta

SEQ ID NO: 518940 - DNA, 25 bp, Homo sapien
ggtttcagtcatgtatgtctacttt

SEQ ID NO: 518941 - DNA, 25 bp, Homo sapien
agtcatgtatgtctactttgtagtt

SEQ ID NO: 518942 - DNA, 25 bp, Homo sapien
tgttttgcatttgacttcatttgac

SEQ ID NO: 518943 - DNA, 25 bp, Homo sapien
tcttgccatggcgaggcctgcagac

SEQ ID NO: 518944 - DNA, 25 bp, Homo sapien
cttgccatggcgaggcctgcagact

SEQ ID NO: 518945 - DNA, 25 bp, Homo sapien
ttgccatggcgaggcctgcagactc

SEQ ID NO: 518946 - DNA, 25 bp, Homo sapien
tccctgccatccggggcctgggctt

SEQ ID NO: 518947 - DNA, 25 bp, Homo sapien
ccctgccatccggggcctgggcttg

SEQ ID NO: 518948 - DNA, 25 bp, Homo sapien
cctgccatccggggcctgggcttgc

SEQ ID NO: 518949 - DNA, 25 bp, Homo sapien
ctgccatccggggcctgggcttgct

SEQ ID NO: 518950 - DNA, 25 bp, Homo sapien
gccatccggggcctgggcttgcttt

SEQ ID NO: 518951 - DNA, 25 bp, Homo sapien
ccatccggggcctgggcttgctttc

SEQ ID NO: 518952 - DNA, 25 bp, Homo sapien
catccggggcctgggcttgctttct

SEQ ID NO: 518953 - DNA, 25 bp, Homo sapien
atccggggcctgggcttgctttctc

SEQ ID NO: 518954 - DNA, 25 bp, Homo sapien
tgtggtacagattcacagtctgaga

SEQ ID NO: 518955 - DNA, 25 bp, Homo sapien
aatgaggcttcaccagtaaaacggc

SEQ ID NO: 518956 - DNA, 25 bp, Homo sapien
gtaaaacggccacgactacttgaga

SEQ ID NO: 518957 - DNA, 25 bp, Homo sapien
cgactacttgagaatacggaacggt

SEQ ID NO: 518958 - DNA, 25 bp, Homo sapien
ggaaaccagtcgatctaaacagaag

SEQ ID NO: 518959 - DNA, 25 bp, Homo sapien
agaagagtcgacgtcggtgcttcca

SEQ ID NO: 518960 - DNA, 25 bp, Homo sapien
ggtgcttccagtgccaaaccaaact

SEQ ID NO: 518961 - DNA, 25 bp, Homo sapien
aattgggatcgtgtcgctgcggtta

SEQ ID NO: 518962 - DNA, 25 bp, Homo sapien
gctgcggttatgtgttctgtatgtt

SEQ ID NO: 518963 - DNA, 25 bp, Homo sapien
acgactgcacattcgaccacatggg

SEQ ID NO: 518964 - DNA, 25 bp, Homo sapien
ggccgggaggaagccatcatgaaaa

SEQ ID NO: 518965 - DNA, 25 bp, Homo sapien
agccttcagctggactcagggttgg

SEQ ID NO: 518966 - DNA, 25 bp, Homo sapien
gaggaggtggcttcctgccccattg

SEQ ID NO: 518967 - DNA, 25 bp, Homo sapien
ttcctgccccattgttctggactgc

SEQ ID NO: 518968 - DNA, 25 bp, Homo sapien
ctggactgcagtgtttcttgggaat

SEQ ID NO: 518969 - DNA, 25 bp, Homo sapien
tggattttcagtaaccaacttggaa

SEQ ID NO: 518970 - DNA, 25 bp, Homo sapien
aaagctgtatttgttcccatgattc

SEQ ID NO: 518971 - DNA, 25 bp, Homo sapien
gttcccatgattcagcaaacaatga

SEQ ID NO: 518972 - DNA, 25 bp, Homo sapien
agtacctactgtgtgtagaagcagc

SEQ ID NO: 518973 - DNA, 25 bp, Homo sapien
gtgtgtagaagcagcaggacagcct

SEQ ID NO: 518974 - DNA, 25 bp, Homo sapien
aggacagcctgtcatcactgggaaa

SEQ ID NO: 518975 - DNA, 25 bp, Homo sapien
gggcttcctgttgcagccttcagct

SEQ ID NO: 518976 - DNA, 25 bp, Homo sapien
aaggggaggtccagccctcttgcaa

SEQ ID NO: 518977 - DNA, 25 bp, Homo sapien
ccctcttgcaagtgtggtgagaggc

SEQ ID NO: 518978 - DNA, 25 bp, Homo sapien
aaaattcagtgacgtacatggctct

SEQ ID NO: 518979 - DNA, 25 bp, Homo sapien
agtgacgtacatggctctggttctg

SEQ ID NO: 518980 - DNA, 25 bp, Homo sapien
gacgtacatggctctggttctggac

SEQ ID NO: 518981 - DNA, 25 bp, Homo sapien
cgtacatggctctggttctggacac

SEQ ID NO: 518982 - DNA, 25 bp, Homo sapien
ggttctggacacaaaatctgtactg

SEQ ID NO: 518983 - DNA, 25 bp, Homo sapien
gacacaaaatctgtactggagagga

SEQ ID NO: 518984 - DNA, 25 bp, Homo sapien
ctgtactggagaggaaatgactgct

SEQ ID NO: 518985 - DNA, 25 bp, Homo sapien
gaaatgactgctgaaataaggcgat

SEQ ID NO: 518986 - DNA, 25 bp, Homo sapien
aaatgcctggaacactaaagtaaag

SEQ ID NO: 518987 - DNA, 25 bp, Homo sapien
attaggtagaagcttaattccacta

SEQ ID NO: 518988 - DNA, 25 bp, Homo sapien
gaagcttaattccactaaatgtaga

SEQ ID NO: 518989 - DNA, 25 bp, Homo sapien
tttagttttcttctctaaccaagat

SEQ ID NO: 518990 - DNA, 25 bp, Homo sapien
aaatatgcttataacttttccaaga

SEQ ID NO: 518991 - DNA, 25 bp, Homo sapien
tccaagaaatgatgattacagtgct

SEQ ID NO: 518992 - DNA, 25 bp, Homo sapien
ttacagtgcttttgtggttacaact

SEQ ID NO: 518993 - DNA, 25 bp, Homo sapien
tgtggttacaactgtttggtatatt

SEQ ID NO: 518994 - DNA, 25 bp, Homo sapien
gggtttactatcacatctaggtctt

SEQ ID NO: 518995 - DNA, 25 bp, Homo sapien
catctaggtcttttttactatgtca

SEQ ID NO: 518996 - DNA, 25 bp, Homo sapien
ataagaatctgaggacagccctgaa

SEQ ID NO: 518997 - DNA, 25 bp, Homo sapien
gtaattcaaggtcatacaatacaaa

SEQ ID NO: 518998 - DNA, 25 bp, Homo sapien
atcttccctagcctttctgggttat

SEQ ID NO: 518999 - DNA, 25 bp, Homo sapien
tgggttatatttgcctcctttgcaa

SEQ ID NO: 519000 - DNA, 25 bp, Homo sapien
gcaaatataatacaggtccaggtct

SEQ ID NO: 519001 - DNA, 25 bp, Homo sapien
acaggtccaggtctggagttccagc

SEQ ID NO: 519002 - DNA, 25 bp, Homo sapien
tcgccctcaatctcggtatctttga

SEQ ID NO: 519003 - DNA, 25 bp, Homo sapien
ctcggtatctttgagtcattttgaa

SEQ ID NO: 519004 - DNA, 25 bp, Homo sapien
aagcttgggatttcagaagggaaca

SEQ ID NO: 519005 - DNA, 25 bp, Homo sapien
aaagacctttggtgtgcgtgcactc

SEQ ID NO: 519006 - DNA, 25 bp, Homo sapien
gtgtgcgtgcactcccatatttgtc

SEQ ID NO: 519007 - DNA, 25 bp, Homo sapien
gcactcccatatttgtctgtcatta

SEQ ID NO: 519008 - DNA, 25 bp, Homo sapien
ttgtctgtcattatcattattcctc

SEQ ID NO: 519009 - DNA, 25 bp, Homo sapien
taggtttctgctttacttaactggc

SEQ ID NO: 519010 - DNA, 25 bp, Homo sapien
aaaatttggtgctgtaagggaggca

SEQ ID NO: 519011 - DNA, 25 bp, Homo sapien
gggaggcagccacaaaaccagtgat

SEQ ID NO: 519012 - DNA, 25 bp, Homo sapien
agccacaaaaccagtgatagcattt

SEQ ID NO: 519013 - DNA, 25 bp, Homo sapien
tagtatcatcttagttctcttccct

SEQ ID NO: 519014 - DNA, 25 bp, Homo sapien
aaagctcaagggtttacattcaact

SEQ ID NO: 519015 - DNA, 25 bp, Homo sapien
gggtttacattcaactgtgacagca

SEQ ID NO: 519016 - DNA, 25 bp, Homo sapien
actgtgacagcactatgaattcatt

SEQ ID NO: 519017 - DNA, 25 bp, Homo sapien
gaagcatgtttcaggttgcactgta

SEQ ID NO: 519018 - DNA, 25 bp, Homo sapien
ggttgcactgtaatttccctatgta

SEQ ID NO: 519019 - DNA, 25 bp, Homo sapien
gaataagccaaaacgtgtgccatat

SEQ ID NO: 519020 - DNA, 25 bp, Homo sapien
ttaccttaagtagtcaaatttacag

SEQ ID NO: 519021 - DNA, 25 bp, Homo sapien
taccttaagtagtcaaatttacaga

SEQ ID NO: 519022 - DNA, 25 bp, Homo sapien
atgcagctcatatttaaagggaaaa

SEQ ID NO: 519023 - DNA, 25 bp, Homo sapien
tttcaaattaaccatcatatcacag

SEQ ID NO: 519024 - DNA, 25 bp, Homo sapien
attaaccatcatatcacagatctct

SEQ ID NO: 519025 - DNA, 25 bp, Homo sapien
ttaaccatcatatcacagatctctt

SEQ ID NO: 519026 - DNA, 25 bp, Homo sapien
taaccatcatatcacagatctcttc

SEQ ID NO: 519027 - DNA, 25 bp, Homo sapien
aaccatcatatcacagatctcttca

SEQ ID NO: 519028 - DNA, 25 bp, Homo sapien
accatcatatcacagatctcttcag

SEQ ID NO: 519029 - DNA, 25 bp, Homo sapien
ccatcatatcacagatctcttcaga

SEQ ID NO: 519030 - DNA, 25 bp, Homo sapien
tcatatcacagatctcttcagaatt

SEQ ID NO: 519031 - DNA, 25 bp, Homo sapien
aagtgacaattagtctcatagcatc

SEQ ID NO: 519032 - DNA, 25 bp, Homo sapien
gagaatctctgaaatctgctttcat

SEQ ID NO: 519033 - DNA, 25 bp, Homo sapien
aaacaagggtgcattcctgtcctgg

SEQ ID NO: 519034 - DNA, 25 bp, Homo sapien
acatttgtttcttagattgctgatc

SEQ ID NO: 519035 - DNA, 25 bp, Homo sapien
ctggtgcgacagaatcctcttggat

SEQ ID NO: 519036 - DNA, 25 bp, Homo sapien
ggattccatggcacagagttactct

SEQ ID NO: 519037 - DNA, 25 bp, Homo sapien
tatgagaccagcctccaagtacttc

SEQ ID NO: 519038 - DNA, 25 bp, Homo sapien
gattgctgatcttgtctccagagtc

SEQ ID NO: 519039 - DNA, 25 bp, Homo sapien
tccagagtccctgttattagcactg

SEQ ID NO: 519040 - DNA, 25 bp, Homo sapien
tgttattagcactgcccttctctgt

SEQ ID NO: 519041 - DNA, 25 bp, Homo sapien
ctggagcctaccctaagtgacaatt

SEQ ID NO: 519042 - DNA, 25 bp, Homo sapien
accagaccaaattcactttccagcc

SEQ ID NO: 519043 - DNA, 25 bp, Homo sapien
gaacctgaaacttgagctagtgtct

SEQ ID NO: 519044 - DNA, 25 bp, Homo sapien
acttgagctagtgtcttgggagaaa

SEQ ID NO: 519045 - DNA, 25 bp, Homo sapien
ggaaatctctacgaggtacccatcc

SEQ ID NO: 519046 - DNA, 25 bp, Homo sapien
tctctacgaggtacccatccttctg

SEQ ID NO: 519047 - DNA, 25 bp, Homo sapien
atccttctgcaccttaggtctgagg

SEQ ID NO: 519048 - DNA, 25 bp, Homo sapien
accttaggtctgaggtgcttggccc

SEQ ID NO: 519049 - DNA, 25 bp, Homo sapien
gaagccctacatgaatgggacagaa

SEQ ID NO: 519050 - DNA, 25 bp, Homo sapien
gaaggtccttaacaacactggagat

SEQ ID NO: 519051 - DNA, 25 bp, Homo sapien
cactggagatgaagcagccgatgct

SEQ ID NO: 519052 - DNA, 25 bp, Homo sapien
agccgatgctgttttggacaaatga

SEQ ID NO: 519053 - DNA, 25 bp, Homo sapien
aggtctctgggcaagcaagtggtta

SEQ ID NO: 519054 - DNA, 25 bp, Homo sapien
gttatttggattgcttgcttccctt

SEQ ID NO: 519055 - DNA, 25 bp, Homo sapien
ctttttccacctgggacattgtaat

SEQ ID NO: 519056 - DNA, 25 bp, Homo sapien
caaaaactattatggcctgagcaca

SEQ ID NO: 519057 - DNA, 25 bp, Homo sapien
gcctgagcacagctgaaatctagca

SEQ ID NO: 519058 - DNA, 25 bp, Homo sapien
cagagtttaactcttctgcctccat

SEQ ID NO: 519059 - DNA, 25 bp, Homo sapien
tgcctccatgtctgtcacttataat

SEQ ID NO: 519060 - DNA, 25 bp, Homo sapien
ataattcaggttctgctgttggctt

SEQ ID NO: 519061 - DNA, 25 bp, Homo sapien
cagaagaatcgttttatgctagtta

SEQ ID NO: 519062 - DNA, 25 bp, Homo sapien
gctagttattgcattcatggttgaa

SEQ ID NO: 519063 - DNA, 25 bp, Homo sapien
gaaagggttccaatgtattaagcaa

SEQ ID NO: 519064 - DNA, 25 bp, Homo sapien
tattcagtttccttaccattaccag

SEQ ID NO: 519065 - DNA, 25 bp, Homo sapien
tccttaccattaccagctcagaagt

SEQ ID NO: 519066 - DNA, 25 bp, Homo sapien
gctagaggctttctacccaaaggat

SEQ ID NO: 519067 - DNA, 25 bp, Homo sapien
gagctagggccttcacatggtggta

SEQ ID NO: 519068 - DNA, 25 bp, Homo sapien
cacatggtggtagcaagtttttcaa

SEQ ID NO: 519069 - DNA, 25 bp, Homo sapien
aaatgcttctgtggacctggcatga

SEQ ID NO: 519070 - DNA, 25 bp, Homo sapien
acctggcatgaaagatccctagatt

SEQ ID NO: 519071 - DNA, 25 bp, Homo sapien
ggaataatacctccatgtctcctgt

SEQ ID NO: 519072 - DNA, 25 bp, Homo sapien
ccatgtctcctgtatgttgagtcta

SEQ ID NO: 519073 - DNA, 25 bp, Homo sapien
ttgagtctagaattgctgtgttgtt

SEQ ID NO: 519074 - DNA, 25 bp, Homo sapien
ttgttcttagaagcagtctttgggc

SEQ ID NO: 519075 - DNA, 25 bp, Homo sapien
ccctgtaagacacttctttctcatt

SEQ ID NO: 519076 - DNA, 25 bp, Homo sapien
attttctcctctgatggtgtgccag

SEQ ID NO: 519077 - DNA, 25 bp, Homo sapien
cctctgatggtgtgccaggatgctg

SEQ ID NO: 519078 - DNA, 25 bp, Homo sapien
aaggctgttcagtgacaaggaacct

SEQ ID NO: 519079 - DNA, 25 bp, Homo sapien
tgacaaggaacctaagacttagtgc

SEQ ID NO: 519080 - DNA, 25 bp, Homo sapien
gacttagtgccaaggactgaaacca

SEQ ID NO: 519081 - DNA, 25 bp, Homo sapien
gatggaaacatctacactttctcat

SEQ ID NO: 519082 - DNA, 25 bp, Homo sapien
actttctcattagtggcctctacag

SEQ ID NO: 519083 - DNA, 25 bp, Homo sapien
attagtggcctctacagcagttgcc

SEQ ID NO: 519084 - DNA, 25 bp, Homo sapien
agcagttgccccaaagaagcgtctc

SEQ ID NO: 519085 - DNA, 25 bp, Homo sapien
tgccccaaagaagcgtctcattgtt

SEQ ID NO: 519086 - DNA, 25 bp, Homo sapien
ggcatgttggaattcttctttaagt

SEQ ID NO: 519087 - DNA, 25 bp, Homo sapien
tagcatttttcatcatatccttccg

SEQ ID NO: 519088 - DNA, 25 bp, Homo sapien
ttcatcatatccttccgaaaccgat

SEQ ID NO: 519089 - DNA, 25 bp, Homo sapien
atccttccgaaaccgattgttcatc

SEQ ID NO: 519090 - DNA, 25 bp, Homo sapien
gaaaccgattgttcatcatgtcaac

SEQ ID NO: 519091 - DNA, 25 bp, Homo sapien
tgttcatcatgtcaaccatttcctc

SEQ ID NO: 519092 - DNA, 25 bp, Homo sapien
atgtcaaccatttcctcatcttcat

SEQ ID NO: 519093 - DNA, 25 bp, Homo sapien
ggtggaaaattaccttttgcttcat

SEQ ID NO: 519094 - DNA, 25 bp, Homo sapien
aaattaccttttgcttcattctcca

SEQ ID NO: 519095 - DNA, 25 bp, Homo sapien
ttaccttttgcttcattctccactt

SEQ ID NO: 519096 - DNA, 25 bp, Homo sapien
tcctcccatggcatgttggaattct

SEQ ID NO: 519097 - DNA, 25 bp, Homo sapien
attctgtatgtcaggcttggcacaa

SEQ ID NO: 519098 - DNA, 25 bp, Homo sapien
tatgctgtagatcagaacctctctg

SEQ ID NO: 519099 - DNA, 25 bp, Homo sapien
ctaatattgcctttttagcatggtt

SEQ ID NO: 519100 - DNA, 25 bp, Homo sapien
gctaagatctagtactgtcactcca

SEQ ID NO: 519101 - DNA, 25 bp, Homo sapien
tagtactgtcactccagtatgtccc

SEQ ID NO: 519102 - DNA, 25 bp, Homo sapien
atgtcccaattctacctacgtttat

SEQ ID NO: 519103 - DNA, 25 bp, Homo sapien
gggtcaacagttctgatctcagcat

SEQ ID NO: 519104 - DNA, 25 bp, Homo sapien
ctgatctcagcattgggtaaagggt

SEQ ID NO: 519105 - DNA, 25 bp, Homo sapien
gacattcagatttacggtccttgat

SEQ ID NO: 519106 - DNA, 25 bp, Homo sapien
caacgttccgttgtgtaataaatgt

SEQ ID NO: 519107 - DNA, 25 bp, Homo sapien
gtaagtgtacatatgcctgggacat

SEQ ID NO: 519108 - DNA, 25 bp, Homo sapien
tgcttgagcacactgatcaaccact

SEQ ID NO: 519109 - DNA, 25 bp, Homo sapien
tgatcaaccactgaactgccttctt

SEQ ID NO: 519110 - DNA, 25 bp, Homo sapien
atggctttcatagttgggatttcag

SEQ ID NO: 519111 - DNA, 25 bp, Homo sapien
ggatttcagagcactgataccagat

SEQ ID NO: 519112 - DNA, 25 bp, Homo sapien
agatattttcagtttgttctctggg

SEQ ID NO: 519113 - DNA, 25 bp, Homo sapien
gggaatttcatttgcatctatgttt

SEQ ID NO: 519114 - DNA, 25 bp, Homo sapien
gcatctatgtttttagctatctgtg

SEQ ID NO: 519115 - DNA, 25 bp, Homo sapien
gatattttgcttctattggaacatt

SEQ ID NO: 519116 - DNA, 25 bp, Homo sapien
ggaacatttgtatactcgcaactat

SEQ ID NO: 519117 - DNA, 25 bp, Homo sapien
gtatactcgcaactatatttctgta

SEQ ID NO: 519118 - DNA, 25 bp, Homo sapien
atatttctgtaaacagctgcagtca

SEQ ID NO: 519119 - DNA, 25 bp, Homo sapien
ctgtgtactagtagggtaggagttt

SEQ ID NO: 519120 - DNA, 25 bp, Homo sapien
taggagtttttgttcagggaccagc

SEQ ID NO: 519121 - DNA, 25 bp, Homo sapien
gagtttttgttcagggaccagcgga

SEQ ID NO: 519122 - DNA, 25 bp, Homo sapien
ttttgttcagggaccagcggaacga

SEQ ID NO: 519123 - DNA, 25 bp, Homo sapien
agggaccagcggaacgaggctttct

SEQ ID NO: 519124 - DNA, 25 bp, Homo sapien
accagcggaacgaggctttctgtcg

SEQ ID NO: 519125 - DNA, 25 bp, Homo sapien
gcggaacgaggctttctgtcgttaa

SEQ ID NO: 519126 - DNA, 25 bp, Homo sapien
gaggctttctgtcgttaataggtct

SEQ ID NO: 519127 - DNA, 25 bp, Homo sapien
gctttctgtcgttaataggtctccc

SEQ ID NO: 519128 - DNA, 25 bp, Homo sapien
tttctgtcgttaataggtctcccct

SEQ ID NO: 519129 - DNA, 25 bp, Homo sapien
tcgttaataggtctcccctctgcta

SEQ ID NO: 519130 - DNA, 25 bp, Homo sapien
aattcggtggttcatgagcttgcct

SEQ ID NO: 519131 - DNA, 25 bp, Homo sapien
agcttgcctggtatttgtttctcta

SEQ ID NO: 519132 - DNA, 25 bp, Homo sapien
acttattatcttacagcgtatgtgt

SEQ ID NO: 519133 - DNA, 25 bp, Homo sapien
ggtatttgtttctctatggcttatc

SEQ ID NO: 519134 - DNA, 25 bp, Homo sapien
gtttctctatggcttatcatctaag

SEQ ID NO: 519135 - DNA, 25 bp, Homo sapien
taatctgttacctaattactgagag

SEQ ID NO: 519136 - DNA, 25 bp, Homo sapien
tactgagaggattcgattcttgctt

SEQ ID NO: 519137 - DNA, 25 bp, Homo sapien
cgattcttgctttatgttattactg

SEQ ID NO: 519138 - DNA, 25 bp, Homo sapien
gttattactgaaacagactgcccag

SEQ ID NO: 519139 - DNA, 25 bp, Homo sapien
tgattattttctagagggtcgtacc

SEQ ID NO: 519140 - DNA, 25 bp, Homo sapien
gggtcgtaccctttattaagctgtg

SEQ ID NO: 519141 - DNA, 25 bp, Homo sapien
tgaaggctgaagtgtggcaattcac

SEQ ID NO: 519142 - DNA, 25 bp, Homo sapien
aaggctgaagtgtggcaattcacgt

SEQ ID NO: 519143 - DNA, 25 bp, Homo sapien
gctgaagtgtggcaattcacgttgt

SEQ ID NO: 519144 - DNA, 25 bp, Homo sapien
tgaagtgtggcaattcacgttgtgg

SEQ ID NO: 519145 - DNA, 25 bp, Homo sapien
aagtgtggcaattcacgttgtgggt

SEQ ID NO: 519146 - DNA, 25 bp, Homo sapien
gtggcaattcacgttgtgggtggcg

SEQ ID NO: 519147 - DNA, 25 bp, Homo sapien
aagctcgaggagtcacccttcccaa

SEQ ID NO: 519148 - DNA, 25 bp, Homo sapien
gaggagtcacccttcccaatcaaaa

SEQ ID NO: 519149 - DNA, 25 bp, Homo sapien
aggagtcacccttcccaatcaaaag

SEQ ID NO: 519150 - DNA, 25 bp, Homo sapien
ggagtcacccttcccaatcaaaagc

SEQ ID NO: 519151 - DNA, 25 bp, Homo sapien
ttcccaatcaaaagcccagacccca

SEQ ID NO: 519152 - DNA, 25 bp, Homo sapien
taccagtgtttattcctgttccccg

SEQ ID NO: 519153 - DNA, 25 bp, Homo sapien
tgtttattcctgttccccgggagag

SEQ ID NO: 519154 - DNA, 25 bp, Homo sapien
tgttccccgggagaggaggcatttt

SEQ ID NO: 519155 - DNA, 25 bp, Homo sapien
tttttctgtcaacactgggcgattt

SEQ ID NO: 519156 - DNA, 25 bp, Homo sapien
ttctgtcaacactgggcgatttaag

SEQ ID NO: 519157 - DNA, 25 bp, Homo sapien
cactgggcgatttaagaactgactt

SEQ ID NO: 519158 - DNA, 25 bp, Homo sapien
tgttcaccttaagtagagaggctgg

SEQ ID NO: 519159 - DNA, 25 bp, Homo sapien
gggtgagtcaatatttactcagcct

SEQ ID NO: 519160 - DNA, 25 bp, Homo sapien
tcaatatttactcagcctcagtgcc

SEQ ID NO: 519161 - DNA, 25 bp, Homo sapien
ttactcagcctcagtgcctcagaaa

SEQ ID NO: 519162 - DNA, 25 bp, Homo sapien
tggcaagtccagaataagtcctttt

SEQ ID NO: 519163 - DNA, 25 bp, Homo sapien
gcccaaacaaattcgaatatcttct

SEQ ID NO: 519164 - DNA, 25 bp, Homo sapien
aattcgaatatcttctaaaacagga

SEQ ID NO: 519165 - DNA, 25 bp, Homo sapien
tatcttctaaaacaggaatacctct

SEQ ID NO: 519166 - DNA, 25 bp, Homo sapien
ggaatacctctcaatgtcttaccaa

SEQ ID NO: 519167 - DNA, 25 bp, Homo sapien
aatacctctcaatgtcttaccaaag

SEQ ID NO: 519168 - DNA, 25 bp, Homo sapien
ttaccaaagaaaggactcacagcaa

SEQ ID NO: 519169 - DNA, 25 bp, Homo sapien
agaaaggactcacagcaaagcaaac

SEQ ID NO: 519170 - DNA, 25 bp, Homo sapien
tggcagtgatcttcctaaagtatca

SEQ ID NO: 519171 - DNA, 25 bp, Homo sapien
gcagtgatcttcctaaagtatcaac

SEQ ID NO: 519172 - DNA, 25 bp, Homo sapien
gatcttcctaaagtatcaactcagc

SEQ ID NO: 519173 - DNA, 25 bp, Homo sapien
taaagtatcaactcagccacgttct

SEQ ID NO: 519174 - DNA, 25 bp, Homo sapien
gatggaaaatacgtctctttttatt

SEQ ID NO: 519175 - DNA, 25 bp, Homo sapien
ttcacacctctgcatcatagacaac

SEQ ID NO: 519176 - DNA, 25 bp, Homo sapien
tagacaactgagtatctcccttggc

SEQ ID NO: 519177 - DNA, 25 bp, Homo sapien
gtgctccattcctcagccgtttgga

SEQ ID NO: 519178 - DNA, 25 bp, Homo sapien
attcctcagccgtttggacagggag

SEQ ID NO: 519179 - DNA, 25 bp, Homo sapien
accaaggagcccatgtgagacacac

SEQ ID NO: 519180 - DNA, 25 bp, Homo sapien
ggagcccatgtgagacacactgcta

SEQ ID NO: 519181 - DNA, 25 bp, Homo sapien
gtgagacacactgctatgactgcct

SEQ ID NO: 519182 - DNA, 25 bp, Homo sapien
actgctatgactgcctcttgttaat

SEQ ID NO: 519183 - DNA, 25 bp, Homo sapien
gctatgactgcctcttgttaatgtc

SEQ ID NO: 519184 - DNA, 25 bp, Homo sapien
gttaatgtcagcatcacctcatcac

SEQ ID NO: 519185 - DNA, 25 bp, Homo sapien
gaccaaagcaaaagcttcgccggga

SEQ ID NO: 519186 - DNA, 25 bp, Homo sapien
tttccacccagcactgggagacaga

SEQ ID NO: 519187 - DNA, 25 bp, Homo sapien
actgagagcctctaggtttgcagga

SEQ ID NO: 519188 - DNA, 25 bp, Homo sapien
gcaggaatgcacttggctgttctta

SEQ ID NO: 519189 - DNA, 25 bp, Homo sapien
gcacttggctgttcttaggtttttg

SEQ ID NO: 519190 - DNA, 25 bp, Homo sapien
gtgtatctttaactgttactctaat

SEQ ID NO: 519191 - DNA, 25 bp, Homo sapien
gggcctgtgtacttcttgtagtttg

SEQ ID NO: 519192 - DNA, 25 bp, Homo sapien
acttcttgtagtttggaggcccatg

SEQ ID NO: 519193 - DNA, 25 bp, Homo sapien
ggaggcccatgaatagtctttatcg

SEQ ID NO: 519194 - DNA, 25 bp, Homo sapien
atagtctttatcgaccctgggaaat

SEQ ID NO: 519195 - DNA, 25 bp, Homo sapien
gtgagtcattcttgggagggaaccc

SEQ ID NO: 519196 - DNA, 25 bp, Homo sapien
cacccattcaagcatcctgtggata

SEQ ID NO: 519197 - DNA, 25 bp, Homo sapien
agaattcagggaaccatccacacac

SEQ ID NO: 519198 - DNA, 25 bp, Homo sapien
aaccctgggaagcatccagttctca

SEQ ID NO: 519199 - DNA, 25 bp, Homo sapien
agcatccagttctcaaatcgttttt

SEQ ID NO: 519200 - DNA, 25 bp, Homo sapien
acaagaacattccttgacttccctc

SEQ ID NO: 519201 - DNA, 25 bp, Homo sapien
cttccctcctgctggtgttttaaag

SEQ ID NO: 519202 - DNA, 25 bp, Homo sapien
aagtagggaagatatctggcaggca

SEQ ID NO: 519203 - DNA, 25 bp, Homo sapien
tgaggatgacctaggcaccctacgc

SEQ ID NO: 519204 - DNA, 25 bp, Homo sapien
aggcaccctacgctagtgtgagaag

SEQ ID NO: 519205 - DNA, 25 bp, Homo sapien
ctagtgtgagaagcctgcgccccag

SEQ ID NO: 519206 - DNA, 25 bp, Homo sapien
aggatctgtgttagtccctgggatg

SEQ ID NO: 519207 - DNA, 25 bp, Homo sapien
agtagagtgcttgcttaagcctggg

SEQ ID NO: 519208 - DNA, 25 bp, Homo sapien
tgggagcccatctttatagctattt

SEQ ID NO: 519209 - DNA, 25 bp, Homo sapien
gagcccatctttatagctatttgat

SEQ ID NO: 519210 - DNA, 25 bp, Homo sapien
agaaaagagacatggccatttctaa

SEQ ID NO: 519211 - DNA, 25 bp, Homo sapien
aaggtgagtgtgtctattcccagca

SEQ ID NO: 519212 - DNA, 25 bp, Homo sapien
gagtgtgtctattcccagcagatat

SEQ ID NO: 519213 - DNA, 25 bp, Homo sapien
gtgtctattcccagcagatataaag

SEQ ID NO: 519214 - DNA, 25 bp, Homo sapien
catcttccagcctcaaatatagaga

SEQ ID NO: 519215 - DNA, 25 bp, Homo sapien
tgttagtgcaaggtcctgggctcta

SEQ ID NO: 519216 - DNA, 25 bp, Homo sapien
aaggtcctgggctctaggtgatcat

SEQ ID NO: 519217 - DNA, 25 bp, Homo sapien
tgggctctaggtgatcatttcataa

SEQ ID NO: 519218 - DNA, 25 bp, Homo sapien
gcactcttaatgttatccaggactt

SEQ ID NO: 519219 - DNA, 25 bp, Homo sapien
ggaaacttagccgagtgaacaccaa

SEQ ID NO: 519220 - DNA, 25 bp, Homo sapien
gttggccagcaggaaacttctagtt

SEQ ID NO: 519221 - DNA, 25 bp, Homo sapien
gaagaccatctttatcagagtatgt

SEQ ID NO: 519222 - DNA, 25 bp, Homo sapien
aggtgaatacagtttatgcagcagt

SEQ ID NO: 519223 - DNA, 25 bp, Homo sapien
aaggacgactatttttccacataga

SEQ ID NO: 519224 - DNA, 25 bp, Homo sapien
tttccacatagatccttgtagacag

SEQ ID NO: 519225 - DNA, 25 bp, Homo sapien
aacttctagttcttgccaaaggctg

SEQ ID NO: 519226 - DNA, 25 bp, Homo sapien
ggcatctgcatcattaaccataggg

SEQ ID NO: 519227 - DNA, 25 bp, Homo sapien
accatagggtgggtgatgttgtatc

SEQ ID NO: 519228 - DNA, 25 bp, Homo sapien
gttgtatcgaagaacagcactctta

SEQ ID NO: 519229 - DNA, 25 bp, Homo sapien
tgctttctgaaggttttggtgtaca

SEQ ID NO: 519230 - DNA, 25 bp, Homo sapien
gttttggtgtacattgagccccaga

SEQ ID NO: 519231 - DNA, 25 bp, Homo sapien
ccttgaccccagtacgaagtctatg

SEQ ID NO: 519232 - DNA, 25 bp, Homo sapien
aagtctatgccctgaatccccagag

SEQ ID NO: 519233 - DNA, 25 bp, Homo sapien
aatccccagagtagcccttcctggt

SEQ ID NO: 519234 - DNA, 25 bp, Homo sapien
gacaaacagcgtccactacatctag

SEQ ID NO: 519235 - DNA, 25 bp, Homo sapien
actacatctaggactgccggctaag

SEQ ID NO: 519236 - DNA, 25 bp, Homo sapien
aggactgccggctaagtggacacac

SEQ ID NO: 519237 - DNA, 25 bp, Homo sapien
aagtggacacacttcttgacctcct

SEQ ID NO: 519238 - DNA, 25 bp, Homo sapien
ttgacctcctaccaggaactttggt

SEQ ID NO: 519239 - DNA, 25 bp, Homo sapien
gagaccagctggtagcaataaacat

SEQ ID NO: 519240 - DNA, 25 bp, Homo sapien
agaccacaagttgatccaactaatg

SEQ ID NO: 519241 - DNA, 25 bp, Homo sapien
aggatttccttcgtgattacaccca

SEQ ID NO: 519242 - DNA, 25 bp, Homo sapien
agagacgctgtgatgatctgactcg

SEQ ID NO: 519243 - DNA, 25 bp, Homo sapien
gatgatctgactcgaaggatgcgca

SEQ ID NO: 519244 - DNA, 25 bp, Homo sapien
atgcgcagagatggttggccagcta

SEQ ID NO: 519245 - DNA, 25 bp, Homo sapien
gttggccagctatgtgtatccatgg

SEQ ID NO: 519246 - DNA, 25 bp, Homo sapien
gattacacccagatcaacgtaggca

SEQ ID NO: 519247 - DNA, 25 bp, Homo sapien
gtacttaatgagttccgttctggaa

SEQ ID NO: 519248 - DNA, 25 bp, Homo sapien
gcaatctggagttgagtgccaacca

SEQ ID NO: 519249 - DNA, 25 bp, Homo sapien
agttgagtgccaaccacaacatcct

SEQ ID NO: 519250 - DNA, 25 bp, Homo sapien
atcctccagatagtggatgtctgca

SEQ ID NO: 519251 - DNA, 25 bp, Homo sapien
agtgctggaaatgtactgggatcga

SEQ ID NO: 519252 - DNA, 25 bp, Homo sapien
gtgctggaaatgtactgggatcgaa

SEQ ID NO: 519253 - DNA, 25 bp, Homo sapien
tgctggaaatgtactgggatcgaag

SEQ ID NO: 519254 - DNA, 25 bp, Homo sapien
gaaatgtactgggatcgaagtgaca

SEQ ID NO: 519255 - DNA, 25 bp, Homo sapien
aatgtactgggatcgaagtgacaaa

SEQ ID NO: 519256 - DNA, 25 bp, Homo sapien
tgtactgggatcgaagtgacaaagt

SEQ ID NO: 519257 - DNA, 25 bp, Homo sapien
ctgggatcgaagtgacaaagtgtgt

SEQ ID NO: 519258 - DNA, 25 bp, Homo sapien
ggatcgaagtgacaaagtgtgtttt

SEQ ID NO: 519259 - DNA, 25 bp, Homo sapien
tagcaaagacatgggcaccggagta

SEQ ID NO: 519260 - DNA, 25 bp, Homo sapien
aaagacatgggcaccggagtaggtc

SEQ ID NO: 519261 - DNA, 25 bp, Homo sapien
acatgggcaccggagtaggtcccgt

SEQ ID NO: 519262 - DNA, 25 bp, Homo sapien
acacataaatacacccagcacttgc

SEQ ID NO: 519263 - DNA, 25 bp, Homo sapien
acacccagcacttgcaaggctagag

SEQ ID NO: 519264 - DNA, 25 bp, Homo sapien
aaggctagagggaaactggtgacac

SEQ ID NO: 519265 - DNA, 25 bp, Homo sapien
ggtgacactctacagtctgactgat

SEQ ID NO: 519266 - DNA, 25 bp, Homo sapien
agtctgactgattcagtgtttctgg

SEQ ID NO: 519267 - DNA, 25 bp, Homo sapien
gtgtttctggagagcaggacataaa

SEQ ID NO: 519268 - DNA, 25 bp, Homo sapien
gaatgatcaaggactctacacactg

SEQ ID NO: 519269 - DNA, 25 bp, Homo sapien
caaggactctacacactgggtggct

SEQ ID NO: 519270 - DNA, 25 bp, Homo sapien
tggagagcccactttcccagaataa

SEQ ID NO: 519271 - DNA, 25 bp, Homo sapien
aaggaatcatgggagcaatggtgtt

SEQ ID NO: 519272 - DNA, 25 bp, Homo sapien
atggtgttgagttcacttcaagccc

SEQ ID NO: 519273 - DNA, 25 bp, Homo sapien
aatactggcagattttgctttagct

SEQ ID NO: 519274 - DNA, 25 bp, Homo sapien
ggcagattttgctttagctatatca

SEQ ID NO: 519275 - DNA, 25 bp, Homo sapien
gattttgctttagctatatcataaa

SEQ ID NO: 519276 - DNA, 25 bp, Homo sapien
gggaaattaacatctgtcacaatag

SEQ ID NO: 519277 - DNA, 25 bp, Homo sapien
acatctgtcacaatagacagtgtat

SEQ ID NO: 519278 - DNA, 25 bp, Homo sapien
aaaattgataactgatggagtagca

SEQ ID NO: 519279 - DNA, 25 bp, Homo sapien
gatggagtagcagtataaacatgtt

SEQ ID NO: 519280 - DNA, 25 bp, Homo sapien
gttaaaattattttgcttccatgga

SEQ ID NO: 519281 - DNA, 25 bp, Homo sapien
tggcttagcagcaaagagtcttgtt

SEQ ID NO: 519282 - DNA, 25 bp, Homo sapien
gcagcaaagagtcttgttgtaaaca

SEQ ID NO: 519283 - DNA, 25 bp, Homo sapien
tgttgtaaacaaaatactggcagat

SEQ ID NO: 519284 - DNA, 25 bp, Homo sapien
gcatgtttctcggtgcagatctgaa

SEQ ID NO: 519285 - DNA, 25 bp, Homo sapien
gatctgaaatcacatccagctcctg

SEQ ID NO: 519286 - DNA, 25 bp, Homo sapien
tccagctcctgatgttttcttctcc

SEQ ID NO: 519287 - DNA, 25 bp, Homo sapien
ctctgactgcagaggaagtgttcct

SEQ ID NO: 519288 - DNA, 25 bp, Homo sapien
aagtgttcctacctgcaggaaggca

SEQ ID NO: 519289 - DNA, 25 bp, Homo sapien
agggcgttcactcagaccatctgtg

SEQ ID NO: 519290 - DNA, 25 bp, Homo sapien
tgctctgccctgagttcagttgaga

SEQ ID NO: 519291 - DNA, 25 bp, Homo sapien
aatggagggatttaccacctcacat

SEQ ID NO: 519292 - DNA, 25 bp, Homo sapien
taccacctcacatatgtccagttaa

SEQ ID NO: 519293 - DNA, 25 bp, Homo sapien
tttgtggacttgtaaccgtcgcagc

SEQ ID NO: 519294 - DNA, 25 bp, Homo sapien
gtcgcagcccaatgatacaacagta

SEQ ID NO: 519295 - DNA, 25 bp, Homo sapien
aaatactcaataatttgtccctggt

SEQ ID NO: 519296 - DNA, 25 bp, Homo sapien
tactcaataatttgtccctggtttt

SEQ ID NO: 519297 - DNA, 25 bp, Homo sapien
ttctttttgaagagccagattccag

SEQ ID NO: 519298 - DNA, 25 bp, Homo sapien
tttgaagagccagattccagtgatc

SEQ ID NO: 519299 - DNA, 25 bp, Homo sapien
aggccttaagaagctgcatttgtaa

SEQ ID NO: 519300 - DNA, 25 bp, Homo sapien
ggaaaatagcttaaccttcaacctg

SEQ ID NO: 519301 - DNA, 25 bp, Homo sapien
aatagcttaaccttcaacctgtgtg

SEQ ID NO: 519302 - DNA, 25 bp, Homo sapien
tagcttaaccttcaacctgtgtgac

SEQ ID NO: 519303 - DNA, 25 bp, Homo sapien
gcttaaccttcaacctgtgtgacat

SEQ ID NO: 519304 - DNA, 25 bp, Homo sapien
taaccttcaacctgtgtgacattta

SEQ ID NO: 519305 - DNA, 25 bp, Homo sapien
tgaacccaaccgtaaaagctatctt

SEQ ID NO: 519306 - DNA, 25 bp, Homo sapien
atttgtccaccagcattaatgtaac

SEQ ID NO: 519307 - DNA, 25 bp, Homo sapien
ggacacgaagtgatttttgtaacct

SEQ ID NO: 519308 - DNA, 25 bp, Homo sapien
gagcagttaatgaatgtgccaacat

SEQ ID NO: 519309 - DNA, 25 bp, Homo sapien
atgtgccaacattttctaggaaggg

SEQ ID NO: 519310 - DNA, 25 bp, Homo sapien
ggacagcaagaatattctgctctgt

SEQ ID NO: 519311 - DNA, 25 bp, Homo sapien
ctgtagttaaaatactggctggctt

SEQ ID NO: 519312 - DNA, 25 bp, Homo sapien
tggctggcttttgatgtcttcatgc

SEQ ID NO: 519313 - DNA, 25 bp, Homo sapien
gtcttcatgcttaattgtgatcact

SEQ ID NO: 519314 - DNA, 25 bp, Homo sapien
attgtgatcactttcttgcactgtg

SEQ ID NO: 519315 - DNA, 25 bp, Homo sapien
cttgcactgtgatgtttttacgtga

SEQ ID NO: 519316 - DNA, 25 bp, Homo sapien
gtagaagtctaccatattattttat

SEQ ID NO: 519317 - DNA, 25 bp, Homo sapien
tgttaatagttaactcccggtggtg

SEQ ID NO: 519318 - DNA, 25 bp, Homo sapien
aatgcatttgtgtactattgaataa

SEQ ID NO: 519319 - DNA, 25 bp, Homo sapien
aaaaatagtgcacagttttcttttg

SEQ ID NO: 519320 - DNA, 25 bp, Homo sapien
tttgttgttacgaaaggtgtcatac

SEQ ID NO: 519321 - DNA, 25 bp, Homo sapien
gttacgaaaggtgtcatacatttga

SEQ ID NO: 519322 - DNA, 25 bp, Homo sapien
ttgaaagaggacatatgcacagttt

SEQ ID NO: 519323 - DNA, 25 bp, Homo sapien
gaggacatatgcacagtttaaataa

SEQ ID NO: 519324 - DNA, 25 bp, Homo sapien
taataacatagtgaatacccactgc

SEQ ID NO: 519325 - DNA, 25 bp, Homo sapien
aaagcaggctgcaacagtatttatg

SEQ ID NO: 519326 - DNA, 25 bp, Homo sapien
gacatatgatcctatatacacgtaa

SEQ ID NO: 519327 - DNA, 25 bp, Homo sapien
acacgtaaaatcttgtgtgtgtgtt

SEQ ID NO: 519328 - DNA, 25 bp, Homo sapien
atttaaaacccgcagtagactctga

SEQ ID NO: 519329 - DNA, 25 bp, Homo sapien
gtagactctgaaatatccagtcatc

SEQ ID NO: 519330 - DNA, 25 bp, Homo sapien
agtcatcaaactcctggctaactgg

SEQ ID NO: 519331 - DNA, 25 bp, Homo sapien
ggctaactggatgatttggctataa

SEQ ID NO: 519332 - DNA, 25 bp, Homo sapien
ttcatctgtctctcgaaatatctac

SEQ ID NO: 519333 - DNA, 25 bp, Homo sapien
gtctctcgaaatatctacagtagga

SEQ ID NO: 519334 - DNA, 25 bp, Homo sapien
gaatgtcacatgtactattgtcact

SEQ ID NO: 519335 - DNA, 25 bp, Homo sapien
gtactattgtcactccttaggtttt

SEQ ID NO: 519336 - DNA, 25 bp, Homo sapien
tgtcactccttaggttttcagctat

SEQ ID NO: 519337 - DNA, 25 bp, Homo sapien
atgtaagtctctcatcatacagatg

SEQ ID NO: 519338 - DNA, 25 bp, Homo sapien
cagatgaattcatttgctaacaaaa

SEQ ID NO: 519339 - DNA, 25 bp, Homo sapien
tgtggcccagcctgtcgctgcgctg

SEQ ID NO: 519340 - DNA, 25 bp, Homo sapien
ccagcctgtcgctgcgctggagtcg

SEQ ID NO: 519341 - DNA, 25 bp, Homo sapien
tcgctgcgctggagtcggcggcgga

SEQ ID NO: 519342 - DNA, 25 bp, Homo sapien
atccccgtgaaccacctcatagagg

SEQ ID NO: 519343 - DNA, 25 bp, Homo sapien
gtgaaccacctcatagagggctccc

SEQ ID NO: 519344 - DNA, 25 bp, Homo sapien
gaaccacctcatagagggctcccag

SEQ ID NO: 519345 - DNA, 25 bp, Homo sapien
accacctcatagagggctcccagaa

SEQ ID NO: 519346 - DNA, 25 bp, Homo sapien
tcatagagggctcccagaagtgtgt

SEQ ID NO: 519347 - DNA, 25 bp, Homo sapien
gctcccagaagtgtgtggctgagct

SEQ ID NO: 519348 - DNA, 25 bp, Homo sapien
ttcttagtgggctcggccaagcctg

SEQ ID NO: 519349 - DNA, 25 bp, Homo sapien
tcttagtgggctcggccaagcctgt

SEQ ID NO: 519350 - DNA, 25 bp, Homo sapien
acgtggccttggaattttcattttg

SEQ ID NO: 519351 - DNA, 25 bp, Homo sapien
ggccttggaattttcattttgatgc

SEQ ID NO: 519352 - DNA, 25 bp, Homo sapien
cttggaattttcattttgatgcaga

SEQ ID NO: 519353 - DNA, 25 bp, Homo sapien
gcatgttttggtgcacaaaatcctt

SEQ ID NO: 519354 - DNA, 25 bp, Homo sapien
tttggtgcacaaaatccttctgtgg

SEQ ID NO: 519355 - DNA, 25 bp, Homo sapien
gcacagtaagaaacaataggcaagc

SEQ ID NO: 519356 - DNA, 25 bp, Homo sapien
aacaataggcaagcgttatgttttt

SEQ ID NO: 519357 - DNA, 25 bp, Homo sapien
aattactttgtatgcttgtttgaac

SEQ ID NO: 519358 - DNA, 25 bp, Homo sapien
actttgtatgcttgtttgaacccta

SEQ ID NO: 519359 - DNA, 25 bp, Homo sapien
gtatgcttgtttgaaccctatgggt

SEQ ID NO: 519360 - DNA, 25 bp, Homo sapien
atgcttgtttgaaccctatgggttc

SEQ ID NO: 519361 - DNA, 25 bp, Homo sapien
ccggacttgtacagagcaaccgcag

SEQ ID NO: 519362 - DNA, 25 bp, Homo sapien
gacttgtacagagcaaccgcagggc

SEQ ID NO: 519363 - DNA, 25 bp, Homo sapien
ttgtacagagcaaccgcagggccgc

SEQ ID NO: 519364 - DNA, 25 bp, Homo sapien
tgtacagagcaaccgcagggccgcc

SEQ ID NO: 519365 - DNA, 25 bp, Homo sapien
cagaatgtctgctttgggtgcggtt

SEQ ID NO: 519366 - DNA, 25 bp, Homo sapien
agaatgtctgctttgggtgcggttt

SEQ ID NO: 519367 - DNA, 25 bp, Homo sapien
aatgtctgctttgggtgcggttttg

SEQ ID NO: 519368 - DNA, 25 bp, Homo sapien
tgcggttttgtactcggtttggaat

SEQ ID NO: 519369 - DNA, 25 bp, Homo sapien
gcggttttgtactcggtttggaatg

SEQ ID NO: 519370 - DNA, 25 bp, Homo sapien
ccctttccgtggcttctctgcattt

SEQ ID NO: 519371 - DNA, 25 bp, Homo sapien
cttctctgcatttgggttattatta

SEQ ID NO: 519372 - DNA, 25 bp, Homo sapien
gccccagagctagttgctgtctggt

SEQ ID NO: 519373 - DNA, 25 bp, Homo sapien
ttgctgtctggtgtttgctggtgaa

SEQ ID NO: 519374 - DNA, 25 bp, Homo sapien
gctggtgaaaacatgagcagtagtt

SEQ ID NO: 519375 - DNA, 25 bp, Homo sapien
ggaaagcctaattaattcaactaat

SEQ ID NO: 519376 - DNA, 25 bp, Homo sapien
aatgtttattaagctcctactctgt

SEQ ID NO: 519377 - DNA, 25 bp, Homo sapien
ttaagctcctactctgtgcaaatca

SEQ ID NO: 519378 - DNA, 25 bp, Homo sapien
tactctgtgcaaatcactctactca

SEQ ID NO: 519379 - DNA, 25 bp, Homo sapien
atcactctactcaagaggagctcac

SEQ ID NO: 519380 - DNA, 25 bp, Homo sapien
aggagctcacataagagtgcaggat

SEQ ID NO: 519381 - DNA, 25 bp, Homo sapien
aaacccctttggcaccctgctgatt

SEQ ID NO: 519382 - DNA, 25 bp, Homo sapien
tggcaccctgctgattgatttggaa

SEQ ID NO: 519383 - DNA, 25 bp, Homo sapien
agcacgcagccctgggcttctttga

SEQ ID NO: 519384 - DNA, 25 bp, Homo sapien
ttgactgcctccgagccgaagtgga

SEQ ID NO: 519385 - DNA, 25 bp, Homo sapien
tctcccggagaacaggccaaatcgt

SEQ ID NO: 519386 - DNA, 25 bp, Homo sapien
gatgttgtcatcagcaccgtgagcc

SEQ ID NO: 519387 - DNA, 25 bp, Homo sapien
tgagcccgactttcatccggtcgta

SEQ ID NO: 519388 - DNA, 25 bp, Homo sapien
gtcgtaccacgtgtatccagagcaa

SEQ ID NO: 519389 - DNA, 25 bp, Homo sapien
aactgggaagcttccatttggaaat

SEQ ID NO: 519390 - DNA, 25 bp, Homo sapien
ttttcaggaagctgacctacggcgt

SEQ ID NO: 519391 - DNA, 25 bp, Homo sapien
caggccaaatcgtgttagtgaataa

SEQ ID NO: 519392 - DNA, 25 bp, Homo sapien
acctacggcgtgcacccagtagagg

SEQ ID NO: 519393 - DNA, 25 bp, Homo sapien
gtacgacttacgctgcctccaagca

SEQ ID NO: 519394 - DNA, 25 bp, Homo sapien
cagctgggtcttcataggagccaaa

SEQ ID NO: 519395 - DNA, 25 bp, Homo sapien
ttcataggagccaaagacctcaggg

SEQ ID NO: 519396 - DNA, 25 bp, Homo sapien
ttcccagggcatcgaaatgaacgat

SEQ ID NO: 519397 - DNA, 25 bp, Homo sapien
gtaaaagcccctttgagcagttctt

SEQ ID NO: 519398 - DNA, 25 bp, Homo sapien
aagcccctttgagcagttcttaaag

SEQ ID NO: 519399 - DNA, 25 bp, Homo sapien
gttcttaaagaacagcccagacaca

SEQ ID NO: 519400 - DNA, 25 bp, Homo sapien
acaaatacgagggatggccagagct

SEQ ID NO: 519401 - DNA, 25 bp, Homo sapien
ccattttagggtggctgtggctctt

SEQ ID NO: 519402 - DNA, 25 bp, Homo sapien
tagggtggctgtggctcttcctcag

SEQ ID NO: 519403 - DNA, 25 bp, Homo sapien
gctcctgcctgacttaggagtcaga

SEQ ID NO: 519404 - DNA, 25 bp, Homo sapien
atgaaagcaggaaactcttctctga

SEQ ID NO: 519405 - DNA, 25 bp, Homo sapien
gtttgttcagaagccgggtcagctc

SEQ ID NO: 519406 - DNA, 25 bp, Homo sapien
ttgcttagtcatgtgtccctccttg

SEQ ID NO: 519407 - DNA, 25 bp, Homo sapien
agtcatgtgtccctccttgagttgc

SEQ ID NO: 519408 - DNA, 25 bp, Homo sapien
cctccttgtgggtttacactacatt

SEQ ID NO: 519409 - DNA, 25 bp, Homo sapien
ttggagtcattgtctaatgctgaca

SEQ ID NO: 519410 - DNA, 25 bp, Homo sapien
accctctcccattatttgtgcacta

SEQ ID NO: 519411 - DNA, 25 bp, Homo sapien
ctgtgtagacagagccaggcctcac

SEQ ID NO: 519412 - DNA, 25 bp, Homo sapien
gcctcacctgtttgtttaggccaag

SEQ ID NO: 519413 - DNA, 25 bp, Homo sapien
ttaggccaagatgccatggacatgc

SEQ ID NO: 519414 - DNA, 25 bp, Homo sapien
gacatgcagcgttagtgatcccact

SEQ ID NO: 519415 - DNA, 25 bp, Homo sapien
gcagcgttagtgatcccactagctg

SEQ ID NO: 519416 - DNA, 25 bp, Homo sapien
ccagaacactgtaagccatataaac

SEQ ID NO: 519417 - DNA, 25 bp, Homo sapien
gaaaacctcacttaagttcactaga

SEQ ID NO: 519418 - DNA, 25 bp, Homo sapien
agttcactagaacagtaaacaggag

SEQ ID NO: 519419 - DNA, 25 bp, Homo sapien
acagcaatgacctcacctagatgac

SEQ ID NO: 519420 - DNA, 25 bp, Homo sapien
gacctcacctagatgactcaagttt

SEQ ID NO: 519421 - DNA, 25 bp, Homo sapien
acatcaagattttgacgggtactat

SEQ ID NO: 519422 - DNA, 25 bp, Homo sapien
tttgacgggtactataatgcttaat

SEQ ID NO: 519423 - DNA, 25 bp, Homo sapien
taatgcttaatatgtccaaattttc

SEQ ID NO: 519424 - DNA, 25 bp, Homo sapien
aacagtagggaaagagtcagcaaca

SEQ ID NO: 519425 - DNA, 25 bp, Homo sapien
aaagagtcagcaacagtgaaaccat

SEQ ID NO: 519426 - DNA, 25 bp, Homo sapien
gaaaccatctgtttaaaatgggcaa

SEQ ID NO: 519427 - DNA, 25 bp, Homo sapien
tccatggccccaggtggaaatgcag

SEQ ID NO: 519428 - DNA, 25 bp, Homo sapien
gtggaaatgcagatccagctgctgg

SEQ ID NO: 519429 - DNA, 25 bp, Homo sapien
ggaaatgcagatccagctgctggca

SEQ ID NO: 519430 - DNA, 25 bp, Homo sapien
gaaatgcagatccagctgctggcag

SEQ ID NO: 519431 - DNA, 25 bp, Homo sapien
aaatgcagatccagctgctggcaga

SEQ ID NO: 519432 - DNA, 25 bp, Homo sapien
aatgcagatccagctgctggcagag

SEQ ID NO: 519433 - DNA, 25 bp, Homo sapien
cagaggagctccaggctcagcgcca

SEQ ID NO: 519434 - DNA, 25 bp, Homo sapien
cggcaggccctgtgctagcgtgttc

SEQ ID NO: 519435 - DNA, 25 bp, Homo sapien
tgtgctagcgtgttcgcaccaggaa

SEQ ID NO: 519436 - DNA, 25 bp, Homo sapien
tgttcgcaccaggaacgcaggtgct

SEQ ID NO: 519437 - DNA, 25 bp, Homo sapien
gccacctccaggaacagaacacagt

SEQ ID NO: 519438 - DNA, 25 bp, Homo sapien
ggccactcctgggttggagcccgat

SEQ ID NO: 519439 - DNA, 25 bp, Homo sapien
ttggagcccgattttatttgtaaag

SEQ ID NO: 519440 - DNA, 25 bp, Homo sapien
gacagtcgagcaaatgttcctattt

SEQ ID NO: 519441 - DNA, 25 bp, Homo sapien
gttcctattttcgtgggatctgcac

SEQ ID NO: 519442 - DNA, 25 bp, Homo sapien
atctgcacacgtctttgtcagttgt

SEQ ID NO: 519443 - DNA, 25 bp, Homo sapien
tggtcatgatcttagtcacctgcta

SEQ ID NO: 519444 - DNA, 25 bp, Homo sapien
tgattacaacatttcctcactgcgg

SEQ ID NO: 519445 - DNA, 25 bp, Homo sapien
tcctcactgcgggatatttctgacc

SEQ ID NO: 519446 - DNA, 25 bp, Homo sapien
ggatatttctgacccgctttagaac

SEQ ID NO: 519447 - DNA, 25 bp, Homo sapien
gaacttaagacctgattctagcaat

SEQ ID NO: 519448 - DNA, 25 bp, Homo sapien
gattctagcaataaacgtgtccgag

SEQ ID NO: 519449 - DNA, 25 bp, Homo sapien
gcaggcctaagagtactttgagctt

SEQ ID NO: 519450 - DNA, 25 bp, Homo sapien
gagtactttgagcttctagaagaag

SEQ ID NO: 519451 - DNA, 25 bp, Homo sapien
agaaagttggtgcatcttctcctcc

SEQ ID NO: 519452 - DNA, 25 bp, Homo sapien
tggtgcatcttctcctccccaagag

SEQ ID NO: 519453 - DNA, 25 bp, Homo sapien
gagcctgagtataagaagttggatt

SEQ ID NO: 519454 - DNA, 25 bp, Homo sapien
tataattaaagccaccacaaaacaa

SEQ ID NO: 519455 - DNA, 25 bp, Homo sapien
acctaaacaagccatgttcatgagt

SEQ ID NO: 519456 - DNA, 25 bp, Homo sapien
tcatgagtaattgtaagtggcttct

SEQ ID NO: 519457 - DNA, 25 bp, Homo sapien
agtggcttctggatgagacctggca

SEQ ID NO: 519458 - DNA, 25 bp, Homo sapien
agacctggcagtgtctctacatact

SEQ ID NO: 519459 - DNA, 25 bp, Homo sapien
tgtctctacatacttcctcagggag

SEQ ID NO: 519460 - DNA, 25 bp, Homo sapien
ggtctgccatatggtgatgtcccag

SEQ ID NO: 519461 - DNA, 25 bp, Homo sapien
tcccagctctcgtgctatgaagtta

SEQ ID NO: 519462 - DNA, 25 bp, Homo sapien
gaagttaaagcctctttctcaacag

SEQ ID NO: 519463 - DNA, 25 bp, Homo sapien
ggctgcagatgatcacccaggaaga

SEQ ID NO: 519464 - DNA, 25 bp, Homo sapien
gaatgcccaaagcaaaccatctcag

SEQ ID NO: 519465 - DNA, 25 bp, Homo sapien
tggtcactgcttctgtgccaagaag

SEQ ID NO: 519466 - DNA, 25 bp, Homo sapien
aacctatggtcatggctttgagtcc

SEQ ID NO: 519467 - DNA, 25 bp, Homo sapien
tggcatcacatgctcatgacccaca

SEQ ID NO: 519468 - DNA, 25 bp, Homo sapien
atgcagccagtctgtcatttttggg

SEQ ID NO: 519469 - DNA, 25 bp, Homo sapien
catttttgggtgtttcctctgtagc

SEQ ID NO: 519470 - DNA, 25 bp, Homo sapien
tctgtagccgggtctgccatatggt

SEQ ID NO: 519471 - DNA, 25 bp, Homo sapien
ctgcatcatagacaactgagtatct

SEQ ID NO: 519472 - DNA, 25 bp, Homo sapien
tagacaactgagtatctcccttggc

SEQ ID NO: 519473 - DNA, 25 bp, Homo sapien
gacaactgagtatctcccttggccc

SEQ ID NO: 519474 - DNA, 25 bp, Homo sapien
gtgctccattcctcagccgtttgga

SEQ ID NO: 519475 - DNA, 25 bp, Homo sapien
attcctcagccgtttggacagggag

SEQ ID NO: 519476 - DNA, 25 bp, Homo sapien
accaaggagcccatgtgagacacac

SEQ ID NO: 519477 - DNA, 25 bp, Homo sapien
ggagcccatgtgagacacactgcta

SEQ ID NO: 519478 - DNA, 25 bp, Homo sapien
gtgagacacactgctatgactgcct

SEQ ID NO: 519479 - DNA, 25 bp, Homo sapien
acactgctatgactgcctcttgtta

SEQ ID NO: 519480 - DNA, 25 bp, Homo sapien
tgctatgactgcctcttgttaatgt

SEQ ID NO: 519481 - DNA, 25 bp, Homo sapien
ctatgactgcctcttgttaatgtca

SEQ ID NO: 519482 - DNA, 25 bp, Homo sapien
tggtatgcgcgacagcacggctctt

SEQ ID NO: 519483 - DNA, 25 bp, Homo sapien
gcgacagcacggctcttaccttctt

SEQ ID NO: 519484 - DNA, 25 bp, Homo sapien
taccttctttctggctacagctatg

SEQ ID NO: 519485 - DNA, 25 bp, Homo sapien
ggactgtttttctgcgcatgagacc

SEQ ID NO: 519486 - DNA, 25 bp, Homo sapien
gcatgagacccctgaacacacagct

SEQ ID NO: 519487 - DNA, 25 bp, Homo sapien
acagctggaactctggttatgccta

SEQ ID NO: 519488 - DNA, 25 bp, Homo sapien
aaataactattactgctactggcaa

SEQ ID NO: 519489 - DNA, 25 bp, Homo sapien
aaccaagatgaagacccactagaag

SEQ ID NO: 519490 - DNA, 25 bp, Homo sapien
attactgctactggcaaagtctccc

SEQ ID NO: 519491 - DNA, 25 bp, Homo sapien
gtctcccctctgctattagagtgaa

SEQ ID NO: 519492 - DNA, 25 bp, Homo sapien
cagagttaccgctatggcaactggt

SEQ ID NO: 519493 - DNA, 25 bp, Homo sapien
tgggcaggagcctctacatcccctt

SEQ ID NO: 519494 - DNA, 25 bp, Homo sapien
tctctccatgactcttgacatccta

SEQ ID NO: 519495 - DNA, 25 bp, Homo sapien
atgactcttgacatcctagcttctt

SEQ ID NO: 519496 - DNA, 25 bp, Homo sapien
tcttgacatcctagcttcttctaag

SEQ ID NO: 519497 - DNA, 25 bp, Homo sapien
ttgacatcctagcttcttctaaggg

SEQ ID NO: 519498 - DNA, 25 bp, Homo sapien
ttattgatagttcatctggattacc

SEQ ID NO: 519499 - DNA, 25 bp, Homo sapien
taccaaaatcactctgcagccctgc

SEQ ID NO: 519500 - DNA, 25 bp, Homo sapien
cctgcccgaggctagtaggctgcaa

SEQ ID NO: 519501 - DNA, 25 bp, Homo sapien
ccgaggctagtaggctgcaaccctg

SEQ ID NO: 519502 - DNA, 25 bp, Homo sapien
tcaagccaactatgcagcccacaag

SEQ ID NO: 519503 - DNA, 25 bp, Homo sapien
gccaactatgcagcccacaagaagg

SEQ ID NO: 519504 - DNA, 25 bp, Homo sapien
tgggcttcttagcacgaaaacaata

SEQ ID NO: 519505 - DNA, 25 bp, Homo sapien
cctttattgtgtggtgataatacag

SEQ ID NO: 519506 - DNA, 25 bp, Homo sapien
gaattacagagcattccttctgagg

SEQ ID NO: 519507 - DNA, 25 bp, Homo sapien
tacagagcattccttctgaggagga

SEQ ID NO: 519508 - DNA, 25 bp, Homo sapien
cttctgaggaggagatttttgcacc

SEQ ID NO: 519509 - DNA, 25 bp, Homo sapien
aggaggagatttttgcacctgaaaa

SEQ ID NO: 519510 - DNA, 25 bp, Homo sapien
gagatttttgcacctgaaaaaggca

SEQ ID NO: 519511 - DNA, 25 bp, Homo sapien
aaggcagccatagttttccagaagc

SEQ ID NO: 519512 - DNA, 25 bp, Homo sapien
gccatagttttccagaagcaactca

SEQ ID NO: 519513 - DNA, 25 bp, Homo sapien
aggtcagattgctcggagagtttac

SEQ ID NO: 519514 - DNA, 25 bp, Homo sapien
tcagattgctcggagagtttacaga

SEQ ID NO: 519515 - DNA, 25 bp, Homo sapien
aaacttaatgtacctgaattcttca

SEQ ID NO: 519516 - DNA, 25 bp, Homo sapien
gaattcttcatggtgtatttgcaaa

SEQ ID NO: 519517 - DNA, 25 bp, Homo sapien
tggtgtatttgcaaactaacttaac

SEQ ID NO: 519518 - DNA, 25 bp, Homo sapien
gcagccggtacagaaaggtgtaagt

SEQ ID NO: 519519 - DNA, 25 bp, Homo sapien
ggaagcttcatctgaccaatgtggg

SEQ ID NO: 519520 - DNA, 25 bp, Homo sapien
tctgaccaatgtgggtgctggtttc

SEQ ID NO: 519521 - DNA, 25 bp, Homo sapien
ttgtgaaatgtgtccctaagcctcc

SEQ ID NO: 519522 - DNA, 25 bp, Homo sapien
gaaatgtgtccctaagcctccttct

SEQ ID NO: 519523 - DNA, 25 bp, Homo sapien
acccacccaggtgtctaagatagga

SEQ ID NO: 519524 - DNA, 25 bp, Homo sapien
agataggacatgctcctttctttct

SEQ ID NO: 519525 - DNA, 25 bp, Homo sapien
taggacatgctcctttctttctcta

SEQ ID NO: 519526 - DNA, 25 bp, Homo sapien
gcgggagaggacaacgttttatgca

SEQ ID NO: 519527 - DNA, 25 bp, Homo sapien
gacaacgttttatgcaagagtggat

SEQ ID NO: 519528 - DNA, 25 bp, Homo sapien
aagagtggattctcggagcctctgc

SEQ ID NO: 519529 - DNA, 25 bp, Homo sapien
gcccgcgtccagcaaccaggagaaa

SEQ ID NO: 519530 - DNA, 25 bp, Homo sapien
tggattctcggagcctctgcactct

SEQ ID NO: 519531 - DNA, 25 bp, Homo sapien
ctgcactctccatcagggctgctgg

SEQ ID NO: 519532 - DNA, 25 bp, Homo sapien
ggctgctggcatggaaaacacagag

SEQ ID NO: 519533 - DNA, 25 bp, Homo sapien
gaaaacacagagaaaccatcaccta

SEQ ID NO: 519534 - DNA, 25 bp, Homo sapien
gaaaccatcacctaggacttgattg

SEQ ID NO: 519535 - DNA, 25 bp, Homo sapien
cacctaggacttgattgaactactg

SEQ ID NO: 519536 - DNA, 25 bp, Homo sapien
ccaaggccgcgtctgctagcaggga

SEQ ID NO: 519537 - DNA, 25 bp, Homo sapien
tattggactgagatatttggttacc

SEQ ID NO: 519538 - DNA, 25 bp, Homo sapien
atttggttaccatggaggccaatgc

SEQ ID NO: 519539 - DNA, 25 bp, Homo sapien
tttgaatagcctactcccaagtaag

SEQ ID NO: 519540 - DNA, 25 bp, Homo sapien
tagcctactcccaagtaagagcaaa

SEQ ID NO: 519541 - DNA, 25 bp, Homo sapien
agagcaaatctgtatgataacattt

SEQ ID NO: 519542 - DNA, 25 bp, Homo sapien
gataacattttttcctctggacata

SEQ ID NO: 519543 - DNA, 25 bp, Homo sapien
tttcctctggacataagacataaca

SEQ ID NO: 519544 - DNA, 25 bp, Homo sapien
gatgtacatttacaagcggccttat

SEQ ID NO: 519545 - DNA, 25 bp, Homo sapien
aagcggccttatgtacatttcccaa

SEQ ID NO: 519546 - DNA, 25 bp, Homo sapien
tgtacatttcccaacaatcttttta

SEQ ID NO: 519547 - DNA, 25 bp, Homo sapien
ggcaaaattgtgaccatatgtgtat

SEQ ID NO: 519548 - DNA, 25 bp, Homo sapien
gccatttaaaatgctctcctgcaat

SEQ ID NO: 519549 - DNA, 25 bp, Homo sapien
taaaatgctctcctgcaataccacc

SEQ ID NO: 519550 - DNA, 25 bp, Homo sapien
gcaataccaccccttcatttaacat

SEQ ID NO: 519551 - DNA, 25 bp, Homo sapien
ttcctgtaccatcacatattgaaga

SEQ ID NO: 519552 - DNA, 25 bp, Homo sapien
ctgtaccatcacatattgaagagaa

SEQ ID NO: 519553 - DNA, 25 bp, Homo sapien
gaaaacagtattacagcaaagctta

SEQ ID NO: 519554 - DNA, 25 bp, Homo sapien
tacagcaaagcttagatagtttaac

SEQ ID NO: 519555 - DNA, 25 bp, Homo sapien
gcaaagcttagatagtttaacataa

SEQ ID NO: 519556 - DNA, 25 bp, Homo sapien
tgattcttaaaaaatctttggcctt

SEQ ID NO: 519557 - DNA, 25 bp, Homo sapien
caattttgccattctagaaactatt

SEQ ID NO: 519558 - DNA, 25 bp, Homo sapien
tttgccattctagaaactattttag

SEQ ID NO: 519559 - DNA, 25 bp, Homo sapien
aaacccaacaatctttgagacaatg

SEQ ID NO: 519560 - DNA, 25 bp, Homo sapien
gagacaatgcaataattaaacaggg

SEQ ID NO: 519561 - DNA, 25 bp, Homo sapien
gaaggaatgttaaaattctcagcaa

SEQ ID NO: 519562 - DNA, 25 bp, Homo sapien
agagaacttgccatgacctatgata

SEQ ID NO: 519563 - DNA, 25 bp, Homo sapien
gaacttgccatgacctatgatacat

SEQ ID NO: 519564 - DNA, 25 bp, Homo sapien
atgacctatgatacatgaatacaag

SEQ ID NO: 519565 - DNA, 25 bp, Homo sapien
tggtgtcaccaagagctttggctct

SEQ ID NO: 519566 - DNA, 25 bp, Homo sapien
gagctttggctctatatgaaaaata

SEQ ID NO: 519567 - DNA, 25 bp, Homo sapien
acttagaacagtgttcttctacctg

SEQ ID NO: 519568 - DNA, 25 bp, Homo sapien
tacctcactccttctggttgcagag

SEQ ID NO: 519569 - DNA, 25 bp, Homo sapien
cactccttctggttgcagagcaaaa

SEQ ID NO: 519570 - DNA, 25 bp, Homo sapien
tagttatttgtcataggctattgat

SEQ ID NO: 519571 - DNA, 25 bp, Homo sapien
aatttcattagttttgtccactata

SEQ ID NO: 519572 - DNA, 25 bp, Homo sapien
gttgtgtcaaatacaaattctggta

SEQ ID NO: 519573 - DNA, 25 bp, Homo sapien
tacaaattctggtaaactgttaggt

SEQ ID NO: 519574 - DNA, 25 bp, Homo sapien
ggttttaacaccagacagtattcaa

SEQ ID NO: 519575 - DNA, 25 bp, Homo sapien
acaccagacagtattcaaaggaaat

SEQ ID NO: 519576 - DNA, 25 bp, Homo sapien
gcaaacataaatccatagtcttcat

SEQ ID NO: 519577 - DNA, 25 bp, Homo sapien
tatattgtcacctttgtaaaagtgt

SEQ ID NO: 519578 - DNA, 25 bp, Homo sapien
gttttgtatatctttgggcatcttg

SEQ ID NO: 519579 - DNA, 25 bp, Homo sapien
atatctttgggcatcttgtgtctag

SEQ ID NO: 519580 - DNA, 25 bp, Homo sapien
gggcatcttgtgtctagctataata

SEQ ID NO: 519581 - DNA, 25 bp, Homo sapien
atgcactggttcttgaagctttggc

SEQ ID NO: 519582 - DNA, 25 bp, Homo sapien
gttcttgaagctttggcccagaagt

SEQ ID NO: 519583 - DNA, 25 bp, Homo sapien
aaatatgtcttttacctgttcacat

SEQ ID NO: 519584 - DNA, 25 bp, Homo sapien
tgttcacattgcattgggccagggc

SEQ ID NO: 519585 - DNA, 25 bp, Homo sapien
tgcattgggccagggcaattatcat

SEQ ID NO: 519586 - DNA, 25 bp, Homo sapien
ttatcatggctgcaagtaacttcaa

SEQ ID NO: 519587 - DNA, 25 bp, Homo sapien
aagtgcgatcttggcatgtgtcaga

SEQ ID NO: 519588 - DNA, 25 bp, Homo sapien
gagcattaatgactgtctttacagg

SEQ ID NO: 519589 - DNA, 25 bp, Homo sapien
tttcatcatttcctactgtgttacc

SEQ ID NO: 519590 - DNA, 25 bp, Homo sapien
tactgtgttacctaaactttctgag

SEQ ID NO: 519591 - DNA, 25 bp, Homo sapien
ctgagccccagtttcttattactaa

SEQ ID NO: 519592 - DNA, 25 bp, Homo sapien
ggttgtgcttctgaagttccactgt

SEQ ID NO: 519593 - DNA, 25 bp, Homo sapien
gcttctgaagttccactgtgctcaa

SEQ ID NO: 519594 - DNA, 25 bp, Homo sapien
gttccactgtgctcaaagtgcttgg

SEQ ID NO: 519595 - DNA, 25 bp, Homo sapien
aagtgcttggtgaaagttagcgaag

SEQ ID NO: 519596 - DNA, 25 bp, Homo sapien
gaaagttagcgaaggtgattttaca

SEQ ID NO: 519597 - DNA, 25 bp, Homo sapien
aaaaaatcctcattactcttctctc

SEQ ID NO: 519598 - DNA, 25 bp, Homo sapien
ttaagccccaactggaccctaggca

SEQ ID NO: 519599 - DNA, 25 bp, Homo sapien
aactggaccctaggcaaaagtgagt

SEQ ID NO: 519600 - DNA, 25 bp, Homo sapien
gcaaaagtgagtggcactcctctgc

SEQ ID NO: 519601 - DNA, 25 bp, Homo sapien
ggcaagccccggcatcttcttgctg

SEQ ID NO: 519602 - DNA, 25 bp, Homo sapien
atgaacagacttggatgggccacgg

SEQ ID NO: 519603 - DNA, 25 bp, Homo sapien
aatgataatgggtgattgttgatgt

SEQ ID NO: 519604 - DNA, 25 bp, Homo sapien
tgataatgggtgattgttgatgtaa

SEQ ID NO: 519605 - DNA, 25 bp, Homo sapien
gataatgggtgattgttgatgtaag

SEQ ID NO: 519606 - DNA, 25 bp, Homo sapien
taatgggtgattgttgatgtaagta

SEQ ID NO: 519607 - DNA, 25 bp, Homo sapien
aatgggtgattgttgatgtaagtaa

SEQ ID NO: 519608 - DNA, 25 bp, Homo sapien
atgggtgattgttgatgtaagtaaa

SEQ ID NO: 519609 - DNA, 25 bp, Homo sapien
gggtgattgttgatgtaagtaaaga

SEQ ID NO: 519610 - DNA, 25 bp, Homo sapien
aagattaaattgaaggccagcacgg

SEQ ID NO: 519611 - DNA, 25 bp, Homo sapien
agattaaattgaaggccagcacggt

SEQ ID NO: 519612 - DNA, 25 bp, Homo sapien
gattaaattgaaggccagcacggtg

SEQ ID NO: 519613 - DNA, 25 bp, Homo sapien
attaaattgaaggccagcacggtgg

SEQ ID NO: 519614 - DNA, 25 bp, Homo sapien
gaaagtgggctttgaacgggatcca

SEQ ID NO: 519615 - DNA, 25 bp, Homo sapien
ggctttgaacgggatccaagtctaa

SEQ ID NO: 519616 - DNA, 25 bp, Homo sapien
caagtctaagatgtttccggtgagc

SEQ ID NO: 519617 - DNA, 25 bp, Homo sapien
ggctgccatgggattgaaagcatgt

SEQ ID NO: 519618 - DNA, 25 bp, Homo sapien
atgtttccggtgagctgccagggac

SEQ ID NO: 519619 - DNA, 25 bp, Homo sapien
gggacaaagggctctcagacatctt

SEQ ID NO: 519620 - DNA, 25 bp, Homo sapien
aagggctctcagacatcttgggtcc

SEQ ID NO: 519621 - DNA, 25 bp, Homo sapien
agacatcttgggtccccagtggctg

SEQ ID NO: 519622 - DNA, 25 bp, Homo sapien
tcacagagcttgtccccgagttgat

SEQ ID NO: 519623 - DNA, 25 bp, Homo sapien
tgtccccgagttgattcactgtgca

SEQ ID NO: 519624 - DNA, 25 bp, Homo sapien
aggtgacagagtagcatgcctccaa

SEQ ID NO: 519625 - DNA, 25 bp, Homo sapien
atatatatgttttgtttcttaggga

SEQ ID NO: 519626 - DNA, 25 bp, Homo sapien
gtttcttagggaaaacagtctgaga

SEQ ID NO: 519627 - DNA, 25 bp, Homo sapien
gatagtagattgtttctttagaaac

SEQ ID NO: 519628 - DNA, 25 bp, Homo sapien
tgtgttaccatggaaaaggatattc

SEQ ID NO: 519629 - DNA, 25 bp, Homo sapien
ggatattcacagtagtacagttctc

SEQ ID NO: 519630 - DNA, 25 bp, Homo sapien
gtagtacagttctcaatatttttaa

SEQ ID NO: 519631 - DNA, 25 bp, Homo sapien
gaaactgggcagaagctctgcattc

SEQ ID NO: 519632 - DNA, 25 bp, Homo sapien
agaagctctgcattctcacttgtac

SEQ ID NO: 519633 - DNA, 25 bp, Homo sapien
ctctgcattctcacttgtactttga

SEQ ID NO: 519634 - DNA, 25 bp, Homo sapien
ctcacttgtactttgatttcttatt

SEQ ID NO: 519635 - DNA, 25 bp, Homo sapien
ttcttgggcaggcaatttgaggaaa

SEQ ID NO: 519636 - DNA, 25 bp, Homo sapien
ggacacagtatttacctggcattct

SEQ ID NO: 519637 - DNA, 25 bp, Homo sapien
atttacctggcattcttttagatca

SEQ ID NO: 519638 - DNA, 25 bp, Homo sapien
cctggcattcttttagatcaaacga

SEQ ID NO: 519639 - DNA, 25 bp, Homo sapien
gatcaaacgaactggttatctgagg

SEQ ID NO: 519640 - DNA, 25 bp, Homo sapien
gaactggctcgggtgggccttcctt

SEQ ID NO: 519641 - DNA, 25 bp, Homo sapien
ttcccaccaaggctttgtctttctc

SEQ ID NO: 519642 - DNA, 25 bp, Homo sapien
tttctcttccagttgcacatcctaa

SEQ ID NO: 519643 - DNA, 25 bp, Homo sapien
ttccagttgcacatcctaaagtttg

SEQ ID NO: 519644 - DNA, 25 bp, Homo sapien
gcacatcctaaagtttgaagagtct

SEQ ID NO: 519645 - DNA, 25 bp, Homo sapien
ccagactgtgcccaggattgattca

SEQ ID NO: 519646 - DNA, 25 bp, Homo sapien
actgtgcccaggattgattcaattt

SEQ ID NO: 519647 - DNA, 25 bp, Homo sapien
tcctcttcttccacctcttagagtg

SEQ ID NO: 519648 - DNA, 25 bp, Homo sapien
ttccacctcttagagtgccttggct

SEQ ID NO: 519649 - DNA, 25 bp, Homo sapien
atcacagccccatttcttggatgga

SEQ ID NO: 519650 - DNA, 25 bp, Homo sapien
cagccccatttcttggatggagaaa

SEQ ID NO: 519651 - DNA, 25 bp, Homo sapien
gcttttgaggacagtcaggagccct

SEQ ID NO: 519652 - DNA, 25 bp, Homo sapien
ttgaggacagtcaggagccctccta

SEQ ID NO: 519653 - DNA, 25 bp, Homo sapien
ggacagtcaggagccctcctatggg

SEQ ID NO: 519654 - DNA, 25 bp, Homo sapien
ctcctatgggctccagtgatgcact

SEQ ID NO: 519655 - DNA, 25 bp, Homo sapien
atgggctccagtgatgcactcacca

SEQ ID NO: 519656 - DNA, 25 bp, Homo sapien
agtgatgcactcaccagcttctggt

SEQ ID NO: 519657 - DNA, 25 bp, Homo sapien
gatgcactcaccagcttctggtcct

SEQ ID NO: 519658 - DNA, 25 bp, Homo sapien
tccagatcttttttgggagattttc

SEQ ID NO: 519659 - DNA, 25 bp, Homo sapien
ggagattttcctacagcttggttgt

SEQ ID NO: 519660 - DNA, 25 bp, Homo sapien
ttagcatttttagcacacaggagaa

SEQ ID NO: 519661 - DNA, 25 bp, Homo sapien
acacattctatgtctgataattctt

SEQ ID NO: 519662 - DNA, 25 bp, Homo sapien
gataattcttaatggcacttttact

SEQ ID NO: 519663 - DNA, 25 bp, Homo sapien
gggatcttgggtacattcttaattt

SEQ ID NO: 519664 - DNA, 25 bp, Homo sapien
gtttattcttcacgcttgacttgca

SEQ ID NO: 519665 - DNA, 25 bp, Homo sapien
ttgacttgcaagtgggatattcccc

SEQ ID NO: 519666 - DNA, 25 bp, Homo sapien
aagtgggatattcccctgccacaag

SEQ ID NO: 519667 - DNA, 25 bp, Homo sapien
tcccctgccacaagtgtcaaacagt

SEQ ID NO: 519668 - DNA, 25 bp, Homo sapien
attcttcctgtgttgtgactggaca

SEQ ID NO: 519669 - DNA, 25 bp, Homo sapien
actccaaactggtcctagcactaaa

SEQ ID NO: 519670 - DNA, 25 bp, Homo sapien
ctgagtgttgggaggcagtctcaca

SEQ ID NO: 519671 - DNA, 25 bp, Homo sapien
gaggcagtctcacatgcactggcaa

SEQ ID NO: 519672 - DNA, 25 bp, Homo sapien
tgcactggcaagacccattttcatg

SEQ ID NO: 519673 - DNA, 25 bp, Homo sapien
gcaagacccattttcatgctgtcaa

SEQ ID NO: 519674 - DNA, 25 bp, Homo sapien
tcatgctgtcaatgtcaatgtcaca

SEQ ID NO: 519675 - DNA, 25 bp, Homo sapien
tgtcaatgtcacaaactcctttcca

SEQ ID NO: 519676 - DNA, 25 bp, Homo sapien
cgggtgtgggtctccctcagactat

SEQ ID NO: 519677 - DNA, 25 bp, Homo sapien
ggtctccctcagactatggactcag

SEQ ID NO: 519678 - DNA, 25 bp, Homo sapien
tatggactcagctaacaccgaaccc

SEQ ID NO: 519679 - DNA, 25 bp, Homo sapien
aggaagagctttcccctacagcttc

SEQ ID NO: 519680 - DNA, 25 bp, Homo sapien
gaaaacagtcttgttaaggtgaaag

SEQ ID NO: 519681 - DNA, 25 bp, Homo sapien
gggtccttggtgatggatcattatt

SEQ ID NO: 519682 - DNA, 25 bp, Homo sapien
cttggtgatggatcattatttcaaa

SEQ ID NO: 519683 - DNA, 25 bp, Homo sapien
gaatagtggttcctcttgatgtata

SEQ ID NO: 519684 - DNA, 25 bp, Homo sapien
ggttcctcttgatgtatagtatgcc

SEQ ID NO: 519685 - DNA, 25 bp, Homo sapien
cctcttgatgtatagtatgcctgta

SEQ ID NO: 519686 - DNA, 25 bp, Homo sapien
agtatgcctgtattatagtttttac

SEQ ID NO: 519687 - DNA, 25 bp, Homo sapien
caaaattgtgaacttgtgtaatagt

SEQ ID NO: 519688 - DNA, 25 bp, Homo sapien
gttgaatttctaactgtttatacat

SEQ ID NO: 519689 - DNA, 25 bp, Homo sapien
atcaattacaatctgaatttctaag

SEQ ID NO: 519690 - DNA, 25 bp, Homo sapien
gatgcaatatggaatggttcacaat

SEQ ID NO: 519691 - DNA, 25 bp, Homo sapien
aaatactcaataatttgtccctggt

SEQ ID NO: 519692 - DNA, 25 bp, Homo sapien
tactcaataatttgtccctggtttt

SEQ ID NO: 519693 - DNA, 25 bp, Homo sapien
ttctttttgaagagccagattccag

SEQ ID NO: 519694 - DNA, 25 bp, Homo sapien
tttgaagagccagattccagtgatc

SEQ ID NO: 519695 - DNA, 25 bp, Homo sapien
ctgcctctcagaaatttccacattt

SEQ ID NO: 519696 - DNA, 25 bp, Homo sapien
aggccttaagaagctgcatttgtaa

SEQ ID NO: 519697 - DNA, 25 bp, Homo sapien
ggaaaatagcttaaccttcaacctg

SEQ ID NO: 519698 - DNA, 25 bp, Homo sapien
agcttaaccttcaacctgtgtgaca

SEQ ID NO: 519699 - DNA, 25 bp, Homo sapien
taaccttcaacctgtgtgacattta

SEQ ID NO: 519700 - DNA, 25 bp, Homo sapien
aacctgtgtgacatttaactttttg

SEQ ID NO: 519701 - DNA, 25 bp, Homo sapien
tgaacccaaccgtaaaagctatctt

SEQ ID NO: 519702 - DNA, 25 bp, Homo sapien
tgatgctaagaatttgacctccaac

SEQ ID NO: 519703 - DNA, 25 bp, Homo sapien
tgacctccaactaagcaaacatttt

SEQ ID NO: 519704 - DNA, 25 bp, Homo sapien
tagatccaaattgaggacctgtgtc

SEQ ID NO: 519705 - DNA, 25 bp, Homo sapien
gtgtcctgtttttataagattgcaa

SEQ ID NO: 519706 - DNA, 25 bp, Homo sapien
aagattgcaacccagctatgctcat

SEQ ID NO: 519707 - DNA, 25 bp, Homo sapien
cccagctatgctcatttgtttatgt

SEQ ID NO: 519708 - DNA, 25 bp, Homo sapien
atgttttgtatatggctgcttttgt

SEQ ID NO: 519709 - DNA, 25 bp, Homo sapien
atggctgcttttgtgttacagtggt

SEQ ID NO: 519710 - DNA, 25 bp, Homo sapien
gaagtgatggaatacctttcttact

SEQ ID NO: 519711 - DNA, 25 bp, Homo sapien
gaatacctttcttacttttgtggag

SEQ ID NO: 519712 - DNA, 25 bp, Homo sapien
tttgtggagttacatctgatgctaa

SEQ ID NO: 519713 - DNA, 25 bp, Homo sapien
gtatgtgagcttgggcaaatcgctt

SEQ ID NO: 519714 - DNA, 25 bp, Homo sapien
ggcaaatcgcttaatctttgagtct

SEQ ID NO: 519715 - DNA, 25 bp, Homo sapien
tgagtctagttttctctcaaaatga

SEQ ID NO: 519716 - DNA, 25 bp, Homo sapien
aaatgatttccgagtttccagctag

SEQ ID NO: 519717 - DNA, 25 bp, Homo sapien
gtttccagctagtcctagagttcta

SEQ ID NO: 519718 - DNA, 25 bp, Homo sapien
aattattttatcatgctgttgctgg

SEQ ID NO: 519719 - DNA, 25 bp, Homo sapien
ggaatatgactaacccttttgaagc

SEQ ID NO: 519720 - DNA, 25 bp, Homo sapien
gactaacccttttgaagctactaat

SEQ ID NO: 519721 - DNA, 25 bp, Homo sapien
gctactaattttatgtcgagcttta

SEQ ID NO: 519722 - DNA, 25 bp, Homo sapien
gtcgagctttaaagtccataattgt

SEQ ID NO: 519723 - DNA, 25 bp, Homo sapien
attatttgacctacagtatgtccaa

SEQ ID NO: 519724 - DNA, 25 bp, Homo sapien
cactcatggcagaagcttgctctgg

SEQ ID NO: 519725 - DNA, 25 bp, Homo sapien
agaagcttgctctggctaacaacca

SEQ ID NO: 519726 - DNA, 25 bp, Homo sapien
tgctctggctaacaaccactatcat

SEQ ID NO: 519727 - DNA, 25 bp, Homo sapien
aacatctgaggctgcgcaatctcta

SEQ ID NO: 519728 - DNA, 25 bp, Homo sapien
gttgctgtgactgacgggactcttg

SEQ ID NO: 519729 - DNA, 25 bp, Homo sapien
acgggactcttggtggaagccctat

SEQ ID NO: 519730 - DNA, 25 bp, Homo sapien
tggtggaagccctattcccatgtgc

SEQ ID NO: 519731 - DNA, 25 bp, Homo sapien
gcagctccccaaggaagcaggacat

SEQ ID NO: 519732 - DNA, 25 bp, Homo sapien
aggctgcgcaatctctaaggaaaag

SEQ ID NO: 519733 - DNA, 25 bp, Homo sapien
gcaggacattgttggattctctaag

SEQ ID NO: 519734 - DNA, 25 bp, Homo sapien
tgttggattctctaagaagctcaga

SEQ ID NO: 519735 - DNA, 25 bp, Homo sapien
gggatgattctctttggtggaatta

SEQ ID NO: 519736 - DNA, 25 bp, Homo sapien
aagtaaagatactcggcagtgctca

SEQ ID NO: 519737 - DNA, 25 bp, Homo sapien
actcggcagtgctcagtggtatagt

SEQ ID NO: 519738 - DNA, 25 bp, Homo sapien
gtggtatagtggagtcctggactct

SEQ ID NO: 519739 - DNA, 25 bp, Homo sapien
gagttgtaaggtcagcgtaaaaagc

SEQ ID NO: 519740 - DNA, 25 bp, Homo sapien
agttcagtcagaagttcccatgaaa

SEQ ID NO: 519741 - DNA, 25 bp, Homo sapien
ggtttccctggaggtctgtgtgcca

SEQ ID NO: 519742 - DNA, 25 bp, Homo sapien
tctgtgtgccattccttggtaagtt

SEQ ID NO: 519743 - DNA, 25 bp, Homo sapien
gtaagtttcatgtagccagtgtttc

SEQ ID NO: 519744 - DNA, 25 bp, Homo sapien
gccagtgtttcctctgacagaagtt

SEQ ID NO: 519745 - DNA, 25 bp, Homo sapien
ctctgacagaagttgggaccagttt

SEQ ID NO: 519746 - DNA, 25 bp, Homo sapien
tggtcacccaatcaatagctgtgaa

SEQ ID NO: 519747 - DNA, 25 bp, Homo sapien
tgtgaagacttccttattcctgctg

SEQ ID NO: 519748 - DNA, 25 bp, Homo sapien
ttccttattcctgctgaacttcctt

SEQ ID NO: 519749 - DNA, 25 bp, Homo sapien
ggatatcttcatggataagcctgtg

SEQ ID NO: 519750 - DNA, 25 bp, Homo sapien
gataagcctgtgtctgtggacagag

SEQ ID NO: 519751 - DNA, 25 bp, Homo sapien
gcccaagtgctgaggctcgaaagac

SEQ ID NO: 519752 - DNA, 25 bp, Homo sapien
agacaggttttacaatcagccaatt

SEQ ID NO: 519753 - DNA, 25 bp, Homo sapien
attaaacatcttaccagttgctgta

SEQ ID NO: 519754 - DNA, 25 bp, Homo sapien
ccagttgctgtaccccttgccaagg

SEQ ID NO: 519755 - DNA, 25 bp, Homo sapien
gggatgagctgaggagcttcttttc

SEQ ID NO: 519756 - DNA, 25 bp, Homo sapien
tcttttctttaggtccaacatcaaa

SEQ ID NO: 519757 - DNA, 25 bp, Homo sapien
aaagcgatcgctgtacgggacacca

SEQ ID NO: 519758 - DNA, 25 bp, Homo sapien
agcgatcgctgtacgggacaccaaa

SEQ ID NO: 519759 - DNA, 25 bp, Homo sapien
gtacgggacaccaaacccatacctg

SEQ ID NO: 519760 - DNA, 25 bp, Homo sapien
taccttccaggcaaccagtgtcaat

SEQ ID NO: 519761 - DNA, 25 bp, Homo sapien
ttccaggcaaccagtgtcaatctcc

SEQ ID NO: 519762 - DNA, 25 bp, Homo sapien
acatccctgcccgaagtgaggagaa

SEQ ID NO: 519763 - DNA, 25 bp, Homo sapien
atccctgcccgaagtgaggagaacg

SEQ ID NO: 519764 - DNA, 25 bp, Homo sapien
gcccgaagtgaggagaacggtaatt

SEQ ID NO: 519765 - DNA, 25 bp, Homo sapien
actctgcgtccttacacttgctgag

SEQ ID NO: 519766 - DNA, 25 bp, Homo sapien
cgtccttacacttgctgagcactga

SEQ ID NO: 519767 - DNA, 25 bp, Homo sapien
gctgagcactgacaccaaatttaaa

SEQ ID NO: 519768 - DNA, 25 bp, Homo sapien
gtttctcagattaagacactgttag

SEQ ID NO: 519769 - DNA, 25 bp, Homo sapien
gttagaacctaaagtagtagctgat

SEQ ID NO: 519770 - DNA, 25 bp, Homo sapien
agattgtctgaataggcatcctcat

SEQ ID NO: 519771 - DNA, 25 bp, Homo sapien
gcatcctcatctatatttacccaaa

SEQ ID NO: 519772 - DNA, 25 bp, Homo sapien
tatttacccaaaacctcgcttactg

SEQ ID NO: 519773 - DNA, 25 bp, Homo sapien
aaaacctcgcttactgtcatgtgca

SEQ ID NO: 519774 - DNA, 25 bp, Homo sapien
gcttactgtcatgtgcactacaaat

SEQ ID NO: 519775 - DNA, 25 bp, Homo sapien
ttgcaatttggaaacctactgtatt

SEQ ID NO: 519776 - DNA, 25 bp, Homo sapien
aaattctgtcagtttatggttcttg

SEQ ID NO: 519777 - DNA, 25 bp, Homo sapien
tgaagactgatgtcctttcccaaac

SEQ ID NO: 519778 - DNA, 25 bp, Homo sapien
aaacactggttactgcagcagcatt

SEQ ID NO: 519779 - DNA, 25 bp, Homo sapien
atctgttcatgtgcccagcatttat

SEQ ID NO: 519780 - DNA, 25 bp, Homo sapien
aagcacctgctgtatgcaaggttcc

SEQ ID NO: 519781 - DNA, 25 bp, Homo sapien
aaggttcccatgttacggcagtgaa

SEQ ID NO: 519782 - DNA, 25 bp, Homo sapien
ataattgttccctccatcagcgatt

SEQ ID NO: 519783 - DNA, 25 bp, Homo sapien
atcagcgattgattcagtcatcaag

SEQ ID NO: 519784 - DNA, 25 bp, Homo sapien
ggcactagtgatacacattcatttt

SEQ ID NO: 519785 - DNA, 25 bp, Homo sapien
tgtccagccagctcttgctaagcaa

SEQ ID NO: 519786 - DNA, 25 bp, Homo sapien
tgctaagcaatcacgtgcacacagg

SEQ ID NO: 519787 - DNA, 25 bp, Homo sapien
tgcacacaggcagcattaatggagt

SEQ ID NO: 519788 - DNA, 25 bp, Homo sapien
ctactgcatgccagcaacagggctt

SEQ ID NO: 519789 - DNA, 25 bp, Homo sapien
attgggaggaaccaagccctcttca

SEQ ID NO: 519790 - DNA, 25 bp, Homo sapien
aaacaggacttaaaatgacattcag

SEQ ID NO: 519791 - DNA, 25 bp, Homo sapien
attggatgactaactatcaaataga

SEQ ID NO: 519792 - DNA, 25 bp, Homo sapien
gtatcaataccaaatagcttctgtt

SEQ ID NO: 519793 - DNA, 25 bp, Homo sapien
tttgctgaaggctaaattcacagcg

SEQ ID NO: 519794 - DNA, 25 bp, Homo sapien
ggctaaattcacagcgctatgcaat

SEQ ID NO: 519795 - DNA, 25 bp, Homo sapien
aattcacagcgctatgcaattctta

SEQ ID NO: 519796 - DNA, 25 bp, Homo sapien
tcagttttaaatgtaccttcagaat

SEQ ID NO: 519797 - DNA, 25 bp, Homo sapien
gtaccttcagaataagcttccccac

SEQ ID NO: 519798 - DNA, 25 bp, Homo sapien
cccagtttttgttgcttgaaaatat

SEQ ID NO: 519799 - DNA, 25 bp, Homo sapien
gcttgaaaatattgttgtcccggat

SEQ ID NO: 519800 - DNA, 25 bp, Homo sapien
tgttgtcccggatttttgttaatat

SEQ ID NO: 519801 - DNA, 25 bp, Homo sapien
tggagaatgaatgctgttctgaatt

SEQ ID NO: 519802 - DNA, 25 bp, Homo sapien
gagaaccacacgagctggagattca

SEQ ID NO: 519803 - DNA, 25 bp, Homo sapien
tacttcatttcttaaatcccttgag

SEQ ID NO: 519804 - DNA, 25 bp, Homo sapien
acttcatttcttaaatcccttgagg

SEQ ID NO: 519805 - DNA, 25 bp, Homo sapien
cttcatttcttaaatcccttgaggg

SEQ ID NO: 519806 - DNA, 25 bp, Homo sapien
atcccttgagggtagtaactgcatc

SEQ ID NO: 519807 - DNA, 25 bp, Homo sapien
aactgcatcttctccattgatatag

SEQ ID NO: 519808 - DNA, 25 bp, Homo sapien
actgcatcttctccattgatatagc

SEQ ID NO: 519809 - DNA, 25 bp, Homo sapien
tgcatcttctccattgatatagccc

SEQ ID NO: 519810 - DNA, 25 bp, Homo sapien
gcatcttctccattgatatagcccc

SEQ ID NO: 519811 - DNA, 25 bp, Homo sapien
catcttctccattgatatagcccct

SEQ ID NO: 519812 - DNA, 25 bp, Homo sapien
atgctattaggccacgctttgcaat

SEQ ID NO: 519813 - DNA, 25 bp, Homo sapien
cacgctttgcaattggcctgaggat

SEQ ID NO: 519814 - DNA, 25 bp, Homo sapien
tggcctgaggatgacactaatgttt

SEQ ID NO: 519815 - DNA, 25 bp, Homo sapien
aacctaaatctaattcttcctgagt

SEQ ID NO: 519816 - DNA, 25 bp, Homo sapien
tagcctggactctcgcattttatat

SEQ ID NO: 519817 - DNA, 25 bp, Homo sapien
atctaattcttcctgagtagcttct

SEQ ID NO: 519818 - DNA, 25 bp, Homo sapien
ttccaaccacctactaaagattctg

SEQ ID NO: 519819 - DNA, 25 bp, Homo sapien
gattctgttgagtatcagtcaggct

SEQ ID NO: 519820 - DNA, 25 bp, Homo sapien
gagtatcagtcaggctttatcctta

SEQ ID NO: 519821 - DNA, 25 bp, Homo sapien
gctttatttacttagggcttcctgt

SEQ ID NO: 519822 - DNA, 25 bp, Homo sapien
tgtcctcagtgggaatgctattagg

SEQ ID NO: 519823 - DNA, 25 bp, Homo sapien
gtgggtgcagagcaatagcctctcc

SEQ ID NO: 519824 - DNA, 25 bp, Homo sapien
tcacagcggtgtgaagagtgacctc

SEQ ID NO: 519825 - DNA, 25 bp, Homo sapien
gacctcactgtccttagggttagca

SEQ ID NO: 519826 - DNA, 25 bp, Homo sapien
ttagggttagcatcctggccgagga

SEQ ID NO: 519827 - DNA, 25 bp, Homo sapien
gaggatgtcacagggctcctggtct

SEQ ID NO: 519828 - DNA, 25 bp, Homo sapien
gtcctcatgtgctatgtgaccctga

SEQ ID NO: 519829 - DNA, 25 bp, Homo sapien
tcagtccacttacctgaactgaggg

SEQ ID NO: 519830 - DNA, 25 bp, Homo sapien
gataatggaccaacctctcaaggct

SEQ ID NO: 519831 - DNA, 25 bp, Homo sapien
tcaaggctgttgtgccaatgaaaca

SEQ ID NO: 519832 - DNA, 25 bp, Homo sapien
gaaacaaaggccagcccagggctta

SEQ ID NO: 519833 - DNA, 25 bp, Homo sapien
cagggcttagcacaagcatgctcaa

SEQ ID NO: 519834 - DNA, 25 bp, Homo sapien
gaacagatacaaggacatactgcca

SEQ ID NO: 519835 - DNA, 25 bp, Homo sapien
gcgtctatgggccaaaagcatatgt

SEQ ID NO: 519836 - DNA, 25 bp, Homo sapien
atgggccaaaagcatatgtagcaac

SEQ ID NO: 519837 - DNA, 25 bp, Homo sapien
ggccaaaagcatatgtagcaactca

SEQ ID NO: 519838 - DNA, 25 bp, Homo sapien
aaagcatatgtagcaactcaaggac

SEQ ID NO: 519839 - DNA, 25 bp, Homo sapien
atatgtagcaactcaaggaccttta

SEQ ID NO: 519840 - DNA, 25 bp, Homo sapien
atgtagcaactcaaggacctttagc

SEQ ID NO: 519841 - DNA, 25 bp, Homo sapien
gtagcaactcaaggacctttagcaa

SEQ ID NO: 519842 - DNA, 25 bp, Homo sapien
gcaactcaaggacctttagcaaata

SEQ ID NO: 519843 - DNA, 25 bp, Homo sapien
ctcaaggacctttagcaaatacagt

SEQ ID NO: 519844 - DNA, 25 bp, Homo sapien
cagtaatagatttttggaggatggt

SEQ ID NO: 519845 - DNA, 25 bp, Homo sapien
ctggtattactttacatcagtaggc

SEQ ID NO: 519846 - DNA, 25 bp, Homo sapien
acatcagtaggcatctttgacatga

SEQ ID NO: 519847 - DNA, 25 bp, Homo sapien
gtaggcatctttgacatgagcatat

SEQ ID NO: 519848 - DNA, 25 bp, Homo sapien
gcatataaatattttgttgactcag

SEQ ID NO: 519849 - DNA, 25 bp, Homo sapien
tgttgactcagcaaaggtgacactt

SEQ ID NO: 519850 - DNA, 25 bp, Homo sapien
gacactttgtgactaaagtatccca

SEQ ID NO: 519851 - DNA, 25 bp, Homo sapien
gagaggtgtaactgtttgttaacta

SEQ ID NO: 519852 - DNA, 25 bp, Homo sapien
attacatggatttcatactaggcag

SEQ ID NO: 519853 - DNA, 25 bp, Homo sapien
ggatttcatactaggcagtgacaac

SEQ ID NO: 519854 - DNA, 25 bp, Homo sapien
ggcagtgacaactaacatgttactt

SEQ ID NO: 519855 - DNA, 25 bp, Homo sapien
gtgtataatgggttgtctttttatt

SEQ ID NO: 519856 - DNA, 25 bp, Homo sapien
gagttgctacatatgcttttggccc

SEQ ID NO: 519857 - DNA, 25 bp, Homo sapien
acatatgcttttggcccatagacgc

SEQ ID NO: 519858 - DNA, 25 bp, Homo sapien
ttggcccatagacgccatggcagta

SEQ ID NO: 519859 - DNA, 25 bp, Homo sapien
tcaaattctcggcaggccattacaa

SEQ ID NO: 519860 - DNA, 25 bp, Homo sapien
agacgccatggcagtatgtccttgt

SEQ ID NO: 519861 - DNA, 25 bp, Homo sapien
gccatggcagtatgtccttgtatct

SEQ ID NO: 519862 - DNA, 25 bp, Homo sapien
ggcaggccattacaatgatcacaac

SEQ ID NO: 519863 - DNA, 25 bp, Homo sapien
gatcacaacattatactcccatacc

SEQ ID NO: 519864 - DNA, 25 bp, Homo sapien
ccataccatcctccaaaaatctatt

SEQ ID NO: 519865 - DNA, 25 bp, Homo sapien
aaaatctattactgtatttgctaaa

SEQ ID NO: 519866 - DNA, 25 bp, Homo sapien
gctaaaggtccttgagttgctacat

SEQ ID NO: 519867 - DNA, 25 bp, Homo sapien
aaatgattttcatgttaggccaaaa

SEQ ID NO: 519868 - DNA, 25 bp, Homo sapien
acttatagggtacatatgttgtcat

SEQ ID NO: 519869 - DNA, 25 bp, Homo sapien
aaggtaaaagtgatgcatgccaaac

SEQ ID NO: 519870 - DNA, 25 bp, Homo sapien
gatgcatgccaaaccaaactaaacc

SEQ ID NO: 519871 - DNA, 25 bp, Homo sapien
atttggattatctgctattcgggta

SEQ ID NO: 519872 - DNA, 25 bp, Homo sapien
tgctattcgggtaatcttcacagaa

SEQ ID NO: 519873 - DNA, 25 bp, Homo sapien
agaatctgcagtttactgagggcat

SEQ ID NO: 519874 - DNA, 25 bp, Homo sapien
ctgcagtttactgagggcatttcag

SEQ ID NO: 519875 - DNA, 25 bp, Homo sapien
aacaggactttgtccagactctcct

SEQ ID NO: 519876 - DNA, 25 bp, Homo sapien
ctcttacctttgtgccttgactgtg

SEQ ID NO: 519877 - DNA, 25 bp, Homo sapien
gtggcaagatactttggttggttaa

SEQ ID NO: 519878 - DNA, 25 bp, Homo sapien
gaagcaacgaggacagatatccttc

SEQ ID NO: 519879 - DNA, 25 bp, Homo sapien
gatatccttcacatgtatctctctc

SEQ ID NO: 519880 - DNA, 25 bp, Homo sapien
ttcacatgtatctctctcctttccg

SEQ ID NO: 519881 - DNA, 25 bp, Homo sapien
tctcctttccggcaaaagcaaggag

SEQ ID NO: 519882 - DNA, 25 bp, Homo sapien
agcatccggcgagaagacttaagtg

SEQ ID NO: 519883 - DNA, 25 bp, Homo sapien
gaagacttaagtgacatactcaaaa

SEQ ID NO: 519884 - DNA, 25 bp, Homo sapien
gggaggtcgcagattctgtagccaa

SEQ ID NO: 519885 - DNA, 25 bp, Homo sapien
gattctgtagccaagacggctggga

SEQ ID NO: 519886 - DNA, 25 bp, Homo sapien
gaaaaggacggagcgccacggacag

SEQ ID NO: 519887 - DNA, 25 bp, Homo sapien
ggcgggactgtcaaatggtccagaa

SEQ ID NO: 519888 - DNA, 25 bp, Homo sapien
gaagatacacattcccacagaagtt

SEQ ID NO: 519889 - DNA, 25 bp, Homo sapien
tccacttcaccatcggatgtttgcc

SEQ ID NO: 519890 - DNA, 25 bp, Homo sapien
caccatcggatgtttgccactcaga

SEQ ID NO: 519891 - DNA, 25 bp, Homo sapien
cggatgtttgccactcagactgagg

SEQ ID NO: 519892 - DNA, 25 bp, Homo sapien
gggagctcagagtgacccaaattct

SEQ ID NO: 519893 - DNA, 25 bp, Homo sapien
agctcagagtgacccaaattctcaa

SEQ ID NO: 519894 - DNA, 25 bp, Homo sapien
gaaaagtttccacgagctacagcta

SEQ ID NO: 519895 - DNA, 25 bp, Homo sapien
gagctacagctataaaagtcactga

SEQ ID NO: 519896 - DNA, 25 bp, Homo sapien
ataaaagtcactgacatttcaggag

SEQ ID NO: 519897 - DNA, 25 bp, Homo sapien
gtccagcagcaccagatggttaatc

SEQ ID NO: 519898 - DNA, 25 bp, Homo sapien
gcaccagatggttaatcaggcacta

SEQ ID NO: 519899 - DNA, 25 bp, Homo sapien
agatggttaatcaggcactaaaaga

SEQ ID NO: 519900 - DNA, 25 bp, Homo sapien
gggcccacccgcagagtggcagagg

SEQ ID NO: 519901 - DNA, 25 bp, Homo sapien
acgttgagctctgtggcgaaggtcc

SEQ ID NO: 519902 - DNA, 25 bp, Homo sapien
agctctgtggcgaaggtcctggcct

SEQ ID NO: 519903 - DNA, 25 bp, Homo sapien
ctgtggcgaaggtcctggccttctg

SEQ ID NO: 519904 - DNA, 25 bp, Homo sapien
tttattgctatttggcccctgcgtt

SEQ ID NO: 519905 - DNA, 25 bp, Homo sapien
agaagagcgacttctcacggtccag

SEQ ID NO: 519906 - DNA, 25 bp, Homo sapien
aagagcgacttctcacggtccagga

SEQ ID NO: 519907 - DNA, 25 bp, Homo sapien
agcgacttctcacggtccaggagga

SEQ ID NO: 519908 - DNA, 25 bp, Homo sapien
ttctcacggtccaggaggaagttgt

SEQ ID NO: 519909 - DNA, 25 bp, Homo sapien
ctatttggcccctgcgttcgtgcct

SEQ ID NO: 519910 - DNA, 25 bp, Homo sapien
ctgcgttcgtgcctccatttgccag

SEQ ID NO: 519911 - DNA, 25 bp, Homo sapien
aagtattttttgactagaccattca

SEQ ID NO: 519912 - DNA, 25 bp, Homo sapien
tagaccattcaaagctacccgaact

SEQ ID NO: 519913 - DNA, 25 bp, Homo sapien
gctacccgaactatgttggaaattt

SEQ ID NO: 519914 - DNA, 25 bp, Homo sapien
tctcattaaaatacaggcccttagg

SEQ ID NO: 519915 - DNA, 25 bp, Homo sapien
aggcccttaggctctatttttcatg

SEQ ID NO: 519916 - DNA, 25 bp, Homo sapien
gtatgagtcgtgtgtaatttatgta

SEQ ID NO: 519917 - DNA, 25 bp, Homo sapien
aaatgtgtgtacagactcactgatg

SEQ ID NO: 519918 - DNA, 25 bp, Homo sapien
tcactgatgcagcactgtagcccat

SEQ ID NO: 519919 - DNA, 25 bp, Homo sapien
atcaccttggagcactgactgtaca

SEQ ID NO: 519920 - DNA, 25 bp, Homo sapien
aagtgaacgcccttgtagagcagcc

SEQ ID NO: 519921 - DNA, 25 bp, Homo sapien
agcccagacgctgctgacgctgtgt

SEQ ID NO: 519922 - DNA, 25 bp, Homo sapien
tggcttcatcatgcacttttccttc

SEQ ID NO: 519923 - DNA, 25 bp, Homo sapien
cttttccttcatagcctattttaag

SEQ ID NO: 519924 - DNA, 25 bp, Homo sapien
gaagttgacttgctgaactgctttt

SEQ ID NO: 519925 - DNA, 25 bp, Homo sapien
gaactgctttttagccaagctattt

SEQ ID NO: 519926 - DNA, 25 bp, Homo sapien
gtatgtggccataatttccaaaagg

SEQ ID NO: 519927 - DNA, 25 bp, Homo sapien
tgttcaattgctgttgctctgcagt

SEQ ID NO: 519928 - DNA, 25 bp, Homo sapien
gctctgcagtgtgcattcatgcagt

SEQ ID NO: 519929 - DNA, 25 bp, Homo sapien
tactgcattgatagtacggcatcag

SEQ ID NO: 519930 - DNA, 25 bp, Homo sapien
gtacggcatcagagaatagatcact

SEQ ID NO: 519931 - DNA, 25 bp, Homo sapien
atagatcacttaggttcaaatccca

SEQ ID NO: 519932 - DNA, 25 bp, Homo sapien
tcaaatcccagtgcatgatcctgag

SEQ ID NO: 519933 - DNA, 25 bp, Homo sapien
tccacttcaccatcggatgtttgcc

SEQ ID NO: 519934 - DNA, 25 bp, Homo sapien
acttcaccatcggatgtttgccact

SEQ ID NO: 519935 - DNA, 25 bp, Homo sapien
caccatcggatgtttgccactcaga

SEQ ID NO: 519936 - DNA, 25 bp, Homo sapien
aagaaaagtttccacgagctacagc

SEQ ID NO: 519937 - DNA, 25 bp, Homo sapien
gaaaagtttccacgagctacagcta

SEQ ID NO: 519938 - DNA, 25 bp, Homo sapien
aaaagtttccacgagctacagctat

SEQ ID NO: 519939 - DNA, 25 bp, Homo sapien
aaagtttccacgagctacagctata

SEQ ID NO: 519940 - DNA, 25 bp, Homo sapien
aagtttccacgagctacagctataa

SEQ ID NO: 519941 - DNA, 25 bp, Homo sapien
gtttccacgagctacagctataaaa

SEQ ID NO: 519942 - DNA, 25 bp, Homo sapien
gagctacagctataaaagtcactga

SEQ ID NO: 519943 - DNA, 25 bp, Homo sapien
gctataaaagtcactgacatttcag

SEQ ID NO: 519944 - DNA, 25 bp, Homo sapien
actcagccacgttctaaaaatgaaa

SEQ ID NO: 519945 - DNA, 25 bp, Homo sapien
ctcagccacgttctaaaaatgaaag

SEQ ID NO: 519946 - DNA, 25 bp, Homo sapien
tcagccacgttctaaaaatgaaagc

SEQ ID NO: 519947 - DNA, 25 bp, Homo sapien
aaaagagcaagaaagcaagctataa

SEQ ID NO: 519948 - DNA, 25 bp, Homo sapien
agcaagctataaaagaagagcgcaa

SEQ ID NO: 519949 - DNA, 25 bp, Homo sapien
ctataaaagaagagcgcaaggaacg

SEQ ID NO: 519950 - DNA, 25 bp, Homo sapien
aaaagaagagcgcaaggaacgaaga

SEQ ID NO: 519951 - DNA, 25 bp, Homo sapien
aagagcgcaaggaacgaagagtgga

SEQ ID NO: 519952 - DNA, 25 bp, Homo sapien
aacaaattagcatttaaactggaga

SEQ ID NO: 519953 - DNA, 25 bp, Homo sapien
caaattagcatttaaactggagaaa

SEQ ID NO: 519954 - DNA, 25 bp, Homo sapien
aattagcatttaaactggagaaaag

SEQ ID NO: 519955 - DNA, 25 bp, Homo sapien
atgatgttcagcttggtattaacca

SEQ ID NO: 519956 - DNA, 25 bp, Homo sapien
agcaagatgaagtcttttcccatga

SEQ ID NO: 519957 - DNA, 25 bp, Homo sapien
tttcccatgaatgtgtccccttatc

SEQ ID NO: 519958 - DNA, 25 bp, Homo sapien
tgaatgtgtccccttatctcattat

SEQ ID NO: 519959 - DNA, 25 bp, Homo sapien
atctcattatagcttatgctcagtt

SEQ ID NO: 519960 - DNA, 25 bp, Homo sapien
atgctcagtttcactttcttggaaa

SEQ ID NO: 519961 - DNA, 25 bp, Homo sapien
attagcctggcactttaggtaactt

SEQ ID NO: 519962 - DNA, 25 bp, Homo sapien
ctggcactttaggtaacttgaaaat

SEQ ID NO: 519963 - DNA, 25 bp, Homo sapien
cttgaaaataactctcacccttctg

SEQ ID NO: 519964 - DNA, 25 bp, Homo sapien
aaaataactctcacccttctgactg

SEQ ID NO: 519965 - DNA, 25 bp, Homo sapien
tatatacacccttacagattttcta

SEQ ID NO: 519966 - DNA, 25 bp, Homo sapien
ggaaatgtgcttttaatctttggtg

SEQ ID NO: 519967 - DNA, 25 bp, Homo sapien
ttaatctttggtgtagcccagcctt

SEQ ID NO: 519968 - DNA, 25 bp, Homo sapien
gtagcccagccttctaggaacaaaa

SEQ ID NO: 519969 - DNA, 25 bp, Homo sapien
aaagtatcctatgttggcaactgca

SEQ ID NO: 519970 - DNA, 25 bp, Homo sapien
gccagtaactcctaaaggtcttgtt

SEQ ID NO: 519971 - DNA, 25 bp, Homo sapien
gtcttgttcctttgacttttcttct

SEQ ID NO: 519972 - DNA, 25 bp, Homo sapien
gatattcatgaattgcaatggcaaa

SEQ ID NO: 519973 - DNA, 25 bp, Homo sapien
ttgcaatggcaaacgttttttaggt

SEQ ID NO: 519974 - DNA, 25 bp, Homo sapien
gggccacaactattatcttaagtgg

SEQ ID NO: 519975 - DNA, 25 bp, Homo sapien
taaaactagcttctactccacttgt

SEQ ID NO: 519976 - DNA, 25 bp, Homo sapien
tactccacttgtaggaaatgtgctt

SEQ ID NO: 519977 - DNA, 25 bp, Homo sapien
tgcacgtgctcagcgaagaccggct

SEQ ID NO: 519978 - DNA, 25 bp, Homo sapien
gaccggctgctgtggaagaaactct

SEQ ID NO: 519979 - DNA, 25 bp, Homo sapien
ggaagaaactctgccagtaccactt

SEQ ID NO: 519980 - DNA, 25 bp, Homo sapien
gatccgcaaacgattaattctgtca

SEQ ID NO: 519981 - DNA, 25 bp, Homo sapien
attctgtcagacaaagggcagctgg

SEQ ID NO: 519982 - DNA, 25 bp, Homo sapien
tttcaaacttgtccgatgttaccca

SEQ ID NO: 519983 - DNA, 25 bp, Homo sapien
tatggagatacccttcagctctgca

SEQ ID NO: 519984 - DNA, 25 bp, Homo sapien
tgtcacatcctttcctggaagggca

SEQ ID NO: 519985 - DNA, 25 bp, Homo sapien
tggaagggcactgaccatccgtgca

SEQ ID NO: 519986 - DNA, 25 bp, Homo sapien
cgtgcactgccaataacccagagag

SEQ ID NO: 519987 - DNA, 25 bp, Homo sapien
aataacccagagagctgctccgttt

SEQ ID NO: 519988 - DNA, 25 bp, Homo sapien
gaggcgacactgctacctcgcgcta

SEQ ID NO: 519989 - DNA, 25 bp, Homo sapien
tgctacctcgcgctaacggatggaa

SEQ ID NO: 519990 - DNA, 25 bp, Homo sapien
acctcgcgctaacggatggaacaga

SEQ ID NO: 519991 - DNA, 25 bp, Homo sapien
atggaacagatcagtctccacgcgg

SEQ ID NO: 519992 - DNA, 25 bp, Homo sapien
aacagatcagtctccacgcggcaag

SEQ ID NO: 519993 - DNA, 25 bp, Homo sapien
ggcaagccctgtgggcatttccaga

SEQ ID NO: 519994 - DNA, 25 bp, Homo sapien
aacgctggggagtctatccacacag

SEQ ID NO: 519995 - DNA, 25 bp, Homo sapien
gaagccagtggacaggcctccagcc

SEQ ID NO: 519996 - DNA, 25 bp, Homo sapien
gggtacaaagttctcttgcctggaa

SEQ ID NO: 519997 - DNA, 25 bp, Homo sapien
aattgagaagccttgactgtcccgg

SEQ ID NO: 519998 - DNA, 25 bp, Homo sapien
aagccttgactgtcccgggcttggt

SEQ ID NO: 519999 - DNA, 25 bp, Homo sapien
gcaagtatgctctataattagggct

SEQ ID NO: 520000 - DNA, 25 bp, Homo sapien
gtatgctctataattagggctaact

SEQ ID NO: 520001 - DNA, 25 bp, Homo sapien
taattagggctaacttcttatattt

SEQ ID NO: 520002 - DNA, 25 bp, Homo sapien
aaatcctatcacttcttttgctttg

SEQ ID NO: 520003 - DNA, 25 bp, Homo sapien
agtatgtgagatttctgtgtattca

SEQ ID NO: 520004 - DNA, 25 bp, Homo sapien
gtgagatttctgtgtattcagtcag

SEQ ID NO: 520005 - DNA, 25 bp, Homo sapien
tcagtcagattatctatgaatggaa

SEQ ID NO: 520006 - DNA, 25 bp, Homo sapien
cagtgtcttagttgtttaaacagtt

SEQ ID NO: 520007 - DNA, 25 bp, Homo sapien
acagtttaatggaaatcagtacaat

SEQ ID NO: 520008 - DNA, 25 bp, Homo sapien
gtacaatattttaccattcaactaa

SEQ ID NO: 520009 - DNA, 25 bp, Homo sapien
actttgttgtatgcaagtatgctct

SEQ ID NO: 520010 - DNA, 25 bp, Homo sapien
ctcataattgttttatagctgaaaa

SEQ ID NO: 520011 - DNA, 25 bp, Homo sapien
tcataattgttttatagctgaaaat

SEQ ID NO: 520012 - DNA, 25 bp, Homo sapien
cataattgttttatagctgaaaata

SEQ ID NO: 520013 - DNA, 25 bp, Homo sapien
ataattgttttatagctgaaaataa

SEQ ID NO: 520014 - DNA, 25 bp, Homo sapien
aaagtcaggaaactggcccggtgcg

SEQ ID NO: 520015 - DNA, 25 bp, Homo sapien
aagtcaggaaactggcccggtgcgg

SEQ ID NO: 520016 - DNA, 25 bp, Homo sapien
agtcaggaaactggcccggtgcggt

SEQ ID NO: 520017 - DNA, 25 bp, Homo sapien
gtcaggaaactggcccggtgcggtg

SEQ ID NO: 520018 - DNA, 25 bp, Homo sapien
tcaggaaactggcccggtgcggtgg

SEQ ID NO: 520019 - DNA, 25 bp, Homo sapien
caggaaactggcccggtgcggtggc

SEQ ID NO: 520020 - DNA, 25 bp, Homo sapien
tggggaggttgaggcgcaagaatcg

SEQ ID NO: 520021 - DNA, 25 bp, Homo sapien
aaaatctcaagcgatatctatctgg

SEQ ID NO: 520022 - DNA, 25 bp, Homo sapien
ttccattttaggagattgagatgca

SEQ ID NO: 520023 - DNA, 25 bp, Homo sapien
gattgagatgcagaacgttaatgtt

SEQ ID NO: 520024 - DNA, 25 bp, Homo sapien
gttaatgttcattacctcctcctac

SEQ ID NO: 520025 - DNA, 25 bp, Homo sapien
tcattctgttgccaaatatcacaga

SEQ ID NO: 520026 - DNA, 25 bp, Homo sapien
gttgccaaatatcacagaagtaatg

SEQ ID NO: 520027 - DNA, 25 bp, Homo sapien
gaggagtttagttacatttggctgt

SEQ ID NO: 520028 - DNA, 25 bp, Homo sapien
ctctgaaagagccaggtttggaatt

SEQ ID NO: 520029 - DNA, 25 bp, Homo sapien
gggtgatctaggaagaaggttccaa

SEQ ID NO: 520030 - DNA, 25 bp, Homo sapien
gaaggttccaaagaagcagaggcat

SEQ ID NO: 520031 - DNA, 25 bp, Homo sapien
aagcagaggcatttgtcaagttacc

SEQ ID NO: 520032 - DNA, 25 bp, Homo sapien
aatgaaactcattgacagacctggg

SEQ ID NO: 520033 - DNA, 25 bp, Homo sapien
gacagacctgggaccttttatgtga

SEQ ID NO: 520034 - DNA, 25 bp, Homo sapien
agacaagatcttggtttggcttcat

SEQ ID NO: 520035 - DNA, 25 bp, Homo sapien
tggtttggcttcatgtactgttttc

SEQ ID NO: 520036 - DNA, 25 bp, Homo sapien
atgtactgttttctagagagagtgc

SEQ ID NO: 520037 - DNA, 25 bp, Homo sapien
gtgctacgaaaaacttatgatgctt

SEQ ID NO: 520038 - DNA, 25 bp, Homo sapien
ttatgatgcttttatgtgataacca

SEQ ID NO: 520039 - DNA, 25 bp, Homo sapien
gttaattctttgtgatgctatatac

SEQ ID NO: 520040 - DNA, 25 bp, Homo sapien
gaaaccactttgttaaacttatctg

SEQ ID NO: 520041 - DNA, 25 bp, Homo sapien
tctggattttaagacacttgtaaac

SEQ ID NO: 520042 - DNA, 25 bp, Homo sapien
gggcattaagagttttacagagcaa

SEQ ID NO: 520043 - DNA, 25 bp, Homo sapien
taaataatccttaccatgtaaagat

SEQ ID NO: 520044 - DNA, 25 bp, Homo sapien
aatccttaccatgtaaagattgtat

SEQ ID NO: 520045 - DNA, 25 bp, Homo sapien
ttattttatggccaagtatactttt

SEQ ID NO: 520046 - DNA, 25 bp, Homo sapien
gtaaggaaatgttgaagtcttgagt

SEQ ID NO: 520047 - DNA, 25 bp, Homo sapien
aaaactatagttagtgtcaactgtg

SEQ ID NO: 520048 - DNA, 25 bp, Homo sapien
ataaatattattcatgtgtggtttt

SEQ ID NO: 520049 - DNA, 25 bp, Homo sapien
taagaaactgttttggcatagagct

SEQ ID NO: 520050 - DNA, 25 bp, Homo sapien
agaaactgttttggcatagagcttt

SEQ ID NO: 520051 - DNA, 25 bp, Homo sapien
agagctttacttaaaatgctgcttc

SEQ ID NO: 520052 - DNA, 25 bp, Homo sapien
gctttacttaaaatgctgcttcatt

SEQ ID NO: 520053 - DNA, 25 bp, Homo sapien
aatgctgcttcattttacacattgt

SEQ ID NO: 520054 - DNA, 25 bp, Homo sapien
atgtattaagtctggcctgggcata

SEQ ID NO: 520055 - DNA, 25 bp, Homo sapien
gagaattcatcaaaatcatgcccat

SEQ ID NO: 520056 - DNA, 25 bp, Homo sapien
aatcatgcccatttgctgttgtaga

SEQ ID NO: 520057 - DNA, 25 bp, Homo sapien
gtagagctacagtattcttcaatgg

SEQ ID NO: 520058 - DNA, 25 bp, Homo sapien
tattcttcaatggtggtgactgacc

SEQ ID NO: 520059 - DNA, 25 bp, Homo sapien
gtgactgaccagtgagtttctactt

SEQ ID NO: 520060 - DNA, 25 bp, Homo sapien
gtttctacttcttacagatgggaca

SEQ ID NO: 520061 - DNA, 25 bp, Homo sapien
gacacaacagtcatgggctgtctca

SEQ ID NO: 520062 - DNA, 25 bp, Homo sapien
aaagcctgaggcagaccacatgaga

SEQ ID NO: 520063 - DNA, 25 bp, Homo sapien
atggagctgtgaacacttcattttt

SEQ ID NO: 520064 - DNA, 25 bp, Homo sapien
tatggtgctattgactacttaatac

SEQ ID NO: 520065 - DNA, 25 bp, Homo sapien
ttaccttaagtagtcaaatttacag

SEQ ID NO: 520066 - DNA, 25 bp, Homo sapien
taccttaagtagtcaaatttacaga

SEQ ID NO: 520067 - DNA, 25 bp, Homo sapien
atgcagctcatatttaaagggaaaa

SEQ ID NO: 520068 - DNA, 25 bp, Homo sapien
tttcaaattaaccatcatatcacag

SEQ ID NO: 520069 - DNA, 25 bp, Homo sapien
attaaccatcatatcacagatctct

SEQ ID NO: 520070 - DNA, 25 bp, Homo sapien
ttaaccatcatatcacagatctctt

SEQ ID NO: 520071 - DNA, 25 bp, Homo sapien
taaccatcatatcacagatctcttc

SEQ ID NO: 520072 - DNA, 25 bp, Homo sapien
aaccatcatatcacagatctcttca

SEQ ID NO: 520073 - DNA, 25 bp, Homo sapien
gggtacaatgataatgggtgattgt

SEQ ID NO: 520074 - DNA, 25 bp, Homo sapien
ggtacaatgataatgggtgattgtt

SEQ ID NO: 520075 - DNA, 25 bp, Homo sapien
gtacaatgataatgggtgattgttg

SEQ ID NO: 520076 - DNA, 25 bp, Homo sapien
tacaatgataatgggtgattgttga

SEQ ID NO: 520077 - DNA, 25 bp, Homo sapien
acaatgataatgggtgattgttgat

SEQ ID NO: 520078 - DNA, 25 bp, Homo sapien
caatgataatgggtgattgttgatg

SEQ ID NO: 520079 - DNA, 25 bp, Homo sapien
aatgataatgggtgattgttgatgt

SEQ ID NO: 520080 - DNA, 25 bp, Homo sapien
aagattaaattgaaggccagcacgg

SEQ ID NO: 520081 - DNA, 25 bp, Homo sapien
agattaaattgaaggccagcacggt

SEQ ID NO: 520082 - DNA, 25 bp, Homo sapien
gattaaattgaaggccagcacggtg

SEQ ID NO: 520083 - DNA, 25 bp, Homo sapien
attaaattgaaggccagcacggtgg

SEQ ID NO: 520084 - DNA, 25 bp, Homo sapien
tcccctagtattggaggaggtgcat

SEQ ID NO: 520085 - DNA, 25 bp, Homo sapien
acttgctccttgctgttgtcgtgat

SEQ ID NO: 520086 - DNA, 25 bp, Homo sapien
cttgctccttgctgttgtcgtgata

SEQ ID NO: 520087 - DNA, 25 bp, Homo sapien
ttgctccttgctgttgtcgtgatag

SEQ ID NO: 520088 - DNA, 25 bp, Homo sapien
tgctccttgctgttgtcgtgatagt

SEQ ID NO: 520089 - DNA, 25 bp, Homo sapien
gctccttgctgttgtcgtgatagtg

SEQ ID NO: 520090 - DNA, 25 bp, Homo sapien
aaagtgtgtagcactccctcttcgc

SEQ ID NO: 520091 - DNA, 25 bp, Homo sapien
aagtgtgtagcactccctcttcgct

SEQ ID NO: 520092 - DNA, 25 bp, Homo sapien
gtgtgtagcactccctcttcgctct

SEQ ID NO: 520093 - DNA, 25 bp, Homo sapien
ctgctccaaccatgtggacgtgcct

SEQ ID NO: 520094 - DNA, 25 bp, Homo sapien
aaccatgtggacgtgcctccttcct

SEQ ID NO: 520095 - DNA, 25 bp, Homo sapien
tgtcgatgcccatgcaggcagaggt

SEQ ID NO: 520096 - DNA, 25 bp, Homo sapien
gacccaaaattgtgatgacgcccag

SEQ ID NO: 520097 - DNA, 25 bp, Homo sapien
aaattgtgatgacgcccagcagagc

SEQ ID NO: 520098 - DNA, 25 bp, Homo sapien
atgacgcccagcagagcccgggtag

SEQ ID NO: 520099 - DNA, 25 bp, Homo sapien
aggattctggtccatgggtttcaga

SEQ ID NO: 520100 - DNA, 25 bp, Homo sapien
tgggtttcagaacgaagtcttcccg

SEQ ID NO: 520101 - DNA, 25 bp, Homo sapien
gaagtcttcccggagcccatgttca

SEQ ID NO: 520102 - DNA, 25 bp, Homo sapien
gcccatgttcacgtggacgcgggtt

SEQ ID NO: 520103 - DNA, 25 bp, Homo sapien
tcctggacggcagcgctgagttcga

SEQ ID NO: 520104 - DNA, 25 bp, Homo sapien
gggttcccgccgagctcaatggctc

SEQ ID NO: 520105 - DNA, 25 bp, Homo sapien
aatggctccatgtatcgctgcaccg

SEQ ID NO: 520106 - DNA, 25 bp, Homo sapien
actgcttggccgcagagaaaatgcc

SEQ ID NO: 520107 - DNA, 25 bp, Homo sapien
cagagaaaatgccctggccaggaag

SEQ ID NO: 520108 - DNA, 25 bp, Homo sapien
gggtgtgtgatgatcaccgttctcc

SEQ ID NO: 520109 - DNA, 25 bp, Homo sapien
gtgtgatgatcaccgttctccggcc

SEQ ID NO: 520110 - DNA, 25 bp, Homo sapien
cggcctccgtcctgaacgtgaaggg

SEQ ID NO: 520111 - DNA, 25 bp, Homo sapien
gtaagaaagtgggaacgcgtcagtc

SEQ ID NO: 520112 - DNA, 25 bp, Homo sapien
ggaagatccggagcccggctagaag

SEQ ID NO: 520113 - DNA, 25 bp, Homo sapien
agcccggctagaagggtcggcctga

SEQ ID NO: 520114 - DNA, 25 bp, Homo sapien
tgagagaagccagtcccgcgcctga

SEQ ID NO: 520115 - DNA, 25 bp, Homo sapien
tgggaacgcgtcagtcccttccttg

SEQ ID NO: 520116 - DNA, 25 bp, Homo sapien
atcccaacactgcttggccgcagag

SEQ ID NO: 520117 - DNA, 25 bp, Homo sapien
tttaaagcacagaaactcttgcatg

SEQ ID NO: 520118 - DNA, 25 bp, Homo sapien
aactcttgcatgctgatatgtctta

SEQ ID NO: 520119 - DNA, 25 bp, Homo sapien
gagaggaaatgccagtctgtttact

SEQ ID NO: 520120 - DNA, 25 bp, Homo sapien
tgtttactcatctgtttcaggataa

SEQ ID NO: 520121 - DNA, 25 bp, Homo sapien
ttcaggataaggcacatttgtacgt

SEQ ID NO: 520122 - DNA, 25 bp, Homo sapien
ggcacatttgtacgtttggttctat

SEQ ID NO: 520123 - DNA, 25 bp, Homo sapien
ggttctataaccattgagtattaag

SEQ ID NO: 520124 - DNA, 25 bp, Homo sapien
aaaaccatgcggacagtatttactg

SEQ ID NO: 520125 - DNA, 25 bp, Homo sapien
tgcggacagtatttactgatctctg

SEQ ID NO: 520126 - DNA, 25 bp, Homo sapien
atctctgtttagatcccactgggtg

SEQ ID NO: 520127 - DNA, 25 bp, Homo sapien
ttagatcccactgggtggatttttg

SEQ ID NO: 520128 - DNA, 25 bp, Homo sapien
tcagcagcagatctccgggattctg

SEQ ID NO: 520129 - DNA, 25 bp, Homo sapien
tctgctgttattatccaaaggcgtt

SEQ ID NO: 520130 - DNA, 25 bp, Homo sapien
agatggatcttcttacatgctagaa

SEQ ID NO: 520131 - DNA, 25 bp, Homo sapien
catgctagaagttttaaacggtcct

SEQ ID NO: 520132 - DNA, 25 bp, Homo sapien
cggtccttaacatgcctttgttcaa

SEQ ID NO: 520133 - DNA, 25 bp, Homo sapien
ctttgttcaagcaccttccagaatg

SEQ ID NO: 520134 - DNA, 25 bp, Homo sapien
tcagcagctctggtttctattacgg

SEQ ID NO: 520135 - DNA, 25 bp, Homo sapien
gctctggtttctattacggtgactt

SEQ ID NO: 520136 - DNA, 25 bp, Homo sapien
aatgtcagattcaagggcccggcgt

SEQ ID NO: 520137 - DNA, 25 bp, Homo sapien
ttgtaatctaggagcgacagttcgt

SEQ ID NO: 520138 - DNA, 25 bp, Homo sapien
gcgacagttcgtgagatgtttattc

SEQ ID NO: 520139 - DNA, 25 bp, Homo sapien
cactaagcaggtattttgcaagaga

SEQ ID NO: 520140 - DNA, 25 bp, Homo sapien
gggtcacctataggcagaaaataga

SEQ ID NO: 520141 - DNA, 25 bp, Homo sapien
aatagattcgtgtctgtttaacagt

SEQ ID NO: 520142 - DNA, 25 bp, Homo sapien
tctgtttaacagtaacccaaataag

SEQ ID NO: 520143 - DNA, 25 bp, Homo sapien
ataagaagccatgttaaatagagac

SEQ ID NO: 520144 - DNA, 25 bp, Homo sapien
gagaaatctggtttctttcgtgttt

SEQ ID NO: 520145 - DNA, 25 bp, Homo sapien
atctggtttctttcgtgtttggtga

SEQ ID NO: 520146 - DNA, 25 bp, Homo sapien
gaaataactgaattttcccatgctt

SEQ ID NO: 520147 - DNA, 25 bp, Homo sapien
ctgaattttcccatgctttaactat

SEQ ID NO: 520148 - DNA, 25 bp, Homo sapien
tttcccatgctttaactatgtgtga

SEQ ID NO: 520149 - DNA, 25 bp, Homo sapien
catgctttaactatgtgtgaggaaa

SEQ ID NO: 520150 - DNA, 25 bp, Homo sapien
cagcgggtcgcaccgggctagctgg

SEQ ID NO: 520151 - DNA, 25 bp, Homo sapien
gcaccgggctagctggctgcccaga

SEQ ID NO: 520152 - DNA, 25 bp, Homo sapien
ggcgagctcctcgacctctgaggga

SEQ ID NO: 520153 - DNA, 25 bp, Homo sapien
agctcctcgacctctgagggaccat

SEQ ID NO: 520154 - DNA, 25 bp, Homo sapien
gacctctgagggaccatctccccga

SEQ ID NO: 520155 - DNA, 25 bp, Homo sapien
gagggtgggctctatattttcattc

SEQ ID NO: 520156 - DNA, 25 bp, Homo sapien
agggtgggctctatattttcattcc

SEQ ID NO: 520157 - DNA, 25 bp, Homo sapien
gggtgggctctatattttcattcca

SEQ ID NO: 520158 - DNA, 25 bp, Homo sapien
ggtgggctctatattttcattccaa

SEQ ID NO: 520159 - DNA, 25 bp, Homo sapien
gtgggctctatattttcattccaaa

SEQ ID NO: 520160 - DNA, 25 bp, Homo sapien
tgggctctatattttcattccaaat

SEQ ID NO: 520161 - DNA, 25 bp, Homo sapien
aacatctggttgaggttatttcatt

SEQ ID NO: 520162 - DNA, 25 bp, Homo sapien
tggaaaccttccttagagtcctgtt

SEQ ID NO: 520163 - DNA, 25 bp, Homo sapien
gagtcctgttgctcagtgtggtcca

SEQ ID NO: 520164 - DNA, 25 bp, Homo sapien
gtgtggtccatcagacggtagtact

SEQ ID NO: 520165 - DNA, 25 bp, Homo sapien
gtagtactgccacaagctgagagct

SEQ ID NO: 520166 - DNA, 25 bp, Homo sapien
agctgagagcttgctgggcacgcaa

SEQ ID NO: 520167 - DNA, 25 bp, Homo sapien
gggcacgcaacccagagtttctgaa

SEQ ID NO: 520168 - DNA, 25 bp, Homo sapien
agtttctgaatcctgttccgtattt

SEQ ID NO: 520169 - DNA, 25 bp, Homo sapien
gattcacagccacattaaagttcag

SEQ ID NO: 520170 - DNA, 25 bp, Homo sapien
aagttcaggagaccataggacccct

SEQ ID NO: 520171 - DNA, 25 bp, Homo sapien
taggacccctgacccatgagaagaa

SEQ ID NO: 520172 - DNA, 25 bp, Homo sapien
atactggccaccatccccgagagag

SEQ ID NO: 520173 - DNA, 25 bp, Homo sapien
catccccgagagaggaaccatcggt

SEQ ID NO: 520174 - DNA, 25 bp, Homo sapien
gaggaaccatcggtgttcccctgat

SEQ ID NO: 520175 - DNA, 25 bp, Homo sapien
atcggtgttcccctgatcactggca

SEQ ID NO: 520176 - DNA, 25 bp, Homo sapien
gatcactggcatggccgcttctgag

SEQ ID NO: 520177 - DNA, 25 bp, Homo sapien
gacagatgttcctggcaggacctct

SEQ ID NO: 520178 - DNA, 25 bp, Homo sapien
ttcctggcaggacctctcctcaaag

SEQ ID NO: 520179 - DNA, 25 bp, Homo sapien
aggctcccgggctccataatgtaat

SEQ ID NO: 520180 - DNA, 25 bp, Homo sapien
cgggctccataatgtaatctgttca

SEQ ID NO: 520181 - DNA, 25 bp, Homo sapien
tgtaatctgttcagcatggagacct

SEQ ID NO: 520182 - DNA, 25 bp, Homo sapien
agcatggagaccttcttctaccgcc

SEQ ID NO: 520183 - DNA, 25 bp, Homo sapien
aactgattataaccactcgggcacc

SEQ ID NO: 520184 - DNA, 25 bp, Homo sapien
atgcccacgagatgaggacagccct

SEQ ID NO: 520185 - DNA, 25 bp, Homo sapien
aggacagccctcaggaaggcaggtt

SEQ ID NO: 520186 - DNA, 25 bp, Homo sapien
ggaaggcaggtttcaccctcaacag

SEQ ID NO: 520187 - DNA, 25 bp, Homo sapien
aacagccaggtgcagcagaccattg

SEQ ID NO: 520188 - DNA, 25 bp, Homo sapien
agaccattgccctgcggtatgcgtg

SEQ ID NO: 520189 - DNA, 25 bp, Homo sapien
gtgcagcaagcttggcatcaacttt

SEQ ID NO: 520190 - DNA, 25 bp, Homo sapien
catcaactttgacagcttcgtggct

SEQ ID NO: 520191 - DNA, 25 bp, Homo sapien
tggcttgtatgatccgcctggagac

SEQ ID NO: 520192 - DNA, 25 bp, Homo sapien
gtggaattcaagacgctctggctga

SEQ ID NO: 520193 - DNA, 25 bp, Homo sapien
agacgctctggctgaagattcagaa

SEQ ID NO: 520194 - DNA, 25 bp, Homo sapien
aaaattacaagtgccaccttccaca

SEQ ID NO: 520195 - DNA, 25 bp, Homo sapien
atctcccaaacttcatttcacaatg

SEQ ID NO: 520196 - DNA, 25 bp, Homo sapien
tttcacaatggctgctgacatcaat

SEQ ID NO: 520197 - DNA, 25 bp, Homo sapien
gtcagacaggataatcaagtttgca

SEQ ID NO: 520198 - DNA, 25 bp, Homo sapien
atgtaacagttctccaagggtccct

SEQ ID NO: 520199 - DNA, 25 bp, Homo sapien
cagcctgcatatagggaaacagacc

SEQ ID NO: 520200 - DNA, 25 bp, Homo sapien
gaaacagaccttagattaggcagaa

SEQ ID NO: 520201 - DNA, 25 bp, Homo sapien
gaaaaggcccttagactgtcaaaca

SEQ ID NO: 520202 - DNA, 25 bp, Homo sapien
aaacacaagagtcctttctccacat

SEQ ID NO: 520203 - DNA, 25 bp, Homo sapien
agtcctttctccacatgcgatttta

SEQ ID NO: 520204 - DNA, 25 bp, Homo sapien
acatgcgattttacaggagttagcc

SEQ ID NO: 520205 - DNA, 25 bp, Homo sapien
tggttcatgaacaacagtgtctaga

SEQ ID NO: 520206 - DNA, 25 bp, Homo sapien
aacagtgtctagaaacccattttga

SEQ ID NO: 520207 - DNA, 25 bp, Homo sapien
tgtctagaaacccattttgaaagtg

SEQ ID NO: 520208 - DNA, 25 bp, Homo sapien
ttattaagtcacctatcacctttaa

SEQ ID NO: 520209 - DNA, 25 bp, Homo sapien
tcacctatcacctttaaacgccttt

SEQ ID NO: 520210 - DNA, 25 bp, Homo sapien
tgtaaagcagggtctcaacttttaa

SEQ ID NO: 520211 - DNA, 25 bp, Homo sapien
cttcttctctgaattattaaagttc

SEQ ID NO: 520212 - DNA, 25 bp, Homo sapien
ttatgacctcatttataaacactaa

SEQ ID NO: 520213 - DNA, 25 bp, Homo sapien
aaacactaaattctgtcacctcctg

SEQ ID NO: 520214 - DNA, 25 bp, Homo sapien
taaattctgtcacctcctgtcattt

SEQ ID NO: 520215 - DNA, 25 bp, Homo sapien
aaatatattttatgagctcttactc

SEQ ID NO: 520216 - DNA, 25 bp, Homo sapien
tagatgctttgtccttatgtggatc

SEQ ID NO: 520217 - DNA, 25 bp, Homo sapien
tccttatgtggatctggacccagat

SEQ ID NO: 520218 - DNA, 25 bp, Homo sapien
ggaaaaatcagaactttgttgtact

SEQ ID NO: 520219 - DNA, 25 bp, Homo sapien
aagatctgacagaatgcaggcagtt

SEQ ID NO: 520220 - DNA, 25 bp, Homo sapien
tccttcgcagtagatgcacctgggt

SEQ ID NO: 520221 - DNA, 25 bp, Homo sapien
gcacctgggtgataaatccaactct

SEQ ID NO: 520222 - DNA, 25 bp, Homo sapien
atccaactctgaccacaaggtggca

SEQ ID NO: 520223 - DNA, 25 bp, Homo sapien
gagtaaatgacaattcctcatatat

SEQ ID NO: 520224 - DNA, 25 bp, Homo sapien
gttgtacttccttacattcatttcc

SEQ ID NO: 520225 - DNA, 25 bp, Homo sapien
tcctgattacatgatgcttttgttt

SEQ ID NO: 520226 - DNA, 25 bp, Homo sapien
tgaatcacgtgtggagggtgtcacc

SEQ ID NO: 520227 - DNA, 25 bp, Homo sapien
ggcccaggacccagaacgggcatct

SEQ ID NO: 520228 - DNA, 25 bp, Homo sapien
ctgggtgctaaggttacaacagcaa

SEQ ID NO: 520229 - DNA, 25 bp, Homo sapien
ggttacaacagcaaacaagactgac

SEQ ID NO: 520230 - DNA, 25 bp, Homo sapien
acaagactgactcattccttttctc

SEQ ID NO: 520231 - DNA, 25 bp, Homo sapien
aagactgactcattccttttctcca

SEQ ID NO: 520232 - DNA, 25 bp, Homo sapien
gggacttactgtcttatcatcccct

SEQ ID NO: 520233 - DNA, 25 bp, Homo sapien
ttactgtcttatcatcccctggact

SEQ ID NO: 520234 - DNA, 25 bp, Homo sapien
tcttatcatcccctggactcaagat

SEQ ID NO: 520235 - DNA, 25 bp, Homo sapien
tatcatcccctggactcaagatgag

SEQ ID NO: 520236 - DNA, 25 bp, Homo sapien
aaaaaaccctgtgagaggccacaga

SEQ ID NO: 520237 - DNA, 25 bp, Homo sapien
aaccctgtgagaggccacagagcag

SEQ ID NO: 520238 - DNA, 25 bp, Homo sapien
tcctgctgaaggtctccagtagtgt

SEQ ID NO: 520239 - DNA, 25 bp, Homo sapien
agtgtatatcatgtttctgggctgc

SEQ ID NO: 520240 - DNA, 25 bp, Homo sapien
tttctgggctgctgtaacccatgct

SEQ ID NO: 520241 - DNA, 25 bp, Homo sapien
atgctgttgtgtgtcacagtcctca

SEQ ID NO: 520242 - DNA, 25 bp, Homo sapien
gtgtgtcacagtcctcagaactgga

SEQ ID NO: 520243 - DNA, 25 bp, Homo sapien
gaactggagccctgaagacttaaac

SEQ ID NO: 520244 - DNA, 25 bp, Homo sapien
ccggtcctaggaactgaagcattaa

SEQ ID NO: 520245 - DNA, 25 bp, Homo sapien
gggagagttgtcaacctagcccatc

SEQ ID NO: 520246 - DNA, 25 bp, Homo sapien
atccccaggatgtaatgactttgac

SEQ ID NO: 520247 - DNA, 25 bp, Homo sapien
gactttgacagatcttttactataa

SEQ ID NO: 520248 - DNA, 25 bp, Homo sapien
ggtgtggtagctataattccagcac

SEQ ID NO: 520249 - DNA, 25 bp, Homo sapien
agccagaggacgaaagccctgccct

SEQ ID NO: 520250 - DNA, 25 bp, Homo sapien
agaccagccctggagtaggtggccc

SEQ ID NO: 520251 - DNA, 25 bp, Homo sapien
acctgggcagtgtccctgcttgtcc

SEQ ID NO: 520252 - DNA, 25 bp, Homo sapien
tgcttgtcctgcagactgtgtggct

SEQ ID NO: 520253 - DNA, 25 bp, Homo sapien
gtggctctgcagacctctagatgga

SEQ ID NO: 520254 - DNA, 25 bp, Homo sapien
ggcacaattctctaatgctggacga

SEQ ID NO: 520255 - DNA, 25 bp, Homo sapien
tgctggacgaggacactgatcatgg

SEQ ID NO: 520256 - DNA, 25 bp, Homo sapien
tgatcatggaaactcaccccaaacc

SEQ ID NO: 520257 - DNA, 25 bp, Homo sapien
accccaaaccttgaatcgtgatagc

SEQ ID NO: 520258 - DNA, 25 bp, Homo sapien
gtgatagcatttgaggcagcctgac

SEQ ID NO: 520259 - DNA, 25 bp, Homo sapien
tgaggcagcctgaccggtgccacat

SEQ ID NO: 520260 - DNA, 25 bp, Homo sapien
ctctgtggttttatacttggtcaaa

SEQ ID NO: 520261 - DNA, 25 bp, Homo sapien
cttggtcaaaagtactcgtcttggt

SEQ ID NO: 520262 - DNA, 25 bp, Homo sapien
actcgtcttggtattgcactgttgt

SEQ ID NO: 520263 - DNA, 25 bp, Homo sapien
cactgttgtgtgcatgagaaaactg

SEQ ID NO: 520264 - DNA, 25 bp, Homo sapien
gggaaggctcactggtacaagaaag

SEQ ID NO: 520265 - DNA, 25 bp, Homo sapien
cactggtacaagaaaggacccctga

SEQ ID NO: 520266 - DNA, 25 bp, Homo sapien
tgaagtctttggtgttgctccgtga

SEQ ID NO: 520267 - DNA, 25 bp, Homo sapien
gttgctccgtgaaaggacatcgcca

SEQ ID NO: 520268 - DNA, 25 bp, Homo sapien
gtgaaaggacatcgccacctggtgc

SEQ ID NO: 520269 - DNA, 25 bp, Homo sapien
acatcgccacctggtgctcatgagg

SEQ ID NO: 520270 - DNA, 25 bp, Homo sapien
gctcatgaggtgtctttgcagaaca

SEQ ID NO: 520271 - DNA, 25 bp, Homo sapien
tctgctgctgtcacccaaaggggag

SEQ ID NO: 520272 - DNA, 25 bp, Homo sapien
cagagccctcttgccactggataaa

SEQ ID NO: 520273 - DNA, 25 bp, Homo sapien
agccctcttgccactggataaacag

SEQ ID NO: 520274 - DNA, 25 bp, Homo sapien
ttgccactggataaacaggcccttg

SEQ ID NO: 520275 - DNA, 25 bp, Homo sapien
gccactggataaacaggcccttggt

SEQ ID NO: 520276 - DNA, 25 bp, Homo sapien
gataaacaggcccttggtgacatcc

SEQ ID NO: 520277 - DNA, 25 bp, Homo sapien
taaacaggcccttggtgacatcccc

SEQ ID NO: 520278 - DNA, 25 bp, Homo sapien
gccaagccagacttgccaagctgga

SEQ ID NO: 520279 - DNA, 25 bp, Homo sapien
agccagacttgccaagctggatgaa

SEQ ID NO: 520280 - DNA, 25 bp, Homo sapien
tgaagatgagctgtaactggtgaaa

SEQ ID NO: 520281 - DNA, 25 bp, Homo sapien
ttccccaaggagcttcagggcagtc

SEQ ID NO: 520282 - DNA, 25 bp, Homo sapien
atgtcgactggttcaccaacatcag

SEQ ID NO: 520283 - DNA, 25 bp, Homo sapien
aacatcagacatttggcgtgctcag

SEQ ID NO: 520284 - DNA, 25 bp, Homo sapien
gcgtgctcagaggttcgagctgcta

SEQ ID NO: 520285 - DNA, 25 bp, Homo sapien
gttcgagctgctaaccttagtggag

SEQ ID NO: 520286 - DNA, 25 bp, Homo sapien
cttagtggagactgctcacttgtca

SEQ ID NO: 520287 - DNA, 25 bp, Homo sapien
acaacaccaccagacttgtgtgcga

SEQ ID NO: 520288 - DNA, 25 bp, Homo sapien
ttgtgtgcgagacagagccactctt

SEQ ID NO: 520289 - DNA, 25 bp, Homo sapien
actctttctatcctggctgttagga

SEQ ID NO: 520290 - DNA, 25 bp, Homo sapien
gaatcttgtttcaatgaccatgaac

SEQ ID NO: 520291 - DNA, 25 bp, Homo sapien
ggaaggatcccacataacaagactt

SEQ ID NO: 520292 - DNA, 25 bp, Homo sapien
tgcaagatatgctcacagagacttt

SEQ ID NO: 520293 - DNA, 25 bp, Homo sapien
gccatggagcgcactgtggagaaca

SEQ ID NO: 520294 - DNA, 25 bp, Homo sapien
tgtggagaacatcgtactgccccgg

SEQ ID NO: 520295 - DNA, 25 bp, Homo sapien
tcttcctcgtcttctgaggacaagg

SEQ ID NO: 520296 - DNA, 25 bp, Homo sapien
gtcttctgaggacaaggcgcacgtt

SEQ ID NO: 520297 - DNA, 25 bp, Homo sapien
aggcgcacgttctccgcagtgcaga

SEQ ID NO: 520298 - DNA, 25 bp, Homo sapien
agcttgccgaggaccccgcgtgaag

SEQ ID NO: 520299 - DNA, 25 bp, Homo sapien
ggcttctgctccctgagactctggg

SEQ ID NO: 520300 - DNA, 25 bp, Homo sapien
tgagactctgggttcacccacagca

SEQ ID NO: 520301 - DNA, 25 bp, Homo sapien
gaggaagaggacaccagcccaagct

SEQ ID NO: 520302 - DNA, 25 bp, Homo sapien
agcccaagctggacctgccatttct

SEQ ID NO: 520303 - DNA, 25 bp, Homo sapien
ttgcctcccctctggatgtatctgg

SEQ ID NO: 520304 - DNA, 25 bp, Homo sapien
ggaatccgatgtttggaatttcagt

SEQ ID NO: 520305 - DNA, 25 bp, Homo sapien
gaatttcagtacttgacaggagggt

SEQ ID NO: 520306 - DNA, 25 bp, Homo sapien
agggttgatagagccacaggttcac

SEQ ID NO: 520307 - DNA, 25 bp, Homo sapien
acaggttcactctcggttatcaata

SEQ ID NO: 520308 - DNA, 25 bp, Homo sapien
ggttatcaatagaagaggctctcca

SEQ ID NO: 520309 - DNA, 25 bp, Homo sapien
aagaggctctccaagtaggtattat

SEQ ID NO: 520310 - DNA, 25 bp, Homo sapien
taggtattatagatgtcctcattgc

SEQ ID NO: 520311 - DNA, 25 bp, Homo sapien
tgtcctcattgccacaaaactcaaa

SEQ ID NO: 520312 - DNA, 25 bp, Homo sapien
gaaatataatatgccctcagacaaa

SEQ ID NO: 520313 - DNA, 25 bp, Homo sapien
attttgatttccacacaggacttaa

SEQ ID NO: 520314 - DNA, 25 bp, Homo sapien
tagaagtatctgagcccctgatgac

SEQ ID NO: 520315 - DNA, 25 bp, Homo sapien
tgaactctccccagcagttgtttgg

SEQ ID NO: 520316 - DNA, 25 bp, Homo sapien
cagcagttgtttggctcctgggtta

SEQ ID NO: 520317 - DNA, 25 bp, Homo sapien
gttagtgcctagatgggagccgttc

SEQ ID NO: 520318 - DNA, 25 bp, Homo sapien
atgggagccgttcatgcctgcaaaa

SEQ ID NO: 520319 - DNA, 25 bp, Homo sapien
gtgcatcctaagagtaacctgctcc

SEQ ID NO: 520320 - DNA, 25 bp, Homo sapien
cctgctcccacagggtttgtggtgg

SEQ ID NO: 520321 - DNA, 25 bp, Homo sapien
gaaaggccaagctggcgtctttcta

SEQ ID NO: 520322 - DNA, 25 bp, Homo sapien
agctggcgtctttctaaatggcatg

SEQ ID NO: 520323 - DNA, 25 bp, Homo sapien
ggcgtctttctaaatggcatgtgtg

SEQ ID NO: 520324 - DNA, 25 bp, Homo sapien
agtgttccaccacctagaaagactg

SEQ ID NO: 520325 - DNA, 25 bp, Homo sapien
ggagtaacgatggagtcactccaga

SEQ ID NO: 520326 - DNA, 25 bp, Homo sapien
tctagcaaaccttcagcaagccaag

SEQ ID NO: 520327 - DNA, 25 bp, Homo sapien
gcaagccaaggtggtagcccttttt

SEQ ID NO: 520328 - DNA, 25 bp, Homo sapien
ggtagccctttttcaacacaatcaa

SEQ ID NO: 520329 - DNA, 25 bp, Homo sapien
aatcaaaatagagaggtcaccagtt

SEQ ID NO: 520330 - DNA, 25 bp, Homo sapien
tcaccagttgtttactaccttatgg

SEQ ID NO: 520331 - DNA, 25 bp, Homo sapien
taccttatggtaaaatgcccggatc

SEQ ID NO: 520332 - DNA, 25 bp, Homo sapien
aatgcccggatcaagatccatgtat

SEQ ID NO: 520333 - DNA, 25 bp, Homo sapien
ccccatattgtgatgatgcaatcaa

SEQ ID NO: 520334 - DNA, 25 bp, Homo sapien
cagcatgccttttaagctagtactt

SEQ ID NO: 520335 - DNA, 25 bp, Homo sapien
gccttttaagctagtacttttcctg

SEQ ID NO: 520336 - DNA, 25 bp, Homo sapien
ttttcctgttttgagctctagcaaa

SEQ ID NO: 520337 - DNA, 25 bp, Homo sapien
gggatggtgtgttttctctcacctc

SEQ ID NO: 520338 - DNA, 25 bp, Homo sapien
tgtgttttctctcacctccctttta

SEQ ID NO: 520339 - DNA, 25 bp, Homo sapien
ccttttatgagggtcctcttgtcca

SEQ ID NO: 520340 - DNA, 25 bp, Homo sapien
tgagggtcctcttgtccatcttcaa

SEQ ID NO: 520341 - DNA, 25 bp, Homo sapien
ttgtccatcttcaagcctcacagtg

SEQ ID NO: 520342 - DNA, 25 bp, Homo sapien
agccagcagagaggaaggactgact

SEQ ID NO: 520343 - DNA, 25 bp, Homo sapien
tgtgtcctcttatgggaatttggga

SEQ ID NO: 520344 - DNA, 25 bp, Homo sapien
ggaatttgggaacatccctcgtctt

SEQ ID NO: 520345 - DNA, 25 bp, Homo sapien
ttgggaacatccctcgtcttgtcct

SEQ ID NO: 520346 - DNA, 25 bp, Homo sapien
gactacaaggagtatgtcctgagga

SEQ ID NO: 520347 - DNA, 25 bp, Homo sapien
gttgggatggtgtgttttctctcac

SEQ ID NO: 520348 - DNA, 25 bp, Homo sapien
gagcagcctgcgcaggtggctggag

SEQ ID NO: 520349 - DNA, 25 bp, Homo sapien
agcagcctgcgcaggtggctggagc

SEQ ID NO: 520350 - DNA, 25 bp, Homo sapien
gcagcctgcgcaggtggctggagct

SEQ ID NO: 520351 - DNA, 25 bp, Homo sapien
ggtggaaatgcagatccagctgctg

SEQ ID NO: 520352 - DNA, 25 bp, Homo sapien
gtggaaatgcagatccagctgctgg

SEQ ID NO: 520353 - DNA, 25 bp, Homo sapien
tggaaatgcagatccagctgctggc

SEQ ID NO: 520354 - DNA, 25 bp, Homo sapien
ggaaatgcagatccagctgctggca

SEQ ID NO: 520355 - DNA, 25 bp, Homo sapien
gaaatgcagatccagctgctggcag

SEQ ID NO: 520356 - DNA, 25 bp, Homo sapien
aaatgcagatccagctgctggcaga

SEQ ID NO: 520357 - DNA, 25 bp, Homo sapien
gcttgctgcttgtgccagttgcctg

SEQ ID NO: 520358 - DNA, 25 bp, Homo sapien
cagttgcctgtttcgcttcagtgtt

SEQ ID NO: 520359 - DNA, 25 bp, Homo sapien
gtttcgcttcagtgtttgattctag

SEQ ID NO: 520360 - DNA, 25 bp, Homo sapien
cagtgtttgattctagcacttacat

SEQ ID NO: 520361 - DNA, 25 bp, Homo sapien
tccccgtaacagtgacttttccagg

SEQ ID NO: 520362 - DNA, 25 bp, Homo sapien
taacagtgacttttccagggaggaa

SEQ ID NO: 520363 - DNA, 25 bp, Homo sapien
gagctgttggccttggtttgcacag

SEQ ID NO: 520364 - DNA, 25 bp, Homo sapien
tgttggccttggtttgcacagagcg

SEQ ID NO: 520365 - DNA, 25 bp, Homo sapien
tcccaccctacgatgtatgaaatgt

SEQ ID NO: 520366 - DNA, 25 bp, Homo sapien
atgtatgtacagaccagagatgttt

SEQ ID NO: 520367 - DNA, 25 bp, Homo sapien
tacagaccagagatgtttatacagc

SEQ ID NO: 520368 - DNA, 25 bp, Homo sapien
agcccagccagagttaccgctatgg

SEQ ID NO: 520369 - DNA, 25 bp, Homo sapien
cagagttaccgctatggcaactggt

SEQ ID NO: 520370 - DNA, 25 bp, Homo sapien
gctatggcaactggtatgcgcgaca

SEQ ID NO: 520371 - DNA, 25 bp, Homo sapien
ctgtgtactagtagggtaggagttt

SEQ ID NO: 520372 - DNA, 25 bp, Homo sapien
ggactgtttttctgcgcatgagacc

SEQ ID NO: 520373 - DNA, 25 bp, Homo sapien
gcatgagacccctgaacacacagct

SEQ ID NO: 520374 - DNA, 25 bp, Homo sapien
taggagtttttgttcagggaccagc

SEQ ID NO: 520375 - DNA, 25 bp, Homo sapien
agggaccagcggaacgaggctttct

SEQ ID NO: 520376 - DNA, 25 bp, Homo sapien
gcggaacgaggctttctgtcgttaa

SEQ ID NO: 520377 - DNA, 25 bp, Homo sapien
tttctgtcgttaataggtctcccct

SEQ ID NO: 520378 - DNA, 25 bp, Homo sapien
gtctcccctctgctattagagtgaa

SEQ ID NO: 520379 - DNA, 25 bp, Homo sapien
ggcacctgggtgacaacaccttctg

SEQ ID NO: 520380 - DNA, 25 bp, Homo sapien
gggtgacaacaccttctggaccgac

SEQ ID NO: 520381 - DNA, 25 bp, Homo sapien
tctggaccgacactctggccatgaa

SEQ ID NO: 520382 - DNA, 25 bp, Homo sapien
acactctggccatgaacctgcgtga

SEQ ID NO: 520383 - DNA, 25 bp, Homo sapien
tggccatgaacctgcgtgacacatt

SEQ ID NO: 520384 - DNA, 25 bp, Homo sapien
gaacctgcgtgacacattcgatgaa

SEQ ID NO: 520385 - DNA, 25 bp, Homo sapien
tgacacattcgatgaagccttcctg

SEQ ID NO: 520386 - DNA, 25 bp, Homo sapien
tggcagctgtgcgatctcatcaagg

SEQ ID NO: 520387 - DNA, 25 bp, Homo sapien
agctgtgcgatctcatcaaggactc

SEQ ID NO: 520388 - DNA, 25 bp, Homo sapien
gtgcgatctcatcaaggactcccca

SEQ ID NO: 520389 - DNA, 25 bp, Homo sapien
taaagttattatggctacctctccc

SEQ ID NO: 520390 - DNA, 25 bp, Homo sapien
tggacaggcccacaagatgaccttg

SEQ ID NO: 520391 - DNA, 25 bp, Homo sapien
caggcccacaagatgaccttgcatg

SEQ ID NO: 520392 - DNA, 25 bp, Homo sapien
ggaggcatcagcagttgagccccga

SEQ ID NO: 520393 - DNA, 25 bp, Homo sapien
gcatcagcagttgagccccgaagga

SEQ ID NO: 520394 - DNA, 25 bp, Homo sapien
tgagccccgaaggagatcaggcagc

SEQ ID NO: 520395 - DNA, 25 bp, Homo sapien
tgcaggtgccagcacggcagggatg

SEQ ID NO: 520396 - DNA, 25 bp, Homo sapien
gggagcgagtcactgcctcctctga

SEQ ID NO: 520397 - DNA, 25 bp, Homo sapien
gcctcctctgagcagagattcagag

SEQ ID NO: 520398 - DNA, 25 bp, Homo sapien
gcagagattcagagtaggatcacat

SEQ ID NO: 520399 - DNA, 25 bp, Homo sapien
tcagagtaggatcacatgaataggg

SEQ ID NO: 520400 - DNA, 25 bp, Homo sapien
aaagagagtctatttttgtctaata

SEQ ID NO: 520401 - DNA, 25 bp, Homo sapien
gcggaaacggctgtctgatggcccc

SEQ ID NO: 520402 - DNA, 25 bp, Homo sapien
tggccccagggcagtgattgactac

SEQ ID NO: 520403 - DNA, 25 bp, Homo sapien
ttgactacagcaaggctgatgcctg

SEQ ID NO: 520404 - DNA, 25 bp, Homo sapien
gcagtgggagccatcgcctatgaaa

SEQ ID NO: 520405 - DNA, 25 bp, Homo sapien
gagccatcgcctatgaaatcttcgg

SEQ ID NO: 520406 - DNA, 25 bp, Homo sapien
ttgtcaatcccttctacggccaggg

SEQ ID NO: 520407 - DNA, 25 bp, Homo sapien
agggcaaggcccaccttgaaagccg

SEQ ID NO: 520408 - DNA, 25 bp, Homo sapien
aaagccgcagctaccaagaggctca

SEQ ID NO: 520409 - DNA, 25 bp, Homo sapien
agctacctgcactgcccgagtcagt

SEQ ID NO: 520410 - DNA, 25 bp, Homo sapien
tcagtgcctccagacgtgagacagt

SEQ ID NO: 520411 - DNA, 25 bp, Homo sapien
gaggccagcaagagaccatctgccc

SEQ ID NO: 520412 - DNA, 25 bp, Homo sapien
atactttcaggcctgctctacaaaa

SEQ ID NO: 520413 - DNA, 25 bp, Homo sapien
tgctctacaaaagtacctgttcttg

SEQ ID NO: 520414 - DNA, 25 bp, Homo sapien
gaaattttacagtctgccattttgg

SEQ ID NO: 520415 - DNA, 25 bp, Homo sapien
taccttttagtaagttggcatgaaa

SEQ ID NO: 520416 - DNA, 25 bp, Homo sapien
caattgggcaaaactacctaggctt

SEQ ID NO: 520417 - DNA, 25 bp, Homo sapien
ctacctaggctttactcttgagtgt

SEQ ID NO: 520418 - DNA, 25 bp, Homo sapien
actcttgagtgtctccttttgatag

SEQ ID NO: 520419 - DNA, 25 bp, Homo sapien
gtttctggaccagtttgtctaagtc

SEQ ID NO: 520420 - DNA, 25 bp, Homo sapien
cagtttgtctaagtcctggctctta

SEQ ID NO: 520421 - DNA, 25 bp, Homo sapien
agtcctggctcttattggttcatat

SEQ ID NO: 520422 - DNA, 25 bp, Homo sapien
aatgttaacttcacttctttgtata

SEQ ID NO: 520423 - DNA, 25 bp, Homo sapien
gcaaagtgaagttgcttcttctact

SEQ ID NO: 520424 - DNA, 25 bp, Homo sapien
gtcttctctcactttgatttgctag

SEQ ID NO: 520425 - DNA, 25 bp, Homo sapien
gacaattacaaacctactgtatctc

SEQ ID NO: 520426 - DNA, 25 bp, Homo sapien
gtatctctaatacagtgtgactggt

SEQ ID NO: 520427 - DNA, 25 bp, Homo sapien
tggtcaggtatttcagttcttagga

SEQ ID NO: 520428 - DNA, 25 bp, Homo sapien
gttcttaggaaggaagtgccaagtt

SEQ ID NO: 520429 - DNA, 25 bp, Homo sapien
tttgggttcctggaacagcgctcac

SEQ ID NO: 520430 - DNA, 25 bp, Homo sapien
ctggaacagcgctcacctttgttta

SEQ ID NO: 520431 - DNA, 25 bp, Homo sapien
gaacactggtttaaagggataatca

SEQ ID NO: 520432 - DNA, 25 bp, Homo sapien
gggataatcatctctgtcacattag

SEQ ID NO: 520433 - DNA, 25 bp, Homo sapien
attagactatccatcatgaccagca

SEQ ID NO: 520434 - DNA, 25 bp, Homo sapien
aggccaatgactgccatatgtttcc

SEQ ID NO: 520435 - DNA, 25 bp, Homo sapien
catatgtttcccattcttctgcttt

SEQ ID NO: 520436 - DNA, 25 bp, Homo sapien
ttcaggaaatccagcctattcaagg

SEQ ID NO: 520437 - DNA, 25 bp, Homo sapien
aggtatcttgactctgttctactac

SEQ ID NO: 520438 - DNA, 25 bp, Homo sapien
gactctgttctactactggataatg

SEQ ID NO: 520439 - DNA, 25 bp, Homo sapien
gagggccaggtctctggatcaaaag

SEQ ID NO: 520440 - DNA, 25 bp, Homo sapien
acagacctattttacaggctccttc

SEQ ID NO: 520441 - DNA, 25 bp, Homo sapien
tccttcacattatcccctgacataa

SEQ ID NO: 520442 - DNA, 25 bp, Homo sapien
gaacatttccaatcctctgggtagg

SEQ ID NO: 520443 - DNA, 25 bp, Homo sapien
ggtttaaaacatctgcctagtctaa

SEQ ID NO: 520444 - DNA, 25 bp, Homo sapien
gaaaggccaatgactgctaatgaca

SEQ ID NO: 520445 - DNA, 25 bp, Homo sapien
agaaacgtcattcctttcttgaaag

SEQ ID NO: 520446 - DNA, 25 bp, Homo sapien
ttgaaagtgaggcacttcctccgtg

SEQ ID NO: 520447 - DNA, 25 bp, Homo sapien
tgaggcacttcctccgtggagccct

SEQ ID NO: 520448 - DNA, 25 bp, Homo sapien
tggagccctccaagcagaactgtgt

SEQ ID NO: 520449 - DNA, 25 bp, Homo sapien
agccctccaagcagaactgtgttcg

SEQ ID NO: 520450 - DNA, 25 bp, Homo sapien
gaactgtgttcgcaaaagtgttttg

SEQ ID NO: 520451 - DNA, 25 bp, Homo sapien
gtgttttgataattctagttcttac

SEQ ID NO: 520452 - DNA, 25 bp, Homo sapien
tctagttcttacattatttggttat

SEQ ID NO: 520453 - DNA, 25 bp, Homo sapien
ttggttatttatcggtttgccaata

SEQ ID NO: 520454 - DNA, 25 bp, Homo sapien
atcggtttgccaatattagccatag

SEQ ID NO: 520455 - DNA, 25 bp, Homo sapien
ttagccatagatttaaaaccattca

SEQ ID NO: 520456 - DNA, 25 bp, Homo sapien
tacttcatttcttaaatcccttgag

SEQ ID NO: 520457 - DNA, 25 bp, Homo sapien
acttcatttcttaaatcccttgagg

SEQ ID NO: 520458 - DNA, 25 bp, Homo sapien
cttcatttcttaaatcccttgaggg

SEQ ID NO: 520459 - DNA, 25 bp, Homo sapien
aatcccttgagggtagtaactgcat

SEQ ID NO: 520460 - DNA, 25 bp, Homo sapien
atcccttgagggtagtaactgcatc

SEQ ID NO: 520461 - DNA, 25 bp, Homo sapien
aactgcatcttctccattgatatag

SEQ ID NO: 520462 - DNA, 25 bp, Homo sapien
actgcatcttctccattgatatagc

SEQ ID NO: 520463 - DNA, 25 bp, Homo sapien
ctgcatcttctccattgatatagcc

SEQ ID NO: 520464 - DNA, 25 bp, Homo sapien
tgcatcttctccattgatatagccc

SEQ ID NO: 520465 - DNA, 25 bp, Homo sapien
gcatcttctccattgatatagcccc

SEQ ID NO: 520466 - DNA, 25 bp, Homo sapien
catcttctccattgatatagcccct

SEQ ID NO: 520467 - DNA, 25 bp, Homo sapien
accacactttgctaactcttgtgtg

SEQ ID NO: 520468 - DNA, 25 bp, Homo sapien
tttgctaactcttgtgtgcacatat

SEQ ID NO: 520469 - DNA, 25 bp, Homo sapien
tagcgagggaatggtgccgcctcca

SEQ ID NO: 520470 - DNA, 25 bp, Homo sapien
aatggtgccgcctccagcttccgta

SEQ ID NO: 520471 - DNA, 25 bp, Homo sapien
agcttccgtaagctgcccgggctct

SEQ ID NO: 520472 - DNA, 25 bp, Homo sapien
ggctgggaagtgactgtgctcttat

SEQ ID NO: 520473 - DNA, 25 bp, Homo sapien
gaagtgactgtgctcttattgtaca

SEQ ID NO: 520474 - DNA, 25 bp, Homo sapien
gactgtgctcttattgtacactctt

SEQ ID NO: 520475 - DNA, 25 bp, Homo sapien
tattgtacactctttatttctctgt

SEQ ID NO: 520476 - DNA, 25 bp, Homo sapien
atttctctgtatctttggcttgtgc

SEQ ID NO: 520477 - DNA, 25 bp, Homo sapien
taatgggatttgtctgccttttcaa

SEQ ID NO: 520478 - DNA, 25 bp, Homo sapien
aaaaactcatttatacctgtgtatt

SEQ ID NO: 520479 - DNA, 25 bp, Homo sapien
agctacaatctgttcaatgttttta

SEQ ID NO: 520480 - DNA, 25 bp, Homo sapien
ataaagttggtcttttgacgagagg

SEQ ID NO: 520481 - DNA, 25 bp, Homo sapien
gaggatgtcacggtcagttgtaact

SEQ ID NO: 520482 - DNA, 25 bp, Homo sapien
cacggtcagttgtaactttgccttc

SEQ ID NO: 520483 - DNA, 25 bp, Homo sapien
aactttgccttcacaaggcaactgg

SEQ ID NO: 520484 - DNA, 25 bp, Homo sapien
gggtagtgtgcctccttgacatttc

SEQ ID NO: 520485 - DNA, 25 bp, Homo sapien
gtgcctccttgacatttcgttcaag

SEQ ID NO: 520486 - DNA, 25 bp, Homo sapien
ttcgttcaagttatagattcaatgg

SEQ ID NO: 520487 - DNA, 25 bp, Homo sapien
ggagctatgtcttgttttaagttgc

SEQ ID NO: 520488 - DNA, 25 bp, Homo sapien
aatgcattgtattagatcttcaaac

SEQ ID NO: 520489 - DNA, 25 bp, Homo sapien
tgaacaatgaggatcaactcttttt

SEQ ID NO: 520490 - DNA, 25 bp, Homo sapien
ttatttcctctgtgagggtaagtat

SEQ ID NO: 520491 - DNA, 25 bp, Homo sapien
gggtaagtattgatagtccagtcat

SEQ ID NO: 520492 - DNA, 25 bp, Homo sapien
gtattgatagtccagtcatagactg

SEQ ID NO: 520493 - DNA, 25 bp, Homo sapien
gtcatagactggtaacacaggcaca

SEQ ID NO: 520494 - DNA, 25 bp, Homo sapien
gactggtaacacaggcacaccatta

SEQ ID NO: 520495 - DNA, 25 bp, Homo sapien
gtaacacaggcacaccattaaaaat

SEQ ID NO: 520496 - DNA, 25 bp, Homo sapien
atgaaactccgtattttatgtatga

SEQ ID NO: 520497 - DNA, 25 bp, Homo sapien
aactccgtattttatgtatgatgta

SEQ ID NO: 520498 - DNA, 25 bp, Homo sapien
atgaagaatagtacatactgtttcc

SEQ ID NO: 520499 - DNA, 25 bp, Homo sapien
ttttatatgaatagcacttgtcact

SEQ ID NO: 520500 - DNA, 25 bp, Homo sapien
tctctccctcttgccagctctgtga

SEQ ID NO: 520501 - DNA, 25 bp, Homo sapien
agctctgtgagtctggccagggcgg

SEQ ID NO: 520502 - DNA, 25 bp, Homo sapien
gagggcatctgtctgccatcgcccg

SEQ ID NO: 520503 - DNA, 25 bp, Homo sapien
ggggatgtccagagactaggcctct

SEQ ID NO: 520504 - DNA, 25 bp, Homo sapien
gctgccaatctaagccagtctcact

SEQ ID NO: 520505 - DNA, 25 bp, Homo sapien
gccaatctaagccagtctcactgtg

SEQ ID NO: 520506 - DNA, 25 bp, Homo sapien
aatctaagccagtctcactgtgaac

SEQ ID NO: 520507 - DNA, 25 bp, Homo sapien
taagccagtctcactgtgaaccaca

SEQ ID NO: 520508 - DNA, 25 bp, Homo sapien
cagtctcactgtgaaccacacgaaa

SEQ ID NO: 520509 - DNA, 25 bp, Homo sapien
tgtgaaccacacgaaacctcaactg

SEQ ID NO: 520510 - DNA, 25 bp, Homo sapien
tgaaccacacgaaacctcaactggg

SEQ ID NO: 520511 - DNA, 25 bp, Homo sapien
tctcttcctgctcctaacaaacagg

SEQ ID NO: 520512 - DNA, 25 bp, Homo sapien
caaggcctaggcatgactattcaaa

SEQ ID NO: 520513 - DNA, 25 bp, Homo sapien
ctgaatggctcagcttctctctggt

SEQ ID NO: 520514 - DNA, 25 bp, Homo sapien
ttctctctggtggtggtttctggct

SEQ ID NO: 520515 - DNA, 25 bp, Homo sapien
ctggatagaataagcctgacgaaac

SEQ ID NO: 520516 - DNA, 25 bp, Homo sapien
gcctgacgaaacctagctattgtaa

SEQ ID NO: 520517 - DNA, 25 bp, Homo sapien
gctattgtaagctagtttcttcagt

SEQ ID NO: 520518 - DNA, 25 bp, Homo sapien
gctagtttcttcagttattcttttc

SEQ ID NO: 520519 - DNA, 25 bp, Homo sapien
ttattcttttccctatccctgtcta

SEQ ID NO: 520520 - DNA, 25 bp, Homo sapien
tcttttccctatccctgtctaagct

SEQ ID NO: 520521 - DNA, 25 bp, Homo sapien
aatacaaagcgtgattctccccatt

SEQ ID NO: 520522 - DNA, 25 bp, Homo sapien
gaacaacatcactgtggttactcat

SEQ ID NO: 520523 - DNA, 25 bp, Homo sapien
gttactcatccatcagactatctgt

SEQ ID NO: 520524 - DNA, 25 bp, Homo sapien
gtaaatgatgtagcactgtagtgat

SEQ ID NO: 520525 - DNA, 25 bp, Homo sapien
ttgcttcatgccttggtgatggatg

SEQ ID NO: 520526 - DNA, 25 bp, Homo sapien
catgccttggtgatggatgccagca

SEQ ID NO: 520527 - DNA, 25 bp, Homo sapien
atggatgccagcatgttaaactgct

SEQ ID NO: 520528 - DNA, 25 bp, Homo sapien
aactgctgaagtttgattttctgat

SEQ ID NO: 520529 - DNA, 25 bp, Homo sapien
aatttagaccactcctttaatgcag

SEQ ID NO: 520530 - DNA, 25 bp, Homo sapien
accactcctttaatgcagaccaaaa

SEQ ID NO: 520531 - DNA, 25 bp, Homo sapien
ttattgaatgccttaaatgtcccag

SEQ ID NO: 520532 - DNA, 25 bp, Homo sapien
aaatgtcccaggtattgagaataaa

SEQ ID NO: 520533 - DNA, 25 bp, Homo sapien
actggatttccggtccggccagaca

SEQ ID NO: 520534 - DNA, 25 bp, Homo sapien
agatctggctgcaattccccaatgg

SEQ ID NO: 520535 - DNA, 25 bp, Homo sapien
aatggccagaaccacaaggtctcga

SEQ ID NO: 520536 - DNA, 25 bp, Homo sapien
acaaggtctcgaacaccgtcttcat

SEQ ID NO: 520537 - DNA, 25 bp, Homo sapien
gggcagccaaggtaccgttggacaa

SEQ ID NO: 520538 - DNA, 25 bp, Homo sapien
aagtccaaatggctttccctgacgt

SEQ ID NO: 520539 - DNA, 25 bp, Homo sapien
tttccctgacgttgcattgaatgcg

SEQ ID NO: 520540 - DNA, 25 bp, Homo sapien
aatgcgctgagcatcttgtgtgtcc

SEQ ID NO: 520541 - DNA, 25 bp, Homo sapien
tgtgtgtccctgtcacaaggcagat

SEQ ID NO: 520542 - DNA, 25 bp, Homo sapien
ggcagatggtttcagccaagcttcc

SEQ ID NO: 520543 - DNA, 25 bp, Homo sapien
aaacatgtgatatctcgagcctcct

SEQ ID NO: 520544 - DNA, 25 bp, Homo sapien
ccttcttggcgaatgttaagaactg

SEQ ID NO: 520545 - DNA, 25 bp, Homo sapien
gaactgaacatttggcgtggacact

SEQ ID NO: 520546 - DNA, 25 bp, Homo sapien
atttggcgtggacactagctacata

SEQ ID NO: 520547 - DNA, 25 bp, Homo sapien
tactttgtattattgtcctcttaac

SEQ ID NO: 520548 - DNA, 25 bp, Homo sapien
attgtcctcttaacaccaaattgaa

SEQ ID NO: 520549 - DNA, 25 bp, Homo sapien
aaactgctatatgaagaagggccta

SEQ ID NO: 520550 - DNA, 25 bp, Homo sapien
tggaggttttacactacttgccctg

SEQ ID NO: 520551 - DNA, 25 bp, Homo sapien
ttgccctgctttctatatctagttt

SEQ ID NO: 520552 - DNA, 25 bp, Homo sapien
atctagtttaagctgttaggactca

SEQ ID NO: 520553 - DNA, 25 bp, Homo sapien
gctgttaggactcaatggctctgat

SEQ ID NO: 520554 - DNA, 25 bp, Homo sapien
aggactcaatggctctgattttgac

SEQ ID NO: 520555 - DNA, 25 bp, Homo sapien
tctcttcctgctcctaacaaacagg

SEQ ID NO: 520556 - DNA, 25 bp, Homo sapien
caaggcctaggcatgactattcaaa

SEQ ID NO: 520557 - DNA, 25 bp, Homo sapien
aggcctaggcatgactattcaaaca

SEQ ID NO: 520558 - DNA, 25 bp, Homo sapien
gcctaggcatgactattcaaacaga

SEQ ID NO: 520559 - DNA, 25 bp, Homo sapien
gctcagcttctctctggtggtggtt

SEQ ID NO: 520560 - DNA, 25 bp, Homo sapien
agcttctctctggtggtggtttctg

SEQ ID NO: 520561 - DNA, 25 bp, Homo sapien
ttctctctggtggtggtttctggct

SEQ ID NO: 520562 - DNA, 25 bp, Homo sapien
aaatacaaagcgtgattctccccat

SEQ ID NO: 520563 - DNA, 25 bp, Homo sapien
aatacaaagcgtgattctccccatt

SEQ ID NO: 520564 - DNA, 25 bp, Homo sapien
atacaaagcgtgattctccccattc

SEQ ID NO: 520565 - DNA, 25 bp, Homo sapien
tacaaagcgtgattctccccattcc

SEQ ID NO: 520566 - DNA, 25 bp, Homo sapien
gaggccttccacatttttggatgct

SEQ ID NO: 520567 - DNA, 25 bp, Homo sapien
ccacatttttggatgctaatagaac

SEQ ID NO: 520568 - DNA, 25 bp, Homo sapien
aatagaacaggcaataggcagttat

SEQ ID NO: 520569 - DNA, 25 bp, Homo sapien
ataaatggatacatttcacgctggg

SEQ ID NO: 520570 - DNA, 25 bp, Homo sapien
agacaatttaaggaagtgagcagtt

SEQ ID NO: 520571 - DNA, 25 bp, Homo sapien
tttctgagcaggaatgtggtacagt

SEQ ID NO: 520572 - DNA, 25 bp, Homo sapien
agtcaccaaagtaaataaagccatt

SEQ ID NO: 520573 - DNA, 25 bp, Homo sapien
gttaggtctatattttttactgcac

SEQ ID NO: 520574 - DNA, 25 bp, Homo sapien
gtctatattttttactgcacatcct

SEQ ID NO: 520575 - DNA, 25 bp, Homo sapien
ttactgcacatcctaaggacacagc

SEQ ID NO: 520576 - DNA, 25 bp, Homo sapien
aaggacacagcagaaatggtggttg

SEQ ID NO: 520577 - DNA, 25 bp, Homo sapien
accaggaagtagagcagcaggtgca

SEQ ID NO: 520578 - DNA, 25 bp, Homo sapien
cggcaggccctgtgctagcgtgttc

SEQ ID NO: 520579 - DNA, 25 bp, Homo sapien
caggccctgtgctagcgtgttcgca

SEQ ID NO: 520580 - DNA, 25 bp, Homo sapien
tgtgctagcgtgttcgcaccaggaa

SEQ ID NO: 520581 - DNA, 25 bp, Homo sapien
tagcgtgttcgcaccaggaacgcag

SEQ ID NO: 520582 - DNA, 25 bp, Homo sapien
cgtgttcgcaccaggaacgcaggtg

SEQ ID NO: 520583 - DNA, 25 bp, Homo sapien
gttcgcaccaggaacgcaggtgctg

SEQ ID NO: 520584 - DNA, 25 bp, Homo sapien
caggaacgcaggtgctgggctgtcg

SEQ ID NO: 520585 - DNA, 25 bp, Homo sapien
aggccacctccaggaacagaacaca

SEQ ID NO: 520586 - DNA, 25 bp, Homo sapien
cagaacacagttttaagtttgattt

SEQ ID NO: 520587 - DNA, 25 bp, Homo sapien
ttttatttcaaaatgctttgcaatt

SEQ ID NO: 520588 - DNA, 25 bp, Homo sapien
gaaggattgcctcctttactgtatg

SEQ ID NO: 520589 - DNA, 25 bp, Homo sapien
ttactgtatgttttccactgagatg

SEQ ID NO: 520590 - DNA, 25 bp, Homo sapien
gtatgttttccactgagatgaagat

SEQ ID NO: 520591 - DNA, 25 bp, Homo sapien
agatgaagattttggtcatttcctc

SEQ ID NO: 520592 - DNA, 25 bp, Homo sapien
tatgaaatcttagcattcactagtc

SEQ ID NO: 520593 - DNA, 25 bp, Homo sapien
tggaaaaccagccaaatggacacat

SEQ ID NO: 520594 - DNA, 25 bp, Homo sapien
gccaaatggacacatatacactggt

SEQ ID NO: 520595 - DNA, 25 bp, Homo sapien
atatacactggtctgtacccgcaga

SEQ ID NO: 520596 - DNA, 25 bp, Homo sapien
acactggtctgtacccgcagagaaa

SEQ ID NO: 520597 - DNA, 25 bp, Homo sapien
ggtctgtacccgcagagaaagaaat

SEQ ID NO: 520598 - DNA, 25 bp, Homo sapien
gaaatgcaaatctctgtgatcagaa

SEQ ID NO: 520599 - DNA, 25 bp, Homo sapien
ttaattttctctttatacaagctga

SEQ ID NO: 520600 - DNA, 25 bp, Homo sapien
tctctttatacaagctgagtcatat

SEQ ID NO: 520601 - DNA, 25 bp, Homo sapien
taatttgatgttggcttagataatt

SEQ ID NO: 520602 - DNA, 25 bp, Homo sapien
gattttatattctggatttgtgttt

SEQ ID NO: 520603 - DNA, 25 bp, Homo sapien
agactttggtgatcactttgcaaat

SEQ ID NO: 520604 - DNA, 25 bp, Homo sapien
tggtgatcactttgcaaatatttgt

SEQ ID NO: 520605 - DNA, 25 bp, Homo sapien
tgcaaatatttgttaatccttgagt

SEQ ID NO: 520606 - DNA, 25 bp, Homo sapien
atccttgagtttgagaacctgtctt

SEQ ID NO: 520607 - DNA, 25 bp, Homo sapien
tgagtttgagaacctgtcttttaaa

SEQ ID NO: 520608 - DNA, 25 bp, Homo sapien
gtctgtactgataaaacccattgtg

SEQ ID NO: 520609 - DNA, 25 bp, Homo sapien
gataaaacccattgtgtacaaaact

SEQ ID NO: 520610 - DNA, 25 bp, Homo sapien
tcactactgcggtttgcctgtgcct

SEQ ID NO: 520611 - DNA, 25 bp, Homo sapien
cggtttgcctgtgcctggacaatga

SEQ ID NO: 520612 - DNA, 25 bp, Homo sapien
ttgcctgtgcctggacaatgaggcg

SEQ ID NO: 520613 - DNA, 25 bp, Homo sapien
tccctccccgggtttgcaaatagag

SEQ ID NO: 520614 - DNA, 25 bp, Homo sapien
gcaaatagaggctaccgggtgctgt

SEQ ID NO: 520615 - DNA, 25 bp, Homo sapien
aggctaccgggtgctgtattcagca

SEQ ID NO: 520616 - DNA, 25 bp, Homo sapien
tcagcaacacctgttttactatttg

SEQ ID NO: 520617 - DNA, 25 bp, Homo sapien
ttattaaactatcatctccaccttc

SEQ ID NO: 520618 - DNA, 25 bp, Homo sapien
ctccaccttccttttgattagcaat

SEQ ID NO: 520619 - DNA, 25 bp, Homo sapien
ggtggtgtataattctacttttcta

SEQ ID NO: 520620 - DNA, 25 bp, Homo sapien
acttttctagtagattactgtgtgg

SEQ ID NO: 520621 - DNA, 25 bp, Homo sapien
gtaaatatgactgtagccttttaag

SEQ ID NO: 520622 - DNA, 25 bp, Homo sapien
gccttttaagcttcagtctcagcag

SEQ ID NO: 520623 - DNA, 25 bp, Homo sapien
ttcagtctcagcagagaatttccta

SEQ ID NO: 520624 - DNA, 25 bp, Homo sapien
gaatttcctaaatgcgtttgaccta

SEQ ID NO: 520625 - DNA, 25 bp, Homo sapien
gcgtttgacctaatgaaactgatca

SEQ ID NO: 520626 - DNA, 25 bp, Homo sapien
cacttaggtttttcttcttatagct

SEQ ID NO: 520627 - DNA, 25 bp, Homo sapien
aatatggacttgctgtgtaatggaa

SEQ ID NO: 520628 - DNA, 25 bp, Homo sapien
taagttctgcaaaaccctctcattc

SEQ ID NO: 520629 - DNA, 25 bp, Homo sapien
tctcattcatgaaaaggtgctcctt

SEQ ID NO: 520630 - DNA, 25 bp, Homo sapien
ggtgctccttgctagacagaaactt

SEQ ID NO: 520631 - DNA, 25 bp, Homo sapien
agacagaaacttgctgatttacagt

SEQ ID NO: 520632 - DNA, 25 bp, Homo sapien
tggcctggagggtgacaccatgtca

SEQ ID NO: 520633 - DNA, 25 bp, Homo sapien
attcccgtcagagtttgctttgatt

SEQ ID NO: 520634 - DNA, 25 bp, Homo sapien
ccttttatttttagctctgcactcc

SEQ ID NO: 520635 - DNA, 25 bp, Homo sapien
tatttttagctctgcactccatgtg

SEQ ID NO: 520636 - DNA, 25 bp, Homo sapien
agctctgcactccatgtggtttcag

SEQ ID NO: 520637 - DNA, 25 bp, Homo sapien
cactccatgtggtttcagggttcag

SEQ ID NO: 520638 - DNA, 25 bp, Homo sapien
ggtttcagggttcagtctgatccat

SEQ ID NO: 520639 - DNA, 25 bp, Homo sapien
gtctgatccatcaaaaggttctttt

SEQ ID NO: 520640 - DNA, 25 bp, Homo sapien
tttggtcatgtggaaaactcaatgt

SEQ ID NO: 520641 - DNA, 25 bp, Homo sapien
caatgtataatttagacgtctgtca

SEQ ID NO: 520642 - DNA, 25 bp, Homo sapien
agacgtctgtcaaaaatccgacaaa

SEQ ID NO: 520643 - DNA, 25 bp, Homo sapien
gggcttggtagagcccaactaggct

SEQ ID NO: 520644 - DNA, 25 bp, Homo sapien
ttggtagagcccaactaggctgggt

SEQ ID NO: 520645 - DNA, 25 bp, Homo sapien
agagagtgcttatgactctcccacc

SEQ ID NO: 520646 - DNA, 25 bp, Homo sapien
accctcgtgactccagtgaccaatg

SEQ ID NO: 520647 - DNA, 25 bp, Homo sapien
gtgactccagtgaccaatgcctcca

SEQ ID NO: 520648 - DNA, 25 bp, Homo sapien
aatgcctccacctcttggaccaggt

SEQ ID NO: 520649 - DNA, 25 bp, Homo sapien
tgagtggtgggtcctgctcctatct

SEQ ID NO: 520650 - DNA, 25 bp, Homo sapien
cttcaatgctgtggcccctcagtga

SEQ ID NO: 520651 - DNA, 25 bp, Homo sapien
ctcagtgacttccttgggtgatcct

SEQ ID NO: 520652 - DNA, 25 bp, Homo sapien
ttgggtgatcctgactttctagcca

SEQ ID NO: 520653 - DNA, 25 bp, Homo sapien
gatcctgactttctagccattaata

SEQ ID NO: 520654 - DNA, 25 bp, Homo sapien
aggactcacatctgtactcagcctt

SEQ ID NO: 520655 - DNA, 25 bp, Homo sapien
ctcagccttttaaactgtggtttat

SEQ ID NO: 520656 - DNA, 25 bp, Homo sapien
ttcattttacagtgagttgtaagct

SEQ ID NO: 520657 - DNA, 25 bp, Homo sapien
ttttctcctccatcctgaatgagac

SEQ ID NO: 520658 - DNA, 25 bp, Homo sapien
tccatcctgaatgagacagagtctc

SEQ ID NO: 520659 - DNA, 25 bp, Homo sapien
gacagagtctcataggaaaattcct

SEQ ID NO: 520660 - DNA, 25 bp, Homo sapien
aggaaaattcctgcattctttagct

SEQ ID NO: 520661 - DNA, 25 bp, Homo sapien
ggttaagtaacatgtgtccgaggtc

SEQ ID NO: 520662 - DNA, 25 bp, Homo sapien
gtgtccgaggtcacatggttaataa

SEQ ID NO: 520663 - DNA, 25 bp, Homo sapien
ataagaagtggacccaggactcaca

SEQ ID NO: 520664 - DNA, 25 bp, Homo sapien
agtggacccaggactcacatctgta

SEQ ID NO: 520665 - DNA, 25 bp, Homo sapien
aggaagcctatgagatgccaaaatc

SEQ ID NO: 520666 - DNA, 25 bp, Homo sapien
gagatgccaaaatcacacctttaga

SEQ ID NO: 520667 - DNA, 25 bp, Homo sapien
atcacacctttagagagcaccttgc

SEQ ID NO: 520668 - DNA, 25 bp, Homo sapien
agagcaccttgctctaataggtgat

SEQ ID NO: 520669 - DNA, 25 bp, Homo sapien
ccttgctctaataggtgatgcatga

SEQ ID NO: 520670 - DNA, 25 bp, Homo sapien
gtgatgcatgagcaaacagtgagat

SEQ ID NO: 520671 - DNA, 25 bp, Homo sapien
atatctttcaagtactaacccctca

SEQ ID NO: 520672 - DNA, 25 bp, Homo sapien
tatctttcaagtactaacccctcaa

SEQ ID NO: 520673 - DNA, 25 bp, Homo sapien
tcaaaaaagcccacacatacaaaat

SEQ ID NO: 520674 - DNA, 25 bp, Homo sapien
gataccactttgtcttttaggtctt

SEQ ID NO: 520675 - DNA, 25 bp, Homo sapien
aacttctaaaaattgcttgcagatg

SEQ ID NO: 520676 - DNA, 25 bp, Homo sapien
ttgtatatgccctatacctcttggg

SEQ ID NO: 520677 - DNA, 25 bp, Homo sapien
cctatacctcttgggcatactttgt

SEQ ID NO: 520678 - DNA, 25 bp, Homo sapien
ctcttgggcatactttgtctataga

SEQ ID NO: 520679 - DNA, 25 bp, Homo sapien
gacctttaggtacattttgggccag

SEQ ID NO: 520680 - DNA, 25 bp, Homo sapien
ttgggccagtagtcaaataatccta

SEQ ID NO: 520681 - DNA, 25 bp, Homo sapien
gtagtcaaataatcctagggccgat

SEQ ID NO: 520682 - DNA, 25 bp, Homo sapien
atcctagggccgatataaaaatctt

SEQ ID NO: 520683 - DNA, 25 bp, Homo sapien
gtcaggtaatttttcccaagccgtg

SEQ ID NO: 520684 - DNA, 25 bp, Homo sapien
gtaatttttcccaagccgtggatat

SEQ ID NO: 520685 - DNA, 25 bp, Homo sapien
caagccgtggatataatctattcaa

SEQ ID NO: 520686 - DNA, 25 bp, Homo sapien
tcaaacatgtttatgctatccattc

SEQ ID NO: 520687 - DNA, 25 bp, Homo sapien
gcagagggccatgaatgtcagttat

SEQ ID NO: 520688 - DNA, 25 bp, Homo sapien
tttttctccttatacaattattttg

SEQ ID NO: 520689 - DNA, 25 bp, Homo sapien
tacaatgtacatggctgttgcatag

SEQ ID NO: 520690 - DNA, 25 bp, Homo sapien
atagaagacatgactggtggaggct

SEQ ID NO: 520691 - DNA, 25 bp, Homo sapien
gctgaggaaagccatgacattctac

SEQ ID NO: 520692 - DNA, 25 bp, Homo sapien
gacattctacaattgccatcaggct

SEQ ID NO: 520693 - DNA, 25 bp, Homo sapien
ttgccatcaggctaaggccccgtga

SEQ ID NO: 520694 - DNA, 25 bp, Homo sapien
gctaaggccccgtgagcatttctct

SEQ ID NO: 520695 - DNA, 25 bp, Homo sapien
cgtgagcatttctctcccttgtaat

SEQ ID NO: 520696 - DNA, 25 bp, Homo sapien
agaccttcaaaggatggaaccaacg

SEQ ID NO: 520697 - DNA, 25 bp, Homo sapien
ggatggaaccaacgaaggaccaaat

SEQ ID NO: 520698 - DNA, 25 bp, Homo sapien
taaacgggcgagtctgggagcattt

SEQ ID NO: 520699 - DNA, 25 bp, Homo sapien
gagtctgggagcattttaagcagca

SEQ ID NO: 520700 - DNA, 25 bp, Homo sapien
aataaggtcctgtcttcactaagcc

SEQ ID NO: 520701 - DNA, 25 bp, Homo sapien
ggtcctgtcttcactaagccattga

SEQ ID NO: 520702 - DNA, 25 bp, Homo sapien
gccattgacatgaatgtgatacttt

SEQ ID NO: 520703 - DNA, 25 bp, Homo sapien
gtgataaaaatactgcaggtagcat

SEQ ID NO: 520704 - DNA, 25 bp, Homo sapien
ctgttttctgactttagccctagga

SEQ ID NO: 520705 - DNA, 25 bp, Homo sapien
tttctgactttagccctaggaaaat

SEQ ID NO: 520706 - DNA, 25 bp, Homo sapien
aagggtcatactagcattgcagtta

SEQ ID NO: 520707 - DNA, 25 bp, Homo sapien
ctgcaggtagcatttaattagggaa

SEQ ID NO: 520708 - DNA, 25 bp, Homo sapien
ggaaattcctgccagttgaaagatg

SEQ ID NO: 520709 - DNA, 25 bp, Homo sapien
aatgcctcggctttggtgagagaac

SEQ ID NO: 520710 - DNA, 25 bp, Homo sapien
gtgagagaactgtacaggcccctct

SEQ ID NO: 520711 - DNA, 25 bp, Homo sapien
gggttacacatcatagaagtctggg

SEQ ID NO: 520712 - DNA, 25 bp, Homo sapien
agaggcctgccagcaagccgttgtg

SEQ ID NO: 520713 - DNA, 25 bp, Homo sapien
ggaactctgagctgctgaccatcgg

SEQ ID NO: 520714 - DNA, 25 bp, Homo sapien
gaaccggaccaagtgcaagccttag

SEQ ID NO: 520715 - DNA, 25 bp, Homo sapien
gtgcaagccttagctctgttcaaag

SEQ ID NO: 520716 - DNA, 25 bp, Homo sapien
gtttacgaccagagcacagttaccc

SEQ ID NO: 520717 - DNA, 25 bp, Homo sapien
cagttaccctgtgactgtaagatgt

SEQ ID NO: 520718 - DNA, 25 bp, Homo sapien
ttattctagtgataacctgggccac

SEQ ID NO: 520719 - DNA, 25 bp, Homo sapien
aacctgggccactgaaatgtttcaa

SEQ ID NO: 520720 - DNA, 25 bp, Homo sapien
gtagacagatcactggccgccactg

SEQ ID NO: 520721 - DNA, 25 bp, Homo sapien
tagacagatcactggccgccactga

SEQ ID NO: 520722 - DNA, 25 bp, Homo sapien
agacagatcactggccgccactgaa

SEQ ID NO: 520723 - DNA, 25 bp, Homo sapien
atcactggccgccactgaagtgtgt

SEQ ID NO: 520724 - DNA, 25 bp, Homo sapien
tcactggccgccactgaagtgtgtc

SEQ ID NO: 520725 - DNA, 25 bp, Homo sapien
actggccgccactgaagtgtgtctg

SEQ ID NO: 520726 - DNA, 25 bp, Homo sapien
ctgaagtgtgtctgcatggcaccac

SEQ ID NO: 520727 - DNA, 25 bp, Homo sapien
tgaagtgtgtctgcatggcaccaca

SEQ ID NO: 520728 - DNA, 25 bp, Homo sapien
gaagtgtgtctgcatggcaccacag

SEQ ID NO: 520729 - DNA, 25 bp, Homo sapien
gtgtgtctgcatggcaccacagggc

SEQ ID NO: 520730 - DNA, 25 bp, Homo sapien
tgtggtgctctttggaggaatgaat

SEQ ID NO: 520731 - DNA, 25 bp, Homo sapien
gccttagtttcttagcccatgaaag

SEQ ID NO: 520732 - DNA, 25 bp, Homo sapien
gtttcttagcccatgaaagagatca

SEQ ID NO: 520733 - DNA, 25 bp, Homo sapien
gacccagggactacctcaagggctt

SEQ ID NO: 520734 - DNA, 25 bp, Homo sapien
gaagatgcaagagcctttagtacca

SEQ ID NO: 520735 - DNA, 25 bp, Homo sapien
agagcctttagtaccaaggttctca

SEQ ID NO: 520736 - DNA, 25 bp, Homo sapien
cccggacagttaaatcagaacctca

SEQ ID NO: 520737 - DNA, 25 bp, Homo sapien
agaacctcagacagcaatatgcctt

SEQ ID NO: 520738 - DNA, 25 bp, Homo sapien
atatgccttgagatgccttgaacca

SEQ ID NO: 520739 - DNA, 25 bp, Homo sapien
gatgccttgaaccatgcttgagaag

SEQ ID NO: 520740 - DNA, 25 bp, Homo sapien
ggacaaacacattattatcttggaa

SEQ ID NO: 520741 - DNA, 25 bp, Homo sapien
atcttggaagaattgcataaggctt

SEQ ID NO: 520742 - DNA, 25 bp, Homo sapien
tcaggttacaccatagctactcaaa

SEQ ID NO: 520743 - DNA, 25 bp, Homo sapien
aactcagatcagtaagtgttggtac

SEQ ID NO: 520744 - DNA, 25 bp, Homo sapien
gtgttggtaccttttagactcataa

SEQ ID NO: 520745 - DNA, 25 bp, Homo sapien
ttgaataaaccattgcaatgcttta

SEQ ID NO: 520746 - DNA, 25 bp, Homo sapien
gctatgattttatggcagacacatc

SEQ ID NO: 520747 - DNA, 25 bp, Homo sapien
agacacatccaagcaaaaccatttt

SEQ ID NO: 520748 - DNA, 25 bp, Homo sapien
ttccaaatgcagaccttcctgatgt

SEQ ID NO: 520749 - DNA, 25 bp, Homo sapien
ctgataaaatgaccctactctctgc

SEQ ID NO: 520750 - DNA, 25 bp, Homo sapien
gaccctactctctgctgtggttcat

SEQ ID NO: 520751 - DNA, 25 bp, Homo sapien
tgtggttcattcttgctccatgctg

SEQ ID NO: 520752 - DNA, 25 bp, Homo sapien
gctccatgctgtccatatttatgat

SEQ ID NO: 520753 - DNA, 25 bp, Homo sapien
atgttgccaccttgtgccagctctc

SEQ ID NO: 520754 - DNA, 25 bp, Homo sapien
tagcttccttcatgacgacagtggt

SEQ ID NO: 520755 - DNA, 25 bp, Homo sapien
gacagtggttgcaattctgctcctc

SEQ ID NO: 520756 - DNA, 25 bp, Homo sapien
tggctccccatgtccagaatctgat

SEQ ID NO: 520757 - DNA, 25 bp, Homo sapien
gaatctgatcatttactggtgtgca

SEQ ID NO: 520758 - DNA, 25 bp, Homo sapien
atttactggtgtgcaccctgggatg

SEQ ID NO: 520759 - DNA, 25 bp, Homo sapien
gaggagacaggacccaacagtatct

SEQ ID NO: 520760 - DNA, 25 bp, Homo sapien
acagtatctcagctgtgctctggta

SEQ ID NO: 520761 - DNA, 25 bp, Homo sapien
gaaagagcatgactggtgtgttaca

SEQ ID NO: 520762 - DNA, 25 bp, Homo sapien
tttccagttgtttgtcctcttcatg

SEQ ID NO: 520763 - DNA, 25 bp, Homo sapien
ttgtcctcttcatgcaaatgttgcc

SEQ ID NO: 520764 - DNA, 25 bp, Homo sapien
gagaagccaggctagtttattcctg

SEQ ID NO: 520765 - DNA, 25 bp, Homo sapien
caggctagtttattcctgtttctat

SEQ ID NO: 520766 - DNA, 25 bp, Homo sapien
gaaacagtgctttgggcagagtcaa

SEQ ID NO: 520767 - DNA, 25 bp, Homo sapien
taaaacaccaggaatattcctttca

SEQ ID NO: 520768 - DNA, 25 bp, Homo sapien
ggcagagtcaaggtatggtagtaaa

SEQ ID NO: 520769 - DNA, 25 bp, Homo sapien
aggtggctgaggtacctttcctagc

SEQ ID NO: 520770 - DNA, 25 bp, Homo sapien
tgaggtacctttcctagctgttcat

SEQ ID NO: 520771 - DNA, 25 bp, Homo sapien
tttcctagctgttcatcttacctat

SEQ ID NO: 520772 - DNA, 25 bp, Homo sapien
agctgttcatcttacctatttccct

SEQ ID NO: 520773 - DNA, 25 bp, Homo sapien
ctatttccctgcctaacgaaacagg

SEQ ID NO: 520774 - DNA, 25 bp, Homo sapien
agaggagctccagactatgcacaag

SEQ ID NO: 520775 - DNA, 25 bp, Homo sapien
gtgacgtttaagttgtttccagatt

SEQ ID NO: 520776 - DNA, 25 bp, Homo sapien
acatagagaggtgactcattctttt

SEQ ID NO: 520777 - DNA, 25 bp, Homo sapien
ggatgactcatatttgaagcaaagt

SEQ ID NO: 520778 - DNA, 25 bp, Homo sapien
gcaaagtacaaaacgcatgctttct

SEQ ID NO: 520779 - DNA, 25 bp, Homo sapien
aacgcatgctttctgtagctactca

SEQ ID NO: 520780 - DNA, 25 bp, Homo sapien
tctgtagctactcataaattctggt

SEQ ID NO: 520781 - DNA, 25 bp, Homo sapien
aattctggtatgagcaaaatgtcaa

SEQ ID NO: 520782 - DNA, 25 bp, Homo sapien
gtcaagatgcttgcttatcaccgac

SEQ ID NO: 520783 - DNA, 25 bp, Homo sapien
atgcttgcttatcaccgaccaagtg

SEQ ID NO: 520784 - DNA, 25 bp, Homo sapien
accgaccaagtgatgattaagctct

SEQ ID NO: 520785 - DNA, 25 bp, Homo sapien
aagtttgtagtatgtcagaatggca

SEQ ID NO: 520786 - DNA, 25 bp, Homo sapien
tgactagatttaactaacttttaat

SEQ ID NO: 520787 - DNA, 25 bp, Homo sapien
cttttaatacgttaccatgagtcaa

SEQ ID NO: 520788 - DNA, 25 bp, Homo sapien
atacgttaccatgagtcaattctgt

SEQ ID NO: 520789 - DNA, 25 bp, Homo sapien
atgagtcaattctgtatgtgctaag

SEQ ID NO: 520790 - DNA, 25 bp, Homo sapien
gtacattttataccactcttgtcta

SEQ ID NO: 520791 - DNA, 25 bp, Homo sapien
actcttgtctatttgttcataaatt

SEQ ID NO: 520792 - DNA, 25 bp, Homo sapien
aaattgatacttgtgaaccagatat

SEQ ID NO: 520793 - DNA, 25 bp, Homo sapien
tgaaccagatatggagtcttaactc

SEQ ID NO: 520794 - DNA, 25 bp, Homo sapien
agatatggagtcttaactcaagctg

SEQ ID NO: 520795 - DNA, 25 bp, Homo sapien
ggttgtggttaatttctatgcttga

SEQ ID NO: 520796 - DNA, 25 bp, Homo sapien
taatttctatgcttgactttgtggg

SEQ ID NO: 520797 - DNA, 25 bp, Homo sapien
tcagaagtcttctaccaagcagcca

SEQ ID NO: 520798 - DNA, 25 bp, Homo sapien
ttctaccaagcagccaactgtaggg

SEQ ID NO: 520799 - DNA, 25 bp, Homo sapien
gggcacaagctcaactcctagagca

SEQ ID NO: 520800 - DNA, 25 bp, Homo sapien
caactcctagagcacaaaaggccat

SEQ ID NO: 520801 - DNA, 25 bp, Homo sapien
cattgtgaatcatcccagtgctgca

SEQ ID NO: 520802 - DNA, 25 bp, Homo sapien
agtgctgcacttatggctctgagga

SEQ ID NO: 520803 - DNA, 25 bp, Homo sapien
aaccttgtctttcgagattttacag

SEQ ID NO: 520804 - DNA, 25 bp, Homo sapien
gaccaataactaaacacatccgact

SEQ ID NO: 520805 - DNA, 25 bp, Homo sapien
atccgactaacagctgccttaatat

SEQ ID NO: 520806 - DNA, 25 bp, Homo sapien
gaatgtggtcgcagattgttaaaga

SEQ ID NO: 520807 - DNA, 25 bp, Homo sapien
ataacttatcagtgctagccattag

SEQ ID NO: 520808 - DNA, 25 bp, Homo sapien
aaatacgtttttcattcagttggat

SEQ ID NO: 520809 - DNA, 25 bp, Homo sapien
tttcattcagttggataaacagggc

SEQ ID NO: 520810 - DNA, 25 bp, Homo sapien
gagggtcccgatggtaagatcctga

SEQ ID NO: 520811 - DNA, 25 bp, Homo sapien
ctgattggaaggtgtgttggttaaa

SEQ ID NO: 520812 - DNA, 25 bp, Homo sapien
aaacaatttctgaactaaccgccag

SEQ ID NO: 520813 - DNA, 25 bp, Homo sapien
gaactaaccgccagatggcatcact

SEQ ID NO: 520814 - DNA, 25 bp, Homo sapien
agatggcatcactggccaggactgt

SEQ ID NO: 520815 - DNA, 25 bp, Homo sapien
actggccaggactgtttactacctg

SEQ ID NO: 520816 - DNA, 25 bp, Homo sapien
gggcaaagtgaaacgaagccactct

SEQ ID NO: 520817 - DNA, 25 bp, Homo sapien
acgaagccactctagggcgaatggg

SEQ ID NO: 520818 - DNA, 25 bp, Homo sapien
gcaacgaataaattgccctttataa

SEQ ID NO: 520819 - DNA, 25 bp, Homo sapien
tcccctgttgggaagctgctgagtg

SEQ ID NO: 520820 - DNA, 25 bp, Homo sapien
ggactgtttttctgcgcatgagacc

SEQ ID NO: 520821 - DNA, 25 bp, Homo sapien
aagatggaaaccacacctctagctg

SEQ ID NO: 520822 - DNA, 25 bp, Homo sapien
tggaaaccacacctctagctgaaaa

SEQ ID NO: 520823 - DNA, 25 bp, Homo sapien
aagacccactagaagtgacgtctca

SEQ ID NO: 520824 - DNA, 25 bp, Homo sapien
tagaagtgacgtctcagtatgttgc

SEQ ID NO: 520825 - DNA, 25 bp, Homo sapien
gatttaagcaattcactggtctcag

SEQ ID NO: 520826 - DNA, 25 bp, Homo sapien
caattcactggtctcagcttcccaa

SEQ ID NO: 520827 - DNA, 25 bp, Homo sapien
gcatgagacccctgaacacacagct

SEQ ID NO: 520828 - DNA, 25 bp, Homo sapien
acagctggaactctggttatgccta

SEQ ID NO: 520829 - DNA, 25 bp, Homo sapien
tggttatgcctaagtgaccccctgt

SEQ ID NO: 520830 - DNA, 25 bp, Homo sapien
gtcattgaaacataataccttacag

SEQ ID NO: 520831 - DNA, 25 bp, Homo sapien
gagataaggaactgattctgcttac

SEQ ID NO: 520832 - DNA, 25 bp, Homo sapien
ctatttctgtcacattggtagaaaa

SEQ ID NO: 520833 - DNA, 25 bp, Homo sapien
gtatagcccctatttgcaacaacac

SEQ ID NO: 520834 - DNA, 25 bp, Homo sapien
tttgcaacaacacgtgaatcatatt

SEQ ID NO: 520835 - DNA, 25 bp, Homo sapien
gaatcatattgagaggaggccagtc

SEQ ID NO: 520836 - DNA, 25 bp, Homo sapien
gaggccagtctgaattatatttttt

SEQ ID NO: 520837 - DNA, 25 bp, Homo sapien
ctttgaaataacttaggcacgaatt

SEQ ID NO: 520838 - DNA, 25 bp, Homo sapien
ttaggcacgaattttaagtacattt

SEQ ID NO: 520839 - DNA, 25 bp, Homo sapien
taagtacatttcttctgcagttgtt

SEQ ID NO: 520840 - DNA, 25 bp, Homo sapien
atttcttctgcagttgttttagtga

SEQ ID NO: 520841 - DNA, 25 bp, Homo sapien
aggactgtttttctgcgcatgagac

SEQ ID NO: 520842 - DNA, 25 bp, Homo sapien
ggactgtttttctgcgcatgagacc

SEQ ID NO: 520843 - DNA, 25 bp, Homo sapien
gactgtttttctgcgcatgagaccc

SEQ ID NO: 520844 - DNA, 25 bp, Homo sapien
aaccaagatgaagacccactagaag

SEQ ID NO: 520845 - DNA, 25 bp, Homo sapien
tgtttttctgcgcatgagacccctg

SEQ ID NO: 520846 - DNA, 25 bp, Homo sapien
gtttttctgcgcatgagacccctga

SEQ ID NO: 520847 - DNA, 25 bp, Homo sapien
tttttctgcgcatgagacccctgaa

SEQ ID NO: 520848 - DNA, 25 bp, Homo sapien
ttttctgcgcatgagacccctgaac

SEQ ID NO: 520849 - DNA, 25 bp, Homo sapien
tttctgcgcatgagacccctgaaca

SEQ ID NO: 520850 - DNA, 25 bp, Homo sapien
tctgcgcatgagacccctgaacaca

SEQ ID NO: 520851 - DNA, 25 bp, Homo sapien
tgcgcatgagacccctgaacacaca

SEQ ID NO: 520852 - DNA, 25 bp, Homo sapien
gctatctgttttatagattggtcta

SEQ ID NO: 520853 - DNA, 25 bp, Homo sapien
gtctaatatatcttttaccagtact

SEQ ID NO: 520854 - DNA, 25 bp, Homo sapien
accagtactacaagaaagtggctta

SEQ ID NO: 520855 - DNA, 25 bp, Homo sapien
aaagtggcttacatgattatggagg

SEQ ID NO: 520856 - DNA, 25 bp, Homo sapien
taagaggtcccatgatctgtcatct

SEQ ID NO: 520857 - DNA, 25 bp, Homo sapien
tgtcatctataagctggagacccag

SEQ ID NO: 520858 - DNA, 25 bp, Homo sapien
gaaggcctgtggtataattcagtct

SEQ ID NO: 520859 - DNA, 25 bp, Homo sapien
gaatccaaaggcttgagaaccaggg

SEQ ID NO: 520860 - DNA, 25 bp, Homo sapien
agaaccagggaagccagtgatgtaa

SEQ ID NO: 520861 - DNA, 25 bp, Homo sapien
gtgatgtaaatccatctgaggacag

SEQ ID NO: 520862 - DNA, 25 bp, Homo sapien
gagatgtcacagctcaaacaatgag

SEQ ID NO: 520863 - DNA, 25 bp, Homo sapien
ggcatgtacatgcttgaagtatggc

SEQ ID NO: 520864 - DNA, 25 bp, Homo sapien
tggcatgtacatggtctgtgggtat

SEQ ID NO: 520865 - DNA, 25 bp, Homo sapien
gggtatgtgtggacaacttcccctg

SEQ ID NO: 520866 - DNA, 25 bp, Homo sapien
caacttcccctgtggttaagcatac

SEQ ID NO: 520867 - DNA, 25 bp, Homo sapien
ctgtggttaagcataccctggcccc

SEQ ID NO: 520868 - DNA, 25 bp, Homo sapien
cagggcctttggtgatagggctctc

SEQ ID NO: 520869 - DNA, 25 bp, Homo sapien
ctctctcaggtgtgaacactggcga

SEQ ID NO: 520870 - DNA, 25 bp, Homo sapien
aacactggcgatgtgggctgctaca

SEQ ID NO: 520871 - DNA, 25 bp, Homo sapien
ggctgctacatctatgacccagtga

SEQ ID NO: 520872 - DNA, 25 bp, Homo sapien
gataaaattcaaatgagacgctcac

SEQ ID NO: 520873 - DNA, 25 bp, Homo sapien
gacgctcacaaaaaaggtcacccta

SEQ ID NO: 520874 - DNA, 25 bp, Homo sapien
agtccttctcaagtactgtgctcac

SEQ ID NO: 520875 - DNA, 25 bp, Homo sapien
ctgtgctcacccagaaaagcagtgt

SEQ ID NO: 520876 - DNA, 25 bp, Homo sapien
gaactcctctgactctaaatatttg

SEQ ID NO: 520877 - DNA, 25 bp, Homo sapien
aaccccagtttaagctatttccatg

SEQ ID NO: 520878 - DNA, 25 bp, Homo sapien
atttccatggcagtttagggtcaca

SEQ ID NO: 520879 - DNA, 25 bp, Homo sapien
agggtcacaggtttgatcccggtgt

SEQ ID NO: 520880 - DNA, 25 bp, Homo sapien
actctaaatatttgggcctgtgggc

SEQ ID NO: 520881 - DNA, 25 bp, Homo sapien
gcccagccagtggtattaatggatg

SEQ ID NO: 520882 - DNA, 25 bp, Homo sapien
gaaggctggagccatctgccttgtt

SEQ ID NO: 520883 - DNA, 25 bp, Homo sapien
atctgccttgttctggagatcatct

SEQ ID NO: 520884 - DNA, 25 bp, Homo sapien
gatcatctgggttctatcagtcctt

SEQ ID NO: 520885 - DNA, 25 bp, Homo sapien
tatgcttatttcttgtgaatttgcc

SEQ ID NO: 520886 - DNA, 25 bp, Homo sapien
tatttcttgtgaatttgcccaaaag

SEQ ID NO: 520887 - DNA, 25 bp, Homo sapien
gtgaatttgcccaaaagtaaggatt

SEQ ID NO: 520888 - DNA, 25 bp, Homo sapien
ggagagttagtactttatagaccaa

SEQ ID NO: 520889 - DNA, 25 bp, Homo sapien
gtactttatagaccaatattttgtt

SEQ ID NO: 520890 - DNA, 25 bp, Homo sapien
ggattgatgttttgaatgtatgcta

SEQ ID NO: 520891 - DNA, 25 bp, Homo sapien
gaatgtatgctattcaagtaaccct

SEQ ID NO: 520892 - DNA, 25 bp, Homo sapien
caagtaacccttcttaattatatat

SEQ ID NO: 520893 - DNA, 25 bp, Homo sapien
ttcttatagacctgttaagtctgta

SEQ ID NO: 520894 - DNA, 25 bp, Homo sapien
acctgttaagtctgtaaagtcattt

SEQ ID NO: 520895 - DNA, 25 bp, Homo sapien
gtctgtaaagtcatttatataggga

SEQ ID NO: 520896 - DNA, 25 bp, Homo sapien
ggacgtgaagctggaaccgcgaaat

SEQ ID NO: 520897 - DNA, 25 bp, Homo sapien
cgaaatgagttagttgtgggccgct

SEQ ID NO: 520898 - DNA, 25 bp, Homo sapien
tggcctcaaggagcgaacgtcagcg

SEQ ID NO: 520899 - DNA, 25 bp, Homo sapien
acgtcagcgcgaagaggagaagctt

SEQ ID NO: 520900 - DNA, 25 bp, Homo sapien
gagaagcttgtgcatacgctctgat

SEQ ID NO: 520901 - DNA, 25 bp, Homo sapien
gcatacgctctgataagggttttaa

SEQ ID NO: 520902 - DNA, 25 bp, Homo sapien
gaggtattaccacagtgctgcgtga

SEQ ID NO: 520903 - DNA, 25 bp, Homo sapien
acagtgctgcgtgacacggttgaga

SEQ ID NO: 520904 - DNA, 25 bp, Homo sapien
gatagcaaaggactttctaggcaaa

SEQ ID NO: 520905 - DNA, 25 bp, Homo sapien
gtggaagtcaaagcacggatgcctg

SEQ ID NO: 520906 - DNA, 25 bp, Homo sapien
agcacggatgcctgaaaattcatag

SEQ ID NO: 520907 - DNA, 25 bp, Homo sapien
attgaattaggacatcagcttaagc

SEQ ID NO: 520908 - DNA, 25 bp, Homo sapien
ggacatcagcttaagcaattcctgt

SEQ ID NO: 520909 - DNA, 25 bp, Homo sapien
gcttaagcaattcctgtaacggttt

SEQ ID NO: 520910 - DNA, 25 bp, Homo sapien
aacgttgttgaagttcaaggcacat

SEQ ID NO: 520911 - DNA, 25 bp, Homo sapien
gttgaagttcaaggcacataataaa

SEQ ID NO: 520912 - DNA, 25 bp, Homo sapien
ggcacataataaaattctccctgat

SEQ ID NO: 520913 - DNA, 25 bp, Homo sapien
caaagtaatgtatcaaagcgttcac

SEQ ID NO: 520914 - DNA, 25 bp, Homo sapien
aagcgttcactttataatgaagtca

SEQ ID NO: 520915 - DNA, 25 bp, Homo sapien
tgaagtcatttcattgggaaggaaa

SEQ ID NO: 520916 - DNA, 25 bp, Homo sapien
cattgggaaggaaagctgcaaagat

SEQ ID NO: 520917 - DNA, 25 bp, Homo sapien
actgaaattgtacatgatacctatt

SEQ ID NO: 520918 - DNA, 25 bp, Homo sapien
cagccggtgggcaaaggtcacctta

SEQ ID NO: 520919 - DNA, 25 bp, Homo sapien
tttctccctatctgtctgttaatcc

SEQ ID NO: 520920 - DNA, 25 bp, Homo sapien
tgttaatccccagaccggttgcatt

SEQ ID NO: 520921 - DNA, 25 bp, Homo sapien
agaccggttgcattttccagttgct

SEQ ID NO: 520922 - DNA, 25 bp, Homo sapien
gggtgtctgtacatagtttgtcttt

SEQ ID NO: 520923 - DNA, 25 bp, Homo sapien
agtgtggtgaccgtcaatcccctaa

SEQ ID NO: 520924 - DNA, 25 bp, Homo sapien
atcccctaatctcccaggttctaat

SEQ ID NO: 520925 - DNA, 25 bp, Homo sapien
atggctgtatgaggaaaacgatgta

SEQ ID NO: 520926 - DNA, 25 bp, Homo sapien
ttaaactggatctctgtggcctagg

SEQ ID NO: 520927 - DNA, 25 bp, Homo sapien
gtggcctaggttttgtacatacaga

SEQ ID NO: 520928 - DNA, 25 bp, Homo sapien
gtacatacagaaactgcatggtatt

SEQ ID NO: 520929 - DNA, 25 bp, Homo sapien
tttggtagcttctagaaaggtctga

SEQ ID NO: 520930 - DNA, 25 bp, Homo sapien
aaaggtctgagtaccctgtagttga

SEQ ID NO: 520931 - DNA, 25 bp, Homo sapien
tgagtaccctgtagttgacctcttc

SEQ ID NO: 520932 - DNA, 25 bp, Homo sapien
gagatccctcttgggaaaggctata

SEQ ID NO: 520933 - DNA, 25 bp, Homo sapien
aaggctatatattgggttggctccc

SEQ ID NO: 520934 - DNA, 25 bp, Homo sapien
tatatattgggttggctcccttccc

SEQ ID NO: 520935 - DNA, 25 bp, Homo sapien
tcccctgtttcccagttgggagagt

SEQ ID NO: 520936 - DNA, 25 bp, Homo sapien
ttgggacccctttatgttgctctga

SEQ ID NO: 520937 - DNA, 25 bp, Homo sapien
cctttatgttgctctgatgggttta

SEQ ID NO: 520938 - DNA, 25 bp, Homo sapien
aagtttcagtagctatatgtcccct

SEQ ID NO: 520939 - DNA, 25 bp, Homo sapien
gtagctatatgtcccctggaagagg

SEQ ID NO: 520940 - DNA, 25 bp, Homo sapien
tgaagcatgtgtaccgtgtgctgca

SEQ ID NO: 520941 - DNA, 25 bp, Homo sapien
gaagttcgagcagttggtcagcatc

SEQ ID NO: 520942 - DNA, 25 bp, Homo sapien
agttggtcagcatcggctcctctta

SEQ ID NO: 520943 - DNA, 25 bp, Homo sapien
tcggctcctcttacaactatgggaa

SEQ ID NO: 520944 - DNA, 25 bp, Homo sapien
atgggaacgaagaccaagccgagtt

SEQ ID NO: 520945 - DNA, 25 bp, Homo sapien
aaggagctgcacaacaccccgtacg

SEQ ID NO: 520946 - DNA, 25 bp, Homo sapien
tacggtacggccagcgagcccagcg

SEQ ID NO: 520947 - DNA, 25 bp, Homo sapien
agcgagaaggccaagattttgcaag

SEQ ID NO: 520948 - DNA, 25 bp, Homo sapien
gattttgcaagaacgaggctcaagg

SEQ ID NO: 520949 - DNA, 25 bp, Homo sapien
gggacacagtattgacagctgaaga

SEQ ID NO: 520950 - DNA, 25 bp, Homo sapien
aaatgatttacgttttcccgagatg

SEQ ID NO: 520951 - DNA, 25 bp, Homo sapien
aagatggaaaccacacctctagctg

SEQ ID NO: 520952 - DNA, 25 bp, Homo sapien
gatggaaaccacacctctagctgaa

SEQ ID NO: 520953 - DNA, 25 bp, Homo sapien
tggaaaccacacctctagctgaaaa

SEQ ID NO: 520954 - DNA, 25 bp, Homo sapien
aagacccactagaagtgacgtctca

SEQ ID NO: 520955 - DNA, 25 bp, Homo sapien
gacccactagaagtgacgtctcagt

SEQ ID NO: 520956 - DNA, 25 bp, Homo sapien
cccactagaagtgacgtctcagtat

SEQ ID NO: 520957 - DNA, 25 bp, Homo sapien
tagaagtgacgtctcagtatgttgc

SEQ ID NO: 520958 - DNA, 25 bp, Homo sapien
gatttaagcaattcactggtctcag

SEQ ID NO: 520959 - DNA, 25 bp, Homo sapien
taagcaattcactggtctcagcttc

SEQ ID NO: 520960 - DNA, 25 bp, Homo sapien
caattcactggtctcagcttcccaa

SEQ ID NO: 520961 - DNA, 25 bp, Homo sapien
tggttatgcctaagtgaccccctgt

SEQ ID NO: 520962 - DNA, 25 bp, Homo sapien
gaatttgcctgatactctctttggg

SEQ ID NO: 520963 - DNA, 25 bp, Homo sapien
cttctgcagtacattggaacctgaa

SEQ ID NO: 520964 - DNA, 25 bp, Homo sapien
taattggagtttgtcttgagaggca

SEQ ID NO: 520965 - DNA, 25 bp, Homo sapien
aaatatagccccaagaatcacaaga

SEQ ID NO: 520966 - DNA, 25 bp, Homo sapien
atcacaagattcgaggaccatgtag

SEQ ID NO: 520967 - DNA, 25 bp, Homo sapien
gaccatgtaggtcttttacgtagcc

SEQ ID NO: 520968 - DNA, 25 bp, Homo sapien
gtcttttacgtagcccaaatccata

SEQ ID NO: 520969 - DNA, 25 bp, Homo sapien
gtagcccaaatccataaattagtct

SEQ ID NO: 520970 - DNA, 25 bp, Homo sapien
tccataaattagtctcactttttgt

SEQ ID NO: 520971 - DNA, 25 bp, Homo sapien
cactttttgtatttatcgtttcata

SEQ ID NO: 520972 - DNA, 25 bp, Homo sapien
gtttcatattaaaccctctatatca

SEQ ID NO: 520973 - DNA, 25 bp, Homo sapien
aaaacaggttccacagtgctaccct

SEQ ID NO: 520974 - DNA, 25 bp, Homo sapien
aggttccacagtgctacccttgctt

SEQ ID NO: 520975 - DNA, 25 bp, Homo sapien
ttcctgccccttgaggtgggccagg

SEQ ID NO: 520976 - DNA, 25 bp, Homo sapien
ctggctcctggctatgcagggatct

SEQ ID NO: 520977 - DNA, 25 bp, Homo sapien
tcctggctatgcagggatctctggt

SEQ ID NO: 520978 - DNA, 25 bp, Homo sapien
gcagggatctctggtccccaggaga

SEQ ID NO: 520979 - DNA, 25 bp, Homo sapien
atctctggtccccaggagaccttgg

SEQ ID NO: 520980 - DNA, 25 bp, Homo sapien
gggagagcaattactttgttcactg

SEQ ID NO: 520981 - DNA, 25 bp, Homo sapien
gcaattactttgttcactgtatgca

SEQ ID NO: 520982 - DNA, 25 bp, Homo sapien
gggagtccccatttgcaggtgggta

SEQ ID NO: 520983 - DNA, 25 bp, Homo sapien
taggcttccctcttctcaggatcca

SEQ ID NO: 520984 - DNA, 25 bp, Homo sapien
gttggcattagtaaacgaatctgtt

SEQ ID NO: 520985 - DNA, 25 bp, Homo sapien
gtaaacgaatctgttctggttactt

SEQ ID NO: 520986 - DNA, 25 bp, Homo sapien
tctggttacttttatactttgataa

SEQ ID NO: 520987 - DNA, 25 bp, Homo sapien
atctcatttccattctctagcctat

SEQ ID NO: 520988 - DNA, 25 bp, Homo sapien
atttccattctctagcctatgctat

SEQ ID NO: 520989 - DNA, 25 bp, Homo sapien
tttctcctccatttcctaattgatg

SEQ ID NO: 520990 - DNA, 25 bp, Homo sapien
tcctaattgatggtactgtagagcc

SEQ ID NO: 520991 - DNA, 25 bp, Homo sapien
tctccaaagggaatcggtgttattt

SEQ ID NO: 520992 - DNA, 25 bp, Homo sapien
tggctttgggaccttactgatctga

SEQ ID NO: 520993 - DNA, 25 bp, Homo sapien
ggaccttactgatctgatgcatgtt

SEQ ID NO: 520994 - DNA, 25 bp, Homo sapien
tatctaaaggcctgattttgtttgg

SEQ ID NO: 520995 - DNA, 25 bp, Homo sapien
aaccgaataggtgcttttcagtcat

SEQ ID NO: 520996 - DNA, 25 bp, Homo sapien
ggtgcttttcagtcataatttccag

SEQ ID NO: 520997 - DNA, 25 bp, Homo sapien
aattagaagttaccacctgatgcct

SEQ ID NO: 520998 - DNA, 25 bp, Homo sapien
aagttaccacctgatgcctttatct

SEQ ID NO: 520999 - DNA, 25 bp, Homo sapien
ctttatctccttgccttctttagaa

SEQ ID NO: 521000 - DNA, 25 bp, Homo sapien
gccttctttagaacttgtctaatag

SEQ ID NO: 521001 - DNA, 25 bp, Homo sapien
ttttctaggcctagaacatgaccca

SEQ ID NO: 521002 - DNA, 25 bp, Homo sapien
agacctacctgatgtttacccacct

SEQ ID NO: 521003 - DNA, 25 bp, Homo sapien
ctgatgtttacccacctaaaatctg

SEQ ID NO: 521004 - DNA, 25 bp, Homo sapien
gaacaggcttatctcatttagtatt

SEQ ID NO: 521005 - DNA, 25 bp, Homo sapien
gaataggagcactaaccgaataggt

SEQ ID NO: 521006 - DNA, 25 bp, Homo sapien
ctttcactacactacaggatatgat

SEQ ID NO: 521007 - DNA, 25 bp, Homo sapien
ggatatgatctccatgtagtccata

SEQ ID NO: 521008 - DNA, 25 bp, Homo sapien
gtagtccatataaacctgcagagtg

SEQ ID NO: 521009 - DNA, 25 bp, Homo sapien
cagagtgattttccagagtgctcga

SEQ ID NO: 521010 - DNA, 25 bp, Homo sapien
gagtgctcgatactgttaattacat

SEQ ID NO: 521011 - DNA, 25 bp, Homo sapien
aattacatctccattagggctgaaa

SEQ ID NO: 521012 - DNA, 25 bp, Homo sapien
gaatgacctacgtttctgtatacag

SEQ ID NO: 521013 - DNA, 25 bp, Homo sapien
atacagctgtgttgcttttgatgtt

SEQ ID NO: 521014 - DNA, 25 bp, Homo sapien
aagtgtgtgcactgaggctctgcgt

SEQ ID NO: 521015 - DNA, 25 bp, Homo sapien
gctctgcgtgtggtccgtatggaaa

SEQ ID NO: 521016 - DNA, 25 bp, Homo sapien
tggtagccctgcgagttaagtactg

SEQ ID NO: 521017 - DNA, 25 bp, Homo sapien
agtgagggcaaaataatcctatggt

SEQ ID NO: 521018 - DNA, 25 bp, Homo sapien
agacaagtgaattttctgagggtga

SEQ ID NO: 521019 - DNA, 25 bp, Homo sapien
ctgagggtgatgaaagtgttgcttc

SEQ ID NO: 521020 - DNA, 25 bp, Homo sapien
tgggtctatttatttgtctaacatg

SEQ ID NO: 521021 - DNA, 25 bp, Homo sapien
atttatttgtctaacatgtacagtt

SEQ ID NO: 521022 - DNA, 25 bp, Homo sapien
aacatgtacagttaaggtttatgcc

SEQ ID NO: 521023 - DNA, 25 bp, Homo sapien
acagttaaggtttatgccttgcaat

SEQ ID NO: 521024 - DNA, 25 bp, Homo sapien
aggtttatgccttgcaatgtatgta

SEQ ID NO: 521025 - DNA, 25 bp, Homo sapien
gtttatgccttgcaatgtatgtaca

SEQ ID NO: 521026 - DNA, 25 bp, Homo sapien
ttgcaatgtatgtacatcttcacaa

SEQ ID NO: 521027 - DNA, 25 bp, Homo sapien
gaaagggttgaagtatagatgaagc

SEQ ID NO: 521028 - DNA, 25 bp, Homo sapien
catagctaaattctcaaccgccagg

SEQ ID NO: 521029 - DNA, 25 bp, Homo sapien
aaccgccaggcaccttcagaagaat

SEQ ID NO: 521030 - DNA, 25 bp, Homo sapien
cttcagaagaatccagcctaatact

SEQ ID NO: 521031 - DNA, 25 bp, Homo sapien
agcctaatactggaatttgtgctat

SEQ ID NO: 521032 - DNA, 25 bp, Homo sapien
aatttgtgctattatcttcctctcc

SEQ ID NO: 521033 - DNA, 25 bp, Homo sapien
tcaccacagttgtctaggaaatgac

SEQ ID NO: 521034 - DNA, 25 bp, Homo sapien
gagaggttcctgagctgagtccctt

SEQ ID NO: 521035 - DNA, 25 bp, Homo sapien
gagctgagtcccttaatttctggat

SEQ ID NO: 521036 - DNA, 25 bp, Homo sapien
gaccaacaagttttgtccaatgtat

SEQ ID NO: 521037 - DNA, 25 bp, Homo sapien
gtatttgtttctcagaccttgccta

SEQ ID NO: 521038 - DNA, 25 bp, Homo sapien
ctcagaccttgcctaggcactaaaa

SEQ ID NO: 521039 - DNA, 25 bp, Homo sapien
gaaagcatccgcagtgacctagaga

SEQ ID NO: 521040 - DNA, 25 bp, Homo sapien
aaagcatccgcagtgacctagagag

SEQ ID NO: 521041 - DNA, 25 bp, Homo sapien
aagcatccgcagtgacctagagagt

SEQ ID NO: 521042 - DNA, 25 bp, Homo sapien
agcatccgcagtgacctagagagtt

SEQ ID NO: 521043 - DNA, 25 bp, Homo sapien
gcatccgcagtgacctagagagttc

SEQ ID NO: 521044 - DNA, 25 bp, Homo sapien
agagagttctgatgcacagtcagac

SEQ ID NO: 521045 - DNA, 25 bp, Homo sapien
gagttctgatgcacagtcagacgat

SEQ ID NO: 521046 - DNA, 25 bp, Homo sapien
gttctgatgcacagtcagacgatgt

SEQ ID NO: 521047 - DNA, 25 bp, Homo sapien
gatgcacagtcagacgatgtgccag

SEQ ID NO: 521048 - DNA, 25 bp, Homo sapien
cacagtcagacgatgtgccagacat

SEQ ID NO: 521049 - DNA, 25 bp, Homo sapien
gtcagacgatgtgccagacatcacc

SEQ ID NO: 521050 - DNA, 25 bp, Homo sapien
ggttgtcattcagactttaacatta

SEQ ID NO: 521051 - DNA, 25 bp, Homo sapien
acctttctcatgcttccttgtgttt

SEQ ID NO: 521052 - DNA, 25 bp, Homo sapien
tatgtgtgcttttgggtggaagtta

SEQ ID NO: 521053 - DNA, 25 bp, Homo sapien
gtttgtgtctttcctagttgaatac

SEQ ID NO: 521054 - DNA, 25 bp, Homo sapien
ctagttgaatacaaccttcagagaa

SEQ ID NO: 521055 - DNA, 25 bp, Homo sapien
ttatgccttggaaattactacctgg

SEQ ID NO: 521056 - DNA, 25 bp, Homo sapien
ggaaattactacctggcacacaaag

SEQ ID NO: 521057 - DNA, 25 bp, Homo sapien
aagcagttggaggtctcttccagat

SEQ ID NO: 521058 - DNA, 25 bp, Homo sapien
tccagattgctcttctgccgaatta

SEQ ID NO: 521059 - DNA, 25 bp, Homo sapien
gctcttctgccgaattatttgtatc

SEQ ID NO: 521060 - DNA, 25 bp, Homo sapien
atttgtatctattccgagctgatta

SEQ ID NO: 521061 - DNA, 25 bp, Homo sapien
agcaaatctgcataaatggtaacca

SEQ ID NO: 521062 - DNA, 25 bp, Homo sapien
taaatggtaaccagtagctctactt

SEQ ID NO: 521063 - DNA, 25 bp, Homo sapien
ggtaaccagtagctctacttttatt

SEQ ID NO: 521064 - DNA, 25 bp, Homo sapien
ttttatgttgcttaactgttttatt

SEQ ID NO: 521065 - DNA, 25 bp, Homo sapien
tgaaggaaacctgtgtgatttaaaa

SEQ ID NO: 521066 - DNA, 25 bp, Homo sapien
tagcttttgcaactttattactggt

SEQ ID NO: 521067 - DNA, 25 bp, Homo sapien
ctggttatatacatttggccattat

SEQ ID NO: 521068 - DNA, 25 bp, Homo sapien
ttggccattatgatgtgcaagcaat

SEQ ID NO: 521069 - DNA, 25 bp, Homo sapien
aaatgcttgtttttgtagtagtttg

SEQ ID NO: 521070 - DNA, 25 bp, Homo sapien
gtctgtaaacagcatcactttgatt

SEQ ID NO: 521071 - DNA, 25 bp, Homo sapien
aacagcatcactttgattacaatag

SEQ ID NO: 521072 - DNA, 25 bp, Homo sapien
tcagacacagcagtggtgccaacgt

SEQ ID NO: 521073 - DNA, 25 bp, Homo sapien
agtggtgccaacgtgaatctacctc

SEQ ID NO: 521074 - DNA, 25 bp, Homo sapien
gaatctacctcgtgctagagtctga

SEQ ID NO: 521075 - DNA, 25 bp, Homo sapien
agagtctgagtagcctagtctatca

SEQ ID NO: 521076 - DNA, 25 bp, Homo sapien
tagtctatcacccaacacagataag

SEQ ID NO: 521077 - DNA, 25 bp, Homo sapien
tcccaggaaccaacatctaagaagg

SEQ ID NO: 521078 - DNA, 25 bp, Homo sapien
agccccaaatgtaactgaatgatga

SEQ ID NO: 521079 - DNA, 25 bp, Homo sapien
gatgaccagggataactatttacta

SEQ ID NO: 521080 - DNA, 25 bp, Homo sapien
actagtgcttttatgatttattgta

SEQ ID NO: 521081 - DNA, 25 bp, Homo sapien
tgtaactttcccagtatttgttaat

SEQ ID NO: 521082 - DNA, 25 bp, Homo sapien
gtttctcctgtacttacgagcagta

SEQ ID NO: 521083 - DNA, 25 bp, Homo sapien
ctaagttgttaactgtcaagtccag

SEQ ID NO: 521084 - DNA, 25 bp, Homo sapien
gttaactgtcaagtccagttatgta

SEQ ID NO: 521085 - DNA, 25 bp, Homo sapien
gtattctgtaagttgtgttctagtc

SEQ ID NO: 521086 - DNA, 25 bp, Homo sapien
aagttgtgttctagtctttgactaa

SEQ ID NO: 521087 - DNA, 25 bp, Homo sapien
aatttatcatctcttataatgggac

SEQ ID NO: 521088 - DNA, 25 bp, Homo sapien
ctcttataatgggacttaatctttc

SEQ ID NO: 521089 - DNA, 25 bp, Homo sapien
agcatataagagcttgtcaatagag

SEQ ID NO: 521090 - DNA, 25 bp, Homo sapien
gagcttgtcaatagagcaatcaatc

SEQ ID NO: 521091 - DNA, 25 bp, Homo sapien
cataacattgaagttagtctggtta

SEQ ID NO: 521092 - DNA, 25 bp, Homo sapien
taagagttttggtttagacttcatt

SEQ ID NO: 521093 - DNA, 25 bp, Homo sapien
agacttcatttatattttccttact

SEQ ID NO: 521094 - DNA, 25 bp, Homo sapien
cagacagacagcacgccatgtgggt

SEQ ID NO: 521095 - DNA, 25 bp, Homo sapien
gggtgtaggaacatgcttacgtgca

SEQ ID NO: 521096 - DNA, 25 bp, Homo sapien
ttacgtgcatgtgcgtgtctctgct

SEQ ID NO: 521097 - DNA, 25 bp, Homo sapien
atgtgcgtgtctctgctgccgtgcc

SEQ ID NO: 521098 - DNA, 25 bp, Homo sapien
tctgctgcaggctgaactgctcaca

SEQ ID NO: 521099 - DNA, 25 bp, Homo sapien
aactgctcacacattggtgtgctga

SEQ ID NO: 521100 - DNA, 25 bp, Homo sapien
cacattggtgtgctgagagcctgac

SEQ ID NO: 521101 - DNA, 25 bp, Homo sapien
gtgctgagagcctgacgacatcatg

SEQ ID NO: 521102 - DNA, 25 bp, Homo sapien
tgacgacatcatgctgcccagctgg

SEQ ID NO: 521103 - DNA, 25 bp, Homo sapien
tgcccagctggctttggcctgaagg

SEQ ID NO: 521104 - DNA, 25 bp, Homo sapien
agagccggctcatccatcagcttga

SEQ ID NO: 521105 - DNA, 25 bp, Homo sapien
gggcacaaggtctacagcctgctgt

SEQ ID NO: 521106 - DNA, 25 bp, Homo sapien
gcctgctgttcgcagatcagctgag

SEQ ID NO: 521107 - DNA, 25 bp, Homo sapien
atcagctgagctacgaggtggcacg

SEQ ID NO: 521108 - DNA, 25 bp, Homo sapien
gccaagcggaggagcttttccacaa

SEQ ID NO: 521109 - DNA, 25 bp, Homo sapien
ttttccacaatctgtgcacgcagca

SEQ ID NO: 521110 - DNA, 25 bp, Homo sapien
gcacgcagcagcaccgagaagacta

SEQ ID NO: 521111 - DNA, 25 bp, Homo sapien
gagaagactaccagctcgtcatggt

SEQ ID NO: 521112 - DNA, 25 bp, Homo sapien
tgcccacttacgatgaggtgctgct

SEQ ID NO: 521113 - DNA, 25 bp, Homo sapien
ccagctcgtcatggtctgtgatggg

SEQ ID NO: 521114 - DNA, 25 bp, Homo sapien
ttcagccagcacaaggtcttcgtca

SEQ ID NO: 521115 - DNA, 25 bp, Homo sapien
cccggcaaccacctttgaggaggtg

SEQ ID NO: 521116 - DNA, 25 bp, Homo sapien
atgagacgactgcttcggagccgct

SEQ ID NO: 521117 - DNA, 25 bp, Homo sapien
cgctctgctggtcctctaagagaat

SEQ ID NO: 521118 - DNA, 25 bp, Homo sapien
gatcaaaagatgacgtgacccattt

SEQ ID NO: 521119 - DNA, 25 bp, Homo sapien
gacccattttaatcaccactatatt

SEQ ID NO: 521120 - DNA, 25 bp, Homo sapien
atgtttccaaatgactttagctttt

SEQ ID NO: 521121 - DNA, 25 bp, Homo sapien
tggacatagctatcagttcgccacc

SEQ ID NO: 521122 - DNA, 25 bp, Homo sapien
gttcgccaccattgcagatgtatgt

SEQ ID NO: 521123 - DNA, 25 bp, Homo sapien
tagacacttgatatgcctgccaatc

SEQ ID NO: 521124 - DNA, 25 bp, Homo sapien
atatgcctgccaatcacatttacca

SEQ ID NO: 521125 - DNA, 25 bp, Homo sapien
catttaccaaagagtgtcgtgcagt

SEQ ID NO: 521126 - DNA, 25 bp, Homo sapien
cgtgcagtacagtcaagccgaagct

SEQ ID NO: 521127 - DNA, 25 bp, Homo sapien
gagtgtctcaaacagccgcatgggc

SEQ ID NO: 521128 - DNA, 25 bp, Homo sapien
gaagagtgctcagtccagttttggt

SEQ ID NO: 521129 - DNA, 25 bp, Homo sapien
gaatttgtcttgttgccctaaggcc

SEQ ID NO: 521130 - DNA, 25 bp, Homo sapien
taaggcctcctatgaaagactgaca

SEQ ID NO: 521131 - DNA, 25 bp, Homo sapien
gactgacaggcttggactgaatctt

SEQ ID NO: 521132 - DNA, 25 bp, Homo sapien
gactgaatcttgtgatctggacacc

SEQ ID NO: 521133 - DNA, 25 bp, Homo sapien
atctggacaccaagggtcacctgtg

SEQ ID NO: 521134 - DNA, 25 bp, Homo sapien
ctgtgggcccagagctagctctgaa

SEQ ID NO: 521135 - DNA, 25 bp, Homo sapien
agtttctttgagaacctccacagca

SEQ ID NO: 521136 - DNA, 25 bp, Homo sapien
gcaaaagtttggtcctctgttccca

SEQ ID NO: 521137 - DNA, 25 bp, Homo sapien
tgttcccaatgcatgtcccacttta

SEQ ID NO: 521138 - DNA, 25 bp, Homo sapien
gaagtgggcatctcggagccagcct

SEQ ID NO: 521139 - DNA, 25 bp, Homo sapien
taagactaggttttggctaaggtga

SEQ ID NO: 521140 - DNA, 25 bp, Homo sapien
atcagcaaccctttccaggtagaaa

SEQ ID NO: 521141 - DNA, 25 bp, Homo sapien
tttccaggtagaaattccagcggga

SEQ ID NO: 521142 - DNA, 25 bp, Homo sapien
ttccagcgggagttcaggttcccaa

SEQ ID NO: 521143 - DNA, 25 bp, Homo sapien
agttcaggttcccaagcaatttcac

SEQ ID NO: 521144 - DNA, 25 bp, Homo sapien
ggttcccaagcaatttcacgtacat

SEQ ID NO: 521145 - DNA, 25 bp, Homo sapien
gcaatttcacgtacatggctggtaa

SEQ ID NO: 521146 - DNA, 25 bp, Homo sapien
gctggtaagtgactgatctttcccc

SEQ ID NO: 521147 - DNA, 25 bp, Homo sapien
ccgcttggtagcctcacagatgagt

SEQ ID NO: 521148 - DNA, 25 bp, Homo sapien
gtagcctcacagatgagtcttggat

SEQ ID NO: 521149 - DNA, 25 bp, Homo sapien
aggagagaccatcatacaaattgat

SEQ ID NO: 521150 - DNA, 25 bp, Homo sapien
aaattgatggctcttgatttgcagc

SEQ ID NO: 521151 - DNA, 25 bp, Homo sapien
gatggctcttgatttgcagctgtat

SEQ ID NO: 521152 - DNA, 25 bp, Homo sapien
tttgcagctgtatctggagcttacc

SEQ ID NO: 521153 - DNA, 25 bp, Homo sapien
gctgtatctggagcttaccgaatct

SEQ ID NO: 521154 - DNA, 25 bp, Homo sapien
tatctggagcttaccgaatctagtg

SEQ ID NO: 521155 - DNA, 25 bp, Homo sapien
gagcttaccgaatctagtgcagctt

SEQ ID NO: 521156 - DNA, 25 bp, Homo sapien
ttaccgaatctagtgcagctttaaa

SEQ ID NO: 521157 - DNA, 25 bp, Homo sapien
aatagggagccgattctgtttccaa

SEQ ID NO: 521158 - DNA, 25 bp, Homo sapien
tagggagccgattctgtttccaagt

SEQ ID NO: 521159 - DNA, 25 bp, Homo sapien
ccaagttcagaaggagcagcgattt

SEQ ID NO: 521160 - DNA, 25 bp, Homo sapien
ctctattaatataaccttggaattc

SEQ ID NO: 521161 - DNA, 25 bp, Homo sapien
attctaattatgttgttctggctgc

SEQ ID NO: 521162 - DNA, 25 bp, Homo sapien
aattatgttgttctggctgcttgta

SEQ ID NO: 521163 - DNA, 25 bp, Homo sapien
gctgcttgtagtatcagttcgcccc

SEQ ID NO: 521164 - DNA, 25 bp, Homo sapien
agttcgcccctcttgttagggagat

SEQ ID NO: 521165 - DNA, 25 bp, Homo sapien
agcaaaaatcctacctactcagaat

SEQ ID NO: 521166 - DNA, 25 bp, Homo sapien
aatcctacctactcagaatcatctt

SEQ ID NO: 521167 - DNA, 25 bp, Homo sapien
catcttcttaggttgtctcctaaat

SEQ ID NO: 521168 - DNA, 25 bp, Homo sapien
ggttgtctcctaaatctgaacaata

SEQ ID NO: 521169 - DNA, 25 bp, Homo sapien
aattacattttgtctcttgagattt

SEQ ID NO: 521170 - DNA, 25 bp, Homo sapien
taatcaattagaactctttagggag

SEQ ID NO: 521171 - DNA, 25 bp, Homo sapien
ccacacccaaagaacttcggatcaa

SEQ ID NO: 521172 - DNA, 25 bp, Homo sapien
aaagaacttcggatcaagagacaaa

SEQ ID NO: 521173 - DNA, 25 bp, Homo sapien
gacaaaactcctcagatagcatctc

SEQ ID NO: 521174 - DNA, 25 bp, Homo sapien
aactcctcagatagcatctcaagcc

SEQ ID NO: 521175 - DNA, 25 bp, Homo sapien
agatagcatctcaagcctcaacagc

SEQ ID NO: 521176 - DNA, 25 bp, Homo sapien
atctcaagcctcaacagcatcacta

SEQ ID NO: 521177 - DNA, 25 bp, Homo sapien
aagcctcaacagcatcactagccat

SEQ ID NO: 521178 - DNA, 25 bp, Homo sapien
tcaacagcatcactagccattccag

SEQ ID NO: 521179 - DNA, 25 bp, Homo sapien
agcatcactagccattccagcatcg

SEQ ID NO: 521180 - DNA, 25 bp, Homo sapien
tcactagccattccagcatcggcag

SEQ ID NO: 521181 - DNA, 25 bp, Homo sapien
gccattccagcatcggcagcagcaa

SEQ ID NO: 521182 - DNA, 25 bp, Homo sapien
acagagccacctgggcagcccgaga

SEQ ID NO: 521183 - DNA, 25 bp, Homo sapien
ccctgagcttcatttgcatcttgag

SEQ ID NO: 521184 - DNA, 25 bp, Homo sapien
gcttcatttgcatcttgaggagtaa

SEQ ID NO: 521185 - DNA, 25 bp, Homo sapien
tgaaatgggaatgctggtctggctc

SEQ ID NO: 521186 - DNA, 25 bp, Homo sapien
atgggaatgctggtctggctcagct

SEQ ID NO: 521187 - DNA, 25 bp, Homo sapien
ctcagctggtcgtgggcataagtgc

SEQ ID NO: 521188 - DNA, 25 bp, Homo sapien
gtcgtgggcataagtgcccgctgaa

SEQ ID NO: 521189 - DNA, 25 bp, Homo sapien
gtgcccgctgaatggatggcatctc

SEQ ID NO: 521190 - DNA, 25 bp, Homo sapien
tgaatggatggcatctctccctcct

SEQ ID NO: 521191 - DNA, 25 bp, Homo sapien
tctccctcctgtcttatgttctggg

SEQ ID NO: 521192 - DNA, 25 bp, Homo sapien
tgctgctaatgcttgccctaaccct

SEQ ID NO: 521193 - DNA, 25 bp, Homo sapien
aggtgagggtggaccccatctggct

SEQ ID NO: 521194 - DNA, 25 bp, Homo sapien
tggctgtgctgcacagtgtcctcca

SEQ ID NO: 521195 - DNA, 25 bp, Homo sapien
aacatcgaccgcctaggtcttttct

SEQ ID NO: 521196 - DNA, 25 bp, Homo sapien
aggtcttttctctggccgtttccag

SEQ ID NO: 521197 - DNA, 25 bp, Homo sapien
ttctctggccgtttccaggcacctt

SEQ ID NO: 521198 - DNA, 25 bp, Homo sapien
tcgacaggggacgtagccttttctt

SEQ ID NO: 521199 - DNA, 25 bp, Homo sapien
gaggtttctcttctaagtccttggt

SEQ ID NO: 521200 - DNA, 25 bp, Homo sapien
ttctcttctaagtccttggtctaaa

SEQ ID NO: 521201 - DNA, 25 bp, Homo sapien
aagtccttggtctaaagagcgctgt

SEQ ID NO: 521202 - DNA, 25 bp, Homo sapien
cttggtctaaagagcgctgtcactt

SEQ ID NO: 521203 - DNA, 25 bp, Homo sapien
tctaaagagcgctgtcacttttttc

SEQ ID NO: 521204 - DNA, 25 bp, Homo sapien
tttgtaatcatgccactcactaacg

SEQ ID NO: 521205 - DNA, 25 bp, Homo sapien
gccactcactaacgattttatttct

SEQ ID NO: 521206 - DNA, 25 bp, Homo sapien
cactaacgattttatttctgtagca

SEQ ID NO: 521207 - DNA, 25 bp, Homo sapien
atttctgtagcagaatcattttttc

SEQ ID NO: 521208 - DNA, 25 bp, Homo sapien
ctatgtaaggtgttaatgtgtgtgt

SEQ ID NO: 521209 - DNA, 25 bp, Homo sapien
gtgtatgtgctttggttgtaggaaa

SEQ ID NO: 521210 - DNA, 25 bp, Homo sapien
gtgctttggttgtaggaaaacttga

SEQ ID NO: 521211 - DNA, 25 bp, Homo sapien
aatccttattttcctatttgagagg

SEQ ID NO: 521212 - DNA, 25 bp, Homo sapien
tcctatttgagaggctggttcagca

SEQ ID NO: 521213 - DNA, 25 bp, Homo sapien
gtggataatgttatatacagccaaa

SEQ ID NO: 521214 - DNA, 25 bp, Homo sapien
atgttatatacagccaaagtggatg

SEQ ID NO: 521215 - DNA, 25 bp, Homo sapien
aggaaaaagatcctttgctactgtt

SEQ ID NO: 521216 - DNA, 25 bp, Homo sapien
gaaaaagatcctttgctactgttaa

SEQ ID NO: 521217 - DNA, 25 bp, Homo sapien
aaaaaccccatcctgatgtggccca

SEQ ID NO: 521218 - DNA, 25 bp, Homo sapien
gcccacattcttatttgattctagt

SEQ ID NO: 521219 - DNA, 25 bp, Homo sapien
tctagttttatctgagcaagaggaa

SEQ ID NO: 521220 - DNA, 25 bp, Homo sapien
taaagacttaaaattctggaccatc

SEQ ID NO: 521221 - DNA, 25 bp, Homo sapien
agacttaaaattctggaccatcaag

SEQ ID NO: 521222 - DNA, 25 bp, Homo sapien
cttaaaattctggaccatcaagtgt

SEQ ID NO: 521223 - DNA, 25 bp, Homo sapien
attctggaccatcaagtgtaaattt

SEQ ID NO: 521224 - DNA, 25 bp, Homo sapien
ctggaccatcaagtgtaaatttaat

SEQ ID NO: 521225 - DNA, 25 bp, Homo sapien
ggaccatcaagtgtaaatttaatat

SEQ ID NO: 521226 - DNA, 25 bp, Homo sapien
tctcctcctggagcgaggcattgaa

SEQ ID NO: 521227 - DNA, 25 bp, Homo sapien
tggagcgaggcattgaacctcaggt

SEQ ID NO: 521228 - DNA, 25 bp, Homo sapien
ttgaacctcaggtgatgtcagccct

SEQ ID NO: 521229 - DNA, 25 bp, Homo sapien
aacctcaggtgatgtcagccctggt

SEQ ID NO: 521230 - DNA, 25 bp, Homo sapien
tcaggtgatgtcagccctggttcgt

SEQ ID NO: 521231 - DNA, 25 bp, Homo sapien
tgatgtcagccctggttcgtctcgg

SEQ ID NO: 521232 - DNA, 25 bp, Homo sapien
cctggttcgtctcggcctcagagga

SEQ ID NO: 521233 - DNA, 25 bp, Homo sapien
agaggagcccggctatttttcctga

SEQ ID NO: 521234 - DNA, 25 bp, Homo sapien
ggagcccggctatttttcctgaaca

SEQ ID NO: 521235 - DNA, 25 bp, Homo sapien
agcccggctatttttcctgaacagc

SEQ ID NO: 521236 - DNA, 25 bp, Homo sapien
gtggatgattgtgggctgtgtggcc

SEQ ID NO: 521237 - DNA, 25 bp, Homo sapien
tgaccacacccgtgtttgttcctag

SEQ ID NO: 521238 - DNA, 25 bp, Homo sapien
tgttcctagtctgttcccagccata

SEQ ID NO: 521239 - DNA, 25 bp, Homo sapien
agtctgttcccagccataagcatct

SEQ ID NO: 521240 - DNA, 25 bp, Homo sapien
ataagcatctccacaagccctctgt

SEQ ID NO: 521241 - DNA, 25 bp, Homo sapien
gcttgtgtggcctgatgtccatggc

SEQ ID NO: 521242 - DNA, 25 bp, Homo sapien
ggcctgatgtccatggccaccaagg

SEQ ID NO: 521243 - DNA, 25 bp, Homo sapien
atacgcttctccactcaacctttgg

SEQ ID NO: 521244 - DNA, 25 bp, Homo sapien
caacctttggagagacacggaccac

SEQ ID NO: 521245 - DNA, 25 bp, Homo sapien
gacacggaccaccaaaggcttgatt

SEQ ID NO: 521246 - DNA, 25 bp, Homo sapien
ccaaaggcttgatttttcttcatcc

SEQ ID NO: 521247 - DNA, 25 bp, Homo sapien
tttcttcatcctacattatattcaa

SEQ ID NO: 521248 - DNA, 25 bp, Homo sapien
gatggcttatacacacaggcctcct

SEQ ID NO: 521249 - DNA, 25 bp, Homo sapien
tcagactccaagctaggctgaggct

SEQ ID NO: 521250 - DNA, 25 bp, Homo sapien
aggcagccgattctcttgtgctgat

SEQ ID NO: 521251 - DNA, 25 bp, Homo sapien
tgctgatttaaatgctggacacgga

SEQ ID NO: 521252 - DNA, 25 bp, Homo sapien
caggctgtttaaacgctgcttaaag

SEQ ID NO: 521253 - DNA, 25 bp, Homo sapien
gctgcttaaagtcgcaactgggccc

SEQ ID NO: 521254 - DNA, 25 bp, Homo sapien
gcaactgggcccctttcaagaaatt

SEQ ID NO: 521255 - DNA, 25 bp, Homo sapien
gaaattttgctctaccaggaaaaca

SEQ ID NO: 521256 - DNA, 25 bp, Homo sapien
aacagagctacgttctttgtgagag

SEQ ID NO: 521257 - DNA, 25 bp, Homo sapien
gacttgctctttgtcacagactgca

SEQ ID NO: 521258 - DNA, 25 bp, Homo sapien
gactgcataagttgtcagccttgac

SEQ ID NO: 521259 - DNA, 25 bp, Homo sapien
gcctggaggatggcaagctcatcgt

SEQ ID NO: 521260 - DNA, 25 bp, Homo sapien
agccctctgaggtgcgcagcagcca

SEQ ID NO: 521261 - DNA, 25 bp, Homo sapien
tctgaggtgcgcagcagccagttcg

SEQ ID NO: 521262 - DNA, 25 bp, Homo sapien
gcagcagccagttcgcgcggaagct

SEQ ID NO: 521263 - DNA, 25 bp, Homo sapien
ctgtggcggtcctcgcggcgcatct

SEQ ID NO: 521264 - DNA, 25 bp, Homo sapien
gcatctcccaggtgtcctcgggaga

SEQ ID NO: 521265 - DNA, 25 bp, Homo sapien
gtgtcctcgggagagacggaataca

SEQ ID NO: 521266 - DNA, 25 bp, Homo sapien
gagagacggaatacaaccctactga

SEQ ID NO: 521267 - DNA, 25 bp, Homo sapien
ggaatacaaccctactgaggcgcgc

SEQ ID NO: 521268 - DNA, 25 bp, Homo sapien
tacaaccctactgaggcgcgctgaa

SEQ ID NO: 521269 - DNA, 25 bp, Homo sapien
tgaggcgcgctgaacctggccagtc

SEQ ID NO: 521270 - DNA, 25 bp, Homo sapien
ccccactcaaaaggagggcagctta

SEQ ID NO: 521271 - DNA, 25 bp, Homo sapien
gggcagcttacactcacagcaagat

SEQ ID NO: 521272 - DNA, 25 bp, Homo sapien
agcaagatcctgttgcaacccggag

SEQ ID NO: 521273 - DNA, 25 bp, Homo sapien
tgcaacccggagaatcccaggattt

SEQ ID NO: 521274 - DNA, 25 bp, Homo sapien
ggagtggctgtaccaagcatcacac

SEQ ID NO: 521275 - DNA, 25 bp, Homo sapien
gaaagcatctggttgttgacatagg

SEQ ID NO: 521276 - DNA, 25 bp, Homo sapien
gaacatagtctatacttttgggtct

SEQ ID NO: 521277 - DNA, 25 bp, Homo sapien
ttgggtctttgatttgtactaggca

SEQ ID NO: 521278 - DNA, 25 bp, Homo sapien
tactaggcagagtctttgtacctgt

SEQ ID NO: 521279 - DNA, 25 bp, Homo sapien
aagcatcacacacggatggacacat

SEQ ID NO: 521280 - DNA, 25 bp, Homo sapien
ggatggacacattttaccttctaga

SEQ ID NO: 521281 - DNA, 25 bp, Homo sapien
gttttcaggcaaaagcaagcctcca

SEQ ID NO: 521282 - DNA, 25 bp, Homo sapien
aaagcaagcctccaaaagccccttg

SEQ ID NO: 521283 - DNA, 25 bp, Homo sapien
gtacaccagactgccggcaagcaag

SEQ ID NO: 521284 - DNA, 25 bp, Homo sapien
aggtggcgaacagctgggatcctcc

SEQ ID NO: 521285 - DNA, 25 bp, Homo sapien
tcctccagtgaaaagtttgctcagc

SEQ ID NO: 521286 - DNA, 25 bp, Homo sapien
tttgctcagcgcgagagatgtcaag

SEQ ID NO: 521287 - DNA, 25 bp, Homo sapien
aagaggctgggattgtcgcctatcg

SEQ ID NO: 521288 - DNA, 25 bp, Homo sapien
ctcactcacacttcctgggaaatga

SEQ ID NO: 521289 - DNA, 25 bp, Homo sapien
aggagaactaataggcagcccgcat

SEQ ID NO: 521290 - DNA, 25 bp, Homo sapien
ataggcagcccgcatttgcagccag

SEQ ID NO: 521291 - DNA, 25 bp, Homo sapien
ggtattccttgaagtgaagcgctca

SEQ ID NO: 521292 - DNA, 25 bp, Homo sapien
gtggcatgatgttacctaaggctta

SEQ ID NO: 521293 - DNA, 25 bp, Homo sapien
aaggcttaggcttagcttgatttct

SEQ ID NO: 521294 - DNA, 25 bp, Homo sapien
aggcttagcttgatttctgggccca

SEQ ID NO: 521295 - DNA, 25 bp, Homo sapien
ttctgggcccactgtctgtgttctt

SEQ ID NO: 521296 - DNA, 25 bp, Homo sapien
gtctgtgttcttaagatgccaacct

SEQ ID NO: 521297 - DNA, 25 bp, Homo sapien
tgtgttcttaagatgccaacctgtt

SEQ ID NO: 521298 - DNA, 25 bp, Homo sapien
gaacaaggctgtgatgtagtgacta

SEQ ID NO: 521299 - DNA, 25 bp, Homo sapien
gtagtgactattgtctgtgtctcct

SEQ ID NO: 521300 - DNA, 25 bp, Homo sapien
gtgtgtgtctgttcttgtcacaaat

SEQ ID NO: 521301 - DNA, 25 bp, Homo sapien
tgtgtctgttcttgtcacaaatgta

SEQ ID NO: 521302 - DNA, 25 bp, Homo sapien
ggatgcattcattttctgtaataaa

SEQ ID NO: 521303 - DNA, 25 bp, Homo sapien
tcagctttaaggttgttgtgttttt

SEQ ID NO: 521304 - DNA, 25 bp, Homo sapien
agagcagagcgctttgggattgcct

SEQ ID NO: 521305 - DNA, 25 bp, Homo sapien
gagcgctttgggattgcctgatgaa

SEQ ID NO: 521306 - DNA, 25 bp, Homo sapien
gttctccagtgttttccatttctct

SEQ ID NO: 521307 - DNA, 25 bp, Homo sapien
ttcttcttggtcacatatatgccta

SEQ ID NO: 521308 - DNA, 25 bp, Homo sapien
atatgcctaaatgcacagtcatgtg

SEQ ID NO: 521309 - DNA, 25 bp, Homo sapien
tgagggagcatgtaccccaggtaca

SEQ ID NO: 521310 - DNA, 25 bp, Homo sapien
taccccaggtacatccatgaactgc

SEQ ID NO: 521311 - DNA, 25 bp, Homo sapien
aggtacatccatgaactgcggcagc

SEQ ID NO: 521312 - DNA, 25 bp, Homo sapien
gtacatccatgaactgcggcagcag

SEQ ID NO: 521313 - DNA, 25 bp, Homo sapien
catgaactgcggcagcagtttgact

SEQ ID NO: 521314 - DNA, 25 bp, Homo sapien
atgtacagctatgacccagctgagg

SEQ ID NO: 521315 - DNA, 25 bp, Homo sapien
ggagctgctctctgacatgggagac

SEQ ID NO: 521316 - DNA, 25 bp, Homo sapien
ctgctctctgacatgggagacccca

SEQ ID NO: 521317 - DNA, 25 bp, Homo sapien
gagaccccaaggtggtacatggctg

SEQ ID NO: 521318 - DNA, 25 bp, Homo sapien
ccccaaggtggtacatggctggcag

SEQ ID NO: 521319 - DNA, 25 bp, Homo sapien
tggcagagtggctaccagcacaagc

SEQ ID NO: 521320 - DNA, 25 bp, Homo sapien
agtggctaccagcacaagcggatgc

SEQ ID NO: 521321 - DNA, 25 bp, Homo sapien
gcacaagcggatgccactgctggat

SEQ ID NO: 521322 - DNA, 25 bp, Homo sapien
aagcggatgccactgctggatgtca

SEQ ID NO: 521323 - DNA, 25 bp, Homo sapien
actgctggatgtcaagacgtgacct

SEQ ID NO: 521324 - DNA, 25 bp, Homo sapien
ggatgtcaagacgtgacctgacccc

SEQ ID NO: 521325 - DNA, 25 bp, Homo sapien
taagggccaaccaagcatggagtca

SEQ ID NO: 521326 - DNA, 25 bp, Homo sapien
accaagcatggagtcagggaaaaat

SEQ ID NO: 521327 - DNA, 25 bp, Homo sapien
gaaaaataggatcgagggccacaaa

SEQ ID NO: 521328 - DNA, 25 bp, Homo sapien
tcttaaccggaataaaggcttccat

SEQ ID NO: 521329 - DNA, 25 bp, Homo sapien
taaaggcttccattcaaaacccaag

SEQ ID NO: 521330 - DNA, 25 bp, Homo sapien
cctccctagtggaagtgcttgccta

SEQ ID NO: 521331 - DNA, 25 bp, Homo sapien
agaggaataaaacccacatgaatca

SEQ ID NO: 521332 - DNA, 25 bp, Homo sapien
aacccacatgaatcactgtggcatc

SEQ ID NO: 521333 - DNA, 25 bp, Homo sapien
tagtggaagtgcttgcctactcccc

SEQ ID NO: 521334 - DNA, 25 bp, Homo sapien
gcctactcccctaggacaggtaagt

SEQ ID NO: 521335 - DNA, 25 bp, Homo sapien
aagtctaatcctcaatcttttgggc

SEQ ID NO: 521336 - DNA, 25 bp, Homo sapien
ttgcgctccgccacattgcgcgacg

SEQ ID NO: 521337 - DNA, 25 bp, Homo sapien
cacactgcatctgctgccctgcgag

SEQ ID NO: 521338 - DNA, 25 bp, Homo sapien
tgccctgcgaggttgcggtggacgg

SEQ ID NO: 521339 - DNA, 25 bp, Homo sapien
ccgagggactcgaagtgtcgtttcg

SEQ ID NO: 521340 - DNA, 25 bp, Homo sapien
ctcgaagtgtcgtttcggggccgct

SEQ ID NO: 521341 - DNA, 25 bp, Homo sapien
aggaggtggcggtgccgcctggcct

SEQ ID NO: 521342 - DNA, 25 bp, Homo sapien
cgcctggcctcgtgggatacgtgat

SEQ ID NO: 521343 - DNA, 25 bp, Homo sapien
gatacgtgatggtgacagaagagaa

SEQ ID NO: 521344 - DNA, 25 bp, Homo sapien
gaccccttgcgggattccgggactg

SEQ ID NO: 521345 - DNA, 25 bp, Homo sapien
cccttgcgggattccgggactgacg

SEQ ID NO: 521346 - DNA, 25 bp, Homo sapien
catcgagaggcaccgcgtccacttg

SEQ ID NO: 521347 - DNA, 25 bp, Homo sapien
gaaaagagcagagcgctttgggatt

SEQ ID NO: 521348 - DNA, 25 bp, Homo sapien
agagcagagcgctttgggattgcct

SEQ ID NO: 521349 - DNA, 25 bp, Homo sapien
gcagagcgctttgggattgcctgat

SEQ ID NO: 521350 - DNA, 25 bp, Homo sapien
agagcgctttgggattgcctgatga

SEQ ID NO: 521351 - DNA, 25 bp, Homo sapien
gagcgctttgggattgcctgatgaa

SEQ ID NO: 521352 - DNA, 25 bp, Homo sapien
gttctccagtgttttccatttctct

SEQ ID NO: 521353 - DNA, 25 bp, Homo sapien
ttctccagtgttttccatttctctc

SEQ ID NO: 521354 - DNA, 25 bp, Homo sapien
cttcttcttggtcacatatatgcct

SEQ ID NO: 521355 - DNA, 25 bp, Homo sapien
tcttcttggtcacatatatgcctaa

SEQ ID NO: 521356 - DNA, 25 bp, Homo sapien
ttggtcacatatatgcctaaatgca

SEQ ID NO: 521357 - DNA, 25 bp, Homo sapien
atatgcctaaatgcacagtcatgtg

SEQ ID NO: 521358 - DNA, 25 bp, Homo sapien
aagacgcatgaccaagacaacctag

SEQ ID NO: 521359 - DNA, 25 bp, Homo sapien
tgcttgcctttgactatttccttaa
